United States Patent 7,341,835 (METHODS OF ANALYSIS OF ALTERNATIVE SPLICING IN MOUSE) - sequence listing, part 3

SEQ ID NO: 79401 - DNA, 25 bp, Mus musculus
atgtagtgtcctgtgtggccttggc

SEQ ID NO: 79402 - DNA, 25 bp, Mus musculus
atgtatgaagccctgcatggtcccc

SEQ ID NO: 79403 - DNA, 25 bp, Mus musculus
atgtatggggccacacagtcgcaga

SEQ ID NO: 79404 - DNA, 25 bp, Mus musculus
atgtattggtcggtggtcctgcccc

SEQ ID NO: 79405 - DNA, 25 bp, Mus musculus
atgtcaaccccaaggcgtcggatgc

SEQ ID NO: 79406 - DNA, 25 bp, Mus musculus
atgtcaacctacaagcgggccacgc

SEQ ID NO: 79407 - DNA, 25 bp, Mus musculus
atgtcaaggagagcactagatggcc

SEQ ID NO: 79408 - DNA, 25 bp, Mus musculus
atgtccagctccgaagccgaagacg

SEQ ID NO: 79409 - DNA, 25 bp, Mus musculus
atgtccagggcagacccgggaaaga

SEQ ID NO: 79410 - DNA, 25 bp, Mus musculus
atgtcccagacatgaaccagcccag

SEQ ID NO: 79411 - DNA, 25 bp, Mus musculus
atgtcgtcggtgttcggcaagcccc

SEQ ID NO: 79412 - DNA, 25 bp, Mus musculus
atgtctgaggcgacttggtggtacc

SEQ ID NO: 79413 - DNA, 25 bp, Mus musculus
atgtctggtcgtagcgtgcgcctga

SEQ ID NO: 79414 - DNA, 25 bp, Mus musculus
atgtcttcaagaacaccccggctgt

SEQ ID NO: 79415 - DNA, 25 bp, Mus musculus
atgtgaaccaagcacccacctgcaa

SEQ ID NO: 79416 - DNA, 25 bp, Mus musculus
atgtgaggacacacggagtaagtga

SEQ ID NO: 79417 - DNA, 25 bp, Mus musculus
atgtgaggcgaacacccatcccggg

SEQ ID NO: 79418 - DNA, 25 bp, Mus musculus
atgtgagtgggagcgtggagccgag

SEQ ID NO: 79419 - DNA, 25 bp, Mus musculus
atgtgcagcgcctgtgtccctcgac

SEQ ID NO: 79420 - DNA, 25 bp, Mus musculus
atgtgcccttcccatgggcttgtgg

SEQ ID NO: 79421 - DNA, 25 bp, Mus musculus
atgtgccgggtatctacaccagagt

SEQ ID NO: 79422 - DNA, 25 bp, Mus musculus
atgtggaccccgctgtctgcagcct

SEQ ID NO: 79423 - DNA, 25 bp, Mus musculus
atgtggccgaccctgcgctacgtag

SEQ ID NO: 79424 - DNA, 25 bp, Mus musculus
atgtggcctaaatagggtgggcaca

SEQ ID NO: 79425 - DNA, 25 bp, Mus musculus
atgtgggacggaagcctcctacttt

SEQ ID NO: 79426 - DNA, 25 bp, Mus musculus
atgtgggactgagcggcccagccgc

SEQ ID NO: 79427 - DNA, 25 bp, Mus musculus
atgtgtcactagaagagggcttgga

SEQ ID NO: 79428 - DNA, 25 bp, Mus musculus
atgtgtgcaaacacccgcacgtcga

SEQ ID NO: 79429 - DNA, 25 bp, Mus musculus
atgtgtgtgcccaggtctgcagcca

SEQ ID NO: 79430 - DNA, 25 bp, Mus musculus
atgttaaaagactcctgaataaact

SEQ ID NO: 79431 - DNA, 25 bp, Mus musculus
atgttaaaagcttctgttgtggata

SEQ ID NO: 79432 - DNA, 25 bp, Mus musculus
atgttaccacagtgcaccacggcca

SEQ ID NO: 79433 - DNA, 25 bp, Mus musculus
atgttacggtggacagtgcatctgg

SEQ ID NO: 79434 - DNA, 25 bp, Mus musculus
atgttctccgcgtccctaggcgtgc

SEQ ID NO: 79435 - DNA, 25 bp, Mus musculus
atgttgacagcccaccgtgcaggca

SEQ ID NO: 79436 - DNA, 25 bp, Mus musculus
atgttgaccgatggcctgccccagt

SEQ ID NO: 79437 - DNA, 25 bp, Mus musculus
atgttgctaacatgaatttgaagtc

SEQ ID NO: 79438 - DNA, 25 bp, Mus musculus
atgttggccacccttccacttggaa

SEQ ID NO: 79439 - DNA, 25 bp, Mus musculus
atgtttaatagtccaaacaaccaag

SEQ ID NO: 79440 - DNA, 25 bp, Mus musculus
atgtttacagcttccaatctatcag

SEQ ID NO: 79441 - DNA, 25 bp, Mus musculus
atgtttcagtacttggtaaacaagc

SEQ ID NO: 79442 - DNA, 25 bp, Mus musculus
attaaccagctggaagctctgttac

SEQ ID NO: 79443 - DNA, 25 bp, Mus musculus
attaagagagaaatacttcccctgg

SEQ ID NO: 79444 - DNA, 25 bp, Mus musculus
attaagcttgctctttagaaggtgc

SEQ ID NO: 79445 - DNA, 25 bp, Mus musculus
attaaggcttgtacgggctccttga

SEQ ID NO: 79446 - DNA, 25 bp, Mus musculus
attaataaagagacaggagagtggg

SEQ ID NO: 79447 - DNA, 25 bp, Mus musculus
attaatacttggctgaactggagga

SEQ ID NO: 79448 - DNA, 25 bp, Mus musculus
attaatcccggggagccgtggcctg

SEQ ID NO: 79449 - DNA, 25 bp, Mus musculus
attaattccatgagcaacagccctg

SEQ ID NO: 79450 - DNA, 25 bp, Mus musculus
attacacagtgcgtggcctcctggg

SEQ ID NO: 79451 - DNA, 25 bp, Mus musculus
attaccaggccggttcaccaaggag

SEQ ID NO: 79452 - DNA, 25 bp, Mus musculus
attaccatgatgagggctacgggcc

SEQ ID NO: 79453 - DNA, 25 bp, Mus musculus
attacctcatcatgacctgtcagcc

SEQ ID NO: 79454 - DNA, 25 bp, Mus musculus
attacctgcagctcaaccttgcggg

SEQ ID NO: 79455 - DNA, 25 bp, Mus musculus
attacgtgcactctacttgcagggg

SEQ ID NO: 79456 - DNA, 25 bp, Mus musculus
attactgacaagaccacttctcacc

SEQ ID NO: 79457 - DNA, 25 bp, Mus musculus
attactgtgagaagcccgcatgccc

SEQ ID NO: 79458 - DNA, 25 bp, Mus musculus
attaggagacaattgacgcggagcc

SEQ ID NO: 79459 - DNA, 25 bp, Mus musculus
attaggcctccaaaatgttttgtgc

SEQ ID NO: 79460 - DNA, 25 bp, Mus musculus
attagtggatcccatggctgacacg

SEQ ID NO: 79461 - DNA, 25 bp, Mus musculus
attatacagacacgccactggagaa

SEQ ID NO: 79462 - DNA, 25 bp, Mus musculus
attatcacagagtatggttgggagc

SEQ ID NO: 79463 - DNA, 25 bp, Mus musculus
attattggctcaaaaggcaccagcg

SEQ ID NO: 79464 - DNA, 25 bp, Mus musculus
attcaaagatgtgggacggaagcct

SEQ ID NO: 79465 - DNA, 25 bp, Mus musculus
attcaacggccgtgcagggacaagt

SEQ ID NO: 79466 - DNA, 25 bp, Mus musculus
attcacgcgtttgaccactgccggg

SEQ ID NO: 79467 - DNA, 25 bp, Mus musculus
attcactttcctccggcaggagctg

SEQ ID NO: 79468 - DNA, 25 bp, Mus musculus
attcagccccagcaaggcggatgga

SEQ ID NO: 79469 - DNA, 25 bp, Mus musculus
attcagccgccgtggactcagacat

SEQ ID NO: 79470 - DNA, 25 bp, Mus musculus
attcatggggcagtccaggtgtccc

SEQ ID NO: 79471 - DNA, 25 bp, Mus musculus
attcattatacctgagtacagaagt

SEQ ID NO: 79472 - DNA, 25 bp, Mus musculus
attccaaggaaatagaccgcagccg

SEQ ID NO: 79473 - DNA, 25 bp, Mus musculus
attccagcgccacgacctgatcgag

SEQ ID NO: 79474 - DNA, 25 bp, Mus musculus
attccatgagagatagggcgcccgg

SEQ ID NO: 79475 - DNA, 25 bp, Mus musculus
attcccagcctggtggtcccagagg

SEQ ID NO: 79476 - DNA, 25 bp, Mus musculus
attccccggcgcttcggagaggctt

SEQ ID NO: 79477 - DNA, 25 bp, Mus musculus
attcccgatgtggagcctgctgcct

SEQ ID NO: 79478 - DNA, 25 bp, Mus musculus
attcccgttgggagcggaacgctgc

SEQ ID NO: 79479 - DNA, 25 bp, Mus musculus
attccctggctgaagccctccgagg

SEQ ID NO: 79480 - DNA, 25 bp, Mus musculus
attccgaaaagtggcccgagtacag

SEQ ID NO: 79481 - DNA, 25 bp, Mus musculus
attcctaccccatttggaggccaag

SEQ ID NO: 79482 - DNA, 25 bp, Mus musculus
attcctctcggactctcgggcgctg

SEQ ID NO: 79483 - DNA, 25 bp, Mus musculus
attcctctgagaacggcagcctgcg

SEQ ID NO: 79484 - DNA, 25 bp, Mus musculus
attcctggcaaggaggacctggcta

SEQ ID NO: 79485 - DNA, 25 bp, Mus musculus
attcctgtctctgagcgtcggtcag

SEQ ID NO: 79486 - DNA, 25 bp, Mus musculus
attccttgcaaagccgcgggcgaga

SEQ ID NO: 79487 - DNA, 25 bp, Mus musculus
attcgagtggcctatcagcgggagc

SEQ ID NO: 79488 - DNA, 25 bp, Mus musculus
attcgccttcccaggtgcactcaga

SEQ ID NO: 79489 - DNA, 25 bp, Mus musculus
attcgcggcctctggttctcggcgg

SEQ ID NO: 79490 - DNA, 25 bp, Mus musculus
attcgctgggtttggatcgggcaca

SEQ ID NO: 79491 - DNA, 25 bp, Mus musculus
attcggactgcgcagccatgctgcg

SEQ ID NO: 79492 - DNA, 25 bp, Mus musculus
attcggagtcgcctggaacacagag

SEQ ID NO: 79493 - DNA, 25 bp, Mus musculus
attcggcttgctcagactgaagcgc

SEQ ID NO: 79494 - DNA, 25 bp, Mus musculus
attctccagagctactcaaataccg

SEQ ID NO: 79495 - DNA, 25 bp, Mus musculus
attctcggtttactcctgctccaag

SEQ ID NO: 79496 - DNA, 25 bp, Mus musculus
attctgaggctgacgatgcgcctgg

SEQ ID NO: 79497 - DNA, 25 bp, Mus musculus
attctgaggcttggctgcggttgaa

SEQ ID NO: 79498 - DNA, 25 bp, Mus musculus
attctgccagtatgtgtcccaaggg

SEQ ID NO: 79499 - DNA, 25 bp, Mus musculus
attctggaagtgagcgggaagaccc

SEQ ID NO: 79500 - DNA, 25 bp, Mus musculus
attctggaccgtaaccctcgcttgc

SEQ ID NO: 79501 - DNA, 25 bp, Mus musculus
attctgtgtaacttctcttctggat

SEQ ID NO: 79502 - DNA, 25 bp, Mus musculus
attctgttcttaagcaggcatcgcg

SEQ ID NO: 79503 - DNA, 25 bp, Mus musculus
attctttggacagaccattctcggg

SEQ ID NO: 79504 - DNA, 25 bp, Mus musculus
attgaaactgctttcaaggatattg

SEQ ID NO: 79505 - DNA, 25 bp, Mus musculus
attgaacccgcaggaagactcgcag

SEQ ID NO: 79506 - DNA, 25 bp, Mus musculus
attgaacgcctgtgtccaagtgacc

SEQ ID NO: 79507 - DNA, 25 bp, Mus musculus
attgacaaatctcccaggactttgg

SEQ ID NO: 79508 - DNA, 25 bp, Mus musculus
attgacatgatgacacaaaaccagc

SEQ ID NO: 79509 - DNA, 25 bp, Mus musculus
attgacccctgtgagccgagctcag

SEQ ID NO: 79510 - DNA, 25 bp, Mus musculus
attgacgatgaagaaattgagcggc

SEQ ID NO: 79511 - DNA, 25 bp, Mus musculus
attgagatagcgaaagccatgaggc

SEQ ID NO: 79512 - DNA, 25 bp, Mus musculus
attgagccgctagacgacatcgcag

SEQ ID NO: 79513 - DNA, 25 bp, Mus musculus
attgaggcccgtgaaatccagcagc

SEQ ID NO: 79514 - DNA, 25 bp, Mus musculus
attgagggcaatattgcaagtggga

SEQ ID NO: 79515 - DNA, 25 bp, Mus musculus
attgagtaggagcacacaggcgcac

SEQ ID NO: 79516 - DNA, 25 bp, Mus musculus
attgagtgttacgtctgcgggcagt

SEQ ID NO: 79517 - DNA, 25 bp, Mus musculus
attgatgaggacacccaggaggccg

SEQ ID NO: 79518 - DNA, 25 bp, Mus musculus
attgattgtccttttaatacccaat

SEQ ID NO: 79519 - DNA, 25 bp, Mus musculus
attgcacatgtgtcacccgccagga

SEQ ID NO: 79520 - DNA, 25 bp, Mus musculus
attgcagactggtggcatgggccca

SEQ ID NO: 79521 - DNA, 25 bp, Mus musculus
attgcagcctgcgaagtgaagcggc

SEQ ID NO: 79522 - DNA, 25 bp, Mus musculus
attgcagctgtagtcgctccggccg

SEQ ID NO: 79523 - DNA, 25 bp, Mus musculus
attgcaggcagtggctccgcgacct

SEQ ID NO: 79524 - DNA, 25 bp, Mus musculus
attgcatttatatcaccattgttga

SEQ ID NO: 79525 - DNA, 25 bp, Mus musculus
attgccctggttggaggaatcccca

SEQ ID NO: 79526 - DNA, 25 bp, Mus musculus
attgccgccggcagacgcgcgaagc

SEQ ID NO: 79527 - DNA, 25 bp, Mus musculus
attgccttgggacctgcgctttcgc

SEQ ID NO: 79528 - DNA, 25 bp, Mus musculus
attgcgctgctcgtcatccttgtca

SEQ ID NO: 79529 - DNA, 25 bp, Mus musculus
attgctcatgagaacacctgccctg

SEQ ID NO: 79530 - DNA, 25 bp, Mus musculus
attgctccagaccatgtcgtccctg

SEQ ID NO: 79531 - DNA, 25 bp, Mus musculus
attgctgtgatctcggcttgagaga

SEQ ID NO: 79532 - DNA, 25 bp, Mus musculus
attggaaactctcccagcgggcctg

SEQ ID NO: 79533 - DNA, 25 bp, Mus musculus
attggagattcagtttacacctttg

SEQ ID NO: 79534 - DNA, 25 bp, Mus musculus
attggagctgatagcctcatcgggc

SEQ ID NO: 79535 - DNA, 25 bp, Mus musculus
attggcctcacggtctacagcttag

SEQ ID NO: 79536 - DNA, 25 bp, Mus musculus
attgggaatctccactccagaggag

SEQ ID NO: 79537 - DNA, 25 bp, Mus musculus
attgggaggccagcagaatttcacc

SEQ ID NO: 79538 - DNA, 25 bp, Mus musculus
attgggcagctttccacaaccggcc

SEQ ID NO: 79539 - DNA, 25 bp, Mus musculus
attggtacagcctccgagtcggcgg

SEQ ID NO: 79540 - DNA, 25 bp, Mus musculus
attggtggagcaggctatggccggc

SEQ ID NO: 79541 - DNA, 25 bp, Mus musculus
attgtaaagtcctgatcagtggcca

SEQ ID NO: 79542 - DNA, 25 bp, Mus musculus
attgtacgttgccacagaagccccg

SEQ ID NO: 79543 - DNA, 25 bp, Mus musculus
attgtagctgagatggatgtccctc

SEQ ID NO: 79544 - DNA, 25 bp, Mus musculus
attgtatccacaccgcctggaggct

SEQ ID NO: 79545 - DNA, 25 bp, Mus musculus
attgtcagaggactaaacagcagcc

SEQ ID NO: 79546 - DNA, 25 bp, Mus musculus
attgtccttgtctcgggccgggagc

SEQ ID NO: 79547 - DNA, 25 bp, Mus musculus
attgtgaagatgacaaagagtgacg

SEQ ID NO: 79548 - DNA, 25 bp, Mus musculus
attgtgctaagcctcaacgtgtcgc

SEQ ID NO: 79549 - DNA, 25 bp, Mus musculus
attgtggcccgcgaggttgagtact

SEQ ID NO: 79550 - DNA, 25 bp, Mus musculus
attgtggccgttctctctgctgtca

SEQ ID NO: 79551 - DNA, 25 bp, Mus musculus
attgtgggaaccaggaggcgccatc

SEQ ID NO: 79552 - DNA, 25 bp, Mus musculus
attgtgggcatcaaacgacacgtca

SEQ ID NO: 79553 - DNA, 25 bp, Mus musculus
attgttaatagaaatggccatcagc

SEQ ID NO: 79554 - DNA, 25 bp, Mus musculus
attgttcacagcctgttggtctcga

SEQ ID NO: 79555 - DNA, 25 bp, Mus musculus
attgttcaggacttattgttcaccg

SEQ ID NO: 79556 - DNA, 25 bp, Mus musculus
attgtttgagaaacggccgtgcggc

SEQ ID NO: 79557 - DNA, 25 bp, Mus musculus
atttaactgagttggacatctggac

SEQ ID NO: 79558 - DNA, 25 bp, Mus musculus
atttacaagcaagggccgacaggga

SEQ ID NO: 79559 - DNA, 25 bp, Mus musculus
atttagagagcacgccagactccag

SEQ ID NO: 79560 - DNA, 25 bp, Mus musculus
atttagagccccaggtgtccagcgt

SEQ ID NO: 79561 - DNA, 25 bp, Mus musculus
atttagccaaaaggctgggcctccg

SEQ ID NO: 79562 - DNA, 25 bp, Mus musculus
atttatatcaccattgttgaaatta

SEQ ID NO: 79563 - DNA, 25 bp, Mus musculus
atttcaaaaaatcaggtagcagtcc

SEQ ID NO: 79564 - DNA, 25 bp, Mus musculus
atttcagagacttgagcgcaaaggg

SEQ ID NO: 79565 - DNA, 25 bp, Mus musculus
atttcagtgcctatggccaccactg

SEQ ID NO: 79566 - DNA, 25 bp, Mus musculus
atttcgggcgaagagctcagtgagc

SEQ ID NO: 79567 - DNA, 25 bp, Mus musculus
atttctacaacatccacagcctggg

SEQ ID NO: 79568 - DNA, 25 bp, Mus musculus
atttctccccagaatgcccaacaag

SEQ ID NO: 79569 - DNA, 25 bp, Mus musculus
atttctcgggaggagcttgaagagc

SEQ ID NO: 79570 - DNA, 25 bp, Mus musculus
atttctgagtgcaggagaccccaca

SEQ ID NO: 79571 - DNA, 25 bp, Mus musculus
atttgaagcagggttggcagcaaac

SEQ ID NO: 79572 - DNA, 25 bp, Mus musculus
atttgagaatgtagaactgggcgtc

SEQ ID NO: 79573 - DNA, 25 bp, Mus musculus
atttgcctccagggatagggaagga

SEQ ID NO: 79574 - DNA, 25 bp, Mus musculus
atttgctacgagagcccggaagggc

SEQ ID NO: 79575 - DNA, 25 bp, Mus musculus
atttggaaccaagtgcgcccggtgc

SEQ ID NO: 79576 - DNA, 25 bp, Mus musculus
atttggatggccctgactgactccc

SEQ ID NO: 79577 - DNA, 25 bp, Mus musculus
atttggcgcgtccacgagggcatac

SEQ ID NO: 79578 - DNA, 25 bp, Mus musculus
atttggtgactgaggaaaggaccca

SEQ ID NO: 79579 - DNA, 25 bp, Mus musculus
atttgttggaattccgcgcggtcgc

SEQ ID NO: 79580 - DNA, 25 bp, Mus musculus
attttaagcggcgtcatccggagcg

SEQ ID NO: 79581 - DNA, 25 bp, Mus musculus
attttaatactggtgaacttggcca

SEQ ID NO: 79582 - DNA, 25 bp, Mus musculus
attttatgtggatgttagaacgcgc

SEQ ID NO: 79583 - DNA, 25 bp, Mus musculus
attttattagagctgctgccgcgtc

SEQ ID NO: 79584 - DNA, 25 bp, Mus musculus
attttcacaaatccggtacgatgct

SEQ ID NO: 79585 - DNA, 25 bp, Mus musculus
attttgcggaccctaaagcacgcag

SEQ ID NO: 79586 - DNA, 25 bp, Mus musculus
attttggaccagtggtgccctgcgg

SEQ ID NO: 79587 - DNA, 25 bp, Mus musculus
attttggaccatagcaccctctgag

SEQ ID NO: 79588 - DNA, 25 bp, Mus musculus
attttttcaccacatcaacctgcag

SEQ ID NO: 79589 - DNA, 25 bp, Mus musculus
caaaaaacagagaatatgaccgatt

SEQ ID NO: 79590 - DNA, 25 bp, Mus musculus
caaaaaactctcctttgagggcctg

SEQ ID NO: 79591 - DNA, 25 bp, Mus musculus
caaaaaactggagcactaccgtcgg

SEQ ID NO: 79592 - DNA, 25 bp, Mus musculus
caaaaaactttggagcagatacgac

SEQ ID NO: 79593 - DNA, 25 bp, Mus musculus
caaaaaatccaagcatgtcccagcg

SEQ ID NO: 79594 - DNA, 25 bp, Mus musculus
caaaaaatcgagctgccacgtgttc

SEQ ID NO: 79595 - DNA, 25 bp, Mus musculus
caaaaaatctgtcaactgggtgatc

SEQ ID NO: 79596 - DNA, 25 bp, Mus musculus
caaaaaatggtggaccttcggcagc

SEQ ID NO: 79597 - DNA, 25 bp, Mus musculus
caaaaaatgtgcctagcgaagcgaa

SEQ ID NO: 79598 - DNA, 25 bp, Mus musculus
caaaaacaactgagtgtggcatcac

SEQ ID NO: 79599 - DNA, 25 bp, Mus musculus
caaaaacagagagcgatggtgccat

SEQ ID NO: 79600 - DNA, 25 bp, Mus musculus
caaaaacagtgtaaagcagactacc

SEQ ID NO: 79601 - DNA, 25 bp, Mus musculus
caaaaaccctgactgtctgagaagc

SEQ ID NO: 79602 - DNA, 25 bp, Mus musculus
caaaaaccgtgattggaaaggctcg

SEQ ID NO: 79603 - DNA, 25 bp, Mus musculus
caaaaacctggagtgtgatgccacc

SEQ ID NO: 79604 - DNA, 25 bp, Mus musculus
caaaaacgccgcaaaattgatagtc

SEQ ID NO: 79605 - DNA, 25 bp, Mus musculus
caaaaacggatcctggagatgggca

SEQ ID NO: 79606 - DNA, 25 bp, Mus musculus
caaaaactgtggtgtcctggtgcat

SEQ ID NO: 79607 - DNA, 25 bp, Mus musculus
caaaaactgtttccggtgtgccaag

SEQ ID NO: 79608 - DNA, 25 bp, Mus musculus
caaaaagaagtatgacaaagagacc

SEQ ID NO: 79609 - DNA, 25 bp, Mus musculus
caaaaagatgctcggattggcgaag

SEQ ID NO: 79610 - DNA, 25 bp, Mus musculus
caaaaagatttggatctcccaggcc

SEQ ID NO: 79611 - DNA, 25 bp, Mus musculus
caaaaagcgaaactggccaaagaca

SEQ ID NO: 79612 - DNA, 25 bp, Mus musculus
caaaaagctgtctgacctggaacga

SEQ ID NO: 79613 - DNA, 25 bp, Mus musculus
caaaaaggctgcatcctagaagcca

SEQ ID NO: 79614 - DNA, 25 bp, Mus musculus
caaaaagggttggagatggagcacc

SEQ ID NO: 79615 - DNA, 25 bp, Mus musculus
caaaaagtcacgtttcgacctagag

SEQ ID NO: 79616 - DNA, 25 bp, Mus musculus
caaaaagtcatttgtccacggagtg

SEQ ID NO: 79617 - DNA, 25 bp, Mus musculus
caaaaagtctgtatgacgcctggtc

SEQ ID NO: 79618 - DNA, 25 bp, Mus musculus
caaaaagtgatgtaataagatgcaa

SEQ ID NO: 79619 - DNA, 25 bp, Mus musculus
caaaaagtgtcccagcatcgtgcag

SEQ ID NO: 79620 - DNA, 25 bp, Mus musculus
caaaaagtgtcccttccagagctgg

SEQ ID NO: 79621 - DNA, 25 bp, Mus musculus
caaaaagtttgtcaccgagctacgg

SEQ ID NO: 79622 - DNA, 25 bp, Mus musculus
caaaaatattgttcatcagcagcgg

SEQ ID NO: 79623 - DNA, 25 bp, Mus musculus
caaaaatcctcgtggaatgcctcac

SEQ ID NO: 79624 - DNA, 25 bp, Mus musculus
caaaaatctattctcagggtcagcc

SEQ ID NO: 79625 - DNA, 25 bp, Mus musculus
caaaaatgaatgtgaggcgaacacc

SEQ ID NO: 79626 - DNA, 25 bp, Mus musculus
caaaaatgagagagaaggttcggcc

SEQ ID NO: 79627 - DNA, 25 bp, Mus musculus
caaaaatgcaagtgctggaccggcg

SEQ ID NO: 79628 - DNA, 25 bp, Mus musculus
caaaaatggaacgtcggcggcgtga

SEQ ID NO: 79629 - DNA, 25 bp, Mus musculus
caaaaatggacatcgaggtcccgca

SEQ ID NO: 79630 - DNA, 25 bp, Mus musculus
caaaaatggtgagtttgtatggatc

SEQ ID NO: 79631 - DNA, 25 bp, Mus musculus
caaaaatgtttacgcaaagtgacac

SEQ ID NO: 79632 - DNA, 25 bp, Mus musculus
caaaacaatttctgaggccgagtca

SEQ ID NO: 79633 - DNA, 25 bp, Mus musculus
caaaacacgacgagatgatggccat

SEQ ID NO: 79634 - DNA, 25 bp, Mus musculus
caaaacacggagtgctggctgtgct

SEQ ID NO: 79635 - DNA, 25 bp, Mus musculus
caaaacagaaaacagcgttgaaagc

SEQ ID NO: 79636 - DNA, 25 bp, Mus musculus
caaaacaggaggctaagtggcacct

SEQ ID NO: 79637 - DNA, 25 bp, Mus musculus
caaaacagtgcattgggcttcagac

SEQ ID NO: 79638 - DNA, 25 bp, Mus musculus
caaaacatcaacagtaccaccgtgg

SEQ ID NO: 79639 - DNA, 25 bp, Mus musculus
caaaacattatagagacggacaccc

SEQ ID NO: 79640 - DNA, 25 bp, Mus musculus
caaaaccaacttcatgggcagccat

SEQ ID NO: 79641 - DNA, 25 bp, Mus musculus
caaaaccagccgtacagaaagttca

SEQ ID NO: 79642 - DNA, 25 bp, Mus musculus
caaaaccagcttctcattgagccgc

SEQ ID NO: 79643 - DNA, 25 bp, Mus musculus
caaaaccagtcttaaatgggagacg

SEQ ID NO: 79644 - DNA, 25 bp, Mus musculus
caaaacccaaagcaagccggaagat

SEQ ID NO: 79645 - DNA, 25 bp, Mus musculus
caaaacccaggacagttgtagagcc

SEQ ID NO: 79646 - DNA, 25 bp, Mus musculus
caaaacccctcgatagaagtgagag

SEQ ID NO: 79647 - DNA, 25 bp, Mus musculus
caaaaccctcggtctcatggtggaa

SEQ ID NO: 79648 - DNA, 25 bp, Mus musculus
caaaaccgagtcagttaccagtggc

SEQ ID NO: 79649 - DNA, 25 bp, Mus musculus
caaaacctgtgaggactgggtggat

SEQ ID NO: 79650 - DNA, 25 bp, Mus musculus
caaaacctgtgtcttctggccaagt

SEQ ID NO: 79651 - DNA, 25 bp, Mus musculus
caaaacctttgtccctcagttccag

SEQ ID NO: 79652 - DNA, 25 bp, Mus musculus
caaaacgacagtatgacgagagcca

SEQ ID NO: 79653 - DNA, 25 bp, Mus musculus
caaaacgcagagaaaacgatgtccc

SEQ ID NO: 79654 - DNA, 25 bp, Mus musculus
caaaacgctgtacggtgacaccgga

SEQ ID NO: 79655 - DNA, 25 bp, Mus musculus
caaaacggaacaacctcaggagagc

SEQ ID NO: 79656 - DNA, 25 bp, Mus musculus
caaaacggatggcagatactggcct

SEQ ID NO: 79657 - DNA, 25 bp, Mus musculus
caaaacggcttcaactctacgaggg

SEQ ID NO: 79658 - DNA, 25 bp, Mus musculus
caaaacgggcggtcgagcagaacgt

SEQ ID NO: 79659 - DNA, 25 bp, Mus musculus
caaaacgtcacagaagttcgggcag

SEQ ID NO: 79660 - DNA, 25 bp, Mus musculus
caaaacgtgggttcaaaatcacctg

SEQ ID NO: 79661 - DNA, 25 bp, Mus musculus
caaaactaaatgatgtcatgtcgca

SEQ ID NO: 79662 - DNA, 25 bp, Mus musculus
caaaactaaggaaggagtggttcat

SEQ ID NO: 79663 - DNA, 25 bp, Mus musculus
caaaactgaaatcatctctacccca

SEQ ID NO: 79664 - DNA, 25 bp, Mus musculus
caaaactgagaatgccagggaacca

SEQ ID NO: 79665 - DNA, 25 bp, Mus musculus
caaaactgccagattcctgcttagg

SEQ ID NO: 79666 - DNA, 25 bp, Mus musculus
caaaactgggactatcgctggcagc

SEQ ID NO: 79667 - DNA, 25 bp, Mus musculus
caaaactgggccacgttacagggcg

SEQ ID NO: 79668 - DNA, 25 bp, Mus musculus
caaaactggtgaacagcggatgaag

SEQ ID NO: 79669 - DNA, 25 bp, Mus musculus
caaaacttcctgtggttcgtgggca

SEQ ID NO: 79670 - DNA, 25 bp, Mus musculus
caaaactttacaagtcttgtgggct

SEQ ID NO: 79671 - DNA, 25 bp, Mus musculus
caaaagaagaacttggactgcggcc

SEQ ID NO: 79672 - DNA, 25 bp, Mus musculus
caaaagaagagagctcccacgagag

SEQ ID NO: 79673 - DNA, 25 bp, Mus musculus
caaaagaaggagatgcacacggaca

SEQ ID NO: 79674 - DNA, 25 bp, Mus musculus
caaaagacctcttagtgaaatgagg

SEQ ID NO: 79675 - DNA, 25 bp, Mus musculus
caaaagactagattgtgcctaagca

SEQ ID NO: 79676 - DNA, 25 bp, Mus musculus
caaaagagcagatcaaagcgggaga

SEQ ID NO: 79677 - DNA, 25 bp, Mus musculus
caaaagagcttaccagccatgagga

SEQ ID NO: 79678 - DNA, 25 bp, Mus musculus
caaaagaggaagaggtcgtggtact

SEQ ID NO: 79679 - DNA, 25 bp, Mus musculus
caaaagaggcaaactcccagtgcta

SEQ ID NO: 79680 - DNA, 25 bp, Mus musculus
caaaagagggtcatcagggaggcct

SEQ ID NO: 79681 - DNA, 25 bp, Mus musculus
caaaagaggtccattgtggtgtccc

SEQ ID NO: 79682 - DNA, 25 bp, Mus musculus
caaaagagtaactgagatccttgga

SEQ ID NO: 79683 - DNA, 25 bp, Mus musculus
caaaagatacatggcacccgaggtg

SEQ ID NO: 79684 - DNA, 25 bp, Mus musculus
caaaagatctacacatacgcgggca

SEQ ID NO: 79685 - DNA, 25 bp, Mus musculus
caaaagatgactacaaacataggat

SEQ ID NO: 79686 - DNA, 25 bp, Mus musculus
caaaagatggagtcgggctgctatc

SEQ ID NO: 79687 - DNA, 25 bp, Mus musculus
caaaagatggcgacgccccttgggt

SEQ ID NO: 79688 - DNA, 25 bp, Mus musculus
caaaagatttcagcggtggcagttc

SEQ ID NO: 79689 - DNA, 25 bp, Mus musculus
caaaagcaacggagaagagcctagg

SEQ ID NO: 79690 - DNA, 25 bp, Mus musculus
caaaagcaatgatcggcctggtcac

SEQ ID NO: 79691 - DNA, 25 bp, Mus musculus
caaaagcaattctgttggccaggac

SEQ ID NO: 79692 - DNA, 25 bp, Mus musculus
caaaagcaccgtgtagtggcctggc

SEQ ID NO: 79693 - DNA, 25 bp, Mus musculus
caaaagcactggtaggcatagcata

SEQ ID NO: 79694 - DNA, 25 bp, Mus musculus
caaaagcagcttgagtcacagtgtg

SEQ ID NO: 79695 - DNA, 25 bp, Mus musculus
caaaagcattcaccgaaaggatccg

SEQ ID NO: 79696 - DNA, 25 bp, Mus musculus
caaaagcattggtggcagcagcaga

SEQ ID NO: 79697 - DNA, 25 bp, Mus musculus
caaaagcccagcgtcaatgcggttg

SEQ ID NO: 79698 - DNA, 25 bp, Mus musculus
caaaagcgaaaactcatccgggaat

SEQ ID NO: 79699 - DNA, 25 bp, Mus musculus
caaaagcgtcaacgtggagtcgaga

SEQ ID NO: 79700 - DNA, 25 bp, Mus musculus
caaaagctaagtccccaaatggcag

SEQ ID NO: 79701 - DNA, 25 bp, Mus musculus
caaaagctacaggaagacggcctcc

SEQ ID NO: 79702 - DNA, 25 bp, Mus musculus
caaaagctgaatttagagagcacag

SEQ ID NO: 79703 - DNA, 25 bp, Mus musculus
caaaagctgacaaagtcccatcact

SEQ ID NO: 79704 - DNA, 25 bp, Mus musculus
caaaagctggatttgctctggcaga

SEQ ID NO: 79705 - DNA, 25 bp, Mus musculus
caaaagctggttaagggccacgcat

SEQ ID NO: 79706 - DNA, 25 bp, Mus musculus
caaaagctgtaacggcagcctggcc

SEQ ID NO: 79707 - DNA, 25 bp, Mus musculus
caaaagcttcggagggaactgtcaa

SEQ ID NO: 79708 - DNA, 25 bp, Mus musculus
caaaagcttctaggacccgtgagag

SEQ ID NO: 79709 - DNA, 25 bp, Mus musculus
caaaaggaagtgaaacacctggcgc

SEQ ID NO: 79710 - DNA, 25 bp, Mus musculus
caaaaggacagtgagattgcccgcc

SEQ ID NO: 79711 - DNA, 25 bp, Mus musculus
caaaaggacctaccgagagttgcgt

SEQ ID NO: 79712 - DNA, 25 bp, Mus musculus
caaaaggagaccaacaatcccggtg

SEQ ID NO: 79713 - DNA, 25 bp, Mus musculus
caaaaggagtcaccaacatggctct

SEQ ID NO: 79714 - DNA, 25 bp, Mus musculus
caaaaggcatcgactatgacaagct

SEQ ID NO: 79715 - DNA, 25 bp, Mus musculus
caaaaggccactgtcaagggagaga

SEQ ID NO: 79716 - DNA, 25 bp, Mus musculus
caaaaggccccgttatgatgacaca

SEQ ID NO: 79717 - DNA, 25 bp, Mus musculus
caaaaggctgcgtctacttggagca

SEQ ID NO: 79718 - DNA, 25 bp, Mus musculus
caaaagggatgtcagccggtactgc

SEQ ID NO: 79719 - DNA, 25 bp, Mus musculus
caaaagggtgttagaagaattgact

SEQ ID NO: 79720 - DNA, 25 bp, Mus musculus
caaaaggtgggaagtcagctgctac

SEQ ID NO: 79721 - DNA, 25 bp, Mus musculus
caaaaggtgtccctggcagatggca

SEQ ID NO: 79722 - DNA, 25 bp, Mus musculus
caaaaggtgtgatcaatgactggcg

SEQ ID NO: 79723 - DNA, 25 bp, Mus musculus
caaaaggttctgtcagccaatggca

SEQ ID NO: 79724 - DNA, 25 bp, Mus musculus
caaaaggttttaggtgcagcggcgt

SEQ ID NO: 79725 - DNA, 25 bp, Mus musculus
caaaagtacaagcagcgccatgggt

SEQ ID NO: 79726 - DNA, 25 bp, Mus musculus
caaaagtacttcaaactggagcctc

SEQ ID NO: 79727 - DNA, 25 bp, Mus musculus
caaaagtcaagatcaaccctgtgca

SEQ ID NO: 79728 - DNA, 25 bp, Mus musculus
caaaagtcctcatgggctcgtggga

SEQ ID NO: 79729 - DNA, 25 bp, Mus musculus
caaaagtcgagagaatgcagcgctc

SEQ ID NO: 79730 - DNA, 25 bp, Mus musculus
caaaagtctgttgccctattccagg

SEQ ID NO: 79731 - DNA, 25 bp, Mus musculus
caaaagtctgttggcactcacgagg

SEQ ID NO: 79732 - DNA, 25 bp, Mus musculus
caaaagtgaagtggagatcccagcc

SEQ ID NO: 79733 - DNA, 25 bp, Mus musculus
caaaagtggacaagaagttctcggc

SEQ ID NO: 79734 - DNA, 25 bp, Mus musculus
caaaagtggatacaacagaggaaac

SEQ ID NO: 79735 - DNA, 25 bp, Mus musculus
caaaagtgtctgaaagagaagcccc

SEQ ID NO: 79736 - DNA, 25 bp, Mus musculus
caaaagtgtctgcaaatgaaggttt

SEQ ID NO: 79737 - DNA, 25 bp, Mus musculus
caaaataaacagttgcggcgacgca

SEQ ID NO: 79738 - DNA, 25 bp, Mus musculus
caaaataacgagattaaacaactgg

SEQ ID NO: 79739 - DNA, 25 bp, Mus musculus
caaaataggttctacaggtcccagg

SEQ ID NO: 79740 - DNA, 25 bp, Mus musculus
caaaatcaagcagaggcgaagtcgg

SEQ ID NO: 79741 - DNA, 25 bp, Mus musculus
caaaatcaccagataattgacttag

SEQ ID NO: 79742 - DNA, 25 bp, Mus musculus
caaaatcagcgtgagaagcgggagc

SEQ ID NO: 79743 - DNA, 25 bp, Mus musculus
caaaatcagctgaagagcatgcggc

SEQ ID NO: 79744 - DNA, 25 bp, Mus musculus
caaaatcattgaagttggagacaca

SEQ ID NO: 79745 - DNA, 25 bp, Mus musculus
caaaatccaaactcagtgagacgct

SEQ ID NO: 79746 - DNA, 25 bp, Mus musculus
caaaatccacgtagagagagccgtc

SEQ ID NO: 79747 - DNA, 25 bp, Mus musculus
caaaatccagttttgatggttccag

SEQ ID NO: 79748 - DNA, 25 bp, Mus musculus
caaaatcccggagaagctgagacct

SEQ ID NO: 79749 - DNA, 25 bp, Mus musculus
caaaatccctgctgttcatggtgac

SEQ ID NO: 79750 - DNA, 25 bp, Mus musculus
caaaatcctgagtgctaatggcgag

SEQ ID NO: 79751 - DNA, 25 bp, Mus musculus
caaaatcctttacggatgggcagga

SEQ ID NO: 79752 - DNA, 25 bp, Mus musculus
caaaatcgccctgaaaaactgtggt

SEQ ID NO: 79753 - DNA, 25 bp, Mus musculus
caaaatcgtctgtggatgcctagtc

SEQ ID NO: 79754 - DNA, 25 bp, Mus musculus
caaaatcgtctttcccagtgctaac

SEQ ID NO: 79755 - DNA, 25 bp, Mus musculus
caaaatctattcttcagttgccaga

SEQ ID NO: 79756 - DNA, 25 bp, Mus musculus
caaaatctgcttcggcgatggtgac

SEQ ID NO: 79757 - DNA, 25 bp, Mus musculus
caaaatctttgcagttggcggtcac

SEQ ID NO: 79758 - DNA, 25 bp, Mus musculus
caaaatgaagggactcgcactggac

SEQ ID NO: 79759 - DNA, 25 bp, Mus musculus
caaaatgacggctcggtatcacagc

SEQ ID NO: 79760 - DNA, 25 bp, Mus musculus
caaaatgactgactcaaaatacttc

SEQ ID NO: 79761 - DNA, 25 bp, Mus musculus
caaaatgagcttacctttgagtgat

SEQ ID NO: 79762 - DNA, 25 bp, Mus musculus
caaaatgaggtgaacaaggtggacc

SEQ ID NO: 79763 - DNA, 25 bp, Mus musculus
caaaatgattgacaccaaaggtggc

SEQ ID NO: 79764 - DNA, 25 bp, Mus musculus
caaaatgcccctgtgatgaatgtgt

SEQ ID NO: 79765 - DNA, 25 bp, Mus musculus
caaaatgcctgtgggtgtgatagac

SEQ ID NO: 79766 - DNA, 25 bp, Mus musculus
caaaatgcggttaaggaagcagaag

SEQ ID NO: 79767 - DNA, 25 bp, Mus musculus
caaaatgctgagtgaggcttcggat

SEQ ID NO: 79768 - DNA, 25 bp, Mus musculus
caaaatggaaagctgtccagccacg

SEQ ID NO: 79769 - DNA, 25 bp, Mus musculus
caaaatggaagatgctcctgctttc

SEQ ID NO: 79770 - DNA, 25 bp, Mus musculus
caaaatggaagtggaccgtcagaac

SEQ ID NO: 79771 - DNA, 25 bp, Mus musculus
caaaatggcgaagggctgttgcgaa

SEQ ID NO: 79772 - DNA, 25 bp, Mus musculus
caaaatggcgaggagacagggccac

SEQ ID NO: 79773 - DNA, 25 bp, Mus musculus
caaaatggcttatccggtactggcc

SEQ ID NO: 79774 - DNA, 25 bp, Mus musculus
caaaatggggcgacatcgagcagtg

SEQ ID NO: 79775 - DNA, 25 bp, Mus musculus
caaaatggtacctacctccagcgag

SEQ ID NO: 79776 - DNA, 25 bp, Mus musculus
caaaatggtcatgcctgtctaacac

SEQ ID NO: 79777 - DNA, 25 bp, Mus musculus
caaaatggttatggttctggcggct

SEQ ID NO: 79778 - DNA, 25 bp, Mus musculus
caaaatgtatgctgggctctgcaga

SEQ ID NO: 79779 - DNA, 25 bp, Mus musculus
caaaatgtcacgtttgctcaggtgg

SEQ ID NO: 79780 - DNA, 25 bp, Mus musculus
caaaatgtccgaggtgaagctccca

SEQ ID NO: 79781 - DNA, 25 bp, Mus musculus
caaaatgtcctgagccttccaaaca

SEQ ID NO: 79782 - DNA, 25 bp, Mus musculus
caaaatgtgcctggtgctccaaaga

SEQ ID NO: 79783 - DNA, 25 bp, Mus musculus
caaaattagacctttgtggcgacat

SEQ ID NO: 79784 - DNA, 25 bp, Mus musculus
caaaattcattatacctgagtacag

SEQ ID NO: 79785 - DNA, 25 bp, Mus musculus
caaaattctgcaacaaccacgtcag

SEQ ID NO: 79786 - DNA, 25 bp, Mus musculus
caaaattcttcagggagtgtcacct

SEQ ID NO: 79787 - DNA, 25 bp, Mus musculus
caaaattgaatttaagcggcctggg

SEQ ID NO: 79788 - DNA, 25 bp, Mus musculus
caaaattgagcccagcagctggagc

SEQ ID NO: 79789 - DNA, 25 bp, Mus musculus
caaaattgatgcagcttgtggacca

SEQ ID NO: 79790 - DNA, 25 bp, Mus musculus
caaaattggttggactacatcccgc

SEQ ID NO: 79791 - DNA, 25 bp, Mus musculus
caaaatttctggtgactcaaggagc

SEQ ID NO: 79792 - DNA, 25 bp, Mus musculus
caaaatttggcacaatacctgggta

SEQ ID NO: 79793 - DNA, 25 bp, Mus musculus
caaacaaaagacagggattggcaag

SEQ ID NO: 79794 - DNA, 25 bp, Mus musculus
caaacaaaggcggagttgcaaccac

SEQ ID NO: 79795 - DNA, 25 bp, Mus musculus
caaacaaatcctagacggtgtccac

SEQ ID NO: 79796 - DNA, 25 bp, Mus musculus
caaacaacgatgaggctggttcccc

SEQ ID NO: 79797 - DNA, 25 bp, Mus musculus
caaacaacgctggtctgaaacggga

SEQ ID NO: 79798 - DNA, 25 bp, Mus musculus
caaacaactatgtatagactgctgt

SEQ ID NO: 79799 - DNA, 25 bp, Mus musculus
caaacaactcgatgaggcttccggg

SEQ ID NO: 79800 - DNA, 25 bp, Mus musculus
caaacaactggtgaagtcaggagcc

SEQ ID NO: 79801 - DNA, 25 bp, Mus musculus
caaacaagccctgtgagtgcaatgc

SEQ ID NO: 79802 - DNA, 25 bp, Mus musculus
caaacaagcggagtttggacgcaga

SEQ ID NO: 79803 - DNA, 25 bp, Mus musculus
caaacaaggagtcaggagagagcct

SEQ ID NO: 79804 - DNA, 25 bp, Mus musculus
caaacaaggttctgctggacatggc

SEQ ID NO: 79805 - DNA, 25 bp, Mus musculus
caaacaagtgacaaatctgcgggac

SEQ ID NO: 79806 - DNA, 25 bp, Mus musculus
caaacaagtgtgttcagcagcccct

SEQ ID NO: 79807 - DNA, 25 bp, Mus musculus
caaacaatggctgcttgggacacac

SEQ ID NO: 79808 - DNA, 25 bp, Mus musculus
caaacacagtcttagcggagatcca

SEQ ID NO: 79809 - DNA, 25 bp, Mus musculus
caaacaccaagagcccaggtatggc

SEQ ID NO: 79810 - DNA, 25 bp, Mus musculus
caaacaccatgagaaggacctcgga

SEQ ID NO: 79811 - DNA, 25 bp, Mus musculus
caaacaccgttgcatcaggagacct

SEQ ID NO: 79812 - DNA, 25 bp, Mus musculus
caaacacctgcggatcttagccaag

SEQ ID NO: 79813 - DNA, 25 bp, Mus musculus
caaacacgaccgtaaagagctggct

SEQ ID NO: 79814 - DNA, 25 bp, Mus musculus
caaacacgagttctgctgctgggtc

SEQ ID NO: 79815 - DNA, 25 bp, Mus musculus
caaacacggcagttagcatagctca

SEQ ID NO: 79816 - DNA, 25 bp, Mus musculus
caaacactactctggcctctatggg

SEQ ID NO: 79817 - DNA, 25 bp, Mus musculus
caaacactattggacggagctgaga

SEQ ID NO: 79818 - DNA, 25 bp, Mus musculus
caaacactgagggacatctgtagcc

SEQ ID NO: 79819 - DNA, 25 bp, Mus musculus
caaacactgtgttcgttgacagagc

SEQ ID NO: 79820 - DNA, 25 bp, Mus musculus
caaacacttgaggaactgataccac

SEQ ID NO: 79821 - DNA, 25 bp, Mus musculus
caaacagagtgccaagaatccggaa

SEQ ID NO: 79822 - DNA, 25 bp, Mus musculus
caaacagatgactacccagggagag

SEQ ID NO: 79823 - DNA, 25 bp, Mus musculus
caaacagatgctctacaccaaccag

SEQ ID NO: 79824 - DNA, 25 bp, Mus musculus
caaacagcagaaacttagccagccc

SEQ ID NO: 79825 - DNA, 25 bp, Mus musculus
caaacagcagaaggttaggatggcc

SEQ ID NO: 79826 - DNA, 25 bp, Mus musculus
caaacagcatgcaggttgggagcca

SEQ ID NO: 79827 - DNA, 25 bp, Mus musculus
caaacagcggatccggatggctaac

SEQ ID NO: 79828 - DNA, 25 bp, Mus musculus
caaacagcggtgcagatgttacatc

SEQ ID NO: 79829 - DNA, 25 bp, Mus musculus
caaacagctcaacagcagcttcaga

SEQ ID NO: 79830 - DNA, 25 bp, Mus musculus
caaacagctgcaaggccacatgtgg

SEQ ID NO: 79831 - DNA, 25 bp, Mus musculus
caaacagctgtccagacaaacacta

SEQ ID NO: 79832 - DNA, 25 bp, Mus musculus
caaacaggaggttttgcagttgggc

SEQ ID NO: 79833 - DNA, 25 bp, Mus musculus
caaacaggagtcagaatcctcatgg

SEQ ID NO: 79834 - DNA, 25 bp, Mus musculus
caaacaggagtccatagccgtcagg

SEQ ID NO: 79835 - DNA, 25 bp, Mus musculus
caaacaggtcttgaatcagatcgac

SEQ ID NO: 79836 - DNA, 25 bp, Mus musculus
caaacagtctatgcgtagtgaggag

SEQ ID NO: 79837 - DNA, 25 bp, Mus musculus
caaacagttgtacccctcaggacag

SEQ ID NO: 79838 - DNA, 25 bp, Mus musculus
caaacataaaaatgagctgtggcta

SEQ ID NO: 79839 - DNA, 25 bp, Mus musculus
caaacatagaggtagacgggacggt

SEQ ID NO: 79840 - DNA, 25 bp, Mus musculus
caaacatcagccaccattcctccag

SEQ ID NO: 79841 - DNA, 25 bp, Mus musculus
caaacatcgtggtgtcaggctgtga

SEQ ID NO: 79842 - DNA, 25 bp, Mus musculus
caaacatcttggaccccgggagaat

SEQ ID NO: 79843 - DNA, 25 bp, Mus musculus
caaacatgaatgttggagttgccca

SEQ ID NO: 79844 - DNA, 25 bp, Mus musculus
caaacatgatgttgctgcttgtcaa

SEQ ID NO: 79845 - DNA, 25 bp, Mus musculus
caaacatgctctgcaagttaggctg

SEQ ID NO: 79846 - DNA, 25 bp, Mus musculus
caaacatgctgtgtgcctcatatgg

SEQ ID NO: 79847 - DNA, 25 bp, Mus musculus
caaacattgcctggtgtcggaagcg

SEQ ID NO: 79848 - DNA, 25 bp, Mus musculus
caaacattgtgggacaggcagggtc

SEQ ID NO: 79849 - DNA, 25 bp, Mus musculus
caaaccaaaaactggagagggcagg

SEQ ID NO: 79850 - DNA, 25 bp, Mus musculus
caaaccaacttttggaggctggact

SEQ ID NO: 79851 - DNA, 25 bp, Mus musculus
caaaccacatggtgtgccagccagg

SEQ ID NO: 79852 - DNA, 25 bp, Mus musculus
caaaccactgctagctgcttaaggc

SEQ ID NO: 79853 - DNA, 25 bp, Mus musculus
caaaccactggatgacaaagtgaag

SEQ ID NO: 79854 - DNA, 25 bp, Mus musculus
caaaccagaagtgggtcttggcacc

SEQ ID NO: 79855 - DNA, 25 bp, Mus musculus
caaaccagagctgtaccagggcact

SEQ ID NO: 79856 - DNA, 25 bp, Mus musculus
caaaccagctgaaaccaccttggtc

SEQ ID NO: 79857 - DNA, 25 bp, Mus musculus
caaaccaggctggtagtgagggcca

SEQ ID NO: 79858 - DNA, 25 bp, Mus musculus
caaaccagggtgtcaaggaggtcac

SEQ ID NO: 79859 - DNA, 25 bp, Mus musculus
caaaccatgattgttccgtggccat

SEQ ID NO: 79860 - DNA, 25 bp, Mus musculus
caaaccatgtaatagtaacttggac

SEQ ID NO: 79861 - DNA, 25 bp, Mus musculus
caaaccatttgacctttcggagcag

SEQ ID NO: 79862 - DNA, 25 bp, Mus musculus
caaaccattttgtgtgggcggtgcc

SEQ ID NO: 79863 - DNA, 25 bp, Mus musculus
caaacccacgtggacctagaatcgt

SEQ ID NO: 79864 - DNA, 25 bp, Mus musculus
caaacccatttgtggaggacgacat

SEQ ID NO: 79865 - DNA, 25 bp, Mus musculus
caaacccgccctttgatgtaggaag

SEQ ID NO: 79866 - DNA, 25 bp, Mus musculus
caaacccgggctttaggcagcagct

SEQ ID NO: 79867 - DNA, 25 bp, Mus musculus
caaacccgtgccgaagatcatgggc

SEQ ID NO: 79868 - DNA, 25 bp, Mus musculus
caaacccttgaggacgatgtgttcc

SEQ ID NO: 79869 - DNA, 25 bp, Mus musculus
caaaccgaaatgacaaggcacagga

SEQ ID NO: 79870 - DNA, 25 bp, Mus musculus
caaaccgaacagtctcatgctgaag

SEQ ID NO: 79871 - DNA, 25 bp, Mus musculus
caaaccgaggagctgagatcaaaca

SEQ ID NO: 79872 - DNA, 25 bp, Mus musculus
caaaccgcaggtggttagaccttca

SEQ ID NO: 79873 - DNA, 25 bp, Mus musculus
caaaccggcttatgggaccacagga

SEQ ID NO: 79874 - DNA, 25 bp, Mus musculus
caaaccgggatgtggagctagaaca

SEQ ID NO: 79875 - DNA, 25 bp, Mus musculus
caaaccggttactgactggcctgaa

SEQ ID NO: 79876 - DNA, 25 bp, Mus musculus
caaacctacaggaattggtctccaa

SEQ ID NO: 79877 - DNA, 25 bp, Mus musculus
caaacctaggcgtgtctccaacagg

SEQ ID NO: 79878 - DNA, 25 bp, Mus musculus
caaacctcaagggatagcacatgct

SEQ ID NO: 79879 - DNA, 25 bp, Mus musculus
caaacctcaaggtggtcatggtagt

SEQ ID NO: 79880 - DNA, 25 bp, Mus musculus
caaacctcttcagagcctggcagaa

SEQ ID NO: 79881 - DNA, 25 bp, Mus musculus
caaacctgaaggctttcatgtgccg

SEQ ID NO: 79882 - DNA, 25 bp, Mus musculus
caaacctgagatggaatttaggcca

SEQ ID NO: 79883 - DNA, 25 bp, Mus musculus
caaacctgatcttgtggcgcaccta

SEQ ID NO: 79884 - DNA, 25 bp, Mus musculus
caaacctgattgagaacaagcggca

SEQ ID NO: 79885 - DNA, 25 bp, Mus musculus
caaacctgtaaggaagagacgccag

SEQ ID NO: 79886 - DNA, 25 bp, Mus musculus
caaacctgtacctgggactgctggt

SEQ ID NO: 79887 - DNA, 25 bp, Mus musculus
caaacctgtagtgtatcatggagta

SEQ ID NO: 79888 - DNA, 25 bp, Mus musculus
caaacgaggctcatggaggactgac

SEQ ID NO: 79889 - DNA, 25 bp, Mus musculus
caaacgagtcggagctccatcagct

SEQ ID NO: 79890 - DNA, 25 bp, Mus musculus
caaacgatgagtcctgaaccattac

SEQ ID NO: 79891 - DNA, 25 bp, Mus musculus
caaacgatgcgctcctgcggatggt

SEQ ID NO: 79892 - DNA, 25 bp, Mus musculus
caaacgatgtgaccctggctaacca

SEQ ID NO: 79893 - DNA, 25 bp, Mus musculus
caaacgcactccttggcgaggcata

SEQ ID NO: 79894 - DNA, 25 bp, Mus musculus
caaacgccagtgcttagagaactac

SEQ ID NO: 79895 - DNA, 25 bp, Mus musculus
caaacgccggatcctgattgtggtc

SEQ ID NO: 79896 - DNA, 25 bp, Mus musculus
caaacgcttcaggaagtgacgccca

SEQ ID NO: 79897 - DNA, 25 bp, Mus musculus
caaacggaaacaatgcaatggcagc

SEQ ID NO: 79898 - DNA, 25 bp, Mus musculus
caaacggaccgctgaagttctcgga

SEQ ID NO: 79899 - DNA, 25 bp, Mus musculus
caaacggacggaccatagcagtgct

SEQ ID NO: 79900 - DNA, 25 bp, Mus musculus
caaacggagaatagccaagtgcatg

SEQ ID NO: 79901 - DNA, 25 bp, Mus musculus
caaacggaggaagactgtgaggacc

SEQ ID NO: 79902 - DNA, 25 bp, Mus musculus
caaacggaggcagtatcccagaagg

SEQ ID NO: 79903 - DNA, 25 bp, Mus musculus
caaacggcctgtgcttgggtatcga

SEQ ID NO: 79904 - DNA, 25 bp, Mus musculus
caaacggctctgtgcaatctgcggg

SEQ ID NO: 79905 - DNA, 25 bp, Mus musculus
caaacggctcttctgggttcaggac

SEQ ID NO: 79906 - DNA, 25 bp, Mus musculus
caaacgggaagatattcgagagctc

SEQ ID NO: 79907 - DNA, 25 bp, Mus musculus
caaacgggtccttcctaactgatag

SEQ ID NO: 79908 - DNA, 25 bp, Mus musculus
caaacgggtgatagatgagacctcc

SEQ ID NO: 79909 - DNA, 25 bp, Mus musculus
caaacgtaccatctacacagctggg

SEQ ID NO: 79910 - DNA, 25 bp, Mus musculus
caaacgtagccgcaagaagatggca

SEQ ID NO: 79911 - DNA, 25 bp, Mus musculus
caaacgtgaacctgactgataagga

SEQ ID NO: 79912 - DNA, 25 bp, Mus musculus
caaacgtgacaacagcagtggacat

SEQ ID NO: 79913 - DNA, 25 bp, Mus musculus
caaacgtggaagaggtgacactccc

SEQ ID NO: 79914 - DNA, 25 bp, Mus musculus
caaacgtgtggaaatccttgcccgg

SEQ ID NO: 79915 - DNA, 25 bp, Mus musculus
caaacgttagcgaggtggtgacaga

SEQ ID NO: 79916 - DNA, 25 bp, Mus musculus
caaacgttccaagagtgaggttgac

SEQ ID NO: 79917 - DNA, 25 bp, Mus musculus
caaacgttcgatcagtcgtcggaga

SEQ ID NO: 79918 - DNA, 25 bp, Mus musculus
caaacgttctcagggagacatggct

SEQ ID NO: 79919 - DNA, 25 bp, Mus musculus
caaactaaagaagcggaagcctcga

SEQ ID NO: 79920 - DNA, 25 bp, Mus musculus
caaactaagacatgaagccgtggta

SEQ ID NO: 79921 - DNA, 25 bp, Mus musculus
caaactacggcaaagcttcaggaga

SEQ ID NO: 79922 - DNA, 25 bp, Mus musculus
caaactactctcaagggaaggctac

SEQ ID NO: 79923 - DNA, 25 bp, Mus musculus
caaactaggcacgtgctccagggat

SEQ ID NO: 79924 - DNA, 25 bp, Mus musculus
caaactagtgatgctgggtgccggt

SEQ ID NO: 79925 - DNA, 25 bp, Mus musculus
caaactatctggaagtggaacgcac

SEQ ID NO: 79926 - DNA, 25 bp, Mus musculus
caaactatgtcaagtcagaaggcca

SEQ ID NO: 79927 - DNA, 25 bp, Mus musculus
caaactattaactacggccgagacg

SEQ ID NO: 79928 - DNA, 25 bp, Mus musculus
caaactcactgtgggcaacctggga

SEQ ID NO: 79929 - DNA, 25 bp, Mus musculus
caaactcagcctacagtgcaggtgt

SEQ ID NO: 79930 - DNA, 25 bp, Mus musculus
caaactcatggctttgtgcatcgga

SEQ ID NO: 79931 - DNA, 25 bp, Mus musculus
caaactctggactgagcagaaagcc

SEQ ID NO: 79932 - DNA, 25 bp, Mus musculus
caaactctggcgcaagaggaaacct

SEQ ID NO: 79933 - DNA, 25 bp, Mus musculus
caaactctgtatttgctatgcaggg

SEQ ID NO: 79934 - DNA, 25 bp, Mus musculus
caaactgagacacatgggacaggcc

SEQ ID NO: 79935 - DNA, 25 bp, Mus musculus
caaactgagcgtgctgatccgggag

SEQ ID NO: 79936 - DNA, 25 bp, Mus musculus
caaactgaggtggaagagctgtacg

SEQ ID NO: 79937 - DNA, 25 bp, Mus musculus
caaactgagtatccatgaccgggct

SEQ ID NO: 79938 - DNA, 25 bp, Mus musculus
caaactgatgaagtgaagaacgtac

SEQ ID NO: 79939 - DNA, 25 bp, Mus musculus
caaactgcactctctccgaagggat

SEQ ID NO: 79940 - DNA, 25 bp, Mus musculus
caaactgcagaacaaggtgttccag

SEQ ID NO: 79941 - DNA, 25 bp, Mus musculus
caaactgcgcttccgattgggctac

SEQ ID NO: 79942 - DNA, 25 bp, Mus musculus
caaactgcggcagagcaatcctgaa

SEQ ID NO: 79943 - DNA, 25 bp, Mus musculus
caaactgctctggaggaaataccca

SEQ ID NO: 79944 - DNA, 25 bp, Mus musculus
caaactgctcttgatcgggaacagc

SEQ ID NO: 79945 - DNA, 25 bp, Mus musculus
caaactgctggaactcttaccagga

SEQ ID NO: 79946 - DNA, 25 bp, Mus musculus
caaactgcttattctgccaatcccg

SEQ ID NO: 79947 - DNA, 25 bp, Mus musculus
caaactggaaactgaccctgcagag

SEQ ID NO: 79948 - DNA, 25 bp, Mus musculus
caaactggaaagaaagcggcaacag

SEQ ID NO: 79949 - DNA, 25 bp, Mus musculus
caaactggatcgacacggaaatgac

SEQ ID NO: 79950 - DNA, 25 bp, Mus musculus
caaactgggtgtaccagagctccga

SEQ ID NO: 79951 - DNA, 25 bp, Mus musculus
caaactgggttcgaacttctgctac

SEQ ID NO: 79952 - DNA, 25 bp, Mus musculus
caaactggtgcctgagaagaggacc

SEQ ID NO: 79953 - DNA, 25 bp, Mus musculus
caaactgtaccctaatgcgcggaga

SEQ ID NO: 79954 - DNA, 25 bp, Mus musculus
caaactgtcaggacggtaccggcgg

SEQ ID NO: 79955 - DNA, 25 bp, Mus musculus
caaactgttccgatggtgcaaccaa

SEQ ID NO: 79956 - DNA, 25 bp, Mus musculus
caaactgttctcgaggctggtgaac

SEQ ID NO: 79957 - DNA, 25 bp, Mus musculus
caaacttaatgaggtaagaatcgta

SEQ ID NO: 79958 - DNA, 25 bp, Mus musculus
caaacttcatgacagcgtgggtccc

SEQ ID NO: 79959 - DNA, 25 bp, Mus musculus
caaacttcctcatcctttgctgcag

SEQ ID NO: 79960 - DNA, 25 bp, Mus musculus
caaacttcttcgagatggacatccg

SEQ ID NO: 79961 - DNA, 25 bp, Mus musculus
caaacttgagacgagggattgttcc

SEQ ID NO: 79962 - DNA, 25 bp, Mus musculus
caaacttgggctgtcagtgttcacg

SEQ ID NO: 79963 - DNA, 25 bp, Mus musculus
caaacttgtgtgctgaggagactcg

SEQ ID NO: 79964 - DNA, 25 bp, Mus musculus
caaactttctctaactgggcatgga

SEQ ID NO: 79965 - DNA, 25 bp, Mus musculus
caaactttggactgagctatgccag

SEQ ID NO: 79966 - DNA, 25 bp, Mus musculus
caaactttggccgacttcactgtac

SEQ ID NO: 79967 - DNA, 25 bp, Mus musculus
caaacttttcaacagcaagggaggc

SEQ ID NO: 79968 - DNA, 25 bp, Mus musculus
caaagaaaacacagccgttgcaccg

SEQ ID NO: 79969 - DNA, 25 bp, Mus musculus
caaagaaaactgataagcccaggct

SEQ ID NO: 79970 - DNA, 25 bp, Mus musculus
caaagaaacccaaagagcagccggg

SEQ ID NO: 79971 - DNA, 25 bp, Mus musculus
caaagaaactgatccccttgggaag

SEQ ID NO: 79972 - DNA, 25 bp, Mus musculus
caaagaaagacgtgaagaagcccgc

SEQ ID NO: 79973 - DNA, 25 bp, Mus musculus
caaagaaagcagtgcatattaccac

SEQ ID NO: 79974 - DNA, 25 bp, Mus musculus
caaagaaagttgatcctccagggac

SEQ ID NO: 79975 - DNA, 25 bp, Mus musculus
caaagaacccttgtgatgagccaag

SEQ ID NO: 79976 - DNA, 25 bp, Mus musculus
caaagaacctcggacttctgcagag

SEQ ID NO: 79977 - DNA, 25 bp, Mus musculus
caaagaacttggatctccctgagat

SEQ ID NO: 79978 - DNA, 25 bp, Mus musculus
caaagaagaagcgagtggagcctgc

SEQ ID NO: 79979 - DNA, 25 bp, Mus musculus
caaagaagagtgtttccgctcaggg

SEQ ID NO: 79980 - DNA, 25 bp, Mus musculus
caaagaagcgaaaggctcggaagac

SEQ ID NO: 79981 - DNA, 25 bp, Mus musculus
caaagaagctacgagaagaacgcct

SEQ ID NO: 79982 - DNA, 25 bp, Mus musculus
caaagaaggcctacgaactgcagag

SEQ ID NO: 79983 - DNA, 25 bp, Mus musculus
caaagaaggccttcggcagagggac

SEQ ID NO: 79984 - DNA, 25 bp, Mus musculus
caaagaaggctgttgactggcgact

SEQ ID NO: 79985 - DNA, 25 bp, Mus musculus
caaagaaggtaatcagtagccccgc

SEQ ID NO: 79986 - DNA, 25 bp, Mus musculus
caaagaagtagctctcgccagcaag

SEQ ID NO: 79987 - DNA, 25 bp, Mus musculus
caaagaagtgctgcctgccttggag

SEQ ID NO: 79988 - DNA, 25 bp, Mus musculus
caaagaagtttcacctgaggcctga

SEQ ID NO: 79989 - DNA, 25 bp, Mus musculus
caaagaataactggcaaggcgccca

SEQ ID NO: 79990 - DNA, 25 bp, Mus musculus
caaagaataaggctagggcacaggc

SEQ ID NO: 79991 - DNA, 25 bp, Mus musculus
caaagaatcatcttctgtactgagc

SEQ ID NO: 79992 - DNA, 25 bp, Mus musculus
caaagaatttgatccgcttggtccg

SEQ ID NO: 79993 - DNA, 25 bp, Mus musculus
caaagacaagaagctgtccgggaca

SEQ ID NO: 79994 - DNA, 25 bp, Mus musculus
caaagacaaggcagactttgctgtg

SEQ ID NO: 79995 - DNA, 25 bp, Mus musculus
caaagacaccgatgaagaacgagcc

SEQ ID NO: 79996 - DNA, 25 bp, Mus musculus
caaagacagaatccgggagaaggcc

SEQ ID NO: 79997 - DNA, 25 bp, Mus musculus
caaagacagatcagcaaagccgggt

SEQ ID NO: 79998 - DNA, 25 bp, Mus musculus
caaagacagtaacgaagcagcgggt

SEQ ID NO: 79999 - DNA, 25 bp, Mus musculus
caaagacataggtgcagtccccatg

SEQ ID NO: 80000 - DNA, 25 bp, Mus musculus
caaagacatgaatggattcccggtc

SEQ ID NO: 80001 - DNA, 25 bp, Mus musculus
caaagacatgtctcgcaatgggagc

SEQ ID NO: 80002 - DNA, 25 bp, Mus musculus
caaagacattcagttgaccaggaga

SEQ ID NO: 80003 - DNA, 25 bp, Mus musculus
caaagacattgaccagagtccggga

SEQ ID NO: 80004 - DNA, 25 bp, Mus musculus
caaagaccaagtagagggcgtgctc

SEQ ID NO: 80005 - DNA, 25 bp, Mus musculus
caaagaccaagttcttgaccctggg

SEQ ID NO: 80006 - DNA, 25 bp, Mus musculus
caaagaccactctcatgtgtagggt

SEQ ID NO: 80007 - DNA, 25 bp, Mus musculus
caaagacccagaccatgcgagtgaa

SEQ ID NO: 80008 - DNA, 25 bp, Mus musculus
caaagaccccatgaagctggagcca

SEQ ID NO: 80009 - DNA, 25 bp, Mus musculus
caaagaccgattggtgactctggag

SEQ ID NO: 80010 - DNA, 25 bp, Mus musculus
caaagaccggattggaggccgagta

SEQ ID NO: 80011 - DNA, 25 bp, Mus musculus
caaagacctctctctggcgaaagaa

SEQ ID NO: 80012 - DNA, 25 bp, Mus musculus
caaagacctgtgtggcgagcgagtc

SEQ ID NO: 80013 - DNA, 25 bp, Mus musculus
caaagacggagagctgtgcaagaca

SEQ ID NO: 80014 - DNA, 25 bp, Mus musculus
caaagacgtgaagtcggaagtcgcc

SEQ ID NO: 80015 - DNA, 25 bp, Mus musculus
caaagacgtgtgttgccgatgagtc

SEQ ID NO: 80016 - DNA, 25 bp, Mus musculus
caaagacgtttctgatggcccagga

SEQ ID NO: 80017 - DNA, 25 bp, Mus musculus
caaagactatcctgaccgtggcaga

SEQ ID NO: 80018 - DNA, 25 bp, Mus musculus
caaagactatgaggaaactgagctg

SEQ ID NO: 80019 - DNA, 25 bp, Mus musculus
caaagactgcgggatctggtaccgt

SEQ ID NO: 80020 - DNA, 25 bp, Mus musculus
caaagactgttgactcggactcgac

SEQ ID NO: 80021 - DNA, 25 bp, Mus musculus
caaagacttaactggagctggagag

SEQ ID NO: 80022 - DNA, 25 bp, Mus musculus
caaagacttggaggctctggaggaa

SEQ ID NO: 80023 - DNA, 25 bp, Mus musculus
caaagacttggttccaggctctcca

SEQ ID NO: 80024 - DNA, 25 bp, Mus musculus
caaagagaagaacaggaactcgtct

SEQ ID NO: 80025 - DNA, 25 bp, Mus musculus
caaagagaagacctacggcaagcag

SEQ ID NO: 80026 - DNA, 25 bp, Mus musculus
caaagagaatggatcagaccgggac

SEQ ID NO: 80027 - DNA, 25 bp, Mus musculus
caaagagaccgagaagtactgcggc

SEQ ID NO: 80028 - DNA, 25 bp, Mus musculus
caaagagagcagcacagtatcggcc

SEQ ID NO: 80029 - DNA, 25 bp, Mus musculus
caaagagagctaccccagtgacctt

SEQ ID NO: 80030 - DNA, 25 bp, Mus musculus
caaagagagctcttaccttgaagga

SEQ ID NO: 80031 - DNA, 25 bp, Mus musculus
caaagagaggtctcgatgtgtcttc

SEQ ID NO: 80032 - DNA, 25 bp, Mus musculus
caaagagatgtctgaagacttgcca

SEQ ID NO: 80033 - DNA, 25 bp, Mus musculus
caaagagccaacagagacgatggga

SEQ ID NO: 80034 - DNA, 25 bp, Mus musculus
caaagagcctcccatgaaatcagaa

SEQ ID NO: 80035 - DNA, 25 bp, Mus musculus
caaagagcgagttctccgtaggccc

SEQ ID NO: 80036 - DNA, 25 bp, Mus musculus
caaagagcggatccttgatgttccc

SEQ ID NO: 80037 - DNA, 25 bp, Mus musculus
caaagagcggctcaatgcgtacaca

SEQ ID NO: 80038 - DNA, 25 bp, Mus musculus
caaagagctatatgccctgggagtc

SEQ ID NO: 80039 - DNA, 25 bp, Mus musculus
caaagagctattatcccttgtatta

SEQ ID NO: 80040 - DNA, 25 bp, Mus musculus
caaagagctctgaccaggcctgaag

SEQ ID NO: 80041 - DNA, 25 bp, Mus musculus
caaagaggaggtcattcacttgaac

SEQ ID NO: 80042 - DNA, 25 bp, Mus musculus
caaagaggatcacagacattcagca

SEQ ID NO: 80043 - DNA, 25 bp, Mus musculus
caaagaggatttagagatggaggct

SEQ ID NO: 80044 - DNA, 25 bp, Mus musculus
caaagaggcccatagaagtgtccaa

SEQ ID NO: 80045 - DNA, 25 bp, Mus musculus
caaagaggcgtctgcagcagggctt

SEQ ID NO: 80046 - DNA, 25 bp, Mus musculus
caaagaggctgttccgcagtgatgg

SEQ ID NO: 80047 - DNA, 25 bp, Mus musculus
caaagagggcaagcctggtgttact

SEQ ID NO: 80048 - DNA, 25 bp, Mus musculus
caaagagggcccactggtgcatgtg

SEQ ID NO: 80049 - DNA, 25 bp, Mus musculus
caaagagggtgtcaaagttcagagc

SEQ ID NO: 80050 - DNA, 25 bp, Mus musculus
caaagaggtgtaggaaacgcggaat

SEQ ID NO: 80051 - DNA, 25 bp, Mus musculus
caaagagtactgtggagtccctggt

SEQ ID NO: 80052 - DNA, 25 bp, Mus musculus
caaagagtcgcaggtcatcgccgat

SEQ ID NO: 80053 - DNA, 25 bp, Mus musculus
caaagagtctacatgtctagggtct

SEQ ID NO: 80054 - DNA, 25 bp, Mus musculus
caaagagtctggcactacaagcgga

SEQ ID NO: 80055 - DNA, 25 bp, Mus musculus
caaagagtggtattgaattcccgac

SEQ ID NO: 80056 - DNA, 25 bp, Mus musculus
caaagagtggtgttgcctgtcaaaa

SEQ ID NO: 80057 - DNA, 25 bp, Mus musculus
caaagagtgtagctgtgtcccaata

SEQ ID NO: 80058 - DNA, 25 bp, Mus musculus
caaagagttcactgacctgctggct

SEQ ID NO: 80059 - DNA, 25 bp, Mus musculus
caaagataagaggaaccagtgtcgt

SEQ ID NO: 80060 - DNA, 25 bp, Mus musculus
caaagatagaatacggatcgccagt

SEQ ID NO: 80061 - DNA, 25 bp, Mus musculus
caaagatcctactccagctgggtgg

SEQ ID NO: 80062 - DNA, 25 bp, Mus musculus
caaagatcgggttggaagagggcaa

SEQ ID NO: 80063 - DNA, 25 bp, Mus musculus
caaagatgactgtaaagcgcaccca

SEQ ID NO: 80064 - DNA, 25 bp, Mus musculus
caaagatgatggttttgaccggcgg

SEQ ID NO: 80065 - DNA, 25 bp, Mus musculus
caaagatgctaagggctgtcctgca

SEQ ID NO: 80066 - DNA, 25 bp, Mus musculus
caaagatgctggcttggtgaaatcc

SEQ ID NO: 80067 - DNA, 25 bp, Mus musculus
caaagatggacgtgtctatgccaaa

SEQ ID NO: 80068 - DNA, 25 bp, Mus musculus
caaagatggagaggtcgatcacccc

SEQ ID NO: 80069 - DNA, 25 bp, Mus musculus
caaagatggtttcattcagcgacac

SEQ ID NO: 80070 - DNA, 25 bp, Mus musculus
caaagatgtccgaagagatactggc

SEQ ID NO: 80071 - DNA, 25 bp, Mus musculus
caaagatgtctctcgcatgcgctca

SEQ ID NO: 80072 - DNA, 25 bp, Mus musculus
caaagatgtgctagggctcatgggc

SEQ ID NO: 80073 - DNA, 25 bp, Mus musculus
caaagatgtgggacggaagcctcct

SEQ ID NO: 80074 - DNA, 25 bp, Mus musculus
caaagatgtgttgggctctggcata

SEQ ID NO: 80075 - DNA, 25 bp, Mus musculus
caaagattactatgcactgaaggag

SEQ ID NO: 80076 - DNA, 25 bp, Mus musculus
caaagattccgacttggtggaagcc

SEQ ID NO: 80077 - DNA, 25 bp, Mus musculus
caaagattgcacctgctgggagcat

SEQ ID NO: 80078 - DNA, 25 bp, Mus musculus
caaagattttacagaaggcaccctc

SEQ ID NO: 80079 - DNA, 25 bp, Mus musculus
caaagattttccaggtgtgaattaa

SEQ ID NO: 80080 - DNA, 25 bp, Mus musculus
caaagcaagctttggacaccgaaga

SEQ ID NO: 80081 - DNA, 25 bp, Mus musculus
caaagcaaggactctgtgcggcaga

SEQ ID NO: 80082 - DNA, 25 bp, Mus musculus
caaagcaagggttgaattccacaaa

SEQ ID NO: 80083 - DNA, 25 bp, Mus musculus
caaagcaagtgtctctcgataggat

SEQ ID NO: 80084 - DNA, 25 bp, Mus musculus
caaagcaatgtcaggttacacaaca

SEQ ID NO: 80085 - DNA, 25 bp, Mus musculus
caaagcacgctcaatctctgcacag

SEQ ID NO: 80086 - DNA, 25 bp, Mus musculus
caaagcagaatcagaggcgtctaaa

SEQ ID NO: 80087 - DNA, 25 bp, Mus musculus
caaagcagactattcctacagtggg

SEQ ID NO: 80088 - DNA, 25 bp, Mus musculus
caaagcagagactcagtaaggtggt

SEQ ID NO: 80089 - DNA, 25 bp, Mus musculus
caaagcagcacattttgacgtcgag

SEQ ID NO: 80090 - DNA, 25 bp, Mus musculus
caaagcagcagttggtgccagcatg

SEQ ID NO: 80091 - DNA, 25 bp, Mus musculus
caaagcagctcgaagcactgttagc

SEQ ID NO: 80092 - DNA, 25 bp, Mus musculus
caaagcagtccgtgtgtgctgagca

SEQ ID NO: 80093 - DNA, 25 bp, Mus musculus
caaagcagttcttcagtcatggaca

SEQ ID NO: 80094 - DNA, 25 bp, Mus musculus
caaagccaaggtgaaggatatcgca

SEQ ID NO: 80095 - DNA, 25 bp, Mus musculus
caaagccaagtatcctgactatgag

SEQ ID NO: 80096 - DNA, 25 bp, Mus musculus
caaagccagccctacgcggtgttgc

SEQ ID NO: 80097 - DNA, 25 bp, Mus musculus
caaagccatggcctatctggagagc

SEQ ID NO: 80098 - DNA, 25 bp, Mus musculus
caaagccatggtgactgagaccagc

SEQ ID NO: 80099 - DNA, 25 bp, Mus musculus
caaagcccgggaggtcagaaatttg

SEQ ID NO: 80100 - DNA, 25 bp, Mus musculus
caaagcccgtggagagtcatctaga

SEQ ID NO: 80101 - DNA, 25 bp, Mus musculus
caaagccctcgtgtgcgcgggaccc

SEQ ID NO: 80102 - DNA, 25 bp, Mus musculus
caaagccctgcagaagtacgaaaag

SEQ ID NO: 80103 - DNA, 25 bp, Mus musculus
caaagccgcagagtaaactggccca

SEQ ID NO: 80104 - DNA, 25 bp, Mus musculus
caaagccgcatccatgtgtgctgct

SEQ ID NO: 80105 - DNA, 25 bp, Mus musculus
caaagccgcatcctcctgttgtggg

SEQ ID NO: 80106 - DNA, 25 bp, Mus musculus
caaagccgtatggaatgcccttgag

SEQ ID NO: 80107 - DNA, 25 bp, Mus musculus
caaagccgtgttctgcaggagaaac

SEQ ID NO: 80108 - DNA, 25 bp, Mus musculus
caaagccgtttcactgtccatggga

SEQ ID NO: 80109 - DNA, 25 bp, Mus musculus
caaagcctcactgtttcaactgtgg

SEQ ID NO: 80110 - DNA, 25 bp, Mus musculus
caaagcctgaaggtgcctgggtctc

SEQ ID NO: 80111 - DNA, 25 bp, Mus musculus
caaagcctgaggtctgctgggacaa

SEQ ID NO: 80112 - DNA, 25 bp, Mus musculus
caaagcctgaggttgtggactccac

SEQ ID NO: 80113 - DNA, 25 bp, Mus musculus
caaagcctggtgtatccacggtacc

SEQ ID NO: 80114 - DNA, 25 bp, Mus musculus
caaagcctgtaaatagaacgttcct

SEQ ID NO: 80115 - DNA, 25 bp, Mus musculus
caaagcctgttacttggccaggagc

SEQ ID NO: 80116 - DNA, 25 bp, Mus musculus
caaagccttcagtcccaagtgggtc

SEQ ID NO: 80117 - DNA, 25 bp, Mus musculus
caaagccttcatagcagcgcagtgg

SEQ ID NO: 80118 - DNA, 25 bp, Mus musculus
caaagcctttcgaggtaggagagac

SEQ ID NO: 80119 - DNA, 25 bp, Mus musculus
caaagcgaaattggaggtgtcctcc

SEQ ID NO: 80120 - DNA, 25 bp, Mus musculus
caaagcgagagatgctgtgctgcct

SEQ ID NO: 80121 - DNA, 25 bp, Mus musculus
caaagcgccatctgctggacataaa

SEQ ID NO: 80122 - DNA, 25 bp, Mus musculus
caaagcggggacacagatcgagaac

SEQ ID NO: 80123 - DNA, 25 bp, Mus musculus
caaagcggtaatggtggctctagct

SEQ ID NO: 80124 - DNA, 25 bp, Mus musculus
caaagcggttgcagatctaggatgt

SEQ ID NO: 80125 - DNA, 25 bp, Mus musculus
caaagcgtctgctcttaaggctgaa

SEQ ID NO: 80126 - DNA, 25 bp, Mus musculus
caaagctaacaggactgcacgggac

SEQ ID NO: 80127 - DNA, 25 bp, Mus musculus
caaagctcagtgctctcaagtctcg

SEQ ID NO: 80128 - DNA, 25 bp, Mus musculus
caaagctcatggagaaccggaagcc

SEQ ID NO: 80129 - DNA, 25 bp, Mus musculus
caaagctccaagtgcgcatgtacaa

SEQ ID NO: 80130 - DNA, 25 bp, Mus musculus
caaagctccgagaacctgtggatga

SEQ ID NO: 80131 - DNA, 25 bp, Mus musculus
caaagctctacgatgaaggtgaccc

SEQ ID NO: 80132 - DNA, 25 bp, Mus musculus
caaagctctagggagggcatgtacc

SEQ ID NO: 80133 - DNA, 25 bp, Mus musculus
caaagctgagactgatgatgacgat

SEQ ID NO: 80134 - DNA, 25 bp, Mus musculus
caaagctgagatggaagacctggtc

SEQ ID NO: 80135 - DNA, 25 bp, Mus musculus
caaagctgcaccagggtcttcggga

SEQ ID NO: 80136 - DNA, 25 bp, Mus musculus
caaagctgcagctgtagtcctcaga

SEQ ID NO: 80137 - DNA, 25 bp, Mus musculus
caaagctgccagtgagaagaaatca

SEQ ID NO: 80138 - DNA, 25 bp, Mus musculus
caaagctgcgaagagtgggaaatca

SEQ ID NO: 80139 - DNA, 25 bp, Mus musculus
caaagctgctaaagtgatcctggcc

SEQ ID NO: 80140 - DNA, 25 bp, Mus musculus
caaagctggacgtctcgtatgagcc

SEQ ID NO: 80141 - DNA, 25 bp, Mus musculus
caaagctggtacttctagagcggct

SEQ ID NO: 80142 - DNA, 25 bp, Mus musculus
caaagctggtgtgacccaaatgggc

SEQ ID NO: 80143 - DNA, 25 bp, Mus musculus
caaagctgtccactatgaaattcgg

SEQ ID NO: 80144 - DNA, 25 bp, Mus musculus
caaagctgttgctgagctggatgcc

SEQ ID NO: 80145 - DNA, 25 bp, Mus musculus
caaagcttagtcctcagtatggatg

SEQ ID NO: 80146 - DNA, 25 bp, Mus musculus
caaagcttcccttaaaacaaatctg

SEQ ID NO: 80147 - DNA, 25 bp, Mus musculus
caaagcttgaccttgagggacatgg

SEQ ID NO: 80148 - DNA, 25 bp, Mus musculus
caaagcttgctgaactggatctcaa

SEQ ID NO: 80149 - DNA, 25 bp, Mus musculus
caaagcttggtagcaaaacggccct

SEQ ID NO: 80150 - DNA, 25 bp, Mus musculus
caaagctttgatcgagtctggactc

SEQ ID NO: 80151 - DNA, 25 bp, Mus musculus
caaaggaaacaaacacctgcagtta

SEQ ID NO: 80152 - DNA, 25 bp, Mus musculus
caaaggaaagctaggcagactgctc

SEQ ID NO: 80153 - DNA, 25 bp, Mus musculus
caaaggaaatggacattgtattcca

SEQ ID NO: 80154 - DNA, 25 bp, Mus musculus
caaaggaaatgtcaatgaaaactga

SEQ ID NO: 80155 - DNA, 25 bp, Mus musculus
caaaggaacaatgtggtccgcagca

SEQ ID NO: 80156 - DNA, 25 bp, Mus musculus
caaaggaagccgctggagatgcctc

SEQ ID NO: 80157 - DNA, 25 bp, Mus musculus
caaaggaagcctaccagttagcgca

SEQ ID NO: 80158 - DNA, 25 bp, Mus musculus
caaaggaaggtatctgaggtccggc

SEQ ID NO: 80159 - DNA, 25 bp, Mus musculus
caaaggaatctcagcggagtgggaa

SEQ ID NO: 80160 - DNA, 25 bp, Mus musculus
caaaggaatcttagcccctggcatg

SEQ ID NO: 80161 - DNA, 25 bp, Mus musculus
caaaggacatcgtcaacgggctgag

SEQ ID NO: 80162 - DNA, 25 bp, Mus musculus
caaaggacattcgtggcttggcctc

SEQ ID NO: 80163 - DNA, 25 bp, Mus musculus
caaaggaccccgtacagtgatggag

SEQ ID NO: 80164 - DNA, 25 bp, Mus musculus
caaaggacctcatggctaatgccac

SEQ ID NO: 80165 - DNA, 25 bp, Mus musculus
caaaggacgatgtatctctgcggct

SEQ ID NO: 80166 - DNA, 25 bp, Mus musculus
caaaggacggatgctgctggacaac

SEQ ID NO: 80167 - DNA, 25 bp, Mus musculus
caaaggacttatgggcccttgctca

SEQ ID NO: 80168 - DNA, 25 bp, Mus musculus
caaaggagacaacactgaatgcaga

SEQ ID NO: 80169 - DNA, 25 bp, Mus musculus
caaaggagcagggagcagtcgcagc

SEQ ID NO: 80170 - DNA, 25 bp, Mus musculus
caaaggaggctacgttgccctggat

SEQ ID NO: 80171 - DNA, 25 bp, Mus musculus
caaaggaggctgtgatggaaaactg

SEQ ID NO: 80172 - DNA, 25 bp, Mus musculus
caaaggagtcaaaagctcgcggcaa

SEQ ID NO: 80173 - DNA, 25 bp, Mus musculus
caaaggagtcaagctgtcacacagg

SEQ ID NO: 80174 - DNA, 25 bp, Mus musculus
caaaggagtcattcacttaaccaag

SEQ ID NO: 80175 - DNA, 25 bp, Mus musculus
caaaggagtctctatcgggatgtgg

SEQ ID NO: 80176 - DNA, 25 bp, Mus musculus
caaaggatgtttgaggcagccgctg

SEQ ID NO: 80177 - DNA, 25 bp, Mus musculus
caaaggcaacgaggtgaacatgggc

SEQ ID NO: 80178 - DNA, 25 bp, Mus musculus
caaaggcagcgaaaagtcagatgac

SEQ ID NO: 80179 - DNA, 25 bp, Mus musculus
caaaggcagtggatacaagaccgca

SEQ ID NO: 80180 - DNA, 25 bp, Mus musculus
caaaggcagttattcccagtggagc

SEQ ID NO: 80181 - DNA, 25 bp, Mus musculus
caaaggcatatatcgccagtgcagg

SEQ ID NO: 80182 - DNA, 25 bp, Mus musculus
caaaggcatcggtcatgtcacggat

SEQ ID NO: 80183 - DNA, 25 bp, Mus musculus
caaaggcatcttgcactgggccgag

SEQ ID NO: 80184 - DNA, 25 bp, Mus musculus
caaaggcattgtagagatgactcct

SEQ ID NO: 80185 - DNA, 25 bp, Mus musculus
caaaggccccatgagtgctgtttac

SEQ ID NO: 80186 - DNA, 25 bp, Mus musculus
caaaggcccgtggaaaggcactggt

SEQ ID NO: 80187 - DNA, 25 bp, Mus musculus
caaaggccgcctgatccagatgaga

SEQ ID NO: 80188 - DNA, 25 bp, Mus musculus
caaaggcctgcctgctgacaaaaga

SEQ ID NO: 80189 - DNA, 25 bp, Mus musculus
caaaggcgattttggataaggccac

SEQ ID NO: 80190 - DNA, 25 bp, Mus musculus
caaaggcgctttgagcatggctctc

SEQ ID NO: 80191 - DNA, 25 bp, Mus musculus
caaaggcggccggttttacatcact

SEQ ID NO: 80192 - DNA, 25 bp, Mus musculus
caaaggcgttcagatggcagaaaac

SEQ ID NO: 80193 - DNA, 25 bp, Mus musculus
caaaggctacctaagccgagaggac

SEQ ID NO: 80194 - DNA, 25 bp, Mus musculus
caaaggctatcgagactgtccacaa

SEQ ID NO: 80195 - DNA, 25 bp, Mus musculus
caaaggctatggtgttggcactccc

SEQ ID NO: 80196 - DNA, 25 bp, Mus musculus
caaaggctcccgtctgttccctttg

SEQ ID NO: 80197 - DNA, 25 bp, Mus musculus
caaaggctccttgagcgcagagcgg

SEQ ID NO: 80198 - DNA, 25 bp, Mus musculus
caaaggctctattcactgctggaca

SEQ ID NO: 80199 - DNA, 25 bp, Mus musculus
caaaggctctcaggtggtggtcatc

SEQ ID NO: 80200 - DNA, 25 bp, Mus musculus
caaaggctgggtactggagtctaga

SEQ ID NO: 80201 - DNA, 25 bp, Mus musculus
caaaggcttcgtgtggttggccatc

SEQ ID NO: 80202 - DNA, 25 bp, Mus musculus
caaaggcttcttcttgctggtggaa

SEQ ID NO: 80203 - DNA, 25 bp, Mus musculus
caaaggcttgggaagaatactacaa

SEQ ID NO: 80204 - DNA, 25 bp, Mus musculus
caaaggctttgtgaagctggccctg

SEQ ID NO: 80205 - DNA, 25 bp, Mus musculus
caaagggaaaagtgaaactggcagc

SEQ ID NO: 80206 - DNA, 25 bp, Mus musculus
caaagggaacctgcaaagggcctgt

SEQ ID NO: 80207 - DNA, 25 bp, Mus musculus
caaagggaaccttttggcacacaga

SEQ ID NO: 80208 - DNA, 25 bp, Mus musculus
caaagggaagaagctaaagaagacg

SEQ ID NO: 80209 - DNA, 25 bp, Mus musculus
caaagggacactgcatcaggaagtg

SEQ ID NO: 80210 - DNA, 25 bp, Mus musculus
caaagggagcttcttcaaacaggcc

SEQ ID NO: 80211 - DNA, 25 bp, Mus musculus
caaagggatatctcccacagtgtgg

SEQ ID NO: 80212 - DNA, 25 bp, Mus musculus
caaagggattgtagaagatgtccac

SEQ ID NO: 80213 - DNA, 25 bp, Mus musculus
caaagggctgtctttcagaacacaa

SEQ ID NO: 80214 - DNA, 25 bp, Mus musculus
caaagggtctcacgtaagcactggc

SEQ ID NO: 80215 - DNA, 25 bp, Mus musculus
caaagggtgctccaaggtcaataaa

SEQ ID NO: 80216 - DNA, 25 bp, Mus musculus
caaagggttactgggcattctggac

SEQ ID NO: 80217 - DNA, 25 bp, Mus musculus
caaagggtttctgcgagctcacaca

SEQ ID NO: 80218 - DNA, 25 bp, Mus musculus
caaaggtctcttcgctcattgagag

SEQ ID NO: 80219 - DNA, 25 bp, Mus musculus
caaaggtctggtaagaaggcaagcc

SEQ ID NO: 80220 - DNA, 25 bp, Mus musculus
caaaggtgacaagacgagcttctct

SEQ ID NO: 80221 - DNA, 25 bp, Mus musculus
caaaggtgatccttctaagaaagaa

SEQ ID NO: 80222 - DNA, 25 bp, Mus musculus
caaaggtggagccagcagtcagttc

SEQ ID NO: 80223 - DNA, 25 bp, Mus musculus
caaaggtggttttgcactggcgata

SEQ ID NO: 80224 - DNA, 25 bp, Mus musculus
caaaggtgtgcccatgaaagccaga

SEQ ID NO: 80225 - DNA, 25 bp, Mus musculus
caaaggtgttggacgtcccactgac

SEQ ID NO: 80226 - DNA, 25 bp, Mus musculus
caaaggttgaaacgagttccatggg

SEQ ID NO: 80227 - DNA, 25 bp, Mus musculus
caaaggttgttcttaggctgggcag

SEQ ID NO: 80228 - DNA, 25 bp, Mus musculus
caaagtaaagtcctgtggatccccg

SEQ ID NO: 80229 - DNA, 25 bp, Mus musculus
caaagtaacatggactgaatctgct

SEQ ID NO: 80230 - DNA, 25 bp, Mus musculus
caaagtacactttctgcgggaatgt

SEQ ID NO: 80231 - DNA, 25 bp, Mus musculus
caaagtacgatctaatacgggaggt

SEQ ID NO: 80232 - DNA, 25 bp, Mus musculus
caaagtactgcgagcttcctgttga

SEQ ID NO: 80233 - DNA, 25 bp, Mus musculus
caaagtacttggctacgtcacgggt

SEQ ID NO: 80234 - DNA, 25 bp, Mus musculus
caaagtaggagcatttggtgacttc

SEQ ID NO: 80235 - DNA, 25 bp, Mus musculus
caaagtagtagaagtcgccgaagag

SEQ ID NO: 80236 - DNA, 25 bp, Mus musculus
caaagtatccatcagcgagcagtgc

SEQ ID NO: 80237 - DNA, 25 bp, Mus musculus
caaagtatctacatccccagaggag

SEQ ID NO: 80238 - DNA, 25 bp, Mus musculus
caaagtatctatgggtctaatgggc

SEQ ID NO: 80239 - DNA, 25 bp, Mus musculus
caaagtatctgagcacgtgggaagc

SEQ ID NO: 80240 - DNA, 25 bp, Mus musculus
caaagtatgatcctcgtgctcaaaa

SEQ ID NO: 80241 - DNA, 25 bp, Mus musculus
caaagtcaaaagcagccccaggttc

SEQ ID NO: 80242 - DNA, 25 bp, Mus musculus
caaagtcaaggaagtgcagtgcatc

SEQ ID NO: 80243 - DNA, 25 bp, Mus musculus
caaagtcactgacttccgggagtgg

SEQ ID NO: 80244 - DNA, 25 bp, Mus musculus
caaagtcagttttgctatagtatgt

SEQ ID NO: 80245 - DNA, 25 bp, Mus musculus
caaagtccacttgccttagctgtgg

SEQ ID NO: 80246 - DNA, 25 bp, Mus musculus
caaagtccccatttctggtggagca

SEQ ID NO: 80247 - DNA, 25 bp, Mus musculus
caaagtcccggaaaacatcacaggc

SEQ ID NO: 80248 - DNA, 25 bp, Mus musculus
caaagtccgaggtcccgtgagtgga

SEQ ID NO: 80249 - DNA, 25 bp, Mus musculus
caaagtccgcagcttttttcggtcg

SEQ ID NO: 80250 - DNA, 25 bp, Mus musculus
caaagtcgagtccaagcctgatgag

SEQ ID NO: 80251 - DNA, 25 bp, Mus musculus
caaagtcgcgaggtttcctgggcca

SEQ ID NO: 80252 - DNA, 25 bp, Mus musculus
caaagtcggtactcggatcttcaac

SEQ ID NO: 80253 - DNA, 25 bp, Mus musculus
caaagtcgtctttggctgtggccga

SEQ ID NO: 80254 - DNA, 25 bp, Mus musculus
caaagtcgtgatcctcagcaaggcg

SEQ ID NO: 80255 - DNA, 25 bp, Mus musculus
caaagtctaaggagaaagtaatgga

SEQ ID NO: 80256 - DNA, 25 bp, Mus musculus
caaagtctctgctgcaaggtcgagg

SEQ ID NO: 80257 - DNA, 25 bp, Mus musculus
caaagtctggtgtggctataggaac

SEQ ID NO: 80258 - DNA, 25 bp, Mus musculus
caaagtctggttacggctgaactcc

SEQ ID NO: 80259 - DNA, 25 bp, Mus musculus
caaagtctgttgtagcctgatgctc

SEQ ID NO: 80260 - DNA, 25 bp, Mus musculus
caaagtcttggtactcggcactgtc

SEQ ID NO: 80261 - DNA, 25 bp, Mus musculus
caaagtgaactgatgggtgagcccc

SEQ ID NO: 80262 - DNA, 25 bp, Mus musculus
caaagtgaatcctttccggcctggg

SEQ ID NO: 80263 - DNA, 25 bp, Mus musculus
caaagtgacactgggaaaatagagg

SEQ ID NO: 80264 - DNA, 25 bp, Mus musculus
caaagtgaccttcgtgcggctacag

SEQ ID NO: 80265 - DNA, 25 bp, Mus musculus
caaagtgactaaagcctaccaggac

SEQ ID NO: 80266 - DNA, 25 bp, Mus musculus
caaagtgacttacaaagccaggcag

SEQ ID NO: 80267 - DNA, 25 bp, Mus musculus
caaagtgagctctttcgatcccggc

SEQ ID NO: 80268 - DNA, 25 bp, Mus musculus
caaagtgaggttttcccaggccttg

SEQ ID NO: 80269 - DNA, 25 bp, Mus musculus
caaagtgagtgaacgtctctcccgg

SEQ ID NO: 80270 - DNA, 25 bp, Mus musculus
caaagtgatctcaggactgcagagc

SEQ ID NO: 80271 - DNA, 25 bp, Mus musculus
caaagtgatgagctgacctcccgag

SEQ ID NO: 80272 - DNA, 25 bp, Mus musculus
caaagtgcagatccacagtcaggac

SEQ ID NO: 80273 - DNA, 25 bp, Mus musculus
caaagtgcccagtccggaggcgttt

SEQ ID NO: 80274 - DNA, 25 bp, Mus musculus
caaagtgctactcttatctggccag

SEQ ID NO: 80275 - DNA, 25 bp, Mus musculus
caaagtgctgaggtgagcagtccag

SEQ ID NO: 80276 - DNA, 25 bp, Mus musculus
caaagtgctgctgggttcccgggct

SEQ ID NO: 80277 - DNA, 25 bp, Mus musculus
caaagtggatccttccttgatggaa

SEQ ID NO: 80278 - DNA, 25 bp, Mus musculus
caaagtggattcatcctgcacctca

SEQ ID NO: 80279 - DNA, 25 bp, Mus musculus
caaagtggccggacagttcttcagc

SEQ ID NO: 80280 - DNA, 25 bp, Mus musculus
caaagtggcctcttgttagaagaag

SEQ ID NO: 80281 - DNA, 25 bp, Mus musculus
caaagtgggccgtgagggcatcatc

SEQ ID NO: 80282 - DNA, 25 bp, Mus musculus
caaagtggtacccttctcgaattgg

SEQ ID NO: 80283 - DNA, 25 bp, Mus musculus
caaagtgtacctctggaagctgcca

SEQ ID NO: 80284 - DNA, 25 bp, Mus musculus
caaagtgtgccgttgtctcttcggt

SEQ ID NO: 80285 - DNA, 25 bp, Mus musculus
caaagtgtggatctacccagagggt

SEQ ID NO: 80286 - DNA, 25 bp, Mus musculus
caaagtgtggtcaactcatcgccag

SEQ ID NO: 80287 - DNA, 25 bp, Mus musculus
caaagtgtttgctcgcagtgtgcag

SEQ ID NO: 80288 - DNA, 25 bp, Mus musculus
caaagttagcagagcgactggtaca

SEQ ID NO: 80289 - DNA, 25 bp, Mus musculus
caaagttatccagatatgacgaggg

SEQ ID NO: 80290 - DNA, 25 bp, Mus musculus
caaagttcgaactggtcctggaagg

SEQ ID NO: 80291 - DNA, 25 bp, Mus musculus
caaagttctgatggttatggtacca

SEQ ID NO: 80292 - DNA, 25 bp, Mus musculus
caaagttctggctgatcgaatggag

SEQ ID NO: 80293 - DNA, 25 bp, Mus musculus
caaagttgtcttcgtgtgataggct

SEQ ID NO: 80294 - DNA, 25 bp, Mus musculus
caaagttgtgaatccagtggcgaca

SEQ ID NO: 80295 - DNA, 25 bp, Mus musculus
caaagttgtgcctcccctggatgaa

SEQ ID NO: 80296 - DNA, 25 bp, Mus musculus
caaagtttcagtgtgggatccctag

SEQ ID NO: 80297 - DNA, 25 bp, Mus musculus
caaagtttcgcagcattgtccatgc

SEQ ID NO: 80298 - DNA, 25 bp, Mus musculus
caaataaaaggctagaggagtccat

SEQ ID NO: 80299 - DNA, 25 bp, Mus musculus
caaataaaccaagatgtgccggtac

SEQ ID NO: 80300 - DNA, 25 bp, Mus musculus
caaataaatatcagacggagtgcgt

SEQ ID NO: 80301 - DNA, 25 bp, Mus musculus
caaataagctgggtgacgaagttca

SEQ ID NO: 80302 - DNA, 25 bp, Mus musculus
caaataaggctaactagcacctgca

SEQ ID NO: 80303 - DNA, 25 bp, Mus musculus
caaataagggcagcaaggtcatgga

SEQ ID NO: 80304 - DNA, 25 bp, Mus musculus
caaataagttttagctccagccgag

SEQ ID NO: 80305 - DNA, 25 bp, Mus musculus
caaatacaaagggacggctggcaac

SEQ ID NO: 80306 - DNA, 25 bp, Mus musculus
caaatacaacttctcctttgattac

SEQ ID NO: 80307 - DNA, 25 bp, Mus musculus
caaatacatcaccaagaaagtgtga

SEQ ID NO: 80308 - DNA, 25 bp, Mus musculus
caaataccaaggagatgggattgtt

SEQ ID NO: 80309 - DNA, 25 bp, Mus musculus
caaataccagaatgcagagctccgg

SEQ ID NO: 80310 - DNA, 25 bp, Mus musculus
caaataccagagcaaggccaggcgg

SEQ ID NO: 80311 - DNA, 25 bp, Mus musculus
caaatacctgtatgggatccgagtg

SEQ ID NO: 80312 - DNA, 25 bp, Mus musculus
caaatacgactttacgtccagtcgg

SEQ ID NO: 80313 - DNA, 25 bp, Mus musculus
caaatacgcaggcatctggcactgc

SEQ ID NO: 80314 - DNA, 25 bp, Mus musculus
caaatacgtgctgtgggtggacgac

SEQ ID NO: 80315 - DNA, 25 bp, Mus musculus
caaatactcctgcagaaagccgatc

SEQ ID NO: 80316 - DNA, 25 bp, Mus musculus
caaatactgcactgccatcagcggg

SEQ ID NO: 80317 - DNA, 25 bp, Mus musculus
caaatactgccccatgtgtgacgtc

SEQ ID NO: 80318 - DNA, 25 bp, Mus musculus
caaatactgcgcttgcatgctgatg

SEQ ID NO: 80319 - DNA, 25 bp, Mus musculus
caaatagttgatcaacagtggccag

SEQ ID NO: 80320 - DNA, 25 bp, Mus musculus
caaatatactctagagactcggccc

SEQ ID NO: 80321 - DNA, 25 bp, Mus musculus
caaatatagtatcaaggtcctgcct

SEQ ID NO: 80322 - DNA, 25 bp, Mus musculus
caaatattggagataatgtcagcag

SEQ ID NO: 80323 - DNA, 25 bp, Mus musculus
caaatcaaattcatcgtggacagcc

SEQ ID NO: 80324 - DNA, 25 bp, Mus musculus
caaatcaagggtggaagaaggctcc

SEQ ID NO: 80325 - DNA, 25 bp, Mus musculus
caaatcaatgacatccgaaatcatg

SEQ ID NO: 80326 - DNA, 25 bp, Mus musculus
caaatcagatctcaggtgcctcagc

SEQ ID NO: 80327 - DNA, 25 bp, Mus musculus
caaatcaggctcttgcagctggaac

SEQ ID NO: 80328 - DNA, 25 bp, Mus musculus
caaatcaggttagttcagccgctcc

SEQ ID NO: 80329 - DNA, 25 bp, Mus musculus
caaatcatctggagagcaagtgggt

SEQ ID NO: 80330 - DNA, 25 bp, Mus musculus
caaatcattgccaccgtcatcggaa

SEQ ID NO: 80331 - DNA, 25 bp, Mus musculus
caaatccaagagtaggagcaagagc

SEQ ID NO: 80332 - DNA, 25 bp, Mus musculus
caaatccaagccagttaaatgcagt

SEQ ID NO: 80333 - DNA, 25 bp, Mus musculus
caaatccagacagggtagtcacacc

SEQ ID NO: 80334 - DNA, 25 bp, Mus musculus
caaatccaggactaggaggcaggca

SEQ ID NO: 80335 - DNA, 25 bp, Mus musculus
caaatccaggagtagaaggagatcc

SEQ ID NO: 80336 - DNA, 25 bp, Mus musculus
caaatccattcttctcacgtcagaa

SEQ ID NO: 80337 - DNA, 25 bp, Mus musculus
caaatcccatcgagttcctagcatc

SEQ ID NO: 80338 - DNA, 25 bp, Mus musculus
caaatccggtacgatgctgtgacaa

SEQ ID NO: 80339 - DNA, 25 bp, Mus musculus
caaatccgtctgttttgagccagga

SEQ ID NO: 80340 - DNA, 25 bp, Mus musculus
caaatcctgggtgaccacagatgag

SEQ ID NO: 80341 - DNA, 25 bp, Mus musculus
caaatcctgtaagtcggaactgccc

SEQ ID NO: 80342 - DNA, 25 bp, Mus musculus
caaatcgaagcccaagtctgaccgg

SEQ ID NO: 80343 - DNA, 25 bp, Mus musculus
caaatcgagggaaacataccaatgg

SEQ ID NO: 80344 - DNA, 25 bp, Mus musculus
caaatcgctctttgggaaaacggag

SEQ ID NO: 80345 - DNA, 25 bp, Mus musculus
caaatcgtggccaactttgggctca

SEQ ID NO: 80346 - DNA, 25 bp, Mus musculus
caaatctactctgagttccgtgaga

SEQ ID NO: 80347 - DNA, 25 bp, Mus musculus
caaatctctgcttggatctgcgtca

SEQ ID NO: 80348 - DNA, 25 bp, Mus musculus
caaatctgaacggtggtgagcggct

SEQ ID NO: 80349 - DNA, 25 bp, Mus musculus
caaatctggagccaaaaaggaccca

SEQ ID NO: 80350 - DNA, 25 bp, Mus musculus
caaatctgggattgtgtcttgagct

SEQ ID NO: 80351 - DNA, 25 bp, Mus musculus
caaatgaacgaggtgcacgtggcca

SEQ ID NO: 80352 - DNA, 25 bp, Mus musculus
caaatgaagctggtggcagaaaacc

SEQ ID NO: 80353 - DNA, 25 bp, Mus musculus
caaatgaaggaataccttggaccaa

SEQ ID NO: 80354 - DNA, 25 bp, Mus musculus
caaatgaaggctgtgttccggacca

SEQ ID NO: 80355 - DNA, 25 bp, Mus musculus
caaatgacaagattgaagacatcaa

SEQ ID NO: 80356 - DNA, 25 bp, Mus musculus
caaatgacagatgggctgatacccc

SEQ ID NO: 80357 - DNA, 25 bp, Mus musculus
caaatgacagtgaacctttggtcac

SEQ ID NO: 80358 - DNA, 25 bp, Mus musculus
caaatgactctggattctgtgccta

SEQ ID NO: 80359 - DNA, 25 bp, Mus musculus
caaatgagcctgtgtaccagctgcc

SEQ ID NO: 80360 - DNA, 25 bp, Mus musculus
caaatgagcgcagagtgatcgtccc

SEQ ID NO: 80361 - DNA, 25 bp, Mus musculus
caaatgaggtgctaggtccagaact

SEQ ID NO: 80362 - DNA, 25 bp, Mus musculus
caaatgagtctgagtgtaagagccc

SEQ ID NO: 80363 - DNA, 25 bp, Mus musculus
caaatgatagtggagaccttgctcg

SEQ ID NO: 80364 - DNA, 25 bp, Mus musculus
caaatgatgccgtttatgcagccag

SEQ ID NO: 80365 - DNA, 25 bp, Mus musculus
caaatgcaccaatctctcggagggc

SEQ ID NO: 80366 - DNA, 25 bp, Mus musculus
caaatgcaccagcacaaaagtggga

SEQ ID NO: 80367 - DNA, 25 bp, Mus musculus
caaatgcacttttagggaatcacca

SEQ ID NO: 80368 - DNA, 25 bp, Mus musculus
caaatgcagcgtttctctcagccca

SEQ ID NO: 80369 - DNA, 25 bp, Mus musculus
caaatgcagttgctttcacaagaag

SEQ ID NO: 80370 - DNA, 25 bp, Mus musculus
caaatgcccgcatctctgtgatggg

SEQ ID NO: 80371 - DNA, 25 bp, Mus musculus
caaatgccgatgttggaccatgtca

SEQ ID NO: 80372 - DNA, 25 bp, Mus musculus
caaatgcctcagctcagaaactgtt

SEQ ID NO: 80373 - DNA, 25 bp, Mus musculus
caaatgcggagctgtgtcggtacct

SEQ ID NO: 80374 - DNA, 25 bp, Mus musculus
caaatgcgggagttacaagatcaac

SEQ ID NO: 80375 - DNA, 25 bp, Mus musculus
caaatgcggtgaagctcgatgacac

SEQ ID NO: 80376 - DNA, 25 bp, Mus musculus
caaatgcgtacgtggatctcgtgcc

SEQ ID NO: 80377 - DNA, 25 bp, Mus musculus
caaatgcgtcaagttgcgagcccta

SEQ ID NO: 80378 - DNA, 25 bp, Mus musculus
caaatgctaagcgatggccagctgt

SEQ ID NO: 80379 - DNA, 25 bp, Mus musculus
caaatgctgaattcgtctgggaccg

SEQ ID NO: 80380 - DNA, 25 bp, Mus musculus
caaatgcttagtgctgagtcggaac

SEQ ID NO: 80381 - DNA, 25 bp, Mus musculus
caaatggaaaggaatatatcagagc

SEQ ID NO: 80382 - DNA, 25 bp, Mus musculus
caaatggaacctaatccctgagggc

SEQ ID NO: 80383 - DNA, 25 bp, Mus musculus
caaatggacatgcaaggcttgtgga

SEQ ID NO: 80384 - DNA, 25 bp, Mus musculus
caaatggagactcaatggcttgccg

SEQ ID NO: 80385 - DNA, 25 bp, Mus musculus
caaatggagcgtgtgcatagcccct

SEQ ID NO: 80386 - DNA, 25 bp, Mus musculus
caaatggaggcccagatagacagga

SEQ ID NO: 80387 - DNA, 25 bp, Mus musculus
caaatggaggtgtacaggagccact

SEQ ID NO: 80388 - DNA, 25 bp, Mus musculus
caaatggatgtgctcgaaggcctaa

SEQ ID NO: 80389 - DNA, 25 bp, Mus musculus
caaatggcagaggatagcatggaag

SEQ ID NO: 80390 - DNA, 25 bp, Mus musculus
caaatggcaggcacatgaactggca

SEQ ID NO: 80391 - DNA, 25 bp, Mus musculus
caaatggccgatcttatcagtgtct

SEQ ID NO: 80392 - DNA, 25 bp, Mus musculus
caaatgggatccttggctacagcga

SEQ ID NO: 80393 - DNA, 25 bp, Mus musculus
caaatgggcgccagaaggttctcca

SEQ ID NO: 80394 - DNA, 25 bp, Mus musculus
caaatgggtacgactccaactggct

SEQ ID NO: 80395 - DNA, 25 bp, Mus musculus
caaatgggttattaagaaagtggca

SEQ ID NO: 80396 - DNA, 25 bp, Mus musculus
caaatggtattacttctggaagaac

SEQ ID NO: 80397 - DNA, 25 bp, Mus musculus
caaatggtcacagttaacagggatc

SEQ ID NO: 80398 - DNA, 25 bp, Mus musculus
caaatggtgttgacatccaggtcag

SEQ ID NO: 80399 - DNA, 25 bp, Mus musculus
caaatggttatgcatacactggccc

SEQ ID NO: 80400 - DNA, 25 bp, Mus musculus
caaatggttctctggaggtgctcac

SEQ ID NO: 80401 - DNA, 25 bp, Mus musculus
caaatgtaaagatttcagcaaggcc

SEQ ID NO: 80402 - DNA, 25 bp, Mus musculus
caaatgtacgtgtgcaataaggagg

SEQ ID NO: 80403 - DNA, 25 bp, Mus musculus
caaatgtagttgcaagcccggttac

SEQ ID NO: 80404 - DNA, 25 bp, Mus musculus
caaatgtcaaggagtagcaaagtca

SEQ ID NO: 80405 - DNA, 25 bp, Mus musculus
caaatgtcccgctggtgaatactgg

SEQ ID NO: 80406 - DNA, 25 bp, Mus musculus
caaatgtgaagcgtctgataagtcc

SEQ ID NO: 80407 - DNA, 25 bp, Mus musculus
caaatgtgaattcgaaggctgtgac

SEQ ID NO: 80408 - DNA, 25 bp, Mus musculus
caaatgtgaattgtgctccttccgc

SEQ ID NO: 80409 - DNA, 25 bp, Mus musculus
caaatgtgaccgtgtagaccagcta

SEQ ID NO: 80410 - DNA, 25 bp, Mus musculus
caaatgtgatctcaacgggaagccc

SEQ ID NO: 80411 - DNA, 25 bp, Mus musculus
caaatgtgatggaagcaaaccagcc

SEQ ID NO: 80412 - DNA, 25 bp, Mus musculus
caaatgtgccctttccagagctacc

SEQ ID NO: 80413 - DNA, 25 bp, Mus musculus
caaatgtggatattgtggccggagc

SEQ ID NO: 80414 - DNA, 25 bp, Mus musculus
caaatgttgcacagatccggatggc

SEQ ID NO: 80415 - DNA, 25 bp, Mus musculus
caaattaaccaggtttacagacagg

SEQ ID NO: 80416 - DNA, 25 bp, Mus musculus
caaattacagggaacaaaggcctgg

SEQ ID NO: 80417 - DNA, 25 bp, Mus musculus
caaattacatcgctccggaggtgct

SEQ ID NO: 80418 - DNA, 25 bp, Mus musculus
caaattacttctctccacaactggg

SEQ ID NO: 80419 - DNA, 25 bp, Mus musculus
caaattagaccagacgttcggcagg

SEQ ID NO: 80420 - DNA, 25 bp, Mus musculus
caaattagagaagtctttggcctgg

SEQ ID NO: 80421 - DNA, 25 bp, Mus musculus
caaattagatttagacagtgccgaa

SEQ ID NO: 80422 - DNA, 25 bp, Mus musculus
caaattagcaaacaggaaaggcggc

SEQ ID NO: 80423 - DNA, 25 bp, Mus musculus
caaattagccgtcaccaggagcagt

SEQ ID NO: 80424 - DNA, 25 bp, Mus musculus
caaattataatactgtggtagaagc

SEQ ID NO: 80425 - DNA, 25 bp, Mus musculus
caaattatgtgaagagagcgggtga

SEQ ID NO: 80426 - DNA, 25 bp, Mus musculus
caaattattactgacaaggaagact

SEQ ID NO: 80427 - DNA, 25 bp, Mus musculus
caaattcaaataccggcgcgtggca

SEQ ID NO: 80428 - DNA, 25 bp, Mus musculus
caaattcaagggttaggccagttct

SEQ ID NO: 80429 - DNA, 25 bp, Mus musculus
caaattcacttgttcttgggaagca

SEQ ID NO: 80430 - DNA, 25 bp, Mus musculus
caaattcagctgtggtgtctcggca

SEQ ID NO: 80431 - DNA, 25 bp, Mus musculus
caaattcattggtgcaggtgctgca

SEQ ID NO: 80432 - DNA, 25 bp, Mus musculus
caaattccctactaagactggccgg

SEQ ID NO: 80433 - DNA, 25 bp, Mus musculus
caaattcccttggtcaaagaagtga

SEQ ID NO: 80434 - DNA, 25 bp, Mus musculus
caaattccgagccaacaagggactg

SEQ ID NO: 80435 - DNA, 25 bp, Mus musculus
caaattccgagtgcgtgcagtcaac

SEQ ID NO: 80436 - DNA, 25 bp, Mus musculus
caaattcctccttgggagccatagg

SEQ ID NO: 80437 - DNA, 25 bp, Mus musculus
caaattcctgctcggacttgggacg

SEQ ID NO: 80438 - DNA, 25 bp, Mus musculus
caaattctgaaacgccatgggcata

SEQ ID NO: 80439 - DNA, 25 bp, Mus musculus
caaattctgagtgttaggactgggt

SEQ ID NO: 80440 - DNA, 25 bp, Mus musculus
caaattctggaaggttcttgagttc

SEQ ID NO: 80441 - DNA, 25 bp, Mus musculus
caaattctggactcgaaaccggcca

SEQ ID NO: 80442 - DNA, 25 bp, Mus musculus
caaattctggtgcagagggtcactg

SEQ ID NO: 80443 - DNA, 25 bp, Mus musculus
caaattcttagatgctgcgaggcag

SEQ ID NO: 80444 - DNA, 25 bp, Mus musculus
caaattcttggcatggagtggtgtc

SEQ ID NO: 80445 - DNA, 25 bp, Mus musculus
caaattgactgcagaacagggtccc

SEQ ID NO: 80446 - DNA, 25 bp, Mus musculus
caaattgatgctgcgatcgttcgaa

SEQ ID NO: 80447 - DNA, 25 bp, Mus musculus
caaattgatttcctggctgctcgac

SEQ ID NO: 80448 - DNA, 25 bp, Mus musculus
caaattgcacgtactgggttctcct

SEQ ID NO: 80449 - DNA, 25 bp, Mus musculus
caaattgccttgctgtgaaccctag

SEQ ID NO: 80450 - DNA, 25 bp, Mus musculus
caaattgcgagacatcgagctgatc

SEQ ID NO: 80451 - DNA, 25 bp, Mus musculus
caaattggaagacctgaatagtgag

SEQ ID NO: 80452 - DNA, 25 bp, Mus musculus
caaattggagaagctaatgacccag

SEQ ID NO: 80453 - DNA, 25 bp, Mus musculus
caaattgtacactaagcagggagct

SEQ ID NO: 80454 - DNA, 25 bp, Mus musculus
caaattgtagctctggcgcctgtgc

SEQ ID NO: 80455 - DNA, 25 bp, Mus musculus
caaattgtccttctcttggctgagc

SEQ ID NO: 80456 - DNA, 25 bp, Mus musculus
caaattgtggacttcgtgcaggtgt

SEQ ID NO: 80457 - DNA, 25 bp, Mus musculus
caaattgtggccaaagatccctggg

SEQ ID NO: 80458 - DNA, 25 bp, Mus musculus
caaatttacaagtgagcgagcccca

SEQ ID NO: 80459 - DNA, 25 bp, Mus musculus
caaatttacagccagaagttccagg

SEQ ID NO: 80460 - DNA, 25 bp, Mus musculus
caaatttccaacagaagagccagcc

SEQ ID NO: 80461 - DNA, 25 bp, Mus musculus
caaatttcctctgggcttgctgtgg

SEQ ID NO: 80462 - DNA, 25 bp, Mus musculus
caaatttgagaacaatagctgggtc

SEQ ID NO: 80463 - DNA, 25 bp, Mus musculus
caaatttgagcagtacatgtgcgca

SEQ ID NO: 80464 - DNA, 25 bp, Mus musculus
caaatttgcagaaggagaggccaca

SEQ ID NO: 80465 - DNA, 25 bp, Mus musculus
caaatttggagagtcttactgcatc

SEQ ID NO: 80466 - DNA, 25 bp, Mus musculus
caaatttggcttgcaactgtcagca

SEQ ID NO: 80467 - DNA, 25 bp, Mus musculus
caaattttacacagatcccgtggaa

SEQ ID NO: 80468 - DNA, 25 bp, Mus musculus
caacaaaaagcttgctgcgttctgg

SEQ ID NO: 80469 - DNA, 25 bp, Mus musculus
caacaaaacagtccttcttctacgg

SEQ ID NO: 80470 - DNA, 25 bp, Mus musculus
caacaaaatccagatgtcttcagtg

SEQ ID NO: 80471 - DNA, 25 bp, Mus musculus
caacaaaatggatgtgcccagcaag

SEQ ID NO: 80472 - DNA, 25 bp, Mus musculus
caacaaacacgatggtgccctgaag

SEQ ID NO: 80473 - DNA, 25 bp, Mus musculus
caacaaaccggatgagcgtggcttc

SEQ ID NO: 80474 - DNA, 25 bp, Mus musculus
caacaaacctggattcccggacgag

SEQ ID NO: 80475 - DNA, 25 bp, Mus musculus
caacaaactgctggcctggagtggc

SEQ ID NO: 80476 - DNA, 25 bp, Mus musculus
caacaaagagcctgtgtcgctggta

SEQ ID NO: 80477 - DNA, 25 bp, Mus musculus
caacaaagagtcagtagtcatggcc

SEQ ID NO: 80478 - DNA, 25 bp, Mus musculus
caacaaagagttcatggagcagagc

SEQ ID NO: 80479 - DNA, 25 bp, Mus musculus
caacaaagatctgctggcctgctgg

SEQ ID NO: 80480 - DNA, 25 bp, Mus musculus
caacaaagcctggaagctagacgcg

SEQ ID NO: 80481 - DNA, 25 bp, Mus musculus
caacaaagttgcttcggtggcagaa

SEQ ID NO: 80482 - DNA, 25 bp, Mus musculus
caacaacacctcttgggactgggct

SEQ ID NO: 80483 - DNA, 25 bp, Mus musculus
caacaacacgtggacatggctggac

SEQ ID NO: 80484 - DNA, 25 bp, Mus musculus
caacaacagccatggaaaagataca

SEQ ID NO: 80485 - DNA, 25 bp, Mus musculus
caacaacagcccaagggacccttag

SEQ ID NO: 80486 - DNA, 25 bp, Mus musculus
caacaacagcgatgaagtggccgat

SEQ ID NO: 80487 - DNA, 25 bp, Mus musculus
caacaacaggaaacgaagaagggat

SEQ ID NO: 80488 - DNA, 25 bp, Mus musculus
caacaacaggagtactcagtggcac

SEQ ID NO: 80489 - DNA, 25 bp, Mus musculus
caacaacatcaaggctatcccagag

SEQ ID NO: 80490 - DNA, 25 bp, Mus musculus
caacaaccggaacgtgaaggtgcgc

SEQ ID NO: 80491 - DNA, 25 bp, Mus musculus
caacaaccttgaggacgactcgagc

SEQ ID NO: 80492 - DNA, 25 bp, Mus musculus
caacaacgagataagctgagggcag

SEQ ID NO: 80493 - DNA, 25 bp, Mus musculus
caacaacgtccggaacaagctgaag

SEQ ID NO: 80494 - DNA, 25 bp, Mus musculus
caacaacgtgaagcctggtgaacag

SEQ ID NO: 80495 - DNA, 25 bp, Mus musculus
caacaactggtgtgagaacgcggaa

SEQ ID NO: 80496 - DNA, 25 bp, Mus musculus
caacaactgtggcaggatgagacac

SEQ ID NO: 80497 - DNA, 25 bp, Mus musculus
caacaactttgagggtgagatcacc

SEQ ID NO: 80498 - DNA, 25 bp, Mus musculus
caacaagacgatggctgataacagc

SEQ ID NO: 80499 - DNA, 25 bp, Mus musculus
caacaagacgtttgcaagtggctca

SEQ ID NO: 80500 - DNA, 25 bp, Mus musculus
caacaagaggcactgggaactgatc

SEQ ID NO: 80501 - DNA, 25 bp, Mus musculus
caacaagatcaactgggccatggaa

SEQ ID NO: 80502 - DNA, 25 bp, Mus musculus
caacaagcgtattgagccacagaga

SEQ ID NO: 80503 - DNA, 25 bp, Mus musculus
caacaagctggatggcacatacctg

SEQ ID NO: 80504 - DNA, 25 bp, Mus musculus
caacaaggaaagaggcagagcagct

SEQ ID NO: 80505 - DNA, 25 bp, Mus musculus
caacaaggatatggcagggaagctc

SEQ ID NO: 80506 - DNA, 25 bp, Mus musculus
caacaaggatattgagacccaggtc

SEQ ID NO: 80507 - DNA, 25 bp, Mus musculus
caacaaggccatggatcgcagaaga

SEQ ID NO: 80508 - DNA, 25 bp, Mus musculus
caacaaggccatggcagacgaggtg

SEQ ID NO: 80509 - DNA, 25 bp, Mus musculus
caacaaggccttggatttcatagcc

SEQ ID NO: 80510 - DNA, 25 bp, Mus musculus
caacaaggctggctacggagagtac

SEQ ID NO: 80511 - DNA, 25 bp, Mus musculus
caacaaggcttcaggagagatcaaa

SEQ ID NO: 80512 - DNA, 25 bp, Mus musculus
caacaagggttacaaaggactggat

SEQ ID NO: 80513 - DNA, 25 bp, Mus musculus
caacaagtggacaggatcatcctcc

SEQ ID NO: 80514 - DNA, 25 bp, Mus musculus
caacaagtgggactatgtggcagct

SEQ ID NO: 80515 - DNA, 25 bp, Mus musculus
caacaagtgtgggaactggtacacg

SEQ ID NO: 80516 - DNA, 25 bp, Mus musculus
caacaagtttggtgtggagcagccg

SEQ ID NO: 80517 - DNA, 25 bp, Mus musculus
caacaatcacgtgaagacttgccgg

SEQ ID NO: 80518 - DNA, 25 bp, Mus musculus
caacaatcagaaaagtttgcgaagg

SEQ ID NO: 80519 - DNA, 25 bp, Mus musculus
caacaatctgtccagtgtgcggctg

SEQ ID NO: 80520 - DNA, 25 bp, Mus musculus
caacaatgagaaagtcatcgcaaac

SEQ ID NO: 80521 - DNA, 25 bp, Mus musculus
caacaatggaacttgcgtggacctg

SEQ ID NO: 80522 - DNA, 25 bp, Mus musculus
caacaatgtatgcgtataaacaaaa

SEQ ID NO: 80523 - DNA, 25 bp, Mus musculus
caacaatgtcaaagcctaccgggat

SEQ ID NO: 80524 - DNA, 25 bp, Mus musculus
caacaatgttttgctggctgcaggc

SEQ ID NO: 80525 - DNA, 25 bp, Mus musculus
caacacactagcctgagctacctta

SEQ ID NO: 80526 - DNA, 25 bp, Mus musculus
caacacagctcgttatgccgctgca

SEQ ID NO: 80527 - DNA, 25 bp, Mus musculus
caacacatcattattgatgaagccc

SEQ ID NO: 80528 - DNA, 25 bp, Mus musculus
caacacattagcgtggatggaagtc

SEQ ID NO: 80529 - DNA, 25 bp, Mus musculus
caacacatttcgaggagtcctgcag

SEQ ID NO: 80530 - DNA, 25 bp, Mus musculus
caacaccaagtttactcagccaggg

SEQ ID NO: 80531 - DNA, 25 bp, Mus musculus
caacaccagtttcgacagaggcgct

SEQ ID NO: 80532 - DNA, 25 bp, Mus musculus
caacacccgtggacatgtggagcgt

SEQ ID NO: 80533 - DNA, 25 bp, Mus musculus
caacaccgagcccagctggatctgg

SEQ ID NO: 80534 - DNA, 25 bp, Mus musculus
caacaccgtgggtgctgccgctgag

SEQ ID NO: 80535 - DNA, 25 bp, Mus musculus
caacacctatgtttcagaccgagag

SEQ ID NO: 80536 - DNA, 25 bp, Mus musculus
caacacctctggaatataaagctgc

SEQ ID NO: 80537 - DNA, 25 bp, Mus musculus
caacacgaattgcaggactacctca

SEQ ID NO: 80538 - DNA, 25 bp, Mus musculus
caacacgatgtatgctcggctcggg

SEQ ID NO: 80539 - DNA, 25 bp, Mus musculus
caacacgggaagctatcatcaaaag

SEQ ID NO: 80540 - DNA, 25 bp, Mus musculus
caacacgtttgggagctacatctgc

SEQ ID NO: 80541 - DNA, 25 bp, Mus musculus
caacactcaaggatttaaggagccc

SEQ ID NO: 80542 - DNA, 25 bp, Mus musculus
caacactcatgtgaacatcaaagag

SEQ ID NO: 80543 - DNA, 25 bp, Mus musculus
caacactgggaaggcacggaggaaa

SEQ ID NO: 80544 - DNA, 25 bp, Mus musculus
caacactgggcaaatcgatgaccgc

SEQ ID NO: 80545 - DNA, 25 bp, Mus musculus
caacactgtttgctggagagtccca

SEQ ID NO: 80546 - DNA, 25 bp, Mus musculus
caacacttctctggtcgagctgaaa

SEQ ID NO: 80547 - DNA, 25 bp, Mus musculus
caacactttccagggtgccgctgta

SEQ ID NO: 80548 - DNA, 25 bp, Mus musculus
caacagaaatgtgccagagattgcc

SEQ ID NO: 80549 - DNA, 25 bp, Mus musculus
caacagaacactggaccgatctggg

SEQ ID NO: 80550 - DNA, 25 bp, Mus musculus
caacagaacctactgcaaggagcag

SEQ ID NO: 80551 - DNA, 25 bp, Mus musculus
caacagaagaaaaggtagtggtaca

SEQ ID NO: 80552 - DNA, 25 bp, Mus musculus
caacagaagactatgggaaggtgcc

SEQ ID NO: 80553 - DNA, 25 bp, Mus musculus
caacagaaggcagctccgacttctc

SEQ ID NO: 80554 - DNA, 25 bp, Mus musculus
caacagaatctaagcttcggagaga

SEQ ID NO: 80555 - DNA, 25 bp, Mus musculus
caacagaatgggatacgacacgggt

SEQ ID NO: 80556 - DNA, 25 bp, Mus musculus
caacagacaagccaagtttgcagcc

SEQ ID NO: 80557 - DNA, 25 bp, Mus musculus
caacagacaagtgtgcattgacccg

SEQ ID NO: 80558 - DNA, 25 bp, Mus musculus
caacagacgcttttgggaccattga

SEQ ID NO: 80559 - DNA, 25 bp, Mus musculus
caacagagaggcgagaagagcatct

SEQ ID NO: 80560 - DNA, 25 bp, Mus musculus
caacagagcccgcttgaggcaacta

SEQ ID NO: 80561 - DNA, 25 bp, Mus musculus
caacagaggcatggtcctactgaca

SEQ ID NO: 80562 - DNA, 25 bp, Mus musculus
caacagagggtaaaattctgggctc

SEQ ID NO: 80563 - DNA, 25 bp, Mus musculus
caacagagtccgtggagagagccta

SEQ ID NO: 80564 - DNA, 25 bp, Mus musculus
caacagagtgattgctcgggcagag

SEQ ID NO: 80565 - DNA, 25 bp, Mus musculus
caacagagttctacaaatgaagaag

SEQ ID NO: 80566 - DNA, 25 bp, Mus musculus
caacagatgacactggaaggtccag

SEQ ID NO: 80567 - DNA, 25 bp, Mus musculus
caacagcaagaactcctagaaaagg

SEQ ID NO: 80568 - DNA, 25 bp, Mus musculus
caacagcaagaggaacaacaggagc

SEQ ID NO: 80569 - DNA, 25 bp, Mus musculus
caacagcaagcaagcggtcaggatc

SEQ ID NO: 80570 - DNA, 25 bp, Mus musculus
caacagcagctttcaataacgtggg

SEQ ID NO: 80571 - DNA, 25 bp, Mus musculus
caacagcatgtggttggacctggga

SEQ ID NO: 80572 - DNA, 25 bp, Mus musculus
caacagcattagcaagtgggaccaa

SEQ ID NO: 80573 - DNA, 25 bp, Mus musculus
caacagccaccggattctggagagg

SEQ ID NO: 80574 - DNA, 25 bp, Mus musculus
caacagccacgacaaaactatgagt

SEQ ID NO: 80575 - DNA, 25 bp, Mus musculus
caacagcctgagtgtcaataacggg

SEQ ID NO: 80576 - DNA, 25 bp, Mus musculus
caacagcgctgtagcttgagcctca

SEQ ID NO: 80577 - DNA, 25 bp, Mus musculus
caacagctactccttgcgaagcggt

SEQ ID NO: 80578 - DNA, 25 bp, Mus musculus
caacagctagcaggtctggtaagcc

SEQ ID NO: 80579 - DNA, 25 bp, Mus musculus
caacagctataaggatgaggactac

SEQ ID NO: 80580 - DNA, 25 bp, Mus musculus
caacagctgaggctaataacctggc

SEQ ID NO: 80581 - DNA, 25 bp, Mus musculus
caacagctgattctaaaggacccca

SEQ ID NO: 80582 - DNA, 25 bp, Mus musculus
caacagctgccgacagaatgaagca

SEQ ID NO: 80583 - DNA, 25 bp, Mus musculus
caacagctgctgtatggagacatga

SEQ ID NO: 80584 - DNA, 25 bp, Mus musculus
caacagcttctatgggcaggtgagt

SEQ ID NO: 80585 - DNA, 25 bp, Mus musculus
caacaggacagagcttcagtacgag

SEQ ID NO: 80586 - DNA, 25 bp, Mus musculus
caacaggacgcaccacaggagtggt

SEQ ID NO: 80587 - DNA, 25 bp, Mus musculus
caacaggagagttgtgctacggttc

SEQ ID NO: 80588 - DNA, 25 bp, Mus musculus
caacaggattgtgtcggtgcggtca

SEQ ID NO: 80589 - DNA, 25 bp, Mus musculus
caacaggatttttcgagatctggca

SEQ ID NO: 80590 - DNA, 25 bp, Mus musculus
caacaggctctttgtgagcggtgtc

SEQ ID NO: 80591 - DNA, 25 bp, Mus musculus
caacaggctttgtggaacttccgct

SEQ ID NO: 80592 - DNA, 25 bp, Mus musculus
caacagggcactttctaccgtgggc

SEQ ID NO: 80593 - DNA, 25 bp, Mus musculus
caacagggcgtttggagtccagcag

SEQ ID NO: 80594 - DNA, 25 bp, Mus musculus
caacaggtgacctttgaagtgccca

SEQ ID NO: 80595 - DNA, 25 bp, Mus musculus
caacaggttctaggagcttctggca

SEQ ID NO: 80596 - DNA, 25 bp, Mus musculus
caacaggttgattcggatggacgcc

SEQ ID NO: 80597 - DNA, 25 bp, Mus musculus
caacagtcgtttctacagcctctca

SEQ ID NO: 80598 - DNA, 25 bp, Mus musculus
caacagtgaaacaagtgggcctcct

SEQ ID NO: 80599 - DNA, 25 bp, Mus musculus
caacagtgagacctcgtggtttcct

SEQ ID NO: 80600 - DNA, 25 bp, Mus musculus
caacagtgcttctacaatgagtcta

SEQ ID NO: 80601 - DNA, 25 bp, Mus musculus
caacagtggactcaaacggcgctga

SEQ ID NO: 80602 - DNA, 25 bp, Mus musculus
caacagtggagcgtacgcgaagcta

SEQ ID NO: 80603 - DNA, 25 bp, Mus musculus
caacagtggttggatgaacagcagc

SEQ ID NO: 80604 - DNA, 25 bp, Mus musculus
caacagtgtccaccaggatagcgtc

SEQ ID NO: 80605 - DNA, 25 bp, Mus musculus
caacagtgtggatggcttggcttca

SEQ ID NO: 80606 - DNA, 25 bp, Mus musculus
caacagtgttgaagaggcccagatt

SEQ ID NO: 80607 - DNA, 25 bp, Mus musculus
caacagttgatgcaggtttacgact

SEQ ID NO: 80608 - DNA, 25 bp, Mus musculus
caacagttgatgtccacaggatcca

SEQ ID NO: 80609 - DNA, 25 bp, Mus musculus
caacagttggcatgcacagcaggca

SEQ ID NO: 80610 - DNA, 25 bp, Mus musculus
caacataaatggtgccctggttcca

SEQ ID NO: 80611 - DNA, 25 bp, Mus musculus
caacatcagcatgtgtgggcacaca

SEQ ID NO: 80612 - DNA, 25 bp, Mus musculus
caacatcagtgcagctgtgatggat

SEQ ID NO: 80613 - DNA, 25 bp, Mus musculus
caacatcataattctgggagctgag

SEQ ID NO: 80614 - DNA, 25 bp, Mus musculus
caacatccgtgtggccttagagaag

SEQ ID NO: 80615 - DNA, 25 bp, Mus musculus
caacatcctggctgcaatgtggaca

SEQ ID NO: 80616 - DNA, 25 bp, Mus musculus
caacatcctttcagagttggatgaa

SEQ ID NO: 80617 - DNA, 25 bp, Mus musculus
caacatcgagcgtatcaaggaggag

SEQ ID NO: 80618 - DNA, 25 bp, Mus musculus
caacatcgaggctgtgagcaacgtc

SEQ ID NO: 80619 - DNA, 25 bp, Mus musculus
caacatcggtgaggaagactgtgtc

SEQ ID NO: 80620 - DNA, 25 bp, Mus musculus
caacatctatgatttggtggcgccc

SEQ ID NO: 80621 - DNA, 25 bp, Mus musculus
caacatctcagagggtgacctgcag

SEQ ID NO: 80622 - DNA, 25 bp, Mus musculus
caacatctcatcaagccctctgtgg

SEQ ID NO: 80623 - DNA, 25 bp, Mus musculus
caacatctcgggaattcttagtagg

SEQ ID NO: 80624 - DNA, 25 bp, Mus musculus
caacatctctgtgaattagctggcg

SEQ ID NO: 80625 - DNA, 25 bp, Mus musculus
caacatctgtgtcggctagtcatca

SEQ ID NO: 80626 - DNA, 25 bp, Mus musculus
caacatcttcattacggccttcggg

SEQ ID NO: 80627 - DNA, 25 bp, Mus musculus
caacatcttggaggcagcggtgcca

SEQ ID NO: 80628 - DNA, 25 bp, Mus musculus
caacatcttggtggagagcgaggct

SEQ ID NO: 80629 - DNA, 25 bp, Mus musculus
caacatgaagaagagagatccaccc

SEQ ID NO: 80630 - DNA, 25 bp, Mus musculus
caacatgaatgccacgagcgggtat

SEQ ID NO: 80631 - DNA, 25 bp, Mus musculus
caacatgatgaaagaagcgcagtcg

SEQ ID NO: 80632 - DNA, 25 bp, Mus musculus
caacatgattgaggagcaggtggca

SEQ ID NO: 80633 - DNA, 25 bp, Mus musculus
caacatgattgtgcgctcctgcaag

SEQ ID NO: 80634 - DNA, 25 bp, Mus musculus
caacatgcatgttcccagctgacac

SEQ ID NO: 80635 - DNA, 25 bp, Mus musculus
caacatgcggcaatggaacgtcaac

SEQ ID NO: 80636 - DNA, 25 bp, Mus musculus
caacatgctcttcgtgtatcctggg

SEQ ID NO: 80637 - DNA, 25 bp, Mus musculus
caacatggaagtagaccggctctgc

SEQ ID NO: 80638 - DNA, 25 bp, Mus musculus
caacatggcagcagccgaagtgcct

SEQ ID NO: 80639 - DNA, 25 bp, Mus musculus
caacatggccaagaccgaggagatg

SEQ ID NO: 80640 - DNA, 25 bp, Mus musculus
caacatggcgatggtctacgggagc

SEQ ID NO: 80641 - DNA, 25 bp, Mus musculus
caacatgggtcagctaaaaaggaaa

SEQ ID NO: 80642 - DNA, 25 bp, Mus musculus
caacatggtctccagtgtgactaca

SEQ ID NO: 80643 - DNA, 25 bp, Mus musculus
caacatggtgtgtcagattctggaa

SEQ ID NO: 80644 - DNA, 25 bp, Mus musculus
caacatgtacgtcactggcagcaag

SEQ ID NO: 80645 - DNA, 25 bp, Mus musculus
caacatgtcagagtgggagtcctac

SEQ ID NO: 80646 - DNA, 25 bp, Mus musculus
caacatgtcctggagagctggtacc

SEQ ID NO: 80647 - DNA, 25 bp, Mus musculus
caacatgttctgtagcttagagcgc

SEQ ID NO: 80648 - DNA, 25 bp, Mus musculus
caacattaccgagatgctggcagga

SEQ ID NO: 80649 - DNA, 25 bp, Mus musculus
caacattcaaggacctctgtgagga

SEQ ID NO: 80650 - DNA, 25 bp, Mus musculus
caacattcactatgagaaagaagag

SEQ ID NO: 80651 - DNA, 25 bp, Mus musculus
caacattcatcagcagggacgggca

SEQ ID NO: 80652 - DNA, 25 bp, Mus musculus
caacattgacaagatctcggagcat

SEQ ID NO: 80653 - DNA, 25 bp, Mus musculus
caacattgagagagctgagcagcct

SEQ ID NO: 80654 - DNA, 25 bp, Mus musculus
caacattgagcactatacaggcagc

SEQ ID NO: 80655 - DNA, 25 bp, Mus musculus
caacattgagttgagcgtccgggac

SEQ ID NO: 80656 - DNA, 25 bp, Mus musculus
caacattgcatggtctcttttctaa

SEQ ID NO: 80657 - DNA, 25 bp, Mus musculus
caacattgccgatggtggtttcaca

SEQ ID NO: 80658 - DNA, 25 bp, Mus musculus
caacattgtgtccacgtcaatgaaa

SEQ ID NO: 80659 - DNA, 25 bp, Mus musculus
caacattgttcgcttgagtacagcc

SEQ ID NO: 80660 - DNA, 25 bp, Mus musculus
caacattgttttgttgacacaagca

SEQ ID NO: 80661 - DNA, 25 bp, Mus musculus
caaccaaaagagatcagaggactcc

SEQ ID NO: 80662 - DNA, 25 bp, Mus musculus
caaccaaagtatctcaacctaaatc

SEQ ID NO: 80663 - DNA, 25 bp, Mus musculus
caaccaaccatgtactgtgaagtcc

SEQ ID NO: 80664 - DNA, 25 bp, Mus musculus
caaccaagtgccaagatgctgagcc

SEQ ID NO: 80665 - DNA, 25 bp, Mus musculus
caaccaagtggacatctgtgccctg

SEQ ID NO: 80666 - DNA, 25 bp, Mus musculus
caaccacagcagaggtgacctaagg

SEQ ID NO: 80667 - DNA, 25 bp, Mus musculus
caaccacaggtgctactggagggct

SEQ ID NO: 80668 - DNA, 25 bp, Mus musculus
caaccacatttgactctcaggatag

SEQ ID NO: 80669 - DNA, 25 bp, Mus musculus
caaccacgagttaggctggaaggat

SEQ ID NO: 80670 - DNA, 25 bp, Mus musculus
caaccagaaaaatgggagcgtgcca

SEQ ID NO: 80671 - DNA, 25 bp, Mus musculus
caaccagacctcatggcgaaaagcc

SEQ ID NO: 80672 - DNA, 25 bp, Mus musculus
caaccagagagttaatgtgcgcagc

SEQ ID NO: 80673 - DNA, 25 bp, Mus musculus
caaccagagtgagatcgccatacag

SEQ ID NO: 80674 - DNA, 25 bp, Mus musculus
caaccagagtgagcaacctgagagg

SEQ ID NO: 80675 - DNA, 25 bp, Mus musculus
caaccagagtgaggttatgctgcgg

SEQ ID NO: 80676 - DNA, 25 bp, Mus musculus
caaccagatgtggactgcctagaac

SEQ ID NO: 80677 - DNA, 25 bp, Mus musculus
caaccagcccgggaagtttcagagg

SEQ ID NO: 80678 - DNA, 25 bp, Mus musculus
caaccagcgtcggaatgtgtgacat

SEQ ID NO: 80679 - DNA, 25 bp, Mus musculus
caaccaggagtctgcgagtaaccca

SEQ ID NO: 80680 - DNA, 25 bp, Mus musculus
caaccaggccagagggtggagtctc

SEQ ID NO: 80681 - DNA, 25 bp, Mus musculus
caaccaggcctgcaggtactcctgg

SEQ ID NO: 80682 - DNA, 25 bp, Mus musculus
caaccagggctatctctcagaggca

SEQ ID NO: 80683 - DNA, 25 bp, Mus musculus
caaccagtattgctcgtcgggccaa

SEQ ID NO: 80684 - DNA, 25 bp, Mus musculus
caaccagtgacgagatggtgcccgt

SEQ ID NO: 80685 - DNA, 25 bp, Mus musculus
caaccagtgggagagaaacgggctt

SEQ ID NO: 80686 - DNA, 25 bp, Mus musculus
caaccagtgggtgagctttgacgac

SEQ ID NO: 80687 - DNA, 25 bp, Mus musculus
caaccatattgcctctgaagactca

SEQ ID NO: 80688 - DNA, 25 bp, Mus musculus
caaccatcggaggagctaacactga

SEQ ID NO: 80689 - DNA, 25 bp, Mus musculus
caaccatggttcttcgggattctca

SEQ ID NO: 80690 - DNA, 25 bp, Mus musculus
caacccactgagatgtaatcctaca

SEQ ID NO: 80691 - DNA, 25 bp, Mus musculus
caacccagaggcaagaaattgagag

SEQ ID NO: 80692 - DNA, 25 bp, Mus musculus
caacccagaggtggtggtcgcagta

SEQ ID NO: 80693 - DNA, 25 bp, Mus musculus
caacccaggaaacacagcagtggct

SEQ ID NO: 80694 - DNA, 25 bp, Mus musculus
caacccagggcgatggcgtccgcga

SEQ ID NO: 80695 - DNA, 25 bp, Mus musculus
caacccatgtgagatggcactggac

SEQ ID NO: 80696 - DNA, 25 bp, Mus musculus
caaccccagcagaggagataggagg

SEQ ID NO: 80697 - DNA, 25 bp, Mus musculus
caaccccaggagatacactatgcca

SEQ ID NO: 80698 - DNA, 25 bp, Mus musculus
caaccccaggtgtatagtcccggag

SEQ ID NO: 80699 - DNA, 25 bp, Mus musculus
caaccccggccatgatgaatggaca

SEQ ID NO: 80700 - DNA, 25 bp, Mus musculus
caacccggacaaacagaaagacgct

SEQ ID NO: 80701 - DNA, 25 bp, Mus musculus
caaccctccgggatatagttctcaa

SEQ ID NO: 80702 - DNA, 25 bp, Mus musculus
caaccctctttgactgggaaggatc

SEQ ID NO: 80703 - DNA, 25 bp, Mus musculus
caaccctgaaagatgagaccggagc

SEQ ID NO: 80704 - DNA, 25 bp, Mus musculus
caaccctgccaagagagagaggcct

SEQ ID NO: 80705 - DNA, 25 bp, Mus musculus
caaccctggcgatttgggaggaaca

SEQ ID NO: 80706 - DNA, 25 bp, Mus musculus
caaccctggttttggcatgggaggc

SEQ ID NO: 80707 - DNA, 25 bp, Mus musculus
caaccctgtgccttgctggtgagca

SEQ ID NO: 80708 - DNA, 25 bp, Mus musculus
caacccttggctttgactgggagga

SEQ ID NO: 80709 - DNA, 25 bp, Mus musculus
caacccttggttatggagaaagtga

SEQ ID NO: 80710 - DNA, 25 bp, Mus musculus
caaccctttcggtgagacggaggat

SEQ ID NO: 80711 - DNA, 25 bp, Mus musculus
caaccgaagaaccttgagggctatg

SEQ ID NO: 80712 - DNA, 25 bp, Mus musculus
caaccgaatgatcagctgcatagca

SEQ ID NO: 80713 - DNA, 25 bp, Mus musculus
caaccgagggtggagatgcctgact

SEQ ID NO: 80714 - DNA, 25 bp, Mus musculus
caaccgattcttgaacccagatgga

SEQ ID NO: 80715 - DNA, 25 bp, Mus musculus
caaccgcagtgccttttgacatgat

SEQ ID NO: 80716 - DNA, 25 bp, Mus musculus
caaccgcatgctggccgacatgatg

SEQ ID NO: 80717 - DNA, 25 bp, Mus musculus
caaccgcatgttggacctgtattct

SEQ ID NO: 80718 - DNA, 25 bp, Mus musculus
caaccgccgcatgtgtatatccaga

SEQ ID NO: 80719 - DNA, 25 bp, Mus musculus
caaccgcctgtggatctgggagaag

SEQ ID NO: 80720 - DNA, 25 bp, Mus musculus
caaccgctatcgcaggctctgtgga

SEQ ID NO: 80721 - DNA, 25 bp, Mus musculus
caaccggacctacggacacttgctg

SEQ ID NO: 80722 - DNA, 25 bp, Mus musculus
caaccggagagctaatggcctctac

SEQ ID NO: 80723 - DNA, 25 bp, Mus musculus
caaccggagcttggattttaactgg

SEQ ID NO: 80724 - DNA, 25 bp, Mus musculus
caaccggagtcgtgatattcgcatc

SEQ ID NO: 80725 - DNA, 25 bp, Mus musculus
caaccggcaagggtagagcatacgc

SEQ ID NO: 80726 - DNA, 25 bp, Mus musculus
caaccggcagacctttgtgaagtca

SEQ ID NO: 80727 - DNA, 25 bp, Mus musculus
caaccggcggctgtttgaacaaaat

SEQ ID NO: 80728 - DNA, 25 bp, Mus musculus
caaccgggagttggcatttaaggct

SEQ ID NO: 80729 - DNA, 25 bp, Mus musculus
caaccgggtgttccgtgtcagtgta

SEQ ID NO: 80730 - DNA, 25 bp, Mus musculus
caaccggtggttctaagagaggaca

SEQ ID NO: 80731 - DNA, 25 bp, Mus musculus
caaccgtagaaccatggctgaccga

SEQ ID NO: 80732 - DNA, 25 bp, Mus musculus
caaccgtagtaaagtagatgacagc

SEQ ID NO: 80733 - DNA, 25 bp, Mus musculus
caaccgtctgtcagcaagtgggcac

SEQ ID NO: 80734 - DNA, 25 bp, Mus musculus
caaccgtgtgggtgaagcgttccac

SEQ ID NO: 80735 - DNA, 25 bp, Mus musculus
caacctacaggtggtgccattggaa

SEQ ID NO: 80736 - DNA, 25 bp, Mus musculus
caacctacggcatggctgatggaga

SEQ ID NO: 80737 - DNA, 25 bp, Mus musculus
caacctaggctcaggtgccttcgag

SEQ ID NO: 80738 - DNA, 25 bp, Mus musculus
caacctagtccgtgcctctgagagg

SEQ ID NO: 80739 - DNA, 25 bp, Mus musculus
caacctcagtgttgagcatgtacac

SEQ ID NO: 80740 - DNA, 25 bp, Mus musculus
caacctccagatgagtgaccgacag

SEQ ID NO: 80741 - DNA, 25 bp, Mus musculus
caacctcccaaatcaagtgtacaga

SEQ ID NO: 80742 - DNA, 25 bp, Mus musculus
caacctcgggtccagtgatcacgaa

SEQ ID NO: 80743 - DNA, 25 bp, Mus musculus
caacctctaggcgtgtacgacaggc

SEQ ID NO: 80744 - DNA, 25 bp, Mus musculus
caacctctgtgggaggcatctgact

SEQ ID NO: 80745 - DNA, 25 bp, Mus musculus
caacctcttccagtttgaattcaaa

SEQ ID NO: 80746 - DNA, 25 bp, Mus musculus
caacctcttgctggtcctggagaca

SEQ ID NO: 80747 - DNA, 25 bp, Mus musculus
caacctctttggagtgcaagtacaa

SEQ ID NO: 80748 - DNA, 25 bp, Mus musculus
caacctgagtccaacaggctggtca

SEQ ID NO: 80749 - DNA, 25 bp, Mus musculus
caacctgagtgaggtggaacaagcc

SEQ ID NO: 80750 - DNA, 25 bp, Mus musculus
caacctgatggtgctgggtggctcc

SEQ ID NO: 80751 - DNA, 25 bp, Mus musculus
caacctgcacgcctgggaaatgaag

SEQ ID NO: 80752 - DNA, 25 bp, Mus musculus
caacctgctgcacttggtgacgaag

SEQ ID NO: 80753 - DNA, 25 bp, Mus musculus
caacctggaacgaggacttcctgcc

SEQ ID NO: 80754 - DNA, 25 bp, Mus musculus
caacctggaaggtggctcacagcaa

SEQ ID NO: 80755 - DNA, 25 bp, Mus musculus
caacctggaattgttgcaagtggag

SEQ ID NO: 80756 - DNA, 25 bp, Mus musculus
caacctggacctagtggccaacagt

SEQ ID NO: 80757 - DNA, 25 bp, Mus musculus
caacctggagatggctgtcactatg

SEQ ID NO: 80758 - DNA, 25 bp, Mus musculus
caacctggagttgcactgtgcagcc

SEQ ID NO: 80759 - DNA, 25 bp, Mus musculus
caacctggatgctgtggcgctgaag

SEQ ID NO: 80760 - DNA, 25 bp, Mus musculus
caacctggatgtacttggcaaatac

SEQ ID NO: 80761 - DNA, 25 bp, Mus musculus
caacctggccaaggagcttgagaaa

SEQ ID NO: 80762 - DNA, 25 bp, Mus musculus
caacctggccgaagcagtagagggc

SEQ ID NO: 80763 - DNA, 25 bp, Mus musculus
caacctggctttgggtcagaaccga

SEQ ID NO: 80764 - DNA, 25 bp, Mus musculus
caacctgggtgaatactggatcgag

SEQ ID NO: 80765 - DNA, 25 bp, Mus musculus
caacctggtcagagactggagacag

SEQ ID NO: 80766 - DNA, 25 bp, Mus musculus
caacctggtgttggacgatggcgct

SEQ ID NO: 80767 - DNA, 25 bp, Mus musculus
caacctgtcagttgcgtcggaaaga

SEQ ID NO: 80768 - DNA, 25 bp, Mus musculus
caacctgtctagtgggaaatcagcc

SEQ ID NO: 80769 - DNA, 25 bp, Mus musculus
caacctgtgaactgtaaataggccc

SEQ ID NO: 80770 - DNA, 25 bp, Mus musculus
caacctgtgcctcaaaagtttcaaa

SEQ ID NO: 80771 - DNA, 25 bp, Mus musculus
caacctgtggctttcgatgctgtgc

SEQ ID NO: 80772 - DNA, 25 bp, Mus musculus
caacctgtggttcacgagaaaaagt

SEQ ID NO: 80773 - DNA, 25 bp, Mus musculus
caacctgtgtgagacctgtgatagc

SEQ ID NO: 80774 - DNA, 25 bp, Mus musculus
caacctgtgtgagtcaggagcgcac

SEQ ID NO: 80775 - DNA, 25 bp, Mus musculus
caacctgtgtgtcatcggtggcgac

SEQ ID NO: 80776 - DNA, 25 bp, Mus musculus
caacctgttagaaaatgcctggctc

SEQ ID NO: 80777 - DNA, 25 bp, Mus musculus
caaccttcgagggagtggcgtccat

SEQ ID NO: 80778 - DNA, 25 bp, Mus musculus
caaccttcgctatggcatggagacc

SEQ ID NO: 80779 - DNA, 25 bp, Mus musculus
caaccttcgggagacatggacaacc

SEQ ID NO: 80780 - DNA, 25 bp, Mus musculus
caaccttgacccaagcatgcaaggc

SEQ ID NO: 80781 - DNA, 25 bp, Mus musculus
caaccttggactggaactggcagct

SEQ ID NO: 80782 - DNA, 25 bp, Mus musculus
caaccttggcaaatggagaccgcag

SEQ ID NO: 80783 - DNA, 25 bp, Mus musculus
caaccttggcattcagagaagccta

SEQ ID NO: 80784 - DNA, 25 bp, Mus musculus
caaccttgggcaagacgccgatgag

SEQ ID NO: 80785 - DNA, 25 bp, Mus musculus
caaccttgtggcagggaggacaaca

SEQ ID NO: 80786 - DNA, 25 bp, Mus musculus
caacctttggcaccgcatctatgag

SEQ ID NO: 80787 - DNA, 25 bp, Mus musculus
caacgaacctccaaagacatttact

SEQ ID NO: 80788 - DNA, 25 bp, Mus musculus
caacgaactgtcatggatattggct

SEQ ID NO: 80789 - DNA, 25 bp, Mus musculus
caacgaagaaacacgggagaaggct

SEQ ID NO: 80790 - DNA, 25 bp, Mus musculus
caacgaaggctgacgataagtgctc

SEQ ID NO: 80791 - DNA, 25 bp, Mus musculus
caacgaagggcacgaagagaagcct

SEQ ID NO: 80792 - DNA, 25 bp, Mus musculus
caacgaaggtgatgttgcagcggaa

SEQ ID NO: 80793 - DNA, 25 bp, Mus musculus
caacgaatggctgggaatcaagaac

SEQ ID NO: 80794 - DNA, 25 bp, Mus musculus
caacgaccagcataccagggtagca

SEQ ID NO: 80795 - DNA, 25 bp, Mus musculus
caacgaccatcagttcagagactca

SEQ ID NO: 80796 - DNA, 25 bp, Mus musculus
caacgaccccgaggatgagagtaag

SEQ ID NO: 80797 - DNA, 25 bp, Mus musculus
caacgacctcaggtttgtcgggcgg

SEQ ID NO: 80798 - DNA, 25 bp, Mus musculus
caacgacgtagcaggagaaatagat

SEQ ID NO: 80799 - DNA, 25 bp, Mus musculus
caacgacgtctttctgctgcggact

SEQ ID NO: 80800 - DNA, 25 bp, Mus musculus
caacgactgagaaatacagagctgg

SEQ ID NO: 80801 - DNA, 25 bp, Mus musculus
caacgagaagctgcactacgaggtc

SEQ ID NO: 80802 - DNA, 25 bp, Mus musculus
caacgagaagctggatatggtcaag

SEQ ID NO: 80803 - DNA, 25 bp, Mus musculus
caacgagaagctgtgaatagcggct

SEQ ID NO: 80804 - DNA, 25 bp, Mus musculus
caacgagatcgagctcagaggcgaa

SEQ ID NO: 80805 - DNA, 25 bp, Mus musculus
caacgagatggcagaagacctgtgc

SEQ ID NO: 80806 - DNA, 25 bp, Mus musculus
caacgaggactatgaccgacgcaat

SEQ ID NO: 80807 - DNA, 25 bp, Mus musculus
caacgagtaagctgggaagacgctc

SEQ ID NO: 80808 - DNA, 25 bp, Mus musculus
caacgatcaagatgagctggtagcc

SEQ ID NO: 80809 - DNA, 25 bp, Mus musculus
caacgatcctatttgtaccctagac

SEQ ID NO: 80810 - DNA, 25 bp, Mus musculus
caacgatgacagtttgcaccgggcc

SEQ ID NO: 80811 - DNA, 25 bp, Mus musculus
caacgatgtagccatgttcctagag

SEQ ID NO: 80812 - DNA, 25 bp, Mus musculus
caacgcaacgagttggaggctctgg

SEQ ID NO: 80813 - DNA, 25 bp, Mus musculus
caacgcagcttcaggatggataccc

SEQ ID NO: 80814 - DNA, 25 bp, Mus musculus
caacgccattggagaggctcagtcc

SEQ ID NO: 80815 - DNA, 25 bp, Mus musculus
caacgcccagctagacaatgagaag

SEQ ID NO: 80816 - DNA, 25 bp, Mus musculus
caacgccggatacagctggagatgc

SEQ ID NO: 80817 - DNA, 25 bp, Mus musculus
caacgccgtggactcctattggaaa

SEQ ID NO: 80818 - DNA, 25 bp, Mus musculus
caacgcctttgagcacggtggtgag

SEQ ID NO: 80819 - DNA, 25 bp, Mus musculus
caacgcgggcccagtttgaaacact

SEQ ID NO: 80820 - DNA, 25 bp, Mus musculus
caacgctatcatggggagtggcatc

SEQ ID NO: 80821 - DNA, 25 bp, Mus musculus
caacgctatggtagtgggcgccgaa

SEQ ID NO: 80822 - DNA, 25 bp, Mus musculus
caacgctcccgcctgtgaatagtag

SEQ ID NO: 80823 - DNA, 25 bp, Mus musculus
caacgcttcacagcacgggatgagt

SEQ ID NO: 80824 - DNA, 25 bp, Mus musculus
caacggaacacacatcgcagtgcag

SEQ ID NO: 80825 - DNA, 25 bp, Mus musculus
caacggaaggtcatctgcctgctca

SEQ ID NO: 80826 - DNA, 25 bp, Mus musculus
caacggagacggatcgcagcgagct

SEQ ID NO: 80827 - DNA, 25 bp, Mus musculus
caacggagatgaatgtctttcggga

SEQ ID NO: 80828 - DNA, 25 bp, Mus musculus
caacggatacatcagctgcaatgag

SEQ ID NO: 80829 - DNA, 25 bp, Mus musculus
caacggatatgtgcgggatgagaca

SEQ ID NO: 80830 - DNA, 25 bp, Mus musculus
caacggatcaactttggtctctcaa

SEQ ID NO: 80831 - DNA, 25 bp, Mus musculus
caacggcaaaggcaaggactgcgta

SEQ ID NO: 80832 - DNA, 25 bp, Mus musculus
caacggcaacgccaagaagtgggct

SEQ ID NO: 80833 - DNA, 25 bp, Mus musculus
caacggcaaggctggcactgtgaat

SEQ ID NO: 80834 - DNA, 25 bp, Mus musculus
caacggcagcctttaacagttgagc

SEQ ID NO: 80835 - DNA, 25 bp, Mus musculus
caacggccgaggtgatagcttggct

SEQ ID NO: 80836 - DNA, 25 bp, Mus musculus
caacggctggtggttgaggccttct

SEQ ID NO: 80837 - DNA, 25 bp, Mus musculus
caacggctgttgaatgagggccaga

SEQ ID NO: 80838 - DNA, 25 bp, Mus musculus
caacggcttcgctgtgaattggaca

SEQ ID NO: 80839 - DNA, 25 bp, Mus musculus
caacgggaagacatctgggaaggca

SEQ ID NO: 80840 - DNA, 25 bp, Mus musculus
caacgggactgtgctcaagagtaca

SEQ ID NO: 80841 - DNA, 25 bp, Mus musculus
caacgggagcagactgaataccaga

SEQ ID NO: 80842 - DNA, 25 bp, Mus musculus
caacgggagggattacctggagcac

SEQ ID NO: 80843 - DNA, 25 bp, Mus musculus
caacgggcactccactgactggcat

SEQ ID NO: 80844 - DNA, 25 bp, Mus musculus
caacgggctgatgacaaagtgcttc

SEQ ID NO: 80845 - DNA, 25 bp, Mus musculus
caacgggcttcctgtggagctgaac

SEQ ID NO: 80846 - DNA, 25 bp, Mus musculus
caacgggcttgtgcagactacaggc

SEQ ID NO: 80847 - DNA, 25 bp, Mus musculus
caacgggttctaggctgctggcagc

SEQ ID NO: 80848 - DNA, 25 bp, Mus musculus
caacggtctacggtggcatccatga

SEQ ID NO: 80849 - DNA, 25 bp, Mus musculus
caacggtggcacatgctatgacagc

SEQ ID NO: 80850 - DNA, 25 bp, Mus musculus
caacggtgtcaactacaagatcgga

SEQ ID NO: 80851 - DNA, 25 bp, Mus musculus
caacggtgttgccatctttgaatcg

SEQ ID NO: 80852 - DNA, 25 bp, Mus musculus
caacggttccttcgacagcatgtgg

SEQ ID NO: 80853 - DNA, 25 bp, Mus musculus
caacgtagaagatggtgttccacga

SEQ ID NO: 80854 - DNA, 25 bp, Mus musculus
caacgtatctggaattcattcagca

SEQ ID NO: 80855 - DNA, 25 bp, Mus musculus
caacgtcagcttgcagatgggcagc

SEQ ID NO: 80856 - DNA, 25 bp, Mus musculus
caacgtcatgctgaatggctcggag

SEQ ID NO: 80857 - DNA, 25 bp, Mus musculus
caacgtcccatggagcttgaagctg

SEQ ID NO: 80858 - DNA, 25 bp, Mus musculus
caacgtccgaaccaagctggatgag

SEQ ID NO: 80859 - DNA, 25 bp, Mus musculus
caacgtccgtaggtcacatttggca

SEQ ID NO: 80860 - DNA, 25 bp, Mus musculus
caacgtcctggtggaggatggctcc

SEQ ID NO: 80861 - DNA, 25 bp, Mus musculus
caacgtgaccaaaaccgaatgttgc

SEQ ID NO: 80862 - DNA, 25 bp, Mus musculus
caacgtgagtgactatgagggccct

SEQ ID NO: 80863 - DNA, 25 bp, Mus musculus
caacgtgatcacattccttccgagg

SEQ ID NO: 80864 - DNA, 25 bp, Mus musculus
caacgtgcagaaatgtctccccagg

SEQ ID NO: 80865 - DNA, 25 bp, Mus musculus
caacgtgccgctagtgggctgtaca

SEQ ID NO: 80866 - DNA, 25 bp, Mus musculus
caacgtgctgaaaggggtgcttata

SEQ ID NO: 80867 - DNA, 25 bp, Mus musculus
caacgtgctgaatgtagactaccgc

SEQ ID NO: 80868 - DNA, 25 bp, Mus musculus
caacgtgctggatcgaaatgtccat

SEQ ID NO: 80869 - DNA, 25 bp, Mus musculus
caacgtgctggttctggatggcgtc

SEQ ID NO: 80870 - DNA, 25 bp, Mus musculus
caacgtgctgtatatcgagtcccca

SEQ ID NO: 80871 - DNA, 25 bp, Mus musculus
caacgtggaggaatgctaccgctac

SEQ ID NO: 80872 - DNA, 25 bp, Mus musculus
caacgtggatgaggttgagacagac

SEQ ID NO: 80873 - DNA, 25 bp, Mus musculus
caacgtgggttgcatacccaagaag

SEQ ID NO: 80874 - DNA, 25 bp, Mus musculus
caacgttctcatggcttaggaggct

SEQ ID NO: 80875 - DNA, 25 bp, Mus musculus
caacgttgatggcacgcagaggact

SEQ ID NO: 80876 - DNA, 25 bp, Mus musculus
caacgttggtcctttgagggtggca

SEQ ID NO: 80877 - DNA, 25 bp, Mus musculus
caacgttgtgtgcttcaccaggcat

SEQ ID NO: 80878 - DNA, 25 bp, Mus musculus
caacgtttagatcccgaaatcggct

SEQ ID NO: 80879 - DNA, 25 bp, Mus musculus
caactaacaggtgctctggaaccga

SEQ ID NO: 80880 - DNA, 25 bp, Mus musculus
caactaaggagtgatgagagctgag

SEQ ID NO: 80881 - DNA, 25 bp, Mus musculus
caactaatgggagtgcgtctgggaa

SEQ ID NO: 80882 - DNA, 25 bp, Mus musculus
caactacagtgtgctgcgggacctt

SEQ ID NO: 80883 - DNA, 25 bp, Mus musculus
caactacgacagaggaaatggagta

SEQ ID NO: 80884 - DNA, 25 bp, Mus musculus
caactacgagctggcctggaagtac

SEQ ID NO: 80885 - DNA, 25 bp, Mus musculus
caactacgaggaggacttaacctgc

SEQ ID NO: 80886 - DNA, 25 bp, Mus musculus
caactacgatgcaggtctccatggc

SEQ ID NO: 80887 - DNA, 25 bp, Mus musculus
caactacggaatggtcaggagcacg

SEQ ID NO: 80888 - DNA, 25 bp, Mus musculus
caactacgtggtcatgcaattgcag

SEQ ID NO: 80889 - DNA, 25 bp, Mus musculus
caactactcgctgatggagaacgga

SEQ ID NO: 80890 - DNA, 25 bp, Mus musculus
caactactggatgccttgccgaaaa

SEQ ID NO: 80891 - DNA, 25 bp, Mus musculus
caactagaatgctgtggcaggcact

SEQ ID NO: 80892 - DNA, 25 bp, Mus musculus
caactagtagcggaatggaggctgc

SEQ ID NO: 80893 - DNA, 25 bp, Mus musculus
caactagtggagatgacgggcctca

SEQ ID NO: 80894 - DNA, 25 bp, Mus musculus
caactagttactaatgcacaaggac

SEQ ID NO: 80895 - DNA, 25 bp, Mus musculus
caactatcaagtgcggtatcggccg

SEQ ID NO: 80896 - DNA, 25 bp, Mus musculus
caactatgacgcagaggagagagac

SEQ ID NO: 80897 - DNA, 25 bp, Mus musculus
caactatgagtttccagatccagag

SEQ ID NO: 80898 - DNA, 25 bp, Mus musculus
caactatgatagctcggtgaggccg

SEQ ID NO: 80899 - DNA, 25 bp, Mus musculus
caactatggcgaaatgggacaaacc

SEQ ID NO: 80900 - DNA, 25 bp, Mus musculus
caactatggctgcttggacaactgg

SEQ ID NO: 80901 - DNA, 25 bp, Mus musculus
caactatgggtgtgatctggacgcg

SEQ ID NO: 80902 - DNA, 25 bp, Mus musculus
caactatgtccagaagcgtgagggt

SEQ ID NO: 80903 - DNA, 25 bp, Mus musculus
caactattgatgaggtagaaacaga

SEQ ID NO: 80904 - DNA, 25 bp, Mus musculus
caactattgtctaaatgcccatgga

SEQ ID NO: 80905 - DNA, 25 bp, Mus musculus
caactcatgggtgtacaagctgctg

SEQ ID NO: 80906 - DNA, 25 bp, Mus musculus
caactcatttcctgagagggccctg

SEQ ID NO: 80907 - DNA, 25 bp, Mus musculus
caactccagctattgagtcgtgaga

SEQ ID NO: 80908 - DNA, 25 bp, Mus musculus
caactccgggctatgaacagagcag

SEQ ID NO: 80909 - DNA, 25 bp, Mus musculus
caactccggtgcacgaattccaaaa

SEQ ID NO: 80910 - DNA, 25 bp, Mus musculus
caactcctcatgaatgaactgggcc

SEQ ID NO: 80911 - DNA, 25 bp, Mus musculus
caactcctgagacggaatgagacag

SEQ ID NO: 80912 - DNA, 25 bp, Mus musculus
caactcgaagtggaacagctgctgg

SEQ ID NO: 80913 - DNA, 25 bp, Mus musculus
caactcggacaggagggcctatgct

SEQ ID NO: 80914 - DNA, 25 bp, Mus musculus
caactcggtggagaaacctgtgtcc

SEQ ID NO: 80915 - DNA, 25 bp, Mus musculus
caactcgtttgtagggacgcgctcc

SEQ ID NO: 80916 - DNA, 25 bp, Mus musculus
caactctaatccgtgagaaaagaca

SEQ ID NO: 80917 - DNA, 25 bp, Mus musculus
caactctaggtggtacaaggacggc

SEQ ID NO: 80918 - DNA, 25 bp, Mus musculus
caactctgaacctgtgggctggatt

SEQ ID NO: 80919 - DNA, 25 bp, Mus musculus
caactctgacatcgtgcacgtggag

SEQ ID NO: 80920 - DNA, 25 bp, Mus musculus
caactctgggaacctagctgaaatc

SEQ ID NO: 80921 - DNA, 25 bp, Mus musculus
caactctgtgagtggtgactgtcag

SEQ ID NO: 80922 - DNA, 25 bp, Mus musculus
caactgaatcgccacctagcctggt

SEQ ID NO: 80923 - DNA, 25 bp, Mus musculus
caactgacaaggatggactacgcca

SEQ ID NO: 80924 - DNA, 25 bp, Mus musculus
caactgagaaaagaatgctactacc

SEQ ID NO: 80925 - DNA, 25 bp, Mus musculus
caactgagaagggaaaaggagctcc

SEQ ID NO: 80926 - DNA, 25 bp, Mus musculus
caactgagagggtcttcctgggccc

SEQ ID NO: 80927 - DNA, 25 bp, Mus musculus
caactgagcagccatgagacggcaa

SEQ ID NO: 80928 - DNA, 25 bp, Mus musculus
caactgagccaaagacagactggtt

SEQ ID NO: 80929 - DNA, 25 bp, Mus musculus
caactgatcatccagaaggataagg

SEQ ID NO: 80930 - DNA, 25 bp, Mus musculus
caactgatgcactaacacggaaaag

SEQ ID NO: 80931 - DNA, 25 bp, Mus musculus
caactgcaagaggacattcggtgcc

SEQ ID NO: 80932 - DNA, 25 bp, Mus musculus
caactgcagagcattttcgaggagg

SEQ ID NO: 80933 - DNA, 25 bp, Mus musculus
caactgcagaggtccaactccagag

SEQ ID NO: 80934 - DNA, 25 bp, Mus musculus
caactgcagcgtcatatctcaggat

SEQ ID NO: 80935 - DNA, 25 bp, Mus musculus
caactgcagttgtgaatccaaggga

SEQ ID NO: 80936 - DNA, 25 bp, Mus musculus
caactgccagatctgtgggacccag

SEQ ID NO: 80937 - DNA, 25 bp, Mus musculus
caactgcctacacccagagtgggac

SEQ ID NO: 80938 - DNA, 25 bp, Mus musculus
caactgcgcacgagtgctgcaggag

SEQ ID NO: 80939 - DNA, 25 bp, Mus musculus
caactgcgggaccaaggctttctag

SEQ ID NO: 80940 - DNA, 25 bp, Mus musculus
caactgcgggacgtgattgaatctc

SEQ ID NO: 80941 - DNA, 25 bp, Mus musculus
caactgctcaggtgtctacagggca

SEQ ID NO: 80942 - DNA, 25 bp, Mus musculus
caactgctccagctttgggatacaa

SEQ ID NO: 80943 - DNA, 25 bp, Mus musculus
caactgctctaactctgtgggaagc

SEQ ID NO: 80944 - DNA, 25 bp, Mus musculus
caactgcttcgtgttcggcgggtca

SEQ ID NO: 80945 - DNA, 25 bp, Mus musculus
caactggaaaattgcgtaaactgga

SEQ ID NO: 80946 - DNA, 25 bp, Mus musculus
caactggaacatggtgacgctctgc

SEQ ID NO: 80947 - DNA, 25 bp, Mus musculus
caactggaagcacagagtcttgcct

SEQ ID NO: 80948 - DNA, 25 bp, Mus musculus
caactggaagcgcattcgggagatc

SEQ ID NO: 80949 - DNA, 25 bp, Mus musculus
caactggaagttagacgtgagcacc

SEQ ID NO: 80950 - DNA, 25 bp, Mus musculus
caactggacactatctggagcgacc

SEQ ID NO: 80951 - DNA, 25 bp, Mus musculus
caactggacagagaacgaggagctc

SEQ ID NO: 80952 - DNA, 25 bp, Mus musculus
caactggagagatgtattagtctca

SEQ ID NO: 80953 - DNA, 25 bp, Mus musculus
caactggatcaatgtggaccctagc

SEQ ID NO: 80954 - DNA, 25 bp, Mus musculus
caactggatgccatgagtgacccca

SEQ ID NO: 80955 - DNA, 25 bp, Mus musculus
caactggcctgagtcggattaccca

SEQ ID NO: 80956 - DNA, 25 bp, Mus musculus
caactggctgcgaactgactggatc

SEQ ID NO: 80957 - DNA, 25 bp, Mus musculus
caactggctgcggacgggtttcatc

SEQ ID NO: 80958 - DNA, 25 bp, Mus musculus
caactggctgcggactaactggatt

SEQ ID NO: 80959 - DNA, 25 bp, Mus musculus
caactgggaaaaacgtctgcgatgt

SEQ ID NO: 80960 - DNA, 25 bp, Mus musculus
caactgggaacaagctgagggtgcc

SEQ ID NO: 80961 - DNA, 25 bp, Mus musculus
caactgggacaaatatcactcaaga

SEQ ID NO: 80962 - DNA, 25 bp, Mus musculus
caactgggacatgactgggtacggc

SEQ ID NO: 80963 - DNA, 25 bp, Mus musculus
caactgggctatgtgttggccacgc

SEQ ID NO: 80964 - DNA, 25 bp, Mus musculus
caactgggctctatccatgggagga

SEQ ID NO: 80965 - DNA, 25 bp, Mus musculus
caactggtatgctgtcctggctggg

SEQ ID NO: 80966 - DNA, 25 bp, Mus musculus
caactggtggaggagctacagagcc

SEQ ID NO: 80967 - DNA, 25 bp, Mus musculus
caactggttcaagtgtacccggcac

SEQ ID NO: 80968 - DNA, 25 bp, Mus musculus
caactgtaaatgtagccggccgggt

SEQ ID NO: 80969 - DNA, 25 bp, Mus musculus
caactgtcagcatgactttcaggct

SEQ ID NO: 80970 - DNA, 25 bp, Mus musculus
caactgtccatatgattacaaagca

SEQ ID NO: 80971 - DNA, 25 bp, Mus musculus
caactgtcggaggaaaatgcaaacc

SEQ ID NO: 80972 - DNA, 25 bp, Mus musculus
caactgtgaacactgatgggaagca

SEQ ID NO: 80973 - DNA, 25 bp, Mus musculus
caactgtgagcaaagggaccgctga

SEQ ID NO: 80974 - DNA, 25 bp, Mus musculus
caactgtgctctggatgtagtcggt

SEQ ID NO: 80975 - DNA, 25 bp, Mus musculus
caactgtgggcttcggtgatgtgac

SEQ ID NO: 80976 - DNA, 25 bp, Mus musculus
caactgtgtgcagctcgtgtctcag

SEQ ID NO: 80977 - DNA, 25 bp, Mus musculus
caactgttccatacaaagctgttct

SEQ ID NO: 80978 - DNA, 25 bp, Mus musculus
caactgtttctgcaactttgctgga

SEQ ID NO: 80979 - DNA, 25 bp, Mus musculus
caacttaaacacgtgctgcagacag

SEQ ID NO: 80980 - DNA, 25 bp, Mus musculus
caacttactctggaaatagccggca

SEQ ID NO: 80981 - DNA, 25 bp, Mus musculus
caacttataagggaaacatcgacac

SEQ ID NO: 80982 - DNA, 25 bp, Mus musculus
caacttatatacacaataggaatcc

SEQ ID NO: 80983 - DNA, 25 bp, Mus musculus
caacttatgcagaactgctgtgagg

SEQ ID NO: 80984 - DNA, 25 bp, Mus musculus
caacttcaaggagatatggccatca

SEQ ID NO: 80985 - DNA, 25 bp, Mus musculus
caacttcacccggagctgggtgagg

SEQ ID NO: 80986 - DNA, 25 bp, Mus musculus
caacttcatgaaggtgatcccggct

SEQ ID NO: 80987 - DNA, 25 bp, Mus musculus
caacttccatgagagctatccgtgc

SEQ ID NO: 80988 - DNA, 25 bp, Mus musculus
caacttccgcctgagtggtggacga

SEQ ID NO: 80989 - DNA, 25 bp, Mus musculus
caacttcgaattcccagtttcagcg

SEQ ID NO: 80990 - DNA, 25 bp, Mus musculus
caacttcgccatgttggttggcaga

SEQ ID NO: 80991 - DNA, 25 bp, Mus musculus
caacttcggagacaggaaatggcca

SEQ ID NO: 80992 - DNA, 25 bp, Mus musculus
caacttcggctacgatctgtaccgc

SEQ ID NO: 80993 - DNA, 25 bp, Mus musculus
caacttcgggaacacagtgcttggc

SEQ ID NO: 80994 - DNA, 25 bp, Mus musculus
caacttctgtgagatcgtagccgca

SEQ ID NO: 80995 - DNA, 25 bp, Mus musculus
caacttctgttgctctgtgggctca

SEQ ID NO: 80996 - DNA, 25 bp, Mus musculus
caacttcttcaggaactgggagacc

SEQ ID NO: 80997 - DNA, 25 bp, Mus musculus
caacttgaattggtggaaccaagtg

SEQ ID NO: 80998 - DNA, 25 bp, Mus musculus
caacttgatgaatcaagcaaggctc

SEQ ID NO: 80999 - DNA, 25 bp, Mus musculus
caacttgcagttgagcttcaaagca

SEQ ID NO: 81000 - DNA, 25 bp, Mus musculus
caacttgctgatagactctgccttc

SEQ ID NO: 81001 - DNA, 25 bp, Mus musculus
caacttggaccgttttcgctttgag

SEQ ID NO: 81002 - DNA, 25 bp, Mus musculus
caacttggagccttttgtgcagaag

SEQ ID NO: 81003 - DNA, 25 bp, Mus musculus
caacttggctttgtacgaggagtgg

SEQ ID NO: 81004 - DNA, 25 bp, Mus musculus
caacttgggaactgtggatgtccac

SEQ ID NO: 81005 - DNA, 25 bp, Mus musculus
caacttgggaggctggtatgacctt

SEQ ID NO: 81006 - DNA, 25 bp, Mus musculus
caacttgggccacttctcagagaac

SEQ ID NO: 81007 - DNA, 25 bp, Mus musculus
caacttgggttgttggatgtctgcc

SEQ ID NO: 81008 - DNA, 25 bp, Mus musculus
caacttgtaatcaaaggaagattcc

SEQ ID NO: 81009 - DNA, 25 bp, Mus musculus
caacttgtccagaggttcgtgagga

SEQ ID NO: 81010 - DNA, 25 bp, Mus musculus
caactttagctctggagatcatcaa

SEQ ID NO: 81011 - DNA, 25 bp, Mus musculus
caactttgaaaacgctgtggactat

SEQ ID NO: 81012 - DNA, 25 bp, Mus musculus
caactttgaagaaaagagcggcagt

SEQ ID NO: 81013 - DNA, 25 bp, Mus musculus
caactttgagatgtcggtcgtccag

SEQ ID NO: 81014 - DNA, 25 bp, Mus musculus
caactttgaggtgtgggaccattca

SEQ ID NO: 81015 - DNA, 25 bp, Mus musculus
caactttgagtatgccgtggagcgc

SEQ ID NO: 81016 - DNA, 25 bp, Mus musculus
caactttgtagggtggattctgacc

SEQ ID NO: 81017 - DNA, 25 bp, Mus musculus
caactttgtgcacagctggaccaac

SEQ ID NO: 81018 - DNA, 25 bp, Mus musculus
caactttttgagttcatgtggcaga

SEQ ID NO: 81019 - DNA, 25 bp, Mus musculus
caagaaaaagtggacgtgacgcata

SEQ ID NO: 81020 - DNA, 25 bp, Mus musculus
caagaaaacattaacaggtggttca

SEQ ID NO: 81021 - DNA, 25 bp, Mus musculus
caagaaaacttatgaccgggcgatt

SEQ ID NO: 81022 - DNA, 25 bp, Mus musculus
caagaaaatcgcaagaagcaagcgg

SEQ ID NO: 81023 - DNA, 25 bp, Mus musculus
caagaaacagtattatgatggtacc

SEQ ID NO: 81024 - DNA, 25 bp, Mus musculus
caagaaacatgctgggaaaagtccc

SEQ ID NO: 81025 - DNA, 25 bp, Mus musculus
caagaaacgagctacagactgggag

SEQ ID NO: 81026 - DNA, 25 bp, Mus musculus
caagaaacggctgattgaggacact

SEQ ID NO: 81027 - DNA, 25 bp, Mus musculus
caagaaagaactggcttatgtccca

SEQ ID NO: 81028 - DNA, 25 bp, Mus musculus
caagaaagatggagatatgactgca

SEQ ID NO: 81029 - DNA, 25 bp, Mus musculus
caagaaagcactgggagccaactgc

SEQ ID NO: 81030 - DNA, 25 bp, Mus musculus
caagaaaggaatgctcgctaccgac

SEQ ID NO: 81031 - DNA, 25 bp, Mus musculus
caagaaaggccaccctaagtatagg

SEQ ID NO: 81032 - DNA, 25 bp, Mus musculus
caagaaaggcgagcgagagtgtcac

SEQ ID NO: 81033 - DNA, 25 bp, Mus musculus
caagaaagtggtgtactccgtggtc

SEQ ID NO: 81034 - DNA, 25 bp, Mus musculus
caagaaatctgcattcaaactaggc

SEQ ID NO: 81035 - DNA, 25 bp, Mus musculus
caagaaatgcagttaccagcatgtc

SEQ ID NO: 81036 - DNA, 25 bp, Mus musculus
caagaaatggtatctagctcagtgt

SEQ ID NO: 81037 - DNA, 25 bp, Mus musculus
caagaaattgatgagggcagagacc

SEQ ID NO: 81038 - DNA, 25 bp, Mus musculus
caagaacaaggcaataggaggcgga

SEQ ID NO: 81039 - DNA, 25 bp, Mus musculus
caagaacaagtaggctccagcggcc

SEQ ID NO: 81040 - DNA, 25 bp, Mus musculus
caagaacacatcattgtggcccagg

SEQ ID NO: 81041 - DNA, 25 bp, Mus musculus
caagaacagatcctggtgcctgccc

SEQ ID NO: 81042 - DNA, 25 bp, Mus musculus
caagaacaggtccaagtcggaagag

SEQ ID NO: 81043 - DNA, 25 bp, Mus musculus
caagaacagtgggtgtccctccaaa

SEQ ID NO: 81044 - DNA, 25 bp, Mus musculus
caagaacatctttggcacacccgag

SEQ ID NO: 81045 - DNA, 25 bp, Mus musculus
caagaacatgaaaaggagcgcctca

SEQ ID NO: 81046 - DNA, 25 bp, Mus musculus
caagaacattggtgtggacaacccc

SEQ ID NO: 81047 - DNA, 25 bp, Mus musculus
caagaaccacaacatggcagaggcc

SEQ ID NO: 81048 - DNA, 25 bp, Mus musculus
caagaaccagaaggtgagcgggcca

SEQ ID NO: 81049 - DNA, 25 bp, Mus musculus
caagaaccaggaactggccgacgct

SEQ ID NO: 81050 - DNA, 25 bp, Mus musculus
caagaacccagattaccgtaagcga

SEQ ID NO: 81051 - DNA, 25 bp, Mus musculus
caagaacccaggagacaaggaagca

SEQ ID NO: 81052 - DNA, 25 bp, Mus musculus
caagaaccctgaaatgtgccgagta

SEQ ID NO: 81053 - DNA, 25 bp, Mus musculus
caagaaccgctacaaagatgtggta

SEQ ID NO: 81054 - DNA, 25 bp, Mus musculus
caagaaccgtgcgtgtggctgtttc

SEQ ID NO: 81055 - DNA, 25 bp, Mus musculus
caagaacctttgtcctcaagccagg

SEQ ID NO: 81056 - DNA, 25 bp, Mus musculus
caagaacgagaagcttgaatgggca

SEQ ID NO: 81057 - DNA, 25 bp, Mus musculus
caagaacgatttgctgacaggtcac

SEQ ID NO: 81058 - DNA, 25 bp, Mus musculus
caagaacgccaatgccgtcatggag

SEQ ID NO: 81059 - DNA, 25 bp, Mus musculus
caagaacggatacttgggcctgcaa

SEQ ID NO: 81060 - DNA, 25 bp, Mus musculus
caagaacggctctttgtgggaggca

SEQ ID NO: 81061 - DNA, 25 bp, Mus musculus
caagaactacgaggaggcactccgt

SEQ ID NO: 81062 - DNA, 25 bp, Mus musculus
caagaactatgtggaagtgacccga

SEQ ID NO: 81063 - DNA, 25 bp, Mus musculus
caagaactccaaaggcgaggtgtat

SEQ ID NO: 81064 - DNA, 25 bp, Mus musculus
caagaactcggctgatgtgaagggc

SEQ ID NO: 81065 - DNA, 25 bp, Mus musculus
caagaactctagtggctggaaggaa

SEQ ID NO: 81066 - DNA, 25 bp, Mus musculus
caagaactgtagcaacctgacggtg

SEQ ID NO: 81067 - DNA, 25 bp, Mus musculus
caagaacttctatggaggcaacggc

SEQ ID NO: 81068 - DNA, 25 bp, Mus musculus
caagaacttggtcgtgtgatacatc

SEQ ID NO: 81069 - DNA, 25 bp, Mus musculus
caagaactttataacgactgaagga

SEQ ID NO: 81070 - DNA, 25 bp, Mus musculus
caagaactttgaccttcggcctggt

SEQ ID NO: 81071 - DNA, 25 bp, Mus musculus
caagaagaacaacgtcatggcccgg

SEQ ID NO: 81072 - DNA, 25 bp, Mus musculus
caagaagaactacagggcagatggc

SEQ ID NO: 81073 - DNA, 25 bp, Mus musculus
caagaagacagacagcgatgtggac

SEQ ID NO: 81074 - DNA, 25 bp, Mus musculus
caagaagacatgttcgccaagctga

SEQ ID NO: 81075 - DNA, 25 bp, Mus musculus
caagaagacggaggtagtgatcaca

SEQ ID NO: 81076 - DNA, 25 bp, Mus musculus
caagaagactttgacggtggtatcc

SEQ ID NO: 81077 - DNA, 25 bp, Mus musculus
caagaagagactgacaggagactga

SEQ ID NO: 81078 - DNA, 25 bp, Mus musculus
caagaagagtttagtaaaggtcaga

SEQ ID NO: 81079 - DNA, 25 bp, Mus musculus
caagaagcaaagatcgggttggaag

SEQ ID NO: 81080 - DNA, 25 bp, Mus musculus
caagaagcacaatatgacccagagt

SEQ ID NO: 81081 - DNA, 25 bp, Mus musculus
caagaagcagctatctgggcaacgc

SEQ ID NO: 81082 - DNA, 25 bp, Mus musculus
caagaagccaccagctaaactgcag

SEQ ID NO: 81083 - DNA, 25 bp, Mus musculus
caagaagcccatctggtatgtgagt

SEQ ID NO: 81084 - DNA, 25 bp, Mus musculus
caagaagcctaggaaggacccaggt

SEQ ID NO: 81085 - DNA, 25 bp, Mus musculus
caagaagccttgtgagaatgtccca

SEQ ID NO: 81086 - DNA, 25 bp, Mus musculus
caagaagcctttcacgtgtgccact

SEQ ID NO: 81087 - DNA, 25 bp, Mus musculus
caagaagcgctgtttaagccccagg

SEQ ID NO: 81088 - DNA, 25 bp, Mus musculus
caagaagctgactcgctacctcaac

SEQ ID NO: 81089 - DNA, 25 bp, Mus musculus
caagaagctgcggttcaacatcaca

SEQ ID NO: 81090 - DNA, 25 bp, Mus musculus
caagaaggacgagtcgagctgttcc

SEQ ID NO: 81091 - DNA, 25 bp, Mus musculus
caagaaggaggctggtatcgtgctc

SEQ ID NO: 81092 - DNA, 25 bp, Mus musculus
caagaaggagtctaccgcgacgaat

SEQ ID NO: 81093 - DNA, 25 bp, Mus musculus
caagaaggccaaacgctttctgggc

SEQ ID NO: 81094 - DNA, 25 bp, Mus musculus
caagaaggccttgctcatccagggc

SEQ ID NO: 81095 - DNA, 25 bp, Mus musculus
caagaaggctcagtccgagttccct

SEQ ID NO: 81096 - DNA, 25 bp, Mus musculus
caagaaggctctggcgtttaaatgg

SEQ ID NO: 81097 - DNA, 25 bp, Mus musculus
caagaagggaaatgacaaccaaagg

SEQ ID NO: 81098 - DNA, 25 bp, Mus musculus
caagaagggagctctcaattgtgcc

SEQ ID NO: 81099 - DNA, 25 bp, Mus musculus
caagaaggtccatcgtccctggagg

SEQ ID NO: 81100 - DNA, 25 bp, Mus musculus
caagaaggtccgcaagtctctggct

SEQ ID NO: 81101 - DNA, 25 bp, Mus musculus
caagaaggtgcggttatcggctgcc

SEQ ID NO: 81102 - DNA, 25 bp, Mus musculus
caagaagtacaacgtgccggttcag

SEQ ID NO: 81103 - DNA, 25 bp, Mus musculus
caagaagtcagatggcggtgtcaag

SEQ ID NO: 81104 - DNA, 25 bp, Mus musculus
caagaagtccaaccccgttgtcagg

SEQ ID NO: 81105 - DNA, 25 bp, Mus musculus
caagaagtcgcgctccaagagctcc

SEQ ID NO: 81106 - DNA, 25 bp, Mus musculus
caagaagtcttgcaaacgccgggag

SEQ ID NO: 81107 - DNA, 25 bp, Mus musculus
caagaagtgacacggatgacggcac

SEQ ID NO: 81108 - DNA, 25 bp, Mus musculus
caagaagtgaggtgtccataccagg

SEQ ID NO: 81109 - DNA, 25 bp, Mus musculus
caagaagtgcggcatcacagtctcc

SEQ ID NO: 81110 - DNA, 25 bp, Mus musculus
caagaagtggcagaatgcacccaga

SEQ ID NO: 81111 - DNA, 25 bp, Mus musculus
caagaagttctaccagtgacaggcc

SEQ ID NO: 81112 - DNA, 25 bp, Mus musculus
caagaagttggccttaccgggatag

SEQ ID NO: 81113 - DNA, 25 bp, Mus musculus
caagaagttggtgtagcagctgtcc

SEQ ID NO: 81114 - DNA, 25 bp, Mus musculus
caagaagtttcatgttttgcgcagc

SEQ ID NO: 81115 - DNA, 25 bp, Mus musculus
caagaagtttcctggcataaggccc

SEQ ID NO: 81116 - DNA, 25 bp, Mus musculus
caagaagtttgtgcctactcaacag

SEQ ID NO: 81117 - DNA, 25 bp, Mus musculus
caagaagtttgttcgcactgacgag

SEQ ID NO: 81118 - DNA, 25 bp, Mus musculus
caagaatacaagtgcacaggcggca

SEQ ID NO: 81119 - DNA, 25 bp, Mus musculus
caagaatatcttcatcaatctgagg

SEQ ID NO: 81120 - DNA, 25 bp, Mus musculus
caagaatcacccattacatcaactg

SEQ ID NO: 81121 - DNA, 25 bp, Mus musculus
caagaatcactcagagggcggcgga

SEQ ID NO: 81122 - DNA, 25 bp, Mus musculus
caagaatccaatctggtcatggcca

SEQ ID NO: 81123 - DNA, 25 bp, Mus musculus
caagaatctttcacatgccaaggga

SEQ ID NO: 81124 - DNA, 25 bp, Mus musculus
caagaatgccgatggaactgtcaga

SEQ ID NO: 81125 - DNA, 25 bp, Mus musculus
caagaatgctacagatcccgaatcg

SEQ ID NO: 81126 - DNA, 25 bp, Mus musculus
caagaatggaatggttgccaagctc

SEQ ID NO: 81127 - DNA, 25 bp, Mus musculus
caagaatggcttgggctttggcaaa

SEQ ID NO: 81128 - DNA, 25 bp, Mus musculus
caagaatgtgggatgtgggacccct

SEQ ID NO: 81129 - DNA, 25 bp, Mus musculus
caagaatgtggtgtatgccatagcc

SEQ ID NO: 81130 - DNA, 25 bp, Mus musculus
caagaatgtggttctcgcacgagca

SEQ ID NO: 81131 - DNA, 25 bp, Mus musculus
caagaattaacacggaagctcccgg

SEQ ID NO: 81132 - DNA, 25 bp, Mus musculus
caagaattatatgtcgaccgcagat

SEQ ID NO: 81133 - DNA, 25 bp, Mus musculus
caagaattgtatggaggagacccca

SEQ ID NO: 81134 - DNA, 25 bp, Mus musculus
caagaattgttcctgggcacaagga

SEQ ID NO: 81135 - DNA, 25 bp, Mus musculus
caagaatttccgagtcagtgacggg

SEQ ID NO: 81136 - DNA, 25 bp, Mus musculus
caagaatttgagctggagatggaca

SEQ ID NO: 81137 - DNA, 25 bp, Mus musculus
caagaatttgctatggcgactggca

SEQ ID NO: 81138 - DNA, 25 bp, Mus musculus
caagacaaaaagaatgggcctgcca

SEQ ID NO: 81139 - DNA, 25 bp, Mus musculus
caagacaacctgatcgtggtggccg

SEQ ID NO: 81140 - DNA, 25 bp, Mus musculus
caagacaacgagctgatcacactgg

SEQ ID NO: 81141 - DNA, 25 bp, Mus musculus
caagacaaggcgtatcatggagcag

SEQ ID NO: 81142 - DNA, 25 bp, Mus musculus
caagacaagtttgcatgcagccagg

SEQ ID NO: 81143 - DNA, 25 bp, Mus musculus
caagacaccggccaagtgtgaggcc

SEQ ID NO: 81144 - DNA, 25 bp, Mus musculus
caagacacgtgtggcaagttgccct

SEQ ID NO: 81145 - DNA, 25 bp, Mus musculus
caagacactcagcagctcctcgagt

SEQ ID NO: 81146 - DNA, 25 bp, Mus musculus
caagacactccaactggcttcgctt

SEQ ID NO: 81147 - DNA, 25 bp, Mus musculus
caagacagctgtatatccatgcggc

SEQ ID NO: 81148 - DNA, 25 bp, Mus musculus
caagacagtggaggtagagtcttcc

SEQ ID NO: 81149 - DNA, 25 bp, Mus musculus
caagacataaagtcagccgggcctc

SEQ ID NO: 81150 - DNA, 25 bp, Mus musculus
caagacataaggaatggcgacccca

SEQ ID NO: 81151 - DNA, 25 bp, Mus musculus
caagacatggccgtgattgcaccca

SEQ ID NO: 81152 - DNA, 25 bp, Mus musculus
caagacattttacttaggcaagcac

SEQ ID NO: 81153 - DNA, 25 bp, Mus musculus
caagaccaactctgcccagtgggaa

SEQ ID NO: 81154 - DNA, 25 bp, Mus musculus
caagaccaataagaggcgtgggttc

SEQ ID NO: 81155 - DNA, 25 bp, Mus musculus
caagaccagattgctgagagcggct

SEQ ID NO: 81156 - DNA, 25 bp, Mus musculus
caagaccagcttcggcagattttga

SEQ ID NO: 81157 - DNA, 25 bp, Mus musculus
caagaccagttcaattgggaggacg

SEQ ID NO: 81158 - DNA, 25 bp, Mus musculus
caagaccatgaaaaagctgctgccg

SEQ ID NO: 81159 - DNA, 25 bp, Mus musculus
caagaccatgcgtatccgtatgaca

SEQ ID NO: 81160 - DNA, 25 bp, Mus musculus
caagaccatgttccggattccctgg

SEQ ID NO: 81161 - DNA, 25 bp, Mus musculus
caagacccgcagattggaagtatca

SEQ ID NO: 81162 - DNA, 25 bp, Mus musculus
caagaccctggagagtctcatcgag

SEQ ID NO: 81163 - DNA, 25 bp, Mus musculus
caagaccctgttagccgttggaggc

SEQ ID NO: 81164 - DNA, 25 bp, Mus musculus
caagaccgcgtagcggacatggcga

SEQ ID NO: 81165 - DNA, 25 bp, Mus musculus
caagacctactggacgctgtgtggg

SEQ ID NO: 81166 - DNA, 25 bp, Mus musculus
caagacctcagggttagaacaagcc

SEQ ID NO: 81167 - DNA, 25 bp, Mus musculus
caagacctgagctatggcaacacca

SEQ ID NO: 81168 - DNA, 25 bp, Mus musculus
caagacctgcaatgtagaactgctc

SEQ ID NO: 81169 - DNA, 25 bp, Mus musculus
caagacctggctggaagttaccacc

SEQ ID NO: 81170 - DNA, 25 bp, Mus musculus
caagacctgtgagtgtgatgaccgg

SEQ ID NO: 81171 - DNA, 25 bp, Mus musculus
caagaccttgcaatgctgagcccag

SEQ ID NO: 81172 - DNA, 25 bp, Mus musculus
caagaccttggaagagctggccaat

SEQ ID NO: 81173 - DNA, 25 bp, Mus musculus
caagacgagcctggtggaacgatac

SEQ ID NO: 81174 - DNA, 25 bp, Mus musculus
caagacgctgatgatgcgggacaac

SEQ ID NO: 81175 - DNA, 25 bp, Mus musculus
caagacggctttccagaagtgcaaa

SEQ ID NO: 81176 - DNA, 25 bp, Mus musculus
caagacgggctcagaacgtgtggcc

SEQ ID NO: 81177 - DNA, 25 bp, Mus musculus
caagacggtgctgttgctggccgac

SEQ ID NO: 81178 - DNA, 25 bp, Mus musculus
caagacgtactgttccacggtggca

SEQ ID NO: 81179 - DNA, 25 bp, Mus musculus
caagacgtgagagagctgttgcgac

SEQ ID NO: 81180 - DNA, 25 bp, Mus musculus
caagacgtgcgtggtgcagcgcttc

SEQ ID NO: 81181 - DNA, 25 bp, Mus musculus
caagacgtggcttctaaagtgttcc

SEQ ID NO: 81182 - DNA, 25 bp, Mus musculus
caagacgtggtacctcagctcacga

SEQ ID NO: 81183 - DNA, 25 bp, Mus musculus
caagacgtggtgtccaactatgaga

SEQ ID NO: 81184 - DNA, 25 bp, Mus musculus
caagacgtgtttgttttctgcacca

SEQ ID NO: 81185 - DNA, 25 bp, Mus musculus
caagactatcctattcctgggagac

SEQ ID NO: 81186 - DNA, 25 bp, Mus musculus
caagactattgtggaagcaccctca

SEQ ID NO: 81187 - DNA, 25 bp, Mus musculus
caagactcatcctgaggctcagcgg

SEQ ID NO: 81188 - DNA, 25 bp, Mus musculus
caagactcgaatgcacagctgataa

SEQ ID NO: 81189 - DNA, 25 bp, Mus musculus
caagactcgtatctgttcaagagga

SEQ ID NO: 81190 - DNA, 25 bp, Mus musculus
caagactgaatatctgatagcctgg

SEQ ID NO: 81191 - DNA, 25 bp, Mus musculus
caagactgacggctttaaaactttg

SEQ ID NO: 81192 - DNA, 25 bp, Mus musculus
caagactgagacatacgtggaggca

SEQ ID NO: 81193 - DNA, 25 bp, Mus musculus
caagactgcccagggtagatgaacc

SEQ ID NO: 81194 - DNA, 25 bp, Mus musculus
caagactggaaatgtgtgccggcct

SEQ ID NO: 81195 - DNA, 25 bp, Mus musculus
caagactggacaactgaaagtggag

SEQ ID NO: 81196 - DNA, 25 bp, Mus musculus
caagactgtcagttaagagcccaaa

SEQ ID NO: 81197 - DNA, 25 bp, Mus musculus
caagacttctcaatacacaacgaag

SEQ ID NO: 81198 - DNA, 25 bp, Mus musculus
caagacttcttggaaggacttcaca

SEQ ID NO: 81199 - DNA, 25 bp, Mus musculus
caagacttgaaatgcttagtgttca

SEQ ID NO: 81200 - DNA, 25 bp, Mus musculus
caagactttgtcaaatatgggcata

SEQ ID NO: 81201 - DNA, 25 bp, Mus musculus
caagagaaaaacgagcccaaggtgc

SEQ ID NO: 81202 - DNA, 25 bp, Mus musculus
caagagaaacgtgagagggctgaac

SEQ ID NO: 81203 - DNA, 25 bp, Mus musculus
caagagaagatctcggtcaagggac

SEQ ID NO: 81204 - DNA, 25 bp, Mus musculus
caagagaaggtcagctaaatggttc

SEQ ID NO: 81205 - DNA, 25 bp, Mus musculus
caagagaccagtgccaggatttcca

SEQ ID NO: 81206 - DNA, 25 bp, Mus musculus
caagagaccccagtgatgtagagcc

SEQ ID NO: 81207 - DNA, 25 bp, Mus musculus
caagagacggtagagtgcttacgca

SEQ ID NO: 81208 - DNA, 25 bp, Mus musculus
caagagagaagactggcaaggccta

SEQ ID NO: 81209 - DNA, 25 bp, Mus musculus
caagagagccgtagtctgcagctgc

SEQ ID NO: 81210 - DNA, 25 bp, Mus musculus
caagagagtgaacgtgtgtcgcaac

SEQ ID NO: 81211 - DNA, 25 bp, Mus musculus
caagagagtgtgagttttggtcctg

SEQ ID NO: 81212 - DNA, 25 bp, Mus musculus
caagagatcccatacgaagagagtg

SEQ ID NO: 81213 - DNA, 25 bp, Mus musculus
caagagatcgcagacgtcagcgtcc

SEQ ID NO: 81214 - DNA, 25 bp, Mus musculus
caagagatgaagggtctcctcacac

SEQ ID NO: 81215 - DNA, 25 bp, Mus musculus
caagagatgtacaaggaattcccgg

SEQ ID NO: 81216 - DNA, 25 bp, Mus musculus
caagagatgtcgatgcaaattcaac

SEQ ID NO: 81217 - DNA, 25 bp, Mus musculus
caagagattctcctatagtcgctac

SEQ ID NO: 81218 - DNA, 25 bp, Mus musculus
caagagattgacttcctgcaacagc

SEQ ID NO: 81219 - DNA, 25 bp, Mus musculus
caagagattgagtctgtcagcaccc

SEQ ID NO: 81220 - DNA, 25 bp, Mus musculus
caagagatttctcagtccatcggtg

SEQ ID NO: 81221 - DNA, 25 bp, Mus musculus
caagagcaagacgttttcagtggcg

SEQ ID NO: 81222 - DNA, 25 bp, Mus musculus
caagagcacaccgagggctattctt

SEQ ID NO: 81223 - DNA, 25 bp, Mus musculus
caagagcacagacatgaagtaccgg

SEQ ID NO: 81224 - DNA, 25 bp, Mus musculus
caagagcacccctagctcctgtaag

SEQ ID NO: 81225 - DNA, 25 bp, Mus musculus
caagagcaccttgtgtccactggat

SEQ ID NO: 81226 - DNA, 25 bp, Mus musculus
caagagcagagctttggagccaacg

SEQ ID NO: 81227 - DNA, 25 bp, Mus musculus
caagagcagatgtggacgttcaacc

SEQ ID NO: 81228 - DNA, 25 bp, Mus musculus
caagagcagttagagtcagcccgga

SEQ ID NO: 81229 - DNA, 25 bp, Mus musculus
caagagcatgtgcagtatgggatca

SEQ ID NO: 81230 - DNA, 25 bp, Mus musculus
caagagccactgcagttttcgcgga

SEQ ID NO: 81231 - DNA, 25 bp, Mus musculus
caagagcccagtaagagaatcccgt

SEQ ID NO: 81232 - DNA, 25 bp, Mus musculus
caagagcccgtttcttacgcagaga

SEQ ID NO: 81233 - DNA, 25 bp, Mus musculus
caagagccctttgcccaatttgagt

SEQ ID NO: 81234 - DNA, 25 bp, Mus musculus
caagagccgcaacatccagttcgag

SEQ ID NO: 81235 - DNA, 25 bp, Mus musculus
caagagcctcatctaccgtgacgtg

SEQ ID NO: 81236 - DNA, 25 bp, Mus musculus
caagagcctctatgagagcatcgag

SEQ ID NO: 81237 - DNA, 25 bp, Mus musculus
caagagcctggcaataatgactgag

SEQ ID NO: 81238 - DNA, 25 bp, Mus musculus
caagagcctggcgttttcacaagta

SEQ ID NO: 81239 - DNA, 25 bp, Mus musculus
caagagcgacatccaacgagagaag

SEQ ID NO: 81240 - DNA, 25 bp, Mus musculus
caagagcgcctctgtggtggagaca

SEQ ID NO: 81241 - DNA, 25 bp, Mus musculus
caagagcgggtcatgtttgcacagt

SEQ ID NO: 81242 - DNA, 25 bp, Mus musculus
caagagcggttgcttttaccagaag

SEQ ID NO: 81243 - DNA, 25 bp, Mus musculus
caagagcgtctatacaccgttagaa

SEQ ID NO: 81244 - DNA, 25 bp, Mus musculus
caagagctaatgtaaacggccaccc

SEQ ID NO: 81245 - DNA, 25 bp, Mus musculus
caagagctatgtcttccgagggacc

SEQ ID NO: 81246 - DNA, 25 bp, Mus musculus
caagagctctggaagaacatatgcc

SEQ ID NO: 81247 - DNA, 25 bp, Mus musculus
caagagctctttggcaccgtggtcc

SEQ ID NO: 81248 - DNA, 25 bp, Mus musculus
caagagctgacccaatggttgctga

SEQ ID NO: 81249 - DNA, 25 bp, Mus musculus
caagagctgattgaagacgggcagt

SEQ ID NO: 81250 - DNA, 25 bp, Mus musculus
caagagctgcacatgggaggcttca

SEQ ID NO: 81251 - DNA, 25 bp, Mus musculus
caagagctgcagtacgaatccctga

SEQ ID NO: 81252 - DNA, 25 bp, Mus musculus
caagagctgccgatgttcaatggaa

SEQ ID NO: 81253 - DNA, 25 bp, Mus musculus
caagagctggacttcgtcagccaca

SEQ ID NO: 81254 - DNA, 25 bp, Mus musculus
caagagctggatttctgaagatgac

SEQ ID NO: 81255 - DNA, 25 bp, Mus musculus
caagagctggcctcgattcaaggtt

SEQ ID NO: 81256 - DNA, 25 bp, Mus musculus
caagagctgtgggaagatcaacttc

SEQ ID NO: 81257 - DNA, 25 bp, Mus musculus
caagagctgtgtctgacgctagtgc

SEQ ID NO: 81258 - DNA, 25 bp, Mus musculus
caagagcttgtgtggtatgtaattc

SEQ ID NO: 81259 - DNA, 25 bp, Mus musculus
caagagctttcgcagagtgaggatc

SEQ ID NO: 81260 - DNA, 25 bp, Mus musculus
caagaggaacaagtccagcttggca

SEQ ID NO: 81261 - DNA, 25 bp, Mus musculus
caagaggaactacaaaccgccatgg

SEQ ID NO: 81262 - DNA, 25 bp, Mus musculus
caagaggaatgtgtgagtctgcacc

SEQ ID NO: 81263 - DNA, 25 bp, Mus musculus
caagaggacattgccaggattagca

SEQ ID NO: 81264 - DNA, 25 bp, Mus musculus
caagaggacctctctgttcaatgag

SEQ ID NO: 81265 - DNA, 25 bp, Mus musculus
caagaggaggtgtcagctgttatca

SEQ ID NO: 81266 - DNA, 25 bp, Mus musculus
caagaggattccacacagaactggg

SEQ ID NO: 81267 - DNA, 25 bp, Mus musculus
caagaggcacagagcaatccgagtc

SEQ ID NO: 81268 - DNA, 25 bp, Mus musculus
caagaggcagctcccttgagcgtcc

SEQ ID NO: 81269 - DNA, 25 bp, Mus musculus
caagaggcatttcagcagtgtgagc

SEQ ID NO: 81270 - DNA, 25 bp, Mus musculus
caagaggccagctcagatccatgca

SEQ ID NO: 81271 - DNA, 25 bp, Mus musculus
caagaggccctgtccaatgtgctga

SEQ ID NO: 81272 - DNA, 25 bp, Mus musculus
caagaggcctgcagaagtattggca

SEQ ID NO: 81273 - DNA, 25 bp, Mus musculus
caagagggagtatggcctagagacc

SEQ ID NO: 81274 - DNA, 25 bp, Mus musculus
caagagggccacacatcaaacagtg

SEQ ID NO: 81275 - DNA, 25 bp, Mus musculus
caagagggcgctctagacagacagc

SEQ ID NO: 81276 - DNA, 25 bp, Mus musculus
caagaggggaaatatgatgaataaa

SEQ ID NO: 81277 - DNA, 25 bp, Mus musculus
caagagggtacttccttgaacataa

SEQ ID NO: 81278 - DNA, 25 bp, Mus musculus
caagagggtggctaaaggacagtca

SEQ ID NO: 81279 - DNA, 25 bp, Mus musculus
caagaggtacattaaggcactggca

SEQ ID NO: 81280 - DNA, 25 bp, Mus musculus
caagagtactttgtggccgatgagg

SEQ ID NO: 81281 - DNA, 25 bp, Mus musculus
caagagtcactgaagccaactggga

SEQ ID NO: 81282 - DNA, 25 bp, Mus musculus
caagagtcagccgtttgtggaccac

SEQ ID NO: 81283 - DNA, 25 bp, Mus musculus
caagagtccgagctcacagctgtgg

SEQ ID NO: 81284 - DNA, 25 bp, Mus musculus
caagagtcgaaagaggatcatgcct

SEQ ID NO: 81285 - DNA, 25 bp, Mus musculus
caagagtcggaagagctgactgcta

SEQ ID NO: 81286 - DNA, 25 bp, Mus musculus
caagagtcttgctcagtgtgcctga

SEQ ID NO: 81287 - DNA, 25 bp, Mus musculus
caagagtgacattagcatcccgtgc

SEQ ID NO: 81288 - DNA, 25 bp, Mus musculus
caagagtgagatcgcccatcggtat

SEQ ID NO: 81289 - DNA, 25 bp, Mus musculus
caagagtgataatggtccaggatgc

SEQ ID NO: 81290 - DNA, 25 bp, Mus musculus
caagagtgccttggtaaagcctgtc

SEQ ID NO: 81291 - DNA, 25 bp, Mus musculus
caagagtgcgttccagtacgtcagc

SEQ ID NO: 81292 - DNA, 25 bp, Mus musculus
caagagtggatttagacacagcgca

SEQ ID NO: 81293 - DNA, 25 bp, Mus musculus
caagagtggtaaactggtttgagcc

SEQ ID NO: 81294 - DNA, 25 bp, Mus musculus
caagagttaccagtaccgtctaggc

SEQ ID NO: 81295 - DNA, 25 bp, Mus musculus
caagagttaccctatggtggctggg

SEQ ID NO: 81296 - DNA, 25 bp, Mus musculus
caagagttagaggagtacagagaca

SEQ ID NO: 81297 - DNA, 25 bp, Mus musculus
caagagttagctggccatggtgtgc

SEQ ID NO: 81298 - DNA, 25 bp, Mus musculus
caagagttcccagacctcaaaggca

SEQ ID NO: 81299 - DNA, 25 bp, Mus musculus
caagagttcctgcacagactgggca

SEQ ID NO: 81300 - DNA, 25 bp, Mus musculus
caagagttgatggacacccagggac

SEQ ID NO: 81301 - DNA, 25 bp, Mus musculus
caagagttgcatctggaaaggccct

SEQ ID NO: 81302 - DNA, 25 bp, Mus musculus
caagagttggagattagaggtcccc

SEQ ID NO: 81303 - DNA, 25 bp, Mus musculus
caagagtttccgatgcagctcgcac

SEQ ID NO: 81304 - DNA, 25 bp, Mus musculus
caagataaaagagaacaagcacccg

SEQ ID NO: 81305 - DNA, 25 bp, Mus musculus
caagataacgcgctgtggacacatt

SEQ ID NO: 81306 - DNA, 25 bp, Mus musculus
caagataacggacttcgggctgtgc

SEQ ID NO: 81307 - DNA, 25 bp, Mus musculus
caagatacctttatgatcagctggc

SEQ ID NO: 81308 - DNA, 25 bp, Mus musculus
caagatatctaatcctgggaagagc

SEQ ID NO: 81309 - DNA, 25 bp, Mus musculus
caagatattatctgggttccctaaa

SEQ ID NO: 81310 - DNA, 25 bp, Mus musculus
caagatatttactgcgggttggtcc

SEQ ID NO: 81311 - DNA, 25 bp, Mus musculus
caagatcaaagagcagctgatggct

SEQ ID NO: 81312 - DNA, 25 bp, Mus musculus
caagatcaagataacctaccgccgg

SEQ ID NO: 81313 - DNA, 25 bp, Mus musculus
caagatcaatgcctggacggctcag

SEQ ID NO: 81314 - DNA, 25 bp, Mus musculus
caagatcaattgctaccggaaagag

SEQ ID NO: 81315 - DNA, 25 bp, Mus musculus
caagatcaccagtgccgtctggggc

SEQ ID NO: 81316 - DNA, 25 bp, Mus musculus
caagatcagcaaaatcagtccagag

SEQ ID NO: 81317 - DNA, 25 bp, Mus musculus
caagatcatgagaaaaaactgaggc

SEQ ID NO: 81318 - DNA, 25 bp, Mus musculus
caagatccgattgttccggccggac

SEQ ID NO: 81319 - DNA, 25 bp, Mus musculus
caagatccgctgtgttctgatgcca

SEQ ID NO: 81320 - DNA, 25 bp, Mus musculus
caagatcctgaaggtcatccgcaag

SEQ ID NO: 81321 - DNA, 25 bp, Mus musculus
caagatccttgtggccactatggag

SEQ ID NO: 81322 - DNA, 25 bp, Mus musculus
caagatcgacactataaatgctaga

SEQ ID NO: 81323 - DNA, 25 bp, Mus musculus
caagatcgctaaggaggtggacccc

SEQ ID NO: 81324 - DNA, 25 bp, Mus musculus
caagatcgtgatcgccgttgtcaag

SEQ ID NO: 81325 - DNA, 25 bp, Mus musculus
caagatctccaacgtcaacaaggcc

SEQ ID NO: 81326 - DNA, 25 bp, Mus musculus
caagatctggatgcagcctgtgacc

SEQ ID NO: 81327 - DNA, 25 bp, Mus musculus
caagatctgtatgtccgcctcatag

SEQ ID NO: 81328 - DNA, 25 bp, Mus musculus
caagatctgttgaaagagcgccaaa

SEQ ID NO: 81329 - DNA, 25 bp, Mus musculus
caagatcttcaagccgtggaaatgg

SEQ ID NO: 81330 - DNA, 25 bp, Mus musculus
caagatcttcgaagagcagggccag

SEQ ID NO: 81331 - DNA, 25 bp, Mus musculus
caagatcttgctctcattgctcggg

SEQ ID NO: 81332 - DNA, 25 bp, Mus musculus
caagatgaaaggcaccgtccagaag

SEQ ID NO: 81333 - DNA, 25 bp, Mus musculus
caagatgaccatgctccaagagtgc

SEQ ID NO: 81334 - DNA, 25 bp, Mus musculus
caagatgagaccgtggctgacacca

SEQ ID NO: 81335 - DNA, 25 bp, Mus musculus
caagatgagactgaccctgaagcag

SEQ ID NO: 81336 - DNA, 25 bp, Mus musculus
caagatgagagtgcacaagatctcc

SEQ ID NO: 81337 - DNA, 25 bp, Mus musculus
caagatgagcaagctaaaagtggtg

SEQ ID NO: 81338 - DNA, 25 bp, Mus musculus
caagatgagcatttcaggaagcggc

SEQ ID NO: 81339 - DNA, 25 bp, Mus musculus
caagatgagcgataaaccagacttg

SEQ ID NO: 81340 - DNA, 25 bp, Mus musculus
caagatgagtatgacccaatggagg

SEQ ID NO: 81341 - DNA, 25 bp, Mus musculus
caagatgagttcagccgattcggca

SEQ ID NO: 81342 - DNA, 25 bp, Mus musculus
caagatgatgaaggcgcgagcatgc

SEQ ID NO: 81343 - DNA, 25 bp, Mus musculus
caagatgcattacctgctcagcaca

SEQ ID NO: 81344 - DNA, 25 bp, Mus musculus
caagatgcctggagttatgtgaccc

SEQ ID NO: 81345 - DNA, 25 bp, Mus musculus
caagatgcgttcgttgtgcaggagc

SEQ ID NO: 81346 - DNA, 25 bp, Mus musculus
caagatgctcactctgcgtagggag

SEQ ID NO: 81347 - DNA, 25 bp, Mus musculus
caagatgctcattcacatccggaca

SEQ ID NO: 81348 - DNA, 25 bp, Mus musculus
caagatgctgaatgcgagagagccc

SEQ ID NO: 81349 - DNA, 25 bp, Mus musculus
caagatgctgcagaacacctgggtc

SEQ ID NO: 81350 - DNA, 25 bp, Mus musculus
caagatgctgcagttgacagtcagg

SEQ ID NO: 81351 - DNA, 25 bp, Mus musculus
caagatgctgccaacctttgtccgg

SEQ ID NO: 81352 - DNA, 25 bp, Mus musculus
caagatgctgtaccatgccaggtgc

SEQ ID NO: 81353 - DNA, 25 bp, Mus musculus
caagatggagagctctgcagtcccc

SEQ ID NO: 81354 - DNA, 25 bp, Mus musculus
caagatggagcagcacactagtaac

SEQ ID NO: 81355 - DNA, 25 bp, Mus musculus
caagatggagggacaacagggacca

SEQ ID NO: 81356 - DNA, 25 bp, Mus musculus
caagatggatgatcaggaccctggg

SEQ ID NO: 81357 - DNA, 25 bp, Mus musculus
caagatggcaaacctagcagagggc

SEQ ID NO: 81358 - DNA, 25 bp, Mus musculus
caagatggcagaccagaacctggag

SEQ ID NO: 81359 - DNA, 25 bp, Mus musculus
caagatggcagcagcggtgttgcga

SEQ ID NO: 81360 - DNA, 25 bp, Mus musculus
caagatggcgttatcaaaccctagc

SEQ ID NO: 81361 - DNA, 25 bp, Mus musculus
caagatggctgcacagaactgccgc

SEQ ID NO: 81362 - DNA, 25 bp, Mus musculus
caagatggctgtattctgatcccac

SEQ ID NO: 81363 - DNA, 25 bp, Mus musculus
caagatgggctttatccaccgggac

SEQ ID NO: 81364 - DNA, 25 bp, Mus musculus
caagatggtcttcgaaacaggacag

SEQ ID NO: 81365 - DNA, 25 bp, Mus musculus
caagatggtgcctgttaacctaaac

SEQ ID NO: 81366 - DNA, 25 bp, Mus musculus
caagatgtatagcagccagcaggtg

SEQ ID NO: 81367 - DNA, 25 bp, Mus musculus
caagatgtccctcagaaagtgccag

SEQ ID NO: 81368 - DNA, 25 bp, Mus musculus
caagatgtccctggcgaacatctac

SEQ ID NO: 81369 - DNA, 25 bp, Mus musculus
caagatgtctataagcccaaggcgg

SEQ ID NO: 81370 - DNA, 25 bp, Mus musculus
caagatgtgtaccattcgaatgagc

SEQ ID NO: 81371 - DNA, 25 bp, Mus musculus
caagatgtgtatcatgtggtcaccc

SEQ ID NO: 81372 - DNA, 25 bp, Mus musculus
caagattaagccaatttgaatggga

SEQ ID NO: 81373 - DNA, 25 bp, Mus musculus
caagattaaggcttgtacgggctcc

SEQ ID NO: 81374 - DNA, 25 bp, Mus musculus
caagattatcccactgctgacagac

SEQ ID NO: 81375 - DNA, 25 bp, Mus musculus
caagattatctcgttggcaacaggc

SEQ ID NO: 81376 - DNA, 25 bp, Mus musculus
caagattcaaggctaccggtgggta

SEQ ID NO: 81377 - DNA, 25 bp, Mus musculus
caagattcactagtcggtccagata

SEQ ID NO: 81378 - DNA, 25 bp, Mus musculus
caagattcatccagcagggttaggg

SEQ ID NO: 81379 - DNA, 25 bp, Mus musculus
caagattcattgtcactgggacagc

SEQ ID NO: 81380 - DNA, 25 bp, Mus musculus
caagattcgggtctcagatggagcc

SEQ ID NO: 81381 - DNA, 25 bp, Mus musculus
caagattctatcacaagtaaccacc

SEQ ID NO: 81382 - DNA, 25 bp, Mus musculus
caagattcttgggatcccgtctggg

SEQ ID NO: 81383 - DNA, 25 bp, Mus musculus
caagattgcagcctgtgcccagtgt

SEQ ID NO: 81384 - DNA, 25 bp, Mus musculus
caagattgctaagtgtgtgtctaca

SEQ ID NO: 81385 - DNA, 25 bp, Mus musculus
caagattggcgaccgagttggcttc

SEQ ID NO: 81386 - DNA, 25 bp, Mus musculus
caagattgtaaggaaagctggcagt

SEQ ID NO: 81387 - DNA, 25 bp, Mus musculus
caagatttcctcagagctctccgga

SEQ ID NO: 81388 - DNA, 25 bp, Mus musculus
caagatttggagtccggcacctgct

SEQ ID NO: 81389 - DNA, 25 bp, Mus musculus
caagatttttcccaaagctgacgag

SEQ ID NO: 81390 - DNA, 25 bp, Mus musculus
caagcaaagtgtacggatgtcatcc

SEQ ID NO: 81391 - DNA, 25 bp, Mus musculus
caagcaaattctgtgcgaaaggctc

SEQ ID NO: 81392 - DNA, 25 bp, Mus musculus
caagcaacaacccttcccagggaga

SEQ ID NO: 81393 - DNA, 25 bp, Mus musculus
caagcaacagttgtccgagaagctg

SEQ ID NO: 81394 - DNA, 25 bp, Mus musculus
caagcaacccgtgagaaagcactgg

SEQ ID NO: 81395 - DNA, 25 bp, Mus musculus
caagcaactatggtgcgagatcgcc

SEQ ID NO: 81396 - DNA, 25 bp, Mus musculus
caagcaagaaatggccatggagtac

SEQ ID NO: 81397 - DNA, 25 bp, Mus musculus
caagcaagcagccagttgggttcat

SEQ ID NO: 81398 - DNA, 25 bp, Mus musculus
caagcaagcctacagaacgtgttca

SEQ ID NO: 81399 - DNA, 25 bp, Mus musculus
caagcaagcgtttcccaggcaggaa

SEQ ID NO: 81400 - DNA, 25 bp, Mus musculus
caagcaagctgatacgtgagtggca

SEQ ID NO: 81401 - DNA, 25 bp, Mus musculus
caagcaaggtctgaggctgggttcc

SEQ ID NO: 81402 - DNA, 25 bp, Mus musculus
caagcaagtggctcgagtagcagac

SEQ ID NO: 81403 - DNA, 25 bp, Mus musculus
caagcaagttgggtccatcggatgc

SEQ ID NO: 81404 - DNA, 25 bp, Mus musculus
caagcaatccacagttcaatgaagt

SEQ ID NO: 81405 - DNA, 25 bp, Mus musculus
caagcaattagaacgaggagaggcc

SEQ ID NO: 81406 - DNA, 25 bp, Mus musculus
caagcacattaagaagccgatccgc

SEQ ID NO: 81407 - DNA, 25 bp, Mus musculus
caagcaccaggagattcgagccatg

SEQ ID NO: 81408 - DNA, 25 bp, Mus musculus
caagcacccgtttgtggacagcaac

SEQ ID NO: 81409 - DNA, 25 bp, Mus musculus
caagcaccttcagcatgcatgcgga

SEQ ID NO: 81410 - DNA, 25 bp, Mus musculus
caagcaccttgttacctcagaggag

SEQ ID NO: 81411 - DNA, 25 bp, Mus musculus
caagcacctttgcattcggaatgaa

SEQ ID NO: 81412 - DNA, 25 bp, Mus musculus
caagcacgtgttgagtgggagccct

SEQ ID NO: 81413 - DNA, 25 bp, Mus musculus
caagcactagtggaggaagttctga

SEQ ID NO: 81414 - DNA, 25 bp, Mus musculus
caagcactatgagcttgtgcgggag

SEQ ID NO: 81415 - DNA, 25 bp, Mus musculus
caagcactgacgacaaaagttcgag

SEQ ID NO: 81416 - DNA, 25 bp, Mus musculus
caagcactgcaagcctgagtggcca

SEQ ID NO: 81417 - DNA, 25 bp, Mus musculus
caagcactgcatgttcacggatgtc

SEQ ID NO: 81418 - DNA, 25 bp, Mus musculus
caagcacttattaggtcaacaacac

SEQ ID NO: 81419 - DNA, 25 bp, Mus musculus
caagcacttccgcagctcagagagt

SEQ ID NO: 81420 - DNA, 25 bp, Mus musculus
caagcacttcgcagttgggtggcac

SEQ ID NO: 81421 - DNA, 25 bp, Mus musculus
caagcagaacgatgtggaaatccca

SEQ ID NO: 81422 - DNA, 25 bp, Mus musculus
caagcagaacttgtccttcaataag

SEQ ID NO: 81423 - DNA, 25 bp, Mus musculus
caagcagaagtatccggaacagcca

SEQ ID NO: 81424 - DNA, 25 bp, Mus musculus
caagcagaatccatcgcaaagtgag

SEQ ID NO: 81425 - DNA, 25 bp, Mus musculus
caagcagcacgaagtggagatccca

SEQ ID NO: 81426 - DNA, 25 bp, Mus musculus
caagcagcagtgactgaggcctaca

SEQ ID NO: 81427 - DNA, 25 bp, Mus musculus
caagcagcagttttgtcctcaggag

SEQ ID NO: 81428 - DNA, 25 bp, Mus musculus
caagcagccactgctggaggatggc

SEQ ID NO: 81429 - DNA, 25 bp, Mus musculus
caagcagccgttagtggtcagggca

SEQ ID NO: 81430 - DNA, 25 bp, Mus musculus
caagcagcctcacgttgttggagca

SEQ ID NO: 81431 - DNA, 25 bp, Mus musculus
caagcagctcaatctgtggtccacg

SEQ ID NO: 81432 - DNA, 25 bp, Mus musculus
caagcagctcggttctgtgcagaga

SEQ ID NO: 81433 - DNA, 25 bp, Mus musculus
caagcagctgaggttactaccacag

SEQ ID NO: 81434 - DNA, 25 bp, Mus musculus
caagcagctgcttcactgtatggcc

SEQ ID NO: 81435 - DNA, 25 bp, Mus musculus
caagcagctggacggagaaccctga

SEQ ID NO: 81436 - DNA, 25 bp, Mus musculus
caagcaggccaggacagtgctgaca

SEQ ID NO: 81437 - DNA, 25 bp, Mus musculus
caagcaggcgttaatcgagatccga

SEQ ID NO: 81438 - DNA, 25 bp, Mus musculus
caagcaggcttttggcgtcatgaac

SEQ ID NO: 81439 - DNA, 25 bp, Mus musculus
caagcaggtcatctccaagatcagg

SEQ ID NO: 81440 - DNA, 25 bp, Mus musculus
caagcaggtgatgtccgtggtccag

SEQ ID NO: 81441 - DNA, 25 bp, Mus musculus
caagcaggtttcctaccaagaggtc

SEQ ID NO: 81442 - DNA, 25 bp, Mus musculus
caagcaggttttcatgtagatttga

SEQ ID NO: 81443 - DNA, 25 bp, Mus musculus
caagcagtaaaagcagtgttcccag

SEQ ID NO: 81444 - DNA, 25 bp, Mus musculus
caagcagtagagtgggacggtttcc

SEQ ID NO: 81445 - DNA, 25 bp, Mus musculus
caagcagtatgacatctacgagcag

SEQ ID NO: 81446 - DNA, 25 bp, Mus musculus
caagcagtattattccatggcaggg

SEQ ID NO: 81447 - DNA, 25 bp, Mus musculus
caagcagtattgtggagtcccgtcg

SEQ ID NO: 81448 - DNA, 25 bp, Mus musculus
caagcagtccacatacagaagcgat

SEQ ID NO: 81449 - DNA, 25 bp, Mus musculus
caagcagtctgacaaggagtcgcag

SEQ ID NO: 81450 - DNA, 25 bp, Mus musculus
caagcagtgacagtgtggctcagac

SEQ ID NO: 81451 - DNA, 25 bp, Mus musculus
caagcagtgagatcacgcagttagc

SEQ ID NO: 81452 - DNA, 25 bp, Mus musculus
caagcagtgttccaagatggtcccc

SEQ ID NO: 81453 - DNA, 25 bp, Mus musculus
caagcagttgagagcccgttgagag

SEQ ID NO: 81454 - DNA, 25 bp, Mus musculus
caagcagttggtggaagacctggac

SEQ ID NO: 81455 - DNA, 25 bp, Mus musculus
caagcagttgttctacctggtcggg

SEQ ID NO: 81456 - DNA, 25 bp, Mus musculus
caagcatattgaccgtggttgcagc

SEQ ID NO: 81457 - DNA, 25 bp, Mus musculus
caagcatatttaaatttggcccaga

SEQ ID NO: 81458 - DNA, 25 bp, Mus musculus
caagcatctcaacgacgacgtggtc

SEQ ID NO: 81459 - DNA, 25 bp, Mus musculus
caagcatgaccctgacctggaaaag

SEQ ID NO: 81460 - DNA, 25 bp, Mus musculus
caagcatgaggctatgggccacact

SEQ ID NO: 81461 - DNA, 25 bp, Mus musculus
caagcatgatggctcaccaagaaag

SEQ ID NO: 81462 - DNA, 25 bp, Mus musculus
caagcatgcctttgagatcatccac

SEQ ID NO: 81463 - DNA, 25 bp, Mus musculus
caagcatgctaaaggcacaccaggt

SEQ ID NO: 81464 - DNA, 25 bp, Mus musculus
caagcatgctgttgcagtgatgacc

SEQ ID NO: 81465 - DNA, 25 bp, Mus musculus
caagcatgtctgtgtatgattacct

SEQ ID NO: 81466 - DNA, 25 bp, Mus musculus
caagcatgtgcgactctaaggacct

SEQ ID NO: 81467 - DNA, 25 bp, Mus musculus
caagcattggaagaatttagagaaa

SEQ ID NO: 81468 - DNA, 25 bp, Mus musculus
caagcattggacaaaagaggccaca

SEQ ID NO: 81469 - DNA, 25 bp, Mus musculus
caagcattggttaaagggacaccag

SEQ ID NO: 81470 - DNA, 25 bp, Mus musculus
caagcatttttccttttggtgagtg

SEQ ID NO: 81471 - DNA, 25 bp, Mus musculus
caagccaaaggtgcagtgctgtcag

SEQ ID NO: 81472 - DNA, 25 bp, Mus musculus
caagccaaggtattccagatgccga

SEQ ID NO: 81473 - DNA, 25 bp, Mus musculus
caagccacatgcagagatgccgatc

SEQ ID NO: 81474 - DNA, 25 bp, Mus musculus
caagccagcagtcgagatcaaacag

SEQ ID NO: 81475 - DNA, 25 bp, Mus musculus
caagccaggaatggttttatttttg

SEQ ID NO: 81476 - DNA, 25 bp, Mus musculus
caagccaggctgaccaagaagccaa

SEQ ID NO: 81477 - DNA, 25 bp, Mus musculus
caagccaggttgtgtagagtacagc

SEQ ID NO: 81478 - DNA, 25 bp, Mus musculus
caagccatagggagctctattggga

SEQ ID NO: 81479 - DNA, 25 bp, Mus musculus
caagccattaaagaagccagagacc

SEQ ID NO: 81480 - DNA, 25 bp, Mus musculus
caagccattctccaacaagcgagga

SEQ ID NO: 81481 - DNA, 25 bp, Mus musculus
caagcccaactttttcaccgacagg

SEQ ID NO: 81482 - DNA, 25 bp, Mus musculus
caagcccaaggtggagcagttgtcc

SEQ ID NO: 81483 - DNA, 25 bp, Mus musculus
caagcccagaaatgccttatgtgga

SEQ ID NO: 81484 - DNA, 25 bp, Mus musculus
caagcccagacagttggcagactaa

SEQ ID NO: 81485 - DNA, 25 bp, Mus musculus
caagcccagagttgaggtagagaca

SEQ ID NO: 81486 - DNA, 25 bp, Mus musculus
caagcccagcttttggagaccgacg

SEQ ID NO: 81487 - DNA, 25 bp, Mus musculus
caagcccaggaagcaatacaagatg

SEQ ID NO: 81488 - DNA, 25 bp, Mus musculus
caagcccagtgactgcggccgaaga

SEQ ID NO: 81489 - DNA, 25 bp, Mus musculus
caagcccagtgttcttggagggaca

SEQ ID NO: 81490 - DNA, 25 bp, Mus musculus
caagcccattggaccctgtgtcaca

SEQ ID NO: 81491 - DNA, 25 bp, Mus musculus
caagccccagaaggattagccagaa

SEQ ID NO: 81492 - DNA, 25 bp, Mus musculus
caagcccctgaagaaccgtgatgtc

SEQ ID NO: 81493 - DNA, 25 bp, Mus musculus
caagcccgaggtggatttgctgaaa

SEQ ID NO: 81494 - DNA, 25 bp, Mus musculus
caagccctagccaagcaatgcagga

SEQ ID NO: 81495 - DNA, 25 bp, Mus musculus
caagccctgactgagctggcaaagg

SEQ ID NO: 81496 - DNA, 25 bp, Mus musculus
caagccctggcaacagaaaggcagt

SEQ ID NO: 81497 - DNA, 25 bp, Mus musculus
caagccctgtgggttcaagacgtgg

SEQ ID NO: 81498 - DNA, 25 bp, Mus musculus
caagcccttagtgaggaccagagat

SEQ ID NO: 81499 - DNA, 25 bp, Mus musculus
caagcccttgtgcacttcggtcctg

SEQ ID NO: 81500 - DNA, 25 bp, Mus musculus
caagcccttttgacctgtgcagaga

SEQ ID NO: 81501 - DNA, 25 bp, Mus musculus
caagccgcgtgtggagttcatcgac

SEQ ID NO: 81502 - DNA, 25 bp, Mus musculus
caagccgctcaagtgcaaagtgtgc

SEQ ID NO: 81503 - DNA, 25 bp, Mus musculus
caagccgctgtagagctgcgatcca

SEQ ID NO: 81504 - DNA, 25 bp, Mus musculus
caagccggcagctcgatgagatgag

SEQ ID NO: 81505 - DNA, 25 bp, Mus musculus
caagccggttgtgagtgacgatgac

SEQ ID NO: 81506 - DNA, 25 bp, Mus musculus
caagccgtgcaggagttggtcagcc

SEQ ID NO: 81507 - DNA, 25 bp, Mus musculus
caagcctaactcagctggaagtgcc

SEQ ID NO: 81508 - DNA, 25 bp, Mus musculus
caagcctaagtgtccagcagaaagg

SEQ ID NO: 81509 - DNA, 25 bp, Mus musculus
caagcctacggtggagagattcatc

SEQ ID NO: 81510 - DNA, 25 bp, Mus musculus
caagcctagcctttgggaagccaag

SEQ ID NO: 81511 - DNA, 25 bp, Mus musculus
caagcctatctttacggacgagtcc

SEQ ID NO: 81512 - DNA, 25 bp, Mus musculus
caagcctcgggaattcagatctggg

SEQ ID NO: 81513 - DNA, 25 bp, Mus musculus
caagcctctctaaagggccgaaaga

SEQ ID NO: 81514 - DNA, 25 bp, Mus musculus
caagcctcttggtgcacaataaact

SEQ ID NO: 81515 - DNA, 25 bp, Mus musculus
caagcctgccctttggataggagag

SEQ ID NO: 81516 - DNA, 25 bp, Mus musculus
caagcctgctagttttggaaccacc

SEQ ID NO: 81517 - DNA, 25 bp, Mus musculus
caagcctgctggttaggatcaagga

SEQ ID NO: 81518 - DNA, 25 bp, Mus musculus
caagcctggatggtctggttctagc

SEQ ID NO: 81519 - DNA, 25 bp, Mus musculus
caagcctggattgccgtctatgcat

SEQ ID NO: 81520 - DNA, 25 bp, Mus musculus
caagcctggctgttatgtgtgcatg

SEQ ID NO: 81521 - DNA, 25 bp, Mus musculus
caagcctgtgaagaaggacacccaa

SEQ ID NO: 81522 - DNA, 25 bp, Mus musculus
caagcctgtgcctgatgaagaacca

SEQ ID NO: 81523 - DNA, 25 bp, Mus musculus
caagcctgtgtggactggagcagca

SEQ ID NO: 81524 - DNA, 25 bp, Mus musculus
caagccttggctggaaagttgccag

SEQ ID NO: 81525 - DNA, 25 bp, Mus musculus
caagccttgggattacagggacgcg

SEQ ID NO: 81526 - DNA, 25 bp, Mus musculus
caagccttgtgaacttaagggatat

SEQ ID NO: 81527 - DNA, 25 bp, Mus musculus
caagccttgttccagcaggagatgg

SEQ ID NO: 81528 - DNA, 25 bp, Mus musculus
caagcctttaagtactggagcagcg

SEQ ID NO: 81529 - DNA, 25 bp, Mus musculus
caagcgaaaggtgtcatcaggagaa

SEQ ID NO: 81530 - DNA, 25 bp, Mus musculus
caagcgaaagtgcatcggagagacc

SEQ ID NO: 81531 - DNA, 25 bp, Mus musculus
caagcgaatgctggacatgaaggcc

SEQ ID NO: 81532 - DNA, 25 bp, Mus musculus
caagcgacaaccacaatgctctgtg

SEQ ID NO: 81533 - DNA, 25 bp, Mus musculus
caagcgacacaattccactcgggag

SEQ ID NO: 81534 - DNA, 25 bp, Mus musculus
caagcgaccctcaagctgagcaaga

SEQ ID NO: 81535 - DNA, 25 bp, Mus musculus
caagcgacgtcgatttcacgaaagc

SEQ ID NO: 81536 - DNA, 25 bp, Mus musculus
caagcgagatggcactgaagtcacc

SEQ ID NO: 81537 - DNA, 25 bp, Mus musculus
caagcgagtgaacaagcgcactgcc

SEQ ID NO: 81538 - DNA, 25 bp, Mus musculus
caagcgagtggccttaacacatgga

SEQ ID NO: 81539 - DNA, 25 bp, Mus musculus
caagcgatctctcagcaattgcaac

SEQ ID NO: 81540 - DNA, 25 bp, Mus musculus
caagcgatgagattatgtaacagac

SEQ ID NO: 81541 - DNA, 25 bp, Mus musculus
caagcgcaaatacaaagtgaagctg

SEQ ID NO: 81542 - DNA, 25 bp, Mus musculus
caagcgcaatgccaaggtgtacgag

SEQ ID NO: 81543 - DNA, 25 bp, Mus musculus
caagcgcacgtggaacaggaagtaa

SEQ ID NO: 81544 - DNA, 25 bp, Mus musculus
caagcgccgccgaaatcgttgtcag

SEQ ID NO: 81545 - DNA, 25 bp, Mus musculus
caagcgcctcccatgtgaagtgtgt

SEQ ID NO: 81546 - DNA, 25 bp, Mus musculus
caagcgcgagagaacaaacagatat

SEQ ID NO: 81547 - DNA, 25 bp, Mus musculus
caagcgcgagggaaagagacactta

SEQ ID NO: 81548 - DNA, 25 bp, Mus musculus
caagcgctatgaggacggcatgact

SEQ ID NO: 81549 - DNA, 25 bp, Mus musculus
caagcgctgccatgagttcgtcacg

SEQ ID NO: 81550 - DNA, 25 bp, Mus musculus
caagcgctggcagtacaatgacagt

SEQ ID NO: 81551 - DNA, 25 bp, Mus musculus
caagcgcttgctcttacaggcagac

SEQ ID NO: 81552 - DNA, 25 bp, Mus musculus
caagcgcttgtaggacttggccagc

SEQ ID NO: 81553 - DNA, 25 bp, Mus musculus
caagcgctttacgttaacagcgctc

SEQ ID NO: 81554 - DNA, 25 bp, Mus musculus
caagcgctttggaaacctgactgcc

SEQ ID NO: 81555 - DNA, 25 bp, Mus musculus
caagcgctttgggaacctcaagaac

SEQ ID NO: 81556 - DNA, 25 bp, Mus musculus
caagcggactctgcagactgaagac

SEQ ID NO: 81557 - DNA, 25 bp, Mus musculus
caagcggagccaaaatgtccccgga

SEQ ID NO: 81558 - DNA, 25 bp, Mus musculus
caagcggagctgctatctgaattct

SEQ ID NO: 81559 - DNA, 25 bp, Mus musculus
caagcggagtttggacgcagagaaa

SEQ ID NO: 81560 - DNA, 25 bp, Mus musculus
caagcggatagagtttggctcaggc

SEQ ID NO: 81561 - DNA, 25 bp, Mus musculus
caagcggcagatctttgagccaggt

SEQ ID NO: 81562 - DNA, 25 bp, Mus musculus
caagcggcccagatcatgaaatcat

SEQ ID NO: 81563 - DNA, 25 bp, Mus musculus
caagcggcggcaccagaatatcgtg

SEQ ID NO: 81564 - DNA, 25 bp, Mus musculus
caagcggcgggcttctcagaaagaa

SEQ ID NO: 81565 - DNA, 25 bp, Mus musculus
caagcggcgtttcctgggcaacgat

SEQ ID NO: 81566 - DNA, 25 bp, Mus musculus
caagcggctagatgacctatgcagc

SEQ ID NO: 81567 - DNA, 25 bp, Mus musculus
caagcggctctcataaagatctggc

SEQ ID NO: 81568 - DNA, 25 bp, Mus musculus
caagcggctgcagattgcgggctct

SEQ ID NO: 81569 - DNA, 25 bp, Mus musculus
caagcggtctcagcctacagtgagg

SEQ ID NO: 81570 - DNA, 25 bp, Mus musculus
caagcggtggaagcactgtgtctac

SEQ ID NO: 81571 - DNA, 25 bp, Mus musculus
caagcggtgttttagggacttctgc

SEQ ID NO: 81572 - DNA, 25 bp, Mus musculus
caagcggttctttgcgtgtaacagg

SEQ ID NO: 81573 - DNA, 25 bp, Mus musculus
caagcggttggagaaccagtacgca

SEQ ID NO: 81574 - DNA, 25 bp, Mus musculus
caagcgtctagatcggagtgtctcc

SEQ ID NO: 81575 - DNA, 25 bp, Mus musculus
caagcgtctcgaagttctgggaatc

SEQ ID NO: 81576 - DNA, 25 bp, Mus musculus
caagcgtgagaatggcgaggtatac

SEQ ID NO: 81577 - DNA, 25 bp, Mus musculus
caagcgtggagatgcagctaacggc

SEQ ID NO: 81578 - DNA, 25 bp, Mus musculus
caagcgttatcctcctgtattcgtg

SEQ ID NO: 81579 - DNA, 25 bp, Mus musculus
caagcgttggaaccatcgttacgat

SEQ ID NO: 81580 - DNA, 25 bp, Mus musculus
caagcgtttccggttcaatagcatc

SEQ ID NO: 81581 - DNA, 25 bp, Mus musculus
caagctaagcgcgtttgcagccgtc

SEQ ID NO: 81582 - DNA, 25 bp, Mus musculus
caagctacaagatggcagtgtcaaa

SEQ ID NO: 81583 - DNA, 25 bp, Mus musculus
caagctaccagcgaggacagtgctg

SEQ ID NO: 81584 - DNA, 25 bp, Mus musculus
caagctactgctagtcggagatgtc

SEQ ID NO: 81585 - DNA, 25 bp, Mus musculus
caagctagataagtgtggccgggcc

SEQ ID NO: 81586 - DNA, 25 bp, Mus musculus
caagctagcatatgaactgtacaca

SEQ ID NO: 81587 - DNA, 25 bp, Mus musculus
caagctagcctttatgggaaacgta

SEQ ID NO: 81588 - DNA, 25 bp, Mus musculus
caagctatacgaggaggagtcgcca

SEQ ID NO: 81589 - DNA, 25 bp, Mus musculus
caagctcacagcagttcaggaccat

SEQ ID NO: 81590 - DNA, 25 bp, Mus musculus
caagctcacagtggaggatcccgtc

SEQ ID NO: 81591 - DNA, 25 bp, Mus musculus
caagctcacgttttgggacatggaa

SEQ ID NO: 81592 - DNA, 25 bp, Mus musculus
caagctcaggctaggaccaggtaag

SEQ ID NO: 81593 - DNA, 25 bp, Mus musculus
caagctcaggctccatgaagatcac

SEQ ID NO: 81594 - DNA, 25 bp, Mus musculus
caagctcatccgtactttcgtcatg

SEQ ID NO: 81595 - DNA, 25 bp, Mus musculus
caagctccgcttctatgacgactgg

SEQ ID NO: 81596 - DNA, 25 bp, Mus musculus
caagctccgtagaagagggaaccct

SEQ ID NO: 81597 - DNA, 25 bp, Mus musculus
caagctcgaagactaactggtgggt

SEQ ID NO: 81598 - DNA, 25 bp, Mus musculus
caagctcggccagtttcgtgtgaaa

SEQ ID NO: 81599 - DNA, 25 bp, Mus musculus
caagctctcattggacgggatatcc

SEQ ID NO: 81600 - DNA, 25 bp, Mus musculus
caagctctggatggcggccatgcag

SEQ ID NO: 81601 - DNA, 25 bp, Mus musculus
caagctctggcatctggaccctgat

SEQ ID NO: 81602 - DNA, 25 bp, Mus musculus
caagctcttcagtcagggcattgga

SEQ ID NO: 81603 - DNA, 25 bp, Mus musculus
caagctcttcgtacgtcgacggcaa

SEQ ID NO: 81604 - DNA, 25 bp, Mus musculus
caagctcttctacacgtcgaatatt

SEQ ID NO: 81605 - DNA, 25 bp, Mus musculus
caagctctttgagaacattgggaga

SEQ ID NO: 81606 - DNA, 25 bp, Mus musculus
caagctgaagattttgtcaacgggc

SEQ ID NO: 81607 - DNA, 25 bp, Mus musculus
caagctgacaataaagagcctcagt

SEQ ID NO: 81608 - DNA, 25 bp, Mus musculus
caagctgacagagggacgactcctt

SEQ ID NO: 81609 - DNA, 25 bp, Mus musculus
caagctgaccaacatccagattgag

SEQ ID NO: 81610 - DNA, 25 bp, Mus musculus
caagctgagggcttgtctgagaatg

SEQ ID NO: 81611 - DNA, 25 bp, Mus musculus
caagctgatggactctgatggcctc

SEQ ID NO: 81612 - DNA, 25 bp, Mus musculus
caagctgcagggaacccacttctct

SEQ ID NO: 81613 - DNA, 25 bp, Mus musculus
caagctgcctagttgggccagagct

SEQ ID NO: 81614 - DNA, 25 bp, Mus musculus
caagctgcgagaaggaactggtaca

SEQ ID NO: 81615 - DNA, 25 bp, Mus musculus
caagctgctgccaccgtgcgatgga

SEQ ID NO: 81616 - DNA, 25 bp, Mus musculus
caagctgctggacaaactgctggtc

SEQ ID NO: 81617 - DNA, 25 bp, Mus musculus
caagctggagaaccgtaaggacatc

SEQ ID NO: 81618 - DNA, 25 bp, Mus musculus
caagctggagttggatgcagtcaca

SEQ ID NO: 81619 - DNA, 25 bp, Mus musculus
caagctggattctctgcaaactctg

SEQ ID NO: 81620 - DNA, 25 bp, Mus musculus
caagctggcatcatccctgcagaag

SEQ ID NO: 81621 - DNA, 25 bp, Mus musculus
caagctggcccaggccgctcagtcc

SEQ ID NO: 81622 - DNA, 25 bp, Mus musculus
caagctggcgtaagaacttcaaaac

SEQ ID NO: 81623 - DNA, 25 bp, Mus musculus
caagctgggatctatgagtggaaag

SEQ ID NO: 81624 - DNA, 25 bp, Mus musculus
caagctgggcgtgtcaaaggtgacc

SEQ ID NO: 81625 - DNA, 25 bp, Mus musculus
caagctgggtatgcctcagttcctc

SEQ ID NO: 81626 - DNA, 25 bp, Mus musculus
caagctgggttacatgctccacgca

SEQ ID NO: 81627 - DNA, 25 bp, Mus musculus
caagctgtccagattggctgagccc

SEQ ID NO: 81628 - DNA, 25 bp, Mus musculus
caagctgtcgaaatgcattccggag

SEQ ID NO: 81629 - DNA, 25 bp, Mus musculus
caagctgtcgtcatggtgattggca

SEQ ID NO: 81630 - DNA, 25 bp, Mus musculus
caagctgtgaccgacactggcaaga

SEQ ID NO: 81631 - DNA, 25 bp, Mus musculus
caagctgtgggccatgaagccatca

SEQ ID NO: 81632 - DNA, 25 bp, Mus musculus
caagctgtgtgtacctccagggcac

SEQ ID NO: 81633 - DNA, 25 bp, Mus musculus
caagctgttgtcaacgacaacggca

SEQ ID NO: 81634 - DNA, 25 bp, Mus musculus
caagcttaacaactgtggcatgggc

SEQ ID NO: 81635 - DNA, 25 bp, Mus musculus
caagcttaggatgtgagttttgtcc

SEQ ID NO: 81636 - DNA, 25 bp, Mus musculus
caagcttaggtgtgacttctcagcg

SEQ ID NO: 81637 - DNA, 25 bp, Mus musculus
caagcttcagagttcagtttcaagg

SEQ ID NO: 81638 - DNA, 25 bp, Mus musculus
caagcttccgaggaacggagcagcc

SEQ ID NO: 81639 - DNA, 25 bp, Mus musculus
caagcttccttgacaactgcctgaa

SEQ ID NO: 81640 - DNA, 25 bp, Mus musculus
caagcttcgctacaaaagggccagc

SEQ ID NO: 81641 - DNA, 25 bp, Mus musculus
caagcttctagctgtgaggaggtgc

SEQ ID NO: 81642 - DNA, 25 bp, Mus musculus
caagcttctccaggcaatgagtgac

SEQ ID NO: 81643 - DNA, 25 bp, Mus musculus
caagcttcttacgaccaagatcggg

SEQ ID NO: 81644 - DNA, 25 bp, Mus musculus
caagcttgacaaccgcatggagtct

SEQ ID NO: 81645 - DNA, 25 bp, Mus musculus
caagcttgacaaggtgcggagctga

SEQ ID NO: 81646 - DNA, 25 bp, Mus musculus
caagcttgcaagtcgaatcctggga

SEQ ID NO: 81647 - DNA, 25 bp, Mus musculus
caagcttgttatatgcaggacctaa

SEQ ID NO: 81648 - DNA, 25 bp, Mus musculus
caagctttccggaggcgtcttcaag

SEQ ID NO: 81649 - DNA, 25 bp, Mus musculus
caagctttctctggctccatgaagg

SEQ ID NO: 81650 - DNA, 25 bp, Mus musculus
caagctttctgcatatccagggacc

SEQ ID NO: 81651 - DNA, 25 bp, Mus musculus
caagctttggaaaggatcagcacag

SEQ ID NO: 81652 - DNA, 25 bp, Mus musculus
caaggaaaagcgaggctccaggact

SEQ ID NO: 81653 - DNA, 25 bp, Mus musculus
caaggaaacccttcagctggctgaa

SEQ ID NO: 81654 - DNA, 25 bp, Mus musculus
caaggaaagtatatgacacacggga

SEQ ID NO: 81655 - DNA, 25 bp, Mus musculus
caaggaaatcttgacccgcctggga

SEQ ID NO: 81656 - DNA, 25 bp, Mus musculus
caaggaaatgaataaacagccagcc

SEQ ID NO: 81657 - DNA, 25 bp, Mus musculus
caaggaacgcctcatggagctgcag

SEQ ID NO: 81658 - DNA, 25 bp, Mus musculus
caaggaactaggtcttcccagtgga

SEQ ID NO: 81659 - DNA, 25 bp, Mus musculus
caaggaagaagtgacagcagagcag

SEQ ID NO: 81660 - DNA, 25 bp, Mus musculus
caaggaagacaatcgagctgggagc

SEQ ID NO: 81661 - DNA, 25 bp, Mus musculus
caaggaagagacctccgtcaacaaa

SEQ ID NO: 81662 - DNA, 25 bp, Mus musculus
caaggaagagcctcgtgcgatttga

SEQ ID NO: 81663 - DNA, 25 bp, Mus musculus
caaggaagccaataacgtggagaga

SEQ ID NO: 81664 - DNA, 25 bp, Mus musculus
caaggaagccctcatcgtcggagga

SEQ ID NO: 81665 - DNA, 25 bp, Mus musculus
caaggaagcggctcggaacatagca

SEQ ID NO: 81666 - DNA, 25 bp, Mus musculus
caaggaaggctatcgcccagagaga

SEQ ID NO: 81667 - DNA, 25 bp, Mus musculus
caaggaagggactgatcggtaccga

SEQ ID NO: 81668 - DNA, 25 bp, Mus musculus
caaggaataaagatggcagagggtc

SEQ ID NO: 81669 - DNA, 25 bp, Mus musculus
caaggaatacgtgggcaagacgagc

SEQ ID NO: 81670 - DNA, 25 bp, Mus musculus
caaggaatcccagcatggacaggca

SEQ ID NO: 81671 - DNA, 25 bp, Mus musculus
caaggaatgcctggaggtgatcccc

SEQ ID NO: 81672 - DNA, 25 bp, Mus musculus
caaggaatttacagaccactggtgg

SEQ ID NO: 81673 - DNA, 25 bp, Mus musculus
caaggacaagaaggaagcccctgct

SEQ ID NO: 81674 - DNA, 25 bp, Mus musculus
caaggacaagtttgatggatcgcca

SEQ ID NO: 81675 - DNA, 25 bp, Mus musculus
caaggacagatacttttgatgagcc

SEQ ID NO: 81676 - DNA, 25 bp, Mus musculus
caaggacagcttggctattttccag

SEQ ID NO: 81677 - DNA, 25 bp, Mus musculus
caaggacaggaacaacagattatca

SEQ ID NO: 81678 - DNA, 25 bp, Mus musculus
caaggacatccagcctgtctgtgtg

SEQ ID NO: 81679 - DNA, 25 bp, Mus musculus
caaggacatgcttcgaactctggcc

SEQ ID NO: 81680 - DNA, 25 bp, Mus musculus
caaggaccacccgtatatgagcagc

SEQ ID NO: 81681 - DNA, 25 bp, Mus musculus
caaggaccatccgtacatctctgaa

SEQ ID NO: 81682 - DNA, 25 bp, Mus musculus
caaggaccattcaggagctggacag

SEQ ID NO: 81683 - DNA, 25 bp, Mus musculus
caaggaccccgatatcaacatgcac

SEQ ID NO: 81684 - DNA, 25 bp, Mus musculus
caaggaccgcctgttcataagctat

SEQ ID NO: 81685 - DNA, 25 bp, Mus musculus
caaggaccggacagagaaactgctc

SEQ ID NO: 81686 - DNA, 25 bp, Mus musculus
caaggaccggtatctcctaaaggca

SEQ ID NO: 81687 - DNA, 25 bp, Mus musculus
caaggaccgtatcgttggagtgacc

SEQ ID NO: 81688 - DNA, 25 bp, Mus musculus
caaggacctttacagtgtgcagcaa

SEQ ID NO: 81689 - DNA, 25 bp, Mus musculus
caaggacgaaggctgtgaagctcac

SEQ ID NO: 81690 - DNA, 25 bp, Mus musculus
caaggacgactgtgaacggatggac

SEQ ID NO: 81691 - DNA, 25 bp, Mus musculus
caaggacgatgacaggaaagttcga

SEQ ID NO: 81692 - DNA, 25 bp, Mus musculus
caaggacgctcaaggaaaagttcgg

SEQ ID NO: 81693 - DNA, 25 bp, Mus musculus
caaggacggcgaggccttgcccatt

SEQ ID NO: 81694 - DNA, 25 bp, Mus musculus
caaggactacccaggccatgagatg

SEQ ID NO: 81695 - DNA, 25 bp, Mus musculus
caaggactatgttgtcaggcccaag

SEQ ID NO: 81696 - DNA, 25 bp, Mus musculus
caaggactcattgacttcatcaaaa

SEQ ID NO: 81697 - DNA, 25 bp, Mus musculus
caaggactcccacaaacagctgttg

SEQ ID NO: 81698 - DNA, 25 bp, Mus musculus
caaggactgccaaccagacaaggtg

SEQ ID NO: 81699 - DNA, 25 bp, Mus musculus
caaggactgcctgatcgacaagaga

SEQ ID NO: 81700 - DNA, 25 bp, Mus musculus
caaggactgcgctctctgaattcac

SEQ ID NO: 81701 - DNA, 25 bp, Mus musculus
caaggactgcgggtcccatgatgct

SEQ ID NO: 81702 - DNA, 25 bp, Mus musculus
caaggactggtggacatatgaattc

SEQ ID NO: 81703 - DNA, 25 bp, Mus musculus
caaggacttcatccgcaggctgctg

SEQ ID NO: 81704 - DNA, 25 bp, Mus musculus
caaggacttcgtgattgtccccttg

SEQ ID NO: 81705 - DNA, 25 bp, Mus musculus
caaggacttgctctgcagcgaggaa

SEQ ID NO: 81706 - DNA, 25 bp, Mus musculus
caaggacttggagctcgaaggtccc

SEQ ID NO: 81707 - DNA, 25 bp, Mus musculus
caaggagaacctcactatgcctggc

SEQ ID NO: 81708 - DNA, 25 bp, Mus musculus
caaggagaaggacttttgtggcaca

SEQ ID NO: 81709 - DNA, 25 bp, Mus musculus
caaggagaagtcgtacaaggcggcc

SEQ ID NO: 81710 - DNA, 25 bp, Mus musculus
caaggagacaaaactgctgccaagg

SEQ ID NO: 81711 - DNA, 25 bp, Mus musculus
caaggagactggtggcactgtgcac

SEQ ID NO: 81712 - DNA, 25 bp, Mus musculus
caaggagagacagtattcgccagcg

SEQ ID NO: 81713 - DNA, 25 bp, Mus musculus
caaggagaggtttcacggctgagca

SEQ ID NO: 81714 - DNA, 25 bp, Mus musculus
caaggagatcgtagccatcagctgc

SEQ ID NO: 81715 - DNA, 25 bp, Mus musculus
caaggagatgctgatgaaagggtta

SEQ ID NO: 81716 - DNA, 25 bp, Mus musculus
caaggagatttctacgtgccagagg

SEQ ID NO: 81717 - DNA, 25 bp, Mus musculus
caaggagcacaaggagtatgacagc

SEQ ID NO: 81718 - DNA, 25 bp, Mus musculus
caaggagcatcctcccggagcgggc

SEQ ID NO: 81719 - DNA, 25 bp, Mus musculus
caaggagccctcaccatgaaacaag

SEQ ID NO: 81720 - DNA, 25 bp, Mus musculus
caaggagcgacggaacctgttacgc

SEQ ID NO: 81721 - DNA, 25 bp, Mus musculus
caaggagcgatcttccgtcagggac

SEQ ID NO: 81722 - DNA, 25 bp, Mus musculus
caaggagctgtccatggtcaagatc

SEQ ID NO: 81723 - DNA, 25 bp, Mus musculus
caaggaggaagagattgctcgtatc

SEQ ID NO: 81724 - DNA, 25 bp, Mus musculus
caaggaggagactccttacggcaaa

SEQ ID NO: 81725 - DNA, 25 bp, Mus musculus
caaggaggagcctgtggttacagca

SEQ ID NO: 81726 - DNA, 25 bp, Mus musculus
caaggaggatctaactgcccaggag

SEQ ID NO: 81727 - DNA, 25 bp, Mus musculus
caaggaggcatgattcggaacccaa

SEQ ID NO: 81728 - DNA, 25 bp, Mus musculus
caaggaggcctttggtgagcaaccg

SEQ ID NO: 81729 - DNA, 25 bp, Mus musculus
caaggaggctcgtggtcttccggaa

SEQ ID NO: 81730 - DNA, 25 bp, Mus musculus
caaggaggctctgttgcacaagcac

SEQ ID NO: 81731 - DNA, 25 bp, Mus musculus
caaggaggctgaaggtaccactact

SEQ ID NO: 81732 - DNA, 25 bp, Mus musculus
caaggagtaccttgttgagacctca

SEQ ID NO: 81733 - DNA, 25 bp, Mus musculus
caaggagtcagtccagattctgcga

SEQ ID NO: 81734 - DNA, 25 bp, Mus musculus
caaggagtccattcatgagggtgct

SEQ ID NO: 81735 - DNA, 25 bp, Mus musculus
caaggagtcctacaaagaccggagg

SEQ ID NO: 81736 - DNA, 25 bp, Mus musculus
caaggagtcctgaatggagtggctc

SEQ ID NO: 81737 - DNA, 25 bp, Mus musculus
caaggagtccttttctctgcggcat

SEQ ID NO: 81738 - DNA, 25 bp, Mus musculus
caaggagttgatcttggagacccaa

SEQ ID NO: 81739 - DNA, 25 bp, Mus musculus
caaggatacattgcagaggtgcccg

SEQ ID NO: 81740 - DNA, 25 bp, Mus musculus
caaggatacctatggagacacgcta

SEQ ID NO: 81741 - DNA, 25 bp, Mus musculus
caaggatagccccagtgtgcagaac

SEQ ID NO: 81742 - DNA, 25 bp, Mus musculus
caaggatatcttgcagtctcagccc

SEQ ID NO: 81743 - DNA, 25 bp, Mus musculus
caaggatatggccaaggactcggac

SEQ ID NO: 81744 - DNA, 25 bp, Mus musculus
caaggatattaatggcccgggcaca

SEQ ID NO: 81745 - DNA, 25 bp, Mus musculus
caaggatcagtttggcctctcggca

SEQ ID NO: 81746 - DNA, 25 bp, Mus musculus
caaggatccacggtatgccagatac

SEQ ID NO: 81747 - DNA, 25 bp, Mus musculus
caaggatccccagtcaaggtcagct

SEQ ID NO: 81748 - DNA, 25 bp, Mus musculus
caaggatcgcccaactagaggagga

SEQ ID NO: 81749 - DNA, 25 bp, Mus musculus
caaggatctgtttcactgtggcaca

SEQ ID NO: 81750 - DNA, 25 bp, Mus musculus
caaggatgcccgtgagcctgtcatt

SEQ ID NO: 81751 - DNA, 25 bp, Mus musculus
caaggatgccctcactggagatgaa

SEQ ID NO: 81752 - DNA, 25 bp, Mus musculus
caaggatgggcacatctcacgtgaa

SEQ ID NO: 81753 - DNA, 25 bp, Mus musculus
caaggatggtcaaaagcatgcagtc

SEQ ID NO: 81754 - DNA, 25 bp, Mus musculus
caaggattaaatggacatgaggaaa

SEQ ID NO: 81755 - DNA, 25 bp, Mus musculus
caaggattactaccagctgcaagct

SEQ ID NO: 81756 - DNA, 25 bp, Mus musculus
caaggattcaccattcaagactcac

SEQ ID NO: 81757 - DNA, 25 bp, Mus musculus
caaggattcagttctgccaacggaa

SEQ ID NO: 81758 - DNA, 25 bp, Mus musculus
caaggatttcatggaccccactgtc

SEQ ID NO: 81759 - DNA, 25 bp, Mus musculus
caaggatttccgagtgatttctgcc

SEQ ID NO: 81760 - DNA, 25 bp, Mus musculus
caaggatttcggctttttgaacaga

SEQ ID NO: 81761 - DNA, 25 bp, Mus musculus
caaggcaaaggcaatcggaaaggtt

SEQ ID NO: 81762 - DNA, 25 bp, Mus musculus
caaggcaaggatgcacctgctgtgt

SEQ ID NO: 81763 - DNA, 25 bp, Mus musculus
caaggcaatgagtctgacctcttca

SEQ ID NO: 81764 - DNA, 25 bp, Mus musculus
caaggcacagctggatagcaagatc

SEQ ID NO: 81765 - DNA, 25 bp, Mus musculus
caaggcaccactctcacagtctcct

SEQ ID NO: 81766 - DNA, 25 bp, Mus musculus
caaggcacctatgtggatggagagc

SEQ ID NO: 81767 - DNA, 25 bp, Mus musculus
caaggcacctgaacatgtgtggcat

SEQ ID NO: 81768 - DNA, 25 bp, Mus musculus
caaggcacctgcaacttctctgaag

SEQ ID NO: 81769 - DNA, 25 bp, Mus musculus
caaggcacggaagaggaagagtggt

SEQ ID NO: 81770 - DNA, 25 bp, Mus musculus
caaggcacttcatgattctctggga

SEQ ID NO: 81771 - DNA, 25 bp, Mus musculus
caaggcagaagtctaaccgctggtc

SEQ ID NO: 81772 - DNA, 25 bp, Mus musculus
caaggcagagaccaagtcagtagac

SEQ ID NO: 81773 - DNA, 25 bp, Mus musculus
caaggcagcaaatttaggagagaca

SEQ ID NO: 81774 - DNA, 25 bp, Mus musculus
caaggcagcaccgttctgaagggtc

SEQ ID NO: 81775 - DNA, 25 bp, Mus musculus
caaggcagctcttccgagtctgaca

SEQ ID NO: 81776 - DNA, 25 bp, Mus musculus
caaggcagctggtgggatcattcta

SEQ ID NO: 81777 - DNA, 25 bp, Mus musculus
caaggcagctttgcacacggtggac

SEQ ID NO: 81778 - DNA, 25 bp, Mus musculus
caaggcatcacagagtagtagcatc

SEQ ID NO: 81779 - DNA, 25 bp, Mus musculus
caaggcatcatatggaagcgaccca

SEQ ID NO: 81780 - DNA, 25 bp, Mus musculus
caaggcatccactatttataaggcg

SEQ ID NO: 81781 - DNA, 25 bp, Mus musculus
caaggcatgtggactcctgggaagc

SEQ ID NO: 81782 - DNA, 25 bp, Mus musculus
caaggcattgctccatcagggccag

SEQ ID NO: 81783 - DNA, 25 bp, Mus musculus
caaggcattttttcggtggctgtat

SEQ ID NO: 81784 - DNA, 25 bp, Mus musculus
caaggccaaggccacttgcagagga

SEQ ID NO: 81785 - DNA, 25 bp, Mus musculus
caaggccaaggcgtctgtaagcagc

SEQ ID NO: 81786 - DNA, 25 bp, Mus musculus
caaggccaagtatgggaaggacgcc

SEQ ID NO: 81787 - DNA, 25 bp, Mus musculus
caaggccaagtcaaaatattctcca

SEQ ID NO: 81788 - DNA, 25 bp, Mus musculus
caaggccaccatagggagactgtca

SEQ ID NO: 81789 - DNA, 25 bp, Mus musculus
caaggccagcccgagatagatagaa

SEQ ID NO: 81790 - DNA, 25 bp, Mus musculus
caaggccagctgaaagaggttctgc

SEQ ID NO: 81791 - DNA, 25 bp, Mus musculus
caaggccaggaagacgatggtctca

SEQ ID NO: 81792 - DNA, 25 bp, Mus musculus
caaggccaggttctagagctgcaga

SEQ ID NO: 81793 - DNA, 25 bp, Mus musculus
caaggccagtggtcttgtggagcca

SEQ ID NO: 81794 - DNA, 25 bp, Mus musculus
caaggccatcctggaacggaaagac

SEQ ID NO: 81795 - DNA, 25 bp, Mus musculus
caaggcccagaaatatgacgactcc

SEQ ID NO: 81796 - DNA, 25 bp, Mus musculus
caaggccccttggaagttgatagtc

SEQ ID NO: 81797 - DNA, 25 bp, Mus musculus
caaggcccgtagtcgtgcaagggac

SEQ ID NO: 81798 - DNA, 25 bp, Mus musculus
caaggccgccttggtctgagatgct

SEQ ID NO: 81799 - DNA, 25 bp, Mus musculus
caaggccgctctggaacaagaggca

SEQ ID NO: 81800 - DNA, 25 bp, Mus musculus
caaggccgtgcaccagtgtgacaat

SEQ ID NO: 81801 - DNA, 25 bp, Mus musculus
caaggccgtttgtggtctactgtca

SEQ ID NO: 81802 - DNA, 25 bp, Mus musculus
caaggcctcaatcacctggaagggc

SEQ ID NO: 81803 - DNA, 25 bp, Mus musculus
caaggcctcgcagagacaatttgag

SEQ ID NO: 81804 - DNA, 25 bp, Mus musculus
caaggcctggcagtacctgtctaat

SEQ ID NO: 81805 - DNA, 25 bp, Mus musculus
caaggcctgtagtgattgttgaagc

SEQ ID NO: 81806 - DNA, 25 bp, Mus musculus
caaggcctttgctatgatcgcgtac

SEQ ID NO: 81807 - DNA, 25 bp, Mus musculus
caaggcgaatctctatgggtaacgt

SEQ ID NO: 81808 - DNA, 25 bp, Mus musculus
caaggcgcaagtggaacagatttct

SEQ ID NO: 81809 - DNA, 25 bp, Mus musculus
caaggcggctcaactgtgttaaaca

SEQ ID NO: 81810 - DNA, 25 bp, Mus musculus
caaggcggctgttcgtggatggcca

SEQ ID NO: 81811 - DNA, 25 bp, Mus musculus
caaggcgtagcctctaaatgcgaga

SEQ ID NO: 81812 - DNA, 25 bp, Mus musculus
caaggctaccacttgcaactgcagg

SEQ ID NO: 81813 - DNA, 25 bp, Mus musculus
caaggctacggctactatcgcactg

SEQ ID NO: 81814 - DNA, 25 bp, Mus musculus
caaggctacttctgctaccacaggg

SEQ ID NO: 81815 - DNA, 25 bp, Mus musculus
caaggctcaaagtcctcagagcaag

SEQ ID NO: 81816 - DNA, 25 bp, Mus musculus
caaggctcctgatgaggttctcctg

SEQ ID NO: 81817 - DNA, 25 bp, Mus musculus
caaggctcgcgcaataagcagtgta

SEQ ID NO: 81818 - DNA, 25 bp, Mus musculus
caaggctcgtatggttccagggacg

SEQ ID NO: 81819 - DNA, 25 bp, Mus musculus
caaggctctgcagactgcactgtca

SEQ ID NO: 81820 - DNA, 25 bp, Mus musculus
caaggctctgtaagggtctgacccc

SEQ ID NO: 81821 - DNA, 25 bp, Mus musculus
caaggctgagccacgatgagcggca

SEQ ID NO: 81822 - DNA, 25 bp, Mus musculus
caaggctgataccatgaccctggag

SEQ ID NO: 81823 - DNA, 25 bp, Mus musculus
caaggctgcagctttatcggacaca

SEQ ID NO: 81824 - DNA, 25 bp, Mus musculus
caaggctgctaaagatctcaaggat

SEQ ID NO: 81825 - DNA, 25 bp, Mus musculus
caaggctggccatagtggtacagtc

SEQ ID NO: 81826 - DNA, 25 bp, Mus musculus
caaggctggctacacggaaaagatg

SEQ ID NO: 81827 - DNA, 25 bp, Mus musculus
caaggctggctctgtgttggtcatc

SEQ ID NO: 81828 - DNA, 25 bp, Mus musculus
caaggctgggatttctactgggaga

SEQ ID NO: 81829 - DNA, 25 bp, Mus musculus
caaggctggtcacattgaatctgca

SEQ ID NO: 81830 - DNA, 25 bp, Mus musculus
caaggctggtgactcctcatggaga

SEQ ID NO: 81831 - DNA, 25 bp, Mus musculus
caaggctgtgttagagctcaacgcg

SEQ ID NO: 81832 - DNA, 25 bp, Mus musculus
caaggctgtgtttgtccgtgagcgc

SEQ ID NO: 81833 - DNA, 25 bp, Mus musculus
caaggcttcttcacaggtcgaggtc

SEQ ID NO: 81834 - DNA, 25 bp, Mus musculus
caaggcttgccctgctctggttcag

SEQ ID NO: 81835 - DNA, 25 bp, Mus musculus
caaggcttgcgattacatccgggag

SEQ ID NO: 81836 - DNA, 25 bp, Mus musculus
caaggctttggactgtatgacccac

SEQ ID NO: 81837 - DNA, 25 bp, Mus musculus
caagggacaagaattggcagacccc

SEQ ID NO: 81838 - DNA, 25 bp, Mus musculus
caagggacatgcaggcagctgttca

SEQ ID NO: 81839 - DNA, 25 bp, Mus musculus
caagggacccctgagtttccagagg

SEQ ID NO: 81840 - DNA, 25 bp, Mus musculus
caagggacgggcaattatagagaag

SEQ ID NO: 81841 - DNA, 25 bp, Mus musculus
caagggactgaagatatgccggaca

SEQ ID NO: 81842 - DNA, 25 bp, Mus musculus
caagggacttattgaaatacccagc

SEQ ID NO: 81843 - DNA, 25 bp, Mus musculus
caagggagacatccaaaagctggtt

SEQ ID NO: 81844 - DNA, 25 bp, Mus musculus
caagggagcatgattggcagcttca

SEQ ID NO: 81845 - DNA, 25 bp, Mus musculus
caagggcaaagctacctggtatcca

SEQ ID NO: 81846 - DNA, 25 bp, Mus musculus
caagggcaaagggagtgacaaagac

SEQ ID NO: 81847 - DNA, 25 bp, Mus musculus
caagggcaagaatgtgctgatcaac

SEQ ID NO: 81848 - DNA, 25 bp, Mus musculus
caagggcaaggtttgcaaagtccca

SEQ ID NO: 81849 - DNA, 25 bp, Mus musculus
caagggcacgttccaaggacagaga

SEQ ID NO: 81850 - DNA, 25 bp, Mus musculus
caagggcacttatgcaagcaaaaac

SEQ ID NO: 81851 - DNA, 25 bp, Mus musculus
caagggcagagcatgtactagtctc

SEQ ID NO: 81852 - DNA, 25 bp, Mus musculus
caagggcagagcgtgaagtacctcc

SEQ ID NO: 81853 - DNA, 25 bp, Mus musculus
caagggcagcatactaaaagagaga

SEQ ID NO: 81854 - DNA, 25 bp, Mus musculus
caagggcagcttttcctggaatcca

SEQ ID NO: 81855 - DNA, 25 bp, Mus musculus
caagggcaggtcagcgcttaggact

SEQ ID NO: 81856 - DNA, 25 bp, Mus musculus
caagggcattgcacagaggactttc

SEQ ID NO: 81857 - DNA, 25 bp, Mus musculus
caagggccggacgacaatactctat

SEQ ID NO: 81858 - DNA, 25 bp, Mus musculus
caagggcctgcggaatgataaagat

SEQ ID NO: 81859 - DNA, 25 bp, Mus musculus
caagggcctggtaaattggagtcac

SEQ ID NO: 81860 - DNA, 25 bp, Mus musculus
caagggcctttgtgatgacgacgct

SEQ ID NO: 81861 - DNA, 25 bp, Mus musculus
caagggctgctgtatgaccggagct

SEQ ID NO: 81862 - DNA, 25 bp, Mus musculus
caagggctggacacaacgtaagctt

SEQ ID NO: 81863 - DNA, 25 bp, Mus musculus
caagggctggagatcaaagaaactc

SEQ ID NO: 81864 - DNA, 25 bp, Mus musculus
caagggcttcttgtgcgacgtgatc

SEQ ID NO: 81865 - DNA, 25 bp, Mus musculus
caagggtatcctagatgattcgcca

SEQ ID NO: 81866 - DNA, 25 bp, Mus musculus
caagggtcacatatagtgctgctgc

SEQ ID NO: 81867 - DNA, 25 bp, Mus musculus
caagggtcacattttagagcagcga

SEQ ID NO: 81868 - DNA, 25 bp, Mus musculus
caagggtcctgtagatgtgcctggc

SEQ ID NO: 81869 - DNA, 25 bp, Mus musculus
caagggtgaagatgagctgtctcca

SEQ ID NO: 81870 - DNA, 25 bp, Mus musculus
caagggtggcttgctgactaacgca

SEQ ID NO: 81871 - DNA, 25 bp, Mus musculus
caagggtgtctggaatactgaagca

SEQ ID NO: 81872 - DNA, 25 bp, Mus musculus
caagggttcctcaggacaatgggag

SEQ ID NO: 81873 - DNA, 25 bp, Mus musculus
caagggttcggagaagctctctgcg

SEQ ID NO: 81874 - DNA, 25 bp, Mus musculus
caagggttctggagatgcgcctgca

SEQ ID NO: 81875 - DNA, 25 bp, Mus musculus
caagggttgccaatcttcaccgtca

SEQ ID NO: 81876 - DNA, 25 bp, Mus musculus
caagggtttcttcaagcgcaccatt

SEQ ID NO: 81877 - DNA, 25 bp, Mus musculus
caagggtttggaacttagcggctgc

SEQ ID NO: 81878 - DNA, 25 bp, Mus musculus
caaggtaaagactggatggctactc

SEQ ID NO: 81879 - DNA, 25 bp, Mus musculus
caaggtaccttacattgtgcgccag

SEQ ID NO: 81880 - DNA, 25 bp, Mus musculus
caaggtactgcgaagtgctggtcac

SEQ ID NO: 81881 - DNA, 25 bp, Mus musculus
caaggtagaccgcaggttactcaca

SEQ ID NO: 81882 - DNA, 25 bp, Mus musculus
caaggtagacttcgacatcaagggc

SEQ ID NO: 81883 - DNA, 25 bp, Mus musculus
caaggtagcagagcagcagtcaagg

SEQ ID NO: 81884 - DNA, 25 bp, Mus musculus
caaggtatacataggaggtgaggac

SEQ ID NO: 81885 - DNA, 25 bp, Mus musculus
caaggtatccctaactggcagtgag

SEQ ID NO: 81886 - DNA, 25 bp, Mus musculus
caaggtcaaagagcccaaagcaggc

SEQ ID NO: 81887 - DNA, 25 bp, Mus musculus
caaggtcaaggccaactgagaagca

SEQ ID NO: 81888 - DNA, 25 bp, Mus musculus
caaggtcacacaattagtcatggaa

SEQ ID NO: 81889 - DNA, 25 bp, Mus musculus
caaggtcagaaactagccaaggtcc

SEQ ID NO: 81890 - DNA, 25 bp, Mus musculus
caaggtcagcaactacagcagaggg

SEQ ID NO: 81891 - DNA, 25 bp, Mus musculus
caaggtcagggcgagcaactttctt

SEQ ID NO: 81892 - DNA, 25 bp, Mus musculus
caaggtcattgagctgatggacaca

SEQ ID NO: 81893 - DNA, 25 bp, Mus musculus
caaggtccagatcaagttccagaga

SEQ ID NO: 81894 - DNA, 25 bp, Mus musculus
caaggtccaggctcgaattgctcag

SEQ ID NO: 81895 - DNA, 25 bp, Mus musculus
caaggtccatcgttgtgcccactgt

SEQ ID NO: 81896 - DNA, 25 bp, Mus musculus
caaggtccatgtcctcacaagcagg

SEQ ID NO: 81897 - DNA, 25 bp, Mus musculus
caaggtccattagtgagatcaagcc

SEQ ID NO: 81898 - DNA, 25 bp, Mus musculus
caaggtcctcatgtccagtgcgaat

SEQ ID NO: 81899 - DNA, 25 bp, Mus musculus
caaggtcctgcttggcaattcaaag

SEQ ID NO: 81900 - DNA, 25 bp, Mus musculus
caaggtcctgggtatcatgtccaca

SEQ ID NO: 81901 - DNA, 25 bp, Mus musculus
caaggtccttctgtgatgctgtcca

SEQ ID NO: 81902 - DNA, 25 bp, Mus musculus
caaggtctacgcttaccagatggtc

SEQ ID NO: 81903 - DNA, 25 bp, Mus musculus
caaggtctctaccatgaggcattgc

SEQ ID NO: 81904 - DNA, 25 bp, Mus musculus
caaggtctggacaagcgaggaagtt

SEQ ID NO: 81905 - DNA, 25 bp, Mus musculus
caaggtgaagatctccagcaactgg

SEQ ID NO: 81906 - DNA, 25 bp, Mus musculus
caaggtgaatatagtgaggccatcc

SEQ ID NO: 81907 - DNA, 25 bp, Mus musculus
caaggtgacacagaggcattccaaa

SEQ ID NO: 81908 - DNA, 25 bp, Mus musculus
caaggtgactttgacccagggtcca

SEQ ID NO: 81909 - DNA, 25 bp, Mus musculus
caaggtgagcgccaaactgaagctg

SEQ ID NO: 81910 - DNA, 25 bp, Mus musculus
caaggtgatgaagactatcccactg

SEQ ID NO: 81911 - DNA, 25 bp, Mus musculus
caaggtgatggctgttcctttccaa

SEQ ID NO: 81912 - DNA, 25 bp, Mus musculus
caaggtgccggtgtacagtctctaa

SEQ ID NO: 81913 - DNA, 25 bp, Mus musculus
caaggtgctatatcatgacgtccag

SEQ ID NO: 81914 - DNA, 25 bp, Mus musculus
caaggtgctgaccaagttgcaggca

SEQ ID NO: 81915 - DNA, 25 bp, Mus musculus
caaggtgctggttgggacatgaaac

SEQ ID NO: 81916 - DNA, 25 bp, Mus musculus
caaggtggaagcaatgaccctggac

SEQ ID NO: 81917 - DNA, 25 bp, Mus musculus
caaggtggccacgaagaatagaaat

SEQ ID NO: 81918 - DNA, 25 bp, Mus musculus
caaggtggccgagatctggatcgtc

SEQ ID NO: 81919 - DNA, 25 bp, Mus musculus
caaggtgggccctgaacactgagaa

SEQ ID NO: 81920 - DNA, 25 bp, Mus musculus
caaggtgggtacagcatgcatcagc

SEQ ID NO: 81921 - DNA, 25 bp, Mus musculus
caaggtggtaacttggaccgaacag

SEQ ID NO: 81922 - DNA, 25 bp, Mus musculus
caaggtggttcagacaagacccagg

SEQ ID NO: 81923 - DNA, 25 bp, Mus musculus
caaggtgtacggcaaggcttcgcat

SEQ ID NO: 81924 - DNA, 25 bp, Mus musculus
caaggtgtatctgttagacaacgga

SEQ ID NO: 81925 - DNA, 25 bp, Mus musculus
caaggtgtgcgctccgttgctggaa

SEQ ID NO: 81926 - DNA, 25 bp, Mus musculus
caaggtgtggttactccctgcctgt

SEQ ID NO: 81927 - DNA, 25 bp, Mus musculus
caaggtgttcgactttgagcgctca

SEQ ID NO: 81928 - DNA, 25 bp, Mus musculus
caaggtgtttgacttcgctggcgaa

SEQ ID NO: 81929 - DNA, 25 bp, Mus musculus
caaggttaccgggatgctgcatcca

SEQ ID NO: 81930 - DNA, 25 bp, Mus musculus
caaggttcacctgtcaagtggagca

SEQ ID NO: 81931 - DNA, 25 bp, Mus musculus
caaggttccagcgaggcagaaaaca

SEQ ID NO: 81932 - DNA, 25 bp, Mus musculus
caaggttccccgagatgtcacatgt

SEQ ID NO: 81933 - DNA, 25 bp, Mus musculus
caaggttcgccggatcttagacatc

SEQ ID NO: 81934 - DNA, 25 bp, Mus musculus
caaggttctcgtggctgacaaggac

SEQ ID NO: 81935 - DNA, 25 bp, Mus musculus
caaggttgactttgtgcaccggcgt

SEQ ID NO: 81936 - DNA, 25 bp, Mus musculus
caaggttggccatagcaggagttac

SEQ ID NO: 81937 - DNA, 25 bp, Mus musculus
caaggtttaaccatacagatcgcac

SEQ ID NO: 81938 - DNA, 25 bp, Mus musculus
caaggtttctctacatgtggccaaa

SEQ ID NO: 81939 - DNA, 25 bp, Mus musculus
caaggtttgtcatctaagcgggagc

SEQ ID NO: 81940 - DNA, 25 bp, Mus musculus
caagtaaaagatcttcaggaacaaa

SEQ ID NO: 81941 - DNA, 25 bp, Mus musculus
caagtaatagcttcagggcggttcc

SEQ ID NO: 81942 - DNA, 25 bp, Mus musculus
caagtacaaaccagtcactaaccag

SEQ ID NO: 81943 - DNA, 25 bp, Mus musculus
caagtacaacacacaagattccaag

SEQ ID NO: 81944 - DNA, 25 bp, Mus musculus
caagtacacgtatattcaagaaccc

SEQ ID NO: 81945 - DNA, 25 bp, Mus musculus
caagtacagcatctgcaagagcggt

SEQ ID NO: 81946 - DNA, 25 bp, Mus musculus
caagtacagctgaaaggccgtgacc

SEQ ID NO: 81947 - DNA, 25 bp, Mus musculus
caagtacagtgaagtgttcccacac

SEQ ID NO: 81948 - DNA, 25 bp, Mus musculus
caagtacagtgactatttcaaggcg

SEQ ID NO: 81949 - DNA, 25 bp, Mus musculus
caagtacatcagattcgctggctgc

SEQ ID NO: 81950 - DNA, 25 bp, Mus musculus
caagtacatgaagaacaggcctgct

SEQ ID NO: 81951 - DNA, 25 bp, Mus musculus
caagtaccaccatcagttcagagga

SEQ ID NO: 81952 - DNA, 25 bp, Mus musculus
caagtaccaggatcgactggccaca

SEQ ID NO: 81953 - DNA, 25 bp, Mus musculus
caagtaccggacttacagcaagaag

SEQ ID NO: 81954 - DNA, 25 bp, Mus musculus
caagtacctggccaagaagttcaac

SEQ ID NO: 81955 - DNA, 25 bp, Mus musculus
caagtacgacctgaagaacaacggc

SEQ ID NO: 81956 - DNA, 25 bp, Mus musculus
caagtacggaccctttcagtgcatc

SEQ ID NO: 81957 - DNA, 25 bp, Mus musculus
caagtactaaccctggaagactgga

SEQ ID NO: 81958 - DNA, 25 bp, Mus musculus
caagtactacgggaatctgcggcag

SEQ ID NO: 81959 - DNA, 25 bp, Mus musculus
caagtactatgaactggcccgcaag

SEQ ID NO: 81960 - DNA, 25 bp, Mus musculus
caagtactcaagtggcctttgggca

SEQ ID NO: 81961 - DNA, 25 bp, Mus musculus
caagtactgcacatgtgggacccct

SEQ ID NO: 81962 - DNA, 25 bp, Mus musculus
caagtactgctttgtgtatggccag

SEQ ID NO: 81963 - DNA, 25 bp, Mus musculus
caagtactggctcatgctggacgag

SEQ ID NO: 81964 - DNA, 25 bp, Mus musculus
caagtactggtgttctgctcagcaa

SEQ ID NO: 81965 - DNA, 25 bp, Mus musculus
caagtacttcatttacaccacagga

SEQ ID NO: 81966 - DNA, 25 bp, Mus musculus
caagtacttgtctccagtgagtgca

SEQ ID NO: 81967 - DNA, 25 bp, Mus musculus
caagtactttgtgcagggcatggga

SEQ ID NO: 81968 - DNA, 25 bp, Mus musculus
caagtagacatgaaacagcccctga

SEQ ID NO: 81969 - DNA, 25 bp, Mus musculus
caagtagacttggacctgctgcgga

SEQ ID NO: 81970 - DNA, 25 bp, Mus musculus
caagtagagcctgtgcatggaccca

SEQ ID NO: 81971 - DNA, 25 bp, Mus musculus
caagtagatcgggaacagaaagggc

SEQ ID NO: 81972 - DNA, 25 bp, Mus musculus
caagtagcacttctgtcaccgggca

SEQ ID NO: 81973 - DNA, 25 bp, Mus musculus
caagtagggtctatccagagaagca

SEQ ID NO: 81974 - DNA, 25 bp, Mus musculus
caagtaggtgctttggtgacagacc

SEQ ID NO: 81975 - DNA, 25 bp, Mus musculus
caagtagtgctgtgataccccagac

SEQ ID NO: 81976 - DNA, 25 bp, Mus musculus
caagtatacagagcgaagagaaagg

SEQ ID NO: 81977 - DNA, 25 bp, Mus musculus
caagtatacagcatcctagagacag

SEQ ID NO: 81978 - DNA, 25 bp, Mus musculus
caagtatattgaacgaggagccttc

SEQ ID NO: 81979 - DNA, 25 bp, Mus musculus
caagtatcgggaagctgctcgtcta

SEQ ID NO: 81980 - DNA, 25 bp, Mus musculus
caagtatgaataccacagacagtgg

SEQ ID NO: 81981 - DNA, 25 bp, Mus musculus
caagtatgatccttcagaggccaca

SEQ ID NO: 81982 - DNA, 25 bp, Mus musculus
caagtattacaggtaccctcggtca

SEQ ID NO: 81983 - DNA, 25 bp, Mus musculus
caagtattactttgcagtggacacg

SEQ ID NO: 81984 - DNA, 25 bp, Mus musculus
caagtatttggtcgtgtcagtagcc

SEQ ID NO: 81985 - DNA, 25 bp, Mus musculus
caagtcaaacaacgttgaaatggat

SEQ ID NO: 81986 - DNA, 25 bp, Mus musculus
caagtcaacaatctaagcacgggag

SEQ ID NO: 81987 - DNA, 25 bp, Mus musculus
caagtcaactggtcctttgggtaca

SEQ ID NO: 81988 - DNA, 25 bp, Mus musculus
caagtcaccaaacgctctgcaagag

SEQ ID NO: 81989 - DNA, 25 bp, Mus musculus
caagtcaccccacatttagattgtg

SEQ ID NO: 81990 - DNA, 25 bp, Mus musculus
caagtcactgtgaagaagtctccac

SEQ ID NO: 81991 - DNA, 25 bp, Mus musculus
caagtcagaagacagggcaggccct

SEQ ID NO: 81992 - DNA, 25 bp, Mus musculus
caagtcagactcctagtgcagaggc

SEQ ID NO: 81993 - DNA, 25 bp, Mus musculus
caagtcagatgactctaagcaggtc

SEQ ID NO: 81994 - DNA, 25 bp, Mus musculus
caagtcagcaatgaccagcggtgtc

SEQ ID NO: 81995 - DNA, 25 bp, Mus musculus
caagtcagccatgcctgtgcagcaa

SEQ ID NO: 81996 - DNA, 25 bp, Mus musculus
caagtcagctgatgggtatggagaa

SEQ ID NO: 81997 - DNA, 25 bp, Mus musculus
caagtcagctgtgtcaggagccatc

SEQ ID NO: 81998 - DNA, 25 bp, Mus musculus
caagtcaggagtgaggcaagctgct

SEQ ID NO: 81999 - DNA, 25 bp, Mus musculus
caagtcaggcatgggaaaaacagca

SEQ ID NO: 82000 - DNA, 25 bp, Mus musculus
caagtcagtacgtgtgcgcagagct

SEQ ID NO: 82001 - DNA, 25 bp, Mus musculus
caagtcatctgggatccactacggg

SEQ ID NO: 82002 - DNA, 25 bp, Mus musculus
caagtcatgcttttcaccctgtgga

SEQ ID NO: 82003 - DNA, 25 bp, Mus musculus
caagtcatggcaaggcgtctttggt

SEQ ID NO: 82004 - DNA, 25 bp, Mus musculus
caagtcattgtcagtgccagcggct

SEQ ID NO: 82005 - DNA, 25 bp, Mus musculus
caagtccaaaaggttatctcagaag

SEQ ID NO: 82006 - DNA, 25 bp, Mus musculus
caagtccagcaaggtccccaaagga

SEQ ID NO: 82007 - DNA, 25 bp, Mus musculus
caagtccagcaggtctttaccagta

SEQ ID NO: 82008 - DNA, 25 bp, Mus musculus
caagtccaggagttgaagagtcgcc

SEQ ID NO: 82009 - DNA, 25 bp, Mus musculus
caagtccaggtgctgtgttcctgca

SEQ ID NO: 82010 - DNA, 25 bp, Mus musculus
caagtccagtcatgcagggtcagga

SEQ ID NO: 82011 - DNA, 25 bp, Mus musculus
caagtcccagagaggatcgtggtta

SEQ ID NO: 82012 - DNA, 25 bp, Mus musculus
caagtccccaagcagtgacagctgg

SEQ ID NO: 82013 - DNA, 25 bp, Mus musculus
caagtcccgaagtgtaatctgcagg

SEQ ID NO: 82014 - DNA, 25 bp, Mus musculus
caagtcccgggtgagttaagctgcc

SEQ ID NO: 82015 - DNA, 25 bp, Mus musculus
caagtccctaggcagtggcataacc

SEQ ID NO: 82016 - DNA, 25 bp, Mus musculus
caagtccctggtggtgcatgacaac

SEQ ID NO: 82017 - DNA, 25 bp, Mus musculus
caagtccctgtggtacctggtcaag

SEQ ID NO: 82018 - DNA, 25 bp, Mus musculus
caagtccggagatgtgaaacacgtc

SEQ ID NO: 82019 - DNA, 25 bp, Mus musculus
caagtccgggttctccatcaaagag

SEQ ID NO: 82020 - DNA, 25 bp, Mus musculus
caagtccgtgagctgaggaccatca

SEQ ID NO: 82021 - DNA, 25 bp, Mus musculus
caagtccgttctacaagctgtgcag

SEQ ID NO: 82022 - DNA, 25 bp, Mus musculus
caagtcctgaaagagggcattgccc

SEQ ID NO: 82023 - DNA, 25 bp, Mus musculus
caagtcctgagattgcaccagaaag

SEQ ID NO: 82024 - DNA, 25 bp, Mus musculus
caagtcctggagagggagacagcaa

SEQ ID NO: 82025 - DNA, 25 bp, Mus musculus
caagtcctgggtcaacgctgtagcc

SEQ ID NO: 82026 - DNA, 25 bp, Mus musculus
caagtccttgactggcgcatgcagg

SEQ ID NO: 82027 - DNA, 25 bp, Mus musculus
caagtcctttgcagtccctgccggg

SEQ ID NO: 82028 - DNA, 25 bp, Mus musculus
caagtcgaacaagagaagtgtgaac

SEQ ID NO: 82029 - DNA, 25 bp, Mus musculus
caagtcgatgttagagaagcccacc

SEQ ID NO: 82030 - DNA, 25 bp, Mus musculus
caagtcgccgtagtatttggtacaa

SEQ ID NO: 82031 - DNA, 25 bp, Mus musculus
caagtcgctgctcgttagccacaag

SEQ ID NO: 82032 - DNA, 25 bp, Mus musculus
caagtcggtgagcacgccaagtgaa

SEQ ID NO: 82033 - DNA, 25 bp, Mus musculus
caagtcgtcgctggagaaaatatct

SEQ ID NO: 82034 - DNA, 25 bp, Mus musculus
caagtcgtgaagagcaggactctcc

SEQ ID NO: 82035 - DNA, 25 bp, Mus musculus
caagtctagccttctatggaaagtc

SEQ ID NO: 82036 - DNA, 25 bp, Mus musculus
caagtctatggtggtgtctggagcc

SEQ ID NO: 82037 - DNA, 25 bp, Mus musculus
caagtctcgtgatagcactcccagg

SEQ ID NO: 82038 - DNA, 25 bp, Mus musculus
caagtctgaccctttctgtgtcctc

SEQ ID NO: 82039 - DNA, 25 bp, Mus musculus
caagtctgacttgctgggcaagcca

SEQ ID NO: 82040 - DNA, 25 bp, Mus musculus
caagtctgccagtcatgaaaggaaa

SEQ ID NO: 82041 - DNA, 25 bp, Mus musculus
caagtctgggtacctcagctcggag

SEQ ID NO: 82042 - DNA, 25 bp, Mus musculus
caagtcttcttagtgacctgggacc

SEQ ID NO: 82043 - DNA, 25 bp, Mus musculus
caagtcttggacaacctgggatccc

SEQ ID NO: 82044 - DNA, 25 bp, Mus musculus
caagtcttggttgtgagtctctcac

SEQ ID NO: 82045 - DNA, 25 bp, Mus musculus
caagtctttgtcaagctggcagccc

SEQ ID NO: 82046 - DNA, 25 bp, Mus musculus
caagtgaaaactctgcagtgcttcc

SEQ ID NO: 82047 - DNA, 25 bp, Mus musculus
caagtgaaatacatggccatccagg

SEQ ID NO: 82048 - DNA, 25 bp, Mus musculus
caagtgaacctgttggattctgaag

SEQ ID NO: 82049 - DNA, 25 bp, Mus musculus
caagtgaactcaaagcactgggcta

SEQ ID NO: 82050 - DNA, 25 bp, Mus musculus
caagtgaagcaccaagttgcagtcc

SEQ ID NO: 82051 - DNA, 25 bp, Mus musculus
caagtgaagcggcaagaggtcatca

SEQ ID NO: 82052 - DNA, 25 bp, Mus musculus
caagtgaagctgacattaaggacca

SEQ ID NO: 82053 - DNA, 25 bp, Mus musculus
caagtgaaggtcagctgcctagccg

SEQ ID NO: 82054 - DNA, 25 bp, Mus musculus
caagtgaagttgaaagtaccgccag

SEQ ID NO: 82055 - DNA, 25 bp, Mus musculus
caagtgacaaatgttggaggagcag

SEQ ID NO: 82056 - DNA, 25 bp, Mus musculus
caagtgaccagaaccgcattggaca

SEQ ID NO: 82057 - DNA, 25 bp, Mus musculus
caagtgacccttgagaactgctcgg

SEQ ID NO: 82058 - DNA, 25 bp, Mus musculus
caagtgaccgaacttcttccagacc

SEQ ID NO: 82059 - DNA, 25 bp, Mus musculus
caagtgactgcttcaaatggctaac

SEQ ID NO: 82060 - DNA, 25 bp, Mus musculus
caagtgagagaatagggactgtccc

SEQ ID NO: 82061 - DNA, 25 bp, Mus musculus
caagtgagcaacaccacaatgaccg

SEQ ID NO: 82062 - DNA, 25 bp, Mus musculus
caagtgaggctgtcctgagaaactc

SEQ ID NO: 82063 - DNA, 25 bp, Mus musculus
caagtgatgtcaaaccgaccgagga

SEQ ID NO: 82064 - DNA, 25 bp, Mus musculus
caagtgattcagactcagagctcct

SEQ ID NO: 82065 - DNA, 25 bp, Mus musculus
caagtgcaaagatccacagctggag

SEQ ID NO: 82066 - DNA, 25 bp, Mus musculus
caagtgcaacacaaaggccagagat

SEQ ID NO: 82067 - DNA, 25 bp, Mus musculus
caagtgcaaggaatttggtgacgac

SEQ ID NO: 82068 - DNA, 25 bp, Mus musculus
caagtgcaccatccccgggagtgat

SEQ ID NO: 82069 - DNA, 25 bp, Mus musculus
caagtgcagagtaacagggagaacc

SEQ ID NO: 82070 - DNA, 25 bp, Mus musculus
caagtgcagcggttggacggcattc

SEQ ID NO: 82071 - DNA, 25 bp, Mus musculus
caagtgcagcgtgtgtagcaaggcc

SEQ ID NO: 82072 - DNA, 25 bp, Mus musculus
caagtgcagtactacaaaggctgga

SEQ ID NO: 82073 - DNA, 25 bp, Mus musculus
caagtgccaaaaggacagtccagct

SEQ ID NO: 82074 - DNA, 25 bp, Mus musculus
caagtgccaagaaatgcccaagggt

SEQ ID NO: 82075 - DNA, 25 bp, Mus musculus
caagtgccagttgcagggctaacct

SEQ ID NO: 82076 - DNA, 25 bp, Mus musculus
caagtgcccagactatgaccagatg

SEQ ID NO: 82077 - DNA, 25 bp, Mus musculus
caagtgcccatggtagagatcgacg

SEQ ID NO: 82078 - DNA, 25 bp, Mus musculus
caagtgcccgcaacagtcatgaaag

SEQ ID NO: 82079 - DNA, 25 bp, Mus musculus
caagtgcccggtacctgatccaggg

SEQ ID NO: 82080 - DNA, 25 bp, Mus musculus
caagtgcctgatttgagtcccagga

SEQ ID NO: 82081 - DNA, 25 bp, Mus musculus
caagtgcgcaagtcccaggagttac

SEQ ID NO: 82082 - DNA, 25 bp, Mus musculus
caagtgctatgagctctgtgagaca

SEQ ID NO: 82083 - DNA, 25 bp, Mus musculus
caagtgctcaggcaacaacgtgaag

SEQ ID NO: 82084 - DNA, 25 bp, Mus musculus
caagtgctcatcctgcgcagcatca

SEQ ID NO: 82085 - DNA, 25 bp, Mus musculus
caagtgctccacatattccagaagg

SEQ ID NO: 82086 - DNA, 25 bp, Mus musculus
caagtgctcccactggtccactggg

SEQ ID NO: 82087 - DNA, 25 bp, Mus musculus
caagtgctctctatgctcgggatgc

SEQ ID NO: 82088 - DNA, 25 bp, Mus musculus
caagtgctgcataacaagctgggct

SEQ ID NO: 82089 - DNA, 25 bp, Mus musculus
caagtgctggatggacaactggtca

SEQ ID NO: 82090 - DNA, 25 bp, Mus musculus
caagtgctgtcgtgagtgccagcca

SEQ ID NO: 82091 - DNA, 25 bp, Mus musculus
caagtgctgtgctgagttacatccc

SEQ ID NO: 82092 - DNA, 25 bp, Mus musculus
caagtgcttcactcctaaaggctcg

SEQ ID NO: 82093 - DNA, 25 bp, Mus musculus
caagtgcttccggagaggtctctgc

SEQ ID NO: 82094 - DNA, 25 bp, Mus musculus
caagtgcttcgtggactgcttctga

SEQ ID NO: 82095 - DNA, 25 bp, Mus musculus
caagtgcttgacctaccagagtggg

SEQ ID NO: 82096 - DNA, 25 bp, Mus musculus
caagtgcttggaggaagaacctgga

SEQ ID NO: 82097 - DNA, 25 bp, Mus musculus
caagtgcttgttcagcttattcagg

SEQ ID NO: 82098 - DNA, 25 bp, Mus musculus
caagtggaacgtgaatgtcccgccc

SEQ ID NO: 82099 - DNA, 25 bp, Mus musculus
caagtggaactttgcctacccagcc

SEQ ID NO: 82100 - DNA, 25 bp, Mus musculus
caagtggaagaaggagtgctgccct

SEQ ID NO: 82101 - DNA, 25 bp, Mus musculus
caagtggaagcagcagcaagcgaaa

SEQ ID NO: 82102 - DNA, 25 bp, Mus musculus
caagtggactgtttctggcctcgag

SEQ ID NO: 82103 - DNA, 25 bp, Mus musculus
caagtggagacggaagacttgatcc

SEQ ID NO: 82104 - DNA, 25 bp, Mus musculus
caagtggagccaaccctatatgaag

SEQ ID NO: 82105 - DNA, 25 bp, Mus musculus
caagtggagtatgcccaggaagcag

SEQ ID NO: 82106 - DNA, 25 bp, Mus musculus
caagtggagtttttgcggctcagca

SEQ ID NO: 82107 - DNA, 25 bp, Mus musculus
caagtggatacggaacgacagtgag

SEQ ID NO: 82108 - DNA, 25 bp, Mus musculus
caagtggattgctgggacatggccc

SEQ ID NO: 82109 - DNA, 25 bp, Mus musculus
caagtggcactcagggccttcaagt

SEQ ID NO: 82110 - DNA, 25 bp, Mus musculus
caagtggccgctagagaagaataca

SEQ ID NO: 82111 - DNA, 25 bp, Mus musculus
caagtggcgacctactctaagttcc

SEQ ID NO: 82112 - DNA, 25 bp, Mus musculus
caagtggcgccatatgttcgtaata

SEQ ID NO: 82113 - DNA, 25 bp, Mus musculus
caagtggcgtgtacactattaaacc

SEQ ID NO: 82114 - DNA, 25 bp, Mus musculus
caagtggctatgaaagagaagatcc

SEQ ID NO: 82115 - DNA, 25 bp, Mus musculus
caagtggctcccatacaggcatagg

SEQ ID NO: 82116 - DNA, 25 bp, Mus musculus
caagtgggcggtttatgattcttcc

SEQ ID NO: 82117 - DNA, 25 bp, Mus musculus
caagtgggctggctgattcctttct

SEQ ID NO: 82118 - DNA, 25 bp, Mus musculus
caagtggtaccatcaagaagttccg

SEQ ID NO: 82119 - DNA, 25 bp, Mus musculus
caagtggtcagcagagacatccggc

SEQ ID NO: 82120 - DNA, 25 bp, Mus musculus
caagtggtcgtcatctttgagaagc

SEQ ID NO: 82121 - DNA, 25 bp, Mus musculus
caagtgtaaaaaatgtgatgggccc

SEQ ID NO: 82122 - DNA, 25 bp, Mus musculus
caagtgtaagcattcccagctctga

SEQ ID NO: 82123 - DNA, 25 bp, Mus musculus
caagtgtacagctcagcacaggacc

SEQ ID NO: 82124 - DNA, 25 bp, Mus musculus
caagtgtacgcagccaaagtggaga

SEQ ID NO: 82125 - DNA, 25 bp, Mus musculus
caagtgtagatacatctggcttaag

SEQ ID NO: 82126 - DNA, 25 bp, Mus musculus
caagtgtagtcgctgtctccaaggc

SEQ ID NO: 82127 - DNA, 25 bp, Mus musculus
caagtgtattcatcagagtttggag

SEQ ID NO: 82128 - DNA, 25 bp, Mus musculus
caagtgtcagtcatctacctgcggg

SEQ ID NO: 82129 - DNA, 25 bp, Mus musculus
caagtgtcccaaccagcagtgagtt

SEQ ID NO: 82130 - DNA, 25 bp, Mus musculus
caagtgtcctgactgtgaccaaagc

SEQ ID NO: 82131 - DNA, 25 bp, Mus musculus
caagtgtcctggtgcatatggcccc

SEQ ID NO: 82132 - DNA, 25 bp, Mus musculus
caagtgtcggaaaatgctgccagca

SEQ ID NO: 82133 - DNA, 25 bp, Mus musculus
caagtgtctcttcgttggcctcatc

SEQ ID NO: 82134 - DNA, 25 bp, Mus musculus
caagtgtctggtcaatagtgcaggc

SEQ ID NO: 82135 - DNA, 25 bp, Mus musculus
caagtgtcttcaagtgctccaaagg

SEQ ID NO: 82136 - DNA, 25 bp, Mus musculus
caagtgtgaggccattactgttgag

SEQ ID NO: 82137 - DNA, 25 bp, Mus musculus
caagtgtgccatctatgtcgtaatg

SEQ ID NO: 82138 - DNA, 25 bp, Mus musculus
caagtgtgccatttgagcggccctg

SEQ ID NO: 82139 - DNA, 25 bp, Mus musculus
caagtgtgcgatacccctaagtcct

SEQ ID NO: 82140 - DNA, 25 bp, Mus musculus
caagtgtggaagagatgcatcaatg

SEQ ID NO: 82141 - DNA, 25 bp, Mus musculus
caagtgtgtactcaggttcctccag

SEQ ID NO: 82142 - DNA, 25 bp, Mus musculus
caagtgtgtatgacgaagtgaccaa

SEQ ID NO: 82143 - DNA, 25 bp, Mus musculus
caagtgtgtgaaaaatgccccaggg

SEQ ID NO: 82144 - DNA, 25 bp, Mus musculus
caagtgttgcaaccagctggacgtc

SEQ ID NO: 82145 - DNA, 25 bp, Mus musculus
caagtgttgcaatgggccaaagggt

SEQ ID NO: 82146 - DNA, 25 bp, Mus musculus
caagtgttggcttcggtgtggcatc

SEQ ID NO: 82147 - DNA, 25 bp, Mus musculus
caagtgtttacatctgggcgactcg

SEQ ID NO: 82148 - DNA, 25 bp, Mus musculus
caagtgtttggatgtgcttctggcc

SEQ ID NO: 82149 - DNA, 25 bp, Mus musculus
caagttaagacttgttctcgagtga

SEQ ID NO: 82150 - DNA, 25 bp, Mus musculus
caagttacagagagtgctgctcgca

SEQ ID NO: 82151 - DNA, 25 bp, Mus musculus
caagttacagtgctgctatatgaga

SEQ ID NO: 82152 - DNA, 25 bp, Mus musculus
caagttacattagatgttgacaagg

SEQ ID NO: 82153 - DNA, 25 bp, Mus musculus
caagttacttctccgatgtcgcagc

SEQ ID NO: 82154 - DNA, 25 bp, Mus musculus
caagttagaaaacttccttgattat

SEQ ID NO: 82155 - DNA, 25 bp, Mus musculus
caagttagctgaagccaggactcca

SEQ ID NO: 82156 - DNA, 25 bp, Mus musculus
caagttatcatcacagacatgggcc

SEQ ID NO: 82157 - DNA, 25 bp, Mus musculus
caagttatgggaaatatgagtgagc

SEQ ID NO: 82158 - DNA, 25 bp, Mus musculus
caagttcaaaagaagaccacgggag

SEQ ID NO: 82159 - DNA, 25 bp, Mus musculus
caagttcaagctccgtggctctggg

SEQ ID NO: 82160 - DNA, 25 bp, Mus musculus
caagttcaccggcttctgggattct

SEQ ID NO: 82161 - DNA, 25 bp, Mus musculus
caagttcacgttgtctgagatcaag

SEQ ID NO: 82162 - DNA, 25 bp, Mus musculus
caagttcagagtcctccatccaggg

SEQ ID NO: 82163 - DNA, 25 bp, Mus musculus
caagttcagcctaagaaaaaggagg

SEQ ID NO: 82164 - DNA, 25 bp, Mus musculus
caagttcagcctagaagtccgccag

SEQ ID NO: 82165 - DNA, 25 bp, Mus musculus
caagttcatagcctacagcgctggg

SEQ ID NO: 82166 - DNA, 25 bp, Mus musculus
caagttcatcatgggcgactcgtca

SEQ ID NO: 82167 - DNA, 25 bp, Mus musculus
caagttcatgatcaaccttctacag

SEQ ID NO: 82168 - DNA, 25 bp, Mus musculus
caagttcatggagcttctggagccc

SEQ ID NO: 82169 - DNA, 25 bp, Mus musculus
caagttccactacatggtgcacacg

SEQ ID NO: 82170 - DNA, 25 bp, Mus musculus
caagttccagcttttggcgtcccct

SEQ ID NO: 82171 - DNA, 25 bp, Mus musculus
caagttccaggatggagagctcacc

SEQ ID NO: 82172 - DNA, 25 bp, Mus musculus
caagttccgattcctgcgcaatggg

SEQ ID NO: 82173 - DNA, 25 bp, Mus musculus
caagttccgcaggaatgagcgagcc

SEQ ID NO: 82174 - DNA, 25 bp, Mus musculus
caagttcctgagatgcatgctcaca

SEQ ID NO: 82175 - DNA, 25 bp, Mus musculus
caagttcctgatgcacccggaggag

SEQ ID NO: 82176 - DNA, 25 bp, Mus musculus
caagttcctgctggacaatgcacgg

SEQ ID NO: 82177 - DNA, 25 bp, Mus musculus
caagttcctgtatggttgtcaagca

SEQ ID NO: 82178 - DNA, 25 bp, Mus musculus
caagttcgagaagaagaccgctcca

SEQ ID NO: 82179 - DNA, 25 bp, Mus musculus
caagttcgcaaacaacccaagtcag

SEQ ID NO: 82180 - DNA, 25 bp, Mus musculus
caagttcggttcactggccaagcag

SEQ ID NO: 82181 - DNA, 25 bp, Mus musculus
caagttctagccttatctggagcag

SEQ ID NO: 82182 - DNA, 25 bp, Mus musculus
caagttctcaggcaggtgaccgtag

SEQ ID NO: 82183 - DNA, 25 bp, Mus musculus
caagttctcgagtcaggcacaggtc

SEQ ID NO: 82184 - DNA, 25 bp, Mus musculus
caagttctgacaaatctatggcatc

SEQ ID NO: 82185 - DNA, 25 bp, Mus musculus
caagttctgctctaaggcaggcagc

SEQ ID NO: 82186 - DNA, 25 bp, Mus musculus
caagttctgtgtggagcggctctct

SEQ ID NO: 82187 - DNA, 25 bp, Mus musculus
caagttgaatccctacgcagaagga

SEQ ID NO: 82188 - DNA, 25 bp, Mus musculus
caagttgagaacatggcgacgtcta

SEQ ID NO: 82189 - DNA, 25 bp, Mus musculus
caagttgaggacgaagcaagccagc

SEQ ID NO: 82190 - DNA, 25 bp, Mus musculus
caagttgatgatcccgcgagttgcc

SEQ ID NO: 82191 - DNA, 25 bp, Mus musculus
caagttgccttagaatcagttaccc

SEQ ID NO: 82192 - DNA, 25 bp, Mus musculus
caagttgctgatcattggcaatagc

SEQ ID NO: 82193 - DNA, 25 bp, Mus musculus
caagttggctcaatccttagggaca

SEQ ID NO: 82194 - DNA, 25 bp, Mus musculus
caagttggctccctggatccagaga

SEQ ID NO: 82195 - DNA, 25 bp, Mus musculus
caagttggtatctcatttctgggca

SEQ ID NO: 82196 - DNA, 25 bp, Mus musculus
caagttgtactctacgaatgtccag

SEQ ID NO: 82197 - DNA, 25 bp, Mus musculus
caagttgtcccaaggagccagctgt

SEQ ID NO: 82198 - DNA, 25 bp, Mus musculus
caagtttaaagaccccaattgtgtg

SEQ ID NO: 82199 - DNA, 25 bp, Mus musculus
caagtttaagagacctgttggcttt

SEQ ID NO: 82200 - DNA, 25 bp, Mus musculus
caagtttcctaaaggctcgagtcca

SEQ ID NO: 82201 - DNA, 25 bp, Mus musculus
caagtttctgcaccgctgtggctgc

SEQ ID NO: 82202 - DNA, 25 bp, Mus musculus
caagtttgactacgtaggccggaca

SEQ ID NO: 82203 - DNA, 25 bp, Mus musculus
caagtttgcaataggagcttacacc

SEQ ID NO: 82204 - DNA, 25 bp, Mus musculus
caagtttgcatcagtggtcccagca

SEQ ID NO: 82205 - DNA, 25 bp, Mus musculus
caagtttggcaatgagatcacccag

SEQ ID NO: 82206 - DNA, 25 bp, Mus musculus
caagtttggcctgattggtgttcaa

SEQ ID NO: 82207 - DNA, 25 bp, Mus musculus
caagtttgggcagattcggaagctc

SEQ ID NO: 82208 - DNA, 25 bp, Mus musculus
caagtttggtccagaaacagccatc

SEQ ID NO: 82209 - DNA, 25 bp, Mus musculus
caagttttatgttcgagccccagga

SEQ ID NO: 82210 - DNA, 25 bp, Mus musculus
caagttttcaggagctaccaagagg

SEQ ID NO: 82211 - DNA, 25 bp, Mus musculus
caagttttctggaaccctgagctac

SEQ ID NO: 82212 - DNA, 25 bp, Mus musculus
caagttttggtcacagaaggtctgg

SEQ ID NO: 82213 - DNA, 25 bp, Mus musculus
caagtttttagaatgatcggaagag

SEQ ID NO: 82214 - DNA, 25 bp, Mus musculus
caagtttttgaaatccccagtggag

SEQ ID NO: 82215 - DNA, 25 bp, Mus musculus
caataaaccacagcaggtgccgtca

SEQ ID NO: 82216 - DNA, 25 bp, Mus musculus
caataaactgttggtggaaccaggg

SEQ ID NO: 82217 - DNA, 25 bp, Mus musculus
caataaagacctgggccacagtgtc

SEQ ID NO: 82218 - DNA, 25 bp, Mus musculus
caataaagcatgaacgtgaaggact

SEQ ID NO: 82219 - DNA, 25 bp, Mus musculus
caataaagccctagtgtggacgcct

SEQ ID NO: 82220 - DNA, 25 bp, Mus musculus
caataaatggctcgtgggctctggc

SEQ ID NO: 82221 - DNA, 25 bp, Mus musculus
caataaattatgcatgaggcgagga

SEQ ID NO: 82222 - DNA, 25 bp, Mus musculus
caataacaaggctgcacggagagtc

SEQ ID NO: 82223 - DNA, 25 bp, Mus musculus
caataacagttacctgagagcccag

SEQ ID NO: 82224 - DNA, 25 bp, Mus musculus
caataacatgatacggtgccgctgc

SEQ ID NO: 82225 - DNA, 25 bp, Mus musculus
caataaccgaattggacagctggcc

SEQ ID NO: 82226 - DNA, 25 bp, Mus musculus
caataacctgttggccttgggcaca

SEQ ID NO: 82227 - DNA, 25 bp, Mus musculus
caataaccttggtgtgaagaggccc

SEQ ID NO: 82228 - DNA, 25 bp, Mus musculus
caataacgccatcagctatctaggg

SEQ ID NO: 82229 - DNA, 25 bp, Mus musculus
caataacgctgaatgtggctgggac

SEQ ID NO: 82230 - DNA, 25 bp, Mus musculus
caataactcgaaactggctgagcgg

SEQ ID NO: 82231 - DNA, 25 bp, Mus musculus
caataactggatttgcaacctgccc

SEQ ID NO: 82232 - DNA, 25 bp, Mus musculus
caataacttgctacaagtgaaaatg

SEQ ID NO: 82233 - DNA, 25 bp, Mus musculus
caataagaaaagtgggatcctccca

SEQ ID NO: 82234 - DNA, 25 bp, Mus musculus
caataagaagagctccccaaagggt

SEQ ID NO: 82235 - DNA, 25 bp, Mus musculus
caataagattgaggactggctgcag

SEQ ID NO: 82236 - DNA, 25 bp, Mus musculus
caataagcaggaagtgcgggaagcc

SEQ ID NO: 82237 - DNA, 25 bp, Mus musculus
caataaggacacgtggctgtggtct

SEQ ID NO: 82238 - DNA, 25 bp, Mus musculus
caataaggacattcgtgacgggaaa

SEQ ID NO: 82239 - DNA, 25 bp, Mus musculus
caataaggccgtcaagtgtgcagaa

SEQ ID NO: 82240 - DNA, 25 bp, Mus musculus
caataagtactgaaagatgcactcc

SEQ ID NO: 82241 - DNA, 25 bp, Mus musculus
caataatgaaatcgtgctggtactc

SEQ ID NO: 82242 - DNA, 25 bp, Mus musculus
caataatgacagtcctgagaggcgg

SEQ ID NO: 82243 - DNA, 25 bp, Mus musculus
caataatgcctactgtgtgacctgt

SEQ ID NO: 82244 - DNA, 25 bp, Mus musculus
caataatgcctatgctggcgtccag

SEQ ID NO: 82245 - DNA, 25 bp, Mus musculus
caataatggaccttgcggcgggtaa

SEQ ID NO: 82246 - DNA, 25 bp, Mus musculus
caataatgggatccactaccggctc

SEQ ID NO: 82247 - DNA, 25 bp, Mus musculus
caataattggctggcagagcgccaa

SEQ ID NO: 82248 - DNA, 25 bp, Mus musculus
caatacaaattttcactggatacag

SEQ ID NO: 82249 - DNA, 25 bp, Mus musculus
caatacaagacaaaatgtgaaagcc

SEQ ID NO: 82250 - DNA, 25 bp, Mus musculus
caatacagcccttcgggacaacgag

SEQ ID NO: 82251 - DNA, 25 bp, Mus musculus
caatacaggcacttgatccttggtg

SEQ ID NO: 82252 - DNA, 25 bp, Mus musculus
caatacaggcagttcagggcggatc

SEQ ID NO: 82253 - DNA, 25 bp, Mus musculus
caatacagggacatccggaggactc

SEQ ID NO: 82254 - DNA, 25 bp, Mus musculus
caatacatgaggtgacttccggcca

SEQ ID NO: 82255 - DNA, 25 bp, Mus musculus
caatacccacacgtttgacctgaag

SEQ ID NO: 82256 - DNA, 25 bp, Mus musculus
caataccggttactgcaaacagaga

SEQ ID NO: 82257 - DNA, 25 bp, Mus musculus
caatacctgcagtctccgggaggaa

SEQ ID NO: 82258 - DNA, 25 bp, Mus musculus
caataccttgatgtgctggcgcctt

SEQ ID NO: 82259 - DNA, 25 bp, Mus musculus
caatacgatgcgcaacaactatggg

SEQ ID NO: 82260 - DNA, 25 bp, Mus musculus
caatacgctgaagtgtgtggcccac

SEQ ID NO: 82261 - DNA, 25 bp, Mus musculus
caatacgcttatcttggcagtggca

SEQ ID NO: 82262 - DNA, 25 bp, Mus musculus
caatacgggtcgttgtcgtctgagt

SEQ ID NO: 82263 - DNA, 25 bp, Mus musculus
caatacggtcttcacgttggtctcg

SEQ ID NO: 82264 - DNA, 25 bp, Mus musculus
caatactatgaacattaatgcctcc

SEQ ID NO: 82265 - DNA, 25 bp, Mus musculus
caatactctttcttctaaggatcag

SEQ ID NO: 82266 - DNA, 25 bp, Mus musculus
caatactgccttacaagggaaggca

SEQ ID NO: 82267 - DNA, 25 bp, Mus musculus
caatactgtaacaacggtggtccga

SEQ ID NO: 82268 - DNA, 25 bp, Mus musculus
caatacttggatatttgatgggacc

SEQ ID NO: 82269 - DNA, 25 bp, Mus musculus
caatactttgggtaggcgcttcatg

SEQ ID NO: 82270 - DNA, 25 bp, Mus musculus
caatagaaggaaccagagtccggcc

SEQ ID NO: 82271 - DNA, 25 bp, Mus musculus
caatagacggattgtctggaggaga

SEQ ID NO: 82272 - DNA, 25 bp, Mus musculus
caatagactgacttgggacctcaca

SEQ ID NO: 82273 - DNA, 25 bp, Mus musculus
caatagagagactgggcaatgggct

SEQ ID NO: 82274 - DNA, 25 bp, Mus musculus
caatagagggaaataatctcaccgg

SEQ ID NO: 82275 - DNA, 25 bp, Mus musculus
caatagatcgtcacttagctgtcaa

SEQ ID NO: 82276 - DNA, 25 bp, Mus musculus
caatagcagcagtgttcagcaggaa

SEQ ID NO: 82277 - DNA, 25 bp, Mus musculus
caatagcagggatggtagtgaacag

SEQ ID NO: 82278 - DNA, 25 bp, Mus musculus
caatagcagtggcaatacatggaac

SEQ ID NO: 82279 - DNA, 25 bp, Mus musculus
caatagcctgtgtgaagttaagact

SEQ ID NO: 82280 - DNA, 25 bp, Mus musculus
caatagctccattgaggaagcttca

SEQ ID NO: 82281 - DNA, 25 bp, Mus musculus
caataggaccctgccataggaagac

SEQ ID NO: 82282 - DNA, 25 bp, Mus musculus
caataggcagttcatggcagaaaca

SEQ ID NO: 82283 - DNA, 25 bp, Mus musculus
caatagtacagtatcacaatttgaa

SEQ ID NO: 82284 - DNA, 25 bp, Mus musculus
caatagtcctggatggtgcagtgac

SEQ ID NO: 82285 - DNA, 25 bp, Mus musculus
caatagtgactatgacggtggcagt

SEQ ID NO: 82286 - DNA, 25 bp, Mus musculus
caatagtgggacatgtggacctcta

SEQ ID NO: 82287 - DNA, 25 bp, Mus musculus
caatagttggttaagcttgcgagcc

SEQ ID NO: 82288 - DNA, 25 bp, Mus musculus
caatagttgtaaaagctggacccag

SEQ ID NO: 82289 - DNA, 25 bp, Mus musculus
caatatacctgaggcaatccgcagg

SEQ ID NO: 82290 - DNA, 25 bp, Mus musculus
caatatagagctccaaggagtgccg

SEQ ID NO: 82291 - DNA, 25 bp, Mus musculus
caatatatctgtgccatctgagcca

SEQ ID NO: 82292 - DNA, 25 bp, Mus musculus
caatatcaacacacaagaaggaggt

SEQ ID NO: 82293 - DNA, 25 bp, Mus musculus
caatatcggtgtccagttgctgcag

SEQ ID NO: 82294 - DNA, 25 bp, Mus musculus
caatatctggtgcagtaagccactc

SEQ ID NO: 82295 - DNA, 25 bp, Mus musculus
caatatgaagaaggtacgccggctc

SEQ ID NO: 82296 - DNA, 25 bp, Mus musculus
caatatgaagacaagtgcaccgcgc

SEQ ID NO: 82297 - DNA, 25 bp, Mus musculus
caatatgaaggaggttttccgccgc

SEQ ID NO: 82298 - DNA, 25 bp, Mus musculus
caatatgactaaaaagaagcgggag

SEQ ID NO: 82299 - DNA, 25 bp, Mus musculus
caatatgagtcaagtgccagctgga

SEQ ID NO: 82300 - DNA, 25 bp, Mus musculus
caatatgctgaacgtggatggtccc

SEQ ID NO: 82301 - DNA, 25 bp, Mus musculus
caatatgctgaagtcgtcctacgct

SEQ ID NO: 82302 - DNA, 25 bp, Mus musculus
caatatggaattgtcacccatcatc

SEQ ID NO: 82303 - DNA, 25 bp, Mus musculus
caatatggaggctgaggactaccgc

SEQ ID NO: 82304 - DNA, 25 bp, Mus musculus
caatatggcaatactgtccaggagc

SEQ ID NO: 82305 - DNA, 25 bp, Mus musculus
caatatggcatcttgcatgaggagc

SEQ ID NO: 82306 - DNA, 25 bp, Mus musculus
caatatgggcacatctttaggagac

SEQ ID NO: 82307 - DNA, 25 bp, Mus musculus
caatatgtatgaagtggaccacgac

SEQ ID NO: 82308 - DNA, 25 bp, Mus musculus
caatatgtgagaactgagaccaggg

SEQ ID NO: 82309 - DNA, 25 bp, Mus musculus
caatatgtggccagtttgggacagc

SEQ ID NO: 82310 - DNA, 25 bp, Mus musculus
caatattcaccaggatcttggacgg

SEQ ID NO: 82311 - DNA, 25 bp, Mus musculus
caatattccatcttgcagacagcga

SEQ ID NO: 82312 - DNA, 25 bp, Mus musculus
caatattcttatttctgccaacgga

SEQ ID NO: 82313 - DNA, 25 bp, Mus musculus
caatattgatgccaagtgtccagtc

SEQ ID NO: 82314 - DNA, 25 bp, Mus musculus
caatattgcaagtgggaagacgaca

SEQ ID NO: 82315 - DNA, 25 bp, Mus musculus
caatattgctgttccctactgcgag

SEQ ID NO: 82316 - DNA, 25 bp, Mus musculus
caatattggggatgcacaagccatg

SEQ ID NO: 82317 - DNA, 25 bp, Mus musculus
caatattgtccgctcacgggtgcac

SEQ ID NO: 82318 - DNA, 25 bp, Mus musculus
caatattgtgaaggcagcagcccgt

SEQ ID NO: 82319 - DNA, 25 bp, Mus musculus
caatatttgcattttctcgctggac

SEQ ID NO: 82320 - DNA, 25 bp, Mus musculus
caatatttggaatgtgaccggacag

SEQ ID NO: 82321 - DNA, 25 bp, Mus musculus
caatcaaaatggtgctgtatctctg

SEQ ID NO: 82322 - DNA, 25 bp, Mus musculus
caatcaaattggagcagtagcccac

SEQ ID NO: 82323 - DNA, 25 bp, Mus musculus
caatcaactgaaaaagcacggctac

SEQ ID NO: 82324 - DNA, 25 bp, Mus musculus
caatcaagcctctggctagaaggcg

SEQ ID NO: 82325 - DNA, 25 bp, Mus musculus
caatcaagggtcaagagaagctggc

SEQ ID NO: 82326 - DNA, 25 bp, Mus musculus
caatcaaggtggaaggcaaatgcca

SEQ ID NO: 82327 - DNA, 25 bp, Mus musculus
caatcaatctatcaaggcgtacagg

SEQ ID NO: 82328 - DNA, 25 bp, Mus musculus
caatcaccatggagcatcactgtgg

SEQ ID NO: 82329 - DNA, 25 bp, Mus musculus
caatcaccattgacgggatgacaag

SEQ ID NO: 82330 - DNA, 25 bp, Mus musculus
caatcacgatccaacgaaaggctgg

SEQ ID NO: 82331 - DNA, 25 bp, Mus musculus
caatcactagaagataggtctcccc

SEQ ID NO: 82332 - DNA, 25 bp, Mus musculus
caatcagactgaggacttagggcca

SEQ ID NO: 82333 - DNA, 25 bp, Mus musculus
caatcagatcggctcggtcacagaa

SEQ ID NO: 82334 - DNA, 25 bp, Mus musculus
caatcagatggtggtgcactgggcc

SEQ ID NO: 82335 - DNA, 25 bp, Mus musculus
caatcagcgacatctgggcagtcca

SEQ ID NO: 82336 - DNA, 25 bp, Mus musculus
caatcagcggagtggaataagtacg

SEQ ID NO: 82337 - DNA, 25 bp, Mus musculus
caatcagcttgggaaacatccggaa

SEQ ID NO: 82338 - DNA, 25 bp, Mus musculus
caatcaggacagatgttgttcacca

SEQ ID NO: 82339 - DNA, 25 bp, Mus musculus
caatcaggatttggccacctgcagc

SEQ ID NO: 82340 - DNA, 25 bp, Mus musculus
caatcaggccctggcaaggtcatgt

SEQ ID NO: 82341 - DNA, 25 bp, Mus musculus
caatcaggctaagggagagagctac

SEQ ID NO: 82342 - DNA, 25 bp, Mus musculus
caatcagtagaggagctgggagcca

SEQ ID NO: 82343 - DNA, 25 bp, Mus musculus
caatcagtatatcattcccgtggca

SEQ ID NO: 82344 - DNA, 25 bp, Mus musculus
caatcagtgattgtacccacatggg

SEQ ID NO: 82345 - DNA, 25 bp, Mus musculus
caatcagtgtgaacagaggcgcgtt

SEQ ID NO: 82346 - DNA, 25 bp, Mus musculus
caatcagtgttataggcgatcacca

SEQ ID NO: 82347 - DNA, 25 bp, Mus musculus
caatcatatctacttacacaagcgg

SEQ ID NO: 82348 - DNA, 25 bp, Mus musculus
caatcatcaccgtcagccttagcgt

SEQ ID NO: 82349 - DNA, 25 bp, Mus musculus
caatcatcatgcagatgcctcggaa

SEQ ID NO: 82350 - DNA, 25 bp, Mus musculus
caatcatggcaagacagggaatgga

SEQ ID NO: 82351 - DNA, 25 bp, Mus musculus
caatcatggcttcggcttggccgcg

SEQ ID NO: 82352 - DNA, 25 bp, Mus musculus
caatcatgtactgaaatcctggaat

SEQ ID NO: 82353 - DNA, 25 bp, Mus musculus
caatcatgtatgctgcccgagacgg

SEQ ID NO: 82354 - DNA, 25 bp, Mus musculus
caatccaaggaagcagggaagctcc

SEQ ID NO: 82355 - DNA, 25 bp, Mus musculus
caatccactcgtgttttggaggcca

SEQ ID NO: 82356 - DNA, 25 bp, Mus musculus
caatccacttgttctggtccaggaa

SEQ ID NO: 82357 - DNA, 25 bp, Mus musculus
caatccagatgggttcaggcacact

SEQ ID NO: 82358 - DNA, 25 bp, Mus musculus
caatccaggataaggtgtccaaagg

SEQ ID NO: 82359 - DNA, 25 bp, Mus musculus
caatccaggcctagtctgggtggct

SEQ ID NO: 82360 - DNA, 25 bp, Mus musculus
caatccagtttgtgggaaggtcagc

SEQ ID NO: 82361 - DNA, 25 bp, Mus musculus
caatccatgctagggcaagaactgg

SEQ ID NO: 82362 - DNA, 25 bp, Mus musculus
caatcccatgcagagggcaagaggc

SEQ ID NO: 82363 - DNA, 25 bp, Mus musculus
caatcccgagttttgtggaccgcat

SEQ ID NO: 82364 - DNA, 25 bp, Mus musculus
caatcccgtggtgaagcttgaggcc

SEQ ID NO: 82365 - DNA, 25 bp, Mus musculus
caatccctgtttcgtccgagaagcg

SEQ ID NO: 82366 - DNA, 25 bp, Mus musculus
caatccgcaacataactgtggccta

SEQ ID NO: 82367 - DNA, 25 bp, Mus musculus
caatccgcaggaactatgagctgat

SEQ ID NO: 82368 - DNA, 25 bp, Mus musculus
caatccgctccacaaggtacaggac

SEQ ID NO: 82369 - DNA, 25 bp, Mus musculus
caatccgtgggtgagactagtgact

SEQ ID NO: 82370 - DNA, 25 bp, Mus musculus
caatcctgagctaggtgcaagagca

SEQ ID NO: 82371 - DNA, 25 bp, Mus musculus
caatcctgcactgcaaggtggcggg

SEQ ID NO: 82372 - DNA, 25 bp, Mus musculus
caatcctggtgaacgcaggcctggc

SEQ ID NO: 82373 - DNA, 25 bp, Mus musculus
caatcctgtggaggttggcatccag

SEQ ID NO: 82374 - DNA, 25 bp, Mus musculus
caatccttacctaagaagagttcat

SEQ ID NO: 82375 - DNA, 25 bp, Mus musculus
caatccttgctatgccacggctagg

SEQ ID NO: 82376 - DNA, 25 bp, Mus musculus
caatcctttcacaacagctcctggg

SEQ ID NO: 82377 - DNA, 25 bp, Mus musculus
caatcgaaaggttgctgggctccca

SEQ ID NO: 82378 - DNA, 25 bp, Mus musculus
caatcgaaagtacctcatgtgcggg

SEQ ID NO: 82379 - DNA, 25 bp, Mus musculus
caatcgaagcccgttggtcaagcgg

SEQ ID NO: 82380 - DNA, 25 bp, Mus musculus
caatcgagagaaagcagcaaggcct

SEQ ID NO: 82381 - DNA, 25 bp, Mus musculus
caatcgagattacggaatgcctgga

SEQ ID NO: 82382 - DNA, 25 bp, Mus musculus
caatcgagggagtgttggaccatcc

SEQ ID NO: 82383 - DNA, 25 bp, Mus musculus
caatcgattcccagtgacagcctta

SEQ ID NO: 82384 - DNA, 25 bp, Mus musculus
caatcgcaacgaagagaaagctgta

SEQ ID NO: 82385 - DNA, 25 bp, Mus musculus
caatcgcaggccactctgctgagca

SEQ ID NO: 82386 - DNA, 25 bp, Mus musculus
caatcgcagggaagatatttggctc

SEQ ID NO: 82387 - DNA, 25 bp, Mus musculus
caatcgcccttggagtgtagagttc

SEQ ID NO: 82388 - DNA, 25 bp, Mus musculus
caatcgctcaggattttagttctga

SEQ ID NO: 82389 - DNA, 25 bp, Mus musculus
caatcgctgatccacgcgaggagga

SEQ ID NO: 82390 - DNA, 25 bp, Mus musculus
caatcgcttacgtgagcagaagtag

SEQ ID NO: 82391 - DNA, 25 bp, Mus musculus
caatcggagggagtaagccaagagt

SEQ ID NO: 82392 - DNA, 25 bp, Mus musculus
caatcggagtgacttgttaacaagc

SEQ ID NO: 82393 - DNA, 25 bp, Mus musculus
caatcgggacactcacttaacggaa

SEQ ID NO: 82394 - DNA, 25 bp, Mus musculus
caatcggtgatgtctgctgccggct

SEQ ID NO: 82395 - DNA, 25 bp, Mus musculus
caatcgtcgctctgttgtgaaggga

SEQ ID NO: 82396 - DNA, 25 bp, Mus musculus
caatcgtgatcagatggctgcagct

SEQ ID NO: 82397 - DNA, 25 bp, Mus musculus
caatcgtgatttctgtaagtcaacg

SEQ ID NO: 82398 - DNA, 25 bp, Mus musculus
caatcgttgtgggagtagagctgcc

SEQ ID NO: 82399 - DNA, 25 bp, Mus musculus
caatctacatgatccgatggctggg

SEQ ID NO: 82400 - DNA, 25 bp, Mus musculus
caatctcactttggtgcttgcacag

SEQ ID NO: 82401 - DNA, 25 bp, Mus musculus
caatctcagagggaacctagggtac

SEQ ID NO: 82402 - DNA, 25 bp, Mus musculus
caatctcagggcgtgggctagacga

SEQ ID NO: 82403 - DNA, 25 bp, Mus musculus
caatctcatggactgtgtggacaaa

SEQ ID NO: 82404 - DNA, 25 bp, Mus musculus
caatctccgggagtatctacaggcc

SEQ ID NO: 82405 - DNA, 25 bp, Mus musculus
caatctcggcttttgtagtaggtgg

SEQ ID NO: 82406 - DNA, 25 bp, Mus musculus
caatctctggaaactggtgtctgac

SEQ ID NO: 82407 - DNA, 25 bp, Mus musculus
caatctcttcttctcgggagcccga

SEQ ID NO: 82408 - DNA, 25 bp, Mus musculus
caatctgagttttggagtgtccaca

SEQ ID NO: 82409 - DNA, 25 bp, Mus musculus
caatctgatcgaggagactggccac

SEQ ID NO: 82410 - DNA, 25 bp, Mus musculus
caatctgatgctggaccggctgagt

SEQ ID NO: 82411 - DNA, 25 bp, Mus musculus
caatctgattctgacaggcccaagg

SEQ ID NO: 82412 - DNA, 25 bp, Mus musculus
caatctgattgctgacctggatgaa

SEQ ID NO: 82413 - DNA, 25 bp, Mus musculus
caatctgcctggaaacttgagagca

SEQ ID NO: 82414 - DNA, 25 bp, Mus musculus
caatctgctgtggttcttcaatggc

SEQ ID NO: 82415 - DNA, 25 bp, Mus musculus
caatctggagaaaatcgtggtggct

SEQ ID NO: 82416 - DNA, 25 bp, Mus musculus
caatctggatgaagggttcgtagcc

SEQ ID NO: 82417 - DNA, 25 bp, Mus musculus
caatctgggctacttaggatgctga

SEQ ID NO: 82418 - DNA, 25 bp, Mus musculus
caatctggtgtccagccctaaagaa

SEQ ID NO: 82419 - DNA, 25 bp, Mus musculus
caatctgtgcatcagtcaccctgga

SEQ ID NO: 82420 - DNA, 25 bp, Mus musculus
caatctgtgccagttcttgcctcag

SEQ ID NO: 82421 - DNA, 25 bp, Mus musculus
caatctgtgtgatatggagacggtc

SEQ ID NO: 82422 - DNA, 25 bp, Mus musculus
caatctgttcggatcttgggcagcc

SEQ ID NO: 82423 - DNA, 25 bp, Mus musculus
caatcttcagagacacgtgctttgg

SEQ ID NO: 82424 - DNA, 25 bp, Mus musculus
caatcttgggcttttgctagaactg

SEQ ID NO: 82425 - DNA, 25 bp, Mus musculus
caatcttgtgagttctagtgtcaga

SEQ ID NO: 82426 - DNA, 25 bp, Mus musculus
caatcttgtgtgtctactggtggga

SEQ ID NO: 82427 - DNA, 25 bp, Mus musculus
caatcttttaggtctgaggcaggca

SEQ ID NO: 82428 - DNA, 25 bp, Mus musculus
caatcttttccgtggtcaggaggac

SEQ ID NO: 82429 - DNA, 25 bp, Mus musculus
caatgaaaggaaagcgcaagactct

SEQ ID NO: 82430 - DNA, 25 bp, Mus musculus
caatgaaagggagattgctgaagcc

SEQ ID NO: 82431 - DNA, 25 bp, Mus musculus
caatgaaaggtactgagctaggtcc

SEQ ID NO: 82432 - DNA, 25 bp, Mus musculus
caatgaaattatggccaggctgaca

SEQ ID NO: 82433 - DNA, 25 bp, Mus musculus
caatgaaatttaccgcaagggcacc

SEQ ID NO: 82434 - DNA, 25 bp, Mus musculus
caatgaacaggtgacgcgggaccgc

SEQ ID NO: 82435 - DNA, 25 bp, Mus musculus
caatgaacattctaagctggagtta

SEQ ID NO: 82436 - DNA, 25 bp, Mus musculus
caatgaactgagaaagctgccgtcc

SEQ ID NO: 82437 - DNA, 25 bp, Mus musculus
caatgaagaaacgtcactgagcaag

SEQ ID NO: 82438 - DNA, 25 bp, Mus musculus
caatgaagacatggagtgccgtgct

SEQ ID NO: 82439 - DNA, 25 bp, Mus musculus
caatgaagatggtgccaaagatgct

SEQ ID NO: 82440 - DNA, 25 bp, Mus musculus
caatgaagcctttcgtgggcctgct

SEQ ID NO: 82441 - DNA, 25 bp, Mus musculus
caatgaaggctgtagagagctggca

SEQ ID NO: 82442 - DNA, 25 bp, Mus musculus
caatgaagtcacctcaaagcgagcc

SEQ ID NO: 82443 - DNA, 25 bp, Mus musculus
caatgaagtccgtcccatggaggtg

SEQ ID NO: 82444 - DNA, 25 bp, Mus musculus
caatgaagtgtccaagatcgtccag

SEQ ID NO: 82445 - DNA, 25 bp, Mus musculus
caatgaatgccttggtaccaccaga

SEQ ID NO: 82446 - DNA, 25 bp, Mus musculus
caatgaatgcgggttacagctgtac

SEQ ID NO: 82447 - DNA, 25 bp, Mus musculus
caatgaatgtgggaatcgctggaag

SEQ ID NO: 82448 - DNA, 25 bp, Mus musculus
caatgacaaaatgaagacggcctct

SEQ ID NO: 82449 - DNA, 25 bp, Mus musculus
caatgacagcggcagtgacaaggac

SEQ ID NO: 82450 - DNA, 25 bp, Mus musculus
caatgacagctgatggagactgtgt

SEQ ID NO: 82451 - DNA, 25 bp, Mus musculus
caatgacaggtttagacactccggt

SEQ ID NO: 82452 - DNA, 25 bp, Mus musculus
caatgacagtacaggcaagttctgc

SEQ ID NO: 82453 - DNA, 25 bp, Mus musculus
caatgacatccgtgtggctggcaca

SEQ ID NO: 82454 - DNA, 25 bp, Mus musculus
caatgacattcctcggaggcccagg

SEQ ID NO: 82455 - DNA, 25 bp, Mus musculus
caatgacattgaggctgtgactgca

SEQ ID NO: 82456 - DNA, 25 bp, Mus musculus
caatgacattgatgagctgatcggc

SEQ ID NO: 82457 - DNA, 25 bp, Mus musculus
caatgacccaattttgtgaggccga

SEQ ID NO: 82458 - DNA, 25 bp, Mus musculus
caatgaccctcaaggtcccatttgt

SEQ ID NO: 82459 - DNA, 25 bp, Mus musculus
caatgaccggaactgcaatggtacc

SEQ ID NO: 82460 - DNA, 25 bp, Mus musculus
caatgaccggaactggcagcgtaac

SEQ ID NO: 82461 - DNA, 25 bp, Mus musculus
caatgaccgggtgattcgctggatc

SEQ ID NO: 82462 - DNA, 25 bp, Mus musculus
caatgaccgtctaaagcatgcctta

SEQ ID NO: 82463 - DNA, 25 bp, Mus musculus
caatgacctggaccgtgtatccgcg

SEQ ID NO: 82464 - DNA, 25 bp, Mus musculus
caatgacgacgctgtacgggtgctt

SEQ ID NO: 82465 - DNA, 25 bp, Mus musculus
caatgactaatgctgcaacaatggg

SEQ ID NO: 82466 - DNA, 25 bp, Mus musculus
caatgactccttcttcccacaaagg

SEQ ID NO: 82467 - DNA, 25 bp, Mus musculus
caatgactgaccaacagcgtgaaga

SEQ ID NO: 82468 - DNA, 25 bp, Mus musculus
caatgactgggctgctctgctggaa

SEQ ID NO: 82469 - DNA, 25 bp, Mus musculus
caatgactgtgttcgagtgtcccct

SEQ ID NO: 82470 - DNA, 25 bp, Mus musculus
caatgactttgacgctcctcgggag

SEQ ID NO: 82471 - DNA, 25 bp, Mus musculus
caatgagaaagatcctgacaacaag

SEQ ID NO: 82472 - DNA, 25 bp, Mus musculus
caatgagaatgctgttgtccgaaac

SEQ ID NO: 82473 - DNA, 25 bp, Mus musculus
caatgagacaggtcagagccagcac

SEQ ID NO: 82474 - DNA, 25 bp, Mus musculus
caatgagacagttgggaagcttgca

SEQ ID NO: 82475 - DNA, 25 bp, Mus musculus
caatgagactctggggcacagctca

SEQ ID NO: 82476 - DNA, 25 bp, Mus musculus
caatgagagaaaccaagtcagcagc

SEQ ID NO: 82477 - DNA, 25 bp, Mus musculus
caatgagagaagcaacccggatgac

SEQ ID NO: 82478 - DNA, 25 bp, Mus musculus
caatgagaggaagactgtggcagca

SEQ ID NO: 82479 - DNA, 25 bp, Mus musculus
caatgagatggacagcgtacacggt

SEQ ID NO: 82480 - DNA, 25 bp, Mus musculus
caatgagcacgatggagccacacca

SEQ ID NO: 82481 - DNA, 25 bp, Mus musculus
caatgagcaggatggtgtcacctac

SEQ ID NO: 82482 - DNA, 25 bp, Mus musculus
caatgagccagagctgatgcccaaa

SEQ ID NO: 82483 - DNA, 25 bp, Mus musculus
caatgagccgcctcaagatgaaggc

SEQ ID NO: 82484 - DNA, 25 bp, Mus musculus
caatgagcgcacaccatggatagaa

SEQ ID NO: 82485 - DNA, 25 bp, Mus musculus
caatgagctcaagcatgctgcctga

SEQ ID NO: 82486 - DNA, 25 bp, Mus musculus
caatgaggaggaaagtttgcttgca

SEQ ID NO: 82487 - DNA, 25 bp, Mus musculus
caatgaggatgtacaaactctgaag

SEQ ID NO: 82488 - DNA, 25 bp, Mus musculus
caatgaggcgatctatgtcactgac

SEQ ID NO: 82489 - DNA, 25 bp, Mus musculus
caatgaggtcatggtggaacacttc

SEQ ID NO: 82490 - DNA, 25 bp, Mus musculus
caatgaggtgttgatggcctttacc

SEQ ID NO: 82491 - DNA, 25 bp, Mus musculus
caatgagtacacttggacgactgac

SEQ ID NO: 82492 - DNA, 25 bp, Mus musculus
caatgagtattatggctcctgctcc

SEQ ID NO: 82493 - DNA, 25 bp, Mus musculus
caatgagtcagctaattccctggcc

SEQ ID NO: 82494 - DNA, 25 bp, Mus musculus
caatgagtggttcgtctcggcgttc

SEQ ID NO: 82495 - DNA, 25 bp, Mus musculus
caatgatatgtctgccgtgtaccga

SEQ ID NO: 82496 - DNA, 25 bp, Mus musculus
caatgatccagtgacgtcagacgct

SEQ ID NO: 82497 - DNA, 25 bp, Mus musculus
caatgatcggcaaagcagtggagca

SEQ ID NO: 82498 - DNA, 25 bp, Mus musculus
caatgatcgtcaaggaggcgcggta

SEQ ID NO: 82499 - DNA, 25 bp, Mus musculus
caatgatctctatcgttgggaagtc

SEQ ID NO: 82500 - DNA, 25 bp, Mus musculus
caatgatcttgacgctaaatgcagt

SEQ ID NO: 82501 - DNA, 25 bp, Mus musculus
caatgatcttggtgcctttgagagc

SEQ ID NO: 82502 - DNA, 25 bp, Mus musculus
caatgatcttgtgaaggccctagac

SEQ ID NO: 82503 - DNA, 25 bp, Mus musculus
caatgatgacatggcccacgttgtc

SEQ ID NO: 82504 - DNA, 25 bp, Mus musculus
caatgatgccctggctatccgggaa

SEQ ID NO: 82505 - DNA, 25 bp, Mus musculus
caatgatgcgcaaggtgaggaccaa

SEQ ID NO: 82506 - DNA, 25 bp, Mus musculus
caatgatgcgcttctcagagttgga

SEQ ID NO: 82507 - DNA, 25 bp, Mus musculus
caatgatggaaactccactgtggtg

SEQ ID NO: 82508 - DNA, 25 bp, Mus musculus
caatgatggcatgaccagtctgcat

SEQ ID NO: 82509 - DNA, 25 bp, Mus musculus
caatgatggccacgcagaatgtccc

SEQ ID NO: 82510 - DNA, 25 bp, Mus musculus
caatgatggctcacaggaggaccga

SEQ ID NO: 82511 - DNA, 25 bp, Mus musculus
caatgatgggattctgagccaagcc

SEQ ID NO: 82512 - DNA, 25 bp, Mus musculus
caatgatgttggaacttgcccgtgc

SEQ ID NO: 82513 - DNA, 25 bp, Mus musculus
caatgattaatcctgtgccgcctgg

SEQ ID NO: 82514 - DNA, 25 bp, Mus musculus
caatgattaccctgatctggaggag

SEQ ID NO: 82515 - DNA, 25 bp, Mus musculus
caatgattccccagcaacagagaga

SEQ ID NO: 82516 - DNA, 25 bp, Mus musculus
caatgattccgttgggacacatggg

SEQ ID NO: 82517 - DNA, 25 bp, Mus musculus
caatgattggttccgactggagtcc

SEQ ID NO: 82518 - DNA, 25 bp, Mus musculus
caatgcaaagaaatggagactgcag

SEQ ID NO: 82519 - DNA, 25 bp, Mus musculus
caatgcaattggtgatgggccctgg

SEQ ID NO: 82520 - DNA, 25 bp, Mus musculus
caatgcaccattagcagccactggg

SEQ ID NO: 82521 - DNA, 25 bp, Mus musculus
caatgcacgatctcacctcagaaga

SEQ ID NO: 82522 - DNA, 25 bp, Mus musculus
caatgcacgccggtgcagctggaga

SEQ ID NO: 82523 - DNA, 25 bp, Mus musculus
caatgcagccaactaacatcgtggg

SEQ ID NO: 82524 - DNA, 25 bp, Mus musculus
caatgcagctcttagaaagggtcac

SEQ ID NO: 82525 - DNA, 25 bp, Mus musculus
caatgcaggacctctgtgcgtgcgc

SEQ ID NO: 82526 - DNA, 25 bp, Mus musculus
caatgcaggagctgacacggatcca

SEQ ID NO: 82527 - DNA, 25 bp, Mus musculus
caatgcagttgaccacgtcctggaa

SEQ ID NO: 82528 - DNA, 25 bp, Mus musculus
caatgcatgggacacggctgtgcac

SEQ ID NO: 82529 - DNA, 25 bp, Mus musculus
caatgccaacatggtgggcctagct

SEQ ID NO: 82530 - DNA, 25 bp, Mus musculus
caatgccaacgcagtaggtcccgta

SEQ ID NO: 82531 - DNA, 25 bp, Mus musculus
caatgccaactttctttggaaggag

SEQ ID NO: 82532 - DNA, 25 bp, Mus musculus
caatgccaagttatctcgtagaagg

SEQ ID NO: 82533 - DNA, 25 bp, Mus musculus
caatgccaccgcttgcaagtcagcg

SEQ ID NO: 82534 - DNA, 25 bp, Mus musculus
caatgccactgtttacccggaccag

SEQ ID NO: 82535 - DNA, 25 bp, Mus musculus
caatgccatagtgctggtggccaca

SEQ ID NO: 82536 - DNA, 25 bp, Mus musculus
caatgccatggatgcagagaaggcc

SEQ ID NO: 82537 - DNA, 25 bp, Mus musculus
caatgcccacctgagggacttggat

SEQ ID NO: 82538 - DNA, 25 bp, Mus musculus
caatgccgagtatgcgtgttacaaa

SEQ ID NO: 82539 - DNA, 25 bp, Mus musculus
caatgccgcggcctcctatgagata

SEQ ID NO: 82540 - DNA, 25 bp, Mus musculus
caatgcctatactgagctgaatgac

SEQ ID NO: 82541 - DNA, 25 bp, Mus musculus
caatgcctgcagctacggtgtgact

SEQ ID NO: 82542 - DNA, 25 bp, Mus musculus
caatgccttttggaatgcctgcgga

SEQ ID NO: 82543 - DNA, 25 bp, Mus musculus
caatgcgagcccttgacttcaatac

SEQ ID NO: 82544 - DNA, 25 bp, Mus musculus
caatgcgcgttgttgctggatgaag

SEQ ID NO: 82545 - DNA, 25 bp, Mus musculus
caatgcgggcaaaaccactcttctt

SEQ ID NO: 82546 - DNA, 25 bp, Mus musculus
caatgcggttgccacactagagaaa

SEQ ID NO: 82547 - DNA, 25 bp, Mus musculus
caatgctaaagtggctgtcctggga

SEQ ID NO: 82548 - DNA, 25 bp, Mus musculus
caatgctattggcttctcccaggga

SEQ ID NO: 82549 - DNA, 25 bp, Mus musculus
caatgctcagtttgacagcccggag

SEQ ID NO: 82550 - DNA, 25 bp, Mus musculus
caatgctcccctcgaggtgactgag

SEQ ID NO: 82551 - DNA, 25 bp, Mus musculus
caatgctctgtgtgggagtgagacc

SEQ ID NO: 82552 - DNA, 25 bp, Mus musculus
caatgctgagaatgacagaggacca

SEQ ID NO: 82553 - DNA, 25 bp, Mus musculus
caatgctgagccaaaaaagttgccg

SEQ ID NO: 82554 - DNA, 25 bp, Mus musculus
caatgctgcaggtgatccgagccgt

SEQ ID NO: 82555 - DNA, 25 bp, Mus musculus
caatgctgctacacggcagcaggga

SEQ ID NO: 82556 - DNA, 25 bp, Mus musculus
caatgctggaatgaagtaactcaag

SEQ ID NO: 82557 - DNA, 25 bp, Mus musculus
caatgctggcttcggtcctctgact

SEQ ID NO: 82558 - DNA, 25 bp, Mus musculus
caatgctgggcatttggcaaccgcg

SEQ ID NO: 82559 - DNA, 25 bp, Mus musculus
caatgctggtttcgccatcggagga

SEQ ID NO: 82560 - DNA, 25 bp, Mus musculus
caatgctgtagctggagctctcaaa

SEQ ID NO: 82561 - DNA, 25 bp, Mus musculus
caatgctgtctacagagccccgagt

SEQ ID NO: 82562 - DNA, 25 bp, Mus musculus
caatgctgttatcaatgaggacccg

SEQ ID NO: 82563 - DNA, 25 bp, Mus musculus
caatgctgttgggtggcttcgttcc

SEQ ID NO: 82564 - DNA, 25 bp, Mus musculus
caatgctgttgtggagactggccga

SEQ ID NO: 82565 - DNA, 25 bp, Mus musculus
caatgcttcatcttcgtgccagtca

SEQ ID NO: 82566 - DNA, 25 bp, Mus musculus
caatggaaagtcctggctgccggaa

SEQ ID NO: 82567 - DNA, 25 bp, Mus musculus
caatggaaataacgtggaggccccg

SEQ ID NO: 82568 - DNA, 25 bp, Mus musculus
caatggaatgaaaacctcccggccg

SEQ ID NO: 82569 - DNA, 25 bp, Mus musculus
caatggaattgtcgttgcaactact

SEQ ID NO: 82570 - DNA, 25 bp, Mus musculus
caatggacacgtcatgaaactgaat

SEQ ID NO: 82571 - DNA, 25 bp, Mus musculus
caatggacagaataccacctgatag

SEQ ID NO: 82572 - DNA, 25 bp, Mus musculus
caatggacagcccaggcctagaaac

SEQ ID NO: 82573 - DNA, 25 bp, Mus musculus
caatggaccctccttaccaaatggt

SEQ ID NO: 82574 - DNA, 25 bp, Mus musculus
caatggacgctgtggctcaggtgac

SEQ ID NO: 82575 - DNA, 25 bp, Mus musculus
caatggactctcttactgcagcaaa

SEQ ID NO: 82576 - DNA, 25 bp, Mus musculus
caatggactgaccacaagtgctgta

SEQ ID NO: 82577 - DNA, 25 bp, Mus musculus
caatggactgcaagcatagtggaac

SEQ ID NO: 82578 - DNA, 25 bp, Mus musculus
caatggacttgcctcctatgagcag

SEQ ID NO: 82579 - DNA, 25 bp, Mus musculus
caatggagccatctttgagccttca

SEQ ID NO: 82580 - DNA, 25 bp, Mus musculus
caatggagcggagtaacacacagct

SEQ ID NO: 82581 - DNA, 25 bp, Mus musculus
caatggaggcatcggtactgagccc

SEQ ID NO: 82582 - DNA, 25 bp, Mus musculus
caatggaggctcagggaacaaacct

SEQ ID NO: 82583 - DNA, 25 bp, Mus musculus
caatggagtctacgttcagcagccc

SEQ ID NO: 82584 - DNA, 25 bp, Mus musculus
caatggagtctaggcagctcgaggc

SEQ ID NO: 82585 - DNA, 25 bp, Mus musculus
caatggatagctgtgcctctggtga

SEQ ID NO: 82586 - DNA, 25 bp, Mus musculus
caatggatcccgctctggatggccc

SEQ ID NO: 82587 - DNA, 25 bp, Mus musculus
caatggatctttcacctcaaccgga

SEQ ID NO: 82588 - DNA, 25 bp, Mus musculus
caatggatgcccttctcaggaaaga

SEQ ID NO: 82589 - DNA, 25 bp, Mus musculus
caatggatgggtaacacagatcgcc

SEQ ID NO: 82590 - DNA, 25 bp, Mus musculus
caatggatgtcgatgagggtcaaga

SEQ ID NO: 82591 - DNA, 25 bp, Mus musculus
caatggattctgaattatcacagag

SEQ ID NO: 82592 - DNA, 25 bp, Mus musculus
caatggattgcatggcttgggacag

SEQ ID NO: 82593 - DNA, 25 bp, Mus musculus
caatggatttcctggccccaaaggc

SEQ ID NO: 82594 - DNA, 25 bp, Mus musculus
caatggcaaatcgagggaaacatac

SEQ ID NO: 82595 - DNA, 25 bp, Mus musculus
caatggcagatgtagatcctgatac

SEQ ID NO: 82596 - DNA, 25 bp, Mus musculus
caatggcagcctgcctaagcccacg

SEQ ID NO: 82597 - DNA, 25 bp, Mus musculus
caatggcagtactgtttggacccaa

SEQ ID NO: 82598 - DNA, 25 bp, Mus musculus
caatggcattgagtccctgggtgtg

SEQ ID NO: 82599 - DNA, 25 bp, Mus musculus
caatggccaaagtgatgctgctagc

SEQ ID NO: 82600 - DNA, 25 bp, Mus musculus
caatggccatagcaagtctgaacgg

SEQ ID NO: 82601 - DNA, 25 bp, Mus musculus
caatggccatcagctgtgcgaagag

SEQ ID NO: 82602 - DNA, 25 bp, Mus musculus
caatggccctgtagagtcggtcaca

SEQ ID NO: 82603 - DNA, 25 bp, Mus musculus
caatggcccttctgtcaatgggaca

SEQ ID NO: 82604 - DNA, 25 bp, Mus musculus
caatggcctcaatgagcacgatgga

SEQ ID NO: 82605 - DNA, 25 bp, Mus musculus
caatggccttgtagattcctccgac

SEQ ID NO: 82606 - DNA, 25 bp, Mus musculus
caatggcgaatactggctgggtaac

SEQ ID NO: 82607 - DNA, 25 bp, Mus musculus
caatggcgatattctgtggagcaaa

SEQ ID NO: 82608 - DNA, 25 bp, Mus musculus
caatggcgctggagcttcgtcttca

SEQ ID NO: 82609 - DNA, 25 bp, Mus musculus
caatggcggactgtaacccagacat

SEQ ID NO: 82610 - DNA, 25 bp, Mus musculus
caatggcggagtaactgaacggacc

SEQ ID NO: 82611 - DNA, 25 bp, Mus musculus
caatggcgtggaaatctctgtgccc

SEQ ID NO: 82612 - DNA, 25 bp, Mus musculus
caatggctacgtgattgactttaac

SEQ ID NO: 82613 - DNA, 25 bp, Mus musculus
caatggctagtgagacctctggcca

SEQ ID NO: 82614 - DNA, 25 bp, Mus musculus
caatggctatgtgtccctcgatggg

SEQ ID NO: 82615 - DNA, 25 bp, Mus musculus
caatggctccagtaggtcagcacgg

SEQ ID NO: 82616 - DNA, 25 bp, Mus musculus
caatggctgacgacagcgtgttacc

SEQ ID NO: 82617 - DNA, 25 bp, Mus musculus
caatggctgcaagacagtggcctcc

SEQ ID NO: 82618 - DNA, 25 bp, Mus musculus
caatggctggcatggacgagaagac

SEQ ID NO: 82619 - DNA, 25 bp, Mus musculus
caatggcttcttactgacctgagag

SEQ ID NO: 82620 - DNA, 25 bp, Mus musculus
caatggctttatcacacgcgagttc

SEQ ID NO: 82621 - DNA, 25 bp, Mus musculus
caatggctttgcacgtttcacaggg

SEQ ID NO: 82622 - DNA, 25 bp, Mus musculus
caatgggaacgcgacacatggactc

SEQ ID NO: 82623 - DNA, 25 bp, Mus musculus
caatgggactcaggcgaacaggaat

SEQ ID NO: 82624 - DNA, 25 bp, Mus musculus
caatgggactgcatatctgccgtgc

SEQ ID NO: 82625 - DNA, 25 bp, Mus musculus
caatgggagcaactttgtaggcaaa

SEQ ID NO: 82626 - DNA, 25 bp, Mus musculus
caatgggaggaggtgcttacccacc

SEQ ID NO: 82627 - DNA, 25 bp, Mus musculus
caatgggatgatgaaccaggctgct

SEQ ID NO: 82628 - DNA, 25 bp, Mus musculus
caatgggatgcctcttctgaaggag

SEQ ID NO: 82629 - DNA, 25 bp, Mus musculus
caatgggattctcagcggtttggat

SEQ ID NO: 82630 - DNA, 25 bp, Mus musculus
caatgggcatacagctaggtgggaa

SEQ ID NO: 82631 - DNA, 25 bp, Mus musculus
caatgggccttcttgctcagtctat

SEQ ID NO: 82632 - DNA, 25 bp, Mus musculus
caatgggccttgcttgggatacaga

SEQ ID NO: 82633 - DNA, 25 bp, Mus musculus
caatgggcgacttgtcagctgcaga

SEQ ID NO: 82634 - DNA, 25 bp, Mus musculus
caatgggcgtcttcctcctgaggag

SEQ ID NO: 82635 - DNA, 25 bp, Mus musculus
caatgggctacgaagtgcaaatcac

SEQ ID NO: 82636 - DNA, 25 bp, Mus musculus
caatgggctattgatgacacatggc

SEQ ID NO: 82637 - DNA, 25 bp, Mus musculus
caatgggcttcgtgtggcatctcaa

SEQ ID NO: 82638 - DNA, 25 bp, Mus musculus
caatgggttatattgttcggcagac

SEQ ID NO: 82639 - DNA, 25 bp, Mus musculus
caatggtacagtgctcgctggaagc

SEQ ID NO: 82640 - DNA, 25 bp, Mus musculus
caatggtaccatgcaagatgagccc

SEQ ID NO: 82641 - DNA, 25 bp, Mus musculus
caatggtaccttgccaacatcgagt

SEQ ID NO: 82642 - DNA, 25 bp, Mus musculus
caatggtcatggtgaacattgcaca

SEQ ID NO: 82643 - DNA, 25 bp, Mus musculus
caatggtctgtttccaaagagtggc

SEQ ID NO: 82644 - DNA, 25 bp, Mus musculus
caatggtgagacagtgacgctgccc

SEQ ID NO: 82645 - DNA, 25 bp, Mus musculus
caatggtgcaggaaagacaatccca

SEQ ID NO: 82646 - DNA, 25 bp, Mus musculus
caatggtgccaactgcatgaacggc

SEQ ID NO: 82647 - DNA, 25 bp, Mus musculus
caatggtgggctagcctcaggaaac

SEQ ID NO: 82648 - DNA, 25 bp, Mus musculus
caatggtggtgcatggtacagcgtc

SEQ ID NO: 82649 - DNA, 25 bp, Mus musculus
caatggtgtccctgagcagataggc

SEQ ID NO: 82650 - DNA, 25 bp, Mus musculus
caatggtgtggtcctgtcgatgcct

SEQ ID NO: 82651 - DNA, 25 bp, Mus musculus
caatgtaaaagcacaagaactggcc

SEQ ID NO: 82652 - DNA, 25 bp, Mus musculus
caatgtacagctggttcctggctcc

SEQ ID NO: 82653 - DNA, 25 bp, Mus musculus
caatgtagagatccatataccagtc

SEQ ID NO: 82654 - DNA, 25 bp, Mus musculus
caatgtagatgacgatgcggccgaa

SEQ ID NO: 82655 - DNA, 25 bp, Mus musculus
caatgtagcgaatgtcccgctcggg

SEQ ID NO: 82656 - DNA, 25 bp, Mus musculus
caatgtagcggtgaacgaggactgc

SEQ ID NO: 82657 - DNA, 25 bp, Mus musculus
caatgtagctgtataggactggcac

SEQ ID NO: 82658 - DNA, 25 bp, Mus musculus
caatgtcaacaaggcactgcgggtc

SEQ ID NO: 82659 - DNA, 25 bp, Mus musculus
caatgtcaagagttgggcaaccaga

SEQ ID NO: 82660 - DNA, 25 bp, Mus musculus
caatgtcactgtagtttctgggaaa

SEQ ID NO: 82661 - DNA, 25 bp, Mus musculus
caatgtcagctctgggcgttgtgtc

SEQ ID NO: 82662 - DNA, 25 bp, Mus musculus
caatgtcattgtgactcgactgacc

SEQ ID NO: 82663 - DNA, 25 bp, Mus musculus
caatgtcatttggatggtcattccc

SEQ ID NO: 82664 - DNA, 25 bp, Mus musculus
caatgtccacgtcagatgaggccac

SEQ ID NO: 82665 - DNA, 25 bp, Mus musculus
caatgtccactatcactgctcaggg

SEQ ID NO: 82666 - DNA, 25 bp, Mus musculus
caatgtcccatcgtggagcgcctta

SEQ ID NO: 82667 - DNA, 25 bp, Mus musculus
caatgtcccttatggtgtgggcaaa

SEQ ID NO: 82668 - DNA, 25 bp, Mus musculus
caatgtccgagcatcagagttggcc

SEQ ID NO: 82669 - DNA, 25 bp, Mus musculus
caatgtcctctggtgtccagtcagg

SEQ ID NO: 82670 - DNA, 25 bp, Mus musculus
caatgtcgccaaacgtaagagctct

SEQ ID NO: 82671 - DNA, 25 bp, Mus musculus
caatgtcgctgcaacctgaagggct

SEQ ID NO: 82672 - DNA, 25 bp, Mus musculus
caatgtcgtggcctacatcggcagc

SEQ ID NO: 82673 - DNA, 25 bp, Mus musculus
caatgtcgttcgtctggtggccttc

SEQ ID NO: 82674 - DNA, 25 bp, Mus musculus
caatgtctcactggctaagagtgga

SEQ ID NO: 82675 - DNA, 25 bp, Mus musculus
caatgtctgtaaacgctctgaggtc

SEQ ID NO: 82676 - DNA, 25 bp, Mus musculus
caatgtctgtgtttgtccagggtcc

SEQ ID NO: 82677 - DNA, 25 bp, Mus musculus
caatgtgaacggcaactcagggacg

SEQ ID NO: 82678 - DNA, 25 bp, Mus musculus
caatgtgaaggagggatcaactgac

SEQ ID NO: 82679 - DNA, 25 bp, Mus musculus
caatgtgaagttctgcatagatgcc

SEQ ID NO: 82680 - DNA, 25 bp, Mus musculus
caatgtgaatgatcctgaggctgaa

SEQ ID NO: 82681 - DNA, 25 bp, Mus musculus
caatgtgacagaccgaacccggtgg

SEQ ID NO: 82682 - DNA, 25 bp, Mus musculus
caatgtgagtgatccgaagggtcca

SEQ ID NO: 82683 - DNA, 25 bp, Mus musculus
caatgtgatgactcctggctatggc

SEQ ID NO: 82684 - DNA, 25 bp, Mus musculus
caatgtgccactatctgaaagagga

SEQ ID NO: 82685 - DNA, 25 bp, Mus musculus
caatgtgccatcacgctgtctgctg

SEQ ID NO: 82686 - DNA, 25 bp, Mus musculus
caatgtgccatgtccgcagcggttg

SEQ ID NO: 82687 - DNA, 25 bp, Mus musculus
caatgtgcgtgtgtttaagctgggc

SEQ ID NO: 82688 - DNA, 25 bp, Mus musculus
caatgtgctgtccaggctgctgaac

SEQ ID NO: 82689 - DNA, 25 bp, Mus musculus
caatgtgcttagctggatgggccta

SEQ ID NO: 82690 - DNA, 25 bp, Mus musculus
caatgtggatgaggtgcagatcccc

SEQ ID NO: 82691 - DNA, 25 bp, Mus musculus
caatgtggcctttagaccttctgaa

SEQ ID NO: 82692 - DNA, 25 bp, Mus musculus
caatgtggctgtgtactacgtgtcc

SEQ ID NO: 82693 - DNA, 25 bp, Mus musculus
caatgtgggactgagcggcccagcc

SEQ ID NO: 82694 - DNA, 25 bp, Mus musculus
caatgtgggagacagcactctagcg

SEQ ID NO: 82695 - DNA, 25 bp, Mus musculus
caatgtgggcgacatcctgagtgca

SEQ ID NO: 82696 - DNA, 25 bp, Mus musculus
caatgtggtagtggacatgcagatc

SEQ ID NO: 82697 - DNA, 25 bp, Mus musculus
caatgtggtggctcaaggatgttct

SEQ ID NO: 82698 - DNA, 25 bp, Mus musculus
caatgtggttagttggatcggccta

SEQ ID NO: 82699 - DNA, 25 bp, Mus musculus
caatgtgtgataaaagaaagccaac

SEQ ID NO: 82700 - DNA, 25 bp, Mus musculus
caatgtgtggaccatctgccggaac

SEQ ID NO: 82701 - DNA, 25 bp, Mus musculus
caatgtgtggcaccctggactacct

SEQ ID NO: 82702 - DNA, 25 bp, Mus musculus
caatgtgtgggcaagaggcatccgt

SEQ ID NO: 82703 - DNA, 25 bp, Mus musculus
caatgttactcaggcctggaggcaa

SEQ ID NO: 82704 - DNA, 25 bp, Mus musculus
caatgttcacccagatcagtcaggc

SEQ ID NO: 82705 - DNA, 25 bp, Mus musculus
caatgttcggatgtgctgcagtgac

SEQ ID NO: 82706 - DNA, 25 bp, Mus musculus
caatgttgctaggtgttgcaggcac

SEQ ID NO: 82707 - DNA, 25 bp, Mus musculus
caatgttgctgtcaacgttcagtca

SEQ ID NO: 82708 - DNA, 25 bp, Mus musculus
caatgttgtggccttctccgagatc

SEQ ID NO: 82709 - DNA, 25 bp, Mus musculus
caatgttgtggtatctttcgagggc

SEQ ID NO: 82710 - DNA, 25 bp, Mus musculus
caattaaagtgcaaggaatcctgtc

SEQ ID NO: 82711 - DNA, 25 bp, Mus musculus
caattaaatcaaacagaaggaggct

SEQ ID NO: 82712 - DNA, 25 bp, Mus musculus
caattaagtggtgtttgcaggcaag

SEQ ID NO: 82713 - DNA, 25 bp, Mus musculus
caattaatttggtgtcgtgggcccg

SEQ ID NO: 82714 - DNA, 25 bp, Mus musculus
caattacacatacaagcgcttcgag

SEQ ID NO: 82715 - DNA, 25 bp, Mus musculus
caattacagcatgtcgagtctggtc

SEQ ID NO: 82716 - DNA, 25 bp, Mus musculus
caattacccaacagtgcctcgcggg

SEQ ID NO: 82717 - DNA, 25 bp, Mus musculus
caattacgactcaacctgctggagg

SEQ ID NO: 82718 - DNA, 25 bp, Mus musculus
caattacgggcattgtcatgatggc

SEQ ID NO: 82719 - DNA, 25 bp, Mus musculus
caattacgtagaatgtgtgggcgcc

SEQ ID NO: 82720 - DNA, 25 bp, Mus musculus
caattactctccgtagcctggcagt

SEQ ID NO: 82721 - DNA, 25 bp, Mus musculus
caattactggtatctgtgtggccct

SEQ ID NO: 82722 - DNA, 25 bp, Mus musculus
caattacttccactgcagcagcggg

SEQ ID NO: 82723 - DNA, 25 bp, Mus musculus
caattagactcttcacctgctcgga

SEQ ID NO: 82724 - DNA, 25 bp, Mus musculus
caattagcccatgtttgtcagtaca

SEQ ID NO: 82725 - DNA, 25 bp, Mus musculus
caattagccggtacagatctgagga

SEQ ID NO: 82726 - DNA, 25 bp, Mus musculus
caattagccgtgatttgggccccga

SEQ ID NO: 82727 - DNA, 25 bp, Mus musculus
caattaggaccttgacagggtgggc

SEQ ID NO: 82728 - DNA, 25 bp, Mus musculus
caattatccctcgaggtgccaggca

SEQ ID NO: 82729 - DNA, 25 bp, Mus musculus
caattatgactgctatgggaaaccc

SEQ ID NO: 82730 - DNA, 25 bp, Mus musculus
caattatgatgggttttgagcccct

SEQ ID NO: 82731 - DNA, 25 bp, Mus musculus
caattatgcactgggaaaaggccag

SEQ ID NO: 82732 - DNA, 25 bp, Mus musculus
caattatgccagacgtgagcggctc

SEQ ID NO: 82733 - DNA, 25 bp, Mus musculus
caattatgcgatatggcatgccacc

SEQ ID NO: 82734 - DNA, 25 bp, Mus musculus
caattatgtgtagtgcgccaagcag

SEQ ID NO: 82735 - DNA, 25 bp, Mus musculus
caattattgcggtgatggtggccct

SEQ ID NO: 82736 - DNA, 25 bp, Mus musculus
caattcaaaaggtcatgagcgcgtc

SEQ ID NO: 82737 - DNA, 25 bp, Mus musculus
caattcaaaggttggccatggcttc

SEQ ID NO: 82738 - DNA, 25 bp, Mus musculus
caattcaaggtgaccaggacacagt

SEQ ID NO: 82739 - DNA, 25 bp, Mus musculus
caattcacagagacgagcatgagct

SEQ ID NO: 82740 - DNA, 25 bp, Mus musculus
caattcacatgaggaaaacgcccag

SEQ ID NO: 82741 - DNA, 25 bp, Mus musculus
caattcagagtgataggaccagggt

SEQ ID NO: 82742 - DNA, 25 bp, Mus musculus
caattcagctgtggaggccgtgtca

SEQ ID NO: 82743 - DNA, 25 bp, Mus musculus
caattcaggagccagaggtgcctca

SEQ ID NO: 82744 - DNA, 25 bp, Mus musculus
caattcagtttggtgctccggcctc

SEQ ID NO: 82745 - DNA, 25 bp, Mus musculus
caattcatggatttagccccgtggt

SEQ ID NO: 82746 - DNA, 25 bp, Mus musculus
caattccagaagtaagagacacacc

SEQ ID NO: 82747 - DNA, 25 bp, Mus musculus
caattccagaatcgaaagaggccct

SEQ ID NO: 82748 - DNA, 25 bp, Mus musculus
caattcccagcaccctcgtcgggca

SEQ ID NO: 82749 - DNA, 25 bp, Mus musculus
caattcccggaagatcgatcggcca

SEQ ID NO: 82750 - DNA, 25 bp, Mus musculus
caattcccgttcatgggctcgcagt

SEQ ID NO: 82751 - DNA, 25 bp, Mus musculus
caattccgatgtatgatgccgctca

SEQ ID NO: 82752 - DNA, 25 bp, Mus musculus
caattcctgtgcaaaggtcctgaag

SEQ ID NO: 82753 - DNA, 25 bp, Mus musculus
caattctcagctgggctttgcccta

SEQ ID NO: 82754 - DNA, 25 bp, Mus musculus
caattctctggatctcaatggcagt

SEQ ID NO: 82755 - DNA, 25 bp, Mus musculus
caattctgataagatcttcccaggg

SEQ ID NO: 82756 - DNA, 25 bp, Mus musculus
caattctgccaagcgaggttatcca

SEQ ID NO: 82757 - DNA, 25 bp, Mus musculus
caattctggaatctcatgcggtagg

SEQ ID NO: 82758 - DNA, 25 bp, Mus musculus
caattctggagctagtggttccctc

SEQ ID NO: 82759 - DNA, 25 bp, Mus musculus
caattctggagtcactgtcccggga

SEQ ID NO: 82760 - DNA, 25 bp, Mus musculus
caattctggcatgaggagttacaag

SEQ ID NO: 82761 - DNA, 25 bp, Mus musculus
caattctggccccatcatttgtggc

SEQ ID NO: 82762 - DNA, 25 bp, Mus musculus
caattctgtaccttttggatggccg

SEQ ID NO: 82763 - DNA, 25 bp, Mus musculus
caattcttagggttggagcagggac

SEQ ID NO: 82764 - DNA, 25 bp, Mus musculus
caattgaccgaaagcaagaggtacc

SEQ ID NO: 82765 - DNA, 25 bp, Mus musculus
caattgactggagtggagacatgcc

SEQ ID NO: 82766 - DNA, 25 bp, Mus musculus
caattgagaacacactggctgggac

SEQ ID NO: 82767 - DNA, 25 bp, Mus musculus
caattgaggatgtacaggaggagac

SEQ ID NO: 82768 - DNA, 25 bp, Mus musculus
caattgaggtcacgtttgctgggta

SEQ ID NO: 82769 - DNA, 25 bp, Mus musculus
caattgcaactaccatcaaaccggg

SEQ ID NO: 82770 - DNA, 25 bp, Mus musculus
caattgcaggcaactgcagtgtcca

SEQ ID NO: 82771 - DNA, 25 bp, Mus musculus
caattgcagtgtggaacggtggcca

SEQ ID NO: 82772 - DNA, 25 bp, Mus musculus
caattgccctatctctgggtctggg

SEQ ID NO: 82773 - DNA, 25 bp, Mus musculus
caattgcgaagatgaaggctctgtg

SEQ ID NO: 82774 - DNA, 25 bp, Mus musculus
caattgcttggctgccactttggga

SEQ ID NO: 82775 - DNA, 25 bp, Mus musculus
caattggactgctatttcgagggag

SEQ ID NO: 82776 - DNA, 25 bp, Mus musculus
caattggagatagagcctggccacc

SEQ ID NO: 82777 - DNA, 25 bp, Mus musculus
caattggagccccaggaggtagacc

SEQ ID NO: 82778 - DNA, 25 bp, Mus musculus
caattggatacaaaaagggcaggcc

SEQ ID NO: 82779 - DNA, 25 bp, Mus musculus
caattggatgaaagaggtgacgctc

SEQ ID NO: 82780 - DNA, 25 bp, Mus musculus
caattggattgtagctgcctatgcg

SEQ ID NO: 82781 - DNA, 25 bp, Mus musculus
caattgggagactgctttttcgaca

SEQ ID NO: 82782 - DNA, 25 bp, Mus musculus
caattggttgccagacttgggagcc

SEQ ID NO: 82783 - DNA, 25 bp, Mus musculus
caattgtagcgctcagactgtatga

SEQ ID NO: 82784 - DNA, 25 bp, Mus musculus
caattgtgaacaaggtggttgcggc

SEQ ID NO: 82785 - DNA, 25 bp, Mus musculus
caattgtgcactaggccgaatgacc

SEQ ID NO: 82786 - DNA, 25 bp, Mus musculus
caattgtgccttggcgccttgtctg

SEQ ID NO: 82787 - DNA, 25 bp, Mus musculus
caatttagaatatagccctggcttg

SEQ ID NO: 82788 - DNA, 25 bp, Mus musculus
caatttaggttgtagaggaataggc

SEQ ID NO: 82789 - DNA, 25 bp, Mus musculus
caatttatacggaaccagtgtgcaa

SEQ ID NO: 82790 - DNA, 25 bp, Mus musculus
caatttatatcatgtgggcggtgca

SEQ ID NO: 82791 - DNA, 25 bp, Mus musculus
caatttatttgctgagtcccacgga

SEQ ID NO: 82792 - DNA, 25 bp, Mus musculus
caatttcagcaatttgaaagagcac

SEQ ID NO: 82793 - DNA, 25 bp, Mus musculus
caatttcagggtaaggatgtcttcc

SEQ ID NO: 82794 - DNA, 25 bp, Mus musculus
caatttcccttcatgagatgcaggc

SEQ ID NO: 82795 - DNA, 25 bp, Mus musculus
caatttcctgactcgagttactggc

SEQ ID NO: 82796 - DNA, 25 bp, Mus musculus
caatttcgaggacttgtttggcgca

SEQ ID NO: 82797 - DNA, 25 bp, Mus musculus
caatttcgtgggttcacagtcgtga

SEQ ID NO: 82798 - DNA, 25 bp, Mus musculus
caatttctgagaggcaacaggcggc

SEQ ID NO: 82799 - DNA, 25 bp, Mus musculus
caatttctgcaggagaaaggcctcc

SEQ ID NO: 82800 - DNA, 25 bp, Mus musculus
caatttgacatctggactggctccg

SEQ ID NO: 82801 - DNA, 25 bp, Mus musculus
caatttgacttcttcgagactgagg

SEQ ID NO: 82802 - DNA, 25 bp, Mus musculus
caatttgagatggaggagctaatcc

SEQ ID NO: 82803 - DNA, 25 bp, Mus musculus
caatttgagtagcacccacataacc

SEQ ID NO: 82804 - DNA, 25 bp, Mus musculus
caatttgattggacgcttgcagctc

SEQ ID NO: 82805 - DNA, 25 bp, Mus musculus
caatttgcaaaacgactgcaggtca

SEQ ID NO: 82806 - DNA, 25 bp, Mus musculus
caatttggagaaacatctgaccccc

SEQ ID NO: 82807 - DNA, 25 bp, Mus musculus
caatttggagcaaagacttgggtca

SEQ ID NO: 82808 - DNA, 25 bp, Mus musculus
caatttggatacttcagcgggcacc

SEQ ID NO: 82809 - DNA, 25 bp, Mus musculus
caatttgtccagagtggctgcttac

SEQ ID NO: 82810 - DNA, 25 bp, Mus musculus
caatttgtgcaggagagtcaccgga

SEQ ID NO: 82811 - DNA, 25 bp, Mus musculus
caattttaaagagaagactaccctg

SEQ ID NO: 82812 - DNA, 25 bp, Mus musculus
caattttcctgggtgtagtgctgcg

SEQ ID NO: 82813 - DNA, 25 bp, Mus musculus
caattttctgtgctctcccaacggt

SEQ ID NO: 82814 - DNA, 25 bp, Mus musculus
caattttgacgagatggacacctcc

SEQ ID NO: 82815 - DNA, 25 bp, Mus musculus
caattttgctcatccagctgtgcga

SEQ ID NO: 82816 - DNA, 25 bp, Mus musculus
caatttttcagaaggaggaccaggc

SEQ ID NO: 82817 - DNA, 25 bp, Mus musculus
caatttttccacatgaccagcggac

SEQ ID NO: 82818 - DNA, 25 bp, Mus musculus
caatttttgcgcctctggagggcct

SEQ ID NO: 82819 - DNA, 25 bp, Mus musculus
cacaaaaagaaagggcgccagtcac

SEQ ID NO: 82820 - DNA, 25 bp, Mus musculus
cacaaaaagacacacacggctgaca

SEQ ID NO: 82821 - DNA, 25 bp, Mus musculus
cacaaaacaagagactgggcagcca

SEQ ID NO: 82822 - DNA, 25 bp, Mus musculus
cacaaaactgttagtgacacaacgg

SEQ ID NO: 82823 - DNA, 25 bp, Mus musculus
cacaaaagcccatggacacatccag

SEQ ID NO: 82824 - DNA, 25 bp, Mus musculus
cacaaaaggctttcctggcatgatg

SEQ ID NO: 82825 - DNA, 25 bp, Mus musculus
cacaaaagtggtgctgtggccagcc

SEQ ID NO: 82826 - DNA, 25 bp, Mus musculus
cacaaaagttgaacgcacctgaggc

SEQ ID NO: 82827 - DNA, 25 bp, Mus musculus
cacaaacagagcataaggcaattca

SEQ ID NO: 82828 - DNA, 25 bp, Mus musculus
cacaaaccgggctggatggctttat

SEQ ID NO: 82829 - DNA, 25 bp, Mus musculus
cacaaacgatgttgcagagtccgat

SEQ ID NO: 82830 - DNA, 25 bp, Mus musculus
cacaaagaatctacagggcctgagc

SEQ ID NO: 82831 - DNA, 25 bp, Mus musculus
cacaaagagagaactaggcaagcct

SEQ ID NO: 82832 - DNA, 25 bp, Mus musculus
cacaaagagctaccggatgaacaga

SEQ ID NO: 82833 - DNA, 25 bp, Mus musculus
cacaaagagcttttgagcctggact

SEQ ID NO: 82834 - DNA, 25 bp, Mus musculus
cacaaagagtcagacggaaggtcac

SEQ ID NO: 82835 - DNA, 25 bp, Mus musculus
cacaaagatgttggaaggaaaacca

SEQ ID NO: 82836 - DNA, 25 bp, Mus musculus
cacaaagcctcggatccttggatct

SEQ ID NO: 82837 - DNA, 25 bp, Mus musculus
cacaaagctagctggcatggaggaa

SEQ ID NO: 82838 - DNA, 25 bp, Mus musculus
cacaaagctgctggttactgaggat

SEQ ID NO: 82839 - DNA, 25 bp, Mus musculus
cacaaaggtccagttagcagagcta

SEQ ID NO: 82840 - DNA, 25 bp, Mus musculus
cacaaagtactggagctcgggaggt

SEQ ID NO: 82841 - DNA, 25 bp, Mus musculus
cacaaagtcaacgtgcagggtgagc

SEQ ID NO: 82842 - DNA, 25 bp, Mus musculus
cacaaagtcatggaaaagctgggtt

SEQ ID NO: 82843 - DNA, 25 bp, Mus musculus
cacaaagtctattctgccagtccaa

SEQ ID NO: 82844 - DNA, 25 bp, Mus musculus
cacaaagtttctacaggacacagtc

SEQ ID NO: 82845 - DNA, 25 bp, Mus musculus
cacaaataggacaaagagttctgcc

SEQ ID NO: 82846 - DNA, 25 bp, Mus musculus
cacaaatccggtacgatgctgtgac

SEQ ID NO: 82847 - DNA, 25 bp, Mus musculus
cacaaatgaggccatagaggagcag

SEQ ID NO: 82848 - DNA, 25 bp, Mus musculus
cacaaattcggagacgagagagacg

SEQ ID NO: 82849 - DNA, 25 bp, Mus musculus
cacaaattctgtggagaatcttcaa

SEQ ID NO: 82850 - DNA, 25 bp, Mus musculus
cacaaatttatagaagctggccagt

SEQ ID NO: 82851 - DNA, 25 bp, Mus musculus
cacaacacaggtctgggagggatcc

SEQ ID NO: 82852 - DNA, 25 bp, Mus musculus
cacaacaccctggaatggagcgact

SEQ ID NO: 82853 - DNA, 25 bp, Mus musculus
cacaacacgtggatgccgctgatga

SEQ ID NO: 82854 - DNA, 25 bp, Mus musculus
cacaacaggtggctacagtcataca

SEQ ID NO: 82855 - DNA, 25 bp, Mus musculus
cacaacatcttgagcggacagcgat

SEQ ID NO: 82856 - DNA, 25 bp, Mus musculus
cacaaccggttacagcagctgagga

SEQ ID NO: 82857 - DNA, 25 bp, Mus musculus
cacaacctagatgaggacgagccgg

SEQ ID NO: 82858 - DNA, 25 bp, Mus musculus
cacaacctgaaagtggctgaggcag

SEQ ID NO: 82859 - DNA, 25 bp, Mus musculus
cacaacctgagggagcgatacttct

SEQ ID NO: 82860 - DNA, 25 bp, Mus musculus
cacaacctggaaatggtgggcgaga

SEQ ID NO: 82861 - DNA, 25 bp, Mus musculus
cacaacctgtactttgaggcggcct

SEQ ID NO: 82862 - DNA, 25 bp, Mus musculus
cacaacgagaagaagtcggtcctga

SEQ ID NO: 82863 - DNA, 25 bp, Mus musculus
cacaacgagatgtgtaacagcaaca

SEQ ID NO: 82864 - DNA, 25 bp, Mus musculus
cacaacgctggaaaattcgatgccc

SEQ ID NO: 82865 - DNA, 25 bp, Mus musculus
cacaacgtgtctctgatgctggagg

SEQ ID NO: 82866 - DNA, 25 bp, Mus musculus
cacaacgttggactactggcgcatg

SEQ ID NO: 82867 - DNA, 25 bp, Mus musculus
cacaactacctcagcgcagcggttg

SEQ ID NO: 82868 - DNA, 25 bp, Mus musculus
cacaactacttggaaagcatgggcc

SEQ ID NO: 82869 - DNA, 25 bp, Mus musculus
cacaactgcggtgagaatgccgcct

SEQ ID NO: 82870 - DNA, 25 bp, Mus musculus
cacaactggctgaacacgtctaatg

SEQ ID NO: 82871 - DNA, 25 bp, Mus musculus
cacaactgggactttgagccacgca

SEQ ID NO: 82872 - DNA, 25 bp, Mus musculus
cacaactgggaggaactgcaaagcc

SEQ ID NO: 82873 - DNA, 25 bp, Mus musculus
cacaactgggcttggataggagtca

SEQ ID NO: 82874 - DNA, 25 bp, Mus musculus
cacaactgtccatatgattacaaag

SEQ ID NO: 82875 - DNA, 25 bp, Mus musculus
cacaacttgagaatcactgcctaga

SEQ ID NO: 82876 - DNA, 25 bp, Mus musculus
cacaagaaacgtgctgccgaggagc

SEQ ID NO: 82877 - DNA, 25 bp, Mus musculus
cacaagaaccgacactggacctggt

SEQ ID NO: 82878 - DNA, 25 bp, Mus musculus
cacaagacatctgaggacacacaca

SEQ ID NO: 82879 - DNA, 25 bp, Mus musculus
cacaagaccctttgagatggatcga

SEQ ID NO: 82880 - DNA, 25 bp, Mus musculus
cacaagacttgggaaagggcaggac

SEQ ID NO: 82881 - DNA, 25 bp, Mus musculus
cacaagagaacaggaatgcacgtgt

SEQ ID NO: 82882 - DNA, 25 bp, Mus musculus
cacaagagaaggagaacacgtgccc

SEQ ID NO: 82883 - DNA, 25 bp, Mus musculus
cacaagaggctccagttaacgagga

SEQ ID NO: 82884 - DNA, 25 bp, Mus musculus
cacaagataaaaatccgagagagtc

SEQ ID NO: 82885 - DNA, 25 bp, Mus musculus
cacaagatcattttcgttccggaac

SEQ ID NO: 82886 - DNA, 25 bp, Mus musculus
cacaagatgaccttcctaaggagct

SEQ ID NO: 82887 - DNA, 25 bp, Mus musculus
cacaagatgagcacctggaagccat

SEQ ID NO: 82888 - DNA, 25 bp, Mus musculus
cacaagattcccaagctagagccgg

SEQ ID NO: 82889 - DNA, 25 bp, Mus musculus
cacaagattctagtgggaagactcc

SEQ ID NO: 82890 - DNA, 25 bp, Mus musculus
cacaagcaaccctagactgcaggag

SEQ ID NO: 82891 - DNA, 25 bp, Mus musculus
cacaagcagtcagcagatgatgcga

SEQ ID NO: 82892 - DNA, 25 bp, Mus musculus
cacaagcctgccttcactgaggaag

SEQ ID NO: 82893 - DNA, 25 bp, Mus musculus
cacaagcgagagtggtgcagatcca

SEQ ID NO: 82894 - DNA, 25 bp, Mus musculus
cacaagcgggtacacagtggcgaaa

SEQ ID NO: 82895 - DNA, 25 bp, Mus musculus
cacaagcgtcacgaggagggacata

SEQ ID NO: 82896 - DNA, 25 bp, Mus musculus
cacaagcgtctaaggataggccaga

SEQ ID NO: 82897 - DNA, 25 bp, Mus musculus
cacaagctccttgagagttctagcc

SEQ ID NO: 82898 - DNA, 25 bp, Mus musculus
cacaagctgttaggtgccctggagc

SEQ ID NO: 82899 - DNA, 25 bp, Mus musculus
cacaagctgttgagcaggtacctca

SEQ ID NO: 82900 - DNA, 25 bp, Mus musculus
cacaagcttgactttcggaacgacc

SEQ ID NO: 82901 - DNA, 25 bp, Mus musculus
cacaaggaaaatagtggaagcctgc

SEQ ID NO: 82902 - DNA, 25 bp, Mus musculus
cacaaggacaggtcgttatgcccgc

SEQ ID NO: 82903 - DNA, 25 bp, Mus musculus
cacaaggacttcgagccagtggctt

SEQ ID NO: 82904 - DNA, 25 bp, Mus musculus
cacaaggagaaactatacctgagag

SEQ ID NO: 82905 - DNA, 25 bp, Mus musculus
cacaaggaggtggactcaggcacca

SEQ ID NO: 82906 - DNA, 25 bp, Mus musculus
cacaaggagtttgagcaactggccc

SEQ ID NO: 82907 - DNA, 25 bp, Mus musculus
cacaaggcacgctcatggaggaagt

SEQ ID NO: 82908 - DNA, 25 bp, Mus musculus
cacaaggccgtgaatctgtctgaca

SEQ ID NO: 82909 - DNA, 25 bp, Mus musculus
cacaagggacatgctcgatgatgat

SEQ ID NO: 82910 - DNA, 25 bp, Mus musculus
cacaagggaccagtgcaggtgatcc

SEQ ID NO: 82911 - DNA, 25 bp, Mus musculus
cacaagggaggatggttctcggaca

SEQ ID NO: 82912 - DNA, 25 bp, Mus musculus
cacaaggtgacggatagagaagaca

SEQ ID NO: 82913 - DNA, 25 bp, Mus musculus
cacaaggtgcagatgctcatagaca

SEQ ID NO: 82914 - DNA, 25 bp, Mus musculus
cacaaggtgcgtcactctgaggaca

SEQ ID NO: 82915 - DNA, 25 bp, Mus musculus
cacaaggtgctgttaggaagctcca

SEQ ID NO: 82916 - DNA, 25 bp, Mus musculus
cacaaggtgtggtgatggctgcctc

SEQ ID NO: 82917 - DNA, 25 bp, Mus musculus
cacaagtaaccaccagagagctcca

SEQ ID NO: 82918 - DNA, 25 bp, Mus musculus
cacaagtagtgccaagacgcgggct

SEQ ID NO: 82919 - DNA, 25 bp, Mus musculus
cacaagtatgtgttgggccagaaca

SEQ ID NO: 82920 - DNA, 25 bp, Mus musculus
cacaagtcttgggaccatttgggtc

SEQ ID NO: 82921 - DNA, 25 bp, Mus musculus
cacaagtgagactgatcgaatccaa

SEQ ID NO: 82922 - DNA, 25 bp, Mus musculus
cacaagtgaggcgtcaaaggcagca

SEQ ID NO: 82923 - DNA, 25 bp, Mus musculus
cacaagtgatcctgacatgagacgg

SEQ ID NO: 82924 - DNA, 25 bp, Mus musculus
cacaagtggactggtgactcaactc

SEQ ID NO: 82925 - DNA, 25 bp, Mus musculus
cacaagtgggttcgacatctaagcc

SEQ ID NO: 82926 - DNA, 25 bp, Mus musculus
cacaagtgtagcagcccagaggtat

SEQ ID NO: 82927 - DNA, 25 bp, Mus musculus
cacaagtgtgagaacacgccaggct

SEQ ID NO: 82928 - DNA, 25 bp, Mus musculus
cacaagttcctaacctacgggcagc

SEQ ID NO: 82929 - DNA, 25 bp, Mus musculus
cacaagttcgtgagtcccgtggaaa

SEQ ID NO: 82930 - DNA, 25 bp, Mus musculus
cacaagttctactccccgaggaaga

SEQ ID NO: 82931 - DNA, 25 bp, Mus musculus
cacaagttctttgcggctacgtcca

SEQ ID NO: 82932 - DNA, 25 bp, Mus musculus
cacaataactccaagcacgggcgga

SEQ ID NO: 82933 - DNA, 25 bp, Mus musculus
cacaataactttgtaggccgtctca

SEQ ID NO: 82934 - DNA, 25 bp, Mus musculus
cacaatagaggcatatgcgctgtca

SEQ ID NO: 82935 - DNA, 25 bp, Mus musculus
cacaatatgtgcagactaggccatg

SEQ ID NO: 82936 - DNA, 25 bp, Mus musculus
cacaatattcctgtctacaaggaga

SEQ ID NO: 82937 - DNA, 25 bp, Mus musculus
cacaatccacactgcagtggcactg

SEQ ID NO: 82938 - DNA, 25 bp, Mus musculus
cacaatccgtgttgcagtgcaggcc

SEQ ID NO: 82939 - DNA, 25 bp, Mus musculus
cacaatctgtacctttttgaccgga

SEQ ID NO: 82940 - DNA, 25 bp, Mus musculus
cacaatcttacgttgcttatggatg

SEQ ID NO: 82941 - DNA, 25 bp, Mus musculus
cacaatctttgggagtcatgagccc

SEQ ID NO: 82942 - DNA, 25 bp, Mus musculus
cacaatgaaggttctcttactaaaa

SEQ ID NO: 82943 - DNA, 25 bp, Mus musculus
cacaatgacaacagctggatccgac

SEQ ID NO: 82944 - DNA, 25 bp, Mus musculus
cacaatgacattgagctgtacagtc

SEQ ID NO: 82945 - DNA, 25 bp, Mus musculus
cacaatgatgatgaatggtccaaac

SEQ ID NO: 82946 - DNA, 25 bp, Mus musculus
cacaatgcgcacaattggaggctca

SEQ ID NO: 82947 - DNA, 25 bp, Mus musculus
cacaatgcggtggtgcacgaactgc

SEQ ID NO: 82948 - DNA, 25 bp, Mus musculus
cacaatgcttatagccagctgggca

SEQ ID NO: 82949 - DNA, 25 bp, Mus musculus
cacaatgctttggaagaccggtcca

SEQ ID NO: 82950 - DNA, 25 bp, Mus musculus
cacaatggtttccaggcagtgagag

SEQ ID NO: 82951 - DNA, 25 bp, Mus musculus
cacaatgtagactctgatgacctga

SEQ ID NO: 82952 - DNA, 25 bp, Mus musculus
cacaatgtctgtcatcctgttaaca

SEQ ID NO: 82953 - DNA, 25 bp, Mus musculus
cacaattaagatccccaaggcacgg

SEQ ID NO: 82954 - DNA, 25 bp, Mus musculus
cacaattactttatctggaaaacac

SEQ ID NO: 82955 - DNA, 25 bp, Mus musculus
cacaattagtcatggaagaactagg

SEQ ID NO: 82956 - DNA, 25 bp, Mus musculus
cacaattcaagagggagacagccag

SEQ ID NO: 82957 - DNA, 25 bp, Mus musculus
cacaattctgttggtcctgggactc

SEQ ID NO: 82958 - DNA, 25 bp, Mus musculus
cacaattggcctgtttgggaaaact

SEQ ID NO: 82959 - DNA, 25 bp, Mus musculus
cacaattggctttggacagatcaag

SEQ ID NO: 82960 - DNA, 25 bp, Mus musculus
cacacaacatgggtcagctaaaaag

SEQ ID NO: 82961 - DNA, 25 bp, Mus musculus
cacacaagcctcgagttgggcctgg

SEQ ID NO: 82962 - DNA, 25 bp, Mus musculus
cacacaaggagcagatggagcgtca

SEQ ID NO: 82963 - DNA, 25 bp, Mus musculus
cacacaagtgcttctttggccaaag

SEQ ID NO: 82964 - DNA, 25 bp, Mus musculus
cacacaagtgttatgacatcgttcc

SEQ ID NO: 82965 - DNA, 25 bp, Mus musculus
cacacaatgtggagactgtccccga

SEQ ID NO: 82966 - DNA, 25 bp, Mus musculus
cacacacagtgggagagtcacggat

SEQ ID NO: 82967 - DNA, 25 bp, Mus musculus
cacacacataggaaaggaaatctgt

SEQ ID NO: 82968 - DNA, 25 bp, Mus musculus
cacacacatgggaagtgcctgaggc

SEQ ID NO: 82969 - DNA, 25 bp, Mus musculus
cacacaccttgttcctctggaggag

SEQ ID NO: 82970 - DNA, 25 bp, Mus musculus
cacacacgtggagggaaagcattct

SEQ ID NO: 82971 - DNA, 25 bp, Mus musculus
cacacactggatgccatatggatct

SEQ ID NO: 82972 - DNA, 25 bp, Mus musculus
cacacactgtggcagccagaggaca

SEQ ID NO: 82973 - DNA, 25 bp, Mus musculus
cacacacttgcagatggaagccatc

SEQ ID NO: 82974 - DNA, 25 bp, Mus musculus
cacacagaacagaaaggaagtctcc

SEQ ID NO: 82975 - DNA, 25 bp, Mus musculus
cacacagaacgtggaagaatgtatt

SEQ ID NO: 82976 - DNA, 25 bp, Mus musculus
cacacagaaggatcgagtaggcggc

SEQ ID NO: 82977 - DNA, 25 bp, Mus musculus
cacacagactgttgcgggtcctgga

SEQ ID NO: 82978 - DNA, 25 bp, Mus musculus
cacacagagaggtcaatggacatca

SEQ ID NO: 82979 - DNA, 25 bp, Mus musculus
cacacagagcgtgtgtggactcctg

SEQ ID NO: 82980 - DNA, 25 bp, Mus musculus
cacacagaggttggctggcattcca

SEQ ID NO: 82981 - DNA, 25 bp, Mus musculus
cacacagagtggaagaccaggtaca

SEQ ID NO: 82982 - DNA, 25 bp, Mus musculus
cacacagcacagtggtgcccagaga

SEQ ID NO: 82983 - DNA, 25 bp, Mus musculus
cacacagcagatccggctccagtgt

SEQ ID NO: 82984 - DNA, 25 bp, Mus musculus
cacacagcctcggttgggtgaacag

SEQ ID NO: 82985 - DNA, 25 bp, Mus musculus
cacacagcgggtcggtttactacaa

SEQ ID NO: 82986 - DNA, 25 bp, Mus musculus
cacacagctaatggtttgggactat

SEQ ID NO: 82987 - DNA, 25 bp, Mus musculus
cacacagctgtcagatacgggcacg

SEQ ID NO: 82988 - DNA, 25 bp, Mus musculus
cacacagcttcatctgggaccagga

SEQ ID NO: 82989 - DNA, 25 bp, Mus musculus
cacacaggaggaggaatcagatgcc

SEQ ID NO: 82990 - DNA, 25 bp, Mus musculus
cacacaggataatacagcacacgga

SEQ ID NO: 82991 - DNA, 25 bp, Mus musculus
cacacaggatgtacacttcacggag

SEQ ID NO: 82992 - DNA, 25 bp, Mus musculus
cacacaggccatggagaagtacaac

SEQ ID NO: 82993 - DNA, 25 bp, Mus musculus
cacacagggacaggctggtgcatct

SEQ ID NO: 82994 - DNA, 25 bp, Mus musculus
cacacagggcgaagacaagtactac

SEQ ID NO: 82995 - DNA, 25 bp, Mus musculus
cacacagggctaccaacagtcttgt

SEQ ID NO: 82996 - DNA, 25 bp, Mus musculus
cacacagtccgacacgaggagaagg

SEQ ID NO: 82997 - DNA, 25 bp, Mus musculus
cacacagtctcatggaaaaagagcc

SEQ ID NO: 82998 - DNA, 25 bp, Mus musculus
cacacagtctgcaggtttgggcgca

SEQ ID NO: 82999 - DNA, 25 bp, Mus musculus
cacacagtggtatttcggcgcctac

SEQ ID NO: 83000 - DNA, 25 bp, Mus musculus
cacacagtgtgatccaaagacgcct

SEQ ID NO: 83001 - DNA, 25 bp, Mus musculus
cacacagtgttaggagcatctcagc

SEQ ID NO: 83002 - DNA, 25 bp, Mus musculus
cacacagttgtagggagaacacaga

SEQ ID NO: 83003 - DNA, 25 bp, Mus musculus
cacacatagaggactctggagccgc

SEQ ID NO: 83004 - DNA, 25 bp, Mus musculus
cacacatcatggagctggacagtag

SEQ ID NO: 83005 - DNA, 25 bp, Mus musculus
cacacatcgatgagttatatgaaag

SEQ ID NO: 83006 - DNA, 25 bp, Mus musculus
cacacatctgtgctggagcgtctgc

SEQ ID NO: 83007 - DNA, 25 bp, Mus musculus
cacacatgtagtggataggtgaaca

SEQ ID NO: 83008 - DNA, 25 bp, Mus musculus
cacacatgtatgaagacgcccagct

SEQ ID NO: 83009 - DNA, 25 bp, Mus musculus
cacacattagaaactgcagcttgga

SEQ ID NO: 83010 - DNA, 25 bp, Mus musculus
cacacattttttgcaagccacagac

SEQ ID NO: 83011 - DNA, 25 bp, Mus musculus
cacaccaacttaattctgaacgcta

SEQ ID NO: 83012 - DNA, 25 bp, Mus musculus
cacaccaaggagattgacctggtca

SEQ ID NO: 83013 - DNA, 25 bp, Mus musculus
cacacccagaggcattcatgagtcc

SEQ ID NO: 83014 - DNA, 25 bp, Mus musculus
cacacccaggagacttgattgaagt

SEQ ID NO: 83015 - DNA, 25 bp, Mus musculus
cacacccttggagaagtttcgaaag

SEQ ID NO: 83016 - DNA, 25 bp, Mus musculus
cacaccggcggcatagacttggctt

SEQ ID NO: 83017 - DNA, 25 bp, Mus musculus
cacaccgtaggagaaggtcagcttt

SEQ ID NO: 83018 - DNA, 25 bp, Mus musculus
cacaccgtggacaaagcagtactgc

SEQ ID NO: 83019 - DNA, 25 bp, Mus musculus
cacaccgttggctgtggctttcgaa

SEQ ID NO: 83020 - DNA, 25 bp, Mus musculus
cacacctatccatgagcagtgggag

SEQ ID NO: 83021 - DNA, 25 bp, Mus musculus
cacacctgagccaggcatcttctat

SEQ ID NO: 83022 - DNA, 25 bp, Mus musculus
cacacctgatcacatttctggaacg

SEQ ID NO: 83023 - DNA, 25 bp, Mus musculus
cacacctgggaatagagagaggcct

SEQ ID NO: 83024 - DNA, 25 bp, Mus musculus
cacacctgtgagaaatgcagcgtca

SEQ ID NO: 83025 - DNA, 25 bp, Mus musculus
cacaccttggaacattgcactggac

SEQ ID NO: 83026 - DNA, 25 bp, Mus musculus
cacaccttggactgaggatcccaga

SEQ ID NO: 83027 - DNA, 25 bp, Mus musculus
cacacctttgaaccctagggctggg

SEQ ID NO: 83028 - DNA, 25 bp, Mus musculus
cacacgaaagggatcgggcagaagc

SEQ ID NO: 83029 - DNA, 25 bp, Mus musculus
cacacgaagtggcattggtctctgg

SEQ ID NO: 83030 - DNA, 25 bp, Mus musculus
cacacgaatggatcacaagatggcg

SEQ ID NO: 83031 - DNA, 25 bp, Mus musculus
cacacgagcaccatgacagtggcaa

SEQ ID NO: 83032 - DNA, 25 bp, Mus musculus
cacacgagcttgcagagacggagca

SEQ ID NO: 83033 - DNA, 25 bp, Mus musculus
cacacgattgaggacttctggcgaa

SEQ ID NO: 83034 - DNA, 25 bp, Mus musculus
cacacgccaaagatgagtcaaggac

SEQ ID NO: 83035 - DNA, 25 bp, Mus musculus
cacacgctggctgactgatgaggat

SEQ ID NO: 83036 - DNA, 25 bp, Mus musculus
cacacggcctgaagatgaggcggac

SEQ ID NO: 83037 - DNA, 25 bp, Mus musculus
cacacggctgacaaggtgtttacct

SEQ ID NO: 83038 - DNA, 25 bp, Mus musculus
cacacgggaaagtgatggtcgacga

SEQ ID NO: 83039 - DNA, 25 bp, Mus musculus
cacacgggactatgagactaccaga

SEQ ID NO: 83040 - DNA, 25 bp, Mus musculus
cacacgggagagttactagcgacgg

SEQ ID NO: 83041 - DNA, 25 bp, Mus musculus
cacacgggatgatgaccggacagca

SEQ ID NO: 83042 - DNA, 25 bp, Mus musculus
cacacgggctccttagcttttggct

SEQ ID NO: 83043 - DNA, 25 bp, Mus musculus
cacacggtggatggtggccttacat

SEQ ID NO: 83044 - DNA, 25 bp, Mus musculus
cacacggttttacttggtctttgag

SEQ ID NO: 83045 - DNA, 25 bp, Mus musculus
cacacgtcagtggtgagctctggcc

SEQ ID NO: 83046 - DNA, 25 bp, Mus musculus
cacacgtccaaagggttcaagagat

SEQ ID NO: 83047 - DNA, 25 bp, Mus musculus
cacacgtgggatgtcgagatacaca

SEQ ID NO: 83048 - DNA, 25 bp, Mus musculus
cacacgtgttttgcttattggctgc

SEQ ID NO: 83049 - DNA, 25 bp, Mus musculus
cacactacagggagagggcctgagt

SEQ ID NO: 83050 - DNA, 25 bp, Mus musculus
cacactattgtttgggcttggagta

SEQ ID NO: 83051 - DNA, 25 bp, Mus musculus
cacactcaagactccggagagggaa

SEQ ID NO: 83052 - DNA, 25 bp, Mus musculus
cacactccggagagcactgtgcagt

SEQ ID NO: 83053 - DNA, 25 bp, Mus musculus
cacactcctgcgctcctgtgaggtg

SEQ ID NO: 83054 - DNA, 25 bp, Mus musculus
cacactcctgtatgccttatgaaaa

SEQ ID NO: 83055 - DNA, 25 bp, Mus musculus
cacactcgcttgtttgaggacaacg

SEQ ID NO: 83056 - DNA, 25 bp, Mus musculus
cacactctgaagtgggaaccacagc

SEQ ID NO: 83057 - DNA, 25 bp, Mus musculus
cacactcttggaattacggctgggc

SEQ ID NO: 83058 - DNA, 25 bp, Mus musculus
cacactgaatgagagaggagaccac

SEQ ID NO: 83059 - DNA, 25 bp, Mus musculus
cacactgatggaagaatcggccgag

SEQ ID NO: 83060 - DNA, 25 bp, Mus musculus
cacactgatggtagtttggaagtag

SEQ ID NO: 83061 - DNA, 25 bp, Mus musculus
cacactgcagtctggaggctactgg

SEQ ID NO: 83062 - DNA, 25 bp, Mus musculus
cacactggagatggcacctaagaaa

SEQ ID NO: 83063 - DNA, 25 bp, Mus musculus
cacactggaggacgtggcttactcg

SEQ ID NO: 83064 - DNA, 25 bp, Mus musculus
cacactggatttggcggcaagttct

SEQ ID NO: 83065 - DNA, 25 bp, Mus musculus
cacactggcctcagactgatgttcc

SEQ ID NO: 83066 - DNA, 25 bp, Mus musculus
cacactggcctctacacgggagatg

SEQ ID NO: 83067 - DNA, 25 bp, Mus musculus
cacactggcctctctgcagcgattg

SEQ ID NO: 83068 - DNA, 25 bp, Mus musculus
cacactggctgcactgtcagtagga

SEQ ID NO: 83069 - DNA, 25 bp, Mus musculus
cacactggtctgtggtgggaaccaa

SEQ ID NO: 83070 - DNA, 25 bp, Mus musculus
cacactggtgctatttctgggaaga

SEQ ID NO: 83071 - DNA, 25 bp, Mus musculus
cacactgtgagctaggatgcctgac

SEQ ID NO: 83072 - DNA, 25 bp, Mus musculus
cacactgtgctttacgtcctgaaca

SEQ ID NO: 83073 - DNA, 25 bp, Mus musculus
cacactgtggcctgttgtccgagag

SEQ ID NO: 83074 - DNA, 25 bp, Mus musculus
cacactgttgatcggccatggccgg

SEQ ID NO: 83075 - DNA, 25 bp, Mus musculus
cacactgttggctagcctgacaatc

SEQ ID NO: 83076 - DNA, 25 bp, Mus musculus
cacacttgccaagggacgctgtcat

SEQ ID NO: 83077 - DNA, 25 bp, Mus musculus
cacacttgtgctatctatcggagag

SEQ ID NO: 83078 - DNA, 25 bp, Mus musculus
cacacttgttggcatctgtcccagg

SEQ ID NO: 83079 - DNA, 25 bp, Mus musculus
cacactttaaactcagcaggcgatg

SEQ ID NO: 83080 - DNA, 25 bp, Mus musculus
cacactttgtctatgcgttggagca

SEQ ID NO: 83081 - DNA, 25 bp, Mus musculus
cacactttgtggattctggtgcatc

SEQ ID NO: 83082 - DNA, 25 bp, Mus musculus
cacagaaactagatttcacatggat

SEQ ID NO: 83083 - DNA, 25 bp, Mus musculus
cacagaaaggaagaatgaagtcatt

SEQ ID NO: 83084 - DNA, 25 bp, Mus musculus
cacagaaatcgtctctcaggaccag

SEQ ID NO: 83085 - DNA, 25 bp, Mus musculus
cacagaacacatatgaggagctcca

SEQ ID NO: 83086 - DNA, 25 bp, Mus musculus
cacagaacagatcaccaacgagaag

SEQ ID NO: 83087 - DNA, 25 bp, Mus musculus
cacagaagcacaaaacagagggcga

SEQ ID NO: 83088 - DNA, 25 bp, Mus musculus
cacagaagcgtctgaaaatagagga

SEQ ID NO: 83089 - DNA, 25 bp, Mus musculus
cacagaaggagaactatcggcagga

SEQ ID NO: 83090 - DNA, 25 bp, Mus musculus
cacagaaggcttgcctgaggagcag

SEQ ID NO: 83091 - DNA, 25 bp, Mus musculus
cacagaaggtgaccctgagcctgaa

SEQ ID NO: 83092 - DNA, 25 bp, Mus musculus
cacagaagtcagtgaactggctgct

SEQ ID NO: 83093 - DNA, 25 bp, Mus musculus
cacagaagtcgtgaaggccaaggct

SEQ ID NO: 83094 - DNA, 25 bp, Mus musculus
cacagaagtgcgatctggtgaccac

SEQ ID NO: 83095 - DNA, 25 bp, Mus musculus
cacagaagttaatgcggacagacag

SEQ ID NO: 83096 - DNA, 25 bp, Mus musculus
cacagaatacgttattacgacagga

SEQ ID NO: 83097 - DNA, 25 bp, Mus musculus
cacagaatactctacgtgggcggag

SEQ ID NO: 83098 - DNA, 25 bp, Mus musculus
cacagaatcaacatggtctccagtg

SEQ ID NO: 83099 - DNA, 25 bp, Mus musculus
cacagaatgaaaggaatgcgagggc

SEQ ID NO: 83100 - DNA, 25 bp, Mus musculus
cacagaatgaatgactggaccggca

SEQ ID NO: 83101 - DNA, 25 bp, Mus musculus
cacagaatgatgtcaagggctgcca

SEQ ID NO: 83102 - DNA, 25 bp, Mus musculus
cacagaatgttcatgccctggtctc

SEQ ID NO: 83103 - DNA, 25 bp, Mus musculus
cacagacaaagtgcgccaagtgggc

SEQ ID NO: 83104 - DNA, 25 bp, Mus musculus
cacagacaccaaataagatagccat

SEQ ID NO: 83105 - DNA, 25 bp, Mus musculus
cacagacaccagacttgcttgcaag

SEQ ID NO: 83106 - DNA, 25 bp, Mus musculus
cacagacagctaaagaaccgaggac

SEQ ID NO: 83107 - DNA, 25 bp, Mus musculus
cacagacagttctctacatggcaga

SEQ ID NO: 83108 - DNA, 25 bp, Mus musculus
cacagacatcgagtattggtagtac

SEQ ID NO: 83109 - DNA, 25 bp, Mus musculus
cacagacatgacaggagctcaggca

SEQ ID NO: 83110 - DNA, 25 bp, Mus musculus
cacagaccgatgcaatggatccaga

SEQ ID NO: 83111 - DNA, 25 bp, Mus musculus
cacagaccgggctggcaggaaataa

SEQ ID NO: 83112 - DNA, 25 bp, Mus musculus
cacagacgatgtggtggacatagca

SEQ ID NO: 83113 - DNA, 25 bp, Mus musculus
cacagacgctggattgccttgagac

SEQ ID NO: 83114 - DNA, 25 bp, Mus musculus
cacagacggttcagcagtggtgcca

SEQ ID NO: 83115 - DNA, 25 bp, Mus musculus
cacagacgtggtttccgagctcaga

SEQ ID NO: 83116 - DNA, 25 bp, Mus musculus
cacagacgttataatcttaagaaca

SEQ ID NO: 83117 - DNA, 25 bp, Mus musculus
cacagactcctgagtggcccaagaa

SEQ ID NO: 83118 - DNA, 25 bp, Mus musculus
cacagactgggaaaaatgaagacaa

SEQ ID NO: 83119 - DNA, 25 bp, Mus musculus
cacagactgggaactgaatgctcta

SEQ ID NO: 83120 - DNA, 25 bp, Mus musculus
cacagagaactcagctaaggaagaa

SEQ ID NO: 83121 - DNA, 25 bp, Mus musculus
cacagagacagatgaactttgggcc

SEQ ID NO: 83122 - DNA, 25 bp, Mus musculus
cacagagacctcaagtcaagaaacg

SEQ ID NO: 83123 - DNA, 25 bp, Mus musculus
cacagagagctttgcacagggatgt

SEQ ID NO: 83124 - DNA, 25 bp, Mus musculus
cacagagagtttccaacgtgagatc

SEQ ID NO: 83125 - DNA, 25 bp, Mus musculus
cacagagatggaaaacctggccatt

SEQ ID NO: 83126 - DNA, 25 bp, Mus musculus
cacagagcgggcagtgactatctca

SEQ ID NO: 83127 - DNA, 25 bp, Mus musculus
cacagagctgcatccagttttcctg

SEQ ID NO: 83128 - DNA, 25 bp, Mus musculus
cacagaggaaagctcgaggtcaggg

SEQ ID NO: 83129 - DNA, 25 bp, Mus musculus
cacagaggagaatttacagtctgtc

SEQ ID NO: 83130 - DNA, 25 bp, Mus musculus
cacagaggaggacattgttttcctg

SEQ ID NO: 83131 - DNA, 25 bp, Mus musculus
cacagaggaggtctttcgaagctac

SEQ ID NO: 83132 - DNA, 25 bp, Mus musculus
cacagaggcagccaccgtggcagtt

SEQ ID NO: 83133 - DNA, 25 bp, Mus musculus
cacagaggccagtaacgggtcgtaa

SEQ ID NO: 83134 - DNA, 25 bp, Mus musculus
cacagaggccttccgggttgtagaa

SEQ ID NO: 83135 - DNA, 25 bp, Mus musculus
cacagagggaacgtcttggacatca

SEQ ID NO: 83136 - DNA, 25 bp, Mus musculus
cacagagggttttgatgggtcacta

SEQ ID NO: 83137 - DNA, 25 bp, Mus musculus
cacagaggtccgtctgaatcgagct

SEQ ID NO: 83138 - DNA, 25 bp, Mus musculus
cacagaggttcttctccgagccggt

SEQ ID NO: 83139 - DNA, 25 bp, Mus musculus
cacagaggttgctgggctgcttcca

SEQ ID NO: 83140 - DNA, 25 bp, Mus musculus
cacagagtcgttctcggagccgaag

SEQ ID NO: 83141 - DNA, 25 bp, Mus musculus
cacagagtctcctaagccagtgtct

SEQ ID NO: 83142 - DNA, 25 bp, Mus musculus
cacagagtggactgggtcaacctgc

SEQ ID NO: 83143 - DNA, 25 bp, Mus musculus
cacagagtgggaatgagacccttcc

SEQ ID NO: 83144 - DNA, 25 bp, Mus musculus
cacagagttgactgtaggcgctgca

SEQ ID NO: 83145 - DNA, 25 bp, Mus musculus
cacagagtttacatccaggcctagg

SEQ ID NO: 83146 - DNA, 25 bp, Mus musculus
cacagataaccacaatccaatgaag

SEQ ID NO: 83147 - DNA, 25 bp, Mus musculus
cacagatcatgagtcctttggccaa

SEQ ID NO: 83148 - DNA, 25 bp, Mus musculus
cacagatcattgtcatgctgccaga

SEQ ID NO: 83149 - DNA, 25 bp, Mus musculus
cacagatcgttcagacaggagccaa

SEQ ID NO: 83150 - DNA, 25 bp, Mus musculus
cacagatctttccaagaaggcaggg

SEQ ID NO: 83151 - DNA, 25 bp, Mus musculus
cacagatgaagaaggaatggccttc

SEQ ID NO: 83152 - DNA, 25 bp, Mus musculus
cacagatgaatgctgcaaaggttga

SEQ ID NO: 83153 - DNA, 25 bp, Mus musculus
cacagatgacttttcctacgggatg

SEQ ID NO: 83154 - DNA, 25 bp, Mus musculus
cacagatgagcggaaaatgagacta

SEQ ID NO: 83155 - DNA, 25 bp, Mus musculus
cacagatgcctatcaagacgtgtct

SEQ ID NO: 83156 - DNA, 25 bp, Mus musculus
cacagatgcctgaagaagttcctca

SEQ ID NO: 83157 - DNA, 25 bp, Mus musculus
cacagatggaaggatgcaaagcaac

SEQ ID NO: 83158 - DNA, 25 bp, Mus musculus
cacagatggtgatggtccagtggcc

SEQ ID NO: 83159 - DNA, 25 bp, Mus musculus
cacagatggtgtatgagctgaggac

SEQ ID NO: 83160 - DNA, 25 bp, Mus musculus
cacagcagaagaggaatgtcgccca

SEQ ID NO: 83161 - DNA, 25 bp, Mus musculus
cacagcagacgaagcaggatggtcc

SEQ ID NO: 83162 - DNA, 25 bp, Mus musculus
cacagcagggatcgtcaggtaataa

SEQ ID NO: 83163 - DNA, 25 bp, Mus musculus
cacagcaggtcaggagagattccac

SEQ ID NO: 83164 - DNA, 25 bp, Mus musculus
cacagcagtactgaggagcacggac

SEQ ID NO: 83165 - DNA, 25 bp, Mus musculus
cacagcagtccgagaggtttttgaa

SEQ ID NO: 83166 - DNA, 25 bp, Mus musculus
cacagcagttgtgttcagcctgaaa

SEQ ID NO: 83167 - DNA, 25 bp, Mus musculus
cacagcatgagtgaccctggagtaa

SEQ ID NO: 83168 - DNA, 25 bp, Mus musculus
cacagcatgcgtactgactgggcag

SEQ ID NO: 83169 - DNA, 25 bp, Mus musculus
cacagcatggcaagcttgtcctgta

SEQ ID NO: 83170 - DNA, 25 bp, Mus musculus
cacagcattatgtcagtagctcaga

SEQ ID NO: 83171 - DNA, 25 bp, Mus musculus
cacagcccagtgaggacgtctttac

SEQ ID NO: 83172 - DNA, 25 bp, Mus musculus
cacagccctgatgattgcgtcgaag

SEQ ID NO: 83173 - DNA, 25 bp, Mus musculus
cacagccctgcctcttgatggagtg

SEQ ID NO: 83174 - DNA, 25 bp, Mus musculus
cacagcctagggatctttgaaaaga

SEQ ID NO: 83175 - DNA, 25 bp, Mus musculus
cacagcctcagagcacagggtgatt

SEQ ID NO: 83176 - DNA, 25 bp, Mus musculus
cacagcctgacttcggagctaggga

SEQ ID NO: 83177 - DNA, 25 bp, Mus musculus
cacagcctgggtcctcaagatgagt

SEQ ID NO: 83178 - DNA, 25 bp, Mus musculus
cacagcctggtggtgtgccaagtgc

SEQ ID NO: 83179 - DNA, 25 bp, Mus musculus
cacagcctgtaaactttccccaaag

SEQ ID NO: 83180 - DNA, 25 bp, Mus musculus
cacagccttatgaggagatgccctg

SEQ ID NO: 83181 - DNA, 25 bp, Mus musculus
cacagcgaagcagtgctggagtcct

SEQ ID NO: 83182 - DNA, 25 bp, Mus musculus
cacagcgaatgtgtcggtatccgac

SEQ ID NO: 83183 - DNA, 25 bp, Mus musculus
cacagcgagctggttggagaaatta

SEQ ID NO: 83184 - DNA, 25 bp, Mus musculus
cacagcggagcaggctaaggtttcc

SEQ ID NO: 83185 - DNA, 25 bp, Mus musculus
cacagcggcgagaagcagtacaaat

SEQ ID NO: 83186 - DNA, 25 bp, Mus musculus
cacagcgtgagggttctgcaggaac

SEQ ID NO: 83187 - DNA, 25 bp, Mus musculus
cacagctacttctcgtggattctag

SEQ ID NO: 83188 - DNA, 25 bp, Mus musculus
cacagctatctgagtgacagcgaca

SEQ ID NO: 83189 - DNA, 25 bp, Mus musculus
cacagctcaaggagagaaagagatg

SEQ ID NO: 83190 - DNA, 25 bp, Mus musculus
cacagctcacagtggatggtagctg

SEQ ID NO: 83191 - DNA, 25 bp, Mus musculus
cacagctctgcgatatgcccatgga

SEQ ID NO: 83192 - DNA, 25 bp, Mus musculus
cacagctgaagcagtggaaacattt

SEQ ID NO: 83193 - DNA, 25 bp, Mus musculus
cacagctgaattcccttctcagtgc

SEQ ID NO: 83194 - DNA, 25 bp, Mus musculus
cacagctgagcttaactatgggtta

SEQ ID NO: 83195 - DNA, 25 bp, Mus musculus
cacagctgccgaccttgtctttggg

SEQ ID NO: 83196 - DNA, 25 bp, Mus musculus
cacagctggaactacaaggagacct

SEQ ID NO: 83197 - DNA, 25 bp, Mus musculus
cacagctggaagaacgatgggatct

SEQ ID NO: 83198 - DNA, 25 bp, Mus musculus
cacagctggccggaatgcagatcag

SEQ ID NO: 83199 - DNA, 25 bp, Mus musculus
cacagctgggcagatgtgcatctat

SEQ ID NO: 83200 - DNA, 25 bp, Mus musculus
cacagctgtcaggagaagggtcaag

SEQ ID NO: 83201 - DNA, 25 bp, Mus musculus
cacagctgtgaaaacgcagttactg

SEQ ID NO: 83202 - DNA, 25 bp, Mus musculus
cacagctgtgttggaccgggagtcc

SEQ ID NO: 83203 - DNA, 25 bp, Mus musculus
cacagcttcctgatgagcagaaagg

SEQ ID NO: 83204 - DNA, 25 bp, Mus musculus
cacagcttgattccatgggtagtct

SEQ ID NO: 83205 - DNA, 25 bp, Mus musculus
cacagcttgggtgttctctaggccc

SEQ ID NO: 83206 - DNA, 25 bp, Mus musculus
cacagcttggtgagacgtgcttaca

SEQ ID NO: 83207 - DNA, 25 bp, Mus musculus
cacagctttcatcgagacctgggca

SEQ ID NO: 83208 - DNA, 25 bp, Mus musculus
cacaggaaacggttcctctcccagg

SEQ ID NO: 83209 - DNA, 25 bp, Mus musculus
cacaggaacctgagcagtggctgga

SEQ ID NO: 83210 - DNA, 25 bp, Mus musculus
cacaggaacttgagggaatgctgac

SEQ ID NO: 83211 - DNA, 25 bp, Mus musculus
cacaggaagaatgcccgtcctcaga

SEQ ID NO: 83212 - DNA, 25 bp, Mus musculus
cacaggaagagtgagcttttgccca

SEQ ID NO: 83213 - DNA, 25 bp, Mus musculus
cacaggaatgatggtggcagcctcc

SEQ ID NO: 83214 - DNA, 25 bp, Mus musculus
cacaggaccctgatgggcgatgcat

SEQ ID NO: 83215 - DNA, 25 bp, Mus musculus
cacaggacctgagcgatgtgtctac

SEQ ID NO: 83216 - DNA, 25 bp, Mus musculus
cacaggaccttgtacagtgctccac

SEQ ID NO: 83217 - DNA, 25 bp, Mus musculus
cacaggactcacaagaacacggttc

SEQ ID NO: 83218 - DNA, 25 bp, Mus musculus
cacaggactggactgcatgactgca

SEQ ID NO: 83219 - DNA, 25 bp, Mus musculus
cacaggagcggtggatgtgaccctc

SEQ ID NO: 83220 - DNA, 25 bp, Mus musculus
cacaggaggcctgacagcgttacgt

SEQ ID NO: 83221 - DNA, 25 bp, Mus musculus
cacaggaggctggtaaatgggccaa

SEQ ID NO: 83222 - DNA, 25 bp, Mus musculus
cacaggagtcagttagcagagcttc

SEQ ID NO: 83223 - DNA, 25 bp, Mus musculus
cacaggagttaagtgcaggtgccct

SEQ ID NO: 83224 - DNA, 25 bp, Mus musculus
cacaggagtttctggttcccaatga

SEQ ID NO: 83225 - DNA, 25 bp, Mus musculus
cacaggatcttgacagcggcagaga

SEQ ID NO: 83226 - DNA, 25 bp, Mus musculus
cacaggatgatgacaggcttcgaga

SEQ ID NO: 83227 - DNA, 25 bp, Mus musculus
cacaggattctctcagtatgctcag

SEQ ID NO: 83228 - DNA, 25 bp, Mus musculus
cacaggattctgtttgccgcacaga

SEQ ID NO: 83229 - DNA, 25 bp, Mus musculus
cacaggcagctggtcaatatttact

SEQ ID NO: 83230 - DNA, 25 bp, Mus musculus
cacaggcaggagtctagtgtccggc

SEQ ID NO: 83231 - DNA, 25 bp, Mus musculus
cacaggcatgtgtccctgaagcagg

SEQ ID NO: 83232 - DNA, 25 bp, Mus musculus
cacaggcatttcgtgccgtgtggag

SEQ ID NO: 83233 - DNA, 25 bp, Mus musculus
cacaggccagctctcaagtagtcat

SEQ ID NO: 83234 - DNA, 25 bp, Mus musculus
cacaggccgcgctcttaatggatta

SEQ ID NO: 83235 - DNA, 25 bp, Mus musculus
cacaggcgccaagggaaagctttct

SEQ ID NO: 83236 - DNA, 25 bp, Mus musculus
cacaggcgtccatgcttacagaatc

SEQ ID NO: 83237 - DNA, 25 bp, Mus musculus
cacaggctcagtcgccaggcagtct

SEQ ID NO: 83238 - DNA, 25 bp, Mus musculus
cacaggctgactctgtagggagcat

SEQ ID NO: 83239 - DNA, 25 bp, Mus musculus
cacaggctgagcaattggttccgaa

SEQ ID NO: 83240 - DNA, 25 bp, Mus musculus
cacaggctgctcgaaagaagaagaa

SEQ ID NO: 83241 - DNA, 25 bp, Mus musculus
cacaggctggtgaatgactactttc

SEQ ID NO: 83242 - DNA, 25 bp, Mus musculus
cacaggctgtaatctcgagggcttc

SEQ ID NO: 83243 - DNA, 25 bp, Mus musculus
cacaggcttaattttgattgataca

SEQ ID NO: 83244 - DNA, 25 bp, Mus musculus
cacaggctttcctcactacagggtg

SEQ ID NO: 83245 - DNA, 25 bp, Mus musculus
cacagggacagggaagaaatcagcc

SEQ ID NO: 83246 - DNA, 25 bp, Mus musculus
cacagggaccttgtagagaagcaga

SEQ ID NO: 83247 - DNA, 25 bp, Mus musculus
cacagggagcacactgaatggcagg

SEQ ID NO: 83248 - DNA, 25 bp, Mus musculus
cacagggagcttccggaagtgacca

SEQ ID NO: 83249 - DNA, 25 bp, Mus musculus
cacagggagtagaaaccgtggccca

SEQ ID NO: 83250 - DNA, 25 bp, Mus musculus
cacagggccagaggcatcagttctg

SEQ ID NO: 83251 - DNA, 25 bp, Mus musculus
cacagggccttggtgctggaagaac

SEQ ID NO: 83252 - DNA, 25 bp, Mus musculus
cacagggctttcttcactcttggtc

SEQ ID NO: 83253 - DNA, 25 bp, Mus musculus
cacagggtcagccactgaggttcct

SEQ ID NO: 83254 - DNA, 25 bp, Mus musculus
cacagggtctcccactgcaaaggaa

SEQ ID NO: 83255 - DNA, 25 bp, Mus musculus
cacagggtctgtgttgttggccacc

SEQ ID NO: 83256 - DNA, 25 bp, Mus musculus
cacagggtttagtgggtgccttgcc

SEQ ID NO: 83257 - DNA, 25 bp, Mus musculus
cacaggtactcacgctcaggtggaa

SEQ ID NO: 83258 - DNA, 25 bp, Mus musculus
cacaggtccgttggtggcgtgctac

SEQ ID NO: 83259 - DNA, 25 bp, Mus musculus
cacaggtcggatgggaaatttcaga

SEQ ID NO: 83260 - DNA, 25 bp, Mus musculus
cacaggtgccgtcttgggttatctc

SEQ ID NO: 83261 - DNA, 25 bp, Mus musculus
cacaggtggtcgaagggtctcaaag

SEQ ID NO: 83262 - DNA, 25 bp, Mus musculus
cacaggtggtgctcagtcagagtcc

SEQ ID NO: 83263 - DNA, 25 bp, Mus musculus
cacaggtgtggccttagatgcccga

SEQ ID NO: 83264 - DNA, 25 bp, Mus musculus
cacaggttgaaatactgaagtctcc

SEQ ID NO: 83265 - DNA, 25 bp, Mus musculus
cacagtaaggagtgccacggtggtc

SEQ ID NO: 83266 - DNA, 25 bp, Mus musculus
cacagtacctttggcaccggttcag

SEQ ID NO: 83267 - DNA, 25 bp, Mus musculus
cacagtactattgaggcctgcacaa

SEQ ID NO: 83268 - DNA, 25 bp, Mus musculus
cacagtagctgagaaggttgaccgg

SEQ ID NO: 83269 - DNA, 25 bp, Mus musculus
cacagtatcagggttcgtccagctc

SEQ ID NO: 83270 - DNA, 25 bp, Mus musculus
cacagtatcgaacgtccggctggct

SEQ ID NO: 83271 - DNA, 25 bp, Mus musculus
cacagtatctgtccgagaaggtcaa

SEQ ID NO: 83272 - DNA, 25 bp, Mus musculus
cacagtatgaggagataagcatccc

SEQ ID NO: 83273 - DNA, 25 bp, Mus musculus
cacagtatgttccttcagatggtac

SEQ ID NO: 83274 - DNA, 25 bp, Mus musculus
cacagtattactgcgagagggttcc

SEQ ID NO: 83275 - DNA, 25 bp, Mus musculus
cacagtcaacgccaacagaggagct

SEQ ID NO: 83276 - DNA, 25 bp, Mus musculus
cacagtcaagaagaagcgggaatct

SEQ ID NO: 83277 - DNA, 25 bp, Mus musculus
cacagtcaatagtgaccggctccat

SEQ ID NO: 83278 - DNA, 25 bp, Mus musculus
cacagtcagccatgttcaaccaggt

SEQ ID NO: 83279 - DNA, 25 bp, Mus musculus
cacagtcagggtcatctattcagag

SEQ ID NO: 83280 - DNA, 25 bp, Mus musculus
cacagtcagtcttcatggcaggtat

SEQ ID NO: 83281 - DNA, 25 bp, Mus musculus
cacagtcatccggacaggaaagcca

SEQ ID NO: 83282 - DNA, 25 bp, Mus musculus
cacagtcattaaaggccaggagcgg

SEQ ID NO: 83283 - DNA, 25 bp, Mus musculus
cacagtccagggtcacgatgtagct

SEQ ID NO: 83284 - DNA, 25 bp, Mus musculus
cacagtccctgtagtagaagccacc

SEQ ID NO: 83285 - DNA, 25 bp, Mus musculus
cacagtcctgctaaactggtctgga

SEQ ID NO: 83286 - DNA, 25 bp, Mus musculus
cacagtcctgtaccacgaatcttgg

SEQ ID NO: 83287 - DNA, 25 bp, Mus musculus
cacagtcgaatggaaagtggcctca

SEQ ID NO: 83288 - DNA, 25 bp, Mus musculus
cacagtcgactgaaaattcctaggc

SEQ ID NO: 83289 - DNA, 25 bp, Mus musculus
cacagtcgcttcagtcttaccaaga

SEQ ID NO: 83290 - DNA, 25 bp, Mus musculus
cacagtcggtatgttagctgcctct

SEQ ID NO: 83291 - DNA, 25 bp, Mus musculus
cacagtcgtgtgtattatgagagga

SEQ ID NO: 83292 - DNA, 25 bp, Mus musculus
cacagtctccaaagtattctactta

SEQ ID NO: 83293 - DNA, 25 bp, Mus musculus
cacagtctcgcatggtggcagcgac

SEQ ID NO: 83294 - DNA, 25 bp, Mus musculus
cacagtctgaatggttcgggagcac

SEQ ID NO: 83295 - DNA, 25 bp, Mus musculus
cacagtgaagtacgcgtattatgac

SEQ ID NO: 83296 - DNA, 25 bp, Mus musculus
cacagtgaagtagtagcaattctcc

SEQ ID NO: 83297 - DNA, 25 bp, Mus musculus
cacagtgagaagtggatagcgccac

SEQ ID NO: 83298 - DNA, 25 bp, Mus musculus
cacagtgagcagagttgtcatcccc

SEQ ID NO: 83299 - DNA, 25 bp, Mus musculus
cacagtgagctgttccgggagctgc

SEQ ID NO: 83300 - DNA, 25 bp, Mus musculus
cacagtgagggttgtttcctgacaa

SEQ ID NO: 83301 - DNA, 25 bp, Mus musculus
cacagtgaggtcatttccacccggt

SEQ ID NO: 83302 - DNA, 25 bp, Mus musculus
cacagtgcaagcgtgtagggacaca

SEQ ID NO: 83303 - DNA, 25 bp, Mus musculus
cacagtgcaccatgagcggaagttt

SEQ ID NO: 83304 - DNA, 25 bp, Mus musculus
cacagtgccagatcggaagagggaa

SEQ ID NO: 83305 - DNA, 25 bp, Mus musculus
cacagtgcgcatgctcggtagctgc

SEQ ID NO: 83306 - DNA, 25 bp, Mus musculus
cacagtggaaaacatgggcagagtt

SEQ ID NO: 83307 - DNA, 25 bp, Mus musculus
cacagtggcgctggtgaaaaagaca

SEQ ID NO: 83308 - DNA, 25 bp, Mus musculus
cacagtggctcagagaagtcagcct

SEQ ID NO: 83309 - DNA, 25 bp, Mus musculus
cacagtgggaggtatatcatgacca

SEQ ID NO: 83310 - DNA, 25 bp, Mus musculus
cacagtgggcacagtatcgagaatc

SEQ ID NO: 83311 - DNA, 25 bp, Mus musculus
cacagtgggccaattatgtcaaggg

SEQ ID NO: 83312 - DNA, 25 bp, Mus musculus
cacagtggtccaggaagattcgcag

SEQ ID NO: 83313 - DNA, 25 bp, Mus musculus
cacagtggtggcagatcctcttggg

SEQ ID NO: 83314 - DNA, 25 bp, Mus musculus
cacagtgtatgaagaccaactagca

SEQ ID NO: 83315 - DNA, 25 bp, Mus musculus
cacagtgtcccacgaggagttcgat

SEQ ID NO: 83316 - DNA, 25 bp, Mus musculus
cacagtgtcctgtgttgagccccag

SEQ ID NO: 83317 - DNA, 25 bp, Mus musculus
cacagtgtgaagaattgccctaccc

SEQ ID NO: 83318 - DNA, 25 bp, Mus musculus
cacagtgtgatccagcttgctcgaa

SEQ ID NO: 83319 - DNA, 25 bp, Mus musculus
cacagtgtgtattgcggtcgttgga

SEQ ID NO: 83320 - DNA, 25 bp, Mus musculus
cacagtgttcatcttaagttgcagt

SEQ ID NO: 83321 - DNA, 25 bp, Mus musculus
cacagtgttgtggtccagctgcagc

SEQ ID NO: 83322 - DNA, 25 bp, Mus musculus
cacagttacggaggatggagtcttc

SEQ ID NO: 83323 - DNA, 25 bp, Mus musculus
cacagttacttagagcgccatggtc

SEQ ID NO: 83324 - DNA, 25 bp, Mus musculus
cacagttagagataaatgggcggaa

SEQ ID NO: 83325 - DNA, 25 bp, Mus musculus
cacagttcacacagaggaaggcaga

SEQ ID NO: 83326 - DNA, 25 bp, Mus musculus
cacagttcatcattggacccggagg

SEQ ID NO: 83327 - DNA, 25 bp, Mus musculus
cacagttccgatttgctgaggagaa

SEQ ID NO: 83328 - DNA, 25 bp, Mus musculus
cacagttcctccatggctcagaagg

SEQ ID NO: 83329 - DNA, 25 bp, Mus musculus
cacagttcgtggagagcttaaagga

SEQ ID NO: 83330 - DNA, 25 bp, Mus musculus
cacagttggcgtagacggttctctc

SEQ ID NO: 83331 - DNA, 25 bp, Mus musculus
cacagttggttcaaggcaagtggta

SEQ ID NO: 83332 - DNA, 25 bp, Mus musculus
cacagttgtgagaaagaaaacagtt

SEQ ID NO: 83333 - DNA, 25 bp, Mus musculus
cacagttgttcctcccatggtggga

SEQ ID NO: 83334 - DNA, 25 bp, Mus musculus
cacagtttcggttggagattttaca

SEQ ID NO: 83335 - DNA, 25 bp, Mus musculus
cacagtttgaggctcaggctcggaa

SEQ ID NO: 83336 - DNA, 25 bp, Mus musculus
cacagtttgcgggactcagtcccat

SEQ ID NO: 83337 - DNA, 25 bp, Mus musculus
cacataagcaaaggcaacagttggc

SEQ ID NO: 83338 - DNA, 25 bp, Mus musculus
cacatacagctgatgcacgggatca

SEQ ID NO: 83339 - DNA, 25 bp, Mus musculus
cacatacaggttctagctcggaaga

SEQ ID NO: 83340 - DNA, 25 bp, Mus musculus
cacatacatctagaaggcaagccga

SEQ ID NO: 83341 - DNA, 25 bp, Mus musculus
cacatacattatggacaaaggcttc

SEQ ID NO: 83342 - DNA, 25 bp, Mus musculus
cacatacgatggcaaccaggtgggc

SEQ ID NO: 83343 - DNA, 25 bp, Mus musculus
cacatactaagttggagcgctctct

SEQ ID NO: 83344 - DNA, 25 bp, Mus musculus
cacatactgggttctctcgggctgg

SEQ ID NO: 83345 - DNA, 25 bp, Mus musculus
cacatagacgatttggactttgcag

SEQ ID NO: 83346 - DNA, 25 bp, Mus musculus
cacatatttcatctggtgccaggcg

SEQ ID NO: 83347 - DNA, 25 bp, Mus musculus
cacatatttccttaagggagacaag

SEQ ID NO: 83348 - DNA, 25 bp, Mus musculus
cacatcaacctgcagtatagcacaa

SEQ ID NO: 83349 - DNA, 25 bp, Mus musculus
cacatcacctcattcctgattccat

SEQ ID NO: 83350 - DNA, 25 bp, Mus musculus
cacatcacctgcaagaagacgggaa

SEQ ID NO: 83351 - DNA, 25 bp, Mus musculus
cacatcaggtgttttcagtgtgact

SEQ ID NO: 83352 - DNA, 25 bp, Mus musculus
cacatcatcatcagtggccacaatg

SEQ ID NO: 83353 - DNA, 25 bp, Mus musculus
cacatcattcgatggctttagcagc

SEQ ID NO: 83354 - DNA, 25 bp, Mus musculus
cacatccactgaagctgaggcgcat

SEQ ID NO: 83355 - DNA, 25 bp, Mus musculus
cacatcccggcgtatgagtgagttc

SEQ ID NO: 83356 - DNA, 25 bp, Mus musculus
cacatccggatgcataagattctgc

SEQ ID NO: 83357 - DNA, 25 bp, Mus musculus
cacatccgtgactcggtgagcgcag

SEQ ID NO: 83358 - DNA, 25 bp, Mus musculus
cacatcctagttgtggtgacccagt

SEQ ID NO: 83359 - DNA, 25 bp, Mus musculus
cacatcctgcgtagagatgggcagc

SEQ ID NO: 83360 - DNA, 25 bp, Mus musculus
cacatcctgggagaaacgaagggcc

SEQ ID NO: 83361 - DNA, 25 bp, Mus musculus
cacatcgagattattccagggccca

SEQ ID NO: 83362 - DNA, 25 bp, Mus musculus
cacatcgagggctgagaaacaggag

SEQ ID NO: 83363 - DNA, 25 bp, Mus musculus
cacatcgagtgctctaccatggcca

SEQ ID NO: 83364 - DNA, 25 bp, Mus musculus
cacatcgagtttctgtcaaggactg

SEQ ID NO: 83365 - DNA, 25 bp, Mus musculus
cacatcgcagtcagcttctcagagg

SEQ ID NO: 83366 - DNA, 25 bp, Mus musculus
cacatcgcatctttggctgggcaag

SEQ ID NO: 83367 - DNA, 25 bp, Mus musculus
cacatcggaggtagggtggtcacac

SEQ ID NO: 83368 - DNA, 25 bp, Mus musculus
cacatcgggactgaggtcattctgg

SEQ ID NO: 83369 - DNA, 25 bp, Mus musculus
cacatcggtgtgtatgacaggcgtc

SEQ ID NO: 83370 - DNA, 25 bp, Mus musculus
cacatcgtgcttggtagaagctctg

SEQ ID NO: 83371 - DNA, 25 bp, Mus musculus
cacatcgtggaagtgacagaggacg

SEQ ID NO: 83372 - DNA, 25 bp, Mus musculus
cacatctcctaacaggtactgtttc

SEQ ID NO: 83373 - DNA, 25 bp, Mus musculus
cacatctcgggtgactgaggacaca

SEQ ID NO: 83374 - DNA, 25 bp, Mus musculus
cacatctgcattaactgatgctgta

SEQ ID NO: 83375 - DNA, 25 bp, Mus musculus
cacatcttctaaacaaacattgagg

SEQ ID NO: 83376 - DNA, 25 bp, Mus musculus
cacatcttgaacatggcccgggaga

SEQ ID NO: 83377 - DNA, 25 bp, Mus musculus
cacatgacagcctggtgggacttcg

SEQ ID NO: 83378 - DNA, 25 bp, Mus musculus
cacatgacttgatctgcgggtgcag

SEQ ID NO: 83379 - DNA, 25 bp, Mus musculus
cacatgagccaaaggtaagatgcat

SEQ ID NO: 83380 - DNA, 25 bp, Mus musculus
cacatgagctccctgaggtccgtgt

SEQ ID NO: 83381 - DNA, 25 bp, Mus musculus
cacatgaggcacttgcccgaaggct

SEQ ID NO: 83382 - DNA, 25 bp, Mus musculus
cacatgatggctttcattgaacaag

SEQ ID NO: 83383 - DNA, 25 bp, Mus musculus
cacatgatggtgtctaggccagaac

SEQ ID NO: 83384 - DNA, 25 bp, Mus musculus
cacatgcacctcgtgagacctggga

SEQ ID NO: 83385 - DNA, 25 bp, Mus musculus
cacatgcagggagggtgaacgtcaa

SEQ ID NO: 83386 - DNA, 25 bp, Mus musculus
cacatgcctcatggagggagcccaa

SEQ ID NO: 83387 - DNA, 25 bp, Mus musculus
cacatgcgaagcatgttgcatcaca

SEQ ID NO: 83388 - DNA, 25 bp, Mus musculus
cacatgctaggaaaattgtgatatc

SEQ ID NO: 83389 - DNA, 25 bp, Mus musculus
cacatgctatgtattgggtccctcc

SEQ ID NO: 83390 - DNA, 25 bp, Mus musculus
cacatgctgaaggagggaaaaggtc

SEQ ID NO: 83391 - DNA, 25 bp, Mus musculus
cacatgctgctccagcgactgcagg

SEQ ID NO: 83392 - DNA, 25 bp, Mus musculus
cacatggacacagggactgagggaa

SEQ ID NO: 83393 - DNA, 25 bp, Mus musculus
cacatggacgaggtcaatgacgagc

SEQ ID NO: 83394 - DNA, 25 bp, Mus musculus
cacatggatcagtgctggaaatacc

SEQ ID NO: 83395 - DNA, 25 bp, Mus musculus
cacatggattacttgcccctttggc

SEQ ID NO: 83396 - DNA, 25 bp, Mus musculus
cacatggcagggagcccgaggactc

SEQ ID NO: 83397 - DNA, 25 bp, Mus musculus
cacatggccctggactggattatga

SEQ ID NO: 83398 - DNA, 25 bp, Mus musculus
cacatggccttttgtgggacataca

SEQ ID NO: 83399 - DNA, 25 bp, Mus musculus
cacatggctgcgaagggaaaagcta

SEQ ID NO: 83400 - DNA, 25 bp, Mus musculus
cacatgggacatcgtcaaggcgaca

SEQ ID NO: 83401 - DNA, 25 bp, Mus musculus
cacatgggactcagctttgcagcac

SEQ ID NO: 83402 - DNA, 25 bp, Mus musculus
cacatgggagagagccagttaacac

SEQ ID NO: 83403 - DNA, 25 bp, Mus musculus
cacatgggattgctcagacgaagct

SEQ ID NO: 83404 - DNA, 25 bp, Mus musculus
cacatgggcgggacttaaaagagcg

SEQ ID NO: 83405 - DNA, 25 bp, Mus musculus
cacatggtggcggtgtgcaccttta

SEQ ID NO: 83406 - DNA, 25 bp, Mus musculus
cacatgtaggcattcagggcatagc

SEQ ID NO: 83407 - DNA, 25 bp, Mus musculus
cacatgtcacaaggagaggctcttt

SEQ ID NO: 83408 - DNA, 25 bp, Mus musculus
cacatgtctggcagggacacggact

SEQ ID NO: 83409 - DNA, 25 bp, Mus musculus
cacatgtgagaatgatgcccgcact

SEQ ID NO: 83410 - DNA, 25 bp, Mus musculus
cacatgtgagtactgcggcaaggtc

SEQ ID NO: 83411 - DNA, 25 bp, Mus musculus
cacatgtgcgcaagctggtgctgca

SEQ ID NO: 83412 - DNA, 25 bp, Mus musculus
cacatgtggagagctctgtattagg

SEQ ID NO: 83413 - DNA, 25 bp, Mus musculus
cacatgttcaagcactcggaggaga

SEQ ID NO: 83414 - DNA, 25 bp, Mus musculus
cacatgttctgtctgagcctggccg

SEQ ID NO: 83415 - DNA, 25 bp, Mus musculus
cacatgttgaaaggatccggagcct

SEQ ID NO: 83416 - DNA, 25 bp, Mus musculus
cacatgttggtagatcggctcagca

SEQ ID NO: 83417 - DNA, 25 bp, Mus musculus
cacattaacagttaccacacacctg

SEQ ID NO: 83418 - DNA, 25 bp, Mus musculus
cacattacctcaagatctactctag

SEQ ID NO: 83419 - DNA, 25 bp, Mus musculus
cacattagagcatggaacgagcttg

SEQ ID NO: 83420 - DNA, 25 bp, Mus musculus
cacattatggattttcagcgaggaa

SEQ ID NO: 83421 - DNA, 25 bp, Mus musculus
cacattcaagcagttggtcgaagac

SEQ ID NO: 83422 - DNA, 25 bp, Mus musculus
cacattcagctctggcggtgggagc

SEQ ID NO: 83423 - DNA, 25 bp, Mus musculus
cacattccaggtcaaacgtgtaaag

SEQ ID NO: 83424 - DNA, 25 bp, Mus musculus
cacattcgttcctaagggcatgtcc

SEQ ID NO: 83425 - DNA, 25 bp, Mus musculus
cacattctctggctgctggcacact

SEQ ID NO: 83426 - DNA, 25 bp, Mus musculus
cacattgaccggctgaagcagggca

SEQ ID NO: 83427 - DNA, 25 bp, Mus musculus
cacattgagcgactttggagctacc

SEQ ID NO: 83428 - DNA, 25 bp, Mus musculus
cacattgagcgtcatgaagccagca

SEQ ID NO: 83429 - DNA, 25 bp, Mus musculus
cacattgaggtttgggaacggccac

SEQ ID NO: 83430 - DNA, 25 bp, Mus musculus
cacattgcctatgcctccatggaga

SEQ ID NO: 83431 - DNA, 25 bp, Mus musculus
cacattgcctgcttggaaagaagag

SEQ ID NO: 83432 - DNA, 25 bp, Mus musculus
cacattggagtacatatggcttcac

SEQ ID NO: 83433 - DNA, 25 bp, Mus musculus
cacattggcagtggctgtcctgacc

SEQ ID NO: 83434 - DNA, 25 bp, Mus musculus
cacatttagtggtacggcctggcct

SEQ ID NO: 83435 - DNA, 25 bp, Mus musculus
cacatttcccagaaagaaggcgggt

SEQ ID NO: 83436 - DNA, 25 bp, Mus musculus
cacatttctccttgcgaggtgcgcg

SEQ ID NO: 83437 - DNA, 25 bp, Mus musculus
cacatttgataactgtgatgctcca

SEQ ID NO: 83438 - DNA, 25 bp, Mus musculus
cacatttgatactcttcgactctgg

SEQ ID NO: 83439 - DNA, 25 bp, Mus musculus
cacatttgttaccagcaggcgaata

SEQ ID NO: 83440 - DNA, 25 bp, Mus musculus
cacattttacgagggcacctggcgt

SEQ ID NO: 83441 - DNA, 25 bp, Mus musculus
caccaaaaaggtggaagcccaaatg

SEQ ID NO: 83442 - DNA, 25 bp, Mus musculus
caccaaaagtgcagggaataaggcc

SEQ ID NO: 83443 - DNA, 25 bp, Mus musculus
caccaaagcagaaggccgatgcata

SEQ ID NO: 83444 - DNA, 25 bp, Mus musculus
caccaaaggtggcaatgggaccatc

SEQ ID NO: 83445 - DNA, 25 bp, Mus musculus
caccaaaggtgtgaaggaggacttc

SEQ ID NO: 83446 - DNA, 25 bp, Mus musculus
caccaacaaattcatagggaagaga

SEQ ID NO: 83447 - DNA, 25 bp, Mus musculus
caccaacaaggagaattacactgaa

SEQ ID NO: 83448 - DNA, 25 bp, Mus musculus
caccaaccagttcactcaagagcag

SEQ ID NO: 83449 - DNA, 25 bp, Mus musculus
caccaaccatgagaggatgactgag

SEQ ID NO: 83450 - DNA, 25 bp, Mus musculus
caccaaccttggtttctaccatttg

SEQ ID NO: 83451 - DNA, 25 bp, Mus musculus
caccaacggtgatggctgcatcagc

SEQ ID NO: 83452 - DNA, 25 bp, Mus musculus
caccaactcaggtagaacagctgga

SEQ ID NO: 83453 - DNA, 25 bp, Mus musculus
caccaactggtactatgagaaggat

SEQ ID NO: 83454 - DNA, 25 bp, Mus musculus
caccaagaagggaatcggaccaact

SEQ ID NO: 83455 - DNA, 25 bp, Mus musculus
caccaagagtgaatgatccgcccgt

SEQ ID NO: 83456 - DNA, 25 bp, Mus musculus
caccaagatggccaaagaggagacg

SEQ ID NO: 83457 - DNA, 25 bp, Mus musculus
caccaagcaacaggagagtagttct

SEQ ID NO: 83458 - DNA, 25 bp, Mus musculus
caccaagcaagtggttaactttggg

SEQ ID NO: 83459 - DNA, 25 bp, Mus musculus
caccaagcaggagtacgacgaggct

SEQ ID NO: 83460 - DNA, 25 bp, Mus musculus
caccaagctcatttttgaagtggaa

SEQ ID NO: 83461 - DNA, 25 bp, Mus musculus
caccaaggaaatgcttctggattct

SEQ ID NO: 83462 - DNA, 25 bp, Mus musculus
caccaaggaggaggctgataacagc

SEQ ID NO: 83463 - DNA, 25 bp, Mus musculus
caccaagggaccaatgttccaggaa

SEQ ID NO: 83464 - DNA, 25 bp, Mus musculus
caccaaggtcaaaggcatagcagag

SEQ ID NO: 83465 - DNA, 25 bp, Mus musculus
caccaaggtctttgctgtttgccaa

SEQ ID NO: 83466 - DNA, 25 bp, Mus musculus
caccaaggtggaatgggacgagcac

SEQ ID NO: 83467 - DNA, 25 bp, Mus musculus
caccaagtaggaagaggagacaccg

SEQ ID NO: 83468 - DNA, 25 bp, Mus musculus
caccaagtgctacaggaaagggtcc

SEQ ID NO: 83469 - DNA, 25 bp, Mus musculus
caccaagtggaacaaacagagcttc

SEQ ID NO: 83470 - DNA, 25 bp, Mus musculus
caccaagtggctggttgaaccccgg

SEQ ID NO: 83471 - DNA, 25 bp, Mus musculus
caccaagtgggaaaggaccctctag

SEQ ID NO: 83472 - DNA, 25 bp, Mus musculus
caccaatccgatctggcacagagag

SEQ ID NO: 83473 - DNA, 25 bp, Mus musculus
caccaatgacagaagtgccccaata

SEQ ID NO: 83474 - DNA, 25 bp, Mus musculus
caccaatgagtatgacggacacacc

SEQ ID NO: 83475 - DNA, 25 bp, Mus musculus
caccaatgatggacacggagtacac

SEQ ID NO: 83476 - DNA, 25 bp, Mus musculus
caccaattcagcagatggtcacagg

SEQ ID NO: 83477 - DNA, 25 bp, Mus musculus
caccacattcgtgacgtcagagaca

SEQ ID NO: 83478 - DNA, 25 bp, Mus musculus
caccacccaatggaagacaaaaaga

SEQ ID NO: 83479 - DNA, 25 bp, Mus musculus
caccaccctagtgttcttgcaagaa

SEQ ID NO: 83480 - DNA, 25 bp, Mus musculus
caccacctcaactacccatgacaag

SEQ ID NO: 83481 - DNA, 25 bp, Mus musculus
caccacctgaggaagtgtgtattac

SEQ ID NO: 83482 - DNA, 25 bp, Mus musculus
caccacgaaggtgcatgcactgaag

SEQ ID NO: 83483 - DNA, 25 bp, Mus musculus
caccacgacagcaggcggatatttg

SEQ ID NO: 83484 - DNA, 25 bp, Mus musculus
caccacgagatgaatggctccctca

SEQ ID NO: 83485 - DNA, 25 bp, Mus musculus
caccacggcttgctactttggaaca

SEQ ID NO: 83486 - DNA, 25 bp, Mus musculus
caccacggtgctgctagtaatgaaa

SEQ ID NO: 83487 - DNA, 25 bp, Mus musculus
caccacggtggaagatgtgaaacac

SEQ ID NO: 83488 - DNA, 25 bp, Mus musculus
caccactattttcccctcaggttgg

SEQ ID NO: 83489 - DNA, 25 bp, Mus musculus
caccactgagatgggtgtgtctccc

SEQ ID NO: 83490 - DNA, 25 bp, Mus musculus
caccactgcccagatacgaggagag

SEQ ID NO: 83491 - DNA, 25 bp, Mus musculus
caccactgtagtggagtggttctac

SEQ ID NO: 83492 - DNA, 25 bp, Mus musculus
caccagaagctaacaggaatatcac

SEQ ID NO: 83493 - DNA, 25 bp, Mus musculus
caccagacagtgtgtactcgggtgt

SEQ ID NO: 83494 - DNA, 25 bp, Mus musculus
caccagacctcttgattccattttg

SEQ ID NO: 83495 - DNA, 25 bp, Mus musculus
caccagaggctgaataggaagtcgt

SEQ ID NO: 83496 - DNA, 25 bp, Mus musculus
caccagaggcttcaaaggcgagtct

SEQ ID NO: 83497 - DNA, 25 bp, Mus musculus
caccagagtaggtggccgtgaacca

SEQ ID NO: 83498 - DNA, 25 bp, Mus musculus
caccagatgggtacagatggctaca

SEQ ID NO: 83499 - DNA, 25 bp, Mus musculus
caccagatttcgtggaggagctgag

SEQ ID NO: 83500 - DNA, 25 bp, Mus musculus
caccagcagggtggctaggctactg

SEQ ID NO: 83501 - DNA, 25 bp, Mus musculus
caccagcctcgggatgggtaactgc

SEQ ID NO: 83502 - DNA, 25 bp, Mus musculus
caccagcgggaacagaatgagcgcc

SEQ ID NO: 83503 - DNA, 25 bp, Mus musculus
caccagctgggaatcgtcgttggca

SEQ ID NO: 83504 - DNA, 25 bp, Mus musculus
caccagctgtgctatgtttgaagcc

SEQ ID NO: 83505 - DNA, 25 bp, Mus musculus
caccaggagtatgtggcatgccaac

SEQ ID NO: 83506 - DNA, 25 bp, Mus musculus
caccaggctaaggactgtatcgact

SEQ ID NO: 83507 - DNA, 25 bp, Mus musculus
caccagggaaggcaaaatgatcgaa

SEQ ID NO: 83508 - DNA, 25 bp, Mus musculus
caccagggatgagtgactcgctgga

SEQ ID NO: 83509 - DNA, 25 bp, Mus musculus
caccagggccactcatctgtggaag

SEQ ID NO: 83510 - DNA, 25 bp, Mus musculus
caccagggctcacgagtgtcttaaa

SEQ ID NO: 83511 - DNA, 25 bp, Mus musculus
caccagggctctgaatagttgggca

SEQ ID NO: 83512 - DNA, 25 bp, Mus musculus
caccaggtgacattgtaataaccac

SEQ ID NO: 83513 - DNA, 25 bp, Mus musculus
caccaggtggttgactccagctctg

SEQ ID NO: 83514 - DNA, 25 bp, Mus musculus
caccaggttcttatggatgcaagca

SEQ ID NO: 83515 - DNA, 25 bp, Mus musculus
caccaggtttcagactcggaggagg

SEQ ID NO: 83516 - DNA, 25 bp, Mus musculus
caccagtagtgccttgtatgccccg

SEQ ID NO: 83517 - DNA, 25 bp, Mus musculus
caccagtatcgaattcacagaagga

SEQ ID NO: 83518 - DNA, 25 bp, Mus musculus
caccagtattatcagaggcccattg

SEQ ID NO: 83519 - DNA, 25 bp, Mus musculus
caccagtgggttgccaggagtacca

SEQ ID NO: 83520 - DNA, 25 bp, Mus musculus
caccagtggtgggaagcctgtcgta

SEQ ID NO: 83521 - DNA, 25 bp, Mus musculus
caccagtgtctgatacctccgagga

SEQ ID NO: 83522 - DNA, 25 bp, Mus musculus
caccagtgtggattttgacccctca

SEQ ID NO: 83523 - DNA, 25 bp, Mus musculus
caccagtgtggccttaagaggacaa

SEQ ID NO: 83524 - DNA, 25 bp, Mus musculus
caccagttatgcagaggaaattcct

SEQ ID NO: 83525 - DNA, 25 bp, Mus musculus
caccagttcctaccatggagtcaat

SEQ ID NO: 83526 - DNA, 25 bp, Mus musculus
caccagtttagagctgcccaggaaa

SEQ ID NO: 83527 - DNA, 25 bp, Mus musculus
caccatagtgccaagccagtacagg

SEQ ID NO: 83528 - DNA, 25 bp, Mus musculus
caccatagtgctggagtctgggcca

SEQ ID NO: 83529 - DNA, 25 bp, Mus musculus
caccatcaatgtgggtcgtgctgga

SEQ ID NO: 83530 - DNA, 25 bp, Mus musculus
caccatcactagtgtggcgctgtgt

SEQ ID NO: 83531 - DNA, 25 bp, Mus musculus
caccatcagaccaatggacatcgaa

SEQ ID NO: 83532 - DNA, 25 bp, Mus musculus
caccatccaggaagggttgagtgtt

SEQ ID NO: 83533 - DNA, 25 bp, Mus musculus
caccatcggcatgcggagcgaaggc

SEQ ID NO: 83534 - DNA, 25 bp, Mus musculus
caccatcggtttgtagcggacagca

SEQ ID NO: 83535 - DNA, 25 bp, Mus musculus
caccatctgggaaggacggacatcc

SEQ ID NO: 83536 - DNA, 25 bp, Mus musculus
caccatgaagacaatggaggaccag

SEQ ID NO: 83537 - DNA, 25 bp, Mus musculus
caccatgagaaaggagcgcagacct

SEQ ID NO: 83538 - DNA, 25 bp, Mus musculus
caccatgcccgaagtcaaggagctt

SEQ ID NO: 83539 - DNA, 25 bp, Mus musculus
caccatggccattcgagaagtgctc

SEQ ID NO: 83540 - DNA, 25 bp, Mus musculus
caccatggcgtatgtgtggaaccga

SEQ ID NO: 83541 - DNA, 25 bp, Mus musculus
caccatggtcgggagagttcagccc

SEQ ID NO: 83542 - DNA, 25 bp, Mus musculus
caccatggtgaaaagggactaaatc

SEQ ID NO: 83543 - DNA, 25 bp, Mus musculus
caccatggtgatcaacacggaggac

SEQ ID NO: 83544 - DNA, 25 bp, Mus musculus
caccatgtgcattaaggagagccta

SEQ ID NO: 83545 - DNA, 25 bp, Mus musculus
caccatgtgtcagaacggcctggac

SEQ ID NO: 83546 - DNA, 25 bp, Mus musculus
caccatgtgtctcttggtcaacctg

SEQ ID NO: 83547 - DNA, 25 bp, Mus musculus
caccatgttagatgggctgggtcgc

SEQ ID NO: 83548 - DNA, 25 bp, Mus musculus
caccattaaggagagcaacacggac

SEQ ID NO: 83549 - DNA, 25 bp, Mus musculus
caccattctggatgagcccggaaag

SEQ ID NO: 83550 - DNA, 25 bp, Mus musculus
caccattgacgtggacttcgtggac

SEQ ID NO: 83551 - DNA, 25 bp, Mus musculus
caccattgaggattctgttgcaacc

SEQ ID NO: 83552 - DNA, 25 bp, Mus musculus
caccattgcgtggatgagaacattg

SEQ ID NO: 83553 - DNA, 25 bp, Mus musculus
caccatttgagatgctgagccctag

SEQ ID NO: 83554 - DNA, 25 bp, Mus musculus
caccatttggtgaggagccatggcc

SEQ ID NO: 83555 - DNA, 25 bp, Mus musculus
cacccaaatggtgttgcagctcaaa

SEQ ID NO: 83556 - DNA, 25 bp, Mus musculus
cacccaaggacagacctccacagat

SEQ ID NO: 83557 - DNA, 25 bp, Mus musculus
cacccaagtgacgagaaagagttct

SEQ ID NO: 83558 - DNA, 25 bp, Mus musculus
cacccaatgtgagataagaccagca

SEQ ID NO: 83559 - DNA, 25 bp, Mus musculus
cacccacagtgtaggacagttttgg

SEQ ID NO: 83560 - DNA, 25 bp, Mus musculus
cacccacgagttcaagcaggcctgc

SEQ ID NO: 83561 - DNA, 25 bp, Mus musculus
cacccacgctggctgctgattggat

SEQ ID NO: 83562 - DNA, 25 bp, Mus musculus
cacccactgagcatggtctgaagga

SEQ ID NO: 83563 - DNA, 25 bp, Mus musculus
cacccagagctattggaagcagcaa

SEQ ID NO: 83564 - DNA, 25 bp, Mus musculus
cacccagaggcattcatgagtccag

SEQ ID NO: 83565 - DNA, 25 bp, Mus musculus
cacccagatagtggtagacaggacc

SEQ ID NO: 83566 - DNA, 25 bp, Mus musculus
cacccagattggctgcttgttgcgc

SEQ ID NO: 83567 - DNA, 25 bp, Mus musculus
cacccagcaggtactacaggaagaa

SEQ ID NO: 83568 - DNA, 25 bp, Mus musculus
cacccagcctgatgagacccgagaa

SEQ ID NO: 83569 - DNA, 25 bp, Mus musculus
cacccagctgatctggggaccagcg

SEQ ID NO: 83570 - DNA, 25 bp, Mus musculus
cacccagcttatgatgataaggaca

SEQ ID NO: 83571 - DNA, 25 bp, Mus musculus
cacccaggaagtcagcgatgtctca

SEQ ID NO: 83572 - DNA, 25 bp, Mus musculus
cacccaggacagagttttaagagca

SEQ ID NO: 83573 - DNA, 25 bp, Mus musculus
cacccaggagctatcaggagcagga

SEQ ID NO: 83574 - DNA, 25 bp, Mus musculus
cacccaggagtgaaggatgctgctc

SEQ ID NO: 83575 - DNA, 25 bp, Mus musculus
cacccaggccaatcggatgagtgtg

SEQ ID NO: 83576 - DNA, 25 bp, Mus musculus
cacccaggctggatagagcagtcat

SEQ ID NO: 83577 - DNA, 25 bp, Mus musculus
cacccagggttttgtaggctgtgcc

SEQ ID NO: 83578 - DNA, 25 bp, Mus musculus
cacccagtcagagtaagcacagaac

SEQ ID NO: 83579 - DNA, 25 bp, Mus musculus
cacccagtgcgagaagattgtacag

SEQ ID NO: 83580 - DNA, 25 bp, Mus musculus
cacccatctgcttggaggagagaca

SEQ ID NO: 83581 - DNA, 25 bp, Mus musculus
cacccatgagtgagatgacaggcaa

SEQ ID NO: 83582 - DNA, 25 bp, Mus musculus
caccccaacgtcatgaggctcattg

SEQ ID NO: 83583 - DNA, 25 bp, Mus musculus
caccccagtctcttggcgtgctgga

SEQ ID NO: 83584 - DNA, 25 bp, Mus musculus
caccccagtggtttccgtggcaaca

SEQ ID NO: 83585 - DNA, 25 bp, Mus musculus
caccccggaaagatgctgtgcagca

SEQ ID NO: 83586 - DNA, 25 bp, Mus musculus
caccccggtcatcacctggaagaag

SEQ ID NO: 83587 - DNA, 25 bp, Mus musculus
caccccggtggtagatgagaaactt

SEQ ID NO: 83588 - DNA, 25 bp, Mus musculus
caccccgtgaacctgcaatggagaa

SEQ ID NO: 83589 - DNA, 25 bp, Mus musculus
cacccctccattctaaatatgttga

SEQ ID NO: 83590 - DNA, 25 bp, Mus musculus
cacccctcggtgtacaaagtagcca

SEQ ID NO: 83591 - DNA, 25 bp, Mus musculus
cacccctgctgatcgaagaacggag

SEQ ID NO: 83592 - DNA, 25 bp, Mus musculus
cacccctttggtggaagagctgaac

SEQ ID NO: 83593 - DNA, 25 bp, Mus musculus
cacccgaggaaaactagaatgaagc

SEQ ID NO: 83594 - DNA, 25 bp, Mus musculus
cacccgatgttattcctcaaggatt

SEQ ID NO: 83595 - DNA, 25 bp, Mus musculus
cacccgcaggtggtagatgactaca

SEQ ID NO: 83596 - DNA, 25 bp, Mus musculus
cacccgccggggccgcaggcctgtg

SEQ ID NO: 83597 - DNA, 25 bp, Mus musculus
cacccgctacattgcgagtctgaag

SEQ ID NO: 83598 - DNA, 25 bp, Mus musculus
cacccgctgataagagaattccacg

SEQ ID NO: 83599 - DNA, 25 bp, Mus musculus
cacccgctgtcggatgacctgatta

SEQ ID NO: 83600 - DNA, 25 bp, Mus musculus
cacccggaaccctggctgcggaggt

SEQ ID NO: 83601 - DNA, 25 bp, Mus musculus
cacccggacataaagctgcagaagc

SEQ ID NO: 83602 - DNA, 25 bp, Mus musculus
cacccggacgaggaattgggcttca

SEQ ID NO: 83603 - DNA, 25 bp, Mus musculus
cacccggacgggaccttctgtgtga

SEQ ID NO: 83604 - DNA, 25 bp, Mus musculus
cacccgggcgttgtattgtcagaga

SEQ ID NO: 83605 - DNA, 25 bp, Mus musculus
cacccgtactttgatgacttggaca

SEQ ID NO: 83606 - DNA, 25 bp, Mus musculus
cacccgtgactccaattcagaagat

SEQ ID NO: 83607 - DNA, 25 bp, Mus musculus
caccctaagtataggatcggagtgg

SEQ ID NO: 83608 - DNA, 25 bp, Mus musculus
caccctactggacacggacgaggga

SEQ ID NO: 83609 - DNA, 25 bp, Mus musculus
caccctagggaagactgtcgggaca

SEQ ID NO: 83610 - DNA, 25 bp, Mus musculus
caccctagtggtggtactggaagac

SEQ ID NO: 83611 - DNA, 25 bp, Mus musculus
caccctcaagaaaggtagcaaggaa

SEQ ID NO: 83612 - DNA, 25 bp, Mus musculus
caccctcaggcagacataaaagcag

SEQ ID NO: 83613 - DNA, 25 bp, Mus musculus
caccctcgggtgctctacattgata

SEQ ID NO: 83614 - DNA, 25 bp, Mus musculus
caccctctgaaaggtgtctgagcga

SEQ ID NO: 83615 - DNA, 25 bp, Mus musculus
caccctgaggagcaagaaaagcaca

SEQ ID NO: 83616 - DNA, 25 bp, Mus musculus
caccctgagtcgagagcacgattgg

SEQ ID NO: 83617 - DNA, 25 bp, Mus musculus
caccctgagtgtctttgagctggca

SEQ ID NO: 83618 - DNA, 25 bp, Mus musculus
caccctgcgtaggaacgagagtcac

SEQ ID NO: 83619 - DNA, 25 bp, Mus musculus
caccctgctgctgagtctgtctgat

SEQ ID NO: 83620 - DNA, 25 bp, Mus musculus
caccctggagctcaatgaaacgcag

SEQ ID NO: 83621 - DNA, 25 bp, Mus musculus
caccctggaggacagagctctcctg

SEQ ID NO: 83622 - DNA, 25 bp, Mus musculus
caccctggatggagcttaactttga

SEQ ID NO: 83623 - DNA, 25 bp, Mus musculus
caccctggctcgtgtggatttggag

SEQ ID NO: 83624 - DNA, 25 bp, Mus musculus
caccctggttggaatcatagttggc

SEQ ID NO: 83625 - DNA, 25 bp, Mus musculus
caccctgtccgtggtcatcatgaag

SEQ ID NO: 83626 - DNA, 25 bp, Mus musculus
caccctgtggaaacactacgtctac

SEQ ID NO: 83627 - DNA, 25 bp, Mus musculus
caccctgtggaacgagcctattgaa

SEQ ID NO: 83628 - DNA, 25 bp, Mus musculus
caccctgtggttgaaagcctccgaa

SEQ ID NO: 83629 - DNA, 25 bp, Mus musculus
cacccttcaagtccgtgtggagcag

SEQ ID NO: 83630 - DNA, 25 bp, Mus musculus
cacccttgaagtgatcctgaggccg

SEQ ID NO: 83631 - DNA, 25 bp, Mus musculus
cacccttgccagcatgtcttatgga

SEQ ID NO: 83632 - DNA, 25 bp, Mus musculus
cacccttgtacttggctgagtggca

SEQ ID NO: 83633 - DNA, 25 bp, Mus musculus
caccgaacgctctgggctttttcca

SEQ ID NO: 83634 - DNA, 25 bp, Mus musculus
caccgaagagtcagctgtaactaca

SEQ ID NO: 83635 - DNA, 25 bp, Mus musculus
caccgaagctgggaacttgctgaaa

SEQ ID NO: 83636 - DNA, 25 bp, Mus musculus
caccgaagtacctgaaaagggagct

SEQ ID NO: 83637 - DNA, 25 bp, Mus musculus
caccgacagtgtccgagtggtcaag

SEQ ID NO: 83638 - DNA, 25 bp, Mus musculus
caccgactggaattagtgtcgacgg

SEQ ID NO: 83639 - DNA, 25 bp, Mus musculus
caccgagaaaggatggagctgaaat

SEQ ID NO: 83640 - DNA, 25 bp, Mus musculus
caccgagaaggtgctgctagacaac

SEQ ID NO: 83641 - DNA, 25 bp, Mus musculus
caccgagaattatccgatctatcag

SEQ ID NO: 83642 - DNA, 25 bp, Mus musculus
caccgagagtttgccatggaagctg

SEQ ID NO: 83643 - DNA, 25 bp, Mus musculus
caccgagatcattgagggcacgcag

SEQ ID NO: 83644 - DNA, 25 bp, Mus musculus
caccgagggtgagattacattccag

SEQ ID NO: 83645 - DNA, 25 bp, Mus musculus
caccgatgacttgtaaagggaagac

SEQ ID NO: 83646 - DNA, 25 bp, Mus musculus
caccgatgattcctgtaccaatgag

SEQ ID NO: 83647 - DNA, 25 bp, Mus musculus
caccgatgctcagtttgtggacgca

SEQ ID NO: 83648 - DNA, 25 bp, Mus musculus
caccgatggaagagctaaggcgagc

SEQ ID NO: 83649 - DNA, 25 bp, Mus musculus
caccgatggatatgaatgggacccc

SEQ ID NO: 83650 - DNA, 25 bp, Mus musculus
caccgatgggtactggcttctggaa

SEQ ID NO: 83651 - DNA, 25 bp, Mus musculus
caccgatgtgtgaggattgtcccag

SEQ ID NO: 83652 - DNA, 25 bp, Mus musculus
caccgattgggtggaagactagcat

SEQ ID NO: 83653 - DNA, 25 bp, Mus musculus
caccgatttggtggtctgcgtggct

SEQ ID NO: 83654 - DNA, 25 bp, Mus musculus
caccgcactgcagaaagagcacaag

SEQ ID NO: 83655 - DNA, 25 bp, Mus musculus
caccgcagctgtcttctcgaggaga

SEQ ID NO: 83656 - DNA, 25 bp, Mus musculus
caccgcaggaccatcgggatgtggt

SEQ ID NO: 83657 - DNA, 25 bp, Mus musculus
caccgccacgtgatactgtctgaga

SEQ ID NO: 83658 - DNA, 25 bp, Mus musculus
caccgccgccagtctgaggcaggtg

SEQ ID NO: 83659 - DNA, 25 bp, Mus musculus
caccgcctatggagacagttcagga

SEQ ID NO: 83660 - DNA, 25 bp, Mus musculus
caccgcctctgggtctattcaggaa

SEQ ID NO: 83661 - DNA, 25 bp, Mus musculus
caccgcctggctgaggcagagaagt

SEQ ID NO: 83662 - DNA, 25 bp, Mus musculus
caccgcctgggtgcagactttatgc

SEQ ID NO: 83663 - DNA, 25 bp, Mus musculus
caccgcgcgccctaaggtggaactg

SEQ ID NO: 83664 - DNA, 25 bp, Mus musculus
caccgcgtgctggtctgtcctgaaa

SEQ ID NO: 83665 - DNA, 25 bp, Mus musculus
caccgctagtctgtttggaaggctt

SEQ ID NO: 83666 - DNA, 25 bp, Mus musculus
caccgctgaggaaggttgctgaaga

SEQ ID NO: 83667 - DNA, 25 bp, Mus musculus
caccgctgccatggagctgagggtc

SEQ ID NO: 83668 - DNA, 25 bp, Mus musculus
caccgctggactgagtgatcgttcc

SEQ ID NO: 83669 - DNA, 25 bp, Mus musculus
caccgctgtgttcttcgaggttccg

SEQ ID NO: 83670 - DNA, 25 bp, Mus musculus
caccggaaagatggctcacaggact

SEQ ID NO: 83671 - DNA, 25 bp, Mus musculus
caccggacacaactgggagatgaat

SEQ ID NO: 83672 - DNA, 25 bp, Mus musculus
caccggacagatccaagtgaacatc

SEQ ID NO: 83673 - DNA, 25 bp, Mus musculus
caccggagagcttgggaaaatccag

SEQ ID NO: 83674 - DNA, 25 bp, Mus musculus
caccggaggcctagctgacatcttt

SEQ ID NO: 83675 - DNA, 25 bp, Mus musculus
caccggaggcttccgacgcgccttt

SEQ ID NO: 83676 - DNA, 25 bp, Mus musculus
caccggatccagtgtgcagcaggct

SEQ ID NO: 83677 - DNA, 25 bp, Mus musculus
caccggcagcattctagaaaatgag

SEQ ID NO: 83678 - DNA, 25 bp, Mus musculus
caccggcatatgtttgtggagcaga

SEQ ID NO: 83679 - DNA, 25 bp, Mus musculus
caccggcatggtcgcttctgagacg

SEQ ID NO: 83680 - DNA, 25 bp, Mus musculus
caccggccctttgcaatagacatgg

SEQ ID NO: 83681 - DNA, 25 bp, Mus musculus
caccggcgggaggtgggtccgcgcg

SEQ ID NO: 83682 - DNA, 25 bp, Mus musculus
caccgggaacgttatacgaagcgct

SEQ ID NO: 83683 - DNA, 25 bp, Mus musculus
caccgggagtctttcatctggaggg

SEQ ID NO: 83684 - DNA, 25 bp, Mus musculus
caccgggagttaccattgccattca

SEQ ID NO: 83685 - DNA, 25 bp, Mus musculus
caccgggcacttcacaggagaacat

SEQ ID NO: 83686 - DNA, 25 bp, Mus musculus
caccgggcagctaaacggctatgga

SEQ ID NO: 83687 - DNA, 25 bp, Mus musculus
caccgggcgttggaaatagatgaaa

SEQ ID NO: 83688 - DNA, 25 bp, Mus musculus
caccgggctggagtttaccatgtac

SEQ ID NO: 83689 - DNA, 25 bp, Mus musculus
caccgggtactggaaacagatgtac

SEQ ID NO: 83690 - DNA, 25 bp, Mus musculus
caccgggtcgcaatcagtgtggaga

SEQ ID NO: 83691 - DNA, 25 bp, Mus musculus
caccgggtgagtgttcgcaagcaga

SEQ ID NO: 83692 - DNA, 25 bp, Mus musculus
caccggtatccagtcagtgcgggac

SEQ ID NO: 83693 - DNA, 25 bp, Mus musculus
caccggtcggtgatgcgtacaagaa

SEQ ID NO: 83694 - DNA, 25 bp, Mus musculus
caccggtctctacagctgtctggca

SEQ ID NO: 83695 - DNA, 25 bp, Mus musculus
caccggtgtcaagagtcaggatgct

SEQ ID NO: 83696 - DNA, 25 bp, Mus musculus
caccgtcagtgagggagagagaccc

SEQ ID NO: 83697 - DNA, 25 bp, Mus musculus
caccgtcgtcctatggattggcagc

SEQ ID NO: 83698 - DNA, 25 bp, Mus musculus
caccgtctaagatctcactgaaaag

SEQ ID NO: 83699 - DNA, 25 bp, Mus musculus
caccgtgagctgcttatgaaccaca

SEQ ID NO: 83700 - DNA, 25 bp, Mus musculus
caccgtgaggttcaaggcaatgagt

SEQ ID NO: 83701 - DNA, 25 bp, Mus musculus
caccgtgatgtgaagcccagcaatt

SEQ ID NO: 83702 - DNA, 25 bp, Mus musculus
caccgtgctggctctggacttcatg

SEQ ID NO: 83703 - DNA, 25 bp, Mus musculus
caccgtggaccggaacaagttcaga

SEQ ID NO: 83704 - DNA, 25 bp, Mus musculus
caccgtggcggtagaagagtctatc

SEQ ID NO: 83705 - DNA, 25 bp, Mus musculus
caccgtgggcctgtacttggcgcag

SEQ ID NO: 83706 - DNA, 25 bp, Mus musculus
caccgtgtcccgcatggagattcac

SEQ ID NO: 83707 - DNA, 25 bp, Mus musculus
caccgtgtggtctgataaaagcatc

SEQ ID NO: 83708 - DNA, 25 bp, Mus musculus
caccgtgttccgaggatatgtcatc

SEQ ID NO: 83709 - DNA, 25 bp, Mus musculus
caccgttcagcctcatagtggaaac

SEQ ID NO: 83710 - DNA, 25 bp, Mus musculus
caccgttgcctgataagttcttcca

SEQ ID NO: 83711 - DNA, 25 bp, Mus musculus
caccgttgggtagagagagtgtccc

SEQ ID NO: 83712 - DNA, 25 bp, Mus musculus
caccgttgtctttcatgggcgccgc

SEQ ID NO: 83713 - DNA, 25 bp, Mus musculus
cacctacaggactgtggtctcgtcc

SEQ ID NO: 83714 - DNA, 25 bp, Mus musculus
cacctacagtgagtgtgagaccttc

SEQ ID NO: 83715 - DNA, 25 bp, Mus musculus
cacctacctacaggagaagcttggg

SEQ ID NO: 83716 - DNA, 25 bp, Mus musculus
cacctagaggagacatcagtggcta

SEQ ID NO: 83717 - DNA, 25 bp, Mus musculus
cacctagaggaggtcctgcgcaaaa

SEQ ID NO: 83718 - DNA, 25 bp, Mus musculus
cacctagcctggtcctgggtctgtc

SEQ ID NO: 83719 - DNA, 25 bp, Mus musculus
cacctagtctgtttgcaaggaggac

SEQ ID NO: 83720 - DNA, 25 bp, Mus musculus
cacctatacctcatcgttgtcggcg

SEQ ID NO: 83721 - DNA, 25 bp, Mus musculus
cacctatgacctggtagctcttggg

SEQ ID NO: 83722 - DNA, 25 bp, Mus musculus
cacctatgaggaagtgaagcaggct

SEQ ID NO: 83723 - DNA, 25 bp, Mus musculus
cacctatgtgaagaacggcacgtcc

SEQ ID NO: 83724 - DNA, 25 bp, Mus musculus
cacctattgggatggagtcacaccg

SEQ ID NO: 83725 - DNA, 25 bp, Mus musculus
cacctcagcacggactggagaggag

SEQ ID NO: 83726 - DNA, 25 bp, Mus musculus
cacctcatgtttgccgtgcgagaag

SEQ ID NO: 83727 - DNA, 25 bp, Mus musculus
cacctccggagggaactaatgttct

SEQ ID NO: 83728 - DNA, 25 bp, Mus musculus
cacctcctcagtaacactgttttga

SEQ ID NO: 83729 - DNA, 25 bp, Mus musculus
cacctcctgaattcagttgagtcat

SEQ ID NO: 83730 - DNA, 25 bp, Mus musculus
cacctcctgcagagtggagatgaga

SEQ ID NO: 83731 - DNA, 25 bp, Mus musculus
cacctcgagtgacagcaagaagaca

SEQ ID NO: 83732 - DNA, 25 bp, Mus musculus
cacctctcagctgaaggctggcaag

SEQ ID NO: 83733 - DNA, 25 bp, Mus musculus
cacctctcagggagggaacagagca

SEQ ID NO: 83734 - DNA, 25 bp, Mus musculus
cacctctcgctgctcaatttagcag

SEQ ID NO: 83735 - DNA, 25 bp, Mus musculus
cacctctcttgggttggacctgtgt

SEQ ID NO: 83736 - DNA, 25 bp, Mus musculus
cacctctgacgacaaagttgcgccg

SEQ ID NO: 83737 - DNA, 25 bp, Mus musculus
cacctctggatgtctaggactagaa

SEQ ID NO: 83738 - DNA, 25 bp, Mus musculus
cacctctgggaacgtggacatcgat

SEQ ID NO: 83739 - DNA, 25 bp, Mus musculus
cacctcttacaattaggtggctgac

SEQ ID NO: 83740 - DNA, 25 bp, Mus musculus
cacctgaactgcgagtggcgaagaa

SEQ ID NO: 83741 - DNA, 25 bp, Mus musculus
cacctgaagaggaagataggctact

SEQ ID NO: 83742 - DNA, 25 bp, Mus musculus
cacctgaaggcttgtatctcgctac

SEQ ID NO: 83743 - DNA, 25 bp, Mus musculus
cacctgacttcctgcaggctgacag

SEQ ID NO: 83744 - DNA, 25 bp, Mus musculus
cacctgagccgggtgttgttggaat

SEQ ID NO: 83745 - DNA, 25 bp, Mus musculus
cacctgagctggatgatatgacgct

SEQ ID NO: 83746 - DNA, 25 bp, Mus musculus
cacctgaggaaacaaagtccggcac

SEQ ID NO: 83747 - DNA, 25 bp, Mus musculus
cacctgagtgggatgatcgttcaaa

SEQ ID NO: 83748 - DNA, 25 bp, Mus musculus
cacctgatggaagagcggctaatcc

SEQ ID NO: 83749 - DNA, 25 bp, Mus musculus
cacctgcacctatcatgccattgga

SEQ ID NO: 83750 - DNA, 25 bp, Mus musculus
cacctgcagacctgtggctgttccg

SEQ ID NO: 83751 - DNA, 25 bp, Mus musculus
cacctgcagcatgtcctgtgacgag

SEQ ID NO: 83752 - DNA, 25 bp, Mus musculus
cacctgcagttaaagggatgccttc

SEQ ID NO: 83753 - DNA, 25 bp, Mus musculus
cacctgcatggtgagactgcctcga

SEQ ID NO: 83754 - DNA, 25 bp, Mus musculus
cacctgccaggccagttaaagagtc

SEQ ID NO: 83755 - DNA, 25 bp, Mus musculus
cacctgcgcaggaacaatgataatg

SEQ ID NO: 83756 - DNA, 25 bp, Mus musculus
cacctgcggcagtatgagaagagca

SEQ ID NO: 83757 - DNA, 25 bp, Mus musculus
cacctgctatggttccccgaaaagg

SEQ ID NO: 83758 - DNA, 25 bp, Mus musculus
cacctgctcgctcccatgaccaaca

SEQ ID NO: 83759 - DNA, 25 bp, Mus musculus
cacctgctgctcagtaggaagggca

SEQ ID NO: 83760 - DNA, 25 bp, Mus musculus
cacctggaacccctggagaacaagg

SEQ ID NO: 83761 - DNA, 25 bp, Mus musculus
cacctggactggctactttgggaag

SEQ ID NO: 83762 - DNA, 25 bp, Mus musculus
cacctggaggatgtgactgggtacc

SEQ ID NO: 83763 - DNA, 25 bp, Mus musculus
cacctggcaagggaagacaagaaca

SEQ ID NO: 83764 - DNA, 25 bp, Mus musculus
cacctggcaatgatggagcggatct

SEQ ID NO: 83765 - DNA, 25 bp, Mus musculus
cacctggcggtaatcactgggcaga

SEQ ID NO: 83766 - DNA, 25 bp, Mus musculus
cacctgggagtaacctagtcatggc

SEQ ID NO: 83767 - DNA, 25 bp, Mus musculus
cacctgggctgacgatggctactga

SEQ ID NO: 83768 - DNA, 25 bp, Mus musculus
cacctggtgcatcataggaggcaaa

SEQ ID NO: 83769 - DNA, 25 bp, Mus musculus
cacctggtgtgtggtcccgtgaaaa

SEQ ID NO: 83770 - DNA, 25 bp, Mus musculus
cacctggtttctgatggcatatgcc

SEQ ID NO: 83771 - DNA, 25 bp, Mus musculus
cacctgtattgccacggtcgttgga

SEQ ID NO: 83772 - DNA, 25 bp, Mus musculus
cacctgtcgagtgtgttaaggagcc

SEQ ID NO: 83773 - DNA, 25 bp, Mus musculus
cacctgtctgcggaataaagctgat

SEQ ID NO: 83774 - DNA, 25 bp, Mus musculus
cacctgtgaggaaaaaattatatat

SEQ ID NO: 83775 - DNA, 25 bp, Mus musculus
cacctgtgattgtcgagacggcccg

SEQ ID NO: 83776 - DNA, 25 bp, Mus musculus
cacctgtgggagtttatccgagaca

SEQ ID NO: 83777 - DNA, 25 bp, Mus musculus
cacctgtggtcatagagcaagtctc

SEQ ID NO: 83778 - DNA, 25 bp, Mus musculus
cacctgtgtgaagtagaggacccgc

SEQ ID NO: 83779 - DNA, 25 bp, Mus musculus
caccttaagaggactgtttacgcaa

SEQ ID NO: 83780 - DNA, 25 bp, Mus musculus
caccttacaaggtagaagagtccgg

SEQ ID NO: 83781 - DNA, 25 bp, Mus musculus
caccttataccagggaatgtcttca

SEQ ID NO: 83782 - DNA, 25 bp, Mus musculus
caccttattggaaaagatgggagca

SEQ ID NO: 83783 - DNA, 25 bp, Mus musculus
caccttcacaagagagacttcgggc

SEQ ID NO: 83784 - DNA, 25 bp, Mus musculus
caccttcagctttcagggtctgcgg

SEQ ID NO: 83785 - DNA, 25 bp, Mus musculus
caccttcattcacacttagtggcaa

SEQ ID NO: 83786 - DNA, 25 bp, Mus musculus
caccttccaggagtatgcagggcgc

SEQ ID NO: 83787 - DNA, 25 bp, Mus musculus
caccttccatattttatcactgctg

SEQ ID NO: 83788 - DNA, 25 bp, Mus musculus
caccttcgaagcatcctgggagaca

SEQ ID NO: 83789 - DNA, 25 bp, Mus musculus
caccttcgggaagcagaccgagaaa

SEQ ID NO: 83790 - DNA, 25 bp, Mus musculus
caccttctgacaccacctggaatga

SEQ ID NO: 83791 - DNA, 25 bp, Mus musculus
caccttctgggattttctgggacta

SEQ ID NO: 83792 - DNA, 25 bp, Mus musculus
caccttctgggtattgctgagtatc

SEQ ID NO: 83793 - DNA, 25 bp, Mus musculus
caccttctggtgaatagtgggaact

SEQ ID NO: 83794 - DNA, 25 bp, Mus musculus
caccttcttggtgctgtgatgtgat

SEQ ID NO: 83795 - DNA, 25 bp, Mus musculus
caccttgaacaagacagagcaggct

SEQ ID NO: 83796 - DNA, 25 bp, Mus musculus
caccttgcaagtggacagctggcca

SEQ ID NO: 83797 - DNA, 25 bp, Mus musculus
caccttgctgcatggagctgggcca

SEQ ID NO: 83798 - DNA, 25 bp, Mus musculus
caccttggagaacatcggactggag

SEQ ID NO: 83799 - DNA, 25 bp, Mus musculus
caccttggatgatgagccctgtacc

SEQ ID NO: 83800 - DNA, 25 bp, Mus musculus
caccttggcagaggaatctacactg

SEQ ID NO: 83801 - DNA, 25 bp, Mus musculus
caccttgggcatctagctgagggca

SEQ ID NO: 83802 - DNA, 25 bp, Mus musculus
caccttgtgttatgccaggcccgag

SEQ ID NO: 83803 - DNA, 25 bp, Mus musculus
cacctttaaagaggagggagcggct

SEQ ID NO: 83804 - DNA, 25 bp, Mus musculus
cacctttagacctgaggacagatct

SEQ ID NO: 83805 - DNA, 25 bp, Mus musculus
cacctttagcaatgaagtggcgcag

SEQ ID NO: 83806 - DNA, 25 bp, Mus musculus
cacctttccgtagatatgccgatgg

SEQ ID NO: 83807 - DNA, 25 bp, Mus musculus
cacctttcgttgactgaaggctcat

SEQ ID NO: 83808 - DNA, 25 bp, Mus musculus
cacctttctgggatgaggaccaaca

SEQ ID NO: 83809 - DNA, 25 bp, Mus musculus
cacctttgagcagtggacggagcac

SEQ ID NO: 83810 - DNA, 25 bp, Mus musculus
cacctttgatggagagcggtgtctc

SEQ ID NO: 83811 - DNA, 25 bp, Mus musculus
cacctttggatgttcatgtacagac

SEQ ID NO: 83812 - DNA, 25 bp, Mus musculus
cacctttgggcagaatacactgtgc

SEQ ID NO: 83813 - DNA, 25 bp, Mus musculus
cacctttgtaagctatctgtgcaga

SEQ ID NO: 83814 - DNA, 25 bp, Mus musculus
cacctttgtgtcttcggcggacgcg

SEQ ID NO: 83815 - DNA, 25 bp, Mus musculus
caccttttgactaatggataaacgc

SEQ ID NO: 83816 - DNA, 25 bp, Mus musculus
cacgaaaggtgggactgttgcagcc

SEQ ID NO: 83817 - DNA, 25 bp, Mus musculus
cacgaagacaagagggtgaggtcaa

SEQ ID NO: 83818 - DNA, 25 bp, Mus musculus
cacgaagagtgtttgccaatgcgca

SEQ ID NO: 83819 - DNA, 25 bp, Mus musculus
cacgaaggagcagctggcacatcct

SEQ ID NO: 83820 - DNA, 25 bp, Mus musculus
cacgaaggcctgaatcccaggcggc

SEQ ID NO: 83821 - DNA, 25 bp, Mus musculus
cacgaagggcggaccagatttctca

SEQ ID NO: 83822 - DNA, 25 bp, Mus musculus
cacgaagtgcaatgggctccttccg

SEQ ID NO: 83823 - DNA, 25 bp, Mus musculus
cacgaatttgcactggttgtagtga

SEQ ID NO: 83824 - DNA, 25 bp, Mus musculus
cacgacaccagcactctgatgagag

SEQ ID NO: 83825 - DNA, 25 bp, Mus musculus
cacgacctgctgataaggagcatga

SEQ ID NO: 83826 - DNA, 25 bp, Mus musculus
cacgactcgagcagtaatggcaacc

SEQ ID NO: 83827 - DNA, 25 bp, Mus musculus
cacgactcttgaacatcagaagact

SEQ ID NO: 83828 - DNA, 25 bp, Mus musculus
cacgactgcaggaagtggcttttta

SEQ ID NO: 83829 - DNA, 25 bp, Mus musculus
cacgactgtaaggacttcgaggccc

SEQ ID NO: 83830 - DNA, 25 bp, Mus musculus
cacgacttcccagagtttgacgcaa

SEQ ID NO: 83831 - DNA, 25 bp, Mus musculus
cacgacttgcaaaccgagctggaag

SEQ ID NO: 83832 - DNA, 25 bp, Mus musculus
cacgactttaatcagagggcagggc

SEQ ID NO: 83833 - DNA, 25 bp, Mus musculus
cacgagaaaccgtctggctagagag

SEQ ID NO: 83834 - DNA, 25 bp, Mus musculus
cacgagaagggcctaggcattaaac

SEQ ID NO: 83835 - DNA, 25 bp, Mus musculus
cacgagacatccagcaatgggagta

SEQ ID NO: 83836 - DNA, 25 bp, Mus musculus
cacgagagaaacttccttggacaga

SEQ ID NO: 83837 - DNA, 25 bp, Mus musculus
cacgagatgtccaagtgcagagcta

SEQ ID NO: 83838 - DNA, 25 bp, Mus musculus
cacgagcagcatggacgaagacttt

SEQ ID NO: 83839 - DNA, 25 bp, Mus musculus
cacgagcggctggacttaaagaaga

SEQ ID NO: 83840 - DNA, 25 bp, Mus musculus
cacgaggaacctgtcagagtcggga

SEQ ID NO: 83841 - DNA, 25 bp, Mus musculus
cacgaggaagtggtgcttgagaact

SEQ ID NO: 83842 - DNA, 25 bp, Mus musculus
cacgaggacactgcgcctgaggaag

SEQ ID NO: 83843 - DNA, 25 bp, Mus musculus
cacgaggagatctgcacaaccaatg

SEQ ID NO: 83844 - DNA, 25 bp, Mus musculus
cacgaggccccttgattcgatggca

SEQ ID NO: 83845 - DNA, 25 bp, Mus musculus
cacgaggcgaggtccagatgtgcaa

SEQ ID NO: 83846 - DNA, 25 bp, Mus musculus
cacgaggctgctgtaagttgggaca

SEQ ID NO: 83847 - DNA, 25 bp, Mus musculus
cacgaggctgttcatgcagtggcat

SEQ ID NO: 83848 - DNA, 25 bp, Mus musculus
cacgaggtattttgtggttctcact

SEQ ID NO: 83849 - DNA, 25 bp, Mus musculus
cacgaggtcgtaaacactgaacaaa

SEQ ID NO: 83850 - DNA, 25 bp, Mus musculus
cacgagtcctttggccagtgggcaa

SEQ ID NO: 83851 - DNA, 25 bp, Mus musculus
cacgagtgctttctcctcagagggt

SEQ ID NO: 83852 - DNA, 25 bp, Mus musculus
cacgagtgtgaccaatgtgggcccc

SEQ ID NO: 83853 - DNA, 25 bp, Mus musculus
cacgagttcaagcaggcctgccagt

SEQ ID NO: 83854 - DNA, 25 bp, Mus musculus
cacgagttcaggaaggctcaagagg

SEQ ID NO: 83855 - DNA, 25 bp, Mus musculus
cacgagttgccttgcgtcacatgga

SEQ ID NO: 83856 - DNA, 25 bp, Mus musculus
cacgatagtaaagagcacctggcaa

SEQ ID NO: 83857 - DNA, 25 bp, Mus musculus
cacgatcatgagctgcttctggcca

SEQ ID NO: 83858 - DNA, 25 bp, Mus musculus
cacgatcatggtaaggcaacctggt

SEQ ID NO: 83859 - DNA, 25 bp, Mus musculus
cacgatcctgtggtgtgaagagcag

SEQ ID NO: 83860 - DNA, 25 bp, Mus musculus
cacgatcgtactggagacaccttca

SEQ ID NO: 83861 - DNA, 25 bp, Mus musculus
cacgatcttgtctctgcactggaag

SEQ ID NO: 83862 - DNA, 25 bp, Mus musculus
cacgatgaagctcggaaatggtcta

SEQ ID NO: 83863 - DNA, 25 bp, Mus musculus
cacgatgacgaggacaacggtagat

SEQ ID NO: 83864 - DNA, 25 bp, Mus musculus
cacgatgatgtaggctggctgaaga

SEQ ID NO: 83865 - DNA, 25 bp, Mus musculus
cacgatggattccttcaaggtggtg

SEQ ID NO: 83866 - DNA, 25 bp, Mus musculus
cacgatgtagctgcatctgatggct

SEQ ID NO: 83867 - DNA, 25 bp, Mus musculus
cacgatgtgcctctctccggttaaa

SEQ ID NO: 83868 - DNA, 25 bp, Mus musculus
cacgatgttccgcttcatgagggac

SEQ ID NO: 83869 - DNA, 25 bp, Mus musculus
cacgatgttgccctcccggaggaaa

SEQ ID NO: 83870 - DNA, 25 bp, Mus musculus
cacgattacaggagcacatgggaga

SEQ ID NO: 83871 - DNA, 25 bp, Mus musculus
cacgattcactgtctcctggagcag

SEQ ID NO: 83872 - DNA, 25 bp, Mus musculus
cacgatttggagtcaagacagatca

SEQ ID NO: 83873 - DNA, 25 bp, Mus musculus
cacgcaacacagctgtaccagcatg

SEQ ID NO: 83874 - DNA, 25 bp, Mus musculus
cacgcaagactctggagcacaggag

SEQ ID NO: 83875 - DNA, 25 bp, Mus musculus
cacgcaagcttttgaatctggagag

SEQ ID NO: 83876 - DNA, 25 bp, Mus musculus
cacgcaaggccatgattgagaagct

SEQ ID NO: 83877 - DNA, 25 bp, Mus musculus
cacgcaagggagcaacagttaaacc

SEQ ID NO: 83878 - DNA, 25 bp, Mus musculus
cacgcaagtatctgcgcagtgtggg

SEQ ID NO: 83879 - DNA, 25 bp, Mus musculus
cacgcacatgcaattcccgttcatg

SEQ ID NO: 83880 - DNA, 25 bp, Mus musculus
cacgcaccgttcctcctgatgttat

SEQ ID NO: 83881 - DNA, 25 bp, Mus musculus
cacgcaccttggtcttggagagaac

SEQ ID NO: 83882 - DNA, 25 bp, Mus musculus
cacgcacgcgcagacattgagaagc

SEQ ID NO: 83883 - DNA, 25 bp, Mus musculus
cacgcacgcgcgattcttaaagctt

SEQ ID NO: 83884 - DNA, 25 bp, Mus musculus
cacgcacgggtcttgtgaacaccga

SEQ ID NO: 83885 - DNA, 25 bp, Mus musculus
cacgcactggtggttagcagcacgg

SEQ ID NO: 83886 - DNA, 25 bp, Mus musculus
cacgcagattgataagaaaggcacc

SEQ ID NO: 83887 - DNA, 25 bp, Mus musculus
cacgcagcagcctgagcactattac

SEQ ID NO: 83888 - DNA, 25 bp, Mus musculus
cacgcagcggtttttgttcccaaga

SEQ ID NO: 83889 - DNA, 25 bp, Mus musculus
cacgcagctcgggtgatcttagcca

SEQ ID NO: 83890 - DNA, 25 bp, Mus musculus
cacgcagctggttggtgaacagaac

SEQ ID NO: 83891 - DNA, 25 bp, Mus musculus
cacgcaggtgcgaacagacatctat

SEQ ID NO: 83892 - DNA, 25 bp, Mus musculus
cacgcagtgcatagaggagctgagc

SEQ ID NO: 83893 - DNA, 25 bp, Mus musculus
cacgcagtgcggaatgaggcttatc

SEQ ID NO: 83894 - DNA, 25 bp, Mus musculus
cacgcagtgctgatgagcccatgac

SEQ ID NO: 83895 - DNA, 25 bp, Mus musculus
cacgcagtggatatagaagagaagg

SEQ ID NO: 83896 - DNA, 25 bp, Mus musculus
cacgcagttctacgagatgttcaag

SEQ ID NO: 83897 - DNA, 25 bp, Mus musculus
cacgcagttggctggcttcagtgga

SEQ ID NO: 83898 - DNA, 25 bp, Mus musculus
cacgcagttgtgcttcctgtacgca

SEQ ID NO: 83899 - DNA, 25 bp, Mus musculus
cacgcatggtcattgctggaggtca

SEQ ID NO: 83900 - DNA, 25 bp, Mus musculus
cacgcattggtagcttggataacag

SEQ ID NO: 83901 - DNA, 25 bp, Mus musculus
cacgccaagccaaagagagcacatt

SEQ ID NO: 83902 - DNA, 25 bp, Mus musculus
cacgccagaggatgacgattgttta

SEQ ID NO: 83903 - DNA, 25 bp, Mus musculus
cacgccatgatctaagccagaaggg

SEQ ID NO: 83904 - DNA, 25 bp, Mus musculus
cacgccatggtggaggtcagaccaa

SEQ ID NO: 83905 - DNA, 25 bp, Mus musculus
cacgccctccacttaacaaggaagg

SEQ ID NO: 83906 - DNA, 25 bp, Mus musculus
cacgccggcgcagtctacggaaccg

SEQ ID NO: 83907 - DNA, 25 bp, Mus musculus
cacgcctggagtgctacgagagcga

SEQ ID NO: 83908 - DNA, 25 bp, Mus musculus
cacgcgagttgttaactatcccatc

SEQ ID NO: 83909 - DNA, 25 bp, Mus musculus
cacgcgattgagatgctcctggacc

SEQ ID NO: 83910 - DNA, 25 bp, Mus musculus
cacgcgccgcatagaagtgacttct

SEQ ID NO: 83911 - DNA, 25 bp, Mus musculus
cacgcgcgctttggacctttgggtg

SEQ ID NO: 83912 - DNA, 25 bp, Mus musculus
cacgcgctttaacctagagacggaa

SEQ ID NO: 83913 - DNA, 25 bp, Mus musculus
cacgcggacattggaggtatcaccc

SEQ ID NO: 83914 - DNA, 25 bp, Mus musculus
cacgcggaggcgacttcttatactc

SEQ ID NO: 83915 - DNA, 25 bp, Mus musculus
cacgcggtgtttaagctcacgtatc

SEQ ID NO: 83916 - DNA, 25 bp, Mus musculus
cacgcgtctgtgtcttgcaggcaag

SEQ ID NO: 83917 - DNA, 25 bp, Mus musculus
cacgctatgagaagaatcccgcagt

SEQ ID NO: 83918 - DNA, 25 bp, Mus musculus
cacgctcattggaaactggtaatca

SEQ ID NO: 83919 - DNA, 25 bp, Mus musculus
cacgctcgagagtgggttacgcaag

SEQ ID NO: 83920 - DNA, 25 bp, Mus musculus
cacgctctggagacttgcttggaca

SEQ ID NO: 83921 - DNA, 25 bp, Mus musculus
cacgctctggcataagatgcatcgt

SEQ ID NO: 83922 - DNA, 25 bp, Mus musculus
cacgctgaacaaacaggtgaacttc

SEQ ID NO: 83923 - DNA, 25 bp, Mus musculus
cacgctgagcagcagcctgatgcat

SEQ ID NO: 83924 - DNA, 25 bp, Mus musculus
cacgctgcctgtgtccttgtggaga

SEQ ID NO: 83925 - DNA, 25 bp, Mus musculus
cacgctgcggttcgtccattcctag

SEQ ID NO: 83926 - DNA, 25 bp, Mus musculus
cacgctgctcccaagaacggaagaa

SEQ ID NO: 83927 - DNA, 25 bp, Mus musculus
cacgctgctgactaatgctgagaag

SEQ ID NO: 83928 - DNA, 25 bp, Mus musculus
cacgctgcttaccaatacaggcaag

SEQ ID NO: 83929 - DNA, 25 bp, Mus musculus
cacgctggaactctttgccctcatg

SEQ ID NO: 83930 - DNA, 25 bp, Mus musculus
cacgctggagatatgtgtggccgcc

SEQ ID NO: 83931 - DNA, 25 bp, Mus musculus
cacgctggcagctttgacagaaact

SEQ ID NO: 83932 - DNA, 25 bp, Mus musculus
cacgctggcccagtatgcggatgca

SEQ ID NO: 83933 - DNA, 25 bp, Mus musculus
cacgctggtgaatatggagcaaacc

SEQ ID NO: 83934 - DNA, 25 bp, Mus musculus
cacgctgtaaccaaggtggctctgg

SEQ ID NO: 83935 - DNA, 25 bp, Mus musculus
cacgctgtcccagtcttcggatgag

SEQ ID NO: 83936 - DNA, 25 bp, Mus musculus
cacgctgttgcgctgacacgagatt

SEQ ID NO: 83937 - DNA, 25 bp, Mus musculus
cacgcttctaaagctggttcctaca

SEQ ID NO: 83938 - DNA, 25 bp, Mus musculus
cacgcttctatgaggcaggtgagga

SEQ ID NO: 83939 - DNA, 25 bp, Mus musculus
cacgcttgtggagtggcaacagaca

SEQ ID NO: 83940 - DNA, 25 bp, Mus musculus
cacggaagaaaatgggcgggccaat

SEQ ID NO: 83941 - DNA, 25 bp, Mus musculus
cacggaagagattgtccagcgcaca

SEQ ID NO: 83942 - DNA, 25 bp, Mus musculus
cacggaaggcatgggagaattctcc

SEQ ID NO: 83943 - DNA, 25 bp, Mus musculus
cacggaaggctccatcttgggacag

SEQ ID NO: 83944 - DNA, 25 bp, Mus musculus
cacggaagtgctgttctttggccaa

SEQ ID NO: 83945 - DNA, 25 bp, Mus musculus
cacggacaagaaggtgtaagaggac

SEQ ID NO: 83946 - DNA, 25 bp, Mus musculus
cacggacaagttcatagttatgggc

SEQ ID NO: 83947 - DNA, 25 bp, Mus musculus
cacggacaggacagtcgtaagcgca

SEQ ID NO: 83948 - DNA, 25 bp, Mus musculus
cacggacatcatgagggtaaggcca

SEQ ID NO: 83949 - DNA, 25 bp, Mus musculus
cacggacggaagatgacctgagttt

SEQ ID NO: 83950 - DNA, 25 bp, Mus musculus
cacggactctacttcacacttcaaa

SEQ ID NO: 83951 - DNA, 25 bp, Mus musculus
cacggactggccagtaaggttctgc

SEQ ID NO: 83952 - DNA, 25 bp, Mus musculus
cacggagactccctgctgaagttga

SEQ ID NO: 83953 - DNA, 25 bp, Mus musculus
cacggagagcgctgatgactacaat

SEQ ID NO: 83954 - DNA, 25 bp, Mus musculus
cacggagcagtaatgtaaagacaca

SEQ ID NO: 83955 - DNA, 25 bp, Mus musculus
cacggagcgctttgagctgtttgtc

SEQ ID NO: 83956 - DNA, 25 bp, Mus musculus
cacggagcggaaagagatgtcagca

SEQ ID NO: 83957 - DNA, 25 bp, Mus musculus
cacggagctaggcttaaacgctgaa

SEQ ID NO: 83958 - DNA, 25 bp, Mus musculus
cacggaggcaactctgagcttcggg

SEQ ID NO: 83959 - DNA, 25 bp, Mus musculus
cacggaggcgcctggtgaatacttc

SEQ ID NO: 83960 - DNA, 25 bp, Mus musculus
cacggaggcggtgggctcgggcagt

SEQ ID NO: 83961 - DNA, 25 bp, Mus musculus
cacggagtattctcagtacaaggac

SEQ ID NO: 83962 - DNA, 25 bp, Mus musculus
cacggatatgacaacgaactcatgg

SEQ ID NO: 83963 - DNA, 25 bp, Mus musculus
cacggatcatgatgtgatactcaga

SEQ ID NO: 83964 - DNA, 25 bp, Mus musculus
cacggatcccaagaagaaggtggca

SEQ ID NO: 83965 - DNA, 25 bp, Mus musculus
cacggatctggtgaatatcggcttc

SEQ ID NO: 83966 - DNA, 25 bp, Mus musculus
cacggatgtcacactctgggctggt

SEQ ID NO: 83967 - DNA, 25 bp, Mus musculus
cacggattcagagggaagttatacc

SEQ ID NO: 83968 - DNA, 25 bp, Mus musculus
cacggattcgaattgccctgcgcaa

SEQ ID NO: 83969 - DNA, 25 bp, Mus musculus
cacggcaaccgacagatgaccttga

SEQ ID NO: 83970 - DNA, 25 bp, Mus musculus
cacggcaactgctgtcagatgagca

SEQ ID NO: 83971 - DNA, 25 bp, Mus musculus
cacggcactcaactcagatacacag

SEQ ID NO: 83972 - DNA, 25 bp, Mus musculus
cacggcagtggctcagaaagtttat

SEQ ID NO: 83973 - DNA, 25 bp, Mus musculus
cacggcataacatggctggaagcga

SEQ ID NO: 83974 - DNA, 25 bp, Mus musculus
cacggcatggttaagcactagcgag

SEQ ID NO: 83975 - DNA, 25 bp, Mus musculus
cacggcattggacagaagatggacc

SEQ ID NO: 83976 - DNA, 25 bp, Mus musculus
cacggccaagggaagaagaatctgc

SEQ ID NO: 83977 - DNA, 25 bp, Mus musculus
cacggccagcattcgggagaggcaa

SEQ ID NO: 83978 - DNA, 25 bp, Mus musculus
cacggccagtggactttcctggatc

SEQ ID NO: 83979 - DNA, 25 bp, Mus musculus
cacggcgctatggaggagctcgact

SEQ ID NO: 83980 - DNA, 25 bp, Mus musculus
cacggcggctcattgctgaactggg

SEQ ID NO: 83981 - DNA, 25 bp, Mus musculus
cacggcgtagccatcgctgaaggga

SEQ ID NO: 83982 - DNA, 25 bp, Mus musculus
cacggcgtgacgtcttgtgagctta

SEQ ID NO: 83983 - DNA, 25 bp, Mus musculus
cacggcgtgctccagtgtgctaaag

SEQ ID NO: 83984 - DNA, 25 bp, Mus musculus
cacggctaatgagtggaaactggct

SEQ ID NO: 83985 - DNA, 25 bp, Mus musculus
cacggctagaaggagataaagagtc

SEQ ID NO: 83986 - DNA, 25 bp, Mus musculus
cacggctatggttgtttggctatga

SEQ ID NO: 83987 - DNA, 25 bp, Mus musculus
cacggctattctcacagcagtggga

SEQ ID NO: 83988 - DNA, 25 bp, Mus musculus
cacggctgaatatccccggaggagt

SEQ ID NO: 83989 - DNA, 25 bp, Mus musculus
cacggctgccttaccagagagtggg

SEQ ID NO: 83990 - DNA, 25 bp, Mus musculus
cacggctgcttaaagtggtccatgg

SEQ ID NO: 83991 - DNA, 25 bp, Mus musculus
cacggctggagcaaaacgctacaag

SEQ ID NO: 83992 - DNA, 25 bp, Mus musculus
cacggctggagcgagatctgagcaa

SEQ ID NO: 83993 - DNA, 25 bp, Mus musculus
cacggctgtgccgagtttgtggaca

SEQ ID NO: 83994 - DNA, 25 bp, Mus musculus
cacgggaagcttggtggcactcatc

SEQ ID NO: 83995 - DNA, 25 bp, Mus musculus
cacgggaagtgtattggcatggcaa

SEQ ID NO: 83996 - DNA, 25 bp, Mus musculus
cacgggacagcacgctcattggaaa

SEQ ID NO: 83997 - DNA, 25 bp, Mus musculus
cacgggacgcttatgtaactgtgca

SEQ ID NO: 83998 - DNA, 25 bp, Mus musculus
cacgggagatattttggcaggctgc

SEQ ID NO: 83999 - DNA, 25 bp, Mus musculus
cacgggagcagaattcgacccagaa

SEQ ID NO: 84000 - DNA, 25 bp, Mus musculus
cacgggagtaaaggtgaggccaaca

SEQ ID NO: 84001 - DNA, 25 bp, Mus musculus
cacgggagtcggagctctatcagaa

SEQ ID NO: 84002 - DNA, 25 bp, Mus musculus
cacgggatcagcactttcatcgaca

SEQ ID NO: 84003 - DNA, 25 bp, Mus musculus
cacgggatcgcgaccaagtctgaat

SEQ ID NO: 84004 - DNA, 25 bp, Mus musculus
cacgggcaaggcagaaaaagtcacc

SEQ ID NO: 84005 - DNA, 25 bp, Mus musculus
cacgggcagaggagtcaggtcattt

SEQ ID NO: 84006 - DNA, 25 bp, Mus musculus
cacgggcatcgtggaaacacacttc

SEQ ID NO: 84007 - DNA, 25 bp, Mus musculus
cacgggctgcacagaagggacatga

SEQ ID NO: 84008 - DNA, 25 bp, Mus musculus
cacgggctgctgatatttctagact

SEQ ID NO: 84009 - DNA, 25 bp, Mus musculus
cacgggctggacttacggcttgtca

SEQ ID NO: 84010 - DNA, 25 bp, Mus musculus
cacgggctgggatcgatgacatatc

SEQ ID NO: 84011 - DNA, 25 bp, Mus musculus
cacgggtccaaggatgctggatcca

SEQ ID NO: 84012 - DNA, 25 bp, Mus musculus
cacgggtccgagatgctgataccaa

SEQ ID NO: 84013 - DNA, 25 bp, Mus musculus
cacgggtggactcttcaatacgcca

SEQ ID NO: 84014 - DNA, 25 bp, Mus musculus
cacgggtggagtaaacctcctggct

SEQ ID NO: 84015 - DNA, 25 bp, Mus musculus
cacggtacacccatgctgctggatg

SEQ ID NO: 84016 - DNA, 25 bp, Mus musculus
cacggtacttccttctgaagagtga

SEQ ID NO: 84017 - DNA, 25 bp, Mus musculus
cacggtcaagtgtttggctccagac

SEQ ID NO: 84018 - DNA, 25 bp, Mus musculus
cacggtccagggtgctcagcatgtg

SEQ ID NO: 84019 - DNA, 25 bp, Mus musculus
cacggtcccgcgaagttggctttat

SEQ ID NO: 84020 - DNA, 25 bp, Mus musculus
cacggtcctttttgaacagccagag

SEQ ID NO: 84021 - DNA, 25 bp, Mus musculus
cacggtcgcctctgtgtacaaaggg

SEQ ID NO: 84022 - DNA, 25 bp, Mus musculus
cacggtcggaacagctacaagcgct

SEQ ID NO: 84023 - DNA, 25 bp, Mus musculus
cacggtcggccagattgtccagtac

SEQ ID NO: 84024 - DNA, 25 bp, Mus musculus
cacggtctgggctaaggatggtaca

SEQ ID NO: 84025 - DNA, 25 bp, Mus musculus
cacggtgacactgacatgcgaaggg

SEQ ID NO: 84026 - DNA, 25 bp, Mus musculus
cacggtgacttaaagagcccaggct

SEQ ID NO: 84027 - DNA, 25 bp, Mus musculus
cacggtgatcctggctgtcgtttca

SEQ ID NO: 84028 - DNA, 25 bp, Mus musculus
cacggtggacattcccagggctata

SEQ ID NO: 84029 - DNA, 25 bp, Mus musculus
cacggtggatcagtatggagaagtc

SEQ ID NO: 84030 - DNA, 25 bp, Mus musculus
cacggtggcactgtggatgagtatc

SEQ ID NO: 84031 - DNA, 25 bp, Mus musculus
cacggtgggctctcgtgtgacgccc

SEQ ID NO: 84032 - DNA, 25 bp, Mus musculus
cacggtggtcataagtcagggcaga

SEQ ID NO: 84033 - DNA, 25 bp, Mus musculus
cacggtggttctgggaggcatactt

SEQ ID NO: 84034 - DNA, 25 bp, Mus musculus
cacggttatgagaagccactgggct

SEQ ID NO: 84035 - DNA, 25 bp, Mus musculus
cacggttctcttcccgaaggtggct

SEQ ID NO: 84036 - DNA, 25 bp, Mus musculus
cacggttctcttccgaccttgcggg

SEQ ID NO: 84037 - DNA, 25 bp, Mus musculus
cacggttgatacttctctggagaga

SEQ ID NO: 84038 - DNA, 25 bp, Mus musculus
cacggtttccagagacgagttcagg

SEQ ID NO: 84039 - DNA, 25 bp, Mus musculus
cacggtttggacactcacagcatga

SEQ ID NO: 84040 - DNA, 25 bp, Mus musculus
cacgtaattctcctgtgggcatggg

SEQ ID NO: 84041 - DNA, 25 bp, Mus musculus
cacgtacccggctagaaattgtcac

SEQ ID NO: 84042 - DNA, 25 bp, Mus musculus
cacgtacctgctcatcagtgaagac

SEQ ID NO: 84043 - DNA, 25 bp, Mus musculus
cacgtagaagatgggatcgaacagc

SEQ ID NO: 84044 - DNA, 25 bp, Mus musculus
cacgtagaggcaggctctgaacttg

SEQ ID NO: 84045 - DNA, 25 bp, Mus musculus
cacgtagtggatgggcagaccttcg

SEQ ID NO: 84046 - DNA, 25 bp, Mus musculus
cacgtcaagtatgcgagcagctcat

SEQ ID NO: 84047 - DNA, 25 bp, Mus musculus
cacgtcagttatgctgtcagtgtga

SEQ ID NO: 84048 - DNA, 25 bp, Mus musculus
cacgtcatgatggagacctacggga

SEQ ID NO: 84049 - DNA, 25 bp, Mus musculus
cacgtccggctctttgggagaggat

SEQ ID NO: 84050 - DNA, 25 bp, Mus musculus
cacgtcctaaagtaatggcggcggg

SEQ ID NO: 84051 - DNA, 25 bp, Mus musculus
cacgtcgcagggagtttgtgatgca

SEQ ID NO: 84052 - DNA, 25 bp, Mus musculus
cacgtcgcgtttggaaaaattatct

SEQ ID NO: 84053 - DNA, 25 bp, Mus musculus
cacgtcgctgagtgagaactatgcc

SEQ ID NO: 84054 - DNA, 25 bp, Mus musculus
cacgtcggccgagttgaagatccgt

SEQ ID NO: 84055 - DNA, 25 bp, Mus musculus
cacgtcggtgtttggattcggctca

SEQ ID NO: 84056 - DNA, 25 bp, Mus musculus
cacgtcgtcgtgtgctcagaagtca

SEQ ID NO: 84057 - DNA, 25 bp, Mus musculus
cacgtcgtgacgatagtggacctct

SEQ ID NO: 84058 - DNA, 25 bp, Mus musculus
cacgtctatggatggcaaatgcaag

SEQ ID NO: 84059 - DNA, 25 bp, Mus musculus
cacgtctggctgactggatccacag

SEQ ID NO: 84060 - DNA, 25 bp, Mus musculus
cacgtgaagagcagagcattggcct

SEQ ID NO: 84061 - DNA, 25 bp, Mus musculus
cacgtgaatacgttctggaggaccc

SEQ ID NO: 84062 - DNA, 25 bp, Mus musculus
cacgtgacagggacatgccatgtat

SEQ ID NO: 84063 - DNA, 25 bp, Mus musculus
cacgtgatagttcgagaggacccct

SEQ ID NO: 84064 - DNA, 25 bp, Mus musculus
cacgtgattatggtcggtgctgcct

SEQ ID NO: 84065 - DNA, 25 bp, Mus musculus
cacgtgcaccaaaaacaagctgtct

SEQ ID NO: 84066 - DNA, 25 bp, Mus musculus
cacgtgcactcaagcctaagggtag

SEQ ID NO: 84067 - DNA, 25 bp, Mus musculus
cacgtgcagacataggcaaggtctc

SEQ ID NO: 84068 - DNA, 25 bp, Mus musculus
cacgtgcaggcggagctgtctccat

SEQ ID NO: 84069 - DNA, 25 bp, Mus musculus
cacgtgcattaaatggtcactttca

SEQ ID NO: 84070 - DNA, 25 bp, Mus musculus
cacgtgcgggaaaacctttaggcag

SEQ ID NO: 84071 - DNA, 25 bp, Mus musculus
cacgtgcgggaagagttttagacaa

SEQ ID NO: 84072 - DNA, 25 bp, Mus musculus
cacgtgcgttccttgtgcctatgaa

SEQ ID NO: 84073 - DNA, 25 bp, Mus musculus
cacgtgctactaactgtcaggagga

SEQ ID NO: 84074 - DNA, 25 bp, Mus musculus
cacgtgctgctcataggaaggcgct

SEQ ID NO: 84075 - DNA, 25 bp, Mus musculus
cacgtgctttcaaaaggtctccaga

SEQ ID NO: 84076 - DNA, 25 bp, Mus musculus
cacgtggaaagagtgatgcggaacc

SEQ ID NO: 84077 - DNA, 25 bp, Mus musculus
cacgtggataacctggcgaaggctc

SEQ ID NO: 84078 - DNA, 25 bp, Mus musculus
cacgtggcaacaaggatatggccca

SEQ ID NO: 84079 - DNA, 25 bp, Mus musculus
cacgtggccttgtcgctgtcttgca

SEQ ID NO: 84080 - DNA, 25 bp, Mus musculus
cacgtggcggaccaaatgattggca

SEQ ID NO: 84081 - DNA, 25 bp, Mus musculus
cacgtggctgtggtctggactctga

SEQ ID NO: 84082 - DNA, 25 bp, Mus musculus
cacgtggcttttggctgagacctgt

SEQ ID NO: 84083 - DNA, 25 bp, Mus musculus
cacgtgggcaggctaagccagaaca

SEQ ID NO: 84084 - DNA, 25 bp, Mus musculus
cacgtggtatgttatcaagcctgga

SEQ ID NO: 84085 - DNA, 25 bp, Mus musculus
cacgtggtcttcaggagctcaaaca

SEQ ID NO: 84086 - DNA, 25 bp, Mus musculus
cacgtggtgggataaactctttggg

SEQ ID NO: 84087 - DNA, 25 bp, Mus musculus
cacgtggtgtgtcttcatggtcaac

SEQ ID NO: 84088 - DNA, 25 bp, Mus musculus
cacgtggttggcctgatttggatca

SEQ ID NO: 84089 - DNA, 25 bp, Mus musculus
cacgtgtacacaggcggcaaaggat

SEQ ID NO: 84090 - DNA, 25 bp, Mus musculus
cacgtgtcagtgaggcatgagcttc

SEQ ID NO: 84091 - DNA, 25 bp, Mus musculus
cacgtgtcatgctggagtgtccgca

SEQ ID NO: 84092 - DNA, 25 bp, Mus musculus
cacgtgtccctgtccatagtaatcc

SEQ ID NO: 84093 - DNA, 25 bp, Mus musculus
cacgtgtctgtttactggcaaaagc

SEQ ID NO: 84094 - DNA, 25 bp, Mus musculus
cacgtgtgagtggaccttcgcatcc

SEQ ID NO: 84095 - DNA, 25 bp, Mus musculus
cacgtgttcaccttaagcaggctgt

SEQ ID NO: 84096 - DNA, 25 bp, Mus musculus
cacgtgttctctaagcatggctgga

SEQ ID NO: 84097 - DNA, 25 bp, Mus musculus
cacgttagtgctcatgtggagcaga

SEQ ID NO: 84098 - DNA, 25 bp, Mus musculus
cacgttatgcggtttttccatgaaa

SEQ ID NO: 84099 - DNA, 25 bp, Mus musculus
cacgttccggttctgagcttcagga

SEQ ID NO: 84100 - DNA, 25 bp, Mus musculus
cacgttcctaggagctgggcttgga

SEQ ID NO: 84101 - DNA, 25 bp, Mus musculus
cacgttccttcctgcaaattctgga

SEQ ID NO: 84102 - DNA, 25 bp, Mus musculus
cacgttctcctgagcacctggcggg

SEQ ID NO: 84103 - DNA, 25 bp, Mus musculus
cacgttctcgggtttctagtgctcc

SEQ ID NO: 84104 - DNA, 25 bp, Mus musculus
cacgttcttgaaatcagggtcccca

SEQ ID NO: 84105 - DNA, 25 bp, Mus musculus
cacgttgctgatgggaggtctcacc

SEQ ID NO: 84106 - DNA, 25 bp, Mus musculus
cacgttgtcgtgaaatgccacagaa

SEQ ID NO: 84107 - DNA, 25 bp, Mus musculus
cacgttgtgagtgtggaccaaggca

SEQ ID NO: 84108 - DNA, 25 bp, Mus musculus
cacgttgtggagcttcctgtctgaa

SEQ ID NO: 84109 - DNA, 25 bp, Mus musculus
cacgtttccgaagatgatgggctca

SEQ ID NO: 84110 - DNA, 25 bp, Mus musculus
cacgtttccgattgcctgctggcag

SEQ ID NO: 84111 - DNA, 25 bp, Mus musculus
cacgtttgagcatccctcgttgtga

SEQ ID NO: 84112 - DNA, 25 bp, Mus musculus
cacgtttgaggctcgggacctagag

SEQ ID NO: 84113 - DNA, 25 bp, Mus musculus
cacgtttgggatcgaaagtcacatt

SEQ ID NO: 84114 - DNA, 25 bp, Mus musculus
cacgtttgtgtggtccttcaatggc

SEQ ID NO: 84115 - DNA, 25 bp, Mus musculus
cacgttttcgtggaaccggtgcagc

SEQ ID NO: 84116 - DNA, 25 bp, Mus musculus
cactaaacgcgaaggtgaggacgga

SEQ ID NO: 84117 - DNA, 25 bp, Mus musculus
cactaaaggacagccatgggtatgc

SEQ ID NO: 84118 - DNA, 25 bp, Mus musculus
cactaagaaagactcgggtacaacg

SEQ ID NO: 84119 - DNA, 25 bp, Mus musculus
cactaagacagttggagcagcagga

SEQ ID NO: 84120 - DNA, 25 bp, Mus musculus
cactaagactgctaggaaccgtgca

SEQ ID NO: 84121 - DNA, 25 bp, Mus musculus
cactaagccgggtcatggagctcaa

SEQ ID NO: 84122 - DNA, 25 bp, Mus musculus
cactaagcgtgcgagggagagaact

SEQ ID NO: 84123 - DNA, 25 bp, Mus musculus
cactaaggacgcactgaggacagct

SEQ ID NO: 84124 - DNA, 25 bp, Mus musculus
cactaatgagctatgaagttccgga

SEQ ID NO: 84125 - DNA, 25 bp, Mus musculus
cactaattctaggtggctgccccat

SEQ ID NO: 84126 - DNA, 25 bp, Mus musculus
cactaattgactgcttcctggacag

SEQ ID NO: 84127 - DNA, 25 bp, Mus musculus
cactacagcgaagacggaagcatat

SEQ ID NO: 84128 - DNA, 25 bp, Mus musculus
cactacagtctcgaattgagcgtga

SEQ ID NO: 84129 - DNA, 25 bp, Mus musculus
cactacagtgttactttaagacggt

SEQ ID NO: 84130 - DNA, 25 bp, Mus musculus
cactacatcagtggcgagaggccca

SEQ ID NO: 84131 - DNA, 25 bp, Mus musculus
cactaccgctgctgatgtccagagg

SEQ ID NO: 84132 - DNA, 25 bp, Mus musculus
cactacctgcggcttaagcgcgagc

SEQ ID NO: 84133 - DNA, 25 bp, Mus musculus
cactacctgtgatgtcgcctgctta

SEQ ID NO: 84134 - DNA, 25 bp, Mus musculus
cactaccttgaccagaagaggctga

SEQ ID NO: 84135 - DNA, 25 bp, Mus musculus
cactacgacggccatgtccgatttg

SEQ ID NO: 84136 - DNA, 25 bp, Mus musculus
cactacgagaactacagggcacagt

SEQ ID NO: 84137 - DNA, 25 bp, Mus musculus
cactactacctcttgaagccatgag

SEQ ID NO: 84138 - DNA, 25 bp, Mus musculus
cactactgggaggtgcgcttcgaac

SEQ ID NO: 84139 - DNA, 25 bp, Mus musculus
cactactgtactggaggagggtctg

SEQ ID NO: 84140 - DNA, 25 bp, Mus musculus
cactacttggaggtgttgtttcgaa

SEQ ID NO: 84141 - DNA, 25 bp, Mus musculus
cactagaaaacgctcttgggaagcc

SEQ ID NO: 84142 - DNA, 25 bp, Mus musculus
cactagaattaagcaactggtccag

SEQ ID NO: 84143 - DNA, 25 bp, Mus musculus
cactagacatggcttcgaggtgcta

SEQ ID NO: 84144 - DNA, 25 bp, Mus musculus
cactagaccctacgatcaagatgag

SEQ ID NO: 84145 - DNA, 25 bp, Mus musculus
cactagagaaagtcatcgagatcca

SEQ ID NO: 84146 - DNA, 25 bp, Mus musculus
cactagaggcagacaagatcatcgg

SEQ ID NO: 84147 - DNA, 25 bp, Mus musculus
cactagagtagagaccgggtcctca

SEQ ID NO: 84148 - DNA, 25 bp, Mus musculus
cactagagtatgattttggaagcca

SEQ ID NO: 84149 - DNA, 25 bp, Mus musculus
cactagcagagtcctcgccatgtca

SEQ ID NO: 84150 - DNA, 25 bp, Mus musculus
cactagccaagggagaagtggccga

SEQ ID NO: 84151 - DNA, 25 bp, Mus musculus
cactagccatggaattgagccggcg

SEQ ID NO: 84152 - DNA, 25 bp, Mus musculus
cactagccattgtggaggcactcgt

SEQ ID NO: 84153 - DNA, 25 bp, Mus musculus
cactagccccaatttttgagacaag

SEQ ID NO: 84154 - DNA, 25 bp, Mus musculus
cactagcgatggatggtcagagaca

SEQ ID NO: 84155 - DNA, 25 bp, Mus musculus
cactagctgcctcggcagcgcgttg

SEQ ID NO: 84156 - DNA, 25 bp, Mus musculus
cactaggcctgtgatggaacctgac

SEQ ID NO: 84157 - DNA, 25 bp, Mus musculus
cactagggcgtctccaagcagagta

SEQ ID NO: 84158 - DNA, 25 bp, Mus musculus
cactagtacatgtcagcacaggagg

SEQ ID NO: 84159 - DNA, 25 bp, Mus musculus
cactagtagaaggatgactgccgcc

SEQ ID NO: 84160 - DNA, 25 bp, Mus musculus
cactagtccgtgagattcggcagca

SEQ ID NO: 84161 - DNA, 25 bp, Mus musculus
cactagtgtcttccccaagttggct

SEQ ID NO: 84162 - DNA, 25 bp, Mus musculus
cactagtgtttgaggatgatctgcg

SEQ ID NO: 84163 - DNA, 25 bp, Mus musculus
cactataacagttgctgccggagga

SEQ ID NO: 84164 - DNA, 25 bp, Mus musculus
cactatactaactgggagactgtcc

SEQ ID NO: 84165 - DNA, 25 bp, Mus musculus
cactatccagaagagcagctgggat

SEQ ID NO: 84166 - DNA, 25 bp, Mus musculus
cactatctagcctggaagggagcgt

SEQ ID NO: 84167 - DNA, 25 bp, Mus musculus
cactatgaacgaggagtacgagacc

SEQ ID NO: 84168 - DNA, 25 bp, Mus musculus
cactatgacggaagtaaaggcttac

SEQ ID NO: 84169 - DNA, 25 bp, Mus musculus
cactatgcaagtgaagaagtcagca

SEQ ID NO: 84170 - DNA, 25 bp, Mus musculus
cactatgcagttgcagaggacagct

SEQ ID NO: 84171 - DNA, 25 bp, Mus musculus
cactatgctgataagtttgccaaca

SEQ ID NO: 84172 - DNA, 25 bp, Mus musculus
cactatggaacaacctcagactgag

SEQ ID NO: 84173 - DNA, 25 bp, Mus musculus
cactatggatgattttgaacgtcgc

SEQ ID NO: 84174 - DNA, 25 bp, Mus musculus
cactatggatggtgtgagcacagcc

SEQ ID NO: 84175 - DNA, 25 bp, Mus musculus
cactatggcgcgattgtggaccaga

SEQ ID NO: 84176 - DNA, 25 bp, Mus musculus
cactatggtcggaaaactgttcagg

SEQ ID NO: 84177 - DNA, 25 bp, Mus musculus
cactatgtgaaggtgcaaggcctgg

SEQ ID NO: 84178 - DNA, 25 bp, Mus musculus
cactatgttcgatgcaggaaagccc

SEQ ID NO: 84179 - DNA, 25 bp, Mus musculus
cactatgtttttggatggaggagga

SEQ ID NO: 84180 - DNA, 25 bp, Mus musculus
cactattatatccaggccagcagca

SEQ ID NO: 84181 - DNA, 25 bp, Mus musculus
cactattgaaaacaccaggcgacat

SEQ ID NO: 84182 - DNA, 25 bp, Mus musculus
cactattttacaggagcagcggatg

SEQ ID NO: 84183 - DNA, 25 bp, Mus musculus
cactattttctggaactgcggcgcc

SEQ ID NO: 84184 - DNA, 25 bp, Mus musculus
cactcaagaccgtatatggctctac

SEQ ID NO: 84185 - DNA, 25 bp, Mus musculus
cactcaatcttgctgtcctggactg

SEQ ID NO: 84186 - DNA, 25 bp, Mus musculus
cactcacaagcgaagggaaggcgag

SEQ ID NO: 84187 - DNA, 25 bp, Mus musculus
cactcacagcccataggattctggg

SEQ ID NO: 84188 - DNA, 25 bp, Mus musculus
cactcaccatgtggagggacatcac

SEQ ID NO: 84189 - DNA, 25 bp, Mus musculus
cactcaccctcaagtgggtggacag

SEQ ID NO: 84190 - DNA, 25 bp, Mus musculus
cactcaccgggtgggcatgatccgt

SEQ ID NO: 84191 - DNA, 25 bp, Mus musculus
cactcactgggaagtttgctggcaa

SEQ ID NO: 84192 - DNA, 25 bp, Mus musculus
cactcactgggatgaagcagggagc

SEQ ID NO: 84193 - DNA, 25 bp, Mus musculus
cactcactggttacatttggatggc

SEQ ID NO: 84194 - DNA, 25 bp, Mus musculus
cactcactgtttgtggacggatcag

SEQ ID NO: 84195 - DNA, 25 bp, Mus musculus
cactcacttcgatgtgctggaggac

SEQ ID NO: 84196 - DNA, 25 bp, Mus musculus
cactcacttcgggacgttggagccg

SEQ ID NO: 84197 - DNA, 25 bp, Mus musculus
cactcagaaaaacggtggaggacta

SEQ ID NO: 84198 - DNA, 25 bp, Mus musculus
cactcagaactcaggatgaactggg

SEQ ID NO: 84199 - DNA, 25 bp, Mus musculus
cactcagactggaaaggcttatggg

SEQ ID NO: 84200 - DNA, 25 bp, Mus musculus
cactcagagagctggtggagaccca

SEQ ID NO: 84201 - DNA, 25 bp, Mus musculus
cactcagagggtcgccaccatttga

SEQ ID NO: 84202 - DNA, 25 bp, Mus musculus
cactcagcagattctagtacaagca

SEQ ID NO: 84203 - DNA, 25 bp, Mus musculus
cactcagctgctaccaataaagcag

SEQ ID NO: 84204 - DNA, 25 bp, Mus musculus
cactcagctgtctaaggtattcaaa

SEQ ID NO: 84205 - DNA, 25 bp, Mus musculus
cactcaggaaacgtgctcagggaga

SEQ ID NO: 84206 - DNA, 25 bp, Mus musculus
cactcaggagtggaagcctttgtaa

SEQ ID NO: 84207 - DNA, 25 bp, Mus musculus
cactcaggatgcacgttatcaggcc

SEQ ID NO: 84208 - DNA, 25 bp, Mus musculus
cactcaggatgggagcaagcacttt

SEQ ID NO: 84209 - DNA, 25 bp, Mus musculus
cactcaggccgagcgtaagattcga

SEQ ID NO: 84210 - DNA, 25 bp, Mus musculus
cactcaggctgtgtttgcttcagga

SEQ ID NO: 84211 - DNA, 25 bp, Mus musculus
cactcagggatctaatgcaaaggct

SEQ ID NO: 84212 - DNA, 25 bp, Mus musculus
cactcagggcttcacggaaatcgtc

SEQ ID NO: 84213 - DNA, 25 bp, Mus musculus
cactcaggtggctccgggccagagt

SEQ ID NO: 84214 - DNA, 25 bp, Mus musculus
cactcagtctctaagggctacatgg

SEQ ID NO: 84215 - DNA, 25 bp, Mus musculus
cactcagtgacggtgccgcttgttg

SEQ ID NO: 84216 - DNA, 25 bp, Mus musculus
cactcagttacaggtggcagcatga

SEQ ID NO: 84217 - DNA, 25 bp, Mus musculus
cactcagttattttcaactaatgca

SEQ ID NO: 84218 - DNA, 25 bp, Mus musculus
cactcatcgaagaacgaggccggtt

SEQ ID NO: 84219 - DNA, 25 bp, Mus musculus
cactcatgagggtttcttctggcaa

SEQ ID NO: 84220 - DNA, 25 bp, Mus musculus
cactcatgggtgtaagcaagttaga

SEQ ID NO: 84221 - DNA, 25 bp, Mus musculus
cactcatttataattacccgggaag

SEQ ID NO: 84222 - DNA, 25 bp, Mus musculus
cactccacgtactgaagaggcggct

SEQ ID NO: 84223 - DNA, 25 bp, Mus musculus
cactccatgccgagggcttgaatga

SEQ ID NO: 84224 - DNA, 25 bp, Mus musculus
cactcccaggaagctctatagacag

SEQ ID NO: 84225 - DNA, 25 bp, Mus musculus
cactcccggtgtgtgtggtcacttg

SEQ ID NO: 84226 - DNA, 25 bp, Mus musculus
cactccctggtgctaaagacactgg

SEQ ID NO: 84227 - DNA, 25 bp, Mus musculus
cactccggaggagctctttgggcaa

SEQ ID NO: 84228 - DNA, 25 bp, Mus musculus
cactccgtgagcacttaaatgctgc

SEQ ID NO: 84229 - DNA, 25 bp, Mus musculus
cactccgtggtgagaaaggacgcta

SEQ ID NO: 84230 - DNA, 25 bp, Mus musculus
cactccgtgtggctgggaaataaca

SEQ ID NO: 84231 - DNA, 25 bp, Mus musculus
cactcctaagcggtttctggtgcga

SEQ ID NO: 84232 - DNA, 25 bp, Mus musculus
cactcctagccaatggtgatcatgg

SEQ ID NO: 84233 - DNA, 25 bp, Mus musculus
cactcctcagtacaggttccggaag

SEQ ID NO: 84234 - DNA, 25 bp, Mus musculus
cactcctggaaaacatgcacatcga

SEQ ID NO: 84235 - DNA, 25 bp, Mus musculus
cactcctgttgagggctgcagttca

SEQ ID NO: 84236 - DNA, 25 bp, Mus musculus
cactcgaagcgaggcatgtgggcca

SEQ ID NO: 84237 - DNA, 25 bp, Mus musculus
cactcgacaggcaaaggccgtgagt

SEQ ID NO: 84238 - DNA, 25 bp, Mus musculus
cactcgcgactttgactattacaag

SEQ ID NO: 84239 - DNA, 25 bp, Mus musculus
cactcgctgaggatggtattgccta

SEQ ID NO: 84240 - DNA, 25 bp, Mus musculus
cactcgcttagtgttgctggaccct

SEQ ID NO: 84241 - DNA, 25 bp, Mus musculus
cactcggagaaggtggaattgctga

SEQ ID NO: 84242 - DNA, 25 bp, Mus musculus
cactcggcgtgtgtaaagaaactgc

SEQ ID NO: 84243 - DNA, 25 bp, Mus musculus
cactcggctgatgtcaatgcaaggg

SEQ ID NO: 84244 - DNA, 25 bp, Mus musculus
cactcgggagatggctacaacatta

SEQ ID NO: 84245 - DNA, 25 bp, Mus musculus
cactcgggcttctgcaggcagaggt

SEQ ID NO: 84246 - DNA, 25 bp, Mus musculus
cactcggtgtgtgacgtggagatac

SEQ ID NO: 84247 - DNA, 25 bp, Mus musculus
cactcgtgaggagaacatggcaccg

SEQ ID NO: 84248 - DNA, 25 bp, Mus musculus
cactcgtgccctgtatgaagctaag

SEQ ID NO: 84249 - DNA, 25 bp, Mus musculus
cactctaatagcatggtttggccag

SEQ ID NO: 84250 - DNA, 25 bp, Mus musculus
cactctaatggaactgtcccaccag

SEQ ID NO: 84251 - DNA, 25 bp, Mus musculus
cactctacatgggagatctgattgc

SEQ ID NO: 84252 - DNA, 25 bp, Mus musculus
cactctacttgcaggggtgcttacc

SEQ ID NO: 84253 - DNA, 25 bp, Mus musculus
cactctagccgttgccgtctctttg

SEQ ID NO: 84254 - DNA, 25 bp, Mus musculus
cactctagtggagggagcaaatctc

SEQ ID NO: 84255 - DNA, 25 bp, Mus musculus
cactctattcgacggtaccagaaga

SEQ ID NO: 84256 - DNA, 25 bp, Mus musculus
cactctcagagagggtgtacctgtc

SEQ ID NO: 84257 - DNA, 25 bp, Mus musculus
cactctcatgacacggagacacggg

SEQ ID NO: 84258 - DNA, 25 bp, Mus musculus
cactctccagagagcgctggctcag

SEQ ID NO: 84259 - DNA, 25 bp, Mus musculus
cactctcgtgggtgcaaaagcggca

SEQ ID NO: 84260 - DNA, 25 bp, Mus musculus
cactctctgcgtgtgaagaagaccc

SEQ ID NO: 84261 - DNA, 25 bp, Mus musculus
cactctgaagaattgggaggcccac

SEQ ID NO: 84262 - DNA, 25 bp, Mus musculus
cactctgaaggagcgtgagcggctt

SEQ ID NO: 84263 - DNA, 25 bp, Mus musculus
cactctgacaggttcttctggagga

SEQ ID NO: 84264 - DNA, 25 bp, Mus musculus
cactctgacgaggaggcaggacatc

SEQ ID NO: 84265 - DNA, 25 bp, Mus musculus
cactctgagagctgggtgggagcca

SEQ ID NO: 84266 - DNA, 25 bp, Mus musculus
cactctgatcgaagctgagctggcg

SEQ ID NO: 84267 - DNA, 25 bp, Mus musculus
cactctgcaaacaggtaagaaacat

SEQ ID NO: 84268 - DNA, 25 bp, Mus musculus
cactctgctcgagaacctgtggcga

SEQ ID NO: 84269 - DNA, 25 bp, Mus musculus
cactctgctgaaaaacggagcttat

SEQ ID NO: 84270 - DNA, 25 bp, Mus musculus
cactctgcttgagcctgtggaagga

SEQ ID NO: 84271 - DNA, 25 bp, Mus musculus
cactctggaaacctggctgaagaca

SEQ ID NO: 84272 - DNA, 25 bp, Mus musculus
cactctggaaagctgcaggcgtttg

SEQ ID NO: 84273 - DNA, 25 bp, Mus musculus
cactctggacggctaagaaccttca

SEQ ID NO: 84274 - DNA, 25 bp, Mus musculus
cactctggaggttggcaccatggac

SEQ ID NO: 84275 - DNA, 25 bp, Mus musculus
cactctggagttcagcggacagaac

SEQ ID NO: 84276 - DNA, 25 bp, Mus musculus
cactctgtgcccaagtatggtcgac

SEQ ID NO: 84277 - DNA, 25 bp, Mus musculus
cactctgtggatcgaatggtcaaca

SEQ ID NO: 84278 - DNA, 25 bp, Mus musculus
cactctgtggtgaagctgcatgatg

SEQ ID NO: 84279 - DNA, 25 bp, Mus musculus
cactctgttggtgtccttgtggcca

SEQ ID NO: 84280 - DNA, 25 bp, Mus musculus
cactctgtttacgaggaggagggaa

SEQ ID NO: 84281 - DNA, 25 bp, Mus musculus
cactcttaaggccacgagaatatca

SEQ ID NO: 84282 - DNA, 25 bp, Mus musculus
cactcttaaggctgggctagggctg

SEQ ID NO: 84283 - DNA, 25 bp, Mus musculus
cactcttacgaagttcctatgtagc

SEQ ID NO: 84284 - DNA, 25 bp, Mus musculus
cactcttccagcaccgaagggaggg

SEQ ID NO: 84285 - DNA, 25 bp, Mus musculus
cactcttcgggtgcacaggattcag

SEQ ID NO: 84286 - DNA, 25 bp, Mus musculus
cactcttgaagcctgtccttggaga

SEQ ID NO: 84287 - DNA, 25 bp, Mus musculus
cactcttgagcagttgggaccttcg

SEQ ID NO: 84288 - DNA, 25 bp, Mus musculus
cactcttgcagagatggcaggcagc

SEQ ID NO: 84289 - DNA, 25 bp, Mus musculus
cactcttggcctgacggtatcggga

SEQ ID NO: 84290 - DNA, 25 bp, Mus musculus
cactcttgggtacaataatgcctga

SEQ ID NO: 84291 - DNA, 25 bp, Mus musculus
cactcttggtcttcgtttctgatca

SEQ ID NO: 84292 - DNA, 25 bp, Mus musculus
cactcttgtggataccaagtggcgc

SEQ ID NO: 84293 - DNA, 25 bp, Mus musculus
cactgaaaatgtggaagggaagccc

SEQ ID NO: 84294 - DNA, 25 bp, Mus musculus
cactgaaactggaagcgttggccgt

SEQ ID NO: 84295 - DNA, 25 bp, Mus musculus
cactgaaagattgccagcagctgct

SEQ ID NO: 84296 - DNA, 25 bp, Mus musculus
cactgaaagcctgtggagtccctaa

SEQ ID NO: 84297 - DNA, 25 bp, Mus musculus
cactgaaaggatccaaacaagactg

SEQ ID NO: 84298 - DNA, 25 bp, Mus musculus
cactgaaccgactgcaggaagacac

SEQ ID NO: 84299 - DNA, 25 bp, Mus musculus
cactgaacgatggagcagctgctct

SEQ ID NO: 84300 - DNA, 25 bp, Mus musculus
cactgaacggctagaatgaattgca

SEQ ID NO: 84301 - DNA, 25 bp, Mus musculus
cactgaacgtggagccagatggcac

SEQ ID NO: 84302 - DNA, 25 bp, Mus musculus
cactgaactaaagaaggcctatagg

SEQ ID NO: 84303 - DNA, 25 bp, Mus musculus
cactgaactggaagaagggctccgg

SEQ ID NO: 84304 - DNA, 25 bp, Mus musculus
cactgaagaacatagacatgggaca

SEQ ID NO: 84305 - DNA, 25 bp, Mus musculus
cactgaagccagagataactgtgtc

SEQ ID NO: 84306 - DNA, 25 bp, Mus musculus
cactgaagcttctcatagatcggca

SEQ ID NO: 84307 - DNA, 25 bp, Mus musculus
cactgaaggacatatgcaaggctca

SEQ ID NO: 84308 - DNA, 25 bp, Mus musculus
cactgaaggagaatgaaatctgcgt

SEQ ID NO: 84309 - DNA, 25 bp, Mus musculus
cactgaaggagcctgcagcgctcac

SEQ ID NO: 84310 - DNA, 25 bp, Mus musculus
cactgaaggctgtagtagaatccaa

SEQ ID NO: 84311 - DNA, 25 bp, Mus musculus
cactgaaggtggaaaagttcacgac

SEQ ID NO: 84312 - DNA, 25 bp, Mus musculus
cactgaagtcaccagcagtggtagc

SEQ ID NO: 84313 - DNA, 25 bp, Mus musculus
cactgaatatatgagtagcgcccgc

SEQ ID NO: 84314 - DNA, 25 bp, Mus musculus
cactgaatgcatccaaacaagacgg

SEQ ID NO: 84315 - DNA, 25 bp, Mus musculus
cactgaatgggagggttacctgccc

SEQ ID NO: 84316 - DNA, 25 bp, Mus musculus
cactgaatggtagtctggaagaaag

SEQ ID NO: 84317 - DNA, 25 bp, Mus musculus
cactgaattggtaaactatttggca

SEQ ID NO: 84318 - DNA, 25 bp, Mus musculus
cactgacaacaaagggagcgttgcc

SEQ ID NO: 84319 - DNA, 25 bp, Mus musculus
cactgacagagtttgggcctatgat

SEQ ID NO: 84320 - DNA, 25 bp, Mus musculus
cactgacagctttggtaggcatcgt

SEQ ID NO: 84321 - DNA, 25 bp, Mus musculus
cactgacagtagtgccatgtggcaa

SEQ ID NO: 84322 - DNA, 25 bp, Mus musculus
cactgacagtcaggtgccagagcac

SEQ ID NO: 84323 - DNA, 25 bp, Mus musculus
cactgacagttctgaccgtgggcca

SEQ ID NO: 84324 - DNA, 25 bp, Mus musculus
cactgacatccggaaagggcacatg

SEQ ID NO: 84325 - DNA, 25 bp, Mus musculus
cactgaccaggacctcatcaagcta

SEQ ID NO: 84326 - DNA, 25 bp, Mus musculus
cactgaccctgcgtatttcatggag

SEQ ID NO: 84327 - DNA, 25 bp, Mus musculus
cactgaccgttgtccctgagactaa

SEQ ID NO: 84328 - DNA, 25 bp, Mus musculus
cactgacctctggagtcggcaagac

SEQ ID NO: 84329 - DNA, 25 bp, Mus musculus
cactgacctgttggtgagtagatgc

SEQ ID NO: 84330 - DNA, 25 bp, Mus musculus
cactgacgatgtatgcctaaagccc

SEQ ID NO: 84331 - DNA, 25 bp, Mus musculus
cactgacggcatgcgaagtgtccga

SEQ ID NO: 84332 - DNA, 25 bp, Mus musculus
cactgacggcgctcatggacttcgc

SEQ ID NO: 84333 - DNA, 25 bp, Mus musculus
cactgacgggttggttgaaagcgca

SEQ ID NO: 84334 - DNA, 25 bp, Mus musculus
cactgactacttttgggccatgccg

SEQ ID NO: 84335 - DNA, 25 bp, Mus musculus
cactgactgcaggaactacaagagg

SEQ ID NO: 84336 - DNA, 25 bp, Mus musculus
cactgactggtgtcctttctggcaa

SEQ ID NO: 84337 - DNA, 25 bp, Mus musculus
cactgactgtaaggactcttctaag

SEQ ID NO: 84338 - DNA, 25 bp, Mus musculus
cactgactgtatagaaagaggaggc

SEQ ID NO: 84339 - DNA, 25 bp, Mus musculus
cactgacttctgaagatgcagggct

SEQ ID NO: 84340 - DNA, 25 bp, Mus musculus
cactgactttgaattcaaggagctg

SEQ ID NO: 84341 - DNA, 25 bp, Mus musculus
cactgacttttactacgcccaggag

SEQ ID NO: 84342 - DNA, 25 bp, Mus musculus
cactgagaaagcatccggtaggcag

SEQ ID NO: 84343 - DNA, 25 bp, Mus musculus
cactgagaagcgagtgtatctcaac

SEQ ID NO: 84344 - DNA, 25 bp, Mus musculus
cactgagaatgttgtcgtctgccag

SEQ ID NO: 84345 - DNA, 25 bp, Mus musculus
cactgagactagactgaagccgggc

SEQ ID NO: 84346 - DNA, 25 bp, Mus musculus
cactgagactgctggatccctgaag

SEQ ID NO: 84347 - DNA, 25 bp, Mus musculus
cactgagaggtcaagtagggtttcc

SEQ ID NO: 84348 - DNA, 25 bp, Mus musculus
cactgagagtgaccttgtagactgc

SEQ ID NO: 84349 - DNA, 25 bp, Mus musculus
cactgagccttggttttgtgatgcc

SEQ ID NO: 84350 - DNA, 25 bp, Mus musculus
cactgaggagcaacaaggagagacc

SEQ ID NO: 84351 - DNA, 25 bp, Mus musculus
cactgaggagcctcggatccggctg

SEQ ID NO: 84352 - DNA, 25 bp, Mus musculus
cactgaggaggaacacaaggcacat

SEQ ID NO: 84353 - DNA, 25 bp, Mus musculus
cactgaggatgtagagaagaagcca

SEQ ID NO: 84354 - DNA, 25 bp, Mus musculus
cactgaggcaaaagctgctggccga

SEQ ID NO: 84355 - DNA, 25 bp, Mus musculus
cactgaggcgcagagagttgatgac

SEQ ID NO: 84356 - DNA, 25 bp, Mus musculus
cactgagggacatctgtagcctgtc

SEQ ID NO: 84357 - DNA, 25 bp, Mus musculus
cactgagggagctttgccgtatagt

SEQ ID NO: 84358 - DNA, 25 bp, Mus musculus
cactgagggcagtttcaatgaagct

SEQ ID NO: 84359 - DNA, 25 bp, Mus musculus
cactgagggccctttggaggtgcca

SEQ ID NO: 84360 - DNA, 25 bp, Mus musculus
cactgagtagaaagggcgactgacc

SEQ ID NO: 84361 - DNA, 25 bp, Mus musculus
cactgagtcctcgagagctttggca

SEQ ID NO: 84362 - DNA, 25 bp, Mus musculus
cactgagttggagagactggaccta

SEQ ID NO: 84363 - DNA, 25 bp, Mus musculus
cactgatcgctcctttcggtcctga

SEQ ID NO: 84364 - DNA, 25 bp, Mus musculus
cactgatcttgcagctgcagggaaa

SEQ ID NO: 84365 - DNA, 25 bp, Mus musculus
cactgatgaactttgcggctgctcg

SEQ ID NO: 84366 - DNA, 25 bp, Mus musculus
cactgatgacgagtacagggagcaa

SEQ ID NO: 84367 - DNA, 25 bp, Mus musculus
cactgatgatgcttggacggttccg

SEQ ID NO: 84368 - DNA, 25 bp, Mus musculus
cactgatgctttcgaggcgctgaag

SEQ ID NO: 84369 - DNA, 25 bp, Mus musculus
cactgatgggacatgacgatgctgt

SEQ ID NO: 84370 - DNA, 25 bp, Mus musculus
cactgatgtggattatgagaccgca

SEQ ID NO: 84371 - DNA, 25 bp, Mus musculus
cactgattgacaggagacggacacc

SEQ ID NO: 84372 - DNA, 25 bp, Mus musculus
cactgattggttgtctggctgctgc

SEQ ID NO: 84373 - DNA, 25 bp, Mus musculus
cactgcaacctatgcgacgtggacg

SEQ ID NO: 84374 - DNA, 25 bp, Mus musculus
cactgcaatgtcaaggcaagccagc

SEQ ID NO: 84375 - DNA, 25 bp, Mus musculus
cactgcacatgactggaggttacgg

SEQ ID NO: 84376 - DNA, 25 bp, Mus musculus
cactgcaccacggagaaagttgggc

SEQ ID NO: 84377 - DNA, 25 bp, Mus musculus
cactgcaccagggttagctcttgga

SEQ ID NO: 84378 - DNA, 25 bp, Mus musculus
cactgcacggtgaagctgcgtcaga

SEQ ID NO: 84379 - DNA, 25 bp, Mus musculus
cactgcagactgtacctggattggc

SEQ ID NO: 84380 - DNA, 25 bp, Mus musculus
cactgcagctcatggcggagttcct

SEQ ID NO: 84381 - DNA, 25 bp, Mus musculus
cactgcagctgtgagacgggaatca

SEQ ID NO: 84382 - DNA, 25 bp, Mus musculus
cactgcaggaaagtagtagagcccc

SEQ ID NO: 84383 - DNA, 25 bp, Mus musculus
cactgcaggagtccaaaactgtgcg

SEQ ID NO: 84384 - DNA, 25 bp, Mus musculus
cactgcagtattgagagttatacca

SEQ ID NO: 84385 - DNA, 25 bp, Mus musculus
cactgcatgacgtgttcgagaacaa

SEQ ID NO: 84386 - DNA, 25 bp, Mus musculus
cactgccaaggaggatcaagctttc

SEQ ID NO: 84387 - DNA, 25 bp, Mus musculus
cactgccggtgctacaaaggtccta

SEQ ID NO: 84388 - DNA, 25 bp, Mus musculus
cactgcctctgggaattctcatgga

SEQ ID NO: 84389 - DNA, 25 bp, Mus musculus
cactgcctgaaacacggcttgaaag

SEQ ID NO: 84390 - DNA, 25 bp, Mus musculus
cactgcctggtgtataactgtttga

SEQ ID NO: 84391 - DNA, 25 bp, Mus musculus
cactgcgatgtggtgatttttccag

SEQ ID NO: 84392 - DNA, 25 bp, Mus musculus
cactgcgcagtgtgcccaggaatat

SEQ ID NO: 84393 - DNA, 25 bp, Mus musculus
cactgcggacagaaaatgagcaccg

SEQ ID NO: 84394 - DNA, 25 bp, Mus musculus
cactgcgtcaaacctctcctggaga

SEQ ID NO: 84395 - DNA, 25 bp, Mus musculus
cactgctagaaccttgaacctggga

SEQ ID NO: 84396 - DNA, 25 bp, Mus musculus
cactgctagctgcttaaggctcgtg

SEQ ID NO: 84397 - DNA, 25 bp, Mus musculus
cactgctcaagcctgggatgggact

SEQ ID NO: 84398 - DNA, 25 bp, Mus musculus
cactgctcatcctaatctgtttacc

SEQ ID NO: 84399 - DNA, 25 bp, Mus musculus
cactgctcctgggatcgcagaatgc

SEQ ID NO: 84400 - DNA, 25 bp, Mus musculus
cactgctgaaatacaggccctgggc

SEQ ID NO: 84401 - DNA, 25 bp, Mus musculus
cactgctgacgcttggaattaattc

SEQ ID NO: 84402 - DNA, 25 bp, Mus musculus
cactgctgcaggaggaatatgccaa

SEQ ID NO: 84403 - DNA, 25 bp, Mus musculus
cactgctgctatggatatgctggga

SEQ ID NO: 84404 - DNA, 25 bp, Mus musculus
cactgctggagcaactagcccttga

SEQ ID NO: 84405 - DNA, 25 bp, Mus musculus
cactgctgttaatgccgtggcttgg

SEQ ID NO: 84406 - DNA, 25 bp, Mus musculus
cactgcttccagcatgtggtggcca

SEQ ID NO: 84407 - DNA, 25 bp, Mus musculus
cactgcttgagatgttgaccgctaa

SEQ ID NO: 84408 - DNA, 25 bp, Mus musculus
cactgctttgcgacttgcacgggaa

SEQ ID NO: 84409 - DNA, 25 bp, Mus musculus
cactggaaactgaagactgccgtca

SEQ ID NO: 84410 - DNA, 25 bp, Mus musculus
cactggaacatatttgcagaagaca

SEQ ID NO: 84411 - DNA, 25 bp, Mus musculus
cactggaaccccaaagagacttgag

SEQ ID NO: 84412 - DNA, 25 bp, Mus musculus
cactggaaggcgacagcgaagaatc

SEQ ID NO: 84413 - DNA, 25 bp, Mus musculus
cactggaagggtttgataaagcaga

SEQ ID NO: 84414 - DNA, 25 bp, Mus musculus
cactggaagtcatgcaggccgtaca

SEQ ID NO: 84415 - DNA, 25 bp, Mus musculus
cactggacagacgtgtggaaaacat

SEQ ID NO: 84416 - DNA, 25 bp, Mus musculus
cactggacagggaaactcaggcaca

SEQ ID NO: 84417 - DNA, 25 bp, Mus musculus
cactggacggctcagacagccttga

SEQ ID NO: 84418 - DNA, 25 bp, Mus musculus
cactggactctgctaatgatttgcc

SEQ ID NO: 84419 - DNA, 25 bp, Mus musculus
cactggactgttggctctggaagat

SEQ ID NO: 84420 - DNA, 25 bp, Mus musculus
cactggacttgctgaggaattgcac

SEQ ID NO: 84421 - DNA, 25 bp, Mus musculus
cactggagaagtctgggtccgcttt

SEQ ID NO: 84422 - DNA, 25 bp, Mus musculus
cactggagatgtcatgagcctgtct

SEQ ID NO: 84423 - DNA, 25 bp, Mus musculus
cactggagattgcagctgctgagca

SEQ ID NO: 84424 - DNA, 25 bp, Mus musculus
cactggagcactgaacatgatgtac

SEQ ID NO: 84425 - DNA, 25 bp, Mus musculus
cactggagcccaagaacaggttggc

SEQ ID NO: 84426 - DNA, 25 bp, Mus musculus
cactggagctgatatgaaggttaac

SEQ ID NO: 84427 - DNA, 25 bp, Mus musculus
cactggaggacaacagctctttggg

SEQ ID NO: 84428 - DNA, 25 bp, Mus musculus
cactggagtgatgtccttgtcggcc

SEQ ID NO: 84429 - DNA, 25 bp, Mus musculus
cactggatcaggtgctaggccgctt

SEQ ID NO: 84430 - DNA, 25 bp, Mus musculus
cactggatcatcgacacggactacg

SEQ ID NO: 84431 - DNA, 25 bp, Mus musculus
cactggatcccagctatcctgggat

SEQ ID NO: 84432 - DNA, 25 bp, Mus musculus
cactggcaactgacgggaaactcct

SEQ ID NO: 84433 - DNA, 25 bp, Mus musculus
cactggcagagatggctctcctggc

SEQ ID NO: 84434 - DNA, 25 bp, Mus musculus
cactggcagatcatggatgggaatc

SEQ ID NO: 84435 - DNA, 25 bp, Mus musculus
cactggcaggcactgagactctaag

SEQ ID NO: 84436 - DNA, 25 bp, Mus musculus
cactggcagtaaggaagtggtccgc

SEQ ID NO: 84437 - DNA, 25 bp, Mus musculus
cactggcagtatatcgacatctttg

SEQ ID NO: 84438 - DNA, 25 bp, Mus musculus
cactggcatcactgctcaggaacag

SEQ ID NO: 84439 - DNA, 25 bp, Mus musculus
cactggccagcgaatctcatgttta

SEQ ID NO: 84440 - DNA, 25 bp, Mus musculus
cactggccgaatgtcaggaaaagct

SEQ ID NO: 84441 - DNA, 25 bp, Mus musculus
cactggcctctctgggaattaacac

SEQ ID NO: 84442 - DNA, 25 bp, Mus musculus
cactggcctgtctatgaaagctgag

SEQ ID NO: 84443 - DNA, 25 bp, Mus musculus
cactggcgagtctctacaaggctta

SEQ ID NO: 84444 - DNA, 25 bp, Mus musculus
cactggcggagtttaaggacataca

SEQ ID NO: 84445 - DNA, 25 bp, Mus musculus
cactggcggccaaacagagaactct

SEQ ID NO: 84446 - DNA, 25 bp, Mus musculus
cactggcgggcatcattgagtccat

SEQ ID NO: 84447 - DNA, 25 bp, Mus musculus
cactggcgtgtgctcttgacttgca

SEQ ID NO: 84448 - DNA, 25 bp, Mus musculus
cactggctaagagcttgcagaagca

SEQ ID NO: 84449 - DNA, 25 bp, Mus musculus
cactggctacaagtggatcctctga

SEQ ID NO: 84450 - DNA, 25 bp, Mus musculus
cactggctgcggattttatggaaac

SEQ ID NO: 84451 - DNA, 25 bp, Mus musculus
cactggctgcttgtttgctggatca

SEQ ID NO: 84452 - DNA, 25 bp, Mus musculus
cactggctggatttcacttgccaaa

SEQ ID NO: 84453 - DNA, 25 bp, Mus musculus
cactggctggttaatgacatgttca

SEQ ID NO: 84454 - DNA, 25 bp, Mus musculus
cactggcttcaacacgtgcttaggc

SEQ ID NO: 84455 - DNA, 25 bp, Mus musculus
cactggcttcctgatgggctacatt

SEQ ID NO: 84456 - DNA, 25 bp, Mus musculus
cactgggaaaacactcttggcacga

SEQ ID NO: 84457 - DNA, 25 bp, Mus musculus
cactgggaacaactgctggaggcat

SEQ ID NO: 84458 - DNA, 25 bp, Mus musculus
cactgggaacatgcgtcaggaggcc

SEQ ID NO: 84459 - DNA, 25 bp, Mus musculus
cactgggaagcatggaggaggagct

SEQ ID NO: 84460 - DNA, 25 bp, Mus musculus
cactgggaattcgaattcgcgttct

SEQ ID NO: 84461 - DNA, 25 bp, Mus musculus
cactgggacaagtattctgaggtca

SEQ ID NO: 84462 - DNA, 25 bp, Mus musculus
cactgggacaggcattgcagctgcc

SEQ ID NO: 84463 - DNA, 25 bp, Mus musculus
cactgggagaagcacggaaagacat

SEQ ID NO: 84464 - DNA, 25 bp, Mus musculus
cactgggagacaaaaaacatacggg

SEQ ID NO: 84465 - DNA, 25 bp, Mus musculus
cactgggagatgttcatgctgctgc

SEQ ID NO: 84466 - DNA, 25 bp, Mus musculus
cactgggagggctctaaccaggaag

SEQ ID NO: 84467 - DNA, 25 bp, Mus musculus
cactgggattgagctagactctgac

SEQ ID NO: 84468 - DNA, 25 bp, Mus musculus
cactgggcactgtcagaggaagtcc

SEQ ID NO: 84469 - DNA, 25 bp, Mus musculus
cactgggcagggtgtgttcagcaat

SEQ ID NO: 84470 - DNA, 25 bp, Mus musculus
cactgggcagtcactctgagagtca

SEQ ID NO: 84471 - DNA, 25 bp, Mus musculus
cactgggcctaggagatgggcaatt

SEQ ID NO: 84472 - DNA, 25 bp, Mus musculus
cactgggcctccgtagaacaggaat

SEQ ID NO: 84473 - DNA, 25 bp, Mus musculus
cactgggcctttgagcaggaaagca

SEQ ID NO: 84474 - DNA, 25 bp, Mus musculus
cactgggcgagagaaaaccacctgt

SEQ ID NO: 84475 - DNA, 25 bp, Mus musculus
cactgggcgcaggaaacattgacca

SEQ ID NO: 84476 - DNA, 25 bp, Mus musculus
cactgggctcctgcactaaaggtga

SEQ ID NO: 84477 - DNA, 25 bp, Mus musculus
cactgggtcacctgagagtcgagca

SEQ ID NO: 84478 - DNA, 25 bp, Mus musculus
cactgggtgaacactatggcactta

SEQ ID NO: 84479 - DNA, 25 bp, Mus musculus
cactgggtgacctacgttgaactct

SEQ ID NO: 84480 - DNA, 25 bp, Mus musculus
cactgggtgacgtctctggtcctga

SEQ ID NO: 84481 - DNA, 25 bp, Mus musculus
cactgggtgctttgtcagactggca

SEQ ID NO: 84482 - DNA, 25 bp, Mus musculus
cactgggttcttccggttcgatgaa

SEQ ID NO: 84483 - DNA, 25 bp, Mus musculus
cactggtagacttggattgggagaa

SEQ ID NO: 84484 - DNA, 25 bp, Mus musculus
cactggtcaagcctcgctggagaaa

SEQ ID NO: 84485 - DNA, 25 bp, Mus musculus
cactggtcagatccaagccatggtc

SEQ ID NO: 84486 - DNA, 25 bp, Mus musculus
cactggtcgggaacttcactggcag

SEQ ID NO: 84487 - DNA, 25 bp, Mus musculus
cactggtcgggatactcaatggaat

SEQ ID NO: 84488 - DNA, 25 bp, Mus musculus
cactggtctccgtcatgaatcccga

SEQ ID NO: 84489 - DNA, 25 bp, Mus musculus
cactggtctcctgcaagagttcgat

SEQ ID NO: 84490 - DNA, 25 bp, Mus musculus
cactggtgagaacccttaggagcgc

SEQ ID NO: 84491 - DNA, 25 bp, Mus musculus
cactggtgcacctgtcatagagtca

SEQ ID NO: 84492 - DNA, 25 bp, Mus musculus
cactggtgccatcacacggtgacaa

SEQ ID NO: 84493 - DNA, 25 bp, Mus musculus
cactggtggcattacgtggagtctc

SEQ ID NO: 84494 - DNA, 25 bp, Mus musculus
cactggtggcccagctagcactgct

SEQ ID NO: 84495 - DNA, 25 bp, Mus musculus
cactggtgtggcaggatccccactc

SEQ ID NO: 84496 - DNA, 25 bp, Mus musculus
cactggttccatctaaggatcaggc

SEQ ID NO: 84497 - DNA, 25 bp, Mus musculus
cactgtaagcagaaggcccagggtc

SEQ ID NO: 84498 - DNA, 25 bp, Mus musculus
cactgtacaggcacatttgggctgg

SEQ ID NO: 84499 - DNA, 25 bp, Mus musculus
cactgtacatccagggtgagcggcg

SEQ ID NO: 84500 - DNA, 25 bp, Mus musculus
cactgtacgctattcctgtttgcta

SEQ ID NO: 84501 - DNA, 25 bp, Mus musculus
cactgtacttgggtgatggctacgt

SEQ ID NO: 84502 - DNA, 25 bp, Mus musculus
cactgtagaggaagctgtgctcgcc

SEQ ID NO: 84503 - DNA, 25 bp, Mus musculus
cactgtagatacaaagcctgatagg

SEQ ID NO: 84504 - DNA, 25 bp, Mus musculus
cactgtatcgggtgcagcgatgccg

SEQ ID NO: 84505 - DNA, 25 bp, Mus musculus
cactgtatgaggagggattgcttct

SEQ ID NO: 84506 - DNA, 25 bp, Mus musculus
cactgtatgatcaggtgcacccaga

SEQ ID NO: 84507 - DNA, 25 bp, Mus musculus
cactgtatgcgaacaacggctctgt

SEQ ID NO: 84508 - DNA, 25 bp, Mus musculus
cactgtatgcgaagaaggagcgtac

SEQ ID NO: 84509 - DNA, 25 bp, Mus musculus
cactgtatgctactctgggaggtcc

SEQ ID NO: 84510 - DNA, 25 bp, Mus musculus
cactgtatggacagctggtggacct

SEQ ID NO: 84511 - DNA, 25 bp, Mus musculus
cactgtatggcgagagcgacctcta

SEQ ID NO: 84512 - DNA, 25 bp, Mus musculus
cactgtattcgaggtgcccgaggga

SEQ ID NO: 84513 - DNA, 25 bp, Mus musculus
cactgtattcttgtcatccctgaaa

SEQ ID NO: 84514 - DNA, 25 bp, Mus musculus
cactgtatttagaaacctgtttgag

SEQ ID NO: 84515 - DNA, 25 bp, Mus musculus
cactgtcaataggtgatggtgccaa

SEQ ID NO: 84516 - DNA, 25 bp, Mus musculus
cactgtcaccgaagatgaaatcaag

SEQ ID NO: 84517 - DNA, 25 bp, Mus musculus
cactgtcactggtcagggtcctgaa

SEQ ID NO: 84518 - DNA, 25 bp, Mus musculus
cactgtcactggtggtgcctggtac

SEQ ID NO: 84519 - DNA, 25 bp, Mus musculus
cactgtcagggtagccaggactctt

SEQ ID NO: 84520 - DNA, 25 bp, Mus musculus
cactgtcagtatattaggcacgtgg

SEQ ID NO: 84521 - DNA, 25 bp, Mus musculus
cactgtcagtgccagaagggataca

SEQ ID NO: 84522 - DNA, 25 bp, Mus musculus
cactgtccaacccaaaggcaagatc

SEQ ID NO: 84523 - DNA, 25 bp, Mus musculus
cactgtcccaatcaggactggttgg

SEQ ID NO: 84524 - DNA, 25 bp, Mus musculus
cactgtccgaaatgttgcccggtgt

SEQ ID NO: 84525 - DNA, 25 bp, Mus musculus
cactgtccggaagactcagtcaaca

SEQ ID NO: 84526 - DNA, 25 bp, Mus musculus
cactgtcctcttctgactcacggga

SEQ ID NO: 84527 - DNA, 25 bp, Mus musculus
cactgtcctgtatcttccttcggga

SEQ ID NO: 84528 - DNA, 25 bp, Mus musculus
cactgtcgactgtccccgagattgt

SEQ ID NO: 84529 - DNA, 25 bp, Mus musculus
cactgtcgggagaggaagcgtccct

SEQ ID NO: 84530 - DNA, 25 bp, Mus musculus
cactgtcgtgggagtattgccgcct

SEQ ID NO: 84531 - DNA, 25 bp, Mus musculus
cactgtcgtggtgggagagtcaact

SEQ ID NO: 84532 - DNA, 25 bp, Mus musculus
cactgtctataaagttgttgttgct

SEQ ID NO: 84533 - DNA, 25 bp, Mus musculus
cactgtgaactcaaaaacttcaggg

SEQ ID NO: 84534 - DNA, 25 bp, Mus musculus
cactgtgacacagacctttggagag

SEQ ID NO: 84535 - DNA, 25 bp, Mus musculus
cactgtgacatgtattaatggccgg

SEQ ID NO: 84536 - DNA, 25 bp, Mus musculus
cactgtgacgttcaggagacctgcg

SEQ ID NO: 84537 - DNA, 25 bp, Mus musculus
cactgtgactattgggagactgcgc

SEQ ID NO: 84538 - DNA, 25 bp, Mus musculus
cactgtgagccttgttcagagcgga

SEQ ID NO: 84539 - DNA, 25 bp, Mus musculus
cactgtgagcgaaaacaaccctgag

SEQ ID NO: 84540 - DNA, 25 bp, Mus musculus
cactgtgatcatttgtcatggcgta

SEQ ID NO: 84541 - DNA, 25 bp, Mus musculus
cactgtgatccccaattagccgtga

SEQ ID NO: 84542 - DNA, 25 bp, Mus musculus
cactgtgatgtgacatgccaagcag

SEQ ID NO: 84543 - DNA, 25 bp, Mus musculus
cactgtgcacaacggtgagttcaga

SEQ ID NO: 84544 - DNA, 25 bp, Mus musculus
cactgtgcagtaggatctctgggtc

SEQ ID NO: 84545 - DNA, 25 bp, Mus musculus
cactgtgcagtcagcagggtagcag

SEQ ID NO: 84546 - DNA, 25 bp, Mus musculus
cactgtgcctgggaaggtcacccta

SEQ ID NO: 84547 - DNA, 25 bp, Mus musculus
cactgtgcgaaccacggagattaac

SEQ ID NO: 84548 - DNA, 25 bp, Mus musculus
cactgtgctgagatccttggcctag

SEQ ID NO: 84549 - DNA, 25 bp, Mus musculus
cactgtggagtagaaggagctaccc

SEQ ID NO: 84550 - DNA, 25 bp, Mus musculus
cactgtggagtttctcttggccaac

SEQ ID NO: 84551 - DNA, 25 bp, Mus musculus
cactgtggccaatgtgacggtcaaa

SEQ ID NO: 84552 - DNA, 25 bp, Mus musculus
cactgtggccgtgaagaccttgaag

SEQ ID NO: 84553 - DNA, 25 bp, Mus musculus
cactgtggctagaaacccaaagggc

SEQ ID NO: 84554 - DNA, 25 bp, Mus musculus
cactgtgggatggacaaaagccttc

SEQ ID NO: 84555 - DNA, 25 bp, Mus musculus
cactgtggtcacaggatgggaactc

SEQ ID NO: 84556 - DNA, 25 bp, Mus musculus
cactgtggtcgtggcttcaccagcg

SEQ ID NO: 84557 - DNA, 25 bp, Mus musculus
cactgtggtgaaccgatggatgtac

SEQ ID NO: 84558 - DNA, 25 bp, Mus musculus
cactgtgtaacgtggtcatgcggca

SEQ ID NO: 84559 - DNA, 25 bp, Mus musculus
cactgtgtacaggactgtgtgcctc

SEQ ID NO: 84560 - DNA, 25 bp, Mus musculus
cactgtgtatgaggtggtgtactga

SEQ ID NO: 84561 - DNA, 25 bp, Mus musculus
cactgtgtccaacaagatggcagcg

SEQ ID NO: 84562 - DNA, 25 bp, Mus musculus
cactgtgtgcgctctgtgcaagcca

SEQ ID NO: 84563 - DNA, 25 bp, Mus musculus
cactgtgtgtccaccagaagcggct

SEQ ID NO: 84564 - DNA, 25 bp, Mus musculus
cactgtgtgtcgaccttaggagcca

SEQ ID NO: 84565 - DNA, 25 bp, Mus musculus
cactgttagcagcaaatccagatgc

SEQ ID NO: 84566 - DNA, 25 bp, Mus musculus
cactgttatgatgctgcagacggcc

SEQ ID NO: 84567 - DNA, 25 bp, Mus musculus
cactgttcaccagaaagagtcaaaa

SEQ ID NO: 84568 - DNA, 25 bp, Mus musculus
cactgttcagagaagcacggagacc

SEQ ID NO: 84569 - DNA, 25 bp, Mus musculus
cactgttcatcaatggagcccttgg

SEQ ID NO: 84570 - DNA, 25 bp, Mus musculus
cactgttctcataaaacttgccagg

SEQ ID NO: 84571 - DNA, 25 bp, Mus musculus
cactgttctcccagcatgagttatc

SEQ ID NO: 84572 - DNA, 25 bp, Mus musculus
cactgttggatccaggcaacttcca

SEQ ID NO: 84573 - DNA, 25 bp, Mus musculus
cactgtttgcaaaggttgccgccac

SEQ ID NO: 84574 - DNA, 25 bp, Mus musculus
cactgttttgattaagcctgatgag

SEQ ID NO: 84575 - DNA, 25 bp, Mus musculus
cacttaaacagcttggatgcagagc

SEQ ID NO: 84576 - DNA, 25 bp, Mus musculus
cacttaactttttggatgaagcaca

SEQ ID NO: 84577 - DNA, 25 bp, Mus musculus
cacttaatactcagagctgggaact

SEQ ID NO: 84578 - DNA, 25 bp, Mus musculus
cacttacactgggaagagaatcgca

SEQ ID NO: 84579 - DNA, 25 bp, Mus musculus
cacttacatggtgacccgcagggaa

SEQ ID NO: 84580 - DNA, 25 bp, Mus musculus
cacttaccgtatctgggcctttggg

SEQ ID NO: 84581 - DNA, 25 bp, Mus musculus
cacttacgagctgtcaggtggagcc

SEQ ID NO: 84582 - DNA, 25 bp, Mus musculus
cacttacgtactgggaatgtgtcta

SEQ ID NO: 84583 - DNA, 25 bp, Mus musculus
cacttacgtagtcatggagcaggct

SEQ ID NO: 84584 - DNA, 25 bp, Mus musculus
cacttacttgagactagatggcagc

SEQ ID NO: 84585 - DNA, 25 bp, Mus musculus
cacttagagcgctcaggtgtccgaa

SEQ ID NO: 84586 - DNA, 25 bp, Mus musculus
cacttagctgtgagtggccttgaac

SEQ ID NO: 84587 - DNA, 25 bp, Mus musculus
cacttaggtagtcccagaactgggc

SEQ ID NO: 84588 - DNA, 25 bp, Mus musculus
cacttagtcctggttttgcgtccta

SEQ ID NO: 84589 - DNA, 25 bp, Mus musculus
cacttagtgccatgcggaacttgaa

SEQ ID NO: 84590 - DNA, 25 bp, Mus musculus
cacttagtggcaaatggctgtcacc

SEQ ID NO: 84591 - DNA, 25 bp, Mus musculus
cacttatcaatgacatcgagggaga

SEQ ID NO: 84592 - DNA, 25 bp, Mus musculus
cacttatcgtgtgggcaacgcccag

SEQ ID NO: 84593 - DNA, 25 bp, Mus musculus
cacttatctgcaaggagagttacgc

SEQ ID NO: 84594 - DNA, 25 bp, Mus musculus
cacttatgaactagagagacagctc

SEQ ID NO: 84595 - DNA, 25 bp, Mus musculus
cacttatgttgctgggtgtgagaga

SEQ ID NO: 84596 - DNA, 25 bp, Mus musculus
cacttattctgtgtggtaggaacca

SEQ ID NO: 84597 - DNA, 25 bp, Mus musculus
cacttcaagcggttgagggtcatac

SEQ ID NO: 84598 - DNA, 25 bp, Mus musculus
cacttcactactgagctgagaacaa

SEQ ID NO: 84599 - DNA, 25 bp, Mus musculus
cacttcagaagaggaatgtaaccag

SEQ ID NO: 84600 - DNA, 25 bp, Mus musculus
cacttcagcaggatagattttggtc

SEQ ID NO: 84601 - DNA, 25 bp, Mus musculus
cacttcaggtctcagttacgggcaa

SEQ ID NO: 84602 - DNA, 25 bp, Mus musculus
cacttcagtgagttaagcacagcac

SEQ ID NO: 84603 - DNA, 25 bp, Mus musculus
cacttccatgggtgtgcctacagca

SEQ ID NO: 84604 - DNA, 25 bp, Mus musculus
cacttccgatggctggttcagaaca

SEQ ID NO: 84605 - DNA, 25 bp, Mus musculus
cacttccggacatgagactcattgg

SEQ ID NO: 84606 - DNA, 25 bp, Mus musculus
cacttccgggatgacgatgatggcc

SEQ ID NO: 84607 - DNA, 25 bp, Mus musculus
cacttcctggaggtgaaactgggca

SEQ ID NO: 84608 - DNA, 25 bp, Mus musculus
cacttcgaaagaagctgggtacgct

SEQ ID NO: 84609 - DNA, 25 bp, Mus musculus
cacttcgaggagtcaagcaagctgg

SEQ ID NO: 84610 - DNA, 25 bp, Mus musculus
cacttcgagtggataatgctgccag

SEQ ID NO: 84611 - DNA, 25 bp, Mus musculus
cacttcgtggacttggctggctcag

SEQ ID NO: 84612 - DNA, 25 bp, Mus musculus
cacttctaaggttgccatggattca

SEQ ID NO: 84613 - DNA, 25 bp, Mus musculus
cacttctaagtttggccacggatgt

SEQ ID NO: 84614 - DNA, 25 bp, Mus musculus
cacttctactaggtcgcctgcggag

SEQ ID NO: 84615 - DNA, 25 bp, Mus musculus
cacttctatcttcgctgtctcggca

SEQ ID NO: 84616 - DNA, 25 bp, Mus musculus
cacttctctgcactctgctacagga

SEQ ID NO: 84617 - DNA, 25 bp, Mus musculus
cacttctctggctccaaggtgaggg

SEQ ID NO: 84618 - DNA, 25 bp, Mus musculus
cacttctgtgatgtgaccgtgcgca

SEQ ID NO: 84619 - DNA, 25 bp, Mus musculus
cacttcttcgaggatgtgtacacgc

SEQ ID NO: 84620 - DNA, 25 bp, Mus musculus
cacttctttgacacgtacctgctca

SEQ ID NO: 84621 - DNA, 25 bp, Mus musculus
cacttgaagattccagctgcctgaa

SEQ ID NO: 84622 - DNA, 25 bp, Mus musculus
cacttgacaaagctgaggcattggc

SEQ ID NO: 84623 - DNA, 25 bp, Mus musculus
cacttgagatctgaggaacgctgct

SEQ ID NO: 84624 - DNA, 25 bp, Mus musculus
cacttgaggctgctcttaggtaggc

SEQ ID NO: 84625 - DNA, 25 bp, Mus musculus
cacttgcaagtaccttgatggagca

SEQ ID NO: 84626 - DNA, 25 bp, Mus musculus
cacttgcaatgatctggacgcgtct

SEQ ID NO: 84627 - DNA, 25 bp, Mus musculus
cacttgccctggaggatgagcctga

SEQ ID NO: 84628 - DNA, 25 bp, Mus musculus
cacttgctcggtggtaaatggagac

SEQ ID NO: 84629 - DNA, 25 bp, Mus musculus
cacttgctgccgttctgacctggga

SEQ ID NO: 84630 - DNA, 25 bp, Mus musculus
cacttgctgcttgaggcaggcgtga

SEQ ID NO: 84631 - DNA, 25 bp, Mus musculus
cacttgctgtgcttcttgtctctgg

SEQ ID NO: 84632 - DNA, 25 bp, Mus musculus
cacttggaacagatgctgaaggcca

SEQ ID NO: 84633 - DNA, 25 bp, Mus musculus
cacttggaaccagaaggagacgtac

SEQ ID NO: 84634 - DNA, 25 bp, Mus musculus
cacttggaagctattggaatttgat

SEQ ID NO: 84635 - DNA, 25 bp, Mus musculus
cacttggacgcctcttcatggtctt

SEQ ID NO: 84636 - DNA, 25 bp, Mus musculus
cacttggacttttgcaatcagagat

SEQ ID NO: 84637 - DNA, 25 bp, Mus musculus
cacttggagaaatggtttcctcgcc

SEQ ID NO: 84638 - DNA, 25 bp, Mus musculus
cacttggagcagcacgactctgtct

SEQ ID NO: 84639 - DNA, 25 bp, Mus musculus
cacttggagcggaaacgggctgata

SEQ ID NO: 84640 - DNA, 25 bp, Mus musculus
cacttggagtggtcctggagaagac

SEQ ID NO: 84641 - DNA, 25 bp, Mus musculus
cacttggagttacagcaaggcggct

SEQ ID NO: 84642 - DNA, 25 bp, Mus musculus
cacttggattgtgcttcgggagccc

SEQ ID NO: 84643 - DNA, 25 bp, Mus musculus
cacttggcagtggtagaggtcctat

SEQ ID NO: 84644 - DNA, 25 bp, Mus musculus
cacttggctgtggttcccgtgctaa

SEQ ID NO: 84645 - DNA, 25 bp, Mus musculus
cacttgggaatctctggacagacgc

SEQ ID NO: 84646 - DNA, 25 bp, Mus musculus
cacttgggagagcttacggtcacac

SEQ ID NO: 84647 - DNA, 25 bp, Mus musculus
cacttggtgggaggcctgctgtccc

SEQ ID NO: 84648 - DNA, 25 bp, Mus musculus
cacttggttcaggagtggactcgta

SEQ ID NO: 84649 - DNA, 25 bp, Mus musculus
cacttgtactcgaggaacttgcacc

SEQ ID NO: 84650 - DNA, 25 bp, Mus musculus
cacttgtagggattctagagatcaa

SEQ ID NO: 84651 - DNA, 25 bp, Mus musculus
cacttgtagtggtaccatttttggg

SEQ ID NO: 84652 - DNA, 25 bp, Mus musculus
cacttgtctgtaggaagcgtggcaa

SEQ ID NO: 84653 - DNA, 25 bp, Mus musculus
cacttgtcttcagccatgggagagc

SEQ ID NO: 84654 - DNA, 25 bp, Mus musculus
cacttgtgacaaggccgcaggtgac

SEQ ID NO: 84655 - DNA, 25 bp, Mus musculus
cacttgtgcagaagctttggccgcc

SEQ ID NO: 84656 - DNA, 25 bp, Mus musculus
cacttgtggctcaaactcggcttga

SEQ ID NO: 84657 - DNA, 25 bp, Mus musculus
cacttgtgtatctctgggctgaccc

SEQ ID NO: 84658 - DNA, 25 bp, Mus musculus
cacttgtgtgcgaggctttaggact

SEQ ID NO: 84659 - DNA, 25 bp, Mus musculus
cacttgttgtgcagaaagaggccca

SEQ ID NO: 84660 - DNA, 25 bp, Mus musculus
cacttgtttcttcagggcttagcca

SEQ ID NO: 84661 - DNA, 25 bp, Mus musculus
cactttaattgagatggatgcagtc

SEQ ID NO: 84662 - DNA, 25 bp, Mus musculus
cactttagatggacgaatcgctgca

SEQ ID NO: 84663 - DNA, 25 bp, Mus musculus
cactttaggacctgtgaccggctcc

SEQ ID NO: 84664 - DNA, 25 bp, Mus musculus
cactttagggctctcagatgggcag

SEQ ID NO: 84665 - DNA, 25 bp, Mus musculus
cactttatgattatgagggccagac

SEQ ID NO: 84666 - DNA, 25 bp, Mus musculus
cactttattgagcagatgggcggac

SEQ ID NO: 84667 - DNA, 25 bp, Mus musculus
cactttcatgtcatgcggctgacgg

SEQ ID NO: 84668 - DNA, 25 bp, Mus musculus
cactttccggccctagacttgggtg

SEQ ID NO: 84669 - DNA, 25 bp, Mus musculus
cactttccgttcagagtggagcgac

SEQ ID NO: 84670 - DNA, 25 bp, Mus musculus
cactttctagggagcagttatggcc

SEQ ID NO: 84671 - DNA, 25 bp, Mus musculus
cactttctgacaggtgtgtgcgcca

SEQ ID NO: 84672 - DNA, 25 bp, Mus musculus
cactttctgcttggaggatggacca

SEQ ID NO: 84673 - DNA, 25 bp, Mus musculus
cactttgaaaacttaggtcctgtat

SEQ ID NO: 84674 - DNA, 25 bp, Mus musculus
cactttgaaatccttggaaccaact

SEQ ID NO: 84675 - DNA, 25 bp, Mus musculus
cactttgaacgtctagcccgggaga

SEQ ID NO: 84676 - DNA, 25 bp, Mus musculus
cactttgaacttcggagatggtcca

SEQ ID NO: 84677 - DNA, 25 bp, Mus musculus
cactttgaccaagagggagtgtgta

SEQ ID NO: 84678 - DNA, 25 bp, Mus musculus
cactttgagaaacggcggaaccctg

SEQ ID NO: 84679 - DNA, 25 bp, Mus musculus
cactttgagtgtccggagcagcaga

SEQ ID NO: 84680 - DNA, 25 bp, Mus musculus
cactttgatgggatcctgggcctcg

SEQ ID NO: 84681 - DNA, 25 bp, Mus musculus
cactttgattttatggacccaccag

SEQ ID NO: 84682 - DNA, 25 bp, Mus musculus
cactttgcagaaccttgggctagac

SEQ ID NO: 84683 - DNA, 25 bp, Mus musculus
cactttgctacagtgctgcttggga

SEQ ID NO: 84684 - DNA, 25 bp, Mus musculus
cactttgctgtctgtcacgtggacg

SEQ ID NO: 84685 - DNA, 25 bp, Mus musculus
cactttggcctttcttgggaattct

SEQ ID NO: 84686 - DNA, 25 bp, Mus musculus
cactttggcgcctcgtgagacttga

SEQ ID NO: 84687 - DNA, 25 bp, Mus musculus
cactttgggtggaaattggatgcca

SEQ ID NO: 84688 - DNA, 25 bp, Mus musculus
cactttggtttcacagggtgctgaa

SEQ ID NO: 84689 - DNA, 25 bp, Mus musculus
cactttgtgttcgacaatgagccaa

SEQ ID NO: 84690 - DNA, 25 bp, Mus musculus
cacttttgagcccagagaggtcggt

SEQ ID NO: 84691 - DNA, 25 bp, Mus musculus
cacttttgctggagttctgactgaa

SEQ ID NO: 84692 - DNA, 25 bp, Mus musculus
cacttttggatactctactggacag

SEQ ID NO: 84693 - DNA, 25 bp, Mus musculus
cacttttgtcttaatggtctgtgga

SEQ ID NO: 84694 - DNA, 25 bp, Mus musculus
cactttttggagctagcgattggtc

SEQ ID NO: 84695 - DNA, 25 bp, Mus musculus
cagaaaaatggctaccggtgcgcag

SEQ ID NO: 84696 - DNA, 25 bp, Mus musculus
cagaaaaatgtgtgatgaagaccca

SEQ ID NO: 84697 - DNA, 25 bp, Mus musculus
cagaaaacccttgagcggctaagag

SEQ ID NO: 84698 - DNA, 25 bp, Mus musculus
cagaaaacctaccagtgggtgccct

SEQ ID NO: 84699 - DNA, 25 bp, Mus musculus
cagaaaacctccaaagtagatgtgg

SEQ ID NO: 84700 - DNA, 25 bp, Mus musculus
cagaaaacgaaagaaggtgagggct

SEQ ID NO: 84701 - DNA, 25 bp, Mus musculus
cagaaaactctcagactttgggcag

SEQ ID NO: 84702 - DNA, 25 bp, Mus musculus
cagaaaacttcctgaactggcacgt

SEQ ID NO: 84703 - DNA, 25 bp, Mus musculus
cagaaaagaagtgcttcattgagga

SEQ ID NO: 84704 - DNA, 25 bp, Mus musculus
cagaaaagacgaagctggagctgcc

SEQ ID NO: 84705 - DNA, 25 bp, Mus musculus
cagaaaagagccatcgtgcgcatga

SEQ ID NO: 84706 - DNA, 25 bp, Mus musculus
cagaaaagatggtggcgcctcagta

SEQ ID NO: 84707 - DNA, 25 bp, Mus musculus
cagaaaagcggagtcggaagcccga

SEQ ID NO: 84708 - DNA, 25 bp, Mus musculus
cagaaaagctaaggagctggaagag

SEQ ID NO: 84709 - DNA, 25 bp, Mus musculus
cagaaaagggatttaatggtgaaga

SEQ ID NO: 84710 - DNA, 25 bp, Mus musculus
cagaaaagtgcgttcctgatcgcag

SEQ ID NO: 84711 - DNA, 25 bp, Mus musculus
cagaaaatctgggtgggtacgtcaa

SEQ ID NO: 84712 - DNA, 25 bp, Mus musculus
cagaaaatgattctggtcacccagg

SEQ ID NO: 84713 - DNA, 25 bp, Mus musculus
cagaaaatgcctgcggtcctattgc

SEQ ID NO: 84714 - DNA, 25 bp, Mus musculus
cagaaaatggtgattgaaaaggagc

SEQ ID NO: 84715 - DNA, 25 bp, Mus musculus
cagaaaatttctgaggtcaagacct

SEQ ID NO: 84716 - DNA, 25 bp, Mus musculus
cagaaaatttggatccgaacatggg

SEQ ID NO: 84717 - DNA, 25 bp, Mus musculus
cagaaacaatggttcgactgacggt

SEQ ID NO: 84718 - DNA, 25 bp, Mus musculus
cagaaacacatgtgcagcgtgctgc

SEQ ID NO: 84719 - DNA, 25 bp, Mus musculus
cagaaacagtgtatttgcctgggcc

SEQ ID NO: 84720 - DNA, 25 bp, Mus musculus
cagaaacagtgttccaacctgccca

SEQ ID NO: 84721 - DNA, 25 bp, Mus musculus
cagaaacagtttatctttggacgga

SEQ ID NO: 84722 - DNA, 25 bp, Mus musculus
cagaaacatgcctgtgaatcaccag

SEQ ID NO: 84723 - DNA, 25 bp, Mus musculus
cagaaaccagtaacgccatgaaatc

SEQ ID NO: 84724 - DNA, 25 bp, Mus musculus
cagaaacctaatcctgaagcctggg

SEQ ID NO: 84725 - DNA, 25 bp, Mus musculus
cagaaaccttgttagcctgtgggcc

SEQ ID NO: 84726 - DNA, 25 bp, Mus musculus
cagaaacgctggcctccttggagga

SEQ ID NO: 84727 - DNA, 25 bp, Mus musculus
cagaaactaaggtggagactgcact

SEQ ID NO: 84728 - DNA, 25 bp, Mus musculus
cagaaactagtgtgaacagagggcc

SEQ ID NO: 84729 - DNA, 25 bp, Mus musculus
cagaaactctggtagcggcagcaca

SEQ ID NO: 84730 - DNA, 25 bp, Mus musculus
cagaaactgagaagctaatccggga

SEQ ID NO: 84731 - DNA, 25 bp, Mus musculus
cagaaactggtaccacagaggaaca

SEQ ID NO: 84732 - DNA, 25 bp, Mus musculus
cagaaactgtgaaaccagaagaagg

SEQ ID NO: 84733 - DNA, 25 bp, Mus musculus
cagaaactgtgacaactggagggac

SEQ ID NO: 84734 - DNA, 25 bp, Mus musculus
cagaaactgtgcgtaccagtgaagc

SEQ ID NO: 84735 - DNA, 25 bp, Mus musculus
cagaaactgttcctgatagtgttaa

SEQ ID NO: 84736 - DNA, 25 bp, Mus musculus
cagaaacttaaaatggaagagtatg

SEQ ID NO: 84737 - DNA, 25 bp, Mus musculus
cagaaagaagcatgctaagcggact

SEQ ID NO: 84738 - DNA, 25 bp, Mus musculus
cagaaagacaagatggcagaagcct

SEQ ID NO: 84739 - DNA, 25 bp, Mus musculus
cagaaagacataaccgtggtggcgc

SEQ ID NO: 84740 - DNA, 25 bp, Mus musculus
cagaaagactgaaaggagagtgacg

SEQ ID NO: 84741 - DNA, 25 bp, Mus musculus
cagaaagagacgaaattttgggagc

SEQ ID NO: 84742 - DNA, 25 bp, Mus musculus
cagaaagagcagcttcaaaagttga

SEQ ID NO: 84743 - DNA, 25 bp, Mus musculus
cagaaagagtcttccgtccagcgtt

SEQ ID NO: 84744 - DNA, 25 bp, Mus musculus
cagaaagcacaaaacctggtcctgt

SEQ ID NO: 84745 - DNA, 25 bp, Mus musculus
cagaaagcacagattggacccaagc

SEQ ID NO: 84746 - DNA, 25 bp, Mus musculus
cagaaagctctggacctcgaaaagt

SEQ ID NO: 84747 - DNA, 25 bp, Mus musculus
cagaaagctgaaacagaaagtatgg

SEQ ID NO: 84748 - DNA, 25 bp, Mus musculus
cagaaagctgttggatcagtgcgag

SEQ ID NO: 84749 - DNA, 25 bp, Mus musculus
cagaaaggtgaacgccaaatggcca

SEQ ID NO: 84750 - DNA, 25 bp, Mus musculus
cagaaaggtgctcctgtcaaacaaa

SEQ ID NO: 84751 - DNA, 25 bp, Mus musculus
cagaaagtatggaagatttccagaa

SEQ ID NO: 84752 - DNA, 25 bp, Mus musculus
cagaaagtccttacggacccggcag

SEQ ID NO: 84753 - DNA, 25 bp, Mus musculus
cagaaagtctgcaagcagtgccaca

SEQ ID NO: 84754 - DNA, 25 bp, Mus musculus
cagaaagtctttgcgtatgttaaca

SEQ ID NO: 84755 - DNA, 25 bp, Mus musculus
cagaaagtggtgtgattggatcaac

SEQ ID NO: 84756 - DNA, 25 bp, Mus musculus
cagaaagttcaagcccagtgtgcct

SEQ ID NO: 84757 - DNA, 25 bp, Mus musculus
cagaaagttgcaagtaatccaggct

SEQ ID NO: 84758 - DNA, 25 bp, Mus musculus
cagaaataacctgcgtccaaaatcc

SEQ ID NO: 84759 - DNA, 25 bp, Mus musculus
cagaaatacctgagcgtgcaagacc

SEQ ID NO: 84760 - DNA, 25 bp, Mus musculus
cagaaatagacctgcccgtgggagg

SEQ ID NO: 84761 - DNA, 25 bp, Mus musculus
cagaaatcaccagtagagggcagcc

SEQ ID NO: 84762 - DNA, 25 bp, Mus musculus
cagaaatcatcaaagtgccaatggc

SEQ ID NO: 84763 - DNA, 25 bp, Mus musculus
cagaaatcgactgcactctagtggc

SEQ ID NO: 84764 - DNA, 25 bp, Mus musculus
cagaaatcgccaaggagcagggact

SEQ ID NO: 84765 - DNA, 25 bp, Mus musculus
cagaaatcgggagaagtgctaagtc

SEQ ID NO: 84766 - DNA, 25 bp, Mus musculus
cagaaatcgtgcagctcgtgggaaa

SEQ ID NO: 84767 - DNA, 25 bp, Mus musculus
cagaaatctgggatcgcctggagag

SEQ ID NO: 84768 - DNA, 25 bp, Mus musculus
cagaaatgactgcaaaaatggtccc

SEQ ID NO: 84769 - DNA, 25 bp, Mus musculus
cagaaatgagggtttctatgccgac

SEQ ID NO: 84770 - DNA, 25 bp, Mus musculus
cagaaatgcactgtatgagcggcca

SEQ ID NO: 84771 - DNA, 25 bp, Mus musculus
cagaaatgtgcgcttcggaaccaaa

SEQ ID NO: 84772 - DNA, 25 bp, Mus musculus
cagaaatgtgtagagacggtggaac

SEQ ID NO: 84773 - DNA, 25 bp, Mus musculus
cagaaattcaggtggcttcaaagcc

SEQ ID NO: 84774 - DNA, 25 bp, Mus musculus
cagaaattccttcaagcccgagtgg

SEQ ID NO: 84775 - DNA, 25 bp, Mus musculus
cagaacaagccttaagtggaggcca

SEQ ID NO: 84776 - DNA, 25 bp, Mus musculus
cagaacaagcgcctggatgctgtga

SEQ ID NO: 84777 - DNA, 25 bp, Mus musculus
cagaacaagtatcagcaggcagagg

SEQ ID NO: 84778 - DNA, 25 bp, Mus musculus
cagaacactgaaagggaagcggctc

SEQ ID NO: 84779 - DNA, 25 bp, Mus musculus
cagaacagaccttggagtgaaacca

SEQ ID NO: 84780 - DNA, 25 bp, Mus musculus
cagaacagagagtgtcgaggacatc

SEQ ID NO: 84781 - DNA, 25 bp, Mus musculus
cagaacagcctgaaacggtttgagg

SEQ ID NO: 84782 - DNA, 25 bp, Mus musculus
cagaacagctgaacggtctcaaaca

SEQ ID NO: 84783 - DNA, 25 bp, Mus musculus
cagaacaggagagtggagtgaaccc

SEQ ID NO: 84784 - DNA, 25 bp, Mus musculus
cagaacagtggttgtaaccacaatt

SEQ ID NO: 84785 - DNA, 25 bp, Mus musculus
cagaacatcaccatcagccagtacg

SEQ ID NO: 84786 - DNA, 25 bp, Mus musculus
cagaacatgaatgcaggtcacctgg

SEQ ID NO: 84787 - DNA, 25 bp, Mus musculus
cagaacattcgactgagccgggacg

SEQ ID NO: 84788 - DNA, 25 bp, Mus musculus
cagaacattgtgatatccagcggct

SEQ ID NO: 84789 - DNA, 25 bp, Mus musculus
cagaaccccatagagcagtgtgaac

SEQ ID NO: 84790 - DNA, 25 bp, Mus musculus
cagaaccctggcaaaaatcctgagg

SEQ ID NO: 84791 - DNA, 25 bp, Mus musculus
cagaacctattcaggcatgggaagg

SEQ ID NO: 84792 - DNA, 25 bp, Mus musculus
cagaacctgctctacgaagtgatgc

SEQ ID NO: 84793 - DNA, 25 bp, Mus musculus
cagaacggaaatggactgagcaccc

SEQ ID NO: 84794 - DNA, 25 bp, Mus musculus
cagaacgtgcagattctgctcgagg

SEQ ID NO: 84795 - DNA, 25 bp, Mus musculus
cagaacgttgttgaagaatctgaag

SEQ ID NO: 84796 - DNA, 25 bp, Mus musculus
cagaacgtttgtcccagcagatcgc

SEQ ID NO: 84797 - DNA, 25 bp, Mus musculus
cagaactactgtttgggagccccaa

SEQ ID NO: 84798 - DNA, 25 bp, Mus musculus
cagaactagccagcaggtagccagt

SEQ ID NO: 84799 - DNA, 25 bp, Mus musculus
cagaactccgtgtaatgctgggact

SEQ ID NO: 84800 - DNA, 25 bp, Mus musculus
cagaactcctgtggaatgaccagtg

SEQ ID NO: 84801 - DNA, 25 bp, Mus musculus
cagaactgagaaatgctaccgcggc

SEQ ID NO: 84802 - DNA, 25 bp, Mus musculus
cagaactgcctgcatgagggactca

SEQ ID NO: 84803 - DNA, 25 bp, Mus musculus
cagaactgcgggattacaggagctt

SEQ ID NO: 84804 - DNA, 25 bp, Mus musculus
cagaactggcgggacttatcacaca

SEQ ID NO: 84805 - DNA, 25 bp, Mus musculus
cagaactgtgccaaggaactggagc

SEQ ID NO: 84806 - DNA, 25 bp, Mus musculus
cagaactgtgttggaaggaagctcg

SEQ ID NO: 84807 - DNA, 25 bp, Mus musculus
cagaactgtttaaggctgaagcggc

SEQ ID NO: 84808 - DNA, 25 bp, Mus musculus
cagaacttcaggaggtgcagatcac

SEQ ID NO: 84809 - DNA, 25 bp, Mus musculus
cagaacttctgaaagcggtcttcga

SEQ ID NO: 84810 - DNA, 25 bp, Mus musculus
cagaacttctgtagtgagcccttca

SEQ ID NO: 84811 - DNA, 25 bp, Mus musculus
cagaacttgggagctttttccagga

SEQ ID NO: 84812 - DNA, 25 bp, Mus musculus
cagaacttgtggaactgctggagtc

SEQ ID NO: 84813 - DNA, 25 bp, Mus musculus
cagaactttgtgtgagcagagcggc

SEQ ID NO: 84814 - DNA, 25 bp, Mus musculus
cagaagaaaaagtctcgatggcctt

SEQ ID NO: 84815 - DNA, 25 bp, Mus musculus
cagaagaaagtcaggagagcgctcc

SEQ ID NO: 84816 - DNA, 25 bp, Mus musculus
cagaagaaagtcaggccgaggtcgt

SEQ ID NO: 84817 - DNA, 25 bp, Mus musculus
cagaagaaatccagtgcaatgggag

SEQ ID NO: 84818 - DNA, 25 bp, Mus musculus
cagaagaagacctgagtgggaccca

SEQ ID NO: 84819 - DNA, 25 bp, Mus musculus
cagaagaaggaagcgtggaatgccc

SEQ ID NO: 84820 - DNA, 25 bp, Mus musculus
cagaagaaggcctatgagatcgcag

SEQ ID NO: 84821 - DNA, 25 bp, Mus musculus
cagaagaagggaaactcgacggtgt

SEQ ID NO: 84822 - DNA, 25 bp, Mus musculus
cagaagacacgggtcagtgagcacc

SEQ ID NO: 84823 - DNA, 25 bp, Mus musculus
cagaagacagaacgacgcgctggaa

SEQ ID NO: 84824 - DNA, 25 bp, Mus musculus
cagaagacatcagccctgcagaggc

SEQ ID NO: 84825 - DNA, 25 bp, Mus musculus
cagaagaccccgtagtaatggagat

SEQ ID NO: 84826 - DNA, 25 bp, Mus musculus
cagaagacctgctggatcacgaggc

SEQ ID NO: 84827 - DNA, 25 bp, Mus musculus
cagaagacgccatgcagatcatgga

SEQ ID NO: 84828 - DNA, 25 bp, Mus musculus
cagaagactctgaaggcccctaatt

SEQ ID NO: 84829 - DNA, 25 bp, Mus musculus
cagaagactctgtggaaagaggact

SEQ ID NO: 84830 - DNA, 25 bp, Mus musculus
cagaagactgtgtacccgatggagc

SEQ ID NO: 84831 - DNA, 25 bp, Mus musculus
cagaagagaataaactcacctatac

SEQ ID NO: 84832 - DNA, 25 bp, Mus musculus
cagaagagagcttgcggatggccat

SEQ ID NO: 84833 - DNA, 25 bp, Mus musculus
cagaagagcgaagccacaagttgca

SEQ ID NO: 84834 - DNA, 25 bp, Mus musculus
cagaagaggaattctaggtcagcct

SEQ ID NO: 84835 - DNA, 25 bp, Mus musculus
cagaagaggaggagcaatgcaccat

SEQ ID NO: 84836 - DNA, 25 bp, Mus musculus
cagaagaggcgaaagccatctgtgc

SEQ ID NO: 84837 - DNA, 25 bp, Mus musculus
cagaagataccttggcggctgaagc

SEQ ID NO: 84838 - DNA, 25 bp, Mus musculus
cagaagatagccttgaagcatgggt

SEQ ID NO: 84839 - DNA, 25 bp, Mus musculus
cagaagatctaccacatcattaagg

SEQ ID NO: 84840 - DNA, 25 bp, Mus musculus
cagaagatggtacaaaagctggctc

SEQ ID NO: 84841 - DNA, 25 bp, Mus musculus
cagaagatggtcaacagcactgaga

SEQ ID NO: 84842 - DNA, 25 bp, Mus musculus
cagaagcaactgtggacctgggtgc

SEQ ID NO: 84843 - DNA, 25 bp, Mus musculus
cagaagcactgtgggaccatgtgac

SEQ ID NO: 84844 - DNA, 25 bp, Mus musculus
cagaagcagaatgcgccatgcagga

SEQ ID NO: 84845 - DNA, 25 bp, Mus musculus
cagaagcagatgataccactccagg

SEQ ID NO: 84846 - DNA, 25 bp, Mus musculus
cagaagcagctctacacagatgtga

SEQ ID NO: 84847 - DNA, 25 bp, Mus musculus
cagaagcatgatgggaccgtaggcc

SEQ ID NO: 84848 - DNA, 25 bp, Mus musculus
cagaagcatgattcgagcagggctc

SEQ ID NO: 84849 - DNA, 25 bp, Mus musculus
cagaagccacgtttgtctgggcaca

SEQ ID NO: 84850 - DNA, 25 bp, Mus musculus
cagaagcccatgctcaggcaatggc

SEQ ID NO: 84851 - DNA, 25 bp, Mus musculus
cagaagccgttgagtcagccgtgtg

SEQ ID NO: 84852 - DNA, 25 bp, Mus musculus
cagaagccttcacatcttggtcaag

SEQ ID NO: 84853 - DNA, 25 bp, Mus musculus
cagaagccttgcgtttgtcaaaaca

SEQ ID NO: 84854 - DNA, 25 bp, Mus musculus
cagaagcctttgcaggtatcaaaag

SEQ ID NO: 84855 - DNA, 25 bp, Mus musculus
cagaagcgcatgaggaccctgatga

SEQ ID NO: 84856 - DNA, 25 bp, Mus musculus
cagaagcggcaaatccaggagaagc

SEQ ID NO: 84857 - DNA, 25 bp, Mus musculus
cagaagcggccgagctgattttgca

SEQ ID NO: 84858 - DNA, 25 bp, Mus musculus
cagaagcgtctatgattccttcaga

SEQ ID NO: 84859 - DNA, 25 bp, Mus musculus
cagaagctaaactcctgcggcagca

SEQ ID NO: 84860 - DNA, 25 bp, Mus musculus
cagaagctacaagagagtttaggac

SEQ ID NO: 84861 - DNA, 25 bp, Mus musculus
cagaagctacaagcgaaaaatggga

SEQ ID NO: 84862 - DNA, 25 bp, Mus musculus
cagaagctacttcggtcatggaatg

SEQ ID NO: 84863 - DNA, 25 bp, Mus musculus
cagaagctgaatcctaaaggcggag

SEQ ID NO: 84864 - DNA, 25 bp, Mus musculus
cagaagctgctgagaagcgccagaa

SEQ ID NO: 84865 - DNA, 25 bp, Mus musculus
cagaagctggaacgcatggagacca

SEQ ID NO: 84866 - DNA, 25 bp, Mus musculus
cagaagctggccagggctttggaca

SEQ ID NO: 84867 - DNA, 25 bp, Mus musculus
cagaagcttgctcgagtaacccagg

SEQ ID NO: 84868 - DNA, 25 bp, Mus musculus
cagaagcttgcttagcgggcagcgc

SEQ ID NO: 84869 - DNA, 25 bp, Mus musculus
cagaaggaaaagacccgctggctta

SEQ ID NO: 84870 - DNA, 25 bp, Mus musculus
cagaaggacacatggaaccctggca

SEQ ID NO: 84871 - DNA, 25 bp, Mus musculus
cagaaggaccctaggatcgaagcga

SEQ ID NO: 84872 - DNA, 25 bp, Mus musculus
cagaaggacgagtactacctgggag

SEQ ID NO: 84873 - DNA, 25 bp, Mus musculus
cagaaggactgcaaaccgaggatgt

SEQ ID NO: 84874 - DNA, 25 bp, Mus musculus
cagaaggagaccctagtcactctgt

SEQ ID NO: 84875 - DNA, 25 bp, Mus musculus
cagaaggcctgatgggcagtgcaca

SEQ ID NO: 84876 - DNA, 25 bp, Mus musculus
cagaaggcgctctattccacagcta

SEQ ID NO: 84877 - DNA, 25 bp, Mus musculus
cagaaggctctttcgatttcggcag

SEQ ID NO: 84878 - DNA, 25 bp, Mus musculus
cagaaggctgtgaagagacctgcca

SEQ ID NO: 84879 - DNA, 25 bp, Mus musculus
cagaaggcttcatcacgcacgtgga

SEQ ID NO: 84880 - DNA, 25 bp, Mus musculus
cagaagggaacaacatcgtgggact

SEQ ID NO: 84881 - DNA, 25 bp, Mus musculus
cagaagggaacagactacgtgaggc

SEQ ID NO: 84882 - DNA, 25 bp, Mus musculus
cagaagggcactgttgctggcctaa

SEQ ID NO: 84883 - DNA, 25 bp, Mus musculus
cagaagggttcctctgaccagcgga

SEQ ID NO: 84884 - DNA, 25 bp, Mus musculus
cagaaggtatatgtgcagcaccggc

SEQ ID NO: 84885 - DNA, 25 bp, Mus musculus
cagaaggtccaggagctagctcacg

SEQ ID NO: 84886 - DNA, 25 bp, Mus musculus
cagaaggtcttcttcgccaagatgg

SEQ ID NO: 84887 - DNA, 25 bp, Mus musculus
cagaaggtgaattgagcaggcctgc

SEQ ID NO: 84888 - DNA, 25 bp, Mus musculus
cagaagtaaagaagcgtgggacgca

SEQ ID NO: 84889 - DNA, 25 bp, Mus musculus
cagaagtacaacgaggtgaccgcca

SEQ ID NO: 84890 - DNA, 25 bp, Mus musculus
cagaagtacttagcccagctgctga

SEQ ID NO: 84891 - DNA, 25 bp, Mus musculus
cagaagtatgccagcgagagaaccc

SEQ ID NO: 84892 - DNA, 25 bp, Mus musculus
cagaagtattggcaccatggtggaa

SEQ ID NO: 84893 - DNA, 25 bp, Mus musculus
cagaagtcatcggacgctggaatct

SEQ ID NO: 84894 - DNA, 25 bp, Mus musculus
cagaagtcatttgatcccggctcga

SEQ ID NO: 84895 - DNA, 25 bp, Mus musculus
cagaagtcctttgtcctgggctggc

SEQ ID NO: 84896 - DNA, 25 bp, Mus musculus
cagaagtcgcccttggtccccaaat

SEQ ID NO: 84897 - DNA, 25 bp, Mus musculus
cagaagtctattccaacagggacca

SEQ ID NO: 84898 - DNA, 25 bp, Mus musculus
cagaagtgagcttgatgactaccac

SEQ ID NO: 84899 - DNA, 25 bp, Mus musculus
cagaagtgattctggccacatcgag

SEQ ID NO: 84900 - DNA, 25 bp, Mus musculus
cagaagtgccaaatttcagtgagcc

SEQ ID NO: 84901 - DNA, 25 bp, Mus musculus
cagaagtggtccctgtcctacttaa

SEQ ID NO: 84902 - DNA, 25 bp, Mus musculus
cagaagtgtatcgttcgtctcaaga

SEQ ID NO: 84903 - DNA, 25 bp, Mus musculus
cagaagtgtccagatgtgttgcaca

SEQ ID NO: 84904 - DNA, 25 bp, Mus musculus
cagaagttcagcgtcatgcggagta

SEQ ID NO: 84905 - DNA, 25 bp, Mus musculus
cagaagttctgcatcttggaggatg

SEQ ID NO: 84906 - DNA, 25 bp, Mus musculus
cagaagttgaccttcctgacatgtg

SEQ ID NO: 84907 - DNA, 25 bp, Mus musculus
cagaagttgagcagcgacgagaaca

SEQ ID NO: 84908 - DNA, 25 bp, Mus musculus
cagaagttgggatcatcatcggagc

SEQ ID NO: 84909 - DNA, 25 bp, Mus musculus
cagaagttgttccagctaagagcat

SEQ ID NO: 84910 - DNA, 25 bp, Mus musculus
cagaagtttagaggagattttgaat

SEQ ID NO: 84911 - DNA, 25 bp, Mus musculus
cagaataaatgggagactgtttgct

SEQ ID NO: 84912 - DNA, 25 bp, Mus musculus
cagaataagtgtgcagggcctcctt

SEQ ID NO: 84913 - DNA, 25 bp, Mus musculus
cagaatacagcatagtgacagagtc

SEQ ID NO: 84914 - DNA, 25 bp, Mus musculus
cagaatacaggtgcaattgagaaca

SEQ ID NO: 84915 - DNA, 25 bp, Mus musculus
cagaatagttctgggaccgagggca

SEQ ID NO: 84916 - DNA, 25 bp, Mus musculus
cagaatcacttaatagggccgggct

SEQ ID NO: 84917 - DNA, 25 bp, Mus musculus
cagaatcagcgtggctgggccctaa

SEQ ID NO: 84918 - DNA, 25 bp, Mus musculus
cagaatcagtgctacatggccacca

SEQ ID NO: 84919 - DNA, 25 bp, Mus musculus
cagaatcattgcgttggcagagccc

SEQ ID NO: 84920 - DNA, 25 bp, Mus musculus
cagaatcctcaagtgcagacccagg

SEQ ID NO: 84921 - DNA, 25 bp, Mus musculus
cagaatcgtccactgtgatgccaga

SEQ ID NO: 84922 - DNA, 25 bp, Mus musculus
cagaatcgtgttactgatgcaccga

SEQ ID NO: 84923 - DNA, 25 bp, Mus musculus
cagaatctaaagatgaacaccgtca

SEQ ID NO: 84924 - DNA, 25 bp, Mus musculus
cagaatctgaatgacgcctacgggc

SEQ ID NO: 84925 - DNA, 25 bp, Mus musculus
cagaatctgccattgtgtacctcaa

SEQ ID NO: 84926 - DNA, 25 bp, Mus musculus
cagaatctggatggcacctgtgcag

SEQ ID NO: 84927 - DNA, 25 bp, Mus musculus
cagaatctttgtaggtgctcggatc

SEQ ID NO: 84928 - DNA, 25 bp, Mus musculus
cagaatgaagaacagatacgggaac

SEQ ID NO: 84929 - DNA, 25 bp, Mus musculus
cagaatgaccaaatatcgagtggga

SEQ ID NO: 84930 - DNA, 25 bp, Mus musculus
cagaatgacgtaaccaggtggtgtc

SEQ ID NO: 84931 - DNA, 25 bp, Mus musculus
cagaatgactctgacaaccggagaa

SEQ ID NO: 84932 - DNA, 25 bp, Mus musculus
cagaatgattcctgcacagggcggt

SEQ ID NO: 84933 - DNA, 25 bp, Mus musculus
cagaatgcaccgctagtccgcggga

SEQ ID NO: 84934 - DNA, 25 bp, Mus musculus
cagaatgcagctttcctttcaagta

SEQ ID NO: 84935 - DNA, 25 bp, Mus musculus
cagaatgcagggatgttaaccggct

SEQ ID NO: 84936 - DNA, 25 bp, Mus musculus
cagaatgcccagttccggaatcagg

SEQ ID NO: 84937 - DNA, 25 bp, Mus musculus
cagaatgcgtttcagtttcgaagga

SEQ ID NO: 84938 - DNA, 25 bp, Mus musculus
cagaatgctgcagttcaggctgtca

SEQ ID NO: 84939 - DNA, 25 bp, Mus musculus
cagaatgcttgtttggtcacacaga

SEQ ID NO: 84940 - DNA, 25 bp, Mus musculus
cagaatggcatgtatgggctgcacc

SEQ ID NO: 84941 - DNA, 25 bp, Mus musculus
cagaatggcctcagtgcagtgcgga

SEQ ID NO: 84942 - DNA, 25 bp, Mus musculus
cagaatgggcctatcttaggagtga

SEQ ID NO: 84943 - DNA, 25 bp, Mus musculus
cagaatggtgtgtgtcagctgatcc

SEQ ID NO: 84944 - DNA, 25 bp, Mus musculus
cagaatgtaccagggacacatgcag

SEQ ID NO: 84945 - DNA, 25 bp, Mus musculus
cagaatgtagcaaacctcgggacag

SEQ ID NO: 84946 - DNA, 25 bp, Mus musculus
cagaatgtcagctggaagtacgacc

SEQ ID NO: 84947 - DNA, 25 bp, Mus musculus
cagaatgtcttcacggcagccaaga

SEQ ID NO: 84948 - DNA, 25 bp, Mus musculus
cagaatgttctgttacccctggaca

SEQ ID NO: 84949 - DNA, 25 bp, Mus musculus
cagaattcatgttgtgttgtcgcca

SEQ ID NO: 84950 - DNA, 25 bp, Mus musculus
cagaattcttggattatgacacgag

SEQ ID NO: 84951 - DNA, 25 bp, Mus musculus
cagaattgaactggaggctggctcc

SEQ ID NO: 84952 - DNA, 25 bp, Mus musculus
cagaattgtagagccaactgcgcac

SEQ ID NO: 84953 - DNA, 25 bp, Mus musculus
cagaatttaactggatcgcagacag

SEQ ID NO: 84954 - DNA, 25 bp, Mus musculus
cagaatttcttgcaacgtgagccaa

SEQ ID NO: 84955 - DNA, 25 bp, Mus musculus
cagaatttgctgaccatgcctggtg

SEQ ID NO: 84956 - DNA, 25 bp, Mus musculus
cagaatttgctgagtcggccgagga

SEQ ID NO: 84957 - DNA, 25 bp, Mus musculus
cagaatttgcttgtggaccctgaca

SEQ ID NO: 84958 - DNA, 25 bp, Mus musculus
cagacaaaaacaggccaaatgcagc

SEQ ID NO: 84959 - DNA, 25 bp, Mus musculus
cagacaaacgggaacatggccatca

SEQ ID NO: 84960 - DNA, 25 bp, Mus musculus
cagacaaagaatgtcaggagacaca

SEQ ID NO: 84961 - DNA, 25 bp, Mus musculus
cagacaacagttgaggcccctgagt

SEQ ID NO: 84962 - DNA, 25 bp, Mus musculus
cagacaagaacccggataataaaga

SEQ ID NO: 84963 - DNA, 25 bp, Mus musculus
cagacaagacatgccatcagaggat

SEQ ID NO: 84964 - DNA, 25 bp, Mus musculus
cagacaagcgtgctacatctggtgg

SEQ ID NO: 84965 - DNA, 25 bp, Mus musculus
cagacaagcttcacctgccaagata

SEQ ID NO: 84966 - DNA, 25 bp, Mus musculus
cagacaagtggtgatcagagtcccc

SEQ ID NO: 84967 - DNA, 25 bp, Mus musculus
cagacacaacgggatcgatggcctt

SEQ ID NO: 84968 - DNA, 25 bp, Mus musculus
cagacacactgcgagtatcaccgag

SEQ ID NO: 84969 - DNA, 25 bp, Mus musculus
cagacacagacgtatggacgctcgg

SEQ ID NO: 84970 - DNA, 25 bp, Mus musculus
cagacacagctcagcgattggcaca

SEQ ID NO: 84971 - DNA, 25 bp, Mus musculus
cagacacaggcctcagaaaccttgg

SEQ ID NO: 84972 - DNA, 25 bp, Mus musculus
cagacacctctgaacttgacaggaa

SEQ ID NO: 84973 - DNA, 25 bp, Mus musculus
cagacaccttctgagcaggaggaga

SEQ ID NO: 84974 - DNA, 25 bp, Mus musculus
cagacaccttgtactgggcacgcgt

SEQ ID NO: 84975 - DNA, 25 bp, Mus musculus
cagacacgacaggttgtacagggac

SEQ ID NO: 84976 - DNA, 25 bp, Mus musculus
cagacacggacagcttctatggtgc

SEQ ID NO: 84977 - DNA, 25 bp, Mus musculus
cagacacggactttgactttgaggg

SEQ ID NO: 84978 - DNA, 25 bp, Mus musculus
cagacacggcggtaggaaagctgct

SEQ ID NO: 84979 - DNA, 25 bp, Mus musculus
cagacactaacaagcattccaagga

SEQ ID NO: 84980 - DNA, 25 bp, Mus musculus
cagacactggcatctcggacaggaa

SEQ ID NO: 84981 - DNA, 25 bp, Mus musculus
cagacacttcgggtttaagcaggaa

SEQ ID NO: 84982 - DNA, 25 bp, Mus musculus
cagacacttctgatgggcacctaag

SEQ ID NO: 84983 - DNA, 25 bp, Mus musculus
cagacagacctatgggaacactcgg

SEQ ID NO: 84984 - DNA, 25 bp, Mus musculus
cagacagagaacctacagaggctgc

SEQ ID NO: 84985 - DNA, 25 bp, Mus musculus
cagacagatgcgctcagctgatgaa

SEQ ID NO: 84986 - DNA, 25 bp, Mus musculus
cagacagatttcgaagcagagccca

SEQ ID NO: 84987 - DNA, 25 bp, Mus musculus
cagacagccacagcagagtgatttc

SEQ ID NO: 84988 - DNA, 25 bp, Mus musculus
cagacagcgttggtggattccgata

SEQ ID NO: 84989 - DNA, 25 bp, Mus musculus
cagacaggacccatctaagagagag

SEQ ID NO: 84990 - DNA, 25 bp, Mus musculus
cagacagtcttgaacaggccagtgc

SEQ ID NO: 84991 - DNA, 25 bp, Mus musculus
cagacagtcttggagtggcttatac

SEQ ID NO: 84992 - DNA, 25 bp, Mus musculus
cagacagtgagctcggtggagacaa

SEQ ID NO: 84993 - DNA, 25 bp, Mus musculus
cagacagtgtgtactcgggtgtgca

SEQ ID NO: 84994 - DNA, 25 bp, Mus musculus
cagacatcacggaggaggacttcaa

SEQ ID NO: 84995 - DNA, 25 bp, Mus musculus
cagacatccaaaagcgacagataaa

SEQ ID NO: 84996 - DNA, 25 bp, Mus musculus
cagacatccggtgttagagattgtg

SEQ ID NO: 84997 - DNA, 25 bp, Mus musculus
cagacatgcgcaatgagctggagga

SEQ ID NO: 84998 - DNA, 25 bp, Mus musculus
cagacatggcgcagttcaagcaagg

SEQ ID NO: 84999 - DNA, 25 bp, Mus musculus
cagacatgggaatccgaagggagca

SEQ ID NO: 85000 - DNA, 25 bp, Mus musculus
cagacatggggtatccatcgaggga

SEQ ID NO: 85001 - DNA, 25 bp, Mus musculus
cagacatggtcacagacaatggccc

SEQ ID NO: 85002 - DNA, 25 bp, Mus musculus
cagacatgtgccgagctgctgtgaa

SEQ ID NO: 85003 - DNA, 25 bp, Mus musculus
cagacatttcctctctgaattcaag

SEQ ID NO: 85004 - DNA, 25 bp, Mus musculus
cagacattttgtgggaggacacacc

SEQ ID NO: 85005 - DNA, 25 bp, Mus musculus
cagaccaagatgtgcctctaagggc

SEQ ID NO: 85006 - DNA, 25 bp, Mus musculus
cagaccacctcctgatgccacagct

SEQ ID NO: 85007 - DNA, 25 bp, Mus musculus
cagaccaggctctaaggccgtgaag

SEQ ID NO: 85008 - DNA, 25 bp, Mus musculus
cagaccaggctgtatctaaactaaa

SEQ ID NO: 85009 - DNA, 25 bp, Mus musculus
cagaccagtgtctgacaatacccag

SEQ ID NO: 85010 - DNA, 25 bp, Mus musculus
cagaccagttctatcgctacaagat

SEQ ID NO: 85011 - DNA, 25 bp, Mus musculus
cagaccatctacagacgcgtggaag

SEQ ID NO: 85012 - DNA, 25 bp, Mus musculus
cagaccatttctattagggacagcc

SEQ ID NO: 85013 - DNA, 25 bp, Mus musculus
cagaccatttttgccctccgggaag

SEQ ID NO: 85014 - DNA, 25 bp, Mus musculus
cagacccatcgggacaaatatgaga

SEQ ID NO: 85015 - DNA, 25 bp, Mus musculus
cagaccccagaatccctggagtgag

SEQ ID NO: 85016 - DNA, 25 bp, Mus musculus
cagacccctgactatgaagaaagaa

SEQ ID NO: 85017 - DNA, 25 bp, Mus musculus
cagacccctggaagtcgagatggca

SEQ ID NO: 85018 - DNA, 25 bp, Mus musculus
cagaccctgaggaaacaagcgaaga

SEQ ID NO: 85019 - DNA, 25 bp, Mus musculus
cagaccctgaggaaggccatgaaag

SEQ ID NO: 85020 - DNA, 25 bp, Mus musculus
cagaccctgatccacttggttgagg

SEQ ID NO: 85021 - DNA, 25 bp, Mus musculus
cagaccctggtccaaactgaggtgg

SEQ ID NO: 85022 - DNA, 25 bp, Mus musculus
cagaccgaagcctggagagtcagag

SEQ ID NO: 85023 - DNA, 25 bp, Mus musculus
cagaccggacgtaccctatgacagt

SEQ ID NO: 85024 - DNA, 25 bp, Mus musculus
cagaccgggagaagggcaaactact

SEQ ID NO: 85025 - DNA, 25 bp, Mus musculus
cagaccgtctttattcgcgatccaa

SEQ ID NO: 85026 - DNA, 25 bp, Mus musculus
cagaccgtggatgggagaccctgta

SEQ ID NO: 85027 - DNA, 25 bp, Mus musculus
cagaccgttgttgcaagtggcttcc

SEQ ID NO: 85028 - DNA, 25 bp, Mus musculus
cagacctacggttcagcatggcact

SEQ ID NO: 85029 - DNA, 25 bp, Mus musculus
cagacctaggcttgcaggatcggct

SEQ ID NO: 85030 - DNA, 25 bp, Mus musculus
cagacctcacttctggagttgcaga

SEQ ID NO: 85031 - DNA, 25 bp, Mus musculus
cagacctccggttgaaaatggcaga

SEQ ID NO: 85032 - DNA, 25 bp, Mus musculus
cagacctcctcaagagagatgtgtc

SEQ ID NO: 85033 - DNA, 25 bp, Mus musculus
cagacctcggctttgggaaggccaa

SEQ ID NO: 85034 - DNA, 25 bp, Mus musculus
cagacctcgtcagtgctgttgccga

SEQ ID NO: 85035 - DNA, 25 bp, Mus musculus
cagacctcgtgggtcgcatgctgct

SEQ ID NO: 85036 - DNA, 25 bp, Mus musculus
cagacctcttgattccattttgaaa

SEQ ID NO: 85037 - DNA, 25 bp, Mus musculus
cagacctgagcttctatgatgccaa

SEQ ID NO: 85038 - DNA, 25 bp, Mus musculus
cagacctgatgaacctgcgcatgga

SEQ ID NO: 85039 - DNA, 25 bp, Mus musculus
cagacctgccagaccaaagggaagt

SEQ ID NO: 85040 - DNA, 25 bp, Mus musculus
cagacctgctcgacaagatgctgga

SEQ ID NO: 85041 - DNA, 25 bp, Mus musculus
cagacctggccttgcctatggcaga

SEQ ID NO: 85042 - DNA, 25 bp, Mus musculus
cagacctggcgctcatgtccttcat

SEQ ID NO: 85043 - DNA, 25 bp, Mus musculus
cagacctgggctgagagagcgctta

SEQ ID NO: 85044 - DNA, 25 bp, Mus musculus
cagacctggttatcctagcccgaga

SEQ ID NO: 85045 - DNA, 25 bp, Mus musculus
cagacctgtgatgccagacgtatgg

SEQ ID NO: 85046 - DNA, 25 bp, Mus musculus
cagacctgtgcgcaccatgcatgtg

SEQ ID NO: 85047 - DNA, 25 bp, Mus musculus
cagacctttctcgtggtggtggcca

SEQ ID NO: 85048 - DNA, 25 bp, Mus musculus
cagacctttgacttcttgggtgaaa

SEQ ID NO: 85049 - DNA, 25 bp, Mus musculus
cagacgacaaaactcaactcacaga

SEQ ID NO: 85050 - DNA, 25 bp, Mus musculus
cagacgacttcggtgcctactacaa

SEQ ID NO: 85051 - DNA, 25 bp, Mus musculus
cagacgacttggagaacgagggtcc

SEQ ID NO: 85052 - DNA, 25 bp, Mus musculus
cagacgagccccaaagactgcagtt

SEQ ID NO: 85053 - DNA, 25 bp, Mus musculus
cagacgagctgacgcttcaaactgg

SEQ ID NO: 85054 - DNA, 25 bp, Mus musculus
cagacgagctgcttgatccagagga

SEQ ID NO: 85055 - DNA, 25 bp, Mus musculus
cagacgataaggaggagacgataca

SEQ ID NO: 85056 - DNA, 25 bp, Mus musculus
cagacgatgactaagaaggcagcca

SEQ ID NO: 85057 - DNA, 25 bp, Mus musculus
cagacgatgctttaacagggcgcca

SEQ ID NO: 85058 - DNA, 25 bp, Mus musculus
cagacgatgttggaacgccaggagc

SEQ ID NO: 85059 - DNA, 25 bp, Mus musculus
cagacgcagccgcagtatgtggcct

SEQ ID NO: 85060 - DNA, 25 bp, Mus musculus
cagacgcagctgtggaatgccaccg

SEQ ID NO: 85061 - DNA, 25 bp, Mus musculus
cagacgccatcatccagtgtgtgaa

SEQ ID NO: 85062 - DNA, 25 bp, Mus musculus
cagacgcgcctacaagaaaatggtg

SEQ ID NO: 85063 - DNA, 25 bp, Mus musculus
cagacggagttctgaatggagacca

SEQ ID NO: 85064 - DNA, 25 bp, Mus musculus
cagacggcgttggttcgagaagacc

SEQ ID NO: 85065 - DNA, 25 bp, Mus musculus
cagacggtcagctggaaagtcacaa

SEQ ID NO: 85066 - DNA, 25 bp, Mus musculus
cagacggtgtctagcaatcatggcg

SEQ ID NO: 85067 - DNA, 25 bp, Mus musculus
cagacgtaacgttgtgagcgtttcg

SEQ ID NO: 85068 - DNA, 25 bp, Mus musculus
cagacgtaatggtgatgcaggtgtc

SEQ ID NO: 85069 - DNA, 25 bp, Mus musculus
cagacgtcggttcctctcagagagt

SEQ ID NO: 85070 - DNA, 25 bp, Mus musculus
cagacgtctcaccaacaggacggta

SEQ ID NO: 85071 - DNA, 25 bp, Mus musculus
cagacgtgccttaccagactgggca

SEQ ID NO: 85072 - DNA, 25 bp, Mus musculus
cagacgtgcggttgcctgaactaaa

SEQ ID NO: 85073 - DNA, 25 bp, Mus musculus
cagacgtggcctactctcatgatgg

SEQ ID NO: 85074 - DNA, 25 bp, Mus musculus
cagacgttctgctaggagatctcac

SEQ ID NO: 85075 - DNA, 25 bp, Mus musculus
cagactaaaactacaggttcctggt

SEQ ID NO: 85076 - DNA, 25 bp, Mus musculus
cagactaagtgggaccggagacgcc

SEQ ID NO: 85077 - DNA, 25 bp, Mus musculus
cagactacagcggtaagaacactta

SEQ ID NO: 85078 - DNA, 25 bp, Mus musculus
cagactaccagaatcgagcagcttt

SEQ ID NO: 85079 - DNA, 25 bp, Mus musculus
cagactagaagatctgggcgcagcc

SEQ ID NO: 85080 - DNA, 25 bp, Mus musculus
cagactatgagttcacagagggcac

SEQ ID NO: 85081 - DNA, 25 bp, Mus musculus
cagactatgatgaatcgggagggcc

SEQ ID NO: 85082 - DNA, 25 bp, Mus musculus
cagactcatgggttgggactaaatc

SEQ ID NO: 85083 - DNA, 25 bp, Mus musculus
cagactccaatagaatggtgtcacc

SEQ ID NO: 85084 - DNA, 25 bp, Mus musculus
cagactcccataggtgtacaggccg

SEQ ID NO: 85085 - DNA, 25 bp, Mus musculus
cagactccgcactgtgagatgctta

SEQ ID NO: 85086 - DNA, 25 bp, Mus musculus
cagactcctgtaaaaagcaaggaag

SEQ ID NO: 85087 - DNA, 25 bp, Mus musculus
cagactcgacaagctattggccaaa

SEQ ID NO: 85088 - DNA, 25 bp, Mus musculus
cagactcgagagttgagcgcttcaa

SEQ ID NO: 85089 - DNA, 25 bp, Mus musculus
cagactcgagtgaaagggtccctca

SEQ ID NO: 85090 - DNA, 25 bp, Mus musculus
cagactcggctagcaactcagctga

SEQ ID NO: 85091 - DNA, 25 bp, Mus musculus
cagactcgggacaccaactttggca

SEQ ID NO: 85092 - DNA, 25 bp, Mus musculus
cagactctgcctttgcttgggtaca

SEQ ID NO: 85093 - DNA, 25 bp, Mus musculus
cagactctgggtttcgggaaggcct

SEQ ID NO: 85094 - DNA, 25 bp, Mus musculus
cagactctggtactgaactgggcca

SEQ ID NO: 85095 - DNA, 25 bp, Mus musculus
cagactctgtggatgcggtccagga

SEQ ID NO: 85096 - DNA, 25 bp, Mus musculus
cagactcttaatgttggcccgtgga

SEQ ID NO: 85097 - DNA, 25 bp, Mus musculus
cagactcttgatcgtggctggatcc

SEQ ID NO: 85098 - DNA, 25 bp, Mus musculus
cagactgaattttacgaagcgctcc

SEQ ID NO: 85099 - DNA, 25 bp, Mus musculus
cagactgactcctaaactgatggaa

SEQ ID NO: 85100 - DNA, 25 bp, Mus musculus
cagactgagtgcacaagaacgacct

SEQ ID NO: 85101 - DNA, 25 bp, Mus musculus
cagactgcagaagacgccatgcaga

SEQ ID NO: 85102 - DNA, 25 bp, Mus musculus
cagactgccggccatattgggagaa

SEQ ID NO: 85103 - DNA, 25 bp, Mus musculus
cagactgcttggacatggaccccaa

SEQ ID NO: 85104 - DNA, 25 bp, Mus musculus
cagactggacagagccgtggctcct

SEQ ID NO: 85105 - DNA, 25 bp, Mus musculus
cagactggagaagcggtacattgct

SEQ ID NO: 85106 - DNA, 25 bp, Mus musculus
cagactggcgtgtttgagtactaca

SEQ ID NO: 85107 - DNA, 25 bp, Mus musculus
cagactggtcgtagtaaaaaatgga

SEQ ID NO: 85108 - DNA, 25 bp, Mus musculus
cagactggtgtgtggcagctgaccc

SEQ ID NO: 85109 - DNA, 25 bp, Mus musculus
cagactgtaatatctccaggaccga

SEQ ID NO: 85110 - DNA, 25 bp, Mus musculus
cagactgtactgttgacccgaagga

SEQ ID NO: 85111 - DNA, 25 bp, Mus musculus
cagactgtacttaatatcctaagca

SEQ ID NO: 85112 - DNA, 25 bp, Mus musculus
cagactgtatagaatgtgcgaccaa

SEQ ID NO: 85113 - DNA, 25 bp, Mus musculus
cagactgtcagaggaaagacaccac

SEQ ID NO: 85114 - DNA, 25 bp, Mus musculus
cagactgtcctggataacaccgaag

SEQ ID NO: 85115 - DNA, 25 bp, Mus musculus
cagactgtgagattggacccattgg

SEQ ID NO: 85116 - DNA, 25 bp, Mus musculus
cagactgtgccttcatggtggacaa

SEQ ID NO: 85117 - DNA, 25 bp, Mus musculus
cagactgtgctagtccgggtggtcc

SEQ ID NO: 85118 - DNA, 25 bp, Mus musculus
cagactgtggacttcgtcagcagga

SEQ ID NO: 85119 - DNA, 25 bp, Mus musculus
cagactgttcgtgcatgtccgccga

SEQ ID NO: 85120 - DNA, 25 bp, Mus musculus
cagacttagcatggagcacggactc

SEQ ID NO: 85121 - DNA, 25 bp, Mus musculus
cagacttaggcgtggtgactctcgt

SEQ ID NO: 85122 - DNA, 25 bp, Mus musculus
cagacttcagaatgacggcatgaca

SEQ ID NO: 85123 - DNA, 25 bp, Mus musculus
cagacttcagggatctcgaggccaa

SEQ ID NO: 85124 - DNA, 25 bp, Mus musculus
cagacttcagttcgaaactcatggg

SEQ ID NO: 85125 - DNA, 25 bp, Mus musculus
cagacttcgtgcgaaccttggcaga

SEQ ID NO: 85126 - DNA, 25 bp, Mus musculus
cagacttggtgcaatggactcgaca

SEQ ID NO: 85127 - DNA, 25 bp, Mus musculus
cagactttacgggagatgctggaga

SEQ ID NO: 85128 - DNA, 25 bp, Mus musculus
cagacttttaccaaggagtggcccg

SEQ ID NO: 85129 - DNA, 25 bp, Mus musculus
cagacttttccttgttatagtagca

SEQ ID NO: 85130 - DNA, 25 bp, Mus musculus
cagagaaacgctatttccccgagtc

SEQ ID NO: 85131 - DNA, 25 bp, Mus musculus
cagagaaacgctggcccatcgtgta

SEQ ID NO: 85132 - DNA, 25 bp, Mus musculus
cagagaaagagcgacttgaacgcca

SEQ ID NO: 85133 - DNA, 25 bp, Mus musculus
cagagaacacctacctcttgttgga

SEQ ID NO: 85134 - DNA, 25 bp, Mus musculus
cagagaacagagtctttggcaagct

SEQ ID NO: 85135 - DNA, 25 bp, Mus musculus
cagagaacaggtagaacggaacgag

SEQ ID NO: 85136 - DNA, 25 bp, Mus musculus
cagagaacaggtgaagagacgagcc

SEQ ID NO: 85137 - DNA, 25 bp, Mus musculus
cagagaacgactggacactgaggac

SEQ ID NO: 85138 - DNA, 25 bp, Mus musculus
cagagaacggtgtgtcctcccggat

SEQ ID NO: 85139 - DNA, 25 bp, Mus musculus
cagagaacgtagatgtggccgtgca

SEQ ID NO: 85140 - DNA, 25 bp, Mus musculus
cagagaacgttcagtgtgcacctta

SEQ ID NO: 85141 - DNA, 25 bp, Mus musculus
cagagaactacaactacgatgatga

SEQ ID NO: 85142 - DNA, 25 bp, Mus musculus
cagagaactgaggaatccaggagca

SEQ ID NO: 85143 - DNA, 25 bp, Mus musculus
cagagaagaactgctgtgtgcggca

SEQ ID NO: 85144 - DNA, 25 bp, Mus musculus
cagagaagacagctttgtatggtac

SEQ ID NO: 85145 - DNA, 25 bp, Mus musculus
cagagaagagggactgataggccca

SEQ ID NO: 85146 - DNA, 25 bp, Mus musculus
cagagaagccctgcagaactggatg

SEQ ID NO: 85147 - DNA, 25 bp, Mus musculus
cagagaaggcgttttgggacagatc

SEQ ID NO: 85148 - DNA, 25 bp, Mus musculus
cagagaaggctcatagtcgaggcaa

SEQ ID NO: 85149 - DNA, 25 bp, Mus musculus
cagagaaggttccagcactgctaca

SEQ ID NO: 85150 - DNA, 25 bp, Mus musculus
cagagaaggttgagactccgtcccc

SEQ ID NO: 85151 - DNA, 25 bp, Mus musculus
cagagaagtaacatatacatataag

SEQ ID NO: 85152 - DNA, 25 bp, Mus musculus
cagagaagtccttgatgctggtagg

SEQ ID NO: 85153 - DNA, 25 bp, Mus musculus
cagagaagtctgtgcgggtctttga

SEQ ID NO: 85154 - DNA, 25 bp, Mus musculus
cagagaagtttttagaggtcccagc

SEQ ID NO: 85155 - DNA, 25 bp, Mus musculus
cagagaatcgacaaggccaagtagc

SEQ ID NO: 85156 - DNA, 25 bp, Mus musculus
cagagaatctacaacaggccagtgc

SEQ ID NO: 85157 - DNA, 25 bp, Mus musculus
cagagaatgttctgcaccctctgat

SEQ ID NO: 85158 - DNA, 25 bp, Mus musculus
cagagaattaagttgccttattaga

SEQ ID NO: 85159 - DNA, 25 bp, Mus musculus
cagagaattcactgagcgcgagcag

SEQ ID NO: 85160 - DNA, 25 bp, Mus musculus
cagagaattccaactacgacagagg

SEQ ID NO: 85161 - DNA, 25 bp, Mus musculus
cagagacaagggttctgggatctca

SEQ ID NO: 85162 - DNA, 25 bp, Mus musculus
cagagacaattctccggatcaggac

SEQ ID NO: 85163 - DNA, 25 bp, Mus musculus
cagagacagcagtagacctggcaga

SEQ ID NO: 85164 - DNA, 25 bp, Mus musculus
cagagacagccttggatgaaattaa

SEQ ID NO: 85165 - DNA, 25 bp, Mus musculus
cagagacagtcgagtatcagagcaa

SEQ ID NO: 85166 - DNA, 25 bp, Mus musculus
cagagacatccggttggcatggaca

SEQ ID NO: 85167 - DNA, 25 bp, Mus musculus
cagagacatgctgatcaaccccaag

SEQ ID NO: 85168 - DNA, 25 bp, Mus musculus
cagagacattgatactgctgccaaa

SEQ ID NO: 85169 - DNA, 25 bp, Mus musculus
cagagacatttgaggtggccacatg

SEQ ID NO: 85170 - DNA, 25 bp, Mus musculus
cagagaccactggagctaaggccta

SEQ ID NO: 85171 - DNA, 25 bp, Mus musculus
cagagaccaggtaggatttccggga

SEQ ID NO: 85172 - DNA, 25 bp, Mus musculus
cagagaccatgggatccacagagac

SEQ ID NO: 85173 - DNA, 25 bp, Mus musculus
cagagaccccgatcaagttactcag

SEQ ID NO: 85174 - DNA, 25 bp, Mus musculus
cagagacccttcagaataatgtcac

SEQ ID NO: 85175 - DNA, 25 bp, Mus musculus
cagagaccgatggtatcaggcagac

SEQ ID NO: 85176 - DNA, 25 bp, Mus musculus
cagagaccgctcagtgtatgtcccc

SEQ ID NO: 85177 - DNA, 25 bp, Mus musculus
cagagaccggaaaactcaggagagt

SEQ ID NO: 85178 - DNA, 25 bp, Mus musculus
cagagaccgtgcatacagctgtgcg

SEQ ID NO: 85179 - DNA, 25 bp, Mus musculus
cagagacctatttgtggacctcgtg

SEQ ID NO: 85180 - DNA, 25 bp, Mus musculus
cagagacgcattaagctaggcttca

SEQ ID NO: 85181 - DNA, 25 bp, Mus musculus
cagagacggcagacatgattggcgt

SEQ ID NO: 85182 - DNA, 25 bp, Mus musculus
cagagacgggcagatgttcagatat

SEQ ID NO: 85183 - DNA, 25 bp, Mus musculus
cagagacggtgcagcggatcattta

SEQ ID NO: 85184 - DNA, 25 bp, Mus musculus
cagagactaccagaatgctatgcgg

SEQ ID NO: 85185 - DNA, 25 bp, Mus musculus
cagagactccagctactgtgggaac

SEQ ID NO: 85186 - DNA, 25 bp, Mus musculus
cagagactcctagttcagtgatagc

SEQ ID NO: 85187 - DNA, 25 bp, Mus musculus
cagagactccttgaacaactaagac

SEQ ID NO: 85188 - DNA, 25 bp, Mus musculus
cagagactcgtttcccagtggtcag

SEQ ID NO: 85189 - DNA, 25 bp, Mus musculus
cagagactgcaggtgttacaggaag

SEQ ID NO: 85190 - DNA, 25 bp, Mus musculus
cagagactgccctcgttttgaagaa

SEQ ID NO: 85191 - DNA, 25 bp, Mus musculus
cagagactgggaaccgcgtcccctt

SEQ ID NO: 85192 - DNA, 25 bp, Mus musculus
cagagactgtattcatcgtggagat

SEQ ID NO: 85193 - DNA, 25 bp, Mus musculus
cagagactgtcaccaaggaacgaga

SEQ ID NO: 85194 - DNA, 25 bp, Mus musculus
cagagactgtcgttctgacccagca

SEQ ID NO: 85195 - DNA, 25 bp, Mus musculus
cagagacttctggatgcgagcacct

SEQ ID NO: 85196 - DNA, 25 bp, Mus musculus
cagagactttttcccataactatta

SEQ ID NO: 85197 - DNA, 25 bp, Mus musculus
cagagagaacgtgcccaatgggaca

SEQ ID NO: 85198 - DNA, 25 bp, Mus musculus
cagagagaataccagctagtgaaac

SEQ ID NO: 85199 - DNA, 25 bp, Mus musculus
cagagagacccactgccagtgactg

SEQ ID NO: 85200 - DNA, 25 bp, Mus musculus
cagagagagaaaaaccgcaggctct

SEQ ID NO: 85201 - DNA, 25 bp, Mus musculus
cagagagatcccagctaagacagtt

SEQ ID NO: 85202 - DNA, 25 bp, Mus musculus
cagagagatctggtgcagactcccc

SEQ ID NO: 85203 - DNA, 25 bp, Mus musculus
cagagagatcttctaatgttgggac

SEQ ID NO: 85204 - DNA, 25 bp, Mus musculus
cagagagattgcatggcccctgtct

SEQ ID NO: 85205 - DNA, 25 bp, Mus musculus
cagagagcagagaacgactggacac

SEQ ID NO: 85206 - DNA, 25 bp, Mus musculus
cagagagcagcatcatcttgtggag

SEQ ID NO: 85207 - DNA, 25 bp, Mus musculus
cagagagcagcgagtttcagggcct

SEQ ID NO: 85208 - DNA, 25 bp, Mus musculus
cagagagcagctaaagaagtccaac

SEQ ID NO: 85209 - DNA, 25 bp, Mus musculus
cagagagcccatgtcacagcgtagt

SEQ ID NO: 85210 - DNA, 25 bp, Mus musculus
cagagagctcgtagacaggacaatc

SEQ ID NO: 85211 - DNA, 25 bp, Mus musculus
cagagagctctaatggcaatgagac

SEQ ID NO: 85212 - DNA, 25 bp, Mus musculus
cagagagctgtgtaccatcttgcca

SEQ ID NO: 85213 - DNA, 25 bp, Mus musculus
cagagaggaaaaaggacaaagccgg

SEQ ID NO: 85214 - DNA, 25 bp, Mus musculus
cagagaggacacagcggataataca

SEQ ID NO: 85215 - DNA, 25 bp, Mus musculus
cagagaggcatttagttgatcccta

SEQ ID NO: 85216 - DNA, 25 bp, Mus musculus
cagagaggcccaagggatgaggaca

SEQ ID NO: 85217 - DNA, 25 bp, Mus musculus
cagagaggctgttcagaagttcacg

SEQ ID NO: 85218 - DNA, 25 bp, Mus musculus
cagagagggccttcagcctttggtg

SEQ ID NO: 85219 - DNA, 25 bp, Mus musculus
cagagaggtggacccactccagatt

SEQ ID NO: 85220 - DNA, 25 bp, Mus musculus
cagagaggtttaagacgttcagccc

SEQ ID NO: 85221 - DNA, 25 bp, Mus musculus
cagagagtgagctcaagttccacta

SEQ ID NO: 85222 - DNA, 25 bp, Mus musculus
cagagagtgcctgggtatgaacctt

SEQ ID NO: 85223 - DNA, 25 bp, Mus musculus
cagagataatctgcgggcatctgcc

SEQ ID NO: 85224 - DNA, 25 bp, Mus musculus
cagagatacgtgcagctcaagcagg

SEQ ID NO: 85225 - DNA, 25 bp, Mus musculus
cagagatatcgctgggtccgctggc

SEQ ID NO: 85226 - DNA, 25 bp, Mus musculus
cagagatcagtaaggaacctgagcc

SEQ ID NO: 85227 - DNA, 25 bp, Mus musculus
cagagatccattcaagcttgcagag

SEQ ID NO: 85228 - DNA, 25 bp, Mus musculus
cagagatcccagctatgatgtagcc

SEQ ID NO: 85229 - DNA, 25 bp, Mus musculus
cagagatccctttctgctgtaccaa

SEQ ID NO: 85230 - DNA, 25 bp, Mus musculus
cagagatccgacttcaaaaggcagg

SEQ ID NO: 85231 - DNA, 25 bp, Mus musculus
cagagatccgtgctatgaaggccga

SEQ ID NO: 85232 - DNA, 25 bp, Mus musculus
cagagatcctccacgacggtgatga

SEQ ID NO: 85233 - DNA, 25 bp, Mus musculus
cagagatcggccttgcagtttgcaa

SEQ ID NO: 85234 - DNA, 25 bp, Mus musculus
cagagatctggagtcaacgacccaa

SEQ ID NO: 85235 - DNA, 25 bp, Mus musculus
cagagatgcaggagattgaacagtc

SEQ ID NO: 85236 - DNA, 25 bp, Mus musculus
cagagatgccagtgttaaacaacag

SEQ ID NO: 85237 - DNA, 25 bp, Mus musculus
cagagatgcctccattgaatcatca

SEQ ID NO: 85238 - DNA, 25 bp, Mus musculus
cagagatggacaactacgagccagg

SEQ ID NO: 85239 - DNA, 25 bp, Mus musculus
cagagatgttcggaacctcccgcgt

SEQ ID NO: 85240 - DNA, 25 bp, Mus musculus
cagagattacatcaagagggtgtca

SEQ ID NO: 85241 - DNA, 25 bp, Mus musculus
cagagattgtctcatgggcccaaac

SEQ ID NO: 85242 - DNA, 25 bp, Mus musculus
cagagatttacagagcttcctttca

SEQ ID NO: 85243 - DNA, 25 bp, Mus musculus
cagagcaacttcaggccttcaggaa

SEQ ID NO: 85244 - DNA, 25 bp, Mus musculus
cagagcaagacaggaagtaccgcct

SEQ ID NO: 85245 - DNA, 25 bp, Mus musculus
cagagcaagatctgtatgtccgcct

SEQ ID NO: 85246 - DNA, 25 bp, Mus musculus
cagagcaaggaaatggcaggcctcc

SEQ ID NO: 85247 - DNA, 25 bp, Mus musculus
cagagcactattgagcctcggagac

SEQ ID NO: 85248 - DNA, 25 bp, Mus musculus
cagagcactgacacacacaggagac

SEQ ID NO: 85249 - DNA, 25 bp, Mus musculus
cagagcactgtggttcctaaaagca

SEQ ID NO: 85250 - DNA, 25 bp, Mus musculus
cagagcagagcattcacagaggact

SEQ ID NO: 85251 - DNA, 25 bp, Mus musculus
cagagcagatgctgggtcttacacc

SEQ ID NO: 85252 - DNA, 25 bp, Mus musculus
cagagcagcaagcatggtacagcgc

SEQ ID NO: 85253 - DNA, 25 bp, Mus musculus
cagagcagcagagggcctgccccag

SEQ ID NO: 85254 - DNA, 25 bp, Mus musculus
cagagcagccgccagagaaatgtct

SEQ ID NO: 85255 - DNA, 25 bp, Mus musculus
cagagcagcctctgggagatggaca

SEQ ID NO: 85256 - DNA, 25 bp, Mus musculus
cagagcaggagcacccagactatta

SEQ ID NO: 85257 - DNA, 25 bp, Mus musculus
cagagcaggcagacgagctgacgct

SEQ ID NO: 85258 - DNA, 25 bp, Mus musculus
cagagcaggcagctaagaaccgcat

SEQ ID NO: 85259 - DNA, 25 bp, Mus musculus
cagagcagtccgagagcctgactgg

SEQ ID NO: 85260 - DNA, 25 bp, Mus musculus
cagagcatataaagggagtttcacc

SEQ ID NO: 85261 - DNA, 25 bp, Mus musculus
cagagcatctcactaaaggcagcat

SEQ ID NO: 85262 - DNA, 25 bp, Mus musculus
cagagcatgaggataccccggaaat

SEQ ID NO: 85263 - DNA, 25 bp, Mus musculus
cagagcatgccatcgctgagaagag

SEQ ID NO: 85264 - DNA, 25 bp, Mus musculus
cagagcatggttctgacagcagtgc

SEQ ID NO: 85265 - DNA, 25 bp, Mus musculus
cagagcatggttgaacagctggaca

SEQ ID NO: 85266 - DNA, 25 bp, Mus musculus
cagagcattcacaggacagggaagc

SEQ ID NO: 85267 - DNA, 25 bp, Mus musculus
cagagcattcctgagtaggatgtgt

SEQ ID NO: 85268 - DNA, 25 bp, Mus musculus
cagagcattgataaccctttcaggg

SEQ ID NO: 85269 - DNA, 25 bp, Mus musculus
cagagcattggcatatcaccggagc

SEQ ID NO: 85270 - DNA, 25 bp, Mus musculus
cagagccaagcggagatttatcata

SEQ ID NO: 85271 - DNA, 25 bp, Mus musculus
cagagccaaggtatgctgaagacca

SEQ ID NO: 85272 - DNA, 25 bp, Mus musculus
cagagccagccagtcagattcagga

SEQ ID NO: 85273 - DNA, 25 bp, Mus musculus
cagagcccacagactatgactggag

SEQ ID NO: 85274 - DNA, 25 bp, Mus musculus
cagagcccgagtacagtctacctgg

SEQ ID NO: 85275 - DNA, 25 bp, Mus musculus
cagagccctaaacatcttcgacagg

SEQ ID NO: 85276 - DNA, 25 bp, Mus musculus
cagagccctgcagccctattagagt

SEQ ID NO: 85277 - DNA, 25 bp, Mus musculus
cagagccgattcctacagcatgaga

SEQ ID NO: 85278 - DNA, 25 bp, Mus musculus
cagagccgctcacaaatagaggtgt

SEQ ID NO: 85279 - DNA, 25 bp, Mus musculus
cagagcctcatgaagcccgcatggt

SEQ ID NO: 85280 - DNA, 25 bp, Mus musculus
cagagcctgactacctttagcaagg

SEQ ID NO: 85281 - DNA, 25 bp, Mus musculus
cagagcctgagggtacagctgtcca

SEQ ID NO: 85282 - DNA, 25 bp, Mus musculus
cagagcctgcaacatggagcatagg

SEQ ID NO: 85283 - DNA, 25 bp, Mus musculus
cagagcctgcgggatgccattatct

SEQ ID NO: 85284 - DNA, 25 bp, Mus musculus
cagagcctggtgacggatcagctca

SEQ ID NO: 85285 - DNA, 25 bp, Mus musculus
cagagccttcgagccgagtatgagg

SEQ ID NO: 85286 - DNA, 25 bp, Mus musculus
cagagccttggaatgtgaagacaca

SEQ ID NO: 85287 - DNA, 25 bp, Mus musculus
cagagccttgtcttccagggacaga

SEQ ID NO: 85288 - DNA, 25 bp, Mus musculus
cagagcgaagagaaagggtgtacac

SEQ ID NO: 85289 - DNA, 25 bp, Mus musculus
cagagcgaagcaaagcccagaaaac

SEQ ID NO: 85290 - DNA, 25 bp, Mus musculus
cagagcgatagccttgcagctgaga

SEQ ID NO: 85291 - DNA, 25 bp, Mus musculus
cagagcgcccagcaatggatggaca

SEQ ID NO: 85292 - DNA, 25 bp, Mus musculus
cagagcggacggaagggaccggaag

SEQ ID NO: 85293 - DNA, 25 bp, Mus musculus
cagagcggccaggagtttgctgtca

SEQ ID NO: 85294 - DNA, 25 bp, Mus musculus
cagagcggtccgttatcctcatcaa

SEQ ID NO: 85295 - DNA, 25 bp, Mus musculus
cagagcgtgctgcaggacttactga

SEQ ID NO: 85296 - DNA, 25 bp, Mus musculus
cagagcgttccttttgtcaatggca

SEQ ID NO: 85297 - DNA, 25 bp, Mus musculus
cagagctattgagcgcagtactagg

SEQ ID NO: 85298 - DNA, 25 bp, Mus musculus
cagagctcagcatcgatgtcaggga

SEQ ID NO: 85299 - DNA, 25 bp, Mus musculus
cagagctccgaagacaagtgtgcca

SEQ ID NO: 85300 - DNA, 25 bp, Mus musculus
cagagctctgaaagggggaagctcc

SEQ ID NO: 85301 - DNA, 25 bp, Mus musculus
cagagctctgggtaccgctatggca

SEQ ID NO: 85302 - DNA, 25 bp, Mus musculus
cagagctctgttacctttcaaagtt

SEQ ID NO: 85303 - DNA, 25 bp, Mus musculus
cagagctcttatcaaatcctggaga

SEQ ID NO: 85304 - DNA, 25 bp, Mus musculus
cagagctgagatggattcccgttca

SEQ ID NO: 85305 - DNA, 25 bp, Mus musculus
cagagctgatgctatccgttcaaag

SEQ ID NO: 85306 - DNA, 25 bp, Mus musculus
cagagctgcaaaatcgacaagacgc

SEQ ID NO: 85307 - DNA, 25 bp, Mus musculus
cagagctgccagaattccagcttaa

SEQ ID NO: 85308 - DNA, 25 bp, Mus musculus
cagagctgctcgttcgccaaggagc

SEQ ID NO: 85309 - DNA, 25 bp, Mus musculus
cagagctggagtgcataagtgcaca

SEQ ID NO: 85310 - DNA, 25 bp, Mus musculus
cagagctgtcaatgcaggatgagga

SEQ ID NO: 85311 - DNA, 25 bp, Mus musculus
cagagcttactcagggatcggcaga

SEQ ID NO: 85312 - DNA, 25 bp, Mus musculus
cagagcttcagtgcctggatgctgc

SEQ ID NO: 85313 - DNA, 25 bp, Mus musculus
cagagcttctgggagacctttggga

SEQ ID NO: 85314 - DNA, 25 bp, Mus musculus
cagagctttggtctgctggatccca

SEQ ID NO: 85315 - DNA, 25 bp, Mus musculus
cagaggaaccaagtgtgtcgtgatc

SEQ ID NO: 85316 - DNA, 25 bp, Mus musculus
cagaggaagccttgccgggacgcac

SEQ ID NO: 85317 - DNA, 25 bp, Mus musculus
cagaggaagccttttgatgacgcaa

SEQ ID NO: 85318 - DNA, 25 bp, Mus musculus
cagaggaatcactcaggcgagaggc

SEQ ID NO: 85319 - DNA, 25 bp, Mus musculus
cagaggaattgggtccaggtgttct

SEQ ID NO: 85320 - DNA, 25 bp, Mus musculus
cagaggacacaacggatgctccatt

SEQ ID NO: 85321 - DNA, 25 bp, Mus musculus
cagaggacgaactttcaccagcggt

SEQ ID NO: 85322 - DNA, 25 bp, Mus musculus
cagaggactccatctatagaaccac

SEQ ID NO: 85323 - DNA, 25 bp, Mus musculus
cagaggactctgacaagatgaagcc

SEQ ID NO: 85324 - DNA, 25 bp, Mus musculus
cagaggacttattgctgctgatgcg

SEQ ID NO: 85325 - DNA, 25 bp, Mus musculus
cagaggacttcgtgggaagctaaaa

SEQ ID NO: 85326 - DNA, 25 bp, Mus musculus
cagaggagagaaattagtgtgagtc

SEQ ID NO: 85327 - DNA, 25 bp, Mus musculus
cagaggagagggaatgccttgatcc

SEQ ID NO: 85328 - DNA, 25 bp, Mus musculus
cagaggagatgatgccttcagagca

SEQ ID NO: 85329 - DNA, 25 bp, Mus musculus
cagaggagcccagtgtatatgctac

SEQ ID NO: 85330 - DNA, 25 bp, Mus musculus
cagaggagccttctgtgaagccaag

SEQ ID NO: 85331 - DNA, 25 bp, Mus musculus
cagaggagcgctacatggataacaa

SEQ ID NO: 85332 - DNA, 25 bp, Mus musculus
cagaggagctatcatctcagggcca

SEQ ID NO: 85333 - DNA, 25 bp, Mus musculus
cagaggaggccatcaagggactgaa

SEQ ID NO: 85334 - DNA, 25 bp, Mus musculus
cagaggaggctgaccattgtattca

SEQ ID NO: 85335 - DNA, 25 bp, Mus musculus
cagaggagttctttcccaagaagac

SEQ ID NO: 85336 - DNA, 25 bp, Mus musculus
cagaggagttgccacctgttactgt

SEQ ID NO: 85337 - DNA, 25 bp, Mus musculus
cagaggatccgctcaaaggcttacc

SEQ ID NO: 85338 - DNA, 25 bp, Mus musculus
cagaggatgagaagatgccgcccta

SEQ ID NO: 85339 - DNA, 25 bp, Mus musculus
cagaggatgagatgtcccgggccac

SEQ ID NO: 85340 - DNA, 25 bp, Mus musculus
cagaggatgcagttcttcggacgcc

SEQ ID NO: 85341 - DNA, 25 bp, Mus musculus
cagaggatggtttccgtaaagctca

SEQ ID NO: 85342 - DNA, 25 bp, Mus musculus
cagaggcacatcagtgacctgtacg

SEQ ID NO: 85343 - DNA, 25 bp, Mus musculus
cagaggcagccagcttgagcgcaca

SEQ ID NO: 85344 - DNA, 25 bp, Mus musculus
cagaggcagcgtgtgtatcccaagt

SEQ ID NO: 85345 - DNA, 25 bp, Mus musculus
cagaggcagtgctgcgacctctcta

SEQ ID NO: 85346 - DNA, 25 bp, Mus musculus
cagaggcagtgtcccacattcagag

SEQ ID NO: 85347 - DNA, 25 bp, Mus musculus
cagaggcagtttgatgtggacattc

SEQ ID NO: 85348 - DNA, 25 bp, Mus musculus
cagaggccacaaactagggctgggc

SEQ ID NO: 85349 - DNA, 25 bp, Mus musculus
cagaggccagttgctgcatcagctg

SEQ ID NO: 85350 - DNA, 25 bp, Mus musculus
cagaggccgcatggtggtagcatct

SEQ ID NO: 85351 - DNA, 25 bp, Mus musculus
cagaggcctggaacgtagacgacat

SEQ ID NO: 85352 - DNA, 25 bp, Mus musculus
cagaggcctggtgcagaacgacttc

SEQ ID NO: 85353 - DNA, 25 bp, Mus musculus
cagaggccttactgcaggaatttca

SEQ ID NO: 85354 - DNA, 25 bp, Mus musculus
cagaggccttgcagtgccaagaaga

SEQ ID NO: 85355 - DNA, 25 bp, Mus musculus
cagaggcggcttcaatacaagtagg

SEQ ID NO: 85356 - DNA, 25 bp, Mus musculus
cagaggcggtgaagcgactcttacc

SEQ ID NO: 85357 - DNA, 25 bp, Mus musculus
cagaggcgtggcatctacagaagag

SEQ ID NO: 85358 - DNA, 25 bp, Mus musculus
cagaggctcaagacaagcatgggca

SEQ ID NO: 85359 - DNA, 25 bp, Mus musculus
cagaggctctacatagtggctcggc

SEQ ID NO: 85360 - DNA, 25 bp, Mus musculus
cagaggctctcccttcgactgaggg

SEQ ID NO: 85361 - DNA, 25 bp, Mus musculus
cagaggctgaaaccccatagctgtt

SEQ ID NO: 85362 - DNA, 25 bp, Mus musculus
cagaggctgctgtttgaggcatgct

SEQ ID NO: 85363 - DNA, 25 bp, Mus musculus
cagaggcttcttcctacctggtgga

SEQ ID NO: 85364 - DNA, 25 bp, Mus musculus
cagaggcttcttgtacagattcgtc

SEQ ID NO: 85365 - DNA, 25 bp, Mus musculus
cagaggcttgtggaaatagttcacc

SEQ ID NO: 85366 - DNA, 25 bp, Mus musculus
cagagggaagcattctacatgcatg

SEQ ID NO: 85367 - DNA, 25 bp, Mus musculus
cagagggaccataaacctcaagagg

SEQ ID NO: 85368 - DNA, 25 bp, Mus musculus
cagagggaccggaaagctgttgcca

SEQ ID NO: 85369 - DNA, 25 bp, Mus musculus
cagagggagcctatcacaagaaaag

SEQ ID NO: 85370 - DNA, 25 bp, Mus musculus
cagagggatcagacatatggcaaca

SEQ ID NO: 85371 - DNA, 25 bp, Mus musculus
cagagggattgtatcatggactaca

SEQ ID NO: 85372 - DNA, 25 bp, Mus musculus
cagagggccagcttgaggtacagac

SEQ ID NO: 85373 - DNA, 25 bp, Mus musculus
cagagggcgagctatggcacattca

SEQ ID NO: 85374 - DNA, 25 bp, Mus musculus
cagagggcgccttaaccaagaggat

SEQ ID NO: 85375 - DNA, 25 bp, Mus musculus
cagaggggtctggaccaacaggaaa

SEQ ID NO: 85376 - DNA, 25 bp, Mus musculus
cagagggtagccactgtttgtcaca

SEQ ID NO: 85377 - DNA, 25 bp, Mus musculus
cagagggtcaaacaagcgtgcttcc

SEQ ID NO: 85378 - DNA, 25 bp, Mus musculus
cagagggtccagctgttcacacaag

SEQ ID NO: 85379 - DNA, 25 bp, Mus musculus
cagagggtcgtcgttgccaaagaaa

SEQ ID NO: 85380 - DNA, 25 bp, Mus musculus
cagagggtgctgacttgcactggcc

SEQ ID NO: 85381 - DNA, 25 bp, Mus musculus
cagagggtgtcataagttgcagtcc

SEQ ID NO: 85382 - DNA, 25 bp, Mus musculus
cagaggtagaagagagtatcaacag

SEQ ID NO: 85383 - DNA, 25 bp, Mus musculus
cagaggtcatctgcccgtggagaaa

SEQ ID NO: 85384 - DNA, 25 bp, Mus musculus
cagaggtcattctcggcatgggcta

SEQ ID NO: 85385 - DNA, 25 bp, Mus musculus
cagaggtccatcgtgaaaaactggc

SEQ ID NO: 85386 - DNA, 25 bp, Mus musculus
cagaggtcctggaagaagctaacac

SEQ ID NO: 85387 - DNA, 25 bp, Mus musculus
cagaggtctaggtccttcactggga

SEQ ID NO: 85388 - DNA, 25 bp, Mus musculus
cagaggtctagtggactttatgaac

SEQ ID NO: 85389 - DNA, 25 bp, Mus musculus
cagaggtgacggagaatgtcacaga

SEQ ID NO: 85390 - DNA, 25 bp, Mus musculus
cagaggtgatcctgcgagtggacaa

SEQ ID NO: 85391 - DNA, 25 bp, Mus musculus
cagaggtggttcttcaaggagcgca

SEQ ID NO: 85392 - DNA, 25 bp, Mus musculus
cagaggtgtctggaacttgagagcc

SEQ ID NO: 85393 - DNA, 25 bp, Mus musculus
cagaggttctcgcagcttacatggg

SEQ ID NO: 85394 - DNA, 25 bp, Mus musculus
cagaggtttcccatgctctctggaa

SEQ ID NO: 85395 - DNA, 25 bp, Mus musculus
cagaggtttttggtcggccggagcg

SEQ ID NO: 85396 - DNA, 25 bp, Mus musculus
cagagtaaagccaggcatgtgttgc

SEQ ID NO: 85397 - DNA, 25 bp, Mus musculus
cagagtaacgccatcctgagataca

SEQ ID NO: 85398 - DNA, 25 bp, Mus musculus
cagagtacagggaatgactacggca

SEQ ID NO: 85399 - DNA, 25 bp, Mus musculus
cagagtagctaaacgtgccagagct

SEQ ID NO: 85400 - DNA, 25 bp, Mus musculus
cagagtaggtgacccgacgacgcat

SEQ ID NO: 85401 - DNA, 25 bp, Mus musculus
cagagtatacagagtcccttatgga

SEQ ID NO: 85402 - DNA, 25 bp, Mus musculus
cagagtatatccagtatatgcgaag

SEQ ID NO: 85403 - DNA, 25 bp, Mus musculus
cagagtatcatggaagacgacgccc

SEQ ID NO: 85404 - DNA, 25 bp, Mus musculus
cagagtatttggaaccactggccac

SEQ ID NO: 85405 - DNA, 25 bp, Mus musculus
cagagtcacgtgtgagccaaagatg

SEQ ID NO: 85406 - DNA, 25 bp, Mus musculus
cagagtcagagaaggccatccactt

SEQ ID NO: 85407 - DNA, 25 bp, Mus musculus
cagagtcagcagaccagcccttgtt

SEQ ID NO: 85408 - DNA, 25 bp, Mus musculus
cagagtcagggtgctattgaacatc

SEQ ID NO: 85409 - DNA, 25 bp, Mus musculus
cagagtcatctcttacacaccacag

SEQ ID NO: 85410 - DNA, 25 bp, Mus musculus
cagagtccagtcgaagattggctcc

SEQ ID NO: 85411 - DNA, 25 bp, Mus musculus
cagagtcctctgagaagaacattca

SEQ ID NO: 85412 - DNA, 25 bp, Mus musculus
cagagtcctgtagcgcagacattgg

SEQ ID NO: 85413 - DNA, 25 bp, Mus musculus
cagagtccttggagtctagccgagc

SEQ ID NO: 85414 - DNA, 25 bp, Mus musculus
cagagtcgcctcatttccagttaaa

SEQ ID NO: 85415 - DNA, 25 bp, Mus musculus
cagagtcggttgatagctgcctcca

SEQ ID NO: 85416 - DNA, 25 bp, Mus musculus
cagagtctcaacctaggtggctgca

SEQ ID NO: 85417 - DNA, 25 bp, Mus musculus
cagagtctctctggtgtcattaact

SEQ ID NO: 85418 - DNA, 25 bp, Mus musculus
cagagtctgctggatcaaaagatca

SEQ ID NO: 85419 - DNA, 25 bp, Mus musculus
cagagtctggcactgcctctcagta

SEQ ID NO: 85420 - DNA, 25 bp, Mus musculus
cagagtcttaagtcaacctgtccaa

SEQ ID NO: 85421 - DNA, 25 bp, Mus musculus
cagagtcttcaagccagagctcttc

SEQ ID NO: 85422 - DNA, 25 bp, Mus musculus
cagagtgaatcctcctgagttgccc

SEQ ID NO: 85423 - DNA, 25 bp, Mus musculus
cagagtgagaagcatcctcctggtg

SEQ ID NO: 85424 - DNA, 25 bp, Mus musculus
cagagtgagtgcattccaagaggat

SEQ ID NO: 85425 - DNA, 25 bp, Mus musculus
cagagtgcagagatcagtaaggaac

SEQ ID NO: 85426 - DNA, 25 bp, Mus musculus
cagagtgcgccgattttccggttga

SEQ ID NO: 85427 - DNA, 25 bp, Mus musculus
cagagtgcttgatgccatgctccca

SEQ ID NO: 85428 - DNA, 25 bp, Mus musculus
cagagtgcttgtgaaatcagaggcc

SEQ ID NO: 85429 - DNA, 25 bp, Mus musculus
cagagtggagccaagataactaaca

SEQ ID NO: 85430 - DNA, 25 bp, Mus musculus
cagagtggcgtcaggaaggactcca

SEQ ID NO: 85431 - DNA, 25 bp, Mus musculus
cagagtggcttccttccttcgggag

SEQ ID NO: 85432 - DNA, 25 bp, Mus musculus
cagagtgggacgaaagcttcacctt

SEQ ID NO: 85433 - DNA, 25 bp, Mus musculus
cagagtgtaatgctgtccgccaggc

SEQ ID NO: 85434 - DNA, 25 bp, Mus musculus
cagagtgtcatggatccaggctggc

SEQ ID NO: 85435 - DNA, 25 bp, Mus musculus
cagagtgtgaacatcccaagagtac

SEQ ID NO: 85436 - DNA, 25 bp, Mus musculus
cagagtgtgatccttgcctcaaaca

SEQ ID NO: 85437 - DNA, 25 bp, Mus musculus
cagagtgtggagagagttcctgccc

SEQ ID NO: 85438 - DNA, 25 bp, Mus musculus
cagagtgttcctgtcatagtacaca

SEQ ID NO: 85439 - DNA, 25 bp, Mus musculus
cagagttacctgtcctactggcaag

SEQ ID NO: 85440 - DNA, 25 bp, Mus musculus
cagagttactgctgtccgaggagga

SEQ ID NO: 85441 - DNA, 25 bp, Mus musculus
cagagttactgtctgcctgaggcaa

SEQ ID NO: 85442 - DNA, 25 bp, Mus musculus
cagagttactgttttacacggtagc

SEQ ID NO: 85443 - DNA, 25 bp, Mus musculus
cagagttagaccctcgtggacaaag

SEQ ID NO: 85444 - DNA, 25 bp, Mus musculus
cagagttaggctatgtgttccaagc

SEQ ID NO: 85445 - DNA, 25 bp, Mus musculus
cagagttatgttatcacccaaggac

SEQ ID NO: 85446 - DNA, 25 bp, Mus musculus
cagagttcatgaggaggccggacaa

SEQ ID NO: 85447 - DNA, 25 bp, Mus musculus
cagagttccggagctgtgcttctcg

SEQ ID NO: 85448 - DNA, 25 bp, Mus musculus
cagagttccgtcctgagcaagcaca

SEQ ID NO: 85449 - DNA, 25 bp, Mus musculus
cagagttcggtctggcagtgtccgc

SEQ ID NO: 85450 - DNA, 25 bp, Mus musculus
cagagttctgctacctcgaagggac

SEQ ID NO: 85451 - DNA, 25 bp, Mus musculus
cagagttgagtgagagaatggccca

SEQ ID NO: 85452 - DNA, 25 bp, Mus musculus
cagagttgtgttggatcagtttgac

SEQ ID NO: 85453 - DNA, 25 bp, Mus musculus
cagagttgttattttccagcgggaa

SEQ ID NO: 85454 - DNA, 25 bp, Mus musculus
cagagttgtttgatggaacacaccc

SEQ ID NO: 85455 - DNA, 25 bp, Mus musculus
cagagtttaccacggctttgcagcg

SEQ ID NO: 85456 - DNA, 25 bp, Mus musculus
cagagtttatcagcctggccagcca

SEQ ID NO: 85457 - DNA, 25 bp, Mus musculus
cagagtttgttcttggagccagcca

SEQ ID NO: 85458 - DNA, 25 bp, Mus musculus
cagagttttcggacgctgtcactga

SEQ ID NO: 85459 - DNA, 25 bp, Mus musculus
cagataaaagtgctgaagagagaat

SEQ ID NO: 85460 - DNA, 25 bp, Mus musculus
cagataagctggcatctcagggaga

SEQ ID NO: 85461 - DNA, 25 bp, Mus musculus
cagataagtgacctgagactggatg

SEQ ID NO: 85462 - DNA, 25 bp, Mus musculus
cagataatgagctgtgggtcgtcac

SEQ ID NO: 85463 - DNA, 25 bp, Mus musculus
cagatacaagtgacgcccggttagc

SEQ ID NO: 85464 - DNA, 25 bp, Mus musculus
cagatacagatgctgagctggacct

SEQ ID NO: 85465 - DNA, 25 bp, Mus musculus
cagatacatcaaactcaggacggga

SEQ ID NO: 85466 - DNA, 25 bp, Mus musculus
cagatacatgcagttggcagcgcca

SEQ ID NO: 85467 - DNA, 25 bp, Mus musculus
cagataccatcttggacatgcggtc

SEQ ID NO: 85468 - DNA, 25 bp, Mus musculus
cagataccccgtgggcaagttcttc

SEQ ID NO: 85469 - DNA, 25 bp, Mus musculus
cagatacgccttgcagtctcagcag

SEQ ID NO: 85470 - DNA, 25 bp, Mus musculus
cagatacggctgaaagggtcctgga

SEQ ID NO: 85471 - DNA, 25 bp, Mus musculus
cagatactgaagatacagagcccaa

SEQ ID NO: 85472 - DNA, 25 bp, Mus musculus
cagatacttggataagcatgggaca

SEQ ID NO: 85473 - DNA, 25 bp, Mus musculus
cagatagaaatgctttaagttcgct

SEQ ID NO: 85474 - DNA, 25 bp, Mus musculus
cagatagagagattccagcagggac

SEQ ID NO: 85475 - DNA, 25 bp, Mus musculus
cagatagaggacaatgaccaggccc

SEQ ID NO: 85476 - DNA, 25 bp, Mus musculus
cagatagaggaggaattcgaccgca

SEQ ID NO: 85477 - DNA, 25 bp, Mus musculus
cagatagatataaaaaacgtcagcc

SEQ ID NO: 85478 - DNA, 25 bp, Mus musculus
cagatagctgagttacccttggcca

SEQ ID NO: 85479 - DNA, 25 bp, Mus musculus
cagatagggttcaaccagtagggct

SEQ ID NO: 85480 - DNA, 25 bp, Mus musculus
cagatatcaagaaatgtaaacgtgt

SEQ ID NO: 85481 - DNA, 25 bp, Mus musculus
cagatatcctatcagcatgcagcgg

SEQ ID NO: 85482 - DNA, 25 bp, Mus musculus
cagatatctaccattaggctcctaa

SEQ ID NO: 85483 - DNA, 25 bp, Mus musculus
cagatatgaagtgaaacatgcctcc

SEQ ID NO: 85484 - DNA, 25 bp, Mus musculus
cagatatggccttttcccggcagca

SEQ ID NO: 85485 - DNA, 25 bp, Mus musculus
cagatattaatgactcctccgggaa

SEQ ID NO: 85486 - DNA, 25 bp, Mus musculus
cagatattttttctgagcagaaagc

SEQ ID NO: 85487 - DNA, 25 bp, Mus musculus
cagatcaaatggcacaggaagcagc

SEQ ID NO: 85488 - DNA, 25 bp, Mus musculus
cagatcaagatcgagcaggaggcgc

SEQ ID NO: 85489 - DNA, 25 bp, Mus musculus
cagatcacctacaggaaagagggcc

SEQ ID NO: 85490 - DNA, 25 bp, Mus musculus
cagatcacgttcaaagggccaaggt

SEQ ID NO: 85491 - DNA, 25 bp, Mus musculus
cagatcagaccgacagctctgggca

SEQ ID NO: 85492 - DNA, 25 bp, Mus musculus
cagatcagagcaatgctggagccca

SEQ ID NO: 85493 - DNA, 25 bp, Mus musculus
cagatcagctgaaactctactcgga

SEQ ID NO: 85494 - DNA, 25 bp, Mus musculus
cagatcagtgacagattttggtgta

SEQ ID NO: 85495 - DNA, 25 bp, Mus musculus
cagatcagttggttgactggacaca

SEQ ID NO: 85496 - DNA, 25 bp, Mus musculus
cagatcatcaaaaagcacgctgcac

SEQ ID NO: 85497 - DNA, 25 bp, Mus musculus
cagatcatcctgaagaccgtggagg

SEQ ID NO: 85498 - DNA, 25 bp, Mus musculus
cagatcatctgtgtgacgctcaagg

SEQ ID NO: 85499 - DNA, 25 bp, Mus musculus
cagatcatgttctcggttcccggga

SEQ ID NO: 85500 - DNA, 25 bp, Mus musculus
cagatcattgtcactcggaagggca

SEQ ID NO: 85501 - DNA, 25 bp, Mus musculus
cagatccacagttcacgtacacggg

SEQ ID NO: 85502 - DNA, 25 bp, Mus musculus
cagatccagagagcttttgtcccca

SEQ ID NO: 85503 - DNA, 25 bp, Mus musculus
cagatccagatgcagagctccagag

SEQ ID NO: 85504 - DNA, 25 bp, Mus musculus
cagatccagtggcttcacagctcag

SEQ ID NO: 85505 - DNA, 25 bp, Mus musculus
cagatcccattgaacagtggaacaa

SEQ ID NO: 85506 - DNA, 25 bp, Mus musculus
cagatcccctgcgattggtgttaca

SEQ ID NO: 85507 - DNA, 25 bp, Mus musculus
cagatccctccttgtgagcagctgg

SEQ ID NO: 85508 - DNA, 25 bp, Mus musculus
cagatccctgaaaggctactggagc

SEQ ID NO: 85509 - DNA, 25 bp, Mus musculus
cagatccgggacatgcttatgcagt

SEQ ID NO: 85510 - DNA, 25 bp, Mus musculus
cagatcctctggtttcggggcctca

SEQ ID NO: 85511 - DNA, 25 bp, Mus musculus
cagatcctgcaagaggaaggcccaa

SEQ ID NO: 85512 - DNA, 25 bp, Mus musculus
cagatcctggcaagacctgagtgca

SEQ ID NO: 85513 - DNA, 25 bp, Mus musculus
cagatcctggcagtaggtggtacca

SEQ ID NO: 85514 - DNA, 25 bp, Mus musculus
cagatcctgggagtgccccgaaatg

SEQ ID NO: 85515 - DNA, 25 bp, Mus musculus
cagatcctggtggagaggcccatgc

SEQ ID NO: 85516 - DNA, 25 bp, Mus musculus
cagatccttcggagcctggtttcgg

SEQ ID NO: 85517 - DNA, 25 bp, Mus musculus
cagatcgagaaacagcggcagcaaa

SEQ ID NO: 85518 - DNA, 25 bp, Mus musculus
cagatcgtagtcatgagaagccaga

SEQ ID NO: 85519 - DNA, 25 bp, Mus musculus
cagatcgtcttgcttttggagtggc

SEQ ID NO: 85520 - DNA, 25 bp, Mus musculus
cagatctaccagtacgtggccgaca

SEQ ID NO: 85521 - DNA, 25 bp, Mus musculus
cagatctactacacacgatgtgcag

SEQ ID NO: 85522 - DNA, 25 bp, Mus musculus
cagatctatgtgtttgggccaccct

SEQ ID NO: 85523 - DNA, 25 bp, Mus musculus
cagatctcacgaatacagcaggaat

SEQ ID NO: 85524 - DNA, 25 bp, Mus musculus
cagatctcagaagtggatatgccag

SEQ ID NO: 85525 - DNA, 25 bp, Mus musculus
cagatctccatccagcacagacaga

SEQ ID NO: 85526 - DNA, 25 bp, Mus musculus
cagatctgaaggcactggcacgaaa

SEQ ID NO: 85527 - DNA, 25 bp, Mus musculus
cagatctgagaagactgcactgcag

SEQ ID NO: 85528 - DNA, 25 bp, Mus musculus
cagatctgccttggagatgtcatga

SEQ ID NO: 85529 - DNA, 25 bp, Mus musculus
cagatctggaaacctctagaacaag

SEQ ID NO: 85530 - DNA, 25 bp, Mus musculus
cagatctggatatcatggagaagcc

SEQ ID NO: 85531 - DNA, 25 bp, Mus musculus
cagatctgggccacaaggtgtttcc

SEQ ID NO: 85532 - DNA, 25 bp, Mus musculus
cagatctttctgcttgtaaggccca

SEQ ID NO: 85533 - DNA, 25 bp, Mus musculus
cagatgaaccagagcgctttgacca

SEQ ID NO: 85534 - DNA, 25 bp, Mus musculus
cagatgaagaactgcctccgggtcc

SEQ ID NO: 85535 - DNA, 25 bp, Mus musculus
cagatgaagcgaaccggagcaatca

SEQ ID NO: 85536 - DNA, 25 bp, Mus musculus
cagatgacagggaccggtttaagca

SEQ ID NO: 85537 - DNA, 25 bp, Mus musculus
cagatgacagtgacgccatggagat

SEQ ID NO: 85538 - DNA, 25 bp, Mus musculus
cagatgaccgccaacattaaggagc

SEQ ID NO: 85539 - DNA, 25 bp, Mus musculus
cagatgacctggagccgatagtgga

SEQ ID NO: 85540 - DNA, 25 bp, Mus musculus
cagatgaccttgattcggaaagtgg

SEQ ID NO: 85541 - DNA, 25 bp, Mus musculus
cagatgacggaaaggaagacccagt

SEQ ID NO: 85542 - DNA, 25 bp, Mus musculus
cagatgacggtttcaggtgccagga

SEQ ID NO: 85543 - DNA, 25 bp, Mus musculus
cagatgactaactgccccagtggaa

SEQ ID NO: 85544 - DNA, 25 bp, Mus musculus
cagatgactacaaagagggcaagcc

SEQ ID NO: 85545 - DNA, 25 bp, Mus musculus
cagatgagaaggagatgcccctggt

SEQ ID NO: 85546 - DNA, 25 bp, Mus musculus
cagatgagacaagtgggctgcctcc

SEQ ID NO: 85547 - DNA, 25 bp, Mus musculus
cagatgagccagctggtactgccct

SEQ ID NO: 85548 - DNA, 25 bp, Mus musculus
cagatgagcctggtgtgacaagaga

SEQ ID NO: 85549 - DNA, 25 bp, Mus musculus
cagatgagctggataagcctagaga

SEQ ID NO: 85550 - DNA, 25 bp, Mus musculus
cagatgaggacctaactgaggccgt

SEQ ID NO: 85551 - DNA, 25 bp, Mus musculus
cagatgagttgagtggagatgcttc

SEQ ID NO: 85552 - DNA, 25 bp, Mus musculus
cagatgatcctgatgacgggccagc

SEQ ID NO: 85553 - DNA, 25 bp, Mus musculus
cagatgatctggagtgcacccctgg

SEQ ID NO: 85554 - DNA, 25 bp, Mus musculus
cagatgatcttttccaatacgcggg

SEQ ID NO: 85555 - DNA, 25 bp, Mus musculus
cagatgatggaagcagcaacacgac

SEQ ID NO: 85556 - DNA, 25 bp, Mus musculus
cagatgcaggatgaccacgaacgca

SEQ ID NO: 85557 - DNA, 25 bp, Mus musculus
cagatgcagggctacttcaagtcag

SEQ ID NO: 85558 - DNA, 25 bp, Mus musculus
cagatgcagtccctgatggcagtga

SEQ ID NO: 85559 - DNA, 25 bp, Mus musculus
cagatgcccgccagactctgaagga

SEQ ID NO: 85560 - DNA, 25 bp, Mus musculus
cagatgccctgcagtacctacagaa

SEQ ID NO: 85561 - DNA, 25 bp, Mus musculus
cagatgcctacaccatgacgtccat

SEQ ID NO: 85562 - DNA, 25 bp, Mus musculus
cagatgcgcgctatgctggaccagt

SEQ ID NO: 85563 - DNA, 25 bp, Mus musculus
cagatgcggtacctgcagctgtgcc

SEQ ID NO: 85564 - DNA, 25 bp, Mus musculus
cagatgcggtttgaaggaggctttc

SEQ ID NO: 85565 - DNA, 25 bp, Mus musculus
cagatgctaagaaagtacctcccca

SEQ ID NO: 85566 - DNA, 25 bp, Mus musculus
cagatgctaatggacgctggcctcc

SEQ ID NO: 85567 - DNA, 25 bp, Mus musculus
cagatgctacgagacctgcgggaaa

SEQ ID NO: 85568 - DNA, 25 bp, Mus musculus
cagatgctcaagtgccacgtgtttc

SEQ ID NO: 85569 - DNA, 25 bp, Mus musculus
cagatgctcgagacagtagcttggg

SEQ ID NO: 85570 - DNA, 25 bp, Mus musculus
cagatgctctcataaggcgagttca

SEQ ID NO: 85571 - DNA, 25 bp, Mus musculus
cagatgctgagagtttattgtcatt

SEQ ID NO: 85572 - DNA, 25 bp, Mus musculus
cagatgctgagtcctggtgccaaaa

SEQ ID NO: 85573 - DNA, 25 bp, Mus musculus
cagatgctgcgaactgccatgtggg

SEQ ID NO: 85574 - DNA, 25 bp, Mus musculus
cagatgctggacaaacagtggagaa

SEQ ID NO: 85575 - DNA, 25 bp, Mus musculus
cagatgctggctatgccttggcact

SEQ ID NO: 85576 - DNA, 25 bp, Mus musculus
cagatgctgggttttcacacggtgc

SEQ ID NO: 85577 - DNA, 25 bp, Mus musculus
cagatgctggtttccacttacgggt

SEQ ID NO: 85578 - DNA, 25 bp, Mus musculus
cagatggaacaaatgccgcctggct

SEQ ID NO: 85579 - DNA, 25 bp, Mus musculus
cagatggaccgagacagtgatgtca

SEQ ID NO: 85580 - DNA, 25 bp, Mus musculus
cagatggacgactatttgggtggca

SEQ ID NO: 85581 - DNA, 25 bp, Mus musculus
cagatggacgagaagaccaagaaag

SEQ ID NO: 85582 - DNA, 25 bp, Mus musculus
cagatggacgtggatctcctgagta

SEQ ID NO: 85583 - DNA, 25 bp, Mus musculus
cagatggacttgaggccattgtcac

SEQ ID NO: 85584 - DNA, 25 bp, Mus musculus
cagatggaggcctgcagtcatttac

SEQ ID NO: 85585 - DNA, 25 bp, Mus musculus
cagatggatttggtgccgcttcgag

SEQ ID NO: 85586 - DNA, 25 bp, Mus musculus
cagatggcagatttctcagtatttc

SEQ ID NO: 85587 - DNA, 25 bp, Mus musculus
cagatggcagcactatggaggacta

SEQ ID NO: 85588 - DNA, 25 bp, Mus musculus
cagatggcccctgctggctattggg

SEQ ID NO: 85589 - DNA, 25 bp, Mus musculus
cagatggccgccacagagtgtgaac

SEQ ID NO: 85590 - DNA, 25 bp, Mus musculus
cagatggctcctgcattcacggtag

SEQ ID NO: 85591 - DNA, 25 bp, Mus musculus
cagatggctggctaaggttctcggc

SEQ ID NO: 85592 - DNA, 25 bp, Mus musculus
cagatgggaatcaggaggctcttct

SEQ ID NO: 85593 - DNA, 25 bp, Mus musculus
cagatgggagtggtcctttgcagcc

SEQ ID NO: 85594 - DNA, 25 bp, Mus musculus
cagatgggcctgagcttagcacagc

SEQ ID NO: 85595 - DNA, 25 bp, Mus musculus
cagatgggtgctccagtggtcaaac

SEQ ID NO: 85596 - DNA, 25 bp, Mus musculus
cagatggtcaccagctctcagagct

SEQ ID NO: 85597 - DNA, 25 bp, Mus musculus
cagatggtccttcgatgatgttccg

SEQ ID NO: 85598 - DNA, 25 bp, Mus musculus
cagatggtcggaggagaatcacgcc

SEQ ID NO: 85599 - DNA, 25 bp, Mus musculus
cagatgtaatgtttggagcccagaa

SEQ ID NO: 85600 - DNA, 25 bp, Mus musculus
cagatgtacagaatgcccttgagca

SEQ ID NO: 85601 - DNA, 25 bp, Mus musculus
cagatgtaggaagctggctcaagta

SEQ ID NO: 85602 - DNA, 25 bp, Mus musculus
cagatgtatggagcctacctccgga

SEQ ID NO: 85603 - DNA, 25 bp, Mus musculus
cagatgtattgtgctactacttcca

SEQ ID NO: 85604 - DNA, 25 bp, Mus musculus
cagatgtcacctttgtacagactgc

SEQ ID NO: 85605 - DNA, 25 bp, Mus musculus
cagatgtcagcctgggaagcctggc

SEQ ID NO: 85606 - DNA, 25 bp, Mus musculus
cagatgtcccaagttttagatgcca

SEQ ID NO: 85607 - DNA, 25 bp, Mus musculus
cagatgtctttgtccggttccagcc

SEQ ID NO: 85608 - DNA, 25 bp, Mus musculus
cagatgtgacatttgtagaaatggt

SEQ ID NO: 85609 - DNA, 25 bp, Mus musculus
cagatgtgatttccttactggagca

SEQ ID NO: 85610 - DNA, 25 bp, Mus musculus
cagatgtgcacgagaatgcccggac

SEQ ID NO: 85611 - DNA, 25 bp, Mus musculus
cagatgtggcctctctgaaccgccg

SEQ ID NO: 85612 - DNA, 25 bp, Mus musculus
cagatgtggtcagccttgtgcagca

SEQ ID NO: 85613 - DNA, 25 bp, Mus musculus
cagatgtggtgtctgtacacttcca

SEQ ID NO: 85614 - DNA, 25 bp, Mus musculus
cagatgtgtccgtttccccaggtgt

SEQ ID NO: 85615 - DNA, 25 bp, Mus musculus
cagatgttctacattgtgggcgcca

SEQ ID NO: 85616 - DNA, 25 bp, Mus musculus
cagatgtttattggaacagccgatg

SEQ ID NO: 85617 - DNA, 25 bp, Mus musculus
cagattaacacgcagtctccgtggg

SEQ ID NO: 85618 - DNA, 25 bp, Mus musculus
cagattaattatccggaacctcagc

SEQ ID NO: 85619 - DNA, 25 bp, Mus musculus
cagattacggcgaggaacaacgcaa

SEQ ID NO: 85620 - DNA, 25 bp, Mus musculus
cagattactgatagtggtctcagta

SEQ ID NO: 85621 - DNA, 25 bp, Mus musculus
cagattactttgaggatgaccaccc

SEQ ID NO: 85622 - DNA, 25 bp, Mus musculus
cagattaggtcaggtccagagtccc

SEQ ID NO: 85623 - DNA, 25 bp, Mus musculus
cagattatctgcagcacgtgtcgtc

SEQ ID NO: 85624 - DNA, 25 bp, Mus musculus
cagattatgtgaaggtggcaaagcc

SEQ ID NO: 85625 - DNA, 25 bp, Mus musculus
cagattatgtttgccaaggtggtca

SEQ ID NO: 85626 - DNA, 25 bp, Mus musculus
cagattcaagctttgcgccctagtg

SEQ ID NO: 85627 - DNA, 25 bp, Mus musculus
cagattcgaggtcaggactctccgg

SEQ ID NO: 85628 - DNA, 25 bp, Mus musculus
cagattctcttgaggtggccagggc

SEQ ID NO: 85629 - DNA, 25 bp, Mus musculus
cagattctgctgaaagccctcacca

SEQ ID NO: 85630 - DNA, 25 bp, Mus musculus
cagattctgtccataggctacggag

SEQ ID NO: 85631 - DNA, 25 bp, Mus musculus
cagattcttctggacagtggaccac

SEQ ID NO: 85632 - DNA, 25 bp, Mus musculus
cagattgaagcgaccagaagggaca

SEQ ID NO: 85633 - DNA, 25 bp, Mus musculus
cagattgacagcgtggttcgagcct

SEQ ID NO: 85634 - DNA, 25 bp, Mus musculus
cagattgcgtcttccctgtctaaag

SEQ ID NO: 85635 - DNA, 25 bp, Mus musculus
cagattgggattaacatgatggcac

SEQ ID NO: 85636 - DNA, 25 bp, Mus musculus
cagattgggattttgtgtcccagga

SEQ ID NO: 85637 - DNA, 25 bp, Mus musculus
cagattgtccctggaggtcggtacg

SEQ ID NO: 85638 - DNA, 25 bp, Mus musculus
cagattgtgactcctgaggcaccag

SEQ ID NO: 85639 - DNA, 25 bp, Mus musculus
cagattgtgggcacctgtcctgaca

SEQ ID NO: 85640 - DNA, 25 bp, Mus musculus
cagattgtttacacggagtccacca

SEQ ID NO: 85641 - DNA, 25 bp, Mus musculus
cagatttacccctggatgcagcgaa

SEQ ID NO: 85642 - DNA, 25 bp, Mus musculus
cagatttcacgcaacggagacgaca

SEQ ID NO: 85643 - DNA, 25 bp, Mus musculus
cagatttcagtagacccagcagacc

SEQ ID NO: 85644 - DNA, 25 bp, Mus musculus
cagatttcggttaagtggctacaga

SEQ ID NO: 85645 - DNA, 25 bp, Mus musculus
cagatttgtggtgcagccgatggaa

SEQ ID NO: 85646 - DNA, 25 bp, Mus musculus
cagattttatcatgccgcgggagaa

SEQ ID NO: 85647 - DNA, 25 bp, Mus musculus
cagattttatggaactgtgccagca

SEQ ID NO: 85648 - DNA, 25 bp, Mus musculus
cagattttgagttctacaggctcca

SEQ ID NO: 85649 - DNA, 25 bp, Mus musculus
cagattttgtctgcagcactgcgca

SEQ ID NO: 85650 - DNA, 25 bp, Mus musculus
cagatttttctcacggcttggacag

SEQ ID NO: 85651 - DNA, 25 bp, Mus musculus
cagcaaaatcggtggcattctggcc

SEQ ID NO: 85652 - DNA, 25 bp, Mus musculus
cagcaaagagctattatcccttgta

SEQ ID NO: 85653 - DNA, 25 bp, Mus musculus
cagcaaaggctgaattcccaggcca

SEQ ID NO: 85654 - DNA, 25 bp, Mus musculus
cagcaaaggtgtgattgaggagccc

SEQ ID NO: 85655 - DNA, 25 bp, Mus musculus
cagcaaagtgtacagccagagcaag

SEQ ID NO: 85656 - DNA, 25 bp, Mus musculus
cagcaaatactggacactcttaacg

SEQ ID NO: 85657 - DNA, 25 bp, Mus musculus
cagcaaatggcaagaaggtcaaagc

SEQ ID NO: 85658 - DNA, 25 bp, Mus musculus
cagcaaatggtttcccgaagggcca

SEQ ID NO: 85659 - DNA, 25 bp, Mus musculus
cagcaaatgttattgccgcagaagc

SEQ ID NO: 85660 - DNA, 25 bp, Mus musculus
cagcaacaatgtatgcgtataaaca

SEQ ID NO: 85661 - DNA, 25 bp, Mus musculus
cagcaacactgtggtagaagccagg

SEQ ID NO: 85662 - DNA, 25 bp, Mus musculus
cagcaaccagctggctactcgagag

SEQ ID NO: 85663 - DNA, 25 bp, Mus musculus
cagcaacgaaggtgacagtgagcaa

SEQ ID NO: 85664 - DNA, 25 bp, Mus musculus
cagcaacggttatgcgggagcatga

SEQ ID NO: 85665 - DNA, 25 bp, Mus musculus
cagcaacgtcagtttgagagccctc

SEQ ID NO: 85666 - DNA, 25 bp, Mus musculus
cagcaactctgatatgaatgcaaga

SEQ ID NO: 85667 - DNA, 25 bp, Mus musculus
cagcaacttcagtgagacctcggcc

SEQ ID NO: 85668 - DNA, 25 bp, Mus musculus
cagcaacttgagagataactaccga

SEQ ID NO: 85669 - DNA, 25 bp, Mus musculus
cagcaactttagactgggctttggc

SEQ ID NO: 85670 - DNA, 25 bp, Mus musculus
cagcaagaatacagccgcaaggagg

SEQ ID NO: 85671 - DNA, 25 bp, Mus musculus
cagcaagacataatgaaggttgaac

SEQ ID NO: 85672 - DNA, 25 bp, Mus musculus
cagcaagagaggattctgaggcctt

SEQ ID NO: 85673 - DNA, 25 bp, Mus musculus
cagcaagaggaacaacaggagcagc

SEQ ID NO: 85674 - DNA, 25 bp, Mus musculus
cagcaagatccggtcagtgggcaga

SEQ ID NO: 85675 - DNA, 25 bp, Mus musculus
cagcaagattgtgaagcagaaggcc

SEQ ID NO: 85676 - DNA, 25 bp, Mus musculus
cagcaagcactttccaagaaaagag

SEQ ID NO: 85677 - DNA, 25 bp, Mus musculus
cagcaagcatttgtggaacgcgaca

SEQ ID NO: 85678 - DNA, 25 bp, Mus musculus
cagcaagccatgtccttagggtgag

SEQ ID NO: 85679 - DNA, 25 bp, Mus musculus
cagcaagccgagtgactggaacagt

SEQ ID NO: 85680 - DNA, 25 bp, Mus musculus
cagcaagcggctggatgttcctcca

SEQ ID NO: 85681 - DNA, 25 bp, Mus musculus
cagcaagctcacactacccagtggg

SEQ ID NO: 85682 - DNA, 25 bp, Mus musculus
cagcaagctcagaggcaccaggtaa

SEQ ID NO: 85683 - DNA, 25 bp, Mus musculus
cagcaagctgggagtgacgtaatcc

SEQ ID NO: 85684 - DNA, 25 bp, Mus musculus
cagcaaggattttgtcggcaaggcc

SEQ ID NO: 85685 - DNA, 25 bp, Mus musculus
cagcaagggaagtcctgtgagcagc

SEQ ID NO: 85686 - DNA, 25 bp, Mus musculus
cagcaaggttctagggaggtcccct

SEQ ID NO: 85687 - DNA, 25 bp, Mus musculus
cagcaagtatgcgtctgagaggaag

SEQ ID NO: 85688 - DNA, 25 bp, Mus musculus
cagcaagtctttctaggtgcagggc

SEQ ID NO: 85689 - DNA, 25 bp, Mus musculus
cagcaagtgacctgggatcccagtc

SEQ ID NO: 85690 - DNA, 25 bp, Mus musculus
cagcaagttcttctccctggagggc

SEQ ID NO: 85691 - DNA, 25 bp, Mus musculus
cagcaatacatttgccaagctggag

SEQ ID NO: 85692 - DNA, 25 bp, Mus musculus
cagcaatcagatcagtcttggcccc

SEQ ID NO: 85693 - DNA, 25 bp, Mus musculus
cagcaatcattcaactcgaagtgga

SEQ ID NO: 85694 - DNA, 25 bp, Mus musculus
cagcaattgtgtgtcttaggagcca

SEQ ID NO: 85695 - DNA, 25 bp, Mus musculus
cagcacaaagctactgtggaggcca

SEQ ID NO: 85696 - DNA, 25 bp, Mus musculus
cagcacaacatgtcctggatcgagg

SEQ ID NO: 85697 - DNA, 25 bp, Mus musculus
cagcacagccaaggaggtctaccat

SEQ ID NO: 85698 - DNA, 25 bp, Mus musculus
cagcaccaagtttgatgaggaggac

SEQ ID NO: 85699 - DNA, 25 bp, Mus musculus
cagcaccagcaggatcatcgcagat

SEQ ID NO: 85700 - DNA, 25 bp, Mus musculus
cagcaccagggagcttgttagttcc

SEQ ID NO: 85701 - DNA, 25 bp, Mus musculus
cagcaccatggagttaagtggcaca

SEQ ID NO: 85702 - DNA, 25 bp, Mus musculus
cagcacccggaaacactgcaggagt

SEQ ID NO: 85703 - DNA, 25 bp, Mus musculus
cagcacccgggagctccattgttaa

SEQ ID NO: 85704 - DNA, 25 bp, Mus musculus
cagcaccggcagattgaggaaaccc

SEQ ID NO: 85705 - DNA, 25 bp, Mus musculus
cagcacctggtgagagaccttgagc

SEQ ID NO: 85706 - DNA, 25 bp, Mus musculus
cagcacctgttaagaccatgaccat

SEQ ID NO: 85707 - DNA, 25 bp, Mus musculus
cagcaccttccatattttatcactg

SEQ ID NO: 85708 - DNA, 25 bp, Mus musculus
cagcacgaccttttggtggacagtc

SEQ ID NO: 85709 - DNA, 25 bp, Mus musculus
cagcacgagcagaccttccgctgga

SEQ ID NO: 85710 - DNA, 25 bp, Mus musculus
cagcacgccgaggagttcaggcgca

SEQ ID NO: 85711 - DNA, 25 bp, Mus musculus
cagcacgggctgagatccagatccg

SEQ ID NO: 85712 - DNA, 25 bp, Mus musculus
cagcacggtatcgacgacagcagtg

SEQ ID NO: 85713 - DNA, 25 bp, Mus musculus
cagcacggtccagtttgtggcagag

SEQ ID NO: 85714 - DNA, 25 bp, Mus musculus
cagcacgtagtgattggacccagca

SEQ ID NO: 85715 - DNA, 25 bp, Mus musculus
cagcacgtcttaaaacatttactgc

SEQ ID NO: 85716 - DNA, 25 bp, Mus musculus
cagcactacaaccaccattattgtg

SEQ ID NO: 85717 - DNA, 25 bp, Mus musculus
cagcactagaaagaaggccggcatt

SEQ ID NO: 85718 - DNA, 25 bp, Mus musculus
cagcactatggtggtggagcacccc

SEQ ID NO: 85719 - DNA, 25 bp, Mus musculus
cagcactctaaagggaccgaaatgg

SEQ ID NO: 85720 - DNA, 25 bp, Mus musculus
cagcactgagctagagactgagccg

SEQ ID NO: 85721 - DNA, 25 bp, Mus musculus
cagcactgatggcttggttctccca

SEQ ID NO: 85722 - DNA, 25 bp, Mus musculus
cagcactgggtcctaagagctgcca

SEQ ID NO: 85723 - DNA, 25 bp, Mus musculus
cagcacttcgggaaattgccctcca

SEQ ID NO: 85724 - DNA, 25 bp, Mus musculus
cagcagaaagtagacgaaaaccctc

SEQ ID NO: 85725 - DNA, 25 bp, Mus musculus
cagcagaagatctaccacatcatta

SEQ ID NO: 85726 - DNA, 25 bp, Mus musculus
cagcagaagtttgtgccagaccggc

SEQ ID NO: 85727 - DNA, 25 bp, Mus musculus
cagcagacatgagggaacgagatca

SEQ ID NO: 85728 - DNA, 25 bp, Mus musculus
cagcagacggaaaatgacacattcg

SEQ ID NO: 85729 - DNA, 25 bp, Mus musculus
cagcagagaaagcttgatccttggt

SEQ ID NO: 85730 - DNA, 25 bp, Mus musculus
cagcagagacagagtaacacgggcc

SEQ ID NO: 85731 - DNA, 25 bp, Mus musculus
cagcagagaccgaagagacagactt

SEQ ID NO: 85732 - DNA, 25 bp, Mus musculus
cagcagagcaaccagaaggaggaca

SEQ ID NO: 85733 - DNA, 25 bp, Mus musculus
cagcagagcagccttaccattcggg

SEQ ID NO: 85734 - DNA, 25 bp, Mus musculus
cagcagagcattagaggtgcccagt

SEQ ID NO: 85735 - DNA, 25 bp, Mus musculus
cagcagagcattgccagagagccca

SEQ ID NO: 85736 - DNA, 25 bp, Mus musculus
cagcagaggagtttcagatgagccc

SEQ ID NO: 85737 - DNA, 25 bp, Mus musculus
cagcagatcaaatggcacaggaagc

SEQ ID NO: 85738 - DNA, 25 bp, Mus musculus
cagcagatctatgagtggcaccgag

SEQ ID NO: 85739 - DNA, 25 bp, Mus musculus
cagcagatggtctggagcaagccca

SEQ ID NO: 85740 - DNA, 25 bp, Mus musculus
cagcagattggaaggagacacagat

SEQ ID NO: 85741 - DNA, 25 bp, Mus musculus
cagcagcaaggcggagagtaaaagt

SEQ ID NO: 85742 - DNA, 25 bp, Mus musculus
cagcagcactgacgtggagcagtac

SEQ ID NO: 85743 - DNA, 25 bp, Mus musculus
cagcagcagagtcattcaggatata

SEQ ID NO: 85744 - DNA, 25 bp, Mus musculus
cagcagcagatgttgacggttccgg

SEQ ID NO: 85745 - DNA, 25 bp, Mus musculus
cagcagcaggctcgagaagcagaaa

SEQ ID NO: 85746 - DNA, 25 bp, Mus musculus
cagcagcagtactgatgaggaccca

SEQ ID NO: 85747 - DNA, 25 bp, Mus musculus
cagcagcagttaaacaaccttgtct

SEQ ID NO: 85748 - DNA, 25 bp, Mus musculus
cagcagcagttttgggaattttgac

SEQ ID NO: 85749 - DNA, 25 bp, Mus musculus
cagcagcatcactgtccggagtgaa

SEQ ID NO: 85750 - DNA, 25 bp, Mus musculus
cagcagcatccatagccatggagaa

SEQ ID NO: 85751 - DNA, 25 bp, Mus musculus
cagcagcattcattaccacccgatg

SEQ ID NO: 85752 - DNA, 25 bp, Mus musculus
cagcagccaagtaagccgttcctaa

SEQ ID NO: 85753 - DNA, 25 bp, Mus musculus
cagcagccaccagggaccgggagat

SEQ ID NO: 85754 - DNA, 25 bp, Mus musculus
cagcagccactaccggaaagactag

SEQ ID NO: 85755 - DNA, 25 bp, Mus musculus
cagcagccatgttgcgcagacgagt

SEQ ID NO: 85756 - DNA, 25 bp, Mus musculus
cagcagcccgcagatttaaaggaaa

SEQ ID NO: 85757 - DNA, 25 bp, Mus musculus
cagcagccttgcttggcaggagtcc

SEQ ID NO: 85758 - DNA, 25 bp, Mus musculus
cagcagcctttgagtggacgagtca

SEQ ID NO: 85759 - DNA, 25 bp, Mus musculus
cagcagcgacttcgccctgtggaag

SEQ ID NO: 85760 - DNA, 25 bp, Mus musculus
cagcagcgcaagtccaaggagatcg

SEQ ID NO: 85761 - DNA, 25 bp, Mus musculus
cagcagcggctgttgggtgaacaac

SEQ ID NO: 85762 - DNA, 25 bp, Mus musculus
cagcagcgggcatcagattacaccc

SEQ ID NO: 85763 - DNA, 25 bp, Mus musculus
cagcagcgtctgaacaaaaggaagg

SEQ ID NO: 85764 - DNA, 25 bp, Mus musculus
cagcagcgttgagagacacctttcc

SEQ ID NO: 85765 - DNA, 25 bp, Mus musculus
cagcagcgtttgcaagatgcccaag

SEQ ID NO: 85766 - DNA, 25 bp, Mus musculus
cagcagctaacactggcgagtccaa

SEQ ID NO: 85767 - DNA, 25 bp, Mus musculus
cagcagctcatgcaacatcatctgc

SEQ ID NO: 85768 - DNA, 25 bp, Mus musculus
cagcagctctggtgcctgtggtttc

SEQ ID NO: 85769 - DNA, 25 bp, Mus musculus
cagcagctgagattggaagcctcca

SEQ ID NO: 85770 - DNA, 25 bp, Mus musculus
cagcagctgcagtgactcaatggtc

SEQ ID NO: 85771 - DNA, 25 bp, Mus musculus
cagcagctggcggagtcgatgctca

SEQ ID NO: 85772 - DNA, 25 bp, Mus musculus
cagcagctggtaaggttaatacagt

SEQ ID NO: 85773 - DNA, 25 bp, Mus musculus
cagcagctgtaggatgaccgggact

SEQ ID NO: 85774 - DNA, 25 bp, Mus musculus
cagcagcttcgagtccagagggagc

SEQ ID NO: 85775 - DNA, 25 bp, Mus musculus
cagcagcttcgtgacttgggcaaat

SEQ ID NO: 85776 - DNA, 25 bp, Mus musculus
cagcagctttgatagttctcacgga

SEQ ID NO: 85777 - DNA, 25 bp, Mus musculus
cagcagctttgcagacatgatgggc

SEQ ID NO: 85778 - DNA, 25 bp, Mus musculus
cagcagctttgctaagggaccgata

SEQ ID NO: 85779 - DNA, 25 bp, Mus musculus
cagcagctttgtagatggaacgacc

SEQ ID NO: 85780 - DNA, 25 bp, Mus musculus
cagcaggaacctgatcgagaacaag

SEQ ID NO: 85781 - DNA, 25 bp, Mus musculus
cagcaggacatgaactccttcagag

SEQ ID NO: 85782 - DNA, 25 bp, Mus musculus
cagcaggagacgtgtttcagaacgg

SEQ ID NO: 85783 - DNA, 25 bp, Mus musculus
cagcaggagaggaccaaatgtgacc

SEQ ID NO: 85784 - DNA, 25 bp, Mus musculus
cagcaggagttgaaagatggcaaac

SEQ ID NO: 85785 - DNA, 25 bp, Mus musculus
cagcaggagtttaaccttccagtca

SEQ ID NO: 85786 - DNA, 25 bp, Mus musculus
cagcaggcagggactcgtagactat

SEQ ID NO: 85787 - DNA, 25 bp, Mus musculus
cagcaggctccttgcttttaaggaa

SEQ ID NO: 85788 - DNA, 25 bp, Mus musculus
cagcaggctcggtacttaaaggatc

SEQ ID NO: 85789 - DNA, 25 bp, Mus musculus
cagcaggcttccttctctgtggttg

SEQ ID NO: 85790 - DNA, 25 bp, Mus musculus
cagcagggaaggagacaaaggagtt

SEQ ID NO: 85791 - DNA, 25 bp, Mus musculus
cagcagggactactagacagagtta

SEQ ID NO: 85792 - DNA, 25 bp, Mus musculus
cagcagggctgatcgcattgaggtc

SEQ ID NO: 85793 - DNA, 25 bp, Mus musculus
cagcagggttatctcttaatggcac

SEQ ID NO: 85794 - DNA, 25 bp, Mus musculus
cagcaggtagcagtgaaacctctga

SEQ ID NO: 85795 - DNA, 25 bp, Mus musculus
cagcaggtctgaagtgggagatcca

SEQ ID NO: 85796 - DNA, 25 bp, Mus musculus
cagcaggtgaagcaaatcgtgagca

SEQ ID NO: 85797 - DNA, 25 bp, Mus musculus
cagcaggttccttggcccagacaag

SEQ ID NO: 85798 - DNA, 25 bp, Mus musculus
cagcaggttgctcttcttaaggaga

SEQ ID NO: 85799 - DNA, 25 bp, Mus musculus
cagcagtaacctcgtggtcctggag

SEQ ID NO: 85800 - DNA, 25 bp, Mus musculus
cagcagtaagcatacggtggaagca

SEQ ID NO: 85801 - DNA, 25 bp, Mus musculus
cagcagtactaccaagccttgggca

SEQ ID NO: 85802 - DNA, 25 bp, Mus musculus
cagcagtagactccacagattcagg

SEQ ID NO: 85803 - DNA, 25 bp, Mus musculus
cagcagtctagaattgttcagagcc

SEQ ID NO: 85804 - DNA, 25 bp, Mus musculus
cagcagtctagttcttagcccaggg

SEQ ID NO: 85805 - DNA, 25 bp, Mus musculus
cagcagtgaacggaagctcctggag

SEQ ID NO: 85806 - DNA, 25 bp, Mus musculus
cagcagtgaatcatgggaatccccg

SEQ ID NO: 85807 - DNA, 25 bp, Mus musculus
cagcagtgagctcagcacggaagct

SEQ ID NO: 85808 - DNA, 25 bp, Mus musculus
cagcagtgagtcttcggacagttca

SEQ ID NO: 85809 - DNA, 25 bp, Mus musculus
cagcagtgataagcaggtggagaca

SEQ ID NO: 85810 - DNA, 25 bp, Mus musculus
cagcagtgctcagtgggaatgttaa

SEQ ID NO: 85811 - DNA, 25 bp, Mus musculus
cagcagtgctgggtactttagccac

SEQ ID NO: 85812 - DNA, 25 bp, Mus musculus
cagcagtggcagtaacagtggtggg

SEQ ID NO: 85813 - DNA, 25 bp, Mus musculus
cagcagtggcgttgacatcgttggc

SEQ ID NO: 85814 - DNA, 25 bp, Mus musculus
cagcagtgtgatccccatggaagcc

SEQ ID NO: 85815 - DNA, 25 bp, Mus musculus
cagcagttacaatatgggcagcagc

SEQ ID NO: 85816 - DNA, 25 bp, Mus musculus
cagcagttgcgatgcactgaggcaa

SEQ ID NO: 85817 - DNA, 25 bp, Mus musculus
cagcagttgcgtgacatgggcatcc

SEQ ID NO: 85818 - DNA, 25 bp, Mus musculus
cagcagttgctgtcctgggcacaga

SEQ ID NO: 85819 - DNA, 25 bp, Mus musculus
cagcagttgtgaaaagtgggtacca

SEQ ID NO: 85820 - DNA, 25 bp, Mus musculus
cagcagtttgacgacctcttccggg

SEQ ID NO: 85821 - DNA, 25 bp, Mus musculus
cagcagtttgactgtgagccaggag

SEQ ID NO: 85822 - DNA, 25 bp, Mus musculus
cagcatatagttcttttgtaaacct

SEQ ID NO: 85823 - DNA, 25 bp, Mus musculus
cagcatatgtgagtgggacaaaccc

SEQ ID NO: 85824 - DNA, 25 bp, Mus musculus
cagcatcaagccatctaccatgtgg

SEQ ID NO: 85825 - DNA, 25 bp, Mus musculus
cagcatcaccgagggtgtcaccgag

SEQ ID NO: 85826 - DNA, 25 bp, Mus musculus
cagcatcagcaggaggaccagtttc

SEQ ID NO: 85827 - DNA, 25 bp, Mus musculus
cagcatccccttgatacagggcaag

SEQ ID NO: 85828 - DNA, 25 bp, Mus musculus
cagcatcctcattggcgtcacagaa

SEQ ID NO: 85829 - DNA, 25 bp, Mus musculus
cagcatcctctactggctgggcaat

SEQ ID NO: 85830 - DNA, 25 bp, Mus musculus
cagcatcgcgccacttcatgaagga

SEQ ID NO: 85831 - DNA, 25 bp, Mus musculus
cagcatctgctggaaggtacactta

SEQ ID NO: 85832 - DNA, 25 bp, Mus musculus
cagcatctgggccaaaaagtttgag

SEQ ID NO: 85833 - DNA, 25 bp, Mus musculus
cagcatctgtcgtttcacggtcaca

SEQ ID NO: 85834 - DNA, 25 bp, Mus musculus
cagcatcttgtggactttgactgcc

SEQ ID NO: 85835 - DNA, 25 bp, Mus musculus
cagcatgaaccccatccagagtttc

SEQ ID NO: 85836 - DNA, 25 bp, Mus musculus
cagcatgagagctccccgagtgttc

SEQ ID NO: 85837 - DNA, 25 bp, Mus musculus
cagcatgagctttgacgaggacgag

SEQ ID NO: 85838 - DNA, 25 bp, Mus musculus
cagcatgatcagtggcctcgttacc

SEQ ID NO: 85839 - DNA, 25 bp, Mus musculus
cagcatgcagaaagggtggcagccc

SEQ ID NO: 85840 - DNA, 25 bp, Mus musculus
cagcatgccggtcactaagtgtcca

SEQ ID NO: 85841 - DNA, 25 bp, Mus musculus
cagcatgcgcatgtcattgaagacc

SEQ ID NO: 85842 - DNA, 25 bp, Mus musculus
cagcatgcgctgagatctaggagaa

SEQ ID NO: 85843 - DNA, 25 bp, Mus musculus
cagcatgcgttaaggctctgagaga

SEQ ID NO: 85844 - DNA, 25 bp, Mus musculus
cagcatgctgtatttaaagaacttg

SEQ ID NO: 85845 - DNA, 25 bp, Mus musculus
cagcatggcgtcttgggctgagccc

SEQ ID NO: 85846 - DNA, 25 bp, Mus musculus
cagcatggctggctatctgagtgaa

SEQ ID NO: 85847 - DNA, 25 bp, Mus musculus
cagcatggtgctcaaggtcttcttc

SEQ ID NO: 85848 - DNA, 25 bp, Mus musculus
cagcatgtaaagacatgggatacaa

SEQ ID NO: 85849 - DNA, 25 bp, Mus musculus
cagcatgtactctggcggcttgaga

SEQ ID NO: 85850 - DNA, 25 bp, Mus musculus
cagcatgtataccaggcctacgaga

SEQ ID NO: 85851 - DNA, 25 bp, Mus musculus
cagcatgtcagcagcagcgaaatcc

SEQ ID NO: 85852 - DNA, 25 bp, Mus musculus
cagcatgtgtctgaggcagtagccc

SEQ ID NO: 85853 - DNA, 25 bp, Mus musculus
cagcatgtgttcagacataccgcca

SEQ ID NO: 85854 - DNA, 25 bp, Mus musculus
cagcatgttaaagaaggatacgaga

SEQ ID NO: 85855 - DNA, 25 bp, Mus musculus
cagcattacctggttccagctataa

SEQ ID NO: 85856 - DNA, 25 bp, Mus musculus
cagcattatgtcagtagctcagagg

SEQ ID NO: 85857 - DNA, 25 bp, Mus musculus
cagcattcaaggtggagtttgtcac

SEQ ID NO: 85858 - DNA, 25 bp, Mus musculus
cagcattggaaggaaagtgcagaag

SEQ ID NO: 85859 - DNA, 25 bp, Mus musculus
cagcattggccgctagtgcagtcac

SEQ ID NO: 85860 - DNA, 25 bp, Mus musculus
cagcattgtcagtgtaacggcctac

SEQ ID NO: 85861 - DNA, 25 bp, Mus musculus
cagcattgttgaccagagagactta

SEQ ID NO: 85862 - DNA, 25 bp, Mus musculus
cagcatttgaggacttcgcccacgt

SEQ ID NO: 85863 - DNA, 25 bp, Mus musculus
cagccaaacaaaatggcagtgaagc

SEQ ID NO: 85864 - DNA, 25 bp, Mus musculus
cagccaaatccaaggcggcagtgag

SEQ ID NO: 85865 - DNA, 25 bp, Mus musculus
cagccaacggcttctcaatgaggtc

SEQ ID NO: 85866 - DNA, 25 bp, Mus musculus
cagccaacgggagcaaaagtaagtt

SEQ ID NO: 85867 - DNA, 25 bp, Mus musculus
cagccaacgtgtgcgagtccattag

SEQ ID NO: 85868 - DNA, 25 bp, Mus musculus
cagccaagcctcgaactgttgacaa

SEQ ID NO: 85869 - DNA, 25 bp, Mus musculus
cagccaagcctgattgtgaaggtgg

SEQ ID NO: 85870 - DNA, 25 bp, Mus musculus
cagccaagctctgggatgtccgaga

SEQ ID NO: 85871 - DNA, 25 bp, Mus musculus
cagccaaggctttacgggcagatca

SEQ ID NO: 85872 - DNA, 25 bp, Mus musculus
cagccaatggagacgaagcagcttc

SEQ ID NO: 85873 - DNA, 25 bp, Mus musculus
cagccacagcaaagggaatccaagg

SEQ ID NO: 85874 - DNA, 25 bp, Mus musculus
cagccacagtggctccttggctctg

SEQ ID NO: 85875 - DNA, 25 bp, Mus musculus
cagccacagtgttcagccacaagaa

SEQ ID NO: 85876 - DNA, 25 bp, Mus musculus
cagccaccaacacaataaacacaat

SEQ ID NO: 85877 - DNA, 25 bp, Mus musculus
cagccaccgctgttgttgagatcca

SEQ ID NO: 85878 - DNA, 25 bp, Mus musculus
cagccaccggtgactacgatatcaa

SEQ ID NO: 85879 - DNA, 25 bp, Mus musculus
cagccacgacctgctgataaggagc

SEQ ID NO: 85880 - DNA, 25 bp, Mus musculus
cagccacggtttcttgggatatccg

SEQ ID NO: 85881 - DNA, 25 bp, Mus musculus
cagccacttgctccaaaatctattc

SEQ ID NO: 85882 - DNA, 25 bp, Mus musculus
cagccagaaagctcgcggtgtagcc

SEQ ID NO: 85883 - DNA, 25 bp, Mus musculus
cagccagacccagatgccattaaga

SEQ ID NO: 85884 - DNA, 25 bp, Mus musculus
cagccagacctgtgaccatgggtag

SEQ ID NO: 85885 - DNA, 25 bp, Mus musculus
cagccagcagagtgtgtgtcgtgca

SEQ ID NO: 85886 - DNA, 25 bp, Mus musculus
cagccagcattcctgaaacagagga

SEQ ID NO: 85887 - DNA, 25 bp, Mus musculus
cagccagccttggtgcttttaaacc

SEQ ID NO: 85888 - DNA, 25 bp, Mus musculus
cagccagcgtgggtatcatctcaga

SEQ ID NO: 85889 - DNA, 25 bp, Mus musculus
cagccagcgttataaggaaggccgt

SEQ ID NO: 85890 - DNA, 25 bp, Mus musculus
cagccagctgcgtaggtgtcgccta

SEQ ID NO: 85891 - DNA, 25 bp, Mus musculus
cagccagctttagagaactttgagg

SEQ ID NO: 85892 - DNA, 25 bp, Mus musculus
cagccaggatcatgattcctccgac

SEQ ID NO: 85893 - DNA, 25 bp, Mus musculus
cagccaggccgaattcttagtcaca

SEQ ID NO: 85894 - DNA, 25 bp, Mus musculus
cagccaggtggtggacttctaccag

SEQ ID NO: 85895 - DNA, 25 bp, Mus musculus
cagccagtcctgcttacctgtgaag

SEQ ID NO: 85896 - DNA, 25 bp, Mus musculus
cagccagtctgttgcaaaggttaaa

SEQ ID NO: 85897 - DNA, 25 bp, Mus musculus
cagccagtgtgcctgcgtgtgcacc

SEQ ID NO: 85898 - DNA, 25 bp, Mus musculus
cagccagttagaaggaccagggtat

SEQ ID NO: 85899 - DNA, 25 bp, Mus musculus
cagccagttatgcagtcagacagga

SEQ ID NO: 85900 - DNA, 25 bp, Mus musculus
cagccataatccaggagggcccaat

SEQ ID NO: 85901 - DNA, 25 bp, Mus musculus
cagccatagaataagtgaccgggac

SEQ ID NO: 85902 - DNA, 25 bp, Mus musculus
cagccatgatgaatgtgcgcgacca

SEQ ID NO: 85903 - DNA, 25 bp, Mus musculus
cagccatgcgttccgactcgctggt

SEQ ID NO: 85904 - DNA, 25 bp, Mus musculus
cagccatgctttccagacagttacg

SEQ ID NO: 85905 - DNA, 25 bp, Mus musculus
cagccatggaagaccctggtgagac

SEQ ID NO: 85906 - DNA, 25 bp, Mus musculus
cagccatggcaagtaaagggccttc

SEQ ID NO: 85907 - DNA, 25 bp, Mus musculus
cagccatggcgcgtgctatgggacc

SEQ ID NO: 85908 - DNA, 25 bp, Mus musculus
cagccatggttaccttcagccacgt

SEQ ID NO: 85909 - DNA, 25 bp, Mus musculus
cagccattgaggatgccggtagaag

SEQ ID NO: 85910 - DNA, 25 bp, Mus musculus
cagccattggactagagtgctacca

SEQ ID NO: 85911 - DNA, 25 bp, Mus musculus
cagccattttggtggaagagaaaca

SEQ ID NO: 85912 - DNA, 25 bp, Mus musculus
cagcccaaagaggtgtatcagcaac

SEQ ID NO: 85913 - DNA, 25 bp, Mus musculus
cagcccaaggctccagaaatcaaca

SEQ ID NO: 85914 - DNA, 25 bp, Mus musculus
cagcccacagtgttctccaacgtga

SEQ ID NO: 85915 - DNA, 25 bp, Mus musculus
cagcccactcaagactatgttcagg

SEQ ID NO: 85916 - DNA, 25 bp, Mus musculus
cagcccactccatcagtctgtagga

SEQ ID NO: 85917 - DNA, 25 bp, Mus musculus
cagcccagagatcaagcggtggcct

SEQ ID NO: 85918 - DNA, 25 bp, Mus musculus
cagcccaggaggtggtacaatacac

SEQ ID NO: 85919 - DNA, 25 bp, Mus musculus
cagcccaggcctagaaaccttggtg

SEQ ID NO: 85920 - DNA, 25 bp, Mus musculus
cagcccagggagtaaaaaggtgatc

SEQ ID NO: 85921 - DNA, 25 bp, Mus musculus
cagcccagggcttgtcaggtgtgtt

SEQ ID NO: 85922 - DNA, 25 bp, Mus musculus
cagcccaggtagtgagaaacttgca

SEQ ID NO: 85923 - DNA, 25 bp, Mus musculus
cagcccagtggcgaagagggaagtt

SEQ ID NO: 85924 - DNA, 25 bp, Mus musculus
cagcccatgtgagaagcctgcttaa

SEQ ID NO: 85925 - DNA, 25 bp, Mus musculus
cagcccattgacttgatgaaaatcc

SEQ ID NO: 85926 - DNA, 25 bp, Mus musculus
cagccccaacgtgtctcatgatgag

SEQ ID NO: 85927 - DNA, 25 bp, Mus musculus
cagccccaagaggaatggaacagcc

SEQ ID NO: 85928 - DNA, 25 bp, Mus musculus
cagccccaagcagctagaggaggaa

SEQ ID NO: 85929 - DNA, 25 bp, Mus musculus
cagccccacgactgaggatggatga

SEQ ID NO: 85930 - DNA, 25 bp, Mus musculus
cagccccagggttttggaacgcagg

SEQ ID NO: 85931 - DNA, 25 bp, Mus musculus
cagccccagtggagatgggttcgac

SEQ ID NO: 85932 - DNA, 25 bp, Mus musculus
cagccccgagatgtgtcttggaacc

SEQ ID NO: 85933 - DNA, 25 bp, Mus musculus
cagccccgggtggtagtgatcaaga

SEQ ID NO: 85934 - DNA, 25 bp, Mus musculus
cagcccctggcgttgtgagcgataa

SEQ ID NO: 85935 - DNA, 25 bp, Mus musculus
cagcccctggtgtggcatgtgaaga

SEQ ID NO: 85936 - DNA, 25 bp, Mus musculus
cagcccctgttgtggaaagtgaccc

SEQ ID NO: 85937 - DNA, 25 bp, Mus musculus
cagcccgaaggaaggcaaggatgcc

SEQ ID NO: 85938 - DNA, 25 bp, Mus musculus
cagcccgacagagggttgaggtacc

SEQ ID NO: 85939 - DNA, 25 bp, Mus musculus
cagcccgacgtggagagtaaggaaa

SEQ ID NO: 85940 - DNA, 25 bp, Mus musculus
cagcccgagccagaaatgacaggag

SEQ ID NO: 85941 - DNA, 25 bp, Mus musculus
cagcccgcggaagcgcgctgtattt

SEQ ID NO: 85942 - DNA, 25 bp, Mus musculus
cagcccggctgttctccatggaaag

SEQ ID NO: 85943 - DNA, 25 bp, Mus musculus
cagcccgggtggtgtttacttctca

SEQ ID NO: 85944 - DNA, 25 bp, Mus musculus
cagcccggtggcgaatgctgatcca

SEQ ID NO: 85945 - DNA, 25 bp, Mus musculus
cagcccgtgttttcacagtgatcgc

SEQ ID NO: 85946 - DNA, 25 bp, Mus musculus
cagccctacgcggtgttgcggaggc

SEQ ID NO: 85947 - DNA, 25 bp, Mus musculus
cagccctatgagtggatttcctaca

SEQ ID NO: 85948 - DNA, 25 bp, Mus musculus
cagccctccgtgtgcttcagaagga

SEQ ID NO: 85949 - DNA, 25 bp, Mus musculus
cagccctcgggctgtgtggcagttc

SEQ ID NO: 85950 - DNA, 25 bp, Mus musculus
cagccctgacctggctgatagagat

SEQ ID NO: 85951 - DNA, 25 bp, Mus musculus
cagccctggaaaggatgccgagaga

SEQ ID NO: 85952 - DNA, 25 bp, Mus musculus
cagccctgggttttgccagtagtga

SEQ ID NO: 85953 - DNA, 25 bp, Mus musculus
cagccctttagtgtgtgcgagcgcc

SEQ ID NO: 85954 - DNA, 25 bp, Mus musculus
cagccctttggataacagtgagtca

SEQ ID NO: 85955 - DNA, 25 bp, Mus musculus
cagccgaacggtgagcaggattaca

SEQ ID NO: 85956 - DNA, 25 bp, Mus musculus
cagccgagactgaatccaaagagga

SEQ ID NO: 85957 - DNA, 25 bp, Mus musculus
cagccgagggactttccagtgtaaa

SEQ ID NO: 85958 - DNA, 25 bp, Mus musculus
cagccgatgatagatatttacgacc

SEQ ID NO: 85959 - DNA, 25 bp, Mus musculus
cagccgatgcactgtactaaggaag

SEQ ID NO: 85960 - DNA, 25 bp, Mus musculus
cagccgcagggctagtgatcttgct

SEQ ID NO: 85961 - DNA, 25 bp, Mus musculus
cagccgcctggtggtgtacgtctct

SEQ ID NO: 85962 - DNA, 25 bp, Mus musculus
cagccgcgacgtgatccagaagtgt

SEQ ID NO: 85963 - DNA, 25 bp, Mus musculus
cagccgctggttgctcgttatgaga

SEQ ID NO: 85964 - DNA, 25 bp, Mus musculus
cagccgcttatcatgatcatccagg

SEQ ID NO: 85965 - DNA, 25 bp, Mus musculus
cagccgcttggaggatatctatcga

SEQ ID NO: 85966 - DNA, 25 bp, Mus musculus
cagccggataactggcatggacata

SEQ ID NO: 85967 - DNA, 25 bp, Mus musculus
cagccggatagaccagactgagctt

SEQ ID NO: 85968 - DNA, 25 bp, Mus musculus
cagccggatgtgtggcgacattact

SEQ ID NO: 85969 - DNA, 25 bp, Mus musculus
cagccggctcttcctgagcgacagt

SEQ ID NO: 85970 - DNA, 25 bp, Mus musculus
cagccgggagcaagcattaagtgtc

SEQ ID NO: 85971 - DNA, 25 bp, Mus musculus
cagccgggagccttttgtggtcaaa

SEQ ID NO: 85972 - DNA, 25 bp, Mus musculus
cagccggtcagaatggccacgagga

SEQ ID NO: 85973 - DNA, 25 bp, Mus musculus
cagccggtgtttggtgcgaacttca

SEQ ID NO: 85974 - DNA, 25 bp, Mus musculus
cagccgtagccaccagagaagtcgg

SEQ ID NO: 85975 - DNA, 25 bp, Mus musculus
cagccgtaggcaagacggccctggt

SEQ ID NO: 85976 - DNA, 25 bp, Mus musculus
cagccgtccggtgggttgtgacact

SEQ ID NO: 85977 - DNA, 25 bp, Mus musculus
cagccgtgatgatgaatgcaggaag

SEQ ID NO: 85978 - DNA, 25 bp, Mus musculus
cagccgtggatgttagcctctaaaa

SEQ ID NO: 85979 - DNA, 25 bp, Mus musculus
cagccgtggcagaaaaacagaagtc

SEQ ID NO: 85980 - DNA, 25 bp, Mus musculus
cagccgtgggcaaaagatgacatca

SEQ ID NO: 85981 - DNA, 25 bp, Mus musculus
cagccgtgggcatgaacttcctgca

SEQ ID NO: 85982 - DNA, 25 bp, Mus musculus
cagccgtgggtaccagacctgataa

SEQ ID NO: 85983 - DNA, 25 bp, Mus musculus
cagccgtgtacagtggaggtagatc

SEQ ID NO: 85984 - DNA, 25 bp, Mus musculus
cagcctaagacagtgctggtaatca

SEQ ID NO: 85985 - DNA, 25 bp, Mus musculus
cagcctacgaggatgtggttcacca

SEQ ID NO: 85986 - DNA, 25 bp, Mus musculus
cagcctacgggttgtacgcagcctt

SEQ ID NO: 85987 - DNA, 25 bp, Mus musculus
cagcctagtaatggctgcgcccgag

SEQ ID NO: 85988 - DNA, 25 bp, Mus musculus
cagcctagtcatccatgacgtccga

SEQ ID NO: 85989 - DNA, 25 bp, Mus musculus
cagcctatgcaatgtgcttgctgag

SEQ ID NO: 85990 - DNA, 25 bp, Mus musculus
cagcctatgggagcagttacactta

SEQ ID NO: 85991 - DNA, 25 bp, Mus musculus
cagcctcaatggctgtcagagaaag

SEQ ID NO: 85992 - DNA, 25 bp, Mus musculus
cagcctcatggagcttctcgagtca

SEQ ID NO: 85993 - DNA, 25 bp, Mus musculus
cagcctcgccctggatgagaattgt

SEQ ID NO: 85994 - DNA, 25 bp, Mus musculus
cagcctctcaatggatcctgtcagg

SEQ ID NO: 85995 - DNA, 25 bp, Mus musculus
cagcctctggaagtggccttggaaa

SEQ ID NO: 85996 - DNA, 25 bp, Mus musculus
cagcctctgtactatgtggccgaga

SEQ ID NO: 85997 - DNA, 25 bp, Mus musculus
cagcctcttgtgtgatgggtacgat

SEQ ID NO: 85998 - DNA, 25 bp, Mus musculus
cagcctgagggcttactgggcacag

SEQ ID NO: 85999 - DNA, 25 bp, Mus musculus
cagcctgcatgagatcgtgctccaa

SEQ ID NO: 86000 - DNA, 25 bp, Mus musculus
cagcctgcatgtgttgagagagact

SEQ ID NO: 86001 - DNA, 25 bp, Mus musculus
cagcctgccatggtagacataagca

SEQ ID NO: 86002 - DNA, 25 bp, Mus musculus
cagcctgcccgaggatacgctggtg

SEQ ID NO: 86003 - DNA, 25 bp, Mus musculus
cagcctgctgataacctgtggcaaa

SEQ ID NO: 86004 - DNA, 25 bp, Mus musculus
cagcctgcttttccgccgggtgtca

SEQ ID NO: 86005 - DNA, 25 bp, Mus musculus
cagcctggacggaagcggaaatcta

SEQ ID NO: 86006 - DNA, 25 bp, Mus musculus
cagcctggagaagagatggaaattc

SEQ ID NO: 86007 - DNA, 25 bp, Mus musculus
cagcctggagatgcccacttgatgg

SEQ ID NO: 86008 - DNA, 25 bp, Mus musculus
cagcctggcagagcatgtatgcaac

SEQ ID NO: 86009 - DNA, 25 bp, Mus musculus
cagcctggcattgttggacttatga

SEQ ID NO: 86010 - DNA, 25 bp, Mus musculus
cagcctggctgacagagactccatg

SEQ ID NO: 86011 - DNA, 25 bp, Mus musculus
cagcctgggaatagatggaactcat

SEQ ID NO: 86012 - DNA, 25 bp, Mus musculus
cagcctggtatcaccgtgacctgag

SEQ ID NO: 86013 - DNA, 25 bp, Mus musculus
cagcctgtacggagatgttcgtgac

SEQ ID NO: 86014 - DNA, 25 bp, Mus musculus
cagcctgtggtgctaggcaactcag

SEQ ID NO: 86015 - DNA, 25 bp, Mus musculus
cagcctgtgttctgcaagccgagac

SEQ ID NO: 86016 - DNA, 25 bp, Mus musculus
cagcctgttggccatggacggtcaa

SEQ ID NO: 86017 - DNA, 25 bp, Mus musculus
cagccttatgtgcagatggtcctca

SEQ ID NO: 86018 - DNA, 25 bp, Mus musculus
cagccttcggcgctggataccctgg

SEQ ID NO: 86019 - DNA, 25 bp, Mus musculus
cagccttgggaacagaacgctgcgc

SEQ ID NO: 86020 - DNA, 25 bp, Mus musculus
cagccttgtggattacaactcggag

SEQ ID NO: 86021 - DNA, 25 bp, Mus musculus
cagcctttccattcctagccgtgag

SEQ ID NO: 86022 - DNA, 25 bp, Mus musculus
cagcctttggtgtgtgagattcgcc

SEQ ID NO: 86023 - DNA, 25 bp, Mus musculus
cagcgaaagcgctagcggagaatcc

SEQ ID NO: 86024 - DNA, 25 bp, Mus musculus
cagcgaagtcaagacggatgtgaat

SEQ ID NO: 86025 - DNA, 25 bp, Mus musculus
cagcgaatctttgagagggtccgac

SEQ ID NO: 86026 - DNA, 25 bp, Mus musculus
cagcgaatgctgtacgtgtgggcac

SEQ ID NO: 86027 - DNA, 25 bp, Mus musculus
cagcgacctgggatgagagattctc

SEQ ID NO: 86028 - DNA, 25 bp, Mus musculus
cagcgacgcctgagctagtcgagcc

SEQ ID NO: 86029 - DNA, 25 bp, Mus musculus
cagcgactgctgtggaccctggaat

SEQ ID NO: 86030 - DNA, 25 bp, Mus musculus
cagcgacttaagaccggcgaggagt

SEQ ID NO: 86031 - DNA, 25 bp, Mus musculus
cagcgagaacagctgatgacggtca

SEQ ID NO: 86032 - DNA, 25 bp, Mus musculus
cagcgagaactcgatggagaagcac

SEQ ID NO: 86033 - DNA, 25 bp, Mus musculus
cagcgagaatatgtacaccatcatg

SEQ ID NO: 86034 - DNA, 25 bp, Mus musculus
cagcgagcagtattgccaacctgaa

SEQ ID NO: 86035 - DNA, 25 bp, Mus musculus
cagcgagccccttcgggatgaggat

SEQ ID NO: 86036 - DNA, 25 bp, Mus musculus
cagcgagccgaagcctggatgtgta

SEQ ID NO: 86037 - DNA, 25 bp, Mus musculus
cagcgagcttataggcgccaccttt

SEQ ID NO: 86038 - DNA, 25 bp, Mus musculus
cagcgaggtccgaacccaattggtg

SEQ ID NO: 86039 - DNA, 25 bp, Mus musculus
cagcgagtgcgtttcttcccagtgg

SEQ ID NO: 86040 - DNA, 25 bp, Mus musculus
cagcgagtggtgatcagcaacggaa

SEQ ID NO: 86041 - DNA, 25 bp, Mus musculus
cagcgatccggtcagcgagtgctta

SEQ ID NO: 86042 - DNA, 25 bp, Mus musculus
cagcgatgaagggaatgagcctgcc

SEQ ID NO: 86043 - DNA, 25 bp, Mus musculus
cagcgatgacaatatggatgaggcc

SEQ ID NO: 86044 - DNA, 25 bp, Mus musculus
cagcgatgacagctttccagaggca

SEQ ID NO: 86045 - DNA, 25 bp, Mus musculus
cagcgatgtggtctttgtggtacac

SEQ ID NO: 86046 - DNA, 25 bp, Mus musculus
cagcgattccaggacaacggtcgag

SEQ ID NO: 86047 - DNA, 25 bp, Mus musculus
cagcgcaagaggtaagagtgtcact

SEQ ID NO: 86048 - DNA, 25 bp, Mus musculus
cagcgcaccacctgcatgagttttt

SEQ ID NO: 86049 - DNA, 25 bp, Mus musculus
cagcgcacgtcttctgtcagtggca

SEQ ID NO: 86050 - DNA, 25 bp, Mus musculus
cagcgccaatggtgaagatgacaag

SEQ ID NO: 86051 - DNA, 25 bp, Mus musculus
cagcgccacctgaggatttcctgga

SEQ ID NO: 86052 - DNA, 25 bp, Mus musculus
cagcgccacctgatcgtcatctata

SEQ ID NO: 86053 - DNA, 25 bp, Mus musculus
cagcgccagcttgcccttgaagtga

SEQ ID NO: 86054 - DNA, 25 bp, Mus musculus
cagcgccggaaagccaaggcttcat

SEQ ID NO: 86055 - DNA, 25 bp, Mus musculus
cagcgccggaatcgaaccacattca

SEQ ID NO: 86056 - DNA, 25 bp, Mus musculus
cagcgcctccgaagtggcgtaaggt

SEQ ID NO: 86057 - DNA, 25 bp, Mus musculus
cagcgcctgtccattgcttcaagca

SEQ ID NO: 86058 - DNA, 25 bp, Mus musculus
cagcgcgagctgcagaagaaagtca

SEQ ID NO: 86059 - DNA, 25 bp, Mus musculus
cagcgcgctgcctagcctgggatgt

SEQ ID NO: 86060 - DNA, 25 bp, Mus musculus
cagcgcggaaaagacagcaagcaat

SEQ ID NO: 86061 - DNA, 25 bp, Mus musculus
cagcgcgggagcttttccagcggct

SEQ ID NO: 86062 - DNA, 25 bp, Mus musculus
cagcgctatttacgttggattccag

SEQ ID NO: 86063 - DNA, 25 bp, Mus musculus
cagcgctcctgtcttgggaactgta

SEQ ID NO: 86064 - DNA, 25 bp, Mus musculus
cagcgctgcagcgagagtgcagaat

SEQ ID NO: 86065 - DNA, 25 bp, Mus musculus
cagcgctgcttcaactcctatggga

SEQ ID NO: 86066 - DNA, 25 bp, Mus musculus
cagcgctggcacacgttagtcaagg

SEQ ID NO: 86067 - DNA, 25 bp, Mus musculus
cagcgctgtagccagcctctgaaac

SEQ ID NO: 86068 - DNA, 25 bp, Mus musculus
cagcgctgttccagtcccgagtgat

SEQ ID NO: 86069 - DNA, 25 bp, Mus musculus
cagcgctttgaccagatgcgggaca

SEQ ID NO: 86070 - DNA, 25 bp, Mus musculus
cagcgctttttagagctctggagcc

SEQ ID NO: 86071 - DNA, 25 bp, Mus musculus
cagcggaacgtttggcttggcacca

SEQ ID NO: 86072 - DNA, 25 bp, Mus musculus
cagcggaactggaatgacgccgtca

SEQ ID NO: 86073 - DNA, 25 bp, Mus musculus
cagcggaacttcctgaagcagcgcc

SEQ ID NO: 86074 - DNA, 25 bp, Mus musculus
cagcggacgaggatgttttctccca

SEQ ID NO: 86075 - DNA, 25 bp, Mus musculus
cagcggagattttccacagtgcaga

SEQ ID NO: 86076 - DNA, 25 bp, Mus musculus
cagcggagccatagacggaatcatc

SEQ ID NO: 86077 - DNA, 25 bp, Mus musculus
cagcggagcgaaaatggagctattc

SEQ ID NO: 86078 - DNA, 25 bp, Mus musculus
cagcggaggattcttgtggctacca

SEQ ID NO: 86079 - DNA, 25 bp, Mus musculus
cagcggaggccctacaaggctttca

SEQ ID NO: 86080 - DNA, 25 bp, Mus musculus
cagcggaggctttgatgcgtctacg

SEQ ID NO: 86081 - DNA, 25 bp, Mus musculus
cagcggatccctgccttttgatgga

SEQ ID NO: 86082 - DNA, 25 bp, Mus musculus
cagcggcaactcaacagccgaggga

SEQ ID NO: 86083 - DNA, 25 bp, Mus musculus
cagcggcaagtgctgtccaggaggc

SEQ ID NO: 86084 - DNA, 25 bp, Mus musculus
cagcggcaatactgcatccttcggt

SEQ ID NO: 86085 - DNA, 25 bp, Mus musculus
cagcggcagcgtgaaatcaacttgt

SEQ ID NO: 86086 - DNA, 25 bp, Mus musculus
cagcggccactcagtggaggcaaca

SEQ ID NO: 86087 - DNA, 25 bp, Mus musculus
cagcggccatcgtaataatttgcac

SEQ ID NO: 86088 - DNA, 25 bp, Mus musculus
cagcggcctgcaagatgtaaagaga

SEQ ID NO: 86089 - DNA, 25 bp, Mus musculus
cagcggcggatgtctgaaattacag

SEQ ID NO: 86090 - DNA, 25 bp, Mus musculus
cagcggcggtgactgtggcgggcgc

SEQ ID NO: 86091 - DNA, 25 bp, Mus musculus
cagcggctaattggacagcagggcc

SEQ ID NO: 86092 - DNA, 25 bp, Mus musculus
cagcggctctttgggaaatcctcaa

SEQ ID NO: 86093 - DNA, 25 bp, Mus musculus
cagcggctgcaggaattctggatca

SEQ ID NO: 86094 - DNA, 25 bp, Mus musculus
cagcggctggatcccttgaagaagt

SEQ ID NO: 86095 - DNA, 25 bp, Mus musculus
cagcggcttcatcgaaaccgaggaa

SEQ ID NO: 86096 - DNA, 25 bp, Mus musculus
cagcgggagctgtacgtgattctca

SEQ ID NO: 86097 - DNA, 25 bp, Mus musculus
cagcgggatgaccagagcatagtta

SEQ ID NO: 86098 - DNA, 25 bp, Mus musculus
cagcgggcgaagtaaaagccttgga

SEQ ID NO: 86099 - DNA, 25 bp, Mus musculus
cagcgggtgcagcttgaaaatcttc

SEQ ID NO: 86100 - DNA, 25 bp, Mus musculus
cagcggtactcatcctactggagga

SEQ ID NO: 86101 - DNA, 25 bp, Mus musculus
cagcggtcgccctgttgtctagcta

SEQ ID NO: 86102 - DNA, 25 bp, Mus musculus
cagcggtgctccaaggcagcggttt

SEQ ID NO: 86103 - DNA, 25 bp, Mus musculus
cagcggtgtccaatcagtcatgggc

SEQ ID NO: 86104 - DNA, 25 bp, Mus musculus
cagcggttctgtgtggactatgcca

SEQ ID NO: 86105 - DNA, 25 bp, Mus musculus
cagcgtagatggagtaagacaagca

SEQ ID NO: 86106 - DNA, 25 bp, Mus musculus
cagcgtatgcaggagaggacagaca

SEQ ID NO: 86107 - DNA, 25 bp, Mus musculus
cagcgtccagtgttctagttgaaga

SEQ ID NO: 86108 - DNA, 25 bp, Mus musculus
cagcgtcccggctcatggtggtagt

SEQ ID NO: 86109 - DNA, 25 bp, Mus musculus
cagcgtcgaagaagggcaagtagcc

SEQ ID NO: 86110 - DNA, 25 bp, Mus musculus
cagcgtcgggatctgtcagccacta

SEQ ID NO: 86111 - DNA, 25 bp, Mus musculus
cagcgtctacggcaagagttccagc

SEQ ID NO: 86112 - DNA, 25 bp, Mus musculus
cagcgtctcaaaggaagtagggaag

SEQ ID NO: 86113 - DNA, 25 bp, Mus musculus
cagcgtctgactgccttcgaggaag

SEQ ID NO: 86114 - DNA, 25 bp, Mus musculus
cagcgtcttcagcacttgggtttaa

SEQ ID NO: 86115 - DNA, 25 bp, Mus musculus
cagcgtgacctggatctccgcgggt

SEQ ID NO: 86116 - DNA, 25 bp, Mus musculus
cagcgtgagctccaaagtgaggaac

SEQ ID NO: 86117 - DNA, 25 bp, Mus musculus
cagcgtgcccgggagtatatctaca

SEQ ID NO: 86118 - DNA, 25 bp, Mus musculus
cagcgtgcggtacctctgcatgagc

SEQ ID NO: 86119 - DNA, 25 bp, Mus musculus
cagcgtgctggtggatggtttcaca

SEQ ID NO: 86120 - DNA, 25 bp, Mus musculus
cagcgtggctctgatctgaattacg

SEQ ID NO: 86121 - DNA, 25 bp, Mus musculus
cagcgtgggcctggataagagcaca

SEQ ID NO: 86122 - DNA, 25 bp, Mus musculus
cagcgtgttacacaggcacatgtct

SEQ ID NO: 86123 - DNA, 25 bp, Mus musculus
cagcgttgaaagcacagagtcaatg

SEQ ID NO: 86124 - DNA, 25 bp, Mus musculus
cagcgttggcgatgagcctcggaaa

SEQ ID NO: 86125 - DNA, 25 bp, Mus musculus
cagcgttgtgtactatagactccag

SEQ ID NO: 86126 - DNA, 25 bp, Mus musculus
cagcgtttcaatctttctgggatcg

SEQ ID NO: 86127 - DNA, 25 bp, Mus musculus
cagctaaagaagtccaacactctcc

SEQ ID NO: 86128 - DNA, 25 bp, Mus musculus
cagctaacacagcaggaggagatca

SEQ ID NO: 86129 - DNA, 25 bp, Mus musculus
cagctaaggcgcctacaagaggaga

SEQ ID NO: 86130 - DNA, 25 bp, Mus musculus
cagctaagggaatcaacacccaggg

SEQ ID NO: 86131 - DNA, 25 bp, Mus musculus
cagctaagggcaacgtgagagagtc

SEQ ID NO: 86132 - DNA, 25 bp, Mus musculus
cagctaagtctacaggcaaagggca

SEQ ID NO: 86133 - DNA, 25 bp, Mus musculus
cagctaagtgagtctggcagtgaca

SEQ ID NO: 86134 - DNA, 25 bp, Mus musculus
cagctacaagctcagaccaagttca

SEQ ID NO: 86135 - DNA, 25 bp, Mus musculus
cagctacaggatttgtgatgaaaca

SEQ ID NO: 86136 - DNA, 25 bp, Mus musculus
cagctacaggtgaagaggtgtccgc

SEQ ID NO: 86137 - DNA, 25 bp, Mus musculus
cagctacaggttgtgcctgctccag

SEQ ID NO: 86138 - DNA, 25 bp, Mus musculus
cagctacagtgaatcgggtgccagt

SEQ ID NO: 86139 - DNA, 25 bp, Mus musculus
cagctacatagagcagcgcctggac

SEQ ID NO: 86140 - DNA, 25 bp, Mus musculus
cagctacccatttgccagtaaagaa

SEQ ID NO: 86141 - DNA, 25 bp, Mus musculus
cagctaccggctatgtggttctcac

SEQ ID NO: 86142 - DNA, 25 bp, Mus musculus
cagctaccgggagatcttgaaggag

SEQ ID NO: 86143 - DNA, 25 bp, Mus musculus
cagctacgaacattgcctggactca

SEQ ID NO: 86144 - DNA, 25 bp, Mus musculus
cagctacgtttacgactggaggaag

SEQ ID NO: 86145 - DNA, 25 bp, Mus musculus
cagctactatgttgaggtttccacc

SEQ ID NO: 86146 - DNA, 25 bp, Mus musculus
cagctactctgcagttgaacacagg

SEQ ID NO: 86147 - DNA, 25 bp, Mus musculus
cagctactggaaggctgtgcgcgcc

SEQ ID NO: 86148 - DNA, 25 bp, Mus musculus
cagctacttcgggagtttcatgaca

SEQ ID NO: 86149 - DNA, 25 bp, Mus musculus
cagctacttgtttcaccatggcaga

SEQ ID NO: 86150 - DNA, 25 bp, Mus musculus
cagctacttttatgagtcggtcaga

SEQ ID NO: 86151 - DNA, 25 bp, Mus musculus
cagctagagctgatcaacgggtgcc

SEQ ID NO: 86152 - DNA, 25 bp, Mus musculus
cagctagcatggagtgcagagatat

SEQ ID NO: 86153 - DNA, 25 bp, Mus musculus
cagctagccgctaggttagttggtc

SEQ ID NO: 86154 - DNA, 25 bp, Mus musculus
cagctaggatagcagaggagatcta

SEQ ID NO: 86155 - DNA, 25 bp, Mus musculus
cagctagtgactgtctctttctgcg

SEQ ID NO: 86156 - DNA, 25 bp, Mus musculus
cagctatatctagcctggaggccaa

SEQ ID NO: 86157 - DNA, 25 bp, Mus musculus
cagctatcggatcatcagtgtggat

SEQ ID NO: 86158 - DNA, 25 bp, Mus musculus
cagctatcggttgcagcagcgggta

SEQ ID NO: 86159 - DNA, 25 bp, Mus musculus
cagctatgcagagttgtgttggatc

SEQ ID NO: 86160 - DNA, 25 bp, Mus musculus
cagctatgggaaaaatggccgtgac

SEQ ID NO: 86161 - DNA, 25 bp, Mus musculus
cagctatgtgtataaaccatcgggc

SEQ ID NO: 86162 - DNA, 25 bp, Mus musculus
cagctattatagaggtgcacaggga

SEQ ID NO: 86163 - DNA, 25 bp, Mus musculus
cagctattcaggtgcccatgagcaa

SEQ ID NO: 86164 - DNA, 25 bp, Mus musculus
cagctcaaagagcaccttaggtggt

SEQ ID NO: 86165 - DNA, 25 bp, Mus musculus
cagctcaagggcatagtgaccaggt

SEQ ID NO: 86166 - DNA, 25 bp, Mus musculus
cagctcaatttacaaaagcccaggg

SEQ ID NO: 86167 - DNA, 25 bp, Mus musculus
cagctcacaggagtttctggttccc

SEQ ID NO: 86168 - DNA, 25 bp, Mus musculus
cagctcaccatccatgggcagtatc

SEQ ID NO: 86169 - DNA, 25 bp, Mus musculus
cagctcacgagaagcgtagatatcc

SEQ ID NO: 86170 - DNA, 25 bp, Mus musculus
cagctcagaggcgtcaagtttccaa

SEQ ID NO: 86171 - DNA, 25 bp, Mus musculus
cagctcagggagaagataagtcagc

SEQ ID NO: 86172 - DNA, 25 bp, Mus musculus
cagctcagggcagaagagtggtcat

SEQ ID NO: 86173 - DNA, 25 bp, Mus musculus
cagctcaggtgatgtttgtcaacaa

SEQ ID NO: 86174 - DNA, 25 bp, Mus musculus
cagctcatctgatgctgtcagcaca

SEQ ID NO: 86175 - DNA, 25 bp, Mus musculus
cagctcatggccgtgtttggatccc

SEQ ID NO: 86176 - DNA, 25 bp, Mus musculus
cagctccaaagcaagtgtaccaggg

SEQ ID NO: 86177 - DNA, 25 bp, Mus musculus
cagctccaagttccgtcatgtctac

SEQ ID NO: 86178 - DNA, 25 bp, Mus musculus
cagctccaccggatgctgctaatgg

SEQ ID NO: 86179 - DNA, 25 bp, Mus musculus
cagctccgcgctagtgcagcgacgt

SEQ ID NO: 86180 - DNA, 25 bp, Mus musculus
cagctcctccgtattctgcaaagac

SEQ ID NO: 86181 - DNA, 25 bp, Mus musculus
cagctcctgatcaagaggattgtcc

SEQ ID NO: 86182 - DNA, 25 bp, Mus musculus
cagctcgactttgggcacacgtgta

SEQ ID NO: 86183 - DNA, 25 bp, Mus musculus
cagctcgtttgtgtataaggaccag

SEQ ID NO: 86184 - DNA, 25 bp, Mus musculus
cagctctatgaaggtcaaagggcac

SEQ ID NO: 86185 - DNA, 25 bp, Mus musculus
cagctctcggttcatctgggacaga

SEQ ID NO: 86186 - DNA, 25 bp, Mus musculus
cagctctctgagcatccagtgggag

SEQ ID NO: 86187 - DNA, 25 bp, Mus musculus
cagctctgaagcacggaggagacct

SEQ ID NO: 86188 - DNA, 25 bp, Mus musculus
cagctctgacaagaggattcccgac

SEQ ID NO: 86189 - DNA, 25 bp, Mus musculus
cagctctgcagatgatgtaaggagg

SEQ ID NO: 86190 - DNA, 25 bp, Mus musculus
cagctctggccttgttgtatgacga

SEQ ID NO: 86191 - DNA, 25 bp, Mus musculus
cagctctgtgagtgcgaacgactca

SEQ ID NO: 86192 - DNA, 25 bp, Mus musculus
cagctcttagaaagcatggacgtcc

SEQ ID NO: 86193 - DNA, 25 bp, Mus musculus
cagctcttattttgacacagtggaa

SEQ ID NO: 86194 - DNA, 25 bp, Mus musculus
cagctcttcccttgcgatgtgtgtg

SEQ ID NO: 86195 - DNA, 25 bp, Mus musculus
cagctcttcgagatccgcctgagtc

SEQ ID NO: 86196 - DNA, 25 bp, Mus musculus
cagctcttgcatgagaaggaagtcc

SEQ ID NO: 86197 - DNA, 25 bp, Mus musculus
cagctcttggccagtgtcatcgcag

SEQ ID NO: 86198 - DNA, 25 bp, Mus musculus
cagctctttgcgtggagttacagaa

SEQ ID NO: 86199 - DNA, 25 bp, Mus musculus
cagctctttggcctgtaatgacggc

SEQ ID NO: 86200 - DNA, 25 bp, Mus musculus
cagctgaaatagcaagtcttgattc

SEQ ID NO: 86201 - DNA, 25 bp, Mus musculus
cagctgaaatttgcagaatgcttag

SEQ ID NO: 86202 - DNA, 25 bp, Mus musculus
cagctgaagtggtggctctgcttgc

SEQ ID NO: 86203 - DNA, 25 bp, Mus musculus
cagctgacagttgagaaggtatcca

SEQ ID NO: 86204 - DNA, 25 bp, Mus musculus
cagctgaccgagtgcgaactggagc

SEQ ID NO: 86205 - DNA, 25 bp, Mus musculus
cagctgacgcaggatgatgacacgg

SEQ ID NO: 86206 - DNA, 25 bp, Mus musculus
cagctgacgtgatgagactccacag

SEQ ID NO: 86207 - DNA, 25 bp, Mus musculus
cagctgactcctgtgcctgtgagca

SEQ ID NO: 86208 - DNA, 25 bp, Mus musculus
cagctgactgtgaaggtggcatgcc

SEQ ID NO: 86209 - DNA, 25 bp, Mus musculus
cagctgagcccgcagtgagatctct

SEQ ID NO: 86210 - DNA, 25 bp, Mus musculus
cagctgagctgcatggaccgaaggt

SEQ ID NO: 86211 - DNA, 25 bp, Mus musculus
cagctgaggaaggacttgaaggccc

SEQ ID NO: 86212 - DNA, 25 bp, Mus musculus
cagctgaggccatgtgagtctgatc

SEQ ID NO: 86213 - DNA, 25 bp, Mus musculus
cagctgaggcggaaacctaggctgc

SEQ ID NO: 86214 - DNA, 25 bp, Mus musculus
cagctgagggaccagtactgctttg

SEQ ID NO: 86215 - DNA, 25 bp, Mus musculus
cagctgatgagaccaagggtttcca

SEQ ID NO: 86216 - DNA, 25 bp, Mus musculus
cagctgatgagctctgccgtgcagg

SEQ ID NO: 86217 - DNA, 25 bp, Mus musculus
cagctgatgcttcccgtgccagagt

SEQ ID NO: 86218 - DNA, 25 bp, Mus musculus
cagctgcaactgaaaatgtctgaca

SEQ ID NO: 86219 - DNA, 25 bp, Mus musculus
cagctgcaccctatctaagcgtggg

SEQ ID NO: 86220 - DNA, 25 bp, Mus musculus
cagctgcagaagttacacatggaca

SEQ ID NO: 86221 - DNA, 25 bp, Mus musculus
cagctgcagctcagtctcttgaaga

SEQ ID NO: 86222 - DNA, 25 bp, Mus musculus
cagctgcaggcacaaatgaaccgtg

SEQ ID NO: 86223 - DNA, 25 bp, Mus musculus
cagctgcatcagcttcgagctcaga

SEQ ID NO: 86224 - DNA, 25 bp, Mus musculus
cagctgccgggagcatgaagtcatc

SEQ ID NO: 86225 - DNA, 25 bp, Mus musculus
cagctgcctgttgccgttacctgga

SEQ ID NO: 86226 - DNA, 25 bp, Mus musculus
cagctgcgagagcagcggatccagg

SEQ ID NO: 86227 - DNA, 25 bp, Mus musculus
cagctgcgagtgacaagccaaagga

SEQ ID NO: 86228 - DNA, 25 bp, Mus musculus
cagctgcgcgacgtcatggacaact

SEQ ID NO: 86229 - DNA, 25 bp, Mus musculus
cagctgcgcttggaaggaacttaac

SEQ ID NO: 86230 - DNA, 25 bp, Mus musculus
cagctgcggcggtctatggagaaca

SEQ ID NO: 86231 - DNA, 25 bp, Mus musculus
cagctgcgggaagagtcgtgtcaac

SEQ ID NO: 86232 - DNA, 25 bp, Mus musculus
cagctgcggtgtgaactgtctgtcc

SEQ ID NO: 86233 - DNA, 25 bp, Mus musculus
cagctgcgtgattggcctcgtgtgc

SEQ ID NO: 86234 - DNA, 25 bp, Mus musculus
cagctgctagaagatgagggctacc

SEQ ID NO: 86235 - DNA, 25 bp, Mus musculus
cagctgctcccacctgactttgaag

SEQ ID NO: 86236 - DNA, 25 bp, Mus musculus
cagctgctgcatatttgtatactgc

SEQ ID NO: 86237 - DNA, 25 bp, Mus musculus
cagctgctgctgaacgagtatgtcc

SEQ ID NO: 86238 - DNA, 25 bp, Mus musculus
cagctgctgctgacgtgagaatacc

SEQ ID NO: 86239 - DNA, 25 bp, Mus musculus
cagctgctggagtgtctagtaatcc

SEQ ID NO: 86240 - DNA, 25 bp, Mus musculus
cagctgctggtgtagactttgatga

SEQ ID NO: 86241 - DNA, 25 bp, Mus musculus
cagctgcttctaaactccggagcaa

SEQ ID NO: 86242 - DNA, 25 bp, Mus musculus
cagctgcttgacttcgaaaggaccc

SEQ ID NO: 86243 - DNA, 25 bp, Mus musculus
cagctggaaaggctcatcgacctca

SEQ ID NO: 86244 - DNA, 25 bp, Mus musculus
cagctggaagccacacggttgctaa

SEQ ID NO: 86245 - DNA, 25 bp, Mus musculus
cagctggaatacatggacttggagg

SEQ ID NO: 86246 - DNA, 25 bp, Mus musculus
cagctggaatggcagtattaccaga

SEQ ID NO: 86247 - DNA, 25 bp, Mus musculus
cagctggactggaccttggaagacc

SEQ ID NO: 86248 - DNA, 25 bp, Mus musculus
cagctggagatcatgggcaaggaca

SEQ ID NO: 86249 - DNA, 25 bp, Mus musculus
cagctggatcctgaggaagaagaat

SEQ ID NO: 86250 - DNA, 25 bp, Mus musculus
cagctggatgaggtccgccaggtca

SEQ ID NO: 86251 - DNA, 25 bp, Mus musculus
cagctggatggtctacgtgcactac

SEQ ID NO: 86252 - DNA, 25 bp, Mus musculus
cagctggcaatcatgaaagggtttc

SEQ ID NO: 86253 - DNA, 25 bp, Mus musculus
cagctggccaccaggaggtaccaag

SEQ ID NO: 86254 - DNA, 25 bp, Mus musculus
cagctggccagtcaacgagaggtac

SEQ ID NO: 86255 - DNA, 25 bp, Mus musculus
cagctggccattgacacggaggaac

SEQ ID NO: 86256 - DNA, 25 bp, Mus musculus
cagctggcctggtttgatactgacc

SEQ ID NO: 86257 - DNA, 25 bp, Mus musculus
cagctggcgaagacttgggaagtca

SEQ ID NO: 86258 - DNA, 25 bp, Mus musculus
cagctggctctagttcgggacatcc

SEQ ID NO: 86259 - DNA, 25 bp, Mus musculus
cagctgggccgtgatgtagacaaca

SEQ ID NO: 86260 - DNA, 25 bp, Mus musculus
cagctggggctcgtgtccttgaagc

SEQ ID NO: 86261 - DNA, 25 bp, Mus musculus
cagctgggtacacctgctcagagca

SEQ ID NO: 86262 - DNA, 25 bp, Mus musculus
cagctggtacatcgaggaacctcta

SEQ ID NO: 86263 - DNA, 25 bp, Mus musculus
cagctggtactgaagatggattcga

SEQ ID NO: 86264 - DNA, 25 bp, Mus musculus
cagctggtattcctacttggtgtga

SEQ ID NO: 86265 - DNA, 25 bp, Mus musculus
cagctgtagctgtaccaaatcgacc

SEQ ID NO: 86266 - DNA, 25 bp, Mus musculus
cagctgtcataagcttgaagaggac

SEQ ID NO: 86267 - DNA, 25 bp, Mus musculus
cagctgtcctacaatgcgggagccc

SEQ ID NO: 86268 - DNA, 25 bp, Mus musculus
cagctgtctcttgctctggttctgc

SEQ ID NO: 86269 - DNA, 25 bp, Mus musculus
cagctgtgacacatgggcctggaga

SEQ ID NO: 86270 - DNA, 25 bp, Mus musculus
cagctgtgagagaaaaggcaatcca

SEQ ID NO: 86271 - DNA, 25 bp, Mus musculus
cagctgtgagctaccacatttaaac

SEQ ID NO: 86272 - DNA, 25 bp, Mus musculus
cagctgtgcaaatcgctggaccaca

SEQ ID NO: 86273 - DNA, 25 bp, Mus musculus
cagctgtgcgattggagcccgttca

SEQ ID NO: 86274 - DNA, 25 bp, Mus musculus
cagctgtgctatgtttgaagcctga

SEQ ID NO: 86275 - DNA, 25 bp, Mus musculus
cagctgtgggtataggcgactctct

SEQ ID NO: 86276 - DNA, 25 bp, Mus musculus
cagctgtggtctccaagggaacgaa

SEQ ID NO: 86277 - DNA, 25 bp, Mus musculus
cagctgttaagcacccatgaccagc

SEQ ID NO: 86278 - DNA, 25 bp, Mus musculus
cagctgttgcttggagttgactaca

SEQ ID NO: 86279 - DNA, 25 bp, Mus musculus
cagctgttggtggatcttgttgcca

SEQ ID NO: 86280 - DNA, 25 bp, Mus musculus
cagctgtttacctcctgtgcccgat

SEQ ID NO: 86281 - DNA, 25 bp, Mus musculus
cagctgtttgacatgcaatgggcca

SEQ ID NO: 86282 - DNA, 25 bp, Mus musculus
cagcttagtggaggcagactcgact

SEQ ID NO: 86283 - DNA, 25 bp, Mus musculus
cagcttatccagagaggcttctggc

SEQ ID NO: 86284 - DNA, 25 bp, Mus musculus
cagcttattctgtgtggtggcagca

SEQ ID NO: 86285 - DNA, 25 bp, Mus musculus
cagcttattgattgcatgtcagccc

SEQ ID NO: 86286 - DNA, 25 bp, Mus musculus
cagcttcaagctggcctacggagga

SEQ ID NO: 86287 - DNA, 25 bp, Mus musculus
cagcttcaggtaaaggttgccccag

SEQ ID NO: 86288 - DNA, 25 bp, Mus musculus
cagcttccacgtgtttgaccagggc

SEQ ID NO: 86289 - DNA, 25 bp, Mus musculus
cagcttccgcgttctcgtcgcgcgt

SEQ ID NO: 86290 - DNA, 25 bp, Mus musculus
cagcttcctcacagcaaaggcagga

SEQ ID NO: 86291 - DNA, 25 bp, Mus musculus
cagcttcgaaagtcatctccgcaga

SEQ ID NO: 86292 - DNA, 25 bp, Mus musculus
cagcttcgagaaggcagcagtaaag

SEQ ID NO: 86293 - DNA, 25 bp, Mus musculus
cagcttcgagggaattaaggcacgg

SEQ ID NO: 86294 - DNA, 25 bp, Mus musculus
cagcttctatgatgcggaagaactc

SEQ ID NO: 86295 - DNA, 25 bp, Mus musculus
cagcttctgccagacgtgagagcca

SEQ ID NO: 86296 - DNA, 25 bp, Mus musculus
cagcttgaactggaaggctctgcct

SEQ ID NO: 86297 - DNA, 25 bp, Mus musculus
cagcttgacaaagggcatccatcca

SEQ ID NO: 86298 - DNA, 25 bp, Mus musculus
cagcttgacacttgatcagaaggcc

SEQ ID NO: 86299 - DNA, 25 bp, Mus musculus
cagcttgagcccactggttggttcg

SEQ ID NO: 86300 - DNA, 25 bp, Mus musculus
cagcttgcaagcgaggaagacgact

SEQ ID NO: 86301 - DNA, 25 bp, Mus musculus
cagcttgccacactagccgatgaag

SEQ ID NO: 86302 - DNA, 25 bp, Mus musculus
cagcttggagagcaaaggcacttcc

SEQ ID NO: 86303 - DNA, 25 bp, Mus musculus
cagcttggaggagaacacatgagag

SEQ ID NO: 86304 - DNA, 25 bp, Mus musculus
cagcttgggcagtgtacagaccctc

SEQ ID NO: 86305 - DNA, 25 bp, Mus musculus
cagcttgggctgcttattatgctca

SEQ ID NO: 86306 - DNA, 25 bp, Mus musculus
cagcttgtgctttggtctggcagag

SEQ ID NO: 86307 - DNA, 25 bp, Mus musculus
cagcttgtggtttcagcctgaggag

SEQ ID NO: 86308 - DNA, 25 bp, Mus musculus
cagctttaacactggcctgtgcagg

SEQ ID NO: 86309 - DNA, 25 bp, Mus musculus
cagctttacgtagaaacgaaactga

SEQ ID NO: 86310 - DNA, 25 bp, Mus musculus
cagctttactagtccctctgtggga

SEQ ID NO: 86311 - DNA, 25 bp, Mus musculus
cagctttagcaactgtaaccatggg

SEQ ID NO: 86312 - DNA, 25 bp, Mus musculus
cagctttagcctgtgggcctaggcc

SEQ ID NO: 86313 - DNA, 25 bp, Mus musculus
cagctttcgccacttgcttagcaag

SEQ ID NO: 86314 - DNA, 25 bp, Mus musculus
cagctttgacttccgagtggcacca

SEQ ID NO: 86315 - DNA, 25 bp, Mus musculus
cagctttgagaagatcggctacaca

SEQ ID NO: 86316 - DNA, 25 bp, Mus musculus
cagctttggaggtagatctggaaac

SEQ ID NO: 86317 - DNA, 25 bp, Mus musculus
cagctttggccgacaacatagttac

SEQ ID NO: 86318 - DNA, 25 bp, Mus musculus
cagctttgggctgggcacgaagcca

SEQ ID NO: 86319 - DNA, 25 bp, Mus musculus
cagctttgtggacatggttcgagac

SEQ ID NO: 86320 - DNA, 25 bp, Mus musculus
cagcttttacctcttgcgtataatc

SEQ ID NO: 86321 - DNA, 25 bp, Mus musculus
cagcttttcctacagggtgtggccg

SEQ ID NO: 86322 - DNA, 25 bp, Mus musculus
cagcttttctggaaggtggacatga

SEQ ID NO: 86323 - DNA, 25 bp, Mus musculus
cagcttttgactaggtgcatggcac

SEQ ID NO: 86324 - DNA, 25 bp, Mus musculus
cagctttttgcacctggaggacgac

SEQ ID NO: 86325 - DNA, 25 bp, Mus musculus
caggaaaaagctgcttgcactaggg

SEQ ID NO: 86326 - DNA, 25 bp, Mus musculus
caggaaaacctcttgggacaccagg

SEQ ID NO: 86327 - DNA, 25 bp, Mus musculus
caggaaaactgtgggatcgtcgtct

SEQ ID NO: 86328 - DNA, 25 bp, Mus musculus
caggaaaagcccagactcttggatc

SEQ ID NO: 86329 - DNA, 25 bp, Mus musculus
caggaaaaggagatctctagttctt

SEQ ID NO: 86330 - DNA, 25 bp, Mus musculus
caggaaacgtctgctcgggagttca

SEQ ID NO: 86331 - DNA, 25 bp, Mus musculus
caggaaactggtctgctcggcaagt

SEQ ID NO: 86332 - DNA, 25 bp, Mus musculus
caggaaactgtgctgcctgcagcaa

SEQ ID NO: 86333 - DNA, 25 bp, Mus musculus
caggaaagcactatggggcatccag

SEQ ID NO: 86334 - DNA, 25 bp, Mus musculus
caggaaagctgtggtatcgctcccc

SEQ ID NO: 86335 - DNA, 25 bp, Mus musculus
caggaaaggcagtacacatctatcg

SEQ ID NO: 86336 - DNA, 25 bp, Mus musculus
caggaaagttcgaaggagagagaaa

SEQ ID NO: 86337 - DNA, 25 bp, Mus musculus
caggaaatagaacgagagatgcgct

SEQ ID NO: 86338 - DNA, 25 bp, Mus musculus
caggaacaactggactctacgactt

SEQ ID NO: 86339 - DNA, 25 bp, Mus musculus
caggaacaagagtgggcggaaacac

SEQ ID NO: 86340 - DNA, 25 bp, Mus musculus
caggaacagatatgcaggctggcca

SEQ ID NO: 86341 - DNA, 25 bp, Mus musculus
caggaacaggatacgtacgctctca

SEQ ID NO: 86342 - DNA, 25 bp, Mus musculus
caggaacaggcggtcactggagcat

SEQ ID NO: 86343 - DNA, 25 bp, Mus musculus
caggaacccagaccttggccatggt

SEQ ID NO: 86344 - DNA, 25 bp, Mus musculus
caggaacctgacatacgttcaggaa

SEQ ID NO: 86345 - DNA, 25 bp, Mus musculus
caggaacctgtccagcaacttggtg

SEQ ID NO: 86346 - DNA, 25 bp, Mus musculus
caggaacctttcacaacagccatta

SEQ ID NO: 86347 - DNA, 25 bp, Mus musculus
caggaacgagttttatgatgacgcc

SEQ ID NO: 86348 - DNA, 25 bp, Mus musculus
caggaactcacagctaggactgcaa

SEQ ID NO: 86349 - DNA, 25 bp, Mus musculus
caggaactcctttgctccaaggcag

SEQ ID NO: 86350 - DNA, 25 bp, Mus musculus
caggaactgacgctaactcttcaag

SEQ ID NO: 86351 - DNA, 25 bp, Mus musculus
caggaacttcggaggccaaagattc

SEQ ID NO: 86352 - DNA, 25 bp, Mus musculus
caggaagaactgacagacgaggaga

SEQ ID NO: 86353 - DNA, 25 bp, Mus musculus
caggaagaagctatccgggaaacgt

SEQ ID NO: 86354 - DNA, 25 bp, Mus musculus
caggaagacacaggactttacagcc

SEQ ID NO: 86355 - DNA, 25 bp, Mus musculus
caggaagacgctagtgctacagata

SEQ ID NO: 86356 - DNA, 25 bp, Mus musculus
caggaagacttctgacaagatgggc

SEQ ID NO: 86357 - DNA, 25 bp, Mus musculus
caggaagagctatccccaacaacag

SEQ ID NO: 86358 - DNA, 25 bp, Mus musculus
caggaagagggcactggcgacagct

SEQ ID NO: 86359 - DNA, 25 bp, Mus musculus
caggaagattttacacagggacata

SEQ ID NO: 86360 - DNA, 25 bp, Mus musculus
caggaagcactttgacacagaggag

SEQ ID NO: 86361 - DNA, 25 bp, Mus musculus
caggaagccctcatcacagtgaaag

SEQ ID NO: 86362 - DNA, 25 bp, Mus musculus
caggaagccctgctgtaacacttct

SEQ ID NO: 86363 - DNA, 25 bp, Mus musculus
caggaagccggcagagtgactgtta

SEQ ID NO: 86364 - DNA, 25 bp, Mus musculus
caggaagccggttttggcctgagaa

SEQ ID NO: 86365 - DNA, 25 bp, Mus musculus
caggaagcggaagcagtttccattg

SEQ ID NO: 86366 - DNA, 25 bp, Mus musculus
caggaagctctatcacagctgagga

SEQ ID NO: 86367 - DNA, 25 bp, Mus musculus
caggaagctgtattctttaccagca

SEQ ID NO: 86368 - DNA, 25 bp, Mus musculus
caggaaggaaacaatggccctcatc

SEQ ID NO: 86369 - DNA, 25 bp, Mus musculus
caggaaggagcctccctcagggttt

SEQ ID NO: 86370 - DNA, 25 bp, Mus musculus
caggaaggctgagtagcttggctag

SEQ ID NO: 86371 - DNA, 25 bp, Mus musculus
caggaaggctggacaagaactacga

SEQ ID NO: 86372 - DNA, 25 bp, Mus musculus
caggaaggttacaagccagggcctc

SEQ ID NO: 86373 - DNA, 25 bp, Mus musculus
caggaagtcacttaatgccggtgct

SEQ ID NO: 86374 - DNA, 25 bp, Mus musculus
caggaagtcccagttccaggtggag

SEQ ID NO: 86375 - DNA, 25 bp, Mus musculus
caggaagtcctccaaagcctgtgga

SEQ ID NO: 86376 - DNA, 25 bp, Mus musculus
caggaagtctacaagtggccatgga

SEQ ID NO: 86377 - DNA, 25 bp, Mus musculus
caggaagtgaaaatgtggtgccccg

SEQ ID NO: 86378 - DNA, 25 bp, Mus musculus
caggaagttgtatgcggatgccctc

SEQ ID NO: 86379 - DNA, 25 bp, Mus musculus
caggaagtttcaccaagccgatgcc

SEQ ID NO: 86380 - DNA, 25 bp, Mus musculus
caggaatacaaactcagacttggca

SEQ ID NO: 86381 - DNA, 25 bp, Mus musculus
caggaatactatgacaggaaggctc

SEQ ID NO: 86382 - DNA, 25 bp, Mus musculus
caggaatactgaagtgcccggagtg

SEQ ID NO: 86383 - DNA, 25 bp, Mus musculus
caggaatatcattggcgtcatcccc

SEQ ID NO: 86384 - DNA, 25 bp, Mus musculus
caggaatatgtggaacagctgctgc

SEQ ID NO: 86385 - DNA, 25 bp, Mus musculus
caggaatcgccaactttgcccgagt

SEQ ID NO: 86386 - DNA, 25 bp, Mus musculus
caggaatcgcgggtgaagttctcca

SEQ ID NO: 86387 - DNA, 25 bp, Mus musculus
caggaatctataccagctgcagcaa

SEQ ID NO: 86388 - DNA, 25 bp, Mus musculus
caggaatctggaaacaatggctaca

SEQ ID NO: 86389 - DNA, 25 bp, Mus musculus
caggaatcttgcagaagaccgcagt

SEQ ID NO: 86390 - DNA, 25 bp, Mus musculus
caggaatgctgaggaaaactcggcc

SEQ ID NO: 86391 - DNA, 25 bp, Mus musculus
caggaattccagtcgttagtagtga

SEQ ID NO: 86392 - DNA, 25 bp, Mus musculus
caggaattccgttatggcctagaag

SEQ ID NO: 86393 - DNA, 25 bp, Mus musculus
caggaatttgatgaccaaaagcaag

SEQ ID NO: 86394 - DNA, 25 bp, Mus musculus
caggacaaattgctgtggaagctca

SEQ ID NO: 86395 - DNA, 25 bp, Mus musculus
caggacaacaggtgagaactgggca

SEQ ID NO: 86396 - DNA, 25 bp, Mus musculus
caggacaacgttttcttccccagtg

SEQ ID NO: 86397 - DNA, 25 bp, Mus musculus
caggacaactagcagatgggacacc

SEQ ID NO: 86398 - DNA, 25 bp, Mus musculus
caggacaatgtggtagtggacatgc

SEQ ID NO: 86399 - DNA, 25 bp, Mus musculus
caggacacagactatgctgaactgg

SEQ ID NO: 86400 - DNA, 25 bp, Mus musculus
caggacacattacaggagaagcaga

SEQ ID NO: 86401 - DNA, 25 bp, Mus musculus
caggacaccattgccgcaaactaag

SEQ ID NO: 86402 - DNA, 25 bp, Mus musculus
caggacagaacagagcacaacgtat

SEQ ID NO: 86403 - DNA, 25 bp, Mus musculus
caggacagaactcagaccgcagcat

SEQ ID NO: 86404 - DNA, 25 bp, Mus musculus
caggacagatgttgttcaccagact

SEQ ID NO: 86405 - DNA, 25 bp, Mus musculus
caggacagcgtgagcctgctcacct

SEQ ID NO: 86406 - DNA, 25 bp, Mus musculus
caggacaggacgtggatctggagca

SEQ ID NO: 86407 - DNA, 25 bp, Mus musculus
caggacagtcaagctggatgcgaca

SEQ ID NO: 86408 - DNA, 25 bp, Mus musculus
caggacatatttgacgccgtcgtga

SEQ ID NO: 86409 - DNA, 25 bp, Mus musculus
caggacatcattgccatcttgggta

SEQ ID NO: 86410 - DNA, 25 bp, Mus musculus
caggacatgagttcttggagtacaa

SEQ ID NO: 86411 - DNA, 25 bp, Mus musculus
caggacatggacattgtgtggcacc

SEQ ID NO: 86412 - DNA, 25 bp, Mus musculus
caggacatgggcacctctgggtatt

SEQ ID NO: 86413 - DNA, 25 bp, Mus musculus
caggacattgaggaccagctgtaca

SEQ ID NO: 86414 - DNA, 25 bp, Mus musculus
caggaccaagtaatcccgcagtaaa

SEQ ID NO: 86415 - DNA, 25 bp, Mus musculus
caggaccaggccattttgcaccgaa

SEQ ID NO: 86416 - DNA, 25 bp, Mus musculus
caggaccattgactgcccatgagta

SEQ ID NO: 86417 - DNA, 25 bp, Mus musculus
caggaccctcgctttgaaatttgca

SEQ ID NO: 86418 - DNA, 25 bp, Mus musculus
caggaccctgcataccagcggataa

SEQ ID NO: 86419 - DNA, 25 bp, Mus musculus
caggaccctggacgcgttttcctca

SEQ ID NO: 86420 - DNA, 25 bp, Mus musculus
caggacccttcgatgtggatacaga

SEQ ID NO: 86421 - DNA, 25 bp, Mus musculus
caggaccggcaactgaaaatcgtcg

SEQ ID NO: 86422 - DNA, 25 bp, Mus musculus
caggaccgtcgcagagtgtgtattt

SEQ ID NO: 86423 - DNA, 25 bp, Mus musculus
caggacctacagcatggtaactcca

SEQ ID NO: 86424 - DNA, 25 bp, Mus musculus
caggacctatttaaggaggcaagcc

SEQ ID NO: 86425 - DNA, 25 bp, Mus musculus
caggacctcagtgagaaggagctgt

SEQ ID NO: 86426 - DNA, 25 bp, Mus musculus
caggacctgaactgtgatttctgca

SEQ ID NO: 86427 - DNA, 25 bp, Mus musculus
caggacctggtgttggagctctaga

SEQ ID NO: 86428 - DNA, 25 bp, Mus musculus
caggaccttgctcgcagctatggca

SEQ ID NO: 86429 - DNA, 25 bp, Mus musculus
caggacgacattgaagattgcttga

SEQ ID NO: 86430 - DNA, 25 bp, Mus musculus
caggacgacgctatggtggactact

SEQ ID NO: 86431 - DNA, 25 bp, Mus musculus
caggacgcgcgggagaatctttccc

SEQ ID NO: 86432 - DNA, 25 bp, Mus musculus
caggacgctaggatgaaacagatca

SEQ ID NO: 86433 - DNA, 25 bp, Mus musculus
caggacggactttctggctactgac

SEQ ID NO: 86434 - DNA, 25 bp, Mus musculus
caggacggccactgagaccttgaga

SEQ ID NO: 86435 - DNA, 25 bp, Mus musculus
caggacggtgctcttcgctgccatt

SEQ ID NO: 86436 - DNA, 25 bp, Mus musculus
caggacgtgcttcgatccagagtca

SEQ ID NO: 86437 - DNA, 25 bp, Mus musculus
caggactaccggtgccccgcaagtt

SEQ ID NO: 86438 - DNA, 25 bp, Mus musculus
caggactagtagtggccagcggaat

SEQ ID NO: 86439 - DNA, 25 bp, Mus musculus
caggactcatgatcttggaagccag

SEQ ID NO: 86440 - DNA, 25 bp, Mus musculus
caggactcatggagtctcctgcgtg

SEQ ID NO: 86441 - DNA, 25 bp, Mus musculus
caggactccctgcagatcagttttg

SEQ ID NO: 86442 - DNA, 25 bp, Mus musculus
caggactccttgtccttgatctttc

SEQ ID NO: 86443 - DNA, 25 bp, Mus musculus
caggactcgcaggtctactggatag

SEQ ID NO: 86444 - DNA, 25 bp, Mus musculus
caggactgcgctgagattgccgact

SEQ ID NO: 86445 - DNA, 25 bp, Mus musculus
caggactgctttgctgaggccctac

SEQ ID NO: 86446 - DNA, 25 bp, Mus musculus
caggactggatgtttctacggccga

SEQ ID NO: 86447 - DNA, 25 bp, Mus musculus
caggactggtctttgaggataagcc

SEQ ID NO: 86448 - DNA, 25 bp, Mus musculus
caggactgtgtgcaatggctgcccc

SEQ ID NO: 86449 - DNA, 25 bp, Mus musculus
caggacttaaaggatcacatgcgtg

SEQ ID NO: 86450 - DNA, 25 bp, Mus musculus
caggacttccactcaggcatgatgc

SEQ ID NO: 86451 - DNA, 25 bp, Mus musculus
caggacttctttgtgctgcccgagt

SEQ ID NO: 86452 - DNA, 25 bp, Mus musculus
caggacttggtccaagaattcgaag

SEQ ID NO: 86453 - DNA, 25 bp, Mus musculus
caggacttgtatcatgccatcgcca

SEQ ID NO: 86454 - DNA, 25 bp, Mus musculus
caggactttcgaggacattgcccgg

SEQ ID NO: 86455 - DNA, 25 bp, Mus musculus
caggactttgtaaggacttggcata

SEQ ID NO: 86456 - DNA, 25 bp, Mus musculus
caggagaagcggaagacaatcaatg

SEQ ID NO: 86457 - DNA, 25 bp, Mus musculus
caggagaatcatggaacagtcgaca

SEQ ID NO: 86458 - DNA, 25 bp, Mus musculus
caggagaatggattgctgcgcgccc

SEQ ID NO: 86459 - DNA, 25 bp, Mus musculus
caggagacacctatgcaccagagta

SEQ ID NO: 86460 - DNA, 25 bp, Mus musculus
caggagacactgcacgttcaggagc

SEQ ID NO: 86461 - DNA, 25 bp, Mus musculus
caggagaccctagaagccttcgagc

SEQ ID NO: 86462 - DNA, 25 bp, Mus musculus
caggagaccgactggcgtagcgccg

SEQ ID NO: 86463 - DNA, 25 bp, Mus musculus
caggagacctgtcgctagtgaccag

SEQ ID NO: 86464 - DNA, 25 bp, Mus musculus
caggagacgtgtttcagaacggatg

SEQ ID NO: 86465 - DNA, 25 bp, Mus musculus
caggagactagcaggttggaatttc

SEQ ID NO: 86466 - DNA, 25 bp, Mus musculus
caggagactatttgttcgaaccgca

SEQ ID NO: 86467 - DNA, 25 bp, Mus musculus
caggagactttttgcattatcacgg

SEQ ID NO: 86468 - DNA, 25 bp, Mus musculus
caggagagaaaagccatgaaggtat

SEQ ID NO: 86469 - DNA, 25 bp, Mus musculus
caggagagacccagaaggagttctc

SEQ ID NO: 86470 - DNA, 25 bp, Mus musculus
caggagagagacacaagcttgccaa

SEQ ID NO: 86471 - DNA, 25 bp, Mus musculus
caggagagatctgctcgacaggact

SEQ ID NO: 86472 - DNA, 25 bp, Mus musculus
caggagagtatgcaattggctagcc

SEQ ID NO: 86473 - DNA, 25 bp, Mus musculus
caggagatacgaaaagatgaaggag

SEQ ID NO: 86474 - DNA, 25 bp, Mus musculus
caggagatcatctcaagcgcgagag

SEQ ID NO: 86475 - DNA, 25 bp, Mus musculus
caggagatccaagacctctgcaata

SEQ ID NO: 86476 - DNA, 25 bp, Mus musculus
caggagatcctaggcttgaacaagg

SEQ ID NO: 86477 - DNA, 25 bp, Mus musculus
caggagatccttaccaacagcaaga

SEQ ID NO: 86478 - DNA, 25 bp, Mus musculus
caggagatgctgcttcagacgccac

SEQ ID NO: 86479 - DNA, 25 bp, Mus musculus
caggagattgatgttttcaacaacc

SEQ ID NO: 86480 - DNA, 25 bp, Mus musculus
caggagcaaggctacagcaggtgct

SEQ ID NO: 86481 - DNA, 25 bp, Mus musculus
caggagcagcttcgaaaattacagg

SEQ ID NO: 86482 - DNA, 25 bp, Mus musculus
caggagcaggaacacaaacccttct

SEQ ID NO: 86483 - DNA, 25 bp, Mus musculus
caggagcccttttaggagcaccacc

SEQ ID NO: 86484 - DNA, 25 bp, Mus musculus
caggagccgactgaggaaactcttc

SEQ ID NO: 86485 - DNA, 25 bp, Mus musculus
caggagccggagcttatgaacgcta

SEQ ID NO: 86486 - DNA, 25 bp, Mus musculus
caggagctagaggaccggaacatct

SEQ ID NO: 86487 - DNA, 25 bp, Mus musculus
caggagctcaaacactctcacacag

SEQ ID NO: 86488 - DNA, 25 bp, Mus musculus
caggagctgatgctcttgccaaagt

SEQ ID NO: 86489 - DNA, 25 bp, Mus musculus
caggagctgctgcatatcgtcagag

SEQ ID NO: 86490 - DNA, 25 bp, Mus musculus
caggagctgtcgttgaccgaggcct

SEQ ID NO: 86491 - DNA, 25 bp, Mus musculus
caggagcttcctgtaggacaagacc

SEQ ID NO: 86492 - DNA, 25 bp, Mus musculus
caggaggaaaaaatggcagcagcag

SEQ ID NO: 86493 - DNA, 25 bp, Mus musculus
caggaggaaatacccagactgctac

SEQ ID NO: 86494 - DNA, 25 bp, Mus musculus
caggaggacttcaaggcactatggg

SEQ ID NO: 86495 - DNA, 25 bp, Mus musculus
caggaggagcaaacagatacagaga

SEQ ID NO: 86496 - DNA, 25 bp, Mus musculus
caggaggaggtattactagaacagt

SEQ ID NO: 86497 - DNA, 25 bp, Mus musculus
caggaggatgcacccatgattgagc

SEQ ID NO: 86498 - DNA, 25 bp, Mus musculus
caggaggatgttgcagatcagagcc

SEQ ID NO: 86499 - DNA, 25 bp, Mus musculus
caggaggccaggatccagaagctac

SEQ ID NO: 86500 - DNA, 25 bp, Mus musculus
caggaggccattccaacagtgacga

SEQ ID NO: 86501 - DNA, 25 bp, Mus musculus
caggaggcccctgcactttgaagtg

SEQ ID NO: 86502 - DNA, 25 bp, Mus musculus
caggaggcccgggaatttgctagca

SEQ ID NO: 86503 - DNA, 25 bp, Mus musculus
caggaggcggctttcattctctgtc

SEQ ID NO: 86504 - DNA, 25 bp, Mus musculus
caggaggcttctcaactttgcccag

SEQ ID NO: 86505 - DNA, 25 bp, Mus musculus
caggaggcttgggatctaggaaaca

SEQ ID NO: 86506 - DNA, 25 bp, Mus musculus
caggagggcctcttgaaatttgctg

SEQ ID NO: 86507 - DNA, 25 bp, Mus musculus
caggaggtatttattctaggcttga

SEQ ID NO: 86508 - DNA, 25 bp, Mus musculus
caggaggtccactgcaaagctttat

SEQ ID NO: 86509 - DNA, 25 bp, Mus musculus
caggaggtccctacaactccgtgga

SEQ ID NO: 86510 - DNA, 25 bp, Mus musculus
caggaggtgaccatcgagatcgtgc

SEQ ID NO: 86511 - DNA, 25 bp, Mus musculus
caggagtaccacagcgcagagctgg

SEQ ID NO: 86512 - DNA, 25 bp, Mus musculus
caggagtcaacgctgcagaagtgct

SEQ ID NO: 86513 - DNA, 25 bp, Mus musculus
caggagtcacccgtgcttaacagga

SEQ ID NO: 86514 - DNA, 25 bp, Mus musculus
caggagtcctctatgtgcagaaaca

SEQ ID NO: 86515 - DNA, 25 bp, Mus musculus
caggagtctcccaagatgctgcgga

SEQ ID NO: 86516 - DNA, 25 bp, Mus musculus
caggagtcttctgctttggagcctc

SEQ ID NO: 86517 - DNA, 25 bp, Mus musculus
caggagtgaagaacgtgccaagtcc

SEQ ID NO: 86518 - DNA, 25 bp, Mus musculus
caggagtgaatgtgccgtcaccaag

SEQ ID NO: 86519 - DNA, 25 bp, Mus musculus
caggagtgattagccgagtgtccca

SEQ ID NO: 86520 - DNA, 25 bp, Mus musculus
caggagtgtaactgcttgccggaca

SEQ ID NO: 86521 - DNA, 25 bp, Mus musculus
caggagtgtggcttcaacagctctc

SEQ ID NO: 86522 - DNA, 25 bp, Mus musculus
caggagttaaggaccctggacctca

SEQ ID NO: 86523 - DNA, 25 bp, Mus musculus
caggagttcataaacctggatggca

SEQ ID NO: 86524 - DNA, 25 bp, Mus musculus
caggagttccagtctgcctgcaagt

SEQ ID NO: 86525 - DNA, 25 bp, Mus musculus
caggagttccccttggctatccgga

SEQ ID NO: 86526 - DNA, 25 bp, Mus musculus
caggagtttgacacaatggaagacc

SEQ ID NO: 86527 - DNA, 25 bp, Mus musculus
caggagtttgctcagcttctggctc

SEQ ID NO: 86528 - DNA, 25 bp, Mus musculus
caggataacagataacgcaggagtc

SEQ ID NO: 86529 - DNA, 25 bp, Mus musculus
caggataccagtctcatgatgatag

SEQ ID NO: 86530 - DNA, 25 bp, Mus musculus
caggatatccttctgtccagtgcac

SEQ ID NO: 86531 - DNA, 25 bp, Mus musculus
caggatatcggagcaacatggtgtc

SEQ ID NO: 86532 - DNA, 25 bp, Mus musculus
caggatatctgttgcatggcagccg

SEQ ID NO: 86533 - DNA, 25 bp, Mus musculus
caggatcaccccaatgtcactgagt

SEQ ID NO: 86534 - DNA, 25 bp, Mus musculus
caggatcagcgccatagacggagat

SEQ ID NO: 86535 - DNA, 25 bp, Mus musculus
caggatcctagttctcaggcacgga

SEQ ID NO: 86536 - DNA, 25 bp, Mus musculus
caggatcctccttttgcatgcgact

SEQ ID NO: 86537 - DNA, 25 bp, Mus musculus
caggatcctgcatccctaggcaatg

SEQ ID NO: 86538 - DNA, 25 bp, Mus musculus
caggatcctggtcttcatacagaga

SEQ ID NO: 86539 - DNA, 25 bp, Mus musculus
caggatccttgactgttgccgcagg

SEQ ID NO: 86540 - DNA, 25 bp, Mus musculus
caggatctgaaaagccttcctcggg

SEQ ID NO: 86541 - DNA, 25 bp, Mus musculus
caggatctggccacactgattggtt

SEQ ID NO: 86542 - DNA, 25 bp, Mus musculus
caggatgacatgtgcttctgtgcca

SEQ ID NO: 86543 - DNA, 25 bp, Mus musculus
caggatgagacttggccagatggct

SEQ ID NO: 86544 - DNA, 25 bp, Mus musculus
caggatgcactggatcccgagcctt

SEQ ID NO: 86545 - DNA, 25 bp, Mus musculus
caggatgcaggatgacccaagagtc

SEQ ID NO: 86546 - DNA, 25 bp, Mus musculus
caggatgcccatcgttatggtgaca

SEQ ID NO: 86547 - DNA, 25 bp, Mus musculus
caggatgcctccctgagctgtaaat

SEQ ID NO: 86548 - DNA, 25 bp, Mus musculus
caggatgccttctgcaactccgaca

SEQ ID NO: 86549 - DNA, 25 bp, Mus musculus
caggatggaaacaacctttgggcct

SEQ ID NO: 86550 - DNA, 25 bp, Mus musculus
caggatggacctgactttcaagaca

SEQ ID NO: 86551 - DNA, 25 bp, Mus musculus
caggatggatgaacagcgatgctcc

SEQ ID NO: 86552 - DNA, 25 bp, Mus musculus
caggatggctgcatgaaactgtcca

SEQ ID NO: 86553 - DNA, 25 bp, Mus musculus
caggatgggatcagctgagcaagac

SEQ ID NO: 86554 - DNA, 25 bp, Mus musculus
caggatgggcatcgaaacaagagca

SEQ ID NO: 86555 - DNA, 25 bp, Mus musculus
caggatgggcttggcatttggcacc

SEQ ID NO: 86556 - DNA, 25 bp, Mus musculus
caggatggtcatctgaaaagcaggc

SEQ ID NO: 86557 - DNA, 25 bp, Mus musculus
caggatgtacttgacacccagcgaa

SEQ ID NO: 86558 - DNA, 25 bp, Mus musculus
caggatgtagctctggagacccaca

SEQ ID NO: 86559 - DNA, 25 bp, Mus musculus
caggatgtccttgggatgagcctcc

SEQ ID NO: 86560 - DNA, 25 bp, Mus musculus
caggatgtgagtgagactgtccctc

SEQ ID NO: 86561 - DNA, 25 bp, Mus musculus
caggatgtggcagtagagtgacttc

SEQ ID NO: 86562 - DNA, 25 bp, Mus musculus
caggattaccagatctaatggactc

SEQ ID NO: 86563 - DNA, 25 bp, Mus musculus
caggattaccgaaagctgagcagca

SEQ ID NO: 86564 - DNA, 25 bp, Mus musculus
caggattcaaatgtgtagcgcgttc

SEQ ID NO: 86565 - DNA, 25 bp, Mus musculus
caggattcaccaggacctcgagagg

SEQ ID NO: 86566 - DNA, 25 bp, Mus musculus
caggattcgcaagtacagccagacc

SEQ ID NO: 86567 - DNA, 25 bp, Mus musculus
caggattgccctgtcgctgatggac

SEQ ID NO: 86568 - DNA, 25 bp, Mus musculus
caggattgcgtccatatcagaccca

SEQ ID NO: 86569 - DNA, 25 bp, Mus musculus
caggattgtatgctctggctgccaa

SEQ ID NO: 86570 - DNA, 25 bp, Mus musculus
caggattgtggagatcgtagacgcc

SEQ ID NO: 86571 - DNA, 25 bp, Mus musculus
caggcaaagtaaacagaacttggcc

SEQ ID NO: 86572 - DNA, 25 bp, Mus musculus
caggcaactacagcattggaaggaa

SEQ ID NO: 86573 - DNA, 25 bp, Mus musculus
caggcaagtgtaggcacatacccag

SEQ ID NO: 86574 - DNA, 25 bp, Mus musculus
caggcaatttcgtgggcaaggacaa

SEQ ID NO: 86575 - DNA, 25 bp, Mus musculus
caggcacaaagggagtactcttgca

SEQ ID NO: 86576 - DNA, 25 bp, Mus musculus
caggcacaagcaagaggatattccc

SEQ ID NO: 86577 - DNA, 25 bp, Mus musculus
caggcacacagtgggaagcttctcc

SEQ ID NO: 86578 - DNA, 25 bp, Mus musculus
caggcacagcaggtttccatagcaa

SEQ ID NO: 86579 - DNA, 25 bp, Mus musculus
caggcacagctagtatccgggtacg

SEQ ID NO: 86580 - DNA, 25 bp, Mus musculus
caggcaccatgccaaagactggatg

SEQ ID NO: 86581 - DNA, 25 bp, Mus musculus
caggcaccggctgtggacctagaat

SEQ ID NO: 86582 - DNA, 25 bp, Mus musculus
caggcacctataagctgttcttcga

SEQ ID NO: 86583 - DNA, 25 bp, Mus musculus
caggcactgaactgggcacttgacg

SEQ ID NO: 86584 - DNA, 25 bp, Mus musculus
caggcactgagcaagcggacattgt

SEQ ID NO: 86585 - DNA, 25 bp, Mus musculus
caggcactgccaccgggcgaatcgt

SEQ ID NO: 86586 - DNA, 25 bp, Mus musculus
caggcactggtgctaatccctcaga

SEQ ID NO: 86587 - DNA, 25 bp, Mus musculus
caggcacttcctcgctaatatcggg

SEQ ID NO: 86588 - DNA, 25 bp, Mus musculus
caggcacttcttggacatcatcgat

SEQ ID NO: 86589 - DNA, 25 bp, Mus musculus
caggcagaaattgggaatcacatcc

SEQ ID NO: 86590 - DNA, 25 bp, Mus musculus
caggcagaagaatcccaggagccta

SEQ ID NO: 86591 - DNA, 25 bp, Mus musculus
caggcagaccatttacttcagggac

SEQ ID NO: 86592 - DNA, 25 bp, Mus musculus
caggcagattgtgtaaaacaggaac

SEQ ID NO: 86593 - DNA, 25 bp, Mus musculus
caggcagcagctacaggagttatca

SEQ ID NO: 86594 - DNA, 25 bp, Mus musculus
caggcagcagctgttcagaaacggg

SEQ ID NO: 86595 - DNA, 25 bp, Mus musculus
caggcagccaagaaaatgttaccag

SEQ ID NO: 86596 - DNA, 25 bp, Mus musculus
caggcagcccgctatccttggatgg

SEQ ID NO: 86597 - DNA, 25 bp, Mus musculus
caggcagcctgtcgctgatggttct

SEQ ID NO: 86598 - DNA, 25 bp, Mus musculus
caggcagctacagtggcatacagat

SEQ ID NO: 86599 - DNA, 25 bp, Mus musculus
caggcagctcatgacactggctggg

SEQ ID NO: 86600 - DNA, 25 bp, Mus musculus
caggcaggacctggcctgtttgtta

SEQ ID NO: 86601 - DNA, 25 bp, Mus musculus
caggcaggattagagaggcgcctcc

SEQ ID NO: 86602 - DNA, 25 bp, Mus musculus
caggcaggcaaaacccttgtatgca

SEQ ID NO: 86603 - DNA, 25 bp, Mus musculus
caggcaggctgcttcaacaaggaca

SEQ ID NO: 86604 - DNA, 25 bp, Mus musculus
caggcaggtcctcacgctatgtgtg

SEQ ID NO: 86605 - DNA, 25 bp, Mus musculus
caggcagtaccagggattagggtct

SEQ ID NO: 86606 - DNA, 25 bp, Mus musculus
caggcagtgggcaggaatatagcca

SEQ ID NO: 86607 - DNA, 25 bp, Mus musculus
caggcagttgcttacgaggaaccaa

SEQ ID NO: 86608 - DNA, 25 bp, Mus musculus
caggcagtttcttcacaacaggaca

SEQ ID NO: 86609 - DNA, 25 bp, Mus musculus
caggcataaatagctttgaagagaa

SEQ ID NO: 86610 - DNA, 25 bp, Mus musculus
caggcatagaagtcgcacagttggc

SEQ ID NO: 86611 - DNA, 25 bp, Mus musculus
caggcatcagccgttcagtgacagt

SEQ ID NO: 86612 - DNA, 25 bp, Mus musculus
caggcatcagtcatctcattaggag

SEQ ID NO: 86613 - DNA, 25 bp, Mus musculus
caggcatcatgctggtctgcggcat

SEQ ID NO: 86614 - DNA, 25 bp, Mus musculus
caggcatcccgtttggtgagagcaa

SEQ ID NO: 86615 - DNA, 25 bp, Mus musculus
caggcatcgcgtggtcccgtgagct

SEQ ID NO: 86616 - DNA, 25 bp, Mus musculus
caggcatcgggagttccaattaaca

SEQ ID NO: 86617 - DNA, 25 bp, Mus musculus
caggcatctcctcgaatttatgagc

SEQ ID NO: 86618 - DNA, 25 bp, Mus musculus
caggcatgcagcctccaggcagtgc

SEQ ID NO: 86619 - DNA, 25 bp, Mus musculus
caggcatgcatggatagagattcag

SEQ ID NO: 86620 - DNA, 25 bp, Mus musculus
caggcatgcgttggctatgtgtatg

SEQ ID NO: 86621 - DNA, 25 bp, Mus musculus
caggcatggaagttctgttgtcaac

SEQ ID NO: 86622 - DNA, 25 bp, Mus musculus
caggcatgttctctgggttccacta

SEQ ID NO: 86623 - DNA, 25 bp, Mus musculus
caggcattgaattagaccatggccc

SEQ ID NO: 86624 - DNA, 25 bp, Mus musculus
caggccaaacagttatctgaaggac

SEQ ID NO: 86625 - DNA, 25 bp, Mus musculus
caggccaaatacagcagcacaaggg

SEQ ID NO: 86626 - DNA, 25 bp, Mus musculus
caggccaaggcctgcaaggtgcaag

SEQ ID NO: 86627 - DNA, 25 bp, Mus musculus
caggccacatgggatacagcacaaa

SEQ ID NO: 86628 - DNA, 25 bp, Mus musculus
caggccaccttttagcccgatggaa

SEQ ID NO: 86629 - DNA, 25 bp, Mus musculus
caggccactgctgtgtatataaaac

SEQ ID NO: 86630 - DNA, 25 bp, Mus musculus
caggccactgggaacgcatttatac

SEQ ID NO: 86631 - DNA, 25 bp, Mus musculus
caggccagaagatccaaaagctcgg

SEQ ID NO: 86632 - DNA, 25 bp, Mus musculus
caggccaggccaaggttaagtcctc

SEQ ID NO: 86633 - DNA, 25 bp, Mus musculus
caggccatcgctatgagagggacca

SEQ ID NO: 86634 - DNA, 25 bp, Mus musculus
caggccattgcagagttattgcagg

SEQ ID NO: 86635 - DNA, 25 bp, Mus musculus
caggcccagcataaaggccgtgtgg

SEQ ID NO: 86636 - DNA, 25 bp, Mus musculus
caggcccagcctctttcattggtca

SEQ ID NO: 86637 - DNA, 25 bp, Mus musculus
caggcccagcggactgttttgatac

SEQ ID NO: 86638 - DNA, 25 bp, Mus musculus
caggcccagggacttgtgttcagat

SEQ ID NO: 86639 - DNA, 25 bp, Mus musculus
caggcccatggtggtgagacttcca

SEQ ID NO: 86640 - DNA, 25 bp, Mus musculus
caggcccatttacttacaccgcgaa

SEQ ID NO: 86641 - DNA, 25 bp, Mus musculus
caggccccgctacgtggtagacaga

SEQ ID NO: 86642 - DNA, 25 bp, Mus musculus
caggcccggactttgacctcagaga

SEQ ID NO: 86643 - DNA, 25 bp, Mus musculus
caggccctcaagtggcgggaataca

SEQ ID NO: 86644 - DNA, 25 bp, Mus musculus
caggccctccgagacatggtgcgga

SEQ ID NO: 86645 - DNA, 25 bp, Mus musculus
caggccctcgagtctcttctgagag

SEQ ID NO: 86646 - DNA, 25 bp, Mus musculus
caggccctgaatggattgtcggaca

SEQ ID NO: 86647 - DNA, 25 bp, Mus musculus
caggccctgagcgatgagcatgttc

SEQ ID NO: 86648 - DNA, 25 bp, Mus musculus
caggccctggaagactgagtaacgg

SEQ ID NO: 86649 - DNA, 25 bp, Mus musculus
caggccctggactggctagagagca

SEQ ID NO: 86650 - DNA, 25 bp, Mus musculus
caggccctggcctatgcagaagtgg

SEQ ID NO: 86651 - DNA, 25 bp, Mus musculus
caggccctgtccgagattcaagaaa

SEQ ID NO: 86652 - DNA, 25 bp, Mus musculus
caggccctgttaagcagacagatgc

SEQ ID NO: 86653 - DNA, 25 bp, Mus musculus
caggccgaggcttacataaaccgag

SEQ ID NO: 86654 - DNA, 25 bp, Mus musculus
caggccgattacatgggagcagatt

SEQ ID NO: 86655 - DNA, 25 bp, Mus musculus
caggccgcgaggaaaaaatcacttt

SEQ ID NO: 86656 - DNA, 25 bp, Mus musculus
caggccggctcgtcagtctagtggt

SEQ ID NO: 86657 - DNA, 25 bp, Mus musculus
caggccgtcagcgtggatgaaatga

SEQ ID NO: 86658 - DNA, 25 bp, Mus musculus
caggccgttccccagagaaatgtgc

SEQ ID NO: 86659 - DNA, 25 bp, Mus musculus
caggccgttgacagaggtgaaccct

SEQ ID NO: 86660 - DNA, 25 bp, Mus musculus
caggcctacagggacaaaccaggca

SEQ ID NO: 86661 - DNA, 25 bp, Mus musculus
caggcctacgctggagtgcagcagt

SEQ ID NO: 86662 - DNA, 25 bp, Mus musculus
caggcctagaaaccttggtgtcttt

SEQ ID NO: 86663 - DNA, 25 bp, Mus musculus
caggcctagaggacgtcacagttga

SEQ ID NO: 86664 - DNA, 25 bp, Mus musculus
caggcctagcagagctgggacatga

SEQ ID NO: 86665 - DNA, 25 bp, Mus musculus
caggcctagggtccatttctcagca

SEQ ID NO: 86666 - DNA, 25 bp, Mus musculus
caggcctcggtcctagaagatggca

SEQ ID NO: 86667 - DNA, 25 bp, Mus musculus
caggcctgctggtctcacctggtaa

SEQ ID NO: 86668 - DNA, 25 bp, Mus musculus
caggcctgggtgacgtcaacgcagc

SEQ ID NO: 86669 - DNA, 25 bp, Mus musculus
caggcctgtgcctccatactttggt

SEQ ID NO: 86670 - DNA, 25 bp, Mus musculus
caggccttcgttggtgacattgcac

SEQ ID NO: 86671 - DNA, 25 bp, Mus musculus
caggccttgagaagaggattgacca

SEQ ID NO: 86672 - DNA, 25 bp, Mus musculus
caggccttggcaacaacgatcctat

SEQ ID NO: 86673 - DNA, 25 bp, Mus musculus
caggcgacatcggaaaagcagttga

SEQ ID NO: 86674 - DNA, 25 bp, Mus musculus
caggcgatggagtttccggacctcg

SEQ ID NO: 86675 - DNA, 25 bp, Mus musculus
caggcgattggaagaatcagttcac

SEQ ID NO: 86676 - DNA, 25 bp, Mus musculus
caggcgcaagtgatgtggagaccca

SEQ ID NO: 86677 - DNA, 25 bp, Mus musculus
caggcgcaggcagtctgaagaagat

SEQ ID NO: 86678 - DNA, 25 bp, Mus musculus
caggcgctccaagcagtgagatcac

SEQ ID NO: 86679 - DNA, 25 bp, Mus musculus
caggcgctgatcaagaacataagac

SEQ ID NO: 86680 - DNA, 25 bp, Mus musculus
caggcggccgcagggagtcgcagaa

SEQ ID NO: 86681 - DNA, 25 bp, Mus musculus
caggcggctggagggtcctcgccga

SEQ ID NO: 86682 - DNA, 25 bp, Mus musculus
caggcggtagaacctccacctgact

SEQ ID NO: 86683 - DNA, 25 bp, Mus musculus
caggcggtgcaagcatgcatcgatt

SEQ ID NO: 86684 - DNA, 25 bp, Mus musculus
caggcggtgcgtccttaattgctcc

SEQ ID NO: 86685 - DNA, 25 bp, Mus musculus
caggcgtccggatctacaatgtgga

SEQ ID NO: 86686 - DNA, 25 bp, Mus musculus
caggcgtgagtgtgaatgtgccaac

SEQ ID NO: 86687 - DNA, 25 bp, Mus musculus
caggcgttcagaaggagagccaaca

SEQ ID NO: 86688 - DNA, 25 bp, Mus musculus
caggctaccctgtcatcgttgaaga

SEQ ID NO: 86689 - DNA, 25 bp, Mus musculus
caggctagactttgcagcgtggaac

SEQ ID NO: 86690 - DNA, 25 bp, Mus musculus
caggctagtgttgcccagagctccg

SEQ ID NO: 86691 - DNA, 25 bp, Mus musculus
caggctatgagggacagaactgctc

SEQ ID NO: 86692 - DNA, 25 bp, Mus musculus
caggctatggatggatatgtcagga

SEQ ID NO: 86693 - DNA, 25 bp, Mus musculus
caggctcagacgaagacagtgttgc

SEQ ID NO: 86694 - DNA, 25 bp, Mus musculus
caggctcaggctgttgtgactacca

SEQ ID NO: 86695 - DNA, 25 bp, Mus musculus
caggctcattgtcacctttgacgaa

SEQ ID NO: 86696 - DNA, 25 bp, Mus musculus
caggctcccagggatcagtgggcta

SEQ ID NO: 86697 - DNA, 25 bp, Mus musculus
caggctcccgagacaagactgttcg

SEQ ID NO: 86698 - DNA, 25 bp, Mus musculus
caggctccgagcagtctctggtgcg

SEQ ID NO: 86699 - DNA, 25 bp, Mus musculus
caggctccgtatcttctacatggaa

SEQ ID NO: 86700 - DNA, 25 bp, Mus musculus
caggctcctatgtagactgcttcac

SEQ ID NO: 86701 - DNA, 25 bp, Mus musculus
caggctcgggattggccgtctatac

SEQ ID NO: 86702 - DNA, 25 bp, Mus musculus
caggctctagagtgccctgctcctt

SEQ ID NO: 86703 - DNA, 25 bp, Mus musculus
caggctctcagctgcctcacaggat

SEQ ID NO: 86704 - DNA, 25 bp, Mus musculus
caggctctccctgttgaggcagaat

SEQ ID NO: 86705 - DNA, 25 bp, Mus musculus
caggctctcgctaaacagtttgcag

SEQ ID NO: 86706 - DNA, 25 bp, Mus musculus
caggctctctggttggaatcccatg

SEQ ID NO: 86707 - DNA, 25 bp, Mus musculus
caggctctgaaaattgaacacaaaa

SEQ ID NO: 86708 - DNA, 25 bp, Mus musculus
caggctcttgtcacttcaccagcga

SEQ ID NO: 86709 - DNA, 25 bp, Mus musculus
caggctgaagctgttccgacattac

SEQ ID NO: 86710 - DNA, 25 bp, Mus musculus
caggctgacagcaaacttcggaacg

SEQ ID NO: 86711 - DNA, 25 bp, Mus musculus
caggctgacagcctcaacgaggtgc

SEQ ID NO: 86712 - DNA, 25 bp, Mus musculus
caggctgacatcgaccagctggagg

SEQ ID NO: 86713 - DNA, 25 bp, Mus musculus
caggctgagtgatgctctgaccaca

SEQ ID NO: 86714 - DNA, 25 bp, Mus musculus
caggctgatgtcttcccagagggca

SEQ ID NO: 86715 - DNA, 25 bp, Mus musculus
caggctgcatgatgaccttctaccg

SEQ ID NO: 86716 - DNA, 25 bp, Mus musculus
caggctgcatggtgatggtcccgaa

SEQ ID NO: 86717 - DNA, 25 bp, Mus musculus
caggctgccattcttgggagaaatc

SEQ ID NO: 86718 - DNA, 25 bp, Mus musculus
caggctgcccgtcgctgtgatcaat

SEQ ID NO: 86719 - DNA, 25 bp, Mus musculus
caggctgccctagatagtgcgtaca

SEQ ID NO: 86720 - DNA, 25 bp, Mus musculus
caggctgcctcaagtcagagtgcca

SEQ ID NO: 86721 - DNA, 25 bp, Mus musculus
caggctgcctgttatgttcaggcta

SEQ ID NO: 86722 - DNA, 25 bp, Mus musculus
caggctgcgtgtccagatgactttg

SEQ ID NO: 86723 - DNA, 25 bp, Mus musculus
caggctgctggtcattctggtcatc

SEQ ID NO: 86724 - DNA, 25 bp, Mus musculus
caggctgctttggtgttgtacatcg

SEQ ID NO: 86725 - DNA, 25 bp, Mus musculus
caggctggaagcaacgagaagtcat

SEQ ID NO: 86726 - DNA, 25 bp, Mus musculus
caggctggctccatgctagcaagag

SEQ ID NO: 86727 - DNA, 25 bp, Mus musculus
caggctgggcaatctggaccgctat

SEQ ID NO: 86728 - DNA, 25 bp, Mus musculus
caggctggtcctgtggccatcagtg

SEQ ID NO: 86729 - DNA, 25 bp, Mus musculus
caggctggtgctatgagattcaaac

SEQ ID NO: 86730 - DNA, 25 bp, Mus musculus
caggctgtaacctgggttccggaag

SEQ ID NO: 86731 - DNA, 25 bp, Mus musculus
caggctgtactacgctttgccggaa

SEQ ID NO: 86732 - DNA, 25 bp, Mus musculus
caggctgtcagatatattccgggca

SEQ ID NO: 86733 - DNA, 25 bp, Mus musculus
caggctgtggtggacaacgtgtact

SEQ ID NO: 86734 - DNA, 25 bp, Mus musculus
caggctgttccctgtatgcaaacaa

SEQ ID NO: 86735 - DNA, 25 bp, Mus musculus
caggcttactaacccaagacagttt

SEQ ID NO: 86736 - DNA, 25 bp, Mus musculus
caggcttagtgctgatggctgacat

SEQ ID NO: 86737 - DNA, 25 bp, Mus musculus
caggcttcagctattgggcaattca

SEQ ID NO: 86738 - DNA, 25 bp, Mus musculus
caggcttgccttagagtactacaca

SEQ ID NO: 86739 - DNA, 25 bp, Mus musculus
caggcttggcgtgtttaaggacttc

SEQ ID NO: 86740 - DNA, 25 bp, Mus musculus
caggctttcaaggtggacagtgaca

SEQ ID NO: 86741 - DNA, 25 bp, Mus musculus
caggctttgagtggcgctggtctcc

SEQ ID NO: 86742 - DNA, 25 bp, Mus musculus
caggctttgtcttgaatggctccat

SEQ ID NO: 86743 - DNA, 25 bp, Mus musculus
caggcttttagaggcgaggagaaaa

SEQ ID NO: 86744 - DNA, 25 bp, Mus musculus
caggcttttgccagacttgagaaga

SEQ ID NO: 86745 - DNA, 25 bp, Mus musculus
cagggaaaccttgcgtagagccagc

SEQ ID NO: 86746 - DNA, 25 bp, Mus musculus
cagggaaccaggtgtctgagtacat

SEQ ID NO: 86747 - DNA, 25 bp, Mus musculus
cagggaaccatgcaagtataaggac

SEQ ID NO: 86748 - DNA, 25 bp, Mus musculus
cagggaacggcaagctacggcctct

SEQ ID NO: 86749 - DNA, 25 bp, Mus musculus
cagggaactcacctaagacagggac

SEQ ID NO: 86750 - DNA, 25 bp, Mus musculus
cagggaagaagttggatataaatca

SEQ ID NO: 86751 - DNA, 25 bp, Mus musculus
cagggaagatactctggcaaggaac

SEQ ID NO: 86752 - DNA, 25 bp, Mus musculus
cagggaagccaacctgacagaagat

SEQ ID NO: 86753 - DNA, 25 bp, Mus musculus
cagggaagcccgtcacaggcattga

SEQ ID NO: 86754 - DNA, 25 bp, Mus musculus
cagggaatccgccaagacactgatg

SEQ ID NO: 86755 - DNA, 25 bp, Mus musculus
cagggacaccctgcagttttgaggc

SEQ ID NO: 86756 - DNA, 25 bp, Mus musculus
cagggacactggtggcttccattgt

SEQ ID NO: 86757 - DNA, 25 bp, Mus musculus
cagggaccccttcctcgagagaaga

SEQ ID NO: 86758 - DNA, 25 bp, Mus musculus
cagggaccctttttgctacagacag

SEQ ID NO: 86759 - DNA, 25 bp, Mus musculus
cagggacctatttttgccagacagt

SEQ ID NO: 86760 - DNA, 25 bp, Mus musculus
cagggacctctgatgagcacatggc

SEQ ID NO: 86761 - DNA, 25 bp, Mus musculus
cagggacctgcctatattttagtgg

SEQ ID NO: 86762 - DNA, 25 bp, Mus musculus
cagggacgacgccactgttcagtac

SEQ ID NO: 86763 - DNA, 25 bp, Mus musculus
cagggactaagaacagtcgaaataa

SEQ ID NO: 86764 - DNA, 25 bp, Mus musculus
cagggactcctgtttttagctacgg

SEQ ID NO: 86765 - DNA, 25 bp, Mus musculus
cagggacttcccttaccagtggtag

SEQ ID NO: 86766 - DNA, 25 bp, Mus musculus
cagggacttgtcagggaagtcctta

SEQ ID NO: 86767 - DNA, 25 bp, Mus musculus
cagggagaccaagcacatgagcact

SEQ ID NO: 86768 - DNA, 25 bp, Mus musculus
cagggagcccattcgcaagatctac

SEQ ID NO: 86769 - DNA, 25 bp, Mus musculus
cagggagcccgaggactccagcagt

SEQ ID NO: 86770 - DNA, 25 bp, Mus musculus
cagggagcctccatttcgtgcatca

SEQ ID NO: 86771 - DNA, 25 bp, Mus musculus
cagggagcgatttcataaagtaaac

SEQ ID NO: 86772 - DNA, 25 bp, Mus musculus
cagggagcgctttaaacttcgcgac

SEQ ID NO: 86773 - DNA, 25 bp, Mus musculus
cagggagtcgtgtacgagctgaaca

SEQ ID NO: 86774 - DNA, 25 bp, Mus musculus
cagggatactggacttgacgacaca

SEQ ID NO: 86775 - DNA, 25 bp, Mus musculus
cagggatatcctgagaggcttcaaa

SEQ ID NO: 86776 - DNA, 25 bp, Mus musculus
cagggatcagggacagaaaagccct

SEQ ID NO: 86777 - DNA, 25 bp, Mus musculus
cagggatccaggtgacatctctgca

SEQ ID NO: 86778 - DNA, 25 bp, Mus musculus
cagggatccgaattctgaccaagga

SEQ ID NO: 86779 - DNA, 25 bp, Mus musculus
cagggatcctgagacgactggacac

SEQ ID NO: 86780 - DNA, 25 bp, Mus musculus
cagggatcggctttccatcgggagt

SEQ ID NO: 86781 - DNA, 25 bp, Mus musculus
cagggatgagccatgtagaaaggcc

SEQ ID NO: 86782 - DNA, 25 bp, Mus musculus
cagggatgatcaaagccagcagggt

SEQ ID NO: 86783 - DNA, 25 bp, Mus musculus
cagggatggaatatgaccagaaagt

SEQ ID NO: 86784 - DNA, 25 bp, Mus musculus
cagggatgtcattctagtagaggca

SEQ ID NO: 86785 - DNA, 25 bp, Mus musculus
cagggattcccaaggatgaagcctt

SEQ ID NO: 86786 - DNA, 25 bp, Mus musculus
cagggattgcatggttaaactcagc

SEQ ID NO: 86787 - DNA, 25 bp, Mus musculus
cagggatttacgctaaccaggaaga

SEQ ID NO: 86788 - DNA, 25 bp, Mus musculus
cagggcaacatctacaagcccaaca

SEQ ID NO: 86789 - DNA, 25 bp, Mus musculus
cagggcacaggacaacctctggagt

SEQ ID NO: 86790 - DNA, 25 bp, Mus musculus
cagggcacagtgctttcctgtgcta

SEQ ID NO: 86791 - DNA, 25 bp, Mus musculus
cagggcacgacggtagctgttcagc

SEQ ID NO: 86792 - DNA, 25 bp, Mus musculus
cagggcagacgccttcatagtgctg

SEQ ID NO: 86793 - DNA, 25 bp, Mus musculus
cagggcagcgtctgtcaggcaaaga

SEQ ID NO: 86794 - DNA, 25 bp, Mus musculus
cagggcagctgcaaaaggtaacaac

SEQ ID NO: 86795 - DNA, 25 bp, Mus musculus
cagggcaggaaagagctggctcctc

SEQ ID NO: 86796 - DNA, 25 bp, Mus musculus
cagggcaggagaggtaccagactat

SEQ ID NO: 86797 - DNA, 25 bp, Mus musculus
cagggcaggctcaaacatactgggt

SEQ ID NO: 86798 - DNA, 25 bp, Mus musculus
cagggcagtttcacatttgaggaca

SEQ ID NO: 86799 - DNA, 25 bp, Mus musculus
cagggcatcctggaactactacgga

SEQ ID NO: 86800 - DNA, 25 bp, Mus musculus
cagggcatcgatatgagctggtcac

SEQ ID NO: 86801 - DNA, 25 bp, Mus musculus
cagggcatgtacatcagcatggtct

SEQ ID NO: 86802 - DNA, 25 bp, Mus musculus
cagggccaacaaggttcaggttcca

SEQ ID NO: 86803 - DNA, 25 bp, Mus musculus
cagggccacacagaaccttctgaag

SEQ ID NO: 86804 - DNA, 25 bp, Mus musculus
cagggccacatacaagcagcaagaa

SEQ ID NO: 86805 - DNA, 25 bp, Mus musculus
cagggccagcgttccggtttgtcaa

SEQ ID NO: 86806 - DNA, 25 bp, Mus musculus
cagggcccaagcactcagataaggt

SEQ ID NO: 86807 - DNA, 25 bp, Mus musculus
cagggcccactgcatgtgttcgtga

SEQ ID NO: 86808 - DNA, 25 bp, Mus musculus
cagggccgagcatctccggctgtag

SEQ ID NO: 86809 - DNA, 25 bp, Mus musculus
cagggccgctatggtcaaagattga

SEQ ID NO: 86810 - DNA, 25 bp, Mus musculus
cagggccggcgattcgataacttca

SEQ ID NO: 86811 - DNA, 25 bp, Mus musculus
cagggcctacctgtggtgtaaggaa

SEQ ID NO: 86812 - DNA, 25 bp, Mus musculus
cagggcctcgaggagaaattggtcc

SEQ ID NO: 86813 - DNA, 25 bp, Mus musculus
cagggcctcttgcaggaagaacttc

SEQ ID NO: 86814 - DNA, 25 bp, Mus musculus
cagggcctgagagctacgtggctca

SEQ ID NO: 86815 - DNA, 25 bp, Mus musculus
cagggcctgtcaacgcttctgaagg

SEQ ID NO: 86816 - DNA, 25 bp, Mus musculus
cagggccttgccaagtctcagggaa

SEQ ID NO: 86817 - DNA, 25 bp, Mus musculus
cagggcgccatatacaccgtggagt

SEQ ID NO: 86818 - DNA, 25 bp, Mus musculus
cagggcgcttcctcataaacgggca

SEQ ID NO: 86819 - DNA, 25 bp, Mus musculus
cagggcggacaggtacattcatagc

SEQ ID NO: 86820 - DNA, 25 bp, Mus musculus
cagggcggagcaggcggaagtaggg

SEQ ID NO: 86821 - DNA, 25 bp, Mus musculus
cagggctaccagtggctgaagtgca

SEQ ID NO: 86822 - DNA, 25 bp, Mus musculus
cagggctaggctgtgccttccagca

SEQ ID NO: 86823 - DNA, 25 bp, Mus musculus
cagggctatggatccactgtgaagg

SEQ ID NO: 86824 - DNA, 25 bp, Mus musculus
cagggctcgtcatgatatttgcgca

SEQ ID NO: 86825 - DNA, 25 bp, Mus musculus
cagggctgagccaaactgtgttctg

SEQ ID NO: 86826 - DNA, 25 bp, Mus musculus
cagggctgcctagaaagtgtctgtc

SEQ ID NO: 86827 - DNA, 25 bp, Mus musculus
cagggctggcaagcagtaaccttcc

SEQ ID NO: 86828 - DNA, 25 bp, Mus musculus
cagggctggcactaggcaatgtcac

SEQ ID NO: 86829 - DNA, 25 bp, Mus musculus
cagggctggcactcatcaaggattg

SEQ ID NO: 86830 - DNA, 25 bp, Mus musculus
cagggcttctgcaccgagatgtcaa

SEQ ID NO: 86831 - DNA, 25 bp, Mus musculus
cagggcttgacccaattctagtaga

SEQ ID NO: 86832 - DNA, 25 bp, Mus musculus
cagggcttgggctacttttgaccca

SEQ ID NO: 86833 - DNA, 25 bp, Mus musculus
cagggtacttgagatgcccagtgct

SEQ ID NO: 86834 - DNA, 25 bp, Mus musculus
cagggtactttagatggatctttca

SEQ ID NO: 86835 - DNA, 25 bp, Mus musculus
cagggtagccaaacaaagacaagtg

SEQ ID NO: 86836 - DNA, 25 bp, Mus musculus
cagggtagggccacactcctgcgct

SEQ ID NO: 86837 - DNA, 25 bp, Mus musculus
cagggtatcccctaccataagggca

SEQ ID NO: 86838 - DNA, 25 bp, Mus musculus
cagggtcaggtgctttgccaagatc

SEQ ID NO: 86839 - DNA, 25 bp, Mus musculus
cagggtcaggttgaccttagagtca

SEQ ID NO: 86840 - DNA, 25 bp, Mus musculus
cagggtcctggaacaactacagagg

SEQ ID NO: 86841 - DNA, 25 bp, Mus musculus
cagggtctccaactacattgactgg

SEQ ID NO: 86842 - DNA, 25 bp, Mus musculus
cagggtctccggacgatcggttgtt

SEQ ID NO: 86843 - DNA, 25 bp, Mus musculus
cagggtctgagcaatggtgaacaca

SEQ ID NO: 86844 - DNA, 25 bp, Mus musculus
cagggtctgcagttcacgctgggca

SEQ ID NO: 86845 - DNA, 25 bp, Mus musculus
cagggtctgcctttggctgtaagcc

SEQ ID NO: 86846 - DNA, 25 bp, Mus musculus
cagggtgagcctgatctgacagagc

SEQ ID NO: 86847 - DNA, 25 bp, Mus musculus
cagggtgaggcatgttccacagaca

SEQ ID NO: 86848 - DNA, 25 bp, Mus musculus
cagggtgcagagctcacctgtccct

SEQ ID NO: 86849 - DNA, 25 bp, Mus musculus
cagggtgcagctatggctgtcagca

SEQ ID NO: 86850 - DNA, 25 bp, Mus musculus
cagggtgcaggttgaactaagtctc

SEQ ID NO: 86851 - DNA, 25 bp, Mus musculus
cagggtgccaaaactgatgggttac

SEQ ID NO: 86852 - DNA, 25 bp, Mus musculus
cagggtgccacgactgagtaagaac

SEQ ID NO: 86853 - DNA, 25 bp, Mus musculus
cagggtgctgaaggatgggagccac

SEQ ID NO: 86854 - DNA, 25 bp, Mus musculus
cagggtgggagagcttcctagtctc

SEQ ID NO: 86855 - DNA, 25 bp, Mus musculus
cagggtgtacgccaacatgttcaag

SEQ ID NO: 86856 - DNA, 25 bp, Mus musculus
cagggttacgatgccaagtccgata

SEQ ID NO: 86857 - DNA, 25 bp, Mus musculus
cagggttacgtgtccatgagccagc

SEQ ID NO: 86858 - DNA, 25 bp, Mus musculus
cagggttgacatgggacagccttct

SEQ ID NO: 86859 - DNA, 25 bp, Mus musculus
cagggttgacgactctcaccaaaag

SEQ ID NO: 86860 - DNA, 25 bp, Mus musculus
cagggttgcactttttgtactgaac

SEQ ID NO: 86861 - DNA, 25 bp, Mus musculus
cagggttgccttgcgatgacagcga

SEQ ID NO: 86862 - DNA, 25 bp, Mus musculus
cagggttgctcaaaactagtcaggg

SEQ ID NO: 86863 - DNA, 25 bp, Mus musculus
cagggtttactctgcctggcatcac

SEQ ID NO: 86864 - DNA, 25 bp, Mus musculus
caggtaaagcgccaacggagtgacc

SEQ ID NO: 86865 - DNA, 25 bp, Mus musculus
caggtaagcttaccatggcggccag

SEQ ID NO: 86866 - DNA, 25 bp, Mus musculus
caggtaatggctgctagtgaggtcc

SEQ ID NO: 86867 - DNA, 25 bp, Mus musculus
caggtacaggaacagaaggcacatc

SEQ ID NO: 86868 - DNA, 25 bp, Mus musculus
caggtacaggcaacttaagtcctca

SEQ ID NO: 86869 - DNA, 25 bp, Mus musculus
caggtacaggctaggcaggcctcag

SEQ ID NO: 86870 - DNA, 25 bp, Mus musculus
caggtactcactgcagcgtcggtgc

SEQ ID NO: 86871 - DNA, 25 bp, Mus musculus
caggtactgctaggaactgctgagt

SEQ ID NO: 86872 - DNA, 25 bp, Mus musculus
caggtagaaatctccgccgagggtt

SEQ ID NO: 86873 - DNA, 25 bp, Mus musculus
caggtaggccagctttcataggtcc

SEQ ID NO: 86874 - DNA, 25 bp, Mus musculus
caggtagtcagccacaaggaggaaa

SEQ ID NO: 86875 - DNA, 25 bp, Mus musculus
caggtagtccatagtccaagcaagc

SEQ ID NO: 86876 - DNA, 25 bp, Mus musculus
caggtataaggaagctcgggcgttc

SEQ ID NO: 86877 - DNA, 25 bp, Mus musculus
caggtatgaacacgcactctcgagc

SEQ ID NO: 86878 - DNA, 25 bp, Mus musculus
caggtatggctctctggtggccaaa

SEQ ID NO: 86879 - DNA, 25 bp, Mus musculus
caggtattccagttaccagggctca

SEQ ID NO: 86880 - DNA, 25 bp, Mus musculus
caggtatttaaactcttgggagcca

SEQ ID NO: 86881 - DNA, 25 bp, Mus musculus
caggtcacataggtggctgtcgaaa

SEQ ID NO: 86882 - DNA, 25 bp, Mus musculus
caggtcaccttcctaggagaactga

SEQ ID NO: 86883 - DNA, 25 bp, Mus musculus
caggtcagatgacagctggacttct

SEQ ID NO: 86884 - DNA, 25 bp, Mus musculus
caggtcagtcgaggcctgtgttcta

SEQ ID NO: 86885 - DNA, 25 bp, Mus musculus
caggtcatactgtttccctggaggg

SEQ ID NO: 86886 - DNA, 25 bp, Mus musculus
caggtcatggatacagagcacagca

SEQ ID NO: 86887 - DNA, 25 bp, Mus musculus
caggtccacgtgatgtcggagaaca

SEQ ID NO: 86888 - DNA, 25 bp, Mus musculus
caggtccagggaatatcagctcaat

SEQ ID NO: 86889 - DNA, 25 bp, Mus musculus
caggtccagggagattcagccattc

SEQ ID NO: 86890 - DNA, 25 bp, Mus musculus
caggtcccaaactacaggttgtcca

SEQ ID NO: 86891 - DNA, 25 bp, Mus musculus
caggtccccactttgaggatggagc

SEQ ID NO: 86892 - DNA, 25 bp, Mus musculus
caggtcccgactgagagatcgctga

SEQ ID NO: 86893 - DNA, 25 bp, Mus musculus
caggtcccgggattctactggcagt

SEQ ID NO: 86894 - DNA, 25 bp, Mus musculus
caggtccgcatggtgagacaattcc

SEQ ID NO: 86895 - DNA, 25 bp, Mus musculus
caggtccgctgctatgtccacatca

SEQ ID NO: 86896 - DNA, 25 bp, Mus musculus
caggtccggcgtacgttctccctgg

SEQ ID NO: 86897 - DNA, 25 bp, Mus musculus
caggtcctgattgaagcacttgaag

SEQ ID NO: 86898 - DNA, 25 bp, Mus musculus
caggtcctgcatgcgtttgtggaac

SEQ ID NO: 86899 - DNA, 25 bp, Mus musculus
caggtcgggcactacaaggtctagt

SEQ ID NO: 86900 - DNA, 25 bp, Mus musculus
caggtcggttccttctgcgtcgtct

SEQ ID NO: 86901 - DNA, 25 bp, Mus musculus
caggtcgtttggatgatgctctcac

SEQ ID NO: 86902 - DNA, 25 bp, Mus musculus
caggtctacaccatcttgactgtgc

SEQ ID NO: 86903 - DNA, 25 bp, Mus musculus
caggtctaggttttgttgttaatag

SEQ ID NO: 86904 - DNA, 25 bp, Mus musculus
caggtctcctatagcacacaggata

SEQ ID NO: 86905 - DNA, 25 bp, Mus musculus
caggtctgagctatgcattggttcc

SEQ ID NO: 86906 - DNA, 25 bp, Mus musculus
caggtctgccaagccacttgtggaa

SEQ ID NO: 86907 - DNA, 25 bp, Mus musculus
caggtctgtgaagatagcctcgaga

SEQ ID NO: 86908 - DNA, 25 bp, Mus musculus
caggtcttaagcgaaagcgttccca

SEQ ID NO: 86909 - DNA, 25 bp, Mus musculus
caggtcttctcagtccatatggcag

SEQ ID NO: 86910 - DNA, 25 bp, Mus musculus
caggtgaagccctacgtggaagaag

SEQ ID NO: 86911 - DNA, 25 bp, Mus musculus
caggtgacatcattgctcggagaac

SEQ ID NO: 86912 - DNA, 25 bp, Mus musculus
caggtgacatctagaggatccgggc

SEQ ID NO: 86913 - DNA, 25 bp, Mus musculus
caggtgacttacgtgtgctggagca

SEQ ID NO: 86914 - DNA, 25 bp, Mus musculus
caggtgaggttgcttaacatccgcc

SEQ ID NO: 86915 - DNA, 25 bp, Mus musculus
caggtgatacagctttagaacgggc

SEQ ID NO: 86916 - DNA, 25 bp, Mus musculus
caggtgatgcagacagtagggatcc

SEQ ID NO: 86917 - DNA, 25 bp, Mus musculus
caggtgatgtccagcatgaagcaaa

SEQ ID NO: 86918 - DNA, 25 bp, Mus musculus
caggtgcaagagagagccaactcct

SEQ ID NO: 86919 - DNA, 25 bp, Mus musculus
caggtgcacaactctgggcatgatc

SEQ ID NO: 86920 - DNA, 25 bp, Mus musculus
caggtgcagatagtgatgaggaccc

SEQ ID NO: 86921 - DNA, 25 bp, Mus musculus
caggtgcagcaatgatcaatggctc

SEQ ID NO: 86922 - DNA, 25 bp, Mus musculus
caggtgcaggcggatacgatgctta

SEQ ID NO: 86923 - DNA, 25 bp, Mus musculus
caggtgccattgaaaacgctgctct

SEQ ID NO: 86924 - DNA, 25 bp, Mus musculus
caggtgcccgacatggcgagtgctg

SEQ ID NO: 86925 - DNA, 25 bp, Mus musculus
caggtgcctccccagacttagggtg

SEQ ID NO: 86926 - DNA, 25 bp, Mus musculus
caggtgcctcccgatgacaagagtc

SEQ ID NO: 86927 - DNA, 25 bp, Mus musculus
caggtgcctcctgctcagaacagat

SEQ ID NO: 86928 - DNA, 25 bp, Mus musculus
caggtgctcaacgattacctggcgg

SEQ ID NO: 86929 - DNA, 25 bp, Mus musculus
caggtggacctcttgtgaatttagc

SEQ ID NO: 86930 - DNA, 25 bp, Mus musculus
caggtggagccagccattaagcagt

SEQ ID NO: 86931 - DNA, 25 bp, Mus musculus
caggtggcactcctggaacaagtga

SEQ ID NO: 86932 - DNA, 25 bp, Mus musculus
caggtggcagctctggagcaggcag

SEQ ID NO: 86933 - DNA, 25 bp, Mus musculus
caggtggcccaggaggtactattca

SEQ ID NO: 86934 - DNA, 25 bp, Mus musculus
caggtggccctctgacatagcagag

SEQ ID NO: 86935 - DNA, 25 bp, Mus musculus
caggtggcggtgacagagtgggtac

SEQ ID NO: 86936 - DNA, 25 bp, Mus musculus
caggtggctaactacgtgacgggca

SEQ ID NO: 86937 - DNA, 25 bp, Mus musculus
caggtgggccacatgcactgagtgt

SEQ ID NO: 86938 - DNA, 25 bp, Mus musculus
caggtgggccatcactttaggagca

SEQ ID NO: 86939 - DNA, 25 bp, Mus musculus
caggtgggtccaagtcacagagtcg

SEQ ID NO: 86940 - DNA, 25 bp, Mus musculus
caggtggtcctatctcttggcagca

SEQ ID NO: 86941 - DNA, 25 bp, Mus musculus
caggtgtaccctagccacgtggtgg

SEQ ID NO: 86942 - DNA, 25 bp, Mus musculus
caggtgtagggccaagatgtccaaa

SEQ ID NO: 86943 - DNA, 25 bp, Mus musculus
caggtgtcacatgctcatggagcca

SEQ ID NO: 86944 - DNA, 25 bp, Mus musculus
caggtgtcacttgccttgtttggag

SEQ ID NO: 86945 - DNA, 25 bp, Mus musculus
caggtgtcagctatccagaggagga

SEQ ID NO: 86946 - DNA, 25 bp, Mus musculus
caggtgtcatgaagtaagatgcagt

SEQ ID NO: 86947 - DNA, 25 bp, Mus musculus
caggtgtcctataaccaagcaggtc

SEQ ID NO: 86948 - DNA, 25 bp, Mus musculus
caggtgtcgaatggagcccagcagt

SEQ ID NO: 86949 - DNA, 25 bp, Mus musculus
caggtgtcgcgcatcaagcaggtgt

SEQ ID NO: 86950 - DNA, 25 bp, Mus musculus
caggtgtcggttatgagcccggctt

SEQ ID NO: 86951 - DNA, 25 bp, Mus musculus
caggtgtctcatgtggtggcagcac

SEQ ID NO: 86952 - DNA, 25 bp, Mus musculus
caggtgtctggtgctaaagtcatcg

SEQ ID NO: 86953 - DNA, 25 bp, Mus musculus
caggtgtgggttctacctacaagag

SEQ ID NO: 86954 - DNA, 25 bp, Mus musculus
caggtgttctacaggaaaggacctc

SEQ ID NO: 86955 - DNA, 25 bp, Mus musculus
caggtgttgaagaccttaggatcat

SEQ ID NO: 86956 - DNA, 25 bp, Mus musculus
caggtgtttctaacatgttcaatac

SEQ ID NO: 86957 - DNA, 25 bp, Mus musculus
caggttaaggacaacgccaagtggt

SEQ ID NO: 86958 - DNA, 25 bp, Mus musculus
caggttaagtagctgacagtccagg

SEQ ID NO: 86959 - DNA, 25 bp, Mus musculus
caggttacacccatggaagttgaca

SEQ ID NO: 86960 - DNA, 25 bp, Mus musculus
caggttacctggaagccactctcaa

SEQ ID NO: 86961 - DNA, 25 bp, Mus musculus
caggttatcatagcggatccccagc

SEQ ID NO: 86962 - DNA, 25 bp, Mus musculus
caggttcactctcgcactcggatgc

SEQ ID NO: 86963 - DNA, 25 bp, Mus musculus
caggttcagacaactcagtggagca

SEQ ID NO: 86964 - DNA, 25 bp, Mus musculus
caggttcaggctctctaaaggtggc

SEQ ID NO: 86965 - DNA, 25 bp, Mus musculus
caggttcatgcactgattcatccag

SEQ ID NO: 86966 - DNA, 25 bp, Mus musculus
caggttccggaagagagacaaagta

SEQ ID NO: 86967 - DNA, 25 bp, Mus musculus
caggttcctcgtgcggcgctcacca

SEQ ID NO: 86968 - DNA, 25 bp, Mus musculus
caggttctccatgtagcctaggcaa

SEQ ID NO: 86969 - DNA, 25 bp, Mus musculus
caggttctgcatgacgttcggcggc

SEQ ID NO: 86970 - DNA, 25 bp, Mus musculus
caggttctgtttccccttcgacata

SEQ ID NO: 86971 - DNA, 25 bp, Mus musculus
caggttcttctggaggagatccttc

SEQ ID NO: 86972 - DNA, 25 bp, Mus musculus
caggttcttctgttcatgccccggg

SEQ ID NO: 86973 - DNA, 25 bp, Mus musculus
caggttgaccagttgatccaaggga

SEQ ID NO: 86974 - DNA, 25 bp, Mus musculus
caggttgcccagtaattcagacagg

SEQ ID NO: 86975 - DNA, 25 bp, Mus musculus
caggttggtcgcgaaagcgggcgtt

SEQ ID NO: 86976 - DNA, 25 bp, Mus musculus
caggttgtaccgaaggtgcgacctc

SEQ ID NO: 86977 - DNA, 25 bp, Mus musculus
caggttgtgcctggatttctgtgtt

SEQ ID NO: 86978 - DNA, 25 bp, Mus musculus
caggtttacgcacatcacttccgga

SEQ ID NO: 86979 - DNA, 25 bp, Mus musculus
caggtttataatgcacttcaggaga

SEQ ID NO: 86980 - DNA, 25 bp, Mus musculus
caggtttcaacacctcagacccggg

SEQ ID NO: 86981 - DNA, 25 bp, Mus musculus
caggtttcaagatcgcaatgggtgc

SEQ ID NO: 86982 - DNA, 25 bp, Mus musculus
caggtttccatgttcttccgatcag

SEQ ID NO: 86983 - DNA, 25 bp, Mus musculus
caggtttcgagctgtgctttcgctt

SEQ ID NO: 86984 - DNA, 25 bp, Mus musculus
caggtttcgcactcggatctcacgg

SEQ ID NO: 86985 - DNA, 25 bp, Mus musculus
caggtttgaacatcgggagtccagc

SEQ ID NO: 86986 - DNA, 25 bp, Mus musculus
caggtttgattttctgcgctctcag

SEQ ID NO: 86987 - DNA, 25 bp, Mus musculus
caggtttgcaccgttcaacagtgtg

SEQ ID NO: 86988 - DNA, 25 bp, Mus musculus
caggtttgcagagcccattggagga

SEQ ID NO: 86989 - DNA, 25 bp, Mus musculus
caggtttgtaatgtctccaagggca

SEQ ID NO: 86990 - DNA, 25 bp, Mus musculus
caggtttgtgacaagaagtgagaac

SEQ ID NO: 86991 - DNA, 25 bp, Mus musculus
caggttttcagtttggtgcccagca

SEQ ID NO: 86992 - DNA, 25 bp, Mus musculus
caggttttcgtggtgcattgtggat

SEQ ID NO: 86993 - DNA, 25 bp, Mus musculus
caggttttgggcaacgagataaagt

SEQ ID NO: 86994 - DNA, 25 bp, Mus musculus
caggttttgtatatctccaggcaag

SEQ ID NO: 86995 - DNA, 25 bp, Mus musculus
cagtaaactgcatcctgggccaagt

SEQ ID NO: 86996 - DNA, 25 bp, Mus musculus
cagtaaagaagactctgaacatctg

SEQ ID NO: 86997 - DNA, 25 bp, Mus musculus
cagtaaatggacattgctgtaatcc

SEQ ID NO: 86998 - DNA, 25 bp, Mus musculus
cagtaaccagttttacaatggactc

SEQ ID NO: 86999 - DNA, 25 bp, Mus musculus
cagtaaccatgaacagatcctaagc

SEQ ID NO: 87000 - DNA, 25 bp, Mus musculus
cagtaactcagcacagtccaatggg

SEQ ID NO: 87001 - DNA, 25 bp, Mus musculus
cagtaactgtaacttggaagccacc

SEQ ID NO: 87002 - DNA, 25 bp, Mus musculus
cagtaacttcgctgtggcaggtgcc

SEQ ID NO: 87003 - DNA, 25 bp, Mus musculus
cagtaagaagatgtacagcccagca

SEQ ID NO: 87004 - DNA, 25 bp, Mus musculus
cagtaagaagctcgacctggaggcc

SEQ ID NO: 87005 - DNA, 25 bp, Mus musculus
cagtaagaccgaggaagacatggac

SEQ ID NO: 87006 - DNA, 25 bp, Mus musculus
cagtaagactttctgccgggctcag

SEQ ID NO: 87007 - DNA, 25 bp, Mus musculus
cagtaagagtaaagaccacgccgag

SEQ ID NO: 87008 - DNA, 25 bp, Mus musculus
cagtaaggcctgtagctgtgcccca

SEQ ID NO: 87009 - DNA, 25 bp, Mus musculus
cagtaagtcctctgccagtgccaag

SEQ ID NO: 87010 - DNA, 25 bp, Mus musculus
cagtaagtgctgtggcctcgagatc

SEQ ID NO: 87011 - DNA, 25 bp, Mus musculus
cagtaatagagcaaggaattctcca

SEQ ID NO: 87012 - DNA, 25 bp, Mus musculus
cagtaatagtcagagtgcgcgtgca

SEQ ID NO: 87013 - DNA, 25 bp, Mus musculus
cagtaatcgaggaagagacttgcct

SEQ ID NO: 87014 - DNA, 25 bp, Mus musculus
cagtaatggtggatcaagttgttca

SEQ ID NO: 87015 - DNA, 25 bp, Mus musculus
cagtacaaggtgatgaagactatcc

SEQ ID NO: 87016 - DNA, 25 bp, Mus musculus
cagtacagcctgagataatgcttcc

SEQ ID NO: 87017 - DNA, 25 bp, Mus musculus
cagtacagtagctatcctatcaagc

SEQ ID NO: 87018 - DNA, 25 bp, Mus musculus
cagtaccagaaagcccggacgcaat

SEQ ID NO: 87019 - DNA, 25 bp, Mus musculus
cagtaccagaggcagtgtgaactca

SEQ ID NO: 87020 - DNA, 25 bp, Mus musculus
cagtaccagccatgcctcaggaaaa

SEQ ID NO: 87021 - DNA, 25 bp, Mus musculus
cagtacccagacacgagacatatag

SEQ ID NO: 87022 - DNA, 25 bp, Mus musculus
cagtaccgtgccgtggtctacagca

SEQ ID NO: 87023 - DNA, 25 bp, Mus musculus
cagtacgactcggtggaatgcccgt

SEQ ID NO: 87024 - DNA, 25 bp, Mus musculus
cagtacgagctgaaccctggagagg

SEQ ID NO: 87025 - DNA, 25 bp, Mus musculus
cagtacgcttgccacgaccaggtgg

SEQ ID NO: 87026 - DNA, 25 bp, Mus musculus
cagtacggacgacccataagtggac

SEQ ID NO: 87027 - DNA, 25 bp, Mus musculus
cagtacgtagagaagctgagcggca

SEQ ID NO: 87028 - DNA, 25 bp, Mus musculus
cagtactacatctacacagatgcag

SEQ ID NO: 87029 - DNA, 25 bp, Mus musculus
cagtactctcccaaagatgccaaga

SEQ ID NO: 87030 - DNA, 25 bp, Mus musculus
cagtactgcgagttcgacgaccagg

SEQ ID NO: 87031 - DNA, 25 bp, Mus musculus
cagtactgctggtggagactcaaga

SEQ ID NO: 87032 - DNA, 25 bp, Mus musculus
cagtactggctgatcacggcgttcc

SEQ ID NO: 87033 - DNA, 25 bp, Mus musculus
cagtactgtagtgccaagcgggaga

SEQ ID NO: 87034 - DNA, 25 bp, Mus musculus
cagtactgtgctttgaaatggagcc

SEQ ID NO: 87035 - DNA, 25 bp, Mus musculus
cagtactgtggcactggtcagtttc

SEQ ID NO: 87036 - DNA, 25 bp, Mus musculus
cagtactgttgagtgcgggcaagca

SEQ ID NO: 87037 - DNA, 25 bp, Mus musculus
cagtacttagatatgaagcagcagc

SEQ ID NO: 87038 - DNA, 25 bp, Mus musculus
cagtacttaggaagctgtccgggct

SEQ ID NO: 87039 - DNA, 25 bp, Mus musculus
cagtacttcagatcggacatcagca

SEQ ID NO: 87040 - DNA, 25 bp, Mus musculus
cagtacttgggaaaacagcggagct

SEQ ID NO: 87041 - DNA, 25 bp, Mus musculus
cagtactttgtgtgcccggtggaat

SEQ ID NO: 87042 - DNA, 25 bp, Mus musculus
cagtagaagccatccggaaggaacg

SEQ ID NO: 87043 - DNA, 25 bp, Mus musculus
cagtagacactgagcttaccgcgga

SEQ ID NO: 87044 - DNA, 25 bp, Mus musculus
cagtagacggtgtatgaccagacca

SEQ ID NO: 87045 - DNA, 25 bp, Mus musculus
cagtagacgttgaggtggccaatcc

SEQ ID NO: 87046 - DNA, 25 bp, Mus musculus
cagtagactgtaatgcagaagacca

SEQ ID NO: 87047 - DNA, 25 bp, Mus musculus
cagtagacttcaggcccagctagag

SEQ ID NO: 87048 - DNA, 25 bp, Mus musculus
cagtagagcgcttccgtgacctaca

SEQ ID NO: 87049 - DNA, 25 bp, Mus musculus
cagtagaggctctgttgtaagaccc

SEQ ID NO: 87050 - DNA, 25 bp, Mus musculus
cagtagagttttgccacgtgacgag

SEQ ID NO: 87051 - DNA, 25 bp, Mus musculus
cagtagatctgtcaggaagccgagt

SEQ ID NO: 87052 - DNA, 25 bp, Mus musculus
cagtagatgcttgccatcagccagc

SEQ ID NO: 87053 - DNA, 25 bp, Mus musculus
cagtagcacgtgtagcaagagcagc

SEQ ID NO: 87054 - DNA, 25 bp, Mus musculus
cagtagcagaatgcatcgagacgca

SEQ ID NO: 87055 - DNA, 25 bp, Mus musculus
cagtagcagggtgtgtccatgcagc

SEQ ID NO: 87056 - DNA, 25 bp, Mus musculus
cagtagcagttctaagccaggagga

SEQ ID NO: 87057 - DNA, 25 bp, Mus musculus
cagtagccatgaagacaccagtgac

SEQ ID NO: 87058 - DNA, 25 bp, Mus musculus
cagtagcctctgatccaaaggtgta

SEQ ID NO: 87059 - DNA, 25 bp, Mus musculus
cagtagccttcaattgaagcaagac

SEQ ID NO: 87060 - DNA, 25 bp, Mus musculus
cagtagcgaagatggccgcggaact

SEQ ID NO: 87061 - DNA, 25 bp, Mus musculus
cagtagctcagaggcgatgtggacc

SEQ ID NO: 87062 - DNA, 25 bp, Mus musculus
cagtagctcatctctgggatgtgtc

SEQ ID NO: 87063 - DNA, 25 bp, Mus musculus
cagtagcttgcttcgtgggtcggtc

SEQ ID NO: 87064 - DNA, 25 bp, Mus musculus
cagtaggaccgaagcatcattagag

SEQ ID NO: 87065 - DNA, 25 bp, Mus musculus
cagtaggcgtagctcgagaatcaaa

SEQ ID NO: 87066 - DNA, 25 bp, Mus musculus
cagtaggctggatgggcattcatca

SEQ ID NO: 87067 - DNA, 25 bp, Mus musculus
cagtagtagccactctctgtcagaa

SEQ ID NO: 87068 - DNA, 25 bp, Mus musculus
cagtagtgatgacacccatgggccg

SEQ ID NO: 87069 - DNA, 25 bp, Mus musculus
cagtagttccacatgtaacatcatg

SEQ ID NO: 87070 - DNA, 25 bp, Mus musculus
cagtatagcagtgggcctggtcagc

SEQ ID NO: 87071 - DNA, 25 bp, Mus musculus
cagtatataataaagcgctttgatg

SEQ ID NO: 87072 - DNA, 25 bp, Mus musculus
cagtatatatttgcccacgtgggac

SEQ ID NO: 87073 - DNA, 25 bp, Mus musculus
cagtatatgagtccccacgtggtcg

SEQ ID NO: 87074 - DNA, 25 bp, Mus musculus
cagtatatgtttctgcggcagcggc

SEQ ID NO: 87075 - DNA, 25 bp, Mus musculus
cagtatcacatcattctggcccagc

SEQ ID NO: 87076 - DNA, 25 bp, Mus musculus
cagtatcatgcaatccgggcggcta

SEQ ID NO: 87077 - DNA, 25 bp, Mus musculus
cagtatccgttggaaatgttggcca

SEQ ID NO: 87078 - DNA, 25 bp, Mus musculus
cagtatctgagagctgacacaccca

SEQ ID NO: 87079 - DNA, 25 bp, Mus musculus
cagtatctgggttaagagcataagg

SEQ ID NO: 87080 - DNA, 25 bp, Mus musculus
cagtatcttctacgctggtcccagg

SEQ ID NO: 87081 - DNA, 25 bp, Mus musculus
cagtatctttgttaagaactgtgta

SEQ ID NO: 87082 - DNA, 25 bp, Mus musculus
cagtatgaaactgtggttccgctgg

SEQ ID NO: 87083 - DNA, 25 bp, Mus musculus
cagtatgaagatgtgggcaccgctg

SEQ ID NO: 87084 - DNA, 25 bp, Mus musculus
cagtatgacgtcagcaagatgcccg

SEQ ID NO: 87085 - DNA, 25 bp, Mus musculus
cagtatgcagcacaatcagccgatg

SEQ ID NO: 87086 - DNA, 25 bp, Mus musculus
cagtatgcatcaaaagcagagaatg

SEQ ID NO: 87087 - DNA, 25 bp, Mus musculus
cagtatgccaagaagaacaggccca

SEQ ID NO: 87088 - DNA, 25 bp, Mus musculus
cagtatgcgagcagcgacatggacc

SEQ ID NO: 87089 - DNA, 25 bp, Mus musculus
cagtatggacctggaaaccaaaatg

SEQ ID NO: 87090 - DNA, 25 bp, Mus musculus
cagtatggatgcattcattcactca

SEQ ID NO: 87091 - DNA, 25 bp, Mus musculus
cagtatggattctgcgaggctgaca

SEQ ID NO: 87092 - DNA, 25 bp, Mus musculus
cagtatggctctgagggcaggttca

SEQ ID NO: 87093 - DNA, 25 bp, Mus musculus
cagtatgttcatatggttttcagat

SEQ ID NO: 87094 - DNA, 25 bp, Mus musculus
cagtatgttttagatggcagtggcc

SEQ ID NO: 87095 - DNA, 25 bp, Mus musculus
cagtattaccctaagctcagagtgg

SEQ ID NO: 87096 - DNA, 25 bp, Mus musculus
cagtattactgtgcacaagcatcca

SEQ ID NO: 87097 - DNA, 25 bp, Mus musculus
cagtattagcgaggtgtcttgccga

SEQ ID NO: 87098 - DNA, 25 bp, Mus musculus
cagtattcgccttggtaccagtgga

SEQ ID NO: 87099 - DNA, 25 bp, Mus musculus
cagtattgatgggagacactttgcc

SEQ ID NO: 87100 - DNA, 25 bp, Mus musculus
cagtatttacaacagagggcacaag

SEQ ID NO: 87101 - DNA, 25 bp, Mus musculus
cagtatttagtatccacggcaacca

SEQ ID NO: 87102 - DNA, 25 bp, Mus musculus
cagtcaaaggcaagaggtatcaagg

SEQ ID NO: 87103 - DNA, 25 bp, Mus musculus
cagtcaacaggaatcccaccgtggt

SEQ ID NO: 87104 - DNA, 25 bp, Mus musculus
cagtcaaccccaagttcctggcagt

SEQ ID NO: 87105 - DNA, 25 bp, Mus musculus
cagtcaaccccgaagaggagcggtt

SEQ ID NO: 87106 - DNA, 25 bp, Mus musculus
cagtcaacgctgaagagtgcactac

SEQ ID NO: 87107 - DNA, 25 bp, Mus musculus
cagtcaacgggaccatgctcttcca

SEQ ID NO: 87108 - DNA, 25 bp, Mus musculus
cagtcaacgtctatggaaccagcga

SEQ ID NO: 87109 - DNA, 25 bp, Mus musculus
cagtcaagagcttcctgcaactagg

SEQ ID NO: 87110 - DNA, 25 bp, Mus musculus
cagtcaaggagaatcagacagcgcc

SEQ ID NO: 87111 - DNA, 25 bp, Mus musculus
cagtcaatggagacacttggcccct

SEQ ID NO: 87112 - DNA, 25 bp, Mus musculus
cagtcacaagcacagcactaaggct

SEQ ID NO: 87113 - DNA, 25 bp, Mus musculus
cagtcacaattaagatccccaaggc

SEQ ID NO: 87114 - DNA, 25 bp, Mus musculus
cagtcacacctgatgccagcgtgta

SEQ ID NO: 87115 - DNA, 25 bp, Mus musculus
cagtcacactgttggatccaggcaa

SEQ ID NO: 87116 - DNA, 25 bp, Mus musculus
cagtcacagtgaaagccctcgaaga

SEQ ID NO: 87117 - DNA, 25 bp, Mus musculus
cagtcacgggcctcttgctgatgag

SEQ ID NO: 87118 - DNA, 25 bp, Mus musculus
cagtcacggtcctggattcgcaagg

SEQ ID NO: 87119 - DNA, 25 bp, Mus musculus
cagtcactccacagacctcatggag

SEQ ID NO: 87120 - DNA, 25 bp, Mus musculus
cagtcactgactgtcgcagaagcag

SEQ ID NO: 87121 - DNA, 25 bp, Mus musculus
cagtcactgcaaatgtccggtcgag

SEQ ID NO: 87122 - DNA, 25 bp, Mus musculus
cagtcactgggaccttggaagtgcc

SEQ ID NO: 87123 - DNA, 25 bp, Mus musculus
cagtcactgtgtctggccggaaaca

SEQ ID NO: 87124 - DNA, 25 bp, Mus musculus
cagtcagagacccattgtttccagt

SEQ ID NO: 87125 - DNA, 25 bp, Mus musculus
cagtcagaggaagacgtgctcaggc

SEQ ID NO: 87126 - DNA, 25 bp, Mus musculus
cagtcagagttctatggcccaggag

SEQ ID NO: 87127 - DNA, 25 bp, Mus musculus
cagtcagatcaattgctccgagggc

SEQ ID NO: 87128 - DNA, 25 bp, Mus musculus
cagtcagcatcgtatcccagttcgg

SEQ ID NO: 87129 - DNA, 25 bp, Mus musculus
cagtcagcgactccaggttttaaaa

SEQ ID NO: 87130 - DNA, 25 bp, Mus musculus
cagtcagcgcagtgaacttgtctca

SEQ ID NO: 87131 - DNA, 25 bp, Mus musculus
cagtcaggaagaaaaccaagtgtca

SEQ ID NO: 87132 - DNA, 25 bp, Mus musculus
cagtcaggaccacaataagtaacgc

SEQ ID NO: 87133 - DNA, 25 bp, Mus musculus
cagtcaggagctccatggctatcca

SEQ ID NO: 87134 - DNA, 25 bp, Mus musculus
cagtcaggcagaaagaagaagtatc

SEQ ID NO: 87135 - DNA, 25 bp, Mus musculus
cagtcagggctacaattctacacag

SEQ ID NO: 87136 - DNA, 25 bp, Mus musculus
cagtcagtagtataggaaccttccg

SEQ ID NO: 87137 - DNA, 25 bp, Mus musculus
cagtcagtatccaacaagctcctag

SEQ ID NO: 87138 - DNA, 25 bp, Mus musculus
cagtcagtattatggagtcttggga

SEQ ID NO: 87139 - DNA, 25 bp, Mus musculus
cagtcagtccctctcagcgctaggg

SEQ ID NO: 87140 - DNA, 25 bp, Mus musculus
cagtcagtgagaagagtccagcctg

SEQ ID NO: 87141 - DNA, 25 bp, Mus musculus
cagtcagtgccacctattttgtcgg

SEQ ID NO: 87142 - DNA, 25 bp, Mus musculus
cagtcagtgtttaagagtgctcggc

SEQ ID NO: 87143 - DNA, 25 bp, Mus musculus
cagtcatagacactgagacggttgg

SEQ ID NO: 87144 - DNA, 25 bp, Mus musculus
cagtcatagactgctcctgggccaa

SEQ ID NO: 87145 - DNA, 25 bp, Mus musculus
cagtcatagcttattccgtggtcgg

SEQ ID NO: 87146 - DNA, 25 bp, Mus musculus
cagtcatcaagtcgagcctgtctga

SEQ ID NO: 87147 - DNA, 25 bp, Mus musculus
cagtcatcattagagaagcaggcgg

SEQ ID NO: 87148 - DNA, 25 bp, Mus musculus
cagtcatcgaagaacgcctgtccag

SEQ ID NO: 87149 - DNA, 25 bp, Mus musculus
cagtcatcgggctcacaaaaagtga

SEQ ID NO: 87150 - DNA, 25 bp, Mus musculus
cagtcatgacagagctgagcctgag

SEQ ID NO: 87151 - DNA, 25 bp, Mus musculus
cagtcatgagtgtatgctccgtgcc

SEQ ID NO: 87152 - DNA, 25 bp, Mus musculus
cagtcatggaagtgccctgcgacaa

SEQ ID NO: 87153 - DNA, 25 bp, Mus musculus
cagtcatggcatccgaaatctgtaa

SEQ ID NO: 87154 - DNA, 25 bp, Mus musculus
cagtcatggcctgagaatgaagaca

SEQ ID NO: 87155 - DNA, 25 bp, Mus musculus
cagtcattagttttcttcagtggca

SEQ ID NO: 87156 - DNA, 25 bp, Mus musculus
cagtcattcagtgcagacaccggtg

SEQ ID NO: 87157 - DNA, 25 bp, Mus musculus
cagtcattcattggtacggccgcca

SEQ ID NO: 87158 - DNA, 25 bp, Mus musculus
cagtcatttaggacacagcagggca

SEQ ID NO: 87159 - DNA, 25 bp, Mus musculus
cagtccaaagagacggaatgcactt

SEQ ID NO: 87160 - DNA, 25 bp, Mus musculus
cagtccagagacgtccatgtttgaa

SEQ ID NO: 87161 - DNA, 25 bp, Mus musculus
cagtccagcaagtcatggcaaggcg

SEQ ID NO: 87162 - DNA, 25 bp, Mus musculus
cagtccagccatgggaacgacggac

SEQ ID NO: 87163 - DNA, 25 bp, Mus musculus
cagtccaggaaagagaaaggttccg

SEQ ID NO: 87164 - DNA, 25 bp, Mus musculus
cagtccatagctgtgcccagatcaa

SEQ ID NO: 87165 - DNA, 25 bp, Mus musculus
cagtcccaagcgcatcaacagagag

SEQ ID NO: 87166 - DNA, 25 bp, Mus musculus
cagtcccacaagtgtccaggaggca

SEQ ID NO: 87167 - DNA, 25 bp, Mus musculus
cagtccccgctgaaagtgaggttct

SEQ ID NO: 87168 - DNA, 25 bp, Mus musculus
cagtcccggaaatccgcagggtggc

SEQ ID NO: 87169 - DNA, 25 bp, Mus musculus
cagtcccttcctattcagagcataa

SEQ ID NO: 87170 - DNA, 25 bp, Mus musculus
cagtccgaggtctatggcatcacag

SEQ ID NO: 87171 - DNA, 25 bp, Mus musculus
cagtccgcccattaagaagtactcg

SEQ ID NO: 87172 - DNA, 25 bp, Mus musculus
cagtccgccttagcgccgcgggcct

SEQ ID NO: 87173 - DNA, 25 bp, Mus musculus
cagtccggaaaccaagcacagtgag

SEQ ID NO: 87174 - DNA, 25 bp, Mus musculus
cagtccggaggcgtttctgggcaaa

SEQ ID NO: 87175 - DNA, 25 bp, Mus musculus
cagtccggtttggatgctggccaca

SEQ ID NO: 87176 - DNA, 25 bp, Mus musculus
cagtcctcaggatgtctcaaaggaa

SEQ ID NO: 87177 - DNA, 25 bp, Mus musculus
cagtcctcctgtggaaaaacttcct

SEQ ID NO: 87178 - DNA, 25 bp, Mus musculus
cagtcctgagggagaagacggttca

SEQ ID NO: 87179 - DNA, 25 bp, Mus musculus
cagtcctggtgatgtttgccctgca

SEQ ID NO: 87180 - DNA, 25 bp, Mus musculus
cagtcctggtggtggaaatgtcaca

SEQ ID NO: 87181 - DNA, 25 bp, Mus musculus
cagtcctgtgacttgaatcggatgg

SEQ ID NO: 87182 - DNA, 25 bp, Mus musculus
cagtcgactcttgaggaggtggcac

SEQ ID NO: 87183 - DNA, 25 bp, Mus musculus
cagtcgagcggcatgaccattttct

SEQ ID NO: 87184 - DNA, 25 bp, Mus musculus
cagtcgcagtggtacagaatggccg

SEQ ID NO: 87185 - DNA, 25 bp, Mus musculus
cagtcgcctgtctaaggagctgctg

SEQ ID NO: 87186 - DNA, 25 bp, Mus musculus
cagtcggaagacatcaccctgattc

SEQ ID NO: 87187 - DNA, 25 bp, Mus musculus
cagtcggacattgaagctgcactat

SEQ ID NO: 87188 - DNA, 25 bp, Mus musculus
cagtcggagaatgtgcccaatgcca

SEQ ID NO: 87189 - DNA, 25 bp, Mus musculus
cagtcggagacatgcttattgagaa

SEQ ID NO: 87190 - DNA, 25 bp, Mus musculus
cagtcggcgaaatcctggcgatgaa

SEQ ID NO: 87191 - DNA, 25 bp, Mus musculus
cagtcggctgtgaacacgctccatt

SEQ ID NO: 87192 - DNA, 25 bp, Mus musculus
cagtcgggactgttcacgcaataca

SEQ ID NO: 87193 - DNA, 25 bp, Mus musculus
cagtcgggctcggaatgctttggaa

SEQ ID NO: 87194 - DNA, 25 bp, Mus musculus
cagtcggtggaatgcttgtctgaca

SEQ ID NO: 87195 - DNA, 25 bp, Mus musculus
cagtcgtacctttgacttgaggctg

SEQ ID NO: 87196 - DNA, 25 bp, Mus musculus
cagtcgtggactccttgaagaaggc

SEQ ID NO: 87197 - DNA, 25 bp, Mus musculus
cagtcgttgcttggagtcgtaagga

SEQ ID NO: 87198 - DNA, 25 bp, Mus musculus
cagtctacaggacttcaggtgctgt

SEQ ID NO: 87199 - DNA, 25 bp, Mus musculus
cagtctacctgggaaaagccagatg

SEQ ID NO: 87200 - DNA, 25 bp, Mus musculus
cagtctagaggctttggatttgtca

SEQ ID NO: 87201 - DNA, 25 bp, Mus musculus
cagtctagccggatgccaaaaggca

SEQ ID NO: 87202 - DNA, 25 bp, Mus musculus
cagtctagcggatggcccaatgacg

SEQ ID NO: 87203 - DNA, 25 bp, Mus musculus
cagtctaggctttcgctctgaagaa

SEQ ID NO: 87204 - DNA, 25 bp, Mus musculus
cagtctatgaggaaggagtggcccc

SEQ ID NO: 87205 - DNA, 25 bp, Mus musculus
cagtctcagcgtcgatgccagctta

SEQ ID NO: 87206 - DNA, 25 bp, Mus musculus
cagtctcatcgtgtctcggacagga

SEQ ID NO: 87207 - DNA, 25 bp, Mus musculus
cagtctccacagagcagtttcccag

SEQ ID NO: 87208 - DNA, 25 bp, Mus musculus
cagtctcgactcctagaagctttac

SEQ ID NO: 87209 - DNA, 25 bp, Mus musculus
cagtctcgctggcaataaggacagg

SEQ ID NO: 87210 - DNA, 25 bp, Mus musculus
cagtctctatctgtacagtcggtgg

SEQ ID NO: 87211 - DNA, 25 bp, Mus musculus
cagtctctcagcagaacctggtgca

SEQ ID NO: 87212 - DNA, 25 bp, Mus musculus
cagtctctctgggatgtagggcgca

SEQ ID NO: 87213 - DNA, 25 bp, Mus musculus
cagtctctgcaatccacgtggtaaa

SEQ ID NO: 87214 - DNA, 25 bp, Mus musculus
cagtctcttggcgtgctggagagca

SEQ ID NO: 87215 - DNA, 25 bp, Mus musculus
cagtctcttttgtcaggcactaaca

SEQ ID NO: 87216 - DNA, 25 bp, Mus musculus
cagtctgacctagggatactttgcc

SEQ ID NO: 87217 - DNA, 25 bp, Mus musculus
cagtctgagaagtggtctatcagca

SEQ ID NO: 87218 - DNA, 25 bp, Mus musculus
cagtctgagttgtagccctggacca

SEQ ID NO: 87219 - DNA, 25 bp, Mus musculus
cagtctgcagaaatgcctctttggc

SEQ ID NO: 87220 - DNA, 25 bp, Mus musculus
cagtctgctggagtaccttatgcca

SEQ ID NO: 87221 - DNA, 25 bp, Mus musculus
cagtctgctgtgtccaaggctggag

SEQ ID NO: 87222 - DNA, 25 bp, Mus musculus
cagtctggacagaacaagcctggca

SEQ ID NO: 87223 - DNA, 25 bp, Mus musculus
cagtctggactgtataagagcaagc

SEQ ID NO: 87224 - DNA, 25 bp, Mus musculus
cagtctggagactctgacaaaggag

SEQ ID NO: 87225 - DNA, 25 bp, Mus musculus
cagtctggtaggagcacagtcgtcc

SEQ ID NO: 87226 - DNA, 25 bp, Mus musculus
cagtctggtagtttacaggcccaca

SEQ ID NO: 87227 - DNA, 25 bp, Mus musculus
cagtctgtcatggtggaaccaggaa

SEQ ID NO: 87228 - DNA, 25 bp, Mus musculus
cagtctgtgagctcgtgtacctgga

SEQ ID NO: 87229 - DNA, 25 bp, Mus musculus
cagtcttcaggatccgctcgacaag

SEQ ID NO: 87230 - DNA, 25 bp, Mus musculus
cagtcttctctgcaaagggaccaag

SEQ ID NO: 87231 - DNA, 25 bp, Mus musculus
cagtcttgagtgaggtctaagggac

SEQ ID NO: 87232 - DNA, 25 bp, Mus musculus
cagtcttgccatgattggataggcc

SEQ ID NO: 87233 - DNA, 25 bp, Mus musculus
cagtcttgttgcactcggtgggtcc

SEQ ID NO: 87234 - DNA, 25 bp, Mus musculus
cagtctttgaccctctctccatggt

SEQ ID NO: 87235 - DNA, 25 bp, Mus musculus
cagtgaaaagtaccctgatgagact

SEQ ID NO: 87236 - DNA, 25 bp, Mus musculus
cagtgaaaatcaagtcgggcgaggc

SEQ ID NO: 87237 - DNA, 25 bp, Mus musculus
cagtgaaacatcaaaggagttggct

SEQ ID NO: 87238 - DNA, 25 bp, Mus musculus
cagtgaaaccaagcattgaaccgcc

SEQ ID NO: 87239 - DNA, 25 bp, Mus musculus
cagtgaaagccaaagtgacgaccgc

SEQ ID NO: 87240 - DNA, 25 bp, Mus musculus
cagtgaaatagatggttcaaaacca

SEQ ID NO: 87241 - DNA, 25 bp, Mus musculus
cagtgaacatcaggcagtgctgcag

SEQ ID NO: 87242 - DNA, 25 bp, Mus musculus
cagtgaacccggctgtcttccctca

SEQ ID NO: 87243 - DNA, 25 bp, Mus musculus
cagtgaaccctgtcatgtcagtgtg

SEQ ID NO: 87244 - DNA, 25 bp, Mus musculus
cagtgaacctttggtcactgatggg

SEQ ID NO: 87245 - DNA, 25 bp, Mus musculus
cagtgaactgaacggatctgctcgg

SEQ ID NO: 87246 - DNA, 25 bp, Mus musculus
cagtgaagacatatcccaaggaccc

SEQ ID NO: 87247 - DNA, 25 bp, Mus musculus
cagtgaagcccagatcaatttgagc

SEQ ID NO: 87248 - DNA, 25 bp, Mus musculus
cagtgaaggtgcaggagtctctagc

SEQ ID NO: 87249 - DNA, 25 bp, Mus musculus
cagtgaatcacctccgctgtgagaa

SEQ ID NO: 87250 - DNA, 25 bp, Mus musculus
cagtgaatcattcaggtggcaggcc

SEQ ID NO: 87251 - DNA, 25 bp, Mus musculus
cagtgaatctgaagtatcgcctaca

SEQ ID NO: 87252 - DNA, 25 bp, Mus musculus
cagtgaatgttcacgagaggcaccc

SEQ ID NO: 87253 - DNA, 25 bp, Mus musculus
cagtgacaaagacccagtagagcgt

SEQ ID NO: 87254 - DNA, 25 bp, Mus musculus
cagtgacaaggccagctacgctgtg

SEQ ID NO: 87255 - DNA, 25 bp, Mus musculus
cagtgacaccaccagaactagaaga

SEQ ID NO: 87256 - DNA, 25 bp, Mus musculus
cagtgacactgcgactagtggtccc

SEQ ID NO: 87257 - DNA, 25 bp, Mus musculus
cagtgacacttcttccgaggacgag

SEQ ID NO: 87258 - DNA, 25 bp, Mus musculus
cagtgacattgaagttcgcctgaac

SEQ ID NO: 87259 - DNA, 25 bp, Mus musculus
cagtgaccacctgattgaaatggca

SEQ ID NO: 87260 - DNA, 25 bp, Mus musculus
cagtgaccagccatgtagagtgtgc

SEQ ID NO: 87261 - DNA, 25 bp, Mus musculus
cagtgacccgaaagacattgaccag

SEQ ID NO: 87262 - DNA, 25 bp, Mus musculus
cagtgaccggcaggctttggtcaaa

SEQ ID NO: 87263 - DNA, 25 bp, Mus musculus
cagtgaccggtctctcagaaacagg

SEQ ID NO: 87264 - DNA, 25 bp, Mus musculus
cagtgaccgtggcttatagtcctaa

SEQ ID NO: 87265 - DNA, 25 bp, Mus musculus
cagtgaccttcaactttcgtgacga

SEQ ID NO: 87266 - DNA, 25 bp, Mus musculus
cagtgaccttgctcccagagaagaa

SEQ ID NO: 87267 - DNA, 25 bp, Mus musculus
cagtgacgcaaacctggacaggctt

SEQ ID NO: 87268 - DNA, 25 bp, Mus musculus
cagtgacggagatctgtctgaaaac

SEQ ID NO: 87269 - DNA, 25 bp, Mus musculus
cagtgactaagtggccaccttctgc

SEQ ID NO: 87270 - DNA, 25 bp, Mus musculus
cagtgactagtcagcctcagtgcgc

SEQ ID NO: 87271 - DNA, 25 bp, Mus musculus
cagtgactcccagacctaatgttgc

SEQ ID NO: 87272 - DNA, 25 bp, Mus musculus
cagtgactccttgctattccagaaa

SEQ ID NO: 87273 - DNA, 25 bp, Mus musculus
cagtgactcggtacaagcagttggg

SEQ ID NO: 87274 - DNA, 25 bp, Mus musculus
cagtgactggcaggtcctctacaag

SEQ ID NO: 87275 - DNA, 25 bp, Mus musculus
cagtgactgggacattaagacaatc

SEQ ID NO: 87276 - DNA, 25 bp, Mus musculus
cagtgagacaccagttgttgtggac

SEQ ID NO: 87277 - DNA, 25 bp, Mus musculus
cagtgagactctatcgggaaacaaa

SEQ ID NO: 87278 - DNA, 25 bp, Mus musculus
cagtgagagacctacagcatgtgca

SEQ ID NO: 87279 - DNA, 25 bp, Mus musculus
cagtgagcagggaagcctacagtta

SEQ ID NO: 87280 - DNA, 25 bp, Mus musculus
cagtgagcggaatgcctatgccacc

SEQ ID NO: 87281 - DNA, 25 bp, Mus musculus
cagtgagcggccttgggaaacatcg

SEQ ID NO: 87282 - DNA, 25 bp, Mus musculus
cagtgagctgattgggtagagcacc

SEQ ID NO: 87283 - DNA, 25 bp, Mus musculus
cagtgagcttcgatcgctggaatgt

SEQ ID NO: 87284 - DNA, 25 bp, Mus musculus
cagtgaggagcagtatctatggtcg

SEQ ID NO: 87285 - DNA, 25 bp, Mus musculus
cagtgaggcccaggctcgaccagat

SEQ ID NO: 87286 - DNA, 25 bp, Mus musculus
cagtgagggctttcttggcttttcc

SEQ ID NO: 87287 - DNA, 25 bp, Mus musculus
cagtgagtgcatccactggacacag

SEQ ID NO: 87288 - DNA, 25 bp, Mus musculus
cagtgagtgtgaatgaaggctaccg

SEQ ID NO: 87289 - DNA, 25 bp, Mus musculus
cagtgagtgttctggtacccaaggc

SEQ ID NO: 87290 - DNA, 25 bp, Mus musculus
cagtgagttaagcacagcaccacac

SEQ ID NO: 87291 - DNA, 25 bp, Mus musculus
cagtgatctatcaggccagtcaggc

SEQ ID NO: 87292 - DNA, 25 bp, Mus musculus
cagtgatgacacagatctgcagatc

SEQ ID NO: 87293 - DNA, 25 bp, Mus musculus
cagtgatgactagcaccaggctttt

SEQ ID NO: 87294 - DNA, 25 bp, Mus musculus
cagtgatgctgagacggagaagcca

SEQ ID NO: 87295 - DNA, 25 bp, Mus musculus
cagtgatgtatgttgttcaccaccc

SEQ ID NO: 87296 - DNA, 25 bp, Mus musculus
cagtgatgtcatcctgcgggtccag

SEQ ID NO: 87297 - DNA, 25 bp, Mus musculus
cagtgatgtcttactgacatggaag

SEQ ID NO: 87298 - DNA, 25 bp, Mus musculus
cagtgattatcagcaggagtcctac

SEQ ID NO: 87299 - DNA, 25 bp, Mus musculus
cagtgattcagtagtgcggacccgg

SEQ ID NO: 87300 - DNA, 25 bp, Mus musculus
cagtgattcggacagcgaagttgaa

SEQ ID NO: 87301 - DNA, 25 bp, Mus musculus
cagtgattcggatgaggacgacgac

SEQ ID NO: 87302 - DNA, 25 bp, Mus musculus
cagtgattcgggagtacaggccctc

SEQ ID NO: 87303 - DNA, 25 bp, Mus musculus
cagtgattggaagtgcccgatgcaa

SEQ ID NO: 87304 - DNA, 25 bp, Mus musculus
cagtgatttcagtgacggccgggaa

SEQ ID NO: 87305 - DNA, 25 bp, Mus musculus
cagtgatttcctggatggcctgggc

SEQ ID NO: 87306 - DNA, 25 bp, Mus musculus
cagtgcaaaacagcttggtgtggac

SEQ ID NO: 87307 - DNA, 25 bp, Mus musculus
cagtgcaaagcatggcggtcgaatc

SEQ ID NO: 87308 - DNA, 25 bp, Mus musculus
cagtgcaatccgaaaccaagggtat

SEQ ID NO: 87309 - DNA, 25 bp, Mus musculus
cagtgcacactcagaagacagggcc

SEQ ID NO: 87310 - DNA, 25 bp, Mus musculus
cagtgcacagacctcagttctggaa

SEQ ID NO: 87311 - DNA, 25 bp, Mus musculus
cagtgcacatagaaagatggctggc

SEQ ID NO: 87312 - DNA, 25 bp, Mus musculus
cagtgcagaacggaagactccagga

SEQ ID NO: 87313 - DNA, 25 bp, Mus musculus
cagtgcagacatccaaatctggtat

SEQ ID NO: 87314 - DNA, 25 bp, Mus musculus
cagtgcagtataaacacggacggct

SEQ ID NO: 87315 - DNA, 25 bp, Mus musculus
cagtgcagtgaagacaagtgtagcc

SEQ ID NO: 87316 - DNA, 25 bp, Mus musculus
cagtgcatatggtggttgctgagac

SEQ ID NO: 87317 - DNA, 25 bp, Mus musculus
cagtgcatgaagctgcgtgtgctca

SEQ ID NO: 87318 - DNA, 25 bp, Mus musculus
cagtgcatgcagtgtgagagtaacc

SEQ ID NO: 87319 - DNA, 25 bp, Mus musculus
cagtgcatgctcttcaggagggaga

SEQ ID NO: 87320 - DNA, 25 bp, Mus musculus
cagtgccaacgaggacatgcctgta

SEQ ID NO: 87321 - DNA, 25 bp, Mus musculus
cagtgccaacttcggtgaagctgca

SEQ ID NO: 87322 - DNA, 25 bp, Mus musculus
cagtgccacgtcatgagcgtcagag

SEQ ID NO: 87323 - DNA, 25 bp, Mus musculus
cagtgccacgtgtgagcgctgcaag

SEQ ID NO: 87324 - DNA, 25 bp, Mus musculus
cagtgccagataaaccaagtgaagc

SEQ ID NO: 87325 - DNA, 25 bp, Mus musculus
cagtgccagcaggtcttgagttcaa

SEQ ID NO: 87326 - DNA, 25 bp, Mus musculus
cagtgccagggaaaacgctgcacct

SEQ ID NO: 87327 - DNA, 25 bp, Mus musculus
cagtgccatgtgtcctttcggttgc

SEQ ID NO: 87328 - DNA, 25 bp, Mus musculus
cagtgccatgtttctacagggtgcc

SEQ ID NO: 87329 - DNA, 25 bp, Mus musculus
cagtgcccgacttcacagagtgaga

SEQ ID NO: 87330 - DNA, 25 bp, Mus musculus
cagtgccgaaggtcatctccagaga

SEQ ID NO: 87331 - DNA, 25 bp, Mus musculus
cagtgccgcctttgtaccatggcta

SEQ ID NO: 87332 - DNA, 25 bp, Mus musculus
cagtgccggcagagtacccagcctg

SEQ ID NO: 87333 - DNA, 25 bp, Mus musculus
cagtgccgggactccgagccctgtt

SEQ ID NO: 87334 - DNA, 25 bp, Mus musculus
cagtgccgggtccaacatctgtggt

SEQ ID NO: 87335 - DNA, 25 bp, Mus musculus
cagtgcctctggagtgcggcgacta

SEQ ID NO: 87336 - DNA, 25 bp, Mus musculus
cagtgccttagtgaccaaacggtac

SEQ ID NO: 87337 - DNA, 25 bp, Mus musculus
cagtgcctttgagcttagagagttc

SEQ ID NO: 87338 - DNA, 25 bp, Mus musculus
cagtgcgagaacaaagctgctctcc

SEQ ID NO: 87339 - DNA, 25 bp, Mus musculus
cagtgcgagtcgtcctgtggaaacc

SEQ ID NO: 87340 - DNA, 25 bp, Mus musculus
cagtgcggaccatggaggcgtttca

SEQ ID NO: 87341 - DNA, 25 bp, Mus musculus
cagtgcggaggctcagagcctgctc

SEQ ID NO: 87342 - DNA, 25 bp, Mus musculus
cagtgcggcgggaaagcctctgcaa

SEQ ID NO: 87343 - DNA, 25 bp, Mus musculus
cagtgcgtcctccagtggtaccaaa

SEQ ID NO: 87344 - DNA, 25 bp, Mus musculus
cagtgctaacaagaccagaaggttc

SEQ ID NO: 87345 - DNA, 25 bp, Mus musculus
cagtgctactgcaacgccggaaaag

SEQ ID NO: 87346 - DNA, 25 bp, Mus musculus
cagtgctagccccatagtcgtggac

SEQ ID NO: 87347 - DNA, 25 bp, Mus musculus
cagtgctagccttcgtgaaagagaa

SEQ ID NO: 87348 - DNA, 25 bp, Mus musculus
cagtgctcaggcaacttcatgggtt

SEQ ID NO: 87349 - DNA, 25 bp, Mus musculus
cagtgctccaaagagatggccagga

SEQ ID NO: 87350 - DNA, 25 bp, Mus musculus
cagtgctccctctaccacaagaaga

SEQ ID NO: 87351 - DNA, 25 bp, Mus musculus
cagtgctcctatgcgtgaatcccaa

SEQ ID NO: 87352 - DNA, 25 bp, Mus musculus
cagtgctgacacacagctgctggta

SEQ ID NO: 87353 - DNA, 25 bp, Mus musculus
cagtgctgactgcaatgtggaagcc

SEQ ID NO: 87354 - DNA, 25 bp, Mus musculus
cagtgctgagcataaggactcccga

SEQ ID NO: 87355 - DNA, 25 bp, Mus musculus
cagtgctggaactgcggtcacgcaa

SEQ ID NO: 87356 - DNA, 25 bp, Mus musculus
cagtgcttggttgaaagctgcccag

SEQ ID NO: 87357 - DNA, 25 bp, Mus musculus
cagtgcttgtccgttttcctcaaaa

SEQ ID NO: 87358 - DNA, 25 bp, Mus musculus
cagtgcttgtggaggttttgacgtt

SEQ ID NO: 87359 - DNA, 25 bp, Mus musculus
cagtggaaactaacttcctgttcaa

SEQ ID NO: 87360 - DNA, 25 bp, Mus musculus
cagtggaacttcagacctcagcaaa

SEQ ID NO: 87361 - DNA, 25 bp, Mus musculus
cagtggaagaaaagaagccttcagc

SEQ ID NO: 87362 - DNA, 25 bp, Mus musculus
cagtggaagcttgctccttggcgca

SEQ ID NO: 87363 - DNA, 25 bp, Mus musculus
cagtggaaggtagataacccggtct

SEQ ID NO: 87364 - DNA, 25 bp, Mus musculus
cagtggaatccatctagatgaagaa

SEQ ID NO: 87365 - DNA, 25 bp, Mus musculus
cagtggaatgctggaggcttttagc

SEQ ID NO: 87366 - DNA, 25 bp, Mus musculus
cagtggaatgcttgcctggcagaca

SEQ ID NO: 87367 - DNA, 25 bp, Mus musculus
cagtggacaccgttgtgtggcagac

SEQ ID NO: 87368 - DNA, 25 bp, Mus musculus
cagtggacaggacatcagcattgct

SEQ ID NO: 87369 - DNA, 25 bp, Mus musculus
cagtggaccgggaggtcttcctcca

SEQ ID NO: 87370 - DNA, 25 bp, Mus musculus
cagtggacgttttcattaaatgttc

SEQ ID NO: 87371 - DNA, 25 bp, Mus musculus
cagtggactctacctcggcatgaac

SEQ ID NO: 87372 - DNA, 25 bp, Mus musculus
cagtggactgtcattaaaaacggag

SEQ ID NO: 87373 - DNA, 25 bp, Mus musculus
cagtggagaagcgagaaggctaccc

SEQ ID NO: 87374 - DNA, 25 bp, Mus musculus
cagtggagatcaaagcgattgggca

SEQ ID NO: 87375 - DNA, 25 bp, Mus musculus
cagtggagcctccaccggcatctat

SEQ ID NO: 87376 - DNA, 25 bp, Mus musculus
cagtggagcgtgaagacgaaacacc

SEQ ID NO: 87377 - DNA, 25 bp, Mus musculus
cagtggaggaaagagttctctgtca

SEQ ID NO: 87378 - DNA, 25 bp, Mus musculus
cagtggaggataatgcatctgagcc

SEQ ID NO: 87379 - DNA, 25 bp, Mus musculus
cagtggaggcaaacgcaatgcagac

SEQ ID NO: 87380 - DNA, 25 bp, Mus musculus
cagtggatacgtacagaggatggct

SEQ ID NO: 87381 - DNA, 25 bp, Mus musculus
cagtggatataacagacaggccgtt

SEQ ID NO: 87382 - DNA, 25 bp, Mus musculus
cagtggatcccaggacaataaggag

SEQ ID NO: 87383 - DNA, 25 bp, Mus musculus
cagtggatcggcctcaatgacaaga

SEQ ID NO: 87384 - DNA, 25 bp, Mus musculus
cagtggatggaaataggccgtcgtc

SEQ ID NO: 87385 - DNA, 25 bp, Mus musculus
cagtggatggatttattagatcctg

SEQ ID NO: 87386 - DNA, 25 bp, Mus musculus
cagtggattccgagggagactcatc

SEQ ID NO: 87387 - DNA, 25 bp, Mus musculus
cagtggcaaaagctagggaatcccc

SEQ ID NO: 87388 - DNA, 25 bp, Mus musculus
cagtggcagcgctaccagaagtaca

SEQ ID NO: 87389 - DNA, 25 bp, Mus musculus
cagtggcagtctcagcggaatcaat

SEQ ID NO: 87390 - DNA, 25 bp, Mus musculus
cagtggccaagatcagaagcccgtc

SEQ ID NO: 87391 - DNA, 25 bp, Mus musculus
cagtggccacgagcttccagaagaa

SEQ ID NO: 87392 - DNA, 25 bp, Mus musculus
cagtggccactgaatataattgacc

SEQ ID NO: 87393 - DNA, 25 bp, Mus musculus
cagtggccaggataccaaagcctta

SEQ ID NO: 87394 - DNA, 25 bp, Mus musculus
cagtggccgccttgttgactccaaa

SEQ ID NO: 87395 - DNA, 25 bp, Mus musculus
cagtggccgtgcacacagtggaaga

SEQ ID NO: 87396 - DNA, 25 bp, Mus musculus
cagtggcctccctgtggatattaaa

SEQ ID NO: 87397 - DNA, 25 bp, Mus musculus
cagtggcgacatgcatctcgggaaa

SEQ ID NO: 87398 - DNA, 25 bp, Mus musculus
cagtggcgtcctacaacctgtgtca

SEQ ID NO: 87399 - DNA, 25 bp, Mus musculus
cagtggctacgacacacaagctgtt

SEQ ID NO: 87400 - DNA, 25 bp, Mus musculus
cagtggctcagcttgtagccttttc

SEQ ID NO: 87401 - DNA, 25 bp, Mus musculus
cagtggctcagtcttcagcgggctc

SEQ ID NO: 87402 - DNA, 25 bp, Mus musculus
cagtggctgaagtcgcaaggaaaca

SEQ ID NO: 87403 - DNA, 25 bp, Mus musculus
cagtggctgccatgtttgacacgaa

SEQ ID NO: 87404 - DNA, 25 bp, Mus musculus
cagtggctgctcaaaaacaggttct

SEQ ID NO: 87405 - DNA, 25 bp, Mus musculus
cagtggcttcttggagtcacctcta

SEQ ID NO: 87406 - DNA, 25 bp, Mus musculus
cagtgggaaaaagctcctacttcaa

SEQ ID NO: 87407 - DNA, 25 bp, Mus musculus
cagtgggaaagtgcgaacttcagga

SEQ ID NO: 87408 - DNA, 25 bp, Mus musculus
cagtgggaaccagcataaggcggaa

SEQ ID NO: 87409 - DNA, 25 bp, Mus musculus
cagtgggaactggattgagattgcc

SEQ ID NO: 87410 - DNA, 25 bp, Mus musculus
cagtgggacattcctacctcagagg

SEQ ID NO: 87411 - DNA, 25 bp, Mus musculus
cagtgggaccctcaaaatcagattc

SEQ ID NO: 87412 - DNA, 25 bp, Mus musculus
cagtgggacctaagtacaagagccg

SEQ ID NO: 87413 - DNA, 25 bp, Mus musculus
cagtgggacctacctcatcagagag

SEQ ID NO: 87414 - DNA, 25 bp, Mus musculus
cagtgggcatctacggcaaagtgaa

SEQ ID NO: 87415 - DNA, 25 bp, Mus musculus
cagtgggcccaactcaaggctgttc

SEQ ID NO: 87416 - DNA, 25 bp, Mus musculus
cagtgggctccgggaaagccgttcg

SEQ ID NO: 87417 - DNA, 25 bp, Mus musculus
cagtgggtactctgtacatggcaga

SEQ ID NO: 87418 - DNA, 25 bp, Mus musculus
cagtgggtctcatccatggacgggt

SEQ ID NO: 87419 - DNA, 25 bp, Mus musculus
cagtgggtggacatgaatggctctc

SEQ ID NO: 87420 - DNA, 25 bp, Mus musculus
cagtgggtgtgaccaaaaagtgctc

SEQ ID NO: 87421 - DNA, 25 bp, Mus musculus
cagtgggttcgtttgcaccgcggct

SEQ ID NO: 87422 - DNA, 25 bp, Mus musculus
cagtgggttgctgctctccagggat

SEQ ID NO: 87423 - DNA, 25 bp, Mus musculus
cagtggtaagtctttaataccagtt

SEQ ID NO: 87424 - DNA, 25 bp, Mus musculus
cagtggtagcggagtaaatcctttc

SEQ ID NO: 87425 - DNA, 25 bp, Mus musculus
cagtggtatgattgaagccggcaaa

SEQ ID NO: 87426 - DNA, 25 bp, Mus musculus
cagtggtcagcatggaagagcgtcc

SEQ ID NO: 87427 - DNA, 25 bp, Mus musculus
cagtggtcctgacttgctgctgaat

SEQ ID NO: 87428 - DNA, 25 bp, Mus musculus
cagtggtctctgcagcacgaggtct

SEQ ID NO: 87429 - DNA, 25 bp, Mus musculus
cagtggtgaacctagcagggctact

SEQ ID NO: 87430 - DNA, 25 bp, Mus musculus
cagtggtgacccaacagctggtgtc

SEQ ID NO: 87431 - DNA, 25 bp, Mus musculus
cagtggtgccacatcagagatgcta

SEQ ID NO: 87432 - DNA, 25 bp, Mus musculus
cagtggtgcctatgtgcctctgagc

SEQ ID NO: 87433 - DNA, 25 bp, Mus musculus
cagtggtggaagctacgaaatcgca

SEQ ID NO: 87434 - DNA, 25 bp, Mus musculus
cagtggtggatcctgctctgcctga

SEQ ID NO: 87435 - DNA, 25 bp, Mus musculus
cagtggtggtacctccctcagtaca

SEQ ID NO: 87436 - DNA, 25 bp, Mus musculus
cagtggtgtaaatgcagctggagat

SEQ ID NO: 87437 - DNA, 25 bp, Mus musculus
cagtggtgtcaactgtttatgtgcc

SEQ ID NO: 87438 - DNA, 25 bp, Mus musculus
cagtggttgctatgagacccgctcc

SEQ ID NO: 87439 - DNA, 25 bp, Mus musculus
cagtggttgtgactttatggatgta

SEQ ID NO: 87440 - DNA, 25 bp, Mus musculus
cagtggtttccgtggcaacaccaag

SEQ ID NO: 87441 - DNA, 25 bp, Mus musculus
cagtggttttcaccttctggaagaa

SEQ ID NO: 87442 - DNA, 25 bp, Mus musculus
cagtgtaccaggtccagcagaaggt

SEQ ID NO: 87443 - DNA, 25 bp, Mus musculus
cagtgtacggttaccattgctgagc

SEQ ID NO: 87444 - DNA, 25 bp, Mus musculus
cagtgtacgttctgtttcacggcct

SEQ ID NO: 87445 - DNA, 25 bp, Mus musculus
cagtgtactttgtgatgccaaccga

SEQ ID NO: 87446 - DNA, 25 bp, Mus musculus
cagtgtatcagatcgccatggtgca

SEQ ID NO: 87447 - DNA, 25 bp, Mus musculus
cagtgtcacgtacattaagttaacc

SEQ ID NO: 87448 - DNA, 25 bp, Mus musculus
cagtgtcagcttcttcgtttccagg

SEQ ID NO: 87449 - DNA, 25 bp, Mus musculus
cagtgtcagcttgtatagaaggctc

SEQ ID NO: 87450 - DNA, 25 bp, Mus musculus
cagtgtcatgtccagcacctgtggt

SEQ ID NO: 87451 - DNA, 25 bp, Mus musculus
cagtgtcatttcattggctcagcag

SEQ ID NO: 87452 - DNA, 25 bp, Mus musculus
cagtgtccgagagagctgtatcccg

SEQ ID NO: 87453 - DNA, 25 bp, Mus musculus
cagtgtccggacataggagaagcca

SEQ ID NO: 87454 - DNA, 25 bp, Mus musculus
cagtgtcgctgagtaccccatgagc

SEQ ID NO: 87455 - DNA, 25 bp, Mus musculus
cagtgtcggaccaagttcaaaggcc

SEQ ID NO: 87456 - DNA, 25 bp, Mus musculus
cagtgtcgggctacgtgcaggctct

SEQ ID NO: 87457 - DNA, 25 bp, Mus musculus
cagtgtcgtgaaatgaaaccaaacc

SEQ ID NO: 87458 - DNA, 25 bp, Mus musculus
cagtgtctagaataccctggatggc

SEQ ID NO: 87459 - DNA, 25 bp, Mus musculus
cagtgtctcaagtcacaggtgtgtg

SEQ ID NO: 87460 - DNA, 25 bp, Mus musculus
cagtgtctcatcatctgaagctggg

SEQ ID NO: 87461 - DNA, 25 bp, Mus musculus
cagtgtctctctgaccagatggcat

SEQ ID NO: 87462 - DNA, 25 bp, Mus musculus
cagtgtctgatactcctgaggtacc

SEQ ID NO: 87463 - DNA, 25 bp, Mus musculus
cagtgtctgcaatacttgtgggcca

SEQ ID NO: 87464 - DNA, 25 bp, Mus musculus
cagtgtctgcccgatattggtttgc

SEQ ID NO: 87465 - DNA, 25 bp, Mus musculus
cagtgtctggatcagcaacaagacg

SEQ ID NO: 87466 - DNA, 25 bp, Mus musculus
cagtgtctggtaaaaagcccggagc

SEQ ID NO: 87467 - DNA, 25 bp, Mus musculus
cagtgtcttaagtcctgtcaggaga

SEQ ID NO: 87468 - DNA, 25 bp, Mus musculus
cagtgtcttgaggatcttgatgcca

SEQ ID NO: 87469 - DNA, 25 bp, Mus musculus
cagtgtgacctttgacgcagagtga

SEQ ID NO: 87470 - DNA, 25 bp, Mus musculus
cagtgtgatgccgtggttttatgcc

SEQ ID NO: 87471 - DNA, 25 bp, Mus musculus
cagtgtgccatgtgcccaatagaag

SEQ ID NO: 87472 - DNA, 25 bp, Mus musculus
cagtgtgcggctgcaacagatgagt

SEQ ID NO: 87473 - DNA, 25 bp, Mus musculus
cagtgtgctactgtgcctgggaatg

SEQ ID NO: 87474 - DNA, 25 bp, Mus musculus
cagtgtgtactcgggtgtgcagcct

SEQ ID NO: 87475 - DNA, 25 bp, Mus musculus
cagtgtgtagaaagaaaatgccctt

SEQ ID NO: 87476 - DNA, 25 bp, Mus musculus
cagtgtgtatgggacagtctttgac

SEQ ID NO: 87477 - DNA, 25 bp, Mus musculus
cagtgtgtcagaatcggctagtgga

SEQ ID NO: 87478 - DNA, 25 bp, Mus musculus
cagtgtgtggattgccttcataaag

SEQ ID NO: 87479 - DNA, 25 bp, Mus musculus
cagtgtgtggtccatctacccaaca

SEQ ID NO: 87480 - DNA, 25 bp, Mus musculus
cagtgtgttccaaagggtgctctcc

SEQ ID NO: 87481 - DNA, 25 bp, Mus musculus
cagtgtgttgagagttcatccgtca

SEQ ID NO: 87482 - DNA, 25 bp, Mus musculus
cagtgttacactggagttttcggtt

SEQ ID NO: 87483 - DNA, 25 bp, Mus musculus
cagtgttaccgtaccttggacagga

SEQ ID NO: 87484 - DNA, 25 bp, Mus musculus
cagtgttaccttgccttgccagagc

SEQ ID NO: 87485 - DNA, 25 bp, Mus musculus
cagtgttcaagactttaccagggca

SEQ ID NO: 87486 - DNA, 25 bp, Mus musculus
cagtgttcccagaaaccatgacagg

SEQ ID NO: 87487 - DNA, 25 bp, Mus musculus
cagtgttcctatttcaagtgcgtgc

SEQ ID NO: 87488 - DNA, 25 bp, Mus musculus
cagtgttctgcctttattcatgacg

SEQ ID NO: 87489 - DNA, 25 bp, Mus musculus
cagtgttctgtaccaatgccatcaa

SEQ ID NO: 87490 - DNA, 25 bp, Mus musculus
cagtgttgactgaattaaatcgaca

SEQ ID NO: 87491 - DNA, 25 bp, Mus musculus
cagtgttgctggtgaccctggtagc

SEQ ID NO: 87492 - DNA, 25 bp, Mus musculus
cagtgttggctgacttacagcttct

SEQ ID NO: 87493 - DNA, 25 bp, Mus musculus
cagtgttggtaagaagaacccgtct

SEQ ID NO: 87494 - DNA, 25 bp, Mus musculus
cagtgtttactcagtgtggctcccg

SEQ ID NO: 87495 - DNA, 25 bp, Mus musculus
cagtgtttatggctggtcaggacca

SEQ ID NO: 87496 - DNA, 25 bp, Mus musculus
cagtgtttttgcgttgcattccact

SEQ ID NO: 87497 - DNA, 25 bp, Mus musculus
cagttaaaaaactagatccaggatg

SEQ ID NO: 87498 - DNA, 25 bp, Mus musculus
cagttaaaagagcacaggtcctggc

SEQ ID NO: 87499 - DNA, 25 bp, Mus musculus
cagttaaacctcaatgtgcaatgtc

SEQ ID NO: 87500 - DNA, 25 bp, Mus musculus
cagttaaataggaggaagtggcaat

SEQ ID NO: 87501 - DNA, 25 bp, Mus musculus
cagttaaccagcacgtcagagacca

SEQ ID NO: 87502 - DNA, 25 bp, Mus musculus
cagttaagccgcaggaacgtgcgga

SEQ ID NO: 87503 - DNA, 25 bp, Mus musculus
cagttaaggcataaataggcacggc

SEQ ID NO: 87504 - DNA, 25 bp, Mus musculus
cagttaagttggatcctcacctgca

SEQ ID NO: 87505 - DNA, 25 bp, Mus musculus
cagttaatatgcaccgaatggcgta

SEQ ID NO: 87506 - DNA, 25 bp, Mus musculus
cagttaatgggcacctctcgggacg

SEQ ID NO: 87507 - DNA, 25 bp, Mus musculus
cagttaatttcaggctgcccagggc

SEQ ID NO: 87508 - DNA, 25 bp, Mus musculus
cagttacaggtgtttgcagagacca

SEQ ID NO: 87509 - DNA, 25 bp, Mus musculus
cagttacctccactcacagctgtgg

SEQ ID NO: 87510 - DNA, 25 bp, Mus musculus
cagttacctgagatcatgtgggacc

SEQ ID NO: 87511 - DNA, 25 bp, Mus musculus
cagttacgttccagtcaatgggagg

SEQ ID NO: 87512 - DNA, 25 bp, Mus musculus
cagttactcgcccttgtttcagtgg

SEQ ID NO: 87513 - DNA, 25 bp, Mus musculus
cagttactgctacagcaggcgcagg

SEQ ID NO: 87514 - DNA, 25 bp, Mus musculus
cagttagaattgttatcagggccca

SEQ ID NO: 87515 - DNA, 25 bp, Mus musculus
cagttagatttaaaagaagagcaaa

SEQ ID NO: 87516 - DNA, 25 bp, Mus musculus
cagttagctgggttataccttcttc

SEQ ID NO: 87517 - DNA, 25 bp, Mus musculus
cagttagtgatttgctgacatacat

SEQ ID NO: 87518 - DNA, 25 bp, Mus musculus
cagttagtgtaggtttgttgcgcca

SEQ ID NO: 87519 - DNA, 25 bp, Mus musculus
cagttataacaagggccagacgacc

SEQ ID NO: 87520 - DNA, 25 bp, Mus musculus
cagttatcttgttctccatggacgg

SEQ ID NO: 87521 - DNA, 25 bp, Mus musculus
cagttatggagcttcttagtgggcc

SEQ ID NO: 87522 - DNA, 25 bp, Mus musculus
cagttattcaccgaggacgagctta

SEQ ID NO: 87523 - DNA, 25 bp, Mus musculus
cagttattggctcccttcccaagga

SEQ ID NO: 87524 - DNA, 25 bp, Mus musculus
cagttcaaagctggccaagtctgag

SEQ ID NO: 87525 - DNA, 25 bp, Mus musculus
cagttcaaagcttgttgtcttcgac

SEQ ID NO: 87526 - DNA, 25 bp, Mus musculus
cagttcaacccctcagacttttagt

SEQ ID NO: 87527 - DNA, 25 bp, Mus musculus
cagttcaaggattttcagcggagga

SEQ ID NO: 87528 - DNA, 25 bp, Mus musculus
cagttcaatgctggtttatggagcc

SEQ ID NO: 87529 - DNA, 25 bp, Mus musculus
cagttcaattgttgttggcccagcc

SEQ ID NO: 87530 - DNA, 25 bp, Mus musculus
cagttcactgtagcccagtatgaga

SEQ ID NO: 87531 - DNA, 25 bp, Mus musculus
cagttcagatcacaagctaggctcc

SEQ ID NO: 87532 - DNA, 25 bp, Mus musculus
cagttcagcgtggatcaactcatgg

SEQ ID NO: 87533 - DNA, 25 bp, Mus musculus
cagttcagctgtgcacttcttggcg

SEQ ID NO: 87534 - DNA, 25 bp, Mus musculus
cagttcaggctaccacggctgtcaa

SEQ ID NO: 87535 - DNA, 25 bp, Mus musculus
cagttcagtcagtcaatgcaggcac

SEQ ID NO: 87536 - DNA, 25 bp, Mus musculus
cagttcagtgaggtttacaaggcca

SEQ ID NO: 87537 - DNA, 25 bp, Mus musculus
cagttcataacacatctgggccatg

SEQ ID NO: 87538 - DNA, 25 bp, Mus musculus
cagttcatggaacggaaggcccaga

SEQ ID NO: 87539 - DNA, 25 bp, Mus musculus
cagttcattgactcgatctgaggaa

SEQ ID NO: 87540 - DNA, 25 bp, Mus musculus
cagttcattgtctgaaggacgggct

SEQ ID NO: 87541 - DNA, 25 bp, Mus musculus
cagttccagaacatgcggcaagtga

SEQ ID NO: 87542 - DNA, 25 bp, Mus musculus
cagttccaggaggacgggtttctgc

SEQ ID NO: 87543 - DNA, 25 bp, Mus musculus
cagttccatgatgtccgggatgcag

SEQ ID NO: 87544 - DNA, 25 bp, Mus musculus
cagttcccaaagcagtcatggtgca

SEQ ID NO: 87545 - DNA, 25 bp, Mus musculus
cagttcccacaagaggaccaaagca

SEQ ID NO: 87546 - DNA, 25 bp, Mus musculus
cagttcccgagagcatagtcaagag

SEQ ID NO: 87547 - DNA, 25 bp, Mus musculus
cagttccgtgaggacgacttccgta

SEQ ID NO: 87548 - DNA, 25 bp, Mus musculus
cagttcctgacaaccccagatggtg

SEQ ID NO: 87549 - DNA, 25 bp, Mus musculus
cagttcctgactgggcgaaagatcc

SEQ ID NO: 87550 - DNA, 25 bp, Mus musculus
cagttcctgcagtccaaagccagaa

SEQ ID NO: 87551 - DNA, 25 bp, Mus musculus
cagttcctggcagatatgaccgcgc

SEQ ID NO: 87552 - DNA, 25 bp, Mus musculus
cagttcctggcattcctgatactct

SEQ ID NO: 87553 - DNA, 25 bp, Mus musculus
cagttcctgtgatcccaagagtggg

SEQ ID NO: 87554 - DNA, 25 bp, Mus musculus
cagttcggatctgaggtgtggatct

SEQ ID NO: 87555 - DNA, 25 bp, Mus musculus
cagttcgtacttgcccagaatgtcg

SEQ ID NO: 87556 - DNA, 25 bp, Mus musculus
cagttcgtcgtgtttgagggcaacc

SEQ ID NO: 87557 - DNA, 25 bp, Mus musculus
cagttctccgacctgacagaagtgc

SEQ ID NO: 87558 - DNA, 25 bp, Mus musculus
cagttctgaatttggttctcgctca

SEQ ID NO: 87559 - DNA, 25 bp, Mus musculus
cagttctgacaccagggatggacca

SEQ ID NO: 87560 - DNA, 25 bp, Mus musculus
cagttctgaggaggatgcttgagca

SEQ ID NO: 87561 - DNA, 25 bp, Mus musculus
cagttctgatcagactgcgttatat

SEQ ID NO: 87562 - DNA, 25 bp, Mus musculus
cagttctgcaaagagttcaacgaga

SEQ ID NO: 87563 - DNA, 25 bp, Mus musculus
cagttctgcaaagggacaccaggca

SEQ ID NO: 87564 - DNA, 25 bp, Mus musculus
cagttctgccctggaaggaatgaag

SEQ ID NO: 87565 - DNA, 25 bp, Mus musculus
cagttctggaaacaaggctgctcag

SEQ ID NO: 87566 - DNA, 25 bp, Mus musculus
cagttctgtgccagctgcgtgggct

SEQ ID NO: 87567 - DNA, 25 bp, Mus musculus
cagttcttccgagatgccgtgacag

SEQ ID NO: 87568 - DNA, 25 bp, Mus musculus
cagttcttctccagtgcctcaagga

SEQ ID NO: 87569 - DNA, 25 bp, Mus musculus
cagttcttggcagagcagggccagc

SEQ ID NO: 87570 - DNA, 25 bp, Mus musculus
cagttcttgggtctctgctgacggc

SEQ ID NO: 87571 - DNA, 25 bp, Mus musculus
cagttgaaaatcagcgaccgaagtc

SEQ ID NO: 87572 - DNA, 25 bp, Mus musculus
cagttgaagaagcaaggcatccgga

SEQ ID NO: 87573 - DNA, 25 bp, Mus musculus
cagttgacgcggtgcatcggaaagc

SEQ ID NO: 87574 - DNA, 25 bp, Mus musculus
cagttgactgaaactcgggccatca

SEQ ID NO: 87575 - DNA, 25 bp, Mus musculus
cagttgagcaggaacaaggtgacac

SEQ ID NO: 87576 - DNA, 25 bp, Mus musculus
cagttgagcaggttacagaaaggac

SEQ ID NO: 87577 - DNA, 25 bp, Mus musculus
cagttgaggccgacttgacggagaa

SEQ ID NO: 87578 - DNA, 25 bp, Mus musculus
cagttgagtagcacagagaacaggc

SEQ ID NO: 87579 - DNA, 25 bp, Mus musculus
cagttgcagcactcagcgggtttgg

SEQ ID NO: 87580 - DNA, 25 bp, Mus musculus
cagttgcagcagatccaagccagtc

SEQ ID NO: 87581 - DNA, 25 bp, Mus musculus
cagttgcatcgggactttgccagta

SEQ ID NO: 87582 - DNA, 25 bp, Mus musculus
cagttgccacccattgatgtcaaga

SEQ ID NO: 87583 - DNA, 25 bp, Mus musculus
cagttgccagactcctaatttaggc

SEQ ID NO: 87584 - DNA, 25 bp, Mus musculus
cagttgccaggagtgccatgatgca

SEQ ID NO: 87585 - DNA, 25 bp, Mus musculus
cagttgccccagaattcattttcag

SEQ ID NO: 87586 - DNA, 25 bp, Mus musculus
cagttgctcctgaacctgaggttac

SEQ ID NO: 87587 - DNA, 25 bp, Mus musculus
cagttgcttgacacgcaggtgccct

SEQ ID NO: 87588 - DNA, 25 bp, Mus musculus
cagttgctttgatccatgtgggccg

SEQ ID NO: 87589 - DNA, 25 bp, Mus musculus
cagttggacctgtcttggctgggac

SEQ ID NO: 87590 - DNA, 25 bp, Mus musculus
cagttggagaggacagcaacagtca

SEQ ID NO: 87591 - DNA, 25 bp, Mus musculus
cagttggcactcaacagctctgagg

SEQ ID NO: 87592 - DNA, 25 bp, Mus musculus
cagttggcgctgcagaatgtcctca

SEQ ID NO: 87593 - DNA, 25 bp, Mus musculus
cagttgggcgagtttcatctccgga

SEQ ID NO: 87594 - DNA, 25 bp, Mus musculus
cagttgtcaggtctcatgccagggc

SEQ ID NO: 87595 - DNA, 25 bp, Mus musculus
cagttgtccaagcaagtgctgggtc

SEQ ID NO: 87596 - DNA, 25 bp, Mus musculus
cagttgtcccaggtccatgcagggc

SEQ ID NO: 87597 - DNA, 25 bp, Mus musculus
cagttgtgagacacacatgggtgcc

SEQ ID NO: 87598 - DNA, 25 bp, Mus musculus
cagttgtgcctacgactacctggaa

SEQ ID NO: 87599 - DNA, 25 bp, Mus musculus
cagttgtgcctatcttattacaggg

SEQ ID NO: 87600 - DNA, 25 bp, Mus musculus
cagttgtggcacagcatctgacaaa

SEQ ID NO: 87601 - DNA, 25 bp, Mus musculus
cagttgtggccagctttgtttcata

SEQ ID NO: 87602 - DNA, 25 bp, Mus musculus
cagtttaacacccaatgacatcagg

SEQ ID NO: 87603 - DNA, 25 bp, Mus musculus
cagtttaacctggaaaacgtcactg

SEQ ID NO: 87604 - DNA, 25 bp, Mus musculus
cagtttaacttcttagcaatggacg

SEQ ID NO: 87605 - DNA, 25 bp, Mus musculus
cagtttaagaagatcctcggctaca

SEQ ID NO: 87606 - DNA, 25 bp, Mus musculus
cagtttataaacagctctgaggcca

SEQ ID NO: 87607 - DNA, 25 bp, Mus musculus
cagtttataagccaccagttcccgg

SEQ ID NO: 87608 - DNA, 25 bp, Mus musculus
cagtttatccttcgcgtgtcgcccg

SEQ ID NO: 87609 - DNA, 25 bp, Mus musculus
cagtttcacagccacttctgagcgg

SEQ ID NO: 87610 - DNA, 25 bp, Mus musculus
cagtttcagctgagtctctgcggga

SEQ ID NO: 87611 - DNA, 25 bp, Mus musculus
cagtttcagggtccttgaagtcacc

SEQ ID NO: 87612 - DNA, 25 bp, Mus musculus
cagtttcatagcctggagatcgagg

SEQ ID NO: 87613 - DNA, 25 bp, Mus musculus
cagtttcatggtctagggtcatcca

SEQ ID NO: 87614 - DNA, 25 bp, Mus musculus
cagtttccccacagagtttcagtca

SEQ ID NO: 87615 - DNA, 25 bp, Mus musculus
cagtttcctcattgatgggctctgg

SEQ ID NO: 87616 - DNA, 25 bp, Mus musculus
cagtttcgctttgcctgtagagggc

SEQ ID NO: 87617 - DNA, 25 bp, Mus musculus
cagtttcggcctcttcatgcaggaa

SEQ ID NO: 87618 - DNA, 25 bp, Mus musculus
cagtttctacatccagatgcctgga

SEQ ID NO: 87619 - DNA, 25 bp, Mus musculus
cagtttctataagagtggagaccca

SEQ ID NO: 87620 - DNA, 25 bp, Mus musculus
cagtttctcagggtatgcgagcgat

SEQ ID NO: 87621 - DNA, 25 bp, Mus musculus
cagtttctgctaccttagagtggca

SEQ ID NO: 87622 - DNA, 25 bp, Mus musculus
cagtttctgctccttgccaagtcgg

SEQ ID NO: 87623 - DNA, 25 bp, Mus musculus
cagtttgacaaacagtattcgaaag

SEQ ID NO: 87624 - DNA, 25 bp, Mus musculus
cagtttgacatcatggcgtgcgccc

SEQ ID NO: 87625 - DNA, 25 bp, Mus musculus
cagtttgagcgctttaaccaggcca

SEQ ID NO: 87626 - DNA, 25 bp, Mus musculus
cagtttgaggaattcggccgggcct

SEQ ID NO: 87627 - DNA, 25 bp, Mus musculus
cagtttgatatgttcctgtgattca

SEQ ID NO: 87628 - DNA, 25 bp, Mus musculus
cagtttgccttcgtgcacatgcgcg

SEQ ID NO: 87629 - DNA, 25 bp, Mus musculus
cagtttgcttgctcccgcgtcggag

SEQ ID NO: 87630 - DNA, 25 bp, Mus musculus
cagtttggcccaatacggacagtag

SEQ ID NO: 87631 - DNA, 25 bp, Mus musculus
cagtttggcccacagatctagtaca

SEQ ID NO: 87632 - DNA, 25 bp, Mus musculus
cagtttgtggtgagcagcaacagca

SEQ ID NO: 87633 - DNA, 25 bp, Mus musculus
cagtttgtgtgctctgacggctcgg

SEQ ID NO: 87634 - DNA, 25 bp, Mus musculus
cagttttacaaccaacgagtcaagc

SEQ ID NO: 87635 - DNA, 25 bp, Mus musculus
cagttttatgttacaatcttgggct

SEQ ID NO: 87636 - DNA, 25 bp, Mus musculus
cagttttcagctggaagtgtcaacc

SEQ ID NO: 87637 - DNA, 25 bp, Mus musculus
cagttttcctgttggtacaagctca

SEQ ID NO: 87638 - DNA, 25 bp, Mus musculus
cagttttcgcggaaaacgcgcgctg

SEQ ID NO: 87639 - DNA, 25 bp, Mus musculus
cagttttctcacaggaaggcgtgga

SEQ ID NO: 87640 - DNA, 25 bp, Mus musculus
cagttttctgcaaaccaccggacaa

SEQ ID NO: 87641 - DNA, 25 bp, Mus musculus
cagttttctggtggtctccagcgaa

SEQ ID NO: 87642 - DNA, 25 bp, Mus musculus
cagttttggatgattcaggaccctc

SEQ ID NO: 87643 - DNA, 25 bp, Mus musculus
cagttttgggccagtggatacagtc

SEQ ID NO: 87644 - DNA, 25 bp, Mus musculus
cagttttgtgtagcagggcaggcct

SEQ ID NO: 87645 - DNA, 25 bp, Mus musculus
cagtttttagagaaggacagcaccc

SEQ ID NO: 87646 - DNA, 25 bp, Mus musculus
cagtttttccaccaagagcggatgg

SEQ ID NO: 87647 - DNA, 25 bp, Mus musculus
cagtttttctttactctgggccgag

SEQ ID NO: 87648 - DNA, 25 bp, Mus musculus
cagtttttgactatgatccggcaga

SEQ ID NO: 87649 - DNA, 25 bp, Mus musculus
cagtttttgggccacctgcaggcag

SEQ ID NO: 87650 - DNA, 25 bp, Mus musculus
cataaaagcacacacactggcgaag

SEQ ID NO: 87651 - DNA, 25 bp, Mus musculus
cataaaaggcagagtctagacagta

SEQ ID NO: 87652 - DNA, 25 bp, Mus musculus
cataaaagggaaggttgcacactgg

SEQ ID NO: 87653 - DNA, 25 bp, Mus musculus
cataaaagttcgagcgttgagaagc

SEQ ID NO: 87654 - DNA, 25 bp, Mus musculus
cataaacagtgacatacctgaccga

SEQ ID NO: 87655 - DNA, 25 bp, Mus musculus
cataaacgagagtgcatgggtcccc

SEQ ID NO: 87656 - DNA, 25 bp, Mus musculus
cataaacgatggacactgcggcctt

SEQ ID NO: 87657 - DNA, 25 bp, Mus musculus
cataaacgatgtgccttcaagattc

SEQ ID NO: 87658 - DNA, 25 bp, Mus musculus
cataaacgtcacttggatagaccag

SEQ ID NO: 87659 - DNA, 25 bp, Mus musculus
cataaactgttgctgggtggttgca

SEQ ID NO: 87660 - DNA, 25 bp, Mus musculus
cataaagaagcaactggactcagag

SEQ ID NO: 87661 - DNA, 25 bp, Mus musculus
cataaagaccttttcagccagagga

SEQ ID NO: 87662 - DNA, 25 bp, Mus musculus
cataaagactgggagaagcatcacc

SEQ ID NO: 87663 - DNA, 25 bp, Mus musculus
cataaagagcgggtgctagagacac

SEQ ID NO: 87664 - DNA, 25 bp, Mus musculus
cataaagccagcatgcatcccgtga

SEQ ID NO: 87665 - DNA, 25 bp, Mus musculus
cataaaggagacctacatgcggatt

SEQ ID NO: 87666 - DNA, 25 bp, Mus musculus
cataaaggatagagagcaggttgcc

SEQ ID NO: 87667 - DNA, 25 bp, Mus musculus
cataaaggtttatgcggcctgacga

SEQ ID NO: 87668 - DNA, 25 bp, Mus musculus
cataaagtaatgagtgagatcaaga

SEQ ID NO: 87669 - DNA, 25 bp, Mus musculus
cataaagtcctgatgtctgccagaa

SEQ ID NO: 87670 - DNA, 25 bp, Mus musculus
cataaagtgctgtgtgtcaggcgtc

SEQ ID NO: 87671 - DNA, 25 bp, Mus musculus
cataaagtggtccttgccagcatca

SEQ ID NO: 87672 - DNA, 25 bp, Mus musculus
cataaagttggagcggatgctcacg

SEQ ID NO: 87673 - DNA, 25 bp, Mus musculus
cataaatggacttgggactcagcag

SEQ ID NO: 87674 - DNA, 25 bp, Mus musculus
cataacaaagactgagggagcccaa

SEQ ID NO: 87675 - DNA, 25 bp, Mus musculus
cataacatggtgtgggaagtgaaga

SEQ ID NO: 87676 - DNA, 25 bp, Mus musculus
cataaccaaaatctcaaaagtgaag

SEQ ID NO: 87677 - DNA, 25 bp, Mus musculus
cataaccacgccagagctgactact

SEQ ID NO: 87678 - DNA, 25 bp, Mus musculus
cataaccagctagattgggacgagc

SEQ ID NO: 87679 - DNA, 25 bp, Mus musculus
cataaccatgtgtggcatttgctgt

SEQ ID NO: 87680 - DNA, 25 bp, Mus musculus
cataaccgactacgagaggtctcga

SEQ ID NO: 87681 - DNA, 25 bp, Mus musculus
cataacgcccaatgagaagcagcca

SEQ ID NO: 87682 - DNA, 25 bp, Mus musculus
cataacgccggatccaagtctgtgg

SEQ ID NO: 87683 - DNA, 25 bp, Mus musculus
cataacgtgtcaggcacggccaagg

SEQ ID NO: 87684 - DNA, 25 bp, Mus musculus
cataacgttgtggatgaaaccctga

SEQ ID NO: 87685 - DNA, 25 bp, Mus musculus
cataactgccggctgggagaatcct

SEQ ID NO: 87686 - DNA, 25 bp, Mus musculus
cataactggacgtactggcagtgcg

SEQ ID NO: 87687 - DNA, 25 bp, Mus musculus
cataagaagcctcttagcctcccag

SEQ ID NO: 87688 - DNA, 25 bp, Mus musculus
cataagaataatccaagccatgtgg

SEQ ID NO: 87689 - DNA, 25 bp, Mus musculus
cataagacatgtgtggacccgtggc

SEQ ID NO: 87690 - DNA, 25 bp, Mus musculus
cataagatatagctgtgaccctggc

SEQ ID NO: 87691 - DNA, 25 bp, Mus musculus
cataagatctgtcactctgaataca

SEQ ID NO: 87692 - DNA, 25 bp, Mus musculus
cataagatgggctagatggactggc

SEQ ID NO: 87693 - DNA, 25 bp, Mus musculus
cataagcatgtacacaacgggcacg

SEQ ID NO: 87694 - DNA, 25 bp, Mus musculus
cataagcattagctggttaggacca

SEQ ID NO: 87695 - DNA, 25 bp, Mus musculus
cataagccaagggaaacatgacggg

SEQ ID NO: 87696 - DNA, 25 bp, Mus musculus
cataagccaggtgctagaggctcct

SEQ ID NO: 87697 - DNA, 25 bp, Mus musculus
cataagccgctcaaggaaggaatcc

SEQ ID NO: 87698 - DNA, 25 bp, Mus musculus
cataagcctgtattctggaacctcc

SEQ ID NO: 87699 - DNA, 25 bp, Mus musculus
cataagcgtactcgaaagacacgga

SEQ ID NO: 87700 - DNA, 25 bp, Mus musculus
cataagctaggacccacggtgctac

SEQ ID NO: 87701 - DNA, 25 bp, Mus musculus
cataaggaatccagcttcgatgtca

SEQ ID NO: 87702 - DNA, 25 bp, Mus musculus
cataaggatttgattcagtcgcatc

SEQ ID NO: 87703 - DNA, 25 bp, Mus musculus
cataagggacagtttggaagcgttg

SEQ ID NO: 87704 - DNA, 25 bp, Mus musculus
cataaggtggcaatcaaggacaact

SEQ ID NO: 87705 - DNA, 25 bp, Mus musculus
cataagtatcggagcctgggagacc

SEQ ID NO: 87706 - DNA, 25 bp, Mus musculus
cataagtcagtctgagtgcgcgcgc

SEQ ID NO: 87707 - DNA, 25 bp, Mus musculus
cataagtcagttcagccagtggtcg

SEQ ID NO: 87708 - DNA, 25 bp, Mus musculus
cataagtgcccatgagcttcggagc

SEQ ID NO: 87709 - DNA, 25 bp, Mus musculus
cataagtggcttcgcatacgagtac

SEQ ID NO: 87710 - DNA, 25 bp, Mus musculus
cataagtgtgtactccggtgctggc

SEQ ID NO: 87711 - DNA, 25 bp, Mus musculus
cataataactgatcactcattttgt

SEQ ID NO: 87712 - DNA, 25 bp, Mus musculus
cataataagtcagggcaagggcacg

SEQ ID NO: 87713 - DNA, 25 bp, Mus musculus
cataatagtggatccttgaatgtgg

SEQ ID NO: 87714 - DNA, 25 bp, Mus musculus
cataatcactgtggataggcagcct

SEQ ID NO: 87715 - DNA, 25 bp, Mus musculus
cataatcatcaagaggtggtggagc

SEQ ID NO: 87716 - DNA, 25 bp, Mus musculus
cataatcctgctgggagcaaccggg

SEQ ID NO: 87717 - DNA, 25 bp, Mus musculus
cataatggcctttgagcagcaagct

SEQ ID NO: 87718 - DNA, 25 bp, Mus musculus
cataatgtgtggcaactggctcggc

SEQ ID NO: 87719 - DNA, 25 bp, Mus musculus
cataattaaggaacccgagtccgct

SEQ ID NO: 87720 - DNA, 25 bp, Mus musculus
cataattacggcagcaaccgtgggc

SEQ ID NO: 87721 - DNA, 25 bp, Mus musculus
cataattgaaattggtatccggacc

SEQ ID NO: 87722 - DNA, 25 bp, Mus musculus
cataattgcagagagcaggtgtgcc

SEQ ID NO: 87723 - DNA, 25 bp, Mus musculus
cataattggcaaggaccgctgacag

SEQ ID NO: 87724 - DNA, 25 bp, Mus musculus
cataattgtgcatccgaactgggct

SEQ ID NO: 87725 - DNA, 25 bp, Mus musculus
cataatttggtccatgcagctgacg

SEQ ID NO: 87726 - DNA, 25 bp, Mus musculus
catacaacaagaccgatgtggccgc

SEQ ID NO: 87727 - DNA, 25 bp, Mus musculus
catacaatgaggtagctgatgagct

SEQ ID NO: 87728 - DNA, 25 bp, Mus musculus
catacacccatgatgagtgagcagg

SEQ ID NO: 87729 - DNA, 25 bp, Mus musculus
catacaccgaatggagcagcctcat

SEQ ID NO: 87730 - DNA, 25 bp, Mus musculus
catacacctggagaattgagctggc

SEQ ID NO: 87731 - DNA, 25 bp, Mus musculus
catacactggcccatgggtttcaag

SEQ ID NO: 87732 - DNA, 25 bp, Mus musculus
catacactgtcctgggagtactaca

SEQ ID NO: 87733 - DNA, 25 bp, Mus musculus
catacactgtgtaagaggaccttac

SEQ ID NO: 87734 - DNA, 25 bp, Mus musculus
catacagacaacttcctccagaggg

SEQ ID NO: 87735 - DNA, 25 bp, Mus musculus
catacagacatggtgggagagcagc

SEQ ID NO: 87736 - DNA, 25 bp, Mus musculus
catacagagagagtgagtgcaagtc

SEQ ID NO: 87737 - DNA, 25 bp, Mus musculus
catacagagatggtcgagtggcaca

SEQ ID NO: 87738 - DNA, 25 bp, Mus musculus
catacagaggtcgtttgcaacattc

SEQ ID NO: 87739 - DNA, 25 bp, Mus musculus
catacagagtacagctgcagtgacc

SEQ ID NO: 87740 - DNA, 25 bp, Mus musculus
catacagatctgagtgaaaccatgc

SEQ ID NO: 87741 - DNA, 25 bp, Mus musculus
catacagcatccagtaagaagttct

SEQ ID NO: 87742 - DNA, 25 bp, Mus musculus
catacagcgccaggaaatgactgct

SEQ ID NO: 87743 - DNA, 25 bp, Mus musculus
catacagctgagtacagtgagcggc

SEQ ID NO: 87744 - DNA, 25 bp, Mus musculus
catacaggatttaccggctgaaggc

SEQ ID NO: 87745 - DNA, 25 bp, Mus musculus
catacaggctctagagtgccctgct

SEQ ID NO: 87746 - DNA, 25 bp, Mus musculus
catacagggctaggtggtgacagtc

SEQ ID NO: 87747 - DNA, 25 bp, Mus musculus
catacagtgcgcttggccatgggca

SEQ ID NO: 87748 - DNA, 25 bp, Mus musculus
catacagttctttaggctcgcacac

SEQ ID NO: 87749 - DNA, 25 bp, Mus musculus
catacatcgagagtgagggctcaga

SEQ ID NO: 87750 - DNA, 25 bp, Mus musculus
catacatgagcatgtccgcggctgc

SEQ ID NO: 87751 - DNA, 25 bp, Mus musculus
catacatgtgctatcctgggccaga

SEQ ID NO: 87752 - DNA, 25 bp, Mus musculus
catacattatggacaaaggcttcaa

SEQ ID NO: 87753 - DNA, 25 bp, Mus musculus
catacattcaatagagaccgggacc

SEQ ID NO: 87754 - DNA, 25 bp, Mus musculus
catacattgaacttggactgcctgg

SEQ ID NO: 87755 - DNA, 25 bp, Mus musculus
catacattgagttactgtggaccac

SEQ ID NO: 87756 - DNA, 25 bp, Mus musculus
catacattgggagcgtggttatatc

SEQ ID NO: 87757 - DNA, 25 bp, Mus musculus
catacatttaaaggccacggaatcc

SEQ ID NO: 87758 - DNA, 25 bp, Mus musculus
cataccaagaggtgagggtgcacgt

SEQ ID NO: 87759 - DNA, 25 bp, Mus musculus
cataccagggaacgctttccaaggg

SEQ ID NO: 87760 - DNA, 25 bp, Mus musculus
cataccagtgaggatgcccgtctca

SEQ ID NO: 87761 - DNA, 25 bp, Mus musculus
cataccatggtgaagatccggccct

SEQ ID NO: 87762 - DNA, 25 bp, Mus musculus
cataccatgtatgccctcaaaaggg

SEQ ID NO: 87763 - DNA, 25 bp, Mus musculus
catacccattcctgagcaacactgg

SEQ ID NO: 87764 - DNA, 25 bp, Mus musculus
cataccctatgtctactgaagcagg

SEQ ID NO: 87765 - DNA, 25 bp, Mus musculus
cataccctcagaagagcacctggga

SEQ ID NO: 87766 - DNA, 25 bp, Mus musculus
cataccgatcaaattcccagggaca

SEQ ID NO: 87767 - DNA, 25 bp, Mus musculus
catacctagtgaaagtaatgggctt

SEQ ID NO: 87768 - DNA, 25 bp, Mus musculus
catacctcacgggagaacctgggaa

SEQ ID NO: 87769 - DNA, 25 bp, Mus musculus
catacctgggaattatacgttcaca

SEQ ID NO: 87770 - DNA, 25 bp, Mus musculus
catacctgtggcgtcatagcaacca

SEQ ID NO: 87771 - DNA, 25 bp, Mus musculus
cataccttggcatggcgtacacagc

SEQ ID NO: 87772 - DNA, 25 bp, Mus musculus
catacgaaggacaacctgccaggat

SEQ ID NO: 87773 - DNA, 25 bp, Mus musculus
catacgacagtctcaggaggaacct

SEQ ID NO: 87774 - DNA, 25 bp, Mus musculus
catacgagtgctttcctggagcgtc

SEQ ID NO: 87775 - DNA, 25 bp, Mus musculus
catacgagtttcaagcagtggagag

SEQ ID NO: 87776 - DNA, 25 bp, Mus musculus
catacgataagactgtggccctggg

SEQ ID NO: 87777 - DNA, 25 bp, Mus musculus
catacgatctgaagtgcctgaccac

SEQ ID NO: 87778 - DNA, 25 bp, Mus musculus
catacgatctgaggaaagaagccgg

SEQ ID NO: 87779 - DNA, 25 bp, Mus musculus
catacgattctagttctctcacaag

SEQ ID NO: 87780 - DNA, 25 bp, Mus musculus
catacggagcgaagaaaaacgtgcc

SEQ ID NO: 87781 - DNA, 25 bp, Mus musculus
catacgggctagaagatggatcctg

SEQ ID NO: 87782 - DNA, 25 bp, Mus musculus
catacggtcctgtgacaatgctggc

SEQ ID NO: 87783 - DNA, 25 bp, Mus musculus
catacggtgtaaatgcgtggaaaca

SEQ ID NO: 87784 - DNA, 25 bp, Mus musculus
catacgtaatgagcagaggagcaac

SEQ ID NO: 87785 - DNA, 25 bp, Mus musculus
catacgttgtgctccggtctggatc

SEQ ID NO: 87786 - DNA, 25 bp, Mus musculus
catactacacattccccagcaggta

SEQ ID NO: 87787 - DNA, 25 bp, Mus musculus
catactacagagaggtgccatccag

SEQ ID NO: 87788 - DNA, 25 bp, Mus musculus
catactagtctactgggccctgctg

SEQ ID NO: 87789 - DNA, 25 bp, Mus musculus
catactatatacaccgagggctgcc

SEQ ID NO: 87790 - DNA, 25 bp, Mus musculus
catactatatgtgcccagaggtcta

SEQ ID NO: 87791 - DNA, 25 bp, Mus musculus
catactccaggtgcaccagagggtc

SEQ ID NO: 87792 - DNA, 25 bp, Mus musculus
catactcggctcgtaagctgggcat

SEQ ID NO: 87793 - DNA, 25 bp, Mus musculus
catactgaaggaggtagaataccgc

SEQ ID NO: 87794 - DNA, 25 bp, Mus musculus
catactgctacatgcgggtcgtggg

SEQ ID NO: 87795 - DNA, 25 bp, Mus musculus
catactggataaggagatctgtgct

SEQ ID NO: 87796 - DNA, 25 bp, Mus musculus
catactggcttagggattggctcag

SEQ ID NO: 87797 - DNA, 25 bp, Mus musculus
catactgggcaaccgccctagagag

SEQ ID NO: 87798 - DNA, 25 bp, Mus musculus
catactgtacaaactcgtgcgtgca

SEQ ID NO: 87799 - DNA, 25 bp, Mus musculus
catactgtgttcagtcccgggcaag

SEQ ID NO: 87800 - DNA, 25 bp, Mus musculus
catactgtgtttccttcaacaaaga

SEQ ID NO: 87801 - DNA, 25 bp, Mus musculus
catacttaaatgtgggagaagtccc

SEQ ID NO: 87802 - DNA, 25 bp, Mus musculus
catacttctgcgtgagtgctgtgaa

SEQ ID NO: 87803 - DNA, 25 bp, Mus musculus
catacttttgtcactggaggcctga

SEQ ID NO: 87804 - DNA, 25 bp, Mus musculus
catagaaaaggagacatgccagaag

SEQ ID NO: 87805 - DNA, 25 bp, Mus musculus
catagaaccttctcgtcgctgagcg

SEQ ID NO: 87806 - DNA, 25 bp, Mus musculus
catagaactaaaacacagactgggc

SEQ ID NO: 87807 - DNA, 25 bp, Mus musculus
catagaagaaagacaccgacatcgc

SEQ ID NO: 87808 - DNA, 25 bp, Mus musculus
catagaagagatgctgcagacagcc

SEQ ID NO: 87809 - DNA, 25 bp, Mus musculus
catagaagatcagaagaatccatcg

SEQ ID NO: 87810 - DNA, 25 bp, Mus musculus
catagaatcagtggtgcaggaccga

SEQ ID NO: 87811 - DNA, 25 bp, Mus musculus
catagaattctgaggcctggcacaa

SEQ ID NO: 87812 - DNA, 25 bp, Mus musculus
catagaattcttggctgtccctggg

SEQ ID NO: 87813 - DNA, 25 bp, Mus musculus
catagacaacaagtgacggctgcag

SEQ ID NO: 87814 - DNA, 25 bp, Mus musculus
catagacacgctctttcaggaccgg

SEQ ID NO: 87815 - DNA, 25 bp, Mus musculus
catagacacgctggaacgagtggcg

SEQ ID NO: 87816 - DNA, 25 bp, Mus musculus
catagacagcaatcgcagggagggc

SEQ ID NO: 87817 - DNA, 25 bp, Mus musculus
catagacagttagatggacagttcc

SEQ ID NO: 87818 - DNA, 25 bp, Mus musculus
catagaccatgtggcagatgaacgg

SEQ ID NO: 87819 - DNA, 25 bp, Mus musculus
catagacccttctcatggcgtggca

SEQ ID NO: 87820 - DNA, 25 bp, Mus musculus
catagacgatggtgacaagaccaag

SEQ ID NO: 87821 - DNA, 25 bp, Mus musculus
catagacgctacactcgatccaggt

SEQ ID NO: 87822 - DNA, 25 bp, Mus musculus
catagacggacacactgacagaaga

SEQ ID NO: 87823 - DNA, 25 bp, Mus musculus
catagactcgctggcctttgtcaaa

SEQ ID NO: 87824 - DNA, 25 bp, Mus musculus
catagactggagacgaatcagtgcc

SEQ ID NO: 87825 - DNA, 25 bp, Mus musculus
catagacttatgctctccattggaa

SEQ ID NO: 87826 - DNA, 25 bp, Mus musculus
catagagaacagcactgacaaccct

SEQ ID NO: 87827 - DNA, 25 bp, Mus musculus
catagagatgaatgagcctgttcac

SEQ ID NO: 87828 - DNA, 25 bp, Mus musculus
catagagatgtcaaccgatttgggc

SEQ ID NO: 87829 - DNA, 25 bp, Mus musculus
catagagattttcacagatcaagag

SEQ ID NO: 87830 - DNA, 25 bp, Mus musculus
catagagcagatggagcatgtccgg

SEQ ID NO: 87831 - DNA, 25 bp, Mus musculus
catagagcaggctgcctgtagtgga

SEQ ID NO: 87832 - DNA, 25 bp, Mus musculus
catagagcatttgcagggcttgagc

SEQ ID NO: 87833 - DNA, 25 bp, Mus musculus
catagaggactactatgtgggagta

SEQ ID NO: 87834 - DNA, 25 bp, Mus musculus
catagaggatgactgcggtgactac

SEQ ID NO: 87835 - DNA, 25 bp, Mus musculus
catagagggccatgtagtccaggaa

SEQ ID NO: 87836 - DNA, 25 bp, Mus musculus
catagagtacgaactacaggaagat

SEQ ID NO: 87837 - DNA, 25 bp, Mus musculus
catagagtcactgtgcaagaggttc

SEQ ID NO: 87838 - DNA, 25 bp, Mus musculus
catagataccacactggcagaggtg

SEQ ID NO: 87839 - DNA, 25 bp, Mus musculus
catagatcagaagtatgacctggtc

SEQ ID NO: 87840 - DNA, 25 bp, Mus musculus
catagatgaactccgcaatgaggac

SEQ ID NO: 87841 - DNA, 25 bp, Mus musculus
catagatgcgtgtggctacaacgac

SEQ ID NO: 87842 - DNA, 25 bp, Mus musculus
catagatgtgccagtctgggtgcca

SEQ ID NO: 87843 - DNA, 25 bp, Mus musculus
catagattaaggtgtccccagggac

SEQ ID NO: 87844 - DNA, 25 bp, Mus musculus
catagattatcagcgccagccttcg

SEQ ID NO: 87845 - DNA, 25 bp, Mus musculus
catagcaagttcacaggcctttggc

SEQ ID NO: 87846 - DNA, 25 bp, Mus musculus
catagcaagttctggcttctggcaa

SEQ ID NO: 87847 - DNA, 25 bp, Mus musculus
catagcactgtgtcctcgggaaggg

SEQ ID NO: 87848 - DNA, 25 bp, Mus musculus
catagcagttacgaggagagtgcct

SEQ ID NO: 87849 - DNA, 25 bp, Mus musculus
catagcatgttgctcgtccccagga

SEQ ID NO: 87850 - DNA, 25 bp, Mus musculus
catagccaacgaagagttacgaaga

SEQ ID NO: 87851 - DNA, 25 bp, Mus musculus
catagccaggatggttgcacatgcc

SEQ ID NO: 87852 - DNA, 25 bp, Mus musculus
catagccctgactgctcataattgg

SEQ ID NO: 87853 - DNA, 25 bp, Mus musculus
catagccggctccagaaggcttaca

SEQ ID NO: 87854 - DNA, 25 bp, Mus musculus
catagcctctggacactgagactgg

SEQ ID NO: 87855 - DNA, 25 bp, Mus musculus
catagcctgggtattgaacaagggt

SEQ ID NO: 87856 - DNA, 25 bp, Mus musculus
catagcgctttgtcctcagcagaag

SEQ ID NO: 87857 - DNA, 25 bp, Mus musculus
catagcggcttacctgattgtggca

SEQ ID NO: 87858 - DNA, 25 bp, Mus musculus
catagcgttagactgagcaggctcc

SEQ ID NO: 87859 - DNA, 25 bp, Mus musculus
catagctagcatcaatgtccccgtg

SEQ ID NO: 87860 - DNA, 25 bp, Mus musculus
catagctcatcattcggctccggca

SEQ ID NO: 87861 - DNA, 25 bp, Mus musculus
catagctcccgtttcaccaacagtg

SEQ ID NO: 87862 - DNA, 25 bp, Mus musculus
catagctgaatgcactggaggcacc

SEQ ID NO: 87863 - DNA, 25 bp, Mus musculus
catagctgccatcaagacgaagcgc

SEQ ID NO: 87864 - DNA, 25 bp, Mus musculus
catagctgggtactcatttggagcc

SEQ ID NO: 87865 - DNA, 25 bp, Mus musculus
catagcttatgtcatggagaaggcc

SEQ ID NO: 87866 - DNA, 25 bp, Mus musculus
catagcttatttcagccgcgctggg

SEQ ID NO: 87867 - DNA, 25 bp, Mus musculus
catagcttgttcctttaccacggtg

SEQ ID NO: 87868 - DNA, 25 bp, Mus musculus
catagcttttctcagccgccgagga

SEQ ID NO: 87869 - DNA, 25 bp, Mus musculus
cataggaagctcagcagagaccgtc

SEQ ID NO: 87870 - DNA, 25 bp, Mus musculus
cataggaatagggacaggagcatct

SEQ ID NO: 87871 - DNA, 25 bp, Mus musculus
cataggagccaccagtgactcggta

SEQ ID NO: 87872 - DNA, 25 bp, Mus musculus
cataggaggcggttatattccgaca

SEQ ID NO: 87873 - DNA, 25 bp, Mus musculus
cataggcacaagcacgagatgactt

SEQ ID NO: 87874 - DNA, 25 bp, Mus musculus
cataggccagtacacatcagaaggg

SEQ ID NO: 87875 - DNA, 25 bp, Mus musculus
cataggcctgtctctttcgttaaaa

SEQ ID NO: 87876 - DNA, 25 bp, Mus musculus
cataggcgataaagctcccactgag

SEQ ID NO: 87877 - DNA, 25 bp, Mus musculus
cataggctatggttcagctctgggc

SEQ ID NO: 87878 - DNA, 25 bp, Mus musculus
catagggaacaactctgaagcagga

SEQ ID NO: 87879 - DNA, 25 bp, Mus musculus
catagggacaggaggacaatggcta

SEQ ID NO: 87880 - DNA, 25 bp, Mus musculus
catagggctagatctatatcttagg

SEQ ID NO: 87881 - DNA, 25 bp, Mus musculus
catagggtgtgctccagaacctggg

SEQ ID NO: 87882 - DNA, 25 bp, Mus musculus
catagggttagctttgttggtcgcc

SEQ ID NO: 87883 - DNA, 25 bp, Mus musculus
cataggtcaacatgaatcctgggtt

SEQ ID NO: 87884 - DNA, 25 bp, Mus musculus
cataggtcggtggaagagtgcttac

SEQ ID NO: 87885 - DNA, 25 bp, Mus musculus
cataggtctcttaaaccaggcagca

SEQ ID NO: 87886 - DNA, 25 bp, Mus musculus
catagtaaattgagcatgttgtttt

SEQ ID NO: 87887 - DNA, 25 bp, Mus musculus
catagtaactcgtgtggcgttttcc

SEQ ID NO: 87888 - DNA, 25 bp, Mus musculus
catagtaattggtatcctggagctg

SEQ ID NO: 87889 - DNA, 25 bp, Mus musculus
catagtactacgtgtgtgaaaggcc

SEQ ID NO: 87890 - DNA, 25 bp, Mus musculus
catagtagaaatgcagttagcagtc

SEQ ID NO: 87891 - DNA, 25 bp, Mus musculus
catagtcatctgaagggtgaagccc

SEQ ID NO: 87892 - DNA, 25 bp, Mus musculus
catagtccacatagcaacctctttg

SEQ ID NO: 87893 - DNA, 25 bp, Mus musculus
catagtcgtacttgaggcctctcct

SEQ ID NO: 87894 - DNA, 25 bp, Mus musculus
catagtcgtttggaggaagggatcc

SEQ ID NO: 87895 - DNA, 25 bp, Mus musculus
catagtctcagcttcgagtgccggc

SEQ ID NO: 87896 - DNA, 25 bp, Mus musculus
catagtgaagcttgtcccgtggtcc

SEQ ID NO: 87897 - DNA, 25 bp, Mus musculus
catagtgccatggtgaagcaaagga

SEQ ID NO: 87898 - DNA, 25 bp, Mus musculus
catagtggaagttgcaggacaagcc

SEQ ID NO: 87899 - DNA, 25 bp, Mus musculus
catagtggacgcatcttctgtctcc

SEQ ID NO: 87900 - DNA, 25 bp, Mus musculus
catagtgggaaaggctcattcggac

SEQ ID NO: 87901 - DNA, 25 bp, Mus musculus
catagtgtctggatctcgggacgcc

SEQ ID NO: 87902 - DNA, 25 bp, Mus musculus
catagtgtgccctaaagatccggaa

SEQ ID NO: 87903 - DNA, 25 bp, Mus musculus
catagttgaatgcacggcccggatt

SEQ ID NO: 87904 - DNA, 25 bp, Mus musculus
catagttgattcagacgaagaaggc

SEQ ID NO: 87905 - DNA, 25 bp, Mus musculus
catataaggacccagacaatcctgg

SEQ ID NO: 87906 - DNA, 25 bp, Mus musculus
catataattactgcaggctgtcctc

SEQ ID NO: 87907 - DNA, 25 bp, Mus musculus
catatacaaagtggggatttacggc

SEQ ID NO: 87908 - DNA, 25 bp, Mus musculus
catatacttctctacgggcctgaca

SEQ ID NO: 87909 - DNA, 25 bp, Mus musculus
catatacttctttggcttgtccgag

SEQ ID NO: 87910 - DNA, 25 bp, Mus musculus
catataggctcatcctcccggggga

SEQ ID NO: 87911 - DNA, 25 bp, Mus musculus
catatagttccaaatgcagtcagac

SEQ ID NO: 87912 - DNA, 25 bp, Mus musculus
catatcaaccttcgctgtggaggtg

SEQ ID NO: 87913 - DNA, 25 bp, Mus musculus
catatcaagttctaccagcagtgtg

SEQ ID NO: 87914 - DNA, 25 bp, Mus musculus
catatcagtgccttgaacgtgaaca

SEQ ID NO: 87915 - DNA, 25 bp, Mus musculus
catatcatatggctgtggcacggga

SEQ ID NO: 87916 - DNA, 25 bp, Mus musculus
catatccagaaaagggaacgcaggc

SEQ ID NO: 87917 - DNA, 25 bp, Mus musculus
catatccagctcctccaagtcagtg

SEQ ID NO: 87918 - DNA, 25 bp, Mus musculus
catatcctgcagctgtcatagtgac

SEQ ID NO: 87919 - DNA, 25 bp, Mus musculus
catatcctttgagacgtgcaccgca

SEQ ID NO: 87920 - DNA, 25 bp, Mus musculus
catatcgcttttgctgcactagaag

SEQ ID NO: 87921 - DNA, 25 bp, Mus musculus
catatcggataacggcagatggcgc

SEQ ID NO: 87922 - DNA, 25 bp, Mus musculus
catatctcataatcccgacggaggg

SEQ ID NO: 87923 - DNA, 25 bp, Mus musculus
catatctggaggtagctgctccggc

SEQ ID NO: 87924 - DNA, 25 bp, Mus musculus
catatgaaatccctgcatcggcagc

SEQ ID NO: 87925 - DNA, 25 bp, Mus musculus
catatgaagcgaattctccagggaa

SEQ ID NO: 87926 - DNA, 25 bp, Mus musculus
catatgacatgggtccccttgggaa

SEQ ID NO: 87927 - DNA, 25 bp, Mus musculus
catatgaccccaagacccaagagtt

SEQ ID NO: 87928 - DNA, 25 bp, Mus musculus
catatgactgccctccacggtagat

SEQ ID NO: 87929 - DNA, 25 bp, Mus musculus
catatgacttggaagaaccgtaccc

SEQ ID NO: 87930 - DNA, 25 bp, Mus musculus
catatgagccttcagatggttcggg

SEQ ID NO: 87931 - DNA, 25 bp, Mus musculus
catatgagcggccttaggagcccgc

SEQ ID NO: 87932 - DNA, 25 bp, Mus musculus
catatgaggaactaactgggtggct

SEQ ID NO: 87933 - DNA, 25 bp, Mus musculus
catatgatcaactgggcaaagagag

SEQ ID NO: 87934 - DNA, 25 bp, Mus musculus
catatgatcttgagggagccactgc

SEQ ID NO: 87935 - DNA, 25 bp, Mus musculus
catatgccctacttgagagtgtccc

SEQ ID NO: 87936 - DNA, 25 bp, Mus musculus
catatgcgttgggagttggcctgct

SEQ ID NO: 87937 - DNA, 25 bp, Mus musculus
catatgcgtttcatctccgagctgg

SEQ ID NO: 87938 - DNA, 25 bp, Mus musculus
catatgctactctctaaagtggccc

SEQ ID NO: 87939 - DNA, 25 bp, Mus musculus
catatgctactgtggacagccgtgc

SEQ ID NO: 87940 - DNA, 25 bp, Mus musculus
catatgctgccgttattaatcctaa

SEQ ID NO: 87941 - DNA, 25 bp, Mus musculus
catatgctgggaaatttggttctcc

SEQ ID NO: 87942 - DNA, 25 bp, Mus musculus
catatggaagcacacaagaatggcc

SEQ ID NO: 87943 - DNA, 25 bp, Mus musculus
catatggagcagtcgttatacagac

SEQ ID NO: 87944 - DNA, 25 bp, Mus musculus
catatggagctagcaaggtggctgt

SEQ ID NO: 87945 - DNA, 25 bp, Mus musculus
catatggccccaggagatcctggca

SEQ ID NO: 87946 - DNA, 25 bp, Mus musculus
catatggtcacgttgagcccaggac

SEQ ID NO: 87947 - DNA, 25 bp, Mus musculus
catatggtcagttgcctgggagaca

SEQ ID NO: 87948 - DNA, 25 bp, Mus musculus
catatggtgcctagacatgcaggca

SEQ ID NO: 87949 - DNA, 25 bp, Mus musculus
catatggtggtcttactctgagtcc

SEQ ID NO: 87950 - DNA, 25 bp, Mus musculus
catatgtgagcctgcgggaactaga

SEQ ID NO: 87951 - DNA, 25 bp, Mus musculus
catatgtggagtaggcaggcattct

SEQ ID NO: 87952 - DNA, 25 bp, Mus musculus
catattaaacttcctaagcgccggg

SEQ ID NO: 87953 - DNA, 25 bp, Mus musculus
catattatcacagaggccaagcagc

SEQ ID NO: 87954 - DNA, 25 bp, Mus musculus
catattatgtcagagcggaatgttc

SEQ ID NO: 87955 - DNA, 25 bp, Mus musculus
catattattcacttggaaagaaaca

SEQ ID NO: 87956 - DNA, 25 bp, Mus musculus
catattcagtcatggtgcctcagcc

SEQ ID NO: 87957 - DNA, 25 bp, Mus musculus
catattcataataactgatcactca

SEQ ID NO: 87958 - DNA, 25 bp, Mus musculus
catattcatgggagtgctggccaaa

SEQ ID NO: 87959 - DNA, 25 bp, Mus musculus
catattctgtgtgcgtggcatggac

SEQ ID NO: 87960 - DNA, 25 bp, Mus musculus
catattgaagcgtgggcagagaagc

SEQ ID NO: 87961 - DNA, 25 bp, Mus musculus
catattgaggtgctgaaagagtccc

SEQ ID NO: 87962 - DNA, 25 bp, Mus musculus
catattgcgttgagcaccagggaca

SEQ ID NO: 87963 - DNA, 25 bp, Mus musculus
catattgctgtacctggtggcaggc

SEQ ID NO: 87964 - DNA, 25 bp, Mus musculus
catattggcaagtaaaggcagcagc

SEQ ID NO: 87965 - DNA, 25 bp, Mus musculus
catattggtcatgcctatagaggat

SEQ ID NO: 87966 - DNA, 25 bp, Mus musculus
catattgtaaaccaaaacttcaagt

SEQ ID NO: 87967 - DNA, 25 bp, Mus musculus
catattgtctgtacgcctggagcag

SEQ ID NO: 87968 - DNA, 25 bp, Mus musculus
catatttcaactacagaggtgctgg

SEQ ID NO: 87969 - DNA, 25 bp, Mus musculus
catatttcctgagtcaacatggccg

SEQ ID NO: 87970 - DNA, 25 bp, Mus musculus
catatttcttggagtcgtgctggtc

SEQ ID NO: 87971 - DNA, 25 bp, Mus musculus
catatttgcaggtcggccacactgg

SEQ ID NO: 87972 - DNA, 25 bp, Mus musculus
catatttggaagatccccacgccgt

SEQ ID NO: 87973 - DNA, 25 bp, Mus musculus
catatttgttggcacccgagagaac

SEQ ID NO: 87974 - DNA, 25 bp, Mus musculus
catattttatcactgctgtgatctt

SEQ ID NO: 87975 - DNA, 25 bp, Mus musculus
catcaaaaagttccttaaactggtg

SEQ ID NO: 87976 - DNA, 25 bp, Mus musculus
catcaaaaatggagtggacgtcaac

SEQ ID NO: 87977 - DNA, 25 bp, Mus musculus
catcaaaacgtcagaagtggtcaga

SEQ ID NO: 87978 - DNA, 25 bp, Mus musculus
catcaaaacttgtcctgtacccagg

SEQ ID NO: 87979 - DNA, 25 bp, Mus musculus
catcaaaagtgaagtctggcaagcc

SEQ ID NO: 87980 - DNA, 25 bp, Mus musculus
catcaaaccagaaaacctattagtc

SEQ ID NO: 87981 - DNA, 25 bp, Mus musculus
catcaaaccgattccaaagcattcc

SEQ ID NO: 87982 - DNA, 25 bp, Mus musculus
catcaaactcaagaggttcacttgc

SEQ ID NO: 87983 - DNA, 25 bp, Mus musculus
catcaaacttttgccacgtgggtga

SEQ ID NO: 87984 - DNA, 25 bp, Mus musculus
catcaaagaaagcagtgcatattac

SEQ ID NO: 87985 - DNA, 25 bp, Mus musculus
catcaaagagaaaagcagcctgcaa

SEQ ID NO: 87986 - DNA, 25 bp, Mus musculus
catcaaagagcttggctcccggctg

SEQ ID NO: 87987 - DNA, 25 bp, Mus musculus
catcaaagctctttctgaggaaaaa

SEQ ID NO: 87988 - DNA, 25 bp, Mus musculus
catcaaagctttccgggaggaggcc

SEQ ID NO: 87989 - DNA, 25 bp, Mus musculus
catcaaaggcgatgtgggagagcct

SEQ ID NO: 87990 - DNA, 25 bp, Mus musculus
catcaaagtcggtgagacctaccac

SEQ ID NO: 87991 - DNA, 25 bp, Mus musculus
catcaaataccagagcaaggccagg

SEQ ID NO: 87992 - DNA, 25 bp, Mus musculus
catcaaatcgggacaacaagaaggg

SEQ ID NO: 87993 - DNA, 25 bp, Mus musculus
catcaaattcacacatgctgaggtg

SEQ ID NO: 87994 - DNA, 25 bp, Mus musculus
catcaacaagactgcctgggagcta

SEQ ID NO: 87995 - DNA, 25 bp, Mus musculus
catcaacacctgtggctgggtcaag

SEQ ID NO: 87996 - DNA, 25 bp, Mus musculus
catcaacaggaaccgcatgggtcgg

SEQ ID NO: 87997 - DNA, 25 bp, Mus musculus
catcaacctgttcgatacggcggag

SEQ ID NO: 87998 - DNA, 25 bp, Mus musculus
catcaacgcgcagatgaaggccttc

SEQ ID NO: 87999 - DNA, 25 bp, Mus musculus
catcaactccgcagcttagctggga

SEQ ID NO: 88000 - DNA, 25 bp, Mus musculus
catcaactgtggagatagcctgggc

SEQ ID NO: 88001 - DNA, 25 bp, Mus musculus
catcaacttggtttggtctcctgga

SEQ ID NO: 88002 - DNA, 25 bp, Mus musculus
catcaagaaacagatcctgaagcac

SEQ ID NO: 88003 - DNA, 25 bp, Mus musculus
catcaagaatgagtgcaacccagtt

SEQ ID NO: 88004 - DNA, 25 bp, Mus musculus
catcaagagtgagacccatggttcg

SEQ ID NO: 88005 - DNA, 25 bp, Mus musculus
catcaagattatggtggccctcggt

SEQ ID NO: 88006 - DNA, 25 bp, Mus musculus
catcaagattgggaacaagccagca

SEQ ID NO: 88007 - DNA, 25 bp, Mus musculus
catcaagcacatgtggagagctctg

SEQ ID NO: 88008 - DNA, 25 bp, Mus musculus
catcaagcaggcagagtttggacgc

SEQ ID NO: 88009 - DNA, 25 bp, Mus musculus
catcaagcgtcatgagataacaggg

SEQ ID NO: 88010 - DNA, 25 bp, Mus musculus
catcaagctggtgaatctgctctcc

SEQ ID NO: 88011 - DNA, 25 bp, Mus musculus
catcaaggaagcatacgagaaggcc

SEQ ID NO: 88012 - DNA, 25 bp, Mus musculus
catcaaggaattctgcagcccggag

SEQ ID NO: 88013 - DNA, 25 bp, Mus musculus
catcaaggagattgtgcgccgtaac

SEQ ID NO: 88014 - DNA, 25 bp, Mus musculus
catcaaggagcctcgatgggaccag

SEQ ID NO: 88015 - DNA, 25 bp, Mus musculus
catcaaggcatatgtcacccggtcc

SEQ ID NO: 88016 - DNA, 25 bp, Mus musculus
catcaaggcggtgaatgggatcaac

SEQ ID NO: 88017 - DNA, 25 bp, Mus musculus
catcaaggctatcagggtttcagga

SEQ ID NO: 88018 - DNA, 25 bp, Mus musculus
catcaagggcaaagacaggaagccg

SEQ ID NO: 88019 - DNA, 25 bp, Mus musculus
catcaaggtttctgtagactgtcac

SEQ ID NO: 88020 - DNA, 25 bp, Mus musculus
catcaagtacctgccggagtggtct

SEQ ID NO: 88021 - DNA, 25 bp, Mus musculus
catcaagtataaaacagcctgggaa

SEQ ID NO: 88022 - DNA, 25 bp, Mus musculus
catcaagtatgagtccaagcccctg

SEQ ID NO: 88023 - DNA, 25 bp, Mus musculus
catcaagtgcatgggtcaccgagtc

SEQ ID NO: 88024 - DNA, 25 bp, Mus musculus
catcaatgacggttcctggaaaggg

SEQ ID NO: 88025 - DNA, 25 bp, Mus musculus
catcaatgagatacagcccagcgtc

SEQ ID NO: 88026 - DNA, 25 bp, Mus musculus
catcaatggacgcaatcttggaaga

SEQ ID NO: 88027 - DNA, 25 bp, Mus musculus
catcaatggcatggacgtgaatggc

SEQ ID NO: 88028 - DNA, 25 bp, Mus musculus
catcaatggctgtccaaagaacaga

SEQ ID NO: 88029 - DNA, 25 bp, Mus musculus
catcaatggtgtccaagtccagggt

SEQ ID NO: 88030 - DNA, 25 bp, Mus musculus
catcaatgtggtggacaaataccca

SEQ ID NO: 88031 - DNA, 25 bp, Mus musculus
catcacacaggaggactatcgctgc

SEQ ID NO: 88032 - DNA, 25 bp, Mus musculus
catcacactggccattgcctgggtg

SEQ ID NO: 88033 - DNA, 25 bp, Mus musculus
catcacagatcatcgggctttcgga

SEQ ID NO: 88034 - DNA, 25 bp, Mus musculus
catcacaggcaccagctatgaagct

SEQ ID NO: 88035 - DNA, 25 bp, Mus musculus
catcacagggaacttgagaacctga

SEQ ID NO: 88036 - DNA, 25 bp, Mus musculus
catcacatacgtgctgctggctgga

SEQ ID NO: 88037 - DNA, 25 bp, Mus musculus
catcacatgcccctgctgttacggg

SEQ ID NO: 88038 - DNA, 25 bp, Mus musculus
catcacatggacgtggcaaggacct

SEQ ID NO: 88039 - DNA, 25 bp, Mus musculus
catcacatgggttctgcagatctca

SEQ ID NO: 88040 - DNA, 25 bp, Mus musculus
catcaccaggatcatcaaggaggcg

SEQ ID NO: 88041 - DNA, 25 bp, Mus musculus
catcaccattgaggctgagccaaga

SEQ ID NO: 88042 - DNA, 25 bp, Mus musculus
catcacccaaggaggaaaggaagcg

SEQ ID NO: 88043 - DNA, 25 bp, Mus musculus
catcacccagtttgcagccgtttat

SEQ ID NO: 88044 - DNA, 25 bp, Mus musculus
catcacccgtattctccaggacgtt

SEQ ID NO: 88045 - DNA, 25 bp, Mus musculus
catcaccggatagagaaaagaaaaa

SEQ ID NO: 88046 - DNA, 25 bp, Mus musculus
catcaccgtggtgaagggcatccgg

SEQ ID NO: 88047 - DNA, 25 bp, Mus musculus
catcacctcttttggtggagagaag

SEQ ID NO: 88048 - DNA, 25 bp, Mus musculus
catcacctgcaacatgaacgagcgc

SEQ ID NO: 88049 - DNA, 25 bp, Mus musculus
catcacctgggtgggcatcgttgtc

SEQ ID NO: 88050 - DNA, 25 bp, Mus musculus
catcacctttaaacttcaagaagcg

SEQ ID NO: 88051 - DNA, 25 bp, Mus musculus
catcacgaatatgcacctgcgcttg

SEQ ID NO: 88052 - DNA, 25 bp, Mus musculus
catcacgaggaccagggagaactgt

SEQ ID NO: 88053 - DNA, 25 bp, Mus musculus
catcacggctcccaatggccttgag

SEQ ID NO: 88054 - DNA, 25 bp, Mus musculus
catcacggtcaagttcgcaaacaac

SEQ ID NO: 88055 - DNA, 25 bp, Mus musculus
catcacggtgactatgagaaacagt

SEQ ID NO: 88056 - DNA, 25 bp, Mus musculus
catcacgtagagcagcagggcttct

SEQ ID NO: 88057 - DNA, 25 bp, Mus musculus
catcacgtgtgcgtgtgagaggtca

SEQ ID NO: 88058 - DNA, 25 bp, Mus musculus
catcactagtgtggcgctgtgttcc

SEQ ID NO: 88059 - DNA, 25 bp, Mus musculus
catcactgactatgtggaccagcag

SEQ ID NO: 88060 - DNA, 25 bp, Mus musculus
catcactggaggctgcccttgtgcc

SEQ ID NO: 88061 - DNA, 25 bp, Mus musculus
catcactgggtttggcagaaggacc

SEQ ID NO: 88062 - DNA, 25 bp, Mus musculus
catcacttccgagacattgagcgga

SEQ ID NO: 88063 - DNA, 25 bp, Mus musculus
catcagaaaggtgggtacggcaagc

SEQ ID NO: 88064 - DNA, 25 bp, Mus musculus
catcagaagatggtacaacccggcg

SEQ ID NO: 88065 - DNA, 25 bp, Mus musculus
catcagaccctggtgaggtagtgcc

SEQ ID NO: 88066 - DNA, 25 bp, Mus musculus
catcagactgctcccaccgggagtg

SEQ ID NO: 88067 - DNA, 25 bp, Mus musculus
catcagagatgtggaacaagggacc

SEQ ID NO: 88068 - DNA, 25 bp, Mus musculus
catcagagtgtagccactgagggcc

SEQ ID NO: 88069 - DNA, 25 bp, Mus musculus
catcagatgatgagcgagccctgga

SEQ ID NO: 88070 - DNA, 25 bp, Mus musculus
catcagattcgctggctgctatgat

SEQ ID NO: 88071 - DNA, 25 bp, Mus musculus
catcagattggcttatgggcaaacc

SEQ ID NO: 88072 - DNA, 25 bp, Mus musculus
catcagattggctttccagatttgg

SEQ ID NO: 88073 - DNA, 25 bp, Mus musculus
catcagcaacggtggacatccaggt

SEQ ID NO: 88074 - DNA, 25 bp, Mus musculus
catcagcaatggacctttcaaggac

SEQ ID NO: 88075 - DNA, 25 bp, Mus musculus
catcagcactcttaacccggaagcg

SEQ ID NO: 88076 - DNA, 25 bp, Mus musculus
catcagcagagagagagccggctgc

SEQ ID NO: 88077 - DNA, 25 bp, Mus musculus
catcagcagtggagcgttgactgga

SEQ ID NO: 88078 - DNA, 25 bp, Mus musculus
catcagcatcgccttcagtcatgag

SEQ ID NO: 88079 - DNA, 25 bp, Mus musculus
catcagcgtcaagtttgagatcccc

SEQ ID NO: 88080 - DNA, 25 bp, Mus musculus
catcagctgagctctggagtacgcc

SEQ ID NO: 88081 - DNA, 25 bp, Mus musculus
catcagctggcgacacatgtggaaa

SEQ ID NO: 88082 - DNA, 25 bp, Mus musculus
catcagcttctggatacctacttca

SEQ ID NO: 88083 - DNA, 25 bp, Mus musculus
catcaggaaccatcaaggagggcac

SEQ ID NO: 88084 - DNA, 25 bp, Mus musculus
catcaggaaggaagtccagagagcc

SEQ ID NO: 88085 - DNA, 25 bp, Mus musculus
catcaggaatcgtgtggacacgtca

SEQ ID NO: 88086 - DNA, 25 bp, Mus musculus
catcaggagaagctggcaactggca

SEQ ID NO: 88087 - DNA, 25 bp, Mus musculus
catcaggatctctgggcaggtgtcc

SEQ ID NO: 88088 - DNA, 25 bp, Mus musculus
catcaggattcccaaagcgtcgaac

SEQ ID NO: 88089 - DNA, 25 bp, Mus musculus
catcaggcaccaagaagctcaggct

SEQ ID NO: 88090 - DNA, 25 bp, Mus musculus
catcaggccgagcttgtcgagagaa

SEQ ID NO: 88091 - DNA, 25 bp, Mus musculus
catcaggcgggtccagagagtacaa

SEQ ID NO: 88092 - DNA, 25 bp, Mus musculus
catcaggctcctatgtaaggaaacc

SEQ ID NO: 88093 - DNA, 25 bp, Mus musculus
catcagggactaatagagccgggct

SEQ ID NO: 88094 - DNA, 25 bp, Mus musculus
catcagggcagatctcaaaccaggc

SEQ ID NO: 88095 - DNA, 25 bp, Mus musculus
catcagggcgagttctcaggtgtct

SEQ ID NO: 88096 - DNA, 25 bp, Mus musculus
catcagggctggaatgtggctcaac

SEQ ID NO: 88097 - DNA, 25 bp, Mus musculus
catcagggtgggaagagctacctca

SEQ ID NO: 88098 - DNA, 25 bp, Mus musculus
catcaggtagatggagcagggtaac

SEQ ID NO: 88099 - DNA, 25 bp, Mus musculus
catcaggtcagagaaacactgggct

SEQ ID NO: 88100 - DNA, 25 bp, Mus musculus
catcaggtggtggtggccaacatcc

SEQ ID NO: 88101 - DNA, 25 bp, Mus musculus
catcagtacatgtaatggcgagcac

SEQ ID NO: 88102 - DNA, 25 bp, Mus musculus
catcagtagaagtcacacaggacct

SEQ ID NO: 88103 - DNA, 25 bp, Mus musculus
catcagtatgggagaatcaagattc

SEQ ID NO: 88104 - DNA, 25 bp, Mus musculus
catcagtccctgactcagcagcggt

SEQ ID NO: 88105 - DNA, 25 bp, Mus musculus
catcagtctatgtgtgtccccagca

SEQ ID NO: 88106 - DNA, 25 bp, Mus musculus
catcagtctggagggtgtgcacgtc

SEQ ID NO: 88107 - DNA, 25 bp, Mus musculus
catcagtgatctagcaagcagtgtg

SEQ ID NO: 88108 - DNA, 25 bp, Mus musculus
catcagtgatgtttgggacccaagt

SEQ ID NO: 88109 - DNA, 25 bp, Mus musculus
catcagtgcgagctgccaggattcc

SEQ ID NO: 88110 - DNA, 25 bp, Mus musculus
catcagtgctatggctcggagctgg

SEQ ID NO: 88111 - DNA, 25 bp, Mus musculus
catcagtggctctgggaaaagctcg

SEQ ID NO: 88112 - DNA, 25 bp, Mus musculus
catcagtggtgctaaggagatctgc

SEQ ID NO: 88113 - DNA, 25 bp, Mus musculus
catcagttcaaccttgctgagctcc

SEQ ID NO: 88114 - DNA, 25 bp, Mus musculus
catcagtttgataggaaggcctgaa

SEQ ID NO: 88115 - DNA, 25 bp, Mus musculus
catcagtttgatggtggcccagaaa

SEQ ID NO: 88116 - DNA, 25 bp, Mus musculus
catcataagcacttttacgggtggg

SEQ ID NO: 88117 - DNA, 25 bp, Mus musculus
catcatacaggaaccccggtgtggt

SEQ ID NO: 88118 - DNA, 25 bp, Mus musculus
catcatactataaggaagcagctgt

SEQ ID NO: 88119 - DNA, 25 bp, Mus musculus
catcatagatggtgtcctgagggac

SEQ ID NO: 88120 - DNA, 25 bp, Mus musculus
catcatatatgtggaagcctctgga

SEQ ID NO: 88121 - DNA, 25 bp, Mus musculus
catcatcaagcaaaaccaagcaggt

SEQ ID NO: 88122 - DNA, 25 bp, Mus musculus
catcatcacggatgctgcgaaccag

SEQ ID NO: 88123 - DNA, 25 bp, Mus musculus
catcatcagagaccccgtcagtaga

SEQ ID NO: 88124 - DNA, 25 bp, Mus musculus
catcatcagccagtagaaaactggg

SEQ ID NO: 88125 - DNA, 25 bp, Mus musculus
catcatcagctggttcgttcggtcc

SEQ ID NO: 88126 - DNA, 25 bp, Mus musculus
catcatcagtgacgtcttcccgcag

SEQ ID NO: 88127 - DNA, 25 bp, Mus musculus
catcatcatgactgtaccgcgaaag

SEQ ID NO: 88128 - DNA, 25 bp, Mus musculus
catcatccatcaatatttggtggac

SEQ ID NO: 88129 - DNA, 25 bp, Mus musculus
catcatccatggtcagatggcgtac

SEQ ID NO: 88130 - DNA, 25 bp, Mus musculus
catcatcccgccaatcagtggagga

SEQ ID NO: 88131 - DNA, 25 bp, Mus musculus
catcatccggtataaggttcagggc

SEQ ID NO: 88132 - DNA, 25 bp, Mus musculus
catcatcgagagaggcgccttccag

SEQ ID NO: 88133 - DNA, 25 bp, Mus musculus
catcatcgaggatgtacagcggctc

SEQ ID NO: 88134 - DNA, 25 bp, Mus musculus
catcatcggtagtgcgcgctgcaaa

SEQ ID NO: 88135 - DNA, 25 bp, Mus musculus
catcatcgttcttgtggctaccggc

SEQ ID NO: 88136 - DNA, 25 bp, Mus musculus
catcatctggcgctttgctggcaac

SEQ ID NO: 88137 - DNA, 25 bp, Mus musculus
catcatctgggaagaaccggtgcct

SEQ ID NO: 88138 - DNA, 25 bp, Mus musculus
catcatgaacggcacagacgaaggt

SEQ ID NO: 88139 - DNA, 25 bp, Mus musculus
catcatgacagtgctcgagcgggac

SEQ ID NO: 88140 - DNA, 25 bp, Mus musculus
catcatgagcctgtggttggagcca

SEQ ID NO: 88141 - DNA, 25 bp, Mus musculus
catcatgatggaagacctgcctggc

SEQ ID NO: 88142 - DNA, 25 bp, Mus musculus
catcatgcacgggtacatgctgaag

SEQ ID NO: 88143 - DNA, 25 bp, Mus musculus
catcatgcagacttcagagacgggt

SEQ ID NO: 88144 - DNA, 25 bp, Mus musculus
catcatgcagctggtaggacaagcg

SEQ ID NO: 88145 - DNA, 25 bp, Mus musculus
catcatgcgaaagcagaggccagaa

SEQ ID NO: 88146 - DNA, 25 bp, Mus musculus
catcatgcgggttgacattgcgggc

SEQ ID NO: 88147 - DNA, 25 bp, Mus musculus
catcatgctgcatgacgtgaggcac

SEQ ID NO: 88148 - DNA, 25 bp, Mus musculus
catcatgctgtgcagggtggctaca

SEQ ID NO: 88149 - DNA, 25 bp, Mus musculus
catcatgctttggtacagaagcgcc

SEQ ID NO: 88150 - DNA, 25 bp, Mus musculus
catcatggaagaatacgactggtac

SEQ ID NO: 88151 - DNA, 25 bp, Mus musculus
catcatggccggtggatggctccac

SEQ ID NO: 88152 - DNA, 25 bp, Mus musculus
catcatgggcatgcaaggtccaaac

SEQ ID NO: 88153 - DNA, 25 bp, Mus musculus
catcatgggcgctaacattggaacc

SEQ ID NO: 88154 - DNA, 25 bp, Mus musculus
catcatgggtaaacctggcgacaga

SEQ ID NO: 88155 - DNA, 25 bp, Mus musculus
catcatggtggtgtctattgccggg

SEQ ID NO: 88156 - DNA, 25 bp, Mus musculus
catcatggttcttaaggtggctacc

SEQ ID NO: 88157 - DNA, 25 bp, Mus musculus
catcatgtcagccaaggacgagcgg

SEQ ID NO: 88158 - DNA, 25 bp, Mus musculus
catcatgtggatggacagcctgctg

SEQ ID NO: 88159 - DNA, 25 bp, Mus musculus
catcatgtggtaccaacagggcagt

SEQ ID NO: 88160 - DNA, 25 bp, Mus musculus
catcatgttgagcatccaagcggga

SEQ ID NO: 88161 - DNA, 25 bp, Mus musculus
catcattaaggaagactgtcagaaa

SEQ ID NO: 88162 - DNA, 25 bp, Mus musculus
catcattaccaaggagttggcagaa

SEQ ID NO: 88163 - DNA, 25 bp, Mus musculus
catcattcttttctggcccatggaa

SEQ ID NO: 88164 - DNA, 25 bp, Mus musculus
catcattgacaataagcgttacctc

SEQ ID NO: 88165 - DNA, 25 bp, Mus musculus
catcattgatgtcgtgggtgcaccc

SEQ ID NO: 88166 - DNA, 25 bp, Mus musculus
catcattgccttagttgggctggtt

SEQ ID NO: 88167 - DNA, 25 bp, Mus musculus
catcattggtaaaggaggcagctat

SEQ ID NO: 88168 - DNA, 25 bp, Mus musculus
catcattggtgctgtggtcgctgac

SEQ ID NO: 88169 - DNA, 25 bp, Mus musculus
catccaaagattcattcagtgctca

SEQ ID NO: 88170 - DNA, 25 bp, Mus musculus
catccaagcggagccaggctggtac

SEQ ID NO: 88171 - DNA, 25 bp, Mus musculus
catccaaggcaaacgatcaccaagg

SEQ ID NO: 88172 - DNA, 25 bp, Mus musculus
catccaagtggacgaatgactactc

SEQ ID NO: 88173 - DNA, 25 bp, Mus musculus
catccacaccttccaagactgaggg

SEQ ID NO: 88174 - DNA, 25 bp, Mus musculus
catccacacttgcaacatgacatag

SEQ ID NO: 88175 - DNA, 25 bp, Mus musculus
catccactgtatggctatgattcta

SEQ ID NO: 88176 - DNA, 25 bp, Mus musculus
catccactttgtcagtggagagaca

SEQ ID NO: 88177 - DNA, 25 bp, Mus musculus
catccagaagtacgcaacggaagag

SEQ ID NO: 88178 - DNA, 25 bp, Mus musculus
catccagagcaaagtgggatgatct

SEQ ID NO: 88179 - DNA, 25 bp, Mus musculus
catccagagcagcaccggtgagtga

SEQ ID NO: 88180 - DNA, 25 bp, Mus musculus
catccagagtttccactgtaagctg

SEQ ID NO: 88181 - DNA, 25 bp, Mus musculus
catccagattgagttccagcaggag

SEQ ID NO: 88182 - DNA, 25 bp, Mus musculus
catccagcattagagagttgcacag

SEQ ID NO: 88183 - DNA, 25 bp, Mus musculus
catccagccgatgagaagttgcaag

SEQ ID NO: 88184 - DNA, 25 bp, Mus musculus
catccagctgcagagggcctatgag

SEQ ID NO: 88185 - DNA, 25 bp, Mus musculus
catccagcttcctgtaaagagagac

SEQ ID NO: 88186 - DNA, 25 bp, Mus musculus
catccaggaagagtgcaaagtccct

SEQ ID NO: 88187 - DNA, 25 bp, Mus musculus
catccaggacggagtatcaccaagt

SEQ ID NO: 88188 - DNA, 25 bp, Mus musculus
catccagggctgtgaaccaggctat

SEQ ID NO: 88189 - DNA, 25 bp, Mus musculus
catccagggtgcagttgatcatgca

SEQ ID NO: 88190 - DNA, 25 bp, Mus musculus
catccaggttgggaagtggaatcca

SEQ ID NO: 88191 - DNA, 25 bp, Mus musculus
catccagtatgtggcgtcctacaag

SEQ ID NO: 88192 - DNA, 25 bp, Mus musculus
catccagtggtttcaggaggcctat

SEQ ID NO: 88193 - DNA, 25 bp, Mus musculus
catccagttcttcagacgcttggcc

SEQ ID NO: 88194 - DNA, 25 bp, Mus musculus
catccataaagccaggaaaatgaca

SEQ ID NO: 88195 - DNA, 25 bp, Mus musculus
catccataacgtgtacagtgtcagc

SEQ ID NO: 88196 - DNA, 25 bp, Mus musculus
catccatagggaggctagacagtct

SEQ ID NO: 88197 - DNA, 25 bp, Mus musculus
catccatcaatatttggtggacttg

SEQ ID NO: 88198 - DNA, 25 bp, Mus musculus
catccatctccaggcaaagtaaaca

SEQ ID NO: 88199 - DNA, 25 bp, Mus musculus
catccatgcagcttcgaaggtgttc

SEQ ID NO: 88200 - DNA, 25 bp, Mus musculus
catccattgcgtgagacagacagtc

SEQ ID NO: 88201 - DNA, 25 bp, Mus musculus
catccattgtggcttgagaccggcc

SEQ ID NO: 88202 - DNA, 25 bp, Mus musculus
catccatttttacagcggaccagac

SEQ ID NO: 88203 - DNA, 25 bp, Mus musculus
catcccacgtctatgtgaaccaagg

SEQ ID NO: 88204 - DNA, 25 bp, Mus musculus
catcccagagcggtggaagtgcgac

SEQ ID NO: 88205 - DNA, 25 bp, Mus musculus
catcccaggagacttgcttcgagaa

SEQ ID NO: 88206 - DNA, 25 bp, Mus musculus
catcccaggcaaagagacaggtact

SEQ ID NO: 88207 - DNA, 25 bp, Mus musculus
catcccagttggtagctgcagaaaa

SEQ ID NO: 88208 - DNA, 25 bp, Mus musculus
catcccatgaggagtctgagtctga

SEQ ID NO: 88209 - DNA, 25 bp, Mus musculus
catccccaaggacgtggttgaggaa

SEQ ID NO: 88210 - DNA, 25 bp, Mus musculus
catccccagagaaagacttgtccct

SEQ ID NO: 88211 - DNA, 25 bp, Mus musculus
catccccaggatagaggcacaggaa

SEQ ID NO: 88212 - DNA, 25 bp, Mus musculus
catccccaggcttcggagcttcata

SEQ ID NO: 88213 - DNA, 25 bp, Mus musculus
catccccgcagtgaatgatttgacg

SEQ ID NO: 88214 - DNA, 25 bp, Mus musculus
catccccgtgtgtggaaaagagaca

SEQ ID NO: 88215 - DNA, 25 bp, Mus musculus
catcccctaaggagtcgtgggtaga

SEQ ID NO: 88216 - DNA, 25 bp, Mus musculus
catccccttggatgggcacgaggct

SEQ ID NO: 88217 - DNA, 25 bp, Mus musculus
catcccgcctgcctggtgaaaggaa

SEQ ID NO: 88218 - DNA, 25 bp, Mus musculus
catcccggcgtatgagtgagttccg

SEQ ID NO: 88219 - DNA, 25 bp, Mus musculus
catcccgggcactatgtgaatttgg

SEQ ID NO: 88220 - DNA, 25 bp, Mus musculus
catcccgggccttagaaaagttcag

SEQ ID NO: 88221 - DNA, 25 bp, Mus musculus
catcccgggtctgtatgtttctgaa

SEQ ID NO: 88222 - DNA, 25 bp, Mus musculus
catcccgtacgcgacctttgtgttg

SEQ ID NO: 88223 - DNA, 25 bp, Mus musculus
catcccgtgactgcgatgctggtgg

SEQ ID NO: 88224 - DNA, 25 bp, Mus musculus
catcccgttatcagagagtcagtgt

SEQ ID NO: 88225 - DNA, 25 bp, Mus musculus
catccctccggcgtcgccgaggtcg

SEQ ID NO: 88226 - DNA, 25 bp, Mus musculus
catccctctggaaaagatagccgca

SEQ ID NO: 88227 - DNA, 25 bp, Mus musculus
catccctgaggtggtcatgtgaggc

SEQ ID NO: 88228 - DNA, 25 bp, Mus musculus
catccctggagaataacctggagga

SEQ ID NO: 88229 - DNA, 25 bp, Mus musculus
catccctggatgaaatcacctctgg

SEQ ID NO: 88230 - DNA, 25 bp, Mus musculus
catccctgggacaaagctgagcaga

SEQ ID NO: 88231 - DNA, 25 bp, Mus musculus
catccctggtttgcctgataaagcc

SEQ ID NO: 88232 - DNA, 25 bp, Mus musculus
catccctgttaaagtgaagagcaaa

SEQ ID NO: 88233 - DNA, 25 bp, Mus musculus
catcccttaaagtcctcgtggccaa

SEQ ID NO: 88234 - DNA, 25 bp, Mus musculus
catcccttcttcttcagaacacggg

SEQ ID NO: 88235 - DNA, 25 bp, Mus musculus
catccgaaatcatgtcaccttctga

SEQ ID NO: 88236 - DNA, 25 bp, Mus musculus
catccgaagcactccgacagagagt

SEQ ID NO: 88237 - DNA, 25 bp, Mus musculus
catccgaagcattggagagagacct

SEQ ID NO: 88238 - DNA, 25 bp, Mus musculus
catccgaagtcgaacaggtgcagct

SEQ ID NO: 88239 - DNA, 25 bp, Mus musculus
catccgagacatagagataattcac

SEQ ID NO: 88240 - DNA, 25 bp, Mus musculus
catccgagatgtgtgcctgtaccct

SEQ ID NO: 88241 - DNA, 25 bp, Mus musculus
catccgagctgggttgcagaggact

SEQ ID NO: 88242 - DNA, 25 bp, Mus musculus
catccgaggcaacaaggacgtgtct

SEQ ID NO: 88243 - DNA, 25 bp, Mus musculus
catccgagtgtatcctgagagaagc

SEQ ID NO: 88244 - DNA, 25 bp, Mus musculus
catccgagttcagaagattggcaac

SEQ ID NO: 88245 - DNA, 25 bp, Mus musculus
catccgatgccaaacccaggacaag

SEQ ID NO: 88246 - DNA, 25 bp, Mus musculus
catccgattcatcttgggagaggaa

SEQ ID NO: 88247 - DNA, 25 bp, Mus musculus
catccgcaccaatgaagaagttgta

SEQ ID NO: 88248 - DNA, 25 bp, Mus musculus
catccgccccgtattgaggcgctga

SEQ ID NO: 88249 - DNA, 25 bp, Mus musculus
catccgcgagtttatccagggccag

SEQ ID NO: 88250 - DNA, 25 bp, Mus musculus
catccggaacacagactggtgctac

SEQ ID NO: 88251 - DNA, 25 bp, Mus musculus
catccggaaccgagatgaggtttcc

SEQ ID NO: 88252 - DNA, 25 bp, Mus musculus
catccggacacacaccaacgagaag

SEQ ID NO: 88253 - DNA, 25 bp, Mus musculus
catccggagagatcctgaggcctgt

SEQ ID NO: 88254 - DNA, 25 bp, Mus musculus
catccggaggaggagtaagtttgcc

SEQ ID NO: 88255 - DNA, 25 bp, Mus musculus
catccggattcctcaaatagtgctc

SEQ ID NO: 88256 - DNA, 25 bp, Mus musculus
catccggattcctggacagtgctgt

SEQ ID NO: 88257 - DNA, 25 bp, Mus musculus
catccggatttgcaagggctaacta

SEQ ID NO: 88258 - DNA, 25 bp, Mus musculus
catccgggaattcgccatggcgttt

SEQ ID NO: 88259 - DNA, 25 bp, Mus musculus
catccgggagcgaggactcagtgaa

SEQ ID NO: 88260 - DNA, 25 bp, Mus musculus
catccggtgcgagaaacagaacaac

SEQ ID NO: 88261 - DNA, 25 bp, Mus musculus
catccgtctagtctggctgtaggca

SEQ ID NO: 88262 - DNA, 25 bp, Mus musculus
catccgtgagttcctgtgcagcgaa

SEQ ID NO: 88263 - DNA, 25 bp, Mus musculus
catccgtgatgaagacagagctgat

SEQ ID NO: 88264 - DNA, 25 bp, Mus musculus
catccgtgccaaagatgctgccttt

SEQ ID NO: 88265 - DNA, 25 bp, Mus musculus
catccgtgcctacgagcagttgggc

SEQ ID NO: 88266 - DNA, 25 bp, Mus musculus
catccgtgggctagaggtggcctaa

SEQ ID NO: 88267 - DNA, 25 bp, Mus musculus
catccgtgtgtttcactggaggaca

SEQ ID NO: 88268 - DNA, 25 bp, Mus musculus
catcctaatccctatgaagtcacta

SEQ ID NO: 88269 - DNA, 25 bp, Mus musculus
catcctaattcgttgcctctggtgg

SEQ ID NO: 88270 - DNA, 25 bp, Mus musculus
catcctagcacacatccagaagcgg

SEQ ID NO: 88271 - DNA, 25 bp, Mus musculus
catcctaggagaagggacgacaata

SEQ ID NO: 88272 - DNA, 25 bp, Mus musculus
catcctagtgggagtcaggttaccc

SEQ ID NO: 88273 - DNA, 25 bp, Mus musculus
catcctatatggtaacgggcctggc

SEQ ID NO: 88274 - DNA, 25 bp, Mus musculus
catcctcaaggaaccagtgcgtgta

SEQ ID NO: 88275 - DNA, 25 bp, Mus musculus
catcctcatctgacactggtgtaga

SEQ ID NO: 88276 - DNA, 25 bp, Mus musculus
catcctcatggagtcaaaatgctgg

SEQ ID NO: 88277 - DNA, 25 bp, Mus musculus
catcctccatcaaagtcacctgaag

SEQ ID NO: 88278 - DNA, 25 bp, Mus musculus
catcctccgaaagtgctggtccagg

SEQ ID NO: 88279 - DNA, 25 bp, Mus musculus
catcctcggcggaggcgaaacatgg

SEQ ID NO: 88280 - DNA, 25 bp, Mus musculus
catcctcggtgggtaaagggccctg

SEQ ID NO: 88281 - DNA, 25 bp, Mus musculus
catcctctcgatgtggtgaaaacca

SEQ ID NO: 88282 - DNA, 25 bp, Mus musculus
catcctctcgcaggatttactggag

SEQ ID NO: 88283 - DNA, 25 bp, Mus musculus
catcctgaagaagacggctagcctc

SEQ ID NO: 88284 - DNA, 25 bp, Mus musculus
catcctgaagttaaatggccggacc

SEQ ID NO: 88285 - DNA, 25 bp, Mus musculus
catcctgacgggttgctaacctgga

SEQ ID NO: 88286 - DNA, 25 bp, Mus musculus
catcctgcaaagagggtcaagggcg

SEQ ID NO: 88287 - DNA, 25 bp, Mus musculus
catcctgcagttccagtttgccgaa

SEQ ID NO: 88288 - DNA, 25 bp, Mus musculus
catcctgctggatgaaaactgctgt

SEQ ID NO: 88289 - DNA, 25 bp, Mus musculus
catcctggagtacactgttgtccta

SEQ ID NO: 88290 - DNA, 25 bp, Mus musculus
catcctggctttgggacttccggag

SEQ ID NO: 88291 - DNA, 25 bp, Mus musculus
catcctggcttttgtggtcaccctc

SEQ ID NO: 88292 - DNA, 25 bp, Mus musculus
catcctgggaggaatgttctgcact

SEQ ID NO: 88293 - DNA, 25 bp, Mus musculus
catcctggtgacatcattgcctgca

SEQ ID NO: 88294 - DNA, 25 bp, Mus musculus
catcctgtaccgtttctcagatggc

SEQ ID NO: 88295 - DNA, 25 bp, Mus musculus
catcctgtatttcaccaaagtggag

SEQ ID NO: 88296 - DNA, 25 bp, Mus musculus
catcctgtcaagagggtgggtcccc

SEQ ID NO: 88297 - DNA, 25 bp, Mus musculus
catcctgtccaaactgctgagggag

SEQ ID NO: 88298 - DNA, 25 bp, Mus musculus
catcctgtcgatggctgctgtgtta

SEQ ID NO: 88299 - DNA, 25 bp, Mus musculus
catcctgtgtggtcagatttctcag

SEQ ID NO: 88300 - DNA, 25 bp, Mus musculus
catcctgttagctgtggccaatgat

SEQ ID NO: 88301 - DNA, 25 bp, Mus musculus
catcctgttgcaacttccctgtggc

SEQ ID NO: 88302 - DNA, 25 bp, Mus musculus
catcctgttgttgtgcgaggctccc

SEQ ID NO: 88303 - DNA, 25 bp, Mus musculus
catcctgtttggaaattctaccata

SEQ ID NO: 88304 - DNA, 25 bp, Mus musculus
catccttattggaatgagccagtgg

SEQ ID NO: 88305 - DNA, 25 bp, Mus musculus
catccttcatctacacaatgcctgg

SEQ ID NO: 88306 - DNA, 25 bp, Mus musculus
catccttccctaatgccgtcttggg

SEQ ID NO: 88307 - DNA, 25 bp, Mus musculus
catccttctggacaagaccctgagg

SEQ ID NO: 88308 - DNA, 25 bp, Mus musculus
catccttcttgcaatcatcctgtgg

SEQ ID NO: 88309 - DNA, 25 bp, Mus musculus
catcctttcggaggaggaccgcgtg

SEQ ID NO: 88310 - DNA, 25 bp, Mus musculus
catcctttgagccagaagcccttgg

SEQ ID NO: 88311 - DNA, 25 bp, Mus musculus
catcctttgggtaacagccttgtca

SEQ ID NO: 88312 - DNA, 25 bp, Mus musculus
catcgaaagagagggctggaagacc

SEQ ID NO: 88313 - DNA, 25 bp, Mus musculus
catcgaaaggtccagctcagcagag

SEQ ID NO: 88314 - DNA, 25 bp, Mus musculus
catcgaaaggttggagagaattaca

SEQ ID NO: 88315 - DNA, 25 bp, Mus musculus
catcgaaagtgtacagacaaaggct

SEQ ID NO: 88316 - DNA, 25 bp, Mus musculus
catcgaagcacgcagtcactgacga

SEQ ID NO: 88317 - DNA, 25 bp, Mus musculus
catcgaaggcgcaaacataaaatgg

SEQ ID NO: 88318 - DNA, 25 bp, Mus musculus
catcgaaggtgaagctgccgtggac

SEQ ID NO: 88319 - DNA, 25 bp, Mus musculus
catcgaatatctcaagcagcaggtt

SEQ ID NO: 88320 - DNA, 25 bp, Mus musculus
catcgacagcagataccagcagtgg

SEQ ID NO: 88321 - DNA, 25 bp, Mus musculus
catcgacatggacgccgtgtgcaaa

SEQ ID NO: 88322 - DNA, 25 bp, Mus musculus
catcgaccttatcgtccgctgtgaa

SEQ ID NO: 88323 - DNA, 25 bp, Mus musculus
catcgactgggagtgtgacctggac

SEQ ID NO: 88324 - DNA, 25 bp, Mus musculus
catcgagaagataatcatgccaggg

SEQ ID NO: 88325 - DNA, 25 bp, Mus musculus
catcgagacccaggctggcattgtg

SEQ ID NO: 88326 - DNA, 25 bp, Mus musculus
catcgagcagatggagaagttttcc

SEQ ID NO: 88327 - DNA, 25 bp, Mus musculus
catcgaggaagtggagcagcacatt

SEQ ID NO: 88328 - DNA, 25 bp, Mus musculus
catcgaggacatagaagtcgcaccc

SEQ ID NO: 88329 - DNA, 25 bp, Mus musculus
catcgaggaggcaaggaggaaccta

SEQ ID NO: 88330 - DNA, 25 bp, Mus musculus
catcgaggagttgtgtcagaagcga

SEQ ID NO: 88331 - DNA, 25 bp, Mus musculus
catcgaggatctcaaagcacagccc

SEQ ID NO: 88332 - DNA, 25 bp, Mus musculus
catcgagtcaagcagcaagtggcac

SEQ ID NO: 88333 - DNA, 25 bp, Mus musculus
catcgagtcaggctaggtctgccgt

SEQ ID NO: 88334 - DNA, 25 bp, Mus musculus
catcgagtcttacatagaatggctg

SEQ ID NO: 88335 - DNA, 25 bp, Mus musculus
catcgagtgatgaaaagcacccacc

SEQ ID NO: 88336 - DNA, 25 bp, Mus musculus
catcgagtgtttccgctgtgtagcc

SEQ ID NO: 88337 - DNA, 25 bp, Mus musculus
catcgatgaccccagcttgaagagt

SEQ ID NO: 88338 - DNA, 25 bp, Mus musculus
catcgatggtgacggacagttgaaa

SEQ ID NO: 88339 - DNA, 25 bp, Mus musculus
catcgatgtgtttttccggcaaagc

SEQ ID NO: 88340 - DNA, 25 bp, Mus musculus
catcgattgtcttggatgccagaga

SEQ ID NO: 88341 - DNA, 25 bp, Mus musculus
catcgcaaacttggattattcagac

SEQ ID NO: 88342 - DNA, 25 bp, Mus musculus
catcgcaccgaggatactccaggat

SEQ ID NO: 88343 - DNA, 25 bp, Mus musculus
catcgcagatcttggttatggccac

SEQ ID NO: 88344 - DNA, 25 bp, Mus musculus
catcgcagggcatgcagtagcacag

SEQ ID NO: 88345 - DNA, 25 bp, Mus musculus
catcgcagtgtgcaatgtgccggca

SEQ ID NO: 88346 - DNA, 25 bp, Mus musculus
catcgcatatcgaaagtgaccctcg

SEQ ID NO: 88347 - DNA, 25 bp, Mus musculus
catcgcatgaggacagagaccaagg

SEQ ID NO: 88348 - DNA, 25 bp, Mus musculus
catcgccagcaagttccgagggaaa

SEQ ID NO: 88349 - DNA, 25 bp, Mus musculus
catcgccattgtgtgcctcttagga

SEQ ID NO: 88350 - DNA, 25 bp, Mus musculus
catcgcccacaacttggtccacctc

SEQ ID NO: 88351 - DNA, 25 bp, Mus musculus
catcgcccaggctctaaaaactcaa

SEQ ID NO: 88352 - DNA, 25 bp, Mus musculus
catcgcctgggctgtaatgagtagt

SEQ ID NO: 88353 - DNA, 25 bp, Mus musculus
catcgcctgggtcatgtggtacttc

SEQ ID NO: 88354 - DNA, 25 bp, Mus musculus
catcgcgtccttagataaagactta

SEQ ID NO: 88355 - DNA, 25 bp, Mus musculus
catcgcgtggtttgtagtcacagcc

SEQ ID NO: 88356 - DNA, 25 bp, Mus musculus
catcgctcacgggataggcgtagag

SEQ ID NO: 88357 - DNA, 25 bp, Mus musculus
catcgctcttcctgtcctgattgtg

SEQ ID NO: 88358 - DNA, 25 bp, Mus musculus
catcgctgaagggagagcgaggccc

SEQ ID NO: 88359 - DNA, 25 bp, Mus musculus
catcgctgcatgaaaacctgacaca

SEQ ID NO: 88360 - DNA, 25 bp, Mus musculus
catcgctgcgaataaagggcctctt

SEQ ID NO: 88361 - DNA, 25 bp, Mus musculus
catcgctgctccaaagagggatgca

SEQ ID NO: 88362 - DNA, 25 bp, Mus musculus
catcgctgctcggaacattgttaat

SEQ ID NO: 88363 - DNA, 25 bp, Mus musculus
catcgctggaaatgaagagcctcac

SEQ ID NO: 88364 - DNA, 25 bp, Mus musculus
catcgctgtgggttgcacctgcatc

SEQ ID NO: 88365 - DNA, 25 bp, Mus musculus
catcgctgttccacgccaaatggga

SEQ ID NO: 88366 - DNA, 25 bp, Mus musculus
catcggaatgcggtactggaagcca

SEQ ID NO: 88367 - DNA, 25 bp, Mus musculus
catcggagagatggcttcagttgca

SEQ ID NO: 88368 - DNA, 25 bp, Mus musculus
catcggagatcgcacttagaggaga

SEQ ID NO: 88369 - DNA, 25 bp, Mus musculus
catcggagcacttcgggaaaacacc

SEQ ID NO: 88370 - DNA, 25 bp, Mus musculus
catcggaggttcaagcagctaagcg

SEQ ID NO: 88371 - DNA, 25 bp, Mus musculus
catcggcagagtgagaaccacgagg

SEQ ID NO: 88372 - DNA, 25 bp, Mus musculus
catcggcatcatgaagggaggctcc

SEQ ID NO: 88373 - DNA, 25 bp, Mus musculus
catcggccacaatgaagtgatcggg

SEQ ID NO: 88374 - DNA, 25 bp, Mus musculus
catcggccactagggagaagtttct

SEQ ID NO: 88375 - DNA, 25 bp, Mus musculus
catcggccatgaccttctaagcaga

SEQ ID NO: 88376 - DNA, 25 bp, Mus musculus
catcggctaagactgcacggcttgg

SEQ ID NO: 88377 - DNA, 25 bp, Mus musculus
catcggctatgtgacaggactgcag

SEQ ID NO: 88378 - DNA, 25 bp, Mus musculus
catcggctcctcctacaactatggg

SEQ ID NO: 88379 - DNA, 25 bp, Mus musculus
catcggctcgcttgttgctctggga

SEQ ID NO: 88380 - DNA, 25 bp, Mus musculus
catcggctggacgtggtacttccta

SEQ ID NO: 88381 - DNA, 25 bp, Mus musculus
catcggctgtgggttctcaactggc

SEQ ID NO: 88382 - DNA, 25 bp, Mus musculus
catcgggaagtaggagagactgacc

SEQ ID NO: 88383 - DNA, 25 bp, Mus musculus
catcgggccctcaaaatgattgtgg

SEQ ID NO: 88384 - DNA, 25 bp, Mus musculus
catcgggcgcttctttagcggtgac

SEQ ID NO: 88385 - DNA, 25 bp, Mus musculus
catcggtctggcagtggtagtgacc

SEQ ID NO: 88386 - DNA, 25 bp, Mus musculus
catcggtgtcgacttcaccatgaag

SEQ ID NO: 88387 - DNA, 25 bp, Mus musculus
catcggtgtcgatcctgaaggctcc

SEQ ID NO: 88388 - DNA, 25 bp, Mus musculus
catcggttgccgaggtctggaaact

SEQ ID NO: 88389 - DNA, 25 bp, Mus musculus
catcggtttcgtgtcgtgcatcagc

SEQ ID NO: 88390 - DNA, 25 bp, Mus musculus
catcgtacaactggtgaacaagctg

SEQ ID NO: 88391 - DNA, 25 bp, Mus musculus
catcgtacaaggacaagggtgcact

SEQ ID NO: 88392 - DNA, 25 bp, Mus musculus
catcgtacgctacttggagaccaac

SEQ ID NO: 88393 - DNA, 25 bp, Mus musculus
catcgtagataccactcagcagggc

SEQ ID NO: 88394 - DNA, 25 bp, Mus musculus
catcgtatagtttgagggcctctgc

SEQ ID NO: 88395 - DNA, 25 bp, Mus musculus
catcgtcaagaagtgcctggagctc

SEQ ID NO: 88396 - DNA, 25 bp, Mus musculus
catcgtctcggctttccagttcgga

SEQ ID NO: 88397 - DNA, 25 bp, Mus musculus
catcgtctgtcagttgtgcgttgga

SEQ ID NO: 88398 - DNA, 25 bp, Mus musculus
catcgtgaaggtcctcaatgggcag

SEQ ID NO: 88399 - DNA, 25 bp, Mus musculus
catcgtgacaaagagagcacagcca

SEQ ID NO: 88400 - DNA, 25 bp, Mus musculus
catcgtgagaacatgaaacaggcgc

SEQ ID NO: 88401 - DNA, 25 bp, Mus musculus
catcgtgcaagagaaactactgagc

SEQ ID NO: 88402 - DNA, 25 bp, Mus musculus
catcgtgcactggtttagaggctac

SEQ ID NO: 88403 - DNA, 25 bp, Mus musculus
catcgtgccaggcatgaaggctgct

SEQ ID NO: 88404 - DNA, 25 bp, Mus musculus
catcgtgcgagcaggccaagctatt

SEQ ID NO: 88405 - DNA, 25 bp, Mus musculus
catcgtggagtgctctgagtctaac

SEQ ID NO: 88406 - DNA, 25 bp, Mus musculus
catcgtggattctgacaagaggagg

SEQ ID NO: 88407 - DNA, 25 bp, Mus musculus
catcgtggctggatatgggtcacca

SEQ ID NO: 88408 - DNA, 25 bp, Mus musculus
catcgtgggagaaactgtggagaaa

SEQ ID NO: 88409 - DNA, 25 bp, Mus musculus
catcgtgggagatctcttgcggaaa

SEQ ID NO: 88410 - DNA, 25 bp, Mus musculus
catcgtgggaggacatgaggcttct

SEQ ID NO: 88411 - DNA, 25 bp, Mus musculus
catcgtgggcacctacctgctagtg

SEQ ID NO: 88412 - DNA, 25 bp, Mus musculus
catcgtggtcaagagctatcggcct

SEQ ID NO: 88413 - DNA, 25 bp, Mus musculus
catcgtgtactcaccacgttacaac

SEQ ID NO: 88414 - DNA, 25 bp, Mus musculus
catcgtgtgtgccatttgcctcgga

SEQ ID NO: 88415 - DNA, 25 bp, Mus musculus
catcgttacgatgagtggttttgct

SEQ ID NO: 88416 - DNA, 25 bp, Mus musculus
catcgttctgtggtagccctcggaa

SEQ ID NO: 88417 - DNA, 25 bp, Mus musculus
catcgttggccaccgctggatgaga

SEQ ID NO: 88418 - DNA, 25 bp, Mus musculus
catctaaagatggtgcctggtggaa

SEQ ID NO: 88419 - DNA, 25 bp, Mus musculus
catctaaagtgaagccaccaggcct

SEQ ID NO: 88420 - DNA, 25 bp, Mus musculus
catctaactagagttgggctcccca

SEQ ID NO: 88421 - DNA, 25 bp, Mus musculus
catctaaggctccagcgggattcta

SEQ ID NO: 88422 - DNA, 25 bp, Mus musculus
catctaagtgcacagaggagtgcgc

SEQ ID NO: 88423 - DNA, 25 bp, Mus musculus
catctaatttggatgtctgtcccca

SEQ ID NO: 88424 - DNA, 25 bp, Mus musculus
catctacattctcattgctgtggga

SEQ ID NO: 88425 - DNA, 25 bp, Mus musculus
catctaccagaatgaaagcctgttc

SEQ ID NO: 88426 - DNA, 25 bp, Mus musculus
catctactcgggaaagagcggctaa

SEQ ID NO: 88427 - DNA, 25 bp, Mus musculus
catctactttgacagtggaggcaag

SEQ ID NO: 88428 - DNA, 25 bp, Mus musculus
catctagatgactgcagccggtttg

SEQ ID NO: 88429 - DNA, 25 bp, Mus musculus
catctagggacgtgccaggaataca

SEQ ID NO: 88430 - DNA, 25 bp, Mus musculus
catctatcaagtcccggccatgtcg

SEQ ID NO: 88431 - DNA, 25 bp, Mus musculus
catctatcactggtggcaggccgtg

SEQ ID NO: 88432 - DNA, 25 bp, Mus musculus
catctatgcaggagaagtgactctg

SEQ ID NO: 88433 - DNA, 25 bp, Mus musculus
catctatgctggtgtcatcaagaca

SEQ ID NO: 88434 - DNA, 25 bp, Mus musculus
catctatggtgggtcatcagcagcc

SEQ ID NO: 88435 - DNA, 25 bp, Mus musculus
catctatgtgctcaaccaggtggac

SEQ ID NO: 88436 - DNA, 25 bp, Mus musculus
catctattttaagccggcagcaggt

SEQ ID NO: 88437 - DNA, 25 bp, Mus musculus
catctcacgaggtcaacagctgcta

SEQ ID NO: 88438 - DNA, 25 bp, Mus musculus
catctcacggtctgcctggtaaaca

SEQ ID NO: 88439 - DNA, 25 bp, Mus musculus
catctcactagctgaggctggagcc

SEQ ID NO: 88440 - DNA, 25 bp, Mus musculus
catctcactgtgtgcgtggccagga

SEQ ID NO: 88441 - DNA, 25 bp, Mus musculus
catctcagaagcatgactgtggcca

SEQ ID NO: 88442 - DNA, 25 bp, Mus musculus
catctcagagacgagacgtggagcg

SEQ ID NO: 88443 - DNA, 25 bp, Mus musculus
catctcagggccgaaaacggaggca

SEQ ID NO: 88444 - DNA, 25 bp, Mus musculus
catctcagtgcattgatgtgccgca

SEQ ID NO: 88445 - DNA, 25 bp, Mus musculus
catctcatatggcatggtgggcgca

SEQ ID NO: 88446 - DNA, 25 bp, Mus musculus
catctcatgctacggagcagcggcc

SEQ ID NO: 88447 - DNA, 25 bp, Mus musculus
catctccaaggacgagggtgtaccc

SEQ ID NO: 88448 - DNA, 25 bp, Mus musculus
catctccaccttcggagaggccgtt

SEQ ID NO: 88449 - DNA, 25 bp, Mus musculus
catctccagagtgggaaggcccagt

SEQ ID NO: 88450 - DNA, 25 bp, Mus musculus
catctcccacgcagaaggacaggga

SEQ ID NO: 88451 - DNA, 25 bp, Mus musculus
catctccccgaagaaagtggctgaa

SEQ ID NO: 88452 - DNA, 25 bp, Mus musculus
catctccctgggattgctgaagcgg

SEQ ID NO: 88453 - DNA, 25 bp, Mus musculus
catctccggaggcaacatctggttc

SEQ ID NO: 88454 - DNA, 25 bp, Mus musculus
catctcctatctgaaggtgggaccc

SEQ ID NO: 88455 - DNA, 25 bp, Mus musculus
catctcctgctgcaaggtatgggca

SEQ ID NO: 88456 - DNA, 25 bp, Mus musculus
catctcctggagttgggctggttca

SEQ ID NO: 88457 - DNA, 25 bp, Mus musculus
catctcctgtagtgaagatcgtctc

SEQ ID NO: 88458 - DNA, 25 bp, Mus musculus
catctccttctgaggccatctgcag

SEQ ID NO: 88459 - DNA, 25 bp, Mus musculus
catctcgcaagcaactacagggcgg

SEQ ID NO: 88460 - DNA, 25 bp, Mus musculus
catctcgcctttgcagacggtgctg

SEQ ID NO: 88461 - DNA, 25 bp, Mus musculus
catctcgctggcgaacttaagcggg

SEQ ID NO: 88462 - DNA, 25 bp, Mus musculus
catctcggaatatgaggcgctggat

SEQ ID NO: 88463 - DNA, 25 bp, Mus musculus
catctcgggcatcctactgtggtac

SEQ ID NO: 88464 - DNA, 25 bp, Mus musculus
catctcgtaaggaatgtggccccta

SEQ ID NO: 88465 - DNA, 25 bp, Mus musculus
catctcgtcatgtcaggcactgctt

SEQ ID NO: 88466 - DNA, 25 bp, Mus musculus
catctcgtgtgacttaagctggcct

SEQ ID NO: 88467 - DNA, 25 bp, Mus musculus
catctctgagcaggagagtgaaggc

SEQ ID NO: 88468 - DNA, 25 bp, Mus musculus
catctctgcacgagaatctcaggca

SEQ ID NO: 88469 - DNA, 25 bp, Mus musculus
catctctgcagacactctgccatga

SEQ ID NO: 88470 - DNA, 25 bp, Mus musculus
catctctgccctctggaatagaagg

SEQ ID NO: 88471 - DNA, 25 bp, Mus musculus
catctctggaaaatgggacgggaac

SEQ ID NO: 88472 - DNA, 25 bp, Mus musculus
catctctggtgaattggtgtggcag

SEQ ID NO: 88473 - DNA, 25 bp, Mus musculus
catctcttgtgtgggcagcttcatc

SEQ ID NO: 88474 - DNA, 25 bp, Mus musculus
catctcttttgatcgagtgaaactc

SEQ ID NO: 88475 - DNA, 25 bp, Mus musculus
catctgaaattcagggactaagaac

SEQ ID NO: 88476 - DNA, 25 bp, Mus musculus
catctgaaggccgagtagctgggac

SEQ ID NO: 88477 - DNA, 25 bp, Mus musculus
catctgaagggactcatccatggac

SEQ ID NO: 88478 - DNA, 25 bp, Mus musculus
catctgaagttgagagacagctctc

SEQ ID NO: 88479 - DNA, 25 bp, Mus musculus
catctgacactggtgtagatggtca

SEQ ID NO: 88480 - DNA, 25 bp, Mus musculus
catctgagacatgtatctgtgagaa

SEQ ID NO: 88481 - DNA, 25 bp, Mus musculus
catctgagacttggtgaactggcat

SEQ ID NO: 88482 - DNA, 25 bp, Mus musculus
catctgagcttggtagggactgcct

SEQ ID NO: 88483 - DNA, 25 bp, Mus musculus
catctgatgctaacgttctgactaa

SEQ ID NO: 88484 - DNA, 25 bp, Mus musculus
catctgatttcacctgtagttctcc

SEQ ID NO: 88485 - DNA, 25 bp, Mus musculus
catctgcaatcatgtgggcctgtgc

SEQ ID NO: 88486 - DNA, 25 bp, Mus musculus
catctgcaccgtctgcctgggaaaa

SEQ ID NO: 88487 - DNA, 25 bp, Mus musculus
catctgcactctgggaattgggaca

SEQ ID NO: 88488 - DNA, 25 bp, Mus musculus
catctgcagaccttcggatacgaaa

SEQ ID NO: 88489 - DNA, 25 bp, Mus musculus
catctgcagatgagaagcggtaccg

SEQ ID NO: 88490 - DNA, 25 bp, Mus musculus
catctgcagcagagggtccgctttg

SEQ ID NO: 88491 - DNA, 25 bp, Mus musculus
catctgcaggatggcgtttaatggc

SEQ ID NO: 88492 - DNA, 25 bp, Mus musculus
catctgcaggtgtttctccaagggc

SEQ ID NO: 88493 - DNA, 25 bp, Mus musculus
catctgcccctcatgtggaggtgga

SEQ ID NO: 88494 - DNA, 25 bp, Mus musculus
catctgccgctggatatggtgacct

SEQ ID NO: 88495 - DNA, 25 bp, Mus musculus
catctgcctcgggtagaacgtagct

SEQ ID NO: 88496 - DNA, 25 bp, Mus musculus
catctgcgagcaagcggaatatcac

SEQ ID NO: 88497 - DNA, 25 bp, Mus musculus
catctgcgcttgtggtgtaactgct

SEQ ID NO: 88498 - DNA, 25 bp, Mus musculus
catctgcgggtacacacaggtgaga

SEQ ID NO: 88499 - DNA, 25 bp, Mus musculus
catctgctaagtatggtgggcggca

SEQ ID NO: 88500 - DNA, 25 bp, Mus musculus
catctgctatgctggaaacacgtac

SEQ ID NO: 88501 - DNA, 25 bp, Mus musculus
catctgctatgctgtgggctctcag

SEQ ID NO: 88502 - DNA, 25 bp, Mus musculus
catctgctcacatctggaatctgaa

SEQ ID NO: 88503 - DNA, 25 bp, Mus musculus
catctgctcggctcagaaagctgga

SEQ ID NO: 88504 - DNA, 25 bp, Mus musculus
catctgctgcggaacttgctcacgg

SEQ ID NO: 88505 - DNA, 25 bp, Mus musculus
catctgcttgtaactgccagggaag

SEQ ID NO: 88506 - DNA, 25 bp, Mus musculus
catctgctttaccatgtgctgtgtc

SEQ ID NO: 88507 - DNA, 25 bp, Mus musculus
catctggaagcgctgttgaacatta

SEQ ID NO: 88508 - DNA, 25 bp, Mus musculus
catctggaatcctagactgctctgg

SEQ ID NO: 88509 - DNA, 25 bp, Mus musculus
catctggactgcgaggaggcattct

SEQ ID NO: 88510 - DNA, 25 bp, Mus musculus
catctggactttgtttttcctggga

SEQ ID NO: 88511 - DNA, 25 bp, Mus musculus
catctggatgatgtgcaaggccctt

SEQ ID NO: 88512 - DNA, 25 bp, Mus musculus
catctggattctcaaggtcatgaac

SEQ ID NO: 88513 - DNA, 25 bp, Mus musculus
catctggattgttgtagggactgcc

SEQ ID NO: 88514 - DNA, 25 bp, Mus musculus
catctggcaagaacgaagtgtgtac

SEQ ID NO: 88515 - DNA, 25 bp, Mus musculus
catctggcatgagtgggaaatcatc

SEQ ID NO: 88516 - DNA, 25 bp, Mus musculus
catctggcgccgactctgggatgaa

SEQ ID NO: 88517 - DNA, 25 bp, Mus musculus
catctggctggaaagtcgtctactc

SEQ ID NO: 88518 - DNA, 25 bp, Mus musculus
catctgggaaaatgtcagcttctcg

SEQ ID NO: 88519 - DNA, 25 bp, Mus musculus
catctgggaaaggtagcagtgctgc

SEQ ID NO: 88520 - DNA, 25 bp, Mus musculus
catctgggacggagcagaagaaccc

SEQ ID NO: 88521 - DNA, 25 bp, Mus musculus
catctgggatgcactaaacttggaa

SEQ ID NO: 88522 - DNA, 25 bp, Mus musculus
catctgggccgcgtatgataggaac

SEQ ID NO: 88523 - DNA, 25 bp, Mus musculus
catctgggtgaagatttaaagggca

SEQ ID NO: 88524 - DNA, 25 bp, Mus musculus
catctggtccaggtgggagtacaag

SEQ ID NO: 88525 - DNA, 25 bp, Mus musculus
catctggtgctaaggtttagtttaa

SEQ ID NO: 88526 - DNA, 25 bp, Mus musculus
catctggttccaatgtgtggtgccc

SEQ ID NO: 88527 - DNA, 25 bp, Mus musculus
catctggttcttggtgactgcaccc

SEQ ID NO: 88528 - DNA, 25 bp, Mus musculus
catctgtacagggaatctccaggtc

SEQ ID NO: 88529 - DNA, 25 bp, Mus musculus
catctgtagaatggagacgcggtcg

SEQ ID NO: 88530 - DNA, 25 bp, Mus musculus
catctgtagagacttcctgaggaac

SEQ ID NO: 88531 - DNA, 25 bp, Mus musculus
catctgtagccatgaagtgccatct

SEQ ID NO: 88532 - DNA, 25 bp, Mus musculus
catctgtatcctgcctatggctggg

SEQ ID NO: 88533 - DNA, 25 bp, Mus musculus
catctgtctcagctactcggaaggc

SEQ ID NO: 88534 - DNA, 25 bp, Mus musculus
catctgtctctgttaggctggccca

SEQ ID NO: 88535 - DNA, 25 bp, Mus musculus
catctgtctggaggagatcactgcc

SEQ ID NO: 88536 - DNA, 25 bp, Mus musculus
catctgtgaaaatcagccattgagg

SEQ ID NO: 88537 - DNA, 25 bp, Mus musculus
catctgtgacgccatgagagcagcc

SEQ ID NO: 88538 - DNA, 25 bp, Mus musculus
catctgtgagaagccgcatgaagtc

SEQ ID NO: 88539 - DNA, 25 bp, Mus musculus
catctgtgagatgggaactcctgaa

SEQ ID NO: 88540 - DNA, 25 bp, Mus musculus
catctgtgatatcctgcgctgtgca

SEQ ID NO: 88541 - DNA, 25 bp, Mus musculus
catctgtgcaagtggacaacctcgg

SEQ ID NO: 88542 - DNA, 25 bp, Mus musculus
catctgtggacgtgtgtgactgccg

SEQ ID NO: 88543 - DNA, 25 bp, Mus musculus
catctgtggagtgtgtctgtaaacc

SEQ ID NO: 88544 - DNA, 25 bp, Mus musculus
catctgtgtagaactgctgacgcca

SEQ ID NO: 88545 - DNA, 25 bp, Mus musculus
catctgtgtgagtccccaggaacta

SEQ ID NO: 88546 - DNA, 25 bp, Mus musculus
catctgtgtggtgtgccgcgaatcc

SEQ ID NO: 88547 - DNA, 25 bp, Mus musculus
catctgttacagaggcttcccaccg

SEQ ID NO: 88548 - DNA, 25 bp, Mus musculus
catctgttcgtgtgactggaccgac

SEQ ID NO: 88549 - DNA, 25 bp, Mus musculus
catctgtttcatgggcagctgattc

SEQ ID NO: 88550 - DNA, 25 bp, Mus musculus
catctgtttgattatggtctgggca

SEQ ID NO: 88551 - DNA, 25 bp, Mus musculus
catcttaaattggagcgtggagtaa

SEQ ID NO: 88552 - DNA, 25 bp, Mus musculus
catcttagcattctctcagggaagc

SEQ ID NO: 88553 - DNA, 25 bp, Mus musculus
catcttaggaagaagggaagtccct

SEQ ID NO: 88554 - DNA, 25 bp, Mus musculus
catcttagtcgagccaaggagaggg

SEQ ID NO: 88555 - DNA, 25 bp, Mus musculus
catcttataatgaaccggtggctgg

SEQ ID NO: 88556 - DNA, 25 bp, Mus musculus
catcttatgctcagtgccccttggg

SEQ ID NO: 88557 - DNA, 25 bp, Mus musculus
catcttcaagaggaaccaggagcca

SEQ ID NO: 88558 - DNA, 25 bp, Mus musculus
catcttcaagattgtgggaaccaaa

SEQ ID NO: 88559 - DNA, 25 bp, Mus musculus
catcttcagacaagtgagaaacaca

SEQ ID NO: 88560 - DNA, 25 bp, Mus musculus
catcttcaggcagatcgcaggcgac

SEQ ID NO: 88561 - DNA, 25 bp, Mus musculus
catcttcaggctgtcggaccaggac

SEQ ID NO: 88562 - DNA, 25 bp, Mus musculus
catcttcatccagggcttgtccgtg

SEQ ID NO: 88563 - DNA, 25 bp, Mus musculus
catcttccagaggttgctgacccgg

SEQ ID NO: 88564 - DNA, 25 bp, Mus musculus
catcttccggaagaggagcatcctt

SEQ ID NO: 88565 - DNA, 25 bp, Mus musculus
catcttcctggaaccggatctctat

SEQ ID NO: 88566 - DNA, 25 bp, Mus musculus
catcttcgagaaggcaggtgtgcag

SEQ ID NO: 88567 - DNA, 25 bp, Mus musculus
catcttcgatagtcacgtgccttca

SEQ ID NO: 88568 - DNA, 25 bp, Mus musculus
catcttcgggatgaatctggcaaca

SEQ ID NO: 88569 - DNA, 25 bp, Mus musculus
catcttcggtcctagtaactggcac

SEQ ID NO: 88570 - DNA, 25 bp, Mus musculus
catcttcgtgaaggacgctgtgctc

SEQ ID NO: 88571 - DNA, 25 bp, Mus musculus
catcttcgtggtggtcgtggtctac

SEQ ID NO: 88572 - DNA, 25 bp, Mus musculus
catcttctaagcaaccggtgaccaa

SEQ ID NO: 88573 - DNA, 25 bp, Mus musculus
catcttctatgtgggcaagggaacc

SEQ ID NO: 88574 - DNA, 25 bp, Mus musculus
catcttctgcgctgacctgcgtggg

SEQ ID NO: 88575 - DNA, 25 bp, Mus musculus
catcttgaatgagtcagaagcccga

SEQ ID NO: 88576 - DNA, 25 bp, Mus musculus
catcttgacaacagcagtcctggcc

SEQ ID NO: 88577 - DNA, 25 bp, Mus musculus
catcttgacagtggctgacggagac

SEQ ID NO: 88578 - DNA, 25 bp, Mus musculus
catcttgagaccagctactgtcggg

SEQ ID NO: 88579 - DNA, 25 bp, Mus musculus
catcttgagcgagaaggcatcttcc

SEQ ID NO: 88580 - DNA, 25 bp, Mus musculus
catcttgaggagtgtacagcgcacc

SEQ ID NO: 88581 - DNA, 25 bp, Mus musculus
catcttgcttgagggcaccatgaac

SEQ ID NO: 88582 - DNA, 25 bp, Mus musculus
catcttggaccccgggagaatccgc

SEQ ID NO: 88583 - DNA, 25 bp, Mus musculus
catcttggcagggtatggttcccag

SEQ ID NO: 88584 - DNA, 25 bp, Mus musculus
catcttgggtgtgtcagtccaccag

SEQ ID NO: 88585 - DNA, 25 bp, Mus musculus
catcttgtacacttaacagctgaaa

SEQ ID NO: 88586 - DNA, 25 bp, Mus musculus
catcttgtagagtgaagcatgcaga

SEQ ID NO: 88587 - DNA, 25 bp, Mus musculus
catcttgtctaaactccctattggg

SEQ ID NO: 88588 - DNA, 25 bp, Mus musculus
catcttgtgggtcagctggttagtc

SEQ ID NO: 88589 - DNA, 25 bp, Mus musculus
catctttcaagaggacttgagacca

SEQ ID NO: 88590 - DNA, 25 bp, Mus musculus
catctttgaaggagtggagtgccga

SEQ ID NO: 88591 - DNA, 25 bp, Mus musculus
catctttgacagaggtagccagcaa

SEQ ID NO: 88592 - DNA, 25 bp, Mus musculus
catctttgagccagctgcatgggct

SEQ ID NO: 88593 - DNA, 25 bp, Mus musculus
catctttgaggtggtagcacaggac

SEQ ID NO: 88594 - DNA, 25 bp, Mus musculus
catctttgctcaaaataggccagag

SEQ ID NO: 88595 - DNA, 25 bp, Mus musculus
catctttgggttgggcgtactggca

SEQ ID NO: 88596 - DNA, 25 bp, Mus musculus
catctttggtcagggtattcggtca

SEQ ID NO: 88597 - DNA, 25 bp, Mus musculus
catctttgtcatggccgtgggcacc

SEQ ID NO: 88598 - DNA, 25 bp, Mus musculus
catcttttgggtagaggaggtttca

SEQ ID NO: 88599 - DNA, 25 bp, Mus musculus
catcttttgttgagccaagccctga

SEQ ID NO: 88600 - DNA, 25 bp, Mus musculus
catctttttcccagctgctactggg

SEQ ID NO: 88601 - DNA, 25 bp, Mus musculus
catgaaaaccaagttctgcaccggg

SEQ ID NO: 88602 - DNA, 25 bp, Mus musculus
catgaaaagaagtaacgggtgctgc

SEQ ID NO: 88603 - DNA, 25 bp, Mus musculus
catgaaaatggtgaaactggaccgg

SEQ ID NO: 88604 - DNA, 25 bp, Mus musculus
catgaaacttagtccacaacaagct

SEQ ID NO: 88605 - DNA, 25 bp, Mus musculus
catgaaacttgtatggcctagcgct

SEQ ID NO: 88606 - DNA, 25 bp, Mus musculus
catgaaactttctgacacggtgacc

SEQ ID NO: 88607 - DNA, 25 bp, Mus musculus
catgaaagatccaagtcgcagcagt

SEQ ID NO: 88608 - DNA, 25 bp, Mus musculus
catgaaaggctactgctccgaggct

SEQ ID NO: 88609 - DNA, 25 bp, Mus musculus
catgaaaggttgtctgttgctggaa

SEQ ID NO: 88610 - DNA, 25 bp, Mus musculus
catgaacaagaagagtgggaggcct

SEQ ID NO: 88611 - DNA, 25 bp, Mus musculus
catgaacaatgtgaccctgggcaat

SEQ ID NO: 88612 - DNA, 25 bp, Mus musculus
catgaacaccaagacaatgggacac

SEQ ID NO: 88613 - DNA, 25 bp, Mus musculus
catgaacaccaatgtctgcgtggag

SEQ ID NO: 88614 - DNA, 25 bp, Mus musculus
catgaacagatttcccacaagaggg

SEQ ID NO: 88615 - DNA, 25 bp, Mus musculus
catgaacagctatagctcggaagga

SEQ ID NO: 88616 - DNA, 25 bp, Mus musculus
catgaacagtttatcgtacgagaag

SEQ ID NO: 88617 - DNA, 25 bp, Mus musculus
catgaacattgtaagtgccttcccc

SEQ ID NO: 88618 - DNA, 25 bp, Mus musculus
catgaaccagcctaacagaggtccc

SEQ ID NO: 88619 - DNA, 25 bp, Mus musculus
catgaaccccttctgtgagattgca

SEQ ID NO: 88620 - DNA, 25 bp, Mus musculus
catgaacccttcaggcatgggagga

SEQ ID NO: 88621 - DNA, 25 bp, Mus musculus
catgaaccgcatggagatcttccgg

SEQ ID NO: 88622 - DNA, 25 bp, Mus musculus
catgaacctgtttgccacctgggag

SEQ ID NO: 88623 - DNA, 25 bp, Mus musculus
catgaaccttcacccaaggctgtgt

SEQ ID NO: 88624 - DNA, 25 bp, Mus musculus
catgaacctttagtcttcagccatg

SEQ ID NO: 88625 - DNA, 25 bp, Mus musculus
catgaacgagctgggtgtgaccgtc

SEQ ID NO: 88626 - DNA, 25 bp, Mus musculus
catgaacgcttcctgatagatggac

SEQ ID NO: 88627 - DNA, 25 bp, Mus musculus
catgaacggcgggacctgtgcagac

SEQ ID NO: 88628 - DNA, 25 bp, Mus musculus
catgaacggttacactgaagcctgg

SEQ ID NO: 88629 - DNA, 25 bp, Mus musculus
catgaactatgtagggcagctggca

SEQ ID NO: 88630 - DNA, 25 bp, Mus musculus
catgaactccaaccacaatattcgg

SEQ ID NO: 88631 - DNA, 25 bp, Mus musculus
catgaactgagaaggcgattcgaga

SEQ ID NO: 88632 - DNA, 25 bp, Mus musculus
catgaactggcaccaaatgtgttta

SEQ ID NO: 88633 - DNA, 25 bp, Mus musculus
catgaacttatctgtattagaaaag

SEQ ID NO: 88634 - DNA, 25 bp, Mus musculus
catgaacttcgttggctgaactccg

SEQ ID NO: 88635 - DNA, 25 bp, Mus musculus
catgaacttgtacattgaagatagc

SEQ ID NO: 88636 - DNA, 25 bp, Mus musculus
catgaacttgtggagctggcctgcc

SEQ ID NO: 88637 - DNA, 25 bp, Mus musculus
catgaactttgcttagtaccctggc

SEQ ID NO: 88638 - DNA, 25 bp, Mus musculus
catgaagaacattgccagtgacact

SEQ ID NO: 88639 - DNA, 25 bp, Mus musculus
catgaagaaccgaatccctgtggtg

SEQ ID NO: 88640 - DNA, 25 bp, Mus musculus
catgaagaactgcaaccgaggagcc

SEQ ID NO: 88641 - DNA, 25 bp, Mus musculus
catgaagaaggagatatgcaatgcc

SEQ ID NO: 88642 - DNA, 25 bp, Mus musculus
catgaagacaacagtaccagcggct

SEQ ID NO: 88643 - DNA, 25 bp, Mus musculus
catgaagaggtacactgctgaggac

SEQ ID NO: 88644 - DNA, 25 bp, Mus musculus
catgaagatcttactcaaagttggg

SEQ ID NO: 88645 - DNA, 25 bp, Mus musculus
catgaagatctttgtggacacggac

SEQ ID NO: 88646 - DNA, 25 bp, Mus musculus
catgaagatgaagtagaccgcgtgc

SEQ ID NO: 88647 - DNA, 25 bp, Mus musculus
catgaagatgaccataactttgagc

SEQ ID NO: 88648 - DNA, 25 bp, Mus musculus
catgaagatggacgaggttctgtac

SEQ ID NO: 88649 - DNA, 25 bp, Mus musculus
catgaagatgtgaagaaggcgctgc

SEQ ID NO: 88650 - DNA, 25 bp, Mus musculus
catgaagatttctcgttttgaaagg

SEQ ID NO: 88651 - DNA, 25 bp, Mus musculus
catgaagcaatcctgtgtcctccga

SEQ ID NO: 88652 - DNA, 25 bp, Mus musculus
catgaagcacttggtagcagcctgg

SEQ ID NO: 88653 - DNA, 25 bp, Mus musculus
catgaagcagaagaaacgcgagcga

SEQ ID NO: 88654 - DNA, 25 bp, Mus musculus
catgaagcccaattctacggactca

SEQ ID NO: 88655 - DNA, 25 bp, Mus musculus
catgaagctatggagatgccgccgg

SEQ ID NO: 88656 - DNA, 25 bp, Mus musculus
catgaagctgacaccacggagaatc

SEQ ID NO: 88657 - DNA, 25 bp, Mus musculus
catgaagctggagctcgatgccctg

SEQ ID NO: 88658 - DNA, 25 bp, Mus musculus
catgaagctggtgaagccctttcga

SEQ ID NO: 88659 - DNA, 25 bp, Mus musculus
catgaagctgttgtccgacggacga

SEQ ID NO: 88660 - DNA, 25 bp, Mus musculus
catgaagcttgtgctccggtggtac

SEQ ID NO: 88661 - DNA, 25 bp, Mus musculus
catgaaggacaagcgtcagcggctg

SEQ ID NO: 88662 - DNA, 25 bp, Mus musculus
catgaaggctgttcgtaataaccgc

SEQ ID NO: 88663 - DNA, 25 bp, Mus musculus
catgaagggaggacaacaaaacggc

SEQ ID NO: 88664 - DNA, 25 bp, Mus musculus
catgaaggtcattccagccgtgagc

SEQ ID NO: 88665 - DNA, 25 bp, Mus musculus
catgaaggtgctaaagccctggacg

SEQ ID NO: 88666 - DNA, 25 bp, Mus musculus
catgaagtactcagagctggctaca

SEQ ID NO: 88667 - DNA, 25 bp, Mus musculus
catgaagtgaaccttgcttcgccta

SEQ ID NO: 88668 - DNA, 25 bp, Mus musculus
catgaagtgggccatgccctaggac

SEQ ID NO: 88669 - DNA, 25 bp, Mus musculus
catgaagtgttccagcgatggtgac

SEQ ID NO: 88670 - DNA, 25 bp, Mus musculus
catgaagtttgtggctgcgctctcc

SEQ ID NO: 88671 - DNA, 25 bp, Mus musculus
catgaataaaaacttggctgctgct

SEQ ID NO: 88672 - DNA, 25 bp, Mus musculus
catgaataccgggtgtgccagctgc

SEQ ID NO: 88673 - DNA, 25 bp, Mus musculus
catgaataggttgaacacgctgcct

SEQ ID NO: 88674 - DNA, 25 bp, Mus musculus
catgaatatacggaagcccctctgt

SEQ ID NO: 88675 - DNA, 25 bp, Mus musculus
catgaatgacgatcctgctatggtg

SEQ ID NO: 88676 - DNA, 25 bp, Mus musculus
catgaatgaggaatacgacgtgatc

SEQ ID NO: 88677 - DNA, 25 bp, Mus musculus
catgaatggcttcctgccactgtgg

SEQ ID NO: 88678 - DNA, 25 bp, Mus musculus
catgaatgtgtgagggaactcgcca

SEQ ID NO: 88679 - DNA, 25 bp, Mus musculus
catgaattcccttatgagctaccgg

SEQ ID NO: 88680 - DNA, 25 bp, Mus musculus
catgaatttgaagcaactctgggtg

SEQ ID NO: 88681 - DNA, 25 bp, Mus musculus
catgacaactgcgacaaaatacggg

SEQ ID NO: 88682 - DNA, 25 bp, Mus musculus
catgacaatgatcagccgcagggac

SEQ ID NO: 88683 - DNA, 25 bp, Mus musculus
catgacaccatcagggccaggttgg

SEQ ID NO: 88684 - DNA, 25 bp, Mus musculus
catgacacctgcctctaatacacag

SEQ ID NO: 88685 - DNA, 25 bp, Mus musculus
catgacagagctataaggaggagaa

SEQ ID NO: 88686 - DNA, 25 bp, Mus musculus
catgacagagctggtgtcctccagg

SEQ ID NO: 88687 - DNA, 25 bp, Mus musculus
catgacagaggacacaacggatgct

SEQ ID NO: 88688 - DNA, 25 bp, Mus musculus
catgacagcaaaaagagcacccgac

SEQ ID NO: 88689 - DNA, 25 bp, Mus musculus
catgacagtccattgctgagaactt

SEQ ID NO: 88690 - DNA, 25 bp, Mus musculus
catgacagtggtgacggtcaaggcc

SEQ ID NO: 88691 - DNA, 25 bp, Mus musculus
catgacatacgagaagctcagccgg

SEQ ID NO: 88692 - DNA, 25 bp, Mus musculus
catgacatcgagacgccttatggac

SEQ ID NO: 88693 - DNA, 25 bp, Mus musculus
catgacatgcggtaccaaaagctga

SEQ ID NO: 88694 - DNA, 25 bp, Mus musculus
catgacatttgctgaggacaagacc

SEQ ID NO: 88695 - DNA, 25 bp, Mus musculus
catgaccatgaagagccatcaggct

SEQ ID NO: 88696 - DNA, 25 bp, Mus musculus
catgaccatgattcccagtgaggag

SEQ ID NO: 88697 - DNA, 25 bp, Mus musculus
catgacccacgtgttggcaggaggc

SEQ ID NO: 88698 - DNA, 25 bp, Mus musculus
catgaccccttgttaattcctggca

SEQ ID NO: 88699 - DNA, 25 bp, Mus musculus
catgacccgggctgaaatgatcctt

SEQ ID NO: 88700 - DNA, 25 bp, Mus musculus
catgaccctgagcagatttgcttac

SEQ ID NO: 88701 - DNA, 25 bp, Mus musculus
catgaccgagcagaaaatacccagt

SEQ ID NO: 88702 - DNA, 25 bp, Mus musculus
catgaccgagctagtggatccgtgg

SEQ ID NO: 88703 - DNA, 25 bp, Mus musculus
catgacctgatgatgtttgccggcc

SEQ ID NO: 88704 - DNA, 25 bp, Mus musculus
catgacctgcccgagactagtggaa

SEQ ID NO: 88705 - DNA, 25 bp, Mus musculus
catgacctggagctactgagaaagc

SEQ ID NO: 88706 - DNA, 25 bp, Mus musculus
catgaccttagcagacattgagcgg

SEQ ID NO: 88707 - DNA, 25 bp, Mus musculus
catgaccttcactaccactttacgg

SEQ ID NO: 88708 - DNA, 25 bp, Mus musculus
catgaccttgctgggctgctgagca

SEQ ID NO: 88709 - DNA, 25 bp, Mus musculus
catgacgaacatccaagggctgtgt

SEQ ID NO: 88710 - DNA, 25 bp, Mus musculus
catgacgacggcaacttcttcccag

SEQ ID NO: 88711 - DNA, 25 bp, Mus musculus
catgacggacatgctggacagacgg

SEQ ID NO: 88712 - DNA, 25 bp, Mus musculus
catgacgtcacagatcacggtggac

SEQ ID NO: 88713 - DNA, 25 bp, Mus musculus
catgacgtccgacctgaggaccagg

SEQ ID NO: 88714 - DNA, 25 bp, Mus musculus
catgacgtggttgaactttgtccga

SEQ ID NO: 88715 - DNA, 25 bp, Mus musculus
catgactacagggaccgtgaagctc

SEQ ID NO: 88716 - DNA, 25 bp, Mus musculus
catgactacctgaccaatggaaacc

SEQ ID NO: 88717 - DNA, 25 bp, Mus musculus
catgactactcaggcgttaggaagg

SEQ ID NO: 88718 - DNA, 25 bp, Mus musculus
catgactagtcctgcgaggcttgga

SEQ ID NO: 88719 - DNA, 25 bp, Mus musculus
catgactagtcggatcccagaagcg

SEQ ID NO: 88720 - DNA, 25 bp, Mus musculus
catgactcgaacattaagcttcagg

SEQ ID NO: 88721 - DNA, 25 bp, Mus musculus
catgactcgctgctgggactacgac

SEQ ID NO: 88722 - DNA, 25 bp, Mus musculus
catgactgaacgctttgactgccac

SEQ ID NO: 88723 - DNA, 25 bp, Mus musculus
catgactgactggatgtcgggagcc

SEQ ID NO: 88724 - DNA, 25 bp, Mus musculus
catgactgcaggtgcaactggtgca

SEQ ID NO: 88725 - DNA, 25 bp, Mus musculus
catgactgtcaagaagatcgcgatc

SEQ ID NO: 88726 - DNA, 25 bp, Mus musculus
catgactgtggtagatgcagcttca

SEQ ID NO: 88727 - DNA, 25 bp, Mus musculus
catgacttacattccactgctggga

SEQ ID NO: 88728 - DNA, 25 bp, Mus musculus
catgacttcaaaagaccacacagag

SEQ ID NO: 88729 - DNA, 25 bp, Mus musculus
catgacttcagaatgtgccaggctt

SEQ ID NO: 88730 - DNA, 25 bp, Mus musculus
catgacttccgctggactgacggca

SEQ ID NO: 88731 - DNA, 25 bp, Mus musculus
catgacttcgagcaggtccagcgtc

SEQ ID NO: 88732 - DNA, 25 bp, Mus musculus
catgactttgggtgcaaaagccgaa

SEQ ID NO: 88733 - DNA, 25 bp, Mus musculus
catgagaaaaaagcagcatcgtagg

SEQ ID NO: 88734 - DNA, 25 bp, Mus musculus
catgagaaactgaatgccagcaggg

SEQ ID NO: 88735 - DNA, 25 bp, Mus musculus
catgagaaccggaagaacacgctcc

SEQ ID NO: 88736 - DNA, 25 bp, Mus musculus
catgagaactcaggacatcaagtac

SEQ ID NO: 88737 - DNA, 25 bp, Mus musculus
catgagaagcggtatctccgggcac

SEQ ID NO: 88738 - DNA, 25 bp, Mus musculus
catgagaagtggaaccgtcttctgc

SEQ ID NO: 88739 - DNA, 25 bp, Mus musculus
catgagaagtttgagcacctgaagc

SEQ ID NO: 88740 - DNA, 25 bp, Mus musculus
catgagaccactaagcttgagattg

SEQ ID NO: 88741 - DNA, 25 bp, Mus musculus
catgagaccccaggagtgctgtgta

SEQ ID NO: 88742 - DNA, 25 bp, Mus musculus
catgagactccagggatcacgggta

SEQ ID NO: 88743 - DNA, 25 bp, Mus musculus
catgagagacggcttcagaagaaag

SEQ ID NO: 88744 - DNA, 25 bp, Mus musculus
catgagagcacttgtggcccagtta

SEQ ID NO: 88745 - DNA, 25 bp, Mus musculus
catgagaggtggttacatcgggtcc

SEQ ID NO: 88746 - DNA, 25 bp, Mus musculus
catgagatacttcgatagagctgcc

SEQ ID NO: 88747 - DNA, 25 bp, Mus musculus
catgagatgaagaagcgaggaccta

SEQ ID NO: 88748 - DNA, 25 bp, Mus musculus
catgagatgctagcacacagggcag

SEQ ID NO: 88749 - DNA, 25 bp, Mus musculus
catgagatgtttgctgctcgaggag

SEQ ID NO: 88750 - DNA, 25 bp, Mus musculus
catgagcaccgtcatgcagctgcag

SEQ ID NO: 88751 - DNA, 25 bp, Mus musculus
catgagcagaagcaaacgtgacaac

SEQ ID NO: 88752 - DNA, 25 bp, Mus musculus
catgagcagattgagcgcgttgtcc

SEQ ID NO: 88753 - DNA, 25 bp, Mus musculus
catgagcagggagagtggatcatca

SEQ ID NO: 88754 - DNA, 25 bp, Mus musculus
catgagcaggtgtgccaaggatctc

SEQ ID NO: 88755 - DNA, 25 bp, Mus musculus
catgagcatcaacacgcacttgggc

SEQ ID NO: 88756 - DNA, 25 bp, Mus musculus
catgagcatctctcgctgatatccg

SEQ ID NO: 88757 - DNA, 25 bp, Mus musculus
catgagccctgtgtcacgttaagga

SEQ ID NO: 88758 - DNA, 25 bp, Mus musculus
catgagcctcttgggaaaagctggg

SEQ ID NO: 88759 - DNA, 25 bp, Mus musculus
catgagcgcggacggcaagatatac

SEQ ID NO: 88760 - DNA, 25 bp, Mus musculus
catgagcgctttccctttgaactgg

SEQ ID NO: 88761 - DNA, 25 bp, Mus musculus
catgagcggaagtttggtccccggc

SEQ ID NO: 88762 - DNA, 25 bp, Mus musculus
catgagcgtcctctttgtgacaaac

SEQ ID NO: 88763 - DNA, 25 bp, Mus musculus
catgagctatcagcagccacagctg

SEQ ID NO: 88764 - DNA, 25 bp, Mus musculus
catgagctgctctgtgataaacccg

SEQ ID NO: 88765 - DNA, 25 bp, Mus musculus
catgagctgtacaacacggagagcg

SEQ ID NO: 88766 - DNA, 25 bp, Mus musculus
catgagctttcgaggctttcctagg

SEQ ID NO: 88767 - DNA, 25 bp, Mus musculus
catgaggaacaattgctgcagcgcc

SEQ ID NO: 88768 - DNA, 25 bp, Mus musculus
catgaggaacacagagggatgctaa

SEQ ID NO: 88769 - DNA, 25 bp, Mus musculus
catgaggaagcagagccgggtgtat

SEQ ID NO: 88770 - DNA, 25 bp, Mus musculus
catgaggacgcgagcgaaatagacc

SEQ ID NO: 88771 - DNA, 25 bp, Mus musculus
catgaggacggctattcagaggacg

SEQ ID NO: 88772 - DNA, 25 bp, Mus musculus
catgaggactccctgagtggctcgt

SEQ ID NO: 88773 - DNA, 25 bp, Mus musculus
catgaggcctggagtcttggtcacc

SEQ ID NO: 88774 - DNA, 25 bp, Mus musculus
catgaggctggcacagatgagtctg

SEQ ID NO: 88775 - DNA, 25 bp, Mus musculus
catgaggctgggttcagcaattctc

SEQ ID NO: 88776 - DNA, 25 bp, Mus musculus
catgaggctgtgttgaagtgactta

SEQ ID NO: 88777 - DNA, 25 bp, Mus musculus
catgagggctacgtccatgcagacc

SEQ ID NO: 88778 - DNA, 25 bp, Mus musculus
catgagggtcatatcaccagcgata

SEQ ID NO: 88779 - DNA, 25 bp, Mus musculus
catgaggtcatacgctgtctgcagc

SEQ ID NO: 88780 - DNA, 25 bp, Mus musculus
catgaggtctacagttacggtttcc

SEQ ID NO: 88781 - DNA, 25 bp, Mus musculus
catgaggtgtccttaaatgggttcc

SEQ ID NO: 88782 - DNA, 25 bp, Mus musculus
catgaggttacgatttaacgtggcc

SEQ ID NO: 88783 - DNA, 25 bp, Mus musculus
catgaggttttacgacagaggaaga

SEQ ID NO: 88784 - DNA, 25 bp, Mus musculus
catgagtaatgagggatggcgtcca

SEQ ID NO: 88785 - DNA, 25 bp, Mus musculus
catgagtccctgtgagaagtaccga

SEQ ID NO: 88786 - DNA, 25 bp, Mus musculus
catgagtctgcaggagttcacgagg

SEQ ID NO: 88787 - DNA, 25 bp, Mus musculus
catgagtgagaacgcagacctgaag

SEQ ID NO: 88788 - DNA, 25 bp, Mus musculus
catgagtgccctggagtgccagtac

SEQ ID NO: 88789 - DNA, 25 bp, Mus musculus
catgagtgctataagccgaggctgc

SEQ ID NO: 88790 - DNA, 25 bp, Mus musculus
catgagttcgtcacgttctcctgcc

SEQ ID NO: 88791 - DNA, 25 bp, Mus musculus
catgagtttcccagccccaagtggg

SEQ ID NO: 88792 - DNA, 25 bp, Mus musculus
catgagtttgagtcactggtacgcc

SEQ ID NO: 88793 - DNA, 25 bp, Mus musculus
catgagttttgaagatcctctaaga

SEQ ID NO: 88794 - DNA, 25 bp, Mus musculus
catgataaagaacaaaccggccagt

SEQ ID NO: 88795 - DNA, 25 bp, Mus musculus
catgataactcatattgtaaaccaa

SEQ ID NO: 88796 - DNA, 25 bp, Mus musculus
catgatacggagcaagaacactaac

SEQ ID NO: 88797 - DNA, 25 bp, Mus musculus
catgatactgatgcaaggtcctgga

SEQ ID NO: 88798 - DNA, 25 bp, Mus musculus
catgatagaggtggaggctccgatc

SEQ ID NO: 88799 - DNA, 25 bp, Mus musculus
catgatatacgaccccagttggcac

SEQ ID NO: 88800 - DNA, 25 bp, Mus musculus
catgatcaaacccatgttcagagcc

SEQ ID NO: 88801 - DNA, 25 bp, Mus musculus
catgatccagactcagcagttgtgg

SEQ ID NO: 88802 - DNA, 25 bp, Mus musculus
catgatccaggcgtctctgccagag

SEQ ID NO: 88803 - DNA, 25 bp, Mus musculus
catgatcccaactttgtccctgctg

SEQ ID NO: 88804 - DNA, 25 bp, Mus musculus
catgatcctgcaagcagagacttgg

SEQ ID NO: 88805 - DNA, 25 bp, Mus musculus
catgatcgagaacctcaagagggcc

SEQ ID NO: 88806 - DNA, 25 bp, Mus musculus
catgatcgccatgctcacagtgctg

SEQ ID NO: 88807 - DNA, 25 bp, Mus musculus
catgatgaaacttcccgcacgcgtt

SEQ ID NO: 88808 - DNA, 25 bp, Mus musculus
catgatgactgctttgggctgagaa

SEQ ID NO: 88809 - DNA, 25 bp, Mus musculus
catgatgaggcctgcattgccgggc

SEQ ID NO: 88810 - DNA, 25 bp, Mus musculus
catgatgatgcgagcagagaacttc

SEQ ID NO: 88811 - DNA, 25 bp, Mus musculus
catgatgcacagctacagaggtaca

SEQ ID NO: 88812 - DNA, 25 bp, Mus musculus
catgatgcacatggtttgcggtacc

SEQ ID NO: 88813 - DNA, 25 bp, Mus musculus
catgatgccaagagcggaaaagccc

SEQ ID NO: 88814 - DNA, 25 bp, Mus musculus
catgatgccaagaggaagacagagc

SEQ ID NO: 88815 - DNA, 25 bp, Mus musculus
catgatgcccacgatgaccagaggg

SEQ ID NO: 88816 - DNA, 25 bp, Mus musculus
catgatgcccaggagatcctgcgga

SEQ ID NO: 88817 - DNA, 25 bp, Mus musculus
catgatgcccgaagtcctctttagg

SEQ ID NO: 88818 - DNA, 25 bp, Mus musculus
catgatgccctgatcctcgatgtgg

SEQ ID NO: 88819 - DNA, 25 bp, Mus musculus
catgatgcgaactgccaagggtgat

SEQ ID NO: 88820 - DNA, 25 bp, Mus musculus
catgatgcgaagtcacctgcaagca

SEQ ID NO: 88821 - DNA, 25 bp, Mus musculus
catgatgctctggtttgcagcaaaa

SEQ ID NO: 88822 - DNA, 25 bp, Mus musculus
catgatggcactgcctggaggccgc

SEQ ID NO: 88823 - DNA, 25 bp, Mus musculus
catgatggcatcgattctctccgca

SEQ ID NO: 88824 - DNA, 25 bp, Mus musculus
catgatggcgtatgcggataatttc

SEQ ID NO: 88825 - DNA, 25 bp, Mus musculus
catgatgggacagccgagagcaatt

SEQ ID NO: 88826 - DNA, 25 bp, Mus musculus
catgatgggcgtatatgcaccaacc

SEQ ID NO: 88827 - DNA, 25 bp, Mus musculus
catgatggtgattttcgggttcccc

SEQ ID NO: 88828 - DNA, 25 bp, Mus musculus
catgatgtccgctgcaatgggagct

SEQ ID NO: 88829 - DNA, 25 bp, Mus musculus
catgatgtctgttaccggtgtctcc

SEQ ID NO: 88830 - DNA, 25 bp, Mus musculus
catgatgtgaagatctgggcgccga

SEQ ID NO: 88831 - DNA, 25 bp, Mus musculus
catgatgtgatcagttcggaggcca

SEQ ID NO: 88832 - DNA, 25 bp, Mus musculus
catgatgtgcaagaacctgatcggc

SEQ ID NO: 88833 - DNA, 25 bp, Mus musculus
catgatgtggacatacaggcagcat

SEQ ID NO: 88834 - DNA, 25 bp, Mus musculus
catgatgtgggcctttttggcgtcc

SEQ ID NO: 88835 - DNA, 25 bp, Mus musculus
catgatgtgtgcagagagcaaccgc

SEQ ID NO: 88836 - DNA, 25 bp, Mus musculus
catgatgttctgcacctggtagagc

SEQ ID NO: 88837 - DNA, 25 bp, Mus musculus
catgatgttggtgaaacagtcccga

SEQ ID NO: 88838 - DNA, 25 bp, Mus musculus
catgatgtttggctacctggcggac

SEQ ID NO: 88839 - DNA, 25 bp, Mus musculus
catgattaagaacctagcttctggg

SEQ ID NO: 88840 - DNA, 25 bp, Mus musculus
catgattcgagaggtggctggccaa

SEQ ID NO: 88841 - DNA, 25 bp, Mus musculus
catgattgcatcagagacctgggcc

SEQ ID NO: 88842 - DNA, 25 bp, Mus musculus
catgattgcatttctcctgggaaga

SEQ ID NO: 88843 - DNA, 25 bp, Mus musculus
catgattgcttatggcacccagcga

SEQ ID NO: 88844 - DNA, 25 bp, Mus musculus
catgattggcgtgggccttttcacc

SEQ ID NO: 88845 - DNA, 25 bp, Mus musculus
catgattggtgaagaggtgccgcct

SEQ ID NO: 88846 - DNA, 25 bp, Mus musculus
catgcaaaaaatcttcgcccgggaa

SEQ ID NO: 88847 - DNA, 25 bp, Mus musculus
catgcaaaggccaagatcatgtcct

SEQ ID NO: 88848 - DNA, 25 bp, Mus musculus
catgcaaccgctggtgggagccatt

SEQ ID NO: 88849 - DNA, 25 bp, Mus musculus
catgcaacctatgtgtcttgggcaa

SEQ ID NO: 88850 - DNA, 25 bp, Mus musculus
catgcaacctgctgaactggtggac

SEQ ID NO: 88851 - DNA, 25 bp, Mus musculus
catgcaaggtccaaacctcagcaac

SEQ ID NO: 88852 - DNA, 25 bp, Mus musculus
catgcaagtcgtcctggctagaaag

SEQ ID NO: 88853 - DNA, 25 bp, Mus musculus
catgcaagtgctatttcccggagta

SEQ ID NO: 88854 - DNA, 25 bp, Mus musculus
catgcaatggcgagcgcttgtcctg

SEQ ID NO: 88855 - DNA, 25 bp, Mus musculus
catgcaattgtctgggaagctgtca

SEQ ID NO: 88856 - DNA, 25 bp, Mus musculus
catgcacaagcggtcagcatcgtgg

SEQ ID NO: 88857 - DNA, 25 bp, Mus musculus
catgcacagctttgtttccacgggc

SEQ ID NO: 88858 - DNA, 25 bp, Mus musculus
catgcacatcagtggagtgttcgcc

SEQ ID NO: 88859 - DNA, 25 bp, Mus musculus
catgcacctgtgaccttgaaccagc

SEQ ID NO: 88860 - DNA, 25 bp, Mus musculus
catgcacgatatcactgtccagagc

SEQ ID NO: 88861 - DNA, 25 bp, Mus musculus
catgcacgcctaccattgtgagaag

SEQ ID NO: 88862 - DNA, 25 bp, Mus musculus
catgcacggtaaaggaaaccacttt

SEQ ID NO: 88863 - DNA, 25 bp, Mus musculus
catgcacgtgtggaagaccttctcc

SEQ ID NO: 88864 - DNA, 25 bp, Mus musculus
catgcactgatgctgtgaagcctgc

SEQ ID NO: 88865 - DNA, 25 bp, Mus musculus
catgcactttactatcgctgagggc

SEQ ID NO: 88866 - DNA, 25 bp, Mus musculus
catgcagataactgtgctggtccag

SEQ ID NO: 88867 - DNA, 25 bp, Mus musculus
catgcagatcgtgatggacaagggc

SEQ ID NO: 88868 - DNA, 25 bp, Mus musculus
catgcagcagaggatcggtgagatt

SEQ ID NO: 88869 - DNA, 25 bp, Mus musculus
catgcagccaggatacgtggcggac

SEQ ID NO: 88870 - DNA, 25 bp, Mus musculus
catgcagccatagggtcaatcgtgg

SEQ ID NO: 88871 - DNA, 25 bp, Mus musculus
catgcagcctatagaaaatacacag

SEQ ID NO: 88872 - DNA, 25 bp, Mus musculus
catgcagcgccagtacatggagcgg

SEQ ID NO: 88873 - DNA, 25 bp, Mus musculus
catgcagcgcgggtgaagcttttac

SEQ ID NO: 88874 - DNA, 25 bp, Mus musculus
catgcagctcattccgcagcagttg

SEQ ID NO: 88875 - DNA, 25 bp, Mus musculus
catgcagctgcatccctgagagtgg

SEQ ID NO: 88876 - DNA, 25 bp, Mus musculus
catgcagctgcgcaagatcagggac

SEQ ID NO: 88877 - DNA, 25 bp, Mus musculus
catgcaggaaataatcgccagcgta

SEQ ID NO: 88878 - DNA, 25 bp, Mus musculus
catgcaggacagctttgctcgggca

SEQ ID NO: 88879 - DNA, 25 bp, Mus musculus
catgcaggccgggtttatggcagtt

SEQ ID NO: 88880 - DNA, 25 bp, Mus musculus
catgcaggctgtttgacctccgtgc

SEQ ID NO: 88881 - DNA, 25 bp, Mus musculus
catgcagggagctagagacgtgaca

SEQ ID NO: 88882 - DNA, 25 bp, Mus musculus
catgcagggtacaagggtgatccaa

SEQ ID NO: 88883 - DNA, 25 bp, Mus musculus
catgcaggtgccatactgaggtctg

SEQ ID NO: 88884 - DNA, 25 bp, Mus musculus
catgcagtatgaccgagctgtgacg

SEQ ID NO: 88885 - DNA, 25 bp, Mus musculus
catgcagtcgctcttcaagccaggg

SEQ ID NO: 88886 - DNA, 25 bp, Mus musculus
catgcagtgtgttccgagcgggctt

SEQ ID NO: 88887 - DNA, 25 bp, Mus musculus
catgcagttcttgttcacgaaggac

SEQ ID NO: 88888 - DNA, 25 bp, Mus musculus
catgcagtttgtcaacgtgggctac

SEQ ID NO: 88889 - DNA, 25 bp, Mus musculus
catgcataatgaagtgccgccacct

SEQ ID NO: 88890 - DNA, 25 bp, Mus musculus
catgcatatggaggacagcacgcta

SEQ ID NO: 88891 - DNA, 25 bp, Mus musculus
catgcatcaatacagagggctccta

SEQ ID NO: 88892 - DNA, 25 bp, Mus musculus
catgcatcagctcttctctctggtg

SEQ ID NO: 88893 - DNA, 25 bp, Mus musculus
catgcatcggaccacacggattaaa

SEQ ID NO: 88894 - DNA, 25 bp, Mus musculus
catgcatcggagacttgtggttgga

SEQ ID NO: 88895 - DNA, 25 bp, Mus musculus
catgcatctgctggtgggtcgatac

SEQ ID NO: 88896 - DNA, 25 bp, Mus musculus
catgcatcttgctaatggacagacc

SEQ ID NO: 88897 - DNA, 25 bp, Mus musculus
catgcatgtagaggtgaaggacccg

SEQ ID NO: 88898 - DNA, 25 bp, Mus musculus
catgcatgttaaaagactcctgaat

SEQ ID NO: 88899 - DNA, 25 bp, Mus musculus
catgcattgcaaacacagtgtggcc

SEQ ID NO: 88900 - DNA, 25 bp, Mus musculus
catgcatttcccaactggttcccgg

SEQ ID NO: 88901 - DNA, 25 bp, Mus musculus
catgcatttgcaatccggagcttag

SEQ ID NO: 88902 - DNA, 25 bp, Mus musculus
catgccaaagggaggctaagacagc

SEQ ID NO: 88903 - DNA, 25 bp, Mus musculus
catgccaacacaaactgacgtcaag

SEQ ID NO: 88904 - DNA, 25 bp, Mus musculus
catgccagccattgtaagagttcca

SEQ ID NO: 88905 - DNA, 25 bp, Mus musculus
catgccaggccttgttgatacccac

SEQ ID NO: 88906 - DNA, 25 bp, Mus musculus
catgccattgtatgataggttctct

SEQ ID NO: 88907 - DNA, 25 bp, Mus musculus
catgcccacaggagaagcggtactg

SEQ ID NO: 88908 - DNA, 25 bp, Mus musculus
catgcccagataagggatgacctgc

SEQ ID NO: 88909 - DNA, 25 bp, Mus musculus
catgcccaggctagaaaatctcaag

SEQ ID NO: 88910 - DNA, 25 bp, Mus musculus
catgccccggaattgaagctgttct

SEQ ID NO: 88911 - DNA, 25 bp, Mus musculus
catgcccctcaaagtggttcagcca

SEQ ID NO: 88912 - DNA, 25 bp, Mus musculus
catgcccggaagtgcaatgagaccg

SEQ ID NO: 88913 - DNA, 25 bp, Mus musculus
catgcccggcaagaaggacgtaggt

SEQ ID NO: 88914 - DNA, 25 bp, Mus musculus
catgccgaagccacgattgttgtca

SEQ ID NO: 88915 - DNA, 25 bp, Mus musculus
catgccgacttgatctttgagccca

SEQ ID NO: 88916 - DNA, 25 bp, Mus musculus
catgccgaggttgtcgccagaatca

SEQ ID NO: 88917 - DNA, 25 bp, Mus musculus
catgccgcgggtgtccgaaatatcg

SEQ ID NO: 88918 - DNA, 25 bp, Mus musculus
catgccgcgtctctgaggttgcgtc

SEQ ID NO: 88919 - DNA, 25 bp, Mus musculus
catgccgttccaggttcaaggataa

SEQ ID NO: 88920 - DNA, 25 bp, Mus musculus
catgcctacctgctggaaatgagcc

SEQ ID NO: 88921 - DNA, 25 bp, Mus musculus
catgcctctgcagacgtggagaaga

SEQ ID NO: 88922 - DNA, 25 bp, Mus musculus
catgcctgcttggttcagaactctg

SEQ ID NO: 88923 - DNA, 25 bp, Mus musculus
catgcctggatagtgaacgttaaac

SEQ ID NO: 88924 - DNA, 25 bp, Mus musculus
catgcctggcatgatcagcagggcc

SEQ ID NO: 88925 - DNA, 25 bp, Mus musculus
catgcctgtataaggtgtgagagac

SEQ ID NO: 88926 - DNA, 25 bp, Mus musculus
catgcctgtgaaccaagccaagaca

SEQ ID NO: 88927 - DNA, 25 bp, Mus musculus
catgccttaggagttttcgccagcc

SEQ ID NO: 88928 - DNA, 25 bp, Mus musculus
catgcctttttcgtcgacctggaag

SEQ ID NO: 88929 - DNA, 25 bp, Mus musculus
catgcgaaattgtgcctgagccaca

SEQ ID NO: 88930 - DNA, 25 bp, Mus musculus
catgcgactactgactctggagggc

SEQ ID NO: 88931 - DNA, 25 bp, Mus musculus
catgcgccatcctttgaatgctgag

SEQ ID NO: 88932 - DNA, 25 bp, Mus musculus
catgcgccatgttcgagctgtccta

SEQ ID NO: 88933 - DNA, 25 bp, Mus musculus
catgcgcccttcgaaacggatatca

SEQ ID NO: 88934 - DNA, 25 bp, Mus musculus
catgcgccgggatgtacaggagatc

SEQ ID NO: 88935 - DNA, 25 bp, Mus musculus
catgcgcgggcggtgcggtcttaag

SEQ ID NO: 88936 - DNA, 25 bp, Mus musculus
catgcgctaccaacagaatcggctt

SEQ ID NO: 88937 - DNA, 25 bp, Mus musculus
catgcgctgcagaaatagggtggtc

SEQ ID NO: 88938 - DNA, 25 bp, Mus musculus
catgcggaaagagttcaccctggag

SEQ ID NO: 88939 - DNA, 25 bp, Mus musculus
catgcggccagggaagttgtctgac

SEQ ID NO: 88940 - DNA, 25 bp, Mus musculus
catgcgggctccacggtgtgataca

SEQ ID NO: 88941 - DNA, 25 bp, Mus musculus
catgcgggcttctcactttggtacc

SEQ ID NO: 88942 - DNA, 25 bp, Mus musculus
catgcgtacggcaggactatttcct

SEQ ID NO: 88943 - DNA, 25 bp, Mus musculus
catgcgtatggctgacttctggctc

SEQ ID NO: 88944 - DNA, 25 bp, Mus musculus
catgcgtcacggacagcactttgag

SEQ ID NO: 88945 - DNA, 25 bp, Mus musculus
catgcgtgtagggaataccggattc

SEQ ID NO: 88946 - DNA, 25 bp, Mus musculus
catgcgtgtatttaaagctcagccc

SEQ ID NO: 88947 - DNA, 25 bp, Mus musculus
catgcgttcgggaatagagtcgaga

SEQ ID NO: 88948 - DNA, 25 bp, Mus musculus
catgcgtttcactttcaatgagaga

SEQ ID NO: 88949 - DNA, 25 bp, Mus musculus
catgctaacgcacaccaacgagaag

SEQ ID NO: 88950 - DNA, 25 bp, Mus musculus
catgctacagatgttggcactgctg

SEQ ID NO: 88951 - DNA, 25 bp, Mus musculus
catgctaccagtggcagaatctgtg

SEQ ID NO: 88952 - DNA, 25 bp, Mus musculus
catgctacgtgaccagacaggaggt

SEQ ID NO: 88953 - DNA, 25 bp, Mus musculus
catgctactgttcagccggcaggga

SEQ ID NO: 88954 - DNA, 25 bp, Mus musculus
catgctagaggttagatgctggtcc

SEQ ID NO: 88955 - DNA, 25 bp, Mus musculus
catgctagggcaagaactgggaagt

SEQ ID NO: 88956 - DNA, 25 bp, Mus musculus
catgctcagtaatggtgtgaaccca

SEQ ID NO: 88957 - DNA, 25 bp, Mus musculus
catgctcattctgaaattccaggaa

SEQ ID NO: 88958 - DNA, 25 bp, Mus musculus
catgctcctgcgagaagatcaagga

SEQ ID NO: 88959 - DNA, 25 bp, Mus musculus
catgctcctggttgatgaccgcgca

SEQ ID NO: 88960 - DNA, 25 bp, Mus musculus
catgctcggtagctgcacagtgcgc

SEQ ID NO: 88961 - DNA, 25 bp, Mus musculus
catgctctatgtcctggctacgtgg

SEQ ID NO: 88962 - DNA, 25 bp, Mus musculus
catgctctcaaagaagacttccggg

SEQ ID NO: 88963 - DNA, 25 bp, Mus musculus
catgctctctgttacatttgggaag

SEQ ID NO: 88964 - DNA, 25 bp, Mus musculus
catgctctgaagatgacctggcacg

SEQ ID NO: 88965 - DNA, 25 bp, Mus musculus
catgctctgcttgggaatggcttta

SEQ ID NO: 88966 - DNA, 25 bp, Mus musculus
catgctctggatggacatggccatg

SEQ ID NO: 88967 - DNA, 25 bp, Mus musculus
catgctcttcgtgtatcctgggcca

SEQ ID NO: 88968 - DNA, 25 bp, Mus musculus
catgctgaacgagagctccgcaggg

SEQ ID NO: 88969 - DNA, 25 bp, Mus musculus
catgctgaagaagtacgtccgtgcg

SEQ ID NO: 88970 - DNA, 25 bp, Mus musculus
catgctgaagcaacgggactacgag

SEQ ID NO: 88971 - DNA, 25 bp, Mus musculus
catgctgacatctaccgctggttcg

SEQ ID NO: 88972 - DNA, 25 bp, Mus musculus
catgctgatgaaatatggagtcctc

SEQ ID NO: 88973 - DNA, 25 bp, Mus musculus
catgctgatgatgtgggtctcgttc

SEQ ID NO: 88974 - DNA, 25 bp, Mus musculus
catgctgcactcctgaactgtttgg

SEQ ID NO: 88975 - DNA, 25 bp, Mus musculus
catgctgccattgctaagtactttg

SEQ ID NO: 88976 - DNA, 25 bp, Mus musculus
catgctgccgttcttgctggccaca

SEQ ID NO: 88977 - DNA, 25 bp, Mus musculus
catgctgcgctgtgtggacttatcc

SEQ ID NO: 88978 - DNA, 25 bp, Mus musculus
catgctgctgctttagccctttaaa

SEQ ID NO: 88979 - DNA, 25 bp, Mus musculus
catgctggagagtattggcgtgccc

SEQ ID NO: 88980 - DNA, 25 bp, Mus musculus
catgctggaggacattcgtgaaaac

SEQ ID NO: 88981 - DNA, 25 bp, Mus musculus
catgctggccttagacagtcctgaa

SEQ ID NO: 88982 - DNA, 25 bp, Mus musculus
catgctgggagctatctgtgccatc

SEQ ID NO: 88983 - DNA, 25 bp, Mus musculus
catgctggggcatgcatattatgac

SEQ ID NO: 88984 - DNA, 25 bp, Mus musculus
catgctggtaggcagctttggccca

SEQ ID NO: 88985 - DNA, 25 bp, Mus musculus
catgctggtcatgacctgaaggaaa

SEQ ID NO: 88986 - DNA, 25 bp, Mus musculus
catgctggtcctcgaatccctggaa

SEQ ID NO: 88987 - DNA, 25 bp, Mus musculus
catgctgtaatgacacccaaggccc

SEQ ID NO: 88988 - DNA, 25 bp, Mus musculus
catgctgtaccagtctcctgatcgt

SEQ ID NO: 88989 - DNA, 25 bp, Mus musculus
catgctgtcaaaggtggtccactcg

SEQ ID NO: 88990 - DNA, 25 bp, Mus musculus
catgctgtcaaagtggagttctcgc

SEQ ID NO: 88991 - DNA, 25 bp, Mus musculus
catgctgtccagaggagccctgaat

SEQ ID NO: 88992 - DNA, 25 bp, Mus musculus
catgctgtgtaaagacctggcctcg

SEQ ID NO: 88993 - DNA, 25 bp, Mus musculus
catgctgttagtcgtctggcccaaa

SEQ ID NO: 88994 - DNA, 25 bp, Mus musculus
catgcttacctgcagccaggtgcac

SEQ ID NO: 88995 - DNA, 25 bp, Mus musculus
catgcttaggagacttgggctggac

SEQ ID NO: 88996 - DNA, 25 bp, Mus musculus
catgcttcggccatctgcgtggaga

SEQ ID NO: 88997 - DNA, 25 bp, Mus musculus
catgcttcggtacatcaagaaaggc

SEQ ID NO: 88998 - DNA, 25 bp, Mus musculus
catgcttgcggatgtgttgaacact

SEQ ID NO: 88999 - DNA, 25 bp, Mus musculus
catgcttgggaaaagcaccccggga

SEQ ID NO: 89000 - DNA, 25 bp, Mus musculus
catgcttgtccgtccacatgcggct

SEQ ID NO: 89001 - DNA, 25 bp, Mus musculus
catgctttcaaagtggcagcccgcg

SEQ ID NO: 89002 - DNA, 25 bp, Mus musculus
catgctttctcaacaagagggagga

SEQ ID NO: 89003 - DNA, 25 bp, Mus musculus
catgcttttatgaccattgggcctg

SEQ ID NO: 89004 - DNA, 25 bp, Mus musculus
catggaaaaattggtggccacattc

SEQ ID NO: 89005 - DNA, 25 bp, Mus musculus
catggaaacggagagtgagcagaac

SEQ ID NO: 89006 - DNA, 25 bp, Mus musculus
catggaaagccctcggtgactcaag

SEQ ID NO: 89007 - DNA, 25 bp, Mus musculus
catggaaaggatgagcgactcggca

SEQ ID NO: 89008 - DNA, 25 bp, Mus musculus
catggaaatgaacaaggcggccact

SEQ ID NO: 89009 - DNA, 25 bp, Mus musculus
catggaaattgtcccgattggcaca

SEQ ID NO: 89010 - DNA, 25 bp, Mus musculus
catggaacaagcctccaagacggtc

SEQ ID NO: 89011 - DNA, 25 bp, Mus musculus
catggaacagcactacgaacttgga

SEQ ID NO: 89012 - DNA, 25 bp, Mus musculus
catggaacagtaaagaagaccttgc

SEQ ID NO: 89013 - DNA, 25 bp, Mus musculus
catggaacgtcaggcagctgccaat

SEQ ID NO: 89014 - DNA, 25 bp, Mus musculus
catggaactcatgggcaatgtggtc

SEQ ID NO: 89015 - DNA, 25 bp, Mus musculus
catggaactttaggctttgtagaag

SEQ ID NO: 89016 - DNA, 25 bp, Mus musculus
catggaagaactaggaattggatgc

SEQ ID NO: 89017 - DNA, 25 bp, Mus musculus
catggaagacgacgccccggtgatt

SEQ ID NO: 89018 - DNA, 25 bp, Mus musculus
catggaagagctgaccatctgggaa

SEQ ID NO: 89019 - DNA, 25 bp, Mus musculus
catggaagatacgataatgctcagc

SEQ ID NO: 89020 - DNA, 25 bp, Mus musculus
catggaagatgtctcccctggaacc

SEQ ID NO: 89021 - DNA, 25 bp, Mus musculus
catggaagcacaatgactcaggcgc

SEQ ID NO: 89022 - DNA, 25 bp, Mus musculus
catggaagcgtccagatccaggagc

SEQ ID NO: 89023 - DNA, 25 bp, Mus musculus
catggaagctcctgtcaaggtgatc

SEQ ID NO: 89024 - DNA, 25 bp, Mus musculus
catggaatcagagagcacccaggag

SEQ ID NO: 89025 - DNA, 25 bp, Mus musculus
catggaatcccgaggaaagtcagcc

SEQ ID NO: 89026 - DNA, 25 bp, Mus musculus
catggaatgtccaaaccagaggcca

SEQ ID NO: 89027 - DNA, 25 bp, Mus musculus
catggacaatctgctgctgactgag

SEQ ID NO: 89028 - DNA, 25 bp, Mus musculus
catggacacagacttaacagcagca

SEQ ID NO: 89029 - DNA, 25 bp, Mus musculus
catggacacgctagtagaagatgac

SEQ ID NO: 89030 - DNA, 25 bp, Mus musculus
catggacactctggtatttacgaaa

SEQ ID NO: 89031 - DNA, 25 bp, Mus musculus
catggacagcccattgacccggata

SEQ ID NO: 89032 - DNA, 25 bp, Mus musculus
catggacagctactggcatagccgc

SEQ ID NO: 89033 - DNA, 25 bp, Mus musculus
catggacagtgtgaagcagagtgcc

SEQ ID NO: 89034 - DNA, 25 bp, Mus musculus
catggacatagacgccgaacgagag

SEQ ID NO: 89035 - DNA, 25 bp, Mus musculus
catggacatgcctgaggtcctcaag

SEQ ID NO: 89036 - DNA, 25 bp, Mus musculus
catggacatgggtttcacaagagaa

SEQ ID NO: 89037 - DNA, 25 bp, Mus musculus
catggacatgtgttgagcctgcgca

SEQ ID NO: 89038 - DNA, 25 bp, Mus musculus
catggacattattaggaaacacgaa

SEQ ID NO: 89039 - DNA, 25 bp, Mus musculus
catggaccccagtgacatgatgcgg

SEQ ID NO: 89040 - DNA, 25 bp, Mus musculus
catggaccgggtgctgctcaaatac

SEQ ID NO: 89041 - DNA, 25 bp, Mus musculus
catggacctactagaggtagccacc

SEQ ID NO: 89042 - DNA, 25 bp, Mus musculus
catggacctggacacgctagctagg

SEQ ID NO: 89043 - DNA, 25 bp, Mus musculus
catggacctgttgtttgggcgccgg

SEQ ID NO: 89044 - DNA, 25 bp, Mus musculus
catggacgacaatggcacctacgag

SEQ ID NO: 89045 - DNA, 25 bp, Mus musculus
catggacgacattgaggtgtggctc

SEQ ID NO: 89046 - DNA, 25 bp, Mus musculus
catggacgacgcttctgacgagtac

SEQ ID NO: 89047 - DNA, 25 bp, Mus musculus
catggacgagcttgtggagcactac

SEQ ID NO: 89048 - DNA, 25 bp, Mus musculus
catggacgtcctcgtctgcaacggg

SEQ ID NO: 89049 - DNA, 25 bp, Mus musculus
catggactcggactgaagcaggaca

SEQ ID NO: 89050 - DNA, 25 bp, Mus musculus
catggactctgggagcaatggacac

SEQ ID NO: 89051 - DNA, 25 bp, Mus musculus
catggactgtccctataatctggcc

SEQ ID NO: 89052 - DNA, 25 bp, Mus musculus
catggactgtgttggctgcttcaag

SEQ ID NO: 89053 - DNA, 25 bp, Mus musculus
catggactttataagcccgcgttgc

SEQ ID NO: 89054 - DNA, 25 bp, Mus musculus
catggagaaaccgtggctgaagtcc

SEQ ID NO: 89055 - DNA, 25 bp, Mus musculus
catggagaacatggccattggcccc

SEQ ID NO: 89056 - DNA, 25 bp, Mus musculus
catggagaacatgggacctgagaat

SEQ ID NO: 89057 - DNA, 25 bp, Mus musculus
catggagaacccagatagacagccc

SEQ ID NO: 89058 - DNA, 25 bp, Mus musculus
catggagaacctgatcgagctgcac

SEQ ID NO: 89059 - DNA, 25 bp, Mus musculus
catggagagagtgttgaccaccacc

SEQ ID NO: 89060 - DNA, 25 bp, Mus musculus
catggagagctcgatgcagaactac

SEQ ID NO: 89061 - DNA, 25 bp, Mus musculus
catggagatgacttgattgtgaccc

SEQ ID NO: 89062 - DNA, 25 bp, Mus musculus
catggagatggagtcaagtgcccgc

SEQ ID NO: 89063 - DNA, 25 bp, Mus musculus
catggagccacacgtcaggtcaggc

SEQ ID NO: 89064 - DNA, 25 bp, Mus musculus
catggagccatttgatcctgcggag

SEQ ID NO: 89065 - DNA, 25 bp, Mus musculus
catggagccccaccacatgaatgga

SEQ ID NO: 89066 - DNA, 25 bp, Mus musculus
catggagccgcaaaaagaaaattct

SEQ ID NO: 89067 - DNA, 25 bp, Mus musculus
catggagcctgtcttcccaagggat

SEQ ID NO: 89068 - DNA, 25 bp, Mus musculus
catggagcgaatgtttcacaacccg

SEQ ID NO: 89069 - DNA, 25 bp, Mus musculus
catggagcgttggatcaaagagcac

SEQ ID NO: 89070 - DNA, 25 bp, Mus musculus
catggagctcatttggaacctgtgt

SEQ ID NO: 89071 - DNA, 25 bp, Mus musculus
catggagctctacaacttcgtgtgg

SEQ ID NO: 89072 - DNA, 25 bp, Mus musculus
catggagctgtcagccataggcgag

SEQ ID NO: 89073 - DNA, 25 bp, Mus musculus
catggaggacaaggcaacgctgatc

SEQ ID NO: 89074 - DNA, 25 bp, Mus musculus
catggaggacttggtgatagcgcac

SEQ ID NO: 89075 - DNA, 25 bp, Mus musculus
catggaggaggctacatgaatgctg

SEQ ID NO: 89076 - DNA, 25 bp, Mus musculus
catggaggagtacgctcgcgaacct

SEQ ID NO: 89077 - DNA, 25 bp, Mus musculus
catggagggaacagctggtcaaaac

SEQ ID NO: 89078 - DNA, 25 bp, Mus musculus
catggagggacgcacaaggtatttc

SEQ ID NO: 89079 - DNA, 25 bp, Mus musculus
catggagggttcctgtttattacac

SEQ ID NO: 89080 - DNA, 25 bp, Mus musculus
catggaggtgaaaaaggagtgcctt

SEQ ID NO: 89081 - DNA, 25 bp, Mus musculus
catggaggtgaagagaactgacgac

SEQ ID NO: 89082 - DNA, 25 bp, Mus musculus
catggagtacccttttgcctaatat

SEQ ID NO: 89083 - DNA, 25 bp, Mus musculus
catggagtcccaggcatctgagaat

SEQ ID NO: 89084 - DNA, 25 bp, Mus musculus
catggagtcgttggacacaagggcc

SEQ ID NO: 89085 - DNA, 25 bp, Mus musculus
catggagtttcctgcaggctgtgaa

SEQ ID NO: 89086 - DNA, 25 bp, Mus musculus
catggataaggtgaccgtgccctct

SEQ ID NO: 89087 - DNA, 25 bp, Mus musculus
catggatatcgcaaaccgtgggaga

SEQ ID NO: 89088 - DNA, 25 bp, Mus musculus
catggatatgagtgactgagcccaa

SEQ ID NO: 89089 - DNA, 25 bp, Mus musculus
catggatccaaagaactaggtgggc

SEQ ID NO: 89090 - DNA, 25 bp, Mus musculus
catggatccaagagtcagcggtata

SEQ ID NO: 89091 - DNA, 25 bp, Mus musculus
catggatcccggagctggatcggac

SEQ ID NO: 89092 - DNA, 25 bp, Mus musculus
catggatctgacgttaagccgggca

SEQ ID NO: 89093 - DNA, 25 bp, Mus musculus
catggatctgatcatgggcccagca

SEQ ID NO: 89094 - DNA, 25 bp, Mus musculus
catggatcttttagctttcgagagg

SEQ ID NO: 89095 - DNA, 25 bp, Mus musculus
catggatgccaccagtgagagagac

SEQ ID NO: 89096 - DNA, 25 bp, Mus musculus
catggatgccaccttcgatgaagta

SEQ ID NO: 89097 - DNA, 25 bp, Mus musculus
catggatgccatgagagacaaccct

SEQ ID NO: 89098 - DNA, 25 bp, Mus musculus
catggatgtcgtgggatgccttgaa

SEQ ID NO: 89099 - DNA, 25 bp, Mus musculus
catggattccaaacccaggactgaa

SEQ ID NO: 89100 - DNA, 25 bp, Mus musculus
catggattccacactgactgctctg

SEQ ID NO: 89101 - DNA, 25 bp, Mus musculus
catggatttcaaccagttagaggca

SEQ ID NO: 89102 - DNA, 25 bp, Mus musculus
catggattttccttccaaaaatgca

SEQ ID NO: 89103 - DNA, 25 bp, Mus musculus
catggcaaaagtacacagactgttg

SEQ ID NO: 89104 - DNA, 25 bp, Mus musculus
catggcaagaaagtgataactgcct

SEQ ID NO: 89105 - DNA, 25 bp, Mus musculus
catggcaatggtggacacaaaaatc

SEQ ID NO: 89106 - DNA, 25 bp, Mus musculus
catggcacatggaccaggatctgaa

SEQ ID NO: 89107 - DNA, 25 bp, Mus musculus
catggcagaccctgacttctgggca

SEQ ID NO: 89108 - DNA, 25 bp, Mus musculus
catggcagacctcgttaaacaggac

SEQ ID NO: 89109 - DNA, 25 bp, Mus musculus
catggcagagtcaaaagggaaattt

SEQ ID NO: 89110 - DNA, 25 bp, Mus musculus
catggcagcgattctgtaaagagcg

SEQ ID NO: 89111 - DNA, 25 bp, Mus musculus
catggcaggcaacgatgaaaactac

SEQ ID NO: 89112 - DNA, 25 bp, Mus musculus
catggcagggttgagggaaccccac

SEQ ID NO: 89113 - DNA, 25 bp, Mus musculus
catggcatccctactcaagaaggag

SEQ ID NO: 89114 - DNA, 25 bp, Mus musculus
catggcatccttgtgtctgagagaa

SEQ ID NO: 89115 - DNA, 25 bp, Mus musculus
catggcatctggtcccaacatggag

SEQ ID NO: 89116 - DNA, 25 bp, Mus musculus
catggcattcagcaactcggtgttg

SEQ ID NO: 89117 - DNA, 25 bp, Mus musculus
catggcattcgttatgtctgtggat

SEQ ID NO: 89118 - DNA, 25 bp, Mus musculus
catggcatttcgtcctgagcgcagc

SEQ ID NO: 89119 - DNA, 25 bp, Mus musculus
catggccaaaatggaggtgaaatcc

SEQ ID NO: 89120 - DNA, 25 bp, Mus musculus
catggccaatgccttggccagtgcc

SEQ ID NO: 89121 - DNA, 25 bp, Mus musculus
catggccacaacgtcttcaaggagc

SEQ ID NO: 89122 - DNA, 25 bp, Mus musculus
catggccacatgtgtatctcctttg

SEQ ID NO: 89123 - DNA, 25 bp, Mus musculus
catggccagcagtacctttcaggga

SEQ ID NO: 89124 - DNA, 25 bp, Mus musculus
catggccagggcactgcagaagtac

SEQ ID NO: 89125 - DNA, 25 bp, Mus musculus
catggccatctttgagctgctggac

SEQ ID NO: 89126 - DNA, 25 bp, Mus musculus
catggcccagcgtacacaatatctt

SEQ ID NO: 89127 - DNA, 25 bp, Mus musculus
catggcccagggtgtgactgaatac

SEQ ID NO: 89128 - DNA, 25 bp, Mus musculus
catggcccagttggatgcatggcag

SEQ ID NO: 89129 - DNA, 25 bp, Mus musculus
catggcccataaagcagtgctggcg

SEQ ID NO: 89130 - DNA, 25 bp, Mus musculus
catggcccggagaagctgtctgaga

SEQ ID NO: 89131 - DNA, 25 bp, Mus musculus
catggccctcagtggcagtacaggt

SEQ ID NO: 89132 - DNA, 25 bp, Mus musculus
catggccgccatgctgtttgagaag

SEQ ID NO: 89133 - DNA, 25 bp, Mus musculus
catggccgtgacacccgtggtatct

SEQ ID NO: 89134 - DNA, 25 bp, Mus musculus
catggcctcaccgaggtctgagtac

SEQ ID NO: 89135 - DNA, 25 bp, Mus musculus
catggcctcagctgacaagaatggc

SEQ ID NO: 89136 - DNA, 25 bp, Mus musculus
catggcctgcgagacctttcaatat

SEQ ID NO: 89137 - DNA, 25 bp, Mus musculus
catggccttaggcacagggcatgta

SEQ ID NO: 89138 - DNA, 25 bp, Mus musculus
catggcgacggtgaaaactttccct

SEQ ID NO: 89139 - DNA, 25 bp, Mus musculus
catggcgagcacacgtacctgtttg

SEQ ID NO: 89140 - DNA, 25 bp, Mus musculus
catggcgagcgacagaaagacaaac

SEQ ID NO: 89141 - DNA, 25 bp, Mus musculus
catggcgcactcttcaagctcagga

SEQ ID NO: 89142 - DNA, 25 bp, Mus musculus
catggcgcagccagggaagatactc

SEQ ID NO: 89143 - DNA, 25 bp, Mus musculus
catggcgcaggtgatggccccggga

SEQ ID NO: 89144 - DNA, 25 bp, Mus musculus
catggcggagaacagcaagacttcc

SEQ ID NO: 89145 - DNA, 25 bp, Mus musculus
catggcggagtcgtcagcggccact

SEQ ID NO: 89146 - DNA, 25 bp, Mus musculus
catggcggcaagtactcgcgagaga

SEQ ID NO: 89147 - DNA, 25 bp, Mus musculus
catggcggccctgagtgtgagtatc

SEQ ID NO: 89148 - DNA, 25 bp, Mus musculus
catggcgggctcagaaccaaggatt

SEQ ID NO: 89149 - DNA, 25 bp, Mus musculus
catggcgtctgcgtaggaggcacct

SEQ ID NO: 89150 - DNA, 25 bp, Mus musculus
catggcgttcctattactgaccgaa

SEQ ID NO: 89151 - DNA, 25 bp, Mus musculus
catggctagtgccttcaggacggtc

SEQ ID NO: 89152 - DNA, 25 bp, Mus musculus
catggctagtgtactgcgcgtgcgc

SEQ ID NO: 89153 - DNA, 25 bp, Mus musculus
catggctatcaaagtggaagacccc

SEQ ID NO: 89154 - DNA, 25 bp, Mus musculus
catggctattgaagaacaggtggct

SEQ ID NO: 89155 - DNA, 25 bp, Mus musculus
catggctattggctcaaggcaagga

SEQ ID NO: 89156 - DNA, 25 bp, Mus musculus
catggctcagaatctacaggtcaaa

SEQ ID NO: 89157 - DNA, 25 bp, Mus musculus
catggctccaccaagcggatgaaga

SEQ ID NO: 89158 - DNA, 25 bp, Mus musculus
catggctccgaacctcatcttgaag

SEQ ID NO: 89159 - DNA, 25 bp, Mus musculus
catggctctggcatggtctttgccc

SEQ ID NO: 89160 - DNA, 25 bp, Mus musculus
catggctgaaccctctgaagctggt

SEQ ID NO: 89161 - DNA, 25 bp, Mus musculus
catggctgaagtaagctggaagctc

SEQ ID NO: 89162 - DNA, 25 bp, Mus musculus
catggctgaagtgctcaaaggtctc

SEQ ID NO: 89163 - DNA, 25 bp, Mus musculus
catggctgaatgagcctcccttggg

SEQ ID NO: 89164 - DNA, 25 bp, Mus musculus
catggctgagagactgaatacgggt

SEQ ID NO: 89165 - DNA, 25 bp, Mus musculus
catggctgagctgttgaccggaaga

SEQ ID NO: 89166 - DNA, 25 bp, Mus musculus
catggctgatgtgtgcttagtaccc

SEQ ID NO: 89167 - DNA, 25 bp, Mus musculus
catggctgccaaagctgtagcaaac

SEQ ID NO: 89168 - DNA, 25 bp, Mus musculus
catggctggcaagaagtcatcgggc

SEQ ID NO: 89169 - DNA, 25 bp, Mus musculus
catggctggcatggagcaaagttaa

SEQ ID NO: 89170 - DNA, 25 bp, Mus musculus
catggctgtcttctcaaacaagggc

SEQ ID NO: 89171 - DNA, 25 bp, Mus musculus
catggctgttctacgccgcagagtc

SEQ ID NO: 89172 - DNA, 25 bp, Mus musculus
catggcttcgaggtgctaggatctg

SEQ ID NO: 89173 - DNA, 25 bp, Mus musculus
catggctttgctggagtgatcctca

SEQ ID NO: 89174 - DNA, 25 bp, Mus musculus
catggctttggagtaagactgccca

SEQ ID NO: 89175 - DNA, 25 bp, Mus musculus
catgggaaaaacgtggacagagctc

SEQ ID NO: 89176 - DNA, 25 bp, Mus musculus
catgggaaaatactctcaatgccaa

SEQ ID NO: 89177 - DNA, 25 bp, Mus musculus
catgggaacatctacaatgagtggc

SEQ ID NO: 89178 - DNA, 25 bp, Mus musculus
catgggaagcagttgtgggaactcc

SEQ ID NO: 89179 - DNA, 25 bp, Mus musculus
catgggacaccttacgaggatagct

SEQ ID NO: 89180 - DNA, 25 bp, Mus musculus
catgggacaggccacacagtgtcta

SEQ ID NO: 89181 - DNA, 25 bp, Mus musculus
catgggacatattcaggttcctgta

SEQ ID NO: 89182 - DNA, 25 bp, Mus musculus
catgggactctgctaagaaagacga

SEQ ID NO: 89183 - DNA, 25 bp, Mus musculus
catgggactgaagatatggctcggc

SEQ ID NO: 89184 - DNA, 25 bp, Mus musculus
catgggactgtatatgggagagacc

SEQ ID NO: 89185 - DNA, 25 bp, Mus musculus
catgggagccaaaacggtcattgcc

SEQ ID NO: 89186 - DNA, 25 bp, Mus musculus
catgggagctagctttgcgcagaca

SEQ ID NO: 89187 - DNA, 25 bp, Mus musculus
catgggagctcgagcatccacagtg

SEQ ID NO: 89188 - DNA, 25 bp, Mus musculus
catgggatatatgtgaccttgcaga

SEQ ID NO: 89189 - DNA, 25 bp, Mus musculus
catgggatcccgagctggctttggc

SEQ ID NO: 89190 - DNA, 25 bp, Mus musculus
catgggattcttgaaccgtgaagca

SEQ ID NO: 89191 - DNA, 25 bp, Mus musculus
catgggcaaagaaggcatggtcacc

SEQ ID NO: 89192 - DNA, 25 bp, Mus musculus
catgggcaacctgcagatcgacttt

SEQ ID NO: 89193 - DNA, 25 bp, Mus musculus
catgggcacgcacaatcttaatggg

SEQ ID NO: 89194 - DNA, 25 bp, Mus musculus
catgggcactctgggttatctagac

SEQ ID NO: 89195 - DNA, 25 bp, Mus musculus
catgggcaggagaacgatgacctcg

SEQ ID NO: 89196 - DNA, 25 bp, Mus musculus
catgggcatcctggaaatctggcca

SEQ ID NO: 89197 - DNA, 25 bp, Mus musculus
catgggcatcgctatcgaggaacgc

SEQ ID NO: 89198 - DNA, 25 bp, Mus musculus
catgggcatctggtaccgaatgggc

SEQ ID NO: 89199 - DNA, 25 bp, Mus musculus
catgggcatgtgtgtcaacgagcgc

SEQ ID NO: 89200 - DNA, 25 bp, Mus musculus
catgggcattaaccccgagatgtgt

SEQ ID NO: 89201 - DNA, 25 bp, Mus musculus
catgggccacagcaatgaataatct

SEQ ID NO: 89202 - DNA, 25 bp, Mus musculus
catgggccagggatatgaatcagtg

SEQ ID NO: 89203 - DNA, 25 bp, Mus musculus
catgggccatgctccctagaagagg

SEQ ID NO: 89204 - DNA, 25 bp, Mus musculus
catgggccccactgaatggagactc

SEQ ID NO: 89205 - DNA, 25 bp, Mus musculus
catgggcctctgatggaagaaagct

SEQ ID NO: 89206 - DNA, 25 bp, Mus musculus
catgggcctggtttctcagaggtta

SEQ ID NO: 89207 - DNA, 25 bp, Mus musculus
catgggcggagcaatggagcatcat

SEQ ID NO: 89208 - DNA, 25 bp, Mus musculus
catgggcggcatgatcatcgtcctt

SEQ ID NO: 89209 - DNA, 25 bp, Mus musculus
catgggcggcttcatctttctgggc

SEQ ID NO: 89210 - DNA, 25 bp, Mus musculus
catgggcgttgcagtaggaattgaa

SEQ ID NO: 89211 - DNA, 25 bp, Mus musculus
catgggctctatgttccggagtgaa

SEQ ID NO: 89212 - DNA, 25 bp, Mus musculus
catgggctgccacgatagcatgtac

SEQ ID NO: 89213 - DNA, 25 bp, Mus musculus
catgggctgccctactttggagaac

SEQ ID NO: 89214 - DNA, 25 bp, Mus musculus
catgggctgtccaaaagagtattcc

SEQ ID NO: 89215 - DNA, 25 bp, Mus musculus
catgggcttcattggcaaggatgac

SEQ ID NO: 89216 - DNA, 25 bp, Mus musculus
catgggcttgattgtctttgtctgg

SEQ ID NO: 89217 - DNA, 25 bp, Mus musculus
catggggtatccatcgagggacaga

SEQ ID NO: 89218 - DNA, 25 bp, Mus musculus
catgggtaactcctttcctggtgaa

SEQ ID NO: 89219 - DNA, 25 bp, Mus musculus
catgggtatacagggcccagtgctg

SEQ ID NO: 89220 - DNA, 25 bp, Mus musculus
catgggtcagctaaaaaggaaagcc

SEQ ID NO: 89221 - DNA, 25 bp, Mus musculus
catgggtcccaagccaaagttcggc

SEQ ID NO: 89222 - DNA, 25 bp, Mus musculus
catgggtcccagtatgaagctcaac

SEQ ID NO: 89223 - DNA, 25 bp, Mus musculus
catgggtctggcgtgtaaatattca

SEQ ID NO: 89224 - DNA, 25 bp, Mus musculus
catgggtgaactaccaggatggcaa

SEQ ID NO: 89225 - DNA, 25 bp, Mus musculus
catgggtgaccatacgtttgctgga

SEQ ID NO: 89226 - DNA, 25 bp, Mus musculus
catgggtgccccaaatcagtgcaaa

SEQ ID NO: 89227 - DNA, 25 bp, Mus musculus
catgggtgtagacgtccagaagtca

SEQ ID NO: 89228 - DNA, 25 bp, Mus musculus
catggtacagagatgtcgatgccct

SEQ ID NO: 89229 - DNA, 25 bp, Mus musculus
catggtaccaagaccagtatgcgca

SEQ ID NO: 89230 - DNA, 25 bp, Mus musculus
catggtacgagagtttgtcatgcag

SEQ ID NO: 89231 - DNA, 25 bp, Mus musculus
catggtactgggtagatggttcacc

SEQ ID NO: 89232 - DNA, 25 bp, Mus musculus
catggtagcttcaaggtctgctgcc

SEQ ID NO: 89233 - DNA, 25 bp, Mus musculus
catggtaggccgtgggtatgcatcc

SEQ ID NO: 89234 - DNA, 25 bp, Mus musculus
catggtagggccaagtgctagaacc

SEQ ID NO: 89235 - DNA, 25 bp, Mus musculus
catggtagttcagctaattgatgac

SEQ ID NO: 89236 - DNA, 25 bp, Mus musculus
catggtatacagtaaacgctctgga

SEQ ID NO: 89237 - DNA, 25 bp, Mus musculus
catggtatgtgaaccggtctggacc

SEQ ID NO: 89238 - DNA, 25 bp, Mus musculus
catggtcacggtcatggtcatggtc

SEQ ID NO: 89239 - DNA, 25 bp, Mus musculus
catggtcagcactgaatgggcagct

SEQ ID NO: 89240 - DNA, 25 bp, Mus musculus
catggtcagtggctggataccccac

SEQ ID NO: 89241 - DNA, 25 bp, Mus musculus
catggtccaggattgcacagctgtg

SEQ ID NO: 89242 - DNA, 25 bp, Mus musculus
catggtccatcaaagagactgctgg

SEQ ID NO: 89243 - DNA, 25 bp, Mus musculus
catggtcccactcctgtatccagga

SEQ ID NO: 89244 - DNA, 25 bp, Mus musculus
catggtcgcattggccttcctggaa

SEQ ID NO: 89245 - DNA, 25 bp, Mus musculus
catggtcggcagatggttggaaacc

SEQ ID NO: 89246 - DNA, 25 bp, Mus musculus
catggtctactagcatcaacatggc

SEQ ID NO: 89247 - DNA, 25 bp, Mus musculus
catggtctctggagcaccagcacaa

SEQ ID NO: 89248 - DNA, 25 bp, Mus musculus
catggtctgcttgctactggagaga

SEQ ID NO: 89249 - DNA, 25 bp, Mus musculus
catggtctgtcaggatggtcgcccc

SEQ ID NO: 89250 - DNA, 25 bp, Mus musculus
catggtgaaagatgctctgcggtcc

SEQ ID NO: 89251 - DNA, 25 bp, Mus musculus
catggtgacctatcctgccaggtgt

SEQ ID NO: 89252 - DNA, 25 bp, Mus musculus
catggtgacctgagacccgtggatt

SEQ ID NO: 89253 - DNA, 25 bp, Mus musculus
catggtgagcgtgccagtgttcagc

SEQ ID NO: 89254 - DNA, 25 bp, Mus musculus
catggtgatggcctcaatgctgtca

SEQ ID NO: 89255 - DNA, 25 bp, Mus musculus
catggtgccatatttagctactaaa

SEQ ID NO: 89256 - DNA, 25 bp, Mus musculus
catggtgcccgtcatccaaggatga

SEQ ID NO: 89257 - DNA, 25 bp, Mus musculus
catggtgccgcatacctactgtggg

SEQ ID NO: 89258 - DNA, 25 bp, Mus musculus
catggtgcgccgatccaccttgtgg

SEQ ID NO: 89259 - DNA, 25 bp, Mus musculus
catggtgctccctgattggcctgtg

SEQ ID NO: 89260 - DNA, 25 bp, Mus musculus
catggtgctggcgaggctttgctac

SEQ ID NO: 89261 - DNA, 25 bp, Mus musculus
catggtggacaatgaactgcccggc

SEQ ID NO: 89262 - DNA, 25 bp, Mus musculus
catggtggacaatggagcagatgac

SEQ ID NO: 89263 - DNA, 25 bp, Mus musculus
catggtggactactcttacttcgcc

SEQ ID NO: 89264 - DNA, 25 bp, Mus musculus
catggtggccgtacgatggtgcagt

SEQ ID NO: 89265 - DNA, 25 bp, Mus musculus
catggtggctccgttcccaggagaa

SEQ ID NO: 89266 - DNA, 25 bp, Mus musculus
catggtgggacccaacttcagggtt

SEQ ID NO: 89267 - DNA, 25 bp, Mus musculus
catggtggttacgtaccctgaagcc

SEQ ID NO: 89268 - DNA, 25 bp, Mus musculus
catggtgtcctgttgcagactgcca

SEQ ID NO: 89269 - DNA, 25 bp, Mus musculus
catggtgtgaaaggctgagtactga

SEQ ID NO: 89270 - DNA, 25 bp, Mus musculus
catggtgttgccagtagtgggtaca

SEQ ID NO: 89271 - DNA, 25 bp, Mus musculus
catggttacgcatgctcggcttcag

SEQ ID NO: 89272 - DNA, 25 bp, Mus musculus
catggttagtttggaggcctgcact

SEQ ID NO: 89273 - DNA, 25 bp, Mus musculus
catggttctcaagaggaggccacac

SEQ ID NO: 89274 - DNA, 25 bp, Mus musculus
catggttctgcacgctgagatgttg

SEQ ID NO: 89275 - DNA, 25 bp, Mus musculus
catggttctggaccccagcctggca

SEQ ID NO: 89276 - DNA, 25 bp, Mus musculus
catggttctgtttgcagccagccca

SEQ ID NO: 89277 - DNA, 25 bp, Mus musculus
catggttggcagtcattttagacaa

SEQ ID NO: 89278 - DNA, 25 bp, Mus musculus
catggttggtttgacatatcctgca

SEQ ID NO: 89279 - DNA, 25 bp, Mus musculus
catggtttggtcagttaccggccct

SEQ ID NO: 89280 - DNA, 25 bp, Mus musculus
catgtaaaaggaggcgaatgggctc

SEQ ID NO: 89281 - DNA, 25 bp, Mus musculus
catgtaaacagagttgctggcctcc

SEQ ID NO: 89282 - DNA, 25 bp, Mus musculus
catgtaaagtgagttgcgaaaccgg

SEQ ID NO: 89283 - DNA, 25 bp, Mus musculus
catgtaaattcatcaggcgtgaggg

SEQ ID NO: 89284 - DNA, 25 bp, Mus musculus
catgtaacgtgaccatccacaaccg

SEQ ID NO: 89285 - DNA, 25 bp, Mus musculus
catgtaatgtcggaatgcggaggcc

SEQ ID NO: 89286 - DNA, 25 bp, Mus musculus
catgtacaaagctctgggatccacc

SEQ ID NO: 89287 - DNA, 25 bp, Mus musculus
catgtacaccttcgtggtgcgcgac

SEQ ID NO: 89288 - DNA, 25 bp, Mus musculus
catgtacagagcttttgggagacca

SEQ ID NO: 89289 - DNA, 25 bp, Mus musculus
catgtacagggctacaggccagtct

SEQ ID NO: 89290 - DNA, 25 bp, Mus musculus
catgtacatcgctaaggaggagtcc

SEQ ID NO: 89291 - DNA, 25 bp, Mus musculus
catgtaccttgaaacctctgacggc

SEQ ID NO: 89292 - DNA, 25 bp, Mus musculus
catgtactgaaatcctggaattgag

SEQ ID NO: 89293 - DNA, 25 bp, Mus musculus
catgtactggatgtgttggaaggtc

SEQ ID NO: 89294 - DNA, 25 bp, Mus musculus
catgtagacagacccaagaagcttc

SEQ ID NO: 89295 - DNA, 25 bp, Mus musculus
catgtagcccctgaaaactgtgtag

SEQ ID NO: 89296 - DNA, 25 bp, Mus musculus
catgtagtgccctggctcgaaaacc

SEQ ID NO: 89297 - DNA, 25 bp, Mus musculus
catgtataagcccaagaaggtggtt

SEQ ID NO: 89298 - DNA, 25 bp, Mus musculus
catgtatcaagttgggctgcccagc

SEQ ID NO: 89299 - DNA, 25 bp, Mus musculus
catgtatccccatcagaaggcgtga

SEQ ID NO: 89300 - DNA, 25 bp, Mus musculus
catgtatgacagagcttttggagca

SEQ ID NO: 89301 - DNA, 25 bp, Mus musculus
catgtatgacttctttcttggacgg

SEQ ID NO: 89302 - DNA, 25 bp, Mus musculus
catgtatgagcttgacaccagtggc

SEQ ID NO: 89303 - DNA, 25 bp, Mus musculus
catgtatgatgaaaagacccacgag

SEQ ID NO: 89304 - DNA, 25 bp, Mus musculus
catgtatgggatgttcaacgaaggt

SEQ ID NO: 89305 - DNA, 25 bp, Mus musculus
catgtatgtgcaggacctacggagc

SEQ ID NO: 89306 - DNA, 25 bp, Mus musculus
catgtattcaagagaggccaaggca

SEQ ID NO: 89307 - DNA, 25 bp, Mus musculus
catgtattctaggagggccagggcc

SEQ ID NO: 89308 - DNA, 25 bp, Mus musculus
catgtattgaagaccactgttgtgc

SEQ ID NO: 89309 - DNA, 25 bp, Mus musculus
catgtattgcaaggtactggagacc

SEQ ID NO: 89310 - DNA, 25 bp, Mus musculus
catgtattgcatgttgttcctggcg

SEQ ID NO: 89311 - DNA, 25 bp, Mus musculus
catgtcaagtgtgtacgtggagacc

SEQ ID NO: 89312 - DNA, 25 bp, Mus musculus
catgtcacacgtggaggattcggac

SEQ ID NO: 89313 - DNA, 25 bp, Mus musculus
catgtcagaataggggacgtggttc

SEQ ID NO: 89314 - DNA, 25 bp, Mus musculus
catgtcagacttgcagaaaactcgg

SEQ ID NO: 89315 - DNA, 25 bp, Mus musculus
catgtcagagcggaccagtccaggt

SEQ ID NO: 89316 - DNA, 25 bp, Mus musculus
catgtcagatgttgcccaggagaaa

SEQ ID NO: 89317 - DNA, 25 bp, Mus musculus
catgtcagcagagcattcagccagc

SEQ ID NO: 89318 - DNA, 25 bp, Mus musculus
catgtcagcagataaccagcctaca

SEQ ID NO: 89319 - DNA, 25 bp, Mus musculus
catgtcaggccccttcttagggatg

SEQ ID NO: 89320 - DNA, 25 bp, Mus musculus
catgtcatcctatgtgggcgctgga

SEQ ID NO: 89321 - DNA, 25 bp, Mus musculus
catgtcatcggactctgcagatccc

SEQ ID NO: 89322 - DNA, 25 bp, Mus musculus
catgtcatctcgaaggtccctagga

SEQ ID NO: 89323 - DNA, 25 bp, Mus musculus
catgtcattagaaagctaggatggg

SEQ ID NO: 89324 - DNA, 25 bp, Mus musculus
catgtccaatcctggtgatgtccga

SEQ ID NO: 89325 - DNA, 25 bp, Mus musculus
catgtccaccggagagctcaagagg

SEQ ID NO: 89326 - DNA, 25 bp, Mus musculus
catgtccacgacaggaaacaagaga

SEQ ID NO: 89327 - DNA, 25 bp, Mus musculus
catgtccagaatgtgagcgctgctt

SEQ ID NO: 89328 - DNA, 25 bp, Mus musculus
catgtccaggagaccaaattccaga

SEQ ID NO: 89329 - DNA, 25 bp, Mus musculus
catgtccaggctccagactgaggag

SEQ ID NO: 89330 - DNA, 25 bp, Mus musculus
catgtccatgaagctgcgtcggtcc

SEQ ID NO: 89331 - DNA, 25 bp, Mus musculus
catgtccccataactacgcttgcgg

SEQ ID NO: 89332 - DNA, 25 bp, Mus musculus
catgtccgctctctacagaaggagg

SEQ ID NO: 89333 - DNA, 25 bp, Mus musculus
catgtccgttttgtacaggcctcaa

SEQ ID NO: 89334 - DNA, 25 bp, Mus musculus
catgtcctgcgaagccacgctgttg

SEQ ID NO: 89335 - DNA, 25 bp, Mus musculus
catgtccttccgaaaagttgtgcgg

SEQ ID NO: 89336 - DNA, 25 bp, Mus musculus
catgtccttgcagatggatcgcagg

SEQ ID NO: 89337 - DNA, 25 bp, Mus musculus
catgtcggcaagtatgtgcaacgcc

SEQ ID NO: 89338 - DNA, 25 bp, Mus musculus
catgtcgggcgtgcagtccaaagca

SEQ ID NO: 89339 - DNA, 25 bp, Mus musculus
catgtcgtgcagatggaaggcaccc

SEQ ID NO: 89340 - DNA, 25 bp, Mus musculus
catgtctctaaaaaagggccccagg

SEQ ID NO: 89341 - DNA, 25 bp, Mus musculus
catgtctctggtggcggaagcgttc

SEQ ID NO: 89342 - DNA, 25 bp, Mus musculus
catgtctgagaaatagcagccttcc

SEQ ID NO: 89343 - DNA, 25 bp, Mus musculus
catgtctgagctggtacctgagccc

SEQ ID NO: 89344 - DNA, 25 bp, Mus musculus
catgtctggcgaggaacacagagcc

SEQ ID NO: 89345 - DNA, 25 bp, Mus musculus
catgtctggctgtgtgctgctctcg

SEQ ID NO: 89346 - DNA, 25 bp, Mus musculus
catgtctgtgcggagaagggccact

SEQ ID NO: 89347 - DNA, 25 bp, Mus musculus
catgtcttaaggagctgttagagat

SEQ ID NO: 89348 - DNA, 25 bp, Mus musculus
catgtcttggcatccttaaacagga

SEQ ID NO: 89349 - DNA, 25 bp, Mus musculus
catgtgaaatctggcttggtaccga

SEQ ID NO: 89350 - DNA, 25 bp, Mus musculus
catgtgaagcacgaactggctgaga

SEQ ID NO: 89351 - DNA, 25 bp, Mus musculus
catgtgaattgttaccgcctccgct

SEQ ID NO: 89352 - DNA, 25 bp, Mus musculus
catgtgacaagcttctctgtggccc

SEQ ID NO: 89353 - DNA, 25 bp, Mus musculus
catgtgaccgcccagtttggagcca

SEQ ID NO: 89354 - DNA, 25 bp, Mus musculus
catgtgacctcagaaaggctgtgtc

SEQ ID NO: 89355 - DNA, 25 bp, Mus musculus
catgtgacgggcagtggcatctctt

SEQ ID NO: 89356 - DNA, 25 bp, Mus musculus
catgtgagaactggaaacagcacgg

SEQ ID NO: 89357 - DNA, 25 bp, Mus musculus
catgtgagctgtaaactctacaagg

SEQ ID NO: 89358 - DNA, 25 bp, Mus musculus
catgtgagtagacctgctgtgacca

SEQ ID NO: 89359 - DNA, 25 bp, Mus musculus
catgtgatccctcgagccaagaagg

SEQ ID NO: 89360 - DNA, 25 bp, Mus musculus
catgtgcaaagcagccactgagtca

SEQ ID NO: 89361 - DNA, 25 bp, Mus musculus
catgtgcaacgcgaagctgctgagg

SEQ ID NO: 89362 - DNA, 25 bp, Mus musculus
catgtgcactgatagggcaaggcca

SEQ ID NO: 89363 - DNA, 25 bp, Mus musculus
catgtgcagattggccggtgtcctc

SEQ ID NO: 89364 - DNA, 25 bp, Mus musculus
catgtgcagcaccagtgtgtatgac

SEQ ID NO: 89365 - DNA, 25 bp, Mus musculus
catgtgcagtgtgctcaagaggcaa

SEQ ID NO: 89366 - DNA, 25 bp, Mus musculus
catgtgcatcttgtgtttccaggga

SEQ ID NO: 89367 - DNA, 25 bp, Mus musculus
catgtgccagtatacgtttcaggac

SEQ ID NO: 89368 - DNA, 25 bp, Mus musculus
catgtgcccatcgttgccatggaga

SEQ ID NO: 89369 - DNA, 25 bp, Mus musculus
catgtgccttgagaggcctgaagag

SEQ ID NO: 89370 - DNA, 25 bp, Mus musculus
catgtgcgtgcagaactgtggcccg

SEQ ID NO: 89371 - DNA, 25 bp, Mus musculus
catgtgctctgttaaactctggagg

SEQ ID NO: 89372 - DNA, 25 bp, Mus musculus
catgtgctgtgaccctgggctttcc

SEQ ID NO: 89373 - DNA, 25 bp, Mus musculus
catgtgctgtgctgtcagtatctgg

SEQ ID NO: 89374 - DNA, 25 bp, Mus musculus
catgtgctgtggagcgtatactaac

SEQ ID NO: 89375 - DNA, 25 bp, Mus musculus
catgtgcttgttccgccagtacgca

SEQ ID NO: 89376 - DNA, 25 bp, Mus musculus
catgtggaatcagccggagactcct

SEQ ID NO: 89377 - DNA, 25 bp, Mus musculus
catgtggacattaataaacgtgcgc

SEQ ID NO: 89378 - DNA, 25 bp, Mus musculus
catgtggacgtgtggcccttaaacc

SEQ ID NO: 89379 - DNA, 25 bp, Mus musculus
catgtggagacgtgtgtaccttgac

SEQ ID NO: 89380 - DNA, 25 bp, Mus musculus
catgtggagcactgtggtcgccaaa

SEQ ID NO: 89381 - DNA, 25 bp, Mus musculus
catgtggagcgtacctaaaacctta

SEQ ID NO: 89382 - DNA, 25 bp, Mus musculus
catgtggagtacgaggtttccagcc

SEQ ID NO: 89383 - DNA, 25 bp, Mus musculus
catgtggcagcagccaataaggccg

SEQ ID NO: 89384 - DNA, 25 bp, Mus musculus
catgtggccagcaagtaacctgtgg

SEQ ID NO: 89385 - DNA, 25 bp, Mus musculus
catgtggcccatgggagtaaatcca

SEQ ID NO: 89386 - DNA, 25 bp, Mus musculus
catgtggcgtcatgtgtgtctccaa

SEQ ID NO: 89387 - DNA, 25 bp, Mus musculus
catgtgggaacggacactgaccatc

SEQ ID NO: 89388 - DNA, 25 bp, Mus musculus
catgtgggattggaacaaatacttc

SEQ ID NO: 89389 - DNA, 25 bp, Mus musculus
catgtgggcactggagaaaccttcc

SEQ ID NO: 89390 - DNA, 25 bp, Mus musculus
catgtgggcgccgactaatgcagaa

SEQ ID NO: 89391 - DNA, 25 bp, Mus musculus
catgtgggtaccgttgcattagagc

SEQ ID NO: 89392 - DNA, 25 bp, Mus musculus
catgtggtaaaatcggagtctggca

SEQ ID NO: 89393 - DNA, 25 bp, Mus musculus
catgtggtaagcgagatccggagaa

SEQ ID NO: 89394 - DNA, 25 bp, Mus musculus
catgtggtcatccatacagctgggt

SEQ ID NO: 89395 - DNA, 25 bp, Mus musculus
catgtggtcgaatctgggcattggc

SEQ ID NO: 89396 - DNA, 25 bp, Mus musculus
catgtggtgcgctttctcacgggcg

SEQ ID NO: 89397 - DNA, 25 bp, Mus musculus
catgtgtacctaccggctgctgatc

SEQ ID NO: 89398 - DNA, 25 bp, Mus musculus
catgtgtagagaaagcaggaaccga

SEQ ID NO: 89399 - DNA, 25 bp, Mus musculus
catgtgtcagagttcagagcccagg

SEQ ID NO: 89400 - DNA, 25 bp, Mus musculus
catgtgtcaggaccttcgagtgctc

SEQ ID NO: 89401 - DNA, 25 bp, Mus musculus
catgtgtcatctaggtgaggtgttc

SEQ ID NO: 89402 - DNA, 25 bp, Mus musculus
catgtgtcgccaggagtggaagttc

SEQ ID NO: 89403 - DNA, 25 bp, Mus musculus
catgtgtctttggtacctctgccaa

SEQ ID NO: 89404 - DNA, 25 bp, Mus musculus
catgtgtgagtggtgcctgtccgta

SEQ ID NO: 89405 - DNA, 25 bp, Mus musculus
catgtgtgatcgtggagtgcagcaa

SEQ ID NO: 89406 - DNA, 25 bp, Mus musculus
catgtgtggagagttccttcagcac

SEQ ID NO: 89407 - DNA, 25 bp, Mus musculus
catgtgtggcatacatacacttaaa

SEQ ID NO: 89408 - DNA, 25 bp, Mus musculus
catgtgttctagcagcccaaggtga

SEQ ID NO: 89409 - DNA, 25 bp, Mus musculus
catgttaaaagactcctgaataaac

SEQ ID NO: 89410 - DNA, 25 bp, Mus musculus
catgttaagagtagtgcatcgccga

SEQ ID NO: 89411 - DNA, 25 bp, Mus musculus
catgttaagctcgtgggatatctcc

SEQ ID NO: 89412 - DNA, 25 bp, Mus musculus
catgttaatatttaactagagtata

SEQ ID NO: 89413 - DNA, 25 bp, Mus musculus
catgttacggcgacaggaggagctc

SEQ ID NO: 89414 - DNA, 25 bp, Mus musculus
catgttactggctggtggaccggct

SEQ ID NO: 89415 - DNA, 25 bp, Mus musculus
catgttagacatcggtggaggcttc

SEQ ID NO: 89416 - DNA, 25 bp, Mus musculus
catgttataaaagcggcaggaccga

SEQ ID NO: 89417 - DNA, 25 bp, Mus musculus
catgttattctctgaagccggaagc

SEQ ID NO: 89418 - DNA, 25 bp, Mus musculus
catgttcaacccagaggagcgcagt

SEQ ID NO: 89419 - DNA, 25 bp, Mus musculus
catgttcaacgactttggcgaagcc

SEQ ID NO: 89420 - DNA, 25 bp, Mus musculus
catgttcaagcctgtcaaggaggag

SEQ ID NO: 89421 - DNA, 25 bp, Mus musculus
catgttcaatggtgggatggctacc

SEQ ID NO: 89422 - DNA, 25 bp, Mus musculus
catgttcacgcgagctctggagtac

SEQ ID NO: 89423 - DNA, 25 bp, Mus musculus
catgttcagctttgtggacctccgg

SEQ ID NO: 89424 - DNA, 25 bp, Mus musculus
catgttcaggcgtcagaggtccctc

SEQ ID NO: 89425 - DNA, 25 bp, Mus musculus
catgttccaccacttccagaagggt

SEQ ID NO: 89426 - DNA, 25 bp, Mus musculus
catgttcggctccaatcgcggtggc

SEQ ID NO: 89427 - DNA, 25 bp, Mus musculus
catgttcgtggctcaggctgtgcta

SEQ ID NO: 89428 - DNA, 25 bp, Mus musculus
catgttctctgtacgggctggcggt

SEQ ID NO: 89429 - DNA, 25 bp, Mus musculus
catgttctctttcctagttatgtga

SEQ ID NO: 89430 - DNA, 25 bp, Mus musculus
catgttctgggtagggcacgtgttc

SEQ ID NO: 89431 - DNA, 25 bp, Mus musculus
catgttctgtgcaggctaccgtgaa

SEQ ID NO: 89432 - DNA, 25 bp, Mus musculus
catgttctttcacactctcgtggga

SEQ ID NO: 89433 - DNA, 25 bp, Mus musculus
catgttgaaagatgccgccgtgatc

SEQ ID NO: 89434 - DNA, 25 bp, Mus musculus
catgttgaccctgcattgccttata

SEQ ID NO: 89435 - DNA, 25 bp, Mus musculus
catgttgagcaatcggacctgagcc

SEQ ID NO: 89436 - DNA, 25 bp, Mus musculus
catgttgcatcacagggaacttgag

SEQ ID NO: 89437 - DNA, 25 bp, Mus musculus
catgttgcccgaagtggagctgtcc

SEQ ID NO: 89438 - DNA, 25 bp, Mus musculus
catgttgcctagtcagcctgctggg

SEQ ID NO: 89439 - DNA, 25 bp, Mus musculus
catgttgctgctactggccctggtg

SEQ ID NO: 89440 - DNA, 25 bp, Mus musculus
catgttggcaggcttggatcttccc

SEQ ID NO: 89441 - DNA, 25 bp, Mus musculus
catgttgggcgcagtgaccctgctt

SEQ ID NO: 89442 - DNA, 25 bp, Mus musculus
catgttgtaaccctatatgccaggc

SEQ ID NO: 89443 - DNA, 25 bp, Mus musculus
catgttgtgtgcttctttccggacc

SEQ ID NO: 89444 - DNA, 25 bp, Mus musculus
catgttgttttaagctaacagatgc

SEQ ID NO: 89445 - DNA, 25 bp, Mus musculus
catgtttagcctttagcagcaggga

SEQ ID NO: 89446 - DNA, 25 bp, Mus musculus
catgtttagcgaagaccctatggaa

SEQ ID NO: 89447 - DNA, 25 bp, Mus musculus
catgtttaggaagcctcctgtcttc

SEQ ID NO: 89448 - DNA, 25 bp, Mus musculus
catgtttcaagggaggaggctctct

SEQ ID NO: 89449 - DNA, 25 bp, Mus musculus
catgtttcagggatgtgcgggcaac

SEQ ID NO: 89450 - DNA, 25 bp, Mus musculus
catgtttccaaagataatgggccca

SEQ ID NO: 89451 - DNA, 25 bp, Mus musculus
catgtttctctagcagagggccgct

SEQ ID NO: 89452 - DNA, 25 bp, Mus musculus
catgtttctggtgttccgagccgcc

SEQ ID NO: 89453 - DNA, 25 bp, Mus musculus
catgtttgagaaactggaacgggct

SEQ ID NO: 89454 - DNA, 25 bp, Mus musculus
catgtttgatgactatgtccggacg

SEQ ID NO: 89455 - DNA, 25 bp, Mus musculus
catgtttgccaccagtgttactgag

SEQ ID NO: 89456 - DNA, 25 bp, Mus musculus
catgtttgggaagaagcgacacaca

SEQ ID NO: 89457 - DNA, 25 bp, Mus musculus
catgtttgggagcacaaccacagat

SEQ ID NO: 89458 - DNA, 25 bp, Mus musculus
catgtttgggtaccgcacactcgat

SEQ ID NO: 89459 - DNA, 25 bp, Mus musculus
catgttttatctaattccaggaggg

SEQ ID NO: 89460 - DNA, 25 bp, Mus musculus
catgttttgaactaagagtttcacc

SEQ ID NO: 89461 - DNA, 25 bp, Mus musculus
cattaaaacaaaggtggccgtgctg

SEQ ID NO: 89462 - DNA, 25 bp, Mus musculus
cattaaaactaacgcctgtgccctt

SEQ ID NO: 89463 - DNA, 25 bp, Mus musculus
cattaaaagaattggcggaggctac

SEQ ID NO: 89464 - DNA, 25 bp, Mus musculus
cattaaacaccaggaaccaactgag

SEQ ID NO: 89465 - DNA, 25 bp, Mus musculus
cattaaactagactcaggcgtggtc

SEQ ID NO: 89466 - DNA, 25 bp, Mus musculus
cattaaaggcagttggcactcagca

SEQ ID NO: 89467 - DNA, 25 bp, Mus musculus
cattaaagtctgtgaccccgtgcct

SEQ ID NO: 89468 - DNA, 25 bp, Mus musculus
cattaaagtgtttgtcctgacctca

SEQ ID NO: 89469 - DNA, 25 bp, Mus musculus
cattaaatccctcacaggcttcggg

SEQ ID NO: 89470 - DNA, 25 bp, Mus musculus
cattaaatgtattgaaggaggccag

SEQ ID NO: 89471 - DNA, 25 bp, Mus musculus
cattaacaagatcaggccaacaggc

SEQ ID NO: 89472 - DNA, 25 bp, Mus musculus
cattaacagagtagtaagtcaccct

SEQ ID NO: 89473 - DNA, 25 bp, Mus musculus
cattaacatggaagtggccccaggg

SEQ ID NO: 89474 - DNA, 25 bp, Mus musculus
cattaaccaaatgctgctcaggcag

SEQ ID NO: 89475 - DNA, 25 bp, Mus musculus
cattaaccactttgcaggcggagac

SEQ ID NO: 89476 - DNA, 25 bp, Mus musculus
cattaaccatcacgactgtatggct

SEQ ID NO: 89477 - DNA, 25 bp, Mus musculus
cattaaccatgtgcccgagaagcgg

SEQ ID NO: 89478 - DNA, 25 bp, Mus musculus
cattaaccggctacgaaagaaggag

SEQ ID NO: 89479 - DNA, 25 bp, Mus musculus
cattaacgggacagacttttgtaca

SEQ ID NO: 89480 - DNA, 25 bp, Mus musculus
cattaacgtggatcctgctggcctg

SEQ ID NO: 89481 - DNA, 25 bp, Mus musculus
cattaactcagatggagggcagcca

SEQ ID NO: 89482 - DNA, 25 bp, Mus musculus
cattaactttaccatggagaaccag

SEQ ID NO: 89483 - DNA, 25 bp, Mus musculus
cattaagaaggaagctggcgatgcc

SEQ ID NO: 89484 - DNA, 25 bp, Mus musculus
cattaagaatgacctgattgaccgt

SEQ ID NO: 89485 - DNA, 25 bp, Mus musculus
cattaagacgcttcacagccagggc

SEQ ID NO: 89486 - DNA, 25 bp, Mus musculus
cattaagacgtacatgaggccctcg

SEQ ID NO: 89487 - DNA, 25 bp, Mus musculus
cattaagatccagcctgaacgtcgg

SEQ ID NO: 89488 - DNA, 25 bp, Mus musculus
cattaagatggaagacggagttgtc

SEQ ID NO: 89489 - DNA, 25 bp, Mus musculus
cattaaggaagactgtcagaaacca

SEQ ID NO: 89490 - DNA, 25 bp, Mus musculus
cattaaggacatagaacccgggagc

SEQ ID NO: 89491 - DNA, 25 bp, Mus musculus
cattaagtcaaaggaaaggcgcagc

SEQ ID NO: 89492 - DNA, 25 bp, Mus musculus
cattaagtcttctgtcgagggttga

SEQ ID NO: 89493 - DNA, 25 bp, Mus musculus
cattaagttgttcggactgcgagcg

SEQ ID NO: 89494 - DNA, 25 bp, Mus musculus
cattaatctgtaagtgcggcgcggc

SEQ ID NO: 89495 - DNA, 25 bp, Mus musculus
cattaatgatgtctggatccaggca

SEQ ID NO: 89496 - DNA, 25 bp, Mus musculus
cattaatgcctccatttatgatgag

SEQ ID NO: 89497 - DNA, 25 bp, Mus musculus
cattaatggacaggaccaaggcgct

SEQ ID NO: 89498 - DNA, 25 bp, Mus musculus
cattaattactacgaggctgcccag

SEQ ID NO: 89499 - DNA, 25 bp, Mus musculus
cattacaaatgagtggctctctggc

SEQ ID NO: 89500 - DNA, 25 bp, Mus musculus
cattacaacattcagatctgtgcag

SEQ ID NO: 89501 - DNA, 25 bp, Mus musculus
cattacaagaagaaccccatggtgg

SEQ ID NO: 89502 - DNA, 25 bp, Mus musculus
cattacagaagggaagcggaggtta

SEQ ID NO: 89503 - DNA, 25 bp, Mus musculus
cattacagatgatatagcccaggct

SEQ ID NO: 89504 - DNA, 25 bp, Mus musculus
cattacagttccgagccgtgctgga

SEQ ID NO: 89505 - DNA, 25 bp, Mus musculus
cattaccatagagggcagcaagatc

SEQ ID NO: 89506 - DNA, 25 bp, Mus musculus
cattaccattggatctgtgaaacag

SEQ ID NO: 89507 - DNA, 25 bp, Mus musculus
cattaccggaagaatagaaagagac

SEQ ID NO: 89508 - DNA, 25 bp, Mus musculus
cattacctgtgtcggtcttggcaaa

SEQ ID NO: 89509 - DNA, 25 bp, Mus musculus
cattacgaattcagaaaggagcccc

SEQ ID NO: 89510 - DNA, 25 bp, Mus musculus
cattacggtcctgtttaagagccca

SEQ ID NO: 89511 - DNA, 25 bp, Mus musculus
cattactacgcaatgaggtggctca

SEQ ID NO: 89512 - DNA, 25 bp, Mus musculus
cattactcgaaacacagaaaaggcc

SEQ ID NO: 89513 - DNA, 25 bp, Mus musculus
cattactcgcatctgggagaggctt

SEQ ID NO: 89514 - DNA, 25 bp, Mus musculus
cattactgaagcgtctggcagaggc

SEQ ID NO: 89515 - DNA, 25 bp, Mus musculus
cattactgcagaagtcttagccgtg

SEQ ID NO: 89516 - DNA, 25 bp, Mus musculus
cattactgtgacatcggaggctgga

SEQ ID NO: 89517 - DNA, 25 bp, Mus musculus
cattagaagggacttggcctgccct

SEQ ID NO: 89518 - DNA, 25 bp, Mus musculus
cattagacagcctgggatgcactca

SEQ ID NO: 89519 - DNA, 25 bp, Mus musculus
cattagacccggacatggaagagca

SEQ ID NO: 89520 - DNA, 25 bp, Mus musculus
cattagagagctgacagcgcaccac

SEQ ID NO: 89521 - DNA, 25 bp, Mus musculus
cattagcagagacacgtttctgaga

SEQ ID NO: 89522 - DNA, 25 bp, Mus musculus
cattagcatctcattagctgtccgc

SEQ ID NO: 89523 - DNA, 25 bp, Mus musculus
cattagccaacctcaaccgcgtggt

SEQ ID NO: 89524 - DNA, 25 bp, Mus musculus
cattagccctaagtgagatggccgg

SEQ ID NO: 89525 - DNA, 25 bp, Mus musculus
cattagcctgctacctgacagagcc

SEQ ID NO: 89526 - DNA, 25 bp, Mus musculus
cattagcctttggttctggcgtggg

SEQ ID NO: 89527 - DNA, 25 bp, Mus musculus
cattagcggagaacacctgtgcagc

SEQ ID NO: 89528 - DNA, 25 bp, Mus musculus
cattagcgtcatatccagtggcctg

SEQ ID NO: 89529 - DNA, 25 bp, Mus musculus
cattagctggtctaactgcccggag

SEQ ID NO: 89530 - DNA, 25 bp, Mus musculus
cattaggagataccttaacccggag

SEQ ID NO: 89531 - DNA, 25 bp, Mus musculus
cattagggaggaggatcaatgcacc

SEQ ID NO: 89532 - DNA, 25 bp, Mus musculus
cattagtagccaacagcttcaggag

SEQ ID NO: 89533 - DNA, 25 bp, Mus musculus
cattagtaggtgattccaagggaca

SEQ ID NO: 89534 - DNA, 25 bp, Mus musculus
cattagtctgtagtgtttcccgggc

SEQ ID NO: 89535 - DNA, 25 bp, Mus musculus
cattagtgcaacatgagggctggat

SEQ ID NO: 89536 - DNA, 25 bp, Mus musculus
cattagtggcgaaaacttgaactgg

SEQ ID NO: 89537 - DNA, 25 bp, Mus musculus
cattagtgtgtaaaccctgagtctc

SEQ ID NO: 89538 - DNA, 25 bp, Mus musculus
cattataaatgcagctcgagcgagc

SEQ ID NO: 89539 - DNA, 25 bp, Mus musculus
cattataagcttgattggcatcgct

SEQ ID NO: 89540 - DNA, 25 bp, Mus musculus
cattatacggcgatggtgctgctaa

SEQ ID NO: 89541 - DNA, 25 bp, Mus musculus
cattatacttttccagtggagccca

SEQ ID NO: 89542 - DNA, 25 bp, Mus musculus
cattataggaaaagaaggtgctacc

SEQ ID NO: 89543 - DNA, 25 bp, Mus musculus
cattatatactgatgaaccgtgtgt

SEQ ID NO: 89544 - DNA, 25 bp, Mus musculus
cattatatgtcctatcccgtcccgg

SEQ ID NO: 89545 - DNA, 25 bp, Mus musculus
cattatcaacaccaagctgctgaaa

SEQ ID NO: 89546 - DNA, 25 bp, Mus musculus
cattatcaagaacctcaagccggag

SEQ ID NO: 89547 - DNA, 25 bp, Mus musculus
cattatcaagcgcatattggcagca

SEQ ID NO: 89548 - DNA, 25 bp, Mus musculus
cattatcaggaagatcaaggcagct

SEQ ID NO: 89549 - DNA, 25 bp, Mus musculus
cattatcagttagtgtcaagcccaa

SEQ ID NO: 89550 - DNA, 25 bp, Mus musculus
cattatccaagaaggcgtgcacaac

SEQ ID NO: 89551 - DNA, 25 bp, Mus musculus
cattatcccggaggaactggtggca

SEQ ID NO: 89552 - DNA, 25 bp, Mus musculus
cattatcccgttatgatggagcagg

SEQ ID NO: 89553 - DNA, 25 bp, Mus musculus
cattatcgagaagttaaagtcggcc

SEQ ID NO: 89554 - DNA, 25 bp, Mus musculus
cattatcgaggaaccgtggcagggt

SEQ ID NO: 89555 - DNA, 25 bp, Mus musculus
cattatctaggcttgccagtggcgg

SEQ ID NO: 89556 - DNA, 25 bp, Mus musculus
cattatctggttttagacagattca

SEQ ID NO: 89557 - DNA, 25 bp, Mus musculus
cattatgaaactgaaggtagccgag

SEQ ID NO: 89558 - DNA, 25 bp, Mus musculus
cattatgagaccagaaaagctctct

SEQ ID NO: 89559 - DNA, 25 bp, Mus musculus
cattatgagcatccgtgtgcaggga

SEQ ID NO: 89560 - DNA, 25 bp, Mus musculus
cattatgaggagatcagcaaggcgt

SEQ ID NO: 89561 - DNA, 25 bp, Mus musculus
cattatgatggacaccaaggacccg

SEQ ID NO: 89562 - DNA, 25 bp, Mus musculus
cattatgattcccatagcaggagca

SEQ ID NO: 89563 - DNA, 25 bp, Mus musculus
cattatgcagccagtaaaggacctc

SEQ ID NO: 89564 - DNA, 25 bp, Mus musculus
cattatgctgtgtgactgctgagac

SEQ ID NO: 89565 - DNA, 25 bp, Mus musculus
cattatggcgacttggaagagagcc

SEQ ID NO: 89566 - DNA, 25 bp, Mus musculus
cattatggctccctggctgagaggt

SEQ ID NO: 89567 - DNA, 25 bp, Mus musculus
cattatggtgcagaacgtgagcttc

SEQ ID NO: 89568 - DNA, 25 bp, Mus musculus
cattatgtcagtagctcagaggcga

SEQ ID NO: 89569 - DNA, 25 bp, Mus musculus
cattatgtcggagaacaggtccagg

SEQ ID NO: 89570 - DNA, 25 bp, Mus musculus
cattatgtgatccagccccatgatg

SEQ ID NO: 89571 - DNA, 25 bp, Mus musculus
cattatgtgggcaaagagtatttca

SEQ ID NO: 89572 - DNA, 25 bp, Mus musculus
cattattaagatcgtggagttcgcc

SEQ ID NO: 89573 - DNA, 25 bp, Mus musculus
cattattcagaagtggcagtaggac

SEQ ID NO: 89574 - DNA, 25 bp, Mus musculus
cattattgaaaaccgagctctgtgg

SEQ ID NO: 89575 - DNA, 25 bp, Mus musculus
cattattgagaaggctgaacacgga

SEQ ID NO: 89576 - DNA, 25 bp, Mus musculus
cattattgaggtgtccaaggaggcc

SEQ ID NO: 89577 - DNA, 25 bp, Mus musculus
cattattggaaaagttctcagcacc

SEQ ID NO: 89578 - DNA, 25 bp, Mus musculus
cattattggagcagtacagatcgcc

SEQ ID NO: 89579 - DNA, 25 bp, Mus musculus
cattcaaagaaagcgacaggagtct

SEQ ID NO: 89580 - DNA, 25 bp, Mus musculus
cattcaaagagaacttactgtcctg

SEQ ID NO: 89581 - DNA, 25 bp, Mus musculus
cattcaaagccttgcgcagacagct

SEQ ID NO: 89582 - DNA, 25 bp, Mus musculus
cattcaaataacagaagcggacctg

SEQ ID NO: 89583 - DNA, 25 bp, Mus musculus
cattcaaatccaaagttctggccca

SEQ ID NO: 89584 - DNA, 25 bp, Mus musculus
cattcaacaagatgctgactgggac

SEQ ID NO: 89585 - DNA, 25 bp, Mus musculus
cattcaacaggcctgtcagcctcag

SEQ ID NO: 89586 - DNA, 25 bp, Mus musculus
cattcaacgcagagaggacctgagg

SEQ ID NO: 89587 - DNA, 25 bp, Mus musculus
cattcaagacaagagtgttccattg

SEQ ID NO: 89588 - DNA, 25 bp, Mus musculus
cattcaagatgggttggcagccata

SEQ ID NO: 89589 - DNA, 25 bp, Mus musculus
cattcaagggaagcaaggacctgca

SEQ ID NO: 89590 - DNA, 25 bp, Mus musculus
cattcaagggaataagatgctggct

SEQ ID NO: 89591 - DNA, 25 bp, Mus musculus
cattcaagtcccaggaggcatctgc

SEQ ID NO: 89592 - DNA, 25 bp, Mus musculus
cattcaagtctaaggtccttgcccg

SEQ ID NO: 89593 - DNA, 25 bp, Mus musculus
cattcaagtggccaagagctctgca

SEQ ID NO: 89594 - DNA, 25 bp, Mus musculus
cattcaatgtgactttccggcgggc

SEQ ID NO: 89595 - DNA, 25 bp, Mus musculus
cattcacaagtgaccgacagcacgt

SEQ ID NO: 89596 - DNA, 25 bp, Mus musculus
cattcacagcagataggcgatggct

SEQ ID NO: 89597 - DNA, 25 bp, Mus musculus
cattcacagtgagcgcttcagggcc

SEQ ID NO: 89598 - DNA, 25 bp, Mus musculus
cattcaccgtagtagtgaggcctag

SEQ ID NO: 89599 - DNA, 25 bp, Mus musculus
cattcactggagaactacgggcttc

SEQ ID NO: 89600 - DNA, 25 bp, Mus musculus
cattcactttgggaacagaagcagg

SEQ ID NO: 89601 - DNA, 25 bp, Mus musculus
cattcagaactcttgagggcgtcac

SEQ ID NO: 89602 - DNA, 25 bp, Mus musculus
cattcagaagatagtggacagtcac

SEQ ID NO: 89603 - DNA, 25 bp, Mus musculus
cattcagacggtagctacagaggac

SEQ ID NO: 89604 - DNA, 25 bp, Mus musculus
cattcagactggcaaatgggagcct

SEQ ID NO: 89605 - DNA, 25 bp, Mus musculus
cattcagagagatgctttgcgctca

SEQ ID NO: 89606 - DNA, 25 bp, Mus musculus
cattcagaggagtacggaaacggga

SEQ ID NO: 89607 - DNA, 25 bp, Mus musculus
cattcagagggttagtgaccatgct

SEQ ID NO: 89608 - DNA, 25 bp, Mus musculus
cattcagatcttcgtgtgagcgcac

SEQ ID NO: 89609 - DNA, 25 bp, Mus musculus
cattcagcgaggaggccacactttt

SEQ ID NO: 89610 - DNA, 25 bp, Mus musculus
cattcagcgcttgtggaaggactcg

SEQ ID NO: 89611 - DNA, 25 bp, Mus musculus
cattcagctcgtagaggaggagttg

SEQ ID NO: 89612 - DNA, 25 bp, Mus musculus
cattcagctggaggataccttggcc

SEQ ID NO: 89613 - DNA, 25 bp, Mus musculus
cattcagcttggagatacaccaccg

SEQ ID NO: 89614 - DNA, 25 bp, Mus musculus
cattcaggaactattgcgggcagcc

SEQ ID NO: 89615 - DNA, 25 bp, Mus musculus
cattcaggaccgtaacaacttcttc

SEQ ID NO: 89616 - DNA, 25 bp, Mus musculus
cattcagtactgtgtccggccacgg

SEQ ID NO: 89617 - DNA, 25 bp, Mus musculus
cattcagtcctcaaatgtgtgagca

SEQ ID NO: 89618 - DNA, 25 bp, Mus musculus
cattcataaccccagtccgtggatc

SEQ ID NO: 89619 - DNA, 25 bp, Mus musculus
cattcatataacatacatccatgca

SEQ ID NO: 89620 - DNA, 25 bp, Mus musculus
cattcatgcccaatacagtgcggtt

SEQ ID NO: 89621 - DNA, 25 bp, Mus musculus
cattcatggcctctgacagcgagga

SEQ ID NO: 89622 - DNA, 25 bp, Mus musculus
cattcatgtgccctcacctgctgtg

SEQ ID NO: 89623 - DNA, 25 bp, Mus musculus
cattcattcagggaccaaacgtgac

SEQ ID NO: 89624 - DNA, 25 bp, Mus musculus
cattcattgaacagccaggactggg

SEQ ID NO: 89625 - DNA, 25 bp, Mus musculus
cattcattggtggacttttgcttca

SEQ ID NO: 89626 - DNA, 25 bp, Mus musculus
cattccaaatctgtgagggcccaaa

SEQ ID NO: 89627 - DNA, 25 bp, Mus musculus
cattccaagccaagatccatggtag

SEQ ID NO: 89628 - DNA, 25 bp, Mus musculus
cattccaatggcatgggccaaaagg

SEQ ID NO: 89629 - DNA, 25 bp, Mus musculus
cattccacagttctatttccctgaa

SEQ ID NO: 89630 - DNA, 25 bp, Mus musculus
cattccacatcagtttgatggtggc

SEQ ID NO: 89631 - DNA, 25 bp, Mus musculus
cattccagaccgctgacaagctcta

SEQ ID NO: 89632 - DNA, 25 bp, Mus musculus
cattccagagcgaaaagaagttcca

SEQ ID NO: 89633 - DNA, 25 bp, Mus musculus
cattccagctggtggctagaacgct

SEQ ID NO: 89634 - DNA, 25 bp, Mus musculus
cattccaggcatccagtaggctctg

SEQ ID NO: 89635 - DNA, 25 bp, Mus musculus
cattccagtcgaagcaacaggcaac

SEQ ID NO: 89636 - DNA, 25 bp, Mus musculus
cattccatacaatgagaagccagag

SEQ ID NO: 89637 - DNA, 25 bp, Mus musculus
cattccatcaggagcaagggcatca

SEQ ID NO: 89638 - DNA, 25 bp, Mus musculus
cattccatccagtcaaggctgtggc

SEQ ID NO: 89639 - DNA, 25 bp, Mus musculus
cattccatctggaccgcaggagaag

SEQ ID NO: 89640 - DNA, 25 bp, Mus musculus
cattccattctccaaggagcagctg

SEQ ID NO: 89641 - DNA, 25 bp, Mus musculus
cattcccaccacacgaagggctggt

SEQ ID NO: 89642 - DNA, 25 bp, Mus musculus
cattcccagaaggaggatctctacc

SEQ ID NO: 89643 - DNA, 25 bp, Mus musculus
cattcccatagagcgtgtgacacac

SEQ ID NO: 89644 - DNA, 25 bp, Mus musculus
cattccccagataggtgatgtgtcg

SEQ ID NO: 89645 - DNA, 25 bp, Mus musculus
cattccccatcatggaggccgagag

SEQ ID NO: 89646 - DNA, 25 bp, Mus musculus
cattccccgcctcttgtatcttgaa

SEQ ID NO: 89647 - DNA, 25 bp, Mus musculus
cattcccctggagaacacgttgaag

SEQ ID NO: 89648 - DNA, 25 bp, Mus musculus
cattcccgccctagtggaggagtac

SEQ ID NO: 89649 - DNA, 25 bp, Mus musculus
cattcccggaagtgtgtaacgagac

SEQ ID NO: 89650 - DNA, 25 bp, Mus musculus
cattcccggagatagaggttgcttt

SEQ ID NO: 89651 - DNA, 25 bp, Mus musculus
cattcccgggatgagctagctctga

SEQ ID NO: 89652 - DNA, 25 bp, Mus musculus
cattcccggtggcattgatgtcaac

SEQ ID NO: 89653 - DNA, 25 bp, Mus musculus
cattccctctgaagatattgcaaga

SEQ ID NO: 89654 - DNA, 25 bp, Mus musculus
cattccgatcctccttgagagcaaa

SEQ ID NO: 89655 - DNA, 25 bp, Mus musculus
cattccgcatgtgagaacgttttag

SEQ ID NO: 89656 - DNA, 25 bp, Mus musculus
cattccgggatagaagaaccagggc

SEQ ID NO: 89657 - DNA, 25 bp, Mus musculus
cattccgtgatgctggagtacacca

SEQ ID NO: 89658 - DNA, 25 bp, Mus musculus
cattcctaaaggatgggcagtccag

SEQ ID NO: 89659 - DNA, 25 bp, Mus musculus
cattcctcagggatacacagtggag

SEQ ID NO: 89660 - DNA, 25 bp, Mus musculus
cattcctcgttcatgagacctgctg

SEQ ID NO: 89661 - DNA, 25 bp, Mus musculus
cattcctgactttatgtcttttacc

SEQ ID NO: 89662 - DNA, 25 bp, Mus musculus
cattcctgagacagaggacgttctc

SEQ ID NO: 89663 - DNA, 25 bp, Mus musculus
cattcctgagcaacactggtttttg

SEQ ID NO: 89664 - DNA, 25 bp, Mus musculus
cattcctgaggtatcctgagcccct

SEQ ID NO: 89665 - DNA, 25 bp, Mus musculus
cattcctggatggtcttgaagaaag

SEQ ID NO: 89666 - DNA, 25 bp, Mus musculus
cattcctgtacttggttggccgcaa

SEQ ID NO: 89667 - DNA, 25 bp, Mus musculus
cattccttgggatcatcgggtcaaa

SEQ ID NO: 89668 - DNA, 25 bp, Mus musculus
cattccttgggtacctgggcattta

SEQ ID NO: 89669 - DNA, 25 bp, Mus musculus
cattccttggtgctctcagagtgca

SEQ ID NO: 89670 - DNA, 25 bp, Mus musculus
cattcgaaaaatggtgctgcccacc

SEQ ID NO: 89671 - DNA, 25 bp, Mus musculus
cattcgaatgaacctggaaaacggg

SEQ ID NO: 89672 - DNA, 25 bp, Mus musculus
cattcgaatggcctgggtagtcctt

SEQ ID NO: 89673 - DNA, 25 bp, Mus musculus
cattcgacagcagattgagtcctac

SEQ ID NO: 89674 - DNA, 25 bp, Mus musculus
cattcgaccaaacagtgcagtgcgc

SEQ ID NO: 89675 - DNA, 25 bp, Mus musculus
cattcgactccggaagggcttagct

SEQ ID NO: 89676 - DNA, 25 bp, Mus musculus
cattcgaggtggaagactgcgacca

SEQ ID NO: 89677 - DNA, 25 bp, Mus musculus
cattcgagtgttacttcgctggcgg

SEQ ID NO: 89678 - DNA, 25 bp, Mus musculus
cattcgccgccttagaaggaaggaa

SEQ ID NO: 89679 - DNA, 25 bp, Mus musculus
cattcgcggaggtgcagttgtcagc

SEQ ID NO: 89680 - DNA, 25 bp, Mus musculus
cattcgcggcctctggttctcggcg

SEQ ID NO: 89681 - DNA, 25 bp, Mus musculus
cattcgctgctggtgaactgatcca

SEQ ID NO: 89682 - DNA, 25 bp, Mus musculus
cattcggaaatttgacccaaccttg

SEQ ID NO: 89683 - DNA, 25 bp, Mus musculus
cattcggagtgggtcaatgtcacct

SEQ ID NO: 89684 - DNA, 25 bp, Mus musculus
cattcggcagaaggatgtaagcaac

SEQ ID NO: 89685 - DNA, 25 bp, Mus musculus
cattcggcctctttgacagtttcag

SEQ ID NO: 89686 - DNA, 25 bp, Mus musculus
cattcggcggttgctctagagaggc

SEQ ID NO: 89687 - DNA, 25 bp, Mus musculus
cattcggctcaggtattggcactgg

SEQ ID NO: 89688 - DNA, 25 bp, Mus musculus
cattcgggactgtaaagaccctctt

SEQ ID NO: 89689 - DNA, 25 bp, Mus musculus
cattcgggaggacaaccagactaac

SEQ ID NO: 89690 - DNA, 25 bp, Mus musculus
cattcgggcactacgacaagggact

SEQ ID NO: 89691 - DNA, 25 bp, Mus musculus
cattcggggtgtcaagtacaatcag

SEQ ID NO: 89692 - DNA, 25 bp, Mus musculus
cattcgggtatcttagacacaggga

SEQ ID NO: 89693 - DNA, 25 bp, Mus musculus
cattcggtaatgcatgctacaggga

SEQ ID NO: 89694 - DNA, 25 bp, Mus musculus
cattcgtcagcacggttggcatcga

SEQ ID NO: 89695 - DNA, 25 bp, Mus musculus
cattcgttcctaagggcatgtccaa

SEQ ID NO: 89696 - DNA, 25 bp, Mus musculus
cattcgtttcggacacgactgggac

SEQ ID NO: 89697 - DNA, 25 bp, Mus musculus
cattctaaatatgttgaagaacagc

SEQ ID NO: 89698 - DNA, 25 bp, Mus musculus
cattctagacaaactagagaaggtg

SEQ ID NO: 89699 - DNA, 25 bp, Mus musculus
cattctaggcagtgacgtggagttc

SEQ ID NO: 89700 - DNA, 25 bp, Mus musculus
cattctatcagacactgtgggcccg

SEQ ID NO: 89701 - DNA, 25 bp, Mus musculus
cattctatgagaactgctcccgcct

SEQ ID NO: 89702 - DNA, 25 bp, Mus musculus
cattctcaagtattgctgaactgaa

SEQ ID NO: 89703 - DNA, 25 bp, Mus musculus
cattctcagggtactaagggaagcc

SEQ ID NO: 89704 - DNA, 25 bp, Mus musculus
cattctcagtagtggacatccgtgg

SEQ ID NO: 89705 - DNA, 25 bp, Mus musculus
cattctcatgaagaggataatccat

SEQ ID NO: 89706 - DNA, 25 bp, Mus musculus
cattctcattgagctggtgtcatcg

SEQ ID NO: 89707 - DNA, 25 bp, Mus musculus
cattctcctggcgaagggctcggta

SEQ ID NO: 89708 - DNA, 25 bp, Mus musculus
cattctcctgtagtgtccagcctgt

SEQ ID NO: 89709 - DNA, 25 bp, Mus musculus
cattctcgggtgcaaaggctttccc

SEQ ID NO: 89710 - DNA, 25 bp, Mus musculus
cattctcggtgaagtgctgggtgcc

SEQ ID NO: 89711 - DNA, 25 bp, Mus musculus
cattctcgtgctcctaggctgtggc

SEQ ID NO: 89712 - DNA, 25 bp, Mus musculus
cattctcgtgtggacccagaggaac

SEQ ID NO: 89713 - DNA, 25 bp, Mus musculus
cattctctggtcaaatcagtctgga

SEQ ID NO: 89714 - DNA, 25 bp, Mus musculus
cattctctgtagttcatgctggccg

SEQ ID NO: 89715 - DNA, 25 bp, Mus musculus
cattctcttggtggcgtgcagtcct

SEQ ID NO: 89716 - DNA, 25 bp, Mus musculus
cattctgaatcatgaaaaggcccac

SEQ ID NO: 89717 - DNA, 25 bp, Mus musculus
cattctgaatcggagctggacagcg

SEQ ID NO: 89718 - DNA, 25 bp, Mus musculus
cattctgactcagtaggtccgggac

SEQ ID NO: 89719 - DNA, 25 bp, Mus musculus
cattctgagcgtgatgaacgtgccg

SEQ ID NO: 89720 - DNA, 25 bp, Mus musculus
cattctgagggactacaagcaaagc

SEQ ID NO: 89721 - DNA, 25 bp, Mus musculus
cattctgatagagctggccatgcgg

SEQ ID NO: 89722 - DNA, 25 bp, Mus musculus
cattctgcaaattccacctgggtga

SEQ ID NO: 89723 - DNA, 25 bp, Mus musculus
cattctgcggaatcacggactcgtg

SEQ ID NO: 89724 - DNA, 25 bp, Mus musculus
cattctgctcgaagactggacccag

SEQ ID NO: 89725 - DNA, 25 bp, Mus musculus
cattctgctgtacacgatgctggca

SEQ ID NO: 89726 - DNA, 25 bp, Mus musculus
cattctggagaaggtcagcgtccac

SEQ ID NO: 89727 - DNA, 25 bp, Mus musculus
cattctggaggaagtgaaacaccct

SEQ ID NO: 89728 - DNA, 25 bp, Mus musculus
cattctgggaaatctgggaagccac

SEQ ID NO: 89729 - DNA, 25 bp, Mus musculus
cattctgggacactcttcgggacca

SEQ ID NO: 89730 - DNA, 25 bp, Mus musculus
cattctgtcgggtgtagtcccagga

SEQ ID NO: 89731 - DNA, 25 bp, Mus musculus
cattctgtgagctgtggatccggga

SEQ ID NO: 89732 - DNA, 25 bp, Mus musculus
cattctgtggaaggtcaaggctcca

SEQ ID NO: 89733 - DNA, 25 bp, Mus musculus
cattctgtggtggtcacgaagttga

SEQ ID NO: 89734 - DNA, 25 bp, Mus musculus
cattcttcaccactggactgcggga

SEQ ID NO: 89735 - DNA, 25 bp, Mus musculus
cattcttcgcttgtgtgagcggccc

SEQ ID NO: 89736 - DNA, 25 bp, Mus musculus
cattcttgagaggatcactcagcct

SEQ ID NO: 89737 - DNA, 25 bp, Mus musculus
cattcttgtggctggtgggttcctc

SEQ ID NO: 89738 - DNA, 25 bp, Mus musculus
cattcttgttggtggaggctttgcc

SEQ ID NO: 89739 - DNA, 25 bp, Mus musculus
cattctttgccttggtcagagaaga

SEQ ID NO: 89740 - DNA, 25 bp, Mus musculus
cattgaaaaatacctggctccagcg

SEQ ID NO: 89741 - DNA, 25 bp, Mus musculus
cattgaaaacagctggtggacgaaa

SEQ ID NO: 89742 - DNA, 25 bp, Mus musculus
cattgaaaactccttggatgccgga

SEQ ID NO: 89743 - DNA, 25 bp, Mus musculus
cattgaaaaggagtcggctcggtcc

SEQ ID NO: 89744 - DNA, 25 bp, Mus musculus
cattgaaaccgattcccaagacttc

SEQ ID NO: 89745 - DNA, 25 bp, Mus musculus
cattgaaagtcggacacggagggac

SEQ ID NO: 89746 - DNA, 25 bp, Mus musculus
cattgaacatggacgaaggaatccc

SEQ ID NO: 89747 - DNA, 25 bp, Mus musculus
cattgaacgcaaacatggaaaccca

SEQ ID NO: 89748 - DNA, 25 bp, Mus musculus
cattgaacttcagcaggtaggctct

SEQ ID NO: 89749 - DNA, 25 bp, Mus musculus
cattgaagaagcaaaggcccgagca

SEQ ID NO: 89750 - DNA, 25 bp, Mus musculus
cattgaagacttttgtacgtggctc

SEQ ID NO: 89751 - DNA, 25 bp, Mus musculus
cattgaagcaaatatgtacaacaaa

SEQ ID NO: 89752 - DNA, 25 bp, Mus musculus
cattgaagccgaatcagaaagggcc

SEQ ID NO: 89753 - DNA, 25 bp, Mus musculus
cattgaaggtggtatggaagcctgc

SEQ ID NO: 89754 - DNA, 25 bp, Mus musculus
cattgaagtggtgaaatttggacgc

SEQ ID NO: 89755 - DNA, 25 bp, Mus musculus
cattgaataccaggagaagccgttg

SEQ ID NO: 89756 - DNA, 25 bp, Mus musculus
cattgaatagttctggcagctccca

SEQ ID NO: 89757 - DNA, 25 bp, Mus musculus
cattgaatatgcagtcgtcccagct

SEQ ID NO: 89758 - DNA, 25 bp, Mus musculus
cattgaatctgtcaaagacctcctg

SEQ ID NO: 89759 - DNA, 25 bp, Mus musculus
cattgaatgatgtggatagtcgcca

SEQ ID NO: 89760 - DNA, 25 bp, Mus musculus
cattgacaatggtgaactggtaggc

SEQ ID NO: 89761 - DNA, 25 bp, Mus musculus
cattgacacacttcgggagatcctg

SEQ ID NO: 89762 - DNA, 25 bp, Mus musculus
cattgacagcaaactataggcccga

SEQ ID NO: 89763 - DNA, 25 bp, Mus musculus
cattgacaggcatctaggagaacct

SEQ ID NO: 89764 - DNA, 25 bp, Mus musculus
cattgacagtgaagggcatcggtac

SEQ ID NO: 89765 - DNA, 25 bp, Mus musculus
cattgacatggcgtctcatcggccg

SEQ ID NO: 89766 - DNA, 25 bp, Mus musculus
cattgacattccactctagccttga

SEQ ID NO: 89767 - DNA, 25 bp, Mus musculus
cattgacatttacagcgccagttgg

SEQ ID NO: 89768 - DNA, 25 bp, Mus musculus
cattgaccaagtgggtgtgccccgc

SEQ ID NO: 89769 - DNA, 25 bp, Mus musculus
cattgaccaggataatcgcagcacg

SEQ ID NO: 89770 - DNA, 25 bp, Mus musculus
cattgacccgaaattaaagtggatc

SEQ ID NO: 89771 - DNA, 25 bp, Mus musculus
cattgacccggactttgcgagcgtt

SEQ ID NO: 89772 - DNA, 25 bp, Mus musculus
cattgaccggcatggaaagcctatc

SEQ ID NO: 89773 - DNA, 25 bp, Mus musculus
cattgaccgtgcatggactgctgaa

SEQ ID NO: 89774 - DNA, 25 bp, Mus musculus
cattgacctcacaaggaacgagggt

SEQ ID NO: 89775 - DNA, 25 bp, Mus musculus
cattgacctcgagggcaacgtctgc

SEQ ID NO: 89776 - DNA, 25 bp, Mus musculus
cattgacctggctgggaacgaaaga

SEQ ID NO: 89777 - DNA, 25 bp, Mus musculus
cattgacctggtggccttcttgggc

SEQ ID NO: 89778 - DNA, 25 bp, Mus musculus
cattgacctgtgtcttcagaggaga

SEQ ID NO: 89779 - DNA, 25 bp, Mus musculus
cattgacgacgaggacagctttaac

SEQ ID NO: 89780 - DNA, 25 bp, Mus musculus
cattgacgtgctcaagagagacccg

SEQ ID NO: 89781 - DNA, 25 bp, Mus musculus
cattgactacagtttggtggcggct

SEQ ID NO: 89782 - DNA, 25 bp, Mus musculus
cattgactcacgaggctgagcggcc

SEQ ID NO: 89783 - DNA, 25 bp, Mus musculus
cattgactgggacagtgagacccga

SEQ ID NO: 89784 - DNA, 25 bp, Mus musculus
cattgactttggacatatggaggcc

SEQ ID NO: 89785 - DNA, 25 bp, Mus musculus
cattgactttgtgaagcggctgcca

SEQ ID NO: 89786 - DNA, 25 bp, Mus musculus
cattgagaagaactggagtaccgac

SEQ ID NO: 89787 - DNA, 25 bp, Mus musculus
cattgagaagatcaaacggccccgg

SEQ ID NO: 89788 - DNA, 25 bp, Mus musculus
cattgagaaggcgaggaaagctgcc

SEQ ID NO: 89789 - DNA, 25 bp, Mus musculus
cattgagaagttcggcattcggcta

SEQ ID NO: 89790 - DNA, 25 bp, Mus musculus
cattgagaatgtgtgagtcacagcc

SEQ ID NO: 89791 - DNA, 25 bp, Mus musculus
cattgagatagagatgcgagtcccc

SEQ ID NO: 89792 - DNA, 25 bp, Mus musculus
cattgagatcaagcttggccagccg

SEQ ID NO: 89793 - DNA, 25 bp, Mus musculus
cattgagatgctcctgacctcggac

SEQ ID NO: 89794 - DNA, 25 bp, Mus musculus
cattgagccgtacatccatgaaggg

SEQ ID NO: 89795 - DNA, 25 bp, Mus musculus
cattgagcggaaaccagagtacctc

SEQ ID NO: 89796 - DNA, 25 bp, Mus musculus
cattgagctaaaggacagaccaggc

SEQ ID NO: 89797 - DNA, 25 bp, Mus musculus
cattgagctagccttggaaaagcac

SEQ ID NO: 89798 - DNA, 25 bp, Mus musculus
cattgagctgccctaccatggtgag

SEQ ID NO: 89799 - DNA, 25 bp, Mus musculus
cattgagcttgaccagcccatgcag

SEQ ID NO: 89800 - DNA, 25 bp, Mus musculus
cattgaggaactaagaccgctggag

SEQ ID NO: 89801 - DNA, 25 bp, Mus musculus
cattgaggacaacaagattggctcc

SEQ ID NO: 89802 - DNA, 25 bp, Mus musculus
cattgaggacaaccagatccgtgcc

SEQ ID NO: 89803 - DNA, 25 bp, Mus musculus
cattgaggacaatggcaaccctgtg

SEQ ID NO: 89804 - DNA, 25 bp, Mus musculus
cattgaggacatcagcatgaagttc

SEQ ID NO: 89805 - DNA, 25 bp, Mus musculus
cattgaggacgaaggagtcctggac

SEQ ID NO: 89806 - DNA, 25 bp, Mus musculus
cattgaggagattccggacgagacc

SEQ ID NO: 89807 - DNA, 25 bp, Mus musculus
cattgaggccgaagagaaggtccac

SEQ ID NO: 89808 - DNA, 25 bp, Mus musculus
cattgagggagcaaacattcctgga

SEQ ID NO: 89809 - DNA, 25 bp, Mus musculus
cattgagtaccccatgaacaggtgg

SEQ ID NO: 89810 - DNA, 25 bp, Mus musculus
cattgagtatgactggaacctgaca

SEQ ID NO: 89811 - DNA, 25 bp, Mus musculus
cattgagtcccatgtgccctgggcc

SEQ ID NO: 89812 - DNA, 25 bp, Mus musculus
cattgagtctggctccatagcaggc

SEQ ID NO: 89813 - DNA, 25 bp, Mus musculus
cattgagttccaaggaggtggccat

SEQ ID NO: 89814 - DNA, 25 bp, Mus musculus
cattgatatctacttggtcactctg

SEQ ID NO: 89815 - DNA, 25 bp, Mus musculus
cattgatatgatctgccgtgcccac

SEQ ID NO: 89816 - DNA, 25 bp, Mus musculus
cattgatcagaaggaggtacttccg

SEQ ID NO: 89817 - DNA, 25 bp, Mus musculus
cattgatcccaatgccaagggctgg

SEQ ID NO: 89818 - DNA, 25 bp, Mus musculus
cattgatcctggacgagcaaggccg

SEQ ID NO: 89819 - DNA, 25 bp, Mus musculus
cattgatcgggcaaccttgacgaga

SEQ ID NO: 89820 - DNA, 25 bp, Mus musculus
cattgatctagtcagcagtgatgat

SEQ ID NO: 89821 - DNA, 25 bp, Mus musculus
cattgatgaatgtgctcaggtccgg

SEQ ID NO: 89822 - DNA, 25 bp, Mus musculus
cattgatgacgtgcggaacaggttc

SEQ ID NO: 89823 - DNA, 25 bp, Mus musculus
cattgatgagctgagaaaggcactg

SEQ ID NO: 89824 - DNA, 25 bp, Mus musculus
cattgatgagctgatcggcatccct

SEQ ID NO: 89825 - DNA, 25 bp, Mus musculus
cattgatgatgacaagggacggacc

SEQ ID NO: 89826 - DNA, 25 bp, Mus musculus
cattgatgcccatgcaggaggacta

SEQ ID NO: 89827 - DNA, 25 bp, Mus musculus
cattgatgcgatgcagaaggcctgc

SEQ ID NO: 89828 - DNA, 25 bp, Mus musculus
cattgatggacacttgggtagcttc

SEQ ID NO: 89829 - DNA, 25 bp, Mus musculus
cattgatggcaccaaagacgaggac

SEQ ID NO: 89830 - DNA, 25 bp, Mus musculus
cattgatggcgaagccttggtagga

SEQ ID NO: 89831 - DNA, 25 bp, Mus musculus
cattgatggcgtcaacacagacacc

SEQ ID NO: 89832 - DNA, 25 bp, Mus musculus
cattgatgggagaaagactgggact

SEQ ID NO: 89833 - DNA, 25 bp, Mus musculus
cattgattaacctgcaggagcccgg

SEQ ID NO: 89834 - DNA, 25 bp, Mus musculus
cattgattacaacggcgagcggaca

SEQ ID NO: 89835 - DNA, 25 bp, Mus musculus
cattgcaaacgggatgagcttcgta

SEQ ID NO: 89836 - DNA, 25 bp, Mus musculus
cattgcaaagacctgcgggtgctcc

SEQ ID NO: 89837 - DNA, 25 bp, Mus musculus
cattgcaatcgtaaagctgggtatc

SEQ ID NO: 89838 - DNA, 25 bp, Mus musculus
cattgcagccatggatgggtttgcc

SEQ ID NO: 89839 - DNA, 25 bp, Mus musculus
cattgcagcccaggcgatactgtcg

SEQ ID NO: 89840 - DNA, 25 bp, Mus musculus
cattgcagcgggttgcagttggcca

SEQ ID NO: 89841 - DNA, 25 bp, Mus musculus
cattgcagcttggagcgaggacagc

SEQ ID NO: 89842 - DNA, 25 bp, Mus musculus
cattgcaggctagtatataccgagg

SEQ ID NO: 89843 - DNA, 25 bp, Mus musculus
cattgcaggtaccaagaagcgagtg

SEQ ID NO: 89844 - DNA, 25 bp, Mus musculus
cattgcatcagtgggctttcacgag

SEQ ID NO: 89845 - DNA, 25 bp, Mus musculus
cattgcatcgaagaagccactcctg

SEQ ID NO: 89846 - DNA, 25 bp, Mus musculus
cattgcattaattgctgcgtccagc

SEQ ID NO: 89847 - DNA, 25 bp, Mus musculus
cattgccaagagtatagaccctgag

SEQ ID NO: 89848 - DNA, 25 bp, Mus musculus
cattgccaaggccaacatgggtgta

SEQ ID NO: 89849 - DNA, 25 bp, Mus musculus
cattgccacaaggaggttagaagac

SEQ ID NO: 89850 - DNA, 25 bp, Mus musculus
cattgccacctctcgattcagggaa

SEQ ID NO: 89851 - DNA, 25 bp, Mus musculus
cattgccactaaggaagggtacaga

SEQ ID NO: 89852 - DNA, 25 bp, Mus musculus
cattgccagcaccatcgtgagtgtg

SEQ ID NO: 89853 - DNA, 25 bp, Mus musculus
cattgccagctttcgggagactgag

SEQ ID NO: 89854 - DNA, 25 bp, Mus musculus
cattgccaggaagaaacgcatccct

SEQ ID NO: 89855 - DNA, 25 bp, Mus musculus
cattgccatcgacgttggaagccag

SEQ ID NO: 89856 - DNA, 25 bp, Mus musculus
cattgccatcggctgtgaaaggaga

SEQ ID NO: 89857 - DNA, 25 bp, Mus musculus
cattgccatggagaaagtagcatcc

SEQ ID NO: 89858 - DNA, 25 bp, Mus musculus
cattgcccaccagaaaggacagata

SEQ ID NO: 89859 - DNA, 25 bp, Mus musculus
cattgcccagatctaccatgcagtt

SEQ ID NO: 89860 - DNA, 25 bp, Mus musculus
cattgccctgagtgtggatgcacca

SEQ ID NO: 89861 - DNA, 25 bp, Mus musculus
cattgccgacgtccagtgttacact

SEQ ID NO: 89862 - DNA, 25 bp, Mus musculus
cattgccgcaaactaagcatccctt

SEQ ID NO: 89863 - DNA, 25 bp, Mus musculus
cattgccggtcaaggccgaaaggac

SEQ ID NO: 89864 - DNA, 25 bp, Mus musculus
cattgcctcttaagtctcgtgggac

SEQ ID NO: 89865 - DNA, 25 bp, Mus musculus
cattgcctgcttggaaagaagaggt

SEQ ID NO: 89866 - DNA, 25 bp, Mus musculus
cattgcctggcaataagtacgggct

SEQ ID NO: 89867 - DNA, 25 bp, Mus musculus
cattgcctgggtgctcgtgtatttc

SEQ ID NO: 89868 - DNA, 25 bp, Mus musculus
cattgcctttaacaacacctgaaga

SEQ ID NO: 89869 - DNA, 25 bp, Mus musculus
cattgcgacattccgctcgtgggca

SEQ ID NO: 89870 - DNA, 25 bp, Mus musculus
cattgcgagcatgtagacggttaaa

SEQ ID NO: 89871 - DNA, 25 bp, Mus musculus
cattgcgatagagtatgtgaccctc

SEQ ID NO: 89872 - DNA, 25 bp, Mus musculus
cattgcgggacagttctatggccac

SEQ ID NO: 89873 - DNA, 25 bp, Mus musculus
cattgcgtccgttgcagatgatgag

SEQ ID NO: 89874 - DNA, 25 bp, Mus musculus
cattgcgtcggcagtacctgaggct

SEQ ID NO: 89875 - DNA, 25 bp, Mus musculus
cattgcgtctgatctcgtggaggac

SEQ ID NO: 89876 - DNA, 25 bp, Mus musculus
cattgctaacgtcttcttacaggaa

SEQ ID NO: 89877 - DNA, 25 bp, Mus musculus
cattgctaccttggtggtggcccag

SEQ ID NO: 89878 - DNA, 25 bp, Mus musculus
cattgctactcagcgaatcaaggga

SEQ ID NO: 89879 - DNA, 25 bp, Mus musculus
cattgctatcaagtgcccagtatgg

SEQ ID NO: 89880 - DNA, 25 bp, Mus musculus
cattgctattcgatcacctggagac

SEQ ID NO: 89881 - DNA, 25 bp, Mus musculus
cattgctcagcattcgtgtcagggt

SEQ ID NO: 89882 - DNA, 25 bp, Mus musculus
cattgctcagtattggctgggctgc

SEQ ID NO: 89883 - DNA, 25 bp, Mus musculus
cattgctcgggagatcaacgacgta

SEQ ID NO: 89884 - DNA, 25 bp, Mus musculus
cattgctcgtgatgtgacagacaac

SEQ ID NO: 89885 - DNA, 25 bp, Mus musculus
cattgctgaaagagagctgggccga

SEQ ID NO: 89886 - DNA, 25 bp, Mus musculus
cattgctgatgagaaccagaaccac

SEQ ID NO: 89887 - DNA, 25 bp, Mus musculus
cattgctgcacatccctgagggtga

SEQ ID NO: 89888 - DNA, 25 bp, Mus musculus
cattgctgcagcagaataagcaggt

SEQ ID NO: 89889 - DNA, 25 bp, Mus musculus
cattgctgcagggtccgagattaga

SEQ ID NO: 89890 - DNA, 25 bp, Mus musculus
cattgctgccaatatggataccgtg

SEQ ID NO: 89891 - DNA, 25 bp, Mus musculus
cattgctgccactgaactcgaagga

SEQ ID NO: 89892 - DNA, 25 bp, Mus musculus
cattgctgcgcacgtagactgtaca

SEQ ID NO: 89893 - DNA, 25 bp, Mus musculus
cattgctgcgggagaagaagttgcc

SEQ ID NO: 89894 - DNA, 25 bp, Mus musculus
cattgctggaggagataaaggccct

SEQ ID NO: 89895 - DNA, 25 bp, Mus musculus
cattgctgggatggagcctttcgac

SEQ ID NO: 89896 - DNA, 25 bp, Mus musculus
cattgctgtagtctgagcgtgcgca

SEQ ID NO: 89897 - DNA, 25 bp, Mus musculus
cattgctgtattgaaagaccgcccc

SEQ ID NO: 89898 - DNA, 25 bp, Mus musculus
cattgctgtggaagcaggcgctttt

SEQ ID NO: 89899 - DNA, 25 bp, Mus musculus
cattgcttccccataggctctgaga

SEQ ID NO: 89900 - DNA, 25 bp, Mus musculus
cattgcttgcatttggtgagggcct

SEQ ID NO: 89901 - DNA, 25 bp, Mus musculus
cattgcttggcaggtatcagccgct

SEQ ID NO: 89902 - DNA, 25 bp, Mus musculus
cattggaaacggtgactgagacaga

SEQ ID NO: 89903 - DNA, 25 bp, Mus musculus
cattggaaaggcacaaggcattgtc

SEQ ID NO: 89904 - DNA, 25 bp, Mus musculus
cattggaacaactgcatgctgtgga

SEQ ID NO: 89905 - DNA, 25 bp, Mus musculus
cattggaacaagcaaaggtggattt

SEQ ID NO: 89906 - DNA, 25 bp, Mus musculus
cattggaacatctatggcagtgaag

SEQ ID NO: 89907 - DNA, 25 bp, Mus musculus
cattggaaccacatttgaaggacgt

SEQ ID NO: 89908 - DNA, 25 bp, Mus musculus
cattggaactcaaggcccaagaggt

SEQ ID NO: 89909 - DNA, 25 bp, Mus musculus
cattggaagatgcacagatccctta

SEQ ID NO: 89910 - DNA, 25 bp, Mus musculus
cattggaagcttgcaaagatgctgg

SEQ ID NO: 89911 - DNA, 25 bp, Mus musculus
cattggaagttttgaggcggctgac

SEQ ID NO: 89912 - DNA, 25 bp, Mus musculus
cattggaatattaagcccgggagtg

SEQ ID NO: 89913 - DNA, 25 bp, Mus musculus
cattggaattgcttttggactggcc

SEQ ID NO: 89914 - DNA, 25 bp, Mus musculus
cattggacctcaaagaacactgtac

SEQ ID NO: 89915 - DNA, 25 bp, Mus musculus
cattggactgcacgaccttcgaggg

SEQ ID NO: 89916 - DNA, 25 bp, Mus musculus
cattggagaggtgcaggtcttcgac

SEQ ID NO: 89917 - DNA, 25 bp, Mus musculus
cattggagcccctgtgctaggaagc

SEQ ID NO: 89918 - DNA, 25 bp, Mus musculus
cattggaggtatcaccccgggttct

SEQ ID NO: 89919 - DNA, 25 bp, Mus musculus
cattggattcagcttcttggtggtc

SEQ ID NO: 89920 - DNA, 25 bp, Mus musculus
cattggatttcgatttagccaggag

SEQ ID NO: 89921 - DNA, 25 bp, Mus musculus
cattggcaacgctggacaagacctt

SEQ ID NO: 89922 - DNA, 25 bp, Mus musculus
cattggcacacacttcatggatggc

SEQ ID NO: 89923 - DNA, 25 bp, Mus musculus
cattggcacgtttggactgggagct

SEQ ID NO: 89924 - DNA, 25 bp, Mus musculus
cattggcagctctcaagattcctgg

SEQ ID NO: 89925 - DNA, 25 bp, Mus musculus
cattggcatcctcatgaccgggaac

SEQ ID NO: 89926 - DNA, 25 bp, Mus musculus
cattggcccacttgatatgaagcag

SEQ ID NO: 89927 - DNA, 25 bp, Mus musculus
cattggccctgaagctacatggata

SEQ ID NO: 89928 - DNA, 25 bp, Mus musculus
cattggccctgacttccagaagggt

SEQ ID NO: 89929 - DNA, 25 bp, Mus musculus
cattggcctctttgctgtggacaga

SEQ ID NO: 89930 - DNA, 25 bp, Mus musculus
cattggcctgggtgcaagttccctg

SEQ ID NO: 89931 - DNA, 25 bp, Mus musculus
cattggcgttggcagcaaagccgca

SEQ ID NO: 89932 - DNA, 25 bp, Mus musculus
cattggctagtgctgggcactcata

SEQ ID NO: 89933 - DNA, 25 bp, Mus musculus
cattggctcttgtggctgtggcagc

SEQ ID NO: 89934 - DNA, 25 bp, Mus musculus
cattggctggactccggtgatgaca

SEQ ID NO: 89935 - DNA, 25 bp, Mus musculus
cattggctgtctgaaaaggtgtggc

SEQ ID NO: 89936 - DNA, 25 bp, Mus musculus
cattggctgttgtccagagtgggcc

SEQ ID NO: 89937 - DNA, 25 bp, Mus musculus
cattgggaacgtttcatgtgcaacc

SEQ ID NO: 89938 - DNA, 25 bp, Mus musculus
cattgggacatcagaacgtggctcc

SEQ ID NO: 89939 - DNA, 25 bp, Mus musculus
cattgggagctaggcaggacagact

SEQ ID NO: 89940 - DNA, 25 bp, Mus musculus
cattgggatcctgctttctcgggtg

SEQ ID NO: 89941 - DNA, 25 bp, Mus musculus
cattgggccagacaccatggatcca

SEQ ID NO: 89942 - DNA, 25 bp, Mus musculus
cattgggcgcaacagaactaatcga

SEQ ID NO: 89943 - DNA, 25 bp, Mus musculus
cattgggcgcctgttatttcgtgag

SEQ ID NO: 89944 - DNA, 25 bp, Mus musculus
cattgggtgagttctgcagagtcac

SEQ ID NO: 89945 - DNA, 25 bp, Mus musculus
cattggtaatgcagaaaagggactt

SEQ ID NO: 89946 - DNA, 25 bp, Mus musculus
cattggtacacactaacctcggtgg

SEQ ID NO: 89947 - DNA, 25 bp, Mus musculus
cattggtcctctggtgttcggtggc

SEQ ID NO: 89948 - DNA, 25 bp, Mus musculus
cattggtcctggtcatcagccgcta

SEQ ID NO: 89949 - DNA, 25 bp, Mus musculus
cattggtctaagcatcgggtggtca

SEQ ID NO: 89950 - DNA, 25 bp, Mus musculus
cattggtgacgatgtgactcagctc

SEQ ID NO: 89951 - DNA, 25 bp, Mus musculus
cattggtgagatcaagggccacgac

SEQ ID NO: 89952 - DNA, 25 bp, Mus musculus
cattggtgagcctgagagtatcgac

SEQ ID NO: 89953 - DNA, 25 bp, Mus musculus
cattggtgattgaccctaggctggg

SEQ ID NO: 89954 - DNA, 25 bp, Mus musculus
cattggtggctttgccatctggtgc

SEQ ID NO: 89955 - DNA, 25 bp, Mus musculus
cattggtggttgatagatgggactc

SEQ ID NO: 89956 - DNA, 25 bp, Mus musculus
cattggttcagtcccaagcgaggga

SEQ ID NO: 89957 - DNA, 25 bp, Mus musculus
cattggttccgtaaagcaggtagaa

SEQ ID NO: 89958 - DNA, 25 bp, Mus musculus
cattggttggcctgagtctcatagc

SEQ ID NO: 89959 - DNA, 25 bp, Mus musculus
cattgtacgggaaaacacagaaggc

SEQ ID NO: 89960 - DNA, 25 bp, Mus musculus
cattgtaggactataccgtacggga

SEQ ID NO: 89961 - DNA, 25 bp, Mus musculus
cattgtagtggatatgaccttgctg

SEQ ID NO: 89962 - DNA, 25 bp, Mus musculus
cattgtatgggctcgagggcttcca

SEQ ID NO: 89963 - DNA, 25 bp, Mus musculus
cattgtatggttggaattgccgggc

SEQ ID NO: 89964 - DNA, 25 bp, Mus musculus
cattgtcaacagagaaggagtcaac

SEQ ID NO: 89965 - DNA, 25 bp, Mus musculus
cattgtcaaccggaaggagaacaag

SEQ ID NO: 89966 - DNA, 25 bp, Mus musculus
cattgtcaggaaccagggcaaaacc

SEQ ID NO: 89967 - DNA, 25 bp, Mus musculus
cattgtccattgtagagaggaccga

SEQ ID NO: 89968 - DNA, 25 bp, Mus musculus
cattgtccgccaggtagtggagaac

SEQ ID NO: 89969 - DNA, 25 bp, Mus musculus
cattgtccgcgtcatgcagttgcca

SEQ ID NO: 89970 - DNA, 25 bp, Mus musculus
cattgtcctggagctatactggaag

SEQ ID NO: 89971 - DNA, 25 bp, Mus musculus
cattgtcgtgtaccacagaggccgt

SEQ ID NO: 89972 - DNA, 25 bp, Mus musculus
cattgtctgcgtcttgaaccgtgaa

SEQ ID NO: 89973 - DNA, 25 bp, Mus musculus
cattgtctgtgttggtccccgtggc

SEQ ID NO: 89974 - DNA, 25 bp, Mus musculus
cattgtgaaggccatgagcgactac

SEQ ID NO: 89975 - DNA, 25 bp, Mus musculus
cattgtgaatgtctccagccaggcc

SEQ ID NO: 89976 - DNA, 25 bp, Mus musculus
cattgtgatggaaaacaacctccag

SEQ ID NO: 89977 - DNA, 25 bp, Mus musculus
cattgtgatgtcaggccacgagacc

SEQ ID NO: 89978 - DNA, 25 bp, Mus musculus
cattgtgctggtacggaaagggaaa

SEQ ID NO: 89979 - DNA, 25 bp, Mus musculus
cattgtggacactccaggatttggg

SEQ ID NO: 89980 - DNA, 25 bp, Mus musculus
cattgtggaccccttgagcttcagc

SEQ ID NO: 89981 - DNA, 25 bp, Mus musculus
cattgtggcaaacagtcaacatgga

SEQ ID NO: 89982 - DNA, 25 bp, Mus musculus
cattgtggcacgagatgaagtagac

SEQ ID NO: 89983 - DNA, 25 bp, Mus musculus
cattgtggcctggaacgagatcgaa

SEQ ID NO: 89984 - DNA, 25 bp, Mus musculus
cattgtggctgagattgaggacttc

SEQ ID NO: 89985 - DNA, 25 bp, Mus musculus
cattgtggtgaggagaatccgtccc

SEQ ID NO: 89986 - DNA, 25 bp, Mus musculus
cattgtgtccctcctgaacgtgtac

SEQ ID NO: 89987 - DNA, 25 bp, Mus musculus
cattgtgtggacagacgagtcttca

SEQ ID NO: 89988 - DNA, 25 bp, Mus musculus
cattgtgtggagtcaataagacccg

SEQ ID NO: 89989 - DNA, 25 bp, Mus musculus
cattgtgtgtcgagtactccaggga

SEQ ID NO: 89990 - DNA, 25 bp, Mus musculus
cattgtgtgtctggaagagtcgctc

SEQ ID NO: 89991 - DNA, 25 bp, Mus musculus
cattgtgtttaaagctgggagccca

SEQ ID NO: 89992 - DNA, 25 bp, Mus musculus
cattgtgtttcttggcttcggagca

SEQ ID NO: 89993 - DNA, 25 bp, Mus musculus
cattgttacagtggaccaaccccag

SEQ ID NO: 89994 - DNA, 25 bp, Mus musculus
cattgttcgtgttctgcaggctcca

SEQ ID NO: 89995 - DNA, 25 bp, Mus musculus
cattgttgaaaaagccgacagctcc

SEQ ID NO: 89996 - DNA, 25 bp, Mus musculus
cattgttgactatgaatgttttctg

SEQ ID NO: 89997 - DNA, 25 bp, Mus musculus
cattgttgcttactcggaacgtgaa

SEQ ID NO: 89998 - DNA, 25 bp, Mus musculus
cattgttggaccacgaggatcagga

SEQ ID NO: 89999 - DNA, 25 bp, Mus musculus
cattgttgtggcctctggaaagggt

SEQ ID NO: 90000 - DNA, 25 bp, Mus musculus
cattgtttcggagctatgccaggca

SEQ ID NO: 90001 - DNA, 25 bp, Mus musculus
cattgtttctcttccagcttctcgt

SEQ ID NO: 90002 - DNA, 25 bp, Mus musculus
catttaaacctcaatggctgcacga

SEQ ID NO: 90003 - DNA, 25 bp, Mus musculus
catttaaagaccgagtcacctgggc

SEQ ID NO: 90004 - DNA, 25 bp, Mus musculus
catttaaagcagtcggccatcctcc

SEQ ID NO: 90005 - DNA, 25 bp, Mus musculus
catttaaatctgtcaaggcgctctg

SEQ ID NO: 90006 - DNA, 25 bp, Mus musculus
catttaacaaagatggctatcggta

SEQ ID NO: 90007 - DNA, 25 bp, Mus musculus
catttaacgacagaaggttgccagg

SEQ ID NO: 90008 - DNA, 25 bp, Mus musculus
catttaagactagtgatgacaccgt

SEQ ID NO: 90009 - DNA, 25 bp, Mus musculus
catttaaggccaagtccaggtgact

SEQ ID NO: 90010 - DNA, 25 bp, Mus musculus
catttaagtatgctccaggcttgca

SEQ ID NO: 90011 - DNA, 25 bp, Mus musculus
catttaatcatgcaaggccttggtg

SEQ ID NO: 90012 - DNA, 25 bp, Mus musculus
catttacaccacaggaaccgaagag

SEQ ID NO: 90013 - DNA, 25 bp, Mus musculus
catttacacggcaggtggctgtgga

SEQ ID NO: 90014 - DNA, 25 bp, Mus musculus
catttacagcggcacatcctggaga

SEQ ID NO: 90015 - DNA, 25 bp, Mus musculus
catttacccaactgtggctgaggtc

SEQ ID NO: 90016 - DNA, 25 bp, Mus musculus
catttacgaatcagtccgggttcac

SEQ ID NO: 90017 - DNA, 25 bp, Mus musculus
catttactaattactggtggtggcc

SEQ ID NO: 90018 - DNA, 25 bp, Mus musculus
catttactatggagccctggaagcc

SEQ ID NO: 90019 - DNA, 25 bp, Mus musculus
catttactcgggaacactgacgcct

SEQ ID NO: 90020 - DNA, 25 bp, Mus musculus
catttactgaggtggacaacccagc

SEQ ID NO: 90021 - DNA, 25 bp, Mus musculus
catttactgctaaccagattgatga

SEQ ID NO: 90022 - DNA, 25 bp, Mus musculus
catttagaggagaccctgagtgctg

SEQ ID NO: 90023 - DNA, 25 bp, Mus musculus
catttagatatgaccagcgatgctg

SEQ ID NO: 90024 - DNA, 25 bp, Mus musculus
catttaggcgaatcagtgacaggtc

SEQ ID NO: 90025 - DNA, 25 bp, Mus musculus
catttataccattgacggatccagg

SEQ ID NO: 90026 - DNA, 25 bp, Mus musculus
catttatatcaccattgttgaaatt

SEQ ID NO: 90027 - DNA, 25 bp, Mus musculus
catttatcatacaggtggagcatac

SEQ ID NO: 90028 - DNA, 25 bp, Mus musculus
catttatgatatctgccgccgtaac

SEQ ID NO: 90029 - DNA, 25 bp, Mus musculus
catttatgccatagtcaaggagaaa

SEQ ID NO: 90030 - DNA, 25 bp, Mus musculus
catttatggccgcaaatacgacttt

SEQ ID NO: 90031 - DNA, 25 bp, Mus musculus
catttatgggacttgcaagacagag

SEQ ID NO: 90032 - DNA, 25 bp, Mus musculus
catttatgtgcccttaccggacgca

SEQ ID NO: 90033 - DNA, 25 bp, Mus musculus
catttattggtcgactctgcagaga

SEQ ID NO: 90034 - DNA, 25 bp, Mus musculus
catttattggtggaacgcagatggc

SEQ ID NO: 90035 - DNA, 25 bp, Mus musculus
catttcaagccaggaaggatcaacg

SEQ ID NO: 90036 - DNA, 25 bp, Mus musculus
catttcaagcgctatcatgatccca

SEQ ID NO: 90037 - DNA, 25 bp, Mus musculus
catttcacagctctgggcttcgagg

SEQ ID NO: 90038 - DNA, 25 bp, Mus musculus
catttcacatggagacgggaggcaa

SEQ ID NO: 90039 - DNA, 25 bp, Mus musculus
catttcacgaagctggagatctgca

SEQ ID NO: 90040 - DNA, 25 bp, Mus musculus
catttcagatactacccactacggg

SEQ ID NO: 90041 - DNA, 25 bp, Mus musculus
catttcagatgtggactgcgtacgc

SEQ ID NO: 90042 - DNA, 25 bp, Mus musculus
catttcagggaccaagcgtgagacc

SEQ ID NO: 90043 - DNA, 25 bp, Mus musculus
catttcagttcagttcgggtcagtt

SEQ ID NO: 90044 - DNA, 25 bp, Mus musculus
catttcatgtgggatctgagcctac

SEQ ID NO: 90045 - DNA, 25 bp, Mus musculus
catttcattgcttggacaggccggg

SEQ ID NO: 90046 - DNA, 25 bp, Mus musculus
catttcattggtagtatggcccgcg

SEQ ID NO: 90047 - DNA, 25 bp, Mus musculus
catttcatttaccagggtcgggcaa

SEQ ID NO: 90048 - DNA, 25 bp, Mus musculus
catttccaccaagggtatctgctgc

SEQ ID NO: 90049 - DNA, 25 bp, Mus musculus
catttccaggaggtgatgccagctg

SEQ ID NO: 90050 - DNA, 25 bp, Mus musculus
catttccataacctgaggaagtccg

SEQ ID NO: 90051 - DNA, 25 bp, Mus musculus
catttcccaccgaggatagtaggac

SEQ ID NO: 90052 - DNA, 25 bp, Mus musculus
catttcccagaaggatgagcactgc

SEQ ID NO: 90053 - DNA, 25 bp, Mus musculus
catttccctcaccaagtgttgggcg

SEQ ID NO: 90054 - DNA, 25 bp, Mus musculus
catttccctgaactgccattcacag

SEQ ID NO: 90055 - DNA, 25 bp, Mus musculus
catttccctgggatgtggcacagcg

SEQ ID NO: 90056 - DNA, 25 bp, Mus musculus
catttccgaatggagacttggccag

SEQ ID NO: 90057 - DNA, 25 bp, Mus musculus
catttccggaatgtccatagtgaag

SEQ ID NO: 90058 - DNA, 25 bp, Mus musculus
catttccggagctcactggtgcggc

SEQ ID NO: 90059 - DNA, 25 bp, Mus musculus
catttccgggttgttacagccgcga

SEQ ID NO: 90060 - DNA, 25 bp, Mus musculus
catttccggtcagatggatgacgcc

SEQ ID NO: 90061 - DNA, 25 bp, Mus musculus
catttcctctcgagccacggtggta

SEQ ID NO: 90062 - DNA, 25 bp, Mus musculus
catttcctgactggatcgaagggta

SEQ ID NO: 90063 - DNA, 25 bp, Mus musculus
catttcctgaggagttgatgcacca

SEQ ID NO: 90064 - DNA, 25 bp, Mus musculus
catttcctggattacggctggctca

SEQ ID NO: 90065 - DNA, 25 bp, Mus musculus
catttcgagggacgatgacagaccc

SEQ ID NO: 90066 - DNA, 25 bp, Mus musculus
catttcgagtgagcattccaacgga

SEQ ID NO: 90067 - DNA, 25 bp, Mus musculus
catttcgcgattgcggacgttgaga

SEQ ID NO: 90068 - DNA, 25 bp, Mus musculus
catttcgtggaggtaacaatcgcag

SEQ ID NO: 90069 - DNA, 25 bp, Mus musculus
catttcgttgaatgaccctggagga

SEQ ID NO: 90070 - DNA, 25 bp, Mus musculus
catttctaagcgatgcagccagcga

SEQ ID NO: 90071 - DNA, 25 bp, Mus musculus
catttctcatttggctggcaaggcg

SEQ ID NO: 90072 - DNA, 25 bp, Mus musculus
catttctgaagaaaaagccaaggga

SEQ ID NO: 90073 - DNA, 25 bp, Mus musculus
catttctggctgcatttgaagggac

SEQ ID NO: 90074 - DNA, 25 bp, Mus musculus
catttctggctgtctccctggtacg

SEQ ID NO: 90075 - DNA, 25 bp, Mus musculus
catttctgtagaacatctggtgaca

SEQ ID NO: 90076 - DNA, 25 bp, Mus musculus
catttctgtgcacgcatctgggaga

SEQ ID NO: 90077 - DNA, 25 bp, Mus musculus
catttctgtgggaaagggactccaa

SEQ ID NO: 90078 - DNA, 25 bp, Mus musculus
catttcttgcaaaggacagcccagc

SEQ ID NO: 90079 - DNA, 25 bp, Mus musculus
catttctttggacatgtgtgttttc

SEQ ID NO: 90080 - DNA, 25 bp, Mus musculus
catttgaaatgaggcgtttggtgtt

SEQ ID NO: 90081 - DNA, 25 bp, Mus musculus
catttgaagggaaaactgaccgcac

SEQ ID NO: 90082 - DNA, 25 bp, Mus musculus
catttgaagtatcagggaggaaacc

SEQ ID NO: 90083 - DNA, 25 bp, Mus musculus
catttgaatacgagcaacgcttgcg

SEQ ID NO: 90084 - DNA, 25 bp, Mus musculus
catttgacggcatcctgcagtgggc

SEQ ID NO: 90085 - DNA, 25 bp, Mus musculus
catttgagactgctgacctgaagga

SEQ ID NO: 90086 - DNA, 25 bp, Mus musculus
catttgagcacttacaacagttgga

SEQ ID NO: 90087 - DNA, 25 bp, Mus musculus
catttgagcgaaggacccaagggtc

SEQ ID NO: 90088 - DNA, 25 bp, Mus musculus
catttgatacttcagaaggactctc

SEQ ID NO: 90089 - DNA, 25 bp, Mus musculus
catttgatgcacaccccaggaagga

SEQ ID NO: 90090 - DNA, 25 bp, Mus musculus
catttgatgggcgtccaagcagacc

SEQ ID NO: 90091 - DNA, 25 bp, Mus musculus
catttgatttggaacagcagtggca

SEQ ID NO: 90092 - DNA, 25 bp, Mus musculus
catttgcaaccgtagggttcggccg

SEQ ID NO: 90093 - DNA, 25 bp, Mus musculus
catttgcagcatagaggcagctaga

SEQ ID NO: 90094 - DNA, 25 bp, Mus musculus
catttgcaggcccaaggatgctgtg

SEQ ID NO: 90095 - DNA, 25 bp, Mus musculus
catttgccagcgtgaagcagtcctc

SEQ ID NO: 90096 - DNA, 25 bp, Mus musculus
catttgccagtaaagaatccattgg

SEQ ID NO: 90097 - DNA, 25 bp, Mus musculus
catttgcccacgaaagctgcggatc

SEQ ID NO: 90098 - DNA, 25 bp, Mus musculus
catttgccgtaaaacgttgtttgag

SEQ ID NO: 90099 - DNA, 25 bp, Mus musculus
catttgcctcaaggggacttgcttg

SEQ ID NO: 90100 - DNA, 25 bp, Mus musculus
catttgcctgtacagcggatggaga

SEQ ID NO: 90101 - DNA, 25 bp, Mus musculus
catttgcgaagctgctgaaccgcac

SEQ ID NO: 90102 - DNA, 25 bp, Mus musculus
catttgcgcaaagctaagactgaca

SEQ ID NO: 90103 - DNA, 25 bp, Mus musculus
catttgcgtgatcaagcagctgtgc

SEQ ID NO: 90104 - DNA, 25 bp, Mus musculus
catttgctaatacggcctggccagg

SEQ ID NO: 90105 - DNA, 25 bp, Mus musculus
catttgctgatgaactctgggccag

SEQ ID NO: 90106 - DNA, 25 bp, Mus musculus
catttgctgatgctgccgtagaccc

SEQ ID NO: 90107 - DNA, 25 bp, Mus musculus
catttgctgcccatgaacgagacag

SEQ ID NO: 90108 - DNA, 25 bp, Mus musculus
catttggaaccgctgacaggagcct

SEQ ID NO: 90109 - DNA, 25 bp, Mus musculus
catttggaagatgctcctagcggca

SEQ ID NO: 90110 - DNA, 25 bp, Mus musculus
catttggaagcgagtagtgcagctg

SEQ ID NO: 90111 - DNA, 25 bp, Mus musculus
catttggaccttaaaggagcgccgc

SEQ ID NO: 90112 - DNA, 25 bp, Mus musculus
catttggacgctgctgtatctagac

SEQ ID NO: 90113 - DNA, 25 bp, Mus musculus
catttggagccacttacagatgagc

SEQ ID NO: 90114 - DNA, 25 bp, Mus musculus
catttggaggccaagatccgccaga

SEQ ID NO: 90115 - DNA, 25 bp, Mus musculus
catttggatcatagaggccgccacc

SEQ ID NO: 90116 - DNA, 25 bp, Mus musculus
catttggcacatcctactggctggt

SEQ ID NO: 90117 - DNA, 25 bp, Mus musculus
catttggccaaatccttcagctggt

SEQ ID NO: 90118 - DNA, 25 bp, Mus musculus
catttggccttgtccaaccagcgga

SEQ ID NO: 90119 - DNA, 25 bp, Mus musculus
catttggctgcagagtgaacctggc

SEQ ID NO: 90120 - DNA, 25 bp, Mus musculus
catttggctggacgaaagtatcaca

SEQ ID NO: 90121 - DNA, 25 bp, Mus musculus
catttgggaaagtgaagcccagcgg

SEQ ID NO: 90122 - DNA, 25 bp, Mus musculus
catttgggagccagaaaggatcatc

SEQ ID NO: 90123 - DNA, 25 bp, Mus musculus
catttgggcagaagtaggagacacc

SEQ ID NO: 90124 - DNA, 25 bp, Mus musculus
catttgggctcttcgctggccttag

SEQ ID NO: 90125 - DNA, 25 bp, Mus musculus
catttgggcttacagcattacctca

SEQ ID NO: 90126 - DNA, 25 bp, Mus musculus
catttgggtagaagctccagcggta

SEQ ID NO: 90127 - DNA, 25 bp, Mus musculus
catttggtacgacgtcggaggtatc

SEQ ID NO: 90128 - DNA, 25 bp, Mus musculus
catttggtcctggatccctgagcgc

SEQ ID NO: 90129 - DNA, 25 bp, Mus musculus
catttggtgagctcctgtgggagaa

SEQ ID NO: 90130 - DNA, 25 bp, Mus musculus
catttggttagaaagcaacggcgtt

SEQ ID NO: 90131 - DNA, 25 bp, Mus musculus
catttggttagcagacagtgacagc

SEQ ID NO: 90132 - DNA, 25 bp, Mus musculus
catttggtttcagcatgtcaggaga

SEQ ID NO: 90133 - DNA, 25 bp, Mus musculus
catttgtaaactgaatgtcccagag

SEQ ID NO: 90134 - DNA, 25 bp, Mus musculus
catttgtacacacctgtcatcggga

SEQ ID NO: 90135 - DNA, 25 bp, Mus musculus
catttgtcccgatcaaagcagcagt

SEQ ID NO: 90136 - DNA, 25 bp, Mus musculus
catttgtggaaacttgcctgtaatt

SEQ ID NO: 90137 - DNA, 25 bp, Mus musculus
catttgtgggtggtgaaagctccta

SEQ ID NO: 90138 - DNA, 25 bp, Mus musculus
catttgtgtaattgacctgggacca

SEQ ID NO: 90139 - DNA, 25 bp, Mus musculus
catttgtgtgagatacctgcccacc

SEQ ID NO: 90140 - DNA, 25 bp, Mus musculus
catttgtttgtccaagatccgcaga

SEQ ID NO: 90141 - DNA, 25 bp, Mus musculus
cattttaaaagtcgactggaactca

SEQ ID NO: 90142 - DNA, 25 bp, Mus musculus
cattttaaagaacgccactcgagga

SEQ ID NO: 90143 - DNA, 25 bp, Mus musculus
cattttaagcacattccccggaagg

SEQ ID NO: 90144 - DNA, 25 bp, Mus musculus
cattttaccaggtgcatcggattac

SEQ ID NO: 90145 - DNA, 25 bp, Mus musculus
cattttaccttgataacattttgac

SEQ ID NO: 90146 - DNA, 25 bp, Mus musculus
cattttagacaataaaggccatttt

SEQ ID NO: 90147 - DNA, 25 bp, Mus musculus
cattttagctcctggttcgggccgc

SEQ ID NO: 90148 - DNA, 25 bp, Mus musculus
cattttatactgttttggcatggac

SEQ ID NO: 90149 - DNA, 25 bp, Mus musculus
cattttcaacaactgcaaactgaag

SEQ ID NO: 90150 - DNA, 25 bp, Mus musculus
cattttcaccacaaccctgtacgag

SEQ ID NO: 90151 - DNA, 25 bp, Mus musculus
cattttcactgtcgccaagaggaac

SEQ ID NO: 90152 - DNA, 25 bp, Mus musculus
cattttccgagtacacagttgtggc

SEQ ID NO: 90153 - DNA, 25 bp, Mus musculus
cattttcctatgttggctgggagcc

SEQ ID NO: 90154 - DNA, 25 bp, Mus musculus
cattttcctgaagtggtgcagcacg

SEQ ID NO: 90155 - DNA, 25 bp, Mus musculus
cattttcggtgttcgaggacctgga

SEQ ID NO: 90156 - DNA, 25 bp, Mus musculus
cattttcgttcaagagccctgaagg

SEQ ID NO: 90157 - DNA, 25 bp, Mus musculus
cattttcttcatctcggtggctcct

SEQ ID NO: 90158 - DNA, 25 bp, Mus musculus
cattttgaatcaaatagcagggcgc

SEQ ID NO: 90159 - DNA, 25 bp, Mus musculus
cattttgacacatgaggagggctac

SEQ ID NO: 90160 - DNA, 25 bp, Mus musculus
cattttgagagtggccgatggcaga

SEQ ID NO: 90161 - DNA, 25 bp, Mus musculus
cattttgatcgactgctgcccggga

SEQ ID NO: 90162 - DNA, 25 bp, Mus musculus
cattttgcagaaggttgggagaccc

SEQ ID NO: 90163 - DNA, 25 bp, Mus musculus
cattttgcagagatattgggaagcc

SEQ ID NO: 90164 - DNA, 25 bp, Mus musculus
cattttgccaagctacgggatttca

SEQ ID NO: 90165 - DNA, 25 bp, Mus musculus
cattttgcctgaacgtgcgagctgg

SEQ ID NO: 90166 - DNA, 25 bp, Mus musculus
cattttgctggaaacatcgacccgt

SEQ ID NO: 90167 - DNA, 25 bp, Mus musculus
cattttggaatcaaccaaggccagg

SEQ ID NO: 90168 - DNA, 25 bp, Mus musculus
cattttggaccaggatgatttggag

SEQ ID NO: 90169 - DNA, 25 bp, Mus musculus
cattttggagctcctctggtgggaa

SEQ ID NO: 90170 - DNA, 25 bp, Mus musculus
cattttggaggactatggtttggac

SEQ ID NO: 90171 - DNA, 25 bp, Mus musculus
cattttggcacgagccgggatcctg

SEQ ID NO: 90172 - DNA, 25 bp, Mus musculus
cattttggccagagccacatctgca

SEQ ID NO: 90173 - DNA, 25 bp, Mus musculus
cattttgtagtctaggctgcctcga

SEQ ID NO: 90174 - DNA, 25 bp, Mus musculus
cattttgtcaacatgcgacatgctg

SEQ ID NO: 90175 - DNA, 25 bp, Mus musculus
cattttgttacacaggccggctgag

SEQ ID NO: 90176 - DNA, 25 bp, Mus musculus
catttttaatgttggtacgactgtc

SEQ ID NO: 90177 - DNA, 25 bp, Mus musculus
catttttatacctgaaattcctggt

SEQ ID NO: 90178 - DNA, 25 bp, Mus musculus
catttttcgagacacagatgcgcat

SEQ ID NO: 90179 - DNA, 25 bp, Mus musculus
catttttgagcaccaacactacggg

SEQ ID NO: 90180 - DNA, 25 bp, Mus musculus
catttttgcttaacctgaggcggca

SEQ ID NO: 90181 - DNA, 25 bp, Mus musculus
catttttggctttcgttctagaaga

SEQ ID NO: 90182 - DNA, 25 bp, Mus musculus
catttttgggcacctggtggtcagc

SEQ ID NO: 90183 - DNA, 25 bp, Mus musculus
cattttttccagacgagtacttcac

SEQ ID NO: 90184 - DNA, 25 bp, Mus musculus
ccaaaaagagaggagcacctgagtg

SEQ ID NO: 90185 - DNA, 25 bp, Mus musculus
ccaaaaagatgggtgtgcagtcggt

SEQ ID NO: 90186 - DNA, 25 bp, Mus musculus
ccaaaaatgaggtgagggcaggtct

SEQ ID NO: 90187 - DNA, 25 bp, Mus musculus
ccaaaaatggcgactgaaactgtca

SEQ ID NO: 90188 - DNA, 25 bp, Mus musculus
ccaaaacagtgtcaaaatctccaga

SEQ ID NO: 90189 - DNA, 25 bp, Mus musculus
ccaaaacggagaaaatcaggcgacg

SEQ ID NO: 90190 - DNA, 25 bp, Mus musculus
ccaaaagacattgtatacatgcatg

SEQ ID NO: 90191 - DNA, 25 bp, Mus musculus
ccaaaagctagtgtgaaggcgcaaa

SEQ ID NO: 90192 - DNA, 25 bp, Mus musculus
ccaaaaggagcctatcccacgagag

SEQ ID NO: 90193 - DNA, 25 bp, Mus musculus
ccaaaagttccaagatgaggccaca

SEQ ID NO: 90194 - DNA, 25 bp, Mus musculus
ccaaaatccagcagatcgagcgcga

SEQ ID NO: 90195 - DNA, 25 bp, Mus musculus
ccaaaatggccatggacgggtatct

SEQ ID NO: 90196 - DNA, 25 bp, Mus musculus
ccaaaatgttttgtgctcattgagc

SEQ ID NO: 90197 - DNA, 25 bp, Mus musculus
ccaaacaaagatgcaagacatgtca

SEQ ID NO: 90198 - DNA, 25 bp, Mus musculus
ccaaacaggcaggaacggaagtcaa

SEQ ID NO: 90199 - DNA, 25 bp, Mus musculus
ccaaacattgtctcagtgtggaaac

SEQ ID NO: 90200 - DNA, 25 bp, Mus musculus
ccaaaccaaatgtgatctcggagct

SEQ ID NO: 90201 - DNA, 25 bp, Mus musculus
ccaaaccagtgtatctgaagtctca

SEQ ID NO: 90202 - DNA, 25 bp, Mus musculus
ccaaaccattatatgtccaaggaca

SEQ ID NO: 90203 - DNA, 25 bp, Mus musculus
ccaaacccaaggctggccatagtgg

SEQ ID NO: 90204 - DNA, 25 bp, Mus musculus
ccaaaccgtgggtgaccatgggact

SEQ ID NO: 90205 - DNA, 25 bp, Mus musculus
ccaaaccttggagccatcgctgagt

SEQ ID NO: 90206 - DNA, 25 bp, Mus musculus
ccaaacggaggaatcgaaatgccag

SEQ ID NO: 90207 - DNA, 25 bp, Mus musculus
ccaaacggccaagtgaaatatgaca

SEQ ID NO: 90208 - DNA, 25 bp, Mus musculus
ccaaacgtcttgtcctccatgatca

SEQ ID NO: 90209 - DNA, 25 bp, Mus musculus
ccaaactaggttgcgtggcagaaga

SEQ ID NO: 90210 - DNA, 25 bp, Mus musculus
ccaaactatcagagaattccaacta

SEQ ID NO: 90211 - DNA, 25 bp, Mus musculus
ccaaactcagttccaggagtaaggg

SEQ ID NO: 90212 - DNA, 25 bp, Mus musculus
ccaaactgaggaagaaggtctcggt

SEQ ID NO: 90213 - DNA, 25 bp, Mus musculus
ccaaactgcgacgtggtggaggtca

SEQ ID NO: 90214 - DNA, 25 bp, Mus musculus
ccaaactgtacagcagctggtcctg

SEQ ID NO: 90215 - DNA, 25 bp, Mus musculus
ccaaacttacagacagaggaggctc

SEQ ID NO: 90216 - DNA, 25 bp, Mus musculus
ccaaacttcacgtcagaatccagca

SEQ ID NO: 90217 - DNA, 25 bp, Mus musculus
ccaaacttctgagcatcgtggcatg

SEQ ID NO: 90218 - DNA, 25 bp, Mus musculus
ccaaagaaatgagtcgagccatggg

SEQ ID NO: 90219 - DNA, 25 bp, Mus musculus
ccaaagaaggatgtaccggactcac

SEQ ID NO: 90220 - DNA, 25 bp, Mus musculus
ccaaagaccttgaaatgtttgccag

SEQ ID NO: 90221 - DNA, 25 bp, Mus musculus
ccaaagagggtctcacggagcgctt

SEQ ID NO: 90222 - DNA, 25 bp, Mus musculus
ccaaagaggtcgaggattatcagaa

SEQ ID NO: 90223 - DNA, 25 bp, Mus musculus
ccaaagagtctgcaggattaatccc

SEQ ID NO: 90224 - DNA, 25 bp, Mus musculus
ccaaagagtcttccatggagcgcaa

SEQ ID NO: 90225 - DNA, 25 bp, Mus musculus
ccaaagatacttccctaaggcacca

SEQ ID NO: 90226 - DNA, 25 bp, Mus musculus
ccaaagatcgtggccagagactggg

SEQ ID NO: 90227 - DNA, 25 bp, Mus musculus
ccaaagatggaaacaggatctggac

SEQ ID NO: 90228 - DNA, 25 bp, Mus musculus
ccaaagcagatttcctaaggccact

SEQ ID NO: 90229 - DNA, 25 bp, Mus musculus
ccaaagccgccgaaggttgtgtcct

SEQ ID NO: 90230 - DNA, 25 bp, Mus musculus
ccaaagcctgagtgtcaatgacctg

SEQ ID NO: 90231 - DNA, 25 bp, Mus musculus
ccaaagctgttccagacgcagtgtc

SEQ ID NO: 90232 - DNA, 25 bp, Mus musculus
ccaaaggacctttatagtgctccag

SEQ ID NO: 90233 - DNA, 25 bp, Mus musculus
ccaaaggaggaaccgtgaaagctgc

SEQ ID NO: 90234 - DNA, 25 bp, Mus musculus
ccaaaggatctgaaggccgctgtca

SEQ ID NO: 90235 - DNA, 25 bp, Mus musculus
ccaaaggcctttgagaagactgtag

SEQ ID NO: 90236 - DNA, 25 bp, Mus musculus
ccaaagggagggtgtcttgaatcca

SEQ ID NO: 90237 - DNA, 25 bp, Mus musculus
ccaaaggtcagaatgggcaggcagc

SEQ ID NO: 90238 - DNA, 25 bp, Mus musculus
ccaaaggtgtgtgatactgtgccca

SEQ ID NO: 90239 - DNA, 25 bp, Mus musculus
ccaaagtaccacattccaagaaggg

SEQ ID NO: 90240 - DNA, 25 bp, Mus musculus
ccaaagtcatcagagcctgcttgtc

SEQ ID NO: 90241 - DNA, 25 bp, Mus musculus
ccaaagtggcagataagaaagccag

SEQ ID NO: 90242 - DNA, 25 bp, Mus musculus
ccaaagtggcattgagcacagtgag

SEQ ID NO: 90243 - DNA, 25 bp, Mus musculus
ccaaagtggtggtcaaagctccaga

SEQ ID NO: 90244 - DNA, 25 bp, Mus musculus
ccaaagtgtcaaggtttctgaggcc

SEQ ID NO: 90245 - DNA, 25 bp, Mus musculus
ccaaagttgtccgtgttagagcaga

SEQ ID NO: 90246 - DNA, 25 bp, Mus musculus
ccaaataactgcagtggagtaagaa

SEQ ID NO: 90247 - DNA, 25 bp, Mus musculus
ccaaatatgcagaacaacttctgga

SEQ ID NO: 90248 - DNA, 25 bp, Mus musculus
ccaaatgaaagaactcggagccgac

SEQ ID NO: 90249 - DNA, 25 bp, Mus musculus
ccaaatgatgcgtgccaagcggcag

SEQ ID NO: 90250 - DNA, 25 bp, Mus musculus
ccaaatgcaaggtggaaagctttcc

SEQ ID NO: 90251 - DNA, 25 bp, Mus musculus
ccaaatgcagatctttagcaataaa

SEQ ID NO: 90252 - DNA, 25 bp, Mus musculus
ccaaatggagaaagcgggaacgcaa

SEQ ID NO: 90253 - DNA, 25 bp, Mus musculus
ccaaatggagaaatgtgttcgctgc

SEQ ID NO: 90254 - DNA, 25 bp, Mus musculus
ccaaatggtgccagtctgccttcct

SEQ ID NO: 90255 - DNA, 25 bp, Mus musculus
ccaaatgtagtgtgtattccaatag

SEQ ID NO: 90256 - DNA, 25 bp, Mus musculus
ccaaatgtggagttgaatagtcccc

SEQ ID NO: 90257 - DNA, 25 bp, Mus musculus
ccaaatgtttgcagagaggagcagc

SEQ ID NO: 90258 - DNA, 25 bp, Mus musculus
ccaacaaaggagttgaggaggtgcc

SEQ ID NO: 90259 - DNA, 25 bp, Mus musculus
ccaacaaagtgaagagatacctagc

SEQ ID NO: 90260 - DNA, 25 bp, Mus musculus
ccaacaacaactcttaggctagtga

SEQ ID NO: 90261 - DNA, 25 bp, Mus musculus
ccaacaagcttgaggaaaatgtcca

SEQ ID NO: 90262 - DNA, 25 bp, Mus musculus
ccaacaaggagagtggcaaggcttc

SEQ ID NO: 90263 - DNA, 25 bp, Mus musculus
ccaacaatggaagcatctgagcaat

SEQ ID NO: 90264 - DNA, 25 bp, Mus musculus
ccaacacagagggtggacgattcca

SEQ ID NO: 90265 - DNA, 25 bp, Mus musculus
ccaacactggaatggacactgaagt

SEQ ID NO: 90266 - DNA, 25 bp, Mus musculus
ccaacactggacgatcaagagggtt

SEQ ID NO: 90267 - DNA, 25 bp, Mus musculus
ccaacactgggtacactcggaggaa

SEQ ID NO: 90268 - DNA, 25 bp, Mus musculus
ccaacactgtctacggcctaggctt

SEQ ID NO: 90269 - DNA, 25 bp, Mus musculus
ccaacagatggaggttcaaggcgct

SEQ ID NO: 90270 - DNA, 25 bp, Mus musculus
ccaacagctctttaaagggcatcag

SEQ ID NO: 90271 - DNA, 25 bp, Mus musculus
ccaacaggaacttgtgctgcgtgta

SEQ ID NO: 90272 - DNA, 25 bp, Mus musculus
ccaacaggaagaccaggacgagtac

SEQ ID NO: 90273 - DNA, 25 bp, Mus musculus
ccaacaggagttcatggttacgcat

SEQ ID NO: 90274 - DNA, 25 bp, Mus musculus
ccaacaggatcgtgctagaagactc

SEQ ID NO: 90275 - DNA, 25 bp, Mus musculus
ccaacaggttctattacaagaaagg

SEQ ID NO: 90276 - DNA, 25 bp, Mus musculus
ccaacaggttggatggcctagtttt

SEQ ID NO: 90277 - DNA, 25 bp, Mus musculus
ccaacatccatgcaaggcaacagag

SEQ ID NO: 90278 - DNA, 25 bp, Mus musculus
ccaacatcctggtgaactctcgcgg

SEQ ID NO: 90279 - DNA, 25 bp, Mus musculus
ccaacatctagagcgagagcaggct

SEQ ID NO: 90280 - DNA, 25 bp, Mus musculus
ccaacatgctggtcgagtactctac

SEQ ID NO: 90281 - DNA, 25 bp, Mus musculus
ccaacatgcttgtcgctgaggtgaa

SEQ ID NO: 90282 - DNA, 25 bp, Mus musculus
ccaacatggagcaaggaagcaccta

SEQ ID NO: 90283 - DNA, 25 bp, Mus musculus
ccaacatggtggacacagagagccc

SEQ ID NO: 90284 - DNA, 25 bp, Mus musculus
ccaacatgtggaaaagctgcagatc

SEQ ID NO: 90285 - DNA, 25 bp, Mus musculus
ccaacattctgtggagatgcataca

SEQ ID NO: 90286 - DNA, 25 bp, Mus musculus
ccaaccacgtggagttcagcagact

SEQ ID NO: 90287 - DNA, 25 bp, Mus musculus
ccaaccgtggtgttcaaagcctcaa

SEQ ID NO: 90288 - DNA, 25 bp, Mus musculus
ccaacctagcagatagggagctggt

SEQ ID NO: 90289 - DNA, 25 bp, Mus musculus
ccaacgacttcaagctggaggactt

SEQ ID NO: 90290 - DNA, 25 bp, Mus musculus
ccaacgagctctgtgaagtgaaccg

SEQ ID NO: 90291 - DNA, 25 bp, Mus musculus
ccaacgtcacgatgagggtggccgt

SEQ ID NO: 90292 - DNA, 25 bp, Mus musculus
ccaacgtccgggtgggaaatgcact

SEQ ID NO: 90293 - DNA, 25 bp, Mus musculus
ccaacgtcgtgcacttgacagagaa

SEQ ID NO: 90294 - DNA, 25 bp, Mus musculus
ccaactctggttagagggtgatgct

SEQ ID NO: 90295 - DNA, 25 bp, Mus musculus
ccaactgaaggtaatgagagactgc

SEQ ID NO: 90296 - DNA, 25 bp, Mus musculus
ccaactgaagtgctgtctcactggg

SEQ ID NO: 90297 - DNA, 25 bp, Mus musculus
ccaactgaatggaggatgtcctgtc

SEQ ID NO: 90298 - DNA, 25 bp, Mus musculus
ccaactgagtgtagatgacgtcaac

SEQ ID NO: 90299 - DNA, 25 bp, Mus musculus
ccaactgctaggattagtcatgtgc

SEQ ID NO: 90300 - DNA, 25 bp, Mus musculus
ccaactgctggaggacaaactgcaa

SEQ ID NO: 90301 - DNA, 25 bp, Mus musculus
ccaactggatcctggagtcccagaa

SEQ ID NO: 90302 - DNA, 25 bp, Mus musculus
ccaactgggaagatgctttcggaca

SEQ ID NO: 90303 - DNA, 25 bp, Mus musculus
ccaactgggaagctacaagagacac

SEQ ID NO: 90304 - DNA, 25 bp, Mus musculus
ccaactgtgtggactaagatgcatc

SEQ ID NO: 90305 - DNA, 25 bp, Mus musculus
ccaactgttgcggtgtaatgtagac

SEQ ID NO: 90306 - DNA, 25 bp, Mus musculus
ccaacttatgcagaactgctgtgag

SEQ ID NO: 90307 - DNA, 25 bp, Mus musculus
ccaactttgagctcccaggctggga

SEQ ID NO: 90308 - DNA, 25 bp, Mus musculus
ccaactttgggcttgtctctgaagt

SEQ ID NO: 90309 - DNA, 25 bp, Mus musculus
ccaagaaagacttgcgagggcagct

SEQ ID NO: 90310 - DNA, 25 bp, Mus musculus
ccaagaaaggatcgcctgggacaca

SEQ ID NO: 90311 - DNA, 25 bp, Mus musculus
ccaagaaagtctcacaaatgggttc

SEQ ID NO: 90312 - DNA, 25 bp, Mus musculus
ccaagaaatcgctgagaagattcaa

SEQ ID NO: 90313 - DNA, 25 bp, Mus musculus
ccaagaacacgcctgaagagagaga

SEQ ID NO: 90314 - DNA, 25 bp, Mus musculus
ccaagaagaaattacaagacctagt

SEQ ID NO: 90315 - DNA, 25 bp, Mus musculus
ccaagaagacatgcgaggagcacca

SEQ ID NO: 90316 - DNA, 25 bp, Mus musculus
ccaagaagaggaggcaacagaactt

SEQ ID NO: 90317 - DNA, 25 bp, Mus musculus
ccaagaagagtgtgtgtcgccgcct

SEQ ID NO: 90318 - DNA, 25 bp, Mus musculus
ccaagaagcatgtgcggctgcagga

SEQ ID NO: 90319 - DNA, 25 bp, Mus musculus
ccaagaagcgtaagaagcggcgaca

SEQ ID NO: 90320 - DNA, 25 bp, Mus musculus
ccaagaagctagaagagtcggatgc

SEQ ID NO: 90321 - DNA, 25 bp, Mus musculus
ccaagaagctattaccaaaggtgtg

SEQ ID NO: 90322 - DNA, 25 bp, Mus musculus
ccaagaaggctagcacatggactct

SEQ ID NO: 90323 - DNA, 25 bp, Mus musculus
ccaagaagtctaaggtctgctcaga

SEQ ID NO: 90324 - DNA, 25 bp, Mus musculus
ccaagaatcttatcctggcaggagt

SEQ ID NO: 90325 - DNA, 25 bp, Mus musculus
ccaagaatgatgttatgctcagtgc

SEQ ID NO: 90326 - DNA, 25 bp, Mus musculus
ccaagaatggtgaatgtcgacctca

SEQ ID NO: 90327 - DNA, 25 bp, Mus musculus
ccaagaattgaccagggaagccaca

SEQ ID NO: 90328 - DNA, 25 bp, Mus musculus
ccaagacaagagtgtggccagctta

SEQ ID NO: 90329 - DNA, 25 bp, Mus musculus
ccaagacaatgggacacaagatgac

SEQ ID NO: 90330 - DNA, 25 bp, Mus musculus
ccaagacactcagacggaatgttca

SEQ ID NO: 90331 - DNA, 25 bp, Mus musculus
ccaagacagccagaggtacaatgtt

SEQ ID NO: 90332 - DNA, 25 bp, Mus musculus
ccaagaccatgtacgtggactacaa

SEQ ID NO: 90333 - DNA, 25 bp, Mus musculus
ccaagacgcagacttacctggcagt

SEQ ID NO: 90334 - DNA, 25 bp, Mus musculus
ccaagacggaactctgtggctttaa

SEQ ID NO: 90335 - DNA, 25 bp, Mus musculus
ccaagacggacgaggcagaaaagcg

SEQ ID NO: 90336 - DNA, 25 bp, Mus musculus
ccaagacgtatgttggaacaaatgc

SEQ ID NO: 90337 - DNA, 25 bp, Mus musculus
ccaagactaaatgaagttgtttgtc

SEQ ID NO: 90338 - DNA, 25 bp, Mus musculus
ccaagactgtgtccagagcaaggca

SEQ ID NO: 90339 - DNA, 25 bp, Mus musculus
ccaagacttcgtttgagtacaacag

SEQ ID NO: 90340 - DNA, 25 bp, Mus musculus
ccaagagacccagctagaggagcag

SEQ ID NO: 90341 - DNA, 25 bp, Mus musculus
ccaagagatgaagggtctcctcaca

SEQ ID NO: 90342 - DNA, 25 bp, Mus musculus
ccaagagccaaatgtcagacacact

SEQ ID NO: 90343 - DNA, 25 bp, Mus musculus
ccaagaggacctgcgcggacagcga

SEQ ID NO: 90344 - DNA, 25 bp, Mus musculus
ccaagaggatagtatctaaagccac

SEQ ID NO: 90345 - DNA, 25 bp, Mus musculus
ccaagaggatccgtgtgggtctcca

SEQ ID NO: 90346 - DNA, 25 bp, Mus musculus
ccaagaggtccacatgaaggtcagt

SEQ ID NO: 90347 - DNA, 25 bp, Mus musculus
ccaagagtccttgcaagacaggtgc

SEQ ID NO: 90348 - DNA, 25 bp, Mus musculus
ccaagagtgttcttaggtgactcag

SEQ ID NO: 90349 - DNA, 25 bp, Mus musculus
ccaagatgacagactgagaggcctg

SEQ ID NO: 90350 - DNA, 25 bp, Mus musculus
ccaagatgataggtggaaagcccca

SEQ ID NO: 90351 - DNA, 25 bp, Mus musculus
ccaagatggatgcaaagcaggagcc

SEQ ID NO: 90352 - DNA, 25 bp, Mus musculus
ccaagatggcaaccccctccaagga

SEQ ID NO: 90353 - DNA, 25 bp, Mus musculus
ccaagatggctgatgagaaatcccc

SEQ ID NO: 90354 - DNA, 25 bp, Mus musculus
ccaagatgggcatattctgctcagt

SEQ ID NO: 90355 - DNA, 25 bp, Mus musculus
ccaagatggtgaagttgaagtcccc

SEQ ID NO: 90356 - DNA, 25 bp, Mus musculus
ccaagatttcctccatagccatgca

SEQ ID NO: 90357 - DNA, 25 bp, Mus musculus
ccaagcacccacagaagactcttta

SEQ ID NO: 90358 - DNA, 25 bp, Mus musculus
ccaagcacgccaacaaggtcaaagt

SEQ ID NO: 90359 - DNA, 25 bp, Mus musculus
ccaagcacgggcttccggcgaggcc

SEQ ID NO: 90360 - DNA, 25 bp, Mus musculus
ccaagcactctgtggaggtccaggt

SEQ ID NO: 90361 - DNA, 25 bp, Mus musculus
ccaagcagaatgtgtcaggttagcc

SEQ ID NO: 90362 - DNA, 25 bp, Mus musculus
ccaagcagctgcttcactgtatggc

SEQ ID NO: 90363 - DNA, 25 bp, Mus musculus
ccaagcaggtccaggaggaaatcca

SEQ ID NO: 90364 - DNA, 25 bp, Mus musculus
ccaagcatatggacttttcgcctat

SEQ ID NO: 90365 - DNA, 25 bp, Mus musculus
ccaagccagaaatggaaggtgccca

SEQ ID NO: 90366 - DNA, 25 bp, Mus musculus
ccaagccctgactgcaaagacagcg

SEQ ID NO: 90367 - DNA, 25 bp, Mus musculus
ccaagccgcaatgaagagcttctca

SEQ ID NO: 90368 - DNA, 25 bp, Mus musculus
ccaagccgctggtgaagttcatcca

SEQ ID NO: 90369 - DNA, 25 bp, Mus musculus
ccaagcctatttttgcaacagttga

SEQ ID NO: 90370 - DNA, 25 bp, Mus musculus
ccaagcctgtcttccagtgagccag

SEQ ID NO: 90371 - DNA, 25 bp, Mus musculus
ccaagcctttgggagtaggaactga

SEQ ID NO: 90372 - DNA, 25 bp, Mus musculus
ccaagcgagacgagaaggaccggca

SEQ ID NO: 90373 - DNA, 25 bp, Mus musculus
ccaagcggcggatagtgtcacatgt

SEQ ID NO: 90374 - DNA, 25 bp, Mus musculus
ccaagcggtactgcaagaatgccag

SEQ ID NO: 90375 - DNA, 25 bp, Mus musculus
ccaagcgtttaatgaagacagtctc

SEQ ID NO: 90376 - DNA, 25 bp, Mus musculus
ccaagctattcagcggacgagcaca

SEQ ID NO: 90377 - DNA, 25 bp, Mus musculus
ccaagctgggcctggtacagaaagt

SEQ ID NO: 90378 - DNA, 25 bp, Mus musculus
ccaagctggtgtcatcagaaggtcg

SEQ ID NO: 90379 - DNA, 25 bp, Mus musculus
ccaagctgtcccctctcagaggaga

SEQ ID NO: 90380 - DNA, 25 bp, Mus musculus
ccaaggaattgatggagggaaccca

SEQ ID NO: 90381 - DNA, 25 bp, Mus musculus
ccaaggacagcacaacaagcgatgt

SEQ ID NO: 90382 - DNA, 25 bp, Mus musculus
ccaaggacccctatcaggaagagaa

SEQ ID NO: 90383 - DNA, 25 bp, Mus musculus
ccaaggacgaatcagttatagccag

SEQ ID NO: 90384 - DNA, 25 bp, Mus musculus
ccaaggagaaagctggagcccatca

SEQ ID NO: 90385 - DNA, 25 bp, Mus musculus
ccaaggagacactttccggattact

SEQ ID NO: 90386 - DNA, 25 bp, Mus musculus
ccaaggagacctaagaatggccgat

SEQ ID NO: 90387 - DNA, 25 bp, Mus musculus
ccaaggagcacatgaaaccgtacgt

SEQ ID NO: 90388 - DNA, 25 bp, Mus musculus
ccaaggagctttcagcacagagcaa

SEQ ID NO: 90389 - DNA, 25 bp, Mus musculus
ccaaggaggcaaagctgcgtgacct

SEQ ID NO: 90390 - DNA, 25 bp, Mus musculus
ccaaggagtggcttacctgcacagc

SEQ ID NO: 90391 - DNA, 25 bp, Mus musculus
ccaaggatagtggatggaagccaac

SEQ ID NO: 90392 - DNA, 25 bp, Mus musculus
ccaaggatgcagacgagcgaatcga

SEQ ID NO: 90393 - DNA, 25 bp, Mus musculus
ccaaggatgggaagaagtatgcaac

SEQ ID NO: 90394 - DNA, 25 bp, Mus musculus
ccaaggatgtgacccctgaagcagt

SEQ ID NO: 90395 - DNA, 25 bp, Mus musculus
ccaaggcacactctccgggagatac

SEQ ID NO: 90396 - DNA, 25 bp, Mus musculus
ccaaggcacagagggactatgagct

SEQ ID NO: 90397 - DNA, 25 bp, Mus musculus
ccaaggcaccactctcacagtctcc

SEQ ID NO: 90398 - DNA, 25 bp, Mus musculus
ccaaggcccagtgtgttgtagggta

SEQ ID NO: 90399 - DNA, 25 bp, Mus musculus
ccaaggccttggtggaagacacaaa

SEQ ID NO: 90400 - DNA, 25 bp, Mus musculus
ccaaggcctttaagcagaagtgaca

SEQ ID NO: 90401 - DNA, 25 bp, Mus musculus
ccaaggcggggattctcaccacgct

SEQ ID NO: 90402 - DNA, 25 bp, Mus musculus
ccaaggctaagaggcagtgtgctac

SEQ ID NO: 90403 - DNA, 25 bp, Mus musculus
ccaaggctacggagagaaacgctgc

SEQ ID NO: 90404 - DNA, 25 bp, Mus musculus
ccaaggctctgggaatgacgacagc

SEQ ID NO: 90405 - DNA, 25 bp, Mus musculus
ccaaggctgagctctaaggaccata

SEQ ID NO: 90406 - DNA, 25 bp, Mus musculus
ccaaggctgctgtgagcatggcaga

SEQ ID NO: 90407 - DNA, 25 bp, Mus musculus
ccaaggcttcgagattgtgttgaat

SEQ ID NO: 90408 - DNA, 25 bp, Mus musculus
ccaaggcttgataaccgaggtgcta

SEQ ID NO: 90409 - DNA, 25 bp, Mus musculus
ccaaggctttcagggaggctcagat

SEQ ID NO: 90410 - DNA, 25 bp, Mus musculus
ccaaggctttttgttaaggcagcaa

SEQ ID NO: 90411 - DNA, 25 bp, Mus musculus
ccaagggagaactcggagaagcaat

SEQ ID NO: 90412 - DNA, 25 bp, Mus musculus
ccaagggcacaagagtggcagtcca

SEQ ID NO: 90413 - DNA, 25 bp, Mus musculus
ccaagggcaggttcgattgtaactc

SEQ ID NO: 90414 - DNA, 25 bp, Mus musculus
ccaagggcccgtgaagttattgaat

SEQ ID NO: 90415 - DNA, 25 bp, Mus musculus
ccaagggccttgaggagtcgttgcc

SEQ ID NO: 90416 - DNA, 25 bp, Mus musculus
ccaagggcttccatgtcagcagaca

SEQ ID NO: 90417 - DNA, 25 bp, Mus musculus
ccaagggtagtgtgaagtacagaac

SEQ ID NO: 90418 - DNA, 25 bp, Mus musculus
ccaagggtcagatagcaatgaagag

SEQ ID NO: 90419 - DNA, 25 bp, Mus musculus
ccaaggtcaagaagccagggaggaa

SEQ ID NO: 90420 - DNA, 25 bp, Mus musculus
ccaaggtcaccatagatcggcaaag

SEQ ID NO: 90421 - DNA, 25 bp, Mus musculus
ccaaggtcctgtgcttatggcggag

SEQ ID NO: 90422 - DNA, 25 bp, Mus musculus
ccaaggtctcgaggtgttaagcaag

SEQ ID NO: 90423 - DNA, 25 bp, Mus musculus
ccaaggtctcggtgctgatagtcca

SEQ ID NO: 90424 - DNA, 25 bp, Mus musculus
ccaaggtctgctgttgatcgttcag

SEQ ID NO: 90425 - DNA, 25 bp, Mus musculus
ccaaggtcttggacctcaggaagag

SEQ ID NO: 90426 - DNA, 25 bp, Mus musculus
ccaaggtgccaagcgtgcagtttgt

SEQ ID NO: 90427 - DNA, 25 bp, Mus musculus
ccaaggtgcttacagaaaggaagct

SEQ ID NO: 90428 - DNA, 25 bp, Mus musculus
ccaaggtgtccaaatgagtggccca

SEQ ID NO: 90429 - DNA, 25 bp, Mus musculus
ccaagtactccctctatgaagtgca

SEQ ID NO: 90430 - DNA, 25 bp, Mus musculus
ccaagtagcataggaacaatgccca

SEQ ID NO: 90431 - DNA, 25 bp, Mus musculus
ccaagtcagacactgcattagagaa

SEQ ID NO: 90432 - DNA, 25 bp, Mus musculus
ccaagtccgagagggacgtgtctac

SEQ ID NO: 90433 - DNA, 25 bp, Mus musculus
ccaagtccgggtagtgtgtcactcc

SEQ ID NO: 90434 - DNA, 25 bp, Mus musculus
ccaagtccgtgtgcgtgtcagtgga

SEQ ID NO: 90435 - DNA, 25 bp, Mus musculus
ccaagtcctgggagaaatgcgtcag

SEQ ID NO: 90436 - DNA, 25 bp, Mus musculus
ccaagtccttatgtagaagtcacag

SEQ ID NO: 90437 - DNA, 25 bp, Mus musculus
ccaagtctgagagcgcacagagcag

SEQ ID NO: 90438 - DNA, 25 bp, Mus musculus
ccaagtgaaaccgaatgctgaggac

SEQ ID NO: 90439 - DNA, 25 bp, Mus musculus
ccaagtgaacggcaagagggtcctc

SEQ ID NO: 90440 - DNA, 25 bp, Mus musculus
ccaagtgagaagtcccagtaatgcg

SEQ ID NO: 90441 - DNA, 25 bp, Mus musculus
ccaagtgcagaatatgggtcagctc

SEQ ID NO: 90442 - DNA, 25 bp, Mus musculus
ccaagtggagaatgtcataaagcag

SEQ ID NO: 90443 - DNA, 25 bp, Mus musculus
ccaagtggaggaggtgaactgcatc

SEQ ID NO: 90444 - DNA, 25 bp, Mus musculus
ccaagtggctttcggagggcactac

SEQ ID NO: 90445 - DNA, 25 bp, Mus musculus
ccaagtgggaagaatgccagcgtca

SEQ ID NO: 90446 - DNA, 25 bp, Mus musculus
ccaagtgggactcgtggaacaagct

SEQ ID NO: 90447 - DNA, 25 bp, Mus musculus
ccaagtgggataacttcctggcatt

SEQ ID NO: 90448 - DNA, 25 bp, Mus musculus
ccaagtgggcgaacatgcaaacgac

SEQ ID NO: 90449 - DNA, 25 bp, Mus musculus
ccaagtggtcagaaaacggctctca

SEQ ID NO: 90450 - DNA, 25 bp, Mus musculus
ccaagtggttctggacgaggtgcca

SEQ ID NO: 90451 - DNA, 25 bp, Mus musculus
ccaagtgtgccggaattggaatcag

SEQ ID NO: 90452 - DNA, 25 bp, Mus musculus
ccaagtgtgcctgggatgacctcag

SEQ ID NO: 90453 - DNA, 25 bp, Mus musculus
ccaagtgtgtgtggtaactggtgcc

SEQ ID NO: 90454 - DNA, 25 bp, Mus musculus
ccaagttctcacataggttctgtgc

SEQ ID NO: 90455 - DNA, 25 bp, Mus musculus
ccaagttcttgatgtgctaacccca

SEQ ID NO: 90456 - DNA, 25 bp, Mus musculus
ccaagttggtgagtgagcggttcct

SEQ ID NO: 90457 - DNA, 25 bp, Mus musculus
ccaagttgtgggactccagtcggga

SEQ ID NO: 90458 - DNA, 25 bp, Mus musculus
ccaataagcaggaagagactgatcc

SEQ ID NO: 90459 - DNA, 25 bp, Mus musculus
ccaataagggcatgaaggtgactcc

SEQ ID NO: 90460 - DNA, 25 bp, Mus musculus
ccaataccgccagctgaagacagtg

SEQ ID NO: 90461 - DNA, 25 bp, Mus musculus
ccaatagcccagatgggaaaaaact

SEQ ID NO: 90462 - DNA, 25 bp, Mus musculus
ccaatagtgagcgagacggcatgca

SEQ ID NO: 90463 - DNA, 25 bp, Mus musculus
ccaatattagtgagctgaaaagaac

SEQ ID NO: 90464 - DNA, 25 bp, Mus musculus
ccaatcaagtccacaggaagtctgt

SEQ ID NO: 90465 - DNA, 25 bp, Mus musculus
ccaatcctgtgagagcatgagctgt

SEQ ID NO: 90466 - DNA, 25 bp, Mus musculus
ccaatcgcaaactagaacggagggt

SEQ ID NO: 90467 - DNA, 25 bp, Mus musculus
ccaatcggtgagagaaggtcaagat

SEQ ID NO: 90468 - DNA, 25 bp, Mus musculus
ccaatctcaaggtgcagggctgcat

SEQ ID NO: 90469 - DNA, 25 bp, Mus musculus
ccaatcttgaagaaaggctccgtgc

SEQ ID NO: 90470 - DNA, 25 bp, Mus musculus
ccaatgaactgtctgtggacgaagc

SEQ ID NO: 90471 - DNA, 25 bp, Mus musculus
ccaatgaagaagagcggcacgctga

SEQ ID NO: 90472 - DNA, 25 bp, Mus musculus
ccaatgaatcgggtcctggctgtcc

SEQ ID NO: 90473 - DNA, 25 bp, Mus musculus
ccaatgactatggtgctgggactga

SEQ ID NO: 90474 - DNA, 25 bp, Mus musculus
ccaatgagaagatcatccgggccaa

SEQ ID NO: 90475 - DNA, 25 bp, Mus musculus
ccaatgaggaaatgagtgggcagtc

SEQ ID NO: 90476 - DNA, 25 bp, Mus musculus
ccaatgccgataaaggagaaacaac

SEQ ID NO: 90477 - DNA, 25 bp, Mus musculus
ccaatgcggattataacagggacct

SEQ ID NO: 90478 - DNA, 25 bp, Mus musculus
ccaatgctgagtgcagctgttccaa

SEQ ID NO: 90479 - DNA, 25 bp, Mus musculus
ccaatgctggaatggtgtctgacga

SEQ ID NO: 90480 - DNA, 25 bp, Mus musculus
ccaatgctgtctggatctgggacat

SEQ ID NO: 90481 - DNA, 25 bp, Mus musculus
ccaatggaagtgacgtggttctcac

SEQ ID NO: 90482 - DNA, 25 bp, Mus musculus
ccaatggaagtgtcaactgtggagg

SEQ ID NO: 90483 - DNA, 25 bp, Mus musculus
ccaatggcatagaagccctggagca

SEQ ID NO: 90484 - DNA, 25 bp, Mus musculus
ccaatggccgtacacgaaaggctct

SEQ ID NO: 90485 - DNA, 25 bp, Mus musculus
ccaatggtgagacgtggaaacccga

SEQ ID NO: 90486 - DNA, 25 bp, Mus musculus
ccaatggtggtagacatgtgcatca

SEQ ID NO: 90487 - DNA, 25 bp, Mus musculus
ccaatgtctgtaccttttgggaaag

SEQ ID NO: 90488 - DNA, 25 bp, Mus musculus
ccaatgtgagaaatgcaggaaatgc

SEQ ID NO: 90489 - DNA, 25 bp, Mus musculus
ccaatgtgatggagcagagggctct

SEQ ID NO: 90490 - DNA, 25 bp, Mus musculus
ccaatgtgcgggacaagagctactc

SEQ ID NO: 90491 - DNA, 25 bp, Mus musculus
ccaattactgggagacgtgcagcca

SEQ ID NO: 90492 - DNA, 25 bp, Mus musculus
ccaattcagctccagtgtacaggga

SEQ ID NO: 90493 - DNA, 25 bp, Mus musculus
ccaatttcgtgcagcgggtgaggcc

SEQ ID NO: 90494 - DNA, 25 bp, Mus musculus
ccaatttgatgagagacccgtacgc

SEQ ID NO: 90495 - DNA, 25 bp, Mus musculus
ccaatttgccaagggttagctgctc

SEQ ID NO: 90496 - DNA, 25 bp, Mus musculus
ccaatttttggtgcaattcaaggca

SEQ ID NO: 90497 - DNA, 25 bp, Mus musculus
ccacaaacatgacttgctgctggca

SEQ ID NO: 90498 - DNA, 25 bp, Mus musculus
ccacaaaggcaattcttgacaagaa

SEQ ID NO: 90499 - DNA, 25 bp, Mus musculus
ccacaaatgtggaggcaagcctgca

SEQ ID NO: 90500 - DNA, 25 bp, Mus musculus
ccacaaccggaacgtgatcacggag

SEQ ID NO: 90501 - DNA, 25 bp, Mus musculus
ccacaagaatggttgtgcccttggc

SEQ ID NO: 90502 - DNA, 25 bp, Mus musculus
ccacaagacacgttaggataaaatc

SEQ ID NO: 90503 - DNA, 25 bp, Mus musculus
ccacaaggctgggtctaaagacaga

SEQ ID NO: 90504 - DNA, 25 bp, Mus musculus
ccacaagggttttgagaccagctca

SEQ ID NO: 90505 - DNA, 25 bp, Mus musculus
ccacaagtgggacctggagcatcag

SEQ ID NO: 90506 - DNA, 25 bp, Mus musculus
ccacaataaggatgtcagagaccta

SEQ ID NO: 90507 - DNA, 25 bp, Mus musculus
ccacaatggcaaagggcagcaggtt

SEQ ID NO: 90508 - DNA, 25 bp, Mus musculus
ccacaatggtggctaaacgggacat

SEQ ID NO: 90509 - DNA, 25 bp, Mus musculus
ccacacaaagccaaataaggaaatg

SEQ ID NO: 90510 - DNA, 25 bp, Mus musculus
ccacacagcgtgagcaaggagttct

SEQ ID NO: 90511 - DNA, 25 bp, Mus musculus
ccacacggtattggagctgctggag

SEQ ID NO: 90512 - DNA, 25 bp, Mus musculus
ccacactcgaggagttgttactcta

SEQ ID NO: 90513 - DNA, 25 bp, Mus musculus
ccacagaagatgaggcctgggcctt

SEQ ID NO: 90514 - DNA, 25 bp, Mus musculus
ccacagaaggaaggtcacacacaag

SEQ ID NO: 90515 - DNA, 25 bp, Mus musculus
ccacagacgtgtggcatttctggac

SEQ ID NO: 90516 - DNA, 25 bp, Mus musculus
ccacagactgccaagtgggataact

SEQ ID NO: 90517 - DNA, 25 bp, Mus musculus
ccacagaggagaacgaggacaggtt

SEQ ID NO: 90518 - DNA, 25 bp, Mus musculus
ccacagcagtgctgatcggcctcta

SEQ ID NO: 90519 - DNA, 25 bp, Mus musculus
ccacagccgagaagtgtttgcataa

SEQ ID NO: 90520 - DNA, 25 bp, Mus musculus
ccacagcgggatgggactagtttat

SEQ ID NO: 90521 - DNA, 25 bp, Mus musculus
ccacagcttgggtgcagagactcga

SEQ ID NO: 90522 - DNA, 25 bp, Mus musculus
ccacaggaagagtacgaagtcgtca

SEQ ID NO: 90523 - DNA, 25 bp, Mus musculus
ccacaggagccggatccctaattga

SEQ ID NO: 90524 - DNA, 25 bp, Mus musculus
ccacaggaggtatccaagggacact

SEQ ID NO: 90525 - DNA, 25 bp, Mus musculus
ccacagggatgctccgggaatggct

SEQ ID NO: 90526 - DNA, 25 bp, Mus musculus
ccacagggccagaggcatcagttct

SEQ ID NO: 90527 - DNA, 25 bp, Mus musculus
ccacagtagagcgaatgggcctcat

SEQ ID NO: 90528 - DNA, 25 bp, Mus musculus
ccacagtcgtggttgtagaggatga

SEQ ID NO: 90529 - DNA, 25 bp, Mus musculus
ccacagtgggcaataactgaattat

SEQ ID NO: 90530 - DNA, 25 bp, Mus musculus
ccacataacaatcagtcatactcag

SEQ ID NO: 90531 - DNA, 25 bp, Mus musculus
ccacatcaaatacatctgtccacat

SEQ ID NO: 90532 - DNA, 25 bp, Mus musculus
ccacatcattaaggaagactgtcag

SEQ ID NO: 90533 - DNA, 25 bp, Mus musculus
ccacatcgtcatggtgaatggtgtc

SEQ ID NO: 90534 - DNA, 25 bp, Mus musculus
ccacatcgtgtatggctcaaaaaag

SEQ ID NO: 90535 - DNA, 25 bp, Mus musculus
ccacatgatgggagacgagggctca

SEQ ID NO: 90536 - DNA, 25 bp, Mus musculus
ccacatggatggagctcggttgatg

SEQ ID NO: 90537 - DNA, 25 bp, Mus musculus
ccacatgttgttgccggcttccgga

SEQ ID NO: 90538 - DNA, 25 bp, Mus musculus
ccacattgtggaacgcaagcggcta

SEQ ID NO: 90539 - DNA, 25 bp, Mus musculus
ccacatttactggacacactggaga

SEQ ID NO: 90540 - DNA, 25 bp, Mus musculus
ccacatttccggacctggcaagaaa

SEQ ID NO: 90541 - DNA, 25 bp, Mus musculus
ccaccagacagtgtgtactcgggtg

SEQ ID NO: 90542 - DNA, 25 bp, Mus musculus
ccaccagggacattttgtaaggatg

SEQ ID NO: 90543 - DNA, 25 bp, Mus musculus
ccaccaggtggtcagccggattata

SEQ ID NO: 90544 - DNA, 25 bp, Mus musculus
ccaccatggctcaggatggcgtgga

SEQ ID NO: 90545 - DNA, 25 bp, Mus musculus
ccaccatggtggaggaacagtttgt

SEQ ID NO: 90546 - DNA, 25 bp, Mus musculus
ccaccattcgggagatcattaagtt

SEQ ID NO: 90547 - DNA, 25 bp, Mus musculus
ccacccacgagttcaagcaggcctg

SEQ ID NO: 90548 - DNA, 25 bp, Mus musculus
ccacccctgaggatgagcaacaagt

SEQ ID NO: 90549 - DNA, 25 bp, Mus musculus
ccaccctgatgggacagtgctgtat

SEQ ID NO: 90550 - DNA, 25 bp, Mus musculus
ccaccctggtgaatgatgcctataa

SEQ ID NO: 90551 - DNA, 25 bp, Mus musculus
ccaccgaattggtgctgaccggcaa

SEQ ID NO: 90552 - DNA, 25 bp, Mus musculus
ccaccgacttggatgcagaggagga

SEQ ID NO: 90553 - DNA, 25 bp, Mus musculus
ccaccgagggagacactagttgaca

SEQ ID NO: 90554 - DNA, 25 bp, Mus musculus
ccaccgcctaaagggaacggagctg

SEQ ID NO: 90555 - DNA, 25 bp, Mus musculus
ccaccgctggtgatctggcatggga

SEQ ID NO: 90556 - DNA, 25 bp, Mus musculus
ccaccggctgatggaggcctttatc

SEQ ID NO: 90557 - DNA, 25 bp, Mus musculus
ccaccgggcgaatcgtggcagtcat

SEQ ID NO: 90558 - DNA, 25 bp, Mus musculus
ccaccgtgaagctggaaaatggcag

SEQ ID NO: 90559 - DNA, 25 bp, Mus musculus
ccaccgtgtcattagccaggctggg

SEQ ID NO: 90560 - DNA, 25 bp, Mus musculus
ccacctacagtggagtattccgaac

SEQ ID NO: 90561 - DNA, 25 bp, Mus musculus
ccacctcactgtggatgagttcaag

SEQ ID NO: 90562 - DNA, 25 bp, Mus musculus
ccacctctagagaagaccccaagtt

SEQ ID NO: 90563 - DNA, 25 bp, Mus musculus
ccacctcttacaattaggtggctga

SEQ ID NO: 90564 - DNA, 25 bp, Mus musculus
ccacctcttggtgggcagatctgaa

SEQ ID NO: 90565 - DNA, 25 bp, Mus musculus
ccacctgaggatgagccgaagcata

SEQ ID NO: 90566 - DNA, 25 bp, Mus musculus
ccacctgatgtacgctgtgagagag

SEQ ID NO: 90567 - DNA, 25 bp, Mus musculus
ccacctgcatgagtttttattaaag

SEQ ID NO: 90568 - DNA, 25 bp, Mus musculus
ccacctgcgggttgttcagtgctct

SEQ ID NO: 90569 - DNA, 25 bp, Mus musculus
ccacctgctcgctcccatgaccaac

SEQ ID NO: 90570 - DNA, 25 bp, Mus musculus
ccacctggaccgaagctatagctgt

SEQ ID NO: 90571 - DNA, 25 bp, Mus musculus
ccacctgtaacaagagcttctcccg

SEQ ID NO: 90572 - DNA, 25 bp, Mus musculus
ccacctgtcatgtgtatgtgagtga

SEQ ID NO: 90573 - DNA, 25 bp, Mus musculus
ccacctgtgagggaaaggaacagca

SEQ ID NO: 90574 - DNA, 25 bp, Mus musculus
ccacctgtggaacatgtaggatcgt

SEQ ID NO: 90575 - DNA, 25 bp, Mus musculus
ccaccttgcagatggagttcaccaa

SEQ ID NO: 90576 - DNA, 25 bp, Mus musculus
ccacctttgaagacgctgatacaga

SEQ ID NO: 90577 - DNA, 25 bp, Mus musculus
ccacgagaccatccgagtattggag

SEQ ID NO: 90578 - DNA, 25 bp, Mus musculus
ccacgaggaaatccgctgagtcatt

SEQ ID NO: 90579 - DNA, 25 bp, Mus musculus
ccacgaggaagtgctggagatccca

SEQ ID NO: 90580 - DNA, 25 bp, Mus musculus
ccacgcatccgcagaaacatccagg

SEQ ID NO: 90581 - DNA, 25 bp, Mus musculus
ccacgcattgcaggagaaggacaca

SEQ ID NO: 90582 - DNA, 25 bp, Mus musculus
ccacgctggacgaagaggatctggt

SEQ ID NO: 90583 - DNA, 25 bp, Mus musculus
ccacgctgggaacgcattagagagc

SEQ ID NO: 90584 - DNA, 25 bp, Mus musculus
ccacgctgttgctgcccttgtcggg

SEQ ID NO: 90585 - DNA, 25 bp, Mus musculus
ccacggaaatgttgaggctactcga

SEQ ID NO: 90586 - DNA, 25 bp, Mus musculus
ccacggactattttgctcacctgca

SEQ ID NO: 90587 - DNA, 25 bp, Mus musculus
ccacggactgtgaaaatctgcttaa

SEQ ID NO: 90588 - DNA, 25 bp, Mus musculus
ccacggagaggactgtacactgacg

SEQ ID NO: 90589 - DNA, 25 bp, Mus musculus
ccacggatgacttaacagtgttgac

SEQ ID NO: 90590 - DNA, 25 bp, Mus musculus
ccacggatgttttcagacagcgcag

SEQ ID NO: 90591 - DNA, 25 bp, Mus musculus
ccacggcaggttgcatttgggagac

SEQ ID NO: 90592 - DNA, 25 bp, Mus musculus
ccacggccacagctgtgctgtttct

SEQ ID NO: 90593 - DNA, 25 bp, Mus musculus
ccacggctacgaagagacctcagtt

SEQ ID NO: 90594 - DNA, 25 bp, Mus musculus
ccacggctgaagagtgtctggcaaa

SEQ ID NO: 90595 - DNA, 25 bp, Mus musculus
ccacggctgctcattaacaaggaaa

SEQ ID NO: 90596 - DNA, 25 bp, Mus musculus
ccacggcttcggtagcgaccggctg

SEQ ID NO: 90597 - DNA, 25 bp, Mus musculus
ccacgggatccctggagtggctgaa

SEQ ID NO: 90598 - DNA, 25 bp, Mus musculus
ccacgggcctgtacccatttgaggg

SEQ ID NO: 90599 - DNA, 25 bp, Mus musculus
ccacgggtaatctgggagtcacaga

SEQ ID NO: 90600 - DNA, 25 bp, Mus musculus
ccacgggtgggcttgtacactcagt

SEQ ID NO: 90601 - DNA, 25 bp, Mus musculus
ccacggtgactggttggagagaatc

SEQ ID NO: 90602 - DNA, 25 bp, Mus musculus
ccacggtggacagcgctcgttttaa

SEQ ID NO: 90603 - DNA, 25 bp, Mus musculus
ccacggtttggactatggaagacct

SEQ ID NO: 90604 - DNA, 25 bp, Mus musculus
ccacgtcgtcctggctgaaggcagt

SEQ ID NO: 90605 - DNA, 25 bp, Mus musculus
ccacgtggctggagtatatgccgct

SEQ ID NO: 90606 - DNA, 25 bp, Mus musculus
ccacgtgggactgcagacggaagcc

SEQ ID NO: 90607 - DNA, 25 bp, Mus musculus
ccacgtgttctgtgccagggaggca

SEQ ID NO: 90608 - DNA, 25 bp, Mus musculus
ccactaatgctgacatcgtaaccct

SEQ ID NO: 90609 - DNA, 25 bp, Mus musculus
ccactaattgtgaatcactccttct

SEQ ID NO: 90610 - DNA, 25 bp, Mus musculus
ccactacagctcagatcgagagaat

SEQ ID NO: 90611 - DNA, 25 bp, Mus musculus
ccactactccacagggaaggtcagt

SEQ ID NO: 90612 - DNA, 25 bp, Mus musculus
ccactatggttacagcaccgggcag

SEQ ID NO: 90613 - DNA, 25 bp, Mus musculus
ccactcctgaaaatggacttagtca

SEQ ID NO: 90614 - DNA, 25 bp, Mus musculus
ccactctggctgtgggcggagttca

SEQ ID NO: 90615 - DNA, 25 bp, Mus musculus
ccactcttaactcagctcggagagg

SEQ ID NO: 90616 - DNA, 25 bp, Mus musculus
ccactgaaggaggaacacaagattt

SEQ ID NO: 90617 - DNA, 25 bp, Mus musculus
ccactgagaaaggatcggtctgcag

SEQ ID NO: 90618 - DNA, 25 bp, Mus musculus
ccactgagagaaatgggaagccaga

SEQ ID NO: 90619 - DNA, 25 bp, Mus musculus
ccactgagatctagggctctgcaag

SEQ ID NO: 90620 - DNA, 25 bp, Mus musculus
ccactgcacactcagtggtcctggg

SEQ ID NO: 90621 - DNA, 25 bp, Mus musculus
ccactgcggatcaaagctgcgaaga

SEQ ID NO: 90622 - DNA, 25 bp, Mus musculus
ccactgctaactccttccgagttgt

SEQ ID NO: 90623 - DNA, 25 bp, Mus musculus
ccactgctgctgtacgtgagtcccg

SEQ ID NO: 90624 - DNA, 25 bp, Mus musculus
ccactggaggtgtgtgagccaacaa

SEQ ID NO: 90625 - DNA, 25 bp, Mus musculus
ccactgggtgcctgctggctatgct

SEQ ID NO: 90626 - DNA, 25 bp, Mus musculus
ccactgggtgggatacagagtcttc

SEQ ID NO: 90627 - DNA, 25 bp, Mus musculus
ccactggttgaatgaaattgtctgc

SEQ ID NO: 90628 - DNA, 25 bp, Mus musculus
ccactggttggttcgcagggttcac

SEQ ID NO: 90629 - DNA, 25 bp, Mus musculus
ccactgtcgggtttctccgcggcta

SEQ ID NO: 90630 - DNA, 25 bp, Mus musculus
ccactgtgaagagacagggtctgac

SEQ ID NO: 90631 - DNA, 25 bp, Mus musculus
ccactgtgagccctgaggaggaaac

SEQ ID NO: 90632 - DNA, 25 bp, Mus musculus
ccactgtgatggacgtgaagcccgt

SEQ ID NO: 90633 - DNA, 25 bp, Mus musculus
ccactgtgcgtcatgaggagcttca

SEQ ID NO: 90634 - DNA, 25 bp, Mus musculus
ccactgtggtgctgcatggatacaa

SEQ ID NO: 90635 - DNA, 25 bp, Mus musculus
ccactgtgttggctagctaaaaaca

SEQ ID NO: 90636 - DNA, 25 bp, Mus musculus
ccacttaaaaagcatacgtgattta

SEQ ID NO: 90637 - DNA, 25 bp, Mus musculus
ccacttagaaggacttagaaggact

SEQ ID NO: 90638 - DNA, 25 bp, Mus musculus
ccacttagaatgtaaaaccagtata

SEQ ID NO: 90639 - DNA, 25 bp, Mus musculus
ccacttagcccatgggaaggttcca

SEQ ID NO: 90640 - DNA, 25 bp, Mus musculus
ccacttcagggagggactggactcg

SEQ ID NO: 90641 - DNA, 25 bp, Mus musculus
ccacttcatcgctgtggtcactgaa

SEQ ID NO: 90642 - DNA, 25 bp, Mus musculus
ccacttccaaagatgcagacgagcc

SEQ ID NO: 90643 - DNA, 25 bp, Mus musculus
ccacttcgggatgggttgcagtcaa

SEQ ID NO: 90644 - DNA, 25 bp, Mus musculus
ccacttggacttttgcaatcagaga

SEQ ID NO: 90645 - DNA, 25 bp, Mus musculus
ccacttggtttaacggatgagccga

SEQ ID NO: 90646 - DNA, 25 bp, Mus musculus
ccacttgtggcagtgtactacacta

SEQ ID NO: 90647 - DNA, 25 bp, Mus musculus
ccagaaaaagatgggcaggtagccc

SEQ ID NO: 90648 - DNA, 25 bp, Mus musculus
ccagaaaagaaacctgcaacatcat

SEQ ID NO: 90649 - DNA, 25 bp, Mus musculus
ccagaaaaggcaagggctgcctctt

SEQ ID NO: 90650 - DNA, 25 bp, Mus musculus
ccagaaaattcagggtgctcaggat

SEQ ID NO: 90651 - DNA, 25 bp, Mus musculus
ccagaaaattgtcttggaaggcaca

SEQ ID NO: 90652 - DNA, 25 bp, Mus musculus
ccagaaacaatacagtgccgccgtg

SEQ ID NO: 90653 - DNA, 25 bp, Mus musculus
ccagaaactggaagcgtaggtacga

SEQ ID NO: 90654 - DNA, 25 bp, Mus musculus
ccagaaagactgatgcgaggagagc

SEQ ID NO: 90655 - DNA, 25 bp, Mus musculus
ccagaaagagattgggtacttaatg

SEQ ID NO: 90656 - DNA, 25 bp, Mus musculus
ccagaaagcaggaacccaaggactt

SEQ ID NO: 90657 - DNA, 25 bp, Mus musculus
ccagaaatcacttcgggagaagcaa

SEQ ID NO: 90658 - DNA, 25 bp, Mus musculus
ccagaaatcggtggtctgagagcgt

SEQ ID NO: 90659 - DNA, 25 bp, Mus musculus
ccagaacaagatccgcgcctgtggg

SEQ ID NO: 90660 - DNA, 25 bp, Mus musculus
ccagaacactgtatcgagtatgtga

SEQ ID NO: 90661 - DNA, 25 bp, Mus musculus
ccagaacagagacggcttcatcgac

SEQ ID NO: 90662 - DNA, 25 bp, Mus musculus
ccagaacaggcggatgtggtcatca

SEQ ID NO: 90663 - DNA, 25 bp, Mus musculus
ccagaacattcgctacagaggagga

SEQ ID NO: 90664 - DNA, 25 bp, Mus musculus
ccagaaccagttccccaggaggaag

SEQ ID NO: 90665 - DNA, 25 bp, Mus musculus
ccagaacccagtgtaggaggagatt

SEQ ID NO: 90666 - DNA, 25 bp, Mus musculus
ccagaacctggtttcaagtgactac

SEQ ID NO: 90667 - DNA, 25 bp, Mus musculus
ccagaactaaggaacaagacccttg

SEQ ID NO: 90668 - DNA, 25 bp, Mus musculus
ccagaactggcgaggatggcgcaaa

SEQ ID NO: 90669 - DNA, 25 bp, Mus musculus
ccagaagaaatgaggagacagcgtc

SEQ ID NO: 90670 - DNA, 25 bp, Mus musculus
ccagaagaagagagagtgggatatt

SEQ ID NO: 90671 - DNA, 25 bp, Mus musculus
ccagaagaattcagccgacagggca

SEQ ID NO: 90672 - DNA, 25 bp, Mus musculus
ccagaagacaggaggcctggacaag

SEQ ID NO: 90673 - DNA, 25 bp, Mus musculus
ccagaagcgacttgatagaggacga

SEQ ID NO: 90674 - DNA, 25 bp, Mus musculus
ccagaagctaaaggtcaagggcatg

SEQ ID NO: 90675 - DNA, 25 bp, Mus musculus
ccagaagcttgtacagggtgggcac

SEQ ID NO: 90676 - DNA, 25 bp, Mus musculus
ccagaagggaaatactgaacctgca

SEQ ID NO: 90677 - DNA, 25 bp, Mus musculus
ccagaaggtgacagggaccatgcta

SEQ ID NO: 90678 - DNA, 25 bp, Mus musculus
ccagaagtacgcaacggaagaggcc

SEQ ID NO: 90679 - DNA, 25 bp, Mus musculus
ccagaagtggtcttgcagaaggcag

SEQ ID NO: 90680 - DNA, 25 bp, Mus musculus
ccagaagttcaagtgcggcgaggat

SEQ ID NO: 90681 - DNA, 25 bp, Mus musculus
ccagaataaagctgggaaatgcccc

SEQ ID NO: 90682 - DNA, 25 bp, Mus musculus
ccagaatacaaagaagacagcggtg

SEQ ID NO: 90683 - DNA, 25 bp, Mus musculus
ccagaatacagaaaatttttggaga

SEQ ID NO: 90684 - DNA, 25 bp, Mus musculus
ccagaatacctgaaggtgggcgcca

SEQ ID NO: 90685 - DNA, 25 bp, Mus musculus
ccagaataccttaaccatgtgagca

SEQ ID NO: 90686 - DNA, 25 bp, Mus musculus
ccagaatagtggctttgaatacacc

SEQ ID NO: 90687 - DNA, 25 bp, Mus musculus
ccagaatagtgtggaggctactgca

SEQ ID NO: 90688 - DNA, 25 bp, Mus musculus
ccagaatattatagtctgcagttga

SEQ ID NO: 90689 - DNA, 25 bp, Mus musculus
ccagaatgaagaggcccagttcgtg

SEQ ID NO: 90690 - DNA, 25 bp, Mus musculus
ccagaatggaacaagaggcaaaagc

SEQ ID NO: 90691 - DNA, 25 bp, Mus musculus
ccagaatggtctgagccgcggactt

SEQ ID NO: 90692 - DNA, 25 bp, Mus musculus
ccagaattggaatgagacctccgca

SEQ ID NO: 90693 - DNA, 25 bp, Mus musculus
ccagacaaagcagtgtgaacgattc

SEQ ID NO: 90694 - DNA, 25 bp, Mus musculus
ccagacaacaggaacgaggatgatg

SEQ ID NO: 90695 - DNA, 25 bp, Mus musculus
ccagacaagaacccggataataaag

SEQ ID NO: 90696 - DNA, 25 bp, Mus musculus
ccagacaatgatgaacaagggcctt

SEQ ID NO: 90697 - DNA, 25 bp, Mus musculus
ccagacagaaggtcccaggcattct

SEQ ID NO: 90698 - DNA, 25 bp, Mus musculus
ccagacagtgtgtactcgggtgtgc

SEQ ID NO: 90699 - DNA, 25 bp, Mus musculus
ccagacataagagaccgggagaaga

SEQ ID NO: 90700 - DNA, 25 bp, Mus musculus
ccagacatagcccaaagagccaaga

SEQ ID NO: 90701 - DNA, 25 bp, Mus musculus
ccagacatgcaggactccgaagagt

SEQ ID NO: 90702 - DNA, 25 bp, Mus musculus
ccagacatgggctgcaaggaaagcc

SEQ ID NO: 90703 - DNA, 25 bp, Mus musculus
ccagaccagggtaacaggtgtccca

SEQ ID NO: 90704 - DNA, 25 bp, Mus musculus
ccagaccctttctttcatgagccgt

SEQ ID NO: 90705 - DNA, 25 bp, Mus musculus
ccagacctcttgattccattttgaa

SEQ ID NO: 90706 - DNA, 25 bp, Mus musculus
ccagaccttgtttctaagagagtca

SEQ ID NO: 90707 - DNA, 25 bp, Mus musculus
ccagacgccgggactgtccagcgaa

SEQ ID NO: 90708 - DNA, 25 bp, Mus musculus
ccagacggtagtggtggagtacaca

SEQ ID NO: 90709 - DNA, 25 bp, Mus musculus
ccagacgtgcttggcactagggtac

SEQ ID NO: 90710 - DNA, 25 bp, Mus musculus
ccagactctgctgttgaccttgtca

SEQ ID NO: 90711 - DNA, 25 bp, Mus musculus
ccagactctgggtgttgacaagggt

SEQ ID NO: 90712 - DNA, 25 bp, Mus musculus
ccagactgtgtgaatgagggccttt

SEQ ID NO: 90713 - DNA, 25 bp, Mus musculus
ccagacttagggtgggagcctgcca

SEQ ID NO: 90714 - DNA, 25 bp, Mus musculus
ccagacttgtcagaagttgaaacgt

SEQ ID NO: 90715 - DNA, 25 bp, Mus musculus
ccagactttccagcggtcagcagtg

SEQ ID NO: 90716 - DNA, 25 bp, Mus musculus
ccagagaaagacctgtgtagtgtca

SEQ ID NO: 90717 - DNA, 25 bp, Mus musculus
ccagagaaattcactaggtaggagg

SEQ ID NO: 90718 - DNA, 25 bp, Mus musculus
ccagagaacagctttgacttcgtaa

SEQ ID NO: 90719 - DNA, 25 bp, Mus musculus
ccagagaatttagaccacagtgcat

SEQ ID NO: 90720 - DNA, 25 bp, Mus musculus
ccagagacagagcaagatgagttcc

SEQ ID NO: 90721 - DNA, 25 bp, Mus musculus
ccagagacctgtgtgagtgtgttcc

SEQ ID NO: 90722 - DNA, 25 bp, Mus musculus
ccagagagcggctggaccggatcct

SEQ ID NO: 90723 - DNA, 25 bp, Mus musculus
ccagagagggaaccatgggaatatt

SEQ ID NO: 90724 - DNA, 25 bp, Mus musculus
ccagagaggtgccaaaccaggtagt

SEQ ID NO: 90725 - DNA, 25 bp, Mus musculus
ccagagataaagacgggcggccgtt

SEQ ID NO: 90726 - DNA, 25 bp, Mus musculus
ccagagataatggatgaagatcagt

SEQ ID NO: 90727 - DNA, 25 bp, Mus musculus
ccagagatacctccagatattgtga

SEQ ID NO: 90728 - DNA, 25 bp, Mus musculus
ccagagatgaaggtcgagcggtaca

SEQ ID NO: 90729 - DNA, 25 bp, Mus musculus
ccagagatgccaaaagcaggcagct

SEQ ID NO: 90730 - DNA, 25 bp, Mus musculus
ccagagattggagcagagtacagca

SEQ ID NO: 90731 - DNA, 25 bp, Mus musculus
ccagagcagcactgacgagatcaca

SEQ ID NO: 90732 - DNA, 25 bp, Mus musculus
ccagagcagctctagtgatgaagac

SEQ ID NO: 90733 - DNA, 25 bp, Mus musculus
ccagagcatcccatcacagaggtga

SEQ ID NO: 90734 - DNA, 25 bp, Mus musculus
ccagagccaggcagtcaggaaaggt

SEQ ID NO: 90735 - DNA, 25 bp, Mus musculus
ccagagccccggagcggagcctagg

SEQ ID NO: 90736 - DNA, 25 bp, Mus musculus
ccagagccggcagtaaagattcatt

SEQ ID NO: 90737 - DNA, 25 bp, Mus musculus
ccagagccggtttagactgcaaggg

SEQ ID NO: 90738 - DNA, 25 bp, Mus musculus
ccagagcctggaagtgagactccca

SEQ ID NO: 90739 - DNA, 25 bp, Mus musculus
ccagagcggccggacttctcgctcc

SEQ ID NO: 90740 - DNA, 25 bp, Mus musculus
ccagagcgtgctgcaggacttactg

SEQ ID NO: 90741 - DNA, 25 bp, Mus musculus
ccagaggaagcttgatgagacgaca

SEQ ID NO: 90742 - DNA, 25 bp, Mus musculus
ccagaggaatacgtgcccactgtgt

SEQ ID NO: 90743 - DNA, 25 bp, Mus musculus
ccagaggacactatctacggcggct

SEQ ID NO: 90744 - DNA, 25 bp, Mus musculus
ccagaggacctttctaggttcgtgg

SEQ ID NO: 90745 - DNA, 25 bp, Mus musculus
ccagaggagcttatacagggatgtc

SEQ ID NO: 90746 - DNA, 25 bp, Mus musculus
ccagaggaggacatggcactagtca

SEQ ID NO: 90747 - DNA, 25 bp, Mus musculus
ccagaggagtggaaaagcaggaacc

SEQ ID NO: 90748 - DNA, 25 bp, Mus musculus
ccagaggatcatgggtctacgggca

SEQ ID NO: 90749 - DNA, 25 bp, Mus musculus
ccagaggatctatgacggccagtac

SEQ ID NO: 90750 - DNA, 25 bp, Mus musculus
ccagaggcagcctgtagtagtcaca

SEQ ID NO: 90751 - DNA, 25 bp, Mus musculus
ccagaggcatgggtttcccctgaca

SEQ ID NO: 90752 - DNA, 25 bp, Mus musculus
ccagaggctcgctgcttctatggct

SEQ ID NO: 90753 - DNA, 25 bp, Mus musculus
ccagagggagctgaagaccgtgctt

SEQ ID NO: 90754 - DNA, 25 bp, Mus musculus
ccagagggatgcattcggcaggact

SEQ ID NO: 90755 - DNA, 25 bp, Mus musculus
ccagagggccttcgttaaagaagag

SEQ ID NO: 90756 - DNA, 25 bp, Mus musculus
ccagagggcttggaccagctacaag

SEQ ID NO: 90757 - DNA, 25 bp, Mus musculus
ccagaggtgttcatgcagacgggtt

SEQ ID NO: 90758 - DNA, 25 bp, Mus musculus
ccagaggttactacagctgcagtca

SEQ ID NO: 90759 - DNA, 25 bp, Mus musculus
ccagaggttgctccctaggatatgt

SEQ ID NO: 90760 - DNA, 25 bp, Mus musculus
ccagagtaacagttgtggcttgact

SEQ ID NO: 90761 - DNA, 25 bp, Mus musculus
ccagagtcgctggaactaccgggat

SEQ ID NO: 90762 - DNA, 25 bp, Mus musculus
ccagagtctgagatagacatagatg

SEQ ID NO: 90763 - DNA, 25 bp, Mus musculus
ccagagtctgtggatgccgttacat

SEQ ID NO: 90764 - DNA, 25 bp, Mus musculus
ccagagtgagacaccgaaggtcagc

SEQ ID NO: 90765 - DNA, 25 bp, Mus musculus
ccagagtgtgctgtcgtccatcgac

SEQ ID NO: 90766 - DNA, 25 bp, Mus musculus
ccagagttggtgagactgcctgtct

SEQ ID NO: 90767 - DNA, 25 bp, Mus musculus
ccagagttgtgagtcggcactgacc

SEQ ID NO: 90768 - DNA, 25 bp, Mus musculus
ccagagtttccactgtaagctgcgg

SEQ ID NO: 90769 - DNA, 25 bp, Mus musculus
ccagataactggttcggacacggac

SEQ ID NO: 90770 - DNA, 25 bp, Mus musculus
ccagataattaaacaagctaggact

SEQ ID NO: 90771 - DNA, 25 bp, Mus musculus
ccagatagatgagcttgtggcatcc

SEQ ID NO: 90772 - DNA, 25 bp, Mus musculus
ccagatagcgagcttggatgccagc

SEQ ID NO: 90773 - DNA, 25 bp, Mus musculus
ccagatatgacgaggggactttgtt

SEQ ID NO: 90774 - DNA, 25 bp, Mus musculus
ccagatcacagcacacggtccccag

SEQ ID NO: 90775 - DNA, 25 bp, Mus musculus
ccagatcccgtggttcgaaatcaag

SEQ ID NO: 90776 - DNA, 25 bp, Mus musculus
ccagatctaaaaaggtgcattgaat

SEQ ID NO: 90777 - DNA, 25 bp, Mus musculus
ccagatctttttgtgccaggacagg

SEQ ID NO: 90778 - DNA, 25 bp, Mus musculus
ccagatgatgacctagatatttgac

SEQ ID NO: 90779 - DNA, 25 bp, Mus musculus
ccagatgcagacttggacgtaacca

SEQ ID NO: 90780 - DNA, 25 bp, Mus musculus
ccagatgcgtcgatggaggcccgca

SEQ ID NO: 90781 - DNA, 25 bp, Mus musculus
ccagatggatctgcccagcagcagt

SEQ ID NO: 90782 - DNA, 25 bp, Mus musculus
ccagatggcgtaggaaggtcgggct

SEQ ID NO: 90783 - DNA, 25 bp, Mus musculus
ccagatgtcagtagcaaggatcacc

SEQ ID NO: 90784 - DNA, 25 bp, Mus musculus
ccagatgtgaatgttttccagagga

SEQ ID NO: 90785 - DNA, 25 bp, Mus musculus
ccagattaaagtgggctcggagtct

SEQ ID NO: 90786 - DNA, 25 bp, Mus musculus
ccagattggcagagataggagcgcc

SEQ ID NO: 90787 - DNA, 25 bp, Mus musculus
ccagattgttctgaagcgccgggcc

SEQ ID NO: 90788 - DNA, 25 bp, Mus musculus
ccagatttacaagcaagggccgaca

SEQ ID NO: 90789 - DNA, 25 bp, Mus musculus
ccagatttgtggctcaggtcggccc

SEQ ID NO: 90790 - DNA, 25 bp, Mus musculus
ccagattttcattcaggaagagcca

SEQ ID NO: 90791 - DNA, 25 bp, Mus musculus
ccagcaaaagtaacagggagtcctc

SEQ ID NO: 90792 - DNA, 25 bp, Mus musculus
ccagcaacgagggacacgggtttga

SEQ ID NO: 90793 - DNA, 25 bp, Mus musculus
ccagcaagagaggaactagtgggtc

SEQ ID NO: 90794 - DNA, 25 bp, Mus musculus
ccagcaagatcatctattcctatga

SEQ ID NO: 90795 - DNA, 25 bp, Mus musculus
ccagcaagcagaaccgcttcaatgt

SEQ ID NO: 90796 - DNA, 25 bp, Mus musculus
ccagcaagctactgatgggcatccc

SEQ ID NO: 90797 - DNA, 25 bp, Mus musculus
ccagcaaggtgcaatcagactcatt

SEQ ID NO: 90798 - DNA, 25 bp, Mus musculus
ccagcaagtccagcaggtccatgta

SEQ ID NO: 90799 - DNA, 25 bp, Mus musculus
ccagcaagttcctcgcaggcgatgt

SEQ ID NO: 90800 - DNA, 25 bp, Mus musculus
ccagcaagttttgggagagcccgga

SEQ ID NO: 90801 - DNA, 25 bp, Mus musculus
ccagcaatcttgaggaagagatgcg

SEQ ID NO: 90802 - DNA, 25 bp, Mus musculus
ccagcaatgttggaagtggacactt

SEQ ID NO: 90803 - DNA, 25 bp, Mus musculus
ccagcacaactctggcagctacttg

SEQ ID NO: 90804 - DNA, 25 bp, Mus musculus
ccagcacacgaagagttggagagct

SEQ ID NO: 90805 - DNA, 25 bp, Mus musculus
ccagcaccatgggatcaagtcaaat

SEQ ID NO: 90806 - DNA, 25 bp, Mus musculus
ccagcaccgagtgcaatagtgtctg

SEQ ID NO: 90807 - DNA, 25 bp, Mus musculus
ccagcactgcttgtttctgacatgc

SEQ ID NO: 90808 - DNA, 25 bp, Mus musculus
ccagcactgggaaaggcgatcattc

SEQ ID NO: 90809 - DNA, 25 bp, Mus musculus
ccagcactgtggtacgagcggtctt

SEQ ID NO: 90810 - DNA, 25 bp, Mus musculus
ccagcacttaagcaaacgggaattc

SEQ ID NO: 90811 - DNA, 25 bp, Mus musculus
ccagcagaactatggcacggagcta

SEQ ID NO: 90812 - DNA, 25 bp, Mus musculus
ccagcagagcttggaggccaaaggc

SEQ ID NO: 90813 - DNA, 25 bp, Mus musculus
ccagcagcagcggaagtattaccaa

SEQ ID NO: 90814 - DNA, 25 bp, Mus musculus
ccagcagcgagactggcacatcgct

SEQ ID NO: 90815 - DNA, 25 bp, Mus musculus
ccagcagcgagttaggtgaagtcca

SEQ ID NO: 90816 - DNA, 25 bp, Mus musculus
ccagcagcggtgctgactgcccaga

SEQ ID NO: 90817 - DNA, 25 bp, Mus musculus
ccagcagctcaaggtcaagttccga

SEQ ID NO: 90818 - DNA, 25 bp, Mus musculus
ccagcagctggaccgaattgattca

SEQ ID NO: 90819 - DNA, 25 bp, Mus musculus
ccagcagctgggtcaggaaaaccct

SEQ ID NO: 90820 - DNA, 25 bp, Mus musculus
ccagcaggctgtttcatatggcgac

SEQ ID NO: 90821 - DNA, 25 bp, Mus musculus
ccagcaggtattcaaaggagtagtg

SEQ ID NO: 90822 - DNA, 25 bp, Mus musculus
ccagcaggttctagaccacgggcat

SEQ ID NO: 90823 - DNA, 25 bp, Mus musculus
ccagcagtgcctgtcgggaactggc

SEQ ID NO: 90824 - DNA, 25 bp, Mus musculus
ccagcagtgctaaaagcgccaacaa

SEQ ID NO: 90825 - DNA, 25 bp, Mus musculus
ccagcagttgactttgggaacctca

SEQ ID NO: 90826 - DNA, 25 bp, Mus musculus
ccagcagtttagtgggataggccga

SEQ ID NO: 90827 - DNA, 25 bp, Mus musculus
ccagcatgaaaggaagaacaacgaa

SEQ ID NO: 90828 - DNA, 25 bp, Mus musculus
ccagcatgaggatgcacgggagctc

SEQ ID NO: 90829 - DNA, 25 bp, Mus musculus
ccagcatggatgttgtacaagtgcc

SEQ ID NO: 90830 - DNA, 25 bp, Mus musculus
ccagcatggcgtggtccggtaataa

SEQ ID NO: 90831 - DNA, 25 bp, Mus musculus
ccagcatgggacactgtgaggccac

SEQ ID NO: 90832 - DNA, 25 bp, Mus musculus
ccagcatgggagtggccaactttcc

SEQ ID NO: 90833 - DNA, 25 bp, Mus musculus
ccagcatgtcaatacgaggtcacag

SEQ ID NO: 90834 - DNA, 25 bp, Mus musculus
ccagcattaatctagggactccaag

SEQ ID NO: 90835 - DNA, 25 bp, Mus musculus
ccagcattgctgaaaaagagagtcc

SEQ ID NO: 90836 - DNA, 25 bp, Mus musculus
ccagccaagatggagtagcccttag

SEQ ID NO: 90837 - DNA, 25 bp, Mus musculus
ccagccacatagcaaggagaggtcc

SEQ ID NO: 90838 - DNA, 25 bp, Mus musculus
ccagccactgccgagtacgaatttg

SEQ ID NO: 90839 - DNA, 25 bp, Mus musculus
ccagccagacggaagtgaacgcgtt

SEQ ID NO: 90840 - DNA, 25 bp, Mus musculus
ccagccagctggaagttctcaaaga

SEQ ID NO: 90841 - DNA, 25 bp, Mus musculus
ccagccagtcgggtctatcaaacag

SEQ ID NO: 90842 - DNA, 25 bp, Mus musculus
ccagccagtgttggtggagtgccct

SEQ ID NO: 90843 - DNA, 25 bp, Mus musculus
ccagccatcgaataaggaagggttt

SEQ ID NO: 90844 - DNA, 25 bp, Mus musculus
ccagccatttttcttcaccggagca

SEQ ID NO: 90845 - DNA, 25 bp, Mus musculus
ccagcccagaggacacactgtctgg

SEQ ID NO: 90846 - DNA, 25 bp, Mus musculus
ccagcccaggtcacgtccgtgagaa

SEQ ID NO: 90847 - DNA, 25 bp, Mus musculus
ccagcccatcaaaaatggcaagatc

SEQ ID NO: 90848 - DNA, 25 bp, Mus musculus
ccagccctggagagaatagattacc

SEQ ID NO: 90849 - DNA, 25 bp, Mus musculus
ccagccgggcactcatgaatcttca

SEQ ID NO: 90850 - DNA, 25 bp, Mus musculus
ccagccgggctactgtgatgcttta

SEQ ID NO: 90851 - DNA, 25 bp, Mus musculus
ccagccgtgatgatgaatgcaggaa

SEQ ID NO: 90852 - DNA, 25 bp, Mus musculus
ccagcctacctgaacccagagatga

SEQ ID NO: 90853 - DNA, 25 bp, Mus musculus
ccagcctagaggtgagaattacatc

SEQ ID NO: 90854 - DNA, 25 bp, Mus musculus
ccagcctcagtgagatcaaccatca

SEQ ID NO: 90855 - DNA, 25 bp, Mus musculus
ccagcctctcgggactaagttagag

SEQ ID NO: 90856 - DNA, 25 bp, Mus musculus
ccagcctgatctttgctttagccca

SEQ ID NO: 90857 - DNA, 25 bp, Mus musculus
ccagcctggctacatcggaagactt

SEQ ID NO: 90858 - DNA, 25 bp, Mus musculus
ccagcctggttttctgtatgttcca

SEQ ID NO: 90859 - DNA, 25 bp, Mus musculus
ccagcctgtcatgggatatggagca

SEQ ID NO: 90860 - DNA, 25 bp, Mus musculus
ccagcctgtccataggtggaggata

SEQ ID NO: 90861 - DNA, 25 bp, Mus musculus
ccagccttttactgtcctgacaaaa

SEQ ID NO: 90862 - DNA, 25 bp, Mus musculus
ccagcgaagggctggacttctcaga

SEQ ID NO: 90863 - DNA, 25 bp, Mus musculus
ccagcgaggattttgtggatccatg

SEQ ID NO: 90864 - DNA, 25 bp, Mus musculus
ccagcgatggagaacggcacccggt

SEQ ID NO: 90865 - DNA, 25 bp, Mus musculus
ccagcgattcttgaaggaatgggag

SEQ ID NO: 90866 - DNA, 25 bp, Mus musculus
ccagcgccagataaaggagtccaaa

SEQ ID NO: 90867 - DNA, 25 bp, Mus musculus
ccagcgcctcagaacgcaggaaatg

SEQ ID NO: 90868 - DNA, 25 bp, Mus musculus
ccagcgcctgtgaccaaatagagtg

SEQ ID NO: 90869 - DNA, 25 bp, Mus musculus
ccagcgcgctggaaggagttcatgc

SEQ ID NO: 90870 - DNA, 25 bp, Mus musculus
ccagcgcggccaatgaagaagggaa

SEQ ID NO: 90871 - DNA, 25 bp, Mus musculus
ccagcggaaggtgaaacctcagccg

SEQ ID NO: 90872 - DNA, 25 bp, Mus musculus
ccagcggcactatgtgtattaagag

SEQ ID NO: 90873 - DNA, 25 bp, Mus musculus
ccagcgggaacagaatgagcgcctg

SEQ ID NO: 90874 - DNA, 25 bp, Mus musculus
ccagcggtgaagctacatgaagaga

SEQ ID NO: 90875 - DNA, 25 bp, Mus musculus
ccagcggtgcgctcgggcttcgcta

SEQ ID NO: 90876 - DNA, 25 bp, Mus musculus
ccagcgtgaaaaggtggcattggct

SEQ ID NO: 90877 - DNA, 25 bp, Mus musculus
ccagcgtgaagcagtcctctcagag

SEQ ID NO: 90878 - DNA, 25 bp, Mus musculus
ccagcgtggaggataagaacctgtc

SEQ ID NO: 90879 - DNA, 25 bp, Mus musculus
ccagctaagatctgtggaaatccag

SEQ ID NO: 90880 - DNA, 25 bp, Mus musculus
ccagctacatggagaacgggtccga

SEQ ID NO: 90881 - DNA, 25 bp, Mus musculus
ccagctacctggtgcgcaacagtga

SEQ ID NO: 90882 - DNA, 25 bp, Mus musculus
ccagctactggtggaacggagacaa

SEQ ID NO: 90883 - DNA, 25 bp, Mus musculus
ccagctagatagtgaggtggtgaca

SEQ ID NO: 90884 - DNA, 25 bp, Mus musculus
ccagctagatatcggagaggcttca

SEQ ID NO: 90885 - DNA, 25 bp, Mus musculus
ccagctagcagggttttcacatcag

SEQ ID NO: 90886 - DNA, 25 bp, Mus musculus
ccagctataaagatccaacgtcaag

SEQ ID NO: 90887 - DNA, 25 bp, Mus musculus
ccagctatatgagtttccaaggttc

SEQ ID NO: 90888 - DNA, 25 bp, Mus musculus
ccagctatcgggaccatgtgaagga

SEQ ID NO: 90889 - DNA, 25 bp, Mus musculus
ccagctatctctggacatgttgaag

SEQ ID NO: 90890 - DNA, 25 bp, Mus musculus
ccagctcatggctattttgggcagc

SEQ ID NO: 90891 - DNA, 25 bp, Mus musculus
ccagctccatgtctgtggagacgac

SEQ ID NO: 90892 - DNA, 25 bp, Mus musculus
ccagctccttccaggaatgtcggca

SEQ ID NO: 90893 - DNA, 25 bp, Mus musculus
ccagctcgacagtcggcttccggag

SEQ ID NO: 90894 - DNA, 25 bp, Mus musculus
ccagctctcaagaaaatggcctgca

SEQ ID NO: 90895 - DNA, 25 bp, Mus musculus
ccagctctgccagttactagcttgt

SEQ ID NO: 90896 - DNA, 25 bp, Mus musculus
ccagctctgccgctaaaggacacaa

SEQ ID NO: 90897 - DNA, 25 bp, Mus musculus
ccagctctgtgttctggattgcacc

SEQ ID NO: 90898 - DNA, 25 bp, Mus musculus
ccagctgaagagaagacgacaatca

SEQ ID NO: 90899 - DNA, 25 bp, Mus musculus
ccagctgaccatgaaagccaagagc

SEQ ID NO: 90900 - DNA, 25 bp, Mus musculus
ccagctgacgtgatgagactccaca

SEQ ID NO: 90901 - DNA, 25 bp, Mus musculus
ccagctgcaaagtgttttgtaccag

SEQ ID NO: 90902 - DNA, 25 bp, Mus musculus
ccagctgcagagtggccgcattggt

SEQ ID NO: 90903 - DNA, 25 bp, Mus musculus
ccagctggaggctgacaagcgagct

SEQ ID NO: 90904 - DNA, 25 bp, Mus musculus
ccagctggagtgagagaagccaaca

SEQ ID NO: 90905 - DNA, 25 bp, Mus musculus
ccagctggatcctgaggaagaagaa

SEQ ID NO: 90906 - DNA, 25 bp, Mus musculus
ccagctggctttgttgtacttagtc

SEQ ID NO: 90907 - DNA, 25 bp, Mus musculus
ccagctgggcttaggcatcatgaaa

SEQ ID NO: 90908 - DNA, 25 bp, Mus musculus
ccagctggtcatcagatggtgccca

SEQ ID NO: 90909 - DNA, 25 bp, Mus musculus
ccagctgtgccgcttcaagaagtgc

SEQ ID NO: 90910 - DNA, 25 bp, Mus musculus
ccagctgtgcgtctcttatgcagaa

SEQ ID NO: 90911 - DNA, 25 bp, Mus musculus
ccagctgtgtaattaagaatccgac

SEQ ID NO: 90912 - DNA, 25 bp, Mus musculus
ccagctgttaagcacccatgaccag

SEQ ID NO: 90913 - DNA, 25 bp, Mus musculus
ccagctgttggcaattaaaacccac

SEQ ID NO: 90914 - DNA, 25 bp, Mus musculus
ccagcttacggcagctctgagggca

SEQ ID NO: 90915 - DNA, 25 bp, Mus musculus
ccagcttatcaaagttgtgcacaca

SEQ ID NO: 90916 - DNA, 25 bp, Mus musculus
ccagcttcccgtacagatacaagca

SEQ ID NO: 90917 - DNA, 25 bp, Mus musculus
ccagcttcgagagttgtgtcaccag

SEQ ID NO: 90918 - DNA, 25 bp, Mus musculus
ccagcttgccctactttgttcgtcg

SEQ ID NO: 90919 - DNA, 25 bp, Mus musculus
ccagcttggctggaacatgagggct

SEQ ID NO: 90920 - DNA, 25 bp, Mus musculus
ccagcttggcttggatgtgcaacct

SEQ ID NO: 90921 - DNA, 25 bp, Mus musculus
ccagctttattggagtcaatggatt

SEQ ID NO: 90922 - DNA, 25 bp, Mus musculus
ccagctttcagccaatgaggtttct

SEQ ID NO: 90923 - DNA, 25 bp, Mus musculus
ccagctttgagatagcggcacaatg

SEQ ID NO: 90924 - DNA, 25 bp, Mus musculus
ccagctttgccttgacaaagaaata

SEQ ID NO: 90925 - DNA, 25 bp, Mus musculus
ccagcttttccaacgcatggcaggg

SEQ ID NO: 90926 - DNA, 25 bp, Mus musculus
ccagcttttccagagtagggagcaa

SEQ ID NO: 90927 - DNA, 25 bp, Mus musculus
ccaggaaacggacttggagctgaac

SEQ ID NO: 90928 - DNA, 25 bp, Mus musculus
ccaggaaaggccaatcaagagtagt

SEQ ID NO: 90929 - DNA, 25 bp, Mus musculus
ccaggaacatgagagcgagaacagc

SEQ ID NO: 90930 - DNA, 25 bp, Mus musculus
ccaggaagatttcaggatgaagagc

SEQ ID NO: 90931 - DNA, 25 bp, Mus musculus
ccaggaagctctgcgggaccagcag

SEQ ID NO: 90932 - DNA, 25 bp, Mus musculus
ccaggaagtcctcgttgagatgaca

SEQ ID NO: 90933 - DNA, 25 bp, Mus musculus
ccaggaataggtgtacaggaagccc

SEQ ID NO: 90934 - DNA, 25 bp, Mus musculus
ccaggacaacactaaggagggagag

SEQ ID NO: 90935 - DNA, 25 bp, Mus musculus
ccaggacaccaagactacgaagaca

SEQ ID NO: 90936 - DNA, 25 bp, Mus musculus
ccaggacaccaagctctcaggaagg

SEQ ID NO: 90937 - DNA, 25 bp, Mus musculus
ccaggacatcttttaccaggaggat

SEQ ID NO: 90938 - DNA, 25 bp, Mus musculus
ccaggaccggaactacacagtggtt

SEQ ID NO: 90939 - DNA, 25 bp, Mus musculus
ccaggacgcgcctctttggaaggat

SEQ ID NO: 90940 - DNA, 25 bp, Mus musculus
ccaggactcaagtacaaaccagtca

SEQ ID NO: 90941 - DNA, 25 bp, Mus musculus
ccaggactgaatggagcactgtcct

SEQ ID NO: 90942 - DNA, 25 bp, Mus musculus
ccaggagaaaccatcgtggaggcca

SEQ ID NO: 90943 - DNA, 25 bp, Mus musculus
ccaggagaagtaccaaagcgtctgc

SEQ ID NO: 90944 - DNA, 25 bp, Mus musculus
ccaggagaccatccgcgtgactaag

SEQ ID NO: 90945 - DNA, 25 bp, Mus musculus
ccaggagacccagagatcgaggaaa

SEQ ID NO: 90946 - DNA, 25 bp, Mus musculus
ccaggagagctagcatgtttctaca

SEQ ID NO: 90947 - DNA, 25 bp, Mus musculus
ccaggagaggtcatttcagggccag

SEQ ID NO: 90948 - DNA, 25 bp, Mus musculus
ccaggagcagccaagtctgcagtgg

SEQ ID NO: 90949 - DNA, 25 bp, Mus musculus
ccaggagcattgagacgaggaacta

SEQ ID NO: 90950 - DNA, 25 bp, Mus musculus
ccaggagccacttccgagttggaga

SEQ ID NO: 90951 - DNA, 25 bp, Mus musculus
ccaggagcccaagacaatgtttcag

SEQ ID NO: 90952 - DNA, 25 bp, Mus musculus
ccaggagcgagtttccgtgaaactc

SEQ ID NO: 90953 - DNA, 25 bp, Mus musculus
ccaggagcggtttcgaacaatcacg

SEQ ID NO: 90954 - DNA, 25 bp, Mus musculus
ccaggagcttggacttccagcgaat

SEQ ID NO: 90955 - DNA, 25 bp, Mus musculus
ccaggaggagacacttacatgcacg

SEQ ID NO: 90956 - DNA, 25 bp, Mus musculus
ccaggaggagtagtagaagaagcta

SEQ ID NO: 90957 - DNA, 25 bp, Mus musculus
ccaggaggatctaaggaacgcccaa

SEQ ID NO: 90958 - DNA, 25 bp, Mus musculus
ccaggaggcaaaggatgattcggct

SEQ ID NO: 90959 - DNA, 25 bp, Mus musculus
ccaggaggcagatgagacaacacgt

SEQ ID NO: 90960 - DNA, 25 bp, Mus musculus
ccaggaggctacagcatcgcagaag

SEQ ID NO: 90961 - DNA, 25 bp, Mus musculus
ccaggaggtcacgttgtctattcaa

SEQ ID NO: 90962 - DNA, 25 bp, Mus musculus
ccaggaggtcggctacacagatact

SEQ ID NO: 90963 - DNA, 25 bp, Mus musculus
ccaggagtaggaacaaaaattgctg

SEQ ID NO: 90964 - DNA, 25 bp, Mus musculus
ccaggagtccaaggagatgttcccc

SEQ ID NO: 90965 - DNA, 25 bp, Mus musculus
ccaggagtgaacaagcgaaggcaga

SEQ ID NO: 90966 - DNA, 25 bp, Mus musculus
ccaggagtggaaaggtcacctctca

SEQ ID NO: 90967 - DNA, 25 bp, Mus musculus
ccaggagtggtatgctcgtcgacac

SEQ ID NO: 90968 - DNA, 25 bp, Mus musculus
ccaggagttgtacgcttcagaggac

SEQ ID NO: 90969 - DNA, 25 bp, Mus musculus
ccaggagtttgatgtgcccatcggg

SEQ ID NO: 90970 - DNA, 25 bp, Mus musculus
ccaggatacacaggcccatgggaaa

SEQ ID NO: 90971 - DNA, 25 bp, Mus musculus
ccaggatacgaatatgcagggagtc

SEQ ID NO: 90972 - DNA, 25 bp, Mus musculus
ccaggatatctgtaggagtgtcacc

SEQ ID NO: 90973 - DNA, 25 bp, Mus musculus
ccaggatccttggagtgcgtcacaa

SEQ ID NO: 90974 - DNA, 25 bp, Mus musculus
ccaggatcgtcaacggagaggatgc

SEQ ID NO: 90975 - DNA, 25 bp, Mus musculus
ccaggatgaggctcttcatcgctct

SEQ ID NO: 90976 - DNA, 25 bp, Mus musculus
ccaggatgatctgcagggtccggat

SEQ ID NO: 90977 - DNA, 25 bp, Mus musculus
ccaggatgggcaggttcttcagttc

SEQ ID NO: 90978 - DNA, 25 bp, Mus musculus
ccaggatgtcagatttgtcagcaac

SEQ ID NO: 90979 - DNA, 25 bp, Mus musculus
ccaggatgtctctcagtgcaagtag

SEQ ID NO: 90980 - DNA, 25 bp, Mus musculus
ccaggatgttcatgaaagggacaca

SEQ ID NO: 90981 - DNA, 25 bp, Mus musculus
ccaggcacagagtccggagtatatt

SEQ ID NO: 90982 - DNA, 25 bp, Mus musculus
ccaggcagcaatggagaagttccca

SEQ ID NO: 90983 - DNA, 25 bp, Mus musculus
ccaggcagccttcatgggatttgtc

SEQ ID NO: 90984 - DNA, 25 bp, Mus musculus
ccaggcagctgaaagaagatctgtc

SEQ ID NO: 90985 - DNA, 25 bp, Mus musculus
ccaggcaggcagaggatccaattat

SEQ ID NO: 90986 - DNA, 25 bp, Mus musculus
ccaggcagtgcggtgctttacagaa

SEQ ID NO: 90987 - DNA, 25 bp, Mus musculus
ccaggcatctttgggaactcaggac

SEQ ID NO: 90988 - DNA, 25 bp, Mus musculus
ccaggccagatggacgagaagacca

SEQ ID NO: 90989 - DNA, 25 bp, Mus musculus
ccaggccaggaaatagggatccgca

SEQ ID NO: 90990 - DNA, 25 bp, Mus musculus
ccaggcccggttctttgttcagaat

SEQ ID NO: 90991 - DNA, 25 bp, Mus musculus
ccaggccctgaaagacaataagagc

SEQ ID NO: 90992 - DNA, 25 bp, Mus musculus
ccaggccgagcgctgctggtggcgt

SEQ ID NO: 90993 - DNA, 25 bp, Mus musculus
ccaggccgatgagctcaagggcgtt

SEQ ID NO: 90994 - DNA, 25 bp, Mus musculus
ccaggcctcagggtcaagtatgtct

SEQ ID NO: 90995 - DNA, 25 bp, Mus musculus
ccaggcctcagtagcaaaagttgtt

SEQ ID NO: 90996 - DNA, 25 bp, Mus musculus
ccaggcctccgtcaagaactttcag

SEQ ID NO: 90997 - DNA, 25 bp, Mus musculus
ccaggcctcttgcaatgcggaagga

SEQ ID NO: 90998 - DNA, 25 bp, Mus musculus
ccaggcctggcatgaacataaagca

SEQ ID NO: 90999 - DNA, 25 bp, Mus musculus
ccaggcctggcgctatgagaagttt

SEQ ID NO: 91000 - DNA, 25 bp, Mus musculus
ccaggccttgccctttgagcagaag

SEQ ID NO: 91001 - DNA, 25 bp, Mus musculus
ccaggcgacaagacccggaggagct

SEQ ID NO: 91002 - DNA, 25 bp, Mus musculus
ccaggcgccatttggaattactgac

SEQ ID NO: 91003 - DNA, 25 bp, Mus musculus
ccaggcgcttcttctagtcgggcaa

SEQ ID NO: 91004 - DNA, 25 bp, Mus musculus
ccaggcggcgctgctttgaagagcc

SEQ ID NO: 91005 - DNA, 25 bp, Mus musculus
ccaggcggtccggatcgagaatctg

SEQ ID NO: 91006 - DNA, 25 bp, Mus musculus
ccaggctattgggagggttattcga

SEQ ID NO: 91007 - DNA, 25 bp, Mus musculus
ccaggctccgttccgaagctgggaa

SEQ ID NO: 91008 - DNA, 25 bp, Mus musculus
ccaggctctgctctattcttcagga

SEQ ID NO: 91009 - DNA, 25 bp, Mus musculus
ccaggctgcaggtacaggcaactta

SEQ ID NO: 91010 - DNA, 25 bp, Mus musculus
ccaggctgctgaaaaagacccaact

SEQ ID NO: 91011 - DNA, 25 bp, Mus musculus
ccaggctgtgtgtttgattctccaa

SEQ ID NO: 91012 - DNA, 25 bp, Mus musculus
ccaggcttgaggcttcttcatcggg

SEQ ID NO: 91013 - DNA, 25 bp, Mus musculus
ccaggcttgccttgacttcagattc

SEQ ID NO: 91014 - DNA, 25 bp, Mus musculus
ccaggcttggcacgtatggcagcaa

SEQ ID NO: 91015 - DNA, 25 bp, Mus musculus
ccaggcttggcttctgaagggcaca

SEQ ID NO: 91016 - DNA, 25 bp, Mus musculus
ccaggcttttcacgtagctgagagg

SEQ ID NO: 91017 - DNA, 25 bp, Mus musculus
ccagggaactccttatgaatggaac

SEQ ID NO: 91018 - DNA, 25 bp, Mus musculus
ccagggactcggatattcgtgtgaa

SEQ ID NO: 91019 - DNA, 25 bp, Mus musculus
ccagggactgcagaaattaggtgcc

SEQ ID NO: 91020 - DNA, 25 bp, Mus musculus
ccagggagacaagaaacagagtagc

SEQ ID NO: 91021 - DNA, 25 bp, Mus musculus
ccagggagcagcttatggacaggaa

SEQ ID NO: 91022 - DNA, 25 bp, Mus musculus
ccagggaggcacctttagagtgcaa

SEQ ID NO: 91023 - DNA, 25 bp, Mus musculus
ccagggatcaggagctaggccgttt

SEQ ID NO: 91024 - DNA, 25 bp, Mus musculus
ccagggatgaggcttaagaccttaa

SEQ ID NO: 91025 - DNA, 25 bp, Mus musculus
ccagggcaccatccaaaggctttgt

SEQ ID NO: 91026 - DNA, 25 bp, Mus musculus
ccagggcagcttgcatgaggacgtc

SEQ ID NO: 91027 - DNA, 25 bp, Mus musculus
ccagggccacttgagtcagtcagaa

SEQ ID NO: 91028 - DNA, 25 bp, Mus musculus
ccagggccagccatcaagtagtttg

SEQ ID NO: 91029 - DNA, 25 bp, Mus musculus
ccagggcgagagtaacgaagactat

SEQ ID NO: 91030 - DNA, 25 bp, Mus musculus
ccagggcgcttcttttcaatcttag

SEQ ID NO: 91031 - DNA, 25 bp, Mus musculus
ccagggtcaggcagcactgtcctct

SEQ ID NO: 91032 - DNA, 25 bp, Mus musculus
ccagggtcccagaaagccagttctg

SEQ ID NO: 91033 - DNA, 25 bp, Mus musculus
ccagggtccgcttcgaagacggtgc

SEQ ID NO: 91034 - DNA, 25 bp, Mus musculus
ccagggtggtgagaacgcttcagaa

SEQ ID NO: 91035 - DNA, 25 bp, Mus musculus
ccagggttcctacgcggtcattgca

SEQ ID NO: 91036 - DNA, 25 bp, Mus musculus
ccagggttcgacatagttcaggcac

SEQ ID NO: 91037 - DNA, 25 bp, Mus musculus
ccagggttgggtctttccaggctca

SEQ ID NO: 91038 - DNA, 25 bp, Mus musculus
ccaggtagcagagaatccggtgcag

SEQ ID NO: 91039 - DNA, 25 bp, Mus musculus
ccaggtagccacagaagggaagatt

SEQ ID NO: 91040 - DNA, 25 bp, Mus musculus
ccaggtatggagtgaagtgacccca

SEQ ID NO: 91041 - DNA, 25 bp, Mus musculus
ccaggtcaggccacagctgcatgtt

SEQ ID NO: 91042 - DNA, 25 bp, Mus musculus
ccaggtcatgtgcagttaagcgaca

SEQ ID NO: 91043 - DNA, 25 bp, Mus musculus
ccaggtccagaggaaagcaagtcac

SEQ ID NO: 91044 - DNA, 25 bp, Mus musculus
ccaggtcccaagtgaggtggtgaca

SEQ ID NO: 91045 - DNA, 25 bp, Mus musculus
ccaggtcctgttcgtcattgccaaa

SEQ ID NO: 91046 - DNA, 25 bp, Mus musculus
ccaggtctcggtggatacaggagcc

SEQ ID NO: 91047 - DNA, 25 bp, Mus musculus
ccaggtcttcctgaaggcggcagat

SEQ ID NO: 91048 - DNA, 25 bp, Mus musculus
ccaggtgaagcaagagacggcagat

SEQ ID NO: 91049 - DNA, 25 bp, Mus musculus
ccaggtgcagaatggctccgagacg

SEQ ID NO: 91050 - DNA, 25 bp, Mus musculus
ccaggtgctggttttgctcgaaatc

SEQ ID NO: 91051 - DNA, 25 bp, Mus musculus
ccaggtggacccttggtgaagttca

SEQ ID NO: 91052 - DNA, 25 bp, Mus musculus
ccaggtggaggtgagagttcccagc

SEQ ID NO: 91053 - DNA, 25 bp, Mus musculus
ccaggtggtggatgatgaagacaat

SEQ ID NO: 91054 - DNA, 25 bp, Mus musculus
ccaggtggtgtcagcgcaagttgca

SEQ ID NO: 91055 - DNA, 25 bp, Mus musculus
ccaggtgtcagtgggactccaggac

SEQ ID NO: 91056 - DNA, 25 bp, Mus musculus
ccaggtgtcccttgcaacagcagca

SEQ ID NO: 91057 - DNA, 25 bp, Mus musculus
ccaggtgtgaattccaagaagaagc

SEQ ID NO: 91058 - DNA, 25 bp, Mus musculus
ccaggtgttggcatgtttaggaagc

SEQ ID NO: 91059 - DNA, 25 bp, Mus musculus
ccaggtgtttgatcggttccaggac

SEQ ID NO: 91060 - DNA, 25 bp, Mus musculus
ccaggttgacgactgaagaatcaca

SEQ ID NO: 91061 - DNA, 25 bp, Mus musculus
ccaggttttgatggagctagcttca

SEQ ID NO: 91062 - DNA, 25 bp, Mus musculus
ccaggttttggaccagatgagccca

SEQ ID NO: 91063 - DNA, 25 bp, Mus musculus
ccagtaacactggagaggaaccagc

SEQ ID NO: 91064 - DNA, 25 bp, Mus musculus
ccagtaaggctgtggcaataccagt

SEQ ID NO: 91065 - DNA, 25 bp, Mus musculus
ccagtacagggacagcagcagtttc

SEQ ID NO: 91066 - DNA, 25 bp, Mus musculus
ccagtaccagttccgctttgagcgc

SEQ ID NO: 91067 - DNA, 25 bp, Mus musculus
ccagtactggttgtttgcgcgcgcg

SEQ ID NO: 91068 - DNA, 25 bp, Mus musculus
ccagtagtgatagtgaggatgcccc

SEQ ID NO: 91069 - DNA, 25 bp, Mus musculus
ccagtatatctacccaacgagagag

SEQ ID NO: 91070 - DNA, 25 bp, Mus musculus
ccagtatcgcagatgagggcaccta

SEQ ID NO: 91071 - DNA, 25 bp, Mus musculus
ccagtatgccatgagccagaagttg

SEQ ID NO: 91072 - DNA, 25 bp, Mus musculus
ccagtcacggaagtgttgcggcccg

SEQ ID NO: 91073 - DNA, 25 bp, Mus musculus
ccagtcaggcgaccagagaagtcct

SEQ ID NO: 91074 - DNA, 25 bp, Mus musculus
ccagtcagtgtttgtgtgaaggccc

SEQ ID NO: 91075 - DNA, 25 bp, Mus musculus
ccagtccaggcaacaaatatgaatg

SEQ ID NO: 91076 - DNA, 25 bp, Mus musculus
ccagtccagtggatggcatgaagta

SEQ ID NO: 91077 - DNA, 25 bp, Mus musculus
ccagtcctggccatagggtggagaa

SEQ ID NO: 91078 - DNA, 25 bp, Mus musculus
ccagtccttggaagacacggctaag

SEQ ID NO: 91079 - DNA, 25 bp, Mus musculus
ccagtcgccaaggagcttaattata

SEQ ID NO: 91080 - DNA, 25 bp, Mus musculus
ccagtcgcgtttagttagctgtaaa

SEQ ID NO: 91081 - DNA, 25 bp, Mus musculus
ccagtcgggatatcagtcggtgaca

SEQ ID NO: 91082 - DNA, 25 bp, Mus musculus
ccagtctgagccgtttgtgtgtggc

SEQ ID NO: 91083 - DNA, 25 bp, Mus musculus
ccagtctgccctagtttcaaacttg

SEQ ID NO: 91084 - DNA, 25 bp, Mus musculus
ccagtctgcctgatgcaatgctgga

SEQ ID NO: 91085 - DNA, 25 bp, Mus musculus
ccagtcttaaatgggagacggagcg

SEQ ID NO: 91086 - DNA, 25 bp, Mus musculus
ccagtgaaaagaggtcgtggtccct

SEQ ID NO: 91087 - DNA, 25 bp, Mus musculus
ccagtgaagagatctacattaacca

SEQ ID NO: 91088 - DNA, 25 bp, Mus musculus
ccagtgaagatagtggagcctttgc

SEQ ID NO: 91089 - DNA, 25 bp, Mus musculus
ccagtgaagctgagcccaggagcgc

SEQ ID NO: 91090 - DNA, 25 bp, Mus musculus
ccagtgaagctggaaagacggctct

SEQ ID NO: 91091 - DNA, 25 bp, Mus musculus
ccagtgacccaaacaaagacatggt

SEQ ID NO: 91092 - DNA, 25 bp, Mus musculus
ccagtgaccggcaggctttggtcaa

SEQ ID NO: 91093 - DNA, 25 bp, Mus musculus
ccagtgacgactgatgagcagattg

SEQ ID NO: 91094 - DNA, 25 bp, Mus musculus
ccagtgactgcggccgaagaacgcg

SEQ ID NO: 91095 - DNA, 25 bp, Mus musculus
ccagtgactgctgcaggaagatggc

SEQ ID NO: 91096 - DNA, 25 bp, Mus musculus
ccagtgagaagttgggacacggtcc

SEQ ID NO: 91097 - DNA, 25 bp, Mus musculus
ccagtgagagcaagatgagcctgga

SEQ ID NO: 91098 - DNA, 25 bp, Mus musculus
ccagtgagatgatcgaagcgccgtc

SEQ ID NO: 91099 - DNA, 25 bp, Mus musculus
ccagtgagcgagcaaagcaggacta

SEQ ID NO: 91100 - DNA, 25 bp, Mus musculus
ccagtgatgtgaagagacctgaaat

SEQ ID NO: 91101 - DNA, 25 bp, Mus musculus
ccagtgcaacaaccgagaagagttc

SEQ ID NO: 91102 - DNA, 25 bp, Mus musculus
ccagtgcaggtgatccaagtaaagg

SEQ ID NO: 91103 - DNA, 25 bp, Mus musculus
ccagtgccattctgtctcaggctga

SEQ ID NO: 91104 - DNA, 25 bp, Mus musculus
ccagtgccccttcggtggattcaag

SEQ ID NO: 91105 - DNA, 25 bp, Mus musculus
ccagtgccgtttgggaaatcatcaa

SEQ ID NO: 91106 - DNA, 25 bp, Mus musculus
ccagtgcctaaatgagcttcctaaa

SEQ ID NO: 91107 - DNA, 25 bp, Mus musculus
ccagtgctatgaggacattcgagtg

SEQ ID NO: 91108 - DNA, 25 bp, Mus musculus
ccagtgctgacgtttgaggaggccc

SEQ ID NO: 91109 - DNA, 25 bp, Mus musculus
ccagtgctgtgccagaagccagaaa

SEQ ID NO: 91110 - DNA, 25 bp, Mus musculus
ccagtgctttttggcgggaggccca

SEQ ID NO: 91111 - DNA, 25 bp, Mus musculus
ccagtggaaccatgtcttctgctga

SEQ ID NO: 91112 - DNA, 25 bp, Mus musculus
ccagtggaagtacatagcctacgct

SEQ ID NO: 91113 - DNA, 25 bp, Mus musculus
ccagtggagactacgctttcttcaa

SEQ ID NO: 91114 - DNA, 25 bp, Mus musculus
ccagtggagggatcttagggctctc

SEQ ID NO: 91115 - DNA, 25 bp, Mus musculus
ccagtggatccaagaaaggtgctaa

SEQ ID NO: 91116 - DNA, 25 bp, Mus musculus
ccagtggcactgtggtgtgaaatgt

SEQ ID NO: 91117 - DNA, 25 bp, Mus musculus
ccagtggccagatcaaggcagggta

SEQ ID NO: 91118 - DNA, 25 bp, Mus musculus
ccagtggcggattacttcaagcagt

SEQ ID NO: 91119 - DNA, 25 bp, Mus musculus
ccagtgggaccgaacagtgaaagtc

SEQ ID NO: 91120 - DNA, 25 bp, Mus musculus
ccagtgggagagactatggcgctca

SEQ ID NO: 91121 - DNA, 25 bp, Mus musculus
ccagtggtcccaacgaatggctgac

SEQ ID NO: 91122 - DNA, 25 bp, Mus musculus
ccagtggttatttggccgaggccga

SEQ ID NO: 91123 - DNA, 25 bp, Mus musculus
ccagtggttccacaatgggaggtcc

SEQ ID NO: 91124 - DNA, 25 bp, Mus musculus
ccagtgtaccaggaacgatgggaca

SEQ ID NO: 91125 - DNA, 25 bp, Mus musculus
ccagtgtatctcagtggaagcgcca

SEQ ID NO: 91126 - DNA, 25 bp, Mus musculus
ccagtgtctgtagaaacggaagcag

SEQ ID NO: 91127 - DNA, 25 bp, Mus musculus
ccagtgtgaaaagtgccaggagatc

SEQ ID NO: 91128 - DNA, 25 bp, Mus musculus
ccagtgtgactgacgtgcagctcaa

SEQ ID NO: 91129 - DNA, 25 bp, Mus musculus
ccagtgtgaggcttacggaggcttc

SEQ ID NO: 91130 - DNA, 25 bp, Mus musculus
ccagtgtgctggaccaatgccgcac

SEQ ID NO: 91131 - DNA, 25 bp, Mus musculus
ccagtgtgctgggaaagtgctgcct

SEQ ID NO: 91132 - DNA, 25 bp, Mus musculus
ccagtgtgggaattctagggttgcc

SEQ ID NO: 91133 - DNA, 25 bp, Mus musculus
ccagtgttatgttggaagaggacca

SEQ ID NO: 91134 - DNA, 25 bp, Mus musculus
ccagtgttcacaatctgagtgccga

SEQ ID NO: 91135 - DNA, 25 bp, Mus musculus
ccagttagtagtagtcgggcagcca

SEQ ID NO: 91136 - DNA, 25 bp, Mus musculus
ccagttatatccagtgggaggtcca

SEQ ID NO: 91137 - DNA, 25 bp, Mus musculus
ccagttcaaaacaaagagggagtca

SEQ ID NO: 91138 - DNA, 25 bp, Mus musculus
ccagttcaaccttcagagatgcatt

SEQ ID NO: 91139 - DNA, 25 bp, Mus musculus
ccagttcacgaagcatcagcaaggc

SEQ ID NO: 91140 - DNA, 25 bp, Mus musculus
ccagttcattaagtgcaccagcagc

SEQ ID NO: 91141 - DNA, 25 bp, Mus musculus
ccagttcccgtagtcagtttagaga

SEQ ID NO: 91142 - DNA, 25 bp, Mus musculus
ccagttcctgatcccagcagcatgg

SEQ ID NO: 91143 - DNA, 25 bp, Mus musculus
ccagttccttgaggctggtgcagcc

SEQ ID NO: 91144 - DNA, 25 bp, Mus musculus
ccagttcgggaagatgggtacgcta

SEQ ID NO: 91145 - DNA, 25 bp, Mus musculus
ccagttctggaatatgctcgatgat

SEQ ID NO: 91146 - DNA, 25 bp, Mus musculus
ccagttgcaggcttccaccaaagaa

SEQ ID NO: 91147 - DNA, 25 bp, Mus musculus
ccagttgctaagagatgccattcag

SEQ ID NO: 91148 - DNA, 25 bp, Mus musculus
ccagttggcctcactgtggataagg

SEQ ID NO: 91149 - DNA, 25 bp, Mus musculus
ccagttgggagtagaaaagccagtc

SEQ ID NO: 91150 - DNA, 25 bp, Mus musculus
ccagtttgccttggaggatccctag

SEQ ID NO: 91151 - DNA, 25 bp, Mus musculus
ccagttttactgaggcacggatgaa

SEQ ID NO: 91152 - DNA, 25 bp, Mus musculus
ccataaagaagagagggatacgatt

SEQ ID NO: 91153 - DNA, 25 bp, Mus musculus
ccataaaggtagacaggaagtgctc

SEQ ID NO: 91154 - DNA, 25 bp, Mus musculus
ccataaatatggctgaatttgatgc

SEQ ID NO: 91155 - DNA, 25 bp, Mus musculus
ccataacctcagagaaagcctaggg

SEQ ID NO: 91156 - DNA, 25 bp, Mus musculus
ccataacggtggatgagtatagctc

SEQ ID NO: 91157 - DNA, 25 bp, Mus musculus
ccataactacgtgggagacgacaga

SEQ ID NO: 91158 - DNA, 25 bp, Mus musculus
ccataagttatctgggccggcgcat

SEQ ID NO: 91159 - DNA, 25 bp, Mus musculus
ccataatcgttggtgtggcaatcca

SEQ ID NO: 91160 - DNA, 25 bp, Mus musculus
ccataatctggtgaagggtctgaca

SEQ ID NO: 91161 - DNA, 25 bp, Mus musculus
ccataatgggagatcctggtcctca

SEQ ID NO: 91162 - DNA, 25 bp, Mus musculus
ccatacagaggctgtggtatttttg

SEQ ID NO: 91163 - DNA, 25 bp, Mus musculus
ccatacagcatccagtaagaagttc

SEQ ID NO: 91164 - DNA, 25 bp, Mus musculus
ccatacccgggaaagagtaactgtg

SEQ ID NO: 91165 - DNA, 25 bp, Mus musculus
ccatacccgggctgagaggaacatt

SEQ ID NO: 91166 - DNA, 25 bp, Mus musculus
ccatacggattaaaagggctggact

SEQ ID NO: 91167 - DNA, 25 bp, Mus musculus
ccatactatgtgaaggcacccagcg

SEQ ID NO: 91168 - DNA, 25 bp, Mus musculus
ccatactgggactggaaggattcct

SEQ ID NO: 91169 - DNA, 25 bp, Mus musculus
ccatacttgttatcagaggaggaag

SEQ ID NO: 91170 - DNA, 25 bp, Mus musculus
ccatactttttggatagacgccaag

SEQ ID NO: 91171 - DNA, 25 bp, Mus musculus
ccatagaacaaagaagaggccctcc

SEQ ID NO: 91172 - DNA, 25 bp, Mus musculus
ccatagactctacctgacagtgcag

SEQ ID NO: 91173 - DNA, 25 bp, Mus musculus
ccatagagggggctatatttcaagt

SEQ ID NO: 91174 - DNA, 25 bp, Mus musculus
ccatagcaagatttggttagtctgg

SEQ ID NO: 91175 - DNA, 25 bp, Mus musculus
ccatagcaattgagtttaataaacc

SEQ ID NO: 91176 - DNA, 25 bp, Mus musculus
ccatagccattcatgccaaacctgg

SEQ ID NO: 91177 - DNA, 25 bp, Mus musculus
ccataggtgcagattccaaggaggt

SEQ ID NO: 91178 - DNA, 25 bp, Mus musculus
ccatagtgctgttggaccgggagca

SEQ ID NO: 91179 - DNA, 25 bp, Mus musculus
ccatatgtatctgttgccccgtgaa

SEQ ID NO: 91180 - DNA, 25 bp, Mus musculus
ccatattgacttagcggccagggtt

SEQ ID NO: 91181 - DNA, 25 bp, Mus musculus
ccatattttatcactgctgtgatct

SEQ ID NO: 91182 - DNA, 25 bp, Mus musculus
ccatcaaagtctggagggcccatga

SEQ ID NO: 91183 - DNA, 25 bp, Mus musculus
ccatcaagaaaggtccggtgcagct

SEQ ID NO: 91184 - DNA, 25 bp, Mus musculus
ccatcaagcaggagagatgtgatcc

SEQ ID NO: 91185 - DNA, 25 bp, Mus musculus
ccatcaaggaagcaagtcggcaaaa

SEQ ID NO: 91186 - DNA, 25 bp, Mus musculus
ccatcaatatttggtggacttgaac

SEQ ID NO: 91187 - DNA, 25 bp, Mus musculus
ccatcaatgatgaaagccgaggtca

SEQ ID NO: 91188 - DNA, 25 bp, Mus musculus
ccatcaatggaacggtggacaccac

SEQ ID NO: 91189 - DNA, 25 bp, Mus musculus
ccatcaccaagggagctgcttttct

SEQ ID NO: 91190 - DNA, 25 bp, Mus musculus
ccatcaccgtgagcaagtgtggaag

SEQ ID NO: 91191 - DNA, 25 bp, Mus musculus
ccatcagagttgagagcaggagaca

SEQ ID NO: 91192 - DNA, 25 bp, Mus musculus
ccatcagcagaatctacacagtggg

SEQ ID NO: 91193 - DNA, 25 bp, Mus musculus
ccatcagcagctcgaaattccagga

SEQ ID NO: 91194 - DNA, 25 bp, Mus musculus
ccatcaggaagcctacgggcaagtt

SEQ ID NO: 91195 - DNA, 25 bp, Mus musculus
ccatcaggctgagcaggcagcagct

SEQ ID NO: 91196 - DNA, 25 bp, Mus musculus
ccatcagtgtttgaggtggccaaca

SEQ ID NO: 91197 - DNA, 25 bp, Mus musculus
ccatcatcggactcatggtgggcgg

SEQ ID NO: 91198 - DNA, 25 bp, Mus musculus
ccatcatgagccagtttcctgagat

SEQ ID NO: 91199 - DNA, 25 bp, Mus musculus
ccatcatgcggaagcgggtggacat

SEQ ID NO: 91200 - DNA, 25 bp, Mus musculus
ccatcatggaagagcaggcagctca

SEQ ID NO: 91201 - DNA, 25 bp, Mus musculus
ccatcatggaggtagctcacggcaa

SEQ ID NO: 91202 - DNA, 25 bp, Mus musculus
ccatcattacggagagaaagtcaac

SEQ ID NO: 91203 - DNA, 25 bp, Mus musculus
ccatcattacttgggaaaaggacca

SEQ ID NO: 91204 - DNA, 25 bp, Mus musculus
ccatccagagcatagtgcgagcggt

SEQ ID NO: 91205 - DNA, 25 bp, Mus musculus
ccatccaggagtcccagtgtctgct

SEQ ID NO: 91206 - DNA, 25 bp, Mus musculus
ccatccagggagtgaagacagggtt

SEQ ID NO: 91207 - DNA, 25 bp, Mus musculus
ccatccagtgaagacatagcaacct

SEQ ID NO: 91208 - DNA, 25 bp, Mus musculus
ccatccagtggaaagggtgttgccg

SEQ ID NO: 91209 - DNA, 25 bp, Mus musculus
ccatccctgttcagcagactctgaa

SEQ ID NO: 91210 - DNA, 25 bp, Mus musculus
ccatccgagggaaaggtgctagctg

SEQ ID NO: 91211 - DNA, 25 bp, Mus musculus
ccatcctatggcttgtgtgagagtg

SEQ ID NO: 91212 - DNA, 25 bp, Mus musculus
ccatcctgaaaaggcggaagtgctc

SEQ ID NO: 91213 - DNA, 25 bp, Mus musculus
ccatccttaatttcctgcggaccaa

SEQ ID NO: 91214 - DNA, 25 bp, Mus musculus
ccatcgaggttcagggagaccagca

SEQ ID NO: 91215 - DNA, 25 bp, Mus musculus
ccatcgagtgggaacagcagaatca

SEQ ID NO: 91216 - DNA, 25 bp, Mus musculus
ccatcgagtggtgttccagttgaac

SEQ ID NO: 91217 - DNA, 25 bp, Mus musculus
ccatcggaactgaccagctgcgcta

SEQ ID NO: 91218 - DNA, 25 bp, Mus musculus
ccatcggcctgtgggagggataaca

SEQ ID NO: 91219 - DNA, 25 bp, Mus musculus
ccatcggctagtaaaaatttgcttc

SEQ ID NO: 91220 - DNA, 25 bp, Mus musculus
ccatcggctcgggaaggacatcctt

SEQ ID NO: 91221 - DNA, 25 bp, Mus musculus
ccatcgggccgggagaccggcgtgg

SEQ ID NO: 91222 - DNA, 25 bp, Mus musculus
ccatcgtctagagaaggcgcttgtt

SEQ ID NO: 91223 - DNA, 25 bp, Mus musculus
ccatcgtgacgaagctggtgcagca

SEQ ID NO: 91224 - DNA, 25 bp, Mus musculus
ccatcgtggtgaaagtgcctggtca

SEQ ID NO: 91225 - DNA, 25 bp, Mus musculus
ccatcgtgtggtatttgttcagcgc

SEQ ID NO: 91226 - DNA, 25 bp, Mus musculus
ccatctacctgtggagctggagcca

SEQ ID NO: 91227 - DNA, 25 bp, Mus musculus
ccatctactttaagggaatgtggga

SEQ ID NO: 91228 - DNA, 25 bp, Mus musculus
ccatctaggcgaagatgtccgccca

SEQ ID NO: 91229 - DNA, 25 bp, Mus musculus
ccatctatgttcacggaggctacaa

SEQ ID NO: 91230 - DNA, 25 bp, Mus musculus
ccatctcttgaaacaatgtgccgga

SEQ ID NO: 91231 - DNA, 25 bp, Mus musculus
ccatctcttggccacattacgggct

SEQ ID NO: 91232 - DNA, 25 bp, Mus musculus
ccatctgatgaccaaatgtgcccag

SEQ ID NO: 91233 - DNA, 25 bp, Mus musculus
ccatctgcggagagaaggatcggca

SEQ ID NO: 91234 - DNA, 25 bp, Mus musculus
ccatctggtctgctggagcaattca

SEQ ID NO: 91235 - DNA, 25 bp, Mus musculus
ccatctgtctggaaaggcttcgaga

SEQ ID NO: 91236 - DNA, 25 bp, Mus musculus
ccatcttgacacacatgcgggtgga

SEQ ID NO: 91237 - DNA, 25 bp, Mus musculus
ccatcttgttcttctcgtggttccc

SEQ ID NO: 91238 - DNA, 25 bp, Mus musculus
ccatctttgcttgggaaatccgaga

SEQ ID NO: 91239 - DNA, 25 bp, Mus musculus
ccatgaaacagaggacatgataaac

SEQ ID NO: 91240 - DNA, 25 bp, Mus musculus
ccatgaacatcaacggaggcaatac

SEQ ID NO: 91241 - DNA, 25 bp, Mus musculus
ccatgaaccgtcgtggagccattaa

SEQ ID NO: 91242 - DNA, 25 bp, Mus musculus
ccatgaacctggatgctggccgaga

SEQ ID NO: 91243 - DNA, 25 bp, Mus musculus
ccatgaagacatcgagctcctgcgg

SEQ ID NO: 91244 - DNA, 25 bp, Mus musculus
ccatgaagagaacgtaggccacaca

SEQ ID NO: 91245 - DNA, 25 bp, Mus musculus
ccatgaagatcaagaacattgtaaa

SEQ ID NO: 91246 - DNA, 25 bp, Mus musculus
ccatgaagattgcagtaatcgggca

SEQ ID NO: 91247 - DNA, 25 bp, Mus musculus
ccatgaagcagtgtttgaggtccaa

SEQ ID NO: 91248 - DNA, 25 bp, Mus musculus
ccatgaagtcaaagccgagggctac

SEQ ID NO: 91249 - DNA, 25 bp, Mus musculus
ccatgaatcatctgagccgggtcca

SEQ ID NO: 91250 - DNA, 25 bp, Mus musculus
ccatgaatctctgaagggagccgac

SEQ ID NO: 91251 - DNA, 25 bp, Mus musculus
ccatgaccaacatgagctggagctt

SEQ ID NO: 91252 - DNA, 25 bp, Mus musculus
ccatgaccctgtcttcaggagcatc

SEQ ID NO: 91253 - DNA, 25 bp, Mus musculus
ccatgacctgtggatcaggattctg

SEQ ID NO: 91254 - DNA, 25 bp, Mus musculus
ccatgagaatggaactgaggactca

SEQ ID NO: 91255 - DNA, 25 bp, Mus musculus
ccatgagacggcgtattgagggtct

SEQ ID NO: 91256 - DNA, 25 bp, Mus musculus
ccatgagatggatctggttgtgcct

SEQ ID NO: 91257 - DNA, 25 bp, Mus musculus
ccatgagcctcagtgtgaaactgtt

SEQ ID NO: 91258 - DNA, 25 bp, Mus musculus
ccatgagcgaggacaggagttctta

SEQ ID NO: 91259 - DNA, 25 bp, Mus musculus
ccatgagcgctaatgggagatcgcc

SEQ ID NO: 91260 - DNA, 25 bp, Mus musculus
ccatgaggacttctggacccaggaa

SEQ ID NO: 91261 - DNA, 25 bp, Mus musculus
ccatgaggatgcaatgtacgggaca

SEQ ID NO: 91262 - DNA, 25 bp, Mus musculus
ccatgaggctgagcggacagaggtg

SEQ ID NO: 91263 - DNA, 25 bp, Mus musculus
ccatgaggtggaggtgcagtactac

SEQ ID NO: 91264 - DNA, 25 bp, Mus musculus
ccatgagtactacagcagggaggcc

SEQ ID NO: 91265 - DNA, 25 bp, Mus musculus
ccatgagtcgcgaagaggctgaaag

SEQ ID NO: 91266 - DNA, 25 bp, Mus musculus
ccatgagtgcggaggtgaaggtgac

SEQ ID NO: 91267 - DNA, 25 bp, Mus musculus
ccatgagtggatatgcgagacctac

SEQ ID NO: 91268 - DNA, 25 bp, Mus musculus
ccatgagtttattagcagggcaggc

SEQ ID NO: 91269 - DNA, 25 bp, Mus musculus
ccatgatggctgtttctagaaacga

SEQ ID NO: 91270 - DNA, 25 bp, Mus musculus
ccatgatgtgcctgaggacaagatc

SEQ ID NO: 91271 - DNA, 25 bp, Mus musculus
ccatgcagctggtatcccaggatga

SEQ ID NO: 91272 - DNA, 25 bp, Mus musculus
ccatgccaagtggaagtgaggctat

SEQ ID NO: 91273 - DNA, 25 bp, Mus musculus
ccatgccagtcgctcatccagatga

SEQ ID NO: 91274 - DNA, 25 bp, Mus musculus
ccatgcctctatggcactggtagca

SEQ ID NO: 91275 - DNA, 25 bp, Mus musculus
ccatgcgagaggtgaagcgagctct

SEQ ID NO: 91276 - DNA, 25 bp, Mus musculus
ccatgcggcgtctcgttctgcttaa

SEQ ID NO: 91277 - DNA, 25 bp, Mus musculus
ccatgctccgcttccagactgagga

SEQ ID NO: 91278 - DNA, 25 bp, Mus musculus
ccatgctgaccattgaacaactgtc

SEQ ID NO: 91279 - DNA, 25 bp, Mus musculus
ccatgctgcacgtggaattgcccca

SEQ ID NO: 91280 - DNA, 25 bp, Mus musculus
ccatgctgtgtctgttgtgtggcaa

SEQ ID NO: 91281 - DNA, 25 bp, Mus musculus
ccatgctgtgttctgcttggccgag

SEQ ID NO: 91282 - DNA, 25 bp, Mus musculus
ccatgctgttggtttgacgacttcc

SEQ ID NO: 91283 - DNA, 25 bp, Mus musculus
ccatggaagcgtacactcgggaagc

SEQ ID NO: 91284 - DNA, 25 bp, Mus musculus
ccatggaagttgaacccaagaaact

SEQ ID NO: 91285 - DNA, 25 bp, Mus musculus
ccatggacgaagcagaagcaagcct

SEQ ID NO: 91286 - DNA, 25 bp, Mus musculus
ccatggacggtcagcttgcggaatc

SEQ ID NO: 91287 - DNA, 25 bp, Mus musculus
ccatggactcgagtgtttgcagacc

SEQ ID NO: 91288 - DNA, 25 bp, Mus musculus
ccatggagaaactgcgggtgctgct

SEQ ID NO: 91289 - DNA, 25 bp, Mus musculus
ccatggagaccctcggaaggtgatc

SEQ ID NO: 91290 - DNA, 25 bp, Mus musculus
ccatggagaccggaatagccgagac

SEQ ID NO: 91291 - DNA, 25 bp, Mus musculus
ccatggagagcctgagtgaactaca

SEQ ID NO: 91292 - DNA, 25 bp, Mus musculus
ccatggagcaagtcaatagctgtac

SEQ ID NO: 91293 - DNA, 25 bp, Mus musculus
ccatggagccggacacggccacaga

SEQ ID NO: 91294 - DNA, 25 bp, Mus musculus
ccatggagcgagtatacggcaagcc

SEQ ID NO: 91295 - DNA, 25 bp, Mus musculus
ccatggaggtgcagacgtaagccct

SEQ ID NO: 91296 - DNA, 25 bp, Mus musculus
ccatggagtacaaggaggagttact

SEQ ID NO: 91297 - DNA, 25 bp, Mus musculus
ccatggatagaatctttcgccggga

SEQ ID NO: 91298 - DNA, 25 bp, Mus musculus
ccatggatcgacaaagttacacggg

SEQ ID NO: 91299 - DNA, 25 bp, Mus musculus
ccatggatcgcgatgaggaacctct

SEQ ID NO: 91300 - DNA, 25 bp, Mus musculus
ccatggatcggatgaagaagatcaa

SEQ ID NO: 91301 - DNA, 25 bp, Mus musculus
ccatggatctttcctcagggcggag

SEQ ID NO: 91302 - DNA, 25 bp, Mus musculus
ccatggatgtgaaactgaagcgcca

SEQ ID NO: 91303 - DNA, 25 bp, Mus musculus
ccatggatgtgttcatgaaaggact

SEQ ID NO: 91304 - DNA, 25 bp, Mus musculus
ccatggcaagttctacgaggctgac

SEQ ID NO: 91305 - DNA, 25 bp, Mus musculus
ccatggcagaaagaagacagctgtt

SEQ ID NO: 91306 - DNA, 25 bp, Mus musculus
ccatggcagacgaggtgactgagaa

SEQ ID NO: 91307 - DNA, 25 bp, Mus musculus
ccatggcagtggtcctcagaatgtc

SEQ ID NO: 91308 - DNA, 25 bp, Mus musculus
ccatggcatagggtaggcaaagctg

SEQ ID NO: 91309 - DNA, 25 bp, Mus musculus
ccatggccatggactgacgagacca

SEQ ID NO: 91310 - DNA, 25 bp, Mus musculus
ccatggccctgagtttgtatcgaca

SEQ ID NO: 91311 - DNA, 25 bp, Mus musculus
ccatggcggtgtttcacgacgaggt

SEQ ID NO: 91312 - DNA, 25 bp, Mus musculus
ccatggcgtcgttcatctgggtgca

SEQ ID NO: 91313 - DNA, 25 bp, Mus musculus
ccatggctgaacaggagagggacca

SEQ ID NO: 91314 - DNA, 25 bp, Mus musculus
ccatggctgacacttacgctgtggt

SEQ ID NO: 91315 - DNA, 25 bp, Mus musculus
ccatggctggatgtttgcagagcac

SEQ ID NO: 91316 - DNA, 25 bp, Mus musculus
ccatgggaacctcaacgtgaaagcc

SEQ ID NO: 91317 - DNA, 25 bp, Mus musculus
ccatgggaatgactgcagagaacct

SEQ ID NO: 91318 - DNA, 25 bp, Mus musculus
ccatgggacccagaacttgacagtt

SEQ ID NO: 91319 - DNA, 25 bp, Mus musculus
ccatgggagcgcaggttacagacct

SEQ ID NO: 91320 - DNA, 25 bp, Mus musculus
ccatgggcaatggacttcgggcaaa

SEQ ID NO: 91321 - DNA, 25 bp, Mus musculus
ccatgggccaactatgacttggacc

SEQ ID NO: 91322 - DNA, 25 bp, Mus musculus
ccatggggatccagccaaggtcgtc

SEQ ID NO: 91323 - DNA, 25 bp, Mus musculus
ccatgggtgatagaaaggaggcccc

SEQ ID NO: 91324 - DNA, 25 bp, Mus musculus
ccatgggtggaaggtgtcacacact

SEQ ID NO: 91325 - DNA, 25 bp, Mus musculus
ccatgggtgtccactcctggaggga

SEQ ID NO: 91326 - DNA, 25 bp, Mus musculus
ccatggtagaccgatgcgttgtaaa

SEQ ID NO: 91327 - DNA, 25 bp, Mus musculus
ccatggtagcgggtgaccttctgac

SEQ ID NO: 91328 - DNA, 25 bp, Mus musculus
ccatggtctggctggtggcaatgac

SEQ ID NO: 91329 - DNA, 25 bp, Mus musculus
ccatggtgcagaacttagcggcgga

SEQ ID NO: 91330 - DNA, 25 bp, Mus musculus
ccatggtgctgcagggaatgcctac

SEQ ID NO: 91331 - DNA, 25 bp, Mus musculus
ccatggtgctggacgtgcctccaga

SEQ ID NO: 91332 - DNA, 25 bp, Mus musculus
ccatggtggccgacagaacgaaagt

SEQ ID NO: 91333 - DNA, 25 bp, Mus musculus
ccatggtggcgacaagcgtttctgc

SEQ ID NO: 91334 - DNA, 25 bp, Mus musculus
ccatggtgtcacatcagagcagtct

SEQ ID NO: 91335 - DNA, 25 bp, Mus musculus
ccatggtgtcctgtatctatatagt

SEQ ID NO: 91336 - DNA, 25 bp, Mus musculus
ccatggtttgctgtaacccaagtga

SEQ ID NO: 91337 - DNA, 25 bp, Mus musculus
ccatgtaaccatgagagagccagag

SEQ ID NO: 91338 - DNA, 25 bp, Mus musculus
ccatgtagatgagcacgtcgctgaa

SEQ ID NO: 91339 - DNA, 25 bp, Mus musculus
ccatgtagctgagaagtgggaccta

SEQ ID NO: 91340 - DNA, 25 bp, Mus musculus
ccatgtaggagctgggcaggcttct

SEQ ID NO: 91341 - DNA, 25 bp, Mus musculus
ccatgtaggagttgcttggcccaaa

SEQ ID NO: 91342 - DNA, 25 bp, Mus musculus
ccatgtatgcagtcggagggcacga

SEQ ID NO: 91343 - DNA, 25 bp, Mus musculus
ccatgtcaatgaaaagccgtccagc

SEQ ID NO: 91344 - DNA, 25 bp, Mus musculus
ccatgtcagtggtctaggatggcca

SEQ ID NO: 91345 - DNA, 25 bp, Mus musculus
ccatgtcctttgttgaagatgtcac

SEQ ID NO: 91346 - DNA, 25 bp, Mus musculus
ccatgtcggcgcaggcccagatgcg

SEQ ID NO: 91347 - DNA, 25 bp, Mus musculus
ccatgtcggtgcgagagttgaacca

SEQ ID NO: 91348 - DNA, 25 bp, Mus musculus
ccatgtctatggaatcgcagaggcg

SEQ ID NO: 91349 - DNA, 25 bp, Mus musculus
ccatgtctgagttagtggtgcacac

SEQ ID NO: 91350 - DNA, 25 bp, Mus musculus
ccatgtctgctagccatttagggaa

SEQ ID NO: 91351 - DNA, 25 bp, Mus musculus
ccatgtgactgacactgggcagcat

SEQ ID NO: 91352 - DNA, 25 bp, Mus musculus
ccatgtgcagtacgagggcttcacg

SEQ ID NO: 91353 - DNA, 25 bp, Mus musculus
ccatgtgcatttggagaccgttgcc

SEQ ID NO: 91354 - DNA, 25 bp, Mus musculus
ccatgtgctacatgaccagaccgca

SEQ ID NO: 91355 - DNA, 25 bp, Mus musculus
ccatgtgcttttagggttaacccag

SEQ ID NO: 91356 - DNA, 25 bp, Mus musculus
ccatgtggacaagcagtacgtggca

SEQ ID NO: 91357 - DNA, 25 bp, Mus musculus
ccatgtggcccggagcagatgtgaa

SEQ ID NO: 91358 - DNA, 25 bp, Mus musculus
ccatgtgggagctgcatctctataa

SEQ ID NO: 91359 - DNA, 25 bp, Mus musculus
ccatgtggtttggtaaatgccgtgc

SEQ ID NO: 91360 - DNA, 25 bp, Mus musculus
ccatgtgtgcgcctagtgagaagtt

SEQ ID NO: 91361 - DNA, 25 bp, Mus musculus
ccatgtgtgctaaggctggtgttcc

SEQ ID NO: 91362 - DNA, 25 bp, Mus musculus
ccatgttagctgcagaaaatgaccc

SEQ ID NO: 91363 - DNA, 25 bp, Mus musculus
ccatgttgatcgtggctagcacagg

SEQ ID NO: 91364 - DNA, 25 bp, Mus musculus
ccatgttggatgctctgctcgttga

SEQ ID NO: 91365 - DNA, 25 bp, Mus musculus
ccatgttggattgtgcggctgccgc

SEQ ID NO: 91366 - DNA, 25 bp, Mus musculus
ccatgttgggttcccttcttctcct

SEQ ID NO: 91367 - DNA, 25 bp, Mus musculus
ccatgttgtgcggaaggacttccac

SEQ ID NO: 91368 - DNA, 25 bp, Mus musculus
ccattacgagtgctgaacctgctta

SEQ ID NO: 91369 - DNA, 25 bp, Mus musculus
ccattactatgggatccgcctgaag

SEQ ID NO: 91370 - DNA, 25 bp, Mus musculus
ccattagtacagtctgggcccggga

SEQ ID NO: 91371 - DNA, 25 bp, Mus musculus
ccattatcagagaaaaagattatgc

SEQ ID NO: 91372 - DNA, 25 bp, Mus musculus
ccattcacagtgcaggcgaaggaga

SEQ ID NO: 91373 - DNA, 25 bp, Mus musculus
ccattcagaggtccccaacaggaaa

SEQ ID NO: 91374 - DNA, 25 bp, Mus musculus
ccattcagggtgacgaggaggacct

SEQ ID NO: 91375 - DNA, 25 bp, Mus musculus
ccattcagttgtgccgtaggctcac

SEQ ID NO: 91376 - DNA, 25 bp, Mus musculus
ccattcattaagtagctgcggagga

SEQ ID NO: 91377 - DNA, 25 bp, Mus musculus
ccattccggttaagatttgctagtc

SEQ ID NO: 91378 - DNA, 25 bp, Mus musculus
ccattcctgtggaggactgcgggtc

SEQ ID NO: 91379 - DNA, 25 bp, Mus musculus
ccattcgagtgaagtggcgttgcat

SEQ ID NO: 91380 - DNA, 25 bp, Mus musculus
ccattcgcacggaggtcgtggagca

SEQ ID NO: 91381 - DNA, 25 bp, Mus musculus
ccattctagagaggagtaacgggag

SEQ ID NO: 91382 - DNA, 25 bp, Mus musculus
ccattctaggattatgaggccacct

SEQ ID NO: 91383 - DNA, 25 bp, Mus musculus
ccattctcaggtcaaaggcgaggtt

SEQ ID NO: 91384 - DNA, 25 bp, Mus musculus
ccattctggagaggctgctccaagc

SEQ ID NO: 91385 - DNA, 25 bp, Mus musculus
ccattcttaaggaggcttgggagca

SEQ ID NO: 91386 - DNA, 25 bp, Mus musculus
ccattcttagaagcttcaacgccaa

SEQ ID NO: 91387 - DNA, 25 bp, Mus musculus
ccattcttagagaaaacctctacag

SEQ ID NO: 91388 - DNA, 25 bp, Mus musculus
ccattcttggtggtaaaggcgccat

SEQ ID NO: 91389 - DNA, 25 bp, Mus musculus
ccattgaagagataaagcagcggct

SEQ ID NO: 91390 - DNA, 25 bp, Mus musculus
ccattgaaggtccagcagaggcgtt

SEQ ID NO: 91391 - DNA, 25 bp, Mus musculus
ccattgacctatatgagctggagga

SEQ ID NO: 91392 - DNA, 25 bp, Mus musculus
ccattgacggcaggaagctcctgga

SEQ ID NO: 91393 - DNA, 25 bp, Mus musculus
ccattgacggtgtgaggaacatccc

SEQ ID NO: 91394 - DNA, 25 bp, Mus musculus
ccattgagattggagtgacagcact

SEQ ID NO: 91395 - DNA, 25 bp, Mus musculus
ccattgagccccattaagatgtgcc

SEQ ID NO: 91396 - DNA, 25 bp, Mus musculus
ccattgaggtagagtccaaaaggct

SEQ ID NO: 91397 - DNA, 25 bp, Mus musculus
ccattgagtgcttcatgccgctaga

SEQ ID NO: 91398 - DNA, 25 bp, Mus musculus
ccattgagttagatgaagacaccgg

SEQ ID NO: 91399 - DNA, 25 bp, Mus musculus
ccattgataagtccctgacgccgat

SEQ ID NO: 91400 - DNA, 25 bp, Mus musculus
ccattgatcttatcaataacttgct

SEQ ID NO: 91401 - DNA, 25 bp, Mus musculus
ccattgctgccaagatgagtggagc

SEQ ID NO: 91402 - DNA, 25 bp, Mus musculus
ccattgcttctttgtctgatcagga

SEQ ID NO: 91403 - DNA, 25 bp, Mus musculus
ccattggaatattaagcccgggagt

SEQ ID NO: 91404 - DNA, 25 bp, Mus musculus
ccattggatgtgacagggaagacca

SEQ ID NO: 91405 - DNA, 25 bp, Mus musculus
ccattggcaatgagcagaagctgaa

SEQ ID NO: 91406 - DNA, 25 bp, Mus musculus
ccattggcagaccaaagaggaggcc

SEQ ID NO: 91407 - DNA, 25 bp, Mus musculus
ccattggcgtgtggaaaatgccacc

SEQ ID NO: 91408 - DNA, 25 bp, Mus musculus
ccattggctctagtaccctttacag

SEQ ID NO: 91409 - DNA, 25 bp, Mus musculus
ccattggcttttgccctggaagcga

SEQ ID NO: 91410 - DNA, 25 bp, Mus musculus
ccattgggtggatcaggacggaact

SEQ ID NO: 91411 - DNA, 25 bp, Mus musculus
ccattgtaaggcaggagcggtgacc

SEQ ID NO: 91412 - DNA, 25 bp, Mus musculus
ccattgtcatagaagatcagaagaa

SEQ ID NO: 91413 - DNA, 25 bp, Mus musculus
ccattgtctgtataggtgagtccac

SEQ ID NO: 91414 - DNA, 25 bp, Mus musculus
ccattgtggaggatgaagtgaccca

SEQ ID NO: 91415 - DNA, 25 bp, Mus musculus
ccattgtggtgttgcaggctgtcat

SEQ ID NO: 91416 - DNA, 25 bp, Mus musculus
ccattgtgtacacacccactgtggg

SEQ ID NO: 91417 - DNA, 25 bp, Mus musculus
ccatttcaagcgttggaaccatcgt

SEQ ID NO: 91418 - DNA, 25 bp, Mus musculus
ccatttcatgtgttcccgggccaag

SEQ ID NO: 91419 - DNA, 25 bp, Mus musculus
ccatttccagaagaactacaccctg

SEQ ID NO: 91420 - DNA, 25 bp, Mus musculus
ccatttcctggtgctagggtcagca

SEQ ID NO: 91421 - DNA, 25 bp, Mus musculus
ccatttgggagcagtgtggaagccc

SEQ ID NO: 91422 - DNA, 25 bp, Mus musculus
ccattttgcttcgagggacagtaca

SEQ ID NO: 91423 - DNA, 25 bp, Mus musculus
ccattttggatgaacagcacgggca

SEQ ID NO: 91424 - DNA, 25 bp, Mus musculus
ccatttttacgaagattgctgagac

SEQ ID NO: 91425 - DNA, 25 bp, Mus musculus
cccaaaaatggtgagtttgtatgga

SEQ ID NO: 91426 - DNA, 25 bp, Mus musculus
cccaaaacgcggagaaatagtcaga

SEQ ID NO: 91427 - DNA, 25 bp, Mus musculus
cccaaaagggttgagtcatgacttg

SEQ ID NO: 91428 - DNA, 25 bp, Mus musculus
cccaaaagtagtgtgcggcaggctc

SEQ ID NO: 91429 - DNA, 25 bp, Mus musculus
cccaaagaagtgcagagtgtacagg

SEQ ID NO: 91430 - DNA, 25 bp, Mus musculus
cccaaagcactgaggctgagggacc

SEQ ID NO: 91431 - DNA, 25 bp, Mus musculus
cccaaagctgacaagaaggccgtta

SEQ ID NO: 91432 - DNA, 25 bp, Mus musculus
cccaaagctgacctactgaccacag

SEQ ID NO: 91433 - DNA, 25 bp, Mus musculus
cccaaaggaggaaggcaaagcgaat

SEQ ID NO: 91434 - DNA, 25 bp, Mus musculus
cccaaaggatatgcggaaaaagatc

SEQ ID NO: 91435 - DNA, 25 bp, Mus musculus
cccaaagggctgagataacggtgct

SEQ ID NO: 91436 - DNA, 25 bp, Mus musculus
cccaaagttctaggcctacgagtga

SEQ ID NO: 91437 - DNA, 25 bp, Mus musculus
cccaaatgcgacaggaaagaattcc

SEQ ID NO: 91438 - DNA, 25 bp, Mus musculus
cccaaatggtcacccctgaaacata

SEQ ID NO: 91439 - DNA, 25 bp, Mus musculus
cccaaattgtacagagaagcgagtc

SEQ ID NO: 91440 - DNA, 25 bp, Mus musculus
cccaacaagaacaggagagctcagg

SEQ ID NO: 91441 - DNA, 25 bp, Mus musculus
cccaacagctacttgttggtaggag

SEQ ID NO: 91442 - DNA, 25 bp, Mus musculus
cccaacagctgggagaaattgtgac

SEQ ID NO: 91443 - DNA, 25 bp, Mus musculus
cccaacctgaggactatcgataagt

SEQ ID NO: 91444 - DNA, 25 bp, Mus musculus
cccaacctggatgctgtggcgctga

SEQ ID NO: 91445 - DNA, 25 bp, Mus musculus
cccaacgaggaagtggcgaggttct

SEQ ID NO: 91446 - DNA, 25 bp, Mus musculus
cccaactcagtatgaagagcgcatg

SEQ ID NO: 91447 - DNA, 25 bp, Mus musculus
cccaactggatctgggcttgctctg

SEQ ID NO: 91448 - DNA, 25 bp, Mus musculus
cccaactggtcatcatagagactga

SEQ ID NO: 91449 - DNA, 25 bp, Mus musculus
cccaagagagttttgctgaacatcg

SEQ ID NO: 91450 - DNA, 25 bp, Mus musculus
cccaagagatgaagggtctcctcac

SEQ ID NO: 91451 - DNA, 25 bp, Mus musculus
cccaagagattaaggccgagtactg

SEQ ID NO: 91452 - DNA, 25 bp, Mus musculus
cccaagagcagctcagtcgactgga

SEQ ID NO: 91453 - DNA, 25 bp, Mus musculus
cccaagaggaagaggctaaacgcca

SEQ ID NO: 91454 - DNA, 25 bp, Mus musculus
cccaagataacgtgcagtgccggaa

SEQ ID NO: 91455 - DNA, 25 bp, Mus musculus
cccaagataccgacatgagagtggt

SEQ ID NO: 91456 - DNA, 25 bp, Mus musculus
cccaagcagcgagccaagttcaaga

SEQ ID NO: 91457 - DNA, 25 bp, Mus musculus
cccaagcgcatagctaagagaaggt

SEQ ID NO: 91458 - DNA, 25 bp, Mus musculus
cccaagctaagagataagacgcgtt

SEQ ID NO: 91459 - DNA, 25 bp, Mus musculus
cccaaggacagttagaggcttcgcc

SEQ ID NO: 91460 - DNA, 25 bp, Mus musculus
cccaaggagctttgatgaattctta

SEQ ID NO: 91461 - DNA, 25 bp, Mus musculus
cccaaggcattagaacaggcggaat

SEQ ID NO: 91462 - DNA, 25 bp, Mus musculus
cccaagggaaggacatagtgcacaa

SEQ ID NO: 91463 - DNA, 25 bp, Mus musculus
cccaagggcagaatcgggatgcgca

SEQ ID NO: 91464 - DNA, 25 bp, Mus musculus
cccaagggcagaggattcatcaaac

SEQ ID NO: 91465 - DNA, 25 bp, Mus musculus
cccaagggcctcgaatggctgtgga

SEQ ID NO: 91466 - DNA, 25 bp, Mus musculus
cccaaggtgactgctggctgattga

SEQ ID NO: 91467 - DNA, 25 bp, Mus musculus
cccaaggtgggcatctgagagcccc

SEQ ID NO: 91468 - DNA, 25 bp, Mus musculus
cccaaggtgtggctaaaggaagctc

SEQ ID NO: 91469 - DNA, 25 bp, Mus musculus
cccaagtactaagggcttcgagcca

SEQ ID NO: 91470 - DNA, 25 bp, Mus musculus
cccaagtgccgcaggttctcttaca

SEQ ID NO: 91471 - DNA, 25 bp, Mus musculus
cccaagtgggctcggcaagatttta

SEQ ID NO: 91472 - DNA, 25 bp, Mus musculus
cccaagtgtaattatgttgtggaca

SEQ ID NO: 91473 - DNA, 25 bp, Mus musculus
cccaagttcttcagggcagctgtga

SEQ ID NO: 91474 - DNA, 25 bp, Mus musculus
cccaatattccggagaggagagaaa

SEQ ID NO: 91475 - DNA, 25 bp, Mus musculus
cccaatcaaggacagatggatctct

SEQ ID NO: 91476 - DNA, 25 bp, Mus musculus
cccaatgaggatgggtttagcccca

SEQ ID NO: 91477 - DNA, 25 bp, Mus musculus
cccacaacggacagggtagtcactc

SEQ ID NO: 91478 - DNA, 25 bp, Mus musculus
cccacaatgggacgaggctgaatat

SEQ ID NO: 91479 - DNA, 25 bp, Mus musculus
cccacaccattgagaaaccgtataa

SEQ ID NO: 91480 - DNA, 25 bp, Mus musculus
cccacacgaaagcagagcggaacat

SEQ ID NO: 91481 - DNA, 25 bp, Mus musculus
cccacagactgcacagaggaggtga

SEQ ID NO: 91482 - DNA, 25 bp, Mus musculus
cccacagcagggtcgaaattgatgt

SEQ ID NO: 91483 - DNA, 25 bp, Mus musculus
cccacagggctatggaaagcagagt

SEQ ID NO: 91484 - DNA, 25 bp, Mus musculus
cccacaggtacgtgagcaggcttca

SEQ ID NO: 91485 - DNA, 25 bp, Mus musculus
cccacaggtaggctggaagagtacc

SEQ ID NO: 91486 - DNA, 25 bp, Mus musculus
cccacaggtgccaagagggcgctct

SEQ ID NO: 91487 - DNA, 25 bp, Mus musculus
cccacagtgagctggtagaatacta

SEQ ID NO: 91488 - DNA, 25 bp, Mus musculus
cccacagtgtggaaaagggaatgta

SEQ ID NO: 91489 - DNA, 25 bp, Mus musculus
cccacatcgactgctggacaatgag

SEQ ID NO: 91490 - DNA, 25 bp, Mus musculus
cccacattgggcttcgggactggta

SEQ ID NO: 91491 - DNA, 25 bp, Mus musculus
cccaccagaacgtcatagataagtt

SEQ ID NO: 91492 - DNA, 25 bp, Mus musculus
cccaccagacagtgtgtactcgggt

SEQ ID NO: 91493 - DNA, 25 bp, Mus musculus
cccaccagagcccggaacatgaagg

SEQ ID NO: 91494 - DNA, 25 bp, Mus musculus
cccaccaggaggatgacggagagaa

SEQ ID NO: 91495 - DNA, 25 bp, Mus musculus
cccacccaagaggaagctagagatg

SEQ ID NO: 91496 - DNA, 25 bp, Mus musculus
cccacctgctcgctcccatgaccaa

SEQ ID NO: 91497 - DNA, 25 bp, Mus musculus
cccacctggaggacattgaaggcct

SEQ ID NO: 91498 - DNA, 25 bp, Mus musculus
cccacgacctgttcttggcgttatg

SEQ ID NO: 91499 - DNA, 25 bp, Mus musculus
cccacgagatcagcaaggagcacat

SEQ ID NO: 91500 - DNA, 25 bp, Mus musculus
cccacgaggcaagcaaaagttaagt

SEQ ID NO: 91501 - DNA, 25 bp, Mus musculus
cccacgagggatgcgggaagcactt

SEQ ID NO: 91502 - DNA, 25 bp, Mus musculus
cccacgagttatgcttgcttcagaa

SEQ ID NO: 91503 - DNA, 25 bp, Mus musculus
cccacgagttcaagcaggcctgcca

SEQ ID NO: 91504 - DNA, 25 bp, Mus musculus
cccacgagttggacgatagcagcag

SEQ ID NO: 91505 - DNA, 25 bp, Mus musculus
cccacgatgtggaaagtcggtatac

SEQ ID NO: 91506 - DNA, 25 bp, Mus musculus
cccacgattctagcacaggaggaag

SEQ ID NO: 91507 - DNA, 25 bp, Mus musculus
cccacgcctggactgaggaatgctg

SEQ ID NO: 91508 - DNA, 25 bp, Mus musculus
cccacgctggactggaatactcaga

SEQ ID NO: 91509 - DNA, 25 bp, Mus musculus
cccacggcagcatgtaccccagcaa

SEQ ID NO: 91510 - DNA, 25 bp, Mus musculus
cccacggctgctgaatcggatgtat

SEQ ID NO: 91511 - DNA, 25 bp, Mus musculus
cccacgggaagctggtcatcctgtt

SEQ ID NO: 91512 - DNA, 25 bp, Mus musculus
cccacggtagaagcgatgcaggtcc

SEQ ID NO: 91513 - DNA, 25 bp, Mus musculus
cccacgtggttgtacatatttgtca

SEQ ID NO: 91514 - DNA, 25 bp, Mus musculus
cccactaaggattctggaccggtga

SEQ ID NO: 91515 - DNA, 25 bp, Mus musculus
cccactctctggaggtgctatggaa

SEQ ID NO: 91516 - DNA, 25 bp, Mus musculus
cccactctgaacgaacggaaaaatg

SEQ ID NO: 91517 - DNA, 25 bp, Mus musculus
cccactgacaatggctgagacggag

SEQ ID NO: 91518 - DNA, 25 bp, Mus musculus
cccactgctgatagggtgaccctga

SEQ ID NO: 91519 - DNA, 25 bp, Mus musculus
cccactggaaggagacacatcgatt

SEQ ID NO: 91520 - DNA, 25 bp, Mus musculus
cccactggcttgtttggattaggga

SEQ ID NO: 91521 - DNA, 25 bp, Mus musculus
cccactggtcgggcctagaagctga

SEQ ID NO: 91522 - DNA, 25 bp, Mus musculus
cccactggttaggaatagagctgta

SEQ ID NO: 91523 - DNA, 25 bp, Mus musculus
cccactgttggaccccagaagacaa

SEQ ID NO: 91524 - DNA, 25 bp, Mus musculus
cccacttcgggatgttctgtgatgg

SEQ ID NO: 91525 - DNA, 25 bp, Mus musculus
cccacttgccaaggaacaggaagaa

SEQ ID NO: 91526 - DNA, 25 bp, Mus musculus
cccacttggacttttgcaatcagag

SEQ ID NO: 91527 - DNA, 25 bp, Mus musculus
cccactttgtaattaatgctgccag

SEQ ID NO: 91528 - DNA, 25 bp, Mus musculus
cccagaaaatgccagagaaagtgaa

SEQ ID NO: 91529 - DNA, 25 bp, Mus musculus
cccagaaagaggctcaaattaaagt

SEQ ID NO: 91530 - DNA, 25 bp, Mus musculus
cccagaaatgctgaagcaggcgcgg

SEQ ID NO: 91531 - DNA, 25 bp, Mus musculus
cccagaacagagaatccttaaggct

SEQ ID NO: 91532 - DNA, 25 bp, Mus musculus
cccagaagaacgagagcggatgatc

SEQ ID NO: 91533 - DNA, 25 bp, Mus musculus
cccagaagagcatccaggagatcca

SEQ ID NO: 91534 - DNA, 25 bp, Mus musculus
cccagaagatagtggaagaacaggt

SEQ ID NO: 91535 - DNA, 25 bp, Mus musculus
cccagaagtgagtggatgagtgaac

SEQ ID NO: 91536 - DNA, 25 bp, Mus musculus
cccagaataggaagatggcagcaaa

SEQ ID NO: 91537 - DNA, 25 bp, Mus musculus
cccagacacaagctccttgagagtt

SEQ ID NO: 91538 - DNA, 25 bp, Mus musculus
cccagacatgggtataggcggagcc

SEQ ID NO: 91539 - DNA, 25 bp, Mus musculus
cccagactgtgattccgatgaggac

SEQ ID NO: 91540 - DNA, 25 bp, Mus musculus
cccagacttcgctacctgctggtag

SEQ ID NO: 91541 - DNA, 25 bp, Mus musculus
cccagagaatatcaaggacaggtca

SEQ ID NO: 91542 - DNA, 25 bp, Mus musculus
cccagagaatgtggaggaagctatc

SEQ ID NO: 91543 - DNA, 25 bp, Mus musculus
cccagagagccagaagagacggctt

SEQ ID NO: 91544 - DNA, 25 bp, Mus musculus
cccagagaggacaaagtgaaggact

SEQ ID NO: 91545 - DNA, 25 bp, Mus musculus
cccagagatgggtacagcaagtgaa

SEQ ID NO: 91546 - DNA, 25 bp, Mus musculus
cccagagcaatggacgaaggccttt

SEQ ID NO: 91547 - DNA, 25 bp, Mus musculus
cccagagcgtgctgcaggacttact

SEQ ID NO: 91548 - DNA, 25 bp, Mus musculus
cccagaggaaaaggcagcaaaggtt

SEQ ID NO: 91549 - DNA, 25 bp, Mus musculus
cccagaggaggctatagaagcgatc

SEQ ID NO: 91550 - DNA, 25 bp, Mus musculus
cccagaggatcgctgagagcaatca

SEQ ID NO: 91551 - DNA, 25 bp, Mus musculus
cccagaggcctcgtgtttgttcaag

SEQ ID NO: 91552 - DNA, 25 bp, Mus musculus
cccagaggcgggagctaatcttggc

SEQ ID NO: 91553 - DNA, 25 bp, Mus musculus
cccagagggtttgatggcctaccaa

SEQ ID NO: 91554 - DNA, 25 bp, Mus musculus
cccagagtgtggtgtacgcttcaag

SEQ ID NO: 91555 - DNA, 25 bp, Mus musculus
cccagagtttgagccgagtgagcag

SEQ ID NO: 91556 - DNA, 25 bp, Mus musculus
cccagataacatgtggtccagccag

SEQ ID NO: 91557 - DNA, 25 bp, Mus musculus
cccagataagtggagtgaagaaact

SEQ ID NO: 91558 - DNA, 25 bp, Mus musculus
cccagatgagggaggaagagtctct

SEQ ID NO: 91559 - DNA, 25 bp, Mus musculus
cccagatggagttcctgtagaaggg

SEQ ID NO: 91560 - DNA, 25 bp, Mus musculus
cccagatgggaagggaatgaatcca

SEQ ID NO: 91561 - DNA, 25 bp, Mus musculus
cccagatgggtatccggagtggcat

SEQ ID NO: 91562 - DNA, 25 bp, Mus musculus
cccagatgtcaaaacgaagaggcgg

SEQ ID NO: 91563 - DNA, 25 bp, Mus musculus
cccagattggagcagaaagtcatta

SEQ ID NO: 91564 - DNA, 25 bp, Mus musculus
cccagatttggatgcgaggactcca

SEQ ID NO: 91565 - DNA, 25 bp, Mus musculus
cccagcaactagcagaagaagcaac

SEQ ID NO: 91566 - DNA, 25 bp, Mus musculus
cccagcaggagacgtgtttcagaac

SEQ ID NO: 91567 - DNA, 25 bp, Mus musculus
cccagcaggccattagattgtttac

SEQ ID NO: 91568 - DNA, 25 bp, Mus musculus
cccagcatggctgaatgagcaggca

SEQ ID NO: 91569 - DNA, 25 bp, Mus musculus
cccagccaaagcgtgagaagattag

SEQ ID NO: 91570 - DNA, 25 bp, Mus musculus
cccagccaaggagaggatatcgtga

SEQ ID NO: 91571 - DNA, 25 bp, Mus musculus
cccagcccatggtggaagtggacat

SEQ ID NO: 91572 - DNA, 25 bp, Mus musculus
cccagccctgggtacagaagtgaca

SEQ ID NO: 91573 - DNA, 25 bp, Mus musculus
cccagccgggagtccacggatggca

SEQ ID NO: 91574 - DNA, 25 bp, Mus musculus
cccagccgtgatgatgaatgcagga

SEQ ID NO: 91575 - DNA, 25 bp, Mus musculus
cccagcctgggtgaaatacaagtgt

SEQ ID NO: 91576 - DNA, 25 bp, Mus musculus
cccagcgagaaggatggaaaggaat

SEQ ID NO: 91577 - DNA, 25 bp, Mus musculus
cccagcggaagcgtcgagtgcgtgg

SEQ ID NO: 91578 - DNA, 25 bp, Mus musculus
cccagcgtccagatgaagatcaaag

SEQ ID NO: 91579 - DNA, 25 bp, Mus musculus
cccagcgtggtgtgaagtcttcaga

SEQ ID NO: 91580 - DNA, 25 bp, Mus musculus
cccagctcgaacagatgaaggaaga

SEQ ID NO: 91581 - DNA, 25 bp, Mus musculus
cccagctcttccagaccttcagtgt

SEQ ID NO: 91582 - DNA, 25 bp, Mus musculus
cccagctgaaggcaatggagcccag

SEQ ID NO: 91583 - DNA, 25 bp, Mus musculus
cccagctgacgtgatgagactccac

SEQ ID NO: 91584 - DNA, 25 bp, Mus musculus
cccagctgctggtctacgagaatga

SEQ ID NO: 91585 - DNA, 25 bp, Mus musculus
cccagctggatcctgaggaagaaga

SEQ ID NO: 91586 - DNA, 25 bp, Mus musculus
cccagctgggtggaggacagattcc

SEQ ID NO: 91587 - DNA, 25 bp, Mus musculus
cccagctgtagttgttggattctca

SEQ ID NO: 91588 - DNA, 25 bp, Mus musculus
cccagctgtcctagtgtcaataaag

SEQ ID NO: 91589 - DNA, 25 bp, Mus musculus
cccagctgtgaaagaaagaattgcc

SEQ ID NO: 91590 - DNA, 25 bp, Mus musculus
cccagctgtgttcccctagacgaaa

SEQ ID NO: 91591 - DNA, 25 bp, Mus musculus
cccaggaagatgaatctggaattaa

SEQ ID NO: 91592 - DNA, 25 bp, Mus musculus
cccaggaagatgagcaacttcaaac

SEQ ID NO: 91593 - DNA, 25 bp, Mus musculus
cccaggaagctggatctatcaggaa

SEQ ID NO: 91594 - DNA, 25 bp, Mus musculus
cccaggaagcttgtgtaaggaggtt

SEQ ID NO: 91595 - DNA, 25 bp, Mus musculus
cccaggaatgcgcccaccaagaccc

SEQ ID NO: 91596 - DNA, 25 bp, Mus musculus
cccaggacctcagagatttctggaa

SEQ ID NO: 91597 - DNA, 25 bp, Mus musculus
cccaggagatggaagcttgccgctg

SEQ ID NO: 91598 - DNA, 25 bp, Mus musculus
cccaggagttcttggagtcgctcaa

SEQ ID NO: 91599 - DNA, 25 bp, Mus musculus
cccaggatatttgtcaatggacgat

SEQ ID NO: 91600 - DNA, 25 bp, Mus musculus
cccaggatgggtgaattcaatgaga

SEQ ID NO: 91601 - DNA, 25 bp, Mus musculus
cccaggcagtattgcaacaggctca

SEQ ID NO: 91602 - DNA, 25 bp, Mus musculus
cccaggcctagaaaccttggtgtct

SEQ ID NO: 91603 - DNA, 25 bp, Mus musculus
cccaggccttgtcatgttccagtaa

SEQ ID NO: 91604 - DNA, 25 bp, Mus musculus
cccaggcgcagatgcgggccctgtt

SEQ ID NO: 91605 - DNA, 25 bp, Mus musculus
cccaggcgccttttgaggagaggaa

SEQ ID NO: 91606 - DNA, 25 bp, Mus musculus
cccaggctacctatgagatccagtt

SEQ ID NO: 91607 - DNA, 25 bp, Mus musculus
cccaggctgcagagagtaaaatgtc

SEQ ID NO: 91608 - DNA, 25 bp, Mus musculus
cccaggctggcattacggttactac

SEQ ID NO: 91609 - DNA, 25 bp, Mus musculus
cccaggctgtaaaaatgcttcgaga

SEQ ID NO: 91610 - DNA, 25 bp, Mus musculus
cccaggctgtgaccatgcaggcatt

SEQ ID NO: 91611 - DNA, 25 bp, Mus musculus
cccagggaggatcagacacttcaaa

SEQ ID NO: 91612 - DNA, 25 bp, Mus musculus
cccagggatgcaggagattcttctc

SEQ ID NO: 91613 - DNA, 25 bp, Mus musculus
cccagggcgaggatgacgaaatgct

SEQ ID NO: 91614 - DNA, 25 bp, Mus musculus
cccagggcgggaacatgtcatcttc

SEQ ID NO: 91615 - DNA, 25 bp, Mus musculus
cccagggctgttgatgcttcatcta

SEQ ID NO: 91616 - DNA, 25 bp, Mus musculus
cccagggtcctagaaatccagtcag

SEQ ID NO: 91617 - DNA, 25 bp, Mus musculus
cccagggtgatgatgatagagttct

SEQ ID NO: 91618 - DNA, 25 bp, Mus musculus
cccaggtcttggagccgaacataca

SEQ ID NO: 91619 - DNA, 25 bp, Mus musculus
cccaggtgctgcagtgcttgaccaa

SEQ ID NO: 91620 - DNA, 25 bp, Mus musculus
cccaggtggaaggatctgttctgca

SEQ ID NO: 91621 - DNA, 25 bp, Mus musculus
cccaggtgttccaaatagtgctccc

SEQ ID NO: 91622 - DNA, 25 bp, Mus musculus
cccaggttgatcttagccagcagca

SEQ ID NO: 91623 - DNA, 25 bp, Mus musculus
cccaggttttggcagctacttacaa

SEQ ID NO: 91624 - DNA, 25 bp, Mus musculus
cccagtaagcatgaggatgatgtcc

SEQ ID NO: 91625 - DNA, 25 bp, Mus musculus
cccagtaaggaggagatcagacgct

SEQ ID NO: 91626 - DNA, 25 bp, Mus musculus
cccagtcagcatgtgcactgaatta

SEQ ID NO: 91627 - DNA, 25 bp, Mus musculus
cccagtccaggagcatgtatgaaaa

SEQ ID NO: 91628 - DNA, 25 bp, Mus musculus
cccagtcggtgctgtaccagagtga

SEQ ID NO: 91629 - DNA, 25 bp, Mus musculus
cccagtgaagagatccctagtgtac

SEQ ID NO: 91630 - DNA, 25 bp, Mus musculus
cccagtgaccggcaggctttggtca

SEQ ID NO: 91631 - DNA, 25 bp, Mus musculus
cccagtgcagagaccggagatgttc

SEQ ID NO: 91632 - DNA, 25 bp, Mus musculus
cccagtgcagccaacggctgggcag

SEQ ID NO: 91633 - DNA, 25 bp, Mus musculus
cccagtgcttaaagtggagatgccc

SEQ ID NO: 91634 - DNA, 25 bp, Mus musculus
cccagtggacactgggcactggcca

SEQ ID NO: 91635 - DNA, 25 bp, Mus musculus
cccagtgggactctgtgctacacag

SEQ ID NO: 91636 - DNA, 25 bp, Mus musculus
cccagtggtgaagccagcacaagta

SEQ ID NO: 91637 - DNA, 25 bp, Mus musculus
cccagtgttagagtgcttgttcagc

SEQ ID NO: 91638 - DNA, 25 bp, Mus musculus
cccagttcagcgttgtgagcgtcgt

SEQ ID NO: 91639 - DNA, 25 bp, Mus musculus
cccagttcggcggtgttgatcagag

SEQ ID NO: 91640 - DNA, 25 bp, Mus musculus
cccagttggactagagaggctgcat

SEQ ID NO: 91641 - DNA, 25 bp, Mus musculus
cccagttgggtttgaaagaccagca

SEQ ID NO: 91642 - DNA, 25 bp, Mus musculus
cccagtttctcggtttatgtgctct

SEQ ID NO: 91643 - DNA, 25 bp, Mus musculus
cccatactgttttgtggagttccat

SEQ ID NO: 91644 - DNA, 25 bp, Mus musculus
cccatagccagttccggagcagttg

SEQ ID NO: 91645 - DNA, 25 bp, Mus musculus
cccatagctcagagggaaggagtcc

SEQ ID NO: 91646 - DNA, 25 bp, Mus musculus
cccatattatgaatggctggatctg

SEQ ID NO: 91647 - DNA, 25 bp, Mus musculus
cccatcaaaaatggcaagatcctca

SEQ ID NO: 91648 - DNA, 25 bp, Mus musculus
cccatcagtaacatctttgcgtgca

SEQ ID NO: 91649 - DNA, 25 bp, Mus musculus
cccatccacggctgatgagggctgg

SEQ ID NO: 91650 - DNA, 25 bp, Mus musculus
cccatcctgaggacctgaagaaggg

SEQ ID NO: 91651 - DNA, 25 bp, Mus musculus
cccatcgagaaatatcagtttagtc

SEQ ID NO: 91652 - DNA, 25 bp, Mus musculus
cccatcggtgctagtggaagagctc

SEQ ID NO: 91653 - DNA, 25 bp, Mus musculus
cccatctcggtagaggacagtgtct

SEQ ID NO: 91654 - DNA, 25 bp, Mus musculus
cccatgacagaagcggtcgaggctg

SEQ ID NO: 91655 - DNA, 25 bp, Mus musculus
cccatgaccaacatgagctggagct

SEQ ID NO: 91656 - DNA, 25 bp, Mus musculus
cccatgataaggttgctgagcagga

SEQ ID NO: 91657 - DNA, 25 bp, Mus musculus
cccatgataatgtagaagtcgaagc

SEQ ID NO: 91658 - DNA, 25 bp, Mus musculus
cccatgattggtgctcggttttaca

SEQ ID NO: 91659 - DNA, 25 bp, Mus musculus
cccatgcacaagatgatgaacaccg

SEQ ID NO: 91660 - DNA, 25 bp, Mus musculus
cccatgctcccagatgaagggcttt

SEQ ID NO: 91661 - DNA, 25 bp, Mus musculus
cccatgctgagtagcagcggcagcg

SEQ ID NO: 91662 - DNA, 25 bp, Mus musculus
cccatggagaggaagcagaaagcac

SEQ ID NO: 91663 - DNA, 25 bp, Mus musculus
cccatggatggaaacgacagtgact

SEQ ID NO: 91664 - DNA, 25 bp, Mus musculus
cccatggatgggatacatgacaaag

SEQ ID NO: 91665 - DNA, 25 bp, Mus musculus
cccatgggcttgttatgcgttatca

SEQ ID NO: 91666 - DNA, 25 bp, Mus musculus
cccatggtagccctgcagtcaggct

SEQ ID NO: 91667 - DNA, 25 bp, Mus musculus
cccatggttgaattggaagaggcca

SEQ ID NO: 91668 - DNA, 25 bp, Mus musculus
cccatggttttaggttgcacgactc

SEQ ID NO: 91669 - DNA, 25 bp, Mus musculus
cccatgtgggacgaaggatgctgcc

SEQ ID NO: 91670 - DNA, 25 bp, Mus musculus
cccatgtgtcatgggatgggcctgc

SEQ ID NO: 91671 - DNA, 25 bp, Mus musculus
cccatgtgtgaagtgtggtacctca

SEQ ID NO: 91672 - DNA, 25 bp, Mus musculus
cccattaagggagcggaacacatgt

SEQ ID NO: 91673 - DNA, 25 bp, Mus musculus
cccattacaaggagttgttggcaca

SEQ ID NO: 91674 - DNA, 25 bp, Mus musculus
cccattaggaaagctcaggagtgaa

SEQ ID NO: 91675 - DNA, 25 bp, Mus musculus
cccattagttatttgaagtgagaca

SEQ ID NO: 91676 - DNA, 25 bp, Mus musculus
cccattgcagcgatccgggaggact

SEQ ID NO: 91677 - DNA, 25 bp, Mus musculus
cccattggagcaggcctactgtgcg

SEQ ID NO: 91678 - DNA, 25 bp, Mus musculus
cccatttagtgagacaggcctgaga

SEQ ID NO: 91679 - DNA, 25 bp, Mus musculus
cccatttatgggaagcttgcgcgct

SEQ ID NO: 91680 - DNA, 25 bp, Mus musculus
cccatttgttgggtaaggcagtcac

SEQ ID NO: 91681 - DNA, 25 bp, Mus musculus
cccattttcgccagcaatcattcaa

SEQ ID NO: 91682 - DNA, 25 bp, Mus musculus
ccccaaactgtgaattcagttgcaa

SEQ ID NO: 91683 - DNA, 25 bp, Mus musculus
ccccaaagacaagacatggaggctt

SEQ ID NO: 91684 - DNA, 25 bp, Mus musculus
ccccaaagatgcctgtacaagcttc

SEQ ID NO: 91685 - DNA, 25 bp, Mus musculus
ccccaaagatggtgcagagtgaact

SEQ ID NO: 91686 - DNA, 25 bp, Mus musculus
ccccaaccgtgattgtgatggtggg

SEQ ID NO: 91687 - DNA, 25 bp, Mus musculus
ccccaacggctagaacgagacagaa

SEQ ID NO: 91688 - DNA, 25 bp, Mus musculus
ccccaacgtggtgaatctgcatgag

SEQ ID NO: 91689 - DNA, 25 bp, Mus musculus
ccccaagagcagagaggatgtcatg

SEQ ID NO: 91690 - DNA, 25 bp, Mus musculus
ccccaaggagaggagcgaagagtct

SEQ ID NO: 91691 - DNA, 25 bp, Mus musculus
ccccaaggaggctatctgagaggag

SEQ ID NO: 91692 - DNA, 25 bp, Mus musculus
ccccaaggcccatgaagttcgaatt

SEQ ID NO: 91693 - DNA, 25 bp, Mus musculus
ccccaagggcttgtgcagatcatga

SEQ ID NO: 91694 - DNA, 25 bp, Mus musculus
ccccaatgttggtgattgaagatcc

SEQ ID NO: 91695 - DNA, 25 bp, Mus musculus
ccccacagtggagaaggaagtctga

SEQ ID NO: 91696 - DNA, 25 bp, Mus musculus
ccccacccgggatagagaggaaatg

SEQ ID NO: 91697 - DNA, 25 bp, Mus musculus
ccccacctgtgctacgggttgatga

SEQ ID NO: 91698 - DNA, 25 bp, Mus musculus
ccccacgacagagaagacatagata

SEQ ID NO: 91699 - DNA, 25 bp, Mus musculus
ccccacggagtctatgcgcaggagt

SEQ ID NO: 91700 - DNA, 25 bp, Mus musculus
ccccacggtctggaagaaggctgtg

SEQ ID NO: 91701 - DNA, 25 bp, Mus musculus
ccccactgctgagggcctggatttg

SEQ ID NO: 91702 - DNA, 25 bp, Mus musculus
ccccactggtgtcaagtgattttcc

SEQ ID NO: 91703 - DNA, 25 bp, Mus musculus
ccccactgtgaatgcagaggccaga

SEQ ID NO: 91704 - DNA, 25 bp, Mus musculus
ccccactttgggagtcatgtcggtg

SEQ ID NO: 91705 - DNA, 25 bp, Mus musculus
ccccagaagcatgggctagagctag

SEQ ID NO: 91706 - DNA, 25 bp, Mus musculus
ccccagaagctggtggtaccatgaa

SEQ ID NO: 91707 - DNA, 25 bp, Mus musculus
ccccagacagtagaaggtaaagcct

SEQ ID NO: 91708 - DNA, 25 bp, Mus musculus
ccccagaggaggacttgaacgagga

SEQ ID NO: 91709 - DNA, 25 bp, Mus musculus
ccccagaggagttcccagagcctgg

SEQ ID NO: 91710 - DNA, 25 bp, Mus musculus
ccccagcaatggataaattcgtcat

SEQ ID NO: 91711 - DNA, 25 bp, Mus musculus
ccccagccatggagaagggtgtgat

SEQ ID NO: 91712 - DNA, 25 bp, Mus musculus
ccccagctcgggaagaatgtgccac

SEQ ID NO: 91713 - DNA, 25 bp, Mus musculus
ccccagctgtgccttaaggactaat

SEQ ID NO: 91714 - DNA, 25 bp, Mus musculus
ccccaggaaggtctgctataagtaa

SEQ ID NO: 91715 - DNA, 25 bp, Mus musculus
ccccagggaggtgaagacttgcaaa

SEQ ID NO: 91716 - DNA, 25 bp, Mus musculus
ccccagggtacaattgctttgtgga

SEQ ID NO: 91717 - DNA, 25 bp, Mus musculus
ccccagggtgcagaatgaaggctcc

SEQ ID NO: 91718 - DNA, 25 bp, Mus musculus
ccccagtgcgaggaaaatggacttg

SEQ ID NO: 91719 - DNA, 25 bp, Mus musculus
ccccagtgtgggagaagataggtac

SEQ ID NO: 91720 - DNA, 25 bp, Mus musculus
ccccatcggtgaaggtaaaagccag

SEQ ID NO: 91721 - DNA, 25 bp, Mus musculus
ccccatcgtgggaaacagcttcgta

SEQ ID NO: 91722 - DNA, 25 bp, Mus musculus
ccccatcttgggagcagcgattgct

SEQ ID NO: 91723 - DNA, 25 bp, Mus musculus
ccccatctttacatgtaagatcctg

SEQ ID NO: 91724 - DNA, 25 bp, Mus musculus
ccccatgaccagcacaggatgatct

SEQ ID NO: 91725 - DNA, 25 bp, Mus musculus
ccccatggcctacattccggatggg

SEQ ID NO: 91726 - DNA, 25 bp, Mus musculus
ccccatgggtgcagagtgatagtga

SEQ ID NO: 91727 - DNA, 25 bp, Mus musculus
ccccattctggtgttggatgcatag

SEQ ID NO: 91728 - DNA, 25 bp, Mus musculus
ccccattgactagagagaggcgaag

SEQ ID NO: 91729 - DNA, 25 bp, Mus musculus
ccccatttcctgacttgctgaagat

SEQ ID NO: 91730 - DNA, 25 bp, Mus musculus
ccccctgcgaggaaaagcagaccag

SEQ ID NO: 91731 - DNA, 25 bp, Mus musculus
ccccgaaagcatctgcacaagaatc

SEQ ID NO: 91732 - DNA, 25 bp, Mus musculus
ccccgaatggtgcagaacagtgact

SEQ ID NO: 91733 - DNA, 25 bp, Mus musculus
ccccgaatgtggtttctatggactc

SEQ ID NO: 91734 - DNA, 25 bp, Mus musculus
ccccgaattactgctgcggttaaga

SEQ ID NO: 91735 - DNA, 25 bp, Mus musculus
ccccgacgtggaaggagcttgctaa

SEQ ID NO: 91736 - DNA, 25 bp, Mus musculus
ccccgactgactgatgagaggagca

SEQ ID NO: 91737 - DNA, 25 bp, Mus musculus
ccccgagaacaggaagtcaagtaga

SEQ ID NO: 91738 - DNA, 25 bp, Mus musculus
ccccgagctgggaggcaaatactat

SEQ ID NO: 91739 - DNA, 25 bp, Mus musculus
ccccgagggccagcttgtgctttgg

SEQ ID NO: 91740 - DNA, 25 bp, Mus musculus
ccccgaggtcactgtacttggaaga

SEQ ID NO: 91741 - DNA, 25 bp, Mus musculus
ccccgagtggctgacagaaggctat

SEQ ID NO: 91742 - DNA, 25 bp, Mus musculus
ccccgatgctggacatgagtgaggc

SEQ ID NO: 91743 - DNA, 25 bp, Mus musculus
ccccgcgatgggaagttctgtgact

SEQ ID NO: 91744 - DNA, 25 bp, Mus musculus
ccccgctgagtgacagcgggcacat

SEQ ID NO: 91745 - DNA, 25 bp, Mus musculus
ccccgctggtgtagaatagccaata

SEQ ID NO: 91746 - DNA, 25 bp, Mus musculus
ccccggaagtgggatctgtgtgttc

SEQ ID NO: 91747 - DNA, 25 bp, Mus musculus
ccccggacagatgggcttgtttctc

SEQ ID NO: 91748 - DNA, 25 bp, Mus musculus
ccccggagtgaagtggaagccttga

SEQ ID NO: 91749 - DNA, 25 bp, Mus musculus
ccccggagtgctggaaaatcgtgac

SEQ ID NO: 91750 - DNA, 25 bp, Mus musculus
ccccggatacagtgcggcccgagtg

SEQ ID NO: 91751 - DNA, 25 bp, Mus musculus
ccccggcacctggagagtgacatgt

SEQ ID NO: 91752 - DNA, 25 bp, Mus musculus
ccccggcatcgtaagctcaaggagc

SEQ ID NO: 91753 - DNA, 25 bp, Mus musculus
ccccggcgagcaggatagcatgctt

SEQ ID NO: 91754 - DNA, 25 bp, Mus musculus
ccccggcgataaggcagtactataa

SEQ ID NO: 91755 - DNA, 25 bp, Mus musculus
ccccggctacggttatgattatgac

SEQ ID NO: 91756 - DNA, 25 bp, Mus musculus
ccccggcttgaagagcaacttgtct

SEQ ID NO: 91757 - DNA, 25 bp, Mus musculus
ccccgggacacgaaatctagagcta

SEQ ID NO: 91758 - DNA, 25 bp, Mus musculus
ccccgggacgccattcttggagtca

SEQ ID NO: 91759 - DNA, 25 bp, Mus musculus
ccccgggagaaggtagccatggaat

SEQ ID NO: 91760 - DNA, 25 bp, Mus musculus
ccccgggataaacatggcgacgtct

SEQ ID NO: 91761 - DNA, 25 bp, Mus musculus
ccccgggatgagacagttgatgact

SEQ ID NO: 91762 - DNA, 25 bp, Mus musculus
ccccgggctggcgagatattgaacc

SEQ ID NO: 91763 - DNA, 25 bp, Mus musculus
ccccggtggtactgctgagtgagcc

SEQ ID NO: 91764 - DNA, 25 bp, Mus musculus
ccccggtttatcattggtggagcca

SEQ ID NO: 91765 - DNA, 25 bp, Mus musculus
ccccgtgcggatctcgcttaagatg

SEQ ID NO: 91766 - DNA, 25 bp, Mus musculus
ccccgtgcggcagaggcagctgttt

SEQ ID NO: 91767 - DNA, 25 bp, Mus musculus
ccccgtgcgtctagtctatttattg

SEQ ID NO: 91768 - DNA, 25 bp, Mus musculus
ccccgtggagactgatgaaggaccc

SEQ ID NO: 91769 - DNA, 25 bp, Mus musculus
ccccgtggagttggtgagaagctta

SEQ ID NO: 91770 - DNA, 25 bp, Mus musculus
ccccgtggcgttgcttaatgatata

SEQ ID NO: 91771 - DNA, 25 bp, Mus musculus
ccccgtgtgcagagttatcgttgct

SEQ ID NO: 91772 - DNA, 25 bp, Mus musculus
ccccgtgtgtgccatctgtctagaa

SEQ ID NO: 91773 - DNA, 25 bp, Mus musculus
cccctccaggagctacatcagatga

SEQ ID NO: 91774 - DNA, 25 bp, Mus musculus
cccctcccagtcaaatgacagtgta

SEQ ID NO: 91775 - DNA, 25 bp, Mus musculus
cccctccgggagtgtctgggtctga

SEQ ID NO: 91776 - DNA, 25 bp, Mus musculus
cccctccgtgcctggaaactgagta

SEQ ID NO: 91777 - DNA, 25 bp, Mus musculus
cccctctggactagggcggcgatgc

SEQ ID NO: 91778 - DNA, 25 bp, Mus musculus
cccctctgttgtagtaaaaggcact

SEQ ID NO: 91779 - DNA, 25 bp, Mus musculus
cccctgaagaagaagttggagtcct

SEQ ID NO: 91780 - DNA, 25 bp, Mus musculus
cccctgacagaggatcatggaccaa

SEQ ID NO: 91781 - DNA, 25 bp, Mus musculus
cccctgagaaaagaagagatgatcc

SEQ ID NO: 91782 - DNA, 25 bp, Mus musculus
cccctgagcagaatggatgatcttg

SEQ ID NO: 91783 - DNA, 25 bp, Mus musculus
cccctgagcttggtgaactatgaga

SEQ ID NO: 91784 - DNA, 25 bp, Mus musculus
cccctgaggcgttgtttgaccggat

SEQ ID NO: 91785 - DNA, 25 bp, Mus musculus
cccctgatgatgatagtgtgaccac

SEQ ID NO: 91786 - DNA, 25 bp, Mus musculus
cccctgattaggttttcaaagtcag

SEQ ID NO: 91787 - DNA, 25 bp, Mus musculus
cccctgattgctggagacagagaag

SEQ ID NO: 91788 - DNA, 25 bp, Mus musculus
cccctgccaggagttgaatttgtgc

SEQ ID NO: 91789 - DNA, 25 bp, Mus musculus
cccctgctcagaataattgtttctt

SEQ ID NO: 91790 - DNA, 25 bp, Mus musculus
cccctgctgctgacgtggagattga

SEQ ID NO: 91791 - DNA, 25 bp, Mus musculus
cccctggagctgagatcacgatgtt

SEQ ID NO: 91792 - DNA, 25 bp, Mus musculus
cccctggatattggctctgtgaaga

SEQ ID NO: 91793 - DNA, 25 bp, Mus musculus
cccctggtgaaagcctgtgtgtttg

SEQ ID NO: 91794 - DNA, 25 bp, Mus musculus
cccctggtgtggcagatttggcctt

SEQ ID NO: 91795 - DNA, 25 bp, Mus musculus
cccctgtgaggaggaacagcaagct

SEQ ID NO: 91796 - DNA, 25 bp, Mus musculus
cccctgttagctgtgtagtcggata

SEQ ID NO: 91797 - DNA, 25 bp, Mus musculus
cccctgtttacagataacgctaact

SEQ ID NO: 91798 - DNA, 25 bp, Mus musculus
ccccttaggtgaggactccatcaag

SEQ ID NO: 91799 - DNA, 25 bp, Mus musculus
ccccttcaagtcagcatatagttct

SEQ ID NO: 91800 - DNA, 25 bp, Mus musculus
ccccttcagcaaatggtggcctcag

SEQ ID NO: 91801 - DNA, 25 bp, Mus musculus
ccccttctctgtaattggaaacaca

SEQ ID NO: 91802 - DNA, 25 bp, Mus musculus
ccccttggtgtggtgacagtgagca

SEQ ID NO: 91803 - DNA, 25 bp, Mus musculus
cccctttggaataagagctgcatat

SEQ ID NO: 91804 - DNA, 25 bp, Mus musculus
ccccttttgagttcgcgggcaaatg

SEQ ID NO: 91805 - DNA, 25 bp, Mus musculus
cccgaaactttgtgggctggcctca

SEQ ID NO: 91806 - DNA, 25 bp, Mus musculus
cccgaaagcgccatcaaagaaggag

SEQ ID NO: 91807 - DNA, 25 bp, Mus musculus
cccgaagaagctgataggattgcct

SEQ ID NO: 91808 - DNA, 25 bp, Mus musculus
cccgaagaagctgggaaatttgtct

SEQ ID NO: 91809 - DNA, 25 bp, Mus musculus
cccgaagatgatgggaatgacctca

SEQ ID NO: 91810 - DNA, 25 bp, Mus musculus
cccgaaggaagcactgagttgagct

SEQ ID NO: 91811 - DNA, 25 bp, Mus musculus
cccgaaggctgcatatgtgtatgac

SEQ ID NO: 91812 - DNA, 25 bp, Mus musculus
cccgaagtttggtatcaggcagcaa

SEQ ID NO: 91813 - DNA, 25 bp, Mus musculus
cccgaatagctatgactggaggcat

SEQ ID NO: 91814 - DNA, 25 bp, Mus musculus
cccgaatggctggtgagcgaggagc

SEQ ID NO: 91815 - DNA, 25 bp, Mus musculus
cccgacacgtgatctggaaccggct

SEQ ID NO: 91816 - DNA, 25 bp, Mus musculus
cccgacagaaggctctgaaaagata

SEQ ID NO: 91817 - DNA, 25 bp, Mus musculus
cccgactcaggtattgagttgctgc

SEQ ID NO: 91818 - DNA, 25 bp, Mus musculus
cccgactccctttcatccaacacag

SEQ ID NO: 91819 - DNA, 25 bp, Mus musculus
cccgacttcgtctgcgccttgatgg

SEQ ID NO: 91820 - DNA, 25 bp, Mus musculus
cccgagaacactacgaggagctgaa

SEQ ID NO: 91821 - DNA, 25 bp, Mus musculus
cccgagacctccgttaaagagatag

SEQ ID NO: 91822 - DNA, 25 bp, Mus musculus
cccgagactgaggtaaaaatggaag

SEQ ID NO: 91823 - DNA, 25 bp, Mus musculus
cccgagagcgccagacaatgtttga

SEQ ID NO: 91824 - DNA, 25 bp, Mus musculus
cccgagagctacatgacgtggacct

SEQ ID NO: 91825 - DNA, 25 bp, Mus musculus
cccgagagtggtgacgaaacgaaga

SEQ ID NO: 91826 - DNA, 25 bp, Mus musculus
cccgagatgaacaggatggagcttc

SEQ ID NO: 91827 - DNA, 25 bp, Mus musculus
cccgagatgcctgaaaatgaagcca

SEQ ID NO: 91828 - DNA, 25 bp, Mus musculus
cccgagatgttgagctttttgtccg

SEQ ID NO: 91829 - DNA, 25 bp, Mus musculus
cccgagcaaggaaggcggccttcca

SEQ ID NO: 91830 - DNA, 25 bp, Mus musculus
cccgagccttctagcctggatgatg

SEQ ID NO: 91831 - DNA, 25 bp, Mus musculus
cccgaggagtgtcttcagcttatca

SEQ ID NO: 91832 - DNA, 25 bp, Mus musculus
cccgaggtgatggaccctggtatca

SEQ ID NO: 91833 - DNA, 25 bp, Mus musculus
cccgagtgattttgcctggaatgac

SEQ ID NO: 91834 - DNA, 25 bp, Mus musculus
cccgagtgctgttggtgcttcgcca

SEQ ID NO: 91835 - DNA, 25 bp, Mus musculus
cccgatagaggtgagagaggccact

SEQ ID NO: 91836 - DNA, 25 bp, Mus musculus
cccgatcgtgcattggagaggctct

SEQ ID NO: 91837 - DNA, 25 bp, Mus musculus
cccgatgctggctccctcattttcc

SEQ ID NO: 91838 - DNA, 25 bp, Mus musculus
cccgatggctgaatacttgaaactg

SEQ ID NO: 91839 - DNA, 25 bp, Mus musculus
cccgatgggcgcacgctcaattgtg

SEQ ID NO: 91840 - DNA, 25 bp, Mus musculus
cccgatgtcgggattaaggtcagca

SEQ ID NO: 91841 - DNA, 25 bp, Mus musculus
cccgatgtgcggatggcttgcgaaa

SEQ ID NO: 91842 - DNA, 25 bp, Mus musculus
cccgatgttggcagaggatgacgtc

SEQ ID NO: 91843 - DNA, 25 bp, Mus musculus
cccgatttaggcaggcttgactggg

SEQ ID NO: 91844 - DNA, 25 bp, Mus musculus
cccgcaaaacttgaatgaatctgat

SEQ ID NO: 91845 - DNA, 25 bp, Mus musculus
cccgcacgagcccaagggtgatttt

SEQ ID NO: 91846 - DNA, 25 bp, Mus musculus
cccgcactatccctcgggagaatat

SEQ ID NO: 91847 - DNA, 25 bp, Mus musculus
cccgcagtagcgtccgcgcgagcgc

SEQ ID NO: 91848 - DNA, 25 bp, Mus musculus
cccgccctgaggatgcaatcgatta

SEQ ID NO: 91849 - DNA, 25 bp, Mus musculus
cccgccgcggggtggtgctctgact

SEQ ID NO: 91850 - DNA, 25 bp, Mus musculus
cccgccgtgcgtactcactggaggg

SEQ ID NO: 91851 - DNA, 25 bp, Mus musculus
cccgcctcagatttgggaagtgact

SEQ ID NO: 91852 - DNA, 25 bp, Mus musculus
cccgcgacgggtcgcagcagttcgt

SEQ ID NO: 91853 - DNA, 25 bp, Mus musculus
cccgcgagattgatgtgataaaaaa

SEQ ID NO: 91854 - DNA, 25 bp, Mus musculus
cccgcgatggtgctgtctcaaggat

SEQ ID NO: 91855 - DNA, 25 bp, Mus musculus
cccgcgcctttgcagaggaggatac

SEQ ID NO: 91856 - DNA, 25 bp, Mus musculus
cccgcgctgttctgtgtgcaaggaa

SEQ ID NO: 91857 - DNA, 25 bp, Mus musculus
cccgcggacctggaaagtgtcttca

SEQ ID NO: 91858 - DNA, 25 bp, Mus musculus
cccgcggctcagtccggagctgtga

SEQ ID NO: 91859 - DNA, 25 bp, Mus musculus
cccgcggtggcttcttgggcgaaca

SEQ ID NO: 91860 - DNA, 25 bp, Mus musculus
cccgcgtagtggagctgaacaagaa

SEQ ID NO: 91861 - DNA, 25 bp, Mus musculus
cccgctacggagtgagaggctgtca

SEQ ID NO: 91862 - DNA, 25 bp, Mus musculus
cccgctacgtggtagacagagctgc

SEQ ID NO: 91863 - DNA, 25 bp, Mus musculus
cccgctccgtcaaggtgaagatcaa

SEQ ID NO: 91864 - DNA, 25 bp, Mus musculus
cccgctgacgctgctggatgctgat

SEQ ID NO: 91865 - DNA, 25 bp, Mus musculus
cccgctgagcaaggagtagtaagaa

SEQ ID NO: 91866 - DNA, 25 bp, Mus musculus
cccgctggcgggttcatggatcctt

SEQ ID NO: 91867 - DNA, 25 bp, Mus musculus
cccgctgtgtgatgaagctaaagaa

SEQ ID NO: 91868 - DNA, 25 bp, Mus musculus
cccgcttcatgatcgagtgtgacat

SEQ ID NO: 91869 - DNA, 25 bp, Mus musculus
cccggaaacactgcaggagtgtggc

SEQ ID NO: 91870 - DNA, 25 bp, Mus musculus
cccggaacactgtgagggtgccatt

SEQ ID NO: 91871 - DNA, 25 bp, Mus musculus
cccggaagaccagcaaacaggtgtt

SEQ ID NO: 91872 - DNA, 25 bp, Mus musculus
cccggaagatggtcactgcctacaa

SEQ ID NO: 91873 - DNA, 25 bp, Mus musculus
cccggaagcttgagctgctcaactg

SEQ ID NO: 91874 - DNA, 25 bp, Mus musculus
cccggaatgacaacatctatgatga

SEQ ID NO: 91875 - DNA, 25 bp, Mus musculus
cccggaatgagctgggagtgtacct

SEQ ID NO: 91876 - DNA, 25 bp, Mus musculus
cccggaccatccaaggactcattga

SEQ ID NO: 91877 - DNA, 25 bp, Mus musculus
cccggagagtggacaacatggttta

SEQ ID NO: 91878 - DNA, 25 bp, Mus musculus
cccggagattcgtaggtggccttag

SEQ ID NO: 91879 - DNA, 25 bp, Mus musculus
cccggatcagccctgctggagccag

SEQ ID NO: 91880 - DNA, 25 bp, Mus musculus
cccggattcccggacggatgagcga

SEQ ID NO: 91881 - DNA, 25 bp, Mus musculus
cccggattgagattggactgcatta

SEQ ID NO: 91882 - DNA, 25 bp, Mus musculus
cccggcaagcggtctaggagaagca

SEQ ID NO: 91883 - DNA, 25 bp, Mus musculus
cccggcagaacagctcagacaaaaa

SEQ ID NO: 91884 - DNA, 25 bp, Mus musculus
cccggccccagctcatttgtgtggt

SEQ ID NO: 91885 - DNA, 25 bp, Mus musculus
cccggcctcaaagctggtttcagag

SEQ ID NO: 91886 - DNA, 25 bp, Mus musculus
cccggcctgatgttgtggagatgca

SEQ ID NO: 91887 - DNA, 25 bp, Mus musculus
cccggcggagacacagggcaaagat

SEQ ID NO: 91888 - DNA, 25 bp, Mus musculus
cccggctctggaggtcctggactta

SEQ ID NO: 91889 - DNA, 25 bp, Mus musculus
cccggctgtctgcatgttctaataa

SEQ ID NO: 91890 - DNA, 25 bp, Mus musculus
cccggctgtgcctgtacgaagatgg

SEQ ID NO: 91891 - DNA, 25 bp, Mus musculus
cccggcttagccttgtatgtgacag

SEQ ID NO: 91892 - DNA, 25 bp, Mus musculus
cccgggaaacaagtatgagacgcgt

SEQ ID NO: 91893 - DNA, 25 bp, Mus musculus
cccgggactacaggaccaataagtg

SEQ ID NO: 91894 - DNA, 25 bp, Mus musculus
cccgggagctatgacaggagtgttt

SEQ ID NO: 91895 - DNA, 25 bp, Mus musculus
cccgggagtggagagtcagctttac

SEQ ID NO: 91896 - DNA, 25 bp, Mus musculus
cccgggatccctgaattgttgagcc

SEQ ID NO: 91897 - DNA, 25 bp, Mus musculus
cccgggatgaaaggaacagattaca

SEQ ID NO: 91898 - DNA, 25 bp, Mus musculus
cccgggatgcggctgttgtctacca

SEQ ID NO: 91899 - DNA, 25 bp, Mus musculus
cccgggattcaactgaagctgccat

SEQ ID NO: 91900 - DNA, 25 bp, Mus musculus
cccgggattttctagtgcgagctca

SEQ ID NO: 91901 - DNA, 25 bp, Mus musculus
cccgggcacagctactgcagaattt

SEQ ID NO: 91902 - DNA, 25 bp, Mus musculus
cccgggcagcggagccgagcagcgg

SEQ ID NO: 91903 - DNA, 25 bp, Mus musculus
cccgggcagttcaaggtgaggtcat

SEQ ID NO: 91904 - DNA, 25 bp, Mus musculus
cccgggctggcattcgagtggtcat

SEQ ID NO: 91905 - DNA, 25 bp, Mus musculus
cccgggtgttcctgcaggagcaaag

SEQ ID NO: 91906 - DNA, 25 bp, Mus musculus
cccggtcactaagatcatgctgtca

SEQ ID NO: 91907 - DNA, 25 bp, Mus musculus
cccggtggattatgcttgggagcca

SEQ ID NO: 91908 - DNA, 25 bp, Mus musculus
cccggtggtaatgaatgggattctt

SEQ ID NO: 91909 - DNA, 25 bp, Mus musculus
cccggtggtttttgcgtgggctcat

SEQ ID NO: 91910 - DNA, 25 bp, Mus musculus
cccggttaaacccagcgagtgagct

SEQ ID NO: 91911 - DNA, 25 bp, Mus musculus
cccggttcccgctgtgctgtggaga

SEQ ID NO: 91912 - DNA, 25 bp, Mus musculus
cccgtcaaagaagggtgcctgagcc

SEQ ID NO: 91913 - DNA, 25 bp, Mus musculus
cccgtcaaccagtcagagttggcta

SEQ ID NO: 91914 - DNA, 25 bp, Mus musculus
cccgtcgcatgctgcagctggttga

SEQ ID NO: 91915 - DNA, 25 bp, Mus musculus
cccgtcgcgcttggcatagaggaaa

SEQ ID NO: 91916 - DNA, 25 bp, Mus musculus
cccgtcggacgcttgttgttgtcgg

SEQ ID NO: 91917 - DNA, 25 bp, Mus musculus
cccgtctgatgctctggtaggcaca

SEQ ID NO: 91918 - DNA, 25 bp, Mus musculus
cccgtctggcaagagggcgctgata

SEQ ID NO: 91919 - DNA, 25 bp, Mus musculus
cccgtgatggcctatgggctgatct

SEQ ID NO: 91920 - DNA, 25 bp, Mus musculus
cccgtgcctgacgatattgatgatg

SEQ ID NO: 91921 - DNA, 25 bp, Mus musculus
cccgtgctgcttggcctgtatgaga

SEQ ID NO: 91922 - DNA, 25 bp, Mus musculus
cccgtggacatggagagtacccgaa

SEQ ID NO: 91923 - DNA, 25 bp, Mus musculus
cccgtggaccgagaggatttaagca

SEQ ID NO: 91924 - DNA, 25 bp, Mus musculus
cccgtggaccttctggtgaacaatg

SEQ ID NO: 91925 - DNA, 25 bp, Mus musculus
cccgtggcctatcgagtcaagtaca

SEQ ID NO: 91926 - DNA, 25 bp, Mus musculus
cccgtggcgggaccagtctgaatct

SEQ ID NO: 91927 - DNA, 25 bp, Mus musculus
cccgtggctcttggctataacctgt

SEQ ID NO: 91928 - DNA, 25 bp, Mus musculus
cccgtgggcgtggtacaaatgacct

SEQ ID NO: 91929 - DNA, 25 bp, Mus musculus
cccgtggtagcatccggcagggaaa

SEQ ID NO: 91930 - DNA, 25 bp, Mus musculus
cccgtggtggactacgcctactgta

SEQ ID NO: 91931 - DNA, 25 bp, Mus musculus
cccgtgtacaggaagagcctgaact

SEQ ID NO: 91932 - DNA, 25 bp, Mus musculus
cccgtgtgatgtcttggagtataga

SEQ ID NO: 91933 - DNA, 25 bp, Mus musculus
cccgtgtttctatagagagcagcca

SEQ ID NO: 91934 - DNA, 25 bp, Mus musculus
cccgttcaaggataagaagacctgc

SEQ ID NO: 91935 - DNA, 25 bp, Mus musculus
cccgttggttacgtcgccggctgtg

SEQ ID NO: 91936 - DNA, 25 bp, Mus musculus
cccgtttgtgctgggaggcaaccta

SEQ ID NO: 91937 - DNA, 25 bp, Mus musculus
ccctaagatgcttcttgaaaagaca

SEQ ID NO: 91938 - DNA, 25 bp, Mus musculus
ccctaagggacaggaaattgcatga

SEQ ID NO: 91939 - DNA, 25 bp, Mus musculus
ccctaagggtgtggacatgatggct

SEQ ID NO: 91940 - DNA, 25 bp, Mus musculus
ccctaagtttatggacacagtggcg

SEQ ID NO: 91941 - DNA, 25 bp, Mus musculus
ccctacactatgcagcctggcaggg

SEQ ID NO: 91942 - DNA, 25 bp, Mus musculus
ccctacagagggtattgctccaatg

SEQ ID NO: 91943 - DNA, 25 bp, Mus musculus
ccctacagcctgatggagcaagaga

SEQ ID NO: 91944 - DNA, 25 bp, Mus musculus
ccctacaggagtgaagaacgtgcca

SEQ ID NO: 91945 - DNA, 25 bp, Mus musculus
ccctacccttctgggcatgagaggg

SEQ ID NO: 91946 - DNA, 25 bp, Mus musculus
ccctacctttcaagacgaagtggca

SEQ ID NO: 91947 - DNA, 25 bp, Mus musculus
ccctacgcggccgcctaagcatgtc

SEQ ID NO: 91948 - DNA, 25 bp, Mus musculus
ccctacgcggtgttgcggaggcaga

SEQ ID NO: 91949 - DNA, 25 bp, Mus musculus
ccctactgaagtgaatctgctgaca

SEQ ID NO: 91950 - DNA, 25 bp, Mus musculus
ccctacttcaaggtcaagaaatgga

SEQ ID NO: 91951 - DNA, 25 bp, Mus musculus
ccctagaaggctgtgtatagtccat

SEQ ID NO: 91952 - DNA, 25 bp, Mus musculus
ccctagagatgaaaatggccgaatt

SEQ ID NO: 91953 - DNA, 25 bp, Mus musculus
ccctagcagtgtgactcaagtggaa

SEQ ID NO: 91954 - DNA, 25 bp, Mus musculus
ccctagcgaaggttgcggtagactc

SEQ ID NO: 91955 - DNA, 25 bp, Mus musculus
ccctagcggtgtggtcaatgaagaa

SEQ ID NO: 91956 - DNA, 25 bp, Mus musculus
ccctagctttggacttgttgatatc

SEQ ID NO: 91957 - DNA, 25 bp, Mus musculus
ccctaggaatcgtgatcggtggact

SEQ ID NO: 91958 - DNA, 25 bp, Mus musculus
ccctaggcacagtggtttggcagca

SEQ ID NO: 91959 - DNA, 25 bp, Mus musculus
ccctaggccgagtgtgagcaccgcc

SEQ ID NO: 91960 - DNA, 25 bp, Mus musculus
ccctagggaggttcgcgctcccgtg

SEQ ID NO: 91961 - DNA, 25 bp, Mus musculus
ccctagtatggccaatgaagaagat

SEQ ID NO: 91962 - DNA, 25 bp, Mus musculus
ccctagtctgtgtctgccatcctga

SEQ ID NO: 91963 - DNA, 25 bp, Mus musculus
ccctagtgaggagattaacggcgtg

SEQ ID NO: 91964 - DNA, 25 bp, Mus musculus
ccctagttctggataatggagctta

SEQ ID NO: 91965 - DNA, 25 bp, Mus musculus
ccctagtttattcatagatcgcagt

SEQ ID NO: 91966 - DNA, 25 bp, Mus musculus
ccctatcacagtagcaggagacagg

SEQ ID NO: 91967 - DNA, 25 bp, Mus musculus
ccctatcattgtggacgcttgcatc

SEQ ID NO: 91968 - DNA, 25 bp, Mus musculus
ccctatgaatgtgcggcgaggcctt

SEQ ID NO: 91969 - DNA, 25 bp, Mus musculus
ccctatgacatggtgcggtccctgt

SEQ ID NO: 91970 - DNA, 25 bp, Mus musculus
ccctattaatgctgtagaggaacaa

SEQ ID NO: 91971 - DNA, 25 bp, Mus musculus
ccctatttggattgttggcagcgaa

SEQ ID NO: 91972 - DNA, 25 bp, Mus musculus
ccctcaagagaggagaagttctacc

SEQ ID NO: 91973 - DNA, 25 bp, Mus musculus
ccctcaccgctgacagatggcagat

SEQ ID NO: 91974 - DNA, 25 bp, Mus musculus
ccctcactggaggaggtcctgcagt

SEQ ID NO: 91975 - DNA, 25 bp, Mus musculus
ccctcaggacaatgtggtagtggac

SEQ ID NO: 91976 - DNA, 25 bp, Mus musculus
ccctcaggacagatatgaaaactca

SEQ ID NO: 91977 - DNA, 25 bp, Mus musculus
ccctcaggaggaataacgggctggt

SEQ ID NO: 91978 - DNA, 25 bp, Mus musculus
ccctcaggttggagtgtggctgcca

SEQ ID NO: 91979 - DNA, 25 bp, Mus musculus
ccctcagtggaactagcgtttcaaa

SEQ ID NO: 91980 - DNA, 25 bp, Mus musculus
ccctcatcgatagctgggtggatat

SEQ ID NO: 91981 - DNA, 25 bp, Mus musculus
ccctcatttttgaatggagtatgga

SEQ ID NO: 91982 - DNA, 25 bp, Mus musculus
ccctccgagaggaagtggatattct

SEQ ID NO: 91983 - DNA, 25 bp, Mus musculus
ccctccggcgtcgccgaggtcgacg

SEQ ID NO: 91984 - DNA, 25 bp, Mus musculus
ccctccgttgagaatggtgttgcac

SEQ ID NO: 91985 - DNA, 25 bp, Mus musculus
ccctcctgaggacttgcatgacaag

SEQ ID NO: 91986 - DNA, 25 bp, Mus musculus
ccctcgagatggaaaggcacccgtt

SEQ ID NO: 91987 - DNA, 25 bp, Mus musculus
ccctcgatagggtgcttggagacaa

SEQ ID NO: 91988 - DNA, 25 bp, Mus musculus
ccctcgatgatggaacttgtgtctt

SEQ ID NO: 91989 - DNA, 25 bp, Mus musculus
ccctcgatgggaagaggactgtaaa

SEQ ID NO: 91990 - DNA, 25 bp, Mus musculus
ccctcggaaggctgacgtgctgaga

SEQ ID NO: 91991 - DNA, 25 bp, Mus musculus
ccctcggagactggcatcattggca

SEQ ID NO: 91992 - DNA, 25 bp, Mus musculus
ccctcggagagaaagcaaggttgca

SEQ ID NO: 91993 - DNA, 25 bp, Mus musculus
ccctcgggcagcaggttggaaagcc

SEQ ID NO: 91994 - DNA, 25 bp, Mus musculus
ccctcggtggaaaatgaatcgccct

SEQ ID NO: 91995 - DNA, 25 bp, Mus musculus
ccctcggtgggaaataagatgctac

SEQ ID NO: 91996 - DNA, 25 bp, Mus musculus
ccctcgtgtgcgcgggacccagcag

SEQ ID NO: 91997 - DNA, 25 bp, Mus musculus
ccctcgtgtgcggtgttgtctgtga

SEQ ID NO: 91998 - DNA, 25 bp, Mus musculus
ccctcgtgtggagcctaagagaaca

SEQ ID NO: 91999 - DNA, 25 bp, Mus musculus
ccctctaggtgctcaggcggatgaa

SEQ ID NO: 92000 - DNA, 25 bp, Mus musculus
ccctctatggctcctggcagcgtgg

SEQ ID NO: 92001 - DNA, 25 bp, Mus musculus
ccctctattgtgctggtggtgctga

SEQ ID NO: 92002 - DNA, 25 bp, Mus musculus
ccctctgaacgaagggacggacgca

SEQ ID NO: 92003 - DNA, 25 bp, Mus musculus
ccctctgagaggttggaagcgctag

SEQ ID NO: 92004 - DNA, 25 bp, Mus musculus
ccctctgatgtaatggaactccgta

SEQ ID NO: 92005 - DNA, 25 bp, Mus musculus
ccctctgctgtgatggagaccctag

SEQ ID NO: 92006 - DNA, 25 bp, Mus musculus
ccctctggaaaaggccatgctgaca

SEQ ID NO: 92007 - DNA, 25 bp, Mus musculus
ccctctggtgtgtgaggaaggaact

SEQ ID NO: 92008 - DNA, 25 bp, Mus musculus
ccctctgtccgtatgcctgtggcaa

SEQ ID NO: 92009 - DNA, 25 bp, Mus musculus
ccctctgtggagtcggtggtccagt

SEQ ID NO: 92010 - DNA, 25 bp, Mus musculus
ccctctgtgtggtgcagtgtctctc

SEQ ID NO: 92011 - DNA, 25 bp, Mus musculus
ccctcttcgacaaggatggagatgg

SEQ ID NO: 92012 - DNA, 25 bp, Mus musculus
ccctcttcgttagcgggttggagct

SEQ ID NO: 92013 - DNA, 25 bp, Mus musculus
ccctcttgatgctggtgtttggaaa

SEQ ID NO: 92014 - DNA, 25 bp, Mus musculus
ccctcttggtggtcacgtccgcggt

SEQ ID NO: 92015 - DNA, 25 bp, Mus musculus
ccctgaaacaacacttctggtctac

SEQ ID NO: 92016 - DNA, 25 bp, Mus musculus
ccctgaaacgtgaccatgtggatcc

SEQ ID NO: 92017 - DNA, 25 bp, Mus musculus
ccctgaaagatctatcatccaagag

SEQ ID NO: 92018 - DNA, 25 bp, Mus musculus
ccctgaacagagtgtcaaatgtgtt

SEQ ID NO: 92019 - DNA, 25 bp, Mus musculus
ccctgaagaaggcaaggcgaaagca

SEQ ID NO: 92020 - DNA, 25 bp, Mus musculus
ccctgaaggcaaacattcgggctgt

SEQ ID NO: 92021 - DNA, 25 bp, Mus musculus
ccctgaaggcatctagaggtctctg

SEQ ID NO: 92022 - DNA, 25 bp, Mus musculus
ccctgacgagcaattggagaccctt

SEQ ID NO: 92023 - DNA, 25 bp, Mus musculus
ccctgacggcgatccgtagcgctgg

SEQ ID NO: 92024 - DNA, 25 bp, Mus musculus
ccctgactgttgatgtggacggagc

SEQ ID NO: 92025 - DNA, 25 bp, Mus musculus
ccctgagaagcgagtggcatactgc

SEQ ID NO: 92026 - DNA, 25 bp, Mus musculus
ccctgagaccctggataagtttgac

SEQ ID NO: 92027 - DNA, 25 bp, Mus musculus
ccctgagaggtccaaggagcctgaa

SEQ ID NO: 92028 - DNA, 25 bp, Mus musculus
ccctgagcatgagtgagatggaccg

SEQ ID NO: 92029 - DNA, 25 bp, Mus musculus
ccctgagccgagagtgctgtgtgac

SEQ ID NO: 92030 - DNA, 25 bp, Mus musculus
ccctgagcggagttactgggttcca

SEQ ID NO: 92031 - DNA, 25 bp, Mus musculus
ccctgaggatggtgttgagttcccc

SEQ ID NO: 92032 - DNA, 25 bp, Mus musculus
ccctgaggctggaaaaaccgagtgc

SEQ ID NO: 92033 - DNA, 25 bp, Mus musculus
ccctgaggtagttaacgatgagtcc

SEQ ID NO: 92034 - DNA, 25 bp, Mus musculus
ccctgatcggcaaaggtggctccaa

SEQ ID NO: 92035 - DNA, 25 bp, Mus musculus
ccctgatctccatgctggtcatctt

SEQ ID NO: 92036 - DNA, 25 bp, Mus musculus
ccctgatgaaatcggcctgatgaac

SEQ ID NO: 92037 - DNA, 25 bp, Mus musculus
ccctgattggaggtggatgtcacac

SEQ ID NO: 92038 - DNA, 25 bp, Mus musculus
ccctgcagatgagacgatgttccct

SEQ ID NO: 92039 - DNA, 25 bp, Mus musculus
ccctgcctgggctcaagcgtgcgga

SEQ ID NO: 92040 - DNA, 25 bp, Mus musculus
ccctgcgaggacgtgagttgcccag

SEQ ID NO: 92041 - DNA, 25 bp, Mus musculus
ccctgcggaaagactgacatgcggg

SEQ ID NO: 92042 - DNA, 25 bp, Mus musculus
ccctgcgggaagaaatggatgaaga

SEQ ID NO: 92043 - DNA, 25 bp, Mus musculus
ccctgcgggacctgggtgtcaagat

SEQ ID NO: 92044 - DNA, 25 bp, Mus musculus
ccctgcgggatggagaactgtttga

SEQ ID NO: 92045 - DNA, 25 bp, Mus musculus
ccctgcgggccttcatgggccgggt

SEQ ID NO: 92046 - DNA, 25 bp, Mus musculus
ccctgcggtgtacctacgtggagaa

SEQ ID NO: 92047 - DNA, 25 bp, Mus musculus
ccctgcgtgctgacgtcaggcgcgt

SEQ ID NO: 92048 - DNA, 25 bp, Mus musculus
ccctgctactgggaggaaacctgtc

SEQ ID NO: 92049 - DNA, 25 bp, Mus musculus
ccctgctggcaagattacgagcttt

SEQ ID NO: 92050 - DNA, 25 bp, Mus musculus
ccctgcttctggtgaacggccaaga

SEQ ID NO: 92051 - DNA, 25 bp, Mus musculus
ccctggaaatcagcaacatcgtctt

SEQ ID NO: 92052 - DNA, 25 bp, Mus musculus
ccctggaaatgccatagaaaagaaa

SEQ ID NO: 92053 - DNA, 25 bp, Mus musculus
ccctggaacaaagatggtgctggcc

SEQ ID NO: 92054 - DNA, 25 bp, Mus musculus
ccctggaaggatttcctcgttggag

SEQ ID NO: 92055 - DNA, 25 bp, Mus musculus
ccctggaatcctcatgactgaagga

SEQ ID NO: 92056 - DNA, 25 bp, Mus musculus
ccctggaatctcagactagttttga

SEQ ID NO: 92057 - DNA, 25 bp, Mus musculus
ccctggacccgagtgttttcatgaa

SEQ ID NO: 92058 - DNA, 25 bp, Mus musculus
ccctggactgtgaggacctactgaa

SEQ ID NO: 92059 - DNA, 25 bp, Mus musculus
ccctggagagttgtcattggccgct

SEQ ID NO: 92060 - DNA, 25 bp, Mus musculus
ccctggagcagcacgtgtgtatggc

SEQ ID NO: 92061 - DNA, 25 bp, Mus musculus
ccctggagctgtggtagttcaattc

SEQ ID NO: 92062 - DNA, 25 bp, Mus musculus
ccctggaggaaaggcgctctagtct

SEQ ID NO: 92063 - DNA, 25 bp, Mus musculus
ccctggaggaacacgcatagacgat

SEQ ID NO: 92064 - DNA, 25 bp, Mus musculus
ccctggaggcgctgttgaagaaagt

SEQ ID NO: 92065 - DNA, 25 bp, Mus musculus
ccctggagttgctctggctcagtta

SEQ ID NO: 92066 - DNA, 25 bp, Mus musculus
ccctggatcatgctcgggctcagat

SEQ ID NO: 92067 - DNA, 25 bp, Mus musculus
ccctggatgaagctgaccgcatgat

SEQ ID NO: 92068 - DNA, 25 bp, Mus musculus
ccctggatgaggtagagctgcactt

SEQ ID NO: 92069 - DNA, 25 bp, Mus musculus
ccctggcacccgcaagattgagtta

SEQ ID NO: 92070 - DNA, 25 bp, Mus musculus
ccctggccaggaaatgatcatagaa

SEQ ID NO: 92071 - DNA, 25 bp, Mus musculus
ccctggcgaacatctacttggagtc

SEQ ID NO: 92072 - DNA, 25 bp, Mus musculus
ccctggcgagttagaagctgcccct

SEQ ID NO: 92073 - DNA, 25 bp, Mus musculus
ccctggcgccatgccacgaggcatg

SEQ ID NO: 92074 - DNA, 25 bp, Mus musculus
ccctggcggagcatgactggtacca

SEQ ID NO: 92075 - DNA, 25 bp, Mus musculus
ccctggcggaggctttgaacgctct

SEQ ID NO: 92076 - DNA, 25 bp, Mus musculus
ccctggctataaggtgaaacagcga

SEQ ID NO: 92077 - DNA, 25 bp, Mus musculus
ccctggctgcaaaggtcagcatttg

SEQ ID NO: 92078 - DNA, 25 bp, Mus musculus
ccctggctgccatgaatgggcggaa

SEQ ID NO: 92079 - DNA, 25 bp, Mus musculus
ccctggctggtcgacaatgatggca

SEQ ID NO: 92080 - DNA, 25 bp, Mus musculus
ccctgggagacctgtacatagtgta

SEQ ID NO: 92081 - DNA, 25 bp, Mus musculus
ccctgggagcttacacttagtcctg

SEQ ID NO: 92082 - DNA, 25 bp, Mus musculus
ccctgggatggcagagcaacctatt

SEQ ID NO: 92083 - DNA, 25 bp, Mus musculus
ccctgggcactggaaatgatctggc

SEQ ID NO: 92084 - DNA, 25 bp, Mus musculus
ccctgggcagcaacaaagagaactc

SEQ ID NO: 92085 - DNA, 25 bp, Mus musculus
ccctgggcatgtacaagcaagctga

SEQ ID NO: 92086 - DNA, 25 bp, Mus musculus
ccctgggctgctgaaataataaact

SEQ ID NO: 92087 - DNA, 25 bp, Mus musculus
ccctgggtaaggactgcatcgtgca

SEQ ID NO: 92088 - DNA, 25 bp, Mus musculus
ccctgggtaggcgtatgaaaactgc

SEQ ID NO: 92089 - DNA, 25 bp, Mus musculus
ccctgggtgaccagtacgtgaagga

SEQ ID NO: 92090 - DNA, 25 bp, Mus musculus
ccctgggtgtaaattctcataagag

SEQ ID NO: 92091 - DNA, 25 bp, Mus musculus
ccctggtagcagctcacagtgccta

SEQ ID NO: 92092 - DNA, 25 bp, Mus musculus
ccctggtagggtgtatctacatagc

SEQ ID NO: 92093 - DNA, 25 bp, Mus musculus
ccctggtatctcctggctttccttg

SEQ ID NO: 92094 - DNA, 25 bp, Mus musculus
ccctggtcaacaagaagaatgcgct

SEQ ID NO: 92095 - DNA, 25 bp, Mus musculus
ccctggtcagtacgtgtggcctaaa

SEQ ID NO: 92096 - DNA, 25 bp, Mus musculus
ccctggtgccactgcgtagtgttca

SEQ ID NO: 92097 - DNA, 25 bp, Mus musculus
ccctggtggaaaggcaaaatgacca

SEQ ID NO: 92098 - DNA, 25 bp, Mus musculus
ccctggtggacgattgctgggacac

SEQ ID NO: 92099 - DNA, 25 bp, Mus musculus
ccctggtgttagtggcagagttacc

SEQ ID NO: 92100 - DNA, 25 bp, Mus musculus
ccctgtacggcaccgctctcttttc

SEQ ID NO: 92101 - DNA, 25 bp, Mus musculus
ccctgtacgttgcatgctggaccga

SEQ ID NO: 92102 - DNA, 25 bp, Mus musculus
ccctgtaggagtggttggtccagtc

SEQ ID NO: 92103 - DNA, 25 bp, Mus musculus
ccctgtatgctgtgcttgtcagtac

SEQ ID NO: 92104 - DNA, 25 bp, Mus musculus
ccctgtattggttgtgtgcatgcca

SEQ ID NO: 92105 - DNA, 25 bp, Mus musculus
ccctgtatttacgtggctgcgcata

SEQ ID NO: 92106 - DNA, 25 bp, Mus musculus
ccctgtcaactgaggtggagccaaa

SEQ ID NO: 92107 - DNA, 25 bp, Mus musculus
ccctgtcatgtcagtgtgattaaca

SEQ ID NO: 92108 - DNA, 25 bp, Mus musculus
ccctgtcctggaagcaaaaaggaag

SEQ ID NO: 92109 - DNA, 25 bp, Mus musculus
ccctgtcctggagagcaagattcaa

SEQ ID NO: 92110 - DNA, 25 bp, Mus musculus
ccctgtcgtcggaggctggtacaaa

SEQ ID NO: 92111 - DNA, 25 bp, Mus musculus
ccctgtgaagagaggtgagatccca

SEQ ID NO: 92112 - DNA, 25 bp, Mus musculus
ccctgtgcaggaaccagtagaacct

SEQ ID NO: 92113 - DNA, 25 bp, Mus musculus
ccctgtgcggatggaaagatgttcc

SEQ ID NO: 92114 - DNA, 25 bp, Mus musculus
ccctgtgctagagctgctggttaga

SEQ ID NO: 92115 - DNA, 25 bp, Mus musculus
ccctgtggaggaaaccttgggcgca

SEQ ID NO: 92116 - DNA, 25 bp, Mus musculus
ccctgtgggaggcaataaagacaag

SEQ ID NO: 92117 - DNA, 25 bp, Mus musculus
ccctgtgggtcactggcgagtctct

SEQ ID NO: 92118 - DNA, 25 bp, Mus musculus
ccctgtgtaccggatggtggattag

SEQ ID NO: 92119 - DNA, 25 bp, Mus musculus
ccctgtgtccgaaggagatgctcta

SEQ ID NO: 92120 - DNA, 25 bp, Mus musculus
ccctgtgtggtaagagcaagcattt

SEQ ID NO: 92121 - DNA, 25 bp, Mus musculus
ccctgttcacactaggtgtttccta

SEQ ID NO: 92122 - DNA, 25 bp, Mus musculus
ccctgttgctggagcgctgcagagt

SEQ ID NO: 92123 - DNA, 25 bp, Mus musculus
ccctgttggaaagatggataatacc

SEQ ID NO: 92124 - DNA, 25 bp, Mus musculus
ccctgttggaagtcggcacctatga

SEQ ID NO: 92125 - DNA, 25 bp, Mus musculus
ccctgttgggccaggtgttccaggt

SEQ ID NO: 92126 - DNA, 25 bp, Mus musculus
cccttaagaggaggttggagcagaa

SEQ ID NO: 92127 - DNA, 25 bp, Mus musculus
cccttacgagatggcattgatgacc

SEQ ID NO: 92128 - DNA, 25 bp, Mus musculus
cccttacgtggagaagtatagacct

SEQ ID NO: 92129 - DNA, 25 bp, Mus musculus
cccttagcagtgatgggtagcacca

SEQ ID NO: 92130 - DNA, 25 bp, Mus musculus
cccttatagtggctttggctacgga

SEQ ID NO: 92131 - DNA, 25 bp, Mus musculus
cccttatgatcaagagcgttcagaa

SEQ ID NO: 92132 - DNA, 25 bp, Mus musculus
cccttcagagtactgctggtcctca

SEQ ID NO: 92133 - DNA, 25 bp, Mus musculus
cccttcagcaaatggtggcctcagg

SEQ ID NO: 92134 - DNA, 25 bp, Mus musculus
cccttcagtgttgtacggcgatgta

SEQ ID NO: 92135 - DNA, 25 bp, Mus musculus
cccttcattctgagctgtaggccag

SEQ ID NO: 92136 - DNA, 25 bp, Mus musculus
cccttctcaggatgatcctggccta

SEQ ID NO: 92137 - DNA, 25 bp, Mus musculus
cccttgaacggagaatagagtacat

SEQ ID NO: 92138 - DNA, 25 bp, Mus musculus
cccttgactgaactgtgaaaccgag

SEQ ID NO: 92139 - DNA, 25 bp, Mus musculus
cccttgaggcggatgatgaaaaatc

SEQ ID NO: 92140 - DNA, 25 bp, Mus musculus
cccttgcatagcgtgcacagatgtc

SEQ ID NO: 92141 - DNA, 25 bp, Mus musculus
cccttgcggaatgagagcctccagt

SEQ ID NO: 92142 - DNA, 25 bp, Mus musculus
cccttgctgaactagggtgggatga

SEQ ID NO: 92143 - DNA, 25 bp, Mus musculus
cccttggctggaagagctccttacg

SEQ ID NO: 92144 - DNA, 25 bp, Mus musculus
cccttggtcacagctaaaaggagcc

SEQ ID NO: 92145 - DNA, 25 bp, Mus musculus
cccttgtcctctgagtaaatatttg

SEQ ID NO: 92146 - DNA, 25 bp, Mus musculus
cccttgttgaaacggatgagacacc

SEQ ID NO: 92147 - DNA, 25 bp, Mus musculus
cccttgttttggacagatacgcctt

SEQ ID NO: 92148 - DNA, 25 bp, Mus musculus
ccctttagagggaggtgagattgcc

SEQ ID NO: 92149 - DNA, 25 bp, Mus musculus
ccctttagggaagtagctgcagcca

SEQ ID NO: 92150 - DNA, 25 bp, Mus musculus
ccctttagtgtagaatgtcatgcag

SEQ ID NO: 92151 - DNA, 25 bp, Mus musculus
ccctttctcctccagtatgtggtca

SEQ ID NO: 92152 - DNA, 25 bp, Mus musculus
ccctttgaagagaatcgaggccgtg

SEQ ID NO: 92153 - DNA, 25 bp, Mus musculus
ccctttgaggctggcgttgaaccgc

SEQ ID NO: 92154 - DNA, 25 bp, Mus musculus
ccctttgcagggaagtgcattgaga

SEQ ID NO: 92155 - DNA, 25 bp, Mus musculus
ccctttgctcctgaactgctttgga

SEQ ID NO: 92156 - DNA, 25 bp, Mus musculus
ccctttggatgctaagctcgtgtct

SEQ ID NO: 92157 - DNA, 25 bp, Mus musculus
ccctttggcctaattaagtgtgctg

SEQ ID NO: 92158 - DNA, 25 bp, Mus musculus
ccctttggcgcagtgaacaacgtca

SEQ ID NO: 92159 - DNA, 25 bp, Mus musculus
ccctttgggcctgatgacagatttt

SEQ ID NO: 92160 - DNA, 25 bp, Mus musculus
cccttttcactgtaggctggcagca

SEQ ID NO: 92161 - DNA, 25 bp, Mus musculus
ccgaaaaattcagagcttaggagac

SEQ ID NO: 92162 - DNA, 25 bp, Mus musculus
ccgaaagctccgtgaggtggaacag

SEQ ID NO: 92163 - DNA, 25 bp, Mus musculus
ccgaacggcttttcgagatggaaca

SEQ ID NO: 92164 - DNA, 25 bp, Mus musculus
ccgaagaaccttgagggctatgtgg

SEQ ID NO: 92165 - DNA, 25 bp, Mus musculus
ccgaagacggacagctgattgttga

SEQ ID NO: 92166 - DNA, 25 bp, Mus musculus
ccgaagactacgtggaactggtgca

SEQ ID NO: 92167 - DNA, 25 bp, Mus musculus
ccgaagaggattggcttatggacac

SEQ ID NO: 92168 - DNA, 25 bp, Mus musculus
ccgaagaggcaaatgtgaacgacta

SEQ ID NO: 92169 - DNA, 25 bp, Mus musculus
ccgaagagtcgtgcagtacggtgca

SEQ ID NO: 92170 - DNA, 25 bp, Mus musculus
ccgaagcccttgtcctctgagtaaa

SEQ ID NO: 92171 - DNA, 25 bp, Mus musculus
ccgaagcgatgggaagacctgtgca

SEQ ID NO: 92172 - DNA, 25 bp, Mus musculus
ccgaagctgaaagtctgtctctgag

SEQ ID NO: 92173 - DNA, 25 bp, Mus musculus
ccgaagctggatagagggactcacg

SEQ ID NO: 92174 - DNA, 25 bp, Mus musculus
ccgaaggagcggaaagagccaagtt

SEQ ID NO: 92175 - DNA, 25 bp, Mus musculus
ccgaaggatgactgggctgccctga

SEQ ID NO: 92176 - DNA, 25 bp, Mus musculus
ccgaaggcaacagtgatcatggcga

SEQ ID NO: 92177 - DNA, 25 bp, Mus musculus
ccgaaggcaccacggccactgagaa

SEQ ID NO: 92178 - DNA, 25 bp, Mus musculus
ccgaaggttgtgatattaggtccgc

SEQ ID NO: 92179 - DNA, 25 bp, Mus musculus
ccgaatgcatgggaaaggactggcc

SEQ ID NO: 92180 - DNA, 25 bp, Mus musculus
ccgaatgggtgaaattctgccggca

SEQ ID NO: 92181 - DNA, 25 bp, Mus musculus
ccgaattaacgagaggatgccacct

SEQ ID NO: 92182 - DNA, 25 bp, Mus musculus
ccgacaagacttggctctgagctca

SEQ ID NO: 92183 - DNA, 25 bp, Mus musculus
ccgacaatgtggtccggaaacaggc

SEQ ID NO: 92184 - DNA, 25 bp, Mus musculus
ccgacacgggctctgtgtacgtgct

SEQ ID NO: 92185 - DNA, 25 bp, Mus musculus
ccgacactggcaagatgcaggccct

SEQ ID NO: 92186 - DNA, 25 bp, Mus musculus
ccgacacttgtcgtgagaaggaaga

SEQ ID NO: 92187 - DNA, 25 bp, Mus musculus
ccgacagaggctttccacaaagatg

SEQ ID NO: 92188 - DNA, 25 bp, Mus musculus
ccgacagcagcgacgaaaagatcct

SEQ ID NO: 92189 - DNA, 25 bp, Mus musculus
ccgacagcatgtggagacgttcttc

SEQ ID NO: 92190 - DNA, 25 bp, Mus musculus
ccgacagggatccatgtggtcatca

SEQ ID NO: 92191 - DNA, 25 bp, Mus musculus
ccgacatccgagagggacaagtgtt

SEQ ID NO: 92192 - DNA, 25 bp, Mus musculus
ccgacatggtcaccccaggcagcct

SEQ ID NO: 92193 - DNA, 25 bp, Mus musculus
ccgaccaaggaaacacagagaactg

SEQ ID NO: 92194 - DNA, 25 bp, Mus musculus
ccgaccatgtgcaacagctgaggaa

SEQ ID NO: 92195 - DNA, 25 bp, Mus musculus
ccgaccccttggcttacactgtgtg

SEQ ID NO: 92196 - DNA, 25 bp, Mus musculus
ccgacccggagaagcttgaacttga

SEQ ID NO: 92197 - DNA, 25 bp, Mus musculus
ccgaccgaagcaaaacgagggagct

SEQ ID NO: 92198 - DNA, 25 bp, Mus musculus
ccgacgaatatatctggccaatgag

SEQ ID NO: 92199 - DNA, 25 bp, Mus musculus
ccgacgccggcgcttttcagtttgc

SEQ ID NO: 92200 - DNA, 25 bp, Mus musculus
ccgacgtcaattccagagccttcga

SEQ ID NO: 92201 - DNA, 25 bp, Mus musculus
ccgactacagagtgtcaatagagac

SEQ ID NO: 92202 - DNA, 25 bp, Mus musculus
ccgactccgatgttgagggctacgt

SEQ ID NO: 92203 - DNA, 25 bp, Mus musculus
ccgactgagagatcgctgagctgcg

SEQ ID NO: 92204 - DNA, 25 bp, Mus musculus
ccgactgcgccaggccggactctgg

SEQ ID NO: 92205 - DNA, 25 bp, Mus musculus
ccgagaacaagtgaataaggcctat

SEQ ID NO: 92206 - DNA, 25 bp, Mus musculus
ccgagaagcatggtggccgtacgat

SEQ ID NO: 92207 - DNA, 25 bp, Mus musculus
ccgagaagtactgcggcaccttaga

SEQ ID NO: 92208 - DNA, 25 bp, Mus musculus
ccgagaagttaagctgcggacccac

SEQ ID NO: 92209 - DNA, 25 bp, Mus musculus
ccgagaatgcacatgaatgatgggc

SEQ ID NO: 92210 - DNA, 25 bp, Mus musculus
ccgagacactaaagggagaatggca

SEQ ID NO: 92211 - DNA, 25 bp, Mus musculus
ccgagacagccgcaaagagagacta

SEQ ID NO: 92212 - DNA, 25 bp, Mus musculus
ccgagaccggagtagtggctatcca

SEQ ID NO: 92213 - DNA, 25 bp, Mus musculus
ccgagaccttgagttggctgtgcca

SEQ ID NO: 92214 - DNA, 25 bp, Mus musculus
ccgagacgatgagaagtgagccaca

SEQ ID NO: 92215 - DNA, 25 bp, Mus musculus
ccgagagaacgcttgagttggccca

SEQ ID NO: 92216 - DNA, 25 bp, Mus musculus
ccgagagtgacaaccgtcagggcgc

SEQ ID NO: 92217 - DNA, 25 bp, Mus musculus
ccgagagttgtttgctgctgctgcg

SEQ ID NO: 92218 - DNA, 25 bp, Mus musculus
ccgagatccaagagctaagacaagt

SEQ ID NO: 92219 - DNA, 25 bp, Mus musculus
ccgagatcttgtggtcatgctgcac

SEQ ID NO: 92220 - DNA, 25 bp, Mus musculus
ccgagattgtgcctgttcccaggaa

SEQ ID NO: 92221 - DNA, 25 bp, Mus musculus
ccgagcactgaaggaggcaaaatct

SEQ ID NO: 92222 - DNA, 25 bp, Mus musculus
ccgagcacttgagccagatgacaga

SEQ ID NO: 92223 - DNA, 25 bp, Mus musculus
ccgagccatgagagaactggacagg

SEQ ID NO: 92224 - DNA, 25 bp, Mus musculus
ccgagcgaagctgggagatgcatct

SEQ ID NO: 92225 - DNA, 25 bp, Mus musculus
ccgaggacaaggaactggaagcgaa

SEQ ID NO: 92226 - DNA, 25 bp, Mus musculus
ccgaggacacgaggaaaggaagact

SEQ ID NO: 92227 - DNA, 25 bp, Mus musculus
ccgaggaggctacaaagtccagcta

SEQ ID NO: 92228 - DNA, 25 bp, Mus musculus
ccgaggagggtcatccactttgtca

SEQ ID NO: 92229 - DNA, 25 bp, Mus musculus
ccgaggaggtaacatccgagggcga

SEQ ID NO: 92230 - DNA, 25 bp, Mus musculus
ccgaggatcgatcagctgctgagca

SEQ ID NO: 92231 - DNA, 25 bp, Mus musculus
ccgaggcagtgggacgtttagctac

SEQ ID NO: 92232 - DNA, 25 bp, Mus musculus
ccgaggccctcatgggcggagcaat

SEQ ID NO: 92233 - DNA, 25 bp, Mus musculus
ccgaggcggtcagggctgtcattcc

SEQ ID NO: 92234 - DNA, 25 bp, Mus musculus
ccgaggctggcctgaggagtcggcg

SEQ ID NO: 92235 - DNA, 25 bp, Mus musculus
ccgaggcttcattgaggacgtcaca

SEQ ID NO: 92236 - DNA, 25 bp, Mus musculus
ccgagggaccaaggatttaactgca

SEQ ID NO: 92237 - DNA, 25 bp, Mus musculus
ccgagggcaaaagttgcgagccgcc

SEQ ID NO: 92238 - DNA, 25 bp, Mus musculus
ccgaggtgcgggatgtcttcttcaa

SEQ ID NO: 92239 - DNA, 25 bp, Mus musculus
ccgaggtggagcagagtacggcctt

SEQ ID NO: 92240 - DNA, 25 bp, Mus musculus
ccgaggtgttcatttagctggccca

SEQ ID NO: 92241 - DNA, 25 bp, Mus musculus
ccgaggttgaagataaaacgttgca

SEQ ID NO: 92242 - DNA, 25 bp, Mus musculus
ccgaggttgtgaaacgatgccctaa

SEQ ID NO: 92243 - DNA, 25 bp, Mus musculus
ccgagtacacagaccccaaggtggt

SEQ ID NO: 92244 - DNA, 25 bp, Mus musculus
ccgagtatgaggcaattgtacaaga

SEQ ID NO: 92245 - DNA, 25 bp, Mus musculus
ccgagtctgctcacacaggcggcga

SEQ ID NO: 92246 - DNA, 25 bp, Mus musculus
ccgagtgagccatacatagtccaga

SEQ ID NO: 92247 - DNA, 25 bp, Mus musculus
ccgagtgaggtcagtcctggagcct

SEQ ID NO: 92248 - DNA, 25 bp, Mus musculus
ccgagtgccaatgggagcggatccc

SEQ ID NO: 92249 - DNA, 25 bp, Mus musculus
ccgagttacaccaaccaggacagaa

SEQ ID NO: 92250 - DNA, 25 bp, Mus musculus
ccgagttgtgcagtgtgtggaccat

SEQ ID NO: 92251 - DNA, 25 bp, Mus musculus
ccgatacaagggtggaagacattcc

SEQ ID NO: 92252 - DNA, 25 bp, Mus musculus
ccgatatattgaggaactggccaga

SEQ ID NO: 92253 - DNA, 25 bp, Mus musculus
ccgatatgacactggccaaggagga

SEQ ID NO: 92254 - DNA, 25 bp, Mus musculus
ccgatcagaaccaaagtgggaggtg

SEQ ID NO: 92255 - DNA, 25 bp, Mus musculus
ccgatgaagaaagtggagcccctgt

SEQ ID NO: 92256 - DNA, 25 bp, Mus musculus
ccgatgactgtaatgtggaaggagc

SEQ ID NO: 92257 - DNA, 25 bp, Mus musculus
ccgatgattaccactccgaggagaa

SEQ ID NO: 92258 - DNA, 25 bp, Mus musculus
ccgatgccaatgagaacctgtgcga

SEQ ID NO: 92259 - DNA, 25 bp, Mus musculus
ccgatgctggctccctcattttcca

SEQ ID NO: 92260 - DNA, 25 bp, Mus musculus
ccgatggcactctgaagcgggcaga

SEQ ID NO: 92261 - DNA, 25 bp, Mus musculus
ccgatggcattcctgtcaagagaga

SEQ ID NO: 92262 - DNA, 25 bp, Mus musculus
ccgatggctgtctgtcctgagtaat

SEQ ID NO: 92263 - DNA, 25 bp, Mus musculus
ccgatgggaggttttgtcagctaca

SEQ ID NO: 92264 - DNA, 25 bp, Mus musculus
ccgatgtggtggatacgctgaagca

SEQ ID NO: 92265 - DNA, 25 bp, Mus musculus
ccgattcgagcagctgggcaagacg

SEQ ID NO: 92266 - DNA, 25 bp, Mus musculus
ccgattgctgagaggaactggaaga

SEQ ID NO: 92267 - DNA, 25 bp, Mus musculus
ccgattgtggtagctaggaggatcc

SEQ ID NO: 92268 - DNA, 25 bp, Mus musculus
ccgatttgcgtctccgtggacatca

SEQ ID NO: 92269 - DNA, 25 bp, Mus musculus
ccgcaaacagcagaatgtggaccgt

SEQ ID NO: 92270 - DNA, 25 bp, Mus musculus
ccgcaagatgcagccggatcagcag

SEQ ID NO: 92271 - DNA, 25 bp, Mus musculus
ccgcaagatggaatacaagggcagc

SEQ ID NO: 92272 - DNA, 25 bp, Mus musculus
ccgcaagcgactggaggacttattt

SEQ ID NO: 92273 - DNA, 25 bp, Mus musculus
ccgcaagctccggttgaaagacaag

SEQ ID NO: 92274 - DNA, 25 bp, Mus musculus
ccgcaaggagtttggaggccctgat

SEQ ID NO: 92275 - DNA, 25 bp, Mus musculus
ccgcaagtgctaccgcatggttgga

SEQ ID NO: 92276 - DNA, 25 bp, Mus musculus
ccgcaagttgcgagcgcactctgcg

SEQ ID NO: 92277 - DNA, 25 bp, Mus musculus
ccgcactagaggaggtcagagacaa

SEQ ID NO: 92278 - DNA, 25 bp, Mus musculus
ccgcagaaatggagagtggagctca

SEQ ID NO: 92279 - DNA, 25 bp, Mus musculus
ccgcagacatctggctatgaacctg

SEQ ID NO: 92280 - DNA, 25 bp, Mus musculus
ccgcagatctagtataagggcagcc

SEQ ID NO: 92281 - DNA, 25 bp, Mus musculus
ccgcagcaagcgatgagattatgta

SEQ ID NO: 92282 - DNA, 25 bp, Mus musculus
ccgcagcagcgtcttttagaaggac

SEQ ID NO: 92283 - DNA, 25 bp, Mus musculus
ccgcagcgccatgttggatgctctg

SEQ ID NO: 92284 - DNA, 25 bp, Mus musculus
ccgcatcctgactctagtgctacag

SEQ ID NO: 92285 - DNA, 25 bp, Mus musculus
ccgcatgagaccttcggctttaagg

SEQ ID NO: 92286 - DNA, 25 bp, Mus musculus
ccgcatgcgtccgaagctggaaatg

SEQ ID NO: 92287 - DNA, 25 bp, Mus musculus
ccgccacacgagtggaggtgtcagt

SEQ ID NO: 92288 - DNA, 25 bp, Mus musculus
ccgccaccgaggtagtgatgggcaa

SEQ ID NO: 92289 - DNA, 25 bp, Mus musculus
ccgccaggagctgattcacatcgag

SEQ ID NO: 92290 - DNA, 25 bp, Mus musculus
ccgccagggcaaagtgattggcata

SEQ ID NO: 92291 - DNA, 25 bp, Mus musculus
ccgccagggcctggttgaggatcta

SEQ ID NO: 92292 - DNA, 25 bp, Mus musculus
ccgccagtcagtgccacgagttgaa

SEQ ID NO: 92293 - DNA, 25 bp, Mus musculus
ccgccatgaatgaggaatacgacgt

SEQ ID NO: 92294 - DNA, 25 bp, Mus musculus
ccgccatgatcctgctggaggtgaa

SEQ ID NO: 92295 - DNA, 25 bp, Mus musculus
ccgccattttctcgccgcttgtgtg

SEQ ID NO: 92296 - DNA, 25 bp, Mus musculus
ccgcccacgtggcaacaaggatatg

SEQ ID NO: 92297 - DNA, 25 bp, Mus musculus
ccgcccatccggaggaggagtaagt

SEQ ID NO: 92298 - DNA, 25 bp, Mus musculus
ccgcccctcagaaattacaaatacg

SEQ ID NO: 92299 - DNA, 25 bp, Mus musculus
ccgcccttacatggcacgtgtgagg

SEQ ID NO: 92300 - DNA, 25 bp, Mus musculus
ccgccgaaacttgtgctaaactgga

SEQ ID NO: 92301 - DNA, 25 bp, Mus musculus
ccgccgaggtacagccagggttaga

SEQ ID NO: 92302 - DNA, 25 bp, Mus musculus
ccgccgcactttgggaagagctgct

SEQ ID NO: 92303 - DNA, 25 bp, Mus musculus
ccgccgccaggtgaagaacattgtt

SEQ ID NO: 92304 - DNA, 25 bp, Mus musculus
ccgccgccatgatcctgctggaggt

SEQ ID NO: 92305 - DNA, 25 bp, Mus musculus
ccgccgccatgtccggccgttcggt

SEQ ID NO: 92306 - DNA, 25 bp, Mus musculus
ccgccgccggagctgcggacggttt

SEQ ID NO: 92307 - DNA, 25 bp, Mus musculus
ccgccgcgctgtgagagcggagcgg

SEQ ID NO: 92308 - DNA, 25 bp, Mus musculus
ccgccgcgttgtggttatcgagtcg

SEQ ID NO: 92309 - DNA, 25 bp, Mus musculus
ccgccgctcagggtgtaagtcaatg

SEQ ID NO: 92310 - DNA, 25 bp, Mus musculus
ccgccgctgcttggtgctaatgaga

SEQ ID NO: 92311 - DNA, 25 bp, Mus musculus
ccgccggcatgatgtttggcttcca

SEQ ID NO: 92312 - DNA, 25 bp, Mus musculus
ccgccgtcctatgagcagagctgtg

SEQ ID NO: 92313 - DNA, 25 bp, Mus musculus
ccgccgtgatcagttggactaagga

SEQ ID NO: 92314 - DNA, 25 bp, Mus musculus
ccgccgtgtgggaggagaaaaatca

SEQ ID NO: 92315 - DNA, 25 bp, Mus musculus
ccgcctaggccagagtcgtgaggaa

SEQ ID NO: 92316 - DNA, 25 bp, Mus musculus
ccgcctcatagattcaatgaccaaa

SEQ ID NO: 92317 - DNA, 25 bp, Mus musculus
ccgcctcctgaccaaatatgcagaa

SEQ ID NO: 92318 - DNA, 25 bp, Mus musculus
ccgcctcgggcgcagattctttgca

SEQ ID NO: 92319 - DNA, 25 bp, Mus musculus
ccgcctgcgccaaaggctgtgacta

SEQ ID NO: 92320 - DNA, 25 bp, Mus musculus
ccgcctggcagagcgggcgggtcga

SEQ ID NO: 92321 - DNA, 25 bp, Mus musculus
ccgcctgggccaagatatcatcgat

SEQ ID NO: 92322 - DNA, 25 bp, Mus musculus
ccgcctgtttgttacgatgcagata

SEQ ID NO: 92323 - DNA, 25 bp, Mus musculus
ccgccttggagagccgactggatgt

SEQ ID NO: 92324 - DNA, 25 bp, Mus musculus
ccgcgagcaggagaataagtacata

SEQ ID NO: 92325 - DNA, 25 bp, Mus musculus
ccgcgaggcctttcttgaggaggtc

SEQ ID NO: 92326 - DNA, 25 bp, Mus musculus
ccgcgatccctactgtgcctgggat

SEQ ID NO: 92327 - DNA, 25 bp, Mus musculus
ccgcgatgagtcttttgaggttaca

SEQ ID NO: 92328 - DNA, 25 bp, Mus musculus
ccgcgcaggtctcgccgtcagggtt

SEQ ID NO: 92329 - DNA, 25 bp, Mus musculus
ccgcgcctgtggaattttcatggag

SEQ ID NO: 92330 - DNA, 25 bp, Mus musculus
ccgcgcgttgccaggttataacgta

SEQ ID NO: 92331 - DNA, 25 bp, Mus musculus
ccgcgctatgggagaagagaaatac

SEQ ID NO: 92332 - DNA, 25 bp, Mus musculus
ccgcggagctggaatgactggcaac

SEQ ID NO: 92333 - DNA, 25 bp, Mus musculus
ccgcgtcttgggagcactgtcccgg

SEQ ID NO: 92334 - DNA, 25 bp, Mus musculus
ccgctaccgagaagggcgccgcttc

SEQ ID NO: 92335 - DNA, 25 bp, Mus musculus
ccgctacctccaggcaacctggtgg

SEQ ID NO: 92336 - DNA, 25 bp, Mus musculus
ccgctcgtgggaaagagtgtccgct

SEQ ID NO: 92337 - DNA, 25 bp, Mus musculus
ccgctctgcactaccgcgtgggtgg

SEQ ID NO: 92338 - DNA, 25 bp, Mus musculus
ccgctctgctggttgggcctctggt

SEQ ID NO: 92339 - DNA, 25 bp, Mus musculus
ccgctctgtacccttcattcatgtg

SEQ ID NO: 92340 - DNA, 25 bp, Mus musculus
ccgctctgtgaaggtgtggaatgca

SEQ ID NO: 92341 - DNA, 25 bp, Mus musculus
ccgctgacagggtcatacaagatga

SEQ ID NO: 92342 - DNA, 25 bp, Mus musculus
ccgctgagaggctccgggaaaccga

SEQ ID NO: 92343 - DNA, 25 bp, Mus musculus
ccgctgcaagctgggcgactttgga

SEQ ID NO: 92344 - DNA, 25 bp, Mus musculus
ccgctgcgggactctgagctagcac

SEQ ID NO: 92345 - DNA, 25 bp, Mus musculus
ccgctgctgatgtccagaggagtag

SEQ ID NO: 92346 - DNA, 25 bp, Mus musculus
ccgctgctgctggactcgagtctgg

SEQ ID NO: 92347 - DNA, 25 bp, Mus musculus
ccgctgctgctttgaaacgtacaat

SEQ ID NO: 92348 - DNA, 25 bp, Mus musculus
ccgctggcacggaagagactgtcct

SEQ ID NO: 92349 - DNA, 25 bp, Mus musculus
ccgctggctgggaccgtgcacttgc

SEQ ID NO: 92350 - DNA, 25 bp, Mus musculus
ccgctgtcgcctgtctagaagggaa

SEQ ID NO: 92351 - DNA, 25 bp, Mus musculus
ccgctgtctgcagcctggatgagca

SEQ ID NO: 92352 - DNA, 25 bp, Mus musculus
ccgctgtgacaaattatgaggcaaa

SEQ ID NO: 92353 - DNA, 25 bp, Mus musculus
ccgcttgaggatcctggctgctgaa

SEQ ID NO: 92354 - DNA, 25 bp, Mus musculus
ccgcttttacgaaacacagtgagga

SEQ ID NO: 92355 - DNA, 25 bp, Mus musculus
ccggaacgtcagcagcctttcagaa

SEQ ID NO: 92356 - DNA, 25 bp, Mus musculus
ccggaacgtgatcacggagcccatt

SEQ ID NO: 92357 - DNA, 25 bp, Mus musculus
ccggaagactgggatgaacgagcca

SEQ ID NO: 92358 - DNA, 25 bp, Mus musculus
ccggaagcagcagccctttctgagg

SEQ ID NO: 92359 - DNA, 25 bp, Mus musculus
ccggaagcagcttgtgaagaacgaa

SEQ ID NO: 92360 - DNA, 25 bp, Mus musculus
ccggaagcagtttgacctgggctat

SEQ ID NO: 92361 - DNA, 25 bp, Mus musculus
ccggaagccaggagtgtacaccaaa

SEQ ID NO: 92362 - DNA, 25 bp, Mus musculus
ccggaagccatcatccactcttggg

SEQ ID NO: 92363 - DNA, 25 bp, Mus musculus
ccggaaggtgtgaactgcaaaggat

SEQ ID NO: 92364 - DNA, 25 bp, Mus musculus
ccggaagtacaggttttgcacagca

SEQ ID NO: 92365 - DNA, 25 bp, Mus musculus
ccggaagtgccaggctagccgagta

SEQ ID NO: 92366 - DNA, 25 bp, Mus musculus
ccggaagtgtgatagcaggcataga

SEQ ID NO: 92367 - DNA, 25 bp, Mus musculus
ccggaatatatagccctggtgcaga

SEQ ID NO: 92368 - DNA, 25 bp, Mus musculus
ccggaccgggctggttggagccgct

SEQ ID NO: 92369 - DNA, 25 bp, Mus musculus
ccggagaaatgaccccttgctgact

SEQ ID NO: 92370 - DNA, 25 bp, Mus musculus
ccggagaccgctggaaagtgaccag

SEQ ID NO: 92371 - DNA, 25 bp, Mus musculus
ccggagatcaacaaagcagttctgc

SEQ ID NO: 92372 - DNA, 25 bp, Mus musculus
ccggagcacgaaactctggtattta

SEQ ID NO: 92373 - DNA, 25 bp, Mus musculus
ccggagcacgtctctagccctatat

SEQ ID NO: 92374 - DNA, 25 bp, Mus musculus
ccggagcagcagagaaagcgacttc

SEQ ID NO: 92375 - DNA, 25 bp, Mus musculus
ccggagcaggcagtttcttcagttc

SEQ ID NO: 92376 - DNA, 25 bp, Mus musculus
ccggagcctgcatcggtctggcagt

SEQ ID NO: 92377 - DNA, 25 bp, Mus musculus
ccggagctgcggacggtttgcccga

SEQ ID NO: 92378 - DNA, 25 bp, Mus musculus
ccggaggaccattcgctgctggtga

SEQ ID NO: 92379 - DNA, 25 bp, Mus musculus
ccggaggacgaaggtgcacagactt

SEQ ID NO: 92380 - DNA, 25 bp, Mus musculus
ccggaggcacattgggaatcctgag

SEQ ID NO: 92381 - DNA, 25 bp, Mus musculus
ccggagggcccaatggcctcaatga

SEQ ID NO: 92382 - DNA, 25 bp, Mus musculus
ccggagggcgaaggtggagactgcg

SEQ ID NO: 92383 - DNA, 25 bp, Mus musculus
ccggagtagacatcgcagctggaaa

SEQ ID NO: 92384 - DNA, 25 bp, Mus musculus
ccggagtctacacagacgtggccaa

SEQ ID NO: 92385 - DNA, 25 bp, Mus musculus
ccggagtgtcacagtacaagaaaca

SEQ ID NO: 92386 - DNA, 25 bp, Mus musculus
ccggagttccttgtacctggacagg

SEQ ID NO: 92387 - DNA, 25 bp, Mus musculus
ccggatcatgttcgcctggacactg

SEQ ID NO: 92388 - DNA, 25 bp, Mus musculus
ccggatgagtgcaagggaacgcttc

SEQ ID NO: 92389 - DNA, 25 bp, Mus musculus
ccggatggactctggaacgcgttag

SEQ ID NO: 92390 - DNA, 25 bp, Mus musculus
ccggattatagtgcagcctgggctg

SEQ ID NO: 92391 - DNA, 25 bp, Mus musculus
ccggcaaagggttactgggcattct

SEQ ID NO: 92392 - DNA, 25 bp, Mus musculus
ccggcaagcccctaaattacagtcg

SEQ ID NO: 92393 - DNA, 25 bp, Mus musculus
ccggcaaggcctagacgagatgtat

SEQ ID NO: 92394 - DNA, 25 bp, Mus musculus
ccggcactcagggatacttcaagaa

SEQ ID NO: 92395 - DNA, 25 bp, Mus musculus
ccggcactggtgactctgctcatct

SEQ ID NO: 92396 - DNA, 25 bp, Mus musculus
ccggcagatccagcaagaggaggac

SEQ ID NO: 92397 - DNA, 25 bp, Mus musculus
ccggcaggccaagctcatgggcagt

SEQ ID NO: 92398 - DNA, 25 bp, Mus musculus
ccggcaggctttggtcaaaaagcat

SEQ ID NO: 92399 - DNA, 25 bp, Mus musculus
ccggccagaggttcgagagttttct

SEQ ID NO: 92400 - DNA, 25 bp, Mus musculus
ccggccagtctgcaggaagttcatg

SEQ ID NO: 92401 - DNA, 25 bp, Mus musculus
ccggcccaagtatcaggcggtgctg

SEQ ID NO: 92402 - DNA, 25 bp, Mus musculus
ccggcccaggagtatcaagaacaga

SEQ ID NO: 92403 - DNA, 25 bp, Mus musculus
ccggccccgaattgacctgattgtg

SEQ ID NO: 92404 - DNA, 25 bp, Mus musculus
ccggcccctcggatgacagtatata

SEQ ID NO: 92405 - DNA, 25 bp, Mus musculus
ccggccctatcgagcctccggcgct

SEQ ID NO: 92406 - DNA, 25 bp, Mus musculus
ccggcgaattgaaagcagtgatctc

SEQ ID NO: 92407 - DNA, 25 bp, Mus musculus
ccggcgactcgctgatggaacagaa

SEQ ID NO: 92408 - DNA, 25 bp, Mus musculus
ccggcgagatgcttctgtgtgaaac

SEQ ID NO: 92409 - DNA, 25 bp, Mus musculus
ccggcgcctgtttttgacgtgtaca

SEQ ID NO: 92410 - DNA, 25 bp, Mus musculus
ccggcgcgttgctctctgctggagc

SEQ ID NO: 92411 - DNA, 25 bp, Mus musculus
ccggcgctacctggctgtaaatact

SEQ ID NO: 92412 - DNA, 25 bp, Mus musculus
ccggcggctagtggcgtctgaggaa

SEQ ID NO: 92413 - DNA, 25 bp, Mus musculus
ccggcgggaggtgggtccgcgcgtg

SEQ ID NO: 92414 - DNA, 25 bp, Mus musculus
ccggcgtaggcgaaagatgatcagc

SEQ ID NO: 92415 - DNA, 25 bp, Mus musculus
ccggcgtatgcgactggtctatgca

SEQ ID NO: 92416 - DNA, 25 bp, Mus musculus
ccggcgtcctggtctgagaagagcg

SEQ ID NO: 92417 - DNA, 25 bp, Mus musculus
ccggcgtcgccggagtgaattgatc

SEQ ID NO: 92418 - DNA, 25 bp, Mus musculus
ccggcgtgacatgtaggctctcaga

SEQ ID NO: 92419 - DNA, 25 bp, Mus musculus
ccggctatggcatcctggacgggaa

SEQ ID NO: 92420 - DNA, 25 bp, Mus musculus
ccggctcatcttgcagcgaagtcaa

SEQ ID NO: 92421 - DNA, 25 bp, Mus musculus
ccggctccgctctgcatacttggag

SEQ ID NO: 92422 - DNA, 25 bp, Mus musculus
ccggctcggtgctaggcgactctgc

SEQ ID NO: 92423 - DNA, 25 bp, Mus musculus
ccggctgccgtgacaacttgttggt

SEQ ID NO: 92424 - DNA, 25 bp, Mus musculus
ccggctggctgtgctaagttgtttc

SEQ ID NO: 92425 - DNA, 25 bp, Mus musculus
ccgggaaacccagagggcgagccag

SEQ ID NO: 92426 - DNA, 25 bp, Mus musculus
ccgggaagccctgtgtgaacgagat

SEQ ID NO: 92427 - DNA, 25 bp, Mus musculus
ccgggacaacactctgatgcaacag

SEQ ID NO: 92428 - DNA, 25 bp, Mus musculus
ccgggacacctgaagccatttgaaa

SEQ ID NO: 92429 - DNA, 25 bp, Mus musculus
ccgggacatggcaaacaggatcagt

SEQ ID NO: 92430 - DNA, 25 bp, Mus musculus
ccgggacgccattcttggagtcagg

SEQ ID NO: 92431 - DNA, 25 bp, Mus musculus
ccgggactacatggaaagagataaa

SEQ ID NO: 92432 - DNA, 25 bp, Mus musculus
ccgggactccgagatgagctcttca

SEQ ID NO: 92433 - DNA, 25 bp, Mus musculus
ccgggagcagaagcttgacgccttt

SEQ ID NO: 92434 - DNA, 25 bp, Mus musculus
ccgggagcatctgggactttgtttc

SEQ ID NO: 92435 - DNA, 25 bp, Mus musculus
ccgggagctgctgagcaaccagagt

SEQ ID NO: 92436 - DNA, 25 bp, Mus musculus
ccgggatcaaaaacgctcaggagct

SEQ ID NO: 92437 - DNA, 25 bp, Mus musculus
ccgggatcattcaagccatggtgga

SEQ ID NO: 92438 - DNA, 25 bp, Mus musculus
ccgggatgcctatgcctttggagct

SEQ ID NO: 92439 - DNA, 25 bp, Mus musculus
ccgggatggcaagtggctcaatgtc

SEQ ID NO: 92440 - DNA, 25 bp, Mus musculus
ccgggatgtcggaagaaaccaggca

SEQ ID NO: 92441 - DNA, 25 bp, Mus musculus
ccgggattggtgacgtcctgagcaa

SEQ ID NO: 92442 - DNA, 25 bp, Mus musculus
ccgggcaactatggcagcagcagta

SEQ ID NO: 92443 - DNA, 25 bp, Mus musculus
ccgggcaatttgacgacgcggattc

SEQ ID NO: 92444 - DNA, 25 bp, Mus musculus
ccgggcactttggacctcacggtga

SEQ ID NO: 92445 - DNA, 25 bp, Mus musculus
ccgggcagacagagatccgtgctat

SEQ ID NO: 92446 - DNA, 25 bp, Mus musculus
ccgggcagggtcaaaatggcaaact

SEQ ID NO: 92447 - DNA, 25 bp, Mus musculus
ccgggcaggtccaaacagtactgaa

SEQ ID NO: 92448 - DNA, 25 bp, Mus musculus
ccgggccctctatgcgctagtcttg

SEQ ID NO: 92449 - DNA, 25 bp, Mus musculus
ccgggccctggaacaagcagatggc

SEQ ID NO: 92450 - DNA, 25 bp, Mus musculus
ccgggccgatgtggttgcaaatgat

SEQ ID NO: 92451 - DNA, 25 bp, Mus musculus
ccgggccttcaactccagcatggag

SEQ ID NO: 92452 - DNA, 25 bp, Mus musculus
ccgggcgagttcgagagcaagtact

SEQ ID NO: 92453 - DNA, 25 bp, Mus musculus
ccgggctactgtttccgggtgctcg

SEQ ID NO: 92454 - DNA, 25 bp, Mus musculus
ccgggctagtagaagagtcctggct

SEQ ID NO: 92455 - DNA, 25 bp, Mus musculus
ccgggctatccgttgttcacactgt

SEQ ID NO: 92456 - DNA, 25 bp, Mus musculus
ccgggctccgagtgtggaattcaaa

SEQ ID NO: 92457 - DNA, 25 bp, Mus musculus
ccgggctcggaacacacatttatta

SEQ ID NO: 92458 - DNA, 25 bp, Mus musculus
ccgggctgcccgtggatggatttta

SEQ ID NO: 92459 - DNA, 25 bp, Mus musculus
ccgggctgtgaagccatccagggca

SEQ ID NO: 92460 - DNA, 25 bp, Mus musculus
ccgggctgttggttaggattcccag

SEQ ID NO: 92461 - DNA, 25 bp, Mus musculus
ccgggcttcacagggcagtctgcta

SEQ ID NO: 92462 - DNA, 25 bp, Mus musculus
ccgggtaccggcagtatgagaagta

SEQ ID NO: 92463 - DNA, 25 bp, Mus musculus
ccgggtagaccgagagattgcaaaa

SEQ ID NO: 92464 - DNA, 25 bp, Mus musculus
ccgggtcatagacggaagtccagct

SEQ ID NO: 92465 - DNA, 25 bp, Mus musculus
ccgggtgctggccattgaatacttt

SEQ ID NO: 92466 - DNA, 25 bp, Mus musculus
ccgggtgtcgaggatctgagcctta

SEQ ID NO: 92467 - DNA, 25 bp, Mus musculus
ccgggtgtttacatgagaggctcca

SEQ ID NO: 92468 - DNA, 25 bp, Mus musculus
ccgggtttcaggtggtacatctcaa

SEQ ID NO: 92469 - DNA, 25 bp, Mus musculus
ccggtaccgcatagataactggaga

SEQ ID NO: 92470 - DNA, 25 bp, Mus musculus
ccggtacctgtgcttctgagcccag

SEQ ID NO: 92471 - DNA, 25 bp, Mus musculus
ccggtacgatgctgtgacaattaag

SEQ ID NO: 92472 - DNA, 25 bp, Mus musculus
ccggtcacggaaatactccagttgg

SEQ ID NO: 92473 - DNA, 25 bp, Mus musculus
ccggtcgtgtatccagtccgcctta

SEQ ID NO: 92474 - DNA, 25 bp, Mus musculus
ccggtggcacacacggaggacgcac

SEQ ID NO: 92475 - DNA, 25 bp, Mus musculus
ccggtggcagatactgccaagagca

SEQ ID NO: 92476 - DNA, 25 bp, Mus musculus
ccggtgggcggagcctaagcgggcg

SEQ ID NO: 92477 - DNA, 25 bp, Mus musculus
ccggtgggtgaagtcgctgctccta

SEQ ID NO: 92478 - DNA, 25 bp, Mus musculus
ccggtgtcgggcaactaacaggcga

SEQ ID NO: 92479 - DNA, 25 bp, Mus musculus
ccggtgtggattttggcgacctaga

SEQ ID NO: 92480 - DNA, 25 bp, Mus musculus
ccggttattgagaatctgggtgcca

SEQ ID NO: 92481 - DNA, 25 bp, Mus musculus
ccggttcgcggcaaatacttagaca

SEQ ID NO: 92482 - DNA, 25 bp, Mus musculus
ccggttctcaccaagcctgctgtat

SEQ ID NO: 92483 - DNA, 25 bp, Mus musculus
ccggttgtgccgttgcgagattgca

SEQ ID NO: 92484 - DNA, 25 bp, Mus musculus
ccggtttgggcagatcatgattgaa

SEQ ID NO: 92485 - DNA, 25 bp, Mus musculus
ccggtttgttgaatcagttgcaaga

SEQ ID NO: 92486 - DNA, 25 bp, Mus musculus
ccgtaaaatccacgctagagctgca

SEQ ID NO: 92487 - DNA, 25 bp, Mus musculus
ccgtaacatgttggctgaggctctg

SEQ ID NO: 92488 - DNA, 25 bp, Mus musculus
ccgtaacctagatattgagcgtcca

SEQ ID NO: 92489 - DNA, 25 bp, Mus musculus
ccgtacatgcgcaggatggtggcca

SEQ ID NO: 92490 - DNA, 25 bp, Mus musculus
ccgtacatgggcagccccgcgggta

SEQ ID NO: 92491 - DNA, 25 bp, Mus musculus
ccgtacgtccggtgtgcgtcaagat

SEQ ID NO: 92492 - DNA, 25 bp, Mus musculus
ccgtactgtacagcgtggaggagca

SEQ ID NO: 92493 - DNA, 25 bp, Mus musculus
ccgtagtctgagtgatgaggccaaa

SEQ ID NO: 92494 - DNA, 25 bp, Mus musculus
ccgtagtgattctaggcagggtacc

SEQ ID NO: 92495 - DNA, 25 bp, Mus musculus
ccgtagtgtgacaaggtttgaccct

SEQ ID NO: 92496 - DNA, 25 bp, Mus musculus
ccgtataggtgagggacttgaccag

SEQ ID NO: 92497 - DNA, 25 bp, Mus musculus
ccgtatctgtctggatcctggtgtc

SEQ ID NO: 92498 - DNA, 25 bp, Mus musculus
ccgtatgaacgtgtgataaggaact

SEQ ID NO: 92499 - DNA, 25 bp, Mus musculus
ccgtatgacagatggaaggacacta

SEQ ID NO: 92500 - DNA, 25 bp, Mus musculus
ccgtcaaatatagcagtggatccaa

SEQ ID NO: 92501 - DNA, 25 bp, Mus musculus
ccgtcacaccagtcacactgttgga

SEQ ID NO: 92502 - DNA, 25 bp, Mus musculus
ccgtcacatctcattccatcaggag

SEQ ID NO: 92503 - DNA, 25 bp, Mus musculus
ccgtcacggatgaagagcagaccaa

SEQ ID NO: 92504 - DNA, 25 bp, Mus musculus
ccgtcacggtcgcaatgctgctaat

SEQ ID NO: 92505 - DNA, 25 bp, Mus musculus
ccgtcattgacgagtgcacacagat

SEQ ID NO: 92506 - DNA, 25 bp, Mus musculus
ccgtcccacgatcgaagcatgtgaa

SEQ ID NO: 92507 - DNA, 25 bp, Mus musculus
ccgtcccggaaatgcgatggctgtg

SEQ ID NO: 92508 - DNA, 25 bp, Mus musculus
ccgtcctggactaaggcagagtgca

SEQ ID NO: 92509 - DNA, 25 bp, Mus musculus
ccgtccttagatgtctggtcagcaa

SEQ ID NO: 92510 - DNA, 25 bp, Mus musculus
ccgtcgccattttgtagggttctct

SEQ ID NO: 92511 - DNA, 25 bp, Mus musculus
ccgtcggccacacccttagagtttg

SEQ ID NO: 92512 - DNA, 25 bp, Mus musculus
ccgtcgtgggattgtgctgctgacc

SEQ ID NO: 92513 - DNA, 25 bp, Mus musculus
ccgtctaaagggacacaaggatgct

SEQ ID NO: 92514 - DNA, 25 bp, Mus musculus
ccgtctagaaaatgagcgcaaggct

SEQ ID NO: 92515 - DNA, 25 bp, Mus musculus
ccgtctcgcgagagtccaagttgag

SEQ ID NO: 92516 - DNA, 25 bp, Mus musculus
ccgtctgctgcacacatcgttgaag

SEQ ID NO: 92517 - DNA, 25 bp, Mus musculus
ccgtgaaggctgtgcagcatggcaa

SEQ ID NO: 92518 - DNA, 25 bp, Mus musculus
ccgtgaatgccgaagagtgcgctgc

SEQ ID NO: 92519 - DNA, 25 bp, Mus musculus
ccgtgacagtcacagtgccatggag

SEQ ID NO: 92520 - DNA, 25 bp, Mus musculus
ccgtgacctagaagataaaacagac

SEQ ID NO: 92521 - DNA, 25 bp, Mus musculus
ccgtgactggtggatgtgcatgatc

SEQ ID NO: 92522 - DNA, 25 bp, Mus musculus
ccgtgagaacatccgcagtgagctg

SEQ ID NO: 92523 - DNA, 25 bp, Mus musculus
ccgtgagctccgaaggatgagcgat

SEQ ID NO: 92524 - DNA, 25 bp, Mus musculus
ccgtgagcttgcatggtggccacct

SEQ ID NO: 92525 - DNA, 25 bp, Mus musculus
ccgtgatgagcgtcaaaattatccg

SEQ ID NO: 92526 - DNA, 25 bp, Mus musculus
ccgtgatgatgcttgacgagctgct

SEQ ID NO: 92527 - DNA, 25 bp, Mus musculus
ccgtgatggcagagatggcactcct

SEQ ID NO: 92528 - DNA, 25 bp, Mus musculus
ccgtgattttaaccaaggcagttgg

SEQ ID NO: 92529 - DNA, 25 bp, Mus musculus
ccgtgcagcccgacgtggagagtaa

SEQ ID NO: 92530 - DNA, 25 bp, Mus musculus
ccgtgcagggcaattccatgaagct

SEQ ID NO: 92531 - DNA, 25 bp, Mus musculus
ccgtgcattgctagaagatgggaca

SEQ ID NO: 92532 - DNA, 25 bp, Mus musculus
ccgtgccaaggagtagaacaagccc

SEQ ID NO: 92533 - DNA, 25 bp, Mus musculus
ccgtgccggcatagaagactctaag

SEQ ID NO: 92534 - DNA, 25 bp, Mus musculus
ccgtgcgaggtctaccgcgccgagt

SEQ ID NO: 92535 - DNA, 25 bp, Mus musculus
ccgtgcgcagcagtatcttggaaca

SEQ ID NO: 92536 - DNA, 25 bp, Mus musculus
ccgtgctcttggagctggccaatga

SEQ ID NO: 92537 - DNA, 25 bp, Mus musculus
ccgtgcttttcgtggcgctgggcat

SEQ ID NO: 92538 - DNA, 25 bp, Mus musculus
ccgtggacatcagaaggaaggttat

SEQ ID NO: 92539 - DNA, 25 bp, Mus musculus
ccgtggacctaaccaggatgctgga

SEQ ID NO: 92540 - DNA, 25 bp, Mus musculus
ccgtggagaggattctagaagccga

SEQ ID NO: 92541 - DNA, 25 bp, Mus musculus
ccgtggagggctgccaaaatgatca

SEQ ID NO: 92542 - DNA, 25 bp, Mus musculus
ccgtggagtctcatacagcagtgca

SEQ ID NO: 92543 - DNA, 25 bp, Mus musculus
ccgtggatggattttacacacaaga

SEQ ID NO: 92544 - DNA, 25 bp, Mus musculus
ccgtggcaccaaacgaaagaagaag

SEQ ID NO: 92545 - DNA, 25 bp, Mus musculus
ccgtggctaccgaagatttcagtca

SEQ ID NO: 92546 - DNA, 25 bp, Mus musculus
ccgtgggacgctcattcaagggtta

SEQ ID NO: 92547 - DNA, 25 bp, Mus musculus
ccgtggtgcgccagattgacaagca

SEQ ID NO: 92548 - DNA, 25 bp, Mus musculus
ccgtggtggaacagagggcatcatt

SEQ ID NO: 92549 - DNA, 25 bp, Mus musculus
ccgtgtacgattttgaagccgctga

SEQ ID NO: 92550 - DNA, 25 bp, Mus musculus
ccgtgtacgcggaggtggataccat

SEQ ID NO: 92551 - DNA, 25 bp, Mus musculus
ccgtgtatgatagcctgagccccat

SEQ ID NO: 92552 - DNA, 25 bp, Mus musculus
ccgtgtattatattggctggtgcaa

SEQ ID NO: 92553 - DNA, 25 bp, Mus musculus
ccgtgtcaactagccacagtgggag

SEQ ID NO: 92554 - DNA, 25 bp, Mus musculus
ccgtgtcaggcatcaccgtggtgaa

SEQ ID NO: 92555 - DNA, 25 bp, Mus musculus
ccgtgtcatttggagagctagcaaa

SEQ ID NO: 92556 - DNA, 25 bp, Mus musculus
ccgtgtccaggctgcagcgcagaga

SEQ ID NO: 92557 - DNA, 25 bp, Mus musculus
ccgtgtgcagaagaaaactttcacc

SEQ ID NO: 92558 - DNA, 25 bp, Mus musculus
ccgtgtgccaaatgaagaggatcca

SEQ ID NO: 92559 - DNA, 25 bp, Mus musculus
ccgtgtgcccaagaaaatcctcaag

SEQ ID NO: 92560 - DNA, 25 bp, Mus musculus
ccgtgtgcgtgtgcaagagccgcta

SEQ ID NO: 92561 - DNA, 25 bp, Mus musculus
ccgtgttatggctcctgggaccgca

SEQ ID NO: 92562 - DNA, 25 bp, Mus musculus
ccgtgtttatcctgagccgctctgt

SEQ ID NO: 92563 - DNA, 25 bp, Mus musculus
ccgttaagatcgtggcggtagccca

SEQ ID NO: 92564 - DNA, 25 bp, Mus musculus
ccgttagtggtcagggcacttggac

SEQ ID NO: 92565 - DNA, 25 bp, Mus musculus
ccgttatccaggattctaccatcca

SEQ ID NO: 92566 - DNA, 25 bp, Mus musculus
ccgttgacggaggaaggcattgccc

SEQ ID NO: 92567 - DNA, 25 bp, Mus musculus
ccgttgcagttttgacccaagagag

SEQ ID NO: 92568 - DNA, 25 bp, Mus musculus
ccgttgctgcaacaaatgcggcgga

SEQ ID NO: 92569 - DNA, 25 bp, Mus musculus
ccgttgggcgacacatggagaaccc

SEQ ID NO: 92570 - DNA, 25 bp, Mus musculus
ccgttggttacgtcgccggctgtgc

SEQ ID NO: 92571 - DNA, 25 bp, Mus musculus
ccgtttacgcagtcagggcagggat

SEQ ID NO: 92572 - DNA, 25 bp, Mus musculus
ccgtttctgtatgacctggttatga

SEQ ID NO: 92573 - DNA, 25 bp, Mus musculus
ccgtttgtctgtctgagagtgttaa

SEQ ID NO: 92574 - DNA, 25 bp, Mus musculus
ccgttttgaactgcacgaggaccaa

SEQ ID NO: 92575 - DNA, 25 bp, Mus musculus
cctaaaaagagacatccccgtggag

SEQ ID NO: 92576 - DNA, 25 bp, Mus musculus
cctaaaaagggagatgatgtgaaac

SEQ ID NO: 92577 - DNA, 25 bp, Mus musculus
cctaaaacgagagacctgctgcgct

SEQ ID NO: 92578 - DNA, 25 bp, Mus musculus
cctaaaagcgaaggcagcggagttc

SEQ ID NO: 92579 - DNA, 25 bp, Mus musculus
cctaaacagagcagcagtgcagtgc

SEQ ID NO: 92580 - DNA, 25 bp, Mus musculus
cctaaacatacttgtgagtaggtgt

SEQ ID NO: 92581 - DNA, 25 bp, Mus musculus
cctaaacctagaacgtgatgtggag

SEQ ID NO: 92582 - DNA, 25 bp, Mus musculus
cctaaactcggtgtaaagtggcaag

SEQ ID NO: 92583 - DNA, 25 bp, Mus musculus
cctaaaggaattcatccacatactg

SEQ ID NO: 92584 - DNA, 25 bp, Mus musculus
cctaaaggcactggacaaatactgg

SEQ ID NO: 92585 - DNA, 25 bp, Mus musculus
cctaaagtagagaagaaggcagaat

SEQ ID NO: 92586 - DNA, 25 bp, Mus musculus
cctaaagtcaagaagagcgtcagca

SEQ ID NO: 92587 - DNA, 25 bp, Mus musculus
cctaaatgagcaaatgcgggctgcc

SEQ ID NO: 92588 - DNA, 25 bp, Mus musculus
cctaaatgagggtgatgaaggcccc

SEQ ID NO: 92589 - DNA, 25 bp, Mus musculus
cctaaatttgtgaatggcgtgcagc

SEQ ID NO: 92590 - DNA, 25 bp, Mus musculus
cctaacaaatacaacttctcctttg

SEQ ID NO: 92591 - DNA, 25 bp, Mus musculus
cctaacaacataccccgtgcagtga

SEQ ID NO: 92592 - DNA, 25 bp, Mus musculus
cctaacatagaggaagtggttctcc

SEQ ID NO: 92593 - DNA, 25 bp, Mus musculus
cctaacattttggagcagggtcctg

SEQ ID NO: 92594 - DNA, 25 bp, Mus musculus
cctaacgatgaagatggtcctgtcc

SEQ ID NO: 92595 - DNA, 25 bp, Mus musculus
cctaacggcgtcgtatgtgcgggca

SEQ ID NO: 92596 - DNA, 25 bp, Mus musculus
cctaactgggtgtgctttatagctc

SEQ ID NO: 92597 - DNA, 25 bp, Mus musculus
cctaagaagttcaagtgtagagcca

SEQ ID NO: 92598 - DNA, 25 bp, Mus musculus
cctaagacccgggagagtgatcagt

SEQ ID NO: 92599 - DNA, 25 bp, Mus musculus
cctaagagaattgaggtcctccaaa

SEQ ID NO: 92600 - DNA, 25 bp, Mus musculus
cctaagcaggcagatcaagtgttcc

SEQ ID NO: 92601 - DNA, 25 bp, Mus musculus
cctaagctggttggcaagtgggacc

SEQ ID NO: 92602 - DNA, 25 bp, Mus musculus
cctaaggaagtacagagctgggcac

SEQ ID NO: 92603 - DNA, 25 bp, Mus musculus
cctaaggaccagatccatccctggg

SEQ ID NO: 92604 - DNA, 25 bp, Mus musculus
cctaagggagttcgttcacagctga

SEQ ID NO: 92605 - DNA, 25 bp, Mus musculus
cctaagggataagacaggagacttc

SEQ ID NO: 92606 - DNA, 25 bp, Mus musculus
cctaaggtggttttatatgctgccc

SEQ ID NO: 92607 - DNA, 25 bp, Mus musculus
cctaagtagaactgaggaatgccca

SEQ ID NO: 92608 - DNA, 25 bp, Mus musculus
cctaagtctgactcacgggaagaaa

SEQ ID NO: 92609 - DNA, 25 bp, Mus musculus
cctaagtgactttgctgaactgccg

SEQ ID NO: 92610 - DNA, 25 bp, Mus musculus
cctaagtgcgagtaggtttgaaact

SEQ ID NO: 92611 - DNA, 25 bp, Mus musculus
cctaagttgtatgggccggatggcc

SEQ ID NO: 92612 - DNA, 25 bp, Mus musculus
cctaatccctatgaagtcactatgc

SEQ ID NO: 92613 - DNA, 25 bp, Mus musculus
cctaatctctgagtattggaaatga

SEQ ID NO: 92614 - DNA, 25 bp, Mus musculus
cctaatctgtttacccatgaatcag

SEQ ID NO: 92615 - DNA, 25 bp, Mus musculus
cctaatgcagataccaagaagcgga

SEQ ID NO: 92616 - DNA, 25 bp, Mus musculus
cctaatgtggatctaccaccgctgt

SEQ ID NO: 92617 - DNA, 25 bp, Mus musculus
cctaatgtgggcaatgctgaatcga

SEQ ID NO: 92618 - DNA, 25 bp, Mus musculus
cctaattgacagaagaggctatgtc

SEQ ID NO: 92619 - DNA, 25 bp, Mus musculus
cctaattggaatttgagagccctaa

SEQ ID NO: 92620 - DNA, 25 bp, Mus musculus
cctaatttccaggacgcagggacct

SEQ ID NO: 92621 - DNA, 25 bp, Mus musculus
cctaatttctggatggatgggcggt

SEQ ID NO: 92622 - DNA, 25 bp, Mus musculus
cctaatttgagacgcggactttccg

SEQ ID NO: 92623 - DNA, 25 bp, Mus musculus
cctacaaagtggaggagtcgggcta

SEQ ID NO: 92624 - DNA, 25 bp, Mus musculus
cctacaacaagcacattaacatcag

SEQ ID NO: 92625 - DNA, 25 bp, Mus musculus
cctacaatgtggagatctgggacac

SEQ ID NO: 92626 - DNA, 25 bp, Mus musculus
cctacacaagtgaggatgaggcctg

SEQ ID NO: 92627 - DNA, 25 bp, Mus musculus
cctacactgtgttggctcatcaacc

SEQ ID NO: 92628 - DNA, 25 bp, Mus musculus
cctacagaagatgccggagggtaca

SEQ ID NO: 92629 - DNA, 25 bp, Mus musculus
cctacagaaggatgggatggtgcaa

SEQ ID NO: 92630 - DNA, 25 bp, Mus musculus
cctacagagaggaaccacgaaggtg

SEQ ID NO: 92631 - DNA, 25 bp, Mus musculus
cctacagcagagacgggcagttgat

SEQ ID NO: 92632 - DNA, 25 bp, Mus musculus
cctacagcagtttggcagtgacatc

SEQ ID NO: 92633 - DNA, 25 bp, Mus musculus
cctacaggcggagaaacatagagca

SEQ ID NO: 92634 - DNA, 25 bp, Mus musculus
cctacagggcgctggacattgacct

SEQ ID NO: 92635 - DNA, 25 bp, Mus musculus
cctacagggtggacaaaagagccgc

SEQ ID NO: 92636 - DNA, 25 bp, Mus musculus
cctacaggtgacaagcggatctttc

SEQ ID NO: 92637 - DNA, 25 bp, Mus musculus
cctacaggttggttcagtttgatac

SEQ ID NO: 92638 - DNA, 25 bp, Mus musculus
cctacagtccccaggcagaatgtga

SEQ ID NO: 92639 - DNA, 25 bp, Mus musculus
cctacatacctggagcctgggatcg

SEQ ID NO: 92640 - DNA, 25 bp, Mus musculus
cctacatcaacatgcgggaggtgtc

SEQ ID NO: 92641 - DNA, 25 bp, Mus musculus
cctacatcctgatgaagtggccgat

SEQ ID NO: 92642 - DNA, 25 bp, Mus musculus
cctacatgtgtgtttctggcatcca

SEQ ID NO: 92643 - DNA, 25 bp, Mus musculus
cctacatgttatttgggtctgaccg

SEQ ID NO: 92644 - DNA, 25 bp, Mus musculus
cctaccacgtggaaagcagaagcag

SEQ ID NO: 92645 - DNA, 25 bp, Mus musculus
cctaccatgtaggagaacagtggca

SEQ ID NO: 92646 - DNA, 25 bp, Mus musculus
cctacccaagatgtgactactgctg

SEQ ID NO: 92647 - DNA, 25 bp, Mus musculus
cctacccaggagatatatgcagcag

SEQ ID NO: 92648 - DNA, 25 bp, Mus musculus
cctaccccgggtatcagtgttctgg

SEQ ID NO: 92649 - DNA, 25 bp, Mus musculus
cctaccctctgcctgtggggacgga

SEQ ID NO: 92650 - DNA, 25 bp, Mus musculus
cctaccctgaggacaatgagccgaa

SEQ ID NO: 92651 - DNA, 25 bp, Mus musculus
cctacctagatgtgaagcttcccag

SEQ ID NO: 92652 - DNA, 25 bp, Mus musculus
cctacctgcaagaggacactgtgag

SEQ ID NO: 92653 - DNA, 25 bp, Mus musculus
cctacctgctggaaatgagccagct

SEQ ID NO: 92654 - DNA, 25 bp, Mus musculus
cctacctggaactgaaaggcttgca

SEQ ID NO: 92655 - DNA, 25 bp, Mus musculus
cctacgaacatatggctaaaataag

SEQ ID NO: 92656 - DNA, 25 bp, Mus musculus
cctacgagagaggagagttgcaagc

SEQ ID NO: 92657 - DNA, 25 bp, Mus musculus
cctacgcggccgcctaagcatgtcg

SEQ ID NO: 92658 - DNA, 25 bp, Mus musculus
cctacgctggagtgcagcagtatgc

SEQ ID NO: 92659 - DNA, 25 bp, Mus musculus
cctacggatcacagggatgcggcgt

SEQ ID NO: 92660 - DNA, 25 bp, Mus musculus
cctacggcctgatagaaaggatgtc

SEQ ID NO: 92661 - DNA, 25 bp, Mus musculus
cctacggtctgatgtggtgcccatg

SEQ ID NO: 92662 - DNA, 25 bp, Mus musculus
cctacggtgagaactgtgagcgcag

SEQ ID NO: 92663 - DNA, 25 bp, Mus musculus
cctacggtgcatctataaagagtgc

SEQ ID NO: 92664 - DNA, 25 bp, Mus musculus
cctacgttcatttgggtccgcatgc

SEQ ID NO: 92665 - DNA, 25 bp, Mus musculus
cctactacacagagcgggtcctgga

SEQ ID NO: 92666 - DNA, 25 bp, Mus musculus
cctactagacccagatgtggttgcc

SEQ ID NO: 92667 - DNA, 25 bp, Mus musculus
cctactagttaaatggcctctcctg

SEQ ID NO: 92668 - DNA, 25 bp, Mus musculus
cctactatgggacccgaccaaggtg

SEQ ID NO: 92669 - DNA, 25 bp, Mus musculus
cctactatgtatgtggtttattttt

SEQ ID NO: 92670 - DNA, 25 bp, Mus musculus
cctactcagatcgtgtggccgtgga

SEQ ID NO: 92671 - DNA, 25 bp, Mus musculus
cctactccagggtcttcaaagtcag

SEQ ID NO: 92672 - DNA, 25 bp, Mus musculus
cctactctgcaagcggacgggaata

SEQ ID NO: 92673 - DNA, 25 bp, Mus musculus
cctactctgtgggtgggtgtagcca

SEQ ID NO: 92674 - DNA, 25 bp, Mus musculus
cctactgaagcctgaaagaagaatc

SEQ ID NO: 92675 - DNA, 25 bp, Mus musculus
cctactgagcttgaagggaacatca

SEQ ID NO: 92676 - DNA, 25 bp, Mus musculus
cctactgcaaggagaaggtggacct

SEQ ID NO: 92677 - DNA, 25 bp, Mus musculus
cctactggtctcctgaaggcagtga

SEQ ID NO: 92678 - DNA, 25 bp, Mus musculus
cctactggtttaatagctgctgaga

SEQ ID NO: 92679 - DNA, 25 bp, Mus musculus
cctactgtggctgccgcgggaattg

SEQ ID NO: 92680 - DNA, 25 bp, Mus musculus
cctactgtgtgtatgtccagcaggc

SEQ ID NO: 92681 - DNA, 25 bp, Mus musculus
cctacttgacgaaggcctacgacct

SEQ ID NO: 92682 - DNA, 25 bp, Mus musculus
cctacttgacttatggttccctacg

SEQ ID NO: 92683 - DNA, 25 bp, Mus musculus
cctacttggatgactgtcaccggag

SEQ ID NO: 92684 - DNA, 25 bp, Mus musculus
cctactttgagttggcaaggactgc

SEQ ID NO: 92685 - DNA, 25 bp, Mus musculus
cctagaacacacagtatcagctgag

SEQ ID NO: 92686 - DNA, 25 bp, Mus musculus
cctagaaggtggctgtaccgacgac

SEQ ID NO: 92687 - DNA, 25 bp, Mus musculus
cctagaaggtgggaaccaagattca

SEQ ID NO: 92688 - DNA, 25 bp, Mus musculus
cctagaagtagtaggcaaggacggc

SEQ ID NO: 92689 - DNA, 25 bp, Mus musculus
cctagacagatggagaggcgtatcc

SEQ ID NO: 92690 - DNA, 25 bp, Mus musculus
cctagacgacctgtaccgagagatg

SEQ ID NO: 92691 - DNA, 25 bp, Mus musculus
cctagacgatgacagagaagatctt

SEQ ID NO: 92692 - DNA, 25 bp, Mus musculus
cctagacgatgccactgctggtgga

SEQ ID NO: 92693 - DNA, 25 bp, Mus musculus
cctagagacagtagcaacgctgaat

SEQ ID NO: 92694 - DNA, 25 bp, Mus musculus
cctagagcccctgtttgacaaactg

SEQ ID NO: 92695 - DNA, 25 bp, Mus musculus
cctagagccctagagagagagacct

SEQ ID NO: 92696 - DNA, 25 bp, Mus musculus
cctagagccggaagacgaggacgat

SEQ ID NO: 92697 - DNA, 25 bp, Mus musculus
cctagaggacttccgagtgcgctgc

SEQ ID NO: 92698 - DNA, 25 bp, Mus musculus
cctagaggagctaaagaaactgttc

SEQ ID NO: 92699 - DNA, 25 bp, Mus musculus
cctagaggccacctatggagagtac

SEQ ID NO: 92700 - DNA, 25 bp, Mus musculus
cctagagtacatagccaagggagct

SEQ ID NO: 92701 - DNA, 25 bp, Mus musculus
cctagatcacaccagtcctgtgaga

SEQ ID NO: 92702 - DNA, 25 bp, Mus musculus
cctagcaaattgcagaggctgttcc

SEQ ID NO: 92703 - DNA, 25 bp, Mus musculus
cctagcagctgtcgatttcatgaac

SEQ ID NO: 92704 - DNA, 25 bp, Mus musculus
cctagcaggtgtgagtttggttccc

SEQ ID NO: 92705 - DNA, 25 bp, Mus musculus
cctagcatctgctgggcgagtacgg

SEQ ID NO: 92706 - DNA, 25 bp, Mus musculus
cctagccggcgggttctcattactg

SEQ ID NO: 92707 - DNA, 25 bp, Mus musculus
cctagcctagcttggagagtgacct

SEQ ID NO: 92708 - DNA, 25 bp, Mus musculus
cctagcgctaagctgttgcaggcag

SEQ ID NO: 92709 - DNA, 25 bp, Mus musculus
cctagcggcgacatggatgctgccg

SEQ ID NO: 92710 - DNA, 25 bp, Mus musculus
cctagctagcttggccctgggactt

SEQ ID NO: 92711 - DNA, 25 bp, Mus musculus
cctagctggagcgttgacatgtcac

SEQ ID NO: 92712 - DNA, 25 bp, Mus musculus
cctagctttgaaggtattagcggat

SEQ ID NO: 92713 - DNA, 25 bp, Mus musculus
cctaggacgtgttgcaataaagtca

SEQ ID NO: 92714 - DNA, 25 bp, Mus musculus
cctaggaggctagagctgggttctt

SEQ ID NO: 92715 - DNA, 25 bp, Mus musculus
cctaggagtacatcaaatcactgcc

SEQ ID NO: 92716 - DNA, 25 bp, Mus musculus
cctaggagtgtcattgagtactgcc

SEQ ID NO: 92717 - DNA, 25 bp, Mus musculus
cctaggatgcagagagacgggaaca

SEQ ID NO: 92718 - DNA, 25 bp, Mus musculus
cctaggcagctgtgaccggcttgaa

SEQ ID NO: 92719 - DNA, 25 bp, Mus musculus
cctaggccgagtgtgagcaccgcca

SEQ ID NO: 92720 - DNA, 25 bp, Mus musculus
cctaggcgaagattgaggatggccc

SEQ ID NO: 92721 - DNA, 25 bp, Mus musculus
cctaggcgctgcagcgtctgcgccg

SEQ ID NO: 92722 - DNA, 25 bp, Mus musculus
cctagggagagatcagatgccaaag

SEQ ID NO: 92723 - DNA, 25 bp, Mus musculus
cctagggcgccgctaagtttcttag

SEQ ID NO: 92724 - DNA, 25 bp, Mus musculus
cctagggctcatgctgggtactttg

SEQ ID NO: 92725 - DNA, 25 bp, Mus musculus
cctaggtatctacagggacaagatc

SEQ ID NO: 92726 - DNA, 25 bp, Mus musculus
cctaggtcaagatggttgtaaatcc

SEQ ID NO: 92727 - DNA, 25 bp, Mus musculus
cctagtaagacagaagattgccagc

SEQ ID NO: 92728 - DNA, 25 bp, Mus musculus
cctagtaagatgagcgaggcggacc

SEQ ID NO: 92729 - DNA, 25 bp, Mus musculus
cctagtacaggtgaaagaagtcctc

SEQ ID NO: 92730 - DNA, 25 bp, Mus musculus
cctagtcagaatgtgcagggcctac

SEQ ID NO: 92731 - DNA, 25 bp, Mus musculus
cctagtccttacaggtgtgggcagc

SEQ ID NO: 92732 - DNA, 25 bp, Mus musculus
cctagtgaagggtcccagtggcctc

SEQ ID NO: 92733 - DNA, 25 bp, Mus musculus
cctagtgatgaaggtgcccagtgcc

SEQ ID NO: 92734 - DNA, 25 bp, Mus musculus
cctagtgcaatatgtacaccgctga

SEQ ID NO: 92735 - DNA, 25 bp, Mus musculus
cctagtgcaggttcagtcagccatc

SEQ ID NO: 92736 - DNA, 25 bp, Mus musculus
cctagtgcctatgagacccgtagct

SEQ ID NO: 92737 - DNA, 25 bp, Mus musculus
cctagtgccttatgtgccagaggaa

SEQ ID NO: 92738 - DNA, 25 bp, Mus musculus
cctagtggagacagataccttcggg

SEQ ID NO: 92739 - DNA, 25 bp, Mus musculus
cctagtggagggaatgtgcattgca

SEQ ID NO: 92740 - DNA, 25 bp, Mus musculus
cctagtggtcagtaacaagagtgtc

SEQ ID NO: 92741 - DNA, 25 bp, Mus musculus
cctagtgtggtggtgaaatgtgtgc

SEQ ID NO: 92742 - DNA, 25 bp, Mus musculus
cctagtgttcaagaggtgtgggccc

SEQ ID NO: 92743 - DNA, 25 bp, Mus musculus
cctagttacctggacaaagacgagc

SEQ ID NO: 92744 - DNA, 25 bp, Mus musculus
cctataaaaggcacacgcgggcatg

SEQ ID NO: 92745 - DNA, 25 bp, Mus musculus
cctataagctggtgaagactggcaa

SEQ ID NO: 92746 - DNA, 25 bp, Mus musculus
cctataagtcaggattcgagcctcc

SEQ ID NO: 92747 - DNA, 25 bp, Mus musculus
cctatacagatgaagcctgctgaca

SEQ ID NO: 92748 - DNA, 25 bp, Mus musculus
cctatacgtgccaagactgctgctg

SEQ ID NO: 92749 - DNA, 25 bp, Mus musculus
cctatacgttgatggtgactgcaca

SEQ ID NO: 92750 - DNA, 25 bp, Mus musculus
cctatacttggcgagggatctttcc

SEQ ID NO: 92751 - DNA, 25 bp, Mus musculus
cctatagaaggtgttagagaagtca

SEQ ID NO: 92752 - DNA, 25 bp, Mus musculus
cctatagcagatcaacagtggcagc

SEQ ID NO: 92753 - DNA, 25 bp, Mus musculus
cctatatggacagtggtgcagtgcc

SEQ ID NO: 92754 - DNA, 25 bp, Mus musculus
cctatcagaagtgggtccgggagca

SEQ ID NO: 92755 - DNA, 25 bp, Mus musculus
cctatcagtcctccccagcagcggg

SEQ ID NO: 92756 - DNA, 25 bp, Mus musculus
cctatcatcgccgtgcaagtggaga

SEQ ID NO: 92757 - DNA, 25 bp, Mus musculus
cctatcctaggaggctggtttggca

SEQ ID NO: 92758 - DNA, 25 bp, Mus musculus
cctatccttatgtggagagtgaaac

SEQ ID NO: 92759 - DNA, 25 bp, Mus musculus
cctatccttccggtgcagacgggag

SEQ ID NO: 92760 - DNA, 25 bp, Mus musculus
cctatcgctgcaatctctgtgggag

SEQ ID NO: 92761 - DNA, 25 bp, Mus musculus
cctatcggagggacatgatctgttg

SEQ ID NO: 92762 - DNA, 25 bp, Mus musculus
cctatcgtgggtcagttctcaagca

SEQ ID NO: 92763 - DNA, 25 bp, Mus musculus
cctatctacggtggccaacgaggct

SEQ ID NO: 92764 - DNA, 25 bp, Mus musculus
cctatgaaaccaggagagggcgctg

SEQ ID NO: 92765 - DNA, 25 bp, Mus musculus
cctatgaaatggctgtgaagattcc

SEQ ID NO: 92766 - DNA, 25 bp, Mus musculus
cctatgaagcggagctggctgtgca

SEQ ID NO: 92767 - DNA, 25 bp, Mus musculus
cctatgacagttctgatcagactgc

SEQ ID NO: 92768 - DNA, 25 bp, Mus musculus
cctatgagggagaaagcagcttact

SEQ ID NO: 92769 - DNA, 25 bp, Mus musculus
cctatgatgatctgtgtcgagccga

SEQ ID NO: 92770 - DNA, 25 bp, Mus musculus
cctatgatgtcttggatcagaaccg

SEQ ID NO: 92771 - DNA, 25 bp, Mus musculus
cctatgattggccagcagctgcaga

SEQ ID NO: 92772 - DNA, 25 bp, Mus musculus
cctatgcagtagtgggtgggccacc

SEQ ID NO: 92773 - DNA, 25 bp, Mus musculus
cctatggaaagggatgggaagcaca

SEQ ID NO: 92774 - DNA, 25 bp, Mus musculus
cctatggagcagaacaaagagacct

SEQ ID NO: 92775 - DNA, 25 bp, Mus musculus
cctatggcatgcagaggcagctact

SEQ ID NO: 92776 - DNA, 25 bp, Mus musculus
cctatggctgggtcatgtttgtcgc

SEQ ID NO: 92777 - DNA, 25 bp, Mus musculus
cctatgggacatggccgatactgca

SEQ ID NO: 92778 - DNA, 25 bp, Mus musculus
cctatggtcacaagcggtaccggca

SEQ ID NO: 92779 - DNA, 25 bp, Mus musculus
cctatggtcgtcatgaagagcgtgc

SEQ ID NO: 92780 - DNA, 25 bp, Mus musculus
cctatgtaacggagcggatcttggc

SEQ ID NO: 92781 - DNA, 25 bp, Mus musculus
cctatgtacatagcccagggtgacc

SEQ ID NO: 92782 - DNA, 25 bp, Mus musculus
cctatgtgaaccagggcgagaacct

SEQ ID NO: 92783 - DNA, 25 bp, Mus musculus
cctatgtgagagagtccagtgagca

SEQ ID NO: 92784 - DNA, 25 bp, Mus musculus
cctatgtgagctttccaaggaggac

SEQ ID NO: 92785 - DNA, 25 bp, Mus musculus
cctatgtgatgacggtgactggact

SEQ ID NO: 92786 - DNA, 25 bp, Mus musculus
cctatgtggaaagcattgtggaacc

SEQ ID NO: 92787 - DNA, 25 bp, Mus musculus
cctatgttcggaaaacggcagcagt

SEQ ID NO: 92788 - DNA, 25 bp, Mus musculus
cctattattgcacggcaggtgaccc

SEQ ID NO: 92789 - DNA, 25 bp, Mus musculus
cctattccatgggtatcttgagacc

SEQ ID NO: 92790 - DNA, 25 bp, Mus musculus
cctattctgtggctggatctggctg

SEQ ID NO: 92791 - DNA, 25 bp, Mus musculus
cctattgagggtgggatcctaggac

SEQ ID NO: 92792 - DNA, 25 bp, Mus musculus
cctattgctgtgtagtggagatacc

SEQ ID NO: 92793 - DNA, 25 bp, Mus musculus
cctcaaaacatagaatggaaccctt

SEQ ID NO: 92794 - DNA, 25 bp, Mus musculus
cctcaaagatatccgggtgcatggg

SEQ ID NO: 92795 - DNA, 25 bp, Mus musculus
cctcaacagggatcaaaacatactg

SEQ ID NO: 92796 - DNA, 25 bp, Mus musculus
cctcaacatggagcagggcatggca

SEQ ID NO: 92797 - DNA, 25 bp, Mus musculus
cctcaactatgaggccgtggaacaa

SEQ ID NO: 92798 - DNA, 25 bp, Mus musculus
cctcaactccaagcgtgagatcgtg

SEQ ID NO: 92799 - DNA, 25 bp, Mus musculus
cctcaagaggtttcatattttggat

SEQ ID NO: 92800 - DNA, 25 bp, Mus musculus
cctcaagatgcaggagaccagggag

SEQ ID NO: 92801 - DNA, 25 bp, Mus musculus
cctcaagccaggaatggttttattt

SEQ ID NO: 92802 - DNA, 25 bp, Mus musculus
cctcaaggaatgcagaaaggtgatc

SEQ ID NO: 92803 - DNA, 25 bp, Mus musculus
cctcaaggggacttgcttgtggatg

SEQ ID NO: 92804 - DNA, 25 bp, Mus musculus
cctcaagtactggtgtcgctgggaa

SEQ ID NO: 92805 - DNA, 25 bp, Mus musculus
cctcaatggagatggacgagtggac

SEQ ID NO: 92806 - DNA, 25 bp, Mus musculus
cctcacctactctctaaataaaaga

SEQ ID NO: 92807 - DNA, 25 bp, Mus musculus
cctcacctgactgtggtacttctgg

SEQ ID NO: 92808 - DNA, 25 bp, Mus musculus
cctcacgccatggaagaagctcttg

SEQ ID NO: 92809 - DNA, 25 bp, Mus musculus
cctcacggacgtgatggagcagatc

SEQ ID NO: 92810 - DNA, 25 bp, Mus musculus
cctcactgacatggccaaagctgga

SEQ ID NO: 92811 - DNA, 25 bp, Mus musculus
cctcactggaggaaactgctatcat

SEQ ID NO: 92812 - DNA, 25 bp, Mus musculus
cctcagaaacacttgattcttctgg

SEQ ID NO: 92813 - DNA, 25 bp, Mus musculus
cctcagaaacagacgtggactccat

SEQ ID NO: 92814 - DNA, 25 bp, Mus musculus
cctcagaacgcggcgcggagactga

SEQ ID NO: 92815 - DNA, 25 bp, Mus musculus
cctcagaagagatacttcagcatct

SEQ ID NO: 92816 - DNA, 25 bp, Mus musculus
cctcagaaggaggaagacttgggcc

SEQ ID NO: 92817 - DNA, 25 bp, Mus musculus
cctcagaaggtgaaggagtttctcc

SEQ ID NO: 92818 - DNA, 25 bp, Mus musculus
cctcagaatttgatgagtgggagcc

SEQ ID NO: 92819 - DNA, 25 bp, Mus musculus
cctcagacgtggagaagttcatgcc

SEQ ID NO: 92820 - DNA, 25 bp, Mus musculus
cctcagactgtgctccaaggatcca

SEQ ID NO: 92821 - DNA, 25 bp, Mus musculus
cctcagagaacaagtggacggctac

SEQ ID NO: 92822 - DNA, 25 bp, Mus musculus
cctcagagaggttgatgaagacact

SEQ ID NO: 92823 - DNA, 25 bp, Mus musculus
cctcagaggcttccggagtagactc

SEQ ID NO: 92824 - DNA, 25 bp, Mus musculus
cctcagagttctgtgggtctaagac

SEQ ID NO: 92825 - DNA, 25 bp, Mus musculus
cctcagatatgggtggttatgccac

SEQ ID NO: 92826 - DNA, 25 bp, Mus musculus
cctcagatcatcttgggaagggaga

SEQ ID NO: 92827 - DNA, 25 bp, Mus musculus
cctcagcagcgggaaattcggcaga

SEQ ID NO: 92828 - DNA, 25 bp, Mus musculus
cctcagctcagcaggtttgggcaga

SEQ ID NO: 92829 - DNA, 25 bp, Mus musculus
cctcagctggccaaattcagtcctg

SEQ ID NO: 92830 - DNA, 25 bp, Mus musculus
cctcagcttgagcagtttgttaaag

SEQ ID NO: 92831 - DNA, 25 bp, Mus musculus
cctcaggaagcggacgggattgact

SEQ ID NO: 92832 - DNA, 25 bp, Mus musculus
cctcaggacagcaaagcatcgtaga

SEQ ID NO: 92833 - DNA, 25 bp, Mus musculus
cctcaggatagggacaacatggtgc

SEQ ID NO: 92834 - DNA, 25 bp, Mus musculus
cctcaggatcgtgaaaaaggctctg

SEQ ID NO: 92835 - DNA, 25 bp, Mus musculus
cctcaggctggggtcttatgtgccc

SEQ ID NO: 92836 - DNA, 25 bp, Mus musculus
cctcagggatgagagtggcttgaac

SEQ ID NO: 92837 - DNA, 25 bp, Mus musculus
cctcagtatgcctttgctggaagca

SEQ ID NO: 92838 - DNA, 25 bp, Mus musculus
cctcagtgagatcaaccatcaagac

SEQ ID NO: 92839 - DNA, 25 bp, Mus musculus
cctcagtggagggtgtgacactaac

SEQ ID NO: 92840 - DNA, 25 bp, Mus musculus
cctcagttagaggatctcgcctgga

SEQ ID NO: 92841 - DNA, 25 bp, Mus musculus
cctcagttgacaaggagactggcgg

SEQ ID NO: 92842 - DNA, 25 bp, Mus musculus
cctcagtttaacagattttgcaatc

SEQ ID NO: 92843 - DNA, 25 bp, Mus musculus
cctcatagattcaatgaccaaacag

SEQ ID NO: 92844 - DNA, 25 bp, Mus musculus
cctcatagtggaaactaggcataag

SEQ ID NO: 92845 - DNA, 25 bp, Mus musculus
cctcatatgaaagagaaaggtgccc

SEQ ID NO: 92846 - DNA, 25 bp, Mus musculus
cctcatcaacaaggaagggcatgtg

SEQ ID NO: 92847 - DNA, 25 bp, Mus musculus
cctcatcaagccacagaagcgcgtg

SEQ ID NO: 92848 - DNA, 25 bp, Mus musculus
cctcatcaaggtagcggttaaagtg

SEQ ID NO: 92849 - DNA, 25 bp, Mus musculus
cctcatcccagctgttgggagggag

SEQ ID NO: 92850 - DNA, 25 bp, Mus musculus
cctcatctgccggaagtgggaaatg

SEQ ID NO: 92851 - DNA, 25 bp, Mus musculus
cctcatgaaggtctatgtggacccc

SEQ ID NO: 92852 - DNA, 25 bp, Mus musculus
cctcatgaatgaactgggcctggag

SEQ ID NO: 92853 - DNA, 25 bp, Mus musculus
cctcatgaattaagcgctgtgtttg

SEQ ID NO: 92854 - DNA, 25 bp, Mus musculus
cctcatggactgaagcagattggtc

SEQ ID NO: 92855 - DNA, 25 bp, Mus musculus
cctcatggcgctgcgacggagagaa

SEQ ID NO: 92856 - DNA, 25 bp, Mus musculus
cctcatgggaggagaggatactcca

SEQ ID NO: 92857 - DNA, 25 bp, Mus musculus
cctcatgggcggagcaatggagcat

SEQ ID NO: 92858 - DNA, 25 bp, Mus musculus
cctcatggtatgtcagtggcgctgc

SEQ ID NO: 92859 - DNA, 25 bp, Mus musculus
cctcatggtgagtgaaatggagagc

SEQ ID NO: 92860 - DNA, 25 bp, Mus musculus
cctcatggtggtggtatttgaactc

SEQ ID NO: 92861 - DNA, 25 bp, Mus musculus
cctcatggtgttcagctcagtggga

SEQ ID NO: 92862 - DNA, 25 bp, Mus musculus
cctcatgtctatgatccggaagcga

SEQ ID NO: 92863 - DNA, 25 bp, Mus musculus
cctcatgtgacagtgggctttactg

SEQ ID NO: 92864 - DNA, 25 bp, Mus musculus
cctcattaagggaagtgtggctgga

SEQ ID NO: 92865 - DNA, 25 bp, Mus musculus
cctcattgaacgtgggaagaacatg

SEQ ID NO: 92866 - DNA, 25 bp, Mus musculus
cctccaaaagtatggccgtgcctgg

SEQ ID NO: 92867 - DNA, 25 bp, Mus musculus
cctccaaggaaacgagtcaagggca

SEQ ID NO: 92868 - DNA, 25 bp, Mus musculus
cctccaaggcacctgaacatgtgtg

SEQ ID NO: 92869 - DNA, 25 bp, Mus musculus
cctccaagtaatgagttcaagatca

SEQ ID NO: 92870 - DNA, 25 bp, Mus musculus
cctccacaggatgcaaggcggacat

SEQ ID NO: 92871 - DNA, 25 bp, Mus musculus
cctccagaaaccatagcagatggtg

SEQ ID NO: 92872 - DNA, 25 bp, Mus musculus
cctccagcagcagaatgggctgtgc

SEQ ID NO: 92873 - DNA, 25 bp, Mus musculus
cctccagccgtgcttagaaacatcg

SEQ ID NO: 92874 - DNA, 25 bp, Mus musculus
cctccaggagagaagatgacattgc

SEQ ID NO: 92875 - DNA, 25 bp, Mus musculus
cctccaggcgagtttaaggaagtct

SEQ ID NO: 92876 - DNA, 25 bp, Mus musculus
cctccagggaaggatcaggcaacct

SEQ ID NO: 92877 - DNA, 25 bp, Mus musculus
cctccagggagattgtgcagcagct

SEQ ID NO: 92878 - DNA, 25 bp, Mus musculus
cctccagggccaagtgatgtcatct

SEQ ID NO: 92879 - DNA, 25 bp, Mus musculus
cctccaggtgaggagctggataaca

SEQ ID NO: 92880 - DNA, 25 bp, Mus musculus
cctccatcatgaagatacatacatt

SEQ ID NO: 92881 - DNA, 25 bp, Mus musculus
cctcccaaggtgaagtgtgaaacaa

SEQ ID NO: 92882 - DNA, 25 bp, Mus musculus
cctcccagcctggttaatgtgaaaa

SEQ ID NO: 92883 - DNA, 25 bp, Mus musculus
cctccccgcaggttttggcatgaac

SEQ ID NO: 92884 - DNA, 25 bp, Mus musculus
cctcccctgggaagataagctggta

SEQ ID NO: 92885 - DNA, 25 bp, Mus musculus
cctccctgaaggtgctactgatctg

SEQ ID NO: 92886 - DNA, 25 bp, Mus musculus
cctcccttggccagcgtggatagga

SEQ ID NO: 92887 - DNA, 25 bp, Mus musculus
cctccgaagcgaagatggtggacta

SEQ ID NO: 92888 - DNA, 25 bp, Mus musculus
cctccgaaggctcactggtctagaa

SEQ ID NO: 92889 - DNA, 25 bp, Mus musculus
cctccgagcggatgctgaaaaggct

SEQ ID NO: 92890 - DNA, 25 bp, Mus musculus
cctccgagctcgtggaagattcgca

SEQ ID NO: 92891 - DNA, 25 bp, Mus musculus
cctccgaggccagcgacgagaagga

SEQ ID NO: 92892 - DNA, 25 bp, Mus musculus
cctccgccttttcgatcagggtggg

SEQ ID NO: 92893 - DNA, 25 bp, Mus musculus
cctccggaggcgaagttgtgacctg

SEQ ID NO: 92894 - DNA, 25 bp, Mus musculus
cctccggatgtacagcagcagtatt

SEQ ID NO: 92895 - DNA, 25 bp, Mus musculus
cctccgggcgagtacttcagcgttg

SEQ ID NO: 92896 - DNA, 25 bp, Mus musculus
cctccgggctaaattctggcttggc

SEQ ID NO: 92897 - DNA, 25 bp, Mus musculus
cctccggttctggtctttaagctca

SEQ ID NO: 92898 - DNA, 25 bp, Mus musculus
cctcctaaggagtggaagccaagac

SEQ ID NO: 92899 - DNA, 25 bp, Mus musculus
cctcctaagggttaccctatatcat

SEQ ID NO: 92900 - DNA, 25 bp, Mus musculus
cctcctatgggtaagccacctgggt

SEQ ID NO: 92901 - DNA, 25 bp, Mus musculus
cctcctcaatagaagaagtggcaga

SEQ ID NO: 92902 - DNA, 25 bp, Mus musculus
cctcctcctgagatggctggacaca

SEQ ID NO: 92903 - DNA, 25 bp, Mus musculus
cctcctcctggtagcatggttcaag

SEQ ID NO: 92904 - DNA, 25 bp, Mus musculus
cctcctcgagcatgggaagctgcag

SEQ ID NO: 92905 - DNA, 25 bp, Mus musculus
cctcctctagaatatcaagaaatgc

SEQ ID NO: 92906 - DNA, 25 bp, Mus musculus
cctcctctatgcgaaggctttggta

SEQ ID NO: 92907 - DNA, 25 bp, Mus musculus
cctcctgacatagcaaacggtgtgg

SEQ ID NO: 92908 - DNA, 25 bp, Mus musculus
cctcctgatgagaccatggactttg

SEQ ID NO: 92909 - DNA, 25 bp, Mus musculus
cctcctgccttgtgtaagaacctgg

SEQ ID NO: 92910 - DNA, 25 bp, Mus musculus
cctcctggaagctgaagtacccctt

SEQ ID NO: 92911 - DNA, 25 bp, Mus musculus
cctcctggaatgactttaaatgaaa

SEQ ID NO: 92912 - DNA, 25 bp, Mus musculus
cctcctggcatgtggtgatcggcga

SEQ ID NO: 92913 - DNA, 25 bp, Mus musculus
cctcctggcggatgctggctttgat

SEQ ID NO: 92914 - DNA, 25 bp, Mus musculus
cctcctgggccaaagggagacagag

SEQ ID NO: 92915 - DNA, 25 bp, Mus musculus
cctcctgtccaacgaagactcagtg

SEQ ID NO: 92916 - DNA, 25 bp, Mus musculus
cctccttggtggatgagatcgctct

SEQ ID NO: 92917 - DNA, 25 bp, Mus musculus
cctcgaaattgggagcagtcaagat

SEQ ID NO: 92918 - DNA, 25 bp, Mus musculus
cctcgaagtgggttacagcaagcac

SEQ ID NO: 92919 - DNA, 25 bp, Mus musculus
cctcgacgggaagctcaagcatgag

SEQ ID NO: 92920 - DNA, 25 bp, Mus musculus
cctcgagaggagctgtttgtgacat

SEQ ID NO: 92921 - DNA, 25 bp, Mus musculus
cctcgagccgctagatgaagatctc

SEQ ID NO: 92922 - DNA, 25 bp, Mus musculus
cctcgaggcgcagaagcaggagtat

SEQ ID NO: 92923 - DNA, 25 bp, Mus musculus
cctcgaggctgccagtgtgaccttg

SEQ ID NO: 92924 - DNA, 25 bp, Mus musculus
cctcgatggctatgacagggacaac

SEQ ID NO: 92925 - DNA, 25 bp, Mus musculus
cctcgcagaagctggcgggcattgt

SEQ ID NO: 92926 - DNA, 25 bp, Mus musculus
cctcgccgggaagacattgtggaca

SEQ ID NO: 92927 - DNA, 25 bp, Mus musculus
cctcgctgaggtgaagcctctggtg

SEQ ID NO: 92928 - DNA, 25 bp, Mus musculus
cctcggactgagagcatgagtgaat

SEQ ID NO: 92929 - DNA, 25 bp, Mus musculus
cctcggagagaaggaggtgatcaaa

SEQ ID NO: 92930 - DNA, 25 bp, Mus musculus
cctcggagatcggagaactgaaacg

SEQ ID NO: 92931 - DNA, 25 bp, Mus musculus
cctcggatgagtggctttatgtatc

SEQ ID NO: 92932 - DNA, 25 bp, Mus musculus
cctcggcaaggaagagactgtgcta

SEQ ID NO: 92933 - DNA, 25 bp, Mus musculus
cctcggcagcgagtgactggaacac

SEQ ID NO: 92934 - DNA, 25 bp, Mus musculus
cctcggccgggttgagcaagtctct

SEQ ID NO: 92935 - DNA, 25 bp, Mus musculus
cctcggcctcgttgccgcttttggg

SEQ ID NO: 92936 - DNA, 25 bp, Mus musculus
cctcggctacttgtgcggctctgtg

SEQ ID NO: 92937 - DNA, 25 bp, Mus musculus
cctcggctgagtgtccaagtgatga

SEQ ID NO: 92938 - DNA, 25 bp, Mus musculus
cctcgggtgcccaattcattagtgt

SEQ ID NO: 92939 - DNA, 25 bp, Mus musculus
cctcggtgcgcgaggtccgtaaaga

SEQ ID NO: 92940 - DNA, 25 bp, Mus musculus
cctcggtggcggagaactgcattaa

SEQ ID NO: 92941 - DNA, 25 bp, Mus musculus
cctcggtgggattcaagtgcattct

SEQ ID NO: 92942 - DNA, 25 bp, Mus musculus
cctcggttcaaaaggtctagctgca

SEQ ID NO: 92943 - DNA, 25 bp, Mus musculus
cctcgtgaatgggatgaagtactct

SEQ ID NO: 92944 - DNA, 25 bp, Mus musculus
cctcgtgatgagactgattgaaaac

SEQ ID NO: 92945 - DNA, 25 bp, Mus musculus
cctcgtggccaacaaggtggatctg

SEQ ID NO: 92946 - DNA, 25 bp, Mus musculus
cctcgtggtatgttctgtaggaacc

SEQ ID NO: 92947 - DNA, 25 bp, Mus musculus
cctcgtgtgcgcgggacccagcagg

SEQ ID NO: 92948 - DNA, 25 bp, Mus musculus
cctcgtgtgcggtgttgtctgtgaa

SEQ ID NO: 92949 - DNA, 25 bp, Mus musculus
cctcgttgcctttgaatgggaccct

SEQ ID NO: 92950 - DNA, 25 bp, Mus musculus
cctctaagaggaaggcgtcagcttt

SEQ ID NO: 92951 - DNA, 25 bp, Mus musculus
cctctaagatcaaatgatggactcc

SEQ ID NO: 92952 - DNA, 25 bp, Mus musculus
cctctaagctggaacgtaggatcta

SEQ ID NO: 92953 - DNA, 25 bp, Mus musculus
cctctaatgcaatggaaaacgcaag

SEQ ID NO: 92954 - DNA, 25 bp, Mus musculus
cctctacgagatgctacatggcctg

SEQ ID NO: 92955 - DNA, 25 bp, Mus musculus
cctctagatagggaagaaactgcct

SEQ ID NO: 92956 - DNA, 25 bp, Mus musculus
cctctagcaattggattaactggcc

SEQ ID NO: 92957 - DNA, 25 bp, Mus musculus
cctctcaatgaggagctggactatg

SEQ ID NO: 92958 - DNA, 25 bp, Mus musculus
cctctcacttgggaatgcaatggcg

SEQ ID NO: 92959 - DNA, 25 bp, Mus musculus
cctctcagaagttcgggcaatgggc

SEQ ID NO: 92960 - DNA, 25 bp, Mus musculus
cctctcagtgaaaggcagatgtccc

SEQ ID NO: 92961 - DNA, 25 bp, Mus musculus
cctctcatggagtaaaacggtgtga

SEQ ID NO: 92962 - DNA, 25 bp, Mus musculus
cctctcctgagtgtgtgaagctggg

SEQ ID NO: 92963 - DNA, 25 bp, Mus musculus
cctctcggctctcccatggaggagg

SEQ ID NO: 92964 - DNA, 25 bp, Mus musculus
cctctcgggataggagacgacgaag

SEQ ID NO: 92965 - DNA, 25 bp, Mus musculus
cctctcgggcttactgggcaggaga

SEQ ID NO: 92966 - DNA, 25 bp, Mus musculus
cctctcgtcggatgatttggactca

SEQ ID NO: 92967 - DNA, 25 bp, Mus musculus
cctctcgttgcacggccttgggcat

SEQ ID NO: 92968 - DNA, 25 bp, Mus musculus
cctctctctggaccaaagtgaagga

SEQ ID NO: 92969 - DNA, 25 bp, Mus musculus
cctctctctgggatgaagttactaa

SEQ ID NO: 92970 - DNA, 25 bp, Mus musculus
cctctctggttgctaggctttcggg

SEQ ID NO: 92971 - DNA, 25 bp, Mus musculus
cctctgaaagtaaaagacatccctg

SEQ ID NO: 92972 - DNA, 25 bp, Mus musculus
cctctgaactctattttgaggtgga

SEQ ID NO: 92973 - DNA, 25 bp, Mus musculus
cctctgaagtgcacagggagcgaga

SEQ ID NO: 92974 - DNA, 25 bp, Mus musculus
cctctgacgacaaagttgcgccggc

SEQ ID NO: 92975 - DNA, 25 bp, Mus musculus
cctctgaggaactcagactggctgg

SEQ ID NO: 92976 - DNA, 25 bp, Mus musculus
cctctgaggcctgcgtgttgctgga

SEQ ID NO: 92977 - DNA, 25 bp, Mus musculus
cctctgagttcaggtggcagtgaca

SEQ ID NO: 92978 - DNA, 25 bp, Mus musculus
cctctgatgaggagtacctgagccc

SEQ ID NO: 92979 - DNA, 25 bp, Mus musculus
cctctgcaagggttggaagtgcgcc

SEQ ID NO: 92980 - DNA, 25 bp, Mus musculus
cctctgcagggaccaaaaggtttgc

SEQ ID NO: 92981 - DNA, 25 bp, Mus musculus
cctctgcagttaagacggtgggttc

SEQ ID NO: 92982 - DNA, 25 bp, Mus musculus
cctctgcggagattccaggccccac

SEQ ID NO: 92983 - DNA, 25 bp, Mus musculus
cctctgctgctaatttgaagcaaga

SEQ ID NO: 92984 - DNA, 25 bp, Mus musculus
cctctgctgtatatggacttcaaga

SEQ ID NO: 92985 - DNA, 25 bp, Mus musculus
cctctggaattcaagtggatacgga

SEQ ID NO: 92986 - DNA, 25 bp, Mus musculus
cctctggacctgaaatgtgaccctg

SEQ ID NO: 92987 - DNA, 25 bp, Mus musculus
cctctggaggcgaaggctgaaaatg

SEQ ID NO: 92988 - DNA, 25 bp, Mus musculus
cctctggccctcaccattgtccttg

SEQ ID NO: 92989 - DNA, 25 bp, Mus musculus
cctctggcggtggtttgatgaaatc

SEQ ID NO: 92990 - DNA, 25 bp, Mus musculus
cctctggctggatgagctgatgcca

SEQ ID NO: 92991 - DNA, 25 bp, Mus musculus
cctctggctggtgacaatcgtcttc

SEQ ID NO: 92992 - DNA, 25 bp, Mus musculus
cctctgggtgacaacgtgctgactc

SEQ ID NO: 92993 - DNA, 25 bp, Mus musculus
cctctgtagagctcagttcatggaa

SEQ ID NO: 92994 - DNA, 25 bp, Mus musculus
cctctgtagtttttacctacaatca

SEQ ID NO: 92995 - DNA, 25 bp, Mus musculus
cctctgtcagatggcgcgggaactg

SEQ ID NO: 92996 - DNA, 25 bp, Mus musculus
cctctgtgatcgaggagcggcgcaa

SEQ ID NO: 92997 - DNA, 25 bp, Mus musculus
cctctgtggatgaaggtgagaacac

SEQ ID NO: 92998 - DNA, 25 bp, Mus musculus
cctctgtggcttattcggggcggta

SEQ ID NO: 92999 - DNA, 25 bp, Mus musculus
cctctgtgtggctctgatactggag

SEQ ID NO: 93000 - DNA, 25 bp, Mus musculus
cctcttacaattaggtggctgacga

SEQ ID NO: 93001 - DNA, 25 bp, Mus musculus
cctcttattatggtggacgcggtgt

SEQ ID NO: 93002 - DNA, 25 bp, Mus musculus
cctcttcaatagtggcgcggttgcg

SEQ ID NO: 93003 - DNA, 25 bp, Mus musculus
cctcttccaagagaatgaactttga

SEQ ID NO: 93004 - DNA, 25 bp, Mus musculus
cctcttcggcttccgtagacgaggt

SEQ ID NO: 93005 - DNA, 25 bp, Mus musculus
cctcttgacaagatgggcaacagtg

SEQ ID NO: 93006 - DNA, 25 bp, Mus musculus
cctcttgattccattttgaaagaaa

SEQ ID NO: 93007 - DNA, 25 bp, Mus musculus
cctcttggaagtgcacatgggccgc

SEQ ID NO: 93008 - DNA, 25 bp, Mus musculus
cctctttaaaatgtgggtactggca

SEQ ID NO: 93009 - DNA, 25 bp, Mus musculus
cctctttcagaagcgggactgcgat

SEQ ID NO: 93010 - DNA, 25 bp, Mus musculus
cctctttggaattaggcagaacgac

SEQ ID NO: 93011 - DNA, 25 bp, Mus musculus
cctctttgtgggtcaggctggaaca

SEQ ID NO: 93012 - DNA, 25 bp, Mus musculus
cctctttgtttatattgaagcagca

SEQ ID NO: 93013 - DNA, 25 bp, Mus musculus
cctgaaacaaaggaccatgctgtgg

SEQ ID NO: 93014 - DNA, 25 bp, Mus musculus
cctgaaacgagggatgagatgttct

SEQ ID NO: 93015 - DNA, 25 bp, Mus musculus
cctgaaacggaacaagtgaatggat

SEQ ID NO: 93016 - DNA, 25 bp, Mus musculus
cctgaaactccatgggaagtgtgat

SEQ ID NO: 93017 - DNA, 25 bp, Mus musculus
cctgaaagcaaagtttcggaagagc

SEQ ID NO: 93018 - DNA, 25 bp, Mus musculus
cctgaaagccagcataggcagtgtg

SEQ ID NO: 93019 - DNA, 25 bp, Mus musculus
cctgaaagggcattttggctccggg

SEQ ID NO: 93020 - DNA, 25 bp, Mus musculus
cctgaaagtgtcttctgagcagcag

SEQ ID NO: 93021 - DNA, 25 bp, Mus musculus
cctgaaataacgtgggagatgctct

SEQ ID NO: 93022 - DNA, 25 bp, Mus musculus
cctgaaatctgagaaaagtgcggct

SEQ ID NO: 93023 - DNA, 25 bp, Mus musculus
cctgaacatgtgtggcatacataca

SEQ ID NO: 93024 - DNA, 25 bp, Mus musculus
cctgaaccagtggaggactgtgtgc

SEQ ID NO: 93025 - DNA, 25 bp, Mus musculus
cctgaacccagagatgaaagaaaat

SEQ ID NO: 93026 - DNA, 25 bp, Mus musculus
cctgaacggtggatgagaacgctct

SEQ ID NO: 93027 - DNA, 25 bp, Mus musculus
cctgaactggcacgtcatcactgat

SEQ ID NO: 93028 - DNA, 25 bp, Mus musculus
cctgaagaaagaggccgctttgcac

SEQ ID NO: 93029 - DNA, 25 bp, Mus musculus
cctgaagaaccatctactgtgggac

SEQ ID NO: 93030 - DNA, 25 bp, Mus musculus
cctgaagaagatgggacagaggccc

SEQ ID NO: 93031 - DNA, 25 bp, Mus musculus
cctgaagaagcacgaacacgagggc

SEQ ID NO: 93032 - DNA, 25 bp, Mus musculus
cctgaagaatcgttacaacttgggc

SEQ ID NO: 93033 - DNA, 25 bp, Mus musculus
cctgaagactgccacgaatcctaag

SEQ ID NO: 93034 - DNA, 25 bp, Mus musculus
cctgaagaggatgtcggaggccttg

SEQ ID NO: 93035 - DNA, 25 bp, Mus musculus
cctgaagatagaaccattgggtgcc

SEQ ID NO: 93036 - DNA, 25 bp, Mus musculus
cctgaagatcggtgtgggacatcgc

SEQ ID NO: 93037 - DNA, 25 bp, Mus musculus
cctgaagatggagggtcctttgtcc

SEQ ID NO: 93038 - DNA, 25 bp, Mus musculus
cctgaagcagggtcacaaaagtgtg

SEQ ID NO: 93039 - DNA, 25 bp, Mus musculus
cctgaagcatagtgggattggccga

SEQ ID NO: 93040 - DNA, 25 bp, Mus musculus
cctgaagctgcaagagactgcttac

SEQ ID NO: 93041 - DNA, 25 bp, Mus musculus
cctgaagctgggttaatctacacac

SEQ ID NO: 93042 - DNA, 25 bp, Mus musculus
cctgaaggacacagccaatcgcctg

SEQ ID NO: 93043 - DNA, 25 bp, Mus musculus
cctgaaggacgctaaggagtacgct

SEQ ID NO: 93044 - DNA, 25 bp, Mus musculus
cctgaaggatgatatcggagcctgc

SEQ ID NO: 93045 - DNA, 25 bp, Mus musculus
cctgaaggccaagatgaaggtgtat

SEQ ID NO: 93046 - DNA, 25 bp, Mus musculus
cctgaaggctgtccatgaagaaacc

SEQ ID NO: 93047 - DNA, 25 bp, Mus musculus
cctgaagtacgttaacgtgggagat

SEQ ID NO: 93048 - DNA, 25 bp, Mus musculus
cctgaagtgacccagggcaagaact

SEQ ID NO: 93049 - DNA, 25 bp, Mus musculus
cctgaagtgcccagcagtggtagca

SEQ ID NO: 93050 - DNA, 25 bp, Mus musculus
cctgaagtggtggaacccctggaga

SEQ ID NO: 93051 - DNA, 25 bp, Mus musculus
cctgaagttccacggcagctggtga

SEQ ID NO: 93052 - DNA, 25 bp, Mus musculus
cctgaagttgtcatgaaacggcggc

SEQ ID NO: 93053 - DNA, 25 bp, Mus musculus
cctgaataaggcagctgcgggcagt

SEQ ID NO: 93054 - DNA, 25 bp, Mus musculus
cctgaatagtatgcctgaatagaga

SEQ ID NO: 93055 - DNA, 25 bp, Mus musculus
cctgaatcagggttctctaaggagg

SEQ ID NO: 93056 - DNA, 25 bp, Mus musculus
cctgaatcctagtgacggtgagcca

SEQ ID NO: 93057 - DNA, 25 bp, Mus musculus
cctgaatgcagaggagaaagccgtc

SEQ ID NO: 93058 - DNA, 25 bp, Mus musculus
cctgaatgcctaccgagaaaacgtg

SEQ ID NO: 93059 - DNA, 25 bp, Mus musculus
cctgaatggagcgagaaagtggccc

SEQ ID NO: 93060 - DNA, 25 bp, Mus musculus
cctgaatgttcatccgtttgggcgt

SEQ ID NO: 93061 - DNA, 25 bp, Mus musculus
cctgaattgcgtccccgaaatagct

SEQ ID NO: 93062 - DNA, 25 bp, Mus musculus
cctgaatttaagatgctgggtgtcc

SEQ ID NO: 93063 - DNA, 25 bp, Mus musculus
cctgacaagttagtccgggcagcag

SEQ ID NO: 93064 - DNA, 25 bp, Mus musculus
cctgacaatcaggatgcctaccggg

SEQ ID NO: 93065 - DNA, 25 bp, Mus musculus
cctgacagagagctgtatattcttg

SEQ ID NO: 93066 - DNA, 25 bp, Mus musculus
cctgacagttgtgatcgcatggagt

SEQ ID NO: 93067 - DNA, 25 bp, Mus musculus
cctgacatcgctgaggaaaacggaa

SEQ ID NO: 93068 - DNA, 25 bp, Mus musculus
cctgacattgatgcaaatgaagcca

SEQ ID NO: 93069 - DNA, 25 bp, Mus musculus
cctgacattgttgtgcggcctggac

SEQ ID NO: 93070 - DNA, 25 bp, Mus musculus
cctgacatttggtgctctagagcat

SEQ ID NO: 93071 - DNA, 25 bp, Mus musculus
cctgaccaagaaaaaacgagaagct

SEQ ID NO: 93072 - DNA, 25 bp, Mus musculus
cctgaccataaaaaagttgctgctt

SEQ ID NO: 93073 - DNA, 25 bp, Mus musculus
cctgacccaactccagacagaagta

SEQ ID NO: 93074 - DNA, 25 bp, Mus musculus
cctgaccctgaatgagcggctgctt

SEQ ID NO: 93075 - DNA, 25 bp, Mus musculus
cctgaccgcattgcccgcggaggga

SEQ ID NO: 93076 - DNA, 25 bp, Mus musculus
cctgaccggctacagaagtgtcctt

SEQ ID NO: 93077 - DNA, 25 bp, Mus musculus
cctgacctctgtctggagtggagta

SEQ ID NO: 93078 - DNA, 25 bp, Mus musculus
cctgacctgcacaaacatggcgaga

SEQ ID NO: 93079 - DNA, 25 bp, Mus musculus
cctgacgctgctgtttgagaaatgt

SEQ ID NO: 93080 - DNA, 25 bp, Mus musculus
cctgactcagaagcgagagctaaca

SEQ ID NO: 93081 - DNA, 25 bp, Mus musculus
cctgactcggaagagaggctgatcc

SEQ ID NO: 93082 - DNA, 25 bp, Mus musculus
cctgactctttctggcctcgtggaa

SEQ ID NO: 93083 - DNA, 25 bp, Mus musculus
cctgactgacagtgttgaggccgca

SEQ ID NO: 93084 - DNA, 25 bp, Mus musculus
cctgactgacttggatggcattggc

SEQ ID NO: 93085 - DNA, 25 bp, Mus musculus
cctgactgagacctgtgaagatgca

SEQ ID NO: 93086 - DNA, 25 bp, Mus musculus
cctgactgccagctccagagagtaa

SEQ ID NO: 93087 - DNA, 25 bp, Mus musculus
cctgactgcgatggtctcgaaggca

SEQ ID NO: 93088 - DNA, 25 bp, Mus musculus
cctgacttaccagtagatgggagcc

SEQ ID NO: 93089 - DNA, 25 bp, Mus musculus
cctgacttcagatcaagagacggta

SEQ ID NO: 93090 - DNA, 25 bp, Mus musculus
cctgagaagccaggctagtgttgcc

SEQ ID NO: 93091 - DNA, 25 bp, Mus musculus
cctgagaaggcttagcgcctgcgcg

SEQ ID NO: 93092 - DNA, 25 bp, Mus musculus
cctgagaaggtgaaaggaggcatct

SEQ ID NO: 93093 - DNA, 25 bp, Mus musculus
cctgagacaaaaagaaggacctggg

SEQ ID NO: 93094 - DNA, 25 bp, Mus musculus
cctgagacagcgtgaagatgaccga

SEQ ID NO: 93095 - DNA, 25 bp, Mus musculus
cctgagacatgtgggaaccggatgc

SEQ ID NO: 93096 - DNA, 25 bp, Mus musculus
cctgagaccagagatccgtatttta

SEQ ID NO: 93097 - DNA, 25 bp, Mus musculus
cctgagacggagaaagcgcctgctg

SEQ ID NO: 93098 - DNA, 25 bp, Mus musculus
cctgagacgtggaccttgaagaaca

SEQ ID NO: 93099 - DNA, 25 bp, Mus musculus
cctgagacttttgagcctggcctgt

SEQ ID NO: 93100 - DNA, 25 bp, Mus musculus
cctgagagaccctgctgacagtgtc

SEQ ID NO: 93101 - DNA, 25 bp, Mus musculus
cctgagagagactgtgcctgggatc

SEQ ID NO: 93102 - DNA, 25 bp, Mus musculus
cctgagaggccggatgattcttcta

SEQ ID NO: 93103 - DNA, 25 bp, Mus musculus
cctgagatccccatgacagaagcgg

SEQ ID NO: 93104 - DNA, 25 bp, Mus musculus
cctgagatgctggatgtgaaacact

SEQ ID NO: 93105 - DNA, 25 bp, Mus musculus
cctgagatttacttgcaaaggcctt

SEQ ID NO: 93106 - DNA, 25 bp, Mus musculus
cctgagcacaacgaatgggcattaa

SEQ ID NO: 93107 - DNA, 25 bp, Mus musculus
cctgagcagatttgcttacaatgga

SEQ ID NO: 93108 - DNA, 25 bp, Mus musculus
cctgagccagcggaagaatacacag

SEQ ID NO: 93109 - DNA, 25 bp, Mus musculus
cctgagccagctctcaagaaaatgg

SEQ ID NO: 93110 - DNA, 25 bp, Mus musculus
cctgagccccgagtactttgaaaag

SEQ ID NO: 93111 - DNA, 25 bp, Mus musculus
cctgagcccggagaagcagcattct

SEQ ID NO: 93112 - DNA, 25 bp, Mus musculus
cctgagccgagcagctgcgcgacgt

SEQ ID NO: 93113 - DNA, 25 bp, Mus musculus
cctgagccgggcgtttggaaactgc

SEQ ID NO: 93114 - DNA, 25 bp, Mus musculus
cctgagcgatgtgcctcaggcagag

SEQ ID NO: 93115 - DNA, 25 bp, Mus musculus
cctgagcgcgtcactagctcggaag

SEQ ID NO: 93116 - DNA, 25 bp, Mus musculus
cctgagcgtcggaacaagagcggta

SEQ ID NO: 93117 - DNA, 25 bp, Mus musculus
cctgagctcggtgagttgggaccaa

SEQ ID NO: 93118 - DNA, 25 bp, Mus musculus
cctgagctggctgagttacggagtc

SEQ ID NO: 93119 - DNA, 25 bp, Mus musculus
cctgagctggcttctggtgtacaca

SEQ ID NO: 93120 - DNA, 25 bp, Mus musculus
cctgagctgtcagtgaagggagcca

SEQ ID NO: 93121 - DNA, 25 bp, Mus musculus
cctgagctgtcccaaggagaagaaa

SEQ ID NO: 93122 - DNA, 25 bp, Mus musculus
cctgaggaagcgtcatatcggcaac

SEQ ID NO: 93123 - DNA, 25 bp, Mus musculus
cctgaggactcattggcgtgggaac

SEQ ID NO: 93124 - DNA, 25 bp, Mus musculus
cctgaggagaacagtctgcaaagac

SEQ ID NO: 93125 - DNA, 25 bp, Mus musculus
cctgaggatttgtcagctgtcacaa

SEQ ID NO: 93126 - DNA, 25 bp, Mus musculus
cctgaggccataccccaaggaagaa

SEQ ID NO: 93127 - DNA, 25 bp, Mus musculus
cctgaggcgtgatggagacttagaa

SEQ ID NO: 93128 - DNA, 25 bp, Mus musculus
cctgaggctagaaccggactgctgt

SEQ ID NO: 93129 - DNA, 25 bp, Mus musculus
cctgaggctagcttcctggagactt

SEQ ID NO: 93130 - DNA, 25 bp, Mus musculus
cctgaggctcgtgggtttgatctac

SEQ ID NO: 93131 - DNA, 25 bp, Mus musculus
cctgagggacctgacgaagaagatg

SEQ ID NO: 93132 - DNA, 25 bp, Mus musculus
cctgagggccgtaagtgaagtctcc

SEQ ID NO: 93133 - DNA, 25 bp, Mus musculus
cctgaggtacctgcaagaacaaaac

SEQ ID NO: 93134 - DNA, 25 bp, Mus musculus
cctgaggttcttgtctccaacggga

SEQ ID NO: 93135 - DNA, 25 bp, Mus musculus
cctgagtatctcctgcctgtgctaa

SEQ ID NO: 93136 - DNA, 25 bp, Mus musculus
cctgagtcctgccagcctgacatgg

SEQ ID NO: 93137 - DNA, 25 bp, Mus musculus
cctgagtctcacatgtagtggccga

SEQ ID NO: 93138 - DNA, 25 bp, Mus musculus
cctgagtgctggtacagtggacacg

SEQ ID NO: 93139 - DNA, 25 bp, Mus musculus
cctgagtggccagagtttgaaacct

SEQ ID NO: 93140 - DNA, 25 bp, Mus musculus
cctgagtgttgaattgttaaaggcg

SEQ ID NO: 93141 - DNA, 25 bp, Mus musculus
cctgagttcaatgccaagttggcag

SEQ ID NO: 93142 - DNA, 25 bp, Mus musculus
cctgagttcaggtgacaagtggagc

SEQ ID NO: 93143 - DNA, 25 bp, Mus musculus
cctgagttgaggtttgatagctgga

SEQ ID NO: 93144 - DNA, 25 bp, Mus musculus
cctgatacgttgctggaatggctgc

SEQ ID NO: 93145 - DNA, 25 bp, Mus musculus
cctgataggaccacactggagtgca

SEQ ID NO: 93146 - DNA, 25 bp, Mus musculus
cctgatatgtgtagggatggccgct

SEQ ID NO: 93147 - DNA, 25 bp, Mus musculus
cctgatcaccgtggagtttgatgac

SEQ ID NO: 93148 - DNA, 25 bp, Mus musculus
cctgatcactaagaagagacgtcca

SEQ ID NO: 93149 - DNA, 25 bp, Mus musculus
cctgatcatgttgctggacctggag

SEQ ID NO: 93150 - DNA, 25 bp, Mus musculus
cctgatcccatgtgccaggaagatg

SEQ ID NO: 93151 - DNA, 25 bp, Mus musculus
cctgatcgaggagtaccatggccgt

SEQ ID NO: 93152 - DNA, 25 bp, Mus musculus
cctgatgaacatggcaaagctgagc

SEQ ID NO: 93153 - DNA, 25 bp, Mus musculus
cctgatgaagagtccagttgccaac

SEQ ID NO: 93154 - DNA, 25 bp, Mus musculus
cctgatgacaaagacccagtgtggg

SEQ ID NO: 93155 - DNA, 25 bp, Mus musculus
cctgatgagaacgaggacagtgaca

SEQ ID NO: 93156 - DNA, 25 bp, Mus musculus
cctgatgagtttacagcaagacttg

SEQ ID NO: 93157 - DNA, 25 bp, Mus musculus
cctgatgatagtgctgggcgagctc

SEQ ID NO: 93158 - DNA, 25 bp, Mus musculus
cctgatgcagggtgtgctccagacc

SEQ ID NO: 93159 - DNA, 25 bp, Mus musculus
cctgatgcggtatatctcccatgtg

SEQ ID NO: 93160 - DNA, 25 bp, Mus musculus
cctgatggaccagctgcaaggcgtg

SEQ ID NO: 93161 - DNA, 25 bp, Mus musculus
cctgatggacctgtgaggaaagccc

SEQ ID NO: 93162 - DNA, 25 bp, Mus musculus
cctgatggccagagtgaacaaattg

SEQ ID NO: 93163 - DNA, 25 bp, Mus musculus
cctgatggccgctacgtggtgacag

SEQ ID NO: 93164 - DNA, 25 bp, Mus musculus
cctgatggcctcactaactggaaga

SEQ ID NO: 93165 - DNA, 25 bp, Mus musculus
cctgatgggatcaatctgaactgaa

SEQ ID NO: 93166 - DNA, 25 bp, Mus musculus
cctgatgggattctcgtctaaaccg

SEQ ID NO: 93167 - DNA, 25 bp, Mus musculus
cctgatgggcctaaatgagtcttcc

SEQ ID NO: 93168 - DNA, 25 bp, Mus musculus
cctgatggtactagcaaggagtgcg

SEQ ID NO: 93169 - DNA, 25 bp, Mus musculus
cctgatgttcagcatggtgtcctca

SEQ ID NO: 93170 - DNA, 25 bp, Mus musculus
cctgattgaagacgaggagatgcct

SEQ ID NO: 93171 - DNA, 25 bp, Mus musculus
cctgattggaatgtgtaacacggcc

SEQ ID NO: 93172 - DNA, 25 bp, Mus musculus
cctgattgtaaaagacgggctaact

SEQ ID NO: 93173 - DNA, 25 bp, Mus musculus
cctgattgtgggagcatatggagct

SEQ ID NO: 93174 - DNA, 25 bp, Mus musculus
cctgcaaagctaaggctgacgctgg

SEQ ID NO: 93175 - DNA, 25 bp, Mus musculus
cctgcaagagaagcgtccagggctt

SEQ ID NO: 93176 - DNA, 25 bp, Mus musculus
cctgcaagtgccagagaaagagact

SEQ ID NO: 93177 - DNA, 25 bp, Mus musculus
cctgcaatggtggaggaagacccac

SEQ ID NO: 93178 - DNA, 25 bp, Mus musculus
cctgcacaagtggtgtaatgacatg

SEQ ID NO: 93179 - DNA, 25 bp, Mus musculus
cctgcacgaaggagacgaagttctg

SEQ ID NO: 93180 - DNA, 25 bp, Mus musculus
cctgcactgaggagcctcggatccg

SEQ ID NO: 93181 - DNA, 25 bp, Mus musculus
cctgcactgcccttctgagtcctgg

SEQ ID NO: 93182 - DNA, 25 bp, Mus musculus
cctgcactgctctgaaacttcgtag

SEQ ID NO: 93183 - DNA, 25 bp, Mus musculus
cctgcactggctcttggagcttagc

SEQ ID NO: 93184 - DNA, 25 bp, Mus musculus
cctgcacttgctgctctcgggaaga

SEQ ID NO: 93185 - DNA, 25 bp, Mus musculus
cctgcagaacatattcggaatgact

SEQ ID NO: 93186 - DNA, 25 bp, Mus musculus
cctgcagagaatggagtagacgacc

SEQ ID NO: 93187 - DNA, 25 bp, Mus musculus
cctgcagagcaggagaccaagttgg

SEQ ID NO: 93188 - DNA, 25 bp, Mus musculus
cctgcagagtcggaatctaaactgt

SEQ ID NO: 93189 - DNA, 25 bp, Mus musculus
cctgcagagtgatacagaatgtacc

SEQ ID NO: 93190 - DNA, 25 bp, Mus musculus
cctgcagagtggagatgagaaaaag

SEQ ID NO: 93191 - DNA, 25 bp, Mus musculus
cctgcagatttaagtttcacagtct

SEQ ID NO: 93192 - DNA, 25 bp, Mus musculus
cctgcagcaggtagaccaaggagca

SEQ ID NO: 93193 - DNA, 25 bp, Mus musculus
cctgcagcgctgtaaagaggaattc

SEQ ID NO: 93194 - DNA, 25 bp, Mus musculus
cctgcagcgttggagcctctctggt

SEQ ID NO: 93195 - DNA, 25 bp, Mus musculus
cctgcagctgtcgaagaggttgccc

SEQ ID NO: 93196 - DNA, 25 bp, Mus musculus
cctgcaggatgaagtgggacaatgt

SEQ ID NO: 93197 - DNA, 25 bp, Mus musculus
cctgcaggattccttcgactgtggg

SEQ ID NO: 93198 - DNA, 25 bp, Mus musculus
cctgcaggcagaggtgacgcgtctt

SEQ ID NO: 93199 - DNA, 25 bp, Mus musculus
cctgcaggctgggacaatgaaaaga

SEQ ID NO: 93200 - DNA, 25 bp, Mus musculus
cctgcagggctgaaacatgggctag

SEQ ID NO: 93201 - DNA, 25 bp, Mus musculus
cctgcaggtgaaaatccagcggctg

SEQ ID NO: 93202 - DNA, 25 bp, Mus musculus
cctgcaggtgctctagaaacttcaa

SEQ ID NO: 93203 - DNA, 25 bp, Mus musculus
cctgcagtaaccatgaacagatcct

SEQ ID NO: 93204 - DNA, 25 bp, Mus musculus
cctgcagtcagaaggcctgggtcct

SEQ ID NO: 93205 - DNA, 25 bp, Mus musculus
cctgcagtgagcgtgcagcctgtgt

SEQ ID NO: 93206 - DNA, 25 bp, Mus musculus
cctgcagtgtcaagaggaagagctc

SEQ ID NO: 93207 - DNA, 25 bp, Mus musculus
cctgcagtgtgctacgcccttagta

SEQ ID NO: 93208 - DNA, 25 bp, Mus musculus
cctgcagttagttgtattgctgtgg

SEQ ID NO: 93209 - DNA, 25 bp, Mus musculus
cctgcatcacacaaagaggctttgg

SEQ ID NO: 93210 - DNA, 25 bp, Mus musculus
cctgcatcagctcaatgagcagcgg

SEQ ID NO: 93211 - DNA, 25 bp, Mus musculus
cctgcatgagtgtcgataggtacca

SEQ ID NO: 93212 - DNA, 25 bp, Mus musculus
cctgcatgagtttttattaaagtgc

SEQ ID NO: 93213 - DNA, 25 bp, Mus musculus
cctgcatttgctacagaactgaaag

SEQ ID NO: 93214 - DNA, 25 bp, Mus musculus
cctgccagctcggaacaaggcttgg

SEQ ID NO: 93215 - DNA, 25 bp, Mus musculus
cctgccatcttgtcagtgaggaggc

SEQ ID NO: 93216 - DNA, 25 bp, Mus musculus
cctgcccatgcacaagatgatgaac

SEQ ID NO: 93217 - DNA, 25 bp, Mus musculus
cctgcccattgaattccacaagatg

SEQ ID NO: 93218 - DNA, 25 bp, Mus musculus
cctgccccggtgtaagaggtcacaa

SEQ ID NO: 93219 - DNA, 25 bp, Mus musculus
cctgcccgtggaaagcatgagctcg

SEQ ID NO: 93220 - DNA, 25 bp, Mus musculus
cctgccctcctgatgagaccatgga

SEQ ID NO: 93221 - DNA, 25 bp, Mus musculus
cctgcccttgggatgatgactggaa

SEQ ID NO: 93222 - DNA, 25 bp, Mus musculus
cctgccgacataagaagcctcttag

SEQ ID NO: 93223 - DNA, 25 bp, Mus musculus
cctgccgggagtgaagaaatctttg

SEQ ID NO: 93224 - DNA, 25 bp, Mus musculus
cctgccgggtccttgatacactggg

SEQ ID NO: 93225 - DNA, 25 bp, Mus musculus
cctgccgtatcttgcatcatccgaa

SEQ ID NO: 93226 - DNA, 25 bp, Mus musculus
cctgcctagtgtggatgagctgaaa

SEQ ID NO: 93227 - DNA, 25 bp, Mus musculus
cctgcctatcccacaggtatgggct

SEQ ID NO: 93228 - DNA, 25 bp, Mus musculus
cctgcctcagagagtcaagaggaca

SEQ ID NO: 93229 - DNA, 25 bp, Mus musculus
cctgcctcagcaactggtttggaaa

SEQ ID NO: 93230 - DNA, 25 bp, Mus musculus
cctgcctcagcgaagtggtgaagga

SEQ ID NO: 93231 - DNA, 25 bp, Mus musculus
cctgcctctgcgagaagactgtgaa

SEQ ID NO: 93232 - DNA, 25 bp, Mus musculus
cctgcctcttggtggaactgctgga

SEQ ID NO: 93233 - DNA, 25 bp, Mus musculus
cctgcctgaaaaacctgtgaagact

SEQ ID NO: 93234 - DNA, 25 bp, Mus musculus
cctgcctgaaaagggtgaaagtcaa

SEQ ID NO: 93235 - DNA, 25 bp, Mus musculus
cctgcctggcaaggataccctgtgg

SEQ ID NO: 93236 - DNA, 25 bp, Mus musculus
cctgcctggtgaggctgtctttgcc

SEQ ID NO: 93237 - DNA, 25 bp, Mus musculus
cctgcctgtgatgccagacctgtga

SEQ ID NO: 93238 - DNA, 25 bp, Mus musculus
cctgcgaaagggatccagcggtctg

SEQ ID NO: 93239 - DNA, 25 bp, Mus musculus
cctgcgacaggctgccagggatgcc

SEQ ID NO: 93240 - DNA, 25 bp, Mus musculus
cctgcgagggctacaatgaaatcat

SEQ ID NO: 93241 - DNA, 25 bp, Mus musculus
cctgcgcagaagtgaacggcttgaa

SEQ ID NO: 93242 - DNA, 25 bp, Mus musculus
cctgcgctacgtaggcggtgtctgc

SEQ ID NO: 93243 - DNA, 25 bp, Mus musculus
cctgcgcttcctgggtagagagaaa

SEQ ID NO: 93244 - DNA, 25 bp, Mus musculus
cctgcgcttgtttgaggtggccaga

SEQ ID NO: 93245 - DNA, 25 bp, Mus musculus
cctgcggaatgaaaaggctggcgcc

SEQ ID NO: 93246 - DNA, 25 bp, Mus musculus
cctgcggaggaaactgtgtgtgctc

SEQ ID NO: 93247 - DNA, 25 bp, Mus musculus
cctgcggcagttctctgatgacaag

SEQ ID NO: 93248 - DNA, 25 bp, Mus musculus
cctgcggccgtgctttggagattac

SEQ ID NO: 93249 - DNA, 25 bp, Mus musculus
cctgcggctagaggaagtgcaaagc

SEQ ID NO: 93250 - DNA, 25 bp, Mus musculus
cctgcggctggaaagaaagtgctct

SEQ ID NO: 93251 - DNA, 25 bp, Mus musculus
cctgcggctggagtggctctcacta

SEQ ID NO: 93252 - DNA, 25 bp, Mus musculus
cctgcgggactaaattcaacagtga

SEQ ID NO: 93253 - DNA, 25 bp, Mus musculus
cctgcgggagccatgtggtttatcc

SEQ ID NO: 93254 - DNA, 25 bp, Mus musculus
cctgcgggcttgcgccccgggccgt

SEQ ID NO: 93255 - DNA, 25 bp, Mus musculus
cctgcggttcgatgataagcctgac

SEQ ID NO: 93256 - DNA, 25 bp, Mus musculus
cctgcgtcagggatatgggaagcca

SEQ ID NO: 93257 - DNA, 25 bp, Mus musculus
cctgcgtcgttgaagagaatgatcc

SEQ ID NO: 93258 - DNA, 25 bp, Mus musculus
cctgcgtgggcagacacatctattt

SEQ ID NO: 93259 - DNA, 25 bp, Mus musculus
cctgctacagtctgatgttcacagc

SEQ ID NO: 93260 - DNA, 25 bp, Mus musculus
cctgctacggaaagaagtatggacc

SEQ ID NO: 93261 - DNA, 25 bp, Mus musculus
cctgctagaagaacatgccaaactg

SEQ ID NO: 93262 - DNA, 25 bp, Mus musculus
cctgctatgtggcttcaatgagaag

SEQ ID NO: 93263 - DNA, 25 bp, Mus musculus
cctgctcatgggtctgttctccgtc

SEQ ID NO: 93264 - DNA, 25 bp, Mus musculus
cctgctccagaggaatgctatgtgt

SEQ ID NO: 93265 - DNA, 25 bp, Mus musculus
cctgctcctggttaagtgtttgatc

SEQ ID NO: 93266 - DNA, 25 bp, Mus musculus
cctgctccttgggaagtctttggac

SEQ ID NO: 93267 - DNA, 25 bp, Mus musculus
cctgctcgaggacgacaacgatgac

SEQ ID NO: 93268 - DNA, 25 bp, Mus musculus
cctgctctcgatatggctgggtaac

SEQ ID NO: 93269 - DNA, 25 bp, Mus musculus
cctgctcttggggacgctcgaaggc

SEQ ID NO: 93270 - DNA, 25 bp, Mus musculus
cctgctgaagctgggtcatgtgacc

SEQ ID NO: 93271 - DNA, 25 bp, Mus musculus
cctgctgacagtgaaaagaacaatg

SEQ ID NO: 93272 - DNA, 25 bp, Mus musculus
cctgctgagtagtgcctgtgggaca

SEQ ID NO: 93273 - DNA, 25 bp, Mus musculus
cctgctgatgaggacgctaagttcc

SEQ ID NO: 93274 - DNA, 25 bp, Mus musculus
cctgctgcgactgccgtttgggaga

SEQ ID NO: 93275 - DNA, 25 bp, Mus musculus
cctgctgcgcagtgacatgatgatg

SEQ ID NO: 93276 - DNA, 25 bp, Mus musculus
cctgctgctgatgcaagaaggcaca

SEQ ID NO: 93277 - DNA, 25 bp, Mus musculus
cctgctgctggtgcttttgggagtc

SEQ ID NO: 93278 - DNA, 25 bp, Mus musculus
cctgctgcttatggagactacacga

SEQ ID NO: 93279 - DNA, 25 bp, Mus musculus
cctgctggacaaggcggtgaactgc

SEQ ID NO: 93280 - DNA, 25 bp, Mus musculus
cctgctggatgacagtaacagagcc

SEQ ID NO: 93281 - DNA, 25 bp, Mus musculus
cctgctggatgataagactgcctct

SEQ ID NO: 93282 - DNA, 25 bp, Mus musculus
cctgctggccaacactaagtttaca

SEQ ID NO: 93283 - DNA, 25 bp, Mus musculus
cctgctggccttcgagagggcatca

SEQ ID NO: 93284 - DNA, 25 bp, Mus musculus
cctgctgggcaaggacaggaaagca

SEQ ID NO: 93285 - DNA, 25 bp, Mus musculus
cctgctgggccgagtagctgtctct

SEQ ID NO: 93286 - DNA, 25 bp, Mus musculus
cctgctgtcgccttagcaccatgga

SEQ ID NO: 93287 - DNA, 25 bp, Mus musculus
cctgctgtgccacgacatgatgggt

SEQ ID NO: 93288 - DNA, 25 bp, Mus musculus
cctgcttcccgcagctgtgaggaga

SEQ ID NO: 93289 - DNA, 25 bp, Mus musculus
cctgcttctgcttttcgtggcagca

SEQ ID NO: 93290 - DNA, 25 bp, Mus musculus
cctgcttgacctacaacaacggcag

SEQ ID NO: 93291 - DNA, 25 bp, Mus musculus
cctgcttgagggattcaagaagtcc

SEQ ID NO: 93292 - DNA, 25 bp, Mus musculus
cctgcttggcagtgtattggagctc

SEQ ID NO: 93293 - DNA, 25 bp, Mus musculus
cctgcttgtgcttaagaacttgaag

SEQ ID NO: 93294 - DNA, 25 bp, Mus musculus
cctgctttgtgactgcatgctggtg

SEQ ID NO: 93295 - DNA, 25 bp, Mus musculus
cctgcttttggatgagctgcatggg

SEQ ID NO: 93296 - DNA, 25 bp, Mus musculus
cctggaaaagagagacggtggcaat

SEQ ID NO: 93297 - DNA, 25 bp, Mus musculus
cctggaaaatcggtgagggcaagcc

SEQ ID NO: 93298 - DNA, 25 bp, Mus musculus
cctggaaagggacccagcctggact

SEQ ID NO: 93299 - DNA, 25 bp, Mus musculus
cctggaacagggaaggaagctgtct

SEQ ID NO: 93300 - DNA, 25 bp, Mus musculus
cctggaaccttgacccttgaggcta

SEQ ID NO: 93301 - DNA, 25 bp, Mus musculus
cctggaacgagaagacagcagtgag

SEQ ID NO: 93302 - DNA, 25 bp, Mus musculus
cctggaacgagaggagaagcaaaaa

SEQ ID NO: 93303 - DNA, 25 bp, Mus musculus
cctggaacgcaagagggaattgtta

SEQ ID NO: 93304 - DNA, 25 bp, Mus musculus
cctggaactcttctacgacgtgctg

SEQ ID NO: 93305 - DNA, 25 bp, Mus musculus
cctggaagacattcccctggaggat

SEQ ID NO: 93306 - DNA, 25 bp, Mus musculus
cctggaagacattgggacagcagct

SEQ ID NO: 93307 - DNA, 25 bp, Mus musculus
cctggaagagcggaagctcatgatg

SEQ ID NO: 93308 - DNA, 25 bp, Mus musculus
cctggaagatctcatggaccgctat

SEQ ID NO: 93309 - DNA, 25 bp, Mus musculus
cctggaagccctgtatggatatgac

SEQ ID NO: 93310 - DNA, 25 bp, Mus musculus
cctggaagcgccctgagacttgaaa

SEQ ID NO: 93311 - DNA, 25 bp, Mus musculus
cctggaagggctgtcgggacatact

SEQ ID NO: 93312 - DNA, 25 bp, Mus musculus
cctggaagtagcattgtaaagcccc

SEQ ID NO: 93313 - DNA, 25 bp, Mus musculus
cctggaagtccgtgatgggcacagc

SEQ ID NO: 93314 - DNA, 25 bp, Mus musculus
cctggaagttctgacagccgatctt

SEQ ID NO: 93315 - DNA, 25 bp, Mus musculus
cctggaataattccgcttccgtttg

SEQ ID NO: 93316 - DNA, 25 bp, Mus musculus
cctggaatccagatgggaaacgctt

SEQ ID NO: 93317 - DNA, 25 bp, Mus musculus
cctggaatcccgcacattatcaaca

SEQ ID NO: 93318 - DNA, 25 bp, Mus musculus
cctggaatgacagcctttgaaccag

SEQ ID NO: 93319 - DNA, 25 bp, Mus musculus
cctggaatgtacagatggctggcta

SEQ ID NO: 93320 - DNA, 25 bp, Mus musculus
cctggaattctaatctgagtgggca

SEQ ID NO: 93321 - DNA, 25 bp, Mus musculus
cctggaattcttacgtggactataa

SEQ ID NO: 93322 - DNA, 25 bp, Mus musculus
cctggaattgagtccttcaagtgtc

SEQ ID NO: 93323 - DNA, 25 bp, Mus musculus
cctggaatttgatgacctagatggg

SEQ ID NO: 93324 - DNA, 25 bp, Mus musculus
cctggacaacaagtacacggagcac

SEQ ID NO: 93325 - DNA, 25 bp, Mus musculus
cctggacaagaaggacgtgctgccc

SEQ ID NO: 93326 - DNA, 25 bp, Mus musculus
cctggacaaggcctctggagcatct

SEQ ID NO: 93327 - DNA, 25 bp, Mus musculus
cctggacactgaatggtcgctggaa

SEQ ID NO: 93328 - DNA, 25 bp, Mus musculus
cctggacagacctgcaagaagtgca

SEQ ID NO: 93329 - DNA, 25 bp, Mus musculus
cctggacagaggtcttgaaagccct

SEQ ID NO: 93330 - DNA, 25 bp, Mus musculus
cctggacagatggtctgagaagaaa

SEQ ID NO: 93331 - DNA, 25 bp, Mus musculus
cctggacaggaccttctgagggtac

SEQ ID NO: 93332 - DNA, 25 bp, Mus musculus
cctggacatctgctggtgacacttc

SEQ ID NO: 93333 - DNA, 25 bp, Mus musculus
cctggacatgaaggagggacagaca

SEQ ID NO: 93334 - DNA, 25 bp, Mus musculus
cctggacatggtgcatacaacggga

SEQ ID NO: 93335 - DNA, 25 bp, Mus musculus
cctggacattctcaaacggctgctt

SEQ ID NO: 93336 - DNA, 25 bp, Mus musculus
cctggaccccgagattgtgaggcag

SEQ ID NO: 93337 - DNA, 25 bp, Mus musculus
cctggacctgatgcgggaaatgtac

SEQ ID NO: 93338 - DNA, 25 bp, Mus musculus
cctggactacatggcggtggaatac

SEQ ID NO: 93339 - DNA, 25 bp, Mus musculus
cctggactcaaagggaagagcaagc

SEQ ID NO: 93340 - DNA, 25 bp, Mus musculus
cctggactcggagcagtgtgtaaag

SEQ ID NO: 93341 - DNA, 25 bp, Mus musculus
cctggagaagctgcacccctttgat

SEQ ID NO: 93342 - DNA, 25 bp, Mus musculus
cctggagaataaagtcaatagttgg

SEQ ID NO: 93343 - DNA, 25 bp, Mus musculus
cctggagaataacctggaggagacc

SEQ ID NO: 93344 - DNA, 25 bp, Mus musculus
cctggagaccttacccttggagagg

SEQ ID NO: 93345 - DNA, 25 bp, Mus musculus
cctggagactgtattcatagtaaat

SEQ ID NO: 93346 - DNA, 25 bp, Mus musculus
cctggagatcaggaacgctctggat

SEQ ID NO: 93347 - DNA, 25 bp, Mus musculus
cctggagatgagaaccctgctgtta

SEQ ID NO: 93348 - DNA, 25 bp, Mus musculus
cctggagcaagggtagcactgtgac

SEQ ID NO: 93349 - DNA, 25 bp, Mus musculus
cctggagcagatcgagaaagaaaac

SEQ ID NO: 93350 - DNA, 25 bp, Mus musculus
cctggagcagggtcataattgttct

SEQ ID NO: 93351 - DNA, 25 bp, Mus musculus
cctggagcccaaggcagcaaactgt

SEQ ID NO: 93352 - DNA, 25 bp, Mus musculus
cctggagccgagtgaggtcagtcct

SEQ ID NO: 93353 - DNA, 25 bp, Mus musculus
cctggagccgctggatttcaaatgc

SEQ ID NO: 93354 - DNA, 25 bp, Mus musculus
cctggagccgtggacaacttactgc

SEQ ID NO: 93355 - DNA, 25 bp, Mus musculus
cctggagctactgagaaagcataag

SEQ ID NO: 93356 - DNA, 25 bp, Mus musculus
cctggagctaggtattggccgttct

SEQ ID NO: 93357 - DNA, 25 bp, Mus musculus
cctggagctggctaggattccccta

SEQ ID NO: 93358 - DNA, 25 bp, Mus musculus
cctggaggaagtttgaggccctgat

SEQ ID NO: 93359 - DNA, 25 bp, Mus musculus
cctggaggactttcttgcaactgca

SEQ ID NO: 93360 - DNA, 25 bp, Mus musculus
cctggagggactgttcttgttgagc

SEQ ID NO: 93361 - DNA, 25 bp, Mus musculus
cctggaggtagtaatgcctgggaca

SEQ ID NO: 93362 - DNA, 25 bp, Mus musculus
cctggaggtgagaactcaagagact

SEQ ID NO: 93363 - DNA, 25 bp, Mus musculus
cctggagtggaagatcatttatgtg

SEQ ID NO: 93364 - DNA, 25 bp, Mus musculus
cctggagtggcaccgcgcgaactct

SEQ ID NO: 93365 - DNA, 25 bp, Mus musculus
cctggagttcgcgtgggacctgaca

SEQ ID NO: 93366 - DNA, 25 bp, Mus musculus
cctggatatgctgccctgggtgcaa

SEQ ID NO: 93367 - DNA, 25 bp, Mus musculus
cctggatcagtatataataaagcgc

SEQ ID NO: 93368 - DNA, 25 bp, Mus musculus
cctggatcatgacaacagcgtggtc

SEQ ID NO: 93369 - DNA, 25 bp, Mus musculus
cctggatccagagctttcggagaac

SEQ ID NO: 93370 - DNA, 25 bp, Mus musculus
cctggatccgtgttgaagagagact

SEQ ID NO: 93371 - DNA, 25 bp, Mus musculus
cctggatctcatcaagaaaggcgtg

SEQ ID NO: 93372 - DNA, 25 bp, Mus musculus
cctggatcttgagctgacatctagg

SEQ ID NO: 93373 - DNA, 25 bp, Mus musculus
cctggatgacaactcgcgggtaact

SEQ ID NO: 93374 - DNA, 25 bp, Mus musculus
cctggatgcgcgagtcgtgcttcaa

SEQ ID NO: 93375 - DNA, 25 bp, Mus musculus
cctggatgcgtttctacagtgccga

SEQ ID NO: 93376 - DNA, 25 bp, Mus musculus
cctggatgctgcaggtgacagaaac

SEQ ID NO: 93377 - DNA, 25 bp, Mus musculus
cctggatgctgggtacctggctgtc

SEQ ID NO: 93378 - DNA, 25 bp, Mus musculus
cctggatggaaatgacgtagactct

SEQ ID NO: 93379 - DNA, 25 bp, Mus musculus
cctggatggaattgaagtgaatgga

SEQ ID NO: 93380 - DNA, 25 bp, Mus musculus
cctggatggatttaaggcactgacc

SEQ ID NO: 93381 - DNA, 25 bp, Mus musculus
cctggatggcgagacgaaccttaaa

SEQ ID NO: 93382 - DNA, 25 bp, Mus musculus
cctggatgtgcacttctggaaagcc

SEQ ID NO: 93383 - DNA, 25 bp, Mus musculus
cctggatgtgcatcgaaggcattca

SEQ ID NO: 93384 - DNA, 25 bp, Mus musculus
cctggattcacctcacactgtggga

SEQ ID NO: 93385 - DNA, 25 bp, Mus musculus
cctggattccgctggtcatgaagca

SEQ ID NO: 93386 - DNA, 25 bp, Mus musculus
cctggattgccatggtttgctgttt

SEQ ID NO: 93387 - DNA, 25 bp, Mus musculus
cctggattgctctacagatttggaa

SEQ ID NO: 93388 - DNA, 25 bp, Mus musculus
cctggattttagaggtcagagctcc

SEQ ID NO: 93389 - DNA, 25 bp, Mus musculus
cctggcaatagaggatggcaaatcc

SEQ ID NO: 93390 - DNA, 25 bp, Mus musculus
cctggcacacaggaatacattatgt

SEQ ID NO: 93391 - DNA, 25 bp, Mus musculus
cctggcacagaagatatggtcatgg

SEQ ID NO: 93392 - DNA, 25 bp, Mus musculus
cctggcacagtcagacaacaatttg

SEQ ID NO: 93393 - DNA, 25 bp, Mus musculus
cctggcactgtcaggacccgggaga

SEQ ID NO: 93394 - DNA, 25 bp, Mus musculus
cctggcagagccaaggataggtgac

SEQ ID NO: 93395 - DNA, 25 bp, Mus musculus
cctggcagcaaaaccaagaagactg

SEQ ID NO: 93396 - DNA, 25 bp, Mus musculus
cctggcagcacatccgtggaaagtc

SEQ ID NO: 93397 - DNA, 25 bp, Mus musculus
cctggcagccgaagcagccaggaca

SEQ ID NO: 93398 - DNA, 25 bp, Mus musculus
cctggcaggcaaggtgaatgagccc

SEQ ID NO: 93399 - DNA, 25 bp, Mus musculus
cctggcagtcagtcacttttgaaag

SEQ ID NO: 93400 - DNA, 25 bp, Mus musculus
cctggcatgggtggtggtattcctt

SEQ ID NO: 93401 - DNA, 25 bp, Mus musculus
cctggcattcagagacgagagagga

SEQ ID NO: 93402 - DNA, 25 bp, Mus musculus
cctggccaatcctgcgttcgggaac

SEQ ID NO: 93403 - DNA, 25 bp, Mus musculus
cctggccaggtttcagcgatgttaa

SEQ ID NO: 93404 - DNA, 25 bp, Mus musculus
cctggccagtggaggagcttttaca

SEQ ID NO: 93405 - DNA, 25 bp, Mus musculus
cctggccattgcactggaggctgaa

SEQ ID NO: 93406 - DNA, 25 bp, Mus musculus
cctggcccagtatgtaggagggact

SEQ ID NO: 93407 - DNA, 25 bp, Mus musculus
cctggcccggaagctaggtgagttc

SEQ ID NO: 93408 - DNA, 25 bp, Mus musculus
cctggccctggacaatgagatgatt

SEQ ID NO: 93409 - DNA, 25 bp, Mus musculus
cctggccctggagtgtggaaacatt

SEQ ID NO: 93410 - DNA, 25 bp, Mus musculus
cctggccggaagcttggtgaaaact

SEQ ID NO: 93411 - DNA, 25 bp, Mus musculus
cctggccgtctagtggatcatataa

SEQ ID NO: 93412 - DNA, 25 bp, Mus musculus
cctggcctaggtagggatgaccttc

SEQ ID NO: 93413 - DNA, 25 bp, Mus musculus
cctggcctattataagagaccttgt

SEQ ID NO: 93414 - DNA, 25 bp, Mus musculus
cctggcctgagggatcacgatgtgc

SEQ ID NO: 93415 - DNA, 25 bp, Mus musculus
cctggcctgtgggaaagtgagaacc

SEQ ID NO: 93416 - DNA, 25 bp, Mus musculus
cctggcgacctgctctagactgatg

SEQ ID NO: 93417 - DNA, 25 bp, Mus musculus
cctggcgagcccgagttaaaggaca

SEQ ID NO: 93418 - DNA, 25 bp, Mus musculus
cctggcgcagggaaacaacagtgga

SEQ ID NO: 93419 - DNA, 25 bp, Mus musculus
cctggcgctggctaaaaatagctcg

SEQ ID NO: 93420 - DNA, 25 bp, Mus musculus
cctggcggctcgagcccatgctggg

SEQ ID NO: 93421 - DNA, 25 bp, Mus musculus
cctggcgggttcgagctgctctatc

SEQ ID NO: 93422 - DNA, 25 bp, Mus musculus
cctggcgtcaggatgtcatggttca

SEQ ID NO: 93423 - DNA, 25 bp, Mus musculus
cctggctactatgagaacggagact

SEQ ID NO: 93424 - DNA, 25 bp, Mus musculus
cctggctatccttgggcgccgcgga

SEQ ID NO: 93425 - DNA, 25 bp, Mus musculus
cctggctcgtgtgtggttccttgct

SEQ ID NO: 93426 - DNA, 25 bp, Mus musculus
cctggctctgaaccgcagggtctga

SEQ ID NO: 93427 - DNA, 25 bp, Mus musculus
cctggctgaaactgtgaaatacctc

SEQ ID NO: 93428 - DNA, 25 bp, Mus musculus
cctggctgataactgacatgcggcg

SEQ ID NO: 93429 - DNA, 25 bp, Mus musculus
cctggctgatcggaaagtctctgca

SEQ ID NO: 93430 - DNA, 25 bp, Mus musculus
cctggctgccctcctgaatgttaag

SEQ ID NO: 93431 - DNA, 25 bp, Mus musculus
cctggctgccgtcctgaagacactt

SEQ ID NO: 93432 - DNA, 25 bp, Mus musculus
cctggctgcgcagtacgggcattat

SEQ ID NO: 93433 - DNA, 25 bp, Mus musculus
cctggctggaagaatcggctcacaa

SEQ ID NO: 93434 - DNA, 25 bp, Mus musculus
cctggctgggcgatgagaataaccc

SEQ ID NO: 93435 - DNA, 25 bp, Mus musculus
cctggctgggttgtgtgacgactca

SEQ ID NO: 93436 - DNA, 25 bp, Mus musculus
cctggctggtctgaacacacttgga

SEQ ID NO: 93437 - DNA, 25 bp, Mus musculus
cctggctgtgtcaatggagtctgca

SEQ ID NO: 93438 - DNA, 25 bp, Mus musculus
cctggcttaacagtggttccttgaa

SEQ ID NO: 93439 - DNA, 25 bp, Mus musculus
cctggcttggaaccgggtcgacata

SEQ ID NO: 93440 - DNA, 25 bp, Mus musculus
cctgggaaaagatggtcaacgtgct

SEQ ID NO: 93441 - DNA, 25 bp, Mus musculus
cctgggaaatgaaagaacgcctggg

SEQ ID NO: 93442 - DNA, 25 bp, Mus musculus
cctgggaagattaacctgcggacgt

SEQ ID NO: 93443 - DNA, 25 bp, Mus musculus
cctgggaaggctgctaacaaagaca

SEQ ID NO: 93444 - DNA, 25 bp, Mus musculus
cctgggaatagtgaacggaaacgca

SEQ ID NO: 93445 - DNA, 25 bp, Mus musculus
cctgggaattgtgtttggaccgaca

SEQ ID NO: 93446 - DNA, 25 bp, Mus musculus
cctgggacacccattcagtttgata

SEQ ID NO: 93447 - DNA, 25 bp, Mus musculus
cctgggaccctcgaggatatggata

SEQ ID NO: 93448 - DNA, 25 bp, Mus musculus
cctgggacgcgttcatccctggctg

SEQ ID NO: 93449 - DNA, 25 bp, Mus musculus
cctgggactcccttccagatgagct

SEQ ID NO: 93450 - DNA, 25 bp, Mus musculus
cctgggacttgcagcctatggctac

SEQ ID NO: 93451 - DNA, 25 bp, Mus musculus
cctgggagaatctaggagacagcta

SEQ ID NO: 93452 - DNA, 25 bp, Mus musculus
cctgggagacccaactgtgttgctg

SEQ ID NO: 93453 - DNA, 25 bp, Mus musculus
cctgggagagattaaggttcctgtc

SEQ ID NO: 93454 - DNA, 25 bp, Mus musculus
cctgggagatctcatcatggctctg

SEQ ID NO: 93455 - DNA, 25 bp, Mus musculus
cctgggagcagtactcccgctctga

SEQ ID NO: 93456 - DNA, 25 bp, Mus musculus
cctgggagcatagccattttggaag

SEQ ID NO: 93457 - DNA, 25 bp, Mus musculus
cctgggagcatgagcactgtgagca

SEQ ID NO: 93458 - DNA, 25 bp, Mus musculus
cctgggagcattaagaggacagcct

SEQ ID NO: 93459 - DNA, 25 bp, Mus musculus
cctgggagccctgatgtacgacatg

SEQ ID NO: 93460 - DNA, 25 bp, Mus musculus
cctgggagctccaagctggataaat

SEQ ID NO: 93461 - DNA, 25 bp, Mus musculus
cctgggatggcaagaaagccctgga

SEQ ID NO: 93462 - DNA, 25 bp, Mus musculus
cctgggatggctgaactccttcttg

SEQ ID NO: 93463 - DNA, 25 bp, Mus musculus
cctgggatttgccttgtctgaagct

SEQ ID NO: 93464 - DNA, 25 bp, Mus musculus
cctgggcaaccgcaacaactttgaa

SEQ ID NO: 93465 - DNA, 25 bp, Mus musculus
cctgggcaagaactacaaggagcca

SEQ ID NO: 93466 - DNA, 25 bp, Mus musculus
cctgggcaagaagcggaaagtgtca

SEQ ID NO: 93467 - DNA, 25 bp, Mus musculus
cctgggcaccagataatgaacactt

SEQ ID NO: 93468 - DNA, 25 bp, Mus musculus
cctgggcactgaagataggctagca

SEQ ID NO: 93469 - DNA, 25 bp, Mus musculus
cctgggcatgatctacaccgtggga

SEQ ID NO: 93470 - DNA, 25 bp, Mus musculus
cctgggccaggattatgaaacgctt

SEQ ID NO: 93471 - DNA, 25 bp, Mus musculus
cctgggcccttggtctggactgaat

SEQ ID NO: 93472 - DNA, 25 bp, Mus musculus
cctgggcctattgactcactttgta

SEQ ID NO: 93473 - DNA, 25 bp, Mus musculus
cctgggcctggaatctggatacgca

SEQ ID NO: 93474 - DNA, 25 bp, Mus musculus
cctgggcgctgggtgccattgcact

SEQ ID NO: 93475 - DNA, 25 bp, Mus musculus
cctgggcggaagagacaagcctatc

SEQ ID NO: 93476 - DNA, 25 bp, Mus musculus
cctgggcgggagttccatggagact

SEQ ID NO: 93477 - DNA, 25 bp, Mus musculus
cctgggctcctgtcttttgcataaa

SEQ ID NO: 93478 - DNA, 25 bp, Mus musculus
cctgggctccttaggctgcaagaat

SEQ ID NO: 93479 - DNA, 25 bp, Mus musculus
cctgggctggatgaatgcgctgtac

SEQ ID NO: 93480 - DNA, 25 bp, Mus musculus
cctgggctggctgatcaagtgactc

SEQ ID NO: 93481 - DNA, 25 bp, Mus musculus
cctgggctgggcatatgcagcaaca

SEQ ID NO: 93482 - DNA, 25 bp, Mus musculus
cctgggctgtatcggtgctgtcaat

SEQ ID NO: 93483 - DNA, 25 bp, Mus musculus
cctgggcttgtgaaggcactgagaa

SEQ ID NO: 93484 - DNA, 25 bp, Mus musculus
cctgggctttcgctttgatgtggca

SEQ ID NO: 93485 - DNA, 25 bp, Mus musculus
cctggggacagacagcatcatctgc

SEQ ID NO: 93486 - DNA, 25 bp, Mus musculus
cctgggtaccagatacagcagctga

SEQ ID NO: 93487 - DNA, 25 bp, Mus musculus
cctgggtaccgagtgagagaaatca

SEQ ID NO: 93488 - DNA, 25 bp, Mus musculus
cctgggtatgccgtatgtgaacaca

SEQ ID NO: 93489 - DNA, 25 bp, Mus musculus
cctgggtgatcctttctgatggcga

SEQ ID NO: 93490 - DNA, 25 bp, Mus musculus
cctgggtgcactgcatggacagtcc

SEQ ID NO: 93491 - DNA, 25 bp, Mus musculus
cctgggttgtaagatcaaagtgacc

SEQ ID NO: 93492 - DNA, 25 bp, Mus musculus
cctgggtttctgcttgttcggctgc

SEQ ID NO: 93493 - DNA, 25 bp, Mus musculus
cctggtaaatcatgccgtggctcag

SEQ ID NO: 93494 - DNA, 25 bp, Mus musculus
cctggtagaggagatgtatgccgct

SEQ ID NO: 93495 - DNA, 25 bp, Mus musculus
cctggtcaaccgatgtgggccaaga

SEQ ID NO: 93496 - DNA, 25 bp, Mus musculus
cctggtcaagctgcggaggacgtaa

SEQ ID NO: 93497 - DNA, 25 bp, Mus musculus
cctggtcagcattcgcggtgtggac

SEQ ID NO: 93498 - DNA, 25 bp, Mus musculus
cctggtcatcagaaagaaaacgtca

SEQ ID NO: 93499 - DNA, 25 bp, Mus musculus
cctggtcatcatagtcagtctggga

SEQ ID NO: 93500 - DNA, 25 bp, Mus musculus
cctggtcccgccttgcaaaataaga

SEQ ID NO: 93501 - DNA, 25 bp, Mus musculus
cctggtctacctgtgcgtggaggac

SEQ ID NO: 93502 - DNA, 25 bp, Mus musculus
cctggtgaggctgtctttgccaaca

SEQ ID NO: 93503 - DNA, 25 bp, Mus musculus
cctggtgatcgatacactgaaggaa

SEQ ID NO: 93504 - DNA, 25 bp, Mus musculus
cctggtgatgggagaacagagccgg

SEQ ID NO: 93505 - DNA, 25 bp, Mus musculus
cctggtgcaggaaaagaactcggtg

SEQ ID NO: 93506 - DNA, 25 bp, Mus musculus
cctggtgggctgtccattgcaggca

SEQ ID NO: 93507 - DNA, 25 bp, Mus musculus
cctggtgggtgagccctccttatac

SEQ ID NO: 93508 - DNA, 25 bp, Mus musculus
cctggtggtacctggactgggacaa

SEQ ID NO: 93509 - DNA, 25 bp, Mus musculus
cctggtgtcttcaaaggctgtggga

SEQ ID NO: 93510 - DNA, 25 bp, Mus musculus
cctggtgtgaagaacttggccgcct

SEQ ID NO: 93511 - DNA, 25 bp, Mus musculus
cctggtgttattcctgtaaatacag

SEQ ID NO: 93512 - DNA, 25 bp, Mus musculus
cctggttagcccaactggaggagaa

SEQ ID NO: 93513 - DNA, 25 bp, Mus musculus
cctggttccaggtgagtgaattcca

SEQ ID NO: 93514 - DNA, 25 bp, Mus musculus
cctggttctgcaacagctggaggac

SEQ ID NO: 93515 - DNA, 25 bp, Mus musculus
cctggttctggactgctattctgga

SEQ ID NO: 93516 - DNA, 25 bp, Mus musculus
cctggttggacatgatgctgtaaga

SEQ ID NO: 93517 - DNA, 25 bp, Mus musculus
cctggttggcattgctatggagaat

SEQ ID NO: 93518 - DNA, 25 bp, Mus musculus
cctggttggcttcaatccggtgagc

SEQ ID NO: 93519 - DNA, 25 bp, Mus musculus
cctggtttacaggacagacaaatac

SEQ ID NO: 93520 - DNA, 25 bp, Mus musculus
cctggtttcaaatcacattggcaac

SEQ ID NO: 93521 - DNA, 25 bp, Mus musculus
cctggttttcgatccattagagagc

SEQ ID NO: 93522 - DNA, 25 bp, Mus musculus
cctgtaaaaagcaaggaagacatat

SEQ ID NO: 93523 - DNA, 25 bp, Mus musculus
cctgtaaagaagaggatggcactgc

SEQ ID NO: 93524 - DNA, 25 bp, Mus musculus
cctgtaacaagagcttctcccgcct

SEQ ID NO: 93525 - DNA, 25 bp, Mus musculus
cctgtaacatcagtgtcggacgcta

SEQ ID NO: 93526 - DNA, 25 bp, Mus musculus
cctgtaaggaccgagagatcatgcg

SEQ ID NO: 93527 - DNA, 25 bp, Mus musculus
cctgtacaaaggtggcagcaaggcc

SEQ ID NO: 93528 - DNA, 25 bp, Mus musculus
cctgtacagcgtggctgggaaccca

SEQ ID NO: 93529 - DNA, 25 bp, Mus musculus
cctgtacccggaacaacaaagcgag

SEQ ID NO: 93530 - DNA, 25 bp, Mus musculus
cctgtacctcccagagaaccaagtg

SEQ ID NO: 93531 - DNA, 25 bp, Mus musculus
cctgtacctgtgttaaagtggctgt

SEQ ID NO: 93532 - DNA, 25 bp, Mus musculus
cctgtacgacatgaaaggcagttct

SEQ ID NO: 93533 - DNA, 25 bp, Mus musculus
cctgtacggcaccgctctcttttcc

SEQ ID NO: 93534 - DNA, 25 bp, Mus musculus
cctgtactggtcttgatggcccgga

SEQ ID NO: 93535 - DNA, 25 bp, Mus musculus
cctgtagacatagggaggcctgtga

SEQ ID NO: 93536 - DNA, 25 bp, Mus musculus
cctgtagcagtaacggaagaatgga

SEQ ID NO: 93537 - DNA, 25 bp, Mus musculus
cctgtagctgttgatcccactctga

SEQ ID NO: 93538 - DNA, 25 bp, Mus musculus
cctgtaggatatgggcttcctgctt

SEQ ID NO: 93539 - DNA, 25 bp, Mus musculus
cctgtagtctaagccatgggagtct

SEQ ID NO: 93540 - DNA, 25 bp, Mus musculus
cctgtagtctaggatcttggcagca

SEQ ID NO: 93541 - DNA, 25 bp, Mus musculus
cctgtagtgtggaccctgggatctc

SEQ ID NO: 93542 - DNA, 25 bp, Mus musculus
cctgtatcacacttgtggtctctga

SEQ ID NO: 93543 - DNA, 25 bp, Mus musculus
cctgtatggaaccaagatcgactct

SEQ ID NO: 93544 - DNA, 25 bp, Mus musculus
cctgtatgggttggactctgaagcc

SEQ ID NO: 93545 - DNA, 25 bp, Mus musculus
cctgtcaagaaatggaaagccgtcc

SEQ ID NO: 93546 - DNA, 25 bp, Mus musculus
cctgtcaagagagaagtgaaagtgg

SEQ ID NO: 93547 - DNA, 25 bp, Mus musculus
cctgtcaatacgtgaaggaagccaa

SEQ ID NO: 93548 - DNA, 25 bp, Mus musculus
cctgtcaatctgagcacgagtggga

SEQ ID NO: 93549 - DNA, 25 bp, Mus musculus
cctgtcacattcactcaagatggca

SEQ ID NO: 93550 - DNA, 25 bp, Mus musculus
cctgtcactgatgtacactgtgctg

SEQ ID NO: 93551 - DNA, 25 bp, Mus musculus
cctgtcatagaagggtgctgccaac

SEQ ID NO: 93552 - DNA, 25 bp, Mus musculus
cctgtccccatgaaggccattggtg

SEQ ID NO: 93553 - DNA, 25 bp, Mus musculus
cctgtcccgatgtgagttccagcgg

SEQ ID NO: 93554 - DNA, 25 bp, Mus musculus
cctgtcctgattgtggtcgtagcca

SEQ ID NO: 93555 - DNA, 25 bp, Mus musculus
cctgtcctgtgaacgagagggaaca

SEQ ID NO: 93556 - DNA, 25 bp, Mus musculus
cctgtcgcgtgaagagtgggtcctc

SEQ ID NO: 93557 - DNA, 25 bp, Mus musculus
cctgtcggaaatgagcaggtcagga

SEQ ID NO: 93558 - DNA, 25 bp, Mus musculus
cctgtcggacagtgaacccattggg

SEQ ID NO: 93559 - DNA, 25 bp, Mus musculus
cctgtcggcttggtcatggagtaca

SEQ ID NO: 93560 - DNA, 25 bp, Mus musculus
cctgtcgggagaaggctcagaagct

SEQ ID NO: 93561 - DNA, 25 bp, Mus musculus
cctgtcgttcctccttacagtagga

SEQ ID NO: 93562 - DNA, 25 bp, Mus musculus
cctgtctagcgctttgctggagaga

SEQ ID NO: 93563 - DNA, 25 bp, Mus musculus
cctgtctcgttcagattgatgctcc

SEQ ID NO: 93564 - DNA, 25 bp, Mus musculus
cctgtctgatgacgaggagcctcct

SEQ ID NO: 93565 - DNA, 25 bp, Mus musculus
cctgtctggagtggaagctgtcaac

SEQ ID NO: 93566 - DNA, 25 bp, Mus musculus
cctgtctggatgttgggaaatgtac

SEQ ID NO: 93567 - DNA, 25 bp, Mus musculus
cctgtctgtgcctccgtttgtctgt

SEQ ID NO: 93568 - DNA, 25 bp, Mus musculus
cctgtgaactcctggccattgataa

SEQ ID NO: 93569 - DNA, 25 bp, Mus musculus
cctgtgaatgactcccttgtgtgtg

SEQ ID NO: 93570 - DNA, 25 bp, Mus musculus
cctgtgacagattggccttcgtgca

SEQ ID NO: 93571 - DNA, 25 bp, Mus musculus
cctgtgacaggtaacgatgctggaa

SEQ ID NO: 93572 - DNA, 25 bp, Mus musculus
cctgtgaccggttcctattggctga

SEQ ID NO: 93573 - DNA, 25 bp, Mus musculus
cctgtgacgatgagggctattcgga

SEQ ID NO: 93574 - DNA, 25 bp, Mus musculus
cctgtgagactccacatagctctct

SEQ ID NO: 93575 - DNA, 25 bp, Mus musculus
cctgtgagcacacctagtggcctgg

SEQ ID NO: 93576 - DNA, 25 bp, Mus musculus
cctgtgatgcaagagcctggtggta

SEQ ID NO: 93577 - DNA, 25 bp, Mus musculus
cctgtgatgcagaaatatgggagac

SEQ ID NO: 93578 - DNA, 25 bp, Mus musculus
cctgtgatttggctcaagacgccta

SEQ ID NO: 93579 - DNA, 25 bp, Mus musculus
cctgtgcaaggtgatgctgaagtaa

SEQ ID NO: 93580 - DNA, 25 bp, Mus musculus
cctgtgcacgagcagcacggttgta

SEQ ID NO: 93581 - DNA, 25 bp, Mus musculus
cctgtgcagacgaccactgtcagtg

SEQ ID NO: 93582 - DNA, 25 bp, Mus musculus
cctgtgcagatgcttcaacagggag

SEQ ID NO: 93583 - DNA, 25 bp, Mus musculus
cctgtgcaggtggtcatgaagaact

SEQ ID NO: 93584 - DNA, 25 bp, Mus musculus
cctgtgcatggtggtgagtgatctc

SEQ ID NO: 93585 - DNA, 25 bp, Mus musculus
cctgtgccaactgtgaatatgagct

SEQ ID NO: 93586 - DNA, 25 bp, Mus musculus
cctgtgccagaaacaagggcgtcct

SEQ ID NO: 93587 - DNA, 25 bp, Mus musculus
cctgtgcctgactgcctgggtgtgc

SEQ ID NO: 93588 - DNA, 25 bp, Mus musculus
cctgtgcgacgtgctgtatggcaaa

SEQ ID NO: 93589 - DNA, 25 bp, Mus musculus
cctgtgcggttcttgtccggcgtca

SEQ ID NO: 93590 - DNA, 25 bp, Mus musculus
cctgtgctattgagcagtgaccatg

SEQ ID NO: 93591 - DNA, 25 bp, Mus musculus
cctgtgctccctcggacggaagcgg

SEQ ID NO: 93592 - DNA, 25 bp, Mus musculus
cctgtgctcgttcccgagcgacgga

SEQ ID NO: 93593 - DNA, 25 bp, Mus musculus
cctgtgctgcccacggaagatggag

SEQ ID NO: 93594 - DNA, 25 bp, Mus musculus
cctgtgctggacagcgcttctatca

SEQ ID NO: 93595 - DNA, 25 bp, Mus musculus
cctgtggaacatgtaggatcgtttg

SEQ ID NO: 93596 - DNA, 25 bp, Mus musculus
cctgtggaagaagtctgagcgctac

SEQ ID NO: 93597 - DNA, 25 bp, Mus musculus
cctgtggacgctggataaggaagat

SEQ ID NO: 93598 - DNA, 25 bp, Mus musculus
cctgtggagccaatctacctgagaa

SEQ ID NO: 93599 - DNA, 25 bp, Mus musculus
cctgtggagtacatgaacttatctg

SEQ ID NO: 93600 - DNA, 25 bp, Mus musculus
cctgtggatcaggattctgtggccg

SEQ ID NO: 93601 - DNA, 25 bp, Mus musculus
cctgtggcaaggacactgctgacca

SEQ ID NO: 93602 - DNA, 25 bp, Mus musculus
cctgtggcagagcaggaaatcgtaa

SEQ ID NO: 93603 - DNA, 25 bp, Mus musculus
cctgtggcctgcaaggtctagtgaa

SEQ ID NO: 93604 - DNA, 25 bp, Mus musculus
cctgtgggccgaagctgaccaactc

SEQ ID NO: 93605 - DNA, 25 bp, Mus musculus
cctgtgggctactcgggcatccact

SEQ ID NO: 93606 - DNA, 25 bp, Mus musculus
cctgtgggcttctgtagtgatcctg

SEQ ID NO: 93607 - DNA, 25 bp, Mus musculus
cctgtgggtcatcatggagaaaagc

SEQ ID NO: 93608 - DNA, 25 bp, Mus musculus
cctgtgggtctatagctgtgtatca

SEQ ID NO: 93609 - DNA, 25 bp, Mus musculus
cctgtggtcagtcgcatatggccta

SEQ ID NO: 93610 - DNA, 25 bp, Mus musculus
cctgtggtgagcatgaagagagcca

SEQ ID NO: 93611 - DNA, 25 bp, Mus musculus
cctgtgtagacggagcaatggctga

SEQ ID NO: 93612 - DNA, 25 bp, Mus musculus
cctgtgtcaaagctaaggatgatgc

SEQ ID NO: 93613 - DNA, 25 bp, Mus musculus
cctgtgtcacgggaggagaaaccca

SEQ ID NO: 93614 - DNA, 25 bp, Mus musculus
cctgtgtcatgtcctccaccgtgaa

SEQ ID NO: 93615 - DNA, 25 bp, Mus musculus
cctgtgtctgcgaagtcctatggaa

SEQ ID NO: 93616 - DNA, 25 bp, Mus musculus
cctgtgtctgctgtccttgttgata

SEQ ID NO: 93617 - DNA, 25 bp, Mus musculus
cctgtgtcttcctcgagtgcgggca

SEQ ID NO: 93618 - DNA, 25 bp, Mus musculus
cctgtgtgagacctgtgatagcaag

SEQ ID NO: 93619 - DNA, 25 bp, Mus musculus
cctgtgtggataagagcaaaaaccc

SEQ ID NO: 93620 - DNA, 25 bp, Mus musculus
cctgtgtgggtagcaacccctgcta

SEQ ID NO: 93621 - DNA, 25 bp, Mus musculus
cctgtgttcttcgtcatgggtctcc

SEQ ID NO: 93622 - DNA, 25 bp, Mus musculus
cctgtgttgtgggaatcccgcttgg

SEQ ID NO: 93623 - DNA, 25 bp, Mus musculus
cctgtgtttgatgctggaatacaac

SEQ ID NO: 93624 - DNA, 25 bp, Mus musculus
cctgttaagcaggaggacttcccga

SEQ ID NO: 93625 - DNA, 25 bp, Mus musculus
cctgttacgaatatttgaacagagt

SEQ ID NO: 93626 - DNA, 25 bp, Mus musculus
cctgttagtgggacgatgggttcca

SEQ ID NO: 93627 - DNA, 25 bp, Mus musculus
cctgttatctgaaaagcaaaatggg

SEQ ID NO: 93628 - DNA, 25 bp, Mus musculus
cctgttcaagctggtgttagtgggc

SEQ ID NO: 93629 - DNA, 25 bp, Mus musculus
cctgttcagtgggaatatggtcgcc

SEQ ID NO: 93630 - DNA, 25 bp, Mus musculus
cctgttcctacagacacggaagtgg

SEQ ID NO: 93631 - DNA, 25 bp, Mus musculus
cctgttcgcttctatcatgactgga

SEQ ID NO: 93632 - DNA, 25 bp, Mus musculus
cctgttctctatagcagaggatgct

SEQ ID NO: 93633 - DNA, 25 bp, Mus musculus
cctgttctctgaggtggaggcgtca

SEQ ID NO: 93634 - DNA, 25 bp, Mus musculus
cctgttctggactgtgggtactgta

SEQ ID NO: 93635 - DNA, 25 bp, Mus musculus
cctgttgaagccagtggacctgctg

SEQ ID NO: 93636 - DNA, 25 bp, Mus musculus
cctgttgactgagagtggcatgcaa

SEQ ID NO: 93637 - DNA, 25 bp, Mus musculus
cctgttgatgaaagatgacggctcc

SEQ ID NO: 93638 - DNA, 25 bp, Mus musculus
cctgttggaccagctcatgggcacg

SEQ ID NO: 93639 - DNA, 25 bp, Mus musculus
cctgttggagccagagggcatatct

SEQ ID NO: 93640 - DNA, 25 bp, Mus musculus
cctgtttaactgtgaggtgaccaac

SEQ ID NO: 93641 - DNA, 25 bp, Mus musculus
cctgtttcagtattgggtttcggag

SEQ ID NO: 93642 - DNA, 25 bp, Mus musculus
cctgtttccggacaagagtgcctgg

SEQ ID NO: 93643 - DNA, 25 bp, Mus musculus
cctgtttccggccagcctgtgtgaa

SEQ ID NO: 93644 - DNA, 25 bp, Mus musculus
cctgtttgtgctgtgcacgctattt

SEQ ID NO: 93645 - DNA, 25 bp, Mus musculus
cctgtttttgggatacaacatctga

SEQ ID NO: 93646 - DNA, 25 bp, Mus musculus
ccttaaagttcatgggcacggagct

SEQ ID NO: 93647 - DNA, 25 bp, Mus musculus
ccttaacaggatgggtgcagcgaac

SEQ ID NO: 93648 - DNA, 25 bp, Mus musculus
ccttaacctgtgatggctgtggcaa

SEQ ID NO: 93649 - DNA, 25 bp, Mus musculus
ccttaactcagcttgcaacatgcag

SEQ ID NO: 93650 - DNA, 25 bp, Mus musculus
ccttaactgaggctgtaggctgctg

SEQ ID NO: 93651 - DNA, 25 bp, Mus musculus
ccttaactgggcctgtgaacctgca

SEQ ID NO: 93652 - DNA, 25 bp, Mus musculus
ccttaacttccagctaccttgagat

SEQ ID NO: 93653 - DNA, 25 bp, Mus musculus
ccttaagcacagaagaatattttgt

SEQ ID NO: 93654 - DNA, 25 bp, Mus musculus
ccttaagcttgtggtagcagcagtc

SEQ ID NO: 93655 - DNA, 25 bp, Mus musculus
ccttaaggaggtccagctgccttca

SEQ ID NO: 93656 - DNA, 25 bp, Mus musculus
ccttaagtctccctcaatgtgtggc

SEQ ID NO: 93657 - DNA, 25 bp, Mus musculus
ccttaatagagatggagtccgagca

SEQ ID NO: 93658 - DNA, 25 bp, Mus musculus
ccttaatcagggacaattggccagc

SEQ ID NO: 93659 - DNA, 25 bp, Mus musculus
ccttaatgaaattcaagttgcatgt

SEQ ID NO: 93660 - DNA, 25 bp, Mus musculus
ccttaatgcggttctccctggcaca

SEQ ID NO: 93661 - DNA, 25 bp, Mus musculus
ccttacaaggatggagtgcgtgcaa

SEQ ID NO: 93662 - DNA, 25 bp, Mus musculus
ccttacaaggttgtgaggccctctc

SEQ ID NO: 93663 - DNA, 25 bp, Mus musculus
ccttacaagtgtagatacatctggc

SEQ ID NO: 93664 - DNA, 25 bp, Mus musculus
ccttacaccagccagagagattctt

SEQ ID NO: 93665 - DNA, 25 bp, Mus musculus
ccttaccagctttgacaacacagga

SEQ ID NO: 93666 - DNA, 25 bp, Mus musculus
ccttaccttaggacagccactggac

SEQ ID NO: 93667 - DNA, 25 bp, Mus musculus
ccttacgaaatcacgggtgctggag

SEQ ID NO: 93668 - DNA, 25 bp, Mus musculus
ccttacgacgctattcatgtgggag

SEQ ID NO: 93669 - DNA, 25 bp, Mus musculus
ccttacggttttcagctagacttag

SEQ ID NO: 93670 - DNA, 25 bp, Mus musculus
ccttacttggatggatgctgagaca

SEQ ID NO: 93671 - DNA, 25 bp, Mus musculus
ccttagaagctgatggtggcacaac

SEQ ID NO: 93672 - DNA, 25 bp, Mus musculus
ccttagacaaactgaatggattcca

SEQ ID NO: 93673 - DNA, 25 bp, Mus musculus
ccttagagacctggctgtgcacact

SEQ ID NO: 93674 - DNA, 25 bp, Mus musculus
ccttagaggactacggcagcgagaa

SEQ ID NO: 93675 - DNA, 25 bp, Mus musculus
ccttagatcagataggacctgtggg

SEQ ID NO: 93676 - DNA, 25 bp, Mus musculus
ccttagcaggtgcagtaggagctca

SEQ ID NO: 93677 - DNA, 25 bp, Mus musculus
ccttagccctgagaacgtggacgat

SEQ ID NO: 93678 - DNA, 25 bp, Mus musculus
ccttagcctttggatttagaagtga

SEQ ID NO: 93679 - DNA, 25 bp, Mus musculus
ccttagcgcagaagagacgcccttg

SEQ ID NO: 93680 - DNA, 25 bp, Mus musculus
ccttagcgtgtgtgcagaggagcca

SEQ ID NO: 93681 - DNA, 25 bp, Mus musculus
ccttagctaccggatgataggcgct

SEQ ID NO: 93682 - DNA, 25 bp, Mus musculus
ccttagctgtaggaggactaggctc

SEQ ID NO: 93683 - DNA, 25 bp, Mus musculus
ccttaggagagcctctgggcacaca

SEQ ID NO: 93684 - DNA, 25 bp, Mus musculus
ccttaggagtgatccggaccttcgc

SEQ ID NO: 93685 - DNA, 25 bp, Mus musculus
ccttaggctggcttgggagcgcaaa

SEQ ID NO: 93686 - DNA, 25 bp, Mus musculus
ccttagttcagggtcacaagcggtg

SEQ ID NO: 93687 - DNA, 25 bp, Mus musculus
ccttatatgttctgtggacctggag

SEQ ID NO: 93688 - DNA, 25 bp, Mus musculus
ccttatcatcgtgggaatgctggga

SEQ ID NO: 93689 - DNA, 25 bp, Mus musculus
ccttatcgatggtggccagctgacc

SEQ ID NO: 93690 - DNA, 25 bp, Mus musculus
ccttatgaaggagccgaagtgttgc

SEQ ID NO: 93691 - DNA, 25 bp, Mus musculus
ccttatgacctgtagaagccaggcg

SEQ ID NO: 93692 - DNA, 25 bp, Mus musculus
ccttatggagaaagcatcagccctg

SEQ ID NO: 93693 - DNA, 25 bp, Mus musculus
ccttatggagtgagcacgtagcccc

SEQ ID NO: 93694 - DNA, 25 bp, Mus musculus
ccttatggagttatcaccggccttg

SEQ ID NO: 93695 - DNA, 25 bp, Mus musculus
ccttatgggaggacagtggtataca

SEQ ID NO: 93696 - DNA, 25 bp, Mus musculus
ccttatgtgcgctagatgagctcca

SEQ ID NO: 93697 - DNA, 25 bp, Mus musculus
ccttatgtggatcgacagaatcgca

SEQ ID NO: 93698 - DNA, 25 bp, Mus musculus
ccttattgcgagaaacgctgcagct

SEQ ID NO: 93699 - DNA, 25 bp, Mus musculus
ccttattggaatgagccagtggagc

SEQ ID NO: 93700 - DNA, 25 bp, Mus musculus
ccttattgttgtagagagcgtgctc

SEQ ID NO: 93701 - DNA, 25 bp, Mus musculus
ccttcaaaaagtaccatgtggacca

SEQ ID NO: 93702 - DNA, 25 bp, Mus musculus
ccttcaaattggagacaccgtgcac

SEQ ID NO: 93703 - DNA, 25 bp, Mus musculus
ccttcaagacattaaatgcagaggg

SEQ ID NO: 93704 - DNA, 25 bp, Mus musculus
ccttcaagataacgagtgggactac

SEQ ID NO: 93705 - DNA, 25 bp, Mus musculus
ccttcaagatggttctagcagatct

SEQ ID NO: 93706 - DNA, 25 bp, Mus musculus
ccttcaagcgggagaacaagaacct

SEQ ID NO: 93707 - DNA, 25 bp, Mus musculus
ccttcaagggagatagcaagtccac

SEQ ID NO: 93708 - DNA, 25 bp, Mus musculus
ccttcaagggcatgtggatgactga

SEQ ID NO: 93709 - DNA, 25 bp, Mus musculus
ccttcaagtgggtgatgggccccgt

SEQ ID NO: 93710 - DNA, 25 bp, Mus musculus
ccttcaatccgagcatcttagagaa

SEQ ID NO: 93711 - DNA, 25 bp, Mus musculus
ccttcaatgggatggtgtctaccgc

SEQ ID NO: 93712 - DNA, 25 bp, Mus musculus
ccttcacaaaatggactggtgttgc

SEQ ID NO: 93713 - DNA, 25 bp, Mus musculus
ccttcacaccaaagcctcgggaatg

SEQ ID NO: 93714 - DNA, 25 bp, Mus musculus
ccttcacagaagagagcaacgcact

SEQ ID NO: 93715 - DNA, 25 bp, Mus musculus
ccttcacgggcctctcaattgctta

SEQ ID NO: 93716 - DNA, 25 bp, Mus musculus
ccttcactatccagcaggtacagaa

SEQ ID NO: 93717 - DNA, 25 bp, Mus musculus
ccttcactgggtggcctgacaaggc

SEQ ID NO: 93718 - DNA, 25 bp, Mus musculus
ccttcagagaatcctagtttggttc

SEQ ID NO: 93719 - DNA, 25 bp, Mus musculus
ccttcagagtcaatgtggccctaga

SEQ ID NO: 93720 - DNA, 25 bp, Mus musculus
ccttcagatattttgccgggtgggc

SEQ ID NO: 93721 - DNA, 25 bp, Mus musculus
ccttcagatgatgcgagtggccgaa

SEQ ID NO: 93722 - DNA, 25 bp, Mus musculus
ccttcagcaaatggtggcctcagga

SEQ ID NO: 93723 - DNA, 25 bp, Mus musculus
ccttcagctggtgaacttgtcagaa

SEQ ID NO: 93724 - DNA, 25 bp, Mus musculus
ccttcaggacactgggcggagcgca

SEQ ID NO: 93725 - DNA, 25 bp, Mus musculus
ccttcaggaccatggacgtggagcc

SEQ ID NO: 93726 - DNA, 25 bp, Mus musculus
ccttcaggcaggagtcagaactgtc

SEQ ID NO: 93727 - DNA, 25 bp, Mus musculus
ccttcagggccagatgtggtcttca

SEQ ID NO: 93728 - DNA, 25 bp, Mus musculus
ccttcagtcagtgtgtgggagcaga

SEQ ID NO: 93729 - DNA, 25 bp, Mus musculus
ccttcagtgaggatgacgagatcat

SEQ ID NO: 93730 - DNA, 25 bp, Mus musculus
ccttcagtgagtggaggcctgtcct

SEQ ID NO: 93731 - DNA, 25 bp, Mus musculus
ccttcagttccgtcaaagtacccat

SEQ ID NO: 93732 - DNA, 25 bp, Mus musculus
ccttcagtttgtaggaggcagcctg

SEQ ID NO: 93733 - DNA, 25 bp, Mus musculus
ccttcatagaacacccaatggctgg

SEQ ID NO: 93734 - DNA, 25 bp, Mus musculus
ccttcatatctgttagcagcatcaa

SEQ ID NO: 93735 - DNA, 25 bp, Mus musculus
ccttcatctacatggcctagccggg

SEQ ID NO: 93736 - DNA, 25 bp, Mus musculus
ccttcatgaaatacggagacctcca

SEQ ID NO: 93737 - DNA, 25 bp, Mus musculus
ccttcatgatggttctgctgttggg

SEQ ID NO: 93738 - DNA, 25 bp, Mus musculus
ccttcatgctgggtattgggatgct

SEQ ID NO: 93739 - DNA, 25 bp, Mus musculus
ccttcattctgagctgtaggccagg

SEQ ID NO: 93740 - DNA, 25 bp, Mus musculus
ccttcatttttgtagcccagagcag

SEQ ID NO: 93741 - DNA, 25 bp, Mus musculus
ccttccaagctctaagactgaggta

SEQ ID NO: 93742 - DNA, 25 bp, Mus musculus
ccttccacacaaagaaaacatactg

SEQ ID NO: 93743 - DNA, 25 bp, Mus musculus
ccttccaggactatggcggctgtat

SEQ ID NO: 93744 - DNA, 25 bp, Mus musculus
ccttccatattttatcactgctgtg

SEQ ID NO: 93745 - DNA, 25 bp, Mus musculus
ccttccatggctgcataacaatcaa

SEQ ID NO: 93746 - DNA, 25 bp, Mus musculus
ccttccatgtgagtgctgatgggca

SEQ ID NO: 93747 - DNA, 25 bp, Mus musculus
ccttccattgtcatagaagatcaga

SEQ ID NO: 93748 - DNA, 25 bp, Mus musculus
ccttcccaagcaggtcataggctgg

SEQ ID NO: 93749 - DNA, 25 bp, Mus musculus
ccttcccagaagtgtgcatccggtg

SEQ ID NO: 93750 - DNA, 25 bp, Mus musculus
ccttcccgggctttggagtgcgtca

SEQ ID NO: 93751 - DNA, 25 bp, Mus musculus
ccttccctgatggtaaagaggactc

SEQ ID NO: 93752 - DNA, 25 bp, Mus musculus
ccttccgctggatctgtgagatgaa

SEQ ID NO: 93753 - DNA, 25 bp, Mus musculus
ccttccggcagttttggagtggact

SEQ ID NO: 93754 - DNA, 25 bp, Mus musculus
ccttccgggacaagcgagttgcaga

SEQ ID NO: 93755 - DNA, 25 bp, Mus musculus
ccttccgggagctcaaggcagcttt

SEQ ID NO: 93756 - DNA, 25 bp, Mus musculus
ccttccggttcgagatcagcttcga

SEQ ID NO: 93757 - DNA, 25 bp, Mus musculus
ccttcctgaagaatacggtgatgga

SEQ ID NO: 93758 - DNA, 25 bp, Mus musculus
ccttcctgagggtgatggtagcaac

SEQ ID NO: 93759 - DNA, 25 bp, Mus musculus
ccttcctgctgctacaaggcgtaga

SEQ ID NO: 93760 - DNA, 25 bp, Mus musculus
ccttcctggagcaaacactgtctag

SEQ ID NO: 93761 - DNA, 25 bp, Mus musculus
ccttcctggtccacgcgggacttgg

SEQ ID NO: 93762 - DNA, 25 bp, Mus musculus
ccttcctggtgaagacgggctacgc

SEQ ID NO: 93763 - DNA, 25 bp, Mus musculus
ccttcctgtggatgtgttaacaagc

SEQ ID NO: 93764 - DNA, 25 bp, Mus musculus
ccttccttcgagatggagatcaact

SEQ ID NO: 93765 - DNA, 25 bp, Mus musculus
ccttccttgaactatgagcactgca

SEQ ID NO: 93766 - DNA, 25 bp, Mus musculus
ccttcgacgaggtggacatggctca

SEQ ID NO: 93767 - DNA, 25 bp, Mus musculus
ccttcgagaaaggtgaacttggcat

SEQ ID NO: 93768 - DNA, 25 bp, Mus musculus
ccttcgagaatggtgtgatgccttc

SEQ ID NO: 93769 - DNA, 25 bp, Mus musculus
ccttcgagacatcgtggatgacgac

SEQ ID NO: 93770 - DNA, 25 bp, Mus musculus
ccttcgagcagcctgaatactcggt

SEQ ID NO: 93771 - DNA, 25 bp, Mus musculus
ccttcgagcagctggagcatgttcg

SEQ ID NO: 93772 - DNA, 25 bp, Mus musculus
ccttcgagccgagtatgaggcaatt

SEQ ID NO: 93773 - DNA, 25 bp, Mus musculus
ccttcgatcgctgtggtcgggtagc

SEQ ID NO: 93774 - DNA, 25 bp, Mus musculus
ccttcgatgggtgtcagagctctct

SEQ ID NO: 93775 - DNA, 25 bp, Mus musculus
ccttcgcaataaccgctggagggat

SEQ ID NO: 93776 - DNA, 25 bp, Mus musculus
ccttcgcggtccttcagtgggtctt

SEQ ID NO: 93777 - DNA, 25 bp, Mus musculus
ccttcggacatcgtgaaggtggcca

SEQ ID NO: 93778 - DNA, 25 bp, Mus musculus
ccttcggagtccagcaagcattgag

SEQ ID NO: 93779 - DNA, 25 bp, Mus musculus
ccttcggcacggtgcactgcaggag

SEQ ID NO: 93780 - DNA, 25 bp, Mus musculus
ccttcggcctgtagatgtagatcca

SEQ ID NO: 93781 - DNA, 25 bp, Mus musculus
ccttcggcgggaaggtctatgcctt

SEQ ID NO: 93782 - DNA, 25 bp, Mus musculus
ccttcggtcagcagtctctgtgcat

SEQ ID NO: 93783 - DNA, 25 bp, Mus musculus
ccttcgtatgcacgtcaagggcaga

SEQ ID NO: 93784 - DNA, 25 bp, Mus musculus
ccttcgtgaagaagcgctgggagcc

SEQ ID NO: 93785 - DNA, 25 bp, Mus musculus
ccttcgtgagcacagtgggcatcga

SEQ ID NO: 93786 - DNA, 25 bp, Mus musculus
ccttcgtgagtacaatgaaaatcca

SEQ ID NO: 93787 - DNA, 25 bp, Mus musculus
ccttcgttgagttcgaggacccgcg

SEQ ID NO: 93788 - DNA, 25 bp, Mus musculus
ccttcgtttcggagtccttggagcg

SEQ ID NO: 93789 - DNA, 25 bp, Mus musculus
ccttctaaggtccatcctgagagaa

SEQ ID NO: 93790 - DNA, 25 bp, Mus musculus
ccttctaagtgggaaagcgcggcaa

SEQ ID NO: 93791 - DNA, 25 bp, Mus musculus
ccttctacagacgttcagcagtgaa

SEQ ID NO: 93792 - DNA, 25 bp, Mus musculus
ccttctaggagtatgagggcagcct

SEQ ID NO: 93793 - DNA, 25 bp, Mus musculus
ccttctatgcatgagatctacggac

SEQ ID NO: 93794 - DNA, 25 bp, Mus musculus
ccttctcatgttcagccggcataca

SEQ ID NO: 93795 - DNA, 25 bp, Mus musculus
ccttctccaggatggcagaggcgga

SEQ ID NO: 93796 - DNA, 25 bp, Mus musculus
ccttctccgatggagagcgctggaa

SEQ ID NO: 93797 - DNA, 25 bp, Mus musculus
ccttctccgtgtgctggtcagacaa

SEQ ID NO: 93798 - DNA, 25 bp, Mus musculus
ccttctcctttaaatacagccctgg

SEQ ID NO: 93799 - DNA, 25 bp, Mus musculus
ccttctcggattgctccagtcggga

SEQ ID NO: 93800 - DNA, 25 bp, Mus musculus
ccttctctgtgatggcaatgcggac

SEQ ID NO: 93801 - DNA, 25 bp, Mus musculus
ccttctgaaagaattgggcccatct

SEQ ID NO: 93802 - DNA, 25 bp, Mus musculus
ccttctgaaagctgtctctgtggag

SEQ ID NO: 93803 - DNA, 25 bp, Mus musculus
ccttctgaagatgaaactccttctg

SEQ ID NO: 93804 - DNA, 25 bp, Mus musculus
ccttctgacattgagactgaacaag

SEQ ID NO: 93805 - DNA, 25 bp, Mus musculus
ccttctgcaaaggagatgtgctcac

SEQ ID NO: 93806 - DNA, 25 bp, Mus musculus
ccttctgcaggaccggctggtgaac

SEQ ID NO: 93807 - DNA, 25 bp, Mus musculus
ccttctggatcttctcgtgggagta

SEQ ID NO: 93808 - DNA, 25 bp, Mus musculus
ccttctggccgatagtggttatgac

SEQ ID NO: 93809 - DNA, 25 bp, Mus musculus
ccttctggctggaggattatgcaca

SEQ ID NO: 93810 - DNA, 25 bp, Mus musculus
ccttctgggccagtggccacgagat

SEQ ID NO: 93811 - DNA, 25 bp, Mus musculus
ccttctgggcctgcatggtcgttgt

SEQ ID NO: 93812 - DNA, 25 bp, Mus musculus
ccttctgtcagggtgggcaaatggt

SEQ ID NO: 93813 - DNA, 25 bp, Mus musculus
ccttctgtccgggaaatcctggagg

SEQ ID NO: 93814 - DNA, 25 bp, Mus musculus
ccttctgtcttgtaactgggcggta

SEQ ID NO: 93815 - DNA, 25 bp, Mus musculus
ccttctgtgagatttcccaaggcac

SEQ ID NO: 93816 - DNA, 25 bp, Mus musculus
ccttctgtgcgctcatgattgtgga

SEQ ID NO: 93817 - DNA, 25 bp, Mus musculus
ccttctgtgtaatgagcccgtcttg

SEQ ID NO: 93818 - DNA, 25 bp, Mus musculus
ccttctgttactttgcgggcatgac

SEQ ID NO: 93819 - DNA, 25 bp, Mus musculus
ccttcttgctggagagcggactcag

SEQ ID NO: 93820 - DNA, 25 bp, Mus musculus
ccttcttggaagcttggaactcttg

SEQ ID NO: 93821 - DNA, 25 bp, Mus musculus
ccttcttgggcctggcggttgccga

SEQ ID NO: 93822 - DNA, 25 bp, Mus musculus
ccttcttgtaagaagcccctgtctc

SEQ ID NO: 93823 - DNA, 25 bp, Mus musculus
ccttcttgtggctaagatggcggcg

SEQ ID NO: 93824 - DNA, 25 bp, Mus musculus
ccttctttgaggtggctttttggag

SEQ ID NO: 93825 - DNA, 25 bp, Mus musculus
ccttctttgcagtgtgcgacgggca

SEQ ID NO: 93826 - DNA, 25 bp, Mus musculus
ccttgaaagtgggatcctagagaca

SEQ ID NO: 93827 - DNA, 25 bp, Mus musculus
ccttgaaatgtctgtagcctggcat

SEQ ID NO: 93828 - DNA, 25 bp, Mus musculus
ccttgaaccagcaacagtggatgca

SEQ ID NO: 93829 - DNA, 25 bp, Mus musculus
ccttgaacgtggactttagaggaca

SEQ ID NO: 93830 - DNA, 25 bp, Mus musculus
ccttgaagaacttagtactccagaa

SEQ ID NO: 93831 - DNA, 25 bp, Mus musculus
ccttgaagcgaatgctggagaaact

SEQ ID NO: 93832 - DNA, 25 bp, Mus musculus
ccttgaaggatgttgtagcctgagc

SEQ ID NO: 93833 - DNA, 25 bp, Mus musculus
ccttgaagggcaacaggagcattcg

SEQ ID NO: 93834 - DNA, 25 bp, Mus musculus
ccttgaaggtcatgccggacagctg

SEQ ID NO: 93835 - DNA, 25 bp, Mus musculus
ccttgaccatagagaacactgttgt

SEQ ID NO: 93836 - DNA, 25 bp, Mus musculus
ccttgaccatttgccttgagtggac

SEQ ID NO: 93837 - DNA, 25 bp, Mus musculus
ccttgaccttgactgggagttccca

SEQ ID NO: 93838 - DNA, 25 bp, Mus musculus
ccttgactcagaaagcctcctagat

SEQ ID NO: 93839 - DNA, 25 bp, Mus musculus
ccttgactgatggaagggcgcatcg

SEQ ID NO: 93840 - DNA, 25 bp, Mus musculus
ccttgagagaagtcgggcgcttcgc

SEQ ID NO: 93841 - DNA, 25 bp, Mus musculus
ccttgagcctgaaatggcagtcgct

SEQ ID NO: 93842 - DNA, 25 bp, Mus musculus
ccttgaggagcactttagggatgac

SEQ ID NO: 93843 - DNA, 25 bp, Mus musculus
ccttgaggagcagatcagaactgac

SEQ ID NO: 93844 - DNA, 25 bp, Mus musculus
ccttgaggagcttgagcagtttgcc

SEQ ID NO: 93845 - DNA, 25 bp, Mus musculus
ccttgaggatggaagagcttaggat

SEQ ID NO: 93846 - DNA, 25 bp, Mus musculus
ccttgaggcacaggatctactggac

SEQ ID NO: 93847 - DNA, 25 bp, Mus musculus
ccttgaggccactgtgcgtcatgag

SEQ ID NO: 93848 - DNA, 25 bp, Mus musculus
ccttgagggccgtaagcaacttgct

SEQ ID NO: 93849 - DNA, 25 bp, Mus musculus
ccttgagggctatgtgggctttgcc

SEQ ID NO: 93850 - DNA, 25 bp, Mus musculus
ccttgatgaagtggtacggctgcta

SEQ ID NO: 93851 - DNA, 25 bp, Mus musculus
ccttgattggattcagcctgggagc

SEQ ID NO: 93852 - DNA, 25 bp, Mus musculus
ccttgcaaactggagagtgacactc

SEQ ID NO: 93853 - DNA, 25 bp, Mus musculus
ccttgcaacagtgggagctggtacc

SEQ ID NO: 93854 - DNA, 25 bp, Mus musculus
ccttgcagagctgatagaagagtac

SEQ ID NO: 93855 - DNA, 25 bp, Mus musculus
ccttgcatgcttgatcgggaggcag

SEQ ID NO: 93856 - DNA, 25 bp, Mus musculus
ccttgcatggactcagaatgaacca

SEQ ID NO: 93857 - DNA, 25 bp, Mus musculus
ccttgccaggtggaagtctgcagca

SEQ ID NO: 93858 - DNA, 25 bp, Mus musculus
ccttgcccatggagagtgactgtga

SEQ ID NO: 93859 - DNA, 25 bp, Mus musculus
ccttgccggagcttgaagatgctga

SEQ ID NO: 93860 - DNA, 25 bp, Mus musculus
ccttgcctctctgcgactaaggtgg

SEQ ID NO: 93861 - DNA, 25 bp, Mus musculus
ccttgcctgaagaaggaccgcgtgg

SEQ ID NO: 93862 - DNA, 25 bp, Mus musculus
ccttgcctgagtttgtagacaacac

SEQ ID NO: 93863 - DNA, 25 bp, Mus musculus
ccttgcgagcgcgcctaacggagaa

SEQ ID NO: 93864 - DNA, 25 bp, Mus musculus
ccttgcggcacacgcttctaaagct

SEQ ID NO: 93865 - DNA, 25 bp, Mus musculus
ccttgcgtcttcgtgtgagcgtgcg

SEQ ID NO: 93866 - DNA, 25 bp, Mus musculus
ccttgctaaggttcacagtgtcaca

SEQ ID NO: 93867 - DNA, 25 bp, Mus musculus
ccttgctagatgatgtggtcccgcc

SEQ ID NO: 93868 - DNA, 25 bp, Mus musculus
ccttgctgcaagtaccaggtggagt

SEQ ID NO: 93869 - DNA, 25 bp, Mus musculus
ccttgctggatgaggacaagaagcc

SEQ ID NO: 93870 - DNA, 25 bp, Mus musculus
ccttgctggtctgagtggaggacat

SEQ ID NO: 93871 - DNA, 25 bp, Mus musculus
ccttggaaatcttgaaccctacaca

SEQ ID NO: 93872 - DNA, 25 bp, Mus musculus
ccttggaacctgaatgactgctgag

SEQ ID NO: 93873 - DNA, 25 bp, Mus musculus
ccttggaagccgacagaggtggcaa

SEQ ID NO: 93874 - DNA, 25 bp, Mus musculus
ccttggaaggagctgcctgagactc

SEQ ID NO: 93875 - DNA, 25 bp, Mus musculus
ccttggaatctctagcgtaggctga

SEQ ID NO: 93876 - DNA, 25 bp, Mus musculus
ccttggaatggctagatcaggttca

SEQ ID NO: 93877 - DNA, 25 bp, Mus musculus
ccttggacacagtcactttctacaa

SEQ ID NO: 93878 - DNA, 25 bp, Mus musculus
ccttggaccaagtgacggacatgat

SEQ ID NO: 93879 - DNA, 25 bp, Mus musculus
ccttggaccagtaggacctgcatga

SEQ ID NO: 93880 - DNA, 25 bp, Mus musculus
ccttggaccccagtcatataggtga

SEQ ID NO: 93881 - DNA, 25 bp, Mus musculus
ccttggaccggcgtatgggtcgcct

SEQ ID NO: 93882 - DNA, 25 bp, Mus musculus
ccttggactctactgtgggaagacc

SEQ ID NO: 93883 - DNA, 25 bp, Mus musculus
ccttggactcttgggctgcgattct

SEQ ID NO: 93884 - DNA, 25 bp, Mus musculus
ccttggagatgctggagaattcgct

SEQ ID NO: 93885 - DNA, 25 bp, Mus musculus
ccttggagatggtgaagccccagtc

SEQ ID NO: 93886 - DNA, 25 bp, Mus musculus
ccttggagcgaaggcattttaaaat

SEQ ID NO: 93887 - DNA, 25 bp, Mus musculus
ccttggagcggttcctgcggagact

SEQ ID NO: 93888 - DNA, 25 bp, Mus musculus
ccttggagctactgaagctagcaag

SEQ ID NO: 93889 - DNA, 25 bp, Mus musculus
ccttggaggaattactgagaacaga

SEQ ID NO: 93890 - DNA, 25 bp, Mus musculus
ccttggaggacatggatgcgctaga

SEQ ID NO: 93891 - DNA, 25 bp, Mus musculus
ccttggaggccggattgtgcgtaaa

SEQ ID NO: 93892 - DNA, 25 bp, Mus musculus
ccttggatcttatgcacgaccttag

SEQ ID NO: 93893 - DNA, 25 bp, Mus musculus
ccttggatgtctgagcgaatgaaac

SEQ ID NO: 93894 - DNA, 25 bp, Mus musculus
ccttggattcgaagatgatgttgtc

SEQ ID NO: 93895 - DNA, 25 bp, Mus musculus
ccttggcagctgacttgagaaatct

SEQ ID NO: 93896 - DNA, 25 bp, Mus musculus
ccttggcaggtagtgcacgcctcat

SEQ ID NO: 93897 - DNA, 25 bp, Mus musculus
ccttggcatggtagagatggcctta

SEQ ID NO: 93898 - DNA, 25 bp, Mus musculus
ccttggcctgcgagaacattttgat

SEQ ID NO: 93899 - DNA, 25 bp, Mus musculus
ccttggcgagcttggatacgagagt

SEQ ID NO: 93900 - DNA, 25 bp, Mus musculus
ccttggcgctcttgtctctcggcag

SEQ ID NO: 93901 - DNA, 25 bp, Mus musculus
ccttggctccagtgtgcaaatataa

SEQ ID NO: 93902 - DNA, 25 bp, Mus musculus
ccttggctctggactgggcattgga

SEQ ID NO: 93903 - DNA, 25 bp, Mus musculus
ccttggctgaaacaggacgactgga

SEQ ID NO: 93904 - DNA, 25 bp, Mus musculus
ccttggctgtacctccatggattga

SEQ ID NO: 93905 - DNA, 25 bp, Mus musculus
ccttggctttgagactctggcatca

SEQ ID NO: 93906 - DNA, 25 bp, Mus musculus
ccttgggagagacctatgactttga

SEQ ID NO: 93907 - DNA, 25 bp, Mus musculus
ccttgggagcgccagttccgtctgt

SEQ ID NO: 93908 - DNA, 25 bp, Mus musculus
ccttgggatgtctctggctgatgag

SEQ ID NO: 93909 - DNA, 25 bp, Mus musculus
ccttgggcaggatgaagaaccactc

SEQ ID NO: 93910 - DNA, 25 bp, Mus musculus
ccttgggccatgtcacagaatgaac

SEQ ID NO: 93911 - DNA, 25 bp, Mus musculus
ccttgggtcccaagaagattggtct

SEQ ID NO: 93912 - DNA, 25 bp, Mus musculus
ccttgggtggactccattgcagggt

SEQ ID NO: 93913 - DNA, 25 bp, Mus musculus
ccttggtaatcatcagcactttaga

SEQ ID NO: 93914 - DNA, 25 bp, Mus musculus
ccttggtagccaacggagtccgtgc

SEQ ID NO: 93915 - DNA, 25 bp, Mus musculus
ccttggtgacctgagaaaacttctt

SEQ ID NO: 93916 - DNA, 25 bp, Mus musculus
ccttggtgccctccggtcgaagttg

SEQ ID NO: 93917 - DNA, 25 bp, Mus musculus
ccttggtgggtgtaccctgccagca

SEQ ID NO: 93918 - DNA, 25 bp, Mus musculus
ccttggtggtgaatcagatgcagaa

SEQ ID NO: 93919 - DNA, 25 bp, Mus musculus
ccttggtgtcagtttcacagccagc

SEQ ID NO: 93920 - DNA, 25 bp, Mus musculus
ccttgtaaaaggactcaggagcagc

SEQ ID NO: 93921 - DNA, 25 bp, Mus musculus
ccttgtacacgaaggctaaccttat

SEQ ID NO: 93922 - DNA, 25 bp, Mus musculus
ccttgtagagactggaacagccgat

SEQ ID NO: 93923 - DNA, 25 bp, Mus musculus
ccttgtcaagactttggcaaacgga

SEQ ID NO: 93924 - DNA, 25 bp, Mus musculus
ccttgtcagttgtgagcgaggacca

SEQ ID NO: 93925 - DNA, 25 bp, Mus musculus
ccttgtcatgaacagtgcacacgca

SEQ ID NO: 93926 - DNA, 25 bp, Mus musculus
ccttgtcattgcttcccaggaacct

SEQ ID NO: 93927 - DNA, 25 bp, Mus musculus
ccttgtccgctttggcttgtcgatt

SEQ ID NO: 93928 - DNA, 25 bp, Mus musculus
ccttgtcctgtgtgcggaaagcgct

SEQ ID NO: 93929 - DNA, 25 bp, Mus musculus
ccttgtcgcaggtaaactgagggct

SEQ ID NO: 93930 - DNA, 25 bp, Mus musculus
ccttgtctaaggagttacactgcca

SEQ ID NO: 93931 - DNA, 25 bp, Mus musculus
ccttgtctcagggaatatggtggag

SEQ ID NO: 93932 - DNA, 25 bp, Mus musculus
ccttgtctcggtggtggcgtattca

SEQ ID NO: 93933 - DNA, 25 bp, Mus musculus
ccttgtgaagtcttaatgttcggaa

SEQ ID NO: 93934 - DNA, 25 bp, Mus musculus
ccttgtgaccagttccatggatgca

SEQ ID NO: 93935 - DNA, 25 bp, Mus musculus
ccttgtgaggaggaaaccggacgct

SEQ ID NO: 93936 - DNA, 25 bp, Mus musculus
ccttgtgccaatgagccttcccaac

SEQ ID NO: 93937 - DNA, 25 bp, Mus musculus
ccttgtgcctgggtggttgaatcaa

SEQ ID NO: 93938 - DNA, 25 bp, Mus musculus
ccttgtgcggaggatcaggtactac

SEQ ID NO: 93939 - DNA, 25 bp, Mus musculus
ccttgtggaaggaggcgagaacatc

SEQ ID NO: 93940 - DNA, 25 bp, Mus musculus
ccttgtggacaagatctggacagac

SEQ ID NO: 93941 - DNA, 25 bp, Mus musculus
ccttgtggcccgatcactgtgaaga

SEQ ID NO: 93942 - DNA, 25 bp, Mus musculus
ccttgtggtcctaactcagtctgca

SEQ ID NO: 93943 - DNA, 25 bp, Mus musculus
ccttgtgtaacaaagtcagcgtgga

SEQ ID NO: 93944 - DNA, 25 bp, Mus musculus
ccttgtgtgcaatgagactgagaga

SEQ ID NO: 93945 - DNA, 25 bp, Mus musculus
ccttgtgtggtagggttgtccaaga

SEQ ID NO: 93946 - DNA, 25 bp, Mus musculus
ccttgttacagcaaccagtgcagac

SEQ ID NO: 93947 - DNA, 25 bp, Mus musculus
ccttgttgacctcgagtctatggag

SEQ ID NO: 93948 - DNA, 25 bp, Mus musculus
ccttgttggatgacacggtctacga

SEQ ID NO: 93949 - DNA, 25 bp, Mus musculus
ccttgttggccagcaggtgacgcta

SEQ ID NO: 93950 - DNA, 25 bp, Mus musculus
ccttgttttggacagatacgccttt

SEQ ID NO: 93951 - DNA, 25 bp, Mus musculus
cctttaaagcagatcagggtctggc

SEQ ID NO: 93952 - DNA, 25 bp, Mus musculus
cctttacccagtgtgcaagccttaa

SEQ ID NO: 93953 - DNA, 25 bp, Mus musculus
cctttacgacaagctgtggtttgca

SEQ ID NO: 93954 - DNA, 25 bp, Mus musculus
cctttactgtccattccgagcaggg

SEQ ID NO: 93955 - DNA, 25 bp, Mus musculus
cctttagacgcggacggcatccgaa

SEQ ID NO: 93956 - DNA, 25 bp, Mus musculus
cctttagagctagtgggtgagacag

SEQ ID NO: 93957 - DNA, 25 bp, Mus musculus
cctttagagtgcaactgcccagcag

SEQ ID NO: 93958 - DNA, 25 bp, Mus musculus
cctttatgaacagtcagcgggcagc

SEQ ID NO: 93959 - DNA, 25 bp, Mus musculus
cctttatgtcagagagaaccttgga

SEQ ID NO: 93960 - DNA, 25 bp, Mus musculus
cctttatgtgttgaggccagccctc

SEQ ID NO: 93961 - DNA, 25 bp, Mus musculus
cctttcaactcatgaggccagggag

SEQ ID NO: 93962 - DNA, 25 bp, Mus musculus
cctttcaggaactccctttgctcag

SEQ ID NO: 93963 - DNA, 25 bp, Mus musculus
cctttcaggaagtcaatggctaggg

SEQ ID NO: 93964 - DNA, 25 bp, Mus musculus
cctttcatccgggacagtagcgaag

SEQ ID NO: 93965 - DNA, 25 bp, Mus musculus
cctttcatgcttgtagaggccgtca

SEQ ID NO: 93966 - DNA, 25 bp, Mus musculus
cctttccagagtcacatcgctagca

SEQ ID NO: 93967 - DNA, 25 bp, Mus musculus
cctttccccagaagagcatggagcc

SEQ ID NO: 93968 - DNA, 25 bp, Mus musculus
cctttccctgtgacttacatgcctg

SEQ ID NO: 93969 - DNA, 25 bp, Mus musculus
cctttccgaggtgggatctccagga

SEQ ID NO: 93970 - DNA, 25 bp, Mus musculus
cctttccgctgacaagtgagcttgg

SEQ ID NO: 93971 - DNA, 25 bp, Mus musculus
cctttccttaggagggccaggctga

SEQ ID NO: 93972 - DNA, 25 bp, Mus musculus
cctttcgaaagggtgacatggtgac

SEQ ID NO: 93973 - DNA, 25 bp, Mus musculus
cctttcgagttaatcctgggtccag

SEQ ID NO: 93974 - DNA, 25 bp, Mus musculus
cctttcgcctgctgggaatgtggca

SEQ ID NO: 93975 - DNA, 25 bp, Mus musculus
cctttctgagacaggttcgggcggt

SEQ ID NO: 93976 - DNA, 25 bp, Mus musculus
cctttctggctttttgtggagtact

SEQ ID NO: 93977 - DNA, 25 bp, Mus musculus
cctttcttgaagtggagcgcataca

SEQ ID NO: 93978 - DNA, 25 bp, Mus musculus
cctttgaaaagccatccagtccagg

SEQ ID NO: 93979 - DNA, 25 bp, Mus musculus
cctttgaaagcagtgcagcgtgcgc

SEQ ID NO: 93980 - DNA, 25 bp, Mus musculus
cctttgaacccttcactgctgcccg

SEQ ID NO: 93981 - DNA, 25 bp, Mus musculus
cctttgaagcggcagaactgtgact

SEQ ID NO: 93982 - DNA, 25 bp, Mus musculus
cctttgacactaatgggaccactga

SEQ ID NO: 93983 - DNA, 25 bp, Mus musculus
cctttgagaatatgaccagccagac

SEQ ID NO: 93984 - DNA, 25 bp, Mus musculus
cctttgagcttctgggccttagcac

SEQ ID NO: 93985 - DNA, 25 bp, Mus musculus
cctttgatggatgtcagaggcagaa

SEQ ID NO: 93986 - DNA, 25 bp, Mus musculus
cctttgatttgctgcccgaggtgca

SEQ ID NO: 93987 - DNA, 25 bp, Mus musculus
cctttgattttgattctggagtgaa

SEQ ID NO: 93988 - DNA, 25 bp, Mus musculus
cctttgcagcgctctattgggaaga

SEQ ID NO: 93989 - DNA, 25 bp, Mus musculus
cctttgcagtacatgtggtggtacc

SEQ ID NO: 93990 - DNA, 25 bp, Mus musculus
cctttgcagttgataccctgaggga

SEQ ID NO: 93991 - DNA, 25 bp, Mus musculus
cctttgcccggtcagccttgtggga

SEQ ID NO: 93992 - DNA, 25 bp, Mus musculus
cctttgccctgctactgggagagca

SEQ ID NO: 93993 - DNA, 25 bp, Mus musculus
cctttgccgttggtaccagagttgc

SEQ ID NO: 93994 - DNA, 25 bp, Mus musculus
cctttgcctgtagccctggagagag

SEQ ID NO: 93995 - DNA, 25 bp, Mus musculus
cctttgcgagggtctctggagtcac

SEQ ID NO: 93996 - DNA, 25 bp, Mus musculus
cctttgcgcagttgaggacctcttg

SEQ ID NO: 93997 - DNA, 25 bp, Mus musculus
cctttgctgataagacactgctgga

SEQ ID NO: 93998 - DNA, 25 bp, Mus musculus
cctttgctgtgtgggcagtactctg

SEQ ID NO: 93999 - DNA, 25 bp, Mus musculus
cctttggaactttggcgagacagaa

SEQ ID NO: 94000 - DNA, 25 bp, Mus musculus
cctttggactggtccctagggcgca

SEQ ID NO: 94001 - DNA, 25 bp, Mus musculus
cctttggagccgatgcagcctttag

SEQ ID NO: 94002 - DNA, 25 bp, Mus musculus
cctttggaggagtatacagtggacc

SEQ ID NO: 94003 - DNA, 25 bp, Mus musculus
cctttggatgctaagctcgtgtctc

SEQ ID NO: 94004 - DNA, 25 bp, Mus musculus
cctttggcatggtccgcctgggagc

SEQ ID NO: 94005 - DNA, 25 bp, Mus musculus
cctttggccggcttttgagtgaggc

SEQ ID NO: 94006 - DNA, 25 bp, Mus musculus
cctttggctctgtccccactgagga

SEQ ID NO: 94007 - DNA, 25 bp, Mus musculus
cctttgggagaagccttggagctac

SEQ ID NO: 94008 - DNA, 25 bp, Mus musculus
cctttgggcgctttgggctgcagca

SEQ ID NO: 94009 - DNA, 25 bp, Mus musculus
cctttgggcgtctcatggtggaaaa

SEQ ID NO: 94010 - DNA, 25 bp, Mus musculus
cctttgggtacttcagaggaaccag

SEQ ID NO: 94011 - DNA, 25 bp, Mus musculus
cctttggtgtacatgaggaaagcac

SEQ ID NO: 94012 - DNA, 25 bp, Mus musculus
cctttgtaaggactgcgtcgtggaa

SEQ ID NO: 94013 - DNA, 25 bp, Mus musculus
cctttgtacatgcaacaacttggag

SEQ ID NO: 94014 - DNA, 25 bp, Mus musculus
cctttgtagtggctgtcaagcagga

SEQ ID NO: 94015 - DNA, 25 bp, Mus musculus
cctttgtcaaccgaacagctgtgat

SEQ ID NO: 94016 - DNA, 25 bp, Mus musculus
cctttgtcaagatcctgcgagcaga

SEQ ID NO: 94017 - DNA, 25 bp, Mus musculus
cctttgtccttgctgggtgaggcca

SEQ ID NO: 94018 - DNA, 25 bp, Mus musculus
cctttgtctgttccaagtgtgggaa

SEQ ID NO: 94019 - DNA, 25 bp, Mus musculus
cctttgtgactgacgagcatgccca

SEQ ID NO: 94020 - DNA, 25 bp, Mus musculus
cctttgtgcatgtgctgggagacct

SEQ ID NO: 94021 - DNA, 25 bp, Mus musculus
cctttgtgcctctcagtctctgtct

SEQ ID NO: 94022 - DNA, 25 bp, Mus musculus
cctttgtgcgtgaagagctagctcg

SEQ ID NO: 94023 - DNA, 25 bp, Mus musculus
cctttgtgttggaaaatgtgagcgt

SEQ ID NO: 94024 - DNA, 25 bp, Mus musculus
cctttgtgttggatcgtcgtgggcc

SEQ ID NO: 94025 - DNA, 25 bp, Mus musculus
ccttttaacgaacgaacagctagag

SEQ ID NO: 94026 - DNA, 25 bp, Mus musculus
ccttttaagtgtcgctgggattctc

SEQ ID NO: 94027 - DNA, 25 bp, Mus musculus
ccttttaatgcgcagcctagagagc

SEQ ID NO: 94028 - DNA, 25 bp, Mus musculus
ccttttagaccatggcaacgtatct

SEQ ID NO: 94029 - DNA, 25 bp, Mus musculus
ccttttagaggagacgatggaatat

SEQ ID NO: 94030 - DNA, 25 bp, Mus musculus
ccttttaggatctagacatacgggt

SEQ ID NO: 94031 - DNA, 25 bp, Mus musculus
ccttttatgtgcgaacatgtaacaa

SEQ ID NO: 94032 - DNA, 25 bp, Mus musculus
ccttttcaaaagatggagtcgggct

SEQ ID NO: 94033 - DNA, 25 bp, Mus musculus
ccttttctgcagacaagacaccgga

SEQ ID NO: 94034 - DNA, 25 bp, Mus musculus
ccttttgacagcgtcccggaagtca

SEQ ID NO: 94035 - DNA, 25 bp, Mus musculus
ccttttgcaacaggtgagtccccta

SEQ ID NO: 94036 - DNA, 25 bp, Mus musculus
ccttttggaacctgacagatgcagc

SEQ ID NO: 94037 - DNA, 25 bp, Mus musculus
ccttttggacagaggtgctaatgcc

SEQ ID NO: 94038 - DNA, 25 bp, Mus musculus
ccttttggattggtagctgagcggc

SEQ ID NO: 94039 - DNA, 25 bp, Mus musculus
ccttttgtgaaaataggaattccag

SEQ ID NO: 94040 - DNA, 25 bp, Mus musculus
ccttttgtgaactgcagggacccgg

SEQ ID NO: 94041 - DNA, 25 bp, Mus musculus
ccttttgtgaatgacctggacttgc

SEQ ID NO: 94042 - DNA, 25 bp, Mus musculus
ccttttgtgagatcctatgagggag

SEQ ID NO: 94043 - DNA, 25 bp, Mus musculus
ccttttgtgtgttgactgagcccag

SEQ ID NO: 94044 - DNA, 25 bp, Mus musculus
cctttttagatcttttagatgctgc

SEQ ID NO: 94045 - DNA, 25 bp, Mus musculus
cctttttccgggtggctgcaatcct

SEQ ID NO: 94046 - DNA, 25 bp, Mus musculus
cctttttctggctgagagtcgtccc

SEQ ID NO: 94047 - DNA, 25 bp, Mus musculus
cctttttgagtacgacctgctgccc

SEQ ID NO: 94048 - DNA, 25 bp, Mus musculus
ccttttttgcgagggccaagagtgg

SEQ ID NO: 94049 - DNA, 25 bp, Mus musculus
ccttttttgctctgctggctgggac

SEQ ID NO: 94050 - DNA, 25 bp, Mus musculus
cgaaaaacactagccaaggcgcctg

SEQ ID NO: 94051 - DNA, 25 bp, Mus musculus
cgaaaaagactatggttaccagact

SEQ ID NO: 94052 - DNA, 25 bp, Mus musculus
cgaaaaaggagcaatcactgaaggc

SEQ ID NO: 94053 - DNA, 25 bp, Mus musculus
cgaaaaatcaaagctattggtggga

SEQ ID NO: 94054 - DNA, 25 bp, Mus musculus
cgaaaactctgtctgggctattgga

SEQ ID NO: 94055 - DNA, 25 bp, Mus musculus
cgaaaactgggtggtcactgctgcc

SEQ ID NO: 94056 - DNA, 25 bp, Mus musculus
cgaaaagaccaacaggaccatgagt

SEQ ID NO: 94057 - DNA, 25 bp, Mus musculus
cgaaaagttttggatggcttaactg

SEQ ID NO: 94058 - DNA, 25 bp, Mus musculus
cgaaaataagctcgatcatgggcct

SEQ ID NO: 94059 - DNA, 25 bp, Mus musculus
cgaaaccaggtcatcatccctctgg

SEQ ID NO: 94060 - DNA, 25 bp, Mus musculus
cgaaacgccaatgagctatctgtgc

SEQ ID NO: 94061 - DNA, 25 bp, Mus musculus
cgaaactactacttgggcatccagg

SEQ ID NO: 94062 - DNA, 25 bp, Mus musculus
cgaaactgtgagtgactgttcccca

SEQ ID NO: 94063 - DNA, 25 bp, Mus musculus
cgaaagaagactgccgcgaagtgag

SEQ ID NO: 94064 - DNA, 25 bp, Mus musculus
cgaaagagccgtagaagaaagttca

SEQ ID NO: 94065 - DNA, 25 bp, Mus musculus
cgaaagatactgcaaggttcaagga

SEQ ID NO: 94066 - DNA, 25 bp, Mus musculus
cgaaagcagtcacaagtcagctggg

SEQ ID NO: 94067 - DNA, 25 bp, Mus musculus
cgaaagccaggcagatctgaatgac

SEQ ID NO: 94068 - DNA, 25 bp, Mus musculus
cgaaagccttcagagggaagctgct

SEQ ID NO: 94069 - DNA, 25 bp, Mus musculus
cgaaagcgacgaagcagtcggagcc

SEQ ID NO: 94070 - DNA, 25 bp, Mus musculus
cgaaagcggcgcatacgtactcaat

SEQ ID NO: 94071 - DNA, 25 bp, Mus musculus
cgaaagctccgggagaccggccaga

SEQ ID NO: 94072 - DNA, 25 bp, Mus musculus
cgaaagctgcagtgtaaattatacc

SEQ ID NO: 94073 - DNA, 25 bp, Mus musculus
cgaaaggattaaaacagcagcagca

SEQ ID NO: 94074 - DNA, 25 bp, Mus musculus
cgaaagtcatctccgcagaggaagc

SEQ ID NO: 94075 - DNA, 25 bp, Mus musculus
cgaaagtgcacctggaatcgtgggt

SEQ ID NO: 94076 - DNA, 25 bp, Mus musculus
cgaaatcaaatggtcaaggctgctg

SEQ ID NO: 94077 - DNA, 25 bp, Mus musculus
cgaaatcaccagtgcaacccagaac

SEQ ID NO: 94078 - DNA, 25 bp, Mus musculus
cgaaatcacgggtgctggagatgca

SEQ ID NO: 94079 - DNA, 25 bp, Mus musculus
cgaaatcagtgtgaaagaagaggtg

SEQ ID NO: 94080 - DNA, 25 bp, Mus musculus
cgaaatcatccgaagcaaggctgga

SEQ ID NO: 94081 - DNA, 25 bp, Mus musculus
cgaaatcctaggaaggcagcgctgt

SEQ ID NO: 94082 - DNA, 25 bp, Mus musculus
cgaaatctctttcaccggcagggtt

SEQ ID NO: 94083 - DNA, 25 bp, Mus musculus
cgaaatgagtagttccggcggccat

SEQ ID NO: 94084 - DNA, 25 bp, Mus musculus
cgaaatggagcagtcatctggcact

SEQ ID NO: 94085 - DNA, 25 bp, Mus musculus
cgaaattaccgaccacagtgttgtg

SEQ ID NO: 94086 - DNA, 25 bp, Mus musculus
cgaaattttgatccgcccatcgagg

SEQ ID NO: 94087 - DNA, 25 bp, Mus musculus
cgaaattttgtggtgccctgcgccc

SEQ ID NO: 94088 - DNA, 25 bp, Mus musculus
cgaacactttgttaggctccgccaa

SEQ ID NO: 94089 - DNA, 25 bp, Mus musculus
cgaacagaacaggaaagcaaaggcc

SEQ ID NO: 94090 - DNA, 25 bp, Mus musculus
cgaacagagactcttcgacccgagc

SEQ ID NO: 94091 - DNA, 25 bp, Mus musculus
cgaacagcgtggattgcaaagcaac

SEQ ID NO: 94092 - DNA, 25 bp, Mus musculus
cgaaccatcgaaggagcaaagagac

SEQ ID NO: 94093 - DNA, 25 bp, Mus musculus
cgaacctcggacaccagttgggagt

SEQ ID NO: 94094 - DNA, 25 bp, Mus musculus
cgaacctctaggactggatgctgca

SEQ ID NO: 94095 - DNA, 25 bp, Mus musculus
cgaacggagcgaatgtcaacgcaca

SEQ ID NO: 94096 - DNA, 25 bp, Mus musculus
cgaacggagtacagtgaagagaacc

SEQ ID NO: 94097 - DNA, 25 bp, Mus musculus
cgaacgggagggattcctgtcaccg

SEQ ID NO: 94098 - DNA, 25 bp, Mus musculus
cgaactgcggcccaatgattccggg

SEQ ID NO: 94099 - DNA, 25 bp, Mus musculus
cgaactgtatgcagagccccatcag

SEQ ID NO: 94100 - DNA, 25 bp, Mus musculus
cgaacttctccgcattgagcaggag

SEQ ID NO: 94101 - DNA, 25 bp, Mus musculus
cgaagaacatcgtgagtggcgtcct

SEQ ID NO: 94102 - DNA, 25 bp, Mus musculus
cgaagaagtggtaaatgacaggagc

SEQ ID NO: 94103 - DNA, 25 bp, Mus musculus
cgaagacaagctcgtcgtgggcact

SEQ ID NO: 94104 - DNA, 25 bp, Mus musculus
cgaagactagtctacccactggaag

SEQ ID NO: 94105 - DNA, 25 bp, Mus musculus
cgaagactgaccttctggaatctca

SEQ ID NO: 94106 - DNA, 25 bp, Mus musculus
cgaagagccctctatgggaggacaa

SEQ ID NO: 94107 - DNA, 25 bp, Mus musculus
cgaagagtgggaaatcaggaacttt

SEQ ID NO: 94108 - DNA, 25 bp, Mus musculus
cgaagagttcatgctgcgccggtac

SEQ ID NO: 94109 - DNA, 25 bp, Mus musculus
cgaagatctcttcctctgaatttaa

SEQ ID NO: 94110 - DNA, 25 bp, Mus musculus
cgaagatgacattcagtttgttagt

SEQ ID NO: 94111 - DNA, 25 bp, Mus musculus
cgaagatggcggctctcaaactcct

SEQ ID NO: 94112 - DNA, 25 bp, Mus musculus
cgaagattgtcagagtgccccatgc

SEQ ID NO: 94113 - DNA, 25 bp, Mus musculus
cgaagcaaggtttcacgatccgcaa

SEQ ID NO: 94114 - DNA, 25 bp, Mus musculus
cgaagcacgctgaaggcacaatgga

SEQ ID NO: 94115 - DNA, 25 bp, Mus musculus
cgaagccaggcatgctcaatgtgca

SEQ ID NO: 94116 - DNA, 25 bp, Mus musculus
cgaagcctttctgcagtacctgaca

SEQ ID NO: 94117 - DNA, 25 bp, Mus musculus
cgaagcgacattaactgctcggtga

SEQ ID NO: 94118 - DNA, 25 bp, Mus musculus
cgaagcgcgagaagatgcgcgccaa

SEQ ID NO: 94119 - DNA, 25 bp, Mus musculus
cgaagcgttgcaagaagtcctgaag

SEQ ID NO: 94120 - DNA, 25 bp, Mus musculus
cgaagctctgatctggtgaaacacc

SEQ ID NO: 94121 - DNA, 25 bp, Mus musculus
cgaagctctggaaaattaaatgtgg

SEQ ID NO: 94122 - DNA, 25 bp, Mus musculus
cgaagctgaagctgcaggtgaacca

SEQ ID NO: 94123 - DNA, 25 bp, Mus musculus
cgaagctgatggagtttgtgtacaa

SEQ ID NO: 94124 - DNA, 25 bp, Mus musculus
cgaagcttggctgggctgtgctccc

SEQ ID NO: 94125 - DNA, 25 bp, Mus musculus
cgaaggacatgcactctccgcattt

SEQ ID NO: 94126 - DNA, 25 bp, Mus musculus
cgaaggacgaacgtgcagcgatcca

SEQ ID NO: 94127 - DNA, 25 bp, Mus musculus
cgaaggcagttgtgtatctgcagca

SEQ ID NO: 94128 - DNA, 25 bp, Mus musculus
cgaaggcctaaatgtcctggtgaca

SEQ ID NO: 94129 - DNA, 25 bp, Mus musculus
cgaaggctccagaagcgcaatgcat

SEQ ID NO: 94130 - DNA, 25 bp, Mus musculus
cgaaggctggaagggatcgatcaca

SEQ ID NO: 94131 - DNA, 25 bp, Mus musculus
cgaaggctgtccgaggtaggctcct

SEQ ID NO: 94132 - DNA, 25 bp, Mus musculus
cgaaggctgtggtgaaactggaccc

SEQ ID NO: 94133 - DNA, 25 bp, Mus musculus
cgaagggagcagtataaagaaggcc

SEQ ID NO: 94134 - DNA, 25 bp, Mus musculus
cgaagggcgcccaggttccagtcgc

SEQ ID NO: 94135 - DNA, 25 bp, Mus musculus
cgaaggtcctcaccgtgctatggag

SEQ ID NO: 94136 - DNA, 25 bp, Mus musculus
cgaaggtggagagcttcctgcctca

SEQ ID NO: 94137 - DNA, 25 bp, Mus musculus
cgaaggttgcagatcactccggact

SEQ ID NO: 94138 - DNA, 25 bp, Mus musculus
cgaagtcaaggagctttcagaagcc

SEQ ID NO: 94139 - DNA, 25 bp, Mus musculus
cgaagtcttagtccggcttacaggg

SEQ ID NO: 94140 - DNA, 25 bp, Mus musculus
cgaagtggcactacaccaggatgtg

SEQ ID NO: 94141 - DNA, 25 bp, Mus musculus
cgaagtgggctgcagagttggaccg

SEQ ID NO: 94142 - DNA, 25 bp, Mus musculus
cgaagtgtcattgtgtgtcagggca

SEQ ID NO: 94143 - DNA, 25 bp, Mus musculus
cgaagtgtgaaacgatccggagaca

SEQ ID NO: 94144 - DNA, 25 bp, Mus musculus
cgaagtgttggatacaggccagact

SEQ ID NO: 94145 - DNA, 25 bp, Mus musculus
cgaagttctttgtgccaggctccta

SEQ ID NO: 94146 - DNA, 25 bp, Mus musculus
cgaagtttcttcttcccacattgaa

SEQ ID NO: 94147 - DNA, 25 bp, Mus musculus
cgaataatgtcaccgggaagccagg

SEQ ID NO: 94148 - DNA, 25 bp, Mus musculus
cgaataattggcctgaaagatgaat

SEQ ID NO: 94149 - DNA, 25 bp, Mus musculus
cgaatacttgaagcctgggacacaa

SEQ ID NO: 94150 - DNA, 25 bp, Mus musculus
cgaatcatggtttagtgccctgcca

SEQ ID NO: 94151 - DNA, 25 bp, Mus musculus
cgaatccagtgtcagatccagggcc

SEQ ID NO: 94152 - DNA, 25 bp, Mus musculus
cgaatcgtggcagtcatcggcgctg

SEQ ID NO: 94153 - DNA, 25 bp, Mus musculus
cgaatctaccacaaattggatcccc

SEQ ID NO: 94154 - DNA, 25 bp, Mus musculus
cgaatgaagcaaagcgcgagcggaa

SEQ ID NO: 94155 - DNA, 25 bp, Mus musculus
cgaatgagggctgtgaaagacccgc

SEQ ID NO: 94156 - DNA, 25 bp, Mus musculus
cgaatgcacaggaagacacgatgga

SEQ ID NO: 94157 - DNA, 25 bp, Mus musculus
cgaatgcttgcacgtgtacccagga

SEQ ID NO: 94158 - DNA, 25 bp, Mus musculus
cgaatggaagagtatgagcggaacc

SEQ ID NO: 94159 - DNA, 25 bp, Mus musculus
cgaatggcgactagccgtgggcact

SEQ ID NO: 94160 - DNA, 25 bp, Mus musculus
cgaatggcttctggcgatgcggtct

SEQ ID NO: 94161 - DNA, 25 bp, Mus musculus
cgaatggttcctccgtgtggtctaa

SEQ ID NO: 94162 - DNA, 25 bp, Mus musculus
cgaatgtcttcaaagtgactcacct

SEQ ID NO: 94163 - DNA, 25 bp, Mus musculus
cgaattactgctgcggttaagaggg

SEQ ID NO: 94164 - DNA, 25 bp, Mus musculus
cgaattcgctttgctacacatggag

SEQ ID NO: 94165 - DNA, 25 bp, Mus musculus
cgaattcggcctgagaattaaaaga

SEQ ID NO: 94166 - DNA, 25 bp, Mus musculus
cgaattcgtggaacgcagcgtggct

SEQ ID NO: 94167 - DNA, 25 bp, Mus musculus
cgaattgacactcccagcttggagg

SEQ ID NO: 94168 - DNA, 25 bp, Mus musculus
cgaattgcagagcttctcacagagc

SEQ ID NO: 94169 - DNA, 25 bp, Mus musculus
cgaattggaacagctgaccgagagc

SEQ ID NO: 94170 - DNA, 25 bp, Mus musculus
cgaattggagacgagacagcacgct

SEQ ID NO: 94171 - DNA, 25 bp, Mus musculus
cgaattggcgcgatgtctggcgaca

SEQ ID NO: 94172 - DNA, 25 bp, Mus musculus
cgacaaagccgttgttgagtgggat

SEQ ID NO: 94173 - DNA, 25 bp, Mus musculus
cgacaacgccgtagggaagacgcgc

SEQ ID NO: 94174 - DNA, 25 bp, Mus musculus
cgacaacttggaagggaaaggcatt

SEQ ID NO: 94175 - DNA, 25 bp, Mus musculus
cgacaaggactctcagtgcggagga

SEQ ID NO: 94176 - DNA, 25 bp, Mus musculus
cgacacaaggatgcccgtaggaagc

SEQ ID NO: 94177 - DNA, 25 bp, Mus musculus
cgacaccccgggaatacatattgga

SEQ ID NO: 94178 - DNA, 25 bp, Mus musculus
cgacaggaaacaagagagcctcttt

SEQ ID NO: 94179 - DNA, 25 bp, Mus musculus
cgacagtgtgcagctctcattggaa

SEQ ID NO: 94180 - DNA, 25 bp, Mus musculus
cgacattcttgaggactggacgaca

SEQ ID NO: 94181 - DNA, 25 bp, Mus musculus
cgacattgagaaagataacgcacga

SEQ ID NO: 94182 - DNA, 25 bp, Mus musculus
cgacatttgacggttgccgacccga

SEQ ID NO: 94183 - DNA, 25 bp, Mus musculus
cgaccagaagatagtcagcggcctt

SEQ ID NO: 94184 - DNA, 25 bp, Mus musculus
cgaccagaccgtgtggcaatgactg

SEQ ID NO: 94185 - DNA, 25 bp, Mus musculus
cgaccagtataagaagacgacacct

SEQ ID NO: 94186 - DNA, 25 bp, Mus musculus
cgaccattgcttttggatccctcaa

SEQ ID NO: 94187 - DNA, 25 bp, Mus musculus
cgaccccgggaacatgtcctttgtg

SEQ ID NO: 94188 - DNA, 25 bp, Mus musculus
cgacccgcttagagctcaagctcga

SEQ ID NO: 94189 - DNA, 25 bp, Mus musculus
cgaccgaggtggtgctaaacaagct

SEQ ID NO: 94190 - DNA, 25 bp, Mus musculus
cgacctgctcatctgtacggcagag

SEQ ID NO: 94191 - DNA, 25 bp, Mus musculus
cgacctgctgataaggagcatgaac

SEQ ID NO: 94192 - DNA, 25 bp, Mus musculus
cgacctggaaggctgtattaagacc

SEQ ID NO: 94193 - DNA, 25 bp, Mus musculus
cgacctggacgaaaacaagctgaag

SEQ ID NO: 94194 - DNA, 25 bp, Mus musculus
cgacgaatatcagcgcacatgggta

SEQ ID NO: 94195 - DNA, 25 bp, Mus musculus
cgacgacaagatggagaacggcagc

SEQ ID NO: 94196 - DNA, 25 bp, Mus musculus
cgacgacattgtcacccggatgaag

SEQ ID NO: 94197 - DNA, 25 bp, Mus musculus
cgacgacgcatcctggctccttatt

SEQ ID NO: 94198 - DNA, 25 bp, Mus musculus
cgacgacgtggtagtcatggctgaa

SEQ ID NO: 94199 - DNA, 25 bp, Mus musculus
cgacgaggaccgagaaaaggagatt

SEQ ID NO: 94200 - DNA, 25 bp, Mus musculus
cgacgcccacaagattcctgaagaa

SEQ ID NO: 94201 - DNA, 25 bp, Mus musculus
cgacgccgtcagcaggaaaacattt

SEQ ID NO: 94202 - DNA, 25 bp, Mus musculus
cgacggcatggcttccgttttggaa

SEQ ID NO: 94203 - DNA, 25 bp, Mus musculus
cgacggccatgtccgatttgacctg

SEQ ID NO: 94204 - DNA, 25 bp, Mus musculus
cgacggtttctccacccatgtgtgc

SEQ ID NO: 94205 - DNA, 25 bp, Mus musculus
cgactaaaagtgaaggacctgcggc

SEQ ID NO: 94206 - DNA, 25 bp, Mus musculus
cgactaaacttgacagcctcctggg

SEQ ID NO: 94207 - DNA, 25 bp, Mus musculus
cgactaagatggcagtgatggaacc

SEQ ID NO: 94208 - DNA, 25 bp, Mus musculus
cgactaatacggtggatgcagaaac

SEQ ID NO: 94209 - DNA, 25 bp, Mus musculus
cgactaatggaagtgctctacgctt

SEQ ID NO: 94210 - DNA, 25 bp, Mus musculus
cgactactgcttctgtcatttcaga

SEQ ID NO: 94211 - DNA, 25 bp, Mus musculus
cgactagcaagtggcgggcttcagc

SEQ ID NO: 94212 - DNA, 25 bp, Mus musculus
cgactatctctttgcacacggacag

SEQ ID NO: 94213 - DNA, 25 bp, Mus musculus
cgactattaccaaaccatgtctggg

SEQ ID NO: 94214 - DNA, 25 bp, Mus musculus
cgactcaacacacgcggtggcttgc

SEQ ID NO: 94215 - DNA, 25 bp, Mus musculus
cgactcaggtattgagttgctgctg

SEQ ID NO: 94216 - DNA, 25 bp, Mus musculus
cgactccagtggtaagtctttaata

SEQ ID NO: 94217 - DNA, 25 bp, Mus musculus
cgactcgtctgagctcctgctggaa

SEQ ID NO: 94218 - DNA, 25 bp, Mus musculus
cgactctaaggtgggaagcggcctc

SEQ ID NO: 94219 - DNA, 25 bp, Mus musculus
cgactgaaggaatgtgttatattat

SEQ ID NO: 94220 - DNA, 25 bp, Mus musculus
cgactgacggtggatttaattgcca

SEQ ID NO: 94221 - DNA, 25 bp, Mus musculus
cgactgcctagagcaccttatcgag

SEQ ID NO: 94222 - DNA, 25 bp, Mus musculus
cgactggtataaccctcaaggagag

SEQ ID NO: 94223 - DNA, 25 bp, Mus musculus
cgactgtgagctttccggtaccgca

SEQ ID NO: 94224 - DNA, 25 bp, Mus musculus
cgacttcacctgtgacaatggccac

SEQ ID NO: 94225 - DNA, 25 bp, Mus musculus
cgacttggaagggtgcgtgcactat

SEQ ID NO: 94226 - DNA, 25 bp, Mus musculus
cgacttggcgggtgtccgccgtcaa

SEQ ID NO: 94227 - DNA, 25 bp, Mus musculus
cgactttggataagccctctgcaga

SEQ ID NO: 94228 - DNA, 25 bp, Mus musculus
cgactttgttttggaagcatgccca

SEQ ID NO: 94229 - DNA, 25 bp, Mus musculus
cgagaaaccaaagtacgtgctgtgt

SEQ ID NO: 94230 - DNA, 25 bp, Mus musculus
cgagaaagagttgcaggcgctgtcc

SEQ ID NO: 94231 - DNA, 25 bp, Mus musculus
cgagaaagccgcacttacctagcgg

SEQ ID NO: 94232 - DNA, 25 bp, Mus musculus
cgagaaatcttggagacactaatca

SEQ ID NO: 94233 - DNA, 25 bp, Mus musculus
cgagaacagaacagtggttgtaacc

SEQ ID NO: 94234 - DNA, 25 bp, Mus musculus
cgagaactttgtccaccagcaggag

SEQ ID NO: 94235 - DNA, 25 bp, Mus musculus
cgagaagaacttatccagggcgtgc

SEQ ID NO: 94236 - DNA, 25 bp, Mus musculus
cgagaagaccctagatcagtgtggc

SEQ ID NO: 94237 - DNA, 25 bp, Mus musculus
cgagaagccctacgtatgccatgta

SEQ ID NO: 94238 - DNA, 25 bp, Mus musculus
cgagaagccgcaatgaccgagatta

SEQ ID NO: 94239 - DNA, 25 bp, Mus musculus
cgagaagcctcgtggagcacggact

SEQ ID NO: 94240 - DNA, 25 bp, Mus musculus
cgagaagcgaagctctgggataccc

SEQ ID NO: 94241 - DNA, 25 bp, Mus musculus
cgagaagctgctggagacggtcatc

SEQ ID NO: 94242 - DNA, 25 bp, Mus musculus
cgagaaggcgtggaattattaccca

SEQ ID NO: 94243 - DNA, 25 bp, Mus musculus
cgagaagggtcatatgagcgccaca

SEQ ID NO: 94244 - DNA, 25 bp, Mus musculus
cgagaagtcgtggtgatcccgagac

SEQ ID NO: 94245 - DNA, 25 bp, Mus musculus
cgagaatgacttatcccaggtgcta

SEQ ID NO: 94246 - DNA, 25 bp, Mus musculus
cgagaatgagaaactgtgcaaagca

SEQ ID NO: 94247 - DNA, 25 bp, Mus musculus
cgagaatgccaatgtccagctgtca

SEQ ID NO: 94248 - DNA, 25 bp, Mus musculus
cgagaattcgctcagcagcagtgac

SEQ ID NO: 94249 - DNA, 25 bp, Mus musculus
cgagaattctaatgccttccaggac

SEQ ID NO: 94250 - DNA, 25 bp, Mus musculus
cgagacatttttctggatgacggag

SEQ ID NO: 94251 - DNA, 25 bp, Mus musculus
cgagaccctgagtgacatagacgag

SEQ ID NO: 94252 - DNA, 25 bp, Mus musculus
cgagaccgtgtgcagaagaaaactt

SEQ ID NO: 94253 - DNA, 25 bp, Mus musculus
cgagacctttctgagctggaagaga

SEQ ID NO: 94254 - DNA, 25 bp, Mus musculus
cgagacggatctgcgcatcttgggc

SEQ ID NO: 94255 - DNA, 25 bp, Mus musculus
cgagactggagcgtatctgattgac

SEQ ID NO: 94256 - DNA, 25 bp, Mus musculus
cgagacttagaacgtggatgccact

SEQ ID NO: 94257 - DNA, 25 bp, Mus musculus
cgagagagacctgagccgtgaagta

SEQ ID NO: 94258 - DNA, 25 bp, Mus musculus
cgagagatctgggaaaatgactggc

SEQ ID NO: 94259 - DNA, 25 bp, Mus musculus
cgagagatgcgcttagaaagagagc

SEQ ID NO: 94260 - DNA, 25 bp, Mus musculus
cgagagcatccggttttttgtcaat

SEQ ID NO: 94261 - DNA, 25 bp, Mus musculus
cgagagcccggagaacatgattatc

SEQ ID NO: 94262 - DNA, 25 bp, Mus musculus
cgagagcgcaactacgacaaagtgg

SEQ ID NO: 94263 - DNA, 25 bp, Mus musculus
cgagagcgcatgtgtagttcaacca

SEQ ID NO: 94264 - DNA, 25 bp, Mus musculus
cgagagcttgaactgtgccatggca

SEQ ID NO: 94265 - DNA, 25 bp, Mus musculus
cgagaggcagatgacgacgctgaac

SEQ ID NO: 94266 - DNA, 25 bp, Mus musculus
cgagaggccctacccgtgtaatgaa

SEQ ID NO: 94267 - DNA, 25 bp, Mus musculus
cgagaggcctttcgtctgcaactgg

SEQ ID NO: 94268 - DNA, 25 bp, Mus musculus
cgagagtacaacaaagccgtggagt

SEQ ID NO: 94269 - DNA, 25 bp, Mus musculus
cgagagtgagcctggccaacctgaa

SEQ ID NO: 94270 - DNA, 25 bp, Mus musculus
cgagagtggcacaagacgaccaaaa

SEQ ID NO: 94271 - DNA, 25 bp, Mus musculus
cgagagtggctgattgtaaaccgga

SEQ ID NO: 94272 - DNA, 25 bp, Mus musculus
cgagagtggtcctgatgaaggccct

SEQ ID NO: 94273 - DNA, 25 bp, Mus musculus
cgagagtgtgcctgacttccagagg

SEQ ID NO: 94274 - DNA, 25 bp, Mus musculus
cgagagttataattacccatgtgaa

SEQ ID NO: 94275 - DNA, 25 bp, Mus musculus
cgagagtttctcaagggctgcaagc

SEQ ID NO: 94276 - DNA, 25 bp, Mus musculus
cgagataaagtcgttgccggcggcc

SEQ ID NO: 94277 - DNA, 25 bp, Mus musculus
cgagatcaaagcactggcgggctgt

SEQ ID NO: 94278 - DNA, 25 bp, Mus musculus
cgagatcaagatgtggaccgtgcca

SEQ ID NO: 94279 - DNA, 25 bp, Mus musculus
cgagatgactttgaagttcccttca

SEQ ID NO: 94280 - DNA, 25 bp, Mus musculus
cgagatgctgcggttgttccaggcc

SEQ ID NO: 94281 - DNA, 25 bp, Mus musculus
cgagattattcagaagagccacaga

SEQ ID NO: 94282 - DNA, 25 bp, Mus musculus
cgagattccaaacgctgcagagagc

SEQ ID NO: 94283 - DNA, 25 bp, Mus musculus
cgagattgcagctgtagtcgctccg

SEQ ID NO: 94284 - DNA, 25 bp, Mus musculus
cgagattggcttgagtgttccggaa

SEQ ID NO: 94285 - DNA, 25 bp, Mus musculus
cgagcaagcggaggaagaaacgtcc

SEQ ID NO: 94286 - DNA, 25 bp, Mus musculus
cgagcaagttggctgtggacacctt

SEQ ID NO: 94287 - DNA, 25 bp, Mus musculus
cgagcagcggagttgcagcgctttt

SEQ ID NO: 94288 - DNA, 25 bp, Mus musculus
cgagcagcgtctgtgcggcagaact

SEQ ID NO: 94289 - DNA, 25 bp, Mus musculus
cgagcagtcatgagaaatactacat

SEQ ID NO: 94290 - DNA, 25 bp, Mus musculus
cgagcatggtcctggtgttgcacca

SEQ ID NO: 94291 - DNA, 25 bp, Mus musculus
cgagcatgtagacggttaaatgatt

SEQ ID NO: 94292 - DNA, 25 bp, Mus musculus
cgagcattcagggtgggcaagtcca

SEQ ID NO: 94293 - DNA, 25 bp, Mus musculus
cgagcattgtgagactaacgtggac

SEQ ID NO: 94294 - DNA, 25 bp, Mus musculus
cgagccagtgtccatgattgtaccc

SEQ ID NO: 94295 - DNA, 25 bp, Mus musculus
cgagccctagagtccctaaggataa

SEQ ID NO: 94296 - DNA, 25 bp, Mus musculus
cgagcccttcattgtgccagagaga

SEQ ID NO: 94297 - DNA, 25 bp, Mus musculus
cgagccgtgtctgacaccaagaaag

SEQ ID NO: 94298 - DNA, 25 bp, Mus musculus
cgagcctgccaaacctaagaagggt

SEQ ID NO: 94299 - DNA, 25 bp, Mus musculus
cgagcctgccgctggtaaagagaca

SEQ ID NO: 94300 - DNA, 25 bp, Mus musculus
cgagccttgcgagcgcgcctaacgg

SEQ ID NO: 94301 - DNA, 25 bp, Mus musculus
cgagccttgctgtgtgccggaaaag

SEQ ID NO: 94302 - DNA, 25 bp, Mus musculus
cgagcgcaccgaaaggctttgcact

SEQ ID NO: 94303 - DNA, 25 bp, Mus musculus
cgagcgcgcctaacggagaacgggg

SEQ ID NO: 94304 - DNA, 25 bp, Mus musculus
cgagcgcgttgaggacgtacccatt

SEQ ID NO: 94305 - DNA, 25 bp, Mus musculus
cgagcggctctctgggtcaggcctc

SEQ ID NO: 94306 - DNA, 25 bp, Mus musculus
cgagctaaagaagaaatacggaata

SEQ ID NO: 94307 - DNA, 25 bp, Mus musculus
cgagctactcgccaagaagatttct

SEQ ID NO: 94308 - DNA, 25 bp, Mus musculus
cgagctccctcgtccaattcagtat

SEQ ID NO: 94309 - DNA, 25 bp, Mus musculus
cgagctcgccagaagatgttattgg

SEQ ID NO: 94310 - DNA, 25 bp, Mus musculus
cgagctctgtcgtccctggagaaca

SEQ ID NO: 94311 - DNA, 25 bp, Mus musculus
cgagctgcgagcgactagagatcct

SEQ ID NO: 94312 - DNA, 25 bp, Mus musculus
cgagctgctctatcccatgatggca

SEQ ID NO: 94313 - DNA, 25 bp, Mus musculus
cgagctggacaggacccatgttcta

SEQ ID NO: 94314 - DNA, 25 bp, Mus musculus
cgagctgggcaattccgggcatttt

SEQ ID NO: 94315 - DNA, 25 bp, Mus musculus
cgagctggtagctgtactcgctggt

SEQ ID NO: 94316 - DNA, 25 bp, Mus musculus
cgagctggtggcctctaactaggac

SEQ ID NO: 94317 - DNA, 25 bp, Mus musculus
cgagctgttcggtattcccatgaga

SEQ ID NO: 94318 - DNA, 25 bp, Mus musculus
cgagcttataggttcgtgcaaggca

SEQ ID NO: 94319 - DNA, 25 bp, Mus musculus
cgaggaacacagagcctttggcgta

SEQ ID NO: 94320 - DNA, 25 bp, Mus musculus
cgaggaacgtgtcttcagagcacca

SEQ ID NO: 94321 - DNA, 25 bp, Mus musculus
cgaggaagcagtgcaagccaagtgc

SEQ ID NO: 94322 - DNA, 25 bp, Mus musculus
cgaggaagccacaagggtttgtcac

SEQ ID NO: 94323 - DNA, 25 bp, Mus musculus
cgaggaagcgttgcgccagtcgtcc

SEQ ID NO: 94324 - DNA, 25 bp, Mus musculus
cgaggaataacaacagcctggtatc

SEQ ID NO: 94325 - DNA, 25 bp, Mus musculus
cgaggacctgaaccgcgtaaagaag

SEQ ID NO: 94326 - DNA, 25 bp, Mus musculus
cgaggacttccttctcctggacgaa

SEQ ID NO: 94327 - DNA, 25 bp, Mus musculus
cgaggactttcaatatgacgaggac

SEQ ID NO: 94328 - DNA, 25 bp, Mus musculus
cgaggactttgcacattctgggata

SEQ ID NO: 94329 - DNA, 25 bp, Mus musculus
cgaggagaagctggcccttctcaga

SEQ ID NO: 94330 - DNA, 25 bp, Mus musculus
cgaggagagcacagtgcgcttcgcc

SEQ ID NO: 94331 - DNA, 25 bp, Mus musculus
cgaggagctcgaggcatatttcaaa

SEQ ID NO: 94332 - DNA, 25 bp, Mus musculus
cgaggaggccaaagtcttcgagaat

SEQ ID NO: 94333 - DNA, 25 bp, Mus musculus
cgaggaggcctcaaatcttcagtgg

SEQ ID NO: 94334 - DNA, 25 bp, Mus musculus
cgaggatcgaccagaacacagttgt

SEQ ID NO: 94335 - DNA, 25 bp, Mus musculus
cgaggatgacatggttctggacccc

SEQ ID NO: 94336 - DNA, 25 bp, Mus musculus
cgaggatggacctgcgacgtctctt

SEQ ID NO: 94337 - DNA, 25 bp, Mus musculus
cgaggattgtccttgtctcgggccg

SEQ ID NO: 94338 - DNA, 25 bp, Mus musculus
cgaggcacagacacttgatgaagac

SEQ ID NO: 94339 - DNA, 25 bp, Mus musculus
cgaggcagcttgagttaaacgaacg

SEQ ID NO: 94340 - DNA, 25 bp, Mus musculus
cgaggccacaagcaatgatccctgg

SEQ ID NO: 94341 - DNA, 25 bp, Mus musculus
cgaggcccagcggttcatcaatgct

SEQ ID NO: 94342 - DNA, 25 bp, Mus musculus
cgaggcccggcaggcgccgaggagg

SEQ ID NO: 94343 - DNA, 25 bp, Mus musculus
cgaggcgctcgtgctggcctgtaaa

SEQ ID NO: 94344 - DNA, 25 bp, Mus musculus
cgaggctatcgggattcagatgtaa

SEQ ID NO: 94345 - DNA, 25 bp, Mus musculus
cgaggctccatgtagcttagaagca

SEQ ID NO: 94346 - DNA, 25 bp, Mus musculus
cgaggctgcaactccgtgggctccg

SEQ ID NO: 94347 - DNA, 25 bp, Mus musculus
cgagggaatgtgttctttatcagcc

SEQ ID NO: 94348 - DNA, 25 bp, Mus musculus
cgagggactcctagacgtgtttcaa

SEQ ID NO: 94349 - DNA, 25 bp, Mus musculus
cgagggcattttcaagactctgagc

SEQ ID NO: 94350 - DNA, 25 bp, Mus musculus
cgagggcctcttttcactgtccgaa

SEQ ID NO: 94351 - DNA, 25 bp, Mus musculus
cgagggctacaacccatactacatc

SEQ ID NO: 94352 - DNA, 25 bp, Mus musculus
cgagggctattcttctctggagcag

SEQ ID NO: 94353 - DNA, 25 bp, Mus musculus
cgaggtacaggtcagggttttcaca

SEQ ID NO: 94354 - DNA, 25 bp, Mus musculus
cgaggtccagcctaccttggatctt

SEQ ID NO: 94355 - DNA, 25 bp, Mus musculus
cgaggtcctcacgtgcttggaaaga

SEQ ID NO: 94356 - DNA, 25 bp, Mus musculus
cgaggtcgacgcagctcaagccggc

SEQ ID NO: 94357 - DNA, 25 bp, Mus musculus
cgaggtcgcgcaggcgcagacggcg

SEQ ID NO: 94358 - DNA, 25 bp, Mus musculus
cgaggtgcccttaatgccatcagag

SEQ ID NO: 94359 - DNA, 25 bp, Mus musculus
cgaggtggagaagtcagatgaaaca

SEQ ID NO: 94360 - DNA, 25 bp, Mus musculus
cgaggtgtgactgctgtaaatccca

SEQ ID NO: 94361 - DNA, 25 bp, Mus musculus
cgagtaaagccacagtccttcgagg

SEQ ID NO: 94362 - DNA, 25 bp, Mus musculus
cgagtaccaccgctatccagagctg

SEQ ID NO: 94363 - DNA, 25 bp, Mus musculus
cgagtacgcttatgtcccagctgac

SEQ ID NO: 94364 - DNA, 25 bp, Mus musculus
cgagtcacgatgttcccgagggaga

SEQ ID NO: 94365 - DNA, 25 bp, Mus musculus
cgagtcctggccagtattgagggca

SEQ ID NO: 94366 - DNA, 25 bp, Mus musculus
cgagtgaggctctacagacacggtt

SEQ ID NO: 94367 - DNA, 25 bp, Mus musculus
cgagtgatgctggaatacctggacc

SEQ ID NO: 94368 - DNA, 25 bp, Mus musculus
cgagtgcagcccagcaagaatgtca

SEQ ID NO: 94369 - DNA, 25 bp, Mus musculus
cgagtgcattcgaaagaaaagttca

SEQ ID NO: 94370 - DNA, 25 bp, Mus musculus
cgagtgctacagaactgcccgtggc

SEQ ID NO: 94371 - DNA, 25 bp, Mus musculus
cgagtggaccatggaggcacccatt

SEQ ID NO: 94372 - DNA, 25 bp, Mus musculus
cgagtggagtccgttgctaagcaac

SEQ ID NO: 94373 - DNA, 25 bp, Mus musculus
cgagtggatcgcctgcctggataaa

SEQ ID NO: 94374 - DNA, 25 bp, Mus musculus
cgagtgttaagccacttgcagcaga

SEQ ID NO: 94375 - DNA, 25 bp, Mus musculus
cgagttacctgtctccatggagggc

SEQ ID NO: 94376 - DNA, 25 bp, Mus musculus
cgagttagaagctgcccctcaccga

SEQ ID NO: 94377 - DNA, 25 bp, Mus musculus
cgagttcagttctgcccgtttgaga

SEQ ID NO: 94378 - DNA, 25 bp, Mus musculus
cgagttccgtctgctgtgtgaggac

SEQ ID NO: 94379 - DNA, 25 bp, Mus musculus
cgagttctgactgatatggactggc

SEQ ID NO: 94380 - DNA, 25 bp, Mus musculus
cgagttggtatcttcacgggcgccc

SEQ ID NO: 94381 - DNA, 25 bp, Mus musculus
cgagtttgaccggaccatcgcagaa

SEQ ID NO: 94382 - DNA, 25 bp, Mus musculus
cgagtttgagaagaaaaggcccgtg

SEQ ID NO: 94383 - DNA, 25 bp, Mus musculus
cgagtttgcggatatgacaccccgt

SEQ ID NO: 94384 - DNA, 25 bp, Mus musculus
cgagtttgtacttctgcgcaggcgc

SEQ ID NO: 94385 - DNA, 25 bp, Mus musculus
cgagttttacagaaaccgtcagtgt

SEQ ID NO: 94386 - DNA, 25 bp, Mus musculus
cgataaaaatgaatgggaccagcca

SEQ ID NO: 94387 - DNA, 25 bp, Mus musculus
cgataacttgaatctgctgagggca

SEQ ID NO: 94388 - DNA, 25 bp, Mus musculus
cgataaggagatctacgagcagctc

SEQ ID NO: 94389 - DNA, 25 bp, Mus musculus
cgataaggccatctagtggagaagc

SEQ ID NO: 94390 - DNA, 25 bp, Mus musculus
cgatacccgtggcttctggcagtga

SEQ ID NO: 94391 - DNA, 25 bp, Mus musculus
cgatacttcatcttcagacaagggc

SEQ ID NO: 94392 - DNA, 25 bp, Mus musculus
cgatagctgtgaagaagtggaaccc

SEQ ID NO: 94393 - DNA, 25 bp, Mus musculus
cgatagtagccgatcacctgggact

SEQ ID NO: 94394 - DNA, 25 bp, Mus musculus
cgatatcggcgaagtgccggcagcc

SEQ ID NO: 94395 - DNA, 25 bp, Mus musculus
cgatatttggcgacgagggagtccc

SEQ ID NO: 94396 - DNA, 25 bp, Mus musculus
cgatcacagtcctggagaagggcca

SEQ ID NO: 94397 - DNA, 25 bp, Mus musculus
cgatcaggattcattcgactaggat

SEQ ID NO: 94398 - DNA, 25 bp, Mus musculus
cgatcatagcaaagagctcctggag

SEQ ID NO: 94399 - DNA, 25 bp, Mus musculus
cgatccagtgtttgcagcgggaaca

SEQ ID NO: 94400 - DNA, 25 bp, Mus musculus
cgatccgggccaaacgtcttgtcct

SEQ ID NO: 94401 - DNA, 25 bp, Mus musculus
cgatcctcgaacactctttgtcact

SEQ ID NO: 94402 - DNA, 25 bp, Mus musculus
cgatcctgggctacaaaacgctggc

SEQ ID NO: 94403 - DNA, 25 bp, Mus musculus
cgatccttacgctacctctgtgggt

SEQ ID NO: 94404 - DNA, 25 bp, Mus musculus
cgatcggcgtgcacctgggctgcac

SEQ ID NO: 94405 - DNA, 25 bp, Mus musculus
cgatcggctctttccagtttggcta

SEQ ID NO: 94406 - DNA, 25 bp, Mus musculus
cgatcggctttgaggagcaggaact

SEQ ID NO: 94407 - DNA, 25 bp, Mus musculus
cgatcgggagcttcgacttgggcct

SEQ ID NO: 94408 - DNA, 25 bp, Mus musculus
cgatcgggatcttctcattcagcag

SEQ ID NO: 94409 - DNA, 25 bp, Mus musculus
cgatcgtcccgaatactgtgttgtg

SEQ ID NO: 94410 - DNA, 25 bp, Mus musculus
cgatctaaacgaggtccacggtggt

SEQ ID NO: 94411 - DNA, 25 bp, Mus musculus
cgatctccgctcttcaacagtgtag

SEQ ID NO: 94412 - DNA, 25 bp, Mus musculus
cgatctgctggacatatgtctgagg

SEQ ID NO: 94413 - DNA, 25 bp, Mus musculus
cgatcttgaacaaggtggcgccgca

SEQ ID NO: 94414 - DNA, 25 bp, Mus musculus
cgatcttgcattgcgaccagtataa

SEQ ID NO: 94415 - DNA, 25 bp, Mus musculus
cgatgacaggaaagttcgaaggaga

SEQ ID NO: 94416 - DNA, 25 bp, Mus musculus
cgatgacagtcgatggcgtccggaa

SEQ ID NO: 94417 - DNA, 25 bp, Mus musculus
cgatgacataaagagagaggaccct

SEQ ID NO: 94418 - DNA, 25 bp, Mus musculus
cgatgacatcattgggaagatctca

SEQ ID NO: 94419 - DNA, 25 bp, Mus musculus
cgatgacatccgtgactacagggcg

SEQ ID NO: 94420 - DNA, 25 bp, Mus musculus
cgatgaccagatggcgcacagttca

SEQ ID NO: 94421 - DNA, 25 bp, Mus musculus
cgatgacgtgatccggtacgccaag

SEQ ID NO: 94422 - DNA, 25 bp, Mus musculus
cgatgactacttccttctgcgatgg

SEQ ID NO: 94423 - DNA, 25 bp, Mus musculus
cgatgagagaacacccgatgtgaca

SEQ ID NO: 94424 - DNA, 25 bp, Mus musculus
cgatgaggcaatcgtctgctgccaa

SEQ ID NO: 94425 - DNA, 25 bp, Mus musculus
cgatgagggattaccacccatccta

SEQ ID NO: 94426 - DNA, 25 bp, Mus musculus
cgatgatgccttcgagctgaccctg

SEQ ID NO: 94427 - DNA, 25 bp, Mus musculus
cgatgatggaggagacagactcaca

SEQ ID NO: 94428 - DNA, 25 bp, Mus musculus
cgatgcagatatttaaacttcttac

SEQ ID NO: 94429 - DNA, 25 bp, Mus musculus
cgatgccacaagaggaccggcttct

SEQ ID NO: 94430 - DNA, 25 bp, Mus musculus
cgatgccagagaggctgttcagaag

SEQ ID NO: 94431 - DNA, 25 bp, Mus musculus
cgatgcccctatcagatgtgttgaa

SEQ ID NO: 94432 - DNA, 25 bp, Mus musculus
cgatgcctcgtctagaagcattggg

SEQ ID NO: 94433 - DNA, 25 bp, Mus musculus
cgatgcggtattctaggactttaaa

SEQ ID NO: 94434 - DNA, 25 bp, Mus musculus
cgatgctagcgctgcgttgcggccc

SEQ ID NO: 94435 - DNA, 25 bp, Mus musculus
cgatgctgagtacgccacgtggaac

SEQ ID NO: 94436 - DNA, 25 bp, Mus musculus
cgatgctgcgattcctcagggagca

SEQ ID NO: 94437 - DNA, 25 bp, Mus musculus
cgatgctggccagccacatgagtgc

SEQ ID NO: 94438 - DNA, 25 bp, Mus musculus
cgatgcttgctaatggtgtgacctt

SEQ ID NO: 94439 - DNA, 25 bp, Mus musculus
cgatggaacaagcaacagagtacct

SEQ ID NO: 94440 - DNA, 25 bp, Mus musculus
cgatggaccccatcacgggagttgg

SEQ ID NO: 94441 - DNA, 25 bp, Mus musculus
cgatggagaagcacatcaacacttt

SEQ ID NO: 94442 - DNA, 25 bp, Mus musculus
cgatggagacatgggctacagagcc

SEQ ID NO: 94443 - DNA, 25 bp, Mus musculus
cgatggagctgagcatgaagaagtt

SEQ ID NO: 94444 - DNA, 25 bp, Mus musculus
cgatggcatgcctgtgtacacggac

SEQ ID NO: 94445 - DNA, 25 bp, Mus musculus
cgatggcgtctctcgattctgaggt

SEQ ID NO: 94446 - DNA, 25 bp, Mus musculus
cgatggctcccatgatgtctctgtg

SEQ ID NO: 94447 - DNA, 25 bp, Mus musculus
cgatggctctgacgaatcgaaggcc

SEQ ID NO: 94448 - DNA, 25 bp, Mus musculus
cgatggcttccacgctgtctttgag

SEQ ID NO: 94449 - DNA, 25 bp, Mus musculus
cgatgggaactctggaggtctcgct

SEQ ID NO: 94450 - DNA, 25 bp, Mus musculus
cgatgtccggcctctcaaaccgtgt

SEQ ID NO: 94451 - DNA, 25 bp, Mus musculus
cgatgtcgaagctggtggtgccacc

SEQ ID NO: 94452 - DNA, 25 bp, Mus musculus
cgatgtgaccatctacaagacgtgg

SEQ ID NO: 94453 - DNA, 25 bp, Mus musculus
cgatgtgcctcaggcagagatctcg

SEQ ID NO: 94454 - DNA, 25 bp, Mus musculus
cgatgtggacaatgagctcttggac

SEQ ID NO: 94455 - DNA, 25 bp, Mus musculus
cgatgtgtaccccaatggcctacag

SEQ ID NO: 94456 - DNA, 25 bp, Mus musculus
cgatgtgtcttcctgcgagatcttc

SEQ ID NO: 94457 - DNA, 25 bp, Mus musculus
cgatgttttacatgatggagcccag

SEQ ID NO: 94458 - DNA, 25 bp, Mus musculus
cgattaaggcaaatgggaacctggc

SEQ ID NO: 94459 - DNA, 25 bp, Mus musculus
cgattacctgttcaagctgctgctg

SEQ ID NO: 94460 - DNA, 25 bp, Mus musculus
cgattactgagtacacagccacaga

SEQ ID NO: 94461 - DNA, 25 bp, Mus musculus
cgattagcaggattgaagggcagct

SEQ ID NO: 94462 - DNA, 25 bp, Mus musculus
cgattaggaggagaaacagtggaca

SEQ ID NO: 94463 - DNA, 25 bp, Mus musculus
cgattatgatgtgcgcctcaatgac

SEQ ID NO: 94464 - DNA, 25 bp, Mus musculus
cgattatggaaagctgggcgacacc

SEQ ID NO: 94465 - DNA, 25 bp, Mus musculus
cgattattgaggaggtgacacctga

SEQ ID NO: 94466 - DNA, 25 bp, Mus musculus
cgattcaatgagacaaccctgtgca

SEQ ID NO: 94467 - DNA, 25 bp, Mus musculus
cgattcgaccgaagaactttctgga

SEQ ID NO: 94468 - DNA, 25 bp, Mus musculus
cgattctacggtctcatttggcgcg

SEQ ID NO: 94469 - DNA, 25 bp, Mus musculus
cgattctcacagtgattccgaaggg

SEQ ID NO: 94470 - DNA, 25 bp, Mus musculus
cgattgaagaaggtgtgcgagccct

SEQ ID NO: 94471 - DNA, 25 bp, Mus musculus
cgattgcagcatttacaccagtgga

SEQ ID NO: 94472 - DNA, 25 bp, Mus musculus
cgattgccagaaacacagggtgaca

SEQ ID NO: 94473 - DNA, 25 bp, Mus musculus
cgattggttcactccttcctcataa

SEQ ID NO: 94474 - DNA, 25 bp, Mus musculus
cgattgtaattcaccacaggctgca

SEQ ID NO: 94475 - DNA, 25 bp, Mus musculus
cgattgtgtacacgccaacagttgg

SEQ ID NO: 94476 - DNA, 25 bp, Mus musculus
cgatttattggaggcgcagcggaca

SEQ ID NO: 94477 - DNA, 25 bp, Mus musculus
cgatttctgtggctgagtggtcatt

SEQ ID NO: 94478 - DNA, 25 bp, Mus musculus
cgatttgaaagactgacccgggaca

SEQ ID NO: 94479 - DNA, 25 bp, Mus musculus
cgatttggcagtacctggctcgaga

SEQ ID NO: 94480 - DNA, 25 bp, Mus musculus
cgattttgacatgaccctgagcaga

SEQ ID NO: 94481 - DNA, 25 bp, Mus musculus
cgcaaacatcttggaccccgggaga

SEQ ID NO: 94482 - DNA, 25 bp, Mus musculus
cgcaaacgcagttcaggaccagaag

SEQ ID NO: 94483 - DNA, 25 bp, Mus musculus
cgcaaactaagcatccctttgaagt

SEQ ID NO: 94484 - DNA, 25 bp, Mus musculus
cgcaaactacccttcccggatgaga

SEQ ID NO: 94485 - DNA, 25 bp, Mus musculus
cgcaaagcagaatgaaaaggcccca

SEQ ID NO: 94486 - DNA, 25 bp, Mus musculus
cgcaaagtctgtgcaagtggcaagc

SEQ ID NO: 94487 - DNA, 25 bp, Mus musculus
cgcaaattcctgttcacgtgtgaga

SEQ ID NO: 94488 - DNA, 25 bp, Mus musculus
cgcaaatttgatgaccagcaggaca

SEQ ID NO: 94489 - DNA, 25 bp, Mus musculus
cgcaacggaagaggccctgaaggaa

SEQ ID NO: 94490 - DNA, 25 bp, Mus musculus
cgcaagagatgcagaacagttgagc

SEQ ID NO: 94491 - DNA, 25 bp, Mus musculus
cgcaagctttctcggtgcccgacgg

SEQ ID NO: 94492 - DNA, 25 bp, Mus musculus
cgcaaggaagataaggaagagaaca

SEQ ID NO: 94493 - DNA, 25 bp, Mus musculus
cgcaaggatgagaagacagcccaga

SEQ ID NO: 94494 - DNA, 25 bp, Mus musculus
cgcaagtggctctttacaacagaag

SEQ ID NO: 94495 - DNA, 25 bp, Mus musculus
cgcaatgacggagcccaagtccgtg

SEQ ID NO: 94496 - DNA, 25 bp, Mus musculus
cgcaatggcggactgtaacccagac

SEQ ID NO: 94497 - DNA, 25 bp, Mus musculus
cgcaattcgtgcagatggtggcaga

SEQ ID NO: 94498 - DNA, 25 bp, Mus musculus
cgcacaagggctggcactggaaata

SEQ ID NO: 94499 - DNA, 25 bp, Mus musculus
cgcacactggcctgagggcgcttgt

SEQ ID NO: 94500 - DNA, 25 bp, Mus musculus
cgcacaggggtttcaggtggaacta

SEQ ID NO: 94501 - DNA, 25 bp, Mus musculus
cgcaccatcagaccaatggacatcg

SEQ ID NO: 94502 - DNA, 25 bp, Mus musculus
cgcaccatggggtctgcggaccgag

SEQ ID NO: 94503 - DNA, 25 bp, Mus musculus
cgcacccaaagaggcaagagtttta

SEQ ID NO: 94504 - DNA, 25 bp, Mus musculus
cgcacccgtgcacatcgatgtggga

SEQ ID NO: 94505 - DNA, 25 bp, Mus musculus
cgcacccgttaaaaatgcctttgag

SEQ ID NO: 94506 - DNA, 25 bp, Mus musculus
cgcacctgcgagtaggagcacttct

SEQ ID NO: 94507 - DNA, 25 bp, Mus musculus
cgcacgaacttggactactgttgaa

SEQ ID NO: 94508 - DNA, 25 bp, Mus musculus
cgcacgaccgggaattgcgagcaca

SEQ ID NO: 94509 - DNA, 25 bp, Mus musculus
cgcacgccggcgcagtctacggaac

SEQ ID NO: 94510 - DNA, 25 bp, Mus musculus
cgcacggacggtggtgggcgctggg

SEQ ID NO: 94511 - DNA, 25 bp, Mus musculus
cgcacgtggtggagaacacagcctt

SEQ ID NO: 94512 - DNA, 25 bp, Mus musculus
cgcactctgcgtgttgaaggagaca

SEQ ID NO: 94513 - DNA, 25 bp, Mus musculus
cgcactgtctgtgacggctgctgag

SEQ ID NO: 94514 - DNA, 25 bp, Mus musculus
cgcacttacctagcggcgacatgga

SEQ ID NO: 94515 - DNA, 25 bp, Mus musculus
cgcagacgaagacgccaaggaacgt

SEQ ID NO: 94516 - DNA, 25 bp, Mus musculus
cgcagagagttgatgacagtccaag

SEQ ID NO: 94517 - DNA, 25 bp, Mus musculus
cgcagagcatgaggaactggtgtct

SEQ ID NO: 94518 - DNA, 25 bp, Mus musculus
cgcagagcgcgattcagaggtttca

SEQ ID NO: 94519 - DNA, 25 bp, Mus musculus
cgcagaggagctctacgccgagatc

SEQ ID NO: 94520 - DNA, 25 bp, Mus musculus
cgcagaggctatctgttggatttga

SEQ ID NO: 94521 - DNA, 25 bp, Mus musculus
cgcagagggtctgacgggactatta

SEQ ID NO: 94522 - DNA, 25 bp, Mus musculus
cgcagagtccggatcacagcggtta

SEQ ID NO: 94523 - DNA, 25 bp, Mus musculus
cgcagatggtccgtgatggaaaatg

SEQ ID NO: 94524 - DNA, 25 bp, Mus musculus
cgcagatggtgcagttaactcagca

SEQ ID NO: 94525 - DNA, 25 bp, Mus musculus
cgcagcacgggcaagtttcactaca

SEQ ID NO: 94526 - DNA, 25 bp, Mus musculus
cgcagcactttagcagcggaagagg

SEQ ID NO: 94527 - DNA, 25 bp, Mus musculus
cgcagcagttcgtgtggtggtggcg

SEQ ID NO: 94528 - DNA, 25 bp, Mus musculus
cgcagcatcccttgcatagcgtgca

SEQ ID NO: 94529 - DNA, 25 bp, Mus musculus
cgcagcccgacagtgcagtgaattt

SEQ ID NO: 94530 - DNA, 25 bp, Mus musculus
cgcagccgcagagaaacaaagagtt

SEQ ID NO: 94531 - DNA, 25 bp, Mus musculus
cgcagccggcttactctttcgagta

SEQ ID NO: 94532 - DNA, 25 bp, Mus musculus
cgcagcctggatgaaatcgatctct

SEQ ID NO: 94533 - DNA, 25 bp, Mus musculus
cgcagcgaatgctggccactggaga

SEQ ID NO: 94534 - DNA, 25 bp, Mus musculus
cgcagcgtggattttaaccgaggca

SEQ ID NO: 94535 - DNA, 25 bp, Mus musculus
cgcagctggaaaggctcatcgacct

SEQ ID NO: 94536 - DNA, 25 bp, Mus musculus
cgcaggacccaaaggtgcccctgga

SEQ ID NO: 94537 - DNA, 25 bp, Mus musculus
cgcaggatcggagcagcgtacaagc

SEQ ID NO: 94538 - DNA, 25 bp, Mus musculus
cgcaggctgccatcgtgaaagagaa

SEQ ID NO: 94539 - DNA, 25 bp, Mus musculus
cgcagggccctggagaatattgagc

SEQ ID NO: 94540 - DNA, 25 bp, Mus musculus
cgcagggctggaaagacatatggac

SEQ ID NO: 94541 - DNA, 25 bp, Mus musculus
cgcagggttctagggtcaatgccca

SEQ ID NO: 94542 - DNA, 25 bp, Mus musculus
cgcagttagagttccgggtgtttcg

SEQ ID NO: 94543 - DNA, 25 bp, Mus musculus
cgcagttctggcttgtgagcaccaa

SEQ ID NO: 94544 - DNA, 25 bp, Mus musculus
cgcatagctaagagaaggtcacccc

SEQ ID NO: 94545 - DNA, 25 bp, Mus musculus
cgcatcatgactgatcagctagctg

SEQ ID NO: 94546 - DNA, 25 bp, Mus musculus
cgcatgcagagtactggatcagcaa

SEQ ID NO: 94547 - DNA, 25 bp, Mus musculus
cgcatggtaaatgtcttcctgggca

SEQ ID NO: 94548 - DNA, 25 bp, Mus musculus
cgcatggtcagatgcagcacacggg

SEQ ID NO: 94549 - DNA, 25 bp, Mus musculus
cgcatgtccatggagttcttgggaa

SEQ ID NO: 94550 - DNA, 25 bp, Mus musculus
cgcatgttgtcaggcggctttggat

SEQ ID NO: 94551 - DNA, 25 bp, Mus musculus
cgcattaaaggccatcggagacaat

SEQ ID NO: 94552 - DNA, 25 bp, Mus musculus
cgcattgctcttggcgcgcatttct

SEQ ID NO: 94553 - DNA, 25 bp, Mus musculus
cgccaaactgctgttccgggagggt

SEQ ID NO: 94554 - DNA, 25 bp, Mus musculus
cgccaaaggctgtgactactgccag

SEQ ID NO: 94555 - DNA, 25 bp, Mus musculus
cgccaaatgcagatctttagcaata

SEQ ID NO: 94556 - DNA, 25 bp, Mus musculus
cgccaaggcaatagcagtgactctg

SEQ ID NO: 94557 - DNA, 25 bp, Mus musculus
cgccacaaggtgaagtcgggagcct

SEQ ID NO: 94558 - DNA, 25 bp, Mus musculus
cgccacgctacggaagcagcgtaag

SEQ ID NO: 94559 - DNA, 25 bp, Mus musculus
cgccactgcgcttcgttgcagggca

SEQ ID NO: 94560 - DNA, 25 bp, Mus musculus
cgccagaaaaacaagcgcgggttca

SEQ ID NO: 94561 - DNA, 25 bp, Mus musculus
cgccagccatttcaaccagagatct

SEQ ID NO: 94562 - DNA, 25 bp, Mus musculus
cgccagccggagttacacaggcctt

SEQ ID NO: 94563 - DNA, 25 bp, Mus musculus
cgccagcctctcagaatggagatga

SEQ ID NO: 94564 - DNA, 25 bp, Mus musculus
cgccagctgctaccatgaaagacac

SEQ ID NO: 94565 - DNA, 25 bp, Mus musculus
cgccagggcaaaccggaattagttg

SEQ ID NO: 94566 - DNA, 25 bp, Mus musculus
cgccaggtaccgagaagagcacttt

SEQ ID NO: 94567 - DNA, 25 bp, Mus musculus
cgccagtacaccaacaagaagatag

SEQ ID NO: 94568 - DNA, 25 bp, Mus musculus
cgccagtcgctttagaagcgcggaa

SEQ ID NO: 94569 - DNA, 25 bp, Mus musculus
cgccagtgtgtctttgcaatcgcca

SEQ ID NO: 94570 - DNA, 25 bp, Mus musculus
cgccatcagaaattgaccccgagga

SEQ ID NO: 94571 - DNA, 25 bp, Mus musculus
cgccatccatcagtgactctgaggg

SEQ ID NO: 94572 - DNA, 25 bp, Mus musculus
cgccatgatcctgctggaggtgaac

SEQ ID NO: 94573 - DNA, 25 bp, Mus musculus
cgccatgcagagagtctggcccgga

SEQ ID NO: 94574 - DNA, 25 bp, Mus musculus
cgccatggtgcggatttcaaagccc

SEQ ID NO: 94575 - DNA, 25 bp, Mus musculus
cgccattggcgtgaccatctttgtg

SEQ ID NO: 94576 - DNA, 25 bp, Mus musculus
cgccattttgtagggttctctctga

SEQ ID NO: 94577 - DNA, 25 bp, Mus musculus
cgcccaatcgctgctggagacattt

SEQ ID NO: 94578 - DNA, 25 bp, Mus musculus
cgcccaatgtgtgtgacctcaactg

SEQ ID NO: 94579 - DNA, 25 bp, Mus musculus
cgcccagcccgagaggtggatgaat

SEQ ID NO: 94580 - DNA, 25 bp, Mus musculus
cgcccagtatggacctggaaaccaa

SEQ ID NO: 94581 - DNA, 25 bp, Mus musculus
cgcccagtggatgcagatggtctaa

SEQ ID NO: 94582 - DNA, 25 bp, Mus musculus
cgcccagtttgtagtgagccaggta

SEQ ID NO: 94583 - DNA, 25 bp, Mus musculus
cgcccatcgacgtgaagacggagga

SEQ ID NO: 94584 - DNA, 25 bp, Mus musculus
cgcccctcggagtgtggaatttgaa

SEQ ID NO: 94585 - DNA, 25 bp, Mus musculus
cgcccgcgcgatttgaatcctgcgt

SEQ ID NO: 94586 - DNA, 25 bp, Mus musculus
cgcccgggctgaagatgctgcgaaa

SEQ ID NO: 94587 - DNA, 25 bp, Mus musculus
cgccctaaggtggaactgcccggag

SEQ ID NO: 94588 - DNA, 25 bp, Mus musculus
cgccctacgatggagaagagacact

SEQ ID NO: 94589 - DNA, 25 bp, Mus musculus
cgccctagagtagggagacagggtg

SEQ ID NO: 94590 - DNA, 25 bp, Mus musculus
cgccctagtggacatgacaatgaag

SEQ ID NO: 94591 - DNA, 25 bp, Mus musculus
cgccctggtgggtgagcctcctgca

SEQ ID NO: 94592 - DNA, 25 bp, Mus musculus
cgccctgtctaacaacctcagtgta

SEQ ID NO: 94593 - DNA, 25 bp, Mus musculus
cgccctgttcaaagtggcgcagatg

SEQ ID NO: 94594 - DNA, 25 bp, Mus musculus
cgcccttggagatagtcctcaaaga

SEQ ID NO: 94595 - DNA, 25 bp, Mus musculus
cgccgaggtcgacgcagctcaagcc

SEQ ID NO: 94596 - DNA, 25 bp, Mus musculus
cgccgcaggatcacgatgttccgga

SEQ ID NO: 94597 - DNA, 25 bp, Mus musculus
cgccgcagtgcagtggtgggcacgc

SEQ ID NO: 94598 - DNA, 25 bp, Mus musculus
cgccgccgacttgtgaatgggactc

SEQ ID NO: 94599 - DNA, 25 bp, Mus musculus
cgccgccggagctgcggacggtttg

SEQ ID NO: 94600 - DNA, 25 bp, Mus musculus
cgccgccgggacaggtcaggatcca

SEQ ID NO: 94601 - DNA, 25 bp, Mus musculus
cgccgcggagggtcaatttcagtca

SEQ ID NO: 94602 - DNA, 25 bp, Mus musculus
cgccgctttctccttgtggttttca

SEQ ID NO: 94603 - DNA, 25 bp, Mus musculus
cgccggctatcgtgacaagaggaaa

SEQ ID NO: 94604 - DNA, 25 bp, Mus musculus
cgccggctggtggtcgttctattct

SEQ ID NO: 94605 - DNA, 25 bp, Mus musculus
cgccgggctctgtcagtggtctata

SEQ ID NO: 94606 - DNA, 25 bp, Mus musculus
cgccgggtgcgtttccttcatgaga

SEQ ID NO: 94607 - DNA, 25 bp, Mus musculus
cgccggttgatggttgaccgatcct

SEQ ID NO: 94608 - DNA, 25 bp, Mus musculus
cgccgtccacagtcgcttgcaaggg

SEQ ID NO: 94609 - DNA, 25 bp, Mus musculus
cgccgtcggatgactggaaaagcca

SEQ ID NO: 94610 - DNA, 25 bp, Mus musculus
cgccgtgagaccttttgttgaggaa

SEQ ID NO: 94611 - DNA, 25 bp, Mus musculus
cgccgtgctcatcctcttggtggtg

SEQ ID NO: 94612 - DNA, 25 bp, Mus musculus
cgccgtgcttgggttaccgagctga

SEQ ID NO: 94613 - DNA, 25 bp, Mus musculus
cgccgtggaccctgcggaattcttc

SEQ ID NO: 94614 - DNA, 25 bp, Mus musculus
cgccgtggagcgagctggaattcca

SEQ ID NO: 94615 - DNA, 25 bp, Mus musculus
cgccgttatcttttgcaaaatacag

SEQ ID NO: 94616 - DNA, 25 bp, Mus musculus
cgccgttgctgtgggacaccatgta

SEQ ID NO: 94617 - DNA, 25 bp, Mus musculus
cgcctacggagtgcagacagtgaga

SEQ ID NO: 94618 - DNA, 25 bp, Mus musculus
cgcctagaccgatcgcgagcgctga

SEQ ID NO: 94619 - DNA, 25 bp, Mus musculus
cgcctagctctaccggactacgagt

SEQ ID NO: 94620 - DNA, 25 bp, Mus musculus
cgcctatgaacctcgggcggcggct

SEQ ID NO: 94621 - DNA, 25 bp, Mus musculus
cgcctatgcaaaaaacggaacaatc

SEQ ID NO: 94622 - DNA, 25 bp, Mus musculus
cgcctatgggctgtacgcagggcca

SEQ ID NO: 94623 - DNA, 25 bp, Mus musculus
cgcctccaagagagcaatgaccatc

SEQ ID NO: 94624 - DNA, 25 bp, Mus musculus
cgcctccagtttgatgaattccaga

SEQ ID NO: 94625 - DNA, 25 bp, Mus musculus
cgcctcccgccctcgggcagcgtgg

SEQ ID NO: 94626 - DNA, 25 bp, Mus musculus
cgcctccgggagaagtttcatggga

SEQ ID NO: 94627 - DNA, 25 bp, Mus musculus
cgcctcgcgggctgatggctatgaa

SEQ ID NO: 94628 - DNA, 25 bp, Mus musculus
cgcctcttcgccctaggctggcctc

SEQ ID NO: 94629 - DNA, 25 bp, Mus musculus
cgcctgcccataagccatgtactgg

SEQ ID NO: 94630 - DNA, 25 bp, Mus musculus
cgcctgcgcatcttgtacgtggaca

SEQ ID NO: 94631 - DNA, 25 bp, Mus musculus
cgcctgcgcggagcctgtagtattt

SEQ ID NO: 94632 - DNA, 25 bp, Mus musculus
cgcctgctgtgcagacgcttgcaaa

SEQ ID NO: 94633 - DNA, 25 bp, Mus musculus
cgcctgctttgaacgtactgttgaa

SEQ ID NO: 94634 - DNA, 25 bp, Mus musculus
cgcctggaacgagaagacagcagtg

SEQ ID NO: 94635 - DNA, 25 bp, Mus musculus
cgcctggcgggcaatgaacaggtga

SEQ ID NO: 94636 - DNA, 25 bp, Mus musculus
cgccttagaaatggctaagattcac

SEQ ID NO: 94637 - DNA, 25 bp, Mus musculus
cgccttcaggaggaagaccagcagt

SEQ ID NO: 94638 - DNA, 25 bp, Mus musculus
cgccttccaggatctgaagcagctg

SEQ ID NO: 94639 - DNA, 25 bp, Mus musculus
cgccttgaccgggagctgcagctag

SEQ ID NO: 94640 - DNA, 25 bp, Mus musculus
cgccttgctttcatctggttgtcag

SEQ ID NO: 94641 - DNA, 25 bp, Mus musculus
cgccttggccggagctgaaatggtt

SEQ ID NO: 94642 - DNA, 25 bp, Mus musculus
cgcgaatgtttctgcttgatgtgtt

SEQ ID NO: 94643 - DNA, 25 bp, Mus musculus
cgcgacagcgatgctagcgctgcgt

SEQ ID NO: 94644 - DNA, 25 bp, Mus musculus
cgcgagcgagcgaaccatcgaagga

SEQ ID NO: 94645 - DNA, 25 bp, Mus musculus
cgcgagcgcacgtcttccagattga

SEQ ID NO: 94646 - DNA, 25 bp, Mus musculus
cgcgagcgctcattttccctagcaa

SEQ ID NO: 94647 - DNA, 25 bp, Mus musculus
cgcgatgagcatctgcagggcctta

SEQ ID NO: 94648 - DNA, 25 bp, Mus musculus
cgcgatggccctcaagatggtcaag

SEQ ID NO: 94649 - DNA, 25 bp, Mus musculus
cgcgcaggcgcagacggcgttggtt

SEQ ID NO: 94650 - DNA, 25 bp, Mus musculus
cgcgcagtgaatagccttcgagaca

SEQ ID NO: 94651 - DNA, 25 bp, Mus musculus
cgcgcatcggtctaggcgtgatctt

SEQ ID NO: 94652 - DNA, 25 bp, Mus musculus
cgcgccaaggaaagcagttagatgt

SEQ ID NO: 94653 - DNA, 25 bp, Mus musculus
cgcgcccggcgcttcaaaataatgc

SEQ ID NO: 94654 - DNA, 25 bp, Mus musculus
cgcgccgccatattgggaagcgcca

SEQ ID NO: 94655 - DNA, 25 bp, Mus musculus
cgcgcgagaacgaccagctggattt

SEQ ID NO: 94656 - DNA, 25 bp, Mus musculus
cgcgcgagcgtgtgttttaggtaat

SEQ ID NO: 94657 - DNA, 25 bp, Mus musculus
cgcgcgcgtgttgtagctctgtcaa

SEQ ID NO: 94658 - DNA, 25 bp, Mus musculus
cgcgcggcatacacggaagtgtctt

SEQ ID NO: 94659 - DNA, 25 bp, Mus musculus
cgcgcggcttcacgtactctgggaa

SEQ ID NO: 94660 - DNA, 25 bp, Mus musculus
cgcgcgtccccaaagcattgcaaga

SEQ ID NO: 94661 - DNA, 25 bp, Mus musculus
cgcgcgttcccgaagagcctgggaa

SEQ ID NO: 94662 - DNA, 25 bp, Mus musculus
cgcgctcgggagatgaaaaggatcc

SEQ ID NO: 94663 - DNA, 25 bp, Mus musculus
cgcgctctttgaatgcaccatggca

SEQ ID NO: 94664 - DNA, 25 bp, Mus musculus
cgcgctgagcaggaacaagttacaa

SEQ ID NO: 94665 - DNA, 25 bp, Mus musculus
cgcggaaacgctacggatctaagaa

SEQ ID NO: 94666 - DNA, 25 bp, Mus musculus
cgcggaagctttcggcatcagtgca

SEQ ID NO: 94667 - DNA, 25 bp, Mus musculus
cgcggacgtcgctgggacagtccct

SEQ ID NO: 94668 - DNA, 25 bp, Mus musculus
cgcggagacgcgtttggatcctcta

SEQ ID NO: 94669 - DNA, 25 bp, Mus musculus
cgcggaggacacctggacattctca

SEQ ID NO: 94670 - DNA, 25 bp, Mus musculus
cgcggatgtctcagggaagcttgaa

SEQ ID NO: 94671 - DNA, 25 bp, Mus musculus
cgcggcatcggcaggcagaataaaa

SEQ ID NO: 94672 - DNA, 25 bp, Mus musculus
cgcggccgccaagaagtataacatg

SEQ ID NO: 94673 - DNA, 25 bp, Mus musculus
cgcggccggtgacaatagcactctg

SEQ ID NO: 94674 - DNA, 25 bp, Mus musculus
cgcggcgcgggagaccgcggtatgg

SEQ ID NO: 94675 - DNA, 25 bp, Mus musculus
cgcggctgccatttgtcggcaacat

SEQ ID NO: 94676 - DNA, 25 bp, Mus musculus
cgcggctggcatacagactcctaga

SEQ ID NO: 94677 - DNA, 25 bp, Mus musculus
cgcggcttcgctgaacctcactggc

SEQ ID NO: 94678 - DNA, 25 bp, Mus musculus
cgcggcttctcggtgactgtggaaa

SEQ ID NO: 94679 - DNA, 25 bp, Mus musculus
cgcggctttgctctttttctgcaca

SEQ ID NO: 94680 - DNA, 25 bp, Mus musculus
cgcgggaactgaaaatccgagagta

SEQ ID NO: 94681 - DNA, 25 bp, Mus musculus
cgcgggacgcagagcctttgcactt

SEQ ID NO: 94682 - DNA, 25 bp, Mus musculus
cgcgggagtcggagacattgtcatc

SEQ ID NO: 94683 - DNA, 25 bp, Mus musculus
cgcgggcgggccagtgaagccggcg

SEQ ID NO: 94684 - DNA, 25 bp, Mus musculus
cgcgggctcactcatggaggaggtg

SEQ ID NO: 94685 - DNA, 25 bp, Mus musculus
cgcgggctcgctcgccagccgtcct

SEQ ID NO: 94686 - DNA, 25 bp, Mus musculus
cgcgggctttggctatgacatgaac

SEQ ID NO: 94687 - DNA, 25 bp, Mus musculus
cgcgggtccagaagatgaaacgtga

SEQ ID NO: 94688 - DNA, 25 bp, Mus musculus
cgcgggtcgtttcagccacagaagt

SEQ ID NO: 94689 - DNA, 25 bp, Mus musculus
cgcggtagctcaagggacttcagca

SEQ ID NO: 94690 - DNA, 25 bp, Mus musculus
cgcggtgacgctgtaagtgctgggc

SEQ ID NO: 94691 - DNA, 25 bp, Mus musculus
cgcggtggccactaccagaggcagc

SEQ ID NO: 94692 - DNA, 25 bp, Mus musculus
cgcggttggattctcttcagacaaa

SEQ ID NO: 94693 - DNA, 25 bp, Mus musculus
cgcgtagtagctgagcggggctcac

SEQ ID NO: 94694 - DNA, 25 bp, Mus musculus
cgcgtcagggcagcaccatcggtgt

SEQ ID NO: 94695 - DNA, 25 bp, Mus musculus
cgcgtcgcaccgtcgggctttgtca

SEQ ID NO: 94696 - DNA, 25 bp, Mus musculus
cgcgtcggagacagtgtttggctta

SEQ ID NO: 94697 - DNA, 25 bp, Mus musculus
cgcgtctgcgtctgctgctgttaga

SEQ ID NO: 94698 - DNA, 25 bp, Mus musculus
cgcgtgaaccagagacgcgcgggtc

SEQ ID NO: 94699 - DNA, 25 bp, Mus musculus
cgcgtgccagaagcttgggatgaat

SEQ ID NO: 94700 - DNA, 25 bp, Mus musculus
cgcgtgcccctgtccggcagccgag

SEQ ID NO: 94701 - DNA, 25 bp, Mus musculus
cgcgtgcgtgagctggcgcgcgaga

SEQ ID NO: 94702 - DNA, 25 bp, Mus musculus
cgcgtgggcttcttccagggagaca

SEQ ID NO: 94703 - DNA, 25 bp, Mus musculus
cgcgttgagcggaacctgccgaagc

SEQ ID NO: 94704 - DNA, 25 bp, Mus musculus
cgcgttgcctagtccccgagtgtat

SEQ ID NO: 94705 - DNA, 25 bp, Mus musculus
cgctaacagcctcattacagtggtg

SEQ ID NO: 94706 - DNA, 25 bp, Mus musculus
cgctaaccttttggaagacttgaga

SEQ ID NO: 94707 - DNA, 25 bp, Mus musculus
cgctaacgcagctgtacagccaggc

SEQ ID NO: 94708 - DNA, 25 bp, Mus musculus
cgctaagggccgtaaagcggatagt

SEQ ID NO: 94709 - DNA, 25 bp, Mus musculus
cgctaatggacatagacagcacaat

SEQ ID NO: 94710 - DNA, 25 bp, Mus musculus
cgctaccgagttgtggaagctatca

SEQ ID NO: 94711 - DNA, 25 bp, Mus musculus
cgctacggaagcagcgtaaggcgta

SEQ ID NO: 94712 - DNA, 25 bp, Mus musculus
cgctactgtttactttgtgttggca

SEQ ID NO: 94713 - DNA, 25 bp, Mus musculus
cgctagaggataaaccgaaggcttc

SEQ ID NO: 94714 - DNA, 25 bp, Mus musculus
cgctagctctactcgccgtgtggaa

SEQ ID NO: 94715 - DNA, 25 bp, Mus musculus
cgctagctgcatccctttccaggag

SEQ ID NO: 94716 - DNA, 25 bp, Mus musculus
cgctaggatgcctatcctggaaaag

SEQ ID NO: 94717 - DNA, 25 bp, Mus musculus
cgctagtggaagtggcggcatcgct

SEQ ID NO: 94718 - DNA, 25 bp, Mus musculus
cgctatacaggagaggtagtaccac

SEQ ID NO: 94719 - DNA, 25 bp, Mus musculus
cgctatctggtggaggagtttcccc

SEQ ID NO: 94720 - DNA, 25 bp, Mus musculus
cgctatgaagacaccatgctggctg

SEQ ID NO: 94721 - DNA, 25 bp, Mus musculus
cgctatgcttggctggagtacctca

SEQ ID NO: 94722 - DNA, 25 bp, Mus musculus
cgctatggcatgacagagatcggca

SEQ ID NO: 94723 - DNA, 25 bp, Mus musculus
cgctatttaccagagtgggccatcc

SEQ ID NO: 94724 - DNA, 25 bp, Mus musculus
cgctcaaggaggtcgtattgcgcta

SEQ ID NO: 94725 - DNA, 25 bp, Mus musculus
cgctcaatgcccgatgctccatcct

SEQ ID NO: 94726 - DNA, 25 bp, Mus musculus
cgctcacagtggaaggacggacatt

SEQ ID NO: 94727 - DNA, 25 bp, Mus musculus
cgctcagaaagttcgaggtgtggac

SEQ ID NO: 94728 - DNA, 25 bp, Mus musculus
cgctcagcgctgtaagctataggca

SEQ ID NO: 94729 - DNA, 25 bp, Mus musculus
cgctcagtgtgtctcaccaaaggga

SEQ ID NO: 94730 - DNA, 25 bp, Mus musculus
cgctcatggagcgtcgctgggactt

SEQ ID NO: 94731 - DNA, 25 bp, Mus musculus
cgctccagattgtggcctggctgct

SEQ ID NO: 94732 - DNA, 25 bp, Mus musculus
cgctccccttgaccttggtgcggcc

SEQ ID NO: 94733 - DNA, 25 bp, Mus musculus
cgctcgaaggatgaagaagtgtatc

SEQ ID NO: 94734 - DNA, 25 bp, Mus musculus
cgctcgactgctggtgtctggcgga

SEQ ID NO: 94735 - DNA, 25 bp, Mus musculus
cgctctccaggatgtcaacgataaa

SEQ ID NO: 94736 - DNA, 25 bp, Mus musculus
cgctctgaccagtggagggatctta

SEQ ID NO: 94737 - DNA, 25 bp, Mus musculus
cgctctgacttcctgatagctgaaa

SEQ ID NO: 94738 - DNA, 25 bp, Mus musculus
cgctctggaaaaccccgtggttatg

SEQ ID NO: 94739 - DNA, 25 bp, Mus musculus
cgctctggaacaagaaagtggtttc

SEQ ID NO: 94740 - DNA, 25 bp, Mus musculus
cgctctttggtcatggcacccggaa

SEQ ID NO: 94741 - DNA, 25 bp, Mus musculus
cgctgaaagtgaggttctgtaccaa

SEQ ID NO: 94742 - DNA, 25 bp, Mus musculus
cgctgaaagtggtagaagatctgcc

SEQ ID NO: 94743 - DNA, 25 bp, Mus musculus
cgctgaaatgatccgccagatagag

SEQ ID NO: 94744 - DNA, 25 bp, Mus musculus
cgctgaagcggaatttgcctgtgaa

SEQ ID NO: 94745 - DNA, 25 bp, Mus musculus
cgctgacatccactgtgagaactgc

SEQ ID NO: 94746 - DNA, 25 bp, Mus musculus
cgctgacatcctgtgatggtgccat

SEQ ID NO: 94747 - DNA, 25 bp, Mus musculus
cgctgaccagtgactgaaagctgta

SEQ ID NO: 94748 - DNA, 25 bp, Mus musculus
cgctgactgcggaaaagctgtgcat

SEQ ID NO: 94749 - DNA, 25 bp, Mus musculus
cgctgagtgggttttcggatcatgt

SEQ ID NO: 94750 - DNA, 25 bp, Mus musculus
cgctgagttggagacagatcagcca

SEQ ID NO: 94751 - DNA, 25 bp, Mus musculus
cgctgatgaagctggccacccattt

SEQ ID NO: 94752 - DNA, 25 bp, Mus musculus
cgctgattccatcatcggtgtggca

SEQ ID NO: 94753 - DNA, 25 bp, Mus musculus
cgctgcacatttgccggtccgggtt

SEQ ID NO: 94754 - DNA, 25 bp, Mus musculus
cgctgcagcccgtgggagtctagta

SEQ ID NO: 94755 - DNA, 25 bp, Mus musculus
cgctgcagctttactggacctggct

SEQ ID NO: 94756 - DNA, 25 bp, Mus musculus
cgctgcatgatttgcacggaaggag

SEQ ID NO: 94757 - DNA, 25 bp, Mus musculus
cgctgcctgctcagagattctcgaa

SEQ ID NO: 94758 - DNA, 25 bp, Mus musculus
cgctgccttcgacaaatcccatgat

SEQ ID NO: 94759 - DNA, 25 bp, Mus musculus
cgctgcgagccctgggtaaccacgg

SEQ ID NO: 94760 - DNA, 25 bp, Mus musculus
cgctgcggactgtcatcgagcggct

SEQ ID NO: 94761 - DNA, 25 bp, Mus musculus
cgctgcgggaggaaagacgtcctct

SEQ ID NO: 94762 - DNA, 25 bp, Mus musculus
cgctgctgatgacgcctgtgttcct

SEQ ID NO: 94763 - DNA, 25 bp, Mus musculus
cgctgctgctcaggcctggaatgta

SEQ ID NO: 94764 - DNA, 25 bp, Mus musculus
cgctgctggagacatttcgaccttc

SEQ ID NO: 94765 - DNA, 25 bp, Mus musculus
cgctgctggcctactccggttatgg

SEQ ID NO: 94766 - DNA, 25 bp, Mus musculus
cgctgcttccctaggacaaagtcca

SEQ ID NO: 94767 - DNA, 25 bp, Mus musculus
cgctggaactatggcgtccgggcct

SEQ ID NO: 94768 - DNA, 25 bp, Mus musculus
cgctggaagacgtgtacatggcatc

SEQ ID NO: 94769 - DNA, 25 bp, Mus musculus
cgctggaagatcctcagaaggttct

SEQ ID NO: 94770 - DNA, 25 bp, Mus musculus
cgctggaagccagtttaggcctaaa

SEQ ID NO: 94771 - DNA, 25 bp, Mus musculus
cgctggaatcttaatagaggctgtc

SEQ ID NO: 94772 - DNA, 25 bp, Mus musculus
cgctggagaaaatatcttcattaag

SEQ ID NO: 94773 - DNA, 25 bp, Mus musculus
cgctggagagtatgagtgccacgca

SEQ ID NO: 94774 - DNA, 25 bp, Mus musculus
cgctggaggtgccatgtcttccaag

SEQ ID NO: 94775 - DNA, 25 bp, Mus musculus
cgctggatctatgatgtgcggacca

SEQ ID NO: 94776 - DNA, 25 bp, Mus musculus
cgctggatgccaccgttgttgtaaa

SEQ ID NO: 94777 - DNA, 25 bp, Mus musculus
cgctggcagatagaggcggccttct

SEQ ID NO: 94778 - DNA, 25 bp, Mus musculus
cgctgggcacaagaagcaatcctgt

SEQ ID NO: 94779 - DNA, 25 bp, Mus musculus
cgctgggctcgtcgctaggcttttt

SEQ ID NO: 94780 - DNA, 25 bp, Mus musculus
cgctggttaaggagagtggtactac

SEQ ID NO: 94781 - DNA, 25 bp, Mus musculus
cgctgtatcggagcatggtgacaaa

SEQ ID NO: 94782 - DNA, 25 bp, Mus musculus
cgctgtatgaagttgctgggcgaca

SEQ ID NO: 94783 - DNA, 25 bp, Mus musculus
cgctgtatttctccaggctggcaaa

SEQ ID NO: 94784 - DNA, 25 bp, Mus musculus
cgctgtgagacattataaccgagat

SEQ ID NO: 94785 - DNA, 25 bp, Mus musculus
cgctgtgcacggagcagttcggctc

SEQ ID NO: 94786 - DNA, 25 bp, Mus musculus
cgctgtggattggatgacggacctc

SEQ ID NO: 94787 - DNA, 25 bp, Mus musculus
cgctgtggtcactgaatgtgccggc

SEQ ID NO: 94788 - DNA, 25 bp, Mus musculus
cgctgtgtctgtgcttccgagggta

SEQ ID NO: 94789 - DNA, 25 bp, Mus musculus
cgctgtgttcttcgaggttccggac

SEQ ID NO: 94790 - DNA, 25 bp, Mus musculus
cgctgtttcgttctctggctggtac

SEQ ID NO: 94791 - DNA, 25 bp, Mus musculus
cgcttacgtgagcagaagtagttct

SEQ ID NO: 94792 - DNA, 25 bp, Mus musculus
cgcttagaaagagagctggtggaaa

SEQ ID NO: 94793 - DNA, 25 bp, Mus musculus
cgcttagaagaagagagacgttcct

SEQ ID NO: 94794 - DNA, 25 bp, Mus musculus
cgcttagagctcaagctcgacgaca

SEQ ID NO: 94795 - DNA, 25 bp, Mus musculus
cgcttatcttgggagcctggacatt

SEQ ID NO: 94796 - DNA, 25 bp, Mus musculus
cgcttcaaagagagagtcggctaca

SEQ ID NO: 94797 - DNA, 25 bp, Mus musculus
cgcttcaatgtctactgcttccgag

SEQ ID NO: 94798 - DNA, 25 bp, Mus musculus
cgcttcacacgggtggagatggccc

SEQ ID NO: 94799 - DNA, 25 bp, Mus musculus
cgcttcagaaggaagaaacgctcct

SEQ ID NO: 94800 - DNA, 25 bp, Mus musculus
cgcttcagcgggacggtcgacttgt

SEQ ID NO: 94801 - DNA, 25 bp, Mus musculus
cgcttcaggtggagcaggacttcca

SEQ ID NO: 94802 - DNA, 25 bp, Mus musculus
cgcttccggctaggactgttaggca

SEQ ID NO: 94803 - DNA, 25 bp, Mus musculus
cgcttcctggaagcgctgggcttca

SEQ ID NO: 94804 - DNA, 25 bp, Mus musculus
cgcttcgagaagctggacagtgtca

SEQ ID NO: 94805 - DNA, 25 bp, Mus musculus
cgcttcgccatggagcagtcattca

SEQ ID NO: 94806 - DNA, 25 bp, Mus musculus
cgcttgacaatcgagtggctgacca

SEQ ID NO: 94807 - DNA, 25 bp, Mus musculus
cgcttgcagacagtgggcttccgat

SEQ ID NO: 94808 - DNA, 25 bp, Mus musculus
cgcttgccccaaagtcaggatctta

SEQ ID NO: 94809 - DNA, 25 bp, Mus musculus
cgcttgcggcgcagtctaccttaga

SEQ ID NO: 94810 - DNA, 25 bp, Mus musculus
cgcttggataacacccttggaggca

SEQ ID NO: 94811 - DNA, 25 bp, Mus musculus
cgcttggatcttcttctgttacctg

SEQ ID NO: 94812 - DNA, 25 bp, Mus musculus
cgcttggtgactccgtctgtccgtc

SEQ ID NO: 94813 - DNA, 25 bp, Mus musculus
cgctttaaggacgaacagattgaca

SEQ ID NO: 94814 - DNA, 25 bp, Mus musculus
cgctttacgttaacagcgctcggga

SEQ ID NO: 94815 - DNA, 25 bp, Mus musculus
cgctttatgactatgctggccagga

SEQ ID NO: 94816 - DNA, 25 bp, Mus musculus
cgctttatgtatgggcagcgagccc

SEQ ID NO: 94817 - DNA, 25 bp, Mus musculus
cgctttctgctctatgccatggaca

SEQ ID NO: 94818 - DNA, 25 bp, Mus musculus
cgctttggcttcaatgggctgagta

SEQ ID NO: 94819 - DNA, 25 bp, Mus musculus
cgcttttcagtttgccggaggcgcg

SEQ ID NO: 94820 - DNA, 25 bp, Mus musculus
cggaaaaacgtgcacatcaatgaca

SEQ ID NO: 94821 - DNA, 25 bp, Mus musculus
cggaaaccccatcggaactgaccag

SEQ ID NO: 94822 - DNA, 25 bp, Mus musculus
cggaaagactgacatgcgggtcata

SEQ ID NO: 94823 - DNA, 25 bp, Mus musculus
cggaaagatggagtgtcctgcgccc

SEQ ID NO: 94824 - DNA, 25 bp, Mus musculus
cggaaagctgcgataatgtgaaggt

SEQ ID NO: 94825 - DNA, 25 bp, Mus musculus
cggaaatgctgggaactaactgtga

SEQ ID NO: 94826 - DNA, 25 bp, Mus musculus
cggaacattgggatctcagctcaca

SEQ ID NO: 94827 - DNA, 25 bp, Mus musculus
cggaaccatgtttgcagacttagac

SEQ ID NO: 94828 - DNA, 25 bp, Mus musculus
cggaaccgaccatggctttggagcc

SEQ ID NO: 94829 - DNA, 25 bp, Mus musculus
cggaagaagagtcactgcacatttc

SEQ ID NO: 94830 - DNA, 25 bp, Mus musculus
cggaagcatcttacagtggtcgact

SEQ ID NO: 94831 - DNA, 25 bp, Mus musculus
cggaagccagacaagagcgatgagc

SEQ ID NO: 94832 - DNA, 25 bp, Mus musculus
cggaagccgaggacgggagtctcag

SEQ ID NO: 94833 - DNA, 25 bp, Mus musculus
cggaagcgcagagcggacggaaggg

SEQ ID NO: 94834 - DNA, 25 bp, Mus musculus
cggaagctcagttttcagcatggct

SEQ ID NO: 94835 - DNA, 25 bp, Mus musculus
cggaaggccctcagtgtcctgaagg

SEQ ID NO: 94836 - DNA, 25 bp, Mus musculus
cggaagttcgagtgcccatgctgag

SEQ ID NO: 94837 - DNA, 25 bp, Mus musculus
cggaataattccgtatcaaaatctg

SEQ ID NO: 94838 - DNA, 25 bp, Mus musculus
cggaatcaattgcagggagctatgc

SEQ ID NO: 94839 - DNA, 25 bp, Mus musculus
cggaatcttgatggcaccctgggct

SEQ ID NO: 94840 - DNA, 25 bp, Mus musculus
cggaatgtttagtgactcagagagc

SEQ ID NO: 94841 - DNA, 25 bp, Mus musculus
cggaattcaagatcgagcgcctcgg

SEQ ID NO: 94842 - DNA, 25 bp, Mus musculus
cggaattgcacaaggagaggctgca

SEQ ID NO: 94843 - DNA, 25 bp, Mus musculus
cggaatttcagcgtcccagtgggct

SEQ ID NO: 94844 - DNA, 25 bp, Mus musculus
cggacacagcgcagaataggaaata

SEQ ID NO: 94845 - DNA, 25 bp, Mus musculus
cggacagaccccttggtgacctcat

SEQ ID NO: 94846 - DNA, 25 bp, Mus musculus
cggacagcaggcattcatggagact

SEQ ID NO: 94847 - DNA, 25 bp, Mus musculus
cggacaggtcaagctgtgtgacttt

SEQ ID NO: 94848 - DNA, 25 bp, Mus musculus
cggacaggtgtcagaggtattttca

SEQ ID NO: 94849 - DNA, 25 bp, Mus musculus
cggacagtccatgggcagccaaatg

SEQ ID NO: 94850 - DNA, 25 bp, Mus musculus
cggacagtgtgtcgcttccaggacc

SEQ ID NO: 94851 - DNA, 25 bp, Mus musculus
cggacatgaacacggagggaaatct

SEQ ID NO: 94852 - DNA, 25 bp, Mus musculus
cggacatggacttcgactcgtatca

SEQ ID NO: 94853 - DNA, 25 bp, Mus musculus
cggacattgaggcagcacacaggtt

SEQ ID NO: 94854 - DNA, 25 bp, Mus musculus
cggaccaggcggacatcacttatga

SEQ ID NO: 94855 - DNA, 25 bp, Mus musculus
cggacccgcgaaaatgagtgccact

SEQ ID NO: 94856 - DNA, 25 bp, Mus musculus
cggacgcggtgctattcgagtttct

SEQ ID NO: 94857 - DNA, 25 bp, Mus musculus
cggacggaagcgcagagcggacgga

SEQ ID NO: 94858 - DNA, 25 bp, Mus musculus
cggacggagctgaggaaagcgatgc

SEQ ID NO: 94859 - DNA, 25 bp, Mus musculus
cggacgtctggcttcgcgggtttca

SEQ ID NO: 94860 - DNA, 25 bp, Mus musculus
cggactcggtgatgcgacaggacta

SEQ ID NO: 94861 - DNA, 25 bp, Mus musculus
cggactgattggcacctggctttca

SEQ ID NO: 94862 - DNA, 25 bp, Mus musculus
cggactggagttgcttgatcggaaa

SEQ ID NO: 94863 - DNA, 25 bp, Mus musculus
cggactttcacatagtggtagagag

SEQ ID NO: 94864 - DNA, 25 bp, Mus musculus
cggagaaggccatcaagttggcagc

SEQ ID NO: 94865 - DNA, 25 bp, Mus musculus
cggagacccgtagttggcgagctca

SEQ ID NO: 94866 - DNA, 25 bp, Mus musculus
cggagacgatgatatgaagcgaacc

SEQ ID NO: 94867 - DNA, 25 bp, Mus musculus
cggagacgcctaggcttactggcca

SEQ ID NO: 94868 - DNA, 25 bp, Mus musculus
cggagactctgctgaactcggaagt

SEQ ID NO: 94869 - DNA, 25 bp, Mus musculus
cggagagaacgcacctaagaaaact

SEQ ID NO: 94870 - DNA, 25 bp, Mus musculus
cggagagacaactctcagtttaaaa

SEQ ID NO: 94871 - DNA, 25 bp, Mus musculus
cggagagatccgtttgtagcattca

SEQ ID NO: 94872 - DNA, 25 bp, Mus musculus
cggagaggccgttatccagcagtga

SEQ ID NO: 94873 - DNA, 25 bp, Mus musculus
cggagagttcggtggagcccgggca

SEQ ID NO: 94874 - DNA, 25 bp, Mus musculus
cggagatacggattgcacaggagct

SEQ ID NO: 94875 - DNA, 25 bp, Mus musculus
cggagatccagctggcgcagcgcct

SEQ ID NO: 94876 - DNA, 25 bp, Mus musculus
cggagatcttgctaggcttgcccta

SEQ ID NO: 94877 - DNA, 25 bp, Mus musculus
cggagatgtccctatatttattgcg

SEQ ID NO: 94878 - DNA, 25 bp, Mus musculus
cggagcagaatgtaccagggacaca

SEQ ID NO: 94879 - DNA, 25 bp, Mus musculus
cggagcagatcgacacagtgggcat

SEQ ID NO: 94880 - DNA, 25 bp, Mus musculus
cggagcaggataatcggttcagcaa

SEQ ID NO: 94881 - DNA, 25 bp, Mus musculus
cggagcagggtcttcagggtacaaa

SEQ ID NO: 94882 - DNA, 25 bp, Mus musculus
cggagccacctcttactcgctggag

SEQ ID NO: 94883 - DNA, 25 bp, Mus musculus
cggagcccgatgacgacgtggaact

SEQ ID NO: 94884 - DNA, 25 bp, Mus musculus
cggagcgaaaatggagctattccac

SEQ ID NO: 94885 - DNA, 25 bp, Mus musculus
cggagcgtctcatcgggtttgccca

SEQ ID NO: 94886 - DNA, 25 bp, Mus musculus
cggagctacccaaggcccaggcgag

SEQ ID NO: 94887 - DNA, 25 bp, Mus musculus
cggagctcggctgagtcagtcagtc

SEQ ID NO: 94888 - DNA, 25 bp, Mus musculus
cggagctgaaatggttcggaagaac

SEQ ID NO: 94889 - DNA, 25 bp, Mus musculus
cggagctgcggacggtttgcccgag

SEQ ID NO: 94890 - DNA, 25 bp, Mus musculus
cggagctgtgtacgccttgacttaa

SEQ ID NO: 94891 - DNA, 25 bp, Mus musculus
cggaggaatttctcggacagtgcaa

SEQ ID NO: 94892 - DNA, 25 bp, Mus musculus
cggaggacatctgacatccagtggt

SEQ ID NO: 94893 - DNA, 25 bp, Mus musculus
cggaggacgtcgctgctgacatcta

SEQ ID NO: 94894 - DNA, 25 bp, Mus musculus
cggaggagctccgaaaaactgtgga

SEQ ID NO: 94895 - DNA, 25 bp, Mus musculus
cggaggcaatcgacaccttgggaca

SEQ ID NO: 94896 - DNA, 25 bp, Mus musculus
cggaggcacggtgaaataaagttat

SEQ ID NO: 94897 - DNA, 25 bp, Mus musculus
cggaggcagcgcctgcgacgacgac

SEQ ID NO: 94898 - DNA, 25 bp, Mus musculus
cggaggccaagaagcttcagctcaa

SEQ ID NO: 94899 - DNA, 25 bp, Mus musculus
cggaggccatcgagttcacagatga

SEQ ID NO: 94900 - DNA, 25 bp, Mus musculus
cggaggctcagatcaagccaaagct

SEQ ID NO: 94901 - DNA, 25 bp, Mus musculus
cggaggctccctgaagcccagtgga

SEQ ID NO: 94902 - DNA, 25 bp, Mus musculus
cggaggctggacaaaatggtgacca

SEQ ID NO: 94903 - DNA, 25 bp, Mus musculus
cggaggtcctggtagctgcccacca

SEQ ID NO: 94904 - DNA, 25 bp, Mus musculus
cggaggtggtgctcctctcagagac

SEQ ID NO: 94905 - DNA, 25 bp, Mus musculus
cggagtaagcgttcagcgggtcctc

SEQ ID NO: 94906 - DNA, 25 bp, Mus musculus
cggagtatcgctacaatagggctca

SEQ ID NO: 94907 - DNA, 25 bp, Mus musculus
cggagtccacaggagaagagtctct

SEQ ID NO: 94908 - DNA, 25 bp, Mus musculus
cggagtcttcccctgctgatctgag

SEQ ID NO: 94909 - DNA, 25 bp, Mus musculus
cggagtcttcgtgccaacagtggaa

SEQ ID NO: 94910 - DNA, 25 bp, Mus musculus
cggagtgtacaagtccgccgagcag

SEQ ID NO: 94911 - DNA, 25 bp, Mus musculus
cggagttctctcagtgccatcttca

SEQ ID NO: 94912 - DNA, 25 bp, Mus musculus
cggataacatcatcccagatactga

SEQ ID NO: 94913 - DNA, 25 bp, Mus musculus
cggatatattctcatacttggttga

SEQ ID NO: 94914 - DNA, 25 bp, Mus musculus
cggatcacagcggttacagcccggg

SEQ ID NO: 94915 - DNA, 25 bp, Mus musculus
cggatcacagggtggtggacaccat

SEQ ID NO: 94916 - DNA, 25 bp, Mus musculus
cggatcagatccgattgaagtgtat

SEQ ID NO: 94917 - DNA, 25 bp, Mus musculus
cggatcatgcaaaccgtggagatta

SEQ ID NO: 94918 - DNA, 25 bp, Mus musculus
cggatccagctgctcaataatgagt

SEQ ID NO: 94919 - DNA, 25 bp, Mus musculus
cggatccaggaggaactcaagcagg

SEQ ID NO: 94920 - DNA, 25 bp, Mus musculus
cggatccagggcctgctttgtgact

SEQ ID NO: 94921 - DNA, 25 bp, Mus musculus
cggatcctgcgagccgattggtcag

SEQ ID NO: 94922 - DNA, 25 bp, Mus musculus
cggatgacgactccatgggaattca

SEQ ID NO: 94923 - DNA, 25 bp, Mus musculus
cggatgacgagcagcccttgaagct

SEQ ID NO: 94924 - DNA, 25 bp, Mus musculus
cggatgagttcatagaagccctgct

SEQ ID NO: 94925 - DNA, 25 bp, Mus musculus
cggatgattcttctagttgtactga

SEQ ID NO: 94926 - DNA, 25 bp, Mus musculus
cggatgcagaaaggcaggcccagtt

SEQ ID NO: 94927 - DNA, 25 bp, Mus musculus
cggatgctcttcagcgccgttgagt

SEQ ID NO: 94928 - DNA, 25 bp, Mus musculus
cggatgctgaactccatgggctaca

SEQ ID NO: 94929 - DNA, 25 bp, Mus musculus
cggatgggaggctcctgcccacaga

SEQ ID NO: 94930 - DNA, 25 bp, Mus musculus
cggatgtaggtagctatgtagtcgc

SEQ ID NO: 94931 - DNA, 25 bp, Mus musculus
cggatgttgccggttacacacacag

SEQ ID NO: 94932 - DNA, 25 bp, Mus musculus
cggattgaagcccaacggtctgacc

SEQ ID NO: 94933 - DNA, 25 bp, Mus musculus
cggatttaaactcgctgctctggga

SEQ ID NO: 94934 - DNA, 25 bp, Mus musculus
cggcaacaccgagaccgagacaggg

SEQ ID NO: 94935 - DNA, 25 bp, Mus musculus
cggcaagaccttctactggcgcgag

SEQ ID NO: 94936 - DNA, 25 bp, Mus musculus
cggcaagtctgtgtcatggtctgaa

SEQ ID NO: 94937 - DNA, 25 bp, Mus musculus
cggcaatgcggcttcttcaggagaa

SEQ ID NO: 94938 - DNA, 25 bp, Mus musculus
cggcacatgcatcgcttcagcaggt

SEQ ID NO: 94939 - DNA, 25 bp, Mus musculus
cggcaccagcgggttttagaagcag

SEQ ID NO: 94940 - DNA, 25 bp, Mus musculus
cggcagaatgctcttctggagcaac

SEQ ID NO: 94941 - DNA, 25 bp, Mus musculus
cggcagcggcctacacacgaagggt

SEQ ID NO: 94942 - DNA, 25 bp, Mus musculus
cggcaggccaatgcacagctgctgg

SEQ ID NO: 94943 - DNA, 25 bp, Mus musculus
cggcaggcggctggagggtcctcgc

SEQ ID NO: 94944 - DNA, 25 bp, Mus musculus
cggcaggctccgagcagtctctggt

SEQ ID NO: 94945 - DNA, 25 bp, Mus musculus
cggcagtaccgaagatcccagtgtt

SEQ ID NO: 94946 - DNA, 25 bp, Mus musculus
cggcagtgcgtggacacatgactca

SEQ ID NO: 94947 - DNA, 25 bp, Mus musculus
cggcatcaccgagaaggtcgtgttc

SEQ ID NO: 94948 - DNA, 25 bp, Mus musculus
cggcatgatgttgatgtcttagatc

SEQ ID NO: 94949 - DNA, 25 bp, Mus musculus
cggcatggcggtgtcctggaggagc

SEQ ID NO: 94950 - DNA, 25 bp, Mus musculus
cggcatttgaatcgcgcttccgcca

SEQ ID NO: 94951 - DNA, 25 bp, Mus musculus
cggccaaacttggatggagctggac

SEQ ID NO: 94952 - DNA, 25 bp, Mus musculus
cggccaatggcaagttcagtaagtc

SEQ ID NO: 94953 - DNA, 25 bp, Mus musculus
cggccagtagccaatatctcagatg

SEQ ID NO: 94954 - DNA, 25 bp, Mus musculus
cggccagtcctcacatcaagataga

SEQ ID NO: 94955 - DNA, 25 bp, Mus musculus
cggccataaactgggctctatagaa

SEQ ID NO: 94956 - DNA, 25 bp, Mus musculus
cggccattccattcccagggagtga

SEQ ID NO: 94957 - DNA, 25 bp, Mus musculus
cggcccagacggtcagctggaaagt

SEQ ID NO: 94958 - DNA, 25 bp, Mus musculus
cggcccagtgggtcctcctggagaa

SEQ ID NO: 94959 - DNA, 25 bp, Mus musculus
cggcccctggctgcttgcataaaga

SEQ ID NO: 94960 - DNA, 25 bp, Mus musculus
cggccctcgagtgctttctggacaa

SEQ ID NO: 94961 - DNA, 25 bp, Mus musculus
cggccctgaatgagtacctgcggat

SEQ ID NO: 94962 - DNA, 25 bp, Mus musculus
cggccctgcggtgggtatgaaagga

SEQ ID NO: 94963 - DNA, 25 bp, Mus musculus
cggccgagcgggtcctcgcttaacg

SEQ ID NO: 94964 - DNA, 25 bp, Mus musculus
cggccgcagcagcaagactaagaaa

SEQ ID NO: 94965 - DNA, 25 bp, Mus musculus
cggccggttatgaggacaagtaatc

SEQ ID NO: 94966 - DNA, 25 bp, Mus musculus
cggccgtggcaccaaacgaaagaag

SEQ ID NO: 94967 - DNA, 25 bp, Mus musculus
cggcctacagaacatgcaccatgct

SEQ ID NO: 94968 - DNA, 25 bp, Mus musculus
cggcctcggaggtggacttctatat

SEQ ID NO: 94969 - DNA, 25 bp, Mus musculus
cggcctcggcatgggcactatcata

SEQ ID NO: 94970 - DNA, 25 bp, Mus musculus
cggcctctggttctcggcgggagcg

SEQ ID NO: 94971 - DNA, 25 bp, Mus musculus
cggcctggactggagtaccactcaa

SEQ ID NO: 94972 - DNA, 25 bp, Mus musculus
cggcctggccatgtagccttgatag

SEQ ID NO: 94973 - DNA, 25 bp, Mus musculus
cggcctgggccccttgtcggaggtg

SEQ ID NO: 94974 - DNA, 25 bp, Mus musculus
cggccttactgtgctctgtctgaaa

SEQ ID NO: 94975 - DNA, 25 bp, Mus musculus
cggccttacttcacgattcatgata

SEQ ID NO: 94976 - DNA, 25 bp, Mus musculus
cggccttcactgtactgtcacggga

SEQ ID NO: 94977 - DNA, 25 bp, Mus musculus
cggcctttgcaggatcgtggatgat

SEQ ID NO: 94978 - DNA, 25 bp, Mus musculus
cggcgacgccgagttcggatttata

SEQ ID NO: 94979 - DNA, 25 bp, Mus musculus
cggcgagatcaagaaggcaggctct

SEQ ID NO: 94980 - DNA, 25 bp, Mus musculus
cggcgaggtgatcgtccccgtaact

SEQ ID NO: 94981 - DNA, 25 bp, Mus musculus
cggcgattgtctggcggcctggggc

SEQ ID NO: 94982 - DNA, 25 bp, Mus musculus
cggcgccggagctacctgtttttag

SEQ ID NO: 94983 - DNA, 25 bp, Mus musculus
cggcgccggcagcttgtttacacag

SEQ ID NO: 94984 - DNA, 25 bp, Mus musculus
cggcgccgggtccagaagtggaaag

SEQ ID NO: 94985 - DNA, 25 bp, Mus musculus
cggcgctcgactgctggtgtctggc

SEQ ID NO: 94986 - DNA, 25 bp, Mus musculus
cggcgctctcagtgcagtcagtctg

SEQ ID NO: 94987 - DNA, 25 bp, Mus musculus
cggcgctgtgcttggcctcggcttc

SEQ ID NO: 94988 - DNA, 25 bp, Mus musculus
cggcggaatcgccttcgtgacgtac

SEQ ID NO: 94989 - DNA, 25 bp, Mus musculus
cggcggaatcggacacacagatcat

SEQ ID NO: 94990 - DNA, 25 bp, Mus musculus
cggcggacgacgttcgtcatttggt

SEQ ID NO: 94991 - DNA, 25 bp, Mus musculus
cggcggaggagttttatgctcgtct

SEQ ID NO: 94992 - DNA, 25 bp, Mus musculus
cggcggatgcaggagatgttacaca

SEQ ID NO: 94993 - DNA, 25 bp, Mus musculus
cggcggccggctttgcccgatttag

SEQ ID NO: 94994 - DNA, 25 bp, Mus musculus
cggcggcggcagacgcgtgtggcga

SEQ ID NO: 94995 - DNA, 25 bp, Mus musculus
cggcggtgactgtggcgggcgctag

SEQ ID NO: 94996 - DNA, 25 bp, Mus musculus
cggcggtgtcggtagaaaacttcat

SEQ ID NO: 94997 - DNA, 25 bp, Mus musculus
cggcggtgttccttgctcgtgccca

SEQ ID NO: 94998 - DNA, 25 bp, Mus musculus
cggcggttcgcgtttctcgtgttgc

SEQ ID NO: 94999 - DNA, 25 bp, Mus musculus
cggcgtcgccggagtgaattgatcc

SEQ ID NO: 95000 - DNA, 25 bp, Mus musculus
cggcgtgggaggagaccgggagttg

SEQ ID NO: 95001 - DNA, 25 bp, Mus musculus
cggcgttccgagacgcgacacggca

SEQ ID NO: 95002 - DNA, 25 bp, Mus musculus
cggcgttggttcgagaagaccttca

SEQ ID NO: 95003 - DNA, 25 bp, Mus musculus
cggcgttgttcagtcagagcgagaa

SEQ ID NO: 95004 - DNA, 25 bp, Mus musculus
cggctaaagtaagagcgaccagact

SEQ ID NO: 95005 - DNA, 25 bp, Mus musculus
cggctaattgagcaggacccctatg

SEQ ID NO: 95006 - DNA, 25 bp, Mus musculus
cggctacgacgagaacatgaacact

SEQ ID NO: 95007 - DNA, 25 bp, Mus musculus
cggctacggaggtggtctaagtcct

SEQ ID NO: 95008 - DNA, 25 bp, Mus musculus
cggctactgggcaacactttcgtgg

SEQ ID NO: 95009 - DNA, 25 bp, Mus musculus
cggctaggcgaggagatcaagatca

SEQ ID NO: 95010 - DNA, 25 bp, Mus musculus
cggctccagcaagaggacggcatct

SEQ ID NO: 95011 - DNA, 25 bp, Mus musculus
cggctccgagcatggtcctggtgtt

SEQ ID NO: 95012 - DNA, 25 bp, Mus musculus
cggctgacaaggtgtttacctgtga

SEQ ID NO: 95013 - DNA, 25 bp, Mus musculus
cggctgatagagaagacaacgtatg

SEQ ID NO: 95014 - DNA, 25 bp, Mus musculus
cggctgcaggaaatagaacgagaga

SEQ ID NO: 95015 - DNA, 25 bp, Mus musculus
cggctgcccagtacgtgtcacagtg

SEQ ID NO: 95016 - DNA, 25 bp, Mus musculus
cggctgcccggactcgattgagaaa

SEQ ID NO: 95017 - DNA, 25 bp, Mus musculus
cggctgctggtagtcgatcctgaga

SEQ ID NO: 95018 - DNA, 25 bp, Mus musculus
cggctggactgtactaccttgcaga

SEQ ID NO: 95019 - DNA, 25 bp, Mus musculus
cggctggctaggacgccctacctgg

SEQ ID NO: 95020 - DNA, 25 bp, Mus musculus
cggctgtccctctatgtgctgctga

SEQ ID NO: 95021 - DNA, 25 bp, Mus musculus
cggctgtggaggtgttggctgcagt

SEQ ID NO: 95022 - DNA, 25 bp, Mus musculus
cggctgtggagttcgcaaatcatct

SEQ ID NO: 95023 - DNA, 25 bp, Mus musculus
cggctgtgtcaaacccatctacggg

SEQ ID NO: 95024 - DNA, 25 bp, Mus musculus
cggcttccagccaagaaaatagact

SEQ ID NO: 95025 - DNA, 25 bp, Mus musculus
cggcttggacaagaagactcgcagg

SEQ ID NO: 95026 - DNA, 25 bp, Mus musculus
cgggaaagaattccgagcccagtga

SEQ ID NO: 95027 - DNA, 25 bp, Mus musculus
cgggaaagcctattcctggagacct

SEQ ID NO: 95028 - DNA, 25 bp, Mus musculus
cgggaaccagactcaaacgacctat

SEQ ID NO: 95029 - DNA, 25 bp, Mus musculus
cgggaactcacacacctgtcggaaa

SEQ ID NO: 95030 - DNA, 25 bp, Mus musculus
cgggaactggcatcggactcatggt

SEQ ID NO: 95031 - DNA, 25 bp, Mus musculus
cgggaagacttggagaacacactga

SEQ ID NO: 95032 - DNA, 25 bp, Mus musculus
cgggaagccttttctgagctggaca

SEQ ID NO: 95033 - DNA, 25 bp, Mus musculus
cgggaagctagcaaagtcgcagcca

SEQ ID NO: 95034 - DNA, 25 bp, Mus musculus
cgggaaggagattccccggagcagc

SEQ ID NO: 95035 - DNA, 25 bp, Mus musculus
cgggaagggccttgaatctatgatc

SEQ ID NO: 95036 - DNA, 25 bp, Mus musculus
cgggaatctaaatatggtgcacaca

SEQ ID NO: 95037 - DNA, 25 bp, Mus musculus
cgggacaaacataagccacgcgatt

SEQ ID NO: 95038 - DNA, 25 bp, Mus musculus
cgggacacgaaatctagagctagcg

SEQ ID NO: 95039 - DNA, 25 bp, Mus musculus
cgggacagcacgctttgaatgccac

SEQ ID NO: 95040 - DNA, 25 bp, Mus musculus
cgggacatcgaacgcgaggctcaca

SEQ ID NO: 95041 - DNA, 25 bp, Mus musculus
cgggaccatcacacgagggaagaag

SEQ ID NO: 95042 - DNA, 25 bp, Mus musculus
cgggaccctcgtttgcactttggca

SEQ ID NO: 95043 - DNA, 25 bp, Mus musculus
cgggaccgaaagaagactgccgcga

SEQ ID NO: 95044 - DNA, 25 bp, Mus musculus
cgggaccggctcaatgagtttgtca

SEQ ID NO: 95045 - DNA, 25 bp, Mus musculus
cgggacctaggcacctcgaggtgtc

SEQ ID NO: 95046 - DNA, 25 bp, Mus musculus
cgggacctgggcagagaagtggcct

SEQ ID NO: 95047 - DNA, 25 bp, Mus musculus
cgggactcctgtagccaagactgaa

SEQ ID NO: 95048 - DNA, 25 bp, Mus musculus
cgggactgtccagcgaacgagcaag

SEQ ID NO: 95049 - DNA, 25 bp, Mus musculus
cgggagaaaggcgagttccagattc

SEQ ID NO: 95050 - DNA, 25 bp, Mus musculus
cgggagatcaggacgaacactacga

SEQ ID NO: 95051 - DNA, 25 bp, Mus musculus
cgggagatcgaggacaaactgaagc

SEQ ID NO: 95052 - DNA, 25 bp, Mus musculus
cgggagatctaccagctcaagaccc

SEQ ID NO: 95053 - DNA, 25 bp, Mus musculus
cgggagattttcgagcagcacctga

SEQ ID NO: 95054 - DNA, 25 bp, Mus musculus
cgggagcacacttcgcagagacttt

SEQ ID NO: 95055 - DNA, 25 bp, Mus musculus
cgggagcacgcaaccaggactcgtg

SEQ ID NO: 95056 - DNA, 25 bp, Mus musculus
cgggagctagccaaggcaaggcctt

SEQ ID NO: 95057 - DNA, 25 bp, Mus musculus
cgggagctgatcgtagtcggcccct

SEQ ID NO: 95058 - DNA, 25 bp, Mus musculus
cgggagcttcctgaacccttgctaa

SEQ ID NO: 95059 - DNA, 25 bp, Mus musculus
cgggaggagccgacgttcatagatc

SEQ ID NO: 95060 - DNA, 25 bp, Mus musculus
cgggaggtgggtccgcgcgtgatcg

SEQ ID NO: 95061 - DNA, 25 bp, Mus musculus
cgggatactcttcggcgcgtgctta

SEQ ID NO: 95062 - DNA, 25 bp, Mus musculus
cgggatctacagttacggaggcttt

SEQ ID NO: 95063 - DNA, 25 bp, Mus musculus
cgggatctttcacagagacgtgaag

SEQ ID NO: 95064 - DNA, 25 bp, Mus musculus
cgggatgacacacgacgagctaaca

SEQ ID NO: 95065 - DNA, 25 bp, Mus musculus
cgggatgacaggattcgagtagaaa

SEQ ID NO: 95066 - DNA, 25 bp, Mus musculus
cgggatgcaaagatggccctacacc

SEQ ID NO: 95067 - DNA, 25 bp, Mus musculus
cgggatgtcacctccaagtctgacc

SEQ ID NO: 95068 - DNA, 25 bp, Mus musculus
cgggattggctgttggcggcgttgc

SEQ ID NO: 95069 - DNA, 25 bp, Mus musculus
cgggattgtcccagcctagagccgt

SEQ ID NO: 95070 - DNA, 25 bp, Mus musculus
cgggatttagactccaaggcttgca

SEQ ID NO: 95071 - DNA, 25 bp, Mus musculus
cgggcaaatgcgagcagtaagtcga

SEQ ID NO: 95072 - DNA, 25 bp, Mus musculus
cgggcaacaatgacctcgatcctga

SEQ ID NO: 95073 - DNA, 25 bp, Mus musculus
cgggcaaccacaactactgccggaa

SEQ ID NO: 95074 - DNA, 25 bp, Mus musculus
cgggcaagaaagatacagcgcttct

SEQ ID NO: 95075 - DNA, 25 bp, Mus musculus
cgggcacgatgagggcagctgagca

SEQ ID NO: 95076 - DNA, 25 bp, Mus musculus
cgggcagcagcacagtactatctcg

SEQ ID NO: 95077 - DNA, 25 bp, Mus musculus
cgggcagccacacgctcttcgtgga

SEQ ID NO: 95078 - DNA, 25 bp, Mus musculus
cgggcagcccgagtcattcatgtag

SEQ ID NO: 95079 - DNA, 25 bp, Mus musculus
cgggcagccgtggatcgaataattc

SEQ ID NO: 95080 - DNA, 25 bp, Mus musculus
cgggcaggcagtgttagtaagtaca

SEQ ID NO: 95081 - DNA, 25 bp, Mus musculus
cgggcagtcgcctgtctaaggagct

SEQ ID NO: 95082 - DNA, 25 bp, Mus musculus
cgggcagtctgaccaatggcagtac

SEQ ID NO: 95083 - DNA, 25 bp, Mus musculus
cgggcagtctgccagattggcaatt

SEQ ID NO: 95084 - DNA, 25 bp, Mus musculus
cgggccaagatcatcagggagctga

SEQ ID NO: 95085 - DNA, 25 bp, Mus musculus
cgggccaagcccattattgctgaga

SEQ ID NO: 95086 - DNA, 25 bp, Mus musculus
cgggccacctggagggacattgctt

SEQ ID NO: 95087 - DNA, 25 bp, Mus musculus
cgggccctcgctgaataaatctgca

SEQ ID NO: 95088 - DNA, 25 bp, Mus musculus
cgggccctgaggacaatttacacga

SEQ ID NO: 95089 - DNA, 25 bp, Mus musculus
cgggccctgtgctatctgaagatgc

SEQ ID NO: 95090 - DNA, 25 bp, Mus musculus
cgggccggaaactggcaagaaagat

SEQ ID NO: 95091 - DNA, 25 bp, Mus musculus
cgggccgttttggacagctgactta

SEQ ID NO: 95092 - DNA, 25 bp, Mus musculus
cgggcctcgacatggaagacgacga

SEQ ID NO: 95093 - DNA, 25 bp, Mus musculus
cgggcctgccggttgagaccattaa

SEQ ID NO: 95094 - DNA, 25 bp, Mus musculus
cgggcctggcagttgtgaactcgaa

SEQ ID NO: 95095 - DNA, 25 bp, Mus musculus
cgggcctggcgcataactacatgga

SEQ ID NO: 95096 - DNA, 25 bp, Mus musculus
cgggcgagttcaagggcaagtacta

SEQ ID NO: 95097 - DNA, 25 bp, Mus musculus
cgggcgcacgtattccagatcgacc

SEQ ID NO: 95098 - DNA, 25 bp, Mus musculus
cgggcgccagagatcatgctaaact

SEQ ID NO: 95099 - DNA, 25 bp, Mus musculus
cgggcgctggtctatggcaaccatg

SEQ ID NO: 95100 - DNA, 25 bp, Mus musculus
cgggcgtcctagtcacctactggtg

SEQ ID NO: 95101 - DNA, 25 bp, Mus musculus
cgggctaccacagctattgtgcgta

SEQ ID NO: 95102 - DNA, 25 bp, Mus musculus
cgggctcatttgtgcagggattctc

SEQ ID NO: 95103 - DNA, 25 bp, Mus musculus
cgggctcctcatactccatcagtgg

SEQ ID NO: 95104 - DNA, 25 bp, Mus musculus
cgggctgcaggaagtacaacgtcaa

SEQ ID NO: 95105 - DNA, 25 bp, Mus musculus
cgggctgcagtctttggccatcagg

SEQ ID NO: 95106 - DNA, 25 bp, Mus musculus
cgggctggcttatacctgcctggcc

SEQ ID NO: 95107 - DNA, 25 bp, Mus musculus
cgggctggggctgtcggccgcaggg

SEQ ID NO: 95108 - DNA, 25 bp, Mus musculus
cgggctggtgcatcttcatctacaa

SEQ ID NO: 95109 - DNA, 25 bp, Mus musculus
cgggcttcggacttgaggatcccaa

SEQ ID NO: 95110 - DNA, 25 bp, Mus musculus
cgggcttctgaatagtgtgacggac

SEQ ID NO: 95111 - DNA, 25 bp, Mus musculus
cgggcttgcactactaccatcagga

SEQ ID NO: 95112 - DNA, 25 bp, Mus musculus
cgggtacagtacactagcagagaca

SEQ ID NO: 95113 - DNA, 25 bp, Mus musculus
cgggtactcatacgccaagaggatg

SEQ ID NO: 95114 - DNA, 25 bp, Mus musculus
cgggtagcgcagactctgggactct

SEQ ID NO: 95115 - DNA, 25 bp, Mus musculus
cgggtatgtgactgtcagtgaaatc

SEQ ID NO: 95116 - DNA, 25 bp, Mus musculus
cgggtcaaggattggtggttcacct

SEQ ID NO: 95117 - DNA, 25 bp, Mus musculus
cgggtcaccatccaggaactcacag

SEQ ID NO: 95118 - DNA, 25 bp, Mus musculus
cgggtccagtgaagcctagaagtca

SEQ ID NO: 95119 - DNA, 25 bp, Mus musculus
cgggtcctcactaagcaaaatgtca

SEQ ID NO: 95120 - DNA, 25 bp, Mus musculus
cgggtcgtttcagccacagaagtgg

SEQ ID NO: 95121 - DNA, 25 bp, Mus musculus
cgggtcttacacagcctctcggaaa

SEQ ID NO: 95122 - DNA, 25 bp, Mus musculus
cgggtcttacacgatccagtctgag

SEQ ID NO: 95123 - DNA, 25 bp, Mus musculus
cgggtgacacacagacttttgcgca

SEQ ID NO: 95124 - DNA, 25 bp, Mus musculus
cgggtgagtcctgttaacattagct

SEQ ID NO: 95125 - DNA, 25 bp, Mus musculus
cgggtggcggactactgtgaaaaca

SEQ ID NO: 95126 - DNA, 25 bp, Mus musculus
cgggtgtacccgctcacccacggcg

SEQ ID NO: 95127 - DNA, 25 bp, Mus musculus
cgggtgtgaaaagccaaacatcagc

SEQ ID NO: 95128 - DNA, 25 bp, Mus musculus
cgggttaggtagacttccctgcagc

SEQ ID NO: 95129 - DNA, 25 bp, Mus musculus
cgggttctgcccttttcacttgtag

SEQ ID NO: 95130 - DNA, 25 bp, Mus musculus
cgggtttctcagctgattgtctcca

SEQ ID NO: 95131 - DNA, 25 bp, Mus musculus
cggtacagggtaaaggacatcatcg

SEQ ID NO: 95132 - DNA, 25 bp, Mus musculus
cggtacgccaataaatgtagttaca

SEQ ID NO: 95133 - DNA, 25 bp, Mus musculus
cggtactttgtgttgagagctcagc

SEQ ID NO: 95134 - DNA, 25 bp, Mus musculus
cggtagaaatctgggaacgtcatca

SEQ ID NO: 95135 - DNA, 25 bp, Mus musculus
cggtagcaaccctaataagccctca

SEQ ID NO: 95136 - DNA, 25 bp, Mus musculus
cggtagcctcgtggaagccttctga

SEQ ID NO: 95137 - DNA, 25 bp, Mus musculus
cggtatatctcccatgtgcctatga

SEQ ID NO: 95138 - DNA, 25 bp, Mus musculus
cggtatgagtctaaggatggagcca

SEQ ID NO: 95139 - DNA, 25 bp, Mus musculus
cggtattttcgaatgccagagctga

SEQ ID NO: 95140 - DNA, 25 bp, Mus musculus
cggtcaacgaatatggcgctcggca

SEQ ID NO: 95141 - DNA, 25 bp, Mus musculus
cggtcactgctggtcgcttcctgag

SEQ ID NO: 95142 - DNA, 25 bp, Mus musculus
cggtcacttcaaccaccagattgca

SEQ ID NO: 95143 - DNA, 25 bp, Mus musculus
cggtcagggtcggaaggagtcggag

SEQ ID NO: 95144 - DNA, 25 bp, Mus musculus
cggtcagtgctgtgccttgtgctca

SEQ ID NO: 95145 - DNA, 25 bp, Mus musculus
cggtccagttgactctgaggtccaa

SEQ ID NO: 95146 - DNA, 25 bp, Mus musculus
cggtccatcagcttccgcagcgaga

SEQ ID NO: 95147 - DNA, 25 bp, Mus musculus
cggtcccggtgagttgccagacaaa

SEQ ID NO: 95148 - DNA, 25 bp, Mus musculus
cggtcccttcggctacattaagaat

SEQ ID NO: 95149 - DNA, 25 bp, Mus musculus
cggtccgagaacagagtggttgtct

SEQ ID NO: 95150 - DNA, 25 bp, Mus musculus
cggtccgcacgccggcgcagtctac

SEQ ID NO: 95151 - DNA, 25 bp, Mus musculus
cggtccttggagaaacgtacgaatg

SEQ ID NO: 95152 - DNA, 25 bp, Mus musculus
cggtcgggcgggtatggaggcggcg

SEQ ID NO: 95153 - DNA, 25 bp, Mus musculus
cggtcgtgtatccagtccgccttag

SEQ ID NO: 95154 - DNA, 25 bp, Mus musculus
cggtctaactagttgctggctccca

SEQ ID NO: 95155 - DNA, 25 bp, Mus musculus
cggtctacctcccagaaatcactat

SEQ ID NO: 95156 - DNA, 25 bp, Mus musculus
cggtctacctgaagctaggaggcaa

SEQ ID NO: 95157 - DNA, 25 bp, Mus musculus
cggtctctgggagggagctctctac

SEQ ID NO: 95158 - DNA, 25 bp, Mus musculus
cggtctttagtttacgagtggcaat

SEQ ID NO: 95159 - DNA, 25 bp, Mus musculus
cggtgaaacttcagcctgcgtaggc

SEQ ID NO: 95160 - DNA, 25 bp, Mus musculus
cggtgaccccagtacaggcagtggt

SEQ ID NO: 95161 - DNA, 25 bp, Mus musculus
cggtgatggcagatagcagtgtcct

SEQ ID NO: 95162 - DNA, 25 bp, Mus musculus
cggtgatgtttcagacagcggcagc

SEQ ID NO: 95163 - DNA, 25 bp, Mus musculus
cggtgattaccccatggcagtgtca

SEQ ID NO: 95164 - DNA, 25 bp, Mus musculus
cggtgcaggaattcaaccgggacct

SEQ ID NO: 95165 - DNA, 25 bp, Mus musculus
cggtgcagggaactacgaaatttct

SEQ ID NO: 95166 - DNA, 25 bp, Mus musculus
cggtgcatctgtaccccggagctgt

SEQ ID NO: 95167 - DNA, 25 bp, Mus musculus
cggtgccaggccaccgggatagtcc

SEQ ID NO: 95168 - DNA, 25 bp, Mus musculus
cggtgctacggatctgggactgtct

SEQ ID NO: 95169 - DNA, 25 bp, Mus musculus
cggtgctggcatctgacatctgtga

SEQ ID NO: 95170 - DNA, 25 bp, Mus musculus
cggtgctggtcaccgccgtgctcat

SEQ ID NO: 95171 - DNA, 25 bp, Mus musculus
cggtggacatgcagacgtacgagct

SEQ ID NO: 95172 - DNA, 25 bp, Mus musculus
cggtggacccaaagcacctgtgact

SEQ ID NO: 95173 - DNA, 25 bp, Mus musculus
cggtggacctgatgcgctacgttca

SEQ ID NO: 95174 - DNA, 25 bp, Mus musculus
cggtggcagaaagagcaagatcgcc

SEQ ID NO: 95175 - DNA, 25 bp, Mus musculus
cggtggcagcaaagagagtatccct

SEQ ID NO: 95176 - DNA, 25 bp, Mus musculus
cggtggcctggctcaaaatggacaa

SEQ ID NO: 95177 - DNA, 25 bp, Mus musculus
cggtggctgtgctacccgcggctca

SEQ ID NO: 95178 - DNA, 25 bp, Mus musculus
cggtgtactcgggtcttagactcca

SEQ ID NO: 95179 - DNA, 25 bp, Mus musculus
cggtgtgctggataattcaggaggg

SEQ ID NO: 95180 - DNA, 25 bp, Mus musculus
cggtgttctgtcatgagctgcccca

SEQ ID NO: 95181 - DNA, 25 bp, Mus musculus
cggtgtttcggcagaggtaacctca

SEQ ID NO: 95182 - DNA, 25 bp, Mus musculus
cggttacaggaatggaaagcactta

SEQ ID NO: 95183 - DNA, 25 bp, Mus musculus
cggttccagttctacttccagcaga

SEQ ID NO: 95184 - DNA, 25 bp, Mus musculus
cggttcctgatcatggctgccgaaa

SEQ ID NO: 95185 - DNA, 25 bp, Mus musculus
cggttcggccgtgtcctgctggtta

SEQ ID NO: 95186 - DNA, 25 bp, Mus musculus
cggttcttagatgacgccttcagga

SEQ ID NO: 95187 - DNA, 25 bp, Mus musculus
cggttgaacccatctgctcagtgaa

SEQ ID NO: 95188 - DNA, 25 bp, Mus musculus
cggttgcaagacgactcagtggaaa

SEQ ID NO: 95189 - DNA, 25 bp, Mus musculus
cggttgcccagccaaagcttcctga

SEQ ID NO: 95190 - DNA, 25 bp, Mus musculus
cggttgcctttgctccgatgaccaa

SEQ ID NO: 95191 - DNA, 25 bp, Mus musculus
cggttgctgtctcccggttccgtga

SEQ ID NO: 95192 - DNA, 25 bp, Mus musculus
cggttggcatcgatttcaaagtaaa

SEQ ID NO: 95193 - DNA, 25 bp, Mus musculus
cggttggctccctgaagctgattga

SEQ ID NO: 95194 - DNA, 25 bp, Mus musculus
cggttgggaacatagtgactggcac

SEQ ID NO: 95195 - DNA, 25 bp, Mus musculus
cggttggtcaatcgcctaaagaaca

SEQ ID NO: 95196 - DNA, 25 bp, Mus musculus
cggtttcttcattcgccggcgcatg

SEQ ID NO: 95197 - DNA, 25 bp, Mus musculus
cggtttggatgtcaccctggtgcac

SEQ ID NO: 95198 - DNA, 25 bp, Mus musculus
cggttttgaagtctacacgcccata

SEQ ID NO: 95199 - DNA, 25 bp, Mus musculus
cgtaaactctttgctgatgccgaag

SEQ ID NO: 95200 - DNA, 25 bp, Mus musculus
cgtaaagtgctatgggcttaaggtc

SEQ ID NO: 95201 - DNA, 25 bp, Mus musculus
cgtaaatggtcatgtcaagcccaga

SEQ ID NO: 95202 - DNA, 25 bp, Mus musculus
cgtaaattagagtggcatcggagca

SEQ ID NO: 95203 - DNA, 25 bp, Mus musculus
cgtaaattgcaatcgattagggatc

SEQ ID NO: 95204 - DNA, 25 bp, Mus musculus
cgtaacaaggatcccactggtggct

SEQ ID NO: 95205 - DNA, 25 bp, Mus musculus
cgtaacagctgcgaaggattcttcc

SEQ ID NO: 95206 - DNA, 25 bp, Mus musculus
cgtaacccagctgctgagaggcagg

SEQ ID NO: 95207 - DNA, 25 bp, Mus musculus
cgtaaccctgtacggcaccgctctc

SEQ ID NO: 95208 - DNA, 25 bp, Mus musculus
cgtaacgcagaatttcgaatgtggc

SEQ ID NO: 95209 - DNA, 25 bp, Mus musculus
cgtaagaagtcgctctcggcatgaa

SEQ ID NO: 95210 - DNA, 25 bp, Mus musculus
cgtaaggagaaaaatcacaaggtct

SEQ ID NO: 95211 - DNA, 25 bp, Mus musculus
cgtaagtgattgtaagctctctcct

SEQ ID NO: 95212 - DNA, 25 bp, Mus musculus
cgtaatgcggacatgatgaagctcc

SEQ ID NO: 95213 - DNA, 25 bp, Mus musculus
cgtacaagctggatgagtgggccct

SEQ ID NO: 95214 - DNA, 25 bp, Mus musculus
cgtacatcctgaaagaagctggcat

SEQ ID NO: 95215 - DNA, 25 bp, Mus musculus
cgtacatgttctgctctaggcggga

SEQ ID NO: 95216 - DNA, 25 bp, Mus musculus
cgtacccgccatgcagagagtctgg

SEQ ID NO: 95217 - DNA, 25 bp, Mus musculus
cgtaccctggagatgagtctgttgc

SEQ ID NO: 95218 - DNA, 25 bp, Mus musculus
cgtaccgcacagatgaatctcagcc

SEQ ID NO: 95219 - DNA, 25 bp, Mus musculus
cgtaccgcagtatgcaggaacttga

SEQ ID NO: 95220 - DNA, 25 bp, Mus musculus
cgtacgagcgcctggcgctgctact

SEQ ID NO: 95221 - DNA, 25 bp, Mus musculus
cgtactcaacatcatcttatgggtg

SEQ ID NO: 95222 - DNA, 25 bp, Mus musculus
cgtactgtctaaaggtgaaggagat

SEQ ID NO: 95223 - DNA, 25 bp, Mus musculus
cgtagaaactgggtaccggctgtca

SEQ ID NO: 95224 - DNA, 25 bp, Mus musculus
cgtagaagaagctcaccccatggat

SEQ ID NO: 95225 - DNA, 25 bp, Mus musculus
cgtagaccatgaggcaggagacctt

SEQ ID NO: 95226 - DNA, 25 bp, Mus musculus
cgtagagaaagtttgtgagatccac

SEQ ID NO: 95227 - DNA, 25 bp, Mus musculus
cgtagatgatcctcgcaagtttgca

SEQ ID NO: 95228 - DNA, 25 bp, Mus musculus
cgtagcaacttcgtgggcggatcct

SEQ ID NO: 95229 - DNA, 25 bp, Mus musculus
cgtagcattaagtgacggagtccac

SEQ ID NO: 95230 - DNA, 25 bp, Mus musculus
cgtagcgccgcctttcggcagaagc

SEQ ID NO: 95231 - DNA, 25 bp, Mus musculus
cgtagctgcttgcatccatcggaca

SEQ ID NO: 95232 - DNA, 25 bp, Mus musculus
cgtagctttgggagcaaacccaggg

SEQ ID NO: 95233 - DNA, 25 bp, Mus musculus
cgtaggcagactgttcacaaaggct

SEQ ID NO: 95234 - DNA, 25 bp, Mus musculus
cgtaggctgtgagtagctccaggcc

SEQ ID NO: 95235 - DNA, 25 bp, Mus musculus
cgtagggttgctttccggcagcgaa

SEQ ID NO: 95236 - DNA, 25 bp, Mus musculus
cgtagtccactcagattccgcgtgt

SEQ ID NO: 95237 - DNA, 25 bp, Mus musculus
cgtagtctgtgatcgctgcctactg

SEQ ID NO: 95238 - DNA, 25 bp, Mus musculus
cgtagtgaaaccgatagagccagtt

SEQ ID NO: 95239 - DNA, 25 bp, Mus musculus
cgtagttgctttgggagccgccgta

SEQ ID NO: 95240 - DNA, 25 bp, Mus musculus
cgtagtttccaccagaaatgctgtg

SEQ ID NO: 95241 - DNA, 25 bp, Mus musculus
cgtatcgtcagaggcttccagaggg

SEQ ID NO: 95242 - DNA, 25 bp, Mus musculus
cgtatgcagcagatggttggccagc

SEQ ID NO: 95243 - DNA, 25 bp, Mus musculus
cgtatgtccgcatgaacttctttgg

SEQ ID NO: 95244 - DNA, 25 bp, Mus musculus
cgtatgtgctcagtgcttccagcag

SEQ ID NO: 95245 - DNA, 25 bp, Mus musculus
cgtatgtgggctactgtgacctcct

SEQ ID NO: 95246 - DNA, 25 bp, Mus musculus
cgtattcagccaaaccggagacagc

SEQ ID NO: 95247 - DNA, 25 bp, Mus musculus
cgtattcagctgactaagtggtaca

SEQ ID NO: 95248 - DNA, 25 bp, Mus musculus
cgtatttctacgaccccgatgtggg

SEQ ID NO: 95249 - DNA, 25 bp, Mus musculus
cgtatttgcaggaggcccgcttgaa

SEQ ID NO: 95250 - DNA, 25 bp, Mus musculus
cgtcaacaaaatcacgcacgaagtg

SEQ ID NO: 95251 - DNA, 25 bp, Mus musculus
cgtcaacacaaggaaaggctctggc

SEQ ID NO: 95252 - DNA, 25 bp, Mus musculus
cgtcaagaatgtataaccgcctgct

SEQ ID NO: 95253 - DNA, 25 bp, Mus musculus
cgtcaagaggaagtccagccgcaat

SEQ ID NO: 95254 - DNA, 25 bp, Mus musculus
cgtcacagacttccagacgcggtca

SEQ ID NO: 95255 - DNA, 25 bp, Mus musculus
cgtcactggccatgctaatgaggaa

SEQ ID NO: 95256 - DNA, 25 bp, Mus musculus
cgtcagaacacatacattatggaca

SEQ ID NO: 95257 - DNA, 25 bp, Mus musculus
cgtcagatcccgtggaaactgggct

SEQ ID NO: 95258 - DNA, 25 bp, Mus musculus
cgtcagcacatgagccgcatgttgt

SEQ ID NO: 95259 - DNA, 25 bp, Mus musculus
cgtcagcagtgactgttccacagct

SEQ ID NO: 95260 - DNA, 25 bp, Mus musculus
cgtcagcagtgtgagcaagaaaggc

SEQ ID NO: 95261 - DNA, 25 bp, Mus musculus
cgtcagctgcttgatttcagccaaa

SEQ ID NO: 95262 - DNA, 25 bp, Mus musculus
cgtcaggaaggcaaaccacagccca

SEQ ID NO: 95263 - DNA, 25 bp, Mus musculus
cgtcagggtcgctctaaggaaggaa

SEQ ID NO: 95264 - DNA, 25 bp, Mus musculus
cgtcagtcccgctgggaagctgtca

SEQ ID NO: 95265 - DNA, 25 bp, Mus musculus
cgtcagtgactgtgttcggccatgt

SEQ ID NO: 95266 - DNA, 25 bp, Mus musculus
cgtcatagacgagtgcacagtgctt

SEQ ID NO: 95267 - DNA, 25 bp, Mus musculus
cgtcatcaacatccatgaacagcag

SEQ ID NO: 95268 - DNA, 25 bp, Mus musculus
cgtcatcatcaaatcacagcaagcc

SEQ ID NO: 95269 - DNA, 25 bp, Mus musculus
cgtcatcgccaagcccccaccggcg

SEQ ID NO: 95270 - DNA, 25 bp, Mus musculus
cgtcatcgccagtggccggtttgaa

SEQ ID NO: 95271 - DNA, 25 bp, Mus musculus
cgtcatcgccgtcacctgtgtggtg

SEQ ID NO: 95272 - DNA, 25 bp, Mus musculus
cgtcatcggaaaccagatcttgcct

SEQ ID NO: 95273 - DNA, 25 bp, Mus musculus
cgtcatgcatccctgcagagactat

SEQ ID NO: 95274 - DNA, 25 bp, Mus musculus
cgtccaccgagattgagctgcctga

SEQ ID NO: 95275 - DNA, 25 bp, Mus musculus
cgtccactgcgagctggcgaaagct

SEQ ID NO: 95276 - DNA, 25 bp, Mus musculus
cgtccagggctgtccgcaggacaat

SEQ ID NO: 95277 - DNA, 25 bp, Mus musculus
cgtccagtacctgaatgtcctaagg

SEQ ID NO: 95278 - DNA, 25 bp, Mus musculus
cgtccagtgctcacgagccactgaa

SEQ ID NO: 95279 - DNA, 25 bp, Mus musculus
cgtccagttcgatgagggattacca

SEQ ID NO: 95280 - DNA, 25 bp, Mus musculus
cgtccatcccggcaagctagatgtg

SEQ ID NO: 95281 - DNA, 25 bp, Mus musculus
cgtccatggacgatgcaggctatta

SEQ ID NO: 95282 - DNA, 25 bp, Mus musculus
cgtccccaaggaactcggtgtgtgt

SEQ ID NO: 95283 - DNA, 25 bp, Mus musculus
cgtcccggcggatgtaggtagctat

SEQ ID NO: 95284 - DNA, 25 bp, Mus musculus
cgtccctaaaatcaaccgctctatg

SEQ ID NO: 95285 - DNA, 25 bp, Mus musculus
cgtccgaggtgggatgcgatgagaa

SEQ ID NO: 95286 - DNA, 25 bp, Mus musculus
cgtccgccaggttctaaataaagag

SEQ ID NO: 95287 - DNA, 25 bp, Mus musculus
cgtccggagtggataggctgcttca

SEQ ID NO: 95288 - DNA, 25 bp, Mus musculus
cgtccgttgcagatgatgaggctgc

SEQ ID NO: 95289 - DNA, 25 bp, Mus musculus
cgtcctacgggaagtggtgaagcac

SEQ ID NO: 95290 - DNA, 25 bp, Mus musculus
cgtcctacgggctctcggccgaggt

SEQ ID NO: 95291 - DNA, 25 bp, Mus musculus
cgtcctagtgcacctgactgagtca

SEQ ID NO: 95292 - DNA, 25 bp, Mus musculus
cgtcctgaataagaaccgcctggtg

SEQ ID NO: 95293 - DNA, 25 bp, Mus musculus
cgtcctgcgtgtctgttaccaacag

SEQ ID NO: 95294 - DNA, 25 bp, Mus musculus
cgtccttggaagaattgcagttgca

SEQ ID NO: 95295 - DNA, 25 bp, Mus musculus
cgtcgcacatggagcgctggaccga

SEQ ID NO: 95296 - DNA, 25 bp, Mus musculus
cgtcgccagcgggaactaaatcgta

SEQ ID NO: 95297 - DNA, 25 bp, Mus musculus
cgtcgccgaggtcgacgcagctcaa

SEQ ID NO: 95298 - DNA, 25 bp, Mus musculus
cgtcgccgcaggattctactttcac

SEQ ID NO: 95299 - DNA, 25 bp, Mus musculus
cgtcgctctcggatgcacaatattc

SEQ ID NO: 95300 - DNA, 25 bp, Mus musculus
cgtcgctggagaaaatatcttcatt

SEQ ID NO: 95301 - DNA, 25 bp, Mus musculus
cgtcggaattttggcgtcacacagg

SEQ ID NO: 95302 - DNA, 25 bp, Mus musculus
cgtcggactgtgtgattgagcccaa

SEQ ID NO: 95303 - DNA, 25 bp, Mus musculus
cgtcgggcaactcaaaaccacctat

SEQ ID NO: 95304 - DNA, 25 bp, Mus musculus
cgtcgtgtccgcaacataaatggca

SEQ ID NO: 95305 - DNA, 25 bp, Mus musculus
cgtcgttgaagtcccactgttggca

SEQ ID NO: 95306 - DNA, 25 bp, Mus musculus
cgtctaagatctcactgaaaaggca

SEQ ID NO: 95307 - DNA, 25 bp, Mus musculus
cgtctagtctatttattgtcgcggg

SEQ ID NO: 95308 - DNA, 25 bp, Mus musculus
cgtctcaaaggaagctaacatctca

SEQ ID NO: 95309 - DNA, 25 bp, Mus musculus
cgtctcaggaactggcggaccttca

SEQ ID NO: 95310 - DNA, 25 bp, Mus musculus
cgtctcagggttgggtgcaagcata

SEQ ID NO: 95311 - DNA, 25 bp, Mus musculus
cgtctccaaggtgcgcttcatgcag

SEQ ID NO: 95312 - DNA, 25 bp, Mus musculus
cgtctccaggtgtatagcagcaggc

SEQ ID NO: 95313 - DNA, 25 bp, Mus musculus
cgtctctggatgtggtagacgagaa

SEQ ID NO: 95314 - DNA, 25 bp, Mus musculus
cgtctgcagcagagaagggaccaac

SEQ ID NO: 95315 - DNA, 25 bp, Mus musculus
cgtctggaagtaggaggtcgcctca

SEQ ID NO: 95316 - DNA, 25 bp, Mus musculus
cgtctggccttgaccatcagttccg

SEQ ID NO: 95317 - DNA, 25 bp, Mus musculus
cgtctgggaagcctggatctcaaag

SEQ ID NO: 95318 - DNA, 25 bp, Mus musculus
cgtctgtcaagaatgtgcccgagaa

SEQ ID NO: 95319 - DNA, 25 bp, Mus musculus
cgtctgtgcctgatctcccaatgga

SEQ ID NO: 95320 - DNA, 25 bp, Mus musculus
cgtctgtggtcgtccggtatccgaa

SEQ ID NO: 95321 - DNA, 25 bp, Mus musculus
cgtctgttccttgcaagcgggtgaa

SEQ ID NO: 95322 - DNA, 25 bp, Mus musculus
cgtcttactggaacaggaaggccta

SEQ ID NO: 95323 - DNA, 25 bp, Mus musculus
cgtcttctgccccaacaaggtggaa

SEQ ID NO: 95324 - DNA, 25 bp, Mus musculus
cgtcttgcttttggagtggctctta

SEQ ID NO: 95325 - DNA, 25 bp, Mus musculus
cgtcttgtgatgtactgctggatga

SEQ ID NO: 95326 - DNA, 25 bp, Mus musculus
cgtctttcggcactgaggagcctgc

SEQ ID NO: 95327 - DNA, 25 bp, Mus musculus
cgtgaaaaatgaagagatcgatgaa

SEQ ID NO: 95328 - DNA, 25 bp, Mus musculus
cgtgaaaactacaacttccagagct

SEQ ID NO: 95329 - DNA, 25 bp, Mus musculus
cgtgaaagacccttgataagaaata

SEQ ID NO: 95330 - DNA, 25 bp, Mus musculus
cgtgaaagtagaaagggagcgccca

SEQ ID NO: 95331 - DNA, 25 bp, Mus musculus
cgtgaaatccaagcgtgtgcgggca

SEQ ID NO: 95332 - DNA, 25 bp, Mus musculus
cgtgaacagttcaaccccgaagtga

SEQ ID NO: 95333 - DNA, 25 bp, Mus musculus
cgtgaacccactcaaacatgctttg

SEQ ID NO: 95334 - DNA, 25 bp, Mus musculus
cgtgaaccctggcaaccctgtgttt

SEQ ID NO: 95335 - DNA, 25 bp, Mus musculus
cgtgaacgaatcctgcgggagatct

SEQ ID NO: 95336 - DNA, 25 bp, Mus musculus
cgtgaagaggctagactcagatcag

SEQ ID NO: 95337 - DNA, 25 bp, Mus musculus
cgtgaagcaaacctgcaagctctga

SEQ ID NO: 95338 - DNA, 25 bp, Mus musculus
cgtgaaggacgaatttaggagacat

SEQ ID NO: 95339 - DNA, 25 bp, Mus musculus
cgtgaaggcctctggaagtgactgc

SEQ ID NO: 95340 - DNA, 25 bp, Mus musculus
cgtgaagtacacaaagctgaatggc

SEQ ID NO: 95341 - DNA, 25 bp, Mus musculus
cgtgaataggatgtgtctggccgct

SEQ ID NO: 95342 - DNA, 25 bp, Mus musculus
cgtgacaaatcaggatgagggcccc

SEQ ID NO: 95343 - DNA, 25 bp, Mus musculus
cgtgacagccatgagactatcgcca

SEQ ID NO: 95344 - DNA, 25 bp, Mus musculus
cgtgaccatgtggatccaacagctt

SEQ ID NO: 95345 - DNA, 25 bp, Mus musculus
cgtgacctttgtgcttttccgtggg

SEQ ID NO: 95346 - DNA, 25 bp, Mus musculus
cgtgaccttttaacgtgaagcctag

SEQ ID NO: 95347 - DNA, 25 bp, Mus musculus
cgtgacgacgtctagggagcgcgcg

SEQ ID NO: 95348 - DNA, 25 bp, Mus musculus
cgtgacgagtgggtctttgccgaca

SEQ ID NO: 95349 - DNA, 25 bp, Mus musculus
cgtgacgccgaagaacagctatgcc

SEQ ID NO: 95350 - DNA, 25 bp, Mus musculus
cgtgactacttccagatggccaggg

SEQ ID NO: 95351 - DNA, 25 bp, Mus musculus
cgtgactgaagagcgcccgactcag

SEQ ID NO: 95352 - DNA, 25 bp, Mus musculus
cgtgagacctcagcaggacactgac

SEQ ID NO: 95353 - DNA, 25 bp, Mus musculus
cgtgagctgcggtgtgatcgccgct

SEQ ID NO: 95354 - DNA, 25 bp, Mus musculus
cgtgaggacttctatcgcaactgga

SEQ ID NO: 95355 - DNA, 25 bp, Mus musculus
cgtgagggaaaacgaactggctctc

SEQ ID NO: 95356 - DNA, 25 bp, Mus musculus
cgtgagtaatcagagagcgccgcga

SEQ ID NO: 95357 - DNA, 25 bp, Mus musculus
cgtgagtcatgttgcacagttgagc

SEQ ID NO: 95358 - DNA, 25 bp, Mus musculus
cgtgataaaaatccgccacctgctg

SEQ ID NO: 95359 - DNA, 25 bp, Mus musculus
cgtgatcaatcgcttacgtgagcag

SEQ ID NO: 95360 - DNA, 25 bp, Mus musculus
cgtgatgatgaatgcaggaaggagg

SEQ ID NO: 95361 - DNA, 25 bp, Mus musculus
cgtgatgggcaacggtctctcccag

SEQ ID NO: 95362 - DNA, 25 bp, Mus musculus
cgtgattgaatctcaggaggaactt

SEQ ID NO: 95363 - DNA, 25 bp, Mus musculus
cgtgatttcttttgagccccaggct

SEQ ID NO: 95364 - DNA, 25 bp, Mus musculus
cgtgcaaaatttcagcgcgttaatg

SEQ ID NO: 95365 - DNA, 25 bp, Mus musculus
cgtgcaaacagtcctccgagggagt

SEQ ID NO: 95366 - DNA, 25 bp, Mus musculus
cgtgcaactgtgagaaacaccctat

SEQ ID NO: 95367 - DNA, 25 bp, Mus musculus
cgtgcaccttgttcgactccggagg

SEQ ID NO: 95368 - DNA, 25 bp, Mus musculus
cgtgcacggcgcagacaatcgtgga

SEQ ID NO: 95369 - DNA, 25 bp, Mus musculus
cgtgcactacgatgggtaaccccaa

SEQ ID NO: 95370 - DNA, 25 bp, Mus musculus
cgtgcactctacttgcaggggtgct

SEQ ID NO: 95371 - DNA, 25 bp, Mus musculus
cgtgcagaacaaagtggtggtcatc

SEQ ID NO: 95372 - DNA, 25 bp, Mus musculus
cgtgcaggcaagaagcatttgtcca

SEQ ID NO: 95373 - DNA, 25 bp, Mus musculus
cgtgcaggtttcgagctgtgctttc

SEQ ID NO: 95374 - DNA, 25 bp, Mus musculus
cgtgcatcctcaatgctcgggggct

SEQ ID NO: 95375 - DNA, 25 bp, Mus musculus
cgtgcatcgacgtgcttggcaggca

SEQ ID NO: 95376 - DNA, 25 bp, Mus musculus
cgtgcatgttgccttccctgtaaat

SEQ ID NO: 95377 - DNA, 25 bp, Mus musculus
cgtgcattcttctgcccctcgtaag

SEQ ID NO: 95378 - DNA, 25 bp, Mus musculus
cgtgccaagtgtgggcttcgataca

SEQ ID NO: 95379 - DNA, 25 bp, Mus musculus
cgtgcccggaggactacaagtacat

SEQ ID NO: 95380 - DNA, 25 bp, Mus musculus
cgtgccctggactcgtgtagcggct

SEQ ID NO: 95381 - DNA, 25 bp, Mus musculus
cgtgccgggcgcttctcctttgctg

SEQ ID NO: 95382 - DNA, 25 bp, Mus musculus
cgtgcctggaaactgagtacctttt

SEQ ID NO: 95383 - DNA, 25 bp, Mus musculus
cgtgcctggcaggagtactgcaagc

SEQ ID NO: 95384 - DNA, 25 bp, Mus musculus
cgtgcgaccgcattaaacagtcagc

SEQ ID NO: 95385 - DNA, 25 bp, Mus musculus
cgtgcgcatcatcaaccgtaaggtg

SEQ ID NO: 95386 - DNA, 25 bp, Mus musculus
cgtgcgcatccgtgaggcttctctg

SEQ ID NO: 95387 - DNA, 25 bp, Mus musculus
cgtgcggcatcgtctcagggaagta

SEQ ID NO: 95388 - DNA, 25 bp, Mus musculus
cgtgcgggactcagacctggacata

SEQ ID NO: 95389 - DNA, 25 bp, Mus musculus
cgtgcgtatgccttttatgccgtcc

SEQ ID NO: 95390 - DNA, 25 bp, Mus musculus
cgtgcgtggagctcgctggaactat

SEQ ID NO: 95391 - DNA, 25 bp, Mus musculus
cgtgcgtttgaagcccgatcttccg

SEQ ID NO: 95392 - DNA, 25 bp, Mus musculus
cgtgctagctgatctttcggacaac

SEQ ID NO: 95393 - DNA, 25 bp, Mus musculus
cgtgctatgtgatgttgtgggccaa

SEQ ID NO: 95394 - DNA, 25 bp, Mus musculus
cgtgctcatgtggaaacagcgcaga

SEQ ID NO: 95395 - DNA, 25 bp, Mus musculus
cgtgctgatcgctcccgagagcgga

SEQ ID NO: 95396 - DNA, 25 bp, Mus musculus
cgtgctggaaatgcaggactcccta

SEQ ID NO: 95397 - DNA, 25 bp, Mus musculus
cgtgctggacccttcctaattcaat

SEQ ID NO: 95398 - DNA, 25 bp, Mus musculus
cgtgctgggcattcctcaggttgga

SEQ ID NO: 95399 - DNA, 25 bp, Mus musculus
cgtgcttgctgaactcctcctggat

SEQ ID NO: 95400 - DNA, 25 bp, Mus musculus
cgtgcttgctgaactgaccgggcag

SEQ ID NO: 95401 - DNA, 25 bp, Mus musculus
cgtgcttggcgccatcctgatgagc

SEQ ID NO: 95402 - DNA, 25 bp, Mus musculus
cgtgctttccttctcctgagcaaga

SEQ ID NO: 95403 - DNA, 25 bp, Mus musculus
cgtggaacccactggagagagcata

SEQ ID NO: 95404 - DNA, 25 bp, Mus musculus
cgtggaaccggccatgcaagtaatc

SEQ ID NO: 95405 - DNA, 25 bp, Mus musculus
cgtggacaaagtctaacgctagtga

SEQ ID NO: 95406 - DNA, 25 bp, Mus musculus
cgtggacagcctcaataaggagcct

SEQ ID NO: 95407 - DNA, 25 bp, Mus musculus
cgtggacatcatcgacaggaacaat

SEQ ID NO: 95408 - DNA, 25 bp, Mus musculus
cgtggacgaatatgacgagaacagt

SEQ ID NO: 95409 - DNA, 25 bp, Mus musculus
cgtggactctgcttcttccgagaaa

SEQ ID NO: 95410 - DNA, 25 bp, Mus musculus
cgtggacttaactcaccatagcaag

SEQ ID NO: 95411 - DNA, 25 bp, Mus musculus
cgtggactttgacctgaccctcaga

SEQ ID NO: 95412 - DNA, 25 bp, Mus musculus
cgtggagaacgtcctcagaggcctt

SEQ ID NO: 95413 - DNA, 25 bp, Mus musculus
cgtggagaagaataatcagctggcc

SEQ ID NO: 95414 - DNA, 25 bp, Mus musculus
cgtggagaagctctccgacggcatc

SEQ ID NO: 95415 - DNA, 25 bp, Mus musculus
cgtggagatcatcactcggaaagat

SEQ ID NO: 95416 - DNA, 25 bp, Mus musculus
cgtggagcaccatttgcctccaggg

SEQ ID NO: 95417 - DNA, 25 bp, Mus musculus
cgtggagctatttcctatgacagtt

SEQ ID NO: 95418 - DNA, 25 bp, Mus musculus
cgtggagctcaagtgcatggagtct

SEQ ID NO: 95419 - DNA, 25 bp, Mus musculus
cgtggaggcctcttataagtgttta

SEQ ID NO: 95420 - DNA, 25 bp, Mus musculus
cgtggagggtccatctcggaagcct

SEQ ID NO: 95421 - DNA, 25 bp, Mus musculus
cgtggagttcacctcgcagagcatt

SEQ ID NO: 95422 - DNA, 25 bp, Mus musculus
cgtggatacacgcaagagcttctgt

SEQ ID NO: 95423 - DNA, 25 bp, Mus musculus
cgtggatacagcgatggcaactcaa

SEQ ID NO: 95424 - DNA, 25 bp, Mus musculus
cgtggatacatggacccaggctgct

SEQ ID NO: 95425 - DNA, 25 bp, Mus musculus
cgtggatgaagacggattgccctca

SEQ ID NO: 95426 - DNA, 25 bp, Mus musculus
cgtggcaaacactttaggagcgcga

SEQ ID NO: 95427 - DNA, 25 bp, Mus musculus
cgtggcaattgcaacagaggagaaa

SEQ ID NO: 95428 - DNA, 25 bp, Mus musculus
cgtggcactcacctagtgaggttac

SEQ ID NO: 95429 - DNA, 25 bp, Mus musculus
cgtggcatacgaggagctgatcaag

SEQ ID NO: 95430 - DNA, 25 bp, Mus musculus
cgtggccaatttcatccgacagcgg

SEQ ID NO: 95431 - DNA, 25 bp, Mus musculus
cgtggccactggacatgggaagtac

SEQ ID NO: 95432 - DNA, 25 bp, Mus musculus
cgtggccagacatttcctctctgaa

SEQ ID NO: 95433 - DNA, 25 bp, Mus musculus
cgtggccgcagcactctgagcgcga

SEQ ID NO: 95434 - DNA, 25 bp, Mus musculus
cgtggctatttctagaagatccggg

SEQ ID NO: 95435 - DNA, 25 bp, Mus musculus
cgtggctgctgcaagaagcgagctt

SEQ ID NO: 95436 - DNA, 25 bp, Mus musculus
cgtggctttactgcagtcacaggaa

SEQ ID NO: 95437 - DNA, 25 bp, Mus musculus
cgtgggccctatccgagatgttcta

SEQ ID NO: 95438 - DNA, 25 bp, Mus musculus
cgtgggctcattgactgacggacaa

SEQ ID NO: 95439 - DNA, 25 bp, Mus musculus
cgtgggctcccttgcatgattcaga

SEQ ID NO: 95440 - DNA, 25 bp, Mus musculus
cgtgggtaccggtgcagcaagctat

SEQ ID NO: 95441 - DNA, 25 bp, Mus musculus
cgtgggtcatggctaaggtggccca

SEQ ID NO: 95442 - DNA, 25 bp, Mus musculus
cgtgggtccaacaccatgagggtct

SEQ ID NO: 95443 - DNA, 25 bp, Mus musculus
cgtgggtggcacagagaacatcctc

SEQ ID NO: 95444 - DNA, 25 bp, Mus musculus
cgtggtccagcattcacaaacctga

SEQ ID NO: 95445 - DNA, 25 bp, Mus musculus
cgtggtccagtgcatgctgcgcttc

SEQ ID NO: 95446 - DNA, 25 bp, Mus musculus
cgtggtcccagtgccgtaagaactt

SEQ ID NO: 95447 - DNA, 25 bp, Mus musculus
cgtggtcccgtgagctgcggtgtga

SEQ ID NO: 95448 - DNA, 25 bp, Mus musculus
cgtggtcggttggagcaaatatgtc

SEQ ID NO: 95449 - DNA, 25 bp, Mus musculus
cgtggtctcccaggcattaagggtc

SEQ ID NO: 95450 - DNA, 25 bp, Mus musculus
cgtggtctgccaggcctaccttatg

SEQ ID NO: 95451 - DNA, 25 bp, Mus musculus
cgtggtgctgtagacatcgatgaca

SEQ ID NO: 95452 - DNA, 25 bp, Mus musculus
cgtggtggccgttaaacggtctcag

SEQ ID NO: 95453 - DNA, 25 bp, Mus musculus
cgtggttatgccttcatcgagtatg

SEQ ID NO: 95454 - DNA, 25 bp, Mus musculus
cgtgtacagatttctcaaccagaca

SEQ ID NO: 95455 - DNA, 25 bp, Mus musculus
cgtgtacagcagacgagcggtgcca

SEQ ID NO: 95456 - DNA, 25 bp, Mus musculus
cgtgtacggcgcaaagggccacttt

SEQ ID NO: 95457 - DNA, 25 bp, Mus musculus
cgtgtactgaggtcgcccagctcca

SEQ ID NO: 95458 - DNA, 25 bp, Mus musculus
cgtgtagtccagaaaggcatccgct

SEQ ID NO: 95459 - DNA, 25 bp, Mus musculus
cgtgtcgggctgttggtattgtggc

SEQ ID NO: 95460 - DNA, 25 bp, Mus musculus
cgtgtcgtgataacaaagactgtac

SEQ ID NO: 95461 - DNA, 25 bp, Mus musculus
cgtgtctctcaaagcgtcagggaga

SEQ ID NO: 95462 - DNA, 25 bp, Mus musculus
cgtgtctgtcttggccgggcacaga

SEQ ID NO: 95463 - DNA, 25 bp, Mus musculus
cgtgtgaaaccggagaacccatgga

SEQ ID NO: 95464 - DNA, 25 bp, Mus musculus
cgtgtgacgcccaggagagcctaga

SEQ ID NO: 95465 - DNA, 25 bp, Mus musculus
cgtgtgatcgctttctggatggagc

SEQ ID NO: 95466 - DNA, 25 bp, Mus musculus
cgtgtgcagaagaaaactttcacca

SEQ ID NO: 95467 - DNA, 25 bp, Mus musculus
cgtgtgcccggcatgtctcattggc

SEQ ID NO: 95468 - DNA, 25 bp, Mus musculus
cgtgtgcctcctagtttaaggtagg

SEQ ID NO: 95469 - DNA, 25 bp, Mus musculus
cgtgtgctgccgaaaccatatgttc

SEQ ID NO: 95470 - DNA, 25 bp, Mus musculus
cgtgtgctgcgctgtggccgccgct

SEQ ID NO: 95471 - DNA, 25 bp, Mus musculus
cgtgtggaaccaagttacagctcat

SEQ ID NO: 95472 - DNA, 25 bp, Mus musculus
cgtgtggaagccaaaaggagctcac

SEQ ID NO: 95473 - DNA, 25 bp, Mus musculus
cgtgtggacagcttgggacagcctc

SEQ ID NO: 95474 - DNA, 25 bp, Mus musculus
cgtgttaaaattgtgtgcagccagc

SEQ ID NO: 95475 - DNA, 25 bp, Mus musculus
cgtgttacagccttagcagattctg

SEQ ID NO: 95476 - DNA, 25 bp, Mus musculus
cgtgttagcatatccccaagagtcc

SEQ ID NO: 95477 - DNA, 25 bp, Mus musculus
cgtgttcagccaaaaaattccagct

SEQ ID NO: 95478 - DNA, 25 bp, Mus musculus
cgtgttctcaggacagagtggagcc

SEQ ID NO: 95479 - DNA, 25 bp, Mus musculus
cgtgttgaccgagcgctaccgacag

SEQ ID NO: 95480 - DNA, 25 bp, Mus musculus
cgtgttgagttcacaagaccgcggt

SEQ ID NO: 95481 - DNA, 25 bp, Mus musculus
cgtgttgggctacctgattcttgaa

SEQ ID NO: 95482 - DNA, 25 bp, Mus musculus
cgtgttgtagactgaactccgtggc

SEQ ID NO: 95483 - DNA, 25 bp, Mus musculus
cgtgttttgaaacaagcccagtgac

SEQ ID NO: 95484 - DNA, 25 bp, Mus musculus
cgtgttttgtcacagatgcccctag

SEQ ID NO: 95485 - DNA, 25 bp, Mus musculus
cgttaaggccaagccggccagcgag

SEQ ID NO: 95486 - DNA, 25 bp, Mus musculus
cgttaattgatgctgtgatgcccga

SEQ ID NO: 95487 - DNA, 25 bp, Mus musculus
cgttacctcgagtgtgcgtcctgca

SEQ ID NO: 95488 - DNA, 25 bp, Mus musculus
cgttacgcttgtgtgataaaactgg

SEQ ID NO: 95489 - DNA, 25 bp, Mus musculus
cgttacggaattgctttgagacatc

SEQ ID NO: 95490 - DNA, 25 bp, Mus musculus
cgttactgcatgcagctggcccaga

SEQ ID NO: 95491 - DNA, 25 bp, Mus musculus
cgttactgggctaacaggcctgtca

SEQ ID NO: 95492 - DNA, 25 bp, Mus musculus
cgttagcggacctgcggctgctctg

SEQ ID NO: 95493 - DNA, 25 bp, Mus musculus
cgttataaatatcccggtgccagcg

SEQ ID NO: 95494 - DNA, 25 bp, Mus musculus
cgttatccaggattctaccatccat

SEQ ID NO: 95495 - DNA, 25 bp, Mus musculus
cgttatgcggtttttccatgaaaca

SEQ ID NO: 95496 - DNA, 25 bp, Mus musculus
cgttatgctgacaactccctcaggg

SEQ ID NO: 95497 - DNA, 25 bp, Mus musculus
cgttatggatgtcttattggcagcc

SEQ ID NO: 95498 - DNA, 25 bp, Mus musculus
cgttattgattgagctgagaggacc

SEQ ID NO: 95499 - DNA, 25 bp, Mus musculus
cgttattgcgggacgaagagctcga

SEQ ID NO: 95500 - DNA, 25 bp, Mus musculus
cgttcaccaccgtgcagaggaagtg

SEQ ID NO: 95501 - DNA, 25 bp, Mus musculus
cgttcacggcagaaggagagctcag

SEQ ID NO: 95502 - DNA, 25 bp, Mus musculus
cgttcactctcaggcccgtggtgga

SEQ ID NO: 95503 - DNA, 25 bp, Mus musculus
cgttcagaacgataccaccatgtgg

SEQ ID NO: 95504 - DNA, 25 bp, Mus musculus
cgttcaggaaacacaggcatcgcta

SEQ ID NO: 95505 - DNA, 25 bp, Mus musculus
cgttccacgtttgcgctgatgagcc

SEQ ID NO: 95506 - DNA, 25 bp, Mus musculus
cgttccactccacccgaagtgatag

SEQ ID NO: 95507 - DNA, 25 bp, Mus musculus
cgttccatctgcagatcggcctgag

SEQ ID NO: 95508 - DNA, 25 bp, Mus musculus
cgttccctgggcattcgagtggtga

SEQ ID NO: 95509 - DNA, 25 bp, Mus musculus
cgttccggaactcaaagcagatgta

SEQ ID NO: 95510 - DNA, 25 bp, Mus musculus
cgttcctagccgagaagtgtcctgg

SEQ ID NO: 95511 - DNA, 25 bp, Mus musculus
cgttcctcagcgtcatcgtgctctt

SEQ ID NO: 95512 - DNA, 25 bp, Mus musculus
cgttcctgtgttgttatgtagtgga

SEQ ID NO: 95513 - DNA, 25 bp, Mus musculus
cgttccttccgatgacagtgctcta

SEQ ID NO: 95514 - DNA, 25 bp, Mus musculus
cgttcgacatcatgcgggaggccga

SEQ ID NO: 95515 - DNA, 25 bp, Mus musculus
cgttcgagccctatatttccatgga

SEQ ID NO: 95516 - DNA, 25 bp, Mus musculus
cgttcgcaggaagcatacattggct

SEQ ID NO: 95517 - DNA, 25 bp, Mus musculus
cgttcgcctggccaacatcatgaaa

SEQ ID NO: 95518 - DNA, 25 bp, Mus musculus
cgttcgttcttctgcgggctacaag

SEQ ID NO: 95519 - DNA, 25 bp, Mus musculus
cgttctactgcgacgtggaatgtca

SEQ ID NO: 95520 - DNA, 25 bp, Mus musculus
cgttctatggactcaagcaggtgga

SEQ ID NO: 95521 - DNA, 25 bp, Mus musculus
cgttctcagagatatcagccctgcg

SEQ ID NO: 95522 - DNA, 25 bp, Mus musculus
cgttctcctggtagtacgccatcgc

SEQ ID NO: 95523 - DNA, 25 bp, Mus musculus
cgttctcgacggagacctgcaggtg

SEQ ID NO: 95524 - DNA, 25 bp, Mus musculus
cgttctggacacaaaatcaactctg

SEQ ID NO: 95525 - DNA, 25 bp, Mus musculus
cgttctgtcgtgatgcccatggaga

SEQ ID NO: 95526 - DNA, 25 bp, Mus musculus
cgttcttcccttggtcacagctaaa

SEQ ID NO: 95527 - DNA, 25 bp, Mus musculus
cgttgacaaacaaactctgaagtgt

SEQ ID NO: 95528 - DNA, 25 bp, Mus musculus
cgttgacaaggacacacccgaacga

SEQ ID NO: 95529 - DNA, 25 bp, Mus musculus
cgttgactgagctacgcgagaagcg

SEQ ID NO: 95530 - DNA, 25 bp, Mus musculus
cgttgagtccatatttaaactggcc

SEQ ID NO: 95531 - DNA, 25 bp, Mus musculus
cgttgatgctctcccagtgcgcgct

SEQ ID NO: 95532 - DNA, 25 bp, Mus musculus
cgttgcaactactgaagactttatg

SEQ ID NO: 95533 - DNA, 25 bp, Mus musculus
cgttgcagggcacgcggactttctt

SEQ ID NO: 95534 - DNA, 25 bp, Mus musculus
cgttgcagtggtgccgcgtgggaca

SEQ ID NO: 95535 - DNA, 25 bp, Mus musculus
cgttgcagttttgagtcccgcctat

SEQ ID NO: 95536 - DNA, 25 bp, Mus musculus
cgttgccaggttataacgtagaggg

SEQ ID NO: 95537 - DNA, 25 bp, Mus musculus
cgttgccgcttcctgcacgatgtgg

SEQ ID NO: 95538 - DNA, 25 bp, Mus musculus
cgttgccggataccagacaccgtga

SEQ ID NO: 95539 - DNA, 25 bp, Mus musculus
cgttgcgagattgcagctgtagtcg

SEQ ID NO: 95540 - DNA, 25 bp, Mus musculus
cgttgcggaagctgcggaagtacat

SEQ ID NO: 95541 - DNA, 25 bp, Mus musculus
cgttgcggaggcacccgaagcagcc

SEQ ID NO: 95542 - DNA, 25 bp, Mus musculus
cgttgcggctgagctcgtgtgcggc

SEQ ID NO: 95543 - DNA, 25 bp, Mus musculus
cgttggaaaacgcacctattggaca

SEQ ID NO: 95544 - DNA, 25 bp, Mus musculus
cgttggaatctgtcttcgcgcccca

SEQ ID NO: 95545 - DNA, 25 bp, Mus musculus
cgttggatcgtttcatacgttacgc

SEQ ID NO: 95546 - DNA, 25 bp, Mus musculus
cgttggcaccctcaaacatgaaagg

SEQ ID NO: 95547 - DNA, 25 bp, Mus musculus
cgttggcgagttcctcgaagtcaca

SEQ ID NO: 95548 - DNA, 25 bp, Mus musculus
cgttggtctggaactgcctactgca

SEQ ID NO: 95549 - DNA, 25 bp, Mus musculus
cgttgtaccatcaagccgtcaggca

SEQ ID NO: 95550 - DNA, 25 bp, Mus musculus
cgttgtctctaaagtatacacatgg

SEQ ID NO: 95551 - DNA, 25 bp, Mus musculus
cgttgtgagcgataaggaccctgct

SEQ ID NO: 95552 - DNA, 25 bp, Mus musculus
cgttgtgtagcgtctctggaggcca

SEQ ID NO: 95553 - DNA, 25 bp, Mus musculus
cgtttaagtctagcgtgtcccatgc

SEQ ID NO: 95554 - DNA, 25 bp, Mus musculus
cgtttaatgctacggccgaactgga

SEQ ID NO: 95555 - DNA, 25 bp, Mus musculus
cgtttacagaacagactccaagtgg

SEQ ID NO: 95556 - DNA, 25 bp, Mus musculus
cgtttacctttggtatagagagcca

SEQ ID NO: 95557 - DNA, 25 bp, Mus musculus
cgtttactttggtgacagcatgcat

SEQ ID NO: 95558 - DNA, 25 bp, Mus musculus
cgtttatcatggtctccggaggcgg

SEQ ID NO: 95559 - DNA, 25 bp, Mus musculus
cgtttcaggcctacttggatgactg

SEQ ID NO: 95560 - DNA, 25 bp, Mus musculus
cgtttcccaacagaggaccatctga

SEQ ID NO: 95561 - DNA, 25 bp, Mus musculus
cgtttcgaggtcaacatcagcgagc

SEQ ID NO: 95562 - DNA, 25 bp, Mus musculus
cgtttctccgagaaagctgccagcc

SEQ ID NO: 95563 - DNA, 25 bp, Mus musculus
cgtttctgagacacccgactatgtg

SEQ ID NO: 95564 - DNA, 25 bp, Mus musculus
cgtttcttccgacaagaggcagaag

SEQ ID NO: 95565 - DNA, 25 bp, Mus musculus
cgtttcttggaatcggactgtgggc

SEQ ID NO: 95566 - DNA, 25 bp, Mus musculus
cgtttgaagagagggataaatgtcc

SEQ ID NO: 95567 - DNA, 25 bp, Mus musculus
cgtttgacatggatctgacctcgga

SEQ ID NO: 95568 - DNA, 25 bp, Mus musculus
cgtttgagtgtgagcccaatcgcca

SEQ ID NO: 95569 - DNA, 25 bp, Mus musculus
cgtttgatgactacattgcctgctg

SEQ ID NO: 95570 - DNA, 25 bp, Mus musculus
cgtttgcacatgaaggaccaccact

SEQ ID NO: 95571 - DNA, 25 bp, Mus musculus
cgtttgccagaaaagactaggttca

SEQ ID NO: 95572 - DNA, 25 bp, Mus musculus
cgtttgccgaaaccctgtatcctga

SEQ ID NO: 95573 - DNA, 25 bp, Mus musculus
cgtttgcctagatgtgtctgaccca

SEQ ID NO: 95574 - DNA, 25 bp, Mus musculus
cgtttgcgtgtgtgttggtgcctct

SEQ ID NO: 95575 - DNA, 25 bp, Mus musculus
cgtttggaaaacgaagcagaagccg

SEQ ID NO: 95576 - DNA, 25 bp, Mus musculus
cgtttggaagctgcaacacacggga

SEQ ID NO: 95577 - DNA, 25 bp, Mus musculus
cgtttggaagtaagcagcctcgccc

SEQ ID NO: 95578 - DNA, 25 bp, Mus musculus
cgtttgggaagagtcaccgcgatcc

SEQ ID NO: 95579 - DNA, 25 bp, Mus musculus
cgtttgtgacgtcctacccattggg

SEQ ID NO: 95580 - DNA, 25 bp, Mus musculus
cgtttgtgatgctaccctgtggcgg

SEQ ID NO: 95581 - DNA, 25 bp, Mus musculus
cgtttgttcaagtgtgccataggca

SEQ ID NO: 95582 - DNA, 25 bp, Mus musculus
cgttttatttacaggccagctgcga

SEQ ID NO: 95583 - DNA, 25 bp, Mus musculus
cgttttcagcaatagggtcttcaca

SEQ ID NO: 95584 - DNA, 25 bp, Mus musculus
cgttttccagaacggcctgggctgc

SEQ ID NO: 95585 - DNA, 25 bp, Mus musculus
ctaaaaccagtcaatctacacaggg

SEQ ID NO: 95586 - DNA, 25 bp, Mus musculus
ctaaaaccatagaggcacccaaggg

SEQ ID NO: 95587 - DNA, 25 bp, Mus musculus
ctaaaacgctttgaggaggtcgact

SEQ ID NO: 95588 - DNA, 25 bp, Mus musculus
ctaaaactagacatgctccagaggg

SEQ ID NO: 95589 - DNA, 25 bp, Mus musculus
ctaaaactgctgcaggagggcccca

SEQ ID NO: 95590 - DNA, 25 bp, Mus musculus
ctaaaagacttgatcagccccaggc

SEQ ID NO: 95591 - DNA, 25 bp, Mus musculus
ctaaaattgaaaagtaaatggatgg

SEQ ID NO: 95592 - DNA, 25 bp, Mus musculus
ctaaacaacttgtgctcctggaagc

SEQ ID NO: 95593 - DNA, 25 bp, Mus musculus
ctaaacctccttgagcagtaacagg

SEQ ID NO: 95594 - DNA, 25 bp, Mus musculus
ctaaagaacacagaaatggtcatca

SEQ ID NO: 95595 - DNA, 25 bp, Mus musculus
ctaaagaagatagaaagaattccag

SEQ ID NO: 95596 - DNA, 25 bp, Mus musculus
ctaaagaatatgatcttgctaaaaa

SEQ ID NO: 95597 - DNA, 25 bp, Mus musculus
ctaaagaccgcggagagacttcggg

SEQ ID NO: 95598 - DNA, 25 bp, Mus musculus
ctaaagatgcggaagcagttcggca

SEQ ID NO: 95599 - DNA, 25 bp, Mus musculus
ctaaagcagcttggtcacagtgtgg

SEQ ID NO: 95600 - DNA, 25 bp, Mus musculus
ctaaagccagtgatgtgaagagacc

SEQ ID NO: 95601 - DNA, 25 bp, Mus musculus
ctaaaggaggagctatacaaagccc

SEQ ID NO: 95602 - DNA, 25 bp, Mus musculus
ctaaatagtgacgtggtggaaccca

SEQ ID NO: 95603 - DNA, 25 bp, Mus musculus
ctaaattacagtcgccgccattgcc

SEQ ID NO: 95604 - DNA, 25 bp, Mus musculus
ctaaattctggcttggcggcggttc

SEQ ID NO: 95605 - DNA, 25 bp, Mus musculus
ctaacaaaggccaagtagattcggc

SEQ ID NO: 95606 - DNA, 25 bp, Mus musculus
ctaacaaatacaacttctcctttga

SEQ ID NO: 95607 - DNA, 25 bp, Mus musculus
ctaacagcaggcgagaggatctctc

SEQ ID NO: 95608 - DNA, 25 bp, Mus musculus
ctaacagggatcaaccagacaggtg

SEQ ID NO: 95609 - DNA, 25 bp, Mus musculus
ctaacatgatctaaaggagcgggac

SEQ ID NO: 95610 - DNA, 25 bp, Mus musculus
ctaaccacagcagcgaggtgctgtg

SEQ ID NO: 95611 - DNA, 25 bp, Mus musculus
ctaacgagctagatcctgaactggg

SEQ ID NO: 95612 - DNA, 25 bp, Mus musculus
ctaacggagagaccccatcgtggcg

SEQ ID NO: 95613 - DNA, 25 bp, Mus musculus
ctaactaccaggaccaagtgtgccg

SEQ ID NO: 95614 - DNA, 25 bp, Mus musculus
ctaactctgagagcgtacgtggact

SEQ ID NO: 95615 - DNA, 25 bp, Mus musculus
ctaactgttgcctggctccggcgaa

SEQ ID NO: 95616 - DNA, 25 bp, Mus musculus
ctaacttataggaatgggtgggatc

SEQ ID NO: 95617 - DNA, 25 bp, Mus musculus
ctaagacagcgaaggaagaggctga

SEQ ID NO: 95618 - DNA, 25 bp, Mus musculus
ctaagactgagcactgaccctcagc

SEQ ID NO: 95619 - DNA, 25 bp, Mus musculus
ctaagagcgcagaggtcaagctggc

SEQ ID NO: 95620 - DNA, 25 bp, Mus musculus
ctaagaggcaccactttcagcggca

SEQ ID NO: 95621 - DNA, 25 bp, Mus musculus
ctaagcagggattcctaatgcaact

SEQ ID NO: 95622 - DNA, 25 bp, Mus musculus
ctaagccagacactcagcagatgat

SEQ ID NO: 95623 - DNA, 25 bp, Mus musculus
ctaagctgcctcgtagcctgcggat

SEQ ID NO: 95624 - DNA, 25 bp, Mus musculus
ctaagcttcgggagaccaatgcggg

SEQ ID NO: 95625 - DNA, 25 bp, Mus musculus
ctaagcttgctttgcagggcagaca

SEQ ID NO: 95626 - DNA, 25 bp, Mus musculus
ctaaggaaaggaaagtgcagcaccc

SEQ ID NO: 95627 - DNA, 25 bp, Mus musculus
ctaaggactctctcctgcatgggaa

SEQ ID NO: 95628 - DNA, 25 bp, Mus musculus
ctaaggccgagagtgacaaccgtca

SEQ ID NO: 95629 - DNA, 25 bp, Mus musculus
ctaaggcctagcgagtacagagtgc

SEQ ID NO: 95630 - DNA, 25 bp, Mus musculus
ctaaggcctctctgtgtgaacccca

SEQ ID NO: 95631 - DNA, 25 bp, Mus musculus
ctaagggcagcaaggaacatttcac

SEQ ID NO: 95632 - DNA, 25 bp, Mus musculus
ctaagggttaccctatatcatacca

SEQ ID NO: 95633 - DNA, 25 bp, Mus musculus
ctaagtggcttactgctggagagca

SEQ ID NO: 95634 - DNA, 25 bp, Mus musculus
ctaagtgtcctgacagaagaccggc

SEQ ID NO: 95635 - DNA, 25 bp, Mus musculus
ctaagttagaggtagccgtagctgg

SEQ ID NO: 95636 - DNA, 25 bp, Mus musculus
ctaagtttcttagctccggaccgcg

SEQ ID NO: 95637 - DNA, 25 bp, Mus musculus
ctaatagagaaaaactcccagctgg

SEQ ID NO: 95638 - DNA, 25 bp, Mus musculus
ctaatcaaaggccttcagagactgg

SEQ ID NO: 95639 - DNA, 25 bp, Mus musculus
ctaatcatgatggaaggactgctcc

SEQ ID NO: 95640 - DNA, 25 bp, Mus musculus
ctaatgacagctgtgagaatgcacc

SEQ ID NO: 95641 - DNA, 25 bp, Mus musculus
ctaatgagcaaggagggcttccggc

SEQ ID NO: 95642 - DNA, 25 bp, Mus musculus
ctaatgagcgagtgaagcagctgct

SEQ ID NO: 95643 - DNA, 25 bp, Mus musculus
ctaatgagctatgaagttccggaat

SEQ ID NO: 95644 - DNA, 25 bp, Mus musculus
ctaatggacaccagggagagccggt

SEQ ID NO: 95645 - DNA, 25 bp, Mus musculus
ctaatggcatgtaggagcaaacccc

SEQ ID NO: 95646 - DNA, 25 bp, Mus musculus
ctaatggcccatgcgctgaagcgca

SEQ ID NO: 95647 - DNA, 25 bp, Mus musculus
ctaatggccttggtgagcgactcgg

SEQ ID NO: 95648 - DNA, 25 bp, Mus musculus
ctaatggttctgtcaaggaaggccc

SEQ ID NO: 95649 - DNA, 25 bp, Mus musculus
ctaattaagtttctggcacctggct

SEQ ID NO: 95650 - DNA, 25 bp, Mus musculus
ctaattctgctgagctgtgcctgga

SEQ ID NO: 95651 - DNA, 25 bp, Mus musculus
ctaattgggcacgaaggtcctggaa

SEQ ID NO: 95652 - DNA, 25 bp, Mus musculus
ctacaaacgcggtggaggacagctt

SEQ ID NO: 95653 - DNA, 25 bp, Mus musculus
ctacaaactgctcagcactgaagga

SEQ ID NO: 95654 - DNA, 25 bp, Mus musculus
ctacaaggagactgggcgaaccaca

SEQ ID NO: 95655 - DNA, 25 bp, Mus musculus
ctacaataccggcagagtgggagca

SEQ ID NO: 95656 - DNA, 25 bp, Mus musculus
ctacaatgttggctgtggtcctgga

SEQ ID NO: 95657 - DNA, 25 bp, Mus musculus
ctacacaaagggagacctagacttt

SEQ ID NO: 95658 - DNA, 25 bp, Mus musculus
ctacacaaatagaatgcgcggcggg

SEQ ID NO: 95659 - DNA, 25 bp, Mus musculus
ctacacagacaggtgctccaagggc

SEQ ID NO: 95660 - DNA, 25 bp, Mus musculus
ctacacagggatgtccggtggctcc

SEQ ID NO: 95661 - DNA, 25 bp, Mus musculus
ctacaccggcgagaggctgaggtca

SEQ ID NO: 95662 - DNA, 25 bp, Mus musculus
ctacacgaatctggagcgggtggcc

SEQ ID NO: 95663 - DNA, 25 bp, Mus musculus
ctacagaaccgtggtgagacccttg

SEQ ID NO: 95664 - DNA, 25 bp, Mus musculus
ctacagaccacgtgatccggaggga

SEQ ID NO: 95665 - DNA, 25 bp, Mus musculus
ctacagatgttaggcagtgggcaac

SEQ ID NO: 95666 - DNA, 25 bp, Mus musculus
ctacaggatctcgagtcacagccag

SEQ ID NO: 95667 - DNA, 25 bp, Mus musculus
ctacaggatgaaacggcagaggccc

SEQ ID NO: 95668 - DNA, 25 bp, Mus musculus
ctacaggctgacgttccgggcaaat

SEQ ID NO: 95669 - DNA, 25 bp, Mus musculus
ctacagggcgcggactgctgcagct

SEQ ID NO: 95670 - DNA, 25 bp, Mus musculus
ctacagtacccttcgagcacatgaa

SEQ ID NO: 95671 - DNA, 25 bp, Mus musculus
ctacagtatgctggccagaggaccc

SEQ ID NO: 95672 - DNA, 25 bp, Mus musculus
ctacagtgagatcggcacaaaaggc

SEQ ID NO: 95673 - DNA, 25 bp, Mus musculus
ctacagttgtctagtcttgggcacc

SEQ ID NO: 95674 - DNA, 25 bp, Mus musculus
ctacatagagcagcgcctggacacg

SEQ ID NO: 95675 - DNA, 25 bp, Mus musculus
ctacatccagtgaggcagagcagcc

SEQ ID NO: 95676 - DNA, 25 bp, Mus musculus
ctacatcctcatctttcttactggg

SEQ ID NO: 95677 - DNA, 25 bp, Mus musculus
ctacatctagaagagaaccggctga

SEQ ID NO: 95678 - DNA, 25 bp, Mus musculus
ctacatcttggtggccggccttgca

SEQ ID NO: 95679 - DNA, 25 bp, Mus musculus
ctacatggcgcaggtgatggccccg

SEQ ID NO: 95680 - DNA, 25 bp, Mus musculus
ctacatgttcctgggcgaggtggcc

SEQ ID NO: 95681 - DNA, 25 bp, Mus musculus
ctaccaaggtagatgcagctgaggg

SEQ ID NO: 95682 - DNA, 25 bp, Mus musculus
ctaccaagttggcttgatccccagt

SEQ ID NO: 95683 - DNA, 25 bp, Mus musculus
ctaccagctgaagccgcagtggaaa

SEQ ID NO: 95684 - DNA, 25 bp, Mus musculus
ctacccagcaggagacgtgtttcag

SEQ ID NO: 95685 - DNA, 25 bp, Mus musculus
ctacccggtcaaaggatgctgagtc

SEQ ID NO: 95686 - DNA, 25 bp, Mus musculus
ctacccggtgggagagaagcttcgc

SEQ ID NO: 95687 - DNA, 25 bp, Mus musculus
ctaccctctgcctgtggggacggag

SEQ ID NO: 95688 - DNA, 25 bp, Mus musculus
ctaccctggataagagctgcccctt

SEQ ID NO: 95689 - DNA, 25 bp, Mus musculus
ctaccgagtgtctggagtggccaca

SEQ ID NO: 95690 - DNA, 25 bp, Mus musculus
ctaccgagttcgtcatgcgggcgct

SEQ ID NO: 95691 - DNA, 25 bp, Mus musculus
ctaccgatgctctgctgtgcgtggc

SEQ ID NO: 95692 - DNA, 25 bp, Mus musculus
ctaccggtcctcaaggcccgattgg

SEQ ID NO: 95693 - DNA, 25 bp, Mus musculus
ctaccgtgaaggaggcaaagattcg

SEQ ID NO: 95694 - DNA, 25 bp, Mus musculus
ctacgactactttgcccagcagaca

SEQ ID NO: 95695 - DNA, 25 bp, Mus musculus
ctacgagtgtctgagtgccagcggc

SEQ ID NO: 95696 - DNA, 25 bp, Mus musculus
ctacgcagttagatcagttgttccg

SEQ ID NO: 95697 - DNA, 25 bp, Mus musculus
ctacggccggccgaggctgatcttt

SEQ ID NO: 95698 - DNA, 25 bp, Mus musculus
ctacgggcgcagatgtacgagacat

SEQ ID NO: 95699 - DNA, 25 bp, Mus musculus
ctacgggtgtttggccttgctgcga

SEQ ID NO: 95700 - DNA, 25 bp, Mus musculus
ctacgtatattaatgtgcaagagag

SEQ ID NO: 95701 - DNA, 25 bp, Mus musculus
ctactaagagtctgctggacacacc

SEQ ID NO: 95702 - DNA, 25 bp, Mus musculus
ctactacattcaccaaatgttgggc

SEQ ID NO: 95703 - DNA, 25 bp, Mus musculus
ctactactggtatggacttgatgca

SEQ ID NO: 95704 - DNA, 25 bp, Mus musculus
ctactatgaggcttcgggcacggct

SEQ ID NO: 95705 - DNA, 25 bp, Mus musculus
ctactatggcggctggcacgagcat

SEQ ID NO: 95706 - DNA, 25 bp, Mus musculus
ctactatgtgggagtagccagtgat

SEQ ID NO: 95707 - DNA, 25 bp, Mus musculus
ctactctgacgaagacaagcgcggc

SEQ ID NO: 95708 - DNA, 25 bp, Mus musculus
ctactgatgtcatgagtaacacgac

SEQ ID NO: 95709 - DNA, 25 bp, Mus musculus
ctactgcaagatggtgctccacggc

SEQ ID NO: 95710 - DNA, 25 bp, Mus musculus
ctactgcggctttatttgggacgga

SEQ ID NO: 95711 - DNA, 25 bp, Mus musculus
ctactggagaatgatgaggtggaac

SEQ ID NO: 95712 - DNA, 25 bp, Mus musculus
ctactggggccacccgtcatggcag

SEQ ID NO: 95713 - DNA, 25 bp, Mus musculus
ctactggttttctcgggatgggctc

SEQ ID NO: 95714 - DNA, 25 bp, Mus musculus
ctactgttctacaccaggaaagttc

SEQ ID NO: 95715 - DNA, 25 bp, Mus musculus
ctacttatatagatccacgaacggg

SEQ ID NO: 95716 - DNA, 25 bp, Mus musculus
ctacttcattggtggctgcgcggga

SEQ ID NO: 95717 - DNA, 25 bp, Mus musculus
ctacttggagttggacatctgacac

SEQ ID NO: 95718 - DNA, 25 bp, Mus musculus
ctagaaaatgcccaagctcaacttg

SEQ ID NO: 95719 - DNA, 25 bp, Mus musculus
ctagaaagcccggagaagactggaa

SEQ ID NO: 95720 - DNA, 25 bp, Mus musculus
ctagaacaacggatcaactttggtc

SEQ ID NO: 95721 - DNA, 25 bp, Mus musculus
ctagaaccccgagcgtggtcggttg

SEQ ID NO: 95722 - DNA, 25 bp, Mus musculus
ctagaactgatggagcttgtgcccc

SEQ ID NO: 95723 - DNA, 25 bp, Mus musculus
ctagaagcccagatgcgcagagtga

SEQ ID NO: 95724 - DNA, 25 bp, Mus musculus
ctagaatcaaggaaaaggagggagc

SEQ ID NO: 95725 - DNA, 25 bp, Mus musculus
ctagacaaggagttgctgtggaacc

SEQ ID NO: 95726 - DNA, 25 bp, Mus musculus
ctagaccaggacaagattgaggccc

SEQ ID NO: 95727 - DNA, 25 bp, Mus musculus
ctagactactgtcccagcacacgtg

SEQ ID NO: 95728 - DNA, 25 bp, Mus musculus
ctagactttgcagcgtggaacacgg

SEQ ID NO: 95729 - DNA, 25 bp, Mus musculus
ctagagaacgtccttatgtcctggg

SEQ ID NO: 95730 - DNA, 25 bp, Mus musculus
ctagagaggcttgagacagaaactt

SEQ ID NO: 95731 - DNA, 25 bp, Mus musculus
ctagagatgggagctgtcaagaacc

SEQ ID NO: 95732 - DNA, 25 bp, Mus musculus
ctagagcggcttgtcactgagtacc

SEQ ID NO: 95733 - DNA, 25 bp, Mus musculus
ctagagcggtgcaggaagtgtccca

SEQ ID NO: 95734 - DNA, 25 bp, Mus musculus
ctagagctagcttctgaccaccacg

SEQ ID NO: 95735 - DNA, 25 bp, Mus musculus
ctagagggcccaatacagtcaattc

SEQ ID NO: 95736 - DNA, 25 bp, Mus musculus
ctagaggttggcacaaagctggacc

SEQ ID NO: 95737 - DNA, 25 bp, Mus musculus
ctagagtctggcacactgggcacaa

SEQ ID NO: 95738 - DNA, 25 bp, Mus musculus
ctagagtggcctttctggacgaagc

SEQ ID NO: 95739 - DNA, 25 bp, Mus musculus
ctagagttgtctggtggagcccgca

SEQ ID NO: 95740 - DNA, 25 bp, Mus musculus
ctagatcctgcacgttggaaccggg

SEQ ID NO: 95741 - DNA, 25 bp, Mus musculus
ctagatgcctcaccgcaaggagcgg

SEQ ID NO: 95742 - DNA, 25 bp, Mus musculus
ctagatttggtcagatcgagaggca

SEQ ID NO: 95743 - DNA, 25 bp, Mus musculus
ctagcaaaaaagtatggccctgtgt

SEQ ID NO: 95744 - DNA, 25 bp, Mus musculus
ctagcagacagcgagaatgagagga

SEQ ID NO: 95745 - DNA, 25 bp, Mus musculus
ctagcagccacatagagacccgggc

SEQ ID NO: 95746 - DNA, 25 bp, Mus musculus
ctagccacagggatgagcctcgtgc

SEQ ID NO: 95747 - DNA, 25 bp, Mus musculus
ctagccagcaagagtacaaagtgtc

SEQ ID NO: 95748 - DNA, 25 bp, Mus musculus
ctagccctagaaggcaggcccttga

SEQ ID NO: 95749 - DNA, 25 bp, Mus musculus
ctagccgaccgggaagtagctgaag

SEQ ID NO: 95750 - DNA, 25 bp, Mus musculus
ctagccggactctgcaggccgggct

SEQ ID NO: 95751 - DNA, 25 bp, Mus musculus
ctagcgagggctttgagacggccga

SEQ ID NO: 95752 - DNA, 25 bp, Mus musculus
ctagctcctgtaagttcagtcccca

SEQ ID NO: 95753 - DNA, 25 bp, Mus musculus
ctagctgggctctgcttgagacggc

SEQ ID NO: 95754 - DNA, 25 bp, Mus musculus
ctagcttggaagaggaagagccacc

SEQ ID NO: 95755 - DNA, 25 bp, Mus musculus
ctaggaataaagttatcagactccc

SEQ ID NO: 95756 - DNA, 25 bp, Mus musculus
ctaggagaaccagctgtaacagatg

SEQ ID NO: 95757 - DNA, 25 bp, Mus musculus
ctaggcagtgccagccctgaagagg

SEQ ID NO: 95758 - DNA, 25 bp, Mus musculus
ctaggccagggcagaagtcaaatga

SEQ ID NO: 95759 - DNA, 25 bp, Mus musculus
ctaggctggctgagacccgggcctt

SEQ ID NO: 95760 - DNA, 25 bp, Mus musculus
ctagggagccccttgtgcagatgct

SEQ ID NO: 95761 - DNA, 25 bp, Mus musculus
ctagggcccaaagaccaagagtgcg

SEQ ID NO: 95762 - DNA, 25 bp, Mus musculus
ctagggcccttgacgctgaggacaa

SEQ ID NO: 95763 - DNA, 25 bp, Mus musculus
ctagggcgcgactggaaacgtactc

SEQ ID NO: 95764 - DNA, 25 bp, Mus musculus
ctagggtcactagagctaagcttgc

SEQ ID NO: 95765 - DNA, 25 bp, Mus musculus
ctagggtcaggagtgcgccgctttt

SEQ ID NO: 95766 - DNA, 25 bp, Mus musculus
ctaggtggaggttcagcattggatc

SEQ ID NO: 95767 - DNA, 25 bp, Mus musculus
ctagtagtctgtataaagtcacaac

SEQ ID NO: 95768 - DNA, 25 bp, Mus musculus
ctagtagtgaaggaacggaatcgca

SEQ ID NO: 95769 - DNA, 25 bp, Mus musculus
ctagtcctctctgggtttctggcca

SEQ ID NO: 95770 - DNA, 25 bp, Mus musculus
ctagtcctgggtccatgatgtacgc

SEQ ID NO: 95771 - DNA, 25 bp, Mus musculus
ctagtcctggtacccttgctttcca

SEQ ID NO: 95772 - DNA, 25 bp, Mus musculus
ctagtcggaatgaggctgcactgcc

SEQ ID NO: 95773 - DNA, 25 bp, Mus musculus
ctagtctgtgagtttcggtctgacc

SEQ ID NO: 95774 - DNA, 25 bp, Mus musculus
ctagtggaacacaccgatgtgaggg

SEQ ID NO: 95775 - DNA, 25 bp, Mus musculus
ctagtggcttaacagtagcgacagc

SEQ ID NO: 95776 - DNA, 25 bp, Mus musculus
ctagtggggtagtgtccttcgagca

SEQ ID NO: 95777 - DNA, 25 bp, Mus musculus
ctagtgtgaaggtatacgctgctga

SEQ ID NO: 95778 - DNA, 25 bp, Mus musculus
ctagtgtgtcagcaccaaatccccg

SEQ ID NO: 95779 - DNA, 25 bp, Mus musculus
ctagttcaccgttgctcctgggagc

SEQ ID NO: 95780 - DNA, 25 bp, Mus musculus
ctataaaaaggcagctccgcgcgct

SEQ ID NO: 95781 - DNA, 25 bp, Mus musculus
ctataaaaggcacacgcgggcatgc

SEQ ID NO: 95782 - DNA, 25 bp, Mus musculus
ctataaatgctttcatgcggtgggt

SEQ ID NO: 95783 - DNA, 25 bp, Mus musculus
ctataacacatttggtcaaactggg

SEQ ID NO: 95784 - DNA, 25 bp, Mus musculus
ctataagctgcgaggtgatgcccga

SEQ ID NO: 95785 - DNA, 25 bp, Mus musculus
ctatagagaaacacacgcgggacag

SEQ ID NO: 95786 - DNA, 25 bp, Mus musculus
ctatagtgatcgaacctgtgccagg

SEQ ID NO: 95787 - DNA, 25 bp, Mus musculus
ctatatcgggagtggctggtcacga

SEQ ID NO: 95788 - DNA, 25 bp, Mus musculus
ctatcaagaaggacgaagaggtgct

SEQ ID NO: 95789 - DNA, 25 bp, Mus musculus
ctatcaagctgaggaagacgcggaa

SEQ ID NO: 95790 - DNA, 25 bp, Mus musculus
ctatcactagccagcaggaggcggg

SEQ ID NO: 95791 - DNA, 25 bp, Mus musculus
ctatcaggagggacctcggagactg

SEQ ID NO: 95792 - DNA, 25 bp, Mus musculus
ctatcaggagggacgcacagcgcgt

SEQ ID NO: 95793 - DNA, 25 bp, Mus musculus
ctatcccaacccaagtgaagacaga

SEQ ID NO: 95794 - DNA, 25 bp, Mus musculus
ctatcctctatctccaagagcaggg

SEQ ID NO: 95795 - DNA, 25 bp, Mus musculus
ctatcgataagttgagtccagcctc

SEQ ID NO: 95796 - DNA, 25 bp, Mus musculus
ctatctctggtagccctggtatctc

SEQ ID NO: 95797 - DNA, 25 bp, Mus musculus
ctatcttctacagtgacatcatgct

SEQ ID NO: 95798 - DNA, 25 bp, Mus musculus
ctatgaagaacgagagaggcccaac

SEQ ID NO: 95799 - DNA, 25 bp, Mus musculus
ctatgaagacgggaagcagatgtac

SEQ ID NO: 95800 - DNA, 25 bp, Mus musculus
ctatgaagacgtgctggatgtgccc

SEQ ID NO: 95801 - DNA, 25 bp, Mus musculus
ctatgaaggaagatggacggctgct

SEQ ID NO: 95802 - DNA, 25 bp, Mus musculus
ctatgaatatgactttgaacgtggg

SEQ ID NO: 95803 - DNA, 25 bp, Mus musculus
ctatgacaagcaagtgggtggccga

SEQ ID NO: 95804 - DNA, 25 bp, Mus musculus
ctatgacagcgtggagaaactcttc

SEQ ID NO: 95805 - DNA, 25 bp, Mus musculus
ctatgacctgcccttgcctggagga

SEQ ID NO: 95806 - DNA, 25 bp, Mus musculus
ctatgactgtgagtgcctaggcggc

SEQ ID NO: 95807 - DNA, 25 bp, Mus musculus
ctatgagcctgagaacagcgtggcc

SEQ ID NO: 95808 - DNA, 25 bp, Mus musculus
ctatgaggccatacgggcacagctg

SEQ ID NO: 95809 - DNA, 25 bp, Mus musculus
ctatgatgcccctcgggaagcgaga

SEQ ID NO: 95810 - DNA, 25 bp, Mus musculus
ctatgccgttcaggccaagttcgga

SEQ ID NO: 95811 - DNA, 25 bp, Mus musculus
ctatgcgggtgtggagcaacattcc

SEQ ID NO: 95812 - DNA, 25 bp, Mus musculus
ctatgctactggagacaacttcggg

SEQ ID NO: 95813 - DNA, 25 bp, Mus musculus
ctatgctgtagtgatggcgatgcca

SEQ ID NO: 95814 - DNA, 25 bp, Mus musculus
ctatggaaaccatggagaagacacc

SEQ ID NO: 95815 - DNA, 25 bp, Mus musculus
ctatggaagctacaggtgccggacc

SEQ ID NO: 95816 - DNA, 25 bp, Mus musculus
ctatggagtcaaaatccgggcccct

SEQ ID NO: 95817 - DNA, 25 bp, Mus musculus
ctatggcacggtcatgagctgcgcc

SEQ ID NO: 95818 - DNA, 25 bp, Mus musculus
ctatggctatcgaggccgggactgc

SEQ ID NO: 95819 - DNA, 25 bp, Mus musculus
ctatggctcgtggtacaaggcaggc

SEQ ID NO: 95820 - DNA, 25 bp, Mus musculus
ctatgggattggcatcaaagaaagc

SEQ ID NO: 95821 - DNA, 25 bp, Mus musculus
ctatggtacgagaacgaaaatgcat

SEQ ID NO: 95822 - DNA, 25 bp, Mus musculus
ctatggtgcgatcagtaaggattcc

SEQ ID NO: 95823 - DNA, 25 bp, Mus musculus
ctatggtggttaaagctggctgccc

SEQ ID NO: 95824 - DNA, 25 bp, Mus musculus
ctatggttgaagatcgactcgaggc

SEQ ID NO: 95825 - DNA, 25 bp, Mus musculus
ctatgtggaggaaatgtactgtgcc

SEQ ID NO: 95826 - DNA, 25 bp, Mus musculus
ctatgtgtgtggctacctgcaccag

SEQ ID NO: 95827 - DNA, 25 bp, Mus musculus
ctatgttcagaaacggcacgtggaa

SEQ ID NO: 95828 - DNA, 25 bp, Mus musculus
ctattacggagaaaactgacctgac

SEQ ID NO: 95829 - DNA, 25 bp, Mus musculus
ctattacggtaatcgagcggccaca

SEQ ID NO: 95830 - DNA, 25 bp, Mus musculus
ctattgaatcgttgggaagtgtgac

SEQ ID NO: 95831 - DNA, 25 bp, Mus musculus
ctattgtgttgacaaaagtgtctgc

SEQ ID NO: 95832 - DNA, 25 bp, Mus musculus
ctatttaaaggtgcgcgcccgagcc

SEQ ID NO: 95833 - DNA, 25 bp, Mus musculus
ctattttttattttcgaaagatgct

SEQ ID NO: 95834 - DNA, 25 bp, Mus musculus
ctcaaaaggcccaagtcgcaggtct

SEQ ID NO: 95835 - DNA, 25 bp, Mus musculus
ctcaaagaacgggagagacgtctca

SEQ ID NO: 95836 - DNA, 25 bp, Mus musculus
ctcaaagacccggaagtaggcctgg

SEQ ID NO: 95837 - DNA, 25 bp, Mus musculus
ctcaaagatcttaagcggcagctgc

SEQ ID NO: 95838 - DNA, 25 bp, Mus musculus
ctcaactgcgtggaggccgaagcag

SEQ ID NO: 95839 - DNA, 25 bp, Mus musculus
ctcaagacagcacacaacatgggtc

SEQ ID NO: 95840 - DNA, 25 bp, Mus musculus
ctcaagatctactctagacctccag

SEQ ID NO: 95841 - DNA, 25 bp, Mus musculus
ctcaagcgtgcggagaatggaaacg

SEQ ID NO: 95842 - DNA, 25 bp, Mus musculus
ctcaagctaccgagaagagggctcc

SEQ ID NO: 95843 - DNA, 25 bp, Mus musculus
ctcaaggcaaggatgcacctgctgt

SEQ ID NO: 95844 - DNA, 25 bp, Mus musculus
ctcaaggcatggatggatggcgacc

SEQ ID NO: 95845 - DNA, 25 bp, Mus musculus
ctcaaggccatcgaggcgctttcag

SEQ ID NO: 95846 - DNA, 25 bp, Mus musculus
ctcaagttggctttgcagcaggacc

SEQ ID NO: 95847 - DNA, 25 bp, Mus musculus
ctcaatagccccagtagcagaggtg

SEQ ID NO: 95848 - DNA, 25 bp, Mus musculus
ctcaatggcggcgatggacacaaac

SEQ ID NO: 95849 - DNA, 25 bp, Mus musculus
ctcaatggctgcacgaaaatcactg

SEQ ID NO: 95850 - DNA, 25 bp, Mus musculus
ctcaatgtcagtgccttgcagacag

SEQ ID NO: 95851 - DNA, 25 bp, Mus musculus
ctcaatgtgagtataaactgtgaaa

SEQ ID NO: 95852 - DNA, 25 bp, Mus musculus
ctcaattggaagagcaacatgggcc

SEQ ID NO: 95853 - DNA, 25 bp, Mus musculus
ctcaatttagcagggctctcaaagg

SEQ ID NO: 95854 - DNA, 25 bp, Mus musculus
ctcacaaccgagcacgtgcagtgtc

SEQ ID NO: 95855 - DNA, 25 bp, Mus musculus
ctcacaactgtattctagctttggg

SEQ ID NO: 95856 - DNA, 25 bp, Mus musculus
ctcaccggctgctctttaaaaggaa

SEQ ID NO: 95857 - DNA, 25 bp, Mus musculus
ctcacgcaaagctggagaggtgctt

SEQ ID NO: 95858 - DNA, 25 bp, Mus musculus
ctcacgccggatgcgggttgtccct

SEQ ID NO: 95859 - DNA, 25 bp, Mus musculus
ctcacggtaaggaaccagggcctct

SEQ ID NO: 95860 - DNA, 25 bp, Mus musculus
ctcacggtggacatgaggcaggaac

SEQ ID NO: 95861 - DNA, 25 bp, Mus musculus
ctcacgtgaatgacgaccctctaag

SEQ ID NO: 95862 - DNA, 25 bp, Mus musculus
ctcacgtgctacagagggagcgaaa

SEQ ID NO: 95863 - DNA, 25 bp, Mus musculus
ctcacgtggagaatgcgatgcagaa

SEQ ID NO: 95864 - DNA, 25 bp, Mus musculus
ctcacgttctagacactgcctcagg

SEQ ID NO: 95865 - DNA, 25 bp, Mus musculus
ctcactaggcagagacgggatgcaa

SEQ ID NO: 95866 - DNA, 25 bp, Mus musculus
ctcactatctgggaggagcgaggcc

SEQ ID NO: 95867 - DNA, 25 bp, Mus musculus
ctcactgacttgtaccgggatcgga

SEQ ID NO: 95868 - DNA, 25 bp, Mus musculus
ctcactgaggcagcaccgcttggta

SEQ ID NO: 95869 - DNA, 25 bp, Mus musculus
ctcactgctattgggaacagaagcg

SEQ ID NO: 95870 - DNA, 25 bp, Mus musculus
ctcactttggcatcgacatgctgaa

SEQ ID NO: 95871 - DNA, 25 bp, Mus musculus
ctcagaaagggggtctccagccaac

SEQ ID NO: 95872 - DNA, 25 bp, Mus musculus
ctcagaacagatgtgccatgcttca

SEQ ID NO: 95873 - DNA, 25 bp, Mus musculus
ctcagaatacagttttctgtggaag

SEQ ID NO: 95874 - DNA, 25 bp, Mus musculus
ctcagacagtgagatggggccaccc

SEQ ID NO: 95875 - DNA, 25 bp, Mus musculus
ctcagacgtggaggagaacatgtcc

SEQ ID NO: 95876 - DNA, 25 bp, Mus musculus
ctcagactctgggtaagcgaagctc

SEQ ID NO: 95877 - DNA, 25 bp, Mus musculus
ctcagagcaggttttcaaagtggcc

SEQ ID NO: 95878 - DNA, 25 bp, Mus musculus
ctcagagcccgcgaagaagacgagg

SEQ ID NO: 95879 - DNA, 25 bp, Mus musculus
ctcagaggacgtcagttcagggcac

SEQ ID NO: 95880 - DNA, 25 bp, Mus musculus
ctcagaggagtccaccgagaaaggc

SEQ ID NO: 95881 - DNA, 25 bp, Mus musculus
ctcagaggctgtatggaggctccaa

SEQ ID NO: 95882 - DNA, 25 bp, Mus musculus
ctcagaggtgctgcagcaagggtcc

SEQ ID NO: 95883 - DNA, 25 bp, Mus musculus
ctcagagttagcatggcacggccct

SEQ ID NO: 95884 - DNA, 25 bp, Mus musculus
ctcagataatagctgggtgctcgct

SEQ ID NO: 95885 - DNA, 25 bp, Mus musculus
ctcagatagaattttatcagaacat

SEQ ID NO: 95886 - DNA, 25 bp, Mus musculus
ctcagatgaggaggcccttaaggct

SEQ ID NO: 95887 - DNA, 25 bp, Mus musculus
ctcagatggcaacgacaggaagcgc

SEQ ID NO: 95888 - DNA, 25 bp, Mus musculus
ctcagatttcttagaccgagggatc

SEQ ID NO: 95889 - DNA, 25 bp, Mus musculus
ctcagcaaatgcttggaagacttat

SEQ ID NO: 95890 - DNA, 25 bp, Mus musculus
ctcagcatgtgaggacacacggagt

SEQ ID NO: 95891 - DNA, 25 bp, Mus musculus
ctcagccagtttaagctggtgttaa

SEQ ID NO: 95892 - DNA, 25 bp, Mus musculus
ctcagcgagttcgagaaggtccccg

SEQ ID NO: 95893 - DNA, 25 bp, Mus musculus
ctcagcgatgcgtttgcccgggtga

SEQ ID NO: 95894 - DNA, 25 bp, Mus musculus
ctcagcgcgtgaacgcagctcggca

SEQ ID NO: 95895 - DNA, 25 bp, Mus musculus
ctcagcggtcgccactgagccatgg

SEQ ID NO: 95896 - DNA, 25 bp, Mus musculus
ctcaggaaaatggaaacagcggcgg

SEQ ID NO: 95897 - DNA, 25 bp, Mus musculus
ctcaggaccgattaaggaaggaaat

SEQ ID NO: 95898 - DNA, 25 bp, Mus musculus
ctcaggacgggaaagacaaggacca

SEQ ID NO: 95899 - DNA, 25 bp, Mus musculus
ctcaggagaggctttgggccctgcc

SEQ ID NO: 95900 - DNA, 25 bp, Mus musculus
ctcaggagccttccatggccaggga

SEQ ID NO: 95901 - DNA, 25 bp, Mus musculus
ctcaggaggtgttctgggcttcgcc

SEQ ID NO: 95902 - DNA, 25 bp, Mus musculus
ctcaggatcgaatcggctgggcgtt

SEQ ID NO: 95903 - DNA, 25 bp, Mus musculus
ctcaggcaaagcagggatctagacc

SEQ ID NO: 95904 - DNA, 25 bp, Mus musculus
ctcaggctgtgacttgcaggatccc

SEQ ID NO: 95905 - DNA, 25 bp, Mus musculus
ctcagggaccctctggaagcagtga

SEQ ID NO: 95906 - DNA, 25 bp, Mus musculus
ctcaggtacagcgtccgccagaatg

SEQ ID NO: 95907 - DNA, 25 bp, Mus musculus
ctcaggttcggagagtatcagttcc

SEQ ID NO: 95908 - DNA, 25 bp, Mus musculus
ctcagtatgtggaggctgcctggta

SEQ ID NO: 95909 - DNA, 25 bp, Mus musculus
ctcagtcagaggcaaaggtggtatc

SEQ ID NO: 95910 - DNA, 25 bp, Mus musculus
ctcagtcatgaagagatgcagggct

SEQ ID NO: 95911 - DNA, 25 bp, Mus musculus
ctcagtcgactggagggcgaagcac

SEQ ID NO: 95912 - DNA, 25 bp, Mus musculus
ctcagtgagaacgttaaggacctaa

SEQ ID NO: 95913 - DNA, 25 bp, Mus musculus
ctcagtggtcctgccgggagatatc

SEQ ID NO: 95914 - DNA, 25 bp, Mus musculus
ctcagtgtggccaggtgtgacctga

SEQ ID NO: 95915 - DNA, 25 bp, Mus musculus
ctcagttaggctggcggcggtccac

SEQ ID NO: 95916 - DNA, 25 bp, Mus musculus
ctcagttcctggcattcctgatact

SEQ ID NO: 95917 - DNA, 25 bp, Mus musculus
ctcagttctgacaccagggatggac

SEQ ID NO: 95918 - DNA, 25 bp, Mus musculus
ctcagttgagcttccggcgcgaagg

SEQ ID NO: 95919 - DNA, 25 bp, Mus musculus
ctcataacgaaaccgctaccggcgg

SEQ ID NO: 95920 - DNA, 25 bp, Mus musculus
ctcataggaggcgaagcatgggatt

SEQ ID NO: 95921 - DNA, 25 bp, Mus musculus
ctcatattgaagttagccaggcatc

SEQ ID NO: 95922 - DNA, 25 bp, Mus musculus
ctcatcaaagatgcgcagggtgact

SEQ ID NO: 95923 - DNA, 25 bp, Mus musculus
ctcatcaaaggtggccaggcagaca

SEQ ID NO: 95924 - DNA, 25 bp, Mus musculus
ctcatcaggacagaaaggtgcaccc

SEQ ID NO: 95925 - DNA, 25 bp, Mus musculus
ctcatcatgaggcacggaggtccca

SEQ ID NO: 95926 - DNA, 25 bp, Mus musculus
ctcatcatggacagagcagggcgaa

SEQ ID NO: 95927 - DNA, 25 bp, Mus musculus
ctcatcctgggaggccgagaggaca

SEQ ID NO: 95928 - DNA, 25 bp, Mus musculus
ctcatctttcttactgggctccctg

SEQ ID NO: 95929 - DNA, 25 bp, Mus musculus
ctcatgagggtatcagtgtccgggc

SEQ ID NO: 95930 - DNA, 25 bp, Mus musculus
ctcatgcaagactgcaaagaaggcc

SEQ ID NO: 95931 - DNA, 25 bp, Mus musculus
ctcatgctggacaaggacgggcaca

SEQ ID NO: 95932 - DNA, 25 bp, Mus musculus
ctcatggcgttttcgggcacaggga

SEQ ID NO: 95933 - DNA, 25 bp, Mus musculus
ctcatgtacctgagctcgccaggct

SEQ ID NO: 95934 - DNA, 25 bp, Mus musculus
ctcatgtgactatggttggacttcc

SEQ ID NO: 95935 - DNA, 25 bp, Mus musculus
ctcatgttataaacccagggctgga

SEQ ID NO: 95936 - DNA, 25 bp, Mus musculus
ctcatgtttacagctggcccaagaa

SEQ ID NO: 95937 - DNA, 25 bp, Mus musculus
ctcattagctgtccgctcgggctcg

SEQ ID NO: 95938 - DNA, 25 bp, Mus musculus
ctcattccccgcaaggtaccggtgg

SEQ ID NO: 95939 - DNA, 25 bp, Mus musculus
ctcattggagggtcacagcgaagct

SEQ ID NO: 95940 - DNA, 25 bp, Mus musculus
ctcattggagtgtctgtggccttca

SEQ ID NO: 95941 - DNA, 25 bp, Mus musculus
ctcatttatgacagatttggccaag

SEQ ID NO: 95942 - DNA, 25 bp, Mus musculus
ctccaaagatcgtggccagagactg

SEQ ID NO: 95943 - DNA, 25 bp, Mus musculus
ctccaaagcaggtgagggctcagca

SEQ ID NO: 95944 - DNA, 25 bp, Mus musculus
ctccaagcatatggccccaggagat

SEQ ID NO: 95945 - DNA, 25 bp, Mus musculus
ctccaagcctgagaaaagggtggcc

SEQ ID NO: 95946 - DNA, 25 bp, Mus musculus
ctccaagtgtcgcagatcctcagtc

SEQ ID NO: 95947 - DNA, 25 bp, Mus musculus
ctccaatggtgttcaaagcccagct

SEQ ID NO: 95948 - DNA, 25 bp, Mus musculus
ctccaatgtgaaccggccccgaatt

SEQ ID NO: 95949 - DNA, 25 bp, Mus musculus
ctccacccagagttgggtcagtggg

SEQ ID NO: 95950 - DNA, 25 bp, Mus musculus
ctccacgttattgcgggacgaagag

SEQ ID NO: 95951 - DNA, 25 bp, Mus musculus
ctccactcttgctacctgcagggat

SEQ ID NO: 95952 - DNA, 25 bp, Mus musculus
ctccactgacctggtaaagaaggcc

SEQ ID NO: 95953 - DNA, 25 bp, Mus musculus
ctccagagagtaaagaagccgacct

SEQ ID NO: 95954 - DNA, 25 bp, Mus musculus
ctccagatggttatgcggacgcggt

SEQ ID NO: 95955 - DNA, 25 bp, Mus musculus
ctccagcttgccgtcaccattgtcc

SEQ ID NO: 95956 - DNA, 25 bp, Mus musculus
ctccaggaagagttgaatgggcatc

SEQ ID NO: 95957 - DNA, 25 bp, Mus musculus
ctccaggatgagaattttgtcagta

SEQ ID NO: 95958 - DNA, 25 bp, Mus musculus
ctccaggcggcttttgggctccaga

SEQ ID NO: 95959 - DNA, 25 bp, Mus musculus
ctccagggaccgtgggataccatca

SEQ ID NO: 95960 - DNA, 25 bp, Mus musculus
ctccagggtcggtggcatcatcaca

SEQ ID NO: 95961 - DNA, 25 bp, Mus musculus
ctccaggtggaagggctcagtgatc

SEQ ID NO: 95962 - DNA, 25 bp, Mus musculus
ctccagttcccctgaggagagagaa

SEQ ID NO: 95963 - DNA, 25 bp, Mus musculus
ctccagttggagaagtatagcagtc

SEQ ID NO: 95964 - DNA, 25 bp, Mus musculus
ctccatcgtgggactcagcagcctt

SEQ ID NO: 95965 - DNA, 25 bp, Mus musculus
ctccatgatcactttgggagccggg

SEQ ID NO: 95966 - DNA, 25 bp, Mus musculus
ctccatggcccggtgtaggacgctg

SEQ ID NO: 95967 - DNA, 25 bp, Mus musculus
ctccatgggaagtgtgatgatgtca

SEQ ID NO: 95968 - DNA, 25 bp, Mus musculus
ctccattgggaatggtgtctggctc

SEQ ID NO: 95969 - DNA, 25 bp, Mus musculus
ctccattgttgaggcagcgggcgct

SEQ ID NO: 95970 - DNA, 25 bp, Mus musculus
ctcccaaaggagagttgcagttgcc

SEQ ID NO: 95971 - DNA, 25 bp, Mus musculus
ctcccaagcgaggtgaagaagttca

SEQ ID NO: 95972 - DNA, 25 bp, Mus musculus
ctcccaccagagcccggaacatgaa

SEQ ID NO: 95973 - DNA, 25 bp, Mus musculus
ctcccagcgctataaaaactttata

SEQ ID NO: 95974 - DNA, 25 bp, Mus musculus
ctcccaggccagagaacaggtttct

SEQ ID NO: 95975 - DNA, 25 bp, Mus musculus
ctcccaggtgggattggtctacgtg

SEQ ID NO: 95976 - DNA, 25 bp, Mus musculus
ctcccaggttctggacagccccttc

SEQ ID NO: 95977 - DNA, 25 bp, Mus musculus
ctcccataaggacagagaccctcgg

SEQ ID NO: 95978 - DNA, 25 bp, Mus musculus
ctcccatggtcagctccccgatggc

SEQ ID NO: 95979 - DNA, 25 bp, Mus musculus
ctcccccaggaatgcgcccaccaag

SEQ ID NO: 95980 - DNA, 25 bp, Mus musculus
ctcccggaacgctgccgacaaggag

SEQ ID NO: 95981 - DNA, 25 bp, Mus musculus
ctccctactggctctgcatgctggg

SEQ ID NO: 95982 - DNA, 25 bp, Mus musculus
ctccctcacgcaagctgaggaggag

SEQ ID NO: 95983 - DNA, 25 bp, Mus musculus
ctccctcaggcaggctcggtgattg

SEQ ID NO: 95984 - DNA, 25 bp, Mus musculus
ctcccttctcagcataagcaactgg

SEQ ID NO: 95985 - DNA, 25 bp, Mus musculus
ctccgacaacatccttcagctggtg

SEQ ID NO: 95986 - DNA, 25 bp, Mus musculus
ctccgagggagaaacagacgactgg

SEQ ID NO: 95987 - DNA, 25 bp, Mus musculus
ctccgccttttcgatcagggtggga

SEQ ID NO: 95988 - DNA, 25 bp, Mus musculus
ctccgctctgcatacttggagtgtg

SEQ ID NO: 95989 - DNA, 25 bp, Mus musculus
ctccggagattcggccgtgaagcag

SEQ ID NO: 95990 - DNA, 25 bp, Mus musculus
ctccggcaggtgtgctgacgtagaa

SEQ ID NO: 95991 - DNA, 25 bp, Mus musculus
ctccggcgctcgactgctggtgtct

SEQ ID NO: 95992 - DNA, 25 bp, Mus musculus
ctccgggactgccatggtaacctgc

SEQ ID NO: 95993 - DNA, 25 bp, Mus musculus
ctccgggagagagattggacaaata

SEQ ID NO: 95994 - DNA, 25 bp, Mus musculus
ctccgtccgagggagaggcaaatgc

SEQ ID NO: 95995 - DNA, 25 bp, Mus musculus
ctccgtgctctgtccagtggtggga

SEQ ID NO: 95996 - DNA, 25 bp, Mus musculus
ctccgtggttgcatcgaagcgtttg

SEQ ID NO: 95997 - DNA, 25 bp, Mus musculus
ctccgtgtacctgcgcaagaagtcg

SEQ ID NO: 95998 - DNA, 25 bp, Mus musculus
ctcctaaagagtgtgggttgggaca

SEQ ID NO: 95999 - DNA, 25 bp, Mus musculus
ctcctaatagtacagcagaagcagc

SEQ ID NO: 96000 - DNA, 25 bp, Mus musculus
ctcctacgtggaaaaagcctctttg

SEQ ID NO: 96001 - DNA, 25 bp, Mus musculus
ctcctcagacatggaaaagcagctg

SEQ ID NO: 96002 - DNA, 25 bp, Mus musculus
ctcctccaaggagtccggcgagaaa

SEQ ID NO: 96003 - DNA, 25 bp, Mus musculus
ctcctccaggagaaagtcgtctttc

SEQ ID NO: 96004 - DNA, 25 bp, Mus musculus
ctcctcgcggcggaaggagatcctg

SEQ ID NO: 96005 - DNA, 25 bp, Mus musculus
ctcctgaagactccaactgtccggg

SEQ ID NO: 96006 - DNA, 25 bp, Mus musculus
ctcctgaaggctgggtcacttgtct

SEQ ID NO: 96007 - DNA, 25 bp, Mus musculus
ctcctgacgcatggccaagaagaca

SEQ ID NO: 96008 - DNA, 25 bp, Mus musculus
ctcctgatggaaggagacaagcagc

SEQ ID NO: 96009 - DNA, 25 bp, Mus musculus
ctcctgcggccgagaaagacgagtg

SEQ ID NO: 96010 - DNA, 25 bp, Mus musculus
ctcctgctgctgtctgtataagatg

SEQ ID NO: 96011 - DNA, 25 bp, Mus musculus
ctcctggaggaagctaagaagatgg

SEQ ID NO: 96012 - DNA, 25 bp, Mus musculus
ctcctggagtggcaccgcgcgaact

SEQ ID NO: 96013 - DNA, 25 bp, Mus musculus
ctcctggatcgacgccgccaaatta

SEQ ID NO: 96014 - DNA, 25 bp, Mus musculus
ctcctgggagcttgacggaggctaa

SEQ ID NO: 96015 - DNA, 25 bp, Mus musculus
ctcctgttcaggcagcacggtggac

SEQ ID NO: 96016 - DNA, 25 bp, Mus musculus
ctccttacgagtgggaccttgataa

SEQ ID NO: 96017 - DNA, 25 bp, Mus musculus
ctccttcctttgtgtgcgcgcgcga

SEQ ID NO: 96018 - DNA, 25 bp, Mus musculus
ctccttcgcgccgagaagaagctga

SEQ ID NO: 96019 - DNA, 25 bp, Mus musculus
ctccttgatactttcggctggcggg

SEQ ID NO: 96020 - DNA, 25 bp, Mus musculus
ctccttgtgtagcagtgggtgtcca

SEQ ID NO: 96021 - DNA, 25 bp, Mus musculus
ctcctttcccacgagaagagtgcag

SEQ ID NO: 96022 - DNA, 25 bp, Mus musculus
ctccttttgagtgcctgggtgccgc

SEQ ID NO: 96023 - DNA, 25 bp, Mus musculus
ctcgaccgcggtaggcagtgcacag

SEQ ID NO: 96024 - DNA, 25 bp, Mus musculus
ctcgagaatcgggaaggaagacaca

SEQ ID NO: 96025 - DNA, 25 bp, Mus musculus
ctcgagagtgagaagtacaggcgct

SEQ ID NO: 96026 - DNA, 25 bp, Mus musculus
ctcgagctctgaggcgtgagtagct

SEQ ID NO: 96027 - DNA, 25 bp, Mus musculus
ctcgaggtcagggagggagtccgtg

SEQ ID NO: 96028 - DNA, 25 bp, Mus musculus
ctcgaggtgtcagcgctgctctgct

SEQ ID NO: 96029 - DNA, 25 bp, Mus musculus
ctcgagttctgactgatatggactg

SEQ ID NO: 96030 - DNA, 25 bp, Mus musculus
ctcgatttgaactgcccatgggaac

SEQ ID NO: 96031 - DNA, 25 bp, Mus musculus
ctcgcaagcgtgagtgacgaccaca

SEQ ID NO: 96032 - DNA, 25 bp, Mus musculus
ctcgcactgggatgaagaaacacct

SEQ ID NO: 96033 - DNA, 25 bp, Mus musculus
ctcgccagtgatggtgtgcacagag

SEQ ID NO: 96034 - DNA, 25 bp, Mus musculus
ctcgcgcagagtgaaagtagacagc

SEQ ID NO: 96035 - DNA, 25 bp, Mus musculus
ctcgcggtcggtcaggacgtggcat

SEQ ID NO: 96036 - DNA, 25 bp, Mus musculus
ctcgcgttcggtttcggcagcagga

SEQ ID NO: 96037 - DNA, 25 bp, Mus musculus
ctcgctcagcagtatgcacatccta

SEQ ID NO: 96038 - DNA, 25 bp, Mus musculus
ctcggaagaatgtcgagagtttcct

SEQ ID NO: 96039 - DNA, 25 bp, Mus musculus
ctcggacagggcatattcttggtac

SEQ ID NO: 96040 - DNA, 25 bp, Mus musculus
ctcggagacggatcctaggcagtgc

SEQ ID NO: 96041 - DNA, 25 bp, Mus musculus
ctcggagcagtgtgtaaagcacccc

SEQ ID NO: 96042 - DNA, 25 bp, Mus musculus
ctcggagcgggtagggcaatcatca

SEQ ID NO: 96043 - DNA, 25 bp, Mus musculus
ctcggaggtccaaggctgaagaact

SEQ ID NO: 96044 - DNA, 25 bp, Mus musculus
ctcggatggaaaaactggctggtct

SEQ ID NO: 96045 - DNA, 25 bp, Mus musculus
ctcggccagtggaacagatcaggtg

SEQ ID NO: 96046 - DNA, 25 bp, Mus musculus
ctcggcccggaagtgaaacagtgct

SEQ ID NO: 96047 - DNA, 25 bp, Mus musculus
ctcggccgggccaaggagcccgcac

SEQ ID NO: 96048 - DNA, 25 bp, Mus musculus
ctcggccgttgatgctctcccagtg

SEQ ID NO: 96049 - DNA, 25 bp, Mus musculus
ctcggcgtataagtagcggcgcgtc

SEQ ID NO: 96050 - DNA, 25 bp, Mus musculus
ctcggctgcgccttcggtgcggctt

SEQ ID NO: 96051 - DNA, 25 bp, Mus musculus
ctcggcttcgctggcaggaacaaga

SEQ ID NO: 96052 - DNA, 25 bp, Mus musculus
ctcgggaaagcaagctgcaacccct

SEQ ID NO: 96053 - DNA, 25 bp, Mus musculus
ctcgggaatggccttgctgcaccag

SEQ ID NO: 96054 - DNA, 25 bp, Mus musculus
ctcgggacatggtgccgtcccagga

SEQ ID NO: 96055 - DNA, 25 bp, Mus musculus
ctcgggactcgctgatcgcgggctc

SEQ ID NO: 96056 - DNA, 25 bp, Mus musculus
ctcgggcgcagattctttgcacacg

SEQ ID NO: 96057 - DNA, 25 bp, Mus musculus
ctcgggctacaagagtaggggctcc

SEQ ID NO: 96058 - DNA, 25 bp, Mus musculus
ctcgggctgtgtacaaaaaggctgc

SEQ ID NO: 96059 - DNA, 25 bp, Mus musculus
ctcgggttgcggtgaagaccaagac

SEQ ID NO: 96060 - DNA, 25 bp, Mus musculus
ctcgggtttgtgtctgcaggtgcca

SEQ ID NO: 96061 - DNA, 25 bp, Mus musculus
ctcggtccgggacaagtttatcttg

SEQ ID NO: 96062 - DNA, 25 bp, Mus musculus
ctcggtgagaatgctgatttgcagc

SEQ ID NO: 96063 - DNA, 25 bp, Mus musculus
ctcggtgattgggaccgcgagctcc

SEQ ID NO: 96064 - DNA, 25 bp, Mus musculus
ctcggttactatgcgcaggctgaca

SEQ ID NO: 96065 - DNA, 25 bp, Mus musculus
ctcgtaggtgagaacgccgagccgc

SEQ ID NO: 96066 - DNA, 25 bp, Mus musculus
ctcgtcgacgaaaacatgtggctct

SEQ ID NO: 96067 - DNA, 25 bp, Mus musculus
ctcgtgaggaagtttgggccagtcc

SEQ ID NO: 96068 - DNA, 25 bp, Mus musculus
ctcgtgagtagaagtgaaagcctga

SEQ ID NO: 96069 - DNA, 25 bp, Mus musculus
ctcgtgcaagcttctccccgatggg

SEQ ID NO: 96070 - DNA, 25 bp, Mus musculus
ctcgtgcacacaagagaagctgcta

SEQ ID NO: 96071 - DNA, 25 bp, Mus musculus
ctcgtgctgtggagaatcagtactc

SEQ ID NO: 96072 - DNA, 25 bp, Mus musculus
ctcgtggctgctgcttttgctatgc

SEQ ID NO: 96073 - DNA, 25 bp, Mus musculus
ctcgtgtgcggcagcagaggtgtta

SEQ ID NO: 96074 - DNA, 25 bp, Mus musculus
ctcgttgggagtgtgtgctcagaac

SEQ ID NO: 96075 - DNA, 25 bp, Mus musculus
ctcgtttgaattccacgcgctccaa

SEQ ID NO: 96076 - DNA, 25 bp, Mus musculus
ctctaaagtagaggcagtttctgaa

SEQ ID NO: 96077 - DNA, 25 bp, Mus musculus
ctctacagtagaggaagccgttgcc

SEQ ID NO: 96078 - DNA, 25 bp, Mus musculus
ctctacctctctccaagcgggaaca

SEQ ID NO: 96079 - DNA, 25 bp, Mus musculus
ctctacttcgatacatgagcaatga

SEQ ID NO: 96080 - DNA, 25 bp, Mus musculus
ctctagaaacttcaaaatgcgactg

SEQ ID NO: 96081 - DNA, 25 bp, Mus musculus
ctctagaaggaggcgaccgactgat

SEQ ID NO: 96082 - DNA, 25 bp, Mus musculus
ctctagaggatgaggacaggcagac

SEQ ID NO: 96083 - DNA, 25 bp, Mus musculus
ctctagatagaagggcgaggcagac

SEQ ID NO: 96084 - DNA, 25 bp, Mus musculus
ctctagcaggcgtcagaccgcggcg

SEQ ID NO: 96085 - DNA, 25 bp, Mus musculus
ctctagcatgcgttttccttccaac

SEQ ID NO: 96086 - DNA, 25 bp, Mus musculus
ctctaggcacaaagtcaagggttta

SEQ ID NO: 96087 - DNA, 25 bp, Mus musculus
ctctatcgtggtggcggcggccaaa

SEQ ID NO: 96088 - DNA, 25 bp, Mus musculus
ctctcaaagtctcttccaaaggatc

SEQ ID NO: 96089 - DNA, 25 bp, Mus musculus
ctctcaagggtgatcagggcagcgc

SEQ ID NO: 96090 - DNA, 25 bp, Mus musculus
ctctcagaaccaggcagtgctcgtg

SEQ ID NO: 96091 - DNA, 25 bp, Mus musculus
ctctcagcgctctagaagatatgga

SEQ ID NO: 96092 - DNA, 25 bp, Mus musculus
ctctcagggcgtgggaaagtacagc

SEQ ID NO: 96093 - DNA, 25 bp, Mus musculus
ctctccatggcttgggcaccagttc

SEQ ID NO: 96094 - DNA, 25 bp, Mus musculus
ctctccctgcggagctcggctgagt

SEQ ID NO: 96095 - DNA, 25 bp, Mus musculus
ctctccggccctgatccctttgaac

SEQ ID NO: 96096 - DNA, 25 bp, Mus musculus
ctctcctttcccacgagaagagtgc

SEQ ID NO: 96097 - DNA, 25 bp, Mus musculus
ctctcgaaggaggaaagcttacacc

SEQ ID NO: 96098 - DNA, 25 bp, Mus musculus
ctctctccctctcggcggaagccga

SEQ ID NO: 96099 - DNA, 25 bp, Mus musculus
ctctctctgagccgtcacgggtgcg

SEQ ID NO: 96100 - DNA, 25 bp, Mus musculus
ctctctgaaagagtattgattcctg

SEQ ID NO: 96101 - DNA, 25 bp, Mus musculus
ctctctgaaatagtgaccttagcca

SEQ ID NO: 96102 - DNA, 25 bp, Mus musculus
ctctctgagatgtaagtgcgtagca

SEQ ID NO: 96103 - DNA, 25 bp, Mus musculus
ctctctgattcttgagaagagtcaa

SEQ ID NO: 96104 - DNA, 25 bp, Mus musculus
ctctctgcgactaaggtggctgctg

SEQ ID NO: 96105 - DNA, 25 bp, Mus musculus
ctctctgctgtcatctgtttgatta

SEQ ID NO: 96106 - DNA, 25 bp, Mus musculus
ctctctgtaggaggtcttcctgcca

SEQ ID NO: 96107 - DNA, 25 bp, Mus musculus
ctctcttagagattcaactatgcat

SEQ ID NO: 96108 - DNA, 25 bp, Mus musculus
ctctgaaaggcggaagctgatgctt

SEQ ID NO: 96109 - DNA, 25 bp, Mus musculus
ctctgaaagggggaagctccctcct

SEQ ID NO: 96110 - DNA, 25 bp, Mus musculus
ctctgacaccatggggagctgctgg

SEQ ID NO: 96111 - DNA, 25 bp, Mus musculus
ctctgacagagccagtagtggtgct

SEQ ID NO: 96112 - DNA, 25 bp, Mus musculus
ctctgacatagcagaggtggtgctt

SEQ ID NO: 96113 - DNA, 25 bp, Mus musculus
ctctgacgaccgtggtggtgaaaca

SEQ ID NO: 96114 - DNA, 25 bp, Mus musculus
ctctgacgtcgaagaagcacaaggg

SEQ ID NO: 96115 - DNA, 25 bp, Mus musculus
ctctgacgtcgatccagtgttggca

SEQ ID NO: 96116 - DNA, 25 bp, Mus musculus
ctctgactgcggcagccgttgaggg

SEQ ID NO: 96117 - DNA, 25 bp, Mus musculus
ctctgagaaagacagtggagttcat

SEQ ID NO: 96118 - DNA, 25 bp, Mus musculus
ctctgagagccacggccgagaatga

SEQ ID NO: 96119 - DNA, 25 bp, Mus musculus
ctctgagcagaggatgtccagggca

SEQ ID NO: 96120 - DNA, 25 bp, Mus musculus
ctctgagcgcgacaagccatgagca

SEQ ID NO: 96121 - DNA, 25 bp, Mus musculus
ctctgagcgtgctgccttgggacct

SEQ ID NO: 96122 - DNA, 25 bp, Mus musculus
ctctgaggaaactaggtgtgggcat

SEQ ID NO: 96123 - DNA, 25 bp, Mus musculus
ctctgaggaccctcaataacttcct

SEQ ID NO: 96124 - DNA, 25 bp, Mus musculus
ctctgagtacgtggcacgatgcctg

SEQ ID NO: 96125 - DNA, 25 bp, Mus musculus
ctctgagttttaccgcgatggcaaa

SEQ ID NO: 96126 - DNA, 25 bp, Mus musculus
ctctgatggaagagtccgcggagca

SEQ ID NO: 96127 - DNA, 25 bp, Mus musculus
ctctgatgtttggacacggctgccc

SEQ ID NO: 96128 - DNA, 25 bp, Mus musculus
ctctgcaacctgtgcgcggacaagg

SEQ ID NO: 96129 - DNA, 25 bp, Mus musculus
ctctgcacaagaggcctccaagaga

SEQ ID NO: 96130 - DNA, 25 bp, Mus musculus
ctctgcaggagaaaagtaagccgtg

SEQ ID NO: 96131 - DNA, 25 bp, Mus musculus
ctctgccacagaaggtccgggtgtc

SEQ ID NO: 96132 - DNA, 25 bp, Mus musculus
ctctgccagagagcacggtactgct

SEQ ID NO: 96133 - DNA, 25 bp, Mus musculus
ctctgccctttaccgaactcgtgag

SEQ ID NO: 96134 - DNA, 25 bp, Mus musculus
ctctgccgctaaaggacacaatctc

SEQ ID NO: 96135 - DNA, 25 bp, Mus musculus
ctctgccttctttccggtttccgcg

SEQ ID NO: 96136 - DNA, 25 bp, Mus musculus
ctctgcgatgagctgtgtcctgaca

SEQ ID NO: 96137 - DNA, 25 bp, Mus musculus
ctctgcggagattccaggccccaca

SEQ ID NO: 96138 - DNA, 25 bp, Mus musculus
ctctgcggcgttctcaaagttcgga

SEQ ID NO: 96139 - DNA, 25 bp, Mus musculus
ctctgcggctccaagggtttggaac

SEQ ID NO: 96140 - DNA, 25 bp, Mus musculus
ctctgcgtgcaggtgaaggaccgct

SEQ ID NO: 96141 - DNA, 25 bp, Mus musculus
ctctgctagagacagggagtaccta

SEQ ID NO: 96142 - DNA, 25 bp, Mus musculus
ctctgctatggaagtttattaataa

SEQ ID NO: 96143 - DNA, 25 bp, Mus musculus
ctctgctctttttggttactcaggg

SEQ ID NO: 96144 - DNA, 25 bp, Mus musculus
ctctggaagagtgttacagcggctg

SEQ ID NO: 96145 - DNA, 25 bp, Mus musculus
ctctggagcagtgagtgcatccact

SEQ ID NO: 96146 - DNA, 25 bp, Mus musculus
ctctggatcccatgaagcagtttgc

SEQ ID NO: 96147 - DNA, 25 bp, Mus musculus
ctctggatggagcaacgtgttctac

SEQ ID NO: 96148 - DNA, 25 bp, Mus musculus
ctctggcaaaatgaagtgggtaacc

SEQ ID NO: 96149 - DNA, 25 bp, Mus musculus
ctctggcgactacagcctggcgcat

SEQ ID NO: 96150 - DNA, 25 bp, Mus musculus
ctctggctgtcagtcgccaggctgg

SEQ ID NO: 96151 - DNA, 25 bp, Mus musculus
ctctgggagaggcacacactggatt

SEQ ID NO: 96152 - DNA, 25 bp, Mus musculus
ctctgggatgaactgatgaagacaa

SEQ ID NO: 96153 - DNA, 25 bp, Mus musculus
ctctgggcatcgttcctggtgggaa

SEQ ID NO: 96154 - DNA, 25 bp, Mus musculus
ctctgggctcagatagaattttatc

SEQ ID NO: 96155 - DNA, 25 bp, Mus musculus
ctctgggtagccaatgatgagaact

SEQ ID NO: 96156 - DNA, 25 bp, Mus musculus
ctctgggtgataaaacaaatctctg

SEQ ID NO: 96157 - DNA, 25 bp, Mus musculus
ctctgggtgccccttagaggccatc

SEQ ID NO: 96158 - DNA, 25 bp, Mus musculus
ctctggttaaaagcaccgtggctga

SEQ ID NO: 96159 - DNA, 25 bp, Mus musculus
ctctggttctcggcgggagcggcgg

SEQ ID NO: 96160 - DNA, 25 bp, Mus musculus
ctctgtacaactcaatcaagaacga

SEQ ID NO: 96161 - DNA, 25 bp, Mus musculus
ctctgtagcagcatcggtggcggaa

SEQ ID NO: 96162 - DNA, 25 bp, Mus musculus
ctctgtccatccaggagggactgca

SEQ ID NO: 96163 - DNA, 25 bp, Mus musculus
ctctgtcgcgagtgaattgttccca

SEQ ID NO: 96164 - DNA, 25 bp, Mus musculus
ctctgtcttccccggattctctcct

SEQ ID NO: 96165 - DNA, 25 bp, Mus musculus
ctctgtgaacgagcctgagggagcc

SEQ ID NO: 96166 - DNA, 25 bp, Mus musculus
ctctgtgagaagagctccggccctt

SEQ ID NO: 96167 - DNA, 25 bp, Mus musculus
ctctgtggcatagggtgtcattgac

SEQ ID NO: 96168 - DNA, 25 bp, Mus musculus
ctctgtgggccgtgctgttggtcac

SEQ ID NO: 96169 - DNA, 25 bp, Mus musculus
ctctgttacggcatggtgcaaatcc

SEQ ID NO: 96170 - DNA, 25 bp, Mus musculus
ctcttacaaggagaacgtaggcaag

SEQ ID NO: 96171 - DNA, 25 bp, Mus musculus
ctcttacaattaggtggctgacgag

SEQ ID NO: 96172 - DNA, 25 bp, Mus musculus
ctcttactcgggatctgcaggcaca

SEQ ID NO: 96173 - DNA, 25 bp, Mus musculus
ctcttagagaaaggagcagcttaga

SEQ ID NO: 96174 - DNA, 25 bp, Mus musculus
ctcttagtgctgaagaggagaatgc

SEQ ID NO: 96175 - DNA, 25 bp, Mus musculus
ctcttccattaagcactgtgatata

SEQ ID NO: 96176 - DNA, 25 bp, Mus musculus
ctcttcccctggcagtggtagcagc

SEQ ID NO: 96177 - DNA, 25 bp, Mus musculus
ctcttcctgcaccacggtctggagc

SEQ ID NO: 96178 - DNA, 25 bp, Mus musculus
ctcttctaaggacagcagagcagca

SEQ ID NO: 96179 - DNA, 25 bp, Mus musculus
ctcttctgtgggaccccgtgacgtg

SEQ ID NO: 96180 - DNA, 25 bp, Mus musculus
ctcttcttttcagccaaatggtatc

SEQ ID NO: 96181 - DNA, 25 bp, Mus musculus
ctcttgaaattagtgtgccctggga

SEQ ID NO: 96182 - DNA, 25 bp, Mus musculus
ctcttgagggatttggatttgctac

SEQ ID NO: 96183 - DNA, 25 bp, Mus musculus
ctcttgatgcgaggtaattaccgag

SEQ ID NO: 96184 - DNA, 25 bp, Mus musculus
ctcttgccgcgagagtagctttcaa

SEQ ID NO: 96185 - DNA, 25 bp, Mus musculus
ctcttgctgcatgacggactgaccg

SEQ ID NO: 96186 - DNA, 25 bp, Mus musculus
ctcttggaacgaagagcccgggcca

SEQ ID NO: 96187 - DNA, 25 bp, Mus musculus
ctcttggccacattacgggctctgg

SEQ ID NO: 96188 - DNA, 25 bp, Mus musculus
ctcttggcggctatcctcttgggaa

SEQ ID NO: 96189 - DNA, 25 bp, Mus musculus
ctcttggcgtgctggagagcatcct

SEQ ID NO: 96190 - DNA, 25 bp, Mus musculus
ctctttgagggcagcaccagtggga

SEQ ID NO: 96191 - DNA, 25 bp, Mus musculus
ctctttggcatcaggaggagcaaca

SEQ ID NO: 96192 - DNA, 25 bp, Mus musculus
ctctttgggaaaacggaggtgcaag

SEQ ID NO: 96193 - DNA, 25 bp, Mus musculus
ctctttgggaaacaggagaagtgca

SEQ ID NO: 96194 - DNA, 25 bp, Mus musculus
ctctttgggagaggatcgggtcaac

SEQ ID NO: 96195 - DNA, 25 bp, Mus musculus
ctcttttgtcacaaagagtcctaac

SEQ ID NO: 96196 - DNA, 25 bp, Mus musculus
ctgaaaacggaataaagtgaagatc

SEQ ID NO: 96197 - DNA, 25 bp, Mus musculus
ctgaaaagcgcagcctgacagcaag

SEQ ID NO: 96198 - DNA, 25 bp, Mus musculus
ctgaaacccggagatggccagagcc

SEQ ID NO: 96199 - DNA, 25 bp, Mus musculus
ctgaaactggaggatactgacttta

SEQ ID NO: 96200 - DNA, 25 bp, Mus musculus
ctgaaagaaagatgaccctggagtc

SEQ ID NO: 96201 - DNA, 25 bp, Mus musculus
ctgaaagccgaagcgacagcgagaa

SEQ ID NO: 96202 - DNA, 25 bp, Mus musculus
ctgaaaggatgcgagatgtacgtgc

SEQ ID NO: 96203 - DNA, 25 bp, Mus musculus
ctgaaagtgtcccagctccaggaga

SEQ ID NO: 96204 - DNA, 25 bp, Mus musculus
ctgaaatacgaatgcctccctggct

SEQ ID NO: 96205 - DNA, 25 bp, Mus musculus
ctgaaatcctggaattgagtccttc

SEQ ID NO: 96206 - DNA, 25 bp, Mus musculus
ctgaaattgtgtgtagcgcccctcc

SEQ ID NO: 96207 - DNA, 25 bp, Mus musculus
ctgaacactgttatcagcctccggg

SEQ ID NO: 96208 - DNA, 25 bp, Mus musculus
ctgaacatcatggtctgcggcgcct

SEQ ID NO: 96209 - DNA, 25 bp, Mus musculus
ctgaactacagccatatctggacca

SEQ ID NO: 96210 - DNA, 25 bp, Mus musculus
ctgaactacattttgacagaacaac

SEQ ID NO: 96211 - DNA, 25 bp, Mus musculus
ctgaactgcagagggcgctgtccaa

SEQ ID NO: 96212 - DNA, 25 bp, Mus musculus
ctgaactgcatgaaagatctggtgg

SEQ ID NO: 96213 - DNA, 25 bp, Mus musculus
ctgaagaaggagtcagaactgccct

SEQ ID NO: 96214 - DNA, 25 bp, Mus musculus
ctgaagagctccactaaggactcca

SEQ ID NO: 96215 - DNA, 25 bp, Mus musculus
ctgaagatccgcattcaggtggcag

SEQ ID NO: 96216 - DNA, 25 bp, Mus musculus
ctgaagcactgagtcctggacgctg

SEQ ID NO: 96217 - DNA, 25 bp, Mus musculus
ctgaagcaggagtctttgggatccc

SEQ ID NO: 96218 - DNA, 25 bp, Mus musculus
ctgaagcgaatccaccaggaggaga

SEQ ID NO: 96219 - DNA, 25 bp, Mus musculus
ctgaagctacaggagagcagaggct

SEQ ID NO: 96220 - DNA, 25 bp, Mus musculus
ctgaagctgctgaagggtccttcgt

SEQ ID NO: 96221 - DNA, 25 bp, Mus musculus
ctgaagctggcacacgactgagagt

SEQ ID NO: 96222 - DNA, 25 bp, Mus musculus
ctgaagcttccttagtgctagtggt

SEQ ID NO: 96223 - DNA, 25 bp, Mus musculus
ctgaaggagatgtattccgaggcct

SEQ ID NO: 96224 - DNA, 25 bp, Mus musculus
ctgaaggagcctgcagcgctcaccg

SEQ ID NO: 96225 - DNA, 25 bp, Mus musculus
ctgaaggatgggagccacgtgggac

SEQ ID NO: 96226 - DNA, 25 bp, Mus musculus
ctgaaggcagagcttaacagtgaca

SEQ ID NO: 96227 - DNA, 25 bp, Mus musculus
ctgaaggccctgatggcccagagga

SEQ ID NO: 96228 - DNA, 25 bp, Mus musculus
ctgaaggctgcgctgactcaccatc

SEQ ID NO: 96229 - DNA, 25 bp, Mus musculus
ctgaagggagctgacctaacccagg

SEQ ID NO: 96230 - DNA, 25 bp, Mus musculus
ctgaagggtttcagcgccgagacgt

SEQ ID NO: 96231 - DNA, 25 bp, Mus musculus
ctgaagtacagggtgaggtctgcct

SEQ ID NO: 96232 - DNA, 25 bp, Mus musculus
ctgaagtacgttaacgtgggagatc

SEQ ID NO: 96233 - DNA, 25 bp, Mus musculus
ctgaagtcggcttttgaggaaacgg

SEQ ID NO: 96234 - DNA, 25 bp, Mus musculus
ctgaagtgcccactgaccgggaagc

SEQ ID NO: 96235 - DNA, 25 bp, Mus musculus
ctgaagttccccacgggcagtgtga

SEQ ID NO: 96236 - DNA, 25 bp, Mus musculus
ctgaatcacttggacagcctcaagg

SEQ ID NO: 96237 - DNA, 25 bp, Mus musculus
ctgaatgacacgaccagtgggcggc

SEQ ID NO: 96238 - DNA, 25 bp, Mus musculus
ctgaatgagtttggagtggctgccc

SEQ ID NO: 96239 - DNA, 25 bp, Mus musculus
ctgaatggactaaacatgaagagcc

SEQ ID NO: 96240 - DNA, 25 bp, Mus musculus
ctgaatggcggctcgctgaggcggt

SEQ ID NO: 96241 - DNA, 25 bp, Mus musculus
ctgaattgagctgcaatgggcctgg

SEQ ID NO: 96242 - DNA, 25 bp, Mus musculus
ctgacaaaattcattatacctgagt

SEQ ID NO: 96243 - DNA, 25 bp, Mus musculus
ctgacacagagcttatgaaatggac

SEQ ID NO: 96244 - DNA, 25 bp, Mus musculus
ctgacacagtaccagctgctggcca

SEQ ID NO: 96245 - DNA, 25 bp, Mus musculus
ctgacaccccggaggagccagtcga

SEQ ID NO: 96246 - DNA, 25 bp, Mus musculus
ctgacacttcaggaacagccgaggc

SEQ ID NO: 96247 - DNA, 25 bp, Mus musculus
ctgacagccaaagaggagcttctgc

SEQ ID NO: 96248 - DNA, 25 bp, Mus musculus
ctgacagccacagcctggtgatgga

SEQ ID NO: 96249 - DNA, 25 bp, Mus musculus
ctgacagcgaagtcccagagaagga

SEQ ID NO: 96250 - DNA, 25 bp, Mus musculus
ctgacaggttgagaaatgatggccc

SEQ ID NO: 96251 - DNA, 25 bp, Mus musculus
ctgacatctaagcaaggcggccgct

SEQ ID NO: 96252 - DNA, 25 bp, Mus musculus
ctgacatggcgctacctggacgaaa

SEQ ID NO: 96253 - DNA, 25 bp, Mus musculus
ctgaccaagcagctgcttcactgta

SEQ ID NO: 96254 - DNA, 25 bp, Mus musculus
ctgaccaggtctgttagggcagcgc

SEQ ID NO: 96255 - DNA, 25 bp, Mus musculus
ctgacccacgtgagctctgcagctg

SEQ ID NO: 96256 - DNA, 25 bp, Mus musculus
ctgaccgcagaagggagaaaggagc

SEQ ID NO: 96257 - DNA, 25 bp, Mus musculus
ctgacctaggatccctggccttgga

SEQ ID NO: 96258 - DNA, 25 bp, Mus musculus
ctgacctccatgctctgtttgactt

SEQ ID NO: 96259 - DNA, 25 bp, Mus musculus
ctgacctgcccgaagtgaaacgcgt

SEQ ID NO: 96260 - DNA, 25 bp, Mus musculus
ctgacctgggcatggtccccaatct

SEQ ID NO: 96261 - DNA, 25 bp, Mus musculus
ctgaccttaaagagagagtgtgaac

SEQ ID NO: 96262 - DNA, 25 bp, Mus musculus
ctgaccttcagggagaatgccaaag

SEQ ID NO: 96263 - DNA, 25 bp, Mus musculus
ctgacgacgattgtgttccttttcc

SEQ ID NO: 96264 - DNA, 25 bp, Mus musculus
ctgacgctggccttggtgaacctgc

SEQ ID NO: 96265 - DNA, 25 bp, Mus musculus
ctgacggtgctgacctcaggacagt

SEQ ID NO: 96266 - DNA, 25 bp, Mus musculus
ctgacgtctgtcctctccaagtgcg

SEQ ID NO: 96267 - DNA, 25 bp, Mus musculus
ctgactacgggcatgcatgtgggca

SEQ ID NO: 96268 - DNA, 25 bp, Mus musculus
ctgactcgaccagaccgtgtggcaa

SEQ ID NO: 96269 - DNA, 25 bp, Mus musculus
ctgactgcggcagccgttgagggcc

SEQ ID NO: 96270 - DNA, 25 bp, Mus musculus
ctgactggtactccaacaggttgga

SEQ ID NO: 96271 - DNA, 25 bp, Mus musculus
ctgactgtaaggactcttctaagga

SEQ ID NO: 96272 - DNA, 25 bp, Mus musculus
ctgactttggacagtgagaccctga

SEQ ID NO: 96273 - DNA, 25 bp, Mus musculus
ctgagaaatgaagagtccacgttct

SEQ ID NO: 96274 - DNA, 25 bp, Mus musculus
ctgagaagatcagggtcacagtgcc

SEQ ID NO: 96275 - DNA, 25 bp, Mus musculus
ctgagaagggtgacgtccaagcaca

SEQ ID NO: 96276 - DNA, 25 bp, Mus musculus
ctgagaatgggcaatagtgtccctc

SEQ ID NO: 96277 - DNA, 25 bp, Mus musculus
ctgagacagcgaaccaatggagcgc

SEQ ID NO: 96278 - DNA, 25 bp, Mus musculus
ctgagacctccatgagtggagggaa

SEQ ID NO: 96279 - DNA, 25 bp, Mus musculus
ctgagacgttatgggccacgcactg

SEQ ID NO: 96280 - DNA, 25 bp, Mus musculus
ctgagacttttgtggcgctggctgc

SEQ ID NO: 96281 - DNA, 25 bp, Mus musculus
ctgagagagtatcagcagaagaaca

SEQ ID NO: 96282 - DNA, 25 bp, Mus musculus
ctgagaggtaccagccagctgtact

SEQ ID NO: 96283 - DNA, 25 bp, Mus musculus
ctgagagtgcaaaccaaggctgccg

SEQ ID NO: 96284 - DNA, 25 bp, Mus musculus
ctgagatcctgagaaagagagcgct

SEQ ID NO: 96285 - DNA, 25 bp, Mus musculus
ctgagatccttaccctgtccctgtg

SEQ ID NO: 96286 - DNA, 25 bp, Mus musculus
ctgagatctatgagaacctgaggcc

SEQ ID NO: 96287 - DNA, 25 bp, Mus musculus
ctgagcaaggtgttcacagggagca

SEQ ID NO: 96288 - DNA, 25 bp, Mus musculus
ctgagcacacttcataggcccgagg

SEQ ID NO: 96289 - DNA, 25 bp, Mus musculus
ctgagcacggcgtgcggtgggcgcg

SEQ ID NO: 96290 - DNA, 25 bp, Mus musculus
ctgagcacggtgaaaagagaaacgc

SEQ ID NO: 96291 - DNA, 25 bp, Mus musculus
ctgagccagtagtgggacaagccct

SEQ ID NO: 96292 - DNA, 25 bp, Mus musculus
ctgagccctgcgtgggccatggcct

SEQ ID NO: 96293 - DNA, 25 bp, Mus musculus
ctgagcctgctggacaactacctga

SEQ ID NO: 96294 - DNA, 25 bp, Mus musculus
ctgagcctgggcgacctgctggtat

SEQ ID NO: 96295 - DNA, 25 bp, Mus musculus
ctgagcggcccagccgctgccgccg

SEQ ID NO: 96296 - DNA, 25 bp, Mus musculus
ctgagctcgaggcatcccagaagga

SEQ ID NO: 96297 - DNA, 25 bp, Mus musculus
ctgagctcgtgtgcggcagcagagg

SEQ ID NO: 96298 - DNA, 25 bp, Mus musculus
ctgaggaccccaacgcaaatggtgg

SEQ ID NO: 96299 - DNA, 25 bp, Mus musculus
ctgaggacgccggagcagaatgtac

SEQ ID NO: 96300 - DNA, 25 bp, Mus musculus
ctgaggagaaatggtacaaggtcac

SEQ ID NO: 96301 - DNA, 25 bp, Mus musculus
ctgaggagctgaacgccgtcatcgt

SEQ ID NO: 96302 - DNA, 25 bp, Mus musculus
ctgaggatattcaaatgggtgcctg

SEQ ID NO: 96303 - DNA, 25 bp, Mus musculus
ctgaggatggaagatgcaggaactt

SEQ ID NO: 96304 - DNA, 25 bp, Mus musculus
ctgaggcaccacgtgatcccagaga

SEQ ID NO: 96305 - DNA, 25 bp, Mus musculus
ctgaggcccagtcgacgtggcactt

SEQ ID NO: 96306 - DNA, 25 bp, Mus musculus
ctgaggccccgcagtgtcctgacaa

SEQ ID NO: 96307 - DNA, 25 bp, Mus musculus
ctgaggctgagggtatagcagtacc

SEQ ID NO: 96308 - DNA, 25 bp, Mus musculus
ctgagggcttgcacccagcagttga

SEQ ID NO: 96309 - DNA, 25 bp, Mus musculus
ctgagggtccatcccgaagcccaag

SEQ ID NO: 96310 - DNA, 25 bp, Mus musculus
ctgaggtacaaaagaaccaagtact

SEQ ID NO: 96311 - DNA, 25 bp, Mus musculus
ctgaggtctccaagacagagccgct

SEQ ID NO: 96312 - DNA, 25 bp, Mus musculus
ctgaggtgagctgccatcatggaga

SEQ ID NO: 96313 - DNA, 25 bp, Mus musculus
ctgaggttgtatttgctgagaaaac

SEQ ID NO: 96314 - DNA, 25 bp, Mus musculus
ctgagtaaggtccacgcagcagaac

SEQ ID NO: 96315 - DNA, 25 bp, Mus musculus
ctgagtccagaccactacgagcaca

SEQ ID NO: 96316 - DNA, 25 bp, Mus musculus
ctgagtcccagtgccgcagacatga

SEQ ID NO: 96317 - DNA, 25 bp, Mus musculus
ctgagtccccgtacacacactggaa

SEQ ID NO: 96318 - DNA, 25 bp, Mus musculus
ctgagtgaactgtaactgttaaact

SEQ ID NO: 96319 - DNA, 25 bp, Mus musculus
ctgagtgaccctaagaagcggagcc

SEQ ID NO: 96320 - DNA, 25 bp, Mus musculus
ctgagtgaggccaacgtgcggctca

SEQ ID NO: 96321 - DNA, 25 bp, Mus musculus
ctgagtggcaccgtggcccagacag

SEQ ID NO: 96322 - DNA, 25 bp, Mus musculus
ctgagtgggttttcggatcatgtct

SEQ ID NO: 96323 - DNA, 25 bp, Mus musculus
ctgagttgatctccaagttggaaga

SEQ ID NO: 96324 - DNA, 25 bp, Mus musculus
ctgatactagccaggagggcgctga

SEQ ID NO: 96325 - DNA, 25 bp, Mus musculus
ctgatatatgtaaaagctgaggcga

SEQ ID NO: 96326 - DNA, 25 bp, Mus musculus
ctgatccctttgaacccttcactgc

SEQ ID NO: 96327 - DNA, 25 bp, Mus musculus
ctgatctctgtggactggcggtgct

SEQ ID NO: 96328 - DNA, 25 bp, Mus musculus
ctgatctgcccgaagccatgaggag

SEQ ID NO: 96329 - DNA, 25 bp, Mus musculus
ctgatctggttcgacaagctgagga

SEQ ID NO: 96330 - DNA, 25 bp, Mus musculus
ctgatctgtgtagctgaccgcctgg

SEQ ID NO: 96331 - DNA, 25 bp, Mus musculus
ctgatgaatccagctgccagtgcca

SEQ ID NO: 96332 - DNA, 25 bp, Mus musculus
ctgatgaccacgtcctctgacacgg

SEQ ID NO: 96333 - DNA, 25 bp, Mus musculus
ctgatgagaccaccttgaaggagct

SEQ ID NO: 96334 - DNA, 25 bp, Mus musculus
ctgatgagcagaagtcctgtggccg

SEQ ID NO: 96335 - DNA, 25 bp, Mus musculus
ctgatgaggcctgggtagttgtact

SEQ ID NO: 96336 - DNA, 25 bp, Mus musculus
ctgatgcccagtgtataagacccta

SEQ ID NO: 96337 - DNA, 25 bp, Mus musculus
ctgatgcccgctctatctacgttgg

SEQ ID NO: 96338 - DNA, 25 bp, Mus musculus
ctgatgctgccgaattttggagaaa

SEQ ID NO: 96339 - DNA, 25 bp, Mus musculus
ctgatggcggtcactgctggagctc

SEQ ID NO: 96340 - DNA, 25 bp, Mus musculus
ctgatgtactgcaggcaccgggtgc

SEQ ID NO: 96341 - DNA, 25 bp, Mus musculus
ctgatgtcgtgttgggaaggaccct

SEQ ID NO: 96342 - DNA, 25 bp, Mus musculus
ctgatgtgtttaagattggaatggc

SEQ ID NO: 96343 - DNA, 25 bp, Mus musculus
ctgatgtttcagtacttggtaaaca

SEQ ID NO: 96344 - DNA, 25 bp, Mus musculus
ctgattcagaagacgaagacgatca

SEQ ID NO: 96345 - DNA, 25 bp, Mus musculus
ctgattgacaagtactgcccgggca

SEQ ID NO: 96346 - DNA, 25 bp, Mus musculus
ctgattgggcctcttacaagctggg

SEQ ID NO: 96347 - DNA, 25 bp, Mus musculus
ctgatttcatcagttgacccacagt

SEQ ID NO: 96348 - DNA, 25 bp, Mus musculus
ctgcaaaacggagcccacgaagtgt

SEQ ID NO: 96349 - DNA, 25 bp, Mus musculus
ctgcaaatagctcaactcaggcctg

SEQ ID NO: 96350 - DNA, 25 bp, Mus musculus
ctgcaactaggagggaatgagcgcc

SEQ ID NO: 96351 - DNA, 25 bp, Mus musculus
ctgcaagaaatggctcaggagcaag

SEQ ID NO: 96352 - DNA, 25 bp, Mus musculus
ctgcaagttgttccgcgacgacgag

SEQ ID NO: 96353 - DNA, 25 bp, Mus musculus
ctgcacaggaggagacagcagcgtc

SEQ ID NO: 96354 - DNA, 25 bp, Mus musculus
ctgcacgaggactggctgctttggc

SEQ ID NO: 96355 - DNA, 25 bp, Mus musculus
ctgcacgtggtcatgaggtcttcta

SEQ ID NO: 96356 - DNA, 25 bp, Mus musculus
ctgcactcacaagcgaagggaaggc

SEQ ID NO: 96357 - DNA, 25 bp, Mus musculus
ctgcacttagcagggattcggtcct

SEQ ID NO: 96358 - DNA, 25 bp, Mus musculus
ctgcagacgcttccggcgacttggc

SEQ ID NO: 96359 - DNA, 25 bp, Mus musculus
ctgcagagagaggaccgacagcagc

SEQ ID NO: 96360 - DNA, 25 bp, Mus musculus
ctgcagaggaggagataaaccagct

SEQ ID NO: 96361 - DNA, 25 bp, Mus musculus
ctgcagcaccgtgggagagaatact

SEQ ID NO: 96362 - DNA, 25 bp, Mus musculus
ctgcagcactctcccgggaatacaa

SEQ ID NO: 96363 - DNA, 25 bp, Mus musculus
ctgcagcagctcaaaagggagcgca

SEQ ID NO: 96364 - DNA, 25 bp, Mus musculus
ctgcagccggatgacagcaccgtgt

SEQ ID NO: 96365 - DNA, 25 bp, Mus musculus
ctgcagcgaagtccgccagatctac

SEQ ID NO: 96366 - DNA, 25 bp, Mus musculus
ctgcagcgctccacggtgccgggct

SEQ ID NO: 96367 - DNA, 25 bp, Mus musculus
ctgcagcggtctggaagaggtctct

SEQ ID NO: 96368 - DNA, 25 bp, Mus musculus
ctgcaggacagagaagactgagact

SEQ ID NO: 96369 - DNA, 25 bp, Mus musculus
ctgcaggatgttccacgggatccca

SEQ ID NO: 96370 - DNA, 25 bp, Mus musculus
ctgcagtccgatgctcagcagctga

SEQ ID NO: 96371 - DNA, 25 bp, Mus musculus
ctgcagtgctgaagagttggacctc

SEQ ID NO: 96372 - DNA, 25 bp, Mus musculus
ctgcatagttgcatctttcccaaag

SEQ ID NO: 96373 - DNA, 25 bp, Mus musculus
ctgcatggaccaggagagaagccca

SEQ ID NO: 96374 - DNA, 25 bp, Mus musculus
ctgccaagctaaaaaggaagtactg

SEQ ID NO: 96375 - DNA, 25 bp, Mus musculus
ctgccaagtcaggagtgggaacccc

SEQ ID NO: 96376 - DNA, 25 bp, Mus musculus
ctgccacaataaaggtttgctgaca

SEQ ID NO: 96377 - DNA, 25 bp, Mus musculus
ctgccacccacgagttcaagcaggc

SEQ ID NO: 96378 - DNA, 25 bp, Mus musculus
ctgccaccggcaccatgccccaccc

SEQ ID NO: 96379 - DNA, 25 bp, Mus musculus
ctgccacgggtggagtaaacctcct

SEQ ID NO: 96380 - DNA, 25 bp, Mus musculus
ctgccaggcgcagctgggcgacatt

SEQ ID NO: 96381 - DNA, 25 bp, Mus musculus
ctgccaggtcggaggaaggtctcca

SEQ ID NO: 96382 - DNA, 25 bp, Mus musculus
ctgccagtgctggaagcagcatgtt

SEQ ID NO: 96383 - DNA, 25 bp, Mus musculus
ctgccagtttgtggagtttgcaaac

SEQ ID NO: 96384 - DNA, 25 bp, Mus musculus
ctgcccagctggatcctgaggaaga

SEQ ID NO: 96385 - DNA, 25 bp, Mus musculus
ctgcccatgcacaagatgatgaaca

SEQ ID NO: 96386 - DNA, 25 bp, Mus musculus
ctgcccgaggaggaaagcgtcgatc

SEQ ID NO: 96387 - DNA, 25 bp, Mus musculus
ctgcccggacgaaaggagggcacct

SEQ ID NO: 96388 - DNA, 25 bp, Mus musculus
ctgccctcgtgtgcggtgttgtctg

SEQ ID NO: 96389 - DNA, 25 bp, Mus musculus
ctgccgaaggaacagggaaaaagca

SEQ ID NO: 96390 - DNA, 25 bp, Mus musculus
ctgccgccatgtcgaacgggaacat

SEQ ID NO: 96391 - DNA, 25 bp, Mus musculus
ctgccgctggcgaaccggagtcacg

SEQ ID NO: 96392 - DNA, 25 bp, Mus musculus
ctgccgctgtgaggatggttggatg

SEQ ID NO: 96393 - DNA, 25 bp, Mus musculus
ctgccggaagagtgattgctgcgac

SEQ ID NO: 96394 - DNA, 25 bp, Mus musculus
ctgccggagtcctcggtcagagcct

SEQ ID NO: 96395 - DNA, 25 bp, Mus musculus
ctgcctcagggacggtgcttcatat

SEQ ID NO: 96396 - DNA, 25 bp, Mus musculus
ctgcctgagaaagccggcgctgtgc

SEQ ID NO: 96397 - DNA, 25 bp, Mus musculus
ctgcctgagaacaagcccctggtgt

SEQ ID NO: 96398 - DNA, 25 bp, Mus musculus
ctgcctgccaagtgtccgggaaagg

SEQ ID NO: 96399 - DNA, 25 bp, Mus musculus
ctgcctggacagagacagcgtgccg

SEQ ID NO: 96400 - DNA, 25 bp, Mus musculus
ctgcctgggctcaagcgtgcggaga

SEQ ID NO: 96401 - DNA, 25 bp, Mus musculus
ctgccttcaactaggatggcctctc

SEQ ID NO: 96402 - DNA, 25 bp, Mus musculus
ctgccttcggaaggtgactggcctg

SEQ ID NO: 96403 - DNA, 25 bp, Mus musculus
ctgcgagactggctgtatgaacaca

SEQ ID NO: 96404 - DNA, 25 bp, Mus musculus
ctgcgaggcagaccgacgatgtcat

SEQ ID NO: 96405 - DNA, 25 bp, Mus musculus
ctgcgagtttctcctccaaaatggg

SEQ ID NO: 96406 - DNA, 25 bp, Mus musculus
ctgcgctcctctcggccgtccagtg

SEQ ID NO: 96407 - DNA, 25 bp, Mus musculus
ctgcgctggccgtgataaagggctt

SEQ ID NO: 96408 - DNA, 25 bp, Mus musculus
ctgcgctttggcgagctctgcgcag

SEQ ID NO: 96409 - DNA, 25 bp, Mus musculus
ctgcggaagttcgagtgcccatgct

SEQ ID NO: 96410 - DNA, 25 bp, Mus musculus
ctgcggacggtttgcccgagcccgt

SEQ ID NO: 96411 - DNA, 25 bp, Mus musculus
ctgcggacgtgagcttgcctgccgt

SEQ ID NO: 96412 - DNA, 25 bp, Mus musculus
ctgcggaggcacgagctacttcctt

SEQ ID NO: 96413 - DNA, 25 bp, Mus musculus
ctgcggcgttctcaaagttcggaca

SEQ ID NO: 96414 - DNA, 25 bp, Mus musculus
ctgcggtgtgatcgccgctgccggg

SEQ ID NO: 96415 - DNA, 25 bp, Mus musculus
ctgcgtcgttgctccccggttgtaa

SEQ ID NO: 96416 - DNA, 25 bp, Mus musculus
ctgcgtgtcagtagagaatgtgctc

SEQ ID NO: 96417 - DNA, 25 bp, Mus musculus
ctgcgtgtccgtggctgcaacaagg

SEQ ID NO: 96418 - DNA, 25 bp, Mus musculus
ctgctaattgtttaccgttttgaag

SEQ ID NO: 96419 - DNA, 25 bp, Mus musculus
ctgctagctaccttcccgcggtgtg

SEQ ID NO: 96420 - DNA, 25 bp, Mus musculus
ctgctatgaggcttaactgctgtca

SEQ ID NO: 96421 - DNA, 25 bp, Mus musculus
ctgctatgatgagtttggtttccgt

SEQ ID NO: 96422 - DNA, 25 bp, Mus musculus
ctgctcagctagtgggacgccagac

SEQ ID NO: 96423 - DNA, 25 bp, Mus musculus
ctgctcatcacccatgatggtggat

SEQ ID NO: 96424 - DNA, 25 bp, Mus musculus
ctgctcatttcagctgggtggaccc

SEQ ID NO: 96425 - DNA, 25 bp, Mus musculus
ctgctcccagccgtgatgatgaatg

SEQ ID NO: 96426 - DNA, 25 bp, Mus musculus
ctgctcctcatgattttaatactgg

SEQ ID NO: 96427 - DNA, 25 bp, Mus musculus
ctgctcgcagaaatcggcctcggta

SEQ ID NO: 96428 - DNA, 25 bp, Mus musculus
ctgctcggagctggaacctcaggga

SEQ ID NO: 96429 - DNA, 25 bp, Mus musculus
ctgctcgtccggacctgagtggccg

SEQ ID NO: 96430 - DNA, 25 bp, Mus musculus
ctgctctgagactcactgtcagatc

SEQ ID NO: 96431 - DNA, 25 bp, Mus musculus
ctgctctgctggagcggtctgctcc

SEQ ID NO: 96432 - DNA, 25 bp, Mus musculus
ctgctctggacgaggagatgctctg

SEQ ID NO: 96433 - DNA, 25 bp, Mus musculus
ctgctctgtacccaagaagatgctg

SEQ ID NO: 96434 - DNA, 25 bp, Mus musculus
ctgctgacctgacctttgaccgcgg

SEQ ID NO: 96435 - DNA, 25 bp, Mus musculus
ctgctgagaacaaggatggagtacc

SEQ ID NO: 96436 - DNA, 25 bp, Mus musculus
ctgctgagagccgagaaaagtactc

SEQ ID NO: 96437 - DNA, 25 bp, Mus musculus
ctgctgagagcgctggacggcgagg

SEQ ID NO: 96438 - DNA, 25 bp, Mus musculus
ctgctgagaggatggctaagtgccc

SEQ ID NO: 96439 - DNA, 25 bp, Mus musculus
ctgctgagccctctgcgtgcgcggg

SEQ ID NO: 96440 - DNA, 25 bp, Mus musculus
ctgctgcaaaaatgagtgcctcaga

SEQ ID NO: 96441 - DNA, 25 bp, Mus musculus
ctgctgcgggaagcgcgtgtattcc

SEQ ID NO: 96442 - DNA, 25 bp, Mus musculus
ctgctgcggtccttgccgagagtga

SEQ ID NO: 96443 - DNA, 25 bp, Mus musculus
ctgctgctacaaggcgtagaactct

SEQ ID NO: 96444 - DNA, 25 bp, Mus musculus
ctgctgctgagcacggctccggagc

SEQ ID NO: 96445 - DNA, 25 bp, Mus musculus
ctgctgctgcgtaccctgcgtgctg

SEQ ID NO: 96446 - DNA, 25 bp, Mus musculus
ctgctgctgtagattgacggccccg

SEQ ID NO: 96447 - DNA, 25 bp, Mus musculus
ctgctggtggtagatgaagctgacc

SEQ ID NO: 96448 - DNA, 25 bp, Mus musculus
ctgctggttactcaccgccagaaag

SEQ ID NO: 96449 - DNA, 25 bp, Mus musculus
ctgctgtacgactccaggatttgga

SEQ ID NO: 96450 - DNA, 25 bp, Mus musculus
ctgctgtatcttggacgggactatc

SEQ ID NO: 96451 - DNA, 25 bp, Mus musculus
ctgctgtctggctgaagagctgtgc

SEQ ID NO: 96452 - DNA, 25 bp, Mus musculus
ctgctgtggagagctcaggccggca

SEQ ID NO: 96453 - DNA, 25 bp, Mus musculus
ctgctgtggcttgcagcccgcggaa

SEQ ID NO: 96454 - DNA, 25 bp, Mus musculus
ctgctgtggtcaggccgcttcaaga

SEQ ID NO: 96455 - DNA, 25 bp, Mus musculus
ctgctgttctgggtctgggtgcaac

SEQ ID NO: 96456 - DNA, 25 bp, Mus musculus
ctgctgttgctcctttcggccgcgg

SEQ ID NO: 96457 - DNA, 25 bp, Mus musculus
ctgcttcagctttctctgtggaagg

SEQ ID NO: 96458 - DNA, 25 bp, Mus musculus
ctgctttaaaagaccgacggatgga

SEQ ID NO: 96459 - DNA, 25 bp, Mus musculus
ctggaaaaatcctggtgttttgaat

SEQ ID NO: 96460 - DNA, 25 bp, Mus musculus
ctggaaaactggcagtcccctttgc

SEQ ID NO: 96461 - DNA, 25 bp, Mus musculus
ctggaaaatgatgaggacggagccc

SEQ ID NO: 96462 - DNA, 25 bp, Mus musculus
ctggaaaccgcctgtcatgaagaga

SEQ ID NO: 96463 - DNA, 25 bp, Mus musculus
ctggaaaggccaattaaggtgggct

SEQ ID NO: 96464 - DNA, 25 bp, Mus musculus
ctggaaatactgaccattcgtgcat

SEQ ID NO: 96465 - DNA, 25 bp, Mus musculus
ctggaaatggaaccacacccgagga

SEQ ID NO: 96466 - DNA, 25 bp, Mus musculus
ctggaacaagtgaacgccctggtgc

SEQ ID NO: 96467 - DNA, 25 bp, Mus musculus
ctggaaccctacatggatgagaact

SEQ ID NO: 96468 - DNA, 25 bp, Mus musculus
ctggaacctgtgtgtaggctcagga

SEQ ID NO: 96469 - DNA, 25 bp, Mus musculus
ctggaagaccaggaacggctgctgc

SEQ ID NO: 96470 - DNA, 25 bp, Mus musculus
ctggaagagaaagaccgagtgatgc

SEQ ID NO: 96471 - DNA, 25 bp, Mus musculus
ctggaagaggctacggcgagacaac

SEQ ID NO: 96472 - DNA, 25 bp, Mus musculus
ctggaagcagactgtgttctacatg

SEQ ID NO: 96473 - DNA, 25 bp, Mus musculus
ctggaagctgggacagccacgtgac

SEQ ID NO: 96474 - DNA, 25 bp, Mus musculus
ctggaagtcatatctggagaacccc

SEQ ID NO: 96475 - DNA, 25 bp, Mus musculus
ctggaataaattcaggacctggtct

SEQ ID NO: 96476 - DNA, 25 bp, Mus musculus
ctggaatgaagacagtggctcctac

SEQ ID NO: 96477 - DNA, 25 bp, Mus musculus
ctggaatttgacaccggacggcggc

SEQ ID NO: 96478 - DNA, 25 bp, Mus musculus
ctggacagcgaggaggccctcatct

SEQ ID NO: 96479 - DNA, 25 bp, Mus musculus
ctggacatcgttgtcaatcccacaa

SEQ ID NO: 96480 - DNA, 25 bp, Mus musculus
ctggaccaagccgagactgttctgg

SEQ ID NO: 96481 - DNA, 25 bp, Mus musculus
ctggacccagttcctactatgtatg

SEQ ID NO: 96482 - DNA, 25 bp, Mus musculus
ctggaccctgaagataccccggatg

SEQ ID NO: 96483 - DNA, 25 bp, Mus musculus
ctggactctgggaaaagcattgacc

SEQ ID NO: 96484 - DNA, 25 bp, Mus musculus
ctggactctgtttctgcaggcaagg

SEQ ID NO: 96485 - DNA, 25 bp, Mus musculus
ctggactgaagtgcccaggtacttt

SEQ ID NO: 96486 - DNA, 25 bp, Mus musculus
ctggacttctgtgagcctgacgctt

SEQ ID NO: 96487 - DNA, 25 bp, Mus musculus
ctggacttggaagagggccctgctc

SEQ ID NO: 96488 - DNA, 25 bp, Mus musculus
ctggagaactgtagcaccctggtct

SEQ ID NO: 96489 - DNA, 25 bp, Mus musculus
ctggagaatgcaaccccgatttgcg

SEQ ID NO: 96490 - DNA, 25 bp, Mus musculus
ctggagacaccaagttccctgctca

SEQ ID NO: 96491 - DNA, 25 bp, Mus musculus
ctggagagcaatcatggacaacctg

SEQ ID NO: 96492 - DNA, 25 bp, Mus musculus
ctggagaggcagcattggatcccca

SEQ ID NO: 96493 - DNA, 25 bp, Mus musculus
ctggagagtagaagaggtgccattc

SEQ ID NO: 96494 - DNA, 25 bp, Mus musculus
ctggagatcactggcccaaaggtgg

SEQ ID NO: 96495 - DNA, 25 bp, Mus musculus
ctggagatggcgtgaaccgctgcat

SEQ ID NO: 96496 - DNA, 25 bp, Mus musculus
ctggagcccctgaaaatctgacatt

SEQ ID NO: 96497 - DNA, 25 bp, Mus musculus
ctggagcgacttctgcgagcagcac

SEQ ID NO: 96498 - DNA, 25 bp, Mus musculus
ctggagctgcacaccgagctgttgg

SEQ ID NO: 96499 - DNA, 25 bp, Mus musculus
ctggagctggctggcaatgcagcaa

SEQ ID NO: 96500 - DNA, 25 bp, Mus musculus
ctggaggaggcaacctgatgatcct

SEQ ID NO: 96501 - DNA, 25 bp, Mus musculus
ctggaggccattgagaaccacaacc

SEQ ID NO: 96502 - DNA, 25 bp, Mus musculus
ctggagggtagtgagatgtcaccac

SEQ ID NO: 96503 - DNA, 25 bp, Mus musculus
ctggagggtcctcgccgagccgtga

SEQ ID NO: 96504 - DNA, 25 bp, Mus musculus
ctggaggtattcactgagcactgga

SEQ ID NO: 96505 - DNA, 25 bp, Mus musculus
ctggagtcccagaatattaatgagc

SEQ ID NO: 96506 - DNA, 25 bp, Mus musculus
ctggagtgtgtgtaccacttgggct

SEQ ID NO: 96507 - DNA, 25 bp, Mus musculus
ctggagttatgtagaagccttggac

SEQ ID NO: 96508 - DNA, 25 bp, Mus musculus
ctggataaaataaagactctgtggg

SEQ ID NO: 96509 - DNA, 25 bp, Mus musculus
ctggatcagcaatccacagaggaga

SEQ ID NO: 96510 - DNA, 25 bp, Mus musculus
ctggatccagagttgcatatagacc

SEQ ID NO: 96511 - DNA, 25 bp, Mus musculus
ctggatctggctggtgacacagttc

SEQ ID NO: 96512 - DNA, 25 bp, Mus musculus
ctggatctttgaaaccgctggcctc

SEQ ID NO: 96513 - DNA, 25 bp, Mus musculus
ctggattatccgtcagaggtcagtg

SEQ ID NO: 96514 - DNA, 25 bp, Mus musculus
ctggattcaggacaccattgccgca

SEQ ID NO: 96515 - DNA, 25 bp, Mus musculus
ctggattctgtatgagaagccccat

SEQ ID NO: 96516 - DNA, 25 bp, Mus musculus
ctggcacagcagcaagtaacttgat

SEQ ID NO: 96517 - DNA, 25 bp, Mus musculus
ctggcacaggtcagcgagttctcct

SEQ ID NO: 96518 - DNA, 25 bp, Mus musculus
ctggcagaaagggtggaaacagact

SEQ ID NO: 96519 - DNA, 25 bp, Mus musculus
ctggcagaagccatcgcagcaacat

SEQ ID NO: 96520 - DNA, 25 bp, Mus musculus
ctggcagcggcctactatggaatct

SEQ ID NO: 96521 - DNA, 25 bp, Mus musculus
ctggcagctgcagcggtttacagag

SEQ ID NO: 96522 - DNA, 25 bp, Mus musculus
ctggcaggaccatgaattagtgacc

SEQ ID NO: 96523 - DNA, 25 bp, Mus musculus
ctggcagtgctgaccaatgcggtga

SEQ ID NO: 96524 - DNA, 25 bp, Mus musculus
ctggcagtggtagtgaccacaagga

SEQ ID NO: 96525 - DNA, 25 bp, Mus musculus
ctggcatagccgctgcctcaagtgc

SEQ ID NO: 96526 - DNA, 25 bp, Mus musculus
ctggcatcaaactcaagaggttcac

SEQ ID NO: 96527 - DNA, 25 bp, Mus musculus
ctggcatcacgtcccaggaacctga

SEQ ID NO: 96528 - DNA, 25 bp, Mus musculus
ctggcattcctgatactcttcagtg

SEQ ID NO: 96529 - DNA, 25 bp, Mus musculus
ctggccaatcacaattgcgaagatg

SEQ ID NO: 96530 - DNA, 25 bp, Mus musculus
ctggccattgtgcagcgagtgaaca

SEQ ID NO: 96531 - DNA, 25 bp, Mus musculus
ctggcccacaacaggattgtccaga

SEQ ID NO: 96532 - DNA, 25 bp, Mus musculus
ctggcccagatattcctagaggact

SEQ ID NO: 96533 - DNA, 25 bp, Mus musculus
ctggccccaagagcggacgctggtt

SEQ ID NO: 96534 - DNA, 25 bp, Mus musculus
ctggcccggaccttggaggagtaca

SEQ ID NO: 96535 - DNA, 25 bp, Mus musculus
ctggccctaggcctgcgtctgactg

SEQ ID NO: 96536 - DNA, 25 bp, Mus musculus
ctggccgcgctctgcatcagtgacg

SEQ ID NO: 96537 - DNA, 25 bp, Mus musculus
ctggccgcggagtcagtcgaagctc

SEQ ID NO: 96538 - DNA, 25 bp, Mus musculus
ctggcctggcgagaagagacgttcc

SEQ ID NO: 96539 - DNA, 25 bp, Mus musculus
ctggcgaacatctacttggagtcaa

SEQ ID NO: 96540 - DNA, 25 bp, Mus musculus
ctggcgagttagaagctgcccctca

SEQ ID NO: 96541 - DNA, 25 bp, Mus musculus
ctggcgctcggcaggcgggagttga

SEQ ID NO: 96542 - DNA, 25 bp, Mus musculus
ctggcgcttgaagaccacggctgag

SEQ ID NO: 96543 - DNA, 25 bp, Mus musculus
ctggcgggacgcgggggaggcgcgc

SEQ ID NO: 96544 - DNA, 25 bp, Mus musculus
ctggctacagatggctaagagatga

SEQ ID NO: 96545 - DNA, 25 bp, Mus musculus
ctggctagagagcaaggacctcctg

SEQ ID NO: 96546 - DNA, 25 bp, Mus musculus
ctggctatacagacaacttggtgcg

SEQ ID NO: 96547 - DNA, 25 bp, Mus musculus
ctggctatgggaaagacatggtcaa

SEQ ID NO: 96548 - DNA, 25 bp, Mus musculus
ctggctcaaactcaaggaaatcttc

SEQ ID NO: 96549 - DNA, 25 bp, Mus musculus
ctggctccgagaagctgagggctct

SEQ ID NO: 96550 - DNA, 25 bp, Mus musculus
ctggctcgaatactacggaatgagt

SEQ ID NO: 96551 - DNA, 25 bp, Mus musculus
ctggctctcgggaggacgtcctcgc

SEQ ID NO: 96552 - DNA, 25 bp, Mus musculus
ctggctctggtctacactggtgtgg

SEQ ID NO: 96553 - DNA, 25 bp, Mus musculus
ctggctgtggacaaagtcatatttg

SEQ ID NO: 96554 - DNA, 25 bp, Mus musculus
ctggctgtggccgacggcgcgtctg

SEQ ID NO: 96555 - DNA, 25 bp, Mus musculus
ctggcttcaggaggcggctttcatt

SEQ ID NO: 96556 - DNA, 25 bp, Mus musculus
ctggcttcgtcctccagctcttctc

SEQ ID NO: 96557 - DNA, 25 bp, Mus musculus
ctggcttgctaaggctgcacggtga

SEQ ID NO: 96558 - DNA, 25 bp, Mus musculus
ctgggaactttgtccctcagagaca

SEQ ID NO: 96559 - DNA, 25 bp, Mus musculus
ctgggacaggcattgcagctgcctc

SEQ ID NO: 96560 - DNA, 25 bp, Mus musculus
ctgggaccaggctccccgtgggcaa

SEQ ID NO: 96561 - DNA, 25 bp, Mus musculus
ctgggagatccctacgtacggagcc

SEQ ID NO: 96562 - DNA, 25 bp, Mus musculus
ctgggagctgtcagagggtccatcc

SEQ ID NO: 96563 - DNA, 25 bp, Mus musculus
ctgggaggaatgctcttctctctga

SEQ ID NO: 96564 - DNA, 25 bp, Mus musculus
ctgggatcccctccgtgttcggaat

SEQ ID NO: 96565 - DNA, 25 bp, Mus musculus
ctgggcaacctgaggcggcatcagc

SEQ ID NO: 96566 - DNA, 25 bp, Mus musculus
ctgggcaccttttcacagagagctg

SEQ ID NO: 96567 - DNA, 25 bp, Mus musculus
ctgggcagacgcaagcggacagctt

SEQ ID NO: 96568 - DNA, 25 bp, Mus musculus
ctgggcatatggaggaatacctgct

SEQ ID NO: 96569 - DNA, 25 bp, Mus musculus
ctgggcccgaggcatcagagtctac

SEQ ID NO: 96570 - DNA, 25 bp, Mus musculus
ctgggcccttcgagaccatgctgtg

SEQ ID NO: 96571 - DNA, 25 bp, Mus musculus
ctgggccggaggaagtttgtctcct

SEQ ID NO: 96572 - DNA, 25 bp, Mus musculus
ctgggccggtgtgaggatcttcaac

SEQ ID NO: 96573 - DNA, 25 bp, Mus musculus
ctgggcctgcagaactgagtcagtt

SEQ ID NO: 96574 - DNA, 25 bp, Mus musculus
ctgggcgctggtggaaatcgaacct

SEQ ID NO: 96575 - DNA, 25 bp, Mus musculus
ctgggctcagatagaattttatcag

SEQ ID NO: 96576 - DNA, 25 bp, Mus musculus
ctgggctcgatttctagcttttgaa

SEQ ID NO: 96577 - DNA, 25 bp, Mus musculus
ctgggctgcacatcagcctgtgtgg

SEQ ID NO: 96578 - DNA, 25 bp, Mus musculus
ctgggctgccgatgccaaggtcctc

SEQ ID NO: 96579 - DNA, 25 bp, Mus musculus
ctgggtactaaggtcaacgtgaaga

SEQ ID NO: 96580 - DNA, 25 bp, Mus musculus
ctgggtcaattgtaagaccctctgc

SEQ ID NO: 96581 - DNA, 25 bp, Mus musculus
ctgggtccacaggttgcgcaggcaa

SEQ ID NO: 96582 - DNA, 25 bp, Mus musculus
ctgggtctcacaggctacgggatct

SEQ ID NO: 96583 - DNA, 25 bp, Mus musculus
ctgggtgcctatgaccaacagggcc

SEQ ID NO: 96584 - DNA, 25 bp, Mus musculus
ctgggttctggtgccgcgcaagctc

SEQ ID NO: 96585 - DNA, 25 bp, Mus musculus
ctggtaatgagccacagagactgga

SEQ ID NO: 96586 - DNA, 25 bp, Mus musculus
ctggtaccaaaaagagagctgcgcc

SEQ ID NO: 96587 - DNA, 25 bp, Mus musculus
ctggtagagcagagcaacgtggttc

SEQ ID NO: 96588 - DNA, 25 bp, Mus musculus
ctggtagtatccacgggagaagaac

SEQ ID NO: 96589 - DNA, 25 bp, Mus musculus
ctggtcaaactgtgcagtggtatga

SEQ ID NO: 96590 - DNA, 25 bp, Mus musculus
ctggtcactatggtacgagaacgaa

SEQ ID NO: 96591 - DNA, 25 bp, Mus musculus
ctggtcctcagctgtctcctcacag

SEQ ID NO: 96592 - DNA, 25 bp, Mus musculus
ctggtcgcgtctcggaaacccgtag

SEQ ID NO: 96593 - DNA, 25 bp, Mus musculus
ctggtgactccccacaggaaggaca

SEQ ID NO: 96594 - DNA, 25 bp, Mus musculus
ctggtgacttaagatcaggagatga

SEQ ID NO: 96595 - DNA, 25 bp, Mus musculus
ctggtgaggatgacgaattggaatc

SEQ ID NO: 96596 - DNA, 25 bp, Mus musculus
ctggtgagtgacacacggaggacat

SEQ ID NO: 96597 - DNA, 25 bp, Mus musculus
ctggtgatggccctctgcagtcaaa

SEQ ID NO: 96598 - DNA, 25 bp, Mus musculus
ctggtgcagatggaggtcctcatga

SEQ ID NO: 96599 - DNA, 25 bp, Mus musculus
ctggtgcagatgttccgcagcgacg

SEQ ID NO: 96600 - DNA, 25 bp, Mus musculus
ctggtgctaagagaagctgcagcca

SEQ ID NO: 96601 - DNA, 25 bp, Mus musculus
ctggtggaaatcgaacctcgtggta

SEQ ID NO: 96602 - DNA, 25 bp, Mus musculus
ctggtgggcaccttccccacctggg

SEQ ID NO: 96603 - DNA, 25 bp, Mus musculus
ctggtgttcagaggaaggctcccca

SEQ ID NO: 96604 - DNA, 25 bp, Mus musculus
ctggtgttgaactgtatcctgggag

SEQ ID NO: 96605 - DNA, 25 bp, Mus musculus
ctggtgtttccacatgactctgaaa

SEQ ID NO: 96606 - DNA, 25 bp, Mus musculus
ctggttcagtagctgcgcatgagtc

SEQ ID NO: 96607 - DNA, 25 bp, Mus musculus
ctggttcatcccagcacgagacctg

SEQ ID NO: 96608 - DNA, 25 bp, Mus musculus
ctggttgtcagttcgcgtccgggtc

SEQ ID NO: 96609 - DNA, 25 bp, Mus musculus
ctggtttcatactggcaaatggttc

SEQ ID NO: 96610 - DNA, 25 bp, Mus musculus
ctgtaaaagattggatgacaactcc

SEQ ID NO: 96611 - DNA, 25 bp, Mus musculus
ctgtaaccttagtgcagctgcccaa

SEQ ID NO: 96612 - DNA, 25 bp, Mus musculus
ctgtaaggacaaacgcggagctgct

SEQ ID NO: 96613 - DNA, 25 bp, Mus musculus
ctgtacaactcaatcaagaacgaga

SEQ ID NO: 96614 - DNA, 25 bp, Mus musculus
ctgtacagaaacactctgaaagaat

SEQ ID NO: 96615 - DNA, 25 bp, Mus musculus
ctgtacatctacaagtggccggccg

SEQ ID NO: 96616 - DNA, 25 bp, Mus musculus
ctgtaccagaacatcacccttgtgg

SEQ ID NO: 96617 - DNA, 25 bp, Mus musculus
ctgtaccgcctgagatccagtgcca

SEQ ID NO: 96618 - DNA, 25 bp, Mus musculus
ctgtactggcgatcttcgtccccga

SEQ ID NO: 96619 - DNA, 25 bp, Mus musculus
ctgtactgtgcggagctcatggcca

SEQ ID NO: 96620 - DNA, 25 bp, Mus musculus
ctgtagatgttgactggccgcctgc

SEQ ID NO: 96621 - DNA, 25 bp, Mus musculus
ctgtatataaggagccgcatccgcc

SEQ ID NO: 96622 - DNA, 25 bp, Mus musculus
ctgtatgacctggagacggcgtcct

SEQ ID NO: 96623 - DNA, 25 bp, Mus musculus
ctgtatgtcaggtaggcatcagagc

SEQ ID NO: 96624 - DNA, 25 bp, Mus musculus
ctgtatgtccgcctcatagattcaa

SEQ ID NO: 96625 - DNA, 25 bp, Mus musculus
ctgtcaagtactgcagtcatagtat

SEQ ID NO: 96626 - DNA, 25 bp, Mus musculus
ctgtcacagatccaggagattgtgg

SEQ ID NO: 96627 - DNA, 25 bp, Mus musculus
ctgtcagatcagatgagcgcccgct

SEQ ID NO: 96628 - DNA, 25 bp, Mus musculus
ctgtcagcacaacccaaaggagagg

SEQ ID NO: 96629 - DNA, 25 bp, Mus musculus
ctgtcagcatcgtcgccaagaggga

SEQ ID NO: 96630 - DNA, 25 bp, Mus musculus
ctgtcaggacggtaccggcggcact

SEQ ID NO: 96631 - DNA, 25 bp, Mus musculus
ctgtcaggccctgtgtggtgtttcc

SEQ ID NO: 96632 - DNA, 25 bp, Mus musculus
ctgtcagggctctcggcaaagatct

SEQ ID NO: 96633 - DNA, 25 bp, Mus musculus
ctgtcagtgagtggccagaacctgc

SEQ ID NO: 96634 - DNA, 25 bp, Mus musculus
ctgtcatttcagatccgtcgccact

SEQ ID NO: 96635 - DNA, 25 bp, Mus musculus
ctgtccaaataccagctgagcgagg

SEQ ID NO: 96636 - DNA, 25 bp, Mus musculus
ctgtccatatgattacaaagcagaa

SEQ ID NO: 96637 - DNA, 25 bp, Mus musculus
ctgtccatcatgtccagcggcgcga

SEQ ID NO: 96638 - DNA, 25 bp, Mus musculus
ctgtccccgtttggaaggcggtgca

SEQ ID NO: 96639 - DNA, 25 bp, Mus musculus
ctgtccggaaggtcctacataagga

SEQ ID NO: 96640 - DNA, 25 bp, Mus musculus
ctgtcgatgccaccgtcaacgaggc

SEQ ID NO: 96641 - DNA, 25 bp, Mus musculus
ctgtcggaactgaacctggaggtgc

SEQ ID NO: 96642 - DNA, 25 bp, Mus musculus
ctgtcggtaacatgaggaagtgctc

SEQ ID NO: 96643 - DNA, 25 bp, Mus musculus
ctgtcgtccgcgagaagcaactgca

SEQ ID NO: 96644 - DNA, 25 bp, Mus musculus
ctgtctaatagcaaggaactcctgg

SEQ ID NO: 96645 - DNA, 25 bp, Mus musculus
ctgtctatctctggtagccctggta

SEQ ID NO: 96646 - DNA, 25 bp, Mus musculus
ctgtctccgagaaagccaagggcct

SEQ ID NO: 96647 - DNA, 25 bp, Mus musculus
ctgtctctgaagtcaccacacctga

SEQ ID NO: 96648 - DNA, 25 bp, Mus musculus
ctgtctctgattttcgtgggccgtg

SEQ ID NO: 96649 - DNA, 25 bp, Mus musculus
ctgtctgcggcaagaagaggagtca

SEQ ID NO: 96650 - DNA, 25 bp, Mus musculus
ctgtctggctgaagagctgtgccat

SEQ ID NO: 96651 - DNA, 25 bp, Mus musculus
ctgtctgtataagatgtgctgcccc

SEQ ID NO: 96652 - DNA, 25 bp, Mus musculus
ctgtctgtgataagaaggccccata

SEQ ID NO: 96653 - DNA, 25 bp, Mus musculus
ctgtcttcacgaggaggaggccaca

SEQ ID NO: 96654 - DNA, 25 bp, Mus musculus
ctgtgaacaagctcccgggcaagag

SEQ ID NO: 96655 - DNA, 25 bp, Mus musculus
ctgtgaaggcccacaaaggcaagca

SEQ ID NO: 96656 - DNA, 25 bp, Mus musculus
ctgtgaagggtgaatggcccagcct

SEQ ID NO: 96657 - DNA, 25 bp, Mus musculus
ctgtgaagttgaaacaaagccagtg

SEQ ID NO: 96658 - DNA, 25 bp, Mus musculus
ctgtgaatactgaacctgcctgctg

SEQ ID NO: 96659 - DNA, 25 bp, Mus musculus
ctgtgaattttacggattcggaagc

SEQ ID NO: 96660 - DNA, 25 bp, Mus musculus
ctgtgacagtatttcccaaaaggga

SEQ ID NO: 96661 - DNA, 25 bp, Mus musculus
ctgtgacggccggaaatgagtgcct

SEQ ID NO: 96662 - DNA, 25 bp, Mus musculus
ctgtgactccagagaaaaaggctga

SEQ ID NO: 96663 - DNA, 25 bp, Mus musculus
ctgtgagctgcgagagtgccttgaa

SEQ ID NO: 96664 - DNA, 25 bp, Mus musculus
ctgtgaggcttccaacatagtggga

SEQ ID NO: 96665 - DNA, 25 bp, Mus musculus
ctgtgagggacagccagtgacgtca

SEQ ID NO: 96666 - DNA, 25 bp, Mus musculus
ctgtgaggtcgaactgcaggagctt

SEQ ID NO: 96667 - DNA, 25 bp, Mus musculus
ctgtgagtcgcagcaccgaggtgaa

SEQ ID NO: 96668 - DNA, 25 bp, Mus musculus
ctgtgcaacatggagcgtggagcct

SEQ ID NO: 96669 - DNA, 25 bp, Mus musculus
ctgtgcacaacaatggctgaggagc

SEQ ID NO: 96670 - DNA, 25 bp, Mus musculus
ctgtgcagctgaggaatgggaatct

SEQ ID NO: 96671 - DNA, 25 bp, Mus musculus
ctgtgcagctggaaaggagagcccc

SEQ ID NO: 96672 - DNA, 25 bp, Mus musculus
ctgtgcatctcaacaccctgctggg

SEQ ID NO: 96673 - DNA, 25 bp, Mus musculus
ctgtgcatgaactagaaaaggagac

SEQ ID NO: 96674 - DNA, 25 bp, Mus musculus
ctgtgccaccgcatgagaccttcgg

SEQ ID NO: 96675 - DNA, 25 bp, Mus musculus
ctgtgccagaagataaagatgaaac

SEQ ID NO: 96676 - DNA, 25 bp, Mus musculus
ctgtgccagcacaaagagagcgggc

SEQ ID NO: 96677 - DNA, 25 bp, Mus musculus
ctgtgccttagaaaccagtcatggg

SEQ ID NO: 96678 - DNA, 25 bp, Mus musculus
ctgtgcgagactactaagggagcca

SEQ ID NO: 96679 - DNA, 25 bp, Mus musculus
ctgtgcggtcactagaatgggccca

SEQ ID NO: 96680 - DNA, 25 bp, Mus musculus
ctgtgctcagtattagaatttgtta

SEQ ID NO: 96681 - DNA, 25 bp, Mus musculus
ctgtgctccctcggacggaagcggc

SEQ ID NO: 96682 - DNA, 25 bp, Mus musculus
ctgtgctgagcaacatcgaccgtat

SEQ ID NO: 96683 - DNA, 25 bp, Mus musculus
ctgtgctgcagctcacgccagaggt

SEQ ID NO: 96684 - DNA, 25 bp, Mus musculus
ctgtggaactggcacgaagcgtggc

SEQ ID NO: 96685 - DNA, 25 bp, Mus musculus
ctgtggaagaccagccaggaactca

SEQ ID NO: 96686 - DNA, 25 bp, Mus musculus
ctgtggaagatgattcttttgtcaa

SEQ ID NO: 96687 - DNA, 25 bp, Mus musculus
ctgtggaggcctacacgagagcact

SEQ ID NO: 96688 - DNA, 25 bp, Mus musculus
ctgtggagtacatgaacttatctgt

SEQ ID NO: 96689 - DNA, 25 bp, Mus musculus
ctgtggagttcagcccagccagtct

SEQ ID NO: 96690 - DNA, 25 bp, Mus musculus
ctgtggatagaagggataccattcc

SEQ ID NO: 96691 - DNA, 25 bp, Mus musculus
ctgtggattacagggaggtaaaacg

SEQ ID NO: 96692 - DNA, 25 bp, Mus musculus
ctgtggcaagcgctacaagaaccgg

SEQ ID NO: 96693 - DNA, 25 bp, Mus musculus
ctgtggcccgcagggagaccatcgt

SEQ ID NO: 96694 - DNA, 25 bp, Mus musculus
ctgtggccgtcgcaagatcatcctg

SEQ ID NO: 96695 - DNA, 25 bp, Mus musculus
ctgtggcggagcaggaatctcttcc

SEQ ID NO: 96696 - DNA, 25 bp, Mus musculus
ctgtgggagactgggtactgaatat

SEQ ID NO: 96697 - DNA, 25 bp, Mus musculus
ctgtgggcattctgctcagagcgga

SEQ ID NO: 96698 - DNA, 25 bp, Mus musculus
ctgtgggccagttcaagatcggtct

SEQ ID NO: 96699 - DNA, 25 bp, Mus musculus
ctgtgggtgcgctgctggcctccaa

SEQ ID NO: 96700 - DNA, 25 bp, Mus musculus
ctgtggtcaagatcaaggagacgta

SEQ ID NO: 96701 - DNA, 25 bp, Mus musculus
ctgtggtggtagatcccggcgctac

SEQ ID NO: 96702 - DNA, 25 bp, Mus musculus
ctgtggttggatgtttagaggacat

SEQ ID NO: 96703 - DNA, 25 bp, Mus musculus
ctgtgtaacttctcttctggatcta

SEQ ID NO: 96704 - DNA, 25 bp, Mus musculus
ctgtgtaagccaccaaggagcgcct

SEQ ID NO: 96705 - DNA, 25 bp, Mus musculus
ctgtgtcacgtgacgggtgcgccgg

SEQ ID NO: 96706 - DNA, 25 bp, Mus musculus
ctgtgtcctggaccctgatggacca

SEQ ID NO: 96707 - DNA, 25 bp, Mus musculus
ctgtgtcctggcaaactggaagaaa

SEQ ID NO: 96708 - DNA, 25 bp, Mus musculus
ctgtgtgaagatgccctagagggcc

SEQ ID NO: 96709 - DNA, 25 bp, Mus musculus
ctgtgtgccgggataagatgttcgt

SEQ ID NO: 96710 - DNA, 25 bp, Mus musculus
ctgtgtggatcattgtggccgttct

SEQ ID NO: 96711 - DNA, 25 bp, Mus musculus
ctgtgtgtgactcgcgggccaaata

SEQ ID NO: 96712 - DNA, 25 bp, Mus musculus
ctgtgtgtgcaaagtggagctgtca

SEQ ID NO: 96713 - DNA, 25 bp, Mus musculus
ctgtgtgtggtgtctaaggagctcc

SEQ ID NO: 96714 - DNA, 25 bp, Mus musculus
ctgtgttcccgttgcccggttctca

SEQ ID NO: 96715 - DNA, 25 bp, Mus musculus
ctgtgttctacgtggctagccgagg

SEQ ID NO: 96716 - DNA, 25 bp, Mus musculus
ctgtgttctctctctggctgcctgg

SEQ ID NO: 96717 - DNA, 25 bp, Mus musculus
ctgtgtttacagtggaccgggccca

SEQ ID NO: 96718 - DNA, 25 bp, Mus musculus
ctgtgtttgtgctggccaccctgca

SEQ ID NO: 96719 - DNA, 25 bp, Mus musculus
ctgttaagcacccatgaccagccat

SEQ ID NO: 96720 - DNA, 25 bp, Mus musculus
ctgttacacgaactatgactctggg

SEQ ID NO: 96721 - DNA, 25 bp, Mus musculus
ctgttactgagtcttcctgggagga

SEQ ID NO: 96722 - DNA, 25 bp, Mus musculus
ctgttcagcgcatgccgggaaacgt

SEQ ID NO: 96723 - DNA, 25 bp, Mus musculus
ctgttccaaagagcacccaggctgg

SEQ ID NO: 96724 - DNA, 25 bp, Mus musculus
ctgttccagaaaagttggtacattg

SEQ ID NO: 96725 - DNA, 25 bp, Mus musculus
ctgttcggagtcaccttcaccttcg

SEQ ID NO: 96726 - DNA, 25 bp, Mus musculus
ctgttgaaaatgagcagctgtcctc

SEQ ID NO: 96727 - DNA, 25 bp, Mus musculus
ctgttgaacgcaggtagcgctcggc

SEQ ID NO: 96728 - DNA, 25 bp, Mus musculus
ctgttgaagaagcatttggatacat

SEQ ID NO: 96729 - DNA, 25 bp, Mus musculus
ctgttgactatgaggccacccggat

SEQ ID NO: 96730 - DNA, 25 bp, Mus musculus
ctgttgagaaggacggacaagtacc

SEQ ID NO: 96731 - DNA, 25 bp, Mus musculus
ctgttgatatgccaagcagagggca

SEQ ID NO: 96732 - DNA, 25 bp, Mus musculus
ctgttgcaacagatgtcccgggtct

SEQ ID NO: 96733 - DNA, 25 bp, Mus musculus
ctgttgccttgtgggatctgaggaa

SEQ ID NO: 96734 - DNA, 25 bp, Mus musculus
ctgttgcgaagtggtctgtgtttga

SEQ ID NO: 96735 - DNA, 25 bp, Mus musculus
ctgttgcgctttctgagggcccgaa

SEQ ID NO: 96736 - DNA, 25 bp, Mus musculus
ctgttgggagtgaggtgctttaaca

SEQ ID NO: 96737 - DNA, 25 bp, Mus musculus
ctgttgtctgcctcatgggtggaat

SEQ ID NO: 96738 - DNA, 25 bp, Mus musculus
ctgtttccctgcgatcgtggcctgg

SEQ ID NO: 96739 - DNA, 25 bp, Mus musculus
ctgtttgacagcgaggatcctcggg

SEQ ID NO: 96740 - DNA, 25 bp, Mus musculus
ctgtttgacattgctgtctccatga

SEQ ID NO: 96741 - DNA, 25 bp, Mus musculus
ctgtttgattatggtctgggcagtg

SEQ ID NO: 96742 - DNA, 25 bp, Mus musculus
ctgtttggccaggaggtttactgcc

SEQ ID NO: 96743 - DNA, 25 bp, Mus musculus
cttaaagaggacgatagctacggct

SEQ ID NO: 96744 - DNA, 25 bp, Mus musculus
cttaaatgatgtgagagtccttccc

SEQ ID NO: 96745 - DNA, 25 bp, Mus musculus
cttaaatggtgagcacggagatgcc

SEQ ID NO: 96746 - DNA, 25 bp, Mus musculus
cttaaccaatgaggcagaaacactg

SEQ ID NO: 96747 - DNA, 25 bp, Mus musculus
cttaagaactggaacggagactgtc

SEQ ID NO: 96748 - DNA, 25 bp, Mus musculus
cttaagagaagactccaggatccac

SEQ ID NO: 96749 - DNA, 25 bp, Mus musculus
cttaagagagaccaagccgattgct

SEQ ID NO: 96750 - DNA, 25 bp, Mus musculus
cttaagaggctcgatgtgaggctgc

SEQ ID NO: 96751 - DNA, 25 bp, Mus musculus
cttaagcttgatactaccgatggca

SEQ ID NO: 96752 - DNA, 25 bp, Mus musculus
cttaaggcaggcctgaaggaagccc

SEQ ID NO: 96753 - DNA, 25 bp, Mus musculus
cttaaggctcgtgcactcgagacgg

SEQ ID NO: 96754 - DNA, 25 bp, Mus musculus
cttaaggtgcagaccagagtactcc

SEQ ID NO: 96755 - DNA, 25 bp, Mus musculus
cttaatcgagcagaagcaagtcagg

SEQ ID NO: 96756 - DNA, 25 bp, Mus musculus
cttaatgaaacggactgtgtgtgcc

SEQ ID NO: 96757 - DNA, 25 bp, Mus musculus
cttaattcactcacgtcagcagggt

SEQ ID NO: 96758 - DNA, 25 bp, Mus musculus
cttacaacaacctgaatgaacattc

SEQ ID NO: 96759 - DNA, 25 bp, Mus musculus
cttacacgagataggtgagcgctgc

SEQ ID NO: 96760 - DNA, 25 bp, Mus musculus
cttacagcaagacagtgactcttgg

SEQ ID NO: 96761 - DNA, 25 bp, Mus musculus
cttacatctccaagaagctgactcg

SEQ ID NO: 96762 - DNA, 25 bp, Mus musculus
cttaccacgagaaggcaaggatgcc

SEQ ID NO: 96763 - DNA, 25 bp, Mus musculus
cttaccagccttcagttcacctgca

SEQ ID NO: 96764 - DNA, 25 bp, Mus musculus
cttaccccatgaccgatgccgagag

SEQ ID NO: 96765 - DNA, 25 bp, Mus musculus
cttacgaaattgagagggagctccg

SEQ ID NO: 96766 - DNA, 25 bp, Mus musculus
cttacgaagttcctatgtagctcag

SEQ ID NO: 96767 - DNA, 25 bp, Mus musculus
cttacgatgtgcttgagaggaacca

SEQ ID NO: 96768 - DNA, 25 bp, Mus musculus
cttacgggacacaaaaagcgcttgt

SEQ ID NO: 96769 - DNA, 25 bp, Mus musculus
cttactaggatcgtgtgtggacgtg

SEQ ID NO: 96770 - DNA, 25 bp, Mus musculus
cttactgttccgacggccactgccc

SEQ ID NO: 96771 - DNA, 25 bp, Mus musculus
cttagaaacatttgcagagggacag

SEQ ID NO: 96772 - DNA, 25 bp, Mus musculus
cttagaacttgggagagacgctgtg

SEQ ID NO: 96773 - DNA, 25 bp, Mus musculus
cttagaagagctgagcctagggccc

SEQ ID NO: 96774 - DNA, 25 bp, Mus musculus
cttagaagctgcaacgggtggctgc

SEQ ID NO: 96775 - DNA, 25 bp, Mus musculus
cttagaagcttcaacgccaatgaaa

SEQ ID NO: 96776 - DNA, 25 bp, Mus musculus
cttagaatggctcctgcagccgggc

SEQ ID NO: 96777 - DNA, 25 bp, Mus musculus
cttagactcatctcatccacacaga

SEQ ID NO: 96778 - DNA, 25 bp, Mus musculus
cttagactctgtaccggaacgaacg

SEQ ID NO: 96779 - DNA, 25 bp, Mus musculus
cttagagaaatctggtcagcgtgac

SEQ ID NO: 96780 - DNA, 25 bp, Mus musculus
cttagagaatgcctgcaacctgccg

SEQ ID NO: 96781 - DNA, 25 bp, Mus musculus
cttagagaattgagacaagaaacgc

SEQ ID NO: 96782 - DNA, 25 bp, Mus musculus
cttagagagtcatgcgcgggtcctc

SEQ ID NO: 96783 - DNA, 25 bp, Mus musculus
cttagagccccgcattgcagagacc

SEQ ID NO: 96784 - DNA, 25 bp, Mus musculus
cttagagctcaagctcgacgacatt

SEQ ID NO: 96785 - DNA, 25 bp, Mus musculus
cttagagttcaccaggaccagacct

SEQ ID NO: 96786 - DNA, 25 bp, Mus musculus
cttagatgacttctgaacgtcaggc

SEQ ID NO: 96787 - DNA, 25 bp, Mus musculus
cttagatgcgccacggcttcggtag

SEQ ID NO: 96788 - DNA, 25 bp, Mus musculus
cttagcacagagagggagatgcccc

SEQ ID NO: 96789 - DNA, 25 bp, Mus musculus
cttagcccaggatcaggaaactcag

SEQ ID NO: 96790 - DNA, 25 bp, Mus musculus
cttagcccctaagcatcatgtcgga

SEQ ID NO: 96791 - DNA, 25 bp, Mus musculus
cttagcgaagacagtaagcaggtcc

SEQ ID NO: 96792 - DNA, 25 bp, Mus musculus
cttagcggctgcaggggtcccgctc

SEQ ID NO: 96793 - DNA, 25 bp, Mus musculus
cttaggaacgtgtcagatgggagcc

SEQ ID NO: 96794 - DNA, 25 bp, Mus musculus
cttaggacccgggtaggccgctgag

SEQ ID NO: 96795 - DNA, 25 bp, Mus musculus
cttaggcttccaggcgatcagacac

SEQ ID NO: 96796 - DNA, 25 bp, Mus musculus
cttagggaatcctgaaccacggcca

SEQ ID NO: 96797 - DNA, 25 bp, Mus musculus
cttagggtacctgacaacgggcact

SEQ ID NO: 96798 - DNA, 25 bp, Mus musculus
cttagtgtggaaaagaatagaagcc

SEQ ID NO: 96799 - DNA, 25 bp, Mus musculus
cttagttccttgcagcaccactccg

SEQ ID NO: 96800 - DNA, 25 bp, Mus musculus
cttagtttactgacaaggcagctga

SEQ ID NO: 96801 - DNA, 25 bp, Mus musculus
cttataattgacactgatgaggctg

SEQ ID NO: 96802 - DNA, 25 bp, Mus musculus
cttatagataaggagggaccccagc

SEQ ID NO: 96803 - DNA, 25 bp, Mus musculus
cttatcaataacttgctacaagtga

SEQ ID NO: 96804 - DNA, 25 bp, Mus musculus
cttatccagaatgccaagaagtcgg

SEQ ID NO: 96805 - DNA, 25 bp, Mus musculus
cttatcgctcagaaagttcgaggtg

SEQ ID NO: 96806 - DNA, 25 bp, Mus musculus
cttatgaggaagtggtgaaccgacc

SEQ ID NO: 96807 - DNA, 25 bp, Mus musculus
cttatgatatcatgctgaggcgcct

SEQ ID NO: 96808 - DNA, 25 bp, Mus musculus
cttatgatcaataacgtaagtgatt

SEQ ID NO: 96809 - DNA, 25 bp, Mus musculus
cttatgcagaactgctgtgaggacc

SEQ ID NO: 96810 - DNA, 25 bp, Mus musculus
cttatggccaggatagtgtttcact

SEQ ID NO: 96811 - DNA, 25 bp, Mus musculus
cttattcaggatgggagctcaggtg

SEQ ID NO: 96812 - DNA, 25 bp, Mus musculus
cttattgaggctgcatgggacggca

SEQ ID NO: 96813 - DNA, 25 bp, Mus musculus
cttattgagtcaaaccatggtactt

SEQ ID NO: 96814 - DNA, 25 bp, Mus musculus
cttattgggaaaggcaaacgctgtc

SEQ ID NO: 96815 - DNA, 25 bp, Mus musculus
cttcaaacaagctactgtgggcgat

SEQ ID NO: 96816 - DNA, 25 bp, Mus musculus
cttcaaagaactcggagaggccaga

SEQ ID NO: 96817 - DNA, 25 bp, Mus musculus
cttcaaaggcaacagctggaggcta

SEQ ID NO: 96818 - DNA, 25 bp, Mus musculus
cttcaacatggtgcgttctggcggc

SEQ ID NO: 96819 - DNA, 25 bp, Mus musculus
cttcaagaagtacggtgagctgcca

SEQ ID NO: 96820 - DNA, 25 bp, Mus musculus
cttcaagatgaagaatgcctacgag

SEQ ID NO: 96821 - DNA, 25 bp, Mus musculus
cttcaaggatgggtacatggtggtc

SEQ ID NO: 96822 - DNA, 25 bp, Mus musculus
cttcaagtggatgggaaacagagcc

SEQ ID NO: 96823 - DNA, 25 bp, Mus musculus
cttcaagtttgggatataggagggc

SEQ ID NO: 96824 - DNA, 25 bp, Mus musculus
cttcacaatgccctgtttttaaagc

SEQ ID NO: 96825 - DNA, 25 bp, Mus musculus
cttcacatacgactgcagtactgca

SEQ ID NO: 96826 - DNA, 25 bp, Mus musculus
cttcactatgctgcgacggaaaccg

SEQ ID NO: 96827 - DNA, 25 bp, Mus musculus
cttcactattgggcgcgtggtcaga

SEQ ID NO: 96828 - DNA, 25 bp, Mus musculus
cttcactgaacggagcatgctggac

SEQ ID NO: 96829 - DNA, 25 bp, Mus musculus
cttcagaagaagtcgggcagtgctt

SEQ ID NO: 96830 - DNA, 25 bp, Mus musculus
cttcagaagacagcggagtacatcc

SEQ ID NO: 96831 - DNA, 25 bp, Mus musculus
cttcagaagccagagtcatctctta

SEQ ID NO: 96832 - DNA, 25 bp, Mus musculus
cttcagacgcgattgggcaaggctc

SEQ ID NO: 96833 - DNA, 25 bp, Mus musculus
cttcagaggaaggtacagcgaggta

SEQ ID NO: 96834 - DNA, 25 bp, Mus musculus
cttcagatggaggtgcggagtcttc

SEQ ID NO: 96835 - DNA, 25 bp, Mus musculus
cttcagcaaatggtggcctcaggag

SEQ ID NO: 96836 - DNA, 25 bp, Mus musculus
cttcagccgctgctcaagcattgct

SEQ ID NO: 96837 - DNA, 25 bp, Mus musculus
cttcagcctgtatctagcacgtggg

SEQ ID NO: 96838 - DNA, 25 bp, Mus musculus
cttcagctatatgcagtgggtgtgg

SEQ ID NO: 96839 - DNA, 25 bp, Mus musculus
cttcaggaaggttattaagagcact

SEQ ID NO: 96840 - DNA, 25 bp, Mus musculus
cttcagggataagaggttggaatct

SEQ ID NO: 96841 - DNA, 25 bp, Mus musculus
cttcagtgccaaccgcgagtctact

SEQ ID NO: 96842 - DNA, 25 bp, Mus musculus
cttcagtgccaagcgatccgagagc

SEQ ID NO: 96843 - DNA, 25 bp, Mus musculus
cttcagtggtttgacagagatggcc

SEQ ID NO: 96844 - DNA, 25 bp, Mus musculus
cttcagttgtgggaggtgaactcag

SEQ ID NO: 96845 - DNA, 25 bp, Mus musculus
cttcatagtgctggcgcccattttg

SEQ ID NO: 96846 - DNA, 25 bp, Mus musculus
cttcatcgaatttaccccagcggct

SEQ ID NO: 96847 - DNA, 25 bp, Mus musculus
cttcatctaagtgctgggccctcag

SEQ ID NO: 96848 - DNA, 25 bp, Mus musculus
cttcatgcacaaacgagcccagagg

SEQ ID NO: 96849 - DNA, 25 bp, Mus musculus
cttcatggaggccaagagtaactca

SEQ ID NO: 96850 - DNA, 25 bp, Mus musculus
cttcatggaggtgcaacgggaccct

SEQ ID NO: 96851 - DNA, 25 bp, Mus musculus
cttcatggagtacgtggcagccctc

SEQ ID NO: 96852 - DNA, 25 bp, Mus musculus
cttcatgttgaaagtcagaggctcc

SEQ ID NO: 96853 - DNA, 25 bp, Mus musculus
cttcattctgagctgtaggccaggc

SEQ ID NO: 96854 - DNA, 25 bp, Mus musculus
cttcattgaccggaaacgcacaggg

SEQ ID NO: 96855 - DNA, 25 bp, Mus musculus
cttcattggcaccttcaaggctttt

SEQ ID NO: 96856 - DNA, 25 bp, Mus musculus
cttccagcacagaaggtagccagcg

SEQ ID NO: 96857 - DNA, 25 bp, Mus musculus
cttccaggaggacgatgacacatct

SEQ ID NO: 96858 - DNA, 25 bp, Mus musculus
cttccatattttatcactgctgtga

SEQ ID NO: 96859 - DNA, 25 bp, Mus musculus
cttcccgtacagatacaagcagcag

SEQ ID NO: 96860 - DNA, 25 bp, Mus musculus
cttccctatgtcagcagtgagctga

SEQ ID NO: 96861 - DNA, 25 bp, Mus musculus
cttccctcagaacgcggcgcggaga

SEQ ID NO: 96862 - DNA, 25 bp, Mus musculus
cttccctggcatggatccggagtcg

SEQ ID NO: 96863 - DNA, 25 bp, Mus musculus
cttccgagggcaaaggcagaggtct

SEQ ID NO: 96864 - DNA, 25 bp, Mus musculus
cttccgagttgtgggcgacgagccc

SEQ ID NO: 96865 - DNA, 25 bp, Mus musculus
cttccggagtttcatcattgctctg

SEQ ID NO: 96866 - DNA, 25 bp, Mus musculus
cttccgggattggactgaccggcta

SEQ ID NO: 96867 - DNA, 25 bp, Mus musculus
cttccggtgatgaaggtcgggtcct

SEQ ID NO: 96868 - DNA, 25 bp, Mus musculus
cttccgtgggcggaagtcgccgtca

SEQ ID NO: 96869 - DNA, 25 bp, Mus musculus
cttcctaataaaagccagtggctgg

SEQ ID NO: 96870 - DNA, 25 bp, Mus musculus
cttcctcccgagcaaggaaggcggc

SEQ ID NO: 96871 - DNA, 25 bp, Mus musculus
cttcctcgtctttggaagaggagat

SEQ ID NO: 96872 - DNA, 25 bp, Mus musculus
cttcctctcacctgttgcaagggtg

SEQ ID NO: 96873 - DNA, 25 bp, Mus musculus
cttcctgctgatgatgtggcctgag

SEQ ID NO: 96874 - DNA, 25 bp, Mus musculus
cttcctgctgtgccgcccgttgtgg

SEQ ID NO: 96875 - DNA, 25 bp, Mus musculus
cttcctggagcaccgtcgaatgcgc

SEQ ID NO: 96876 - DNA, 25 bp, Mus musculus
cttcctgggcaagatcgacgagctg

SEQ ID NO: 96877 - DNA, 25 bp, Mus musculus
cttcctgggtacaaggtgcgcgaga

SEQ ID NO: 96878 - DNA, 25 bp, Mus musculus
cttcctggtgatggtagatgccctg

SEQ ID NO: 96879 - DNA, 25 bp, Mus musculus
cttcctggtgcgagatagcgagagc

SEQ ID NO: 96880 - DNA, 25 bp, Mus musculus
cttcctggtttgacgaggctgttca

SEQ ID NO: 96881 - DNA, 25 bp, Mus musculus
cttcctgtacaagcgtggtggccgt

SEQ ID NO: 96882 - DNA, 25 bp, Mus musculus
cttcctgtcagaggccaactgcttt

SEQ ID NO: 96883 - DNA, 25 bp, Mus musculus
cttcctgtgaaggagccggaccggt

SEQ ID NO: 96884 - DNA, 25 bp, Mus musculus
cttccttaagcagcaagaaaatgtg

SEQ ID NO: 96885 - DNA, 25 bp, Mus musculus
cttccttgggagaaccaactgctct

SEQ ID NO: 96886 - DNA, 25 bp, Mus musculus
cttcgactacatgttcaagttgctg

SEQ ID NO: 96887 - DNA, 25 bp, Mus musculus
cttcgagaccatgctgtgcggtggc

SEQ ID NO: 96888 - DNA, 25 bp, Mus musculus
cttcgaggaccagatggcagcagca

SEQ ID NO: 96889 - DNA, 25 bp, Mus musculus
cttcgaggtgtgtccctgcgcttgc

SEQ ID NO: 96890 - DNA, 25 bp, Mus musculus
cttcgagtcgggactgggcttctcg

SEQ ID NO: 96891 - DNA, 25 bp, Mus musculus
cttcgagtggcaggagctcccaagt

SEQ ID NO: 96892 - DNA, 25 bp, Mus musculus
cttcgatacatgagcaatgaaaaaa

SEQ ID NO: 96893 - DNA, 25 bp, Mus musculus
cttcgatcctgagctgtatgaggga

SEQ ID NO: 96894 - DNA, 25 bp, Mus musculus
cttcgcaaaagtggagtaggcaaca

SEQ ID NO: 96895 - DNA, 25 bp, Mus musculus
cttcgcagcggaaagagcgaggctc

SEQ ID NO: 96896 - DNA, 25 bp, Mus musculus
cttcgcccggcttgacaggcggtct

SEQ ID NO: 96897 - DNA, 25 bp, Mus musculus
cttcgccggcatgaggtgaccatct

SEQ ID NO: 96898 - DNA, 25 bp, Mus musculus
cttcgcttgaagatccagtcggaga

SEQ ID NO: 96899 - DNA, 25 bp, Mus musculus
cttcggaagcgactttgagaactac

SEQ ID NO: 96900 - DNA, 25 bp, Mus musculus
cttcggatcgaaggccaagtcagag

SEQ ID NO: 96901 - DNA, 25 bp, Mus musculus
cttcggcaatttccgtcgggccctg

SEQ ID NO: 96902 - DNA, 25 bp, Mus musculus
cttcggcgagaagaatgagcactgt

SEQ ID NO: 96903 - DNA, 25 bp, Mus musculus
cttcggcgagaagctgctgggctac

SEQ ID NO: 96904 - DNA, 25 bp, Mus musculus
cttcggctggatagtggtgtttgca

SEQ ID NO: 96905 - DNA, 25 bp, Mus musculus
cttcggcttccgtagacgaggtcgg

SEQ ID NO: 96906 - DNA, 25 bp, Mus musculus
cttcgggtgtgaaaagccaaacatc

SEQ ID NO: 96907 - DNA, 25 bp, Mus musculus
cttcggtcgccatgtgcgcgcaggt

SEQ ID NO: 96908 - DNA, 25 bp, Mus musculus
cttcggtgtggagccaaagtacgct

SEQ ID NO: 96909 - DNA, 25 bp, Mus musculus
cttcgtagaaaagaagaagcgcttc

SEQ ID NO: 96910 - DNA, 25 bp, Mus musculus
cttcgtgacagagtgtgagccctca

SEQ ID NO: 96911 - DNA, 25 bp, Mus musculus
cttcgtgccgctttcttcaggagca

SEQ ID NO: 96912 - DNA, 25 bp, Mus musculus
cttcgtggccacacaagagcagagg

SEQ ID NO: 96913 - DNA, 25 bp, Mus musculus
cttctacagaagatcaatgtgagtc

SEQ ID NO: 96914 - DNA, 25 bp, Mus musculus
cttctacagcttgggatggccacag

SEQ ID NO: 96915 - DNA, 25 bp, Mus musculus
cttctacggtcgcttcaggcacttc

SEQ ID NO: 96916 - DNA, 25 bp, Mus musculus
cttctaggagggaacatgagtaccc

SEQ ID NO: 96917 - DNA, 25 bp, Mus musculus
cttctaggtcatttgggcagtggcc

SEQ ID NO: 96918 - DNA, 25 bp, Mus musculus
cttctataatgtgggtcagtgggca

SEQ ID NO: 96919 - DNA, 25 bp, Mus musculus
cttctatggtgagggcttcttcggc

SEQ ID NO: 96920 - DNA, 25 bp, Mus musculus
cttctcaggatgatcctggcctatc

SEQ ID NO: 96921 - DNA, 25 bp, Mus musculus
cttctccaatacaacagacgtcgag

SEQ ID NO: 96922 - DNA, 25 bp, Mus musculus
cttctccaggacataatgtacaggg

SEQ ID NO: 96923 - DNA, 25 bp, Mus musculus
cttctctctcaaggcaaaaagatga

SEQ ID NO: 96924 - DNA, 25 bp, Mus musculus
cttctcttccttcagttgtgggagg

SEQ ID NO: 96925 - DNA, 25 bp, Mus musculus
cttctcttgagaaaacctgtgggca

SEQ ID NO: 96926 - DNA, 25 bp, Mus musculus
cttctcttgcagagttggatctgta

SEQ ID NO: 96927 - DNA, 25 bp, Mus musculus
cttctcttgcaggtagcccagtgtg

SEQ ID NO: 96928 - DNA, 25 bp, Mus musculus
cttctgaagccacattaagctgggc

SEQ ID NO: 96929 - DNA, 25 bp, Mus musculus
cttctgagacgggtgcccttgctct

SEQ ID NO: 96930 - DNA, 25 bp, Mus musculus
cttctgaggagctgttcaccatggg

SEQ ID NO: 96931 - DNA, 25 bp, Mus musculus
cttctgagggctccctggcctggga

SEQ ID NO: 96932 - DNA, 25 bp, Mus musculus
cttctgattaactgccccgtagccg

SEQ ID NO: 96933 - DNA, 25 bp, Mus musculus
cttctgcatgcacaagcggtcagca

SEQ ID NO: 96934 - DNA, 25 bp, Mus musculus
cttctgcgtcagacggagccgggac

SEQ ID NO: 96935 - DNA, 25 bp, Mus musculus
cttctgctcagtgaaccctgtctat

SEQ ID NO: 96936 - DNA, 25 bp, Mus musculus
cttctggagaggacaacacgctggt

SEQ ID NO: 96937 - DNA, 25 bp, Mus musculus
cttctggcaagaggtgcggacatca

SEQ ID NO: 96938 - DNA, 25 bp, Mus musculus
cttctggccaagaaaaaggctgagg

SEQ ID NO: 96939 - DNA, 25 bp, Mus musculus
cttctgggccaaaaacaggcacttg

SEQ ID NO: 96940 - DNA, 25 bp, Mus musculus
cttctgggctcgttgttgtggctgc

SEQ ID NO: 96941 - DNA, 25 bp, Mus musculus
cttctgtaagtccaggaatggcggc

SEQ ID NO: 96942 - DNA, 25 bp, Mus musculus
cttctgtagtggacaccgggctgac

SEQ ID NO: 96943 - DNA, 25 bp, Mus musculus
cttctgtcagagcaaagagcctcca

SEQ ID NO: 96944 - DNA, 25 bp, Mus musculus
cttctgtggccgcttcctcagcatg

SEQ ID NO: 96945 - DNA, 25 bp, Mus musculus
cttctgtgtcagtctgggacgagga

SEQ ID NO: 96946 - DNA, 25 bp, Mus musculus
cttcttaaaggcaccgaggcgtcca

SEQ ID NO: 96947 - DNA, 25 bp, Mus musculus
cttcttagcaatggacggaggccac

SEQ ID NO: 96948 - DNA, 25 bp, Mus musculus
cttcttagtctagcagggatcccct

SEQ ID NO: 96949 - DNA, 25 bp, Mus musculus
cttcttcaacactgacgtggcccag

SEQ ID NO: 96950 - DNA, 25 bp, Mus musculus
cttcttcccggaatggatctggtcg

SEQ ID NO: 96951 - DNA, 25 bp, Mus musculus
cttcttgaggagacggacagtcgca

SEQ ID NO: 96952 - DNA, 25 bp, Mus musculus
cttcttggcacggatactgatggac

SEQ ID NO: 96953 - DNA, 25 bp, Mus musculus
cttcttgggcgaacagcgtgcggct

SEQ ID NO: 96954 - DNA, 25 bp, Mus musculus
cttcttgtgggcaccctggatgtgg

SEQ ID NO: 96955 - DNA, 25 bp, Mus musculus
cttcttttgtatgtgccgttgctgc

SEQ ID NO: 96956 - DNA, 25 bp, Mus musculus
cttgaactggaaagagaaatagctc

SEQ ID NO: 96957 - DNA, 25 bp, Mus musculus
cttgaagaacaagggcgtgcagccc

SEQ ID NO: 96958 - DNA, 25 bp, Mus musculus
cttgaagaagcaggcagctgagtac

SEQ ID NO: 96959 - DNA, 25 bp, Mus musculus
cttgaagctctttgaatccagggac

SEQ ID NO: 96960 - DNA, 25 bp, Mus musculus
cttgaaggcagatgctactctggcc

SEQ ID NO: 96961 - DNA, 25 bp, Mus musculus
cttgaaggctgtaaaacaaacaggg

SEQ ID NO: 96962 - DNA, 25 bp, Mus musculus
cttgaagggtgagggcaacgcaaac

SEQ ID NO: 96963 - DNA, 25 bp, Mus musculus
cttgaagttgcataaggacccgtgt

SEQ ID NO: 96964 - DNA, 25 bp, Mus musculus
cttgaatagccttggagctgggcct

SEQ ID NO: 96965 - DNA, 25 bp, Mus musculus
cttgaattggtggaaccaagtggct

SEQ ID NO: 96966 - DNA, 25 bp, Mus musculus
cttgacccacaagctgaactactgg

SEQ ID NO: 96967 - DNA, 25 bp, Mus musculus
cttgacttcaatacccggactcagg

SEQ ID NO: 96968 - DNA, 25 bp, Mus musculus
cttgagacagaaatggaatgacccc

SEQ ID NO: 96969 - DNA, 25 bp, Mus musculus
cttgagcaggcattggaagcccact

SEQ ID NO: 96970 - DNA, 25 bp, Mus musculus
cttgagcagtcagcagaaggcctca

SEQ ID NO: 96971 - DNA, 25 bp, Mus musculus
cttgagccgagagggtcataggtat

SEQ ID NO: 96972 - DNA, 25 bp, Mus musculus
cttgagctgcttgtatccgggagat

SEQ ID NO: 96973 - DNA, 25 bp, Mus musculus
cttgagcttaataaatgtgcattcg

SEQ ID NO: 96974 - DNA, 25 bp, Mus musculus
cttgaggaaatcaggcagcgcttac

SEQ ID NO: 96975 - DNA, 25 bp, Mus musculus
cttgaggaggaaatggaccgcaaca

SEQ ID NO: 96976 - DNA, 25 bp, Mus musculus
cttgaggtgatcagcataagaggcc

SEQ ID NO: 96977 - DNA, 25 bp, Mus musculus
cttgagtgaccatgttgggttccct

SEQ ID NO: 96978 - DNA, 25 bp, Mus musculus
cttgagtgctgaggcttcggtctga

SEQ ID NO: 96979 - DNA, 25 bp, Mus musculus
cttgagtggccaatacgagagggct

SEQ ID NO: 96980 - DNA, 25 bp, Mus musculus
cttgagttcgcccagacgctttagg

SEQ ID NO: 96981 - DNA, 25 bp, Mus musculus
cttgatcacaagaacctggacctgg

SEQ ID NO: 96982 - DNA, 25 bp, Mus musculus
cttgatcgactttgttacctgaagg

SEQ ID NO: 96983 - DNA, 25 bp, Mus musculus
cttgatctttggctactggagaatg

SEQ ID NO: 96984 - DNA, 25 bp, Mus musculus
cttgatgacattcggcaggactgga

SEQ ID NO: 96985 - DNA, 25 bp, Mus musculus
cttgatgaccgtggctctgctgctg

SEQ ID NO: 96986 - DNA, 25 bp, Mus musculus
cttgattgaaccagagcagtgtacg

SEQ ID NO: 96987 - DNA, 25 bp, Mus musculus
cttgattggattcagcctgggagcc

SEQ ID NO: 96988 - DNA, 25 bp, Mus musculus
cttgcaactcagtgggatttttgga

SEQ ID NO: 96989 - DNA, 25 bp, Mus musculus
cttgcaagattcagaggtaaccgtg

SEQ ID NO: 96990 - DNA, 25 bp, Mus musculus
cttgcaagcttagaggacctgtgtt

SEQ ID NO: 96991 - DNA, 25 bp, Mus musculus
cttgcacaggatgaaggaagtcacg

SEQ ID NO: 96992 - DNA, 25 bp, Mus musculus
cttgcacagtgggtagacagctact

SEQ ID NO: 96993 - DNA, 25 bp, Mus musculus
cttgcaccaagatgactgagtaggc

SEQ ID NO: 96994 - DNA, 25 bp, Mus musculus
cttgcaccacgagaggcgccggtgt

SEQ ID NO: 96995 - DNA, 25 bp, Mus musculus
cttgcaccgctgtggtggagaacct

SEQ ID NO: 96996 - DNA, 25 bp, Mus musculus
cttgcaggaaaagtcccagtgtgct

SEQ ID NO: 96997 - DNA, 25 bp, Mus musculus
cttgcaggccacgaacgcagtgtct

SEQ ID NO: 96998 - DNA, 25 bp, Mus musculus
cttgcagggaaggtttcaaggcacg

SEQ ID NO: 96999 - DNA, 25 bp, Mus musculus
cttgcatagcgtgcacagatgtcag

SEQ ID NO: 97000 - DNA, 25 bp, Mus musculus
cttgcattaaggctcagggaacact

SEQ ID NO: 97001 - DNA, 25 bp, Mus musculus
cttgcattcacacggcattcggcgg

SEQ ID NO: 97002 - DNA, 25 bp, Mus musculus
cttgcattgcgaccagtataaagaa

SEQ ID NO: 97003 - DNA, 25 bp, Mus musculus
cttgccaaaaacgaggaactgagtt

SEQ ID NO: 97004 - DNA, 25 bp, Mus musculus
cttgcccgcctctttgtgaaggaag

SEQ ID NO: 97005 - DNA, 25 bp, Mus musculus
cttgcccgggcctccgtgggtctga

SEQ ID NO: 97006 - DNA, 25 bp, Mus musculus
cttgcccggtacacaactacagaga

SEQ ID NO: 97007 - DNA, 25 bp, Mus musculus
cttgccgagagtgagcctggccaac

SEQ ID NO: 97008 - DNA, 25 bp, Mus musculus
cttgccgcgtgctggtgttggagga

SEQ ID NO: 97009 - DNA, 25 bp, Mus musculus
cttgcctaagtaccggcgccagagt

SEQ ID NO: 97010 - DNA, 25 bp, Mus musculus
cttgcgagcgcgcctaacggagaac

SEQ ID NO: 97011 - DNA, 25 bp, Mus musculus
cttgcgcgctctgcaccttgtggaa

SEQ ID NO: 97012 - DNA, 25 bp, Mus musculus
cttgcggaggcctggagaaaaaact

SEQ ID NO: 97013 - DNA, 25 bp, Mus musculus
cttgcggcctcacagctgaagctgg

SEQ ID NO: 97014 - DNA, 25 bp, Mus musculus
cttgcgtttatggattcaccgggcc

SEQ ID NO: 97015 - DNA, 25 bp, Mus musculus
cttgctacaatgatgccaaatgtct

SEQ ID NO: 97016 - DNA, 25 bp, Mus musculus
cttgctcaaagaagaggtctgcacc

SEQ ID NO: 97017 - DNA, 25 bp, Mus musculus
cttgctcggtcagaagaagcctgga

SEQ ID NO: 97018 - DNA, 25 bp, Mus musculus
cttgctctggacctgggatggctcc

SEQ ID NO: 97019 - DNA, 25 bp, Mus musculus
cttgctcttgccgcgtgctggtgtt

SEQ ID NO: 97020 - DNA, 25 bp, Mus musculus
cttgctgactctggagggatgctca

SEQ ID NO: 97021 - DNA, 25 bp, Mus musculus
cttgctgatggtgcacggctggcct

SEQ ID NO: 97022 - DNA, 25 bp, Mus musculus
cttgctggagacagttattaaagtc

SEQ ID NO: 97023 - DNA, 25 bp, Mus musculus
cttgctgggttgcttaaaggaatcc

SEQ ID NO: 97024 - DNA, 25 bp, Mus musculus
cttgcttgaagtagcacagaccctg

SEQ ID NO: 97025 - DNA, 25 bp, Mus musculus
cttggaaccgggtcgacatagcgcg

SEQ ID NO: 97026 - DNA, 25 bp, Mus musculus
cttggaagagctgagaggttttcac

SEQ ID NO: 97027 - DNA, 25 bp, Mus musculus
cttggaagaggaccctggactctgc

SEQ ID NO: 97028 - DNA, 25 bp, Mus musculus
cttggaaggccagcacggtggccac

SEQ ID NO: 97029 - DNA, 25 bp, Mus musculus
cttggaaggccgaaatgaaatgggt

SEQ ID NO: 97030 - DNA, 25 bp, Mus musculus
cttggaatcaactgcaggacctgtg

SEQ ID NO: 97031 - DNA, 25 bp, Mus musculus
cttggacccttctgaagatgaagca

SEQ ID NO: 97032 - DNA, 25 bp, Mus musculus
cttggactgcagaggaaacttggct

SEQ ID NO: 97033 - DNA, 25 bp, Mus musculus
cttggactggacagctggatctggc

SEQ ID NO: 97034 - DNA, 25 bp, Mus musculus
cttggactgggatcgagcctgcttc

SEQ ID NO: 97035 - DNA, 25 bp, Mus musculus
cttggactgggcactacagcagcga

SEQ ID NO: 97036 - DNA, 25 bp, Mus musculus
cttggacttcccttgcctggactct

SEQ ID NO: 97037 - DNA, 25 bp, Mus musculus
cttggacttttgcaatcagagataa

SEQ ID NO: 97038 - DNA, 25 bp, Mus musculus
cttggagacactttgcatcagtaac

SEQ ID NO: 97039 - DNA, 25 bp, Mus musculus
cttggagcatgtagccccaaagcca

SEQ ID NO: 97040 - DNA, 25 bp, Mus musculus
cttggagcttagcttcgtgatgact

SEQ ID NO: 97041 - DNA, 25 bp, Mus musculus
cttggaggccattaaccgggaatca

SEQ ID NO: 97042 - DNA, 25 bp, Mus musculus
cttggagggcgcgaaggctcgggtt

SEQ ID NO: 97043 - DNA, 25 bp, Mus musculus
cttggatcgttgtcaatgagagcac

SEQ ID NO: 97044 - DNA, 25 bp, Mus musculus
cttggatttaaagcgatagacgcgg

SEQ ID NO: 97045 - DNA, 25 bp, Mus musculus
cttggatttcatagccagcaaaggg

SEQ ID NO: 97046 - DNA, 25 bp, Mus musculus
cttggcaccacagcgagcctggatt

SEQ ID NO: 97047 - DNA, 25 bp, Mus musculus
cttggcagggacacaaaagggctgt

SEQ ID NO: 97048 - DNA, 25 bp, Mus musculus
cttggcattggtggactcctaggca

SEQ ID NO: 97049 - DNA, 25 bp, Mus musculus
cttggcccagaacattgcggatcgg

SEQ ID NO: 97050 - DNA, 25 bp, Mus musculus
cttggcccaggcgtcattgaacact

SEQ ID NO: 97051 - DNA, 25 bp, Mus musculus
cttggcgcacgcacattgacgggtg

SEQ ID NO: 97052 - DNA, 25 bp, Mus musculus
cttggcgggccagctttatgcagtg

SEQ ID NO: 97053 - DNA, 25 bp, Mus musculus
cttggcgggtgctgttcctcggcac

SEQ ID NO: 97054 - DNA, 25 bp, Mus musculus
cttggctcactccttcctgaatggg

SEQ ID NO: 97055 - DNA, 25 bp, Mus musculus
cttggctgcgccgtgacatcttgga

SEQ ID NO: 97056 - DNA, 25 bp, Mus musculus
cttggctgctccaggttaggaggaa

SEQ ID NO: 97057 - DNA, 25 bp, Mus musculus
cttggctgggcgtccattggctaca

SEQ ID NO: 97058 - DNA, 25 bp, Mus musculus
cttgggaactgaccgcaatggtagc

SEQ ID NO: 97059 - DNA, 25 bp, Mus musculus
cttgggaatagacactcgaaacatt

SEQ ID NO: 97060 - DNA, 25 bp, Mus musculus
cttgggacaacctgatggaccggac

SEQ ID NO: 97061 - DNA, 25 bp, Mus musculus
cttgggagcctcaacggtactttgg

SEQ ID NO: 97062 - DNA, 25 bp, Mus musculus
cttgggagcctctatgcagcagcag

SEQ ID NO: 97063 - DNA, 25 bp, Mus musculus
cttgggccgtgaaaaagataagtct

SEQ ID NO: 97064 - DNA, 25 bp, Mus musculus
cttgggcctcacgatccgaggtgga

SEQ ID NO: 97065 - DNA, 25 bp, Mus musculus
cttgggctaagggtctgaaacacga

SEQ ID NO: 97066 - DNA, 25 bp, Mus musculus
cttgggctgaggaacaagatacaga

SEQ ID NO: 97067 - DNA, 25 bp, Mus musculus
cttgggcttttgctagaactgttgg

SEQ ID NO: 97068 - DNA, 25 bp, Mus musculus
cttggggtggacttccctgacagca

SEQ ID NO: 97069 - DNA, 25 bp, Mus musculus
cttgggtgaagggtacacatgcgcc

SEQ ID NO: 97070 - DNA, 25 bp, Mus musculus
cttgggtgggatcccatggaacacc

SEQ ID NO: 97071 - DNA, 25 bp, Mus musculus
cttggtagagacagctgccgaggac

SEQ ID NO: 97072 - DNA, 25 bp, Mus musculus
cttggtcaggaagtttcaggaagct

SEQ ID NO: 97073 - DNA, 25 bp, Mus musculus
cttggtgacaatgccggcctgaacc

SEQ ID NO: 97074 - DNA, 25 bp, Mus musculus
cttggtgggactggtcactcgtgca

SEQ ID NO: 97075 - DNA, 25 bp, Mus musculus
cttggttcagcccagttgccatgga

SEQ ID NO: 97076 - DNA, 25 bp, Mus musculus
cttggttcccatggactcgccagga

SEQ ID NO: 97077 - DNA, 25 bp, Mus musculus
cttggttggaggcagtgatacacct

SEQ ID NO: 97078 - DNA, 25 bp, Mus musculus
cttggttttcatgggttgttgtatt

SEQ ID NO: 97079 - DNA, 25 bp, Mus musculus
cttgtaagcaataaggacacgtggc

SEQ ID NO: 97080 - DNA, 25 bp, Mus musculus
cttgtagaaagggaccgagcgatcc

SEQ ID NO: 97081 - DNA, 25 bp, Mus musculus
cttgtagtagacttccactgtggag

SEQ ID NO: 97082 - DNA, 25 bp, Mus musculus
cttgtcagacgtggacgggcacgca

SEQ ID NO: 97083 - DNA, 25 bp, Mus musculus
cttgtcagggcagttcacagtaact

SEQ ID NO: 97084 - DNA, 25 bp, Mus musculus
cttgtcatggattcgagcctgtgtc

SEQ ID NO: 97085 - DNA, 25 bp, Mus musculus
cttgtccccaaggtacgaggcaggg

SEQ ID NO: 97086 - DNA, 25 bp, Mus musculus
cttgtcggaaatggcacgtatggtc

SEQ ID NO: 97087 - DNA, 25 bp, Mus musculus
cttgtcgtgaccctgattgggatga

SEQ ID NO: 97088 - DNA, 25 bp, Mus musculus
cttgtgaattggaccccaggcccac

SEQ ID NO: 97089 - DNA, 25 bp, Mus musculus
cttgtggaaaagtatggctggcccc

SEQ ID NO: 97090 - DNA, 25 bp, Mus musculus
cttgtgggcagagaagagcatactc

SEQ ID NO: 97091 - DNA, 25 bp, Mus musculus
cttgtgtcgggaaaggagccagacc

SEQ ID NO: 97092 - DNA, 25 bp, Mus musculus
cttgtgtttggaagacgggtcagct

SEQ ID NO: 97093 - DNA, 25 bp, Mus musculus
cttgttaatcaaccggtcaggctgg

SEQ ID NO: 97094 - DNA, 25 bp, Mus musculus
cttgttagcgaaggaaagactcacc

SEQ ID NO: 97095 - DNA, 25 bp, Mus musculus
cttgttccaagtgaaggcggcatca

SEQ ID NO: 97096 - DNA, 25 bp, Mus musculus
cttgttctaatcaaaatgaaacctg

SEQ ID NO: 97097 - DNA, 25 bp, Mus musculus
cttgttgctgaagaggaaccctacc

SEQ ID NO: 97098 - DNA, 25 bp, Mus musculus
cttgttttgcccaaagaagaagtgc

SEQ ID NO: 97099 - DNA, 25 bp, Mus musculus
ctttaaaacagatcggcaaggctct

SEQ ID NO: 97100 - DNA, 25 bp, Mus musculus
ctttaaggactacaatctggagcgg

SEQ ID NO: 97101 - DNA, 25 bp, Mus musculus
ctttacggggtttacagacatgatt

SEQ ID NO: 97102 - DNA, 25 bp, Mus musculus
ctttacgttaacagcgctcgggact

SEQ ID NO: 97103 - DNA, 25 bp, Mus musculus
ctttactcgaagtggtggcaatgcc

SEQ ID NO: 97104 - DNA, 25 bp, Mus musculus
ctttagagaagctcgggaagacact

SEQ ID NO: 97105 - DNA, 25 bp, Mus musculus
ctttagatcctaagtgcgagtaggt

SEQ ID NO: 97106 - DNA, 25 bp, Mus musculus
ctttagattggaagcggactgcgcc

SEQ ID NO: 97107 - DNA, 25 bp, Mus musculus
ctttaggtcaaagctgagtcgggcc

SEQ ID NO: 97108 - DNA, 25 bp, Mus musculus
ctttagtacttaagccagccgccgc

SEQ ID NO: 97109 - DNA, 25 bp, Mus musculus
ctttatccaggaactagggccattt

SEQ ID NO: 97110 - DNA, 25 bp, Mus musculus
ctttatgaggaacttgtaagcaata

SEQ ID NO: 97111 - DNA, 25 bp, Mus musculus
ctttatggacaactacagcacaggc

SEQ ID NO: 97112 - DNA, 25 bp, Mus musculus
ctttattagcggagaggacggtgtc

SEQ ID NO: 97113 - DNA, 25 bp, Mus musculus
ctttcaaagctcgaacaaaagctcg

SEQ ID NO: 97114 - DNA, 25 bp, Mus musculus
ctttcaaaggccaaggagggagttg

SEQ ID NO: 97115 - DNA, 25 bp, Mus musculus
ctttcaagaactgattgcggctgca

SEQ ID NO: 97116 - DNA, 25 bp, Mus musculus
ctttcaaggagtcagagcaggagca

SEQ ID NO: 97117 - DNA, 25 bp, Mus musculus
ctttcacagccacagccgagttcag

SEQ ID NO: 97118 - DNA, 25 bp, Mus musculus
ctttcactacgataaattcattctc

SEQ ID NO: 97119 - DNA, 25 bp, Mus musculus
ctttcagaagatgcgagggagccac

SEQ ID NO: 97120 - DNA, 25 bp, Mus musculus
ctttcagaagcacaacgaggtggtc

SEQ ID NO: 97121 - DNA, 25 bp, Mus musculus
ctttcagacttgtggaaatgtggcg

SEQ ID NO: 97122 - DNA, 25 bp, Mus musculus
ctttcagagcagtggagatccgtcc

SEQ ID NO: 97123 - DNA, 25 bp, Mus musculus
ctttcagctgaaggccaagagggtc

SEQ ID NO: 97124 - DNA, 25 bp, Mus musculus
ctttcaggaggttggctggtaccca

SEQ ID NO: 97125 - DNA, 25 bp, Mus musculus
ctttcaggcaccagctcgggcggct

SEQ ID NO: 97126 - DNA, 25 bp, Mus musculus
ctttcagggccgctgcaacaagctg

SEQ ID NO: 97127 - DNA, 25 bp, Mus musculus
ctttcagggctggaagcttggatac

SEQ ID NO: 97128 - DNA, 25 bp, Mus musculus
ctttcatgagaggagtggcaactac

SEQ ID NO: 97129 - DNA, 25 bp, Mus musculus
ctttcatgatgggagtcgactggca

SEQ ID NO: 97130 - DNA, 25 bp, Mus musculus
ctttccacaggtcagcagagcactt

SEQ ID NO: 97131 - DNA, 25 bp, Mus musculus
ctttccagtgttggctgacttacag

SEQ ID NO: 97132 - DNA, 25 bp, Mus musculus
ctttcccctgtcagcacttcgggaa

SEQ ID NO: 97133 - DNA, 25 bp, Mus musculus
ctttccgaggagccagtgttgctga

SEQ ID NO: 97134 - DNA, 25 bp, Mus musculus
ctttccggccgctgtttccacactg

SEQ ID NO: 97135 - DNA, 25 bp, Mus musculus
ctttccgtgtctgcaggtgtcctgc

SEQ ID NO: 97136 - DNA, 25 bp, Mus musculus
ctttcctccagaagctagtcgccga

SEQ ID NO: 97137 - DNA, 25 bp, Mus musculus
ctttcctgcggagcccatgggcttg

SEQ ID NO: 97138 - DNA, 25 bp, Mus musculus
ctttcgcagggcgagaggcgtctat

SEQ ID NO: 97139 - DNA, 25 bp, Mus musculus
ctttcggatccacaaggtaatggca

SEQ ID NO: 97140 - DNA, 25 bp, Mus musculus
ctttcggcaaagagaaggccctgca

SEQ ID NO: 97141 - DNA, 25 bp, Mus musculus
ctttcggcagaagaaggcccacatc

SEQ ID NO: 97142 - DNA, 25 bp, Mus musculus
ctttcgtgaccgtggatgtacttcc

SEQ ID NO: 97143 - DNA, 25 bp, Mus musculus
ctttcgtggccaaggtgatgtgcgt

SEQ ID NO: 97144 - DNA, 25 bp, Mus musculus
ctttctagtctctgaactgtcttcc

SEQ ID NO: 97145 - DNA, 25 bp, Mus musculus
ctttctataagagccggattcagtc

SEQ ID NO: 97146 - DNA, 25 bp, Mus musculus
ctttctccagaccagatcgtcttgc

SEQ ID NO: 97147 - DNA, 25 bp, Mus musculus
ctttctcgtgaactagtcatggcta

SEQ ID NO: 97148 - DNA, 25 bp, Mus musculus
ctttctgccctggtcgtgggacgac

SEQ ID NO: 97149 - DNA, 25 bp, Mus musculus
ctttctgcgcaaggccgagtgcatc

SEQ ID NO: 97150 - DNA, 25 bp, Mus musculus
ctttctggcatcagctgggtaggca

SEQ ID NO: 97151 - DNA, 25 bp, Mus musculus
ctttctgggaaaggcgtacctcctg

SEQ ID NO: 97152 - DNA, 25 bp, Mus musculus
ctttctgggaacaagtgcaagacac

SEQ ID NO: 97153 - DNA, 25 bp, Mus musculus
ctttgaaaggcaacccaattggact

SEQ ID NO: 97154 - DNA, 25 bp, Mus musculus
ctttgaaagttaccgggcccagctg

SEQ ID NO: 97155 - DNA, 25 bp, Mus musculus
ctttgaacggctgcaggaagcagga

SEQ ID NO: 97156 - DNA, 25 bp, Mus musculus
ctttgaagatgacgccatgctgacc

SEQ ID NO: 97157 - DNA, 25 bp, Mus musculus
ctttgaaggcttctttgcccatcag

SEQ ID NO: 97158 - DNA, 25 bp, Mus musculus
ctttgaatggctccgcggcatggta

SEQ ID NO: 97159 - DNA, 25 bp, Mus musculus
ctttgacagcatgcttctgcgtggg

SEQ ID NO: 97160 - DNA, 25 bp, Mus musculus
ctttgacaggaagacaggtggattc

SEQ ID NO: 97161 - DNA, 25 bp, Mus musculus
ctttgaccaaaatgaggagctcggg

SEQ ID NO: 97162 - DNA, 25 bp, Mus musculus
ctttgaccagcttgcccctagctct

SEQ ID NO: 97163 - DNA, 25 bp, Mus musculus
ctttgacctgcagaagtcagaggcc

SEQ ID NO: 97164 - DNA, 25 bp, Mus musculus
ctttgactctgctcaccgtgtggga

SEQ ID NO: 97165 - DNA, 25 bp, Mus musculus
ctttgagacagcatggagtccaggc

SEQ ID NO: 97166 - DNA, 25 bp, Mus musculus
ctttgagacttggatgcagacctgc

SEQ ID NO: 97167 - DNA, 25 bp, Mus musculus
ctttgagctgggagccacctggatc

SEQ ID NO: 97168 - DNA, 25 bp, Mus musculus
ctttgagtgattcggataaggcata

SEQ ID NO: 97169 - DNA, 25 bp, Mus musculus
ctttgatacagagagcaggcatgcc

SEQ ID NO: 97170 - DNA, 25 bp, Mus musculus
ctttgatccggccaatggcaagttc

SEQ ID NO: 97171 - DNA, 25 bp, Mus musculus
ctttgatctcttggtgatcggtggg

SEQ ID NO: 97172 - DNA, 25 bp, Mus musculus
ctttgcacagggatgtcatgttgga

SEQ ID NO: 97173 - DNA, 25 bp, Mus musculus
ctttgcacgaaagggctgggctcac

SEQ ID NO: 97174 - DNA, 25 bp, Mus musculus
ctttgcacttttccctcccgagtgt

SEQ ID NO: 97175 - DNA, 25 bp, Mus musculus
ctttgcagccaaacaaaatggcagt

SEQ ID NO: 97176 - DNA, 25 bp, Mus musculus
ctttgccagtgatgatgaacaggac

SEQ ID NO: 97177 - DNA, 25 bp, Mus musculus
ctttgcccggcacaaaagcaggtga

SEQ ID NO: 97178 - DNA, 25 bp, Mus musculus
ctttgcctatgatcaaatcttcctg

SEQ ID NO: 97179 - DNA, 25 bp, Mus musculus
ctttgcctgaggaaagggacatttc

SEQ ID NO: 97180 - DNA, 25 bp, Mus musculus
ctttgcgcctgctgagaagatcgtg

SEQ ID NO: 97181 - DNA, 25 bp, Mus musculus
ctttgcgggcgctcgcggtaagttt

SEQ ID NO: 97182 - DNA, 25 bp, Mus musculus
ctttgctgcggaagggcccagagat

SEQ ID NO: 97183 - DNA, 25 bp, Mus musculus
ctttgcttccccatttaaggctgag

SEQ ID NO: 97184 - DNA, 25 bp, Mus musculus
ctttggaaaagctggacggaactga

SEQ ID NO: 97185 - DNA, 25 bp, Mus musculus
ctttggaacctctcaggacctggaa

SEQ ID NO: 97186 - DNA, 25 bp, Mus musculus
ctttggaagaactgagcaggcagct

SEQ ID NO: 97187 - DNA, 25 bp, Mus musculus
ctttggagaaatgtggacctgtgga

SEQ ID NO: 97188 - DNA, 25 bp, Mus musculus
ctttggagaccctggaagatattga

SEQ ID NO: 97189 - DNA, 25 bp, Mus musculus
ctttggagagttatgaggacaagac

SEQ ID NO: 97190 - DNA, 25 bp, Mus musculus
ctttggagcacaggttcgacgcttg

SEQ ID NO: 97191 - DNA, 25 bp, Mus musculus
ctttggagccgatgcagcctttgga

SEQ ID NO: 97192 - DNA, 25 bp, Mus musculus
ctttggagcctgagagaatgactac

SEQ ID NO: 97193 - DNA, 25 bp, Mus musculus
ctttggagggaacacagctgacgat

SEQ ID NO: 97194 - DNA, 25 bp, Mus musculus
ctttggatgctaagctcgtgtctcc

SEQ ID NO: 97195 - DNA, 25 bp, Mus musculus
ctttggattcaacccctccaggagg

SEQ ID NO: 97196 - DNA, 25 bp, Mus musculus
ctttggatttgctacaacattggac

SEQ ID NO: 97197 - DNA, 25 bp, Mus musculus
ctttggcaacctgggcacggagttc

SEQ ID NO: 97198 - DNA, 25 bp, Mus musculus
ctttggcaatacaaccatcgtggtg

SEQ ID NO: 97199 - DNA, 25 bp, Mus musculus
ctttggcagaaggtaaagagtggtc

SEQ ID NO: 97200 - DNA, 25 bp, Mus musculus
ctttggcaggaaggctgagtagctt

SEQ ID NO: 97201 - DNA, 25 bp, Mus musculus
ctttggcggcctgggaatatggacc

SEQ ID NO: 97202 - DNA, 25 bp, Mus musculus
ctttggctactggagaatgatgagg

SEQ ID NO: 97203 - DNA, 25 bp, Mus musculus
ctttggctgggcaaccatgtggaga

SEQ ID NO: 97204 - DNA, 25 bp, Mus musculus
ctttgggaaatggagcactgatgac

SEQ ID NO: 97205 - DNA, 25 bp, Mus musculus
ctttgggcccatgctaggtgacggc

SEQ ID NO: 97206 - DNA, 25 bp, Mus musculus
ctttggtaaataaatcggcgtctgc

SEQ ID NO: 97207 - DNA, 25 bp, Mus musculus
ctttggtagctagcgagggctttga

SEQ ID NO: 97208 - DNA, 25 bp, Mus musculus
ctttggtgctgttgcctactagggc

SEQ ID NO: 97209 - DNA, 25 bp, Mus musculus
ctttgtacaggagccggcgcctgtt

SEQ ID NO: 97210 - DNA, 25 bp, Mus musculus
ctttgtagttattcaggcctgggca

SEQ ID NO: 97211 - DNA, 25 bp, Mus musculus
ctttgtatcagcataacttgacggg

SEQ ID NO: 97212 - DNA, 25 bp, Mus musculus
ctttgtcaagaaggaccagatgggc

SEQ ID NO: 97213 - DNA, 25 bp, Mus musculus
ctttgtccggagtagtcagtcagct

SEQ ID NO: 97214 - DNA, 25 bp, Mus musculus
ctttgtcgtacactaacccagggag

SEQ ID NO: 97215 - DNA, 25 bp, Mus musculus
ctttgtgactcacgccctcttggga

SEQ ID NO: 97216 - DNA, 25 bp, Mus musculus
ctttgtgactgcatgctggtggtga

SEQ ID NO: 97217 - DNA, 25 bp, Mus musculus
ctttgtgactgcgacattgccctga

SEQ ID NO: 97218 - DNA, 25 bp, Mus musculus
ctttgtgatcctgagccccgtggga

SEQ ID NO: 97219 - DNA, 25 bp, Mus musculus
ctttgtgggccgagttcttgacgca

SEQ ID NO: 97220 - DNA, 25 bp, Mus musculus
ctttgtgggctacaacagcaccggc

SEQ ID NO: 97221 - DNA, 25 bp, Mus musculus
ctttgttctggctgttggattatgg

SEQ ID NO: 97222 - DNA, 25 bp, Mus musculus
ctttgtttacatttgagcttggctc

SEQ ID NO: 97223 - DNA, 25 bp, Mus musculus
ctttgtttaggatgtggtgcctctt

SEQ ID NO: 97224 - DNA, 25 bp, Mus musculus
ctttgttttgctcggtgtgggatcc

SEQ ID NO: 97225 - DNA, 25 bp, Mus musculus
cttttactaattgttcaggacttat

SEQ ID NO: 97226 - DNA, 25 bp, Mus musculus
cttttacttcgaggcagaaggcagc

SEQ ID NO: 97227 - DNA, 25 bp, Mus musculus
cttttagaaatcaaatctgggattg

SEQ ID NO: 97228 - DNA, 25 bp, Mus musculus
cttttaggaaagacatacttgaagc

SEQ ID NO: 97229 - DNA, 25 bp, Mus musculus
cttttcaagcggaacccctgcaaca

SEQ ID NO: 97230 - DNA, 25 bp, Mus musculus
cttttccaccctggccaagggcaca

SEQ ID NO: 97231 - DNA, 25 bp, Mus musculus
cttttcccagtatggtgaggttgtg

SEQ ID NO: 97232 - DNA, 25 bp, Mus musculus
cttttgaaaagagtggagccagctc

SEQ ID NO: 97233 - DNA, 25 bp, Mus musculus
cttttgacggatgcaatctgaccag

SEQ ID NO: 97234 - DNA, 25 bp, Mus musculus
cttttgagttctaatggctgacccc

SEQ ID NO: 97235 - DNA, 25 bp, Mus musculus
cttttgatcgagtgaaactcaccaa

SEQ ID NO: 97236 - DNA, 25 bp, Mus musculus
cttttgcaaagggagctggtgacca

SEQ ID NO: 97237 - DNA, 25 bp, Mus musculus
cttttggaacatagcttggaaggca

SEQ ID NO: 97238 - DNA, 25 bp, Mus musculus
cttttggaagatgaatggtggcccc

SEQ ID NO: 97239 - DNA, 25 bp, Mus musculus
cttttggagcacagttacctccaat

SEQ ID NO: 97240 - DNA, 25 bp, Mus musculus
cttttggagccggttagtccaggcg

SEQ ID NO: 97241 - DNA, 25 bp, Mus musculus
cttttgggaaggaacgagatgcagc

SEQ ID NO: 97242 - DNA, 25 bp, Mus musculus
cttttgtcacaaagagtcctaactg

SEQ ID NO: 97243 - DNA, 25 bp, Mus musculus
cttttgtgatgccacgcctgcaggg

SEQ ID NO: 97244 - DNA, 25 bp, Mus musculus
cttttgtggtgagggcccgactgct

SEQ ID NO: 97245 - DNA, 25 bp, Mus musculus
ctttttaaatagcaggtgtctcggg

SEQ ID NO: 97246 - DNA, 25 bp, Mus musculus
ctttttccaactcagcggggctgta

SEQ ID NO: 97247 - DNA, 25 bp, Mus musculus
ctttttgtgaggaacataagggaca

SEQ ID NO: 97248 - DNA, 25 bp, Mus musculus
gaaaaaacaaaggtccccagtgatg

SEQ ID NO: 97249 - DNA, 25 bp, Mus musculus
gaaaaaacacgagctgtccaggaac

SEQ ID NO: 97250 - DNA, 25 bp, Mus musculus
gaaaaaactcaatcacgccaatgtg

SEQ ID NO: 97251 - DNA, 25 bp, Mus musculus
gaaaaaactggacatgacagccgga

SEQ ID NO: 97252 - DNA, 25 bp, Mus musculus
gaaaaaagatgccaagaccggaagc

SEQ ID NO: 97253 - DNA, 25 bp, Mus musculus
gaaaaaagatgctgcctcggcgatg

SEQ ID NO: 97254 - DNA, 25 bp, Mus musculus
gaaaaaagcaactgtttctgcaact

SEQ ID NO: 97255 - DNA, 25 bp, Mus musculus
gaaaaaagtagaggcaagtcaggca

SEQ ID NO: 97256 - DNA, 25 bp, Mus musculus
gaaaaaagttaacaggcttctcagg

SEQ ID NO: 97257 - DNA, 25 bp, Mus musculus
gaaaaaagttggcaccattggccca

SEQ ID NO: 97258 - DNA, 25 bp, Mus musculus
gaaaaaatccaaacatccgggagca

SEQ ID NO: 97259 - DNA, 25 bp, Mus musculus
gaaaaaatgactgctttggaggcca

SEQ ID NO: 97260 - DNA, 25 bp, Mus musculus
gaaaaaattgaacggcgacagcagg

SEQ ID NO: 97261 - DNA, 25 bp, Mus musculus
gaaaaaattgctcagcttttcagca

SEQ ID NO: 97262 - DNA, 25 bp, Mus musculus
gaaaaacaaaggatcctgaggacct

SEQ ID NO: 97263 - DNA, 25 bp, Mus musculus
gaaaaacaactgtgatgtgggcagc

SEQ ID NO: 97264 - DNA, 25 bp, Mus musculus
gaaaaacaatgtgagctggccccta

SEQ ID NO: 97265 - DNA, 25 bp, Mus musculus
gaaaaacaccagagagtacagcgta

SEQ ID NO: 97266 - DNA, 25 bp, Mus musculus
gaaaaacactttatcctgggatctg

SEQ ID NO: 97267 - DNA, 25 bp, Mus musculus
gaaaaacagctggaagggtcgcatc

SEQ ID NO: 97268 - DNA, 25 bp, Mus musculus
gaaaaacagtcgtgtaccgtggcca

SEQ ID NO: 97269 - DNA, 25 bp, Mus musculus
gaaaaacagtggtatccagcaagcc

SEQ ID NO: 97270 - DNA, 25 bp, Mus musculus
gaaaaacattcccagcgtcagaggc

SEQ ID NO: 97271 - DNA, 25 bp, Mus musculus
gaaaaacccatacttgagcatctaa

SEQ ID NO: 97272 - DNA, 25 bp, Mus musculus
gaaaaacccctattcccatcgagag

SEQ ID NO: 97273 - DNA, 25 bp, Mus musculus
gaaaaacccctggtctgactctgag

SEQ ID NO: 97274 - DNA, 25 bp, Mus musculus
gaaaaaccttcgctgtcccagagag

SEQ ID NO: 97275 - DNA, 25 bp, Mus musculus
gaaaaacgcatctcaggagctcagc

SEQ ID NO: 97276 - DNA, 25 bp, Mus musculus
gaaaaacgtgctgggccatatgcag

SEQ ID NO: 97277 - DNA, 25 bp, Mus musculus
gaaaaactacaggttgactgctggg

SEQ ID NO: 97278 - DNA, 25 bp, Mus musculus
gaaaaactacctcctaatactcata

SEQ ID NO: 97279 - DNA, 25 bp, Mus musculus
gaaaaactctttaagcaggccctga

SEQ ID NO: 97280 - DNA, 25 bp, Mus musculus
gaaaaactgcgcagagaaccctatg

SEQ ID NO: 97281 - DNA, 25 bp, Mus musculus
gaaaaactgctgcatttcatctctg

SEQ ID NO: 97282 - DNA, 25 bp, Mus musculus
gaaaaacttccagatcgtccacggg

SEQ ID NO: 97283 - DNA, 25 bp, Mus musculus
gaaaaacttgcttctctccatggtg

SEQ ID NO: 97284 - DNA, 25 bp, Mus musculus
gaaaaacttgcttttggcgccatca

SEQ ID NO: 97285 - DNA, 25 bp, Mus musculus
gaaaaagaagaaacgtcctgagata

SEQ ID NO: 97286 - DNA, 25 bp, Mus musculus
gaaaaagaagcatcgaggagcggat

SEQ ID NO: 97287 - DNA, 25 bp, Mus musculus
gaaaaagaatcgagtggtgctggcc

SEQ ID NO: 97288 - DNA, 25 bp, Mus musculus
gaaaaagacattcctgtggaggctt

SEQ ID NO: 97289 - DNA, 25 bp, Mus musculus
gaaaaagaccgcctcctggctgagg

SEQ ID NO: 97290 - DNA, 25 bp, Mus musculus
gaaaaagagaaattcgaacccacag

SEQ ID NO: 97291 - DNA, 25 bp, Mus musculus
gaaaaagagccagatcccaagacat

SEQ ID NO: 97292 - DNA, 25 bp, Mus musculus
gaaaaagagctttgcgcctgggact

SEQ ID NO: 97293 - DNA, 25 bp, Mus musculus
gaaaaagcaattgcctggcggcgct

SEQ ID NO: 97294 - DNA, 25 bp, Mus musculus
gaaaaagccaagctcatcggtcaga

SEQ ID NO: 97295 - DNA, 25 bp, Mus musculus
gaaaaagccgaaagagaaagcccag

SEQ ID NO: 97296 - DNA, 25 bp, Mus musculus
gaaaaagccgatgaaccaatggaac

SEQ ID NO: 97297 - DNA, 25 bp, Mus musculus
gaaaaagcgctacgtggcagctgct

SEQ ID NO: 97298 - DNA, 25 bp, Mus musculus
gaaaaagctctaatttgaccaggtg

SEQ ID NO: 97299 - DNA, 25 bp, Mus musculus
gaaaaagctgggtcctgggcctgtt

SEQ ID NO: 97300 - DNA, 25 bp, Mus musculus
gaaaaaggaaggatcggctgccgtc

SEQ ID NO: 97301 - DNA, 25 bp, Mus musculus
gaaaaaggaccttgcctggcatgca

SEQ ID NO: 97302 - DNA, 25 bp, Mus musculus
gaaaaaggagtcaagctctgctgct

SEQ ID NO: 97303 - DNA, 25 bp, Mus musculus
gaaaaaggcccctgtgaccaaggca

SEQ ID NO: 97304 - DNA, 25 bp, Mus musculus
gaaaaagtacgactccactggaatg

SEQ ID NO: 97305 - DNA, 25 bp, Mus musculus
gaaaaagtagatgtgaggccggcca

SEQ ID NO: 97306 - DNA, 25 bp, Mus musculus
gaaaaagtaggctctggaccaccat

SEQ ID NO: 97307 - DNA, 25 bp, Mus musculus
gaaaaagtataaccaggctcctggg

SEQ ID NO: 97308 - DNA, 25 bp, Mus musculus
gaaaaagtatggatcccgcctaccg

SEQ ID NO: 97309 - DNA, 25 bp, Mus musculus
gaaaaagtcctgtccgggaagccag

SEQ ID NO: 97310 - DNA, 25 bp, Mus musculus
gaaaaagtccttcgctagcttcaga

SEQ ID NO: 97311 - DNA, 25 bp, Mus musculus
gaaaaagtctcggtctcgatctcag

SEQ ID NO: 97312 - DNA, 25 bp, Mus musculus
gaaaaagtgcactccggaaaaatct

SEQ ID NO: 97313 - DNA, 25 bp, Mus musculus
gaaaaagtggaattcccagtgaggg

SEQ ID NO: 97314 - DNA, 25 bp, Mus musculus
gaaaaagttctaccagcctgacaag

SEQ ID NO: 97315 - DNA, 25 bp, Mus musculus
gaaaaagttcttgatcggcgagttg

SEQ ID NO: 97316 - DNA, 25 bp, Mus musculus
gaaaaataaggagagccgcctcacc

SEQ ID NO: 97317 - DNA, 25 bp, Mus musculus
gaaaaataccagaaaatcaaactgc

SEQ ID NO: 97318 - DNA, 25 bp, Mus musculus
gaaaaatagccacagaacttccagg

SEQ ID NO: 97319 - DNA, 25 bp, Mus musculus
gaaaaatatcaagggctacagcagc

SEQ ID NO: 97320 - DNA, 25 bp, Mus musculus
gaaaaatccacagacacagaggagg

SEQ ID NO: 97321 - DNA, 25 bp, Mus musculus
gaaaaatctctcatattggcaagta

SEQ ID NO: 97322 - DNA, 25 bp, Mus musculus
gaaaaatctgcagctgctaccgagg

SEQ ID NO: 97323 - DNA, 25 bp, Mus musculus
gaaaaatgagagtcgcctctcccga

SEQ ID NO: 97324 - DNA, 25 bp, Mus musculus
gaaaaatgagccctccgtcgagaac

SEQ ID NO: 97325 - DNA, 25 bp, Mus musculus
gaaaaatgatgcaagccacgggcaa

SEQ ID NO: 97326 - DNA, 25 bp, Mus musculus
gaaaaatgcttctcaaggcccggct

SEQ ID NO: 97327 - DNA, 25 bp, Mus musculus
gaaaaatggattgtaactgctgccc

SEQ ID NO: 97328 - DNA, 25 bp, Mus musculus
gaaaaatggcaccacttacgagggc

SEQ ID NO: 97329 - DNA, 25 bp, Mus musculus
gaaaaatggcatctggacaaggacc

SEQ ID NO: 97330 - DNA, 25 bp, Mus musculus
gaaaaatggcgactgttacggaact

SEQ ID NO: 97331 - DNA, 25 bp, Mus musculus
gaaaaatgtaacctggacatcgttg

SEQ ID NO: 97332 - DNA, 25 bp, Mus musculus
gaaaaatgtttctatgaccgacgtg

SEQ ID NO: 97333 - DNA, 25 bp, Mus musculus
gaaaaattaactgagctcctggaga

SEQ ID NO: 97334 - DNA, 25 bp, Mus musculus
gaaaaattccaactgctccttgaag

SEQ ID NO: 97335 - DNA, 25 bp, Mus musculus
gaaaaattccatgtgatgtcaccga

SEQ ID NO: 97336 - DNA, 25 bp, Mus musculus
gaaaaattccgctatgctcaagatg

SEQ ID NO: 97337 - DNA, 25 bp, Mus musculus
gaaaaattcctgagactaaagcgta

SEQ ID NO: 97338 - DNA, 25 bp, Mus musculus
gaaaaattgacctgactgactacga

SEQ ID NO: 97339 - DNA, 25 bp, Mus musculus
gaaaaatttcgagacagctctgcag

SEQ ID NO: 97340 - DNA, 25 bp, Mus musculus
gaaaacaaactagggcagtgtgcat

SEQ ID NO: 97341 - DNA, 25 bp, Mus musculus
gaaaacaactactatctggcccatg

SEQ ID NO: 97342 - DNA, 25 bp, Mus musculus
gaaaacaacttcattgggagaccag

SEQ ID NO: 97343 - DNA, 25 bp, Mus musculus
gaaaacaagaataaaggatctgccc

SEQ ID NO: 97344 - DNA, 25 bp, Mus musculus
gaaaacaagggtggctacctctgcc

SEQ ID NO: 97345 - DNA, 25 bp, Mus musculus
gaaaacaatgtctgccaacctaaaa

SEQ ID NO: 97346 - DNA, 25 bp, Mus musculus
gaaaacacagccgttgcaccgagtt

SEQ ID NO: 97347 - DNA, 25 bp, Mus musculus
gaaaacacagttgtctctgcaggga

SEQ ID NO: 97348 - DNA, 25 bp, Mus musculus
gaaaacaccctgtggtgaaggccag

SEQ ID NO: 97349 - DNA, 25 bp, Mus musculus
gaaaacacggctcttggctggaatg

SEQ ID NO: 97350 - DNA, 25 bp, Mus musculus
gaaaacactcacagtggtgtccggc

SEQ ID NO: 97351 - DNA, 25 bp, Mus musculus
gaaaacacttgatcccaaagattgg

SEQ ID NO: 97352 - DNA, 25 bp, Mus musculus
gaaaacagccaacaacaatgtggtg

SEQ ID NO: 97353 - DNA, 25 bp, Mus musculus
gaaaacagccatggacaattctgag

SEQ ID NO: 97354 - DNA, 25 bp, Mus musculus
gaaaacagctgaaaccgaagaggga

SEQ ID NO: 97355 - DNA, 25 bp, Mus musculus
gaaaacagctgatctcttgggaagg

SEQ ID NO: 97356 - DNA, 25 bp, Mus musculus
gaaaacaggacagtactccggcatg

SEQ ID NO: 97357 - DNA, 25 bp, Mus musculus
gaaaacaggagagacggacagttcc

SEQ ID NO: 97358 - DNA, 25 bp, Mus musculus
gaaaacagtcaggtcatctgtgagg

SEQ ID NO: 97359 - DNA, 25 bp, Mus musculus
gaaaacagtccatatttgcagctgg

SEQ ID NO: 97360 - DNA, 25 bp, Mus musculus
gaaaacatcaggacgagcctaggcc

SEQ ID NO: 97361 - DNA, 25 bp, Mus musculus
gaaaacatcgttccctttctcggca

SEQ ID NO: 97362 - DNA, 25 bp, Mus musculus
gaaaacatctgagaagacgggacac

SEQ ID NO: 97363 - DNA, 25 bp, Mus musculus
gaaaacatctgcctgcactgggcct

SEQ ID NO: 97364 - DNA, 25 bp, Mus musculus
gaaaacatgacgtctccagccaaat

SEQ ID NO: 97365 - DNA, 25 bp, Mus musculus
gaaaacatgagttcaggcacagctg

SEQ ID NO: 97366 - DNA, 25 bp, Mus musculus
gaaaacatgctcttctggatggcct

SEQ ID NO: 97367 - DNA, 25 bp, Mus musculus
gaaaaccaacgagatgcttctgaac

SEQ ID NO: 97368 - DNA, 25 bp, Mus musculus
gaaaaccaagctccatgagtgggca

SEQ ID NO: 97369 - DNA, 25 bp, Mus musculus
gaaaaccaatcaacatgtctcccag

SEQ ID NO: 97370 - DNA, 25 bp, Mus musculus
gaaaaccagctttcctttcatggtg

SEQ ID NO: 97371 - DNA, 25 bp, Mus musculus
gaaaaccagggctcttactcgggtg

SEQ ID NO: 97372 - DNA, 25 bp, Mus musculus
gaaaaccaggtcatgtgcaaggagt

SEQ ID NO: 97373 - DNA, 25 bp, Mus musculus
gaaaaccagtcaggcagctttgctg

SEQ ID NO: 97374 - DNA, 25 bp, Mus musculus
gaaaaccagtggctgttacaagtaa

SEQ ID NO: 97375 - DNA, 25 bp, Mus musculus
gaaaaccagttaagcgttcctcaga

SEQ ID NO: 97376 - DNA, 25 bp, Mus musculus
gaaaaccagtttgtggccgtgacaa

SEQ ID NO: 97377 - DNA, 25 bp, Mus musculus
gaaaaccatctcgttgtttggcgcg

SEQ ID NO: 97378 - DNA, 25 bp, Mus musculus
gaaaaccatctgtatgctggacggg

SEQ ID NO: 97379 - DNA, 25 bp, Mus musculus
gaaaaccatgacgtgctgtgaaggg

SEQ ID NO: 97380 - DNA, 25 bp, Mus musculus
gaaaaccatgttgaaggccaccagg

SEQ ID NO: 97381 - DNA, 25 bp, Mus musculus
gaaaaccattggctccctggaggct

SEQ ID NO: 97382 - DNA, 25 bp, Mus musculus
gaaaacccactgcaagaccggaaag

SEQ ID NO: 97383 - DNA, 25 bp, Mus musculus
gaaaacccggcaaggatggcattga

SEQ ID NO: 97384 - DNA, 25 bp, Mus musculus
gaaaaccctcactctgagtacgggc

SEQ ID NO: 97385 - DNA, 25 bp, Mus musculus
gaaaaccctgcattctcagcatggg

SEQ ID NO: 97386 - DNA, 25 bp, Mus musculus
gaaaaccctttggatgctaagctcg

SEQ ID NO: 97387 - DNA, 25 bp, Mus musculus
gaaaaccgagacctccagcaatcat

SEQ ID NO: 97388 - DNA, 25 bp, Mus musculus
gaaaaccgcaagacagcgtgggcta

SEQ ID NO: 97389 - DNA, 25 bp, Mus musculus
gaaaaccgtatgcttccagaacctg

SEQ ID NO: 97390 - DNA, 25 bp, Mus musculus
gaaaacctattgtcaccggcgactg

SEQ ID NO: 97391 - DNA, 25 bp, Mus musculus
gaaaacctcccatgctgctgaacag

SEQ ID NO: 97392 - DNA, 25 bp, Mus musculus
gaaaacctgagtaccctaagccaga

SEQ ID NO: 97393 - DNA, 25 bp, Mus musculus
gaaaacctgggccatagactgaaaa

SEQ ID NO: 97394 - DNA, 25 bp, Mus musculus
gaaaacctgggtatccattctgccg

SEQ ID NO: 97395 - DNA, 25 bp, Mus musculus
gaaaacctgtgtggcctcagtgact

SEQ ID NO: 97396 - DNA, 25 bp, Mus musculus
gaaaaccttagctcatggattcccg

SEQ ID NO: 97397 - DNA, 25 bp, Mus musculus
gaaaaccttcatgtatcctgagtgc

SEQ ID NO: 97398 - DNA, 25 bp, Mus musculus
gaaaaccttctagctgtatccagcg

SEQ ID NO: 97399 - DNA, 25 bp, Mus musculus
gaaaaccttgctaaaagaaggcaag

SEQ ID NO: 97400 - DNA, 25 bp, Mus musculus
gaaaacgacccagatcagactcagg

SEQ ID NO: 97401 - DNA, 25 bp, Mus musculus
gaaaacgagacatcgcctctggagc

SEQ ID NO: 97402 - DNA, 25 bp, Mus musculus
gaaaacgagtggatgcctcctggaa

SEQ ID NO: 97403 - DNA, 25 bp, Mus musculus
gaaaacgatccagactatgacccaa

SEQ ID NO: 97404 - DNA, 25 bp, Mus musculus
gaaaacgccaggtgttcaagtccca

SEQ ID NO: 97405 - DNA, 25 bp, Mus musculus
gaaaacgcctaaagtcagacgagag

SEQ ID NO: 97406 - DNA, 25 bp, Mus musculus
gaaaacgcctgggtttgctggagaa

SEQ ID NO: 97407 - DNA, 25 bp, Mus musculus
gaaaacgcgtatcaagagctgctgc

SEQ ID NO: 97408 - DNA, 25 bp, Mus musculus
gaaaacgctcagcatctcgaggtcg

SEQ ID NO: 97409 - DNA, 25 bp, Mus musculus
gaaaacgctgaacgtcgcttggcaa

SEQ ID NO: 97410 - DNA, 25 bp, Mus musculus
gaaaacgcttgtgcacgatgcatgc

SEQ ID NO: 97411 - DNA, 25 bp, Mus musculus
gaaaacgctttgatgttcctccagc

SEQ ID NO: 97412 - DNA, 25 bp, Mus musculus
gaaaacggaaaagacatcactggac

SEQ ID NO: 97413 - DNA, 25 bp, Mus musculus
gaaaacggctcaaagatgagggtga

SEQ ID NO: 97414 - DNA, 25 bp, Mus musculus
gaaaacggtgctgtcattgacccca

SEQ ID NO: 97415 - DNA, 25 bp, Mus musculus
gaaaacgtgtttacttgtagcagct

SEQ ID NO: 97416 - DNA, 25 bp, Mus musculus
gaaaactaaagacgaagctgcggct

SEQ ID NO: 97417 - DNA, 25 bp, Mus musculus
gaaaactacaagtcacaggaacact

SEQ ID NO: 97418 - DNA, 25 bp, Mus musculus
gaaaactacaggattctcagtcggc

SEQ ID NO: 97419 - DNA, 25 bp, Mus musculus
gaaaactactaaggccatctcaggg

SEQ ID NO: 97420 - DNA, 25 bp, Mus musculus
gaaaactactggaactggtctacgg

SEQ ID NO: 97421 - DNA, 25 bp, Mus musculus
gaaaactagaggatgaaaatagtcg

SEQ ID NO: 97422 - DNA, 25 bp, Mus musculus
gaaaactatatctctcctgctgcct

SEQ ID NO: 97423 - DNA, 25 bp, Mus musculus
gaaaactatgccctcgtgtactcct

SEQ ID NO: 97424 - DNA, 25 bp, Mus musculus
gaaaactcaggtgaagtgccgcaag

SEQ ID NO: 97425 - DNA, 25 bp, Mus musculus
gaaaactcggccatccagaaagtgg

SEQ ID NO: 97426 - DNA, 25 bp, Mus musculus
gaaaactcgtttcagcctggccctg

SEQ ID NO: 97427 - DNA, 25 bp, Mus musculus
gaaaactcttcaatgaatcccatgg

SEQ ID NO: 97428 - DNA, 25 bp, Mus musculus
gaaaactgcagtgggctctaaggaa

SEQ ID NO: 97429 - DNA, 25 bp, Mus musculus
gaaaactggaccaacagtgaccgag

SEQ ID NO: 97430 - DNA, 25 bp, Mus musculus
gaaaactggcagtcccctttgcatt

SEQ ID NO: 97431 - DNA, 25 bp, Mus musculus
gaaaactggccaaaggtcttgcaac

SEQ ID NO: 97432 - DNA, 25 bp, Mus musculus
gaaaactggccctccaaccactgaa

SEQ ID NO: 97433 - DNA, 25 bp, Mus musculus
gaaaactggcctacagggaccaaag

SEQ ID NO: 97434 - DNA, 25 bp, Mus musculus
gaaaacttagtgcttccagcccctg

SEQ ID NO: 97435 - DNA, 25 bp, Mus musculus
gaaaacttcaaactccacgtcggag

SEQ ID NO: 97436 - DNA, 25 bp, Mus musculus
gaaaacttcaggatatcaggtgtcg

SEQ ID NO: 97437 - DNA, 25 bp, Mus musculus
gaaaacttcatcaagctctgcaaga

SEQ ID NO: 97438 - DNA, 25 bp, Mus musculus
gaaaacttccagaacttggagcggg

SEQ ID NO: 97439 - DNA, 25 bp, Mus musculus
gaaaacttccgttctgagaggctga

SEQ ID NO: 97440 - DNA, 25 bp, Mus musculus
gaaaacttcgaccacaacacactgg

SEQ ID NO: 97441 - DNA, 25 bp, Mus musculus
gaaaacttcgagagtcgcgtctccg

SEQ ID NO: 97442 - DNA, 25 bp, Mus musculus
gaaaacttctgggactgggactagg

SEQ ID NO: 97443 - DNA, 25 bp, Mus musculus
gaaaacttgaagttagccctggtga

SEQ ID NO: 97444 - DNA, 25 bp, Mus musculus
gaaaacttggcaggctacctctcag

SEQ ID NO: 97445 - DNA, 25 bp, Mus musculus
gaaaactttccgtcttcgccaatgg

SEQ ID NO: 97446 - DNA, 25 bp, Mus musculus
gaaaagaaaatcgagaccgggacag

SEQ ID NO: 97447 - DNA, 25 bp, Mus musculus
gaaaagaaacagtacagcctgagat

SEQ ID NO: 97448 - DNA, 25 bp, Mus musculus
gaaaagaaagcatgtctcctgccgc

SEQ ID NO: 97449 - DNA, 25 bp, Mus musculus
gaaaagaaagttgatcagcctccag

SEQ ID NO: 97450 - DNA, 25 bp, Mus musculus
gaaaagaaataccacaatgttggtc

SEQ ID NO: 97451 - DNA, 25 bp, Mus musculus
gaaaagaacggcatcgggtaccact

SEQ ID NO: 97452 - DNA, 25 bp, Mus musculus
gaaaagaactccaaacgaagctccg

SEQ ID NO: 97453 - DNA, 25 bp, Mus musculus
gaaaagaacttttacctctgtccag

SEQ ID NO: 97454 - DNA, 25 bp, Mus musculus
gaaaagaatttcagcataactccac

SEQ ID NO: 97455 - DNA, 25 bp, Mus musculus
gaaaagacaaagcagagtgacccct

SEQ ID NO: 97456 - DNA, 25 bp, Mus musculus
gaaaagaccagaatgcacagcactg

SEQ ID NO: 97457 - DNA, 25 bp, Mus musculus
gaaaagacccagctctacaacaggc

SEQ ID NO: 97458 - DNA, 25 bp, Mus musculus
gaaaagacggtattgcagtgcagat

SEQ ID NO: 97459 - DNA, 25 bp, Mus musculus
gaaaagacggtctaccatgcagaag

SEQ ID NO: 97460 - DNA, 25 bp, Mus musculus
gaaaagacggtgatacatcgctgac

SEQ ID NO: 97461 - DNA, 25 bp, Mus musculus
gaaaagactcgattccgttctggaa

SEQ ID NO: 97462 - DNA, 25 bp, Mus musculus
gaaaagactgggttccctggcagat

SEQ ID NO: 97463 - DNA, 25 bp, Mus musculus
gaaaagacttcatccaagggccagt

SEQ ID NO: 97464 - DNA, 25 bp, Mus musculus
gaaaagacttcgagaggatgcccct

SEQ ID NO: 97465 - DNA, 25 bp, Mus musculus
gaaaagagaaagacgtggcagcacg

SEQ ID NO: 97466 - DNA, 25 bp, Mus musculus
gaaaagagagattgctggagccacc

SEQ ID NO: 97467 - DNA, 25 bp, Mus musculus
gaaaagagccactgttagcctgtag

SEQ ID NO: 97468 - DNA, 25 bp, Mus musculus
gaaaagaggccctcggagatgcgac

SEQ ID NO: 97469 - DNA, 25 bp, Mus musculus
gaaaagagggcctgttgcatcagcc

SEQ ID NO: 97470 - DNA, 25 bp, Mus musculus
gaaaagaggttcaaattggaccact

SEQ ID NO: 97471 - DNA, 25 bp, Mus musculus
gaaaagataaaaggacgcagaggga

SEQ ID NO: 97472 - DNA, 25 bp, Mus musculus
gaaaagatcacacagagctccctga

SEQ ID NO: 97473 - DNA, 25 bp, Mus musculus
gaaaagatcgcctatgtgtaccctg

SEQ ID NO: 97474 - DNA, 25 bp, Mus musculus
gaaaagatcgtgcactgtcacaagg

SEQ ID NO: 97475 - DNA, 25 bp, Mus musculus
gaaaagatgccgttccaccatgtaa

SEQ ID NO: 97476 - DNA, 25 bp, Mus musculus
gaaaagatgcgtagccacatggccc

SEQ ID NO: 97477 - DNA, 25 bp, Mus musculus
gaaaagatggctgttgtcaccctca

SEQ ID NO: 97478 - DNA, 25 bp, Mus musculus
gaaaagatggtaatgtgcagggtca

SEQ ID NO: 97479 - DNA, 25 bp, Mus musculus
gaaaagattgaagagccatccatag

SEQ ID NO: 97480 - DNA, 25 bp, Mus musculus
gaaaagcaagttctcagcgttaggc

SEQ ID NO: 97481 - DNA, 25 bp, Mus musculus
gaaaagcaattacgatgggtcccgt

SEQ ID NO: 97482 - DNA, 25 bp, Mus musculus
gaaaagcaccatctccacggagttg

SEQ ID NO: 97483 - DNA, 25 bp, Mus musculus
gaaaagcagatagaagaggacctcc

SEQ ID NO: 97484 - DNA, 25 bp, Mus musculus
gaaaagcagctcgtggaaagcacgg

SEQ ID NO: 97485 - DNA, 25 bp, Mus musculus
gaaaagcagctgtcacagacacagt

SEQ ID NO: 97486 - DNA, 25 bp, Mus musculus
gaaaagcaggctcaacacctgtgcc

SEQ ID NO: 97487 - DNA, 25 bp, Mus musculus
gaaaagccaatcttacctgcaagct

SEQ ID NO: 97488 - DNA, 25 bp, Mus musculus
gaaaagccacatgcttatttatggc

SEQ ID NO: 97489 - DNA, 25 bp, Mus musculus
gaaaagccattgctgcggaggatcc

SEQ ID NO: 97490 - DNA, 25 bp, Mus musculus
gaaaagcccacagataccagtcaga

SEQ ID NO: 97491 - DNA, 25 bp, Mus musculus
gaaaagccccggtcttcagtggata

SEQ ID NO: 97492 - DNA, 25 bp, Mus musculus
gaaaagccctattggtgtagccact

SEQ ID NO: 97493 - DNA, 25 bp, Mus musculus
gaaaagcccttaccagaaggctggg

SEQ ID NO: 97494 - DNA, 25 bp, Mus musculus
gaaaagcccttggaagcctgggtca

SEQ ID NO: 97495 - DNA, 25 bp, Mus musculus
gaaaagcctttgatccgtgggatgg

SEQ ID NO: 97496 - DNA, 25 bp, Mus musculus
gaaaagcgagtcctgttttatggaa

SEQ ID NO: 97497 - DNA, 25 bp, Mus musculus
gaaaagcgcaatggtgtggataact

SEQ ID NO: 97498 - DNA, 25 bp, Mus musculus
gaaaagcgcctacctcaaggacaag

SEQ ID NO: 97499 - DNA, 25 bp, Mus musculus
gaaaagcggcacagacgagatgagt

SEQ ID NO: 97500 - DNA, 25 bp, Mus musculus
gaaaagcgggtcagcaatgacgcaa

SEQ ID NO: 97501 - DNA, 25 bp, Mus musculus
gaaaagcgtgtttatcctgctccaa

SEQ ID NO: 97502 - DNA, 25 bp, Mus musculus
gaaaagctaacctgtaactccggtg

SEQ ID NO: 97503 - DNA, 25 bp, Mus musculus
gaaaagctacccagtcctgagcgct

SEQ ID NO: 97504 - DNA, 25 bp, Mus musculus
gaaaagctactccttcctgagagag

SEQ ID NO: 97505 - DNA, 25 bp, Mus musculus
gaaaagctccttggctcagccacag

SEQ ID NO: 97506 - DNA, 25 bp, Mus musculus
gaaaagctcgcctcgaatgtcacgt

SEQ ID NO: 97507 - DNA, 25 bp, Mus musculus
gaaaagctcggtagctcagcggctg

SEQ ID NO: 97508 - DNA, 25 bp, Mus musculus
gaaaagctcttagagggcgctccca

SEQ ID NO: 97509 - DNA, 25 bp, Mus musculus
gaaaagctgtgcattaaaatcctcc

SEQ ID NO: 97510 - DNA, 25 bp, Mus musculus
gaaaagcttcgagatgtcattgccc

SEQ ID NO: 97511 - DNA, 25 bp, Mus musculus
gaaaaggaaaagactcgaccaagat

SEQ ID NO: 97512 - DNA, 25 bp, Mus musculus
gaaaaggagtcatcgggtagaacca

SEQ ID NO: 97513 - DNA, 25 bp, Mus musculus
gaaaaggagttggtagcccgtcagc

SEQ ID NO: 97514 - DNA, 25 bp, Mus musculus
gaaaaggatcctaagttgcagcagg

SEQ ID NO: 97515 - DNA, 25 bp, Mus musculus
gaaaaggatcctcttgcagccaaag

SEQ ID NO: 97516 - DNA, 25 bp, Mus musculus
gaaaaggcacgctgatctgtctgga

SEQ ID NO: 97517 - DNA, 25 bp, Mus musculus
gaaaaggcataagtcctcgtcctcc

SEQ ID NO: 97518 - DNA, 25 bp, Mus musculus
gaaaaggccaaggttgacagtcgcc

SEQ ID NO: 97519 - DNA, 25 bp, Mus musculus
gaaaaggccgccgagatgcataaga

SEQ ID NO: 97520 - DNA, 25 bp, Mus musculus
gaaaaggcctactggttctggaagg

SEQ ID NO: 97521 - DNA, 25 bp, Mus musculus
gaaaaggctcccatgacttccaagg

SEQ ID NO: 97522 - DNA, 25 bp, Mus musculus
gaaaaggctcgactggagatcgaac

SEQ ID NO: 97523 - DNA, 25 bp, Mus musculus
gaaaaggctctaaggttctgtccag

SEQ ID NO: 97524 - DNA, 25 bp, Mus musculus
gaaaagggattctgatgcctggcaa

SEQ ID NO: 97525 - DNA, 25 bp, Mus musculus
gaaaagggctatgctggccaacaat

SEQ ID NO: 97526 - DNA, 25 bp, Mus musculus
gaaaaggtaagagaacgaagctcag

SEQ ID NO: 97527 - DNA, 25 bp, Mus musculus
gaaaaggtacggtcttcagtccctg

SEQ ID NO: 97528 - DNA, 25 bp, Mus musculus
gaaaaggtcataggatctggcagtg

SEQ ID NO: 97529 - DNA, 25 bp, Mus musculus
gaaaaggtcttttacactgcaggct

SEQ ID NO: 97530 - DNA, 25 bp, Mus musculus
gaaaaggttccaggcattctcaggg

SEQ ID NO: 97531 - DNA, 25 bp, Mus musculus
gaaaaggttctgtggcgaacacgct

SEQ ID NO: 97532 - DNA, 25 bp, Mus musculus
gaaaagtagttatgccctataggcg

SEQ ID NO: 97533 - DNA, 25 bp, Mus musculus
gaaaagtatgcctttgtcaactgga

SEQ ID NO: 97534 - DNA, 25 bp, Mus musculus
gaaaagtattccgagtccgtgaagg

SEQ ID NO: 97535 - DNA, 25 bp, Mus musculus
gaaaagtccatctacaaacgtcggg

SEQ ID NO: 97536 - DNA, 25 bp, Mus musculus
gaaaagtccgggacacgattgccct

SEQ ID NO: 97537 - DNA, 25 bp, Mus musculus
gaaaagtcctgctttgggccctgcc

SEQ ID NO: 97538 - DNA, 25 bp, Mus musculus
gaaaagtctcgttccaagtttggcg

SEQ ID NO: 97539 - DNA, 25 bp, Mus musculus
gaaaagtctgtcaccatccaggctc

SEQ ID NO: 97540 - DNA, 25 bp, Mus musculus
gaaaagtcttcgtgaagccagggaa

SEQ ID NO: 97541 - DNA, 25 bp, Mus musculus
gaaaagtgaagcacagacaagctcc

SEQ ID NO: 97542 - DNA, 25 bp, Mus musculus
gaaaagtgacctcctggcgatctct

SEQ ID NO: 97543 - DNA, 25 bp, Mus musculus
gaaaagtggctgaggctctctctca

SEQ ID NO: 97544 - DNA, 25 bp, Mus musculus
gaaaagtgtaatctgtataaaagtg

SEQ ID NO: 97545 - DNA, 25 bp, Mus musculus
gaaaagtgtcactcaactgccgggc

SEQ ID NO: 97546 - DNA, 25 bp, Mus musculus
gaaaagttccgaagctgcctcgagg

SEQ ID NO: 97547 - DNA, 25 bp, Mus musculus
gaaaagttctactgccgatgctgag

SEQ ID NO: 97548 - DNA, 25 bp, Mus musculus
gaaaagttcttactcctgcacccga

SEQ ID NO: 97549 - DNA, 25 bp, Mus musculus
gaaaagtttgcgctcatggctcaga

SEQ ID NO: 97550 - DNA, 25 bp, Mus musculus
gaaaagttttctcacctagctgggc

SEQ ID NO: 97551 - DNA, 25 bp, Mus musculus
gaaaataaccttctagatcaaacct

SEQ ID NO: 97552 - DNA, 25 bp, Mus musculus
gaaaataacgtcaagtcctcccgtg

SEQ ID NO: 97553 - DNA, 25 bp, Mus musculus
gaaaataagccgtacacagccactg

SEQ ID NO: 97554 - DNA, 25 bp, Mus musculus
gaaaataaggcatgcagtcccaagg

SEQ ID NO: 97555 - DNA, 25 bp, Mus musculus
gaaaataggagcaaggtcagtccca

SEQ ID NO: 97556 - DNA, 25 bp, Mus musculus
gaaaatagtcataattgctccctgg

SEQ ID NO: 97557 - DNA, 25 bp, Mus musculus
gaaaatatccccaatccagaccgtg

SEQ ID NO: 97558 - DNA, 25 bp, Mus musculus
gaaaatatgattcgtcttcaaaaca

SEQ ID NO: 97559 - DNA, 25 bp, Mus musculus
gaaaatatgctcagtgcagccgcgt

SEQ ID NO: 97560 - DNA, 25 bp, Mus musculus
gaaaatatggcacctgtcctcatgg

SEQ ID NO: 97561 - DNA, 25 bp, Mus musculus
gaaaatatggccattggtaaaccgg

SEQ ID NO: 97562 - DNA, 25 bp, Mus musculus
gaaaatattcacgtccgttgcccag

SEQ ID NO: 97563 - DNA, 25 bp, Mus musculus
gaaaatattgggagaggcagcacct

SEQ ID NO: 97564 - DNA, 25 bp, Mus musculus
gaaaatcaagctacagactccagcg

SEQ ID NO: 97565 - DNA, 25 bp, Mus musculus
gaaaatcaaggactacaatggccag

SEQ ID NO: 97566 - DNA, 25 bp, Mus musculus
gaaaatcaagtgcacagccttccag

SEQ ID NO: 97567 - DNA, 25 bp, Mus musculus
gaaaatcagaaggaccaaatagttg

SEQ ID NO: 97568 - DNA, 25 bp, Mus musculus
gaaaatcagcgactcattggtgaaa

SEQ ID NO: 97569 - DNA, 25 bp, Mus musculus
gaaaatcaggactttgccatccagg

SEQ ID NO: 97570 - DNA, 25 bp, Mus musculus
gaaaatcatggctgactcgggaccc

SEQ ID NO: 97571 - DNA, 25 bp, Mus musculus
gaaaatccactgtaaattccagaag

SEQ ID NO: 97572 - DNA, 25 bp, Mus musculus
gaaaatccagcgctacagcatcctg

SEQ ID NO: 97573 - DNA, 25 bp, Mus musculus
gaaaatccagggacaatcagagtgg

SEQ ID NO: 97574 - DNA, 25 bp, Mus musculus
gaaaatccgagcatcttaaggtgcc

SEQ ID NO: 97575 - DNA, 25 bp, Mus musculus
gaaaatccgcaacaagcagtcggct

SEQ ID NO: 97576 - DNA, 25 bp, Mus musculus
gaaaatcctaacttactcagcccag

SEQ ID NO: 97577 - DNA, 25 bp, Mus musculus
gaaaatcctcaacactccaaactgt

SEQ ID NO: 97578 - DNA, 25 bp, Mus musculus
gaaaatcctcgacttcggactggcc

SEQ ID NO: 97579 - DNA, 25 bp, Mus musculus
gaaaatcggcccatgaatgtgctca

SEQ ID NO: 97580 - DNA, 25 bp, Mus musculus
gaaaatcgggcacttcatgaaggac

SEQ ID NO: 97581 - DNA, 25 bp, Mus musculus
gaaaatctcagaacagtcagacgca

SEQ ID NO: 97582 - DNA, 25 bp, Mus musculus
gaaaatctcagctggtatctggaag

SEQ ID NO: 97583 - DNA, 25 bp, Mus musculus
gaaaatctcagtgtcgacctcacct

SEQ ID NO: 97584 - DNA, 25 bp, Mus musculus
gaaaatctctcagctgactgccggg

SEQ ID NO: 97585 - DNA, 25 bp, Mus musculus
gaaaatctgatatatgtggacatgg

SEQ ID NO: 97586 - DNA, 25 bp, Mus musculus
gaaaatctggccattcagacccggg

SEQ ID NO: 97587 - DNA, 25 bp, Mus musculus
gaaaatcttcaaatcccagggcaca

SEQ ID NO: 97588 - DNA, 25 bp, Mus musculus
gaaaatcttcgagtacgagacccag

SEQ ID NO: 97589 - DNA, 25 bp, Mus musculus
gaaaatgaaatccagcggctctctg

SEQ ID NO: 97590 - DNA, 25 bp, Mus musculus
gaaaatgaagatgcagactccagat

SEQ ID NO: 97591 - DNA, 25 bp, Mus musculus
gaaaatgaagccagactgaaagcgt

SEQ ID NO: 97592 - DNA, 25 bp, Mus musculus
gaaaatgaccagctccttccatggg

SEQ ID NO: 97593 - DNA, 25 bp, Mus musculus
gaaaatgactcagacgaacaaggct

SEQ ID NO: 97594 - DNA, 25 bp, Mus musculus
gaaaatgagcaggaacagttgctgc

SEQ ID NO: 97595 - DNA, 25 bp, Mus musculus
gaaaatgagcatctgctacactggg

SEQ ID NO: 97596 - DNA, 25 bp, Mus musculus
gaaaatgaggccgtggttcacagca

SEQ ID NO: 97597 - DNA, 25 bp, Mus musculus
gaaaatgatgatgttcttctgctgg

SEQ ID NO: 97598 - DNA, 25 bp, Mus musculus
gaaaatgcatattgtgccacatcgt

SEQ ID NO: 97599 - DNA, 25 bp, Mus musculus
gaaaatgcattcaggccacatggtg

SEQ ID NO: 97600 - DNA, 25 bp, Mus musculus
gaaaatgccaatgctgtgtctgaag

SEQ ID NO: 97601 - DNA, 25 bp, Mus musculus
gaaaatgcccctgattctgccaaga

SEQ ID NO: 97602 - DNA, 25 bp, Mus musculus
gaaaatgcctatgacgtccgcctga

SEQ ID NO: 97603 - DNA, 25 bp, Mus musculus
gaaaatgcgactgacaatcccctgt

SEQ ID NO: 97604 - DNA, 25 bp, Mus musculus
gaaaatgctcatacctgcagtgttg

SEQ ID NO: 97605 - DNA, 25 bp, Mus musculus
gaaaatgctgccaaagctcagacag

SEQ ID NO: 97606 - DNA, 25 bp, Mus musculus
gaaaatgctgcctaactgatgaaaa

SEQ ID NO: 97607 - DNA, 25 bp, Mus musculus
gaaaatgctgttcgccaaaatggac

SEQ ID NO: 97608 - DNA, 25 bp, Mus musculus
gaaaatggaccttcgtcactcaagc

SEQ ID NO: 97609 - DNA, 25 bp, Mus musculus
gaaaatggaggtgattggtgtctgc

SEQ ID NO: 97610 - DNA, 25 bp, Mus musculus
gaaaatggagtgactgcagccggct

SEQ ID NO: 97611 - DNA, 25 bp, Mus musculus
gaaaatggatgagctactgcccctg

SEQ ID NO: 97612 - DNA, 25 bp, Mus musculus
gaaaatggcagagacggaagctacc

SEQ ID NO: 97613 - DNA, 25 bp, Mus musculus
gaaaatggcagtcgcagatcaagca

SEQ ID NO: 97614 - DNA, 25 bp, Mus musculus
gaaaatggcctgcatagaacttcca

SEQ ID NO: 97615 - DNA, 25 bp, Mus musculus
gaaaatggcttcatacctcggaccc

SEQ ID NO: 97616 - DNA, 25 bp, Mus musculus
gaaaatggcttgctgtccttgatca

SEQ ID NO: 97617 - DNA, 25 bp, Mus musculus
gaaaatgggtgcacctttccgacct

SEQ ID NO: 97618 - DNA, 25 bp, Mus musculus
gaaaatggtagaccactgagcctgg

SEQ ID NO: 97619 - DNA, 25 bp, Mus musculus
gaaaatgtacaagtgccagctgcgg

SEQ ID NO: 97620 - DNA, 25 bp, Mus musculus
gaaaatgtacctggctgcagcgcaa

SEQ ID NO: 97621 - DNA, 25 bp, Mus musculus
gaaaatgtctcaagtagcaccccgt

SEQ ID NO: 97622 - DNA, 25 bp, Mus musculus
gaaaatgtctgtccaacaagcccag

SEQ ID NO: 97623 - DNA, 25 bp, Mus musculus
gaaaatgtgcagacagaaggcctag

SEQ ID NO: 97624 - DNA, 25 bp, Mus musculus
gaaaatgtgttactgaacgtctgcg

SEQ ID NO: 97625 - DNA, 25 bp, Mus musculus
gaaaatgttcaggacgtgctgccca

SEQ ID NO: 97626 - DNA, 25 bp, Mus musculus
gaaaatgttggagtatgatcccgcc

SEQ ID NO: 97627 - DNA, 25 bp, Mus musculus
gaaaatgttgttgctaacccaccag

SEQ ID NO: 97628 - DNA, 25 bp, Mus musculus
gaaaattaaactgtggaccatgccc

SEQ ID NO: 97629 - DNA, 25 bp, Mus musculus
gaaaattacaatccctacagctatg

SEQ ID NO: 97630 - DNA, 25 bp, Mus musculus
gaaaattacatctgtcagccccagg

SEQ ID NO: 97631 - DNA, 25 bp, Mus musculus
gaaaattagcaatgcccagctgcag

SEQ ID NO: 97632 - DNA, 25 bp, Mus musculus
gaaaattcaaagctcagaagcactg

SEQ ID NO: 97633 - DNA, 25 bp, Mus musculus
gaaaattccacctcctgaactacag

SEQ ID NO: 97634 - DNA, 25 bp, Mus musculus
gaaaattcccacagccaaacctgag

SEQ ID NO: 97635 - DNA, 25 bp, Mus musculus
gaaaattcgtgcctcctcaatccta

SEQ ID NO: 97636 - DNA, 25 bp, Mus musculus
gaaaattgcattcatgaagagccca

SEQ ID NO: 97637 - DNA, 25 bp, Mus musculus
gaaaattgctggtctgctctagggc

SEQ ID NO: 97638 - DNA, 25 bp, Mus musculus
gaaaattggtctccttgagtgggcc

SEQ ID NO: 97639 - DNA, 25 bp, Mus musculus
gaaaatttagagagcacgccagact

SEQ ID NO: 97640 - DNA, 25 bp, Mus musculus
gaaaattttcgacactggtggccag

SEQ ID NO: 97641 - DNA, 25 bp, Mus musculus
gaaaattttggaccgtcagcccagc

SEQ ID NO: 97642 - DNA, 25 bp, Mus musculus
gaaacaaaattgtataccggactgg

SEQ ID NO: 97643 - DNA, 25 bp, Mus musculus
gaaacaaagagtgcttctgggcagc

SEQ ID NO: 97644 - DNA, 25 bp, Mus musculus
gaaacaaagctgctcaagagggacg

SEQ ID NO: 97645 - DNA, 25 bp, Mus musculus
gaaacaaatctcctcggtgggtgct

SEQ ID NO: 97646 - DNA, 25 bp, Mus musculus
gaaacaaccgcagctgatcgtgaag

SEQ ID NO: 97647 - DNA, 25 bp, Mus musculus
gaaacaacctgctgatcgtccagag

SEQ ID NO: 97648 - DNA, 25 bp, Mus musculus
gaaacaacttcattcactggccgga

SEQ ID NO: 97649 - DNA, 25 bp, Mus musculus
gaaacaagacgaccctaagaagtag

SEQ ID NO: 97650 - DNA, 25 bp, Mus musculus
gaaacaagccagaaggacaaactct

SEQ ID NO: 97651 - DNA, 25 bp, Mus musculus
gaaacaagcgtcaactggtgcatgg

SEQ ID NO: 97652 - DNA, 25 bp, Mus musculus
gaaacaagctaggagtcacgtgaca

SEQ ID NO: 97653 - DNA, 25 bp, Mus musculus
gaaacaagtgaaatgggtccgctcg

SEQ ID NO: 97654 - DNA, 25 bp, Mus musculus
gaaacaatccatatgcaactgaaga

SEQ ID NO: 97655 - DNA, 25 bp, Mus musculus
gaaacaatgtgcacagtggacggcc

SEQ ID NO: 97656 - DNA, 25 bp, Mus musculus
gaaacaattggcctttctgagctga

SEQ ID NO: 97657 - DNA, 25 bp, Mus musculus
gaaacacaagcatcgagccaaggag

SEQ ID NO: 97658 - DNA, 25 bp, Mus musculus
gaaacacaccgtcgacattgaggag

SEQ ID NO: 97659 - DNA, 25 bp, Mus musculus
gaaacacagtctcccacgatgtcac

SEQ ID NO: 97660 - DNA, 25 bp, Mus musculus
gaaacacagttcagcagtggtgaga

SEQ ID NO: 97661 - DNA, 25 bp, Mus musculus
gaaacacagttgtcagagtccatga

SEQ ID NO: 97662 - DNA, 25 bp, Mus musculus
gaaacacatggatcttcgccagcgc

SEQ ID NO: 97663 - DNA, 25 bp, Mus musculus
gaaacacatttggtgagccactcag

SEQ ID NO: 97664 - DNA, 25 bp, Mus musculus
gaaacaccctttcattgtggacctg

SEQ ID NO: 97665 - DNA, 25 bp, Mus musculus
gaaacaccgcatggtatggtccacg

SEQ ID NO: 97666 - DNA, 25 bp, Mus musculus
gaaacaccgtgggaactctgctctc

SEQ ID NO: 97667 - DNA, 25 bp, Mus musculus
gaaacacctgaagaattctcaagct

SEQ ID NO: 97668 - DNA, 25 bp, Mus musculus
gaaacacctgctaccttgaggccct

SEQ ID NO: 97669 - DNA, 25 bp, Mus musculus
gaaacacgaaaagagcagttcacag

SEQ ID NO: 97670 - DNA, 25 bp, Mus musculus
gaaacacgagaaagattggaaccca

SEQ ID NO: 97671 - DNA, 25 bp, Mus musculus
gaaacactagctttgcaccagactt

SEQ ID NO: 97672 - DNA, 25 bp, Mus musculus
gaaacactattctcacaggttcagc

SEQ ID NO: 97673 - DNA, 25 bp, Mus musculus
gaaacactatttcgagcagttcgga

SEQ ID NO: 97674 - DNA, 25 bp, Mus musculus
gaaacactatttgcttcatgtgcag

SEQ ID NO: 97675 - DNA, 25 bp, Mus musculus
gaaacactgaatgtcagagtccgtg

SEQ ID NO: 97676 - DNA, 25 bp, Mus musculus
gaaacactgattcttcttgatcgac

SEQ ID NO: 97677 - DNA, 25 bp, Mus musculus
gaaacactgcacaacttcccgaaag

SEQ ID NO: 97678 - DNA, 25 bp, Mus musculus
gaaacactggaacgcctggactgcg

SEQ ID NO: 97679 - DNA, 25 bp, Mus musculus
gaaacactggaaggacatgatcgct

SEQ ID NO: 97680 - DNA, 25 bp, Mus musculus
gaaacactgggcctgtccctgtgat

SEQ ID NO: 97681 - DNA, 25 bp, Mus musculus
gaaacacttctctcaaacccgatgg

SEQ ID NO: 97682 - DNA, 25 bp, Mus musculus
gaaacacttgcagtccttacggcag

SEQ ID NO: 97683 - DNA, 25 bp, Mus musculus
gaaacactttctgtgcaggactagg

SEQ ID NO: 97684 - DNA, 25 bp, Mus musculus
gaaacagaaggtggatctacagtcc

SEQ ID NO: 97685 - DNA, 25 bp, Mus musculus
gaaacagactgatgagctactaggc

SEQ ID NO: 97686 - DNA, 25 bp, Mus musculus
gaaacagaggaaagaatgggccaca

SEQ ID NO: 97687 - DNA, 25 bp, Mus musculus
gaaacagaggaaagggtcccatcag

SEQ ID NO: 97688 - DNA, 25 bp, Mus musculus
gaaacagaggaactgattgcacctg

SEQ ID NO: 97689 - DNA, 25 bp, Mus musculus
gaaacagatcaacagctcgctagtg

SEQ ID NO: 97690 - DNA, 25 bp, Mus musculus
gaaacagatcgaatggagctccaag

SEQ ID NO: 97691 - DNA, 25 bp, Mus musculus
gaaacagatcgatataatggtggct

SEQ ID NO: 97692 - DNA, 25 bp, Mus musculus
gaaacagatgtacctgctggatgct

SEQ ID NO: 97693 - DNA, 25 bp, Mus musculus
gaaacagcacagcacaatcgagagg

SEQ ID NO: 97694 - DNA, 25 bp, Mus musculus
gaaacagcacctacttaagcaccag

SEQ ID NO: 97695 - DNA, 25 bp, Mus musculus
gaaacagcagtgcatcagggagctc

SEQ ID NO: 97696 - DNA, 25 bp, Mus musculus
gaaacagcggatgcacttgcgagac

SEQ ID NO: 97697 - DNA, 25 bp, Mus musculus
gaaacagcggattctgacgcccaag

SEQ ID NO: 97698 - DNA, 25 bp, Mus musculus
gaaacagctgccttagcttcaggaa

SEQ ID NO: 97699 - DNA, 25 bp, Mus musculus
gaaacagctgctgtctgcgacggag

SEQ ID NO: 97700 - DNA, 25 bp, Mus musculus
gaaacagctggcaacgcaagagtaa

SEQ ID NO: 97701 - DNA, 25 bp, Mus musculus
gaaacagctgtaagctactggaagc

SEQ ID NO: 97702 - DNA, 25 bp, Mus musculus
gaaacagcttgtgaagtccacgaga

SEQ ID NO: 97703 - DNA, 25 bp, Mus musculus
gaaacagctttactggtggacagat

SEQ ID NO: 97704 - DNA, 25 bp, Mus musculus
gaaacaggcagcttcagcggacagt

SEQ ID NO: 97705 - DNA, 25 bp, Mus musculus
gaaacaggcattaatccagtggcag

SEQ ID NO: 97706 - DNA, 25 bp, Mus musculus
gaaacaggtcctgggctatacacag

SEQ ID NO: 97707 - DNA, 25 bp, Mus musculus
gaaacagtattgttccgagcaccac

SEQ ID NO: 97708 - DNA, 25 bp, Mus musculus
gaaacagtatttgcccgaagctcct

SEQ ID NO: 97709 - DNA, 25 bp, Mus musculus
gaaacagtcggaagacatcaccctg

SEQ ID NO: 97710 - DNA, 25 bp, Mus musculus
gaaacagtcgtgagccagagtcaga

SEQ ID NO: 97711 - DNA, 25 bp, Mus musculus
gaaacagtgccagtcaggatcgaaa

SEQ ID NO: 97712 - DNA, 25 bp, Mus musculus
gaaacagtgcctcctgattatcgac

SEQ ID NO: 97713 - DNA, 25 bp, Mus musculus
gaaacagtgctgaattcgcttagga

SEQ ID NO: 97714 - DNA, 25 bp, Mus musculus
gaaacagtgcttgctatcagtggct

SEQ ID NO: 97715 - DNA, 25 bp, Mus musculus
gaaacagtgctttggcaattgaggc

SEQ ID NO: 97716 - DNA, 25 bp, Mus musculus
gaaacagtgtctcttgctcgtgccg

SEQ ID NO: 97717 - DNA, 25 bp, Mus musculus
gaaacatacccatgagatggctgct

SEQ ID NO: 97718 - DNA, 25 bp, Mus musculus
gaaacatatttacccagcagccaag

SEQ ID NO: 97719 - DNA, 25 bp, Mus musculus
gaaacatcaccgctttatcctgctg

SEQ ID NO: 97720 - DNA, 25 bp, Mus musculus
gaaacatcccagttacctaatattg

SEQ ID NO: 97721 - DNA, 25 bp, Mus musculus
gaaacatcctacttggaaatggctg

SEQ ID NO: 97722 - DNA, 25 bp, Mus musculus
gaaacatcctgtggagtgcggagaa

SEQ ID NO: 97723 - DNA, 25 bp, Mus musculus
gaaacatctcctggtagggacagtg

SEQ ID NO: 97724 - DNA, 25 bp, Mus musculus
gaaacatctcggaccagtatggcag

SEQ ID NO: 97725 - DNA, 25 bp, Mus musculus
gaaacatgaaatcatggtagcccca

SEQ ID NO: 97726 - DNA, 25 bp, Mus musculus
gaaacatgacatagaagcccagtgg

SEQ ID NO: 97727 - DNA, 25 bp, Mus musculus
gaaacatgagagtccagagctccct

SEQ ID NO: 97728 - DNA, 25 bp, Mus musculus
gaaacatgccttttgtgagatccta

SEQ ID NO: 97729 - DNA, 25 bp, Mus musculus
gaaacatgcgcaacctatgggctca

SEQ ID NO: 97730 - DNA, 25 bp, Mus musculus
gaaacatgcttaatggcccactgta

SEQ ID NO: 97731 - DNA, 25 bp, Mus musculus
gaaacatgctttctaatgggccctg

SEQ ID NO: 97732 - DNA, 25 bp, Mus musculus
gaaacatggcgtctgctctggagca

SEQ ID NO: 97733 - DNA, 25 bp, Mus musculus
gaaacatggtgaagcgagtggcaat

SEQ ID NO: 97734 - DNA, 25 bp, Mus musculus
gaaacatgtctaaaaagggccgcag

SEQ ID NO: 97735 - DNA, 25 bp, Mus musculus
gaaacatgttccctggaccctggaa

SEQ ID NO: 97736 - DNA, 25 bp, Mus musculus
gaaacattgtgcctgctctgacgtc

SEQ ID NO: 97737 - DNA, 25 bp, Mus musculus
gaaaccaaagcagtctccgaaatgt

SEQ ID NO: 97738 - DNA, 25 bp, Mus musculus
gaaaccaaatccatcgtggagctga

SEQ ID NO: 97739 - DNA, 25 bp, Mus musculus
gaaaccaaatgttcagcgttccagc

SEQ ID NO: 97740 - DNA, 25 bp, Mus musculus
gaaaccaagacacgtgagcctgttg

SEQ ID NO: 97741 - DNA, 25 bp, Mus musculus
gaaaccaagttgcatggctgcccac

SEQ ID NO: 97742 - DNA, 25 bp, Mus musculus
gaaaccacaccagttcttccaggga

SEQ ID NO: 97743 - DNA, 25 bp, Mus musculus
gaaaccactcgggatgaagacgccc

SEQ ID NO: 97744 - DNA, 25 bp, Mus musculus
gaaaccagaagtaatgggcagacca

SEQ ID NO: 97745 - DNA, 25 bp, Mus musculus
gaaaccagaccgaacgcctattgag

SEQ ID NO: 97746 - DNA, 25 bp, Mus musculus
gaaaccagattctgctacacaagtg

SEQ ID NO: 97747 - DNA, 25 bp, Mus musculus
gaaaccagatttctcatcagccgaa

SEQ ID NO: 97748 - DNA, 25 bp, Mus musculus
gaaaccagcatttagagggaaccgg

SEQ ID NO: 97749 - DNA, 25 bp, Mus musculus
gaaaccagcccaggaaatatagagc

SEQ ID NO: 97750 - DNA, 25 bp, Mus musculus
gaaaccagccgagttgttcacatta

SEQ ID NO: 97751 - DNA, 25 bp, Mus musculus
gaaaccagctgacccagaatcgagg

SEQ ID NO: 97752 - DNA, 25 bp, Mus musculus
gaaaccagctgcgattttgagatag

SEQ ID NO: 97753 - DNA, 25 bp, Mus musculus
gaaaccaggcagagcaaattggctg

SEQ ID NO: 97754 - DNA, 25 bp, Mus musculus
gaaaccagtagttaatgttccaagt

SEQ ID NO: 97755 - DNA, 25 bp, Mus musculus
gaaaccatccttggcttcacaggag

SEQ ID NO: 97756 - DNA, 25 bp, Mus musculus
gaaaccatctgtgtggagggcagct

SEQ ID NO: 97757 - DNA, 25 bp, Mus musculus
gaaaccatcttacaggacgacattg

SEQ ID NO: 97758 - DNA, 25 bp, Mus musculus
gaaaccatgaatgtaggcacctcac

SEQ ID NO: 97759 - DNA, 25 bp, Mus musculus
gaaaccatgcgcgtgattatcttga

SEQ ID NO: 97760 - DNA, 25 bp, Mus musculus
gaaaccatggtttgcccggcagaga

SEQ ID NO: 97761 - DNA, 25 bp, Mus musculus
gaaaccatgtttattcctcaggaat

SEQ ID NO: 97762 - DNA, 25 bp, Mus musculus
gaaaccattaagcttgtgcgtcaag

SEQ ID NO: 97763 - DNA, 25 bp, Mus musculus
gaaacccaactagggactgaccgcg

SEQ ID NO: 97764 - DNA, 25 bp, Mus musculus
gaaacccaagttccgaagcatcgtg

SEQ ID NO: 97765 - DNA, 25 bp, Mus musculus
gaaacccaagttctcagctagccag

SEQ ID NO: 97766 - DNA, 25 bp, Mus musculus
gaaacccagataattcaggccaaga

SEQ ID NO: 97767 - DNA, 25 bp, Mus musculus
gaaacccaggctctgagatgcgtcc

SEQ ID NO: 97768 - DNA, 25 bp, Mus musculus
gaaacccatgtcagcagataaccag

SEQ ID NO: 97769 - DNA, 25 bp, Mus musculus
gaaaccccaacgcagtgttaacttg

SEQ ID NO: 97770 - DNA, 25 bp, Mus musculus
gaaaccccatttcctgacttgctga

SEQ ID NO: 97771 - DNA, 25 bp, Mus musculus
gaaacccccagtaagaaatcagaga

SEQ ID NO: 97772 - DNA, 25 bp, Mus musculus
gaaacccctgcgcttcagaccaggt

SEQ ID NO: 97773 - DNA, 25 bp, Mus musculus
gaaacccgaggtatgcttgatctgt

SEQ ID NO: 97774 - DNA, 25 bp, Mus musculus
gaaacccgctcctgtttagatgtga

SEQ ID NO: 97775 - DNA, 25 bp, Mus musculus
gaaacccgctgttcatcagagtagc

SEQ ID NO: 97776 - DNA, 25 bp, Mus musculus
gaaacccggcagaagctcaatgtgt

SEQ ID NO: 97777 - DNA, 25 bp, Mus musculus
gaaacccggctaagtgcagacatgg

SEQ ID NO: 97778 - DNA, 25 bp, Mus musculus
gaaacccgggagtgtcagaacttga

SEQ ID NO: 97779 - DNA, 25 bp, Mus musculus
gaaaccctaaggctacttggagaga

SEQ ID NO: 97780 - DNA, 25 bp, Mus musculus
gaaaccctgaagatgcttgacgaga

SEQ ID NO: 97781 - DNA, 25 bp, Mus musculus
gaaaccctgatgagccttgtgaaaa

SEQ ID NO: 97782 - DNA, 25 bp, Mus musculus
gaaacccttcatggctcgctacgtg

SEQ ID NO: 97783 - DNA, 25 bp, Mus musculus
gaaaccgacccgcttagagctcaag

SEQ ID NO: 97784 - DNA, 25 bp, Mus musculus
gaaaccgcaagtgtctccctacatg

SEQ ID NO: 97785 - DNA, 25 bp, Mus musculus
gaaaccgcccactttctgatgaaga

SEQ ID NO: 97786 - DNA, 25 bp, Mus musculus
gaaaccggaagcagagaaggcgata

SEQ ID NO: 97787 - DNA, 25 bp, Mus musculus
gaaaccgggagctgtttgcagccat

SEQ ID NO: 97788 - DNA, 25 bp, Mus musculus
gaaaccgtacactgttgagatgagt

SEQ ID NO: 97789 - DNA, 25 bp, Mus musculus
gaaaccgtacaggtcaaaggctggg

SEQ ID NO: 97790 - DNA, 25 bp, Mus musculus
gaaaccgtcagtgtttgggagtgat

SEQ ID NO: 97791 - DNA, 25 bp, Mus musculus
gaaacctaaaagcaaggctgccgcg

SEQ ID NO: 97792 - DNA, 25 bp, Mus musculus
gaaacctacgactgacggtcctgag

SEQ ID NO: 97793 - DNA, 25 bp, Mus musculus
gaaacctacgagatcatcttcaaga

SEQ ID NO: 97794 - DNA, 25 bp, Mus musculus
gaaacctatgaagccagcagcatcg

SEQ ID NO: 97795 - DNA, 25 bp, Mus musculus
gaaacctcaacaagcaaggactccc

SEQ ID NO: 97796 - DNA, 25 bp, Mus musculus
gaaacctccaattctgtggccactg

SEQ ID NO: 97797 - DNA, 25 bp, Mus musculus
gaaacctccattgtgatccgcatca

SEQ ID NO: 97798 - DNA, 25 bp, Mus musculus
gaaacctccgaggtacaagtgtggg

SEQ ID NO: 97799 - DNA, 25 bp, Mus musculus
gaaacctcctgcacgaaaggctctg

SEQ ID NO: 97800 - DNA, 25 bp, Mus musculus
gaaacctcgtgggactcagctgtgt

SEQ ID NO: 97801 - DNA, 25 bp, Mus musculus
gaaacctctagaaggagctgatgac

SEQ ID NO: 97802 - DNA, 25 bp, Mus musculus
gaaacctctgacttggaaaccccag

SEQ ID NO: 97803 - DNA, 25 bp, Mus musculus
gaaacctctgtgtcctccaaaggag

SEQ ID NO: 97804 - DNA, 25 bp, Mus musculus
gaaacctctgtttggacaactgaag

SEQ ID NO: 97805 - DNA, 25 bp, Mus musculus
gaaacctgattgcatatggcggcag

SEQ ID NO: 97806 - DNA, 25 bp, Mus musculus
gaaacctgcaaatcactggagtccc

SEQ ID NO: 97807 - DNA, 25 bp, Mus musculus
gaaacctgcgctattaaggcacccg

SEQ ID NO: 97808 - DNA, 25 bp, Mus musculus
gaaacctggaactttctctgtgaat

SEQ ID NO: 97809 - DNA, 25 bp, Mus musculus
gaaacctggagcgttaagcgtcata

SEQ ID NO: 97810 - DNA, 25 bp, Mus musculus
gaaacctggccactgagaatacaga

SEQ ID NO: 97811 - DNA, 25 bp, Mus musculus
gaaacctggccgtcatggatagtcc

SEQ ID NO: 97812 - DNA, 25 bp, Mus musculus
gaaacctgtcatacttaggcccttg

SEQ ID NO: 97813 - DNA, 25 bp, Mus musculus
gaaacctgtcccctgatgacggtgg

SEQ ID NO: 97814 - DNA, 25 bp, Mus musculus
gaaacctgttagtcctggtggacca

SEQ ID NO: 97815 - DNA, 25 bp, Mus musculus
gaaacctgttgcactggtggactga

SEQ ID NO: 97816 - DNA, 25 bp, Mus musculus
gaaaccttaacactccacgtggctg

SEQ ID NO: 97817 - DNA, 25 bp, Mus musculus
gaaaccttatttatccctgcggagt

SEQ ID NO: 97818 - DNA, 25 bp, Mus musculus
gaaaccttcaatgttcctgcactgt

SEQ ID NO: 97819 - DNA, 25 bp, Mus musculus
gaaaccttcagtcccgtggaaatag

SEQ ID NO: 97820 - DNA, 25 bp, Mus musculus
gaaaccttcatcttggccgaagcca

SEQ ID NO: 97821 - DNA, 25 bp, Mus musculus
gaaaccttctcattcgctaccggga

SEQ ID NO: 97822 - DNA, 25 bp, Mus musculus
gaaaccttggagtgcagtgaaccgg

SEQ ID NO: 97823 - DNA, 25 bp, Mus musculus
gaaaccttggattacgaagcatgga

SEQ ID NO: 97824 - DNA, 25 bp, Mus musculus
gaaaccttggctcttagaggctaca

SEQ ID NO: 97825 - DNA, 25 bp, Mus musculus
gaaaccttgggtttgagcactcaga

SEQ ID NO: 97826 - DNA, 25 bp, Mus musculus
gaaacctttccagtgcagatgtcca

SEQ ID NO: 97827 - DNA, 25 bp, Mus musculus
gaaaccttttataacatgggcagca

SEQ ID NO: 97828 - DNA, 25 bp, Mus musculus
gaaacgacgatacttgagacctact

SEQ ID NO: 97829 - DNA, 25 bp, Mus musculus
gaaacgacttcttgacgaactggac

SEQ ID NO: 97830 - DNA, 25 bp, Mus musculus
gaaacgacttgaagctgtgaagcca

SEQ ID NO: 97831 - DNA, 25 bp, Mus musculus
gaaacgagagtctaccagtcttggt

SEQ ID NO: 97832 - DNA, 25 bp, Mus musculus
gaaacgcaggtcatacagctcaacg

SEQ ID NO: 97833 - DNA, 25 bp, Mus musculus
gaaacgcatgctgatccgcaaggtc

SEQ ID NO: 97834 - DNA, 25 bp, Mus musculus
gaaacgccagaagcttatgccgaac

SEQ ID NO: 97835 - DNA, 25 bp, Mus musculus
gaaacgcccaaagaaggatcctgtg

SEQ ID NO: 97836 - DNA, 25 bp, Mus musculus
gaaacgcccatcaatccaagaagat

SEQ ID NO: 97837 - DNA, 25 bp, Mus musculus
gaaacgcccctcatgctacaggaat

SEQ ID NO: 97838 - DNA, 25 bp, Mus musculus
gaaacgccgcgtgactcgtaggtga

SEQ ID NO: 97839 - DNA, 25 bp, Mus musculus
gaaacgcctccgtctctatataagg

SEQ ID NO: 97840 - DNA, 25 bp, Mus musculus
gaaacgcgcgctcagccatgtctct

SEQ ID NO: 97841 - DNA, 25 bp, Mus musculus
gaaacgctaccaaatgtgaagaatg

SEQ ID NO: 97842 - DNA, 25 bp, Mus musculus
gaaacgctactttgaatgccaggcc

SEQ ID NO: 97843 - DNA, 25 bp, Mus musculus
gaaacgctcctaacttacaaggcaa

SEQ ID NO: 97844 - DNA, 25 bp, Mus musculus
gaaacgctggtgtacacagatcctc

SEQ ID NO: 97845 - DNA, 25 bp, Mus musculus
gaaacgctgttctgagtggcttgaa

SEQ ID NO: 97846 - DNA, 25 bp, Mus musculus
gaaacgcttccaggacgacaaggct

SEQ ID NO: 97847 - DNA, 25 bp, Mus musculus
gaaacgcttgatgacagaccggagg

SEQ ID NO: 97848 - DNA, 25 bp, Mus musculus
gaaacggaagccaacataatgagga

SEQ ID NO: 97849 - DNA, 25 bp, Mus musculus
gaaacggacagtggtaactcacctg

SEQ ID NO: 97850 - DNA, 25 bp, Mus musculus
gaaacggatcctgttgtacaccatg

SEQ ID NO: 97851 - DNA, 25 bp, Mus musculus
gaaacggattcggaacagatccacc

SEQ ID NO: 97852 - DNA, 25 bp, Mus musculus
gaaacggcaacttggacctgaggag

SEQ ID NO: 97853 - DNA, 25 bp, Mus musculus
gaaacggcatgggaaagttcacgag

SEQ ID NO: 97854 - DNA, 25 bp, Mus musculus
gaaacggcctctggttgtcatccat

SEQ ID NO: 97855 - DNA, 25 bp, Mus musculus
gaaacggccttgcttattgatccaa

SEQ ID NO: 97856 - DNA, 25 bp, Mus musculus
gaaacggctctgctaaagatggtag

SEQ ID NO: 97857 - DNA, 25 bp, Mus musculus
gaaacggctgcctgcgggccatgcc

SEQ ID NO: 97858 - DNA, 25 bp, Mus musculus
gaaacgggaacagctcaaaagggct

SEQ ID NO: 97859 - DNA, 25 bp, Mus musculus
gaaacggtgacgacgaagcatatcc

SEQ ID NO: 97860 - DNA, 25 bp, Mus musculus
gaaacgtactccctcaaggcaagga

SEQ ID NO: 97861 - DNA, 25 bp, Mus musculus
gaaacgtatttaaatccagtgcgct

SEQ ID NO: 97862 - DNA, 25 bp, Mus musculus
gaaacgtcctgagatatcagccccg

SEQ ID NO: 97863 - DNA, 25 bp, Mus musculus
gaaacgtcgccagtgctctctatga

SEQ ID NO: 97864 - DNA, 25 bp, Mus musculus
gaaacgtctgcttatggacctagac

SEQ ID NO: 97865 - DNA, 25 bp, Mus musculus
gaaacgtgaccatgtggatccaaca

SEQ ID NO: 97866 - DNA, 25 bp, Mus musculus
gaaacgtgagccagactctaatggg

SEQ ID NO: 97867 - DNA, 25 bp, Mus musculus
gaaacgtgctgaggaacagtgtccc

SEQ ID NO: 97868 - DNA, 25 bp, Mus musculus
gaaacgtgtaccagctacctaagga

SEQ ID NO: 97869 - DNA, 25 bp, Mus musculus
gaaacgtgtagcttctgcttcccgg

SEQ ID NO: 97870 - DNA, 25 bp, Mus musculus
gaaacgttcccttgatcgatgaagc

SEQ ID NO: 97871 - DNA, 25 bp, Mus musculus
gaaacgtttgacaaatcaaagttga

SEQ ID NO: 97872 - DNA, 25 bp, Mus musculus
gaaactaaccattccagtgcagagg

SEQ ID NO: 97873 - DNA, 25 bp, Mus musculus
gaaactacaactgagaggtggctgg

SEQ ID NO: 97874 - DNA, 25 bp, Mus musculus
gaaactacaagcagtgataccgcct

SEQ ID NO: 97875 - DNA, 25 bp, Mus musculus
gaaactacagttgcagctaccggct

SEQ ID NO: 97876 - DNA, 25 bp, Mus musculus
gaaactacccggtcaaaggatgctg

SEQ ID NO: 97877 - DNA, 25 bp, Mus musculus
gaaactacggctctagaacaggcac

SEQ ID NO: 97878 - DNA, 25 bp, Mus musculus
gaaactactgcccactctgatgctg

SEQ ID NO: 97879 - DNA, 25 bp, Mus musculus
gaaactagggaggtgctttgacagc

SEQ ID NO: 97880 - DNA, 25 bp, Mus musculus
gaaactcaagcgtctgttacaccag

SEQ ID NO: 97881 - DNA, 25 bp, Mus musculus
gaaactcacatacgaggcgaagact

SEQ ID NO: 97882 - DNA, 25 bp, Mus musculus
gaaactcagcccctggttgctttag

SEQ ID NO: 97883 - DNA, 25 bp, Mus musculus
gaaactcaggatggacgtgtcagcc

SEQ ID NO: 97884 - DNA, 25 bp, Mus musculus
gaaactcagggcagatagcatctct

SEQ ID NO: 97885 - DNA, 25 bp, Mus musculus
gaaactcccaatttgcaaccccagg

SEQ ID NO: 97886 - DNA, 25 bp, Mus musculus
gaaactccgagtgggcttcctgaag

SEQ ID NO: 97887 - DNA, 25 bp, Mus musculus
gaaactccgggactccctagagctg

SEQ ID NO: 97888 - DNA, 25 bp, Mus musculus
gaaactcctcccagtagcagtggaa

SEQ ID NO: 97889 - DNA, 25 bp, Mus musculus
gaaactcctcgtgatgacaggcgcg

SEQ ID NO: 97890 - DNA, 25 bp, Mus musculus
gaaactcctgatcaagaggcagctg

SEQ ID NO: 97891 - DNA, 25 bp, Mus musculus
gaaactcctggccaacattttgagg

SEQ ID NO: 97892 - DNA, 25 bp, Mus musculus
gaaactcctgtgcaagaacttcggg

SEQ ID NO: 97893 - DNA, 25 bp, Mus musculus
gaaactcgagtgacacccactggga

SEQ ID NO: 97894 - DNA, 25 bp, Mus musculus
gaaactcgccaagagtatgctctgg

SEQ ID NO: 97895 - DNA, 25 bp, Mus musculus
gaaactcggttcctaagcaggcgta

SEQ ID NO: 97896 - DNA, 25 bp, Mus musculus
gaaactctacagcaggtagccgtaa

SEQ ID NO: 97897 - DNA, 25 bp, Mus musculus
gaaactctaccacgccacttctggg

SEQ ID NO: 97898 - DNA, 25 bp, Mus musculus
gaaactctacttgggcttctggtgg

SEQ ID NO: 97899 - DNA, 25 bp, Mus musculus
gaaactctcaagtgacatccaaggt

SEQ ID NO: 97900 - DNA, 25 bp, Mus musculus
gaaactctcagttggagccagacag

SEQ ID NO: 97901 - DNA, 25 bp, Mus musculus
gaaactctcattgcccgatccttgt

SEQ ID NO: 97902 - DNA, 25 bp, Mus musculus
gaaactctccactccaaggcctgga

SEQ ID NO: 97903 - DNA, 25 bp, Mus musculus
gaaactctgaaaatgcgggcatgga

SEQ ID NO: 97904 - DNA, 25 bp, Mus musculus
gaaactctggcaggagggtgaccct

SEQ ID NO: 97905 - DNA, 25 bp, Mus musculus
gaaactctggcttctcaacgggaca

SEQ ID NO: 97906 - DNA, 25 bp, Mus musculus
gaaactctggtaagcccctgtaggt

SEQ ID NO: 97907 - DNA, 25 bp, Mus musculus
gaaactcttcgtggacaagataaga

SEQ ID NO: 97908 - DNA, 25 bp, Mus musculus
gaaactcttcttcacggaagccgaa

SEQ ID NO: 97909 - DNA, 25 bp, Mus musculus
gaaactcttggttttcgacctcctg

SEQ ID NO: 97910 - DNA, 25 bp, Mus musculus
gaaactctttcttacagctaacagg

SEQ ID NO: 97911 - DNA, 25 bp, Mus musculus
gaaactgaacatccagaagaggcga

SEQ ID NO: 97912 - DNA, 25 bp, Mus musculus
gaaactgaacccacccgatgagagt

SEQ ID NO: 97913 - DNA, 25 bp, Mus musculus
gaaactgaagctccacagggcatct

SEQ ID NO: 97914 - DNA, 25 bp, Mus musculus
gaaactgaaggagacggagaaatcc

SEQ ID NO: 97915 - DNA, 25 bp, Mus musculus
gaaactgaagggaaagcgtgacctc

SEQ ID NO: 97916 - DNA, 25 bp, Mus musculus
gaaactgaatcgtcaaggtagcacc

SEQ ID NO: 97917 - DNA, 25 bp, Mus musculus
gaaactgacttgtgatcgctgtggc

SEQ ID NO: 97918 - DNA, 25 bp, Mus musculus
gaaactgactttgtagaggtgccat

SEQ ID NO: 97919 - DNA, 25 bp, Mus musculus
gaaactgagtcccagctagaagaga

SEQ ID NO: 97920 - DNA, 25 bp, Mus musculus
gaaactgatgcacagctcaagcctg

SEQ ID NO: 97921 - DNA, 25 bp, Mus musculus
gaaactgattctgcgctgcctggct

SEQ ID NO: 97922 - DNA, 25 bp, Mus musculus
gaaactgcatgactacacggtgctg

SEQ ID NO: 97923 - DNA, 25 bp, Mus musculus
gaaactgccacgaggtgtcctagaa

SEQ ID NO: 97924 - DNA, 25 bp, Mus musculus
gaaactgccgctctttcaggagact

SEQ ID NO: 97925 - DNA, 25 bp, Mus musculus
gaaactgccttaacaaacgagtggg

SEQ ID NO: 97926 - DNA, 25 bp, Mus musculus
gaaactgcgcaagctgctcaaacgg

SEQ ID NO: 97927 - DNA, 25 bp, Mus musculus
gaaactgctcgcttctctctggcta

SEQ ID NO: 97928 - DNA, 25 bp, Mus musculus
gaaactgctcttggaagtgggacct

SEQ ID NO: 97929 - DNA, 25 bp, Mus musculus
gaaactgctcttgtagactcccaac

SEQ ID NO: 97930 - DNA, 25 bp, Mus musculus
gaaactgctgcaatctgagaactat

SEQ ID NO: 97931 - DNA, 25 bp, Mus musculus
gaaactgctttctgtaccctcgcga

SEQ ID NO: 97932 - DNA, 25 bp, Mus musculus
gaaactggagcgaaaccatttgaga

SEQ ID NO: 97933 - DNA, 25 bp, Mus musculus
gaaactggatcaaaccatcatgcgg

SEQ ID NO: 97934 - DNA, 25 bp, Mus musculus
gaaactggattcactagggaaggaa

SEQ ID NO: 97935 - DNA, 25 bp, Mus musculus
gaaactggcaaaactgcatccactg

SEQ ID NO: 97936 - DNA, 25 bp, Mus musculus
gaaactggcaatccaagcctatgga

SEQ ID NO: 97937 - DNA, 25 bp, Mus musculus
gaaactggctgttcctactgatgct

SEQ ID NO: 97938 - DNA, 25 bp, Mus musculus
gaaactggcttctatatgtgagtcc

SEQ ID NO: 97939 - DNA, 25 bp, Mus musculus
gaaactgggatataccaaagaggaa

SEQ ID NO: 97940 - DNA, 25 bp, Mus musculus
gaaactgtagatcctgccactgctg

SEQ ID NO: 97941 - DNA, 25 bp, Mus musculus
gaaactgtcggagattgcctgcttg

SEQ ID NO: 97942 - DNA, 25 bp, Mus musculus
gaaactgtctgcaagtcatgagtcc

SEQ ID NO: 97943 - DNA, 25 bp, Mus musculus
gaaactgtgaagcagatccgccaga

SEQ ID NO: 97944 - DNA, 25 bp, Mus musculus
gaaactgtgcccactatcagaaggg

SEQ ID NO: 97945 - DNA, 25 bp, Mus musculus
gaaactgtgggtgtcctccctggaa

SEQ ID NO: 97946 - DNA, 25 bp, Mus musculus
gaaactgtgtgtaacccacgaactg

SEQ ID NO: 97947 - DNA, 25 bp, Mus musculus
gaaactgttctatagaatcctgcag

SEQ ID NO: 97948 - DNA, 25 bp, Mus musculus
gaaactgttctcgtcaaagctgtgc

SEQ ID NO: 97949 - DNA, 25 bp, Mus musculus
gaaacttaactggtcctcatggcgt

SEQ ID NO: 97950 - DNA, 25 bp, Mus musculus
gaaacttaggccagtgttcgcacgt

SEQ ID NO: 97951 - DNA, 25 bp, Mus musculus
gaaacttcaagagagcgtctgtccg

SEQ ID NO: 97952 - DNA, 25 bp, Mus musculus
gaaacttcaatactgatgcaccggg

SEQ ID NO: 97953 - DNA, 25 bp, Mus musculus
gaaacttccagctggccggagtaag

SEQ ID NO: 97954 - DNA, 25 bp, Mus musculus
gaaacttcgcctgtctgacgactgg

SEQ ID NO: 97955 - DNA, 25 bp, Mus musculus
gaaacttcggctggtgtggagcaaa

SEQ ID NO: 97956 - DNA, 25 bp, Mus musculus
gaaacttctatgaactgagccctca

SEQ ID NO: 97957 - DNA, 25 bp, Mus musculus
gaaacttctccagtgggttcacaag

SEQ ID NO: 97958 - DNA, 25 bp, Mus musculus
gaaacttctcctgtgaggccagcaa

SEQ ID NO: 97959 - DNA, 25 bp, Mus musculus
gaaacttctgattcccgatggcaaa

SEQ ID NO: 97960 - DNA, 25 bp, Mus musculus
gaaacttctgcatcaagcaccgtca

SEQ ID NO: 97961 - DNA, 25 bp, Mus musculus
gaaacttgagatacttggccagcct

SEQ ID NO: 97962 - DNA, 25 bp, Mus musculus
gaaacttgattaagcccgaggaggc

SEQ ID NO: 97963 - DNA, 25 bp, Mus musculus
gaaacttgccaagatcggccaaggc

SEQ ID NO: 97964 - DNA, 25 bp, Mus musculus
gaaacttgcggagagtgaaatagct

SEQ ID NO: 97965 - DNA, 25 bp, Mus musculus
gaaacttggactctcaagcggagat

SEQ ID NO: 97966 - DNA, 25 bp, Mus musculus
gaaacttggcagctccttggactgg

SEQ ID NO: 97967 - DNA, 25 bp, Mus musculus
gaaacttggtacttcatggtgaatg

SEQ ID NO: 97968 - DNA, 25 bp, Mus musculus
gaaactttcagttgcacttcgggat

SEQ ID NO: 97969 - DNA, 25 bp, Mus musculus
gaaactttgagtctactgcgcaggc

SEQ ID NO: 97970 - DNA, 25 bp, Mus musculus
gaaactttgtccaaaacaatggcga

SEQ ID NO: 97971 - DNA, 25 bp, Mus musculus
gaaactttgtgtgcaatggccagga

SEQ ID NO: 97972 - DNA, 25 bp, Mus musculus
gaaacttttagacatcgggccatct

SEQ ID NO: 97973 - DNA, 25 bp, Mus musculus
gaaagaaaaagctgcagtacctgag

SEQ ID NO: 97974 - DNA, 25 bp, Mus musculus
gaaagaaaaaggaccggccagtgtg

SEQ ID NO: 97975 - DNA, 25 bp, Mus musculus
gaaagaaaagttgcctcgggagagc

SEQ ID NO: 97976 - DNA, 25 bp, Mus musculus
gaaagaaaatgtaccaccccagagc

SEQ ID NO: 97977 - DNA, 25 bp, Mus musculus
gaaagaaacccagaggctgcgtctg

SEQ ID NO: 97978 - DNA, 25 bp, Mus musculus
gaaagaaaccccagctgcaagagtg

SEQ ID NO: 97979 - DNA, 25 bp, Mus musculus
gaaagaaactctccacgtggtggcc

SEQ ID NO: 97980 - DNA, 25 bp, Mus musculus
gaaagaaagagtgacccagggagac

SEQ ID NO: 97981 - DNA, 25 bp, Mus musculus
gaaagaaagcccagaagtaaacgag

SEQ ID NO: 97982 - DNA, 25 bp, Mus musculus
gaaagaaagcgccagaaatcggtgt

SEQ ID NO: 97983 - DNA, 25 bp, Mus musculus
gaaagaaatgtggtaggcccagaac

SEQ ID NO: 97984 - DNA, 25 bp, Mus musculus
gaaagaacaatctcctaccagcagg

SEQ ID NO: 97985 - DNA, 25 bp, Mus musculus
gaaagaacccgccattatgagctgg

SEQ ID NO: 97986 - DNA, 25 bp, Mus musculus
gaaagaacctctaagatcaccccag

SEQ ID NO: 97987 - DNA, 25 bp, Mus musculus
gaaagaacgtgatgagccagtcctc

SEQ ID NO: 97988 - DNA, 25 bp, Mus musculus
gaaagaactacgttatgcggtccag

SEQ ID NO: 97989 - DNA, 25 bp, Mus musculus
gaaagaactatcactcaaagaggga

SEQ ID NO: 97990 - DNA, 25 bp, Mus musculus
gaaagaactcttggacctgcgagcc

SEQ ID NO: 97991 - DNA, 25 bp, Mus musculus
gaaagaactgtactgttatcccgag

SEQ ID NO: 97992 - DNA, 25 bp, Mus musculus
gaaagaactgtctgaggcgcgaaga

SEQ ID NO: 97993 - DNA, 25 bp, Mus musculus
gaaagaagagcaacaacttgagcct

SEQ ID NO: 97994 - DNA, 25 bp, Mus musculus
gaaagaagaggtagcaacttgcccc

SEQ ID NO: 97995 - DNA, 25 bp, Mus musculus
gaaagaagattctcccaaatgggcc

SEQ ID NO: 97996 - DNA, 25 bp, Mus musculus
gaaagaagcaaccagccagtcggtg

SEQ ID NO: 97997 - DNA, 25 bp, Mus musculus
gaaagaagcagacatgtccctactg

SEQ ID NO: 97998 - DNA, 25 bp, Mus musculus
gaaagaaggaagtacaggcgaaagc

SEQ ID NO: 97999 - DNA, 25 bp, Mus musculus
gaaagaaggcaatgatgaaattcag

SEQ ID NO: 98000 - DNA, 25 bp, Mus musculus
gaaagaatacatcagcctccggctc

SEQ ID NO: 98001 - DNA, 25 bp, Mus musculus
gaaagaatcgaaggacttggcggca

SEQ ID NO: 98002 - DNA, 25 bp, Mus musculus
gaaagaatgttcgtagggaccagcc

SEQ ID NO: 98003 - DNA, 25 bp, Mus musculus
gaaagaattcataccagcaagaaac

SEQ ID NO: 98004 - DNA, 25 bp, Mus musculus
gaaagacaaagagcagaagcccgag

SEQ ID NO: 98005 - DNA, 25 bp, Mus musculus
gaaagacaaagctccagtgggttgg

SEQ ID NO: 98006 - DNA, 25 bp, Mus musculus
gaaagacaaagttgccatggcccca

SEQ ID NO: 98007 - DNA, 25 bp, Mus musculus
gaaagacaccctctgttctgatgcc

SEQ ID NO: 98008 - DNA, 25 bp, Mus musculus
gaaagacactcttcaagggcaagga

SEQ ID NO: 98009 - DNA, 25 bp, Mus musculus
gaaagacactgctcttggacccaag

SEQ ID NO: 98010 - DNA, 25 bp, Mus musculus
gaaagacagccagaatagctcccag

SEQ ID NO: 98011 - DNA, 25 bp, Mus musculus
gaaagacagccctttgcggccaatg

SEQ ID NO: 98012 - DNA, 25 bp, Mus musculus
gaaagacagtcctcctgatgtggct

SEQ ID NO: 98013 - DNA, 25 bp, Mus musculus
gaaagacagtgctcggattccacca

SEQ ID NO: 98014 - DNA, 25 bp, Mus musculus
gaaagacatcgtcccatacaattca

SEQ ID NO: 98015 - DNA, 25 bp, Mus musculus
gaaagacatgctctcaaactgcaga

SEQ ID NO: 98016 - DNA, 25 bp, Mus musculus
gaaagacatggccaaccaagtgaag

SEQ ID NO: 98017 - DNA, 25 bp, Mus musculus
gaaagaccacgaaaactacatgaag

SEQ ID NO: 98018 - DNA, 25 bp, Mus musculus
gaaagaccacgataatgaagaatat

SEQ ID NO: 98019 - DNA, 25 bp, Mus musculus
gaaagaccagtatttgagaattctg

SEQ ID NO: 98020 - DNA, 25 bp, Mus musculus
gaaagaccctcgaagccactggtat

SEQ ID NO: 98021 - DNA, 25 bp, Mus musculus
gaaagaccggaaaccagcattttgg

SEQ ID NO: 98022 - DNA, 25 bp, Mus musculus
gaaagacctcatgcagtggtacaag

SEQ ID NO: 98023 - DNA, 25 bp, Mus musculus
gaaagacctgagatactgcaccaag

SEQ ID NO: 98024 - DNA, 25 bp, Mus musculus
gaaagacctggaattccgctctgga

SEQ ID NO: 98025 - DNA, 25 bp, Mus musculus
gaaagaccttcaccacagcagagga

SEQ ID NO: 98026 - DNA, 25 bp, Mus musculus
gaaagaccttgttcccatccggaca

SEQ ID NO: 98027 - DNA, 25 bp, Mus musculus
gaaagacgcgtctgttcaagatggc

SEQ ID NO: 98028 - DNA, 25 bp, Mus musculus
gaaagactcatacaacgtgccctga

SEQ ID NO: 98029 - DNA, 25 bp, Mus musculus
gaaagactcatccaacaggacacag

SEQ ID NO: 98030 - DNA, 25 bp, Mus musculus
gaaagactcctacattgccagccag

SEQ ID NO: 98031 - DNA, 25 bp, Mus musculus
gaaagactcctgttaaaaagctggc

SEQ ID NO: 98032 - DNA, 25 bp, Mus musculus
gaaagactcgcgcaactatggctgg

SEQ ID NO: 98033 - DNA, 25 bp, Mus musculus
gaaagactcgttgaatccatatccc

SEQ ID NO: 98034 - DNA, 25 bp, Mus musculus
gaaagactgcacttgcatagagaac

SEQ ID NO: 98035 - DNA, 25 bp, Mus musculus
gaaagactggctagagggcctcctg

SEQ ID NO: 98036 - DNA, 25 bp, Mus musculus
gaaagactgggaactgcaggtgcac

SEQ ID NO: 98037 - DNA, 25 bp, Mus musculus
gaaagactggttccatgtgacacag

SEQ ID NO: 98038 - DNA, 25 bp, Mus musculus
gaaagacttcacttggttgcctagg

SEQ ID NO: 98039 - DNA, 25 bp, Mus musculus
gaaagactttgggtctgagccacag

SEQ ID NO: 98040 - DNA, 25 bp, Mus musculus
gaaagagaccatcccaatgccactg

SEQ ID NO: 98041 - DNA, 25 bp, Mus musculus
gaaagagaccattacaaatccggaa

SEQ ID NO: 98042 - DNA, 25 bp, Mus musculus
gaaagagagaagcacaaatattaag

SEQ ID NO: 98043 - DNA, 25 bp, Mus musculus
gaaagagaggactactcacagtatg

SEQ ID NO: 98044 - DNA, 25 bp, Mus musculus
gaaagagatccctgtaatcctggag

SEQ ID NO: 98045 - DNA, 25 bp, Mus musculus
gaaagagatgaattcgccctccgtc

SEQ ID NO: 98046 - DNA, 25 bp, Mus musculus
gaaagagattccacgctgacctgtg

SEQ ID NO: 98047 - DNA, 25 bp, Mus musculus
gaaagagcacaaaaagacacacacg

SEQ ID NO: 98048 - DNA, 25 bp, Mus musculus
gaaagagcatcgctgctccagcagt

SEQ ID NO: 98049 - DNA, 25 bp, Mus musculus
gaaagagccacatttctcaccaggg

SEQ ID NO: 98050 - DNA, 25 bp, Mus musculus
gaaagagcccctcgagaacggtcat

SEQ ID NO: 98051 - DNA, 25 bp, Mus musculus
gaaagagcccgaagtccagatattg

SEQ ID NO: 98052 - DNA, 25 bp, Mus musculus
gaaagagcctgttatcagctccgtg

SEQ ID NO: 98053 - DNA, 25 bp, Mus musculus
gaaagagccttccttactggttagg

SEQ ID NO: 98054 - DNA, 25 bp, Mus musculus
gaaagagcggcttgctgcttgcctt

SEQ ID NO: 98055 - DNA, 25 bp, Mus musculus
gaaagagctaacgagacagtcgcac

SEQ ID NO: 98056 - DNA, 25 bp, Mus musculus
gaaagaggaacagaggtaccaggcc

SEQ ID NO: 98057 - DNA, 25 bp, Mus musculus
gaaagaggctcagaacttccggctg

SEQ ID NO: 98058 - DNA, 25 bp, Mus musculus
gaaagagggacagagtggattttac

SEQ ID NO: 98059 - DNA, 25 bp, Mus musculus
gaaagagggcatgaaggagacttcc

SEQ ID NO: 98060 - DNA, 25 bp, Mus musculus
gaaagaggtcagaaaggctccccta

SEQ ID NO: 98061 - DNA, 25 bp, Mus musculus
gaaagaggttccaagaaacaaggtg

SEQ ID NO: 98062 - DNA, 25 bp, Mus musculus
gaaagagtcacatcactgcagacag

SEQ ID NO: 98063 - DNA, 25 bp, Mus musculus
gaaagagtctgctatctgggaacca

SEQ ID NO: 98064 - DNA, 25 bp, Mus musculus
gaaagagtgcctccttgtacctgcc

SEQ ID NO: 98065 - DNA, 25 bp, Mus musculus
gaaagagtgtggctccacgtgttca

SEQ ID NO: 98066 - DNA, 25 bp, Mus musculus
gaaagagtgtgtcctcctcgctaga

SEQ ID NO: 98067 - DNA, 25 bp, Mus musculus
gaaagagttctaacgtctggaagcc

SEQ ID NO: 98068 - DNA, 25 bp, Mus musculus
gaaagagttggaagccatggctaaa

SEQ ID NO: 98069 - DNA, 25 bp, Mus musculus
gaaagagttgtcagaggaatcagaa

SEQ ID NO: 98070 - DNA, 25 bp, Mus musculus
gaaagagttgtctcgggtgtccaag

SEQ ID NO: 98071 - DNA, 25 bp, Mus musculus
gaaagatacaggaccatcaccacag

SEQ ID NO: 98072 - DNA, 25 bp, Mus musculus
gaaagataccggataggaaagcagc

SEQ ID NO: 98073 - DNA, 25 bp, Mus musculus
gaaagatcattcctgcctggagaag

SEQ ID NO: 98074 - DNA, 25 bp, Mus musculus
gaaagatccaacacaaggtccagct

SEQ ID NO: 98075 - DNA, 25 bp, Mus musculus
gaaagatccataccaccatgagcgg

SEQ ID NO: 98076 - DNA, 25 bp, Mus musculus
gaaagatcgcctttggatcaggtgt

SEQ ID NO: 98077 - DNA, 25 bp, Mus musculus
gaaagatctccatgaggcacgacgg

SEQ ID NO: 98078 - DNA, 25 bp, Mus musculus
gaaagatgaaccaccacaagtaccg

SEQ ID NO: 98079 - DNA, 25 bp, Mus musculus
gaaagatgactatagcacagcgcag

SEQ ID NO: 98080 - DNA, 25 bp, Mus musculus
gaaagatgagatcctaggcattgcc

SEQ ID NO: 98081 - DNA, 25 bp, Mus musculus
gaaagatgattagcacacatgcgcc

SEQ ID NO: 98082 - DNA, 25 bp, Mus musculus
gaaagatgcagatgcccttccagaa

SEQ ID NO: 98083 - DNA, 25 bp, Mus musculus
gaaagatgcagttatgatgaccaat

SEQ ID NO: 98084 - DNA, 25 bp, Mus musculus
gaaagatgcctctttggagtaatgc

SEQ ID NO: 98085 - DNA, 25 bp, Mus musculus
gaaagatgctttgctcggtagcaac

SEQ ID NO: 98086 - DNA, 25 bp, Mus musculus
gaaagatggatcctgaggccttgca

SEQ ID NO: 98087 - DNA, 25 bp, Mus musculus
gaaagatggcaaacagctctgtgtc

SEQ ID NO: 98088 - DNA, 25 bp, Mus musculus
gaaagatggctaccaatgcgagagc

SEQ ID NO: 98089 - DNA, 25 bp, Mus musculus
gaaagatggcttggacatccagctg

SEQ ID NO: 98090 - DNA, 25 bp, Mus musculus
gaaagattccttgggccccgataag

SEQ ID NO: 98091 - DNA, 25 bp, Mus musculus
gaaagattctgacttccggaacccg

SEQ ID NO: 98092 - DNA, 25 bp, Mus musculus
gaaagcaaagtttcggaagagcgat

SEQ ID NO: 98093 - DNA, 25 bp, Mus musculus
gaaagcaacgtctcttatcctgggc

SEQ ID NO: 98094 - DNA, 25 bp, Mus musculus
gaaagcaacgtttccttgccgccgg

SEQ ID NO: 98095 - DNA, 25 bp, Mus musculus
gaaagcaactgtcggtttcgtgaca

SEQ ID NO: 98096 - DNA, 25 bp, Mus musculus
gaaagcaagacagaagctcctagca

SEQ ID NO: 98097 - DNA, 25 bp, Mus musculus
gaaagcaagtagaaaaggccatggg

SEQ ID NO: 98098 - DNA, 25 bp, Mus musculus
gaaagcaatatctctgcctacctgg

SEQ ID NO: 98099 - DNA, 25 bp, Mus musculus
gaaagcaattcctcatcctcagatg

SEQ ID NO: 98100 - DNA, 25 bp, Mus musculus
gaaagcacacttcagtcccatctgg

SEQ ID NO: 98101 - DNA, 25 bp, Mus musculus
gaaagcacagagaggataacagatc

SEQ ID NO: 98102 - DNA, 25 bp, Mus musculus
gaaagcacagagttctcccatggag

SEQ ID NO: 98103 - DNA, 25 bp, Mus musculus
gaaagcacctgtttgagattacgcc

SEQ ID NO: 98104 - DNA, 25 bp, Mus musculus
gaaagcactctgtgggtcagccacc

SEQ ID NO: 98105 - DNA, 25 bp, Mus musculus
gaaagcactgttcgcaagctgcaga

SEQ ID NO: 98106 - DNA, 25 bp, Mus musculus
gaaagcactgttttccgagcacgag

SEQ ID NO: 98107 - DNA, 25 bp, Mus musculus
gaaagcagaaccacacagcttccgg

SEQ ID NO: 98108 - DNA, 25 bp, Mus musculus
gaaagcagactgaaatcccgggttc

SEQ ID NO: 98109 - DNA, 25 bp, Mus musculus
gaaagcagaggccaaccaacatgtg

SEQ ID NO: 98110 - DNA, 25 bp, Mus musculus
gaaagcagcttaaacccgagtactg

SEQ ID NO: 98111 - DNA, 25 bp, Mus musculus
gaaagcagtgcatattaccactctg

SEQ ID NO: 98112 - DNA, 25 bp, Mus musculus
gaaagcatactgtcaccccaggaga

SEQ ID NO: 98113 - DNA, 25 bp, Mus musculus
gaaagcatattacacagcactagga

SEQ ID NO: 98114 - DNA, 25 bp, Mus musculus
gaaagcatcattaccagttgtccca

SEQ ID NO: 98115 - DNA, 25 bp, Mus musculus
gaaagcatccgaggcagaggtctca

SEQ ID NO: 98116 - DNA, 25 bp, Mus musculus
gaaagcatccttgtccgtctggtgg

SEQ ID NO: 98117 - DNA, 25 bp, Mus musculus
gaaagcatggacgtcctgcatcgga

SEQ ID NO: 98118 - DNA, 25 bp, Mus musculus
gaaagcattactaccttctgtccgg

SEQ ID NO: 98119 - DNA, 25 bp, Mus musculus
gaaagcattgcagacgatcctcagc

SEQ ID NO: 98120 - DNA, 25 bp, Mus musculus
gaaagcattggctcgggactgcagt

SEQ ID NO: 98121 - DNA, 25 bp, Mus musculus
gaaagcattgttactccgtgccctg

SEQ ID NO: 98122 - DNA, 25 bp, Mus musculus
gaaagcatttgtcaagcgggacctg

SEQ ID NO: 98123 - DNA, 25 bp, Mus musculus
gaaagccaactttgttcgcagtccc

SEQ ID NO: 98124 - DNA, 25 bp, Mus musculus
gaaagccaaggcgaaaccgaaagag

SEQ ID NO: 98125 - DNA, 25 bp, Mus musculus
gaaagccaatacctgcctgttgagg

SEQ ID NO: 98126 - DNA, 25 bp, Mus musculus
gaaagccaatctgcagttcccgtgt

SEQ ID NO: 98127 - DNA, 25 bp, Mus musculus
gaaagccaccatcgcggacaagtta

SEQ ID NO: 98128 - DNA, 25 bp, Mus musculus
gaaagccacctagagactgagctgg

SEQ ID NO: 98129 - DNA, 25 bp, Mus musculus
gaaagccacggacaccctggattct

SEQ ID NO: 98130 - DNA, 25 bp, Mus musculus
gaaagccactaggttagacccacag

SEQ ID NO: 98131 - DNA, 25 bp, Mus musculus
gaaagccactgggaacctgactgtg

SEQ ID NO: 98132 - DNA, 25 bp, Mus musculus
gaaagccagcgcaccagtagatgtg

SEQ ID NO: 98133 - DNA, 25 bp, Mus musculus
gaaagccaggaagatcctccaggag

SEQ ID NO: 98134 - DNA, 25 bp, Mus musculus
gaaagccaggacatcgtgaatcaag

SEQ ID NO: 98135 - DNA, 25 bp, Mus musculus
gaaagccaggagatcatctcaagcg

SEQ ID NO: 98136 - DNA, 25 bp, Mus musculus
gaaagccaggtgacagattccattc

SEQ ID NO: 98137 - DNA, 25 bp, Mus musculus
gaaagccagtattgggtgaacaccc

SEQ ID NO: 98138 - DNA, 25 bp, Mus musculus
gaaagccatcaaataccagagcaag

SEQ ID NO: 98139 - DNA, 25 bp, Mus musculus
gaaagccatcgaggtcctgcagtcc

SEQ ID NO: 98140 - DNA, 25 bp, Mus musculus
gaaagccatggtgtccaatgcacaa

SEQ ID NO: 98141 - DNA, 25 bp, Mus musculus
gaaagcccacgttctgtcacagctg

SEQ ID NO: 98142 - DNA, 25 bp, Mus musculus
gaaagcccagaatcccatgcagctg

SEQ ID NO: 98143 - DNA, 25 bp, Mus musculus
gaaagcccagatcttgatggacagc

SEQ ID NO: 98144 - DNA, 25 bp, Mus musculus
gaaagcccagccaaaggaggtgatg

SEQ ID NO: 98145 - DNA, 25 bp, Mus musculus
gaaagcccgtattctccgagagagg

SEQ ID NO: 98146 - DNA, 25 bp, Mus musculus
gaaagcccgtgtgcagtcatgaatg

SEQ ID NO: 98147 - DNA, 25 bp, Mus musculus
gaaagccctactctcctcctgaggg

SEQ ID NO: 98148 - DNA, 25 bp, Mus musculus
gaaagccctgattggcatgactgca

SEQ ID NO: 98149 - DNA, 25 bp, Mus musculus
gaaagccgaagttgcaaatcacctg

SEQ ID NO: 98150 - DNA, 25 bp, Mus musculus
gaaagccgcacttacctagcggcga

SEQ ID NO: 98151 - DNA, 25 bp, Mus musculus
gaaagccggttcttgcgaaagactc

SEQ ID NO: 98152 - DNA, 25 bp, Mus musculus
gaaagcctacatggaattagtcaac

SEQ ID NO: 98153 - DNA, 25 bp, Mus musculus
gaaagcctacttgtgccagtggtga

SEQ ID NO: 98154 - DNA, 25 bp, Mus musculus
gaaagcctagctgaccaggaatggg

SEQ ID NO: 98155 - DNA, 25 bp, Mus musculus
gaaagcctatacttcctacagtacc

SEQ ID NO: 98156 - DNA, 25 bp, Mus musculus
gaaagcctcagcgaaaatcaacgcg

SEQ ID NO: 98157 - DNA, 25 bp, Mus musculus
gaaagcctctgtggagacaaatgga

SEQ ID NO: 98158 - DNA, 25 bp, Mus musculus
gaaagcctgatctccggacatgaac

SEQ ID NO: 98159 - DNA, 25 bp, Mus musculus
gaaagcctgttgttcgcgacatcca

SEQ ID NO: 98160 - DNA, 25 bp, Mus musculus
gaaagccttagatgatagtgccctg

SEQ ID NO: 98161 - DNA, 25 bp, Mus musculus
gaaagccttcagctgaacagtggcc

SEQ ID NO: 98162 - DNA, 25 bp, Mus musculus
gaaagccttgtactgtgaactctaa

SEQ ID NO: 98163 - DNA, 25 bp, Mus musculus
gaaagcctttagtcgggtctccata

SEQ ID NO: 98164 - DNA, 25 bp, Mus musculus
gaaagcctttctcagtcacaccgag

SEQ ID NO: 98165 - DNA, 25 bp, Mus musculus
gaaagcgaaacaacctcatgaccct

SEQ ID NO: 98166 - DNA, 25 bp, Mus musculus
gaaagcgaacgagtctgaggagccc

SEQ ID NO: 98167 - DNA, 25 bp, Mus musculus
gaaagcgagacatcaggtagcaagc

SEQ ID NO: 98168 - DNA, 25 bp, Mus musculus
gaaagcgagcagatactgtgggcct

SEQ ID NO: 98169 - DNA, 25 bp, Mus musculus
gaaagcgagtaaacgtatgacctgc

SEQ ID NO: 98170 - DNA, 25 bp, Mus musculus
gaaagcgatcctagagcacttgagg

SEQ ID NO: 98171 - DNA, 25 bp, Mus musculus
gaaagcgatgtggtttcctgcactg

SEQ ID NO: 98172 - DNA, 25 bp, Mus musculus
gaaagcgatttcactacaaactgcg

SEQ ID NO: 98173 - DNA, 25 bp, Mus musculus
gaaagcgcgaggagacgccgccgcc

SEQ ID NO: 98174 - DNA, 25 bp, Mus musculus
gaaagcgcgccggtgaacagccagc

SEQ ID NO: 98175 - DNA, 25 bp, Mus musculus
gaaagcgctatcgttcacgccgagg

SEQ ID NO: 98176 - DNA, 25 bp, Mus musculus
gaaagcgcttccgattcaattccat

SEQ ID NO: 98177 - DNA, 25 bp, Mus musculus
gaaagcgctttctgctacgacgagt

SEQ ID NO: 98178 - DNA, 25 bp, Mus musculus
gaaagcggtacaagttcgtggccac

SEQ ID NO: 98179 - DNA, 25 bp, Mus musculus
gaaagcgtctgtggagacactgaca

SEQ ID NO: 98180 - DNA, 25 bp, Mus musculus
gaaagcgtgacctcattgtgaccaa

SEQ ID NO: 98181 - DNA, 25 bp, Mus musculus
gaaagcgttcccaatggctccagat

SEQ ID NO: 98182 - DNA, 25 bp, Mus musculus
gaaagctaaatccttgacacccaag

SEQ ID NO: 98183 - DNA, 25 bp, Mus musculus
gaaagctaacactccattctgacgg

SEQ ID NO: 98184 - DNA, 25 bp, Mus musculus
gaaagctaagctaaggtacctggtg

SEQ ID NO: 98185 - DNA, 25 bp, Mus musculus
gaaagctacagataccacccagaat

SEQ ID NO: 98186 - DNA, 25 bp, Mus musculus
gaaagctagaccacgcatttccggg

SEQ ID NO: 98187 - DNA, 25 bp, Mus musculus
gaaagctagcatagagacctccgag

SEQ ID NO: 98188 - DNA, 25 bp, Mus musculus
gaaagctatacgtacaatggcaagg

SEQ ID NO: 98189 - DNA, 25 bp, Mus musculus
gaaagctcagtcaaaacggtcaggt

SEQ ID NO: 98190 - DNA, 25 bp, Mus musculus
gaaagctcctgcgatttgcccagaa

SEQ ID NO: 98191 - DNA, 25 bp, Mus musculus
gaaagctcctgttacaccagagggt

SEQ ID NO: 98192 - DNA, 25 bp, Mus musculus
gaaagctcgggcttagatgcaccta

SEQ ID NO: 98193 - DNA, 25 bp, Mus musculus
gaaagctctaggtgacaatgccgaa

SEQ ID NO: 98194 - DNA, 25 bp, Mus musculus
gaaagctctgctgcaccagcttgag

SEQ ID NO: 98195 - DNA, 25 bp, Mus musculus
gaaagctgcctctgatgaactgagc

SEQ ID NO: 98196 - DNA, 25 bp, Mus musculus
gaaagctgcgaaggaaaagctctcc

SEQ ID NO: 98197 - DNA, 25 bp, Mus musculus
gaaagctgcttcaggattcaacgca

SEQ ID NO: 98198 - DNA, 25 bp, Mus musculus
gaaagctggccaggacttgctcctt

SEQ ID NO: 98199 - DNA, 25 bp, Mus musculus
gaaagctggctaaggacttcgcccg

SEQ ID NO: 98200 - DNA, 25 bp, Mus musculus
gaaagctggcttatcggccacccaa

SEQ ID NO: 98201 - DNA, 25 bp, Mus musculus
gaaagctgggatccctcaggacaag

SEQ ID NO: 98202 - DNA, 25 bp, Mus musculus
gaaagctgggtgtcttctctgagat

SEQ ID NO: 98203 - DNA, 25 bp, Mus musculus
gaaagctggtgtgccatagagccct

SEQ ID NO: 98204 - DNA, 25 bp, Mus musculus
gaaagctggtttgttcctgaccctg

SEQ ID NO: 98205 - DNA, 25 bp, Mus musculus
gaaagctgtgtgagccctcaggaac

SEQ ID NO: 98206 - DNA, 25 bp, Mus musculus
gaaagctgttcttcatcctacaggg

SEQ ID NO: 98207 - DNA, 25 bp, Mus musculus
gaaagcttcagtctgcaatctacag

SEQ ID NO: 98208 - DNA, 25 bp, Mus musculus
gaaagcttccctaggccaaaaagag

SEQ ID NO: 98209 - DNA, 25 bp, Mus musculus
gaaagcttctccagttcatgccttg

SEQ ID NO: 98210 - DNA, 25 bp, Mus musculus
gaaagcttgtcctcacgtggctaag

SEQ ID NO: 98211 - DNA, 25 bp, Mus musculus
gaaagctttacatatgtggttcccg

SEQ ID NO: 98212 - DNA, 25 bp, Mus musculus
gaaagctttctatatggcagggcaa

SEQ ID NO: 98213 - DNA, 25 bp, Mus musculus
gaaagctttctctagtcccagtgac

SEQ ID NO: 98214 - DNA, 25 bp, Mus musculus
gaaaggaaacctcgtgctcctggaa

SEQ ID NO: 98215 - DNA, 25 bp, Mus musculus
gaaaggaaccgaacaataccagagt

SEQ ID NO: 98216 - DNA, 25 bp, Mus musculus
gaaaggaagtctacttgtctgggtc

SEQ ID NO: 98217 - DNA, 25 bp, Mus musculus
gaaaggaatccaagaagccaccagc

SEQ ID NO: 98218 - DNA, 25 bp, Mus musculus
gaaaggaatcccctcctctctgaga

SEQ ID NO: 98219 - DNA, 25 bp, Mus musculus
gaaaggaatcgccattgcgctgctc

SEQ ID NO: 98220 - DNA, 25 bp, Mus musculus
gaaaggacacgttccagcccagatt

SEQ ID NO: 98221 - DNA, 25 bp, Mus musculus
gaaaggacagatagagaagcagccg

SEQ ID NO: 98222 - DNA, 25 bp, Mus musculus
gaaaggaccccaggatggagtagcc

SEQ ID NO: 98223 - DNA, 25 bp, Mus musculus
gaaaggacctactatgtggcagccg

SEQ ID NO: 98224 - DNA, 25 bp, Mus musculus
gaaaggactgtaactacccctgtgg

SEQ ID NO: 98225 - DNA, 25 bp, Mus musculus
gaaaggactgtccttgccccaaggt

SEQ ID NO: 98226 - DNA, 25 bp, Mus musculus
gaaaggagctgcgactagccgccca

SEQ ID NO: 98227 - DNA, 25 bp, Mus musculus
gaaaggaggatccacacctcttgtg

SEQ ID NO: 98228 - DNA, 25 bp, Mus musculus
gaaaggaggctacagaactacgaca

SEQ ID NO: 98229 - DNA, 25 bp, Mus musculus
gaaaggatagttgggtggtaccaca

SEQ ID NO: 98230 - DNA, 25 bp, Mus musculus
gaaaggatcacactgaaagatgtcc

SEQ ID NO: 98231 - DNA, 25 bp, Mus musculus
gaaaggatccatcatgcttgaccgg

SEQ ID NO: 98232 - DNA, 25 bp, Mus musculus
gaaaggattacgacaggtcccgatg

SEQ ID NO: 98233 - DNA, 25 bp, Mus musculus
gaaaggattctattttgcaaagctg

SEQ ID NO: 98234 - DNA, 25 bp, Mus musculus
gaaaggatttccacagttgtccgaa

SEQ ID NO: 98235 - DNA, 25 bp, Mus musculus
gaaaggcacaacgtcatacaatgag

SEQ ID NO: 98236 - DNA, 25 bp, Mus musculus
gaaaggcaccgtctaccttactccg

SEQ ID NO: 98237 - DNA, 25 bp, Mus musculus
gaaaggcacctaacacaaagctggg

SEQ ID NO: 98238 - DNA, 25 bp, Mus musculus
gaaaggcacctattaagacttggac

SEQ ID NO: 98239 - DNA, 25 bp, Mus musculus
gaaaggcacttgtgtgctaagctga

SEQ ID NO: 98240 - DNA, 25 bp, Mus musculus
gaaaggcagcctcaagaagtgctct

SEQ ID NO: 98241 - DNA, 25 bp, Mus musculus
gaaaggcatatgctaactcacagtg

SEQ ID NO: 98242 - DNA, 25 bp, Mus musculus
gaaaggcatctgtcccaagcaggag

SEQ ID NO: 98243 - DNA, 25 bp, Mus musculus
gaaaggccaaaaactctgtcagcag

SEQ ID NO: 98244 - DNA, 25 bp, Mus musculus
gaaaggccacatagctgtgagcgca

SEQ ID NO: 98245 - DNA, 25 bp, Mus musculus
gaaaggccagctcagagttcagacg

SEQ ID NO: 98246 - DNA, 25 bp, Mus musculus
gaaaggccagtacgaatgctcctgc

SEQ ID NO: 98247 - DNA, 25 bp, Mus musculus
gaaaggccatcttgacccagtggga

SEQ ID NO: 98248 - DNA, 25 bp, Mus musculus
gaaaggcccgaggatttcaagatcc

SEQ ID NO: 98249 - DNA, 25 bp, Mus musculus
gaaaggcctcattatccatggagca

SEQ ID NO: 98250 - DNA, 25 bp, Mus musculus
gaaaggcctttacccaatgttcaag

SEQ ID NO: 98251 - DNA, 25 bp, Mus musculus
gaaaggcgagcgagctgcctcaaat

SEQ ID NO: 98252 - DNA, 25 bp, Mus musculus
gaaaggcgcagcaaagacttcttga

SEQ ID NO: 98253 - DNA, 25 bp, Mus musculus
gaaaggcgggtcaatgcacatgtac

SEQ ID NO: 98254 - DNA, 25 bp, Mus musculus
gaaaggcgtggcaaaggttgaccat

SEQ ID NO: 98255 - DNA, 25 bp, Mus musculus
gaaaggctaccggtgtacaacagag

SEQ ID NO: 98256 - DNA, 25 bp, Mus musculus
gaaaggctcctatgccaagtacagc

SEQ ID NO: 98257 - DNA, 25 bp, Mus musculus
gaaaggctcggaagacccagaacag

SEQ ID NO: 98258 - DNA, 25 bp, Mus musculus
gaaaggctctcttgcactgctgtga

SEQ ID NO: 98259 - DNA, 25 bp, Mus musculus
gaaaggcttcatgctaaatccagac

SEQ ID NO: 98260 - DNA, 25 bp, Mus musculus
gaaaggcttctctaaccgtgcccgg

SEQ ID NO: 98261 - DNA, 25 bp, Mus musculus
gaaaggcttttcaggaggaaccaag

SEQ ID NO: 98262 - DNA, 25 bp, Mus musculus
gaaagggacctgactctagagcaaa

SEQ ID NO: 98263 - DNA, 25 bp, Mus musculus
gaaagggcaggagcgagctagctgc

SEQ ID NO: 98264 - DNA, 25 bp, Mus musculus
gaaagggcccgagcaatctgagttg

SEQ ID NO: 98265 - DNA, 25 bp, Mus musculus
gaaagggctcaaggtcagaagcgcc

SEQ ID NO: 98266 - DNA, 25 bp, Mus musculus
gaaagggctctctggtcttcgagga

SEQ ID NO: 98267 - DNA, 25 bp, Mus musculus
gaaagggtacagtccgatacagtcg

SEQ ID NO: 98268 - DNA, 25 bp, Mus musculus
gaaagggtacgctgtgaacatcata

SEQ ID NO: 98269 - DNA, 25 bp, Mus musculus
gaaagggtggaaacagacttcatcc

SEQ ID NO: 98270 - DNA, 25 bp, Mus musculus
gaaagggtgtacacttgtatgcgaa

SEQ ID NO: 98271 - DNA, 25 bp, Mus musculus
gaaagggtgtcaaacagtcagtgcc

SEQ ID NO: 98272 - DNA, 25 bp, Mus musculus
gaaagggtttcgtagccacaggact

SEQ ID NO: 98273 - DNA, 25 bp, Mus musculus
gaaaggtcaccatagctcaacagcc

SEQ ID NO: 98274 - DNA, 25 bp, Mus musculus
gaaaggtcacctctcaggctctcct

SEQ ID NO: 98275 - DNA, 25 bp, Mus musculus
gaaaggtcgccttgtgcaaacgcaa

SEQ ID NO: 98276 - DNA, 25 bp, Mus musculus
gaaaggtcgttcttttgcgcctctg

SEQ ID NO: 98277 - DNA, 25 bp, Mus musculus
gaaaggtgaccaagcccaaagagga

SEQ ID NO: 98278 - DNA, 25 bp, Mus musculus
gaaaggtgactagcttggccggacc

SEQ ID NO: 98279 - DNA, 25 bp, Mus musculus
gaaaggtgccaagctcttcttccgc

SEQ ID NO: 98280 - DNA, 25 bp, Mus musculus
gaaaggtggcccattcacggatagg

SEQ ID NO: 98281 - DNA, 25 bp, Mus musculus
gaaaggtgggatccattgaacagac

SEQ ID NO: 98282 - DNA, 25 bp, Mus musculus
gaaaggtggtcatctcctagctact

SEQ ID NO: 98283 - DNA, 25 bp, Mus musculus
gaaaggtggtgcacatcaacgttgc

SEQ ID NO: 98284 - DNA, 25 bp, Mus musculus
gaaaggtgttccagttacttcttga

SEQ ID NO: 98285 - DNA, 25 bp, Mus musculus
gaaaggttattctggcccttcagca

SEQ ID NO: 98286 - DNA, 25 bp, Mus musculus
gaaaggttgactctggctcccaaag

SEQ ID NO: 98287 - DNA, 25 bp, Mus musculus
gaaaggttgtataatcaagtaaaag

SEQ ID NO: 98288 - DNA, 25 bp, Mus musculus
gaaaggtttcgacttcacgctcatg

SEQ ID NO: 98289 - DNA, 25 bp, Mus musculus
gaaagtaagaaaggtgcctcctggc

SEQ ID NO: 98290 - DNA, 25 bp, Mus musculus
gaaagtaagccattccctggagctg

SEQ ID NO: 98291 - DNA, 25 bp, Mus musculus
gaaagtacactgtggatcgggtcct

SEQ ID NO: 98292 - DNA, 25 bp, Mus musculus
gaaagtaccgcttccactgagacag

SEQ ID NO: 98293 - DNA, 25 bp, Mus musculus
gaaagtactctgagccattctcgca

SEQ ID NO: 98294 - DNA, 25 bp, Mus musculus
gaaagtacttgatgtatccaacagt

SEQ ID NO: 98295 - DNA, 25 bp, Mus musculus
gaaagtagagagttcaaccccagca

SEQ ID NO: 98296 - DNA, 25 bp, Mus musculus
gaaagtagagcctgccatctgggaa

SEQ ID NO: 98297 - DNA, 25 bp, Mus musculus
gaaagtagatcctcgcttcggagcc

SEQ ID NO: 98298 - DNA, 25 bp, Mus musculus
gaaagtagattgtgccgtgctggac

SEQ ID NO: 98299 - DNA, 25 bp, Mus musculus
gaaagtagcgaatgcagtgcagctc

SEQ ID NO: 98300 - DNA, 25 bp, Mus musculus
gaaagtagttcaagtggtggcccct

SEQ ID NO: 98301 - DNA, 25 bp, Mus musculus
gaaagtataaccaacaagggcaggg

SEQ ID NO: 98302 - DNA, 25 bp, Mus musculus
gaaagtataccctctgatcagccga

SEQ ID NO: 98303 - DNA, 25 bp, Mus musculus
gaaagtatcgagacacgctggtgct

SEQ ID NO: 98304 - DNA, 25 bp, Mus musculus
gaaagtatctacatatgcagtgaaa

SEQ ID NO: 98305 - DNA, 25 bp, Mus musculus
gaaagtatgatccagcgctcagcct

SEQ ID NO: 98306 - DNA, 25 bp, Mus musculus
gaaagtatggctccaatgtcaacag

SEQ ID NO: 98307 - DNA, 25 bp, Mus musculus
gaaagtattacagatgcagctgact

SEQ ID NO: 98308 - DNA, 25 bp, Mus musculus
gaaagtcaagcaccggctggtagaa

SEQ ID NO: 98309 - DNA, 25 bp, Mus musculus
gaaagtcaagttgctcaccgggagc

SEQ ID NO: 98310 - DNA, 25 bp, Mus musculus
gaaagtcactgaccggatggaccac

SEQ ID NO: 98311 - DNA, 25 bp, Mus musculus
gaaagtcagaagcacgcagccttaa

SEQ ID NO: 98312 - DNA, 25 bp, Mus musculus
gaaagtcatccctcctgagagcctg

SEQ ID NO: 98313 - DNA, 25 bp, Mus musculus
gaaagtcatcttaagctcctgtcca

SEQ ID NO: 98314 - DNA, 25 bp, Mus musculus
gaaagtcatgactaagaggccacca

SEQ ID NO: 98315 - DNA, 25 bp, Mus musculus
gaaagtcatggatgctcccctcttg

SEQ ID NO: 98316 - DNA, 25 bp, Mus musculus
gaaagtcattagtcaacagcgctgt

SEQ ID NO: 98317 - DNA, 25 bp, Mus musculus
gaaagtcattgatcctaaaagggcc

SEQ ID NO: 98318 - DNA, 25 bp, Mus musculus
gaaagtccatgctgctctcggctat

SEQ ID NO: 98319 - DNA, 25 bp, Mus musculus
gaaagtcccgccgagtatgcgggtc

SEQ ID NO: 98320 - DNA, 25 bp, Mus musculus
gaaagtccctgaagatccaacccag

SEQ ID NO: 98321 - DNA, 25 bp, Mus musculus
gaaagtcctcaacagcattgcttac

SEQ ID NO: 98322 - DNA, 25 bp, Mus musculus
gaaagtcctgccttctccttaggtt

SEQ ID NO: 98323 - DNA, 25 bp, Mus musculus
gaaagtcctggccaataatgctgcc

SEQ ID NO: 98324 - DNA, 25 bp, Mus musculus
gaaagtccttactcatggtcctgag

SEQ ID NO: 98325 - DNA, 25 bp, Mus musculus
gaaagtcgtcttccacttgcacgaa

SEQ ID NO: 98326 - DNA, 25 bp, Mus musculus
gaaagtctatgcgtgggtaccctgt

SEQ ID NO: 98327 - DNA, 25 bp, Mus musculus
gaaagtctccccatgtgtgtttaca

SEQ ID NO: 98328 - DNA, 25 bp, Mus musculus
gaaagtctccctggaagctgaccca

SEQ ID NO: 98329 - DNA, 25 bp, Mus musculus
gaaagtctccttagacaggcgagca

SEQ ID NO: 98330 - DNA, 25 bp, Mus musculus
gaaagtctctccaacaacgtaaggc

SEQ ID NO: 98331 - DNA, 25 bp, Mus musculus
gaaagtctgcagttcgggacggacc

SEQ ID NO: 98332 - DNA, 25 bp, Mus musculus
gaaagtctgccacgcttagctgctc

SEQ ID NO: 98333 - DNA, 25 bp, Mus musculus
gaaagtctgctttgtgcccattgtc

SEQ ID NO: 98334 - DNA, 25 bp, Mus musculus
gaaagtctgggccttgcattgacca

SEQ ID NO: 98335 - DNA, 25 bp, Mus musculus
gaaagtcttccagccatagcctgag

SEQ ID NO: 98336 - DNA, 25 bp, Mus musculus
gaaagtcttccttgcgtagctggcg

SEQ ID NO: 98337 - DNA, 25 bp, Mus musculus
gaaagtcttgctgcacctgctgaag

SEQ ID NO: 98338 - DNA, 25 bp, Mus musculus
gaaagtgaaactggaccctccggat

SEQ ID NO: 98339 - DNA, 25 bp, Mus musculus
gaaagtgacccgtagcaagaacgtg

SEQ ID NO: 98340 - DNA, 25 bp, Mus musculus
gaaagtgacggctgtgcacaaggcc

SEQ ID NO: 98341 - DNA, 25 bp, Mus musculus
gaaagtgacgttccagaggagttcc

SEQ ID NO: 98342 - DNA, 25 bp, Mus musculus
gaaagtgactctctgagaaccagcc

SEQ ID NO: 98343 - DNA, 25 bp, Mus musculus
gaaagtgagcagaccccttgtggta

SEQ ID NO: 98344 - DNA, 25 bp, Mus musculus
gaaagtgagctattcacctgcgcta

SEQ ID NO: 98345 - DNA, 25 bp, Mus musculus
gaaagtgatccaccgtacatggaga

SEQ ID NO: 98346 - DNA, 25 bp, Mus musculus
gaaagtgatctcagtccccaaaggc

SEQ ID NO: 98347 - DNA, 25 bp, Mus musculus
gaaagtgattgcagtcgaccagtct

SEQ ID NO: 98348 - DNA, 25 bp, Mus musculus
gaaagtgattttgcaggcccaggag

SEQ ID NO: 98349 - DNA, 25 bp, Mus musculus
gaaagtgcacagtctcttccggcga

SEQ ID NO: 98350 - DNA, 25 bp, Mus musculus
gaaagtgccaaagacctagtacgcc

SEQ ID NO: 98351 - DNA, 25 bp, Mus musculus
gaaagtgccagtgctgtaccacgta

SEQ ID NO: 98352 - DNA, 25 bp, Mus musculus
gaaagtgcccggagtgactgccatt

SEQ ID NO: 98353 - DNA, 25 bp, Mus musculus
gaaagtgcccgttaaagcagagtcc

SEQ ID NO: 98354 - DNA, 25 bp, Mus musculus
gaaagtgccgcagaagacactcctg

SEQ ID NO: 98355 - DNA, 25 bp, Mus musculus
gaaagtgcctcttctaactatgcca

SEQ ID NO: 98356 - DNA, 25 bp, Mus musculus
gaaagtgctcttgcggctctatggg

SEQ ID NO: 98357 - DNA, 25 bp, Mus musculus
gaaagtgctttggtcggagctccca

SEQ ID NO: 98358 - DNA, 25 bp, Mus musculus
gaaagtggacagcatcagacagaga

SEQ ID NO: 98359 - DNA, 25 bp, Mus musculus
gaaagtggatctctgctcagtcact

SEQ ID NO: 98360 - DNA, 25 bp, Mus musculus
gaaagtggccaggattcaagagctc

SEQ ID NO: 98361 - DNA, 25 bp, Mus musculus
gaaagtggctgactccaagaagctg

SEQ ID NO: 98362 - DNA, 25 bp, Mus musculus
gaaagtggctgctgtccgagatgcc

SEQ ID NO: 98363 - DNA, 25 bp, Mus musculus
gaaagtggtcctcctgcaatgccaa

SEQ ID NO: 98364 - DNA, 25 bp, Mus musculus
gaaagtggtgactcaactgacaggc

SEQ ID NO: 98365 - DNA, 25 bp, Mus musculus
gaaagtggtgccagcgttagccttc

SEQ ID NO: 98366 - DNA, 25 bp, Mus musculus
gaaagtggttagctagccaccaaac

SEQ ID NO: 98367 - DNA, 25 bp, Mus musculus
gaaagtgtactgctgtgacctcacc

SEQ ID NO: 98368 - DNA, 25 bp, Mus musculus
gaaagtgtagaaaatttccagacta

SEQ ID NO: 98369 - DNA, 25 bp, Mus musculus
gaaagtgtcaacctccaagtggcga

SEQ ID NO: 98370 - DNA, 25 bp, Mus musculus
gaaagtgtcagagtcaacgggcaca

SEQ ID NO: 98371 - DNA, 25 bp, Mus musculus
gaaagtgtgaacatccggtggtcca

SEQ ID NO: 98372 - DNA, 25 bp, Mus musculus
gaaagtgtgacaaccaagccttctc

SEQ ID NO: 98373 - DNA, 25 bp, Mus musculus
gaaagtgtggtgcagtctccatcag

SEQ ID NO: 98374 - DNA, 25 bp, Mus musculus
gaaagtgttcggacgacagcagaca

SEQ ID NO: 98375 - DNA, 25 bp, Mus musculus
gaaagttacgtgtgtgcctccaacg

SEQ ID NO: 98376 - DNA, 25 bp, Mus musculus
gaaagttcaaccctcatgtccacgt

SEQ ID NO: 98377 - DNA, 25 bp, Mus musculus
gaaagttcccagctggccacagtgt

SEQ ID NO: 98378 - DNA, 25 bp, Mus musculus
gaaagttgcagattcagagctagcc

SEQ ID NO: 98379 - DNA, 25 bp, Mus musculus
gaaagttgcccgctgtgtaagaaaa

SEQ ID NO: 98380 - DNA, 25 bp, Mus musculus
gaaagttggagccaaaggtccccag

SEQ ID NO: 98381 - DNA, 25 bp, Mus musculus
gaaagttggcgtctcaaagccttgg

SEQ ID NO: 98382 - DNA, 25 bp, Mus musculus
gaaagttgtggatagaagccctcct

SEQ ID NO: 98383 - DNA, 25 bp, Mus musculus
gaaagtttatcctccagtgccagaa

SEQ ID NO: 98384 - DNA, 25 bp, Mus musculus
gaaagtttatgatccagtgtctgaa

SEQ ID NO: 98385 - DNA, 25 bp, Mus musculus
gaaagtttgaaagaagtcactggct

SEQ ID NO: 98386 - DNA, 25 bp, Mus musculus
gaaagtttgattatgaccgggccct

SEQ ID NO: 98387 - DNA, 25 bp, Mus musculus
gaaagtttgtggacagtgcgagaac

SEQ ID NO: 98388 - DNA, 25 bp, Mus musculus
gaaataaataagcacgttccgggcg

SEQ ID NO: 98389 - DNA, 25 bp, Mus musculus
gaaataaatacttggccaagcccgg

SEQ ID NO: 98390 - DNA, 25 bp, Mus musculus
gaaataacttccttttgaacaagca

SEQ ID NO: 98391 - DNA, 25 bp, Mus musculus
gaaatacaaaaaactggtgctgcgg

SEQ ID NO: 98392 - DNA, 25 bp, Mus musculus
gaaatacaacaacagagagcagcac

SEQ ID NO: 98393 - DNA, 25 bp, Mus musculus
gaaatacaatgtgaatgggcgggac

SEQ ID NO: 98394 - DNA, 25 bp, Mus musculus
gaaatacacaacaagacactcccca

SEQ ID NO: 98395 - DNA, 25 bp, Mus musculus
gaaatacagcaaggcctacggaagg

SEQ ID NO: 98396 - DNA, 25 bp, Mus musculus
gaaatacaggcagaaaacatcccgt

SEQ ID NO: 98397 - DNA, 25 bp, Mus musculus
gaaatacagtgtgaagtcgatgcct

SEQ ID NO: 98398 - DNA, 25 bp, Mus musculus
gaaatacagttggagcacgcgaagc

SEQ ID NO: 98399 - DNA, 25 bp, Mus musculus
gaaatacatatgacaacccgctgca

SEQ ID NO: 98400 - DNA, 25 bp, Mus musculus
gaaatacatcgaatctctagccaga

SEQ ID NO: 98401 - DNA, 25 bp, Mus musculus
gaaatacatggattgcaagtgccct

SEQ ID NO: 98402 - DNA, 25 bp, Mus musculus
gaaataccatcttgctttggcagcc

SEQ ID NO: 98403 - DNA, 25 bp, Mus musculus
gaaatacctgggatttacgtcctgt

SEQ ID NO: 98404 - DNA, 25 bp, Mus musculus
gaaatacctggtgctcaagtcatgg

SEQ ID NO: 98405 - DNA, 25 bp, Mus musculus
gaaataccttgaaaacaggcctgtc

SEQ ID NO: 98406 - DNA, 25 bp, Mus musculus
gaaatacgagaaaatgaaggctgcc

SEQ ID NO: 98407 - DNA, 25 bp, Mus musculus
gaaatacggcgacattctccagtgg

SEQ ID NO: 98408 - DNA, 25 bp, Mus musculus
gaaatacggcttctacacgcatgtg

SEQ ID NO: 98409 - DNA, 25 bp, Mus musculus
gaaatactcgtgtgatcaagcaggc

SEQ ID NO: 98410 - DNA, 25 bp, Mus musculus
gaaatactgaaaagagccgaccggt

SEQ ID NO: 98411 - DNA, 25 bp, Mus musculus
gaaatacttgcctgagctgatggca

SEQ ID NO: 98412 - DNA, 25 bp, Mus musculus
gaaatacttgcgcaagcagactacc

SEQ ID NO: 98413 - DNA, 25 bp, Mus musculus
gaaatagaaaggctgcggagtcaac

SEQ ID NO: 98414 - DNA, 25 bp, Mus musculus
gaaatagaagtcagaaacagagcct

SEQ ID NO: 98415 - DNA, 25 bp, Mus musculus
gaaatagactctgatgaccacacgg

SEQ ID NO: 98416 - DNA, 25 bp, Mus musculus
gaaatagagcatgtcctgaacggca

SEQ ID NO: 98417 - DNA, 25 bp, Mus musculus
gaaatagagcgggtgatgcactgcc

SEQ ID NO: 98418 - DNA, 25 bp, Mus musculus
gaaatagagtggatgtgccaagccc

SEQ ID NO: 98419 - DNA, 25 bp, Mus musculus
gaaatagatggttcaaaaccacgtg

SEQ ID NO: 98420 - DNA, 25 bp, Mus musculus
gaaatagattccacttgggccaggt

SEQ ID NO: 98421 - DNA, 25 bp, Mus musculus
gaaatagcaagtcttgattcagaga

SEQ ID NO: 98422 - DNA, 25 bp, Mus musculus
gaaatagccaaagctaatgcagctg

SEQ ID NO: 98423 - DNA, 25 bp, Mus musculus
gaaatagccgacctctgtagccttt

SEQ ID NO: 98424 - DNA, 25 bp, Mus musculus
gaaatagctgatcaagtagaccaag

SEQ ID NO: 98425 - DNA, 25 bp, Mus musculus
gaaataggctacaaacacaccgaat

SEQ ID NO: 98426 - DNA, 25 bp, Mus musculus
gaaatagtcgagaggtcacaccagt

SEQ ID NO: 98427 - DNA, 25 bp, Mus musculus
gaaatagtctcagtggcctcctaga

SEQ ID NO: 98428 - DNA, 25 bp, Mus musculus
gaaatagtcttctaaggcgaggagc

SEQ ID NO: 98429 - DNA, 25 bp, Mus musculus
gaaatagtgctgatcctgggacaag

SEQ ID NO: 98430 - DNA, 25 bp, Mus musculus
gaaatagttgcttccctacaggagc

SEQ ID NO: 98431 - DNA, 25 bp, Mus musculus
gaaatataaccactccatgcaggcc

SEQ ID NO: 98432 - DNA, 25 bp, Mus musculus
gaaatatagccagggtctctgcggc

SEQ ID NO: 98433 - DNA, 25 bp, Mus musculus
gaaatatcaaggtgttacccaaggg

SEQ ID NO: 98434 - DNA, 25 bp, Mus musculus
gaaatatcctgagctttgagtgtcc

SEQ ID NO: 98435 - DNA, 25 bp, Mus musculus
gaaatatcctgatgcgcagactgcc

SEQ ID NO: 98436 - DNA, 25 bp, Mus musculus
gaaatatctaaacagtgctcatcaa

SEQ ID NO: 98437 - DNA, 25 bp, Mus musculus
gaaatatctcaagggaaccacctgc

SEQ ID NO: 98438 - DNA, 25 bp, Mus musculus
gaaatatgacacgtttatccagagg

SEQ ID NO: 98439 - DNA, 25 bp, Mus musculus
gaaatatgagtgagcctgaattgaa

SEQ ID NO: 98440 - DNA, 25 bp, Mus musculus
gaaatatgctaagaatgagaccctg

SEQ ID NO: 98441 - DNA, 25 bp, Mus musculus
gaaatatggcgttccttccctggaa

SEQ ID NO: 98442 - DNA, 25 bp, Mus musculus
gaaatatgggattccggagcacgaa

SEQ ID NO: 98443 - DNA, 25 bp, Mus musculus
gaaatatgtagaccggagccctgtt

SEQ ID NO: 98444 - DNA, 25 bp, Mus musculus
gaaatatgtcctcaacacctgcggg

SEQ ID NO: 98445 - DNA, 25 bp, Mus musculus
gaaatatgtgagagcatgcccatgg

SEQ ID NO: 98446 - DNA, 25 bp, Mus musculus
gaaatatgttaactaagagcagccc

SEQ ID NO: 98447 - DNA, 25 bp, Mus musculus
gaaatattctggatacctggagcac

SEQ ID NO: 98448 - DNA, 25 bp, Mus musculus
gaaatatttattgccctgtgtggta

SEQ ID NO: 98449 - DNA, 25 bp, Mus musculus
gaaatcaaaaccagtcttaaatggg

SEQ ID NO: 98450 - DNA, 25 bp, Mus musculus
gaaatcaaacttgggacctctgcaa

SEQ ID NO: 98451 - DNA, 25 bp, Mus musculus
gaaatcaaagctcaaaccacaggcc

SEQ ID NO: 98452 - DNA, 25 bp, Mus musculus
gaaatcaaaggagtgcaacaacggc

SEQ ID NO: 98453 - DNA, 25 bp, Mus musculus
gaaatcaaagtaacctcgccgtgca

SEQ ID NO: 98454 - DNA, 25 bp, Mus musculus
gaaatcaacaaacgcactgccctgg

SEQ ID NO: 98455 - DNA, 25 bp, Mus musculus
gaaatcaacgccagtggctcggaga

SEQ ID NO: 98456 - DNA, 25 bp, Mus musculus
gaaatcaacgtgctggagaaaatca

SEQ ID NO: 98457 - DNA, 25 bp, Mus musculus
gaaatcaagcagacttcaatcaccg

SEQ ID NO: 98458 - DNA, 25 bp, Mus musculus
gaaatcaaggagcagcctcggagac

SEQ ID NO: 98459 - DNA, 25 bp, Mus musculus
gaaatcaaggattatgtagaggccc

SEQ ID NO: 98460 - DNA, 25 bp, Mus musculus
gaaatcaaggttggccaggagctcc

SEQ ID NO: 98461 - DNA, 25 bp, Mus musculus
gaaatcaatcagttcgtgggaccgc

SEQ ID NO: 98462 - DNA, 25 bp, Mus musculus
gaaatcaatgcgaagaacacttgga

SEQ ID NO: 98463 - DNA, 25 bp, Mus musculus
gaaatcacagatttgagcctcacag

SEQ ID NO: 98464 - DNA, 25 bp, Mus musculus
gaaatcacagcagatggccagacag

SEQ ID NO: 98465 - DNA, 25 bp, Mus musculus
gaaatcacatcttgccatgccaaag

SEQ ID NO: 98466 - DNA, 25 bp, Mus musculus
gaaatcaccctgcagcactactgtg

SEQ ID NO: 98467 - DNA, 25 bp, Mus musculus
gaaatcacggatcaacagctacaga

SEQ ID NO: 98468 - DNA, 25 bp, Mus musculus
gaaatcactattggagctcatcagg

SEQ ID NO: 98469 - DNA, 25 bp, Mus musculus
gaaatcagacagtacctggcccagt

SEQ ID NO: 98470 - DNA, 25 bp, Mus musculus
gaaatcagaggttcctatgggcctg

SEQ ID NO: 98471 - DNA, 25 bp, Mus musculus
gaaatcagatgatgagtcctcccag

SEQ ID NO: 98472 - DNA, 25 bp, Mus musculus
gaaatcagcaaggtcatggcgtcca

SEQ ID NO: 98473 - DNA, 25 bp, Mus musculus
gaaatcagcccggaagttggccaac

SEQ ID NO: 98474 - DNA, 25 bp, Mus musculus
gaaatcagccgacagaagactcagg

SEQ ID NO: 98475 - DNA, 25 bp, Mus musculus
gaaatcagcctgtcacctactggtg

SEQ ID NO: 98476 - DNA, 25 bp, Mus musculus
gaaatcagcttgacccaattcagag

SEQ ID NO: 98477 - DNA, 25 bp, Mus musculus
gaaatcatcctcaggacttccggga

SEQ ID NO: 98478 - DNA, 25 bp, Mus musculus
gaaatcatcctgaagctggaccatg

SEQ ID NO: 98479 - DNA, 25 bp, Mus musculus
gaaatcatctattcggacttcagct

SEQ ID NO: 98480 - DNA, 25 bp, Mus musculus
gaaatcatgactcagaaggaatcct

SEQ ID NO: 98481 - DNA, 25 bp, Mus musculus
gaaatcatgatcacttcctcggata

SEQ ID NO: 98482 - DNA, 25 bp, Mus musculus
gaaatcatgcaccaggacatcgtcc

SEQ ID NO: 98483 - DNA, 25 bp, Mus musculus
gaaatcattctcaagctgcctgtgc

SEQ ID NO: 98484 - DNA, 25 bp, Mus musculus
gaaatccaaaccagcgaaagatcag

SEQ ID NO: 98485 - DNA, 25 bp, Mus musculus
gaaatccaatccagccatccaagct

SEQ ID NO: 98486 - DNA, 25 bp, Mus musculus
gaaatccatatgtgtcagctgacgc

SEQ ID NO: 98487 - DNA, 25 bp, Mus musculus
gaaatccatgacctgcagaacaagt

SEQ ID NO: 98488 - DNA, 25 bp, Mus musculus
gaaatccatggaactgtacctgtgg

SEQ ID NO: 98489 - DNA, 25 bp, Mus musculus
gaaatcccaagtgccggaggaggca

SEQ ID NO: 98490 - DNA, 25 bp, Mus musculus
gaaatcccagctgttaagggcctag

SEQ ID NO: 98491 - DNA, 25 bp, Mus musculus
gaaatcccaggatgcagtaggcctt

SEQ ID NO: 98492 - DNA, 25 bp, Mus musculus
gaaatcccttcgtgtcctcctgtta

SEQ ID NO: 98493 - DNA, 25 bp, Mus musculus
gaaatccgctctatactctcccaag

SEQ ID NO: 98494 - DNA, 25 bp, Mus musculus
gaaatccggaacaccagaagcttaa

SEQ ID NO: 98495 - DNA, 25 bp, Mus musculus
gaaatccgtagcgttgtaggctccc

SEQ ID NO: 98496 - DNA, 25 bp, Mus musculus
gaaatccgttactccacatggaaga

SEQ ID NO: 98497 - DNA, 25 bp, Mus musculus
gaaatcctgatgttttcctggccag

SEQ ID NO: 98498 - DNA, 25 bp, Mus musculus
gaaatcctgcagcaatccctgtggg

SEQ ID NO: 98499 - DNA, 25 bp, Mus musculus
gaaatcctgcatcgaaattctggcg

SEQ ID NO: 98500 - DNA, 25 bp, Mus musculus
gaaatcctgcccgagatgaagaagg

SEQ ID NO: 98501 - DNA, 25 bp, Mus musculus
gaaatcctggaattgagtccttcaa

SEQ ID NO: 98502 - DNA, 25 bp, Mus musculus
gaaatcctttattctgcggagctga

SEQ ID NO: 98503 - DNA, 25 bp, Mus musculus
gaaatcgagagaaattcagtccaag

SEQ ID NO: 98504 - DNA, 25 bp, Mus musculus
gaaatcgagcagactccctatgaag

SEQ ID NO: 98505 - DNA, 25 bp, Mus musculus
gaaatcgcaagtaacagtcgctatg

SEQ ID NO: 98506 - DNA, 25 bp, Mus musculus
gaaatcgcaatcctgtcctgagacg

SEQ ID NO: 98507 - DNA, 25 bp, Mus musculus
gaaatcgccgttactgcaccaagtg

SEQ ID NO: 98508 - DNA, 25 bp, Mus musculus
gaaatcgctgacttacaggagcggc

SEQ ID NO: 98509 - DNA, 25 bp, Mus musculus
gaaatcgggcttctgcaacagcgtc

SEQ ID NO: 98510 - DNA, 25 bp, Mus musculus
gaaatcgggtgcgaagcatgctcca

SEQ ID NO: 98511 - DNA, 25 bp, Mus musculus
gaaatcggtcccttcagttccgtca

SEQ ID NO: 98512 - DNA, 25 bp, Mus musculus
gaaatcgtgaaggaaggcaaagtcc

SEQ ID NO: 98513 - DNA, 25 bp, Mus musculus
gaaatcgtgccaatcatctatgaca

SEQ ID NO: 98514 - DNA, 25 bp, Mus musculus
gaaatcgtgccagaaaacatcgcag

SEQ ID NO: 98515 - DNA, 25 bp, Mus musculus
gaaatcgtgcctcatactaacgctg

SEQ ID NO: 98516 - DNA, 25 bp, Mus musculus
gaaatctaatgtgtatctggcccga

SEQ ID NO: 98517 - DNA, 25 bp, Mus musculus
gaaatctagacgtgagggccagtcc

SEQ ID NO: 98518 - DNA, 25 bp, Mus musculus
gaaatctatgatcctcggaacccag

SEQ ID NO: 98519 - DNA, 25 bp, Mus musculus
gaaatctccaccgagctcattcgct

SEQ ID NO: 98520 - DNA, 25 bp, Mus musculus
gaaatctctgctaatgaaaccccgg

SEQ ID NO: 98521 - DNA, 25 bp, Mus musculus
gaaatctcttctgtggagggaacac

SEQ ID NO: 98522 - DNA, 25 bp, Mus musculus
gaaatctgcattcaaactaggctga

SEQ ID NO: 98523 - DNA, 25 bp, Mus musculus
gaaatctgccctggatggcgccatg

SEQ ID NO: 98524 - DNA, 25 bp, Mus musculus
gaaatctgtcctgtggcatgcaaaa

SEQ ID NO: 98525 - DNA, 25 bp, Mus musculus
gaaatctgtctgaagcttagcctga

SEQ ID NO: 98526 - DNA, 25 bp, Mus musculus
gaaatctgtcttgccctctgaaacg

SEQ ID NO: 98527 - DNA, 25 bp, Mus musculus
gaaatctgtggtcatcctggtgcct

SEQ ID NO: 98528 - DNA, 25 bp, Mus musculus
gaaatcttaatacagtggcgctcag

SEQ ID NO: 98529 - DNA, 25 bp, Mus musculus
gaaatcttacttgttgtgccagaag

SEQ ID NO: 98530 - DNA, 25 bp, Mus musculus
gaaatcttcaatagtgacagtgacc

SEQ ID NO: 98531 - DNA, 25 bp, Mus musculus
gaaatcttgcggatcacagacccaa

SEQ ID NO: 98532 - DNA, 25 bp, Mus musculus
gaaatctttgctgcacacggactct

SEQ ID NO: 98533 - DNA, 25 bp, Mus musculus
gaaatgaaagctcagaggccccttc

SEQ ID NO: 98534 - DNA, 25 bp, Mus musculus
gaaatgaaatgtagttgccacgcac

SEQ ID NO: 98535 - DNA, 25 bp, Mus musculus
gaaatgaacatggacgtcgcaggaa

SEQ ID NO: 98536 - DNA, 25 bp, Mus musculus
gaaatgaagcgtgctaaagtgtccc

SEQ ID NO: 98537 - DNA, 25 bp, Mus musculus
gaaatgaaggtcaaaatcgctggcc

SEQ ID NO: 98538 - DNA, 25 bp, Mus musculus
gaaatgaatgaagattatcccgtag

SEQ ID NO: 98539 - DNA, 25 bp, Mus musculus
gaaatgaccgcctgggactatacac

SEQ ID NO: 98540 - DNA, 25 bp, Mus musculus
gaaatgacctcctccttcgagtgag

SEQ ID NO: 98541 - DNA, 25 bp, Mus musculus
gaaatgacctgcagctaagtgagtc

SEQ ID NO: 98542 - DNA, 25 bp, Mus musculus
gaaatgactcagcaggcggcaacta

SEQ ID NO: 98543 - DNA, 25 bp, Mus musculus
gaaatgactctgtacactgggcagg

SEQ ID NO: 98544 - DNA, 25 bp, Mus musculus
gaaatgactggagttggagccagcc

SEQ ID NO: 98545 - DNA, 25 bp, Mus musculus
gaaatgagatcttctcaggccccag

SEQ ID NO: 98546 - DNA, 25 bp, Mus musculus
gaaatgagcgccacttgtaccaggt

SEQ ID NO: 98547 - DNA, 25 bp, Mus musculus
gaaatgaggatctacaacccctggg

SEQ ID NO: 98548 - DNA, 25 bp, Mus musculus
gaaatgagtctatcaaggtcagcac

SEQ ID NO: 98549 - DNA, 25 bp, Mus musculus
gaaatgagtgcagtcctagaggagc

SEQ ID NO: 98550 - DNA, 25 bp, Mus musculus
gaaatgagtgcccaaagctacagcc

SEQ ID NO: 98551 - DNA, 25 bp, Mus musculus
gaaatgagtgcctcttgcacggcat

SEQ ID NO: 98552 - DNA, 25 bp, Mus musculus
gaaatgagttacattgccacctgag

SEQ ID NO: 98553 - DNA, 25 bp, Mus musculus
gaaatgatcacacttttggtggcaa

SEQ ID NO: 98554 - DNA, 25 bp, Mus musculus
gaaatgatgcactattccaagaact

SEQ ID NO: 98555 - DNA, 25 bp, Mus musculus
gaaatgattatgacccatccccgag

SEQ ID NO: 98556 - DNA, 25 bp, Mus musculus
gaaatgattcacttatgcttcccgt

SEQ ID NO: 98557 - DNA, 25 bp, Mus musculus
gaaatgattgttcgagcaagacaga

SEQ ID NO: 98558 - DNA, 25 bp, Mus musculus
gaaatgcaaagtgatggcctccaag

SEQ ID NO: 98559 - DNA, 25 bp, Mus musculus
gaaatgcaagatgcgtaggcccctg

SEQ ID NO: 98560 - DNA, 25 bp, Mus musculus
gaaatgcaagtgtcacaggtcccag

SEQ ID NO: 98561 - DNA, 25 bp, Mus musculus
gaaatgcaattaaaaagtgggctga

SEQ ID NO: 98562 - DNA, 25 bp, Mus musculus
gaaatgcacactgctctaatggagg

SEQ ID NO: 98563 - DNA, 25 bp, Mus musculus
gaaatgcacagttggtcccgcgatg

SEQ ID NO: 98564 - DNA, 25 bp, Mus musculus
gaaatgcacatacccggtcctcaag

SEQ ID NO: 98565 - DNA, 25 bp, Mus musculus
gaaatgcaccttcttctgagtctga

SEQ ID NO: 98566 - DNA, 25 bp, Mus musculus
gaaatgcactcttctgagctggtgg

SEQ ID NO: 98567 - DNA, 25 bp, Mus musculus
gaaatgcagaatgacccagaagcca

SEQ ID NO: 98568 - DNA, 25 bp, Mus musculus
gaaatgcagcaggacctagaggact

SEQ ID NO: 98569 - DNA, 25 bp, Mus musculus
gaaatgcaggaaccaaagatgaatg

SEQ ID NO: 98570 - DNA, 25 bp, Mus musculus
gaaatgcatcgacaaccacaacggt

SEQ ID NO: 98571 - DNA, 25 bp, Mus musculus
gaaatgccaaaatgttccaaatcag

SEQ ID NO: 98572 - DNA, 25 bp, Mus musculus
gaaatgccaagtgcccaagaaaacc

SEQ ID NO: 98573 - DNA, 25 bp, Mus musculus
gaaatgccacctcctcaagcacaaa

SEQ ID NO: 98574 - DNA, 25 bp, Mus musculus
gaaatgccagtttcaaagagaacgt

SEQ ID NO: 98575 - DNA, 25 bp, Mus musculus
gaaatgcccaatgctttgtgaagag

SEQ ID NO: 98576 - DNA, 25 bp, Mus musculus
gaaatgcccgggtcttcagatgtca

SEQ ID NO: 98577 - DNA, 25 bp, Mus musculus
gaaatgccctttgctgacagcacaa

SEQ ID NO: 98578 - DNA, 25 bp, Mus musculus
gaaatgccgcagatatccggtacgc

SEQ ID NO: 98579 - DNA, 25 bp, Mus musculus
gaaatgccgcaggttgaagcaagag

SEQ ID NO: 98580 - DNA, 25 bp, Mus musculus
gaaatgccgtttgacccctctaagg

SEQ ID NO: 98581 - DNA, 25 bp, Mus musculus
gaaatgcctactttggacagggcca

SEQ ID NO: 98582 - DNA, 25 bp, Mus musculus
gaaatgcctgcattcccctgaaaag

SEQ ID NO: 98583 - DNA, 25 bp, Mus musculus
gaaatgcgcagctgaaacacgcagg

SEQ ID NO: 98584 - DNA, 25 bp, Mus musculus
gaaatgcggacccaaatactgcttg

SEQ ID NO: 98585 - DNA, 25 bp, Mus musculus
gaaatgctagatcagcggcaggcca

SEQ ID NO: 98586 - DNA, 25 bp, Mus musculus
gaaatgctcaagtcgctaactgtag

SEQ ID NO: 98587 - DNA, 25 bp, Mus musculus
gaaatgctcagtcctctacaacagt

SEQ ID NO: 98588 - DNA, 25 bp, Mus musculus
gaaatgctcatcaatcctggagaca

SEQ ID NO: 98589 - DNA, 25 bp, Mus musculus
gaaatgctctccatgactgagggct

SEQ ID NO: 98590 - DNA, 25 bp, Mus musculus
gaaatgctgtaaaccctgtctggga

SEQ ID NO: 98591 - DNA, 25 bp, Mus musculus
gaaatgcttgctcaaataccgaggc

SEQ ID NO: 98592 - DNA, 25 bp, Mus musculus
gaaatgcttggatgaaattgaaaaa

SEQ ID NO: 98593 - DNA, 25 bp, Mus musculus
gaaatgctttaagttcgctctgggg

SEQ ID NO: 98594 - DNA, 25 bp, Mus musculus
gaaatggaccgtgttgtaagactga

SEQ ID NO: 98595 - DNA, 25 bp, Mus musculus
gaaatggactactctcgaaacctgg

SEQ ID NO: 98596 - DNA, 25 bp, Mus musculus
gaaatggagacgctgacatggccta

SEQ ID NO: 98597 - DNA, 25 bp, Mus musculus
gaaatggagcagtgtccgagccagt

SEQ ID NO: 98598 - DNA, 25 bp, Mus musculus
gaaatggagcgcagattccacgagc

SEQ ID NO: 98599 - DNA, 25 bp, Mus musculus
gaaatggagcttaaacaagtctgcc

SEQ ID NO: 98600 - DNA, 25 bp, Mus musculus
gaaatggatcgtaccccgtcggttg

SEQ ID NO: 98601 - DNA, 25 bp, Mus musculus
gaaatggattcagcattccgcgccc

SEQ ID NO: 98602 - DNA, 25 bp, Mus musculus
gaaatggattccctggctgagccag

SEQ ID NO: 98603 - DNA, 25 bp, Mus musculus
gaaatggcagaccatatgatggcca

SEQ ID NO: 98604 - DNA, 25 bp, Mus musculus
gaaatggcatgttgaatgtgtcccc

SEQ ID NO: 98605 - DNA, 25 bp, Mus musculus
gaaatggccaaccaagcgcttctaa

SEQ ID NO: 98606 - DNA, 25 bp, Mus musculus
gaaatggcggttagaagcacttcac

SEQ ID NO: 98607 - DNA, 25 bp, Mus musculus
gaaatggctcccttcctggcctgaa

SEQ ID NO: 98608 - DNA, 25 bp, Mus musculus
gaaatggctgtgatgtcaacataga

SEQ ID NO: 98609 - DNA, 25 bp, Mus musculus
gaaatggctgtgttagctccttctg

SEQ ID NO: 98610 - DNA, 25 bp, Mus musculus
gaaatgggaattaaacacatacttg

SEQ ID NO: 98611 - DNA, 25 bp, Mus musculus
gaaatgggagattagcacactagcc

SEQ ID NO: 98612 - DNA, 25 bp, Mus musculus
gaaatgggccatcctcaaacaaagg

SEQ ID NO: 98613 - DNA, 25 bp, Mus musculus
gaaatgggccttctaagcaccacag

SEQ ID NO: 98614 - DNA, 25 bp, Mus musculus
gaaatgggctcagatcatacctaag

SEQ ID NO: 98615 - DNA, 25 bp, Mus musculus
gaaatgggctccatccacacgtgct

SEQ ID NO: 98616 - DNA, 25 bp, Mus musculus
gaaatgggtgagagcgtgcctacac

SEQ ID NO: 98617 - DNA, 25 bp, Mus musculus
gaaatggtcgtggtttccgtgcccg

SEQ ID NO: 98618 - DNA, 25 bp, Mus musculus
gaaatggtgaagcaaatcaatgaca

SEQ ID NO: 98619 - DNA, 25 bp, Mus musculus
gaaatggtgcctcttactgtgtaaa

SEQ ID NO: 98620 - DNA, 25 bp, Mus musculus
gaaatggttcctagatgagtcctcc

SEQ ID NO: 98621 - DNA, 25 bp, Mus musculus
gaaatgtacactaccactgacgggc

SEQ ID NO: 98622 - DNA, 25 bp, Mus musculus
gaaatgtaccaaagtcggaggctca

SEQ ID NO: 98623 - DNA, 25 bp, Mus musculus
gaaatgtaccaccaagcagatgagc

SEQ ID NO: 98624 - DNA, 25 bp, Mus musculus
gaaatgtcactttatcaccagccag

SEQ ID NO: 98625 - DNA, 25 bp, Mus musculus
gaaatgtcccgagagctacatgacg

SEQ ID NO: 98626 - DNA, 25 bp, Mus musculus
gaaatgtcctccaagactgactcgg

SEQ ID NO: 98627 - DNA, 25 bp, Mus musculus
gaaatgtccttatttaaagcccgtg

SEQ ID NO: 98628 - DNA, 25 bp, Mus musculus
gaaatgtcggagaagtcaggccaga

SEQ ID NO: 98629 - DNA, 25 bp, Mus musculus
gaaatgtcttccttccggtgcaccc

SEQ ID NO: 98630 - DNA, 25 bp, Mus musculus
gaaatgtgaaattgctctgacgacc

SEQ ID NO: 98631 - DNA, 25 bp, Mus musculus
gaaatgtgcagctgtctaaggctct

SEQ ID NO: 98632 - DNA, 25 bp, Mus musculus
gaaatgtgcctgctagacactcaga

SEQ ID NO: 98633 - DNA, 25 bp, Mus musculus
gaaatgtggcgatctcaagaaggca

SEQ ID NO: 98634 - DNA, 25 bp, Mus musculus
gaaatgtgggtcctgtccaatgctg

SEQ ID NO: 98635 - DNA, 25 bp, Mus musculus
gaaatgtgtcaaccactatggagga

SEQ ID NO: 98636 - DNA, 25 bp, Mus musculus
gaaatgtgtcactagaagagggctt

SEQ ID NO: 98637 - DNA, 25 bp, Mus musculus
gaaatgttaccctgatcgtgtggac

SEQ ID NO: 98638 - DNA, 25 bp, Mus musculus
gaaatgttactgttgaaaggcccta

SEQ ID NO: 98639 - DNA, 25 bp, Mus musculus
gaaatgttagtcacagccctggagt

SEQ ID NO: 98640 - DNA, 25 bp, Mus musculus
gaaatgttcaaccagggcagggcct

SEQ ID NO: 98641 - DNA, 25 bp, Mus musculus
gaaatgttcaagcagacagctcgac

SEQ ID NO: 98642 - DNA, 25 bp, Mus musculus
gaaatgttcagtgttcggtggcagc

SEQ ID NO: 98643 - DNA, 25 bp, Mus musculus
gaaatgttgtccacagttgttttgg

SEQ ID NO: 98644 - DNA, 25 bp, Mus musculus
gaaatgtttccagcagtccatgcag

SEQ ID NO: 98645 - DNA, 25 bp, Mus musculus
gaaattaaagagacgagcggcttcg

SEQ ID NO: 98646 - DNA, 25 bp, Mus musculus
gaaattaatagactcgctgccgagg

SEQ ID NO: 98647 - DNA, 25 bp, Mus musculus
gaaattacaacagtcaccgagtgga

SEQ ID NO: 98648 - DNA, 25 bp, Mus musculus
gaaattaccacagcagaaccacaag

SEQ ID NO: 98649 - DNA, 25 bp, Mus musculus
gaaattactcgtcaacaggcggcag

SEQ ID NO: 98650 - DNA, 25 bp, Mus musculus
gaaattagaacgacgccagctggag

SEQ ID NO: 98651 - DNA, 25 bp, Mus musculus
gaaattagagaaaacctggagcgac

SEQ ID NO: 98652 - DNA, 25 bp, Mus musculus
gaaattaggttcatggcacaggaca

SEQ ID NO: 98653 - DNA, 25 bp, Mus musculus
gaaattagtcagaatggcagccacc

SEQ ID NO: 98654 - DNA, 25 bp, Mus musculus
gaaattatcaaagtgacagagcagc

SEQ ID NO: 98655 - DNA, 25 bp, Mus musculus
gaaattatccgagacgtggacctca

SEQ ID NO: 98656 - DNA, 25 bp, Mus musculus
gaaattcaagacgattatcagcctg

SEQ ID NO: 98657 - DNA, 25 bp, Mus musculus
gaaattcaagctggtgttcctggga

SEQ ID NO: 98658 - DNA, 25 bp, Mus musculus
gaaattcacacgtactcgccgtcta

SEQ ID NO: 98659 - DNA, 25 bp, Mus musculus
gaaattcaccacctttagcaaggcc

SEQ ID NO: 98660 - DNA, 25 bp, Mus musculus
gaaattcagaaagcattcgccaccg

SEQ ID NO: 98661 - DNA, 25 bp, Mus musculus
gaaattcaggattaccaagtggcca

SEQ ID NO: 98662 - DNA, 25 bp, Mus musculus
gaaattcagtcttcagggtctcaag

SEQ ID NO: 98663 - DNA, 25 bp, Mus musculus
gaaattccaagatggatgatcagga

SEQ ID NO: 98664 - DNA, 25 bp, Mus musculus
gaaattccaatggtgctctgtgcca

SEQ ID NO: 98665 - DNA, 25 bp, Mus musculus
gaaattccacttccgagcctgagta

SEQ ID NO: 98666 - DNA, 25 bp, Mus musculus
gaaattccagcaaaagcatggtgcc

SEQ ID NO: 98667 - DNA, 25 bp, Mus musculus
gaaattcccaagtgcctgcttacag

SEQ ID NO: 98668 - DNA, 25 bp, Mus musculus
gaaattccccgatgccacggaagaa

SEQ ID NO: 98669 - DNA, 25 bp, Mus musculus
gaaattccgagctcataagaacgtc

SEQ ID NO: 98670 - DNA, 25 bp, Mus musculus
gaaattccggcgtcagatgcgggcc

SEQ ID NO: 98671 - DNA, 25 bp, Mus musculus
gaaattccgtggacgaacttagagc

SEQ ID NO: 98672 - DNA, 25 bp, Mus musculus
gaaattcctaccactatgagcacca

SEQ ID NO: 98673 - DNA, 25 bp, Mus musculus
gaaattcgagaatgatgcagctgtg

SEQ ID NO: 98674 - DNA, 25 bp, Mus musculus
gaaattcggaacctgtcttcagtcc

SEQ ID NO: 98675 - DNA, 25 bp, Mus musculus
gaaattcgggccagtctaaaagcag

SEQ ID NO: 98676 - DNA, 25 bp, Mus musculus
gaaattctagggtatcggccaggtc

SEQ ID NO: 98677 - DNA, 25 bp, Mus musculus
gaaattctgcacttgttgggcagct

SEQ ID NO: 98678 - DNA, 25 bp, Mus musculus
gaaattctgcctcggctacaacgcc

SEQ ID NO: 98679 - DNA, 25 bp, Mus musculus
gaaattcttggtccctatggcatga

SEQ ID NO: 98680 - DNA, 25 bp, Mus musculus
gaaattctttctcaaccagggccca

SEQ ID NO: 98681 - DNA, 25 bp, Mus musculus
gaaattgaacctctgtttgccagta

SEQ ID NO: 98682 - DNA, 25 bp, Mus musculus
gaaattgaagaagatgccggccttg

SEQ ID NO: 98683 - DNA, 25 bp, Mus musculus
gaaattgaccatgctgaacgagagc

SEQ ID NO: 98684 - DNA, 25 bp, Mus musculus
gaaattgactatatctacagggcag

SEQ ID NO: 98685 - DNA, 25 bp, Mus musculus
gaaattgagaagatcccagcgagct

SEQ ID NO: 98686 - DNA, 25 bp, Mus musculus
gaaattgagcgagatctcaggctga

SEQ ID NO: 98687 - DNA, 25 bp, Mus musculus
gaaattgagtactttgacccggcca

SEQ ID NO: 98688 - DNA, 25 bp, Mus musculus
gaaattgatatctccaaagcggccc

SEQ ID NO: 98689 - DNA, 25 bp, Mus musculus
gaaattgatcgtgaattgcagaaga

SEQ ID NO: 98690 - DNA, 25 bp, Mus musculus
gaaattgccaatgcttgcaatgcag

SEQ ID NO: 98691 - DNA, 25 bp, Mus musculus
gaaattgcctcaaacctcaagtgct

SEQ ID NO: 98692 - DNA, 25 bp, Mus musculus
gaaattgcgaattcagaggaagaag

SEQ ID NO: 98693 - DNA, 25 bp, Mus musculus
gaaattgcgcctgaccgggcacggt

SEQ ID NO: 98694 - DNA, 25 bp, Mus musculus
gaaattgctgccaaggacaagctga

SEQ ID NO: 98695 - DNA, 25 bp, Mus musculus
gaaattgctttctcagatcccactc

SEQ ID NO: 98696 - DNA, 25 bp, Mus musculus
gaaattggaagcacaggatcccagg

SEQ ID NO: 98697 - DNA, 25 bp, Mus musculus
gaaattggagaacctgttgagacct

SEQ ID NO: 98698 - DNA, 25 bp, Mus musculus
gaaattggcccgtttcaatgcccga

SEQ ID NO: 98699 - DNA, 25 bp, Mus musculus
gaaattggcgagacacatcctcaca

SEQ ID NO: 98700 - DNA, 25 bp, Mus musculus
gaaattgtagaaactgcgaacactg

SEQ ID NO: 98701 - DNA, 25 bp, Mus musculus
gaaattgtcaattcaagtgggcagg

SEQ ID NO: 98702 - DNA, 25 bp, Mus musculus
gaaattgtggaggatgccttgcagc

SEQ ID NO: 98703 - DNA, 25 bp, Mus musculus
gaaattgtggatcctgcctctgaac

SEQ ID NO: 98704 - DNA, 25 bp, Mus musculus
gaaattgtgtataagtcacccgtgg

SEQ ID NO: 98705 - DNA, 25 bp, Mus musculus
gaaattgtgtcctcaccgtgtggcc

SEQ ID NO: 98706 - DNA, 25 bp, Mus musculus
gaaattgttcgcctgagcagagacc

SEQ ID NO: 98707 - DNA, 25 bp, Mus musculus
gaaattgttgctactagttctggtg

SEQ ID NO: 98708 - DNA, 25 bp, Mus musculus
gaaatttaatgctagacggaaactg

SEQ ID NO: 98709 - DNA, 25 bp, Mus musculus
gaaatttacctgaccataggagcct

SEQ ID NO: 98710 - DNA, 25 bp, Mus musculus
gaaatttactgttggccactgccag

SEQ ID NO: 98711 - DNA, 25 bp, Mus musculus
gaaatttattcagcttgaaaggctg

SEQ ID NO: 98712 - DNA, 25 bp, Mus musculus
gaaatttccatactgctcctgtccg

SEQ ID NO: 98713 - DNA, 25 bp, Mus musculus
gaaatttcttgtttagggatgccca

SEQ ID NO: 98714 - DNA, 25 bp, Mus musculus
gaaatttgactacctgaaggaggag

SEQ ID NO: 98715 - DNA, 25 bp, Mus musculus
gaaatttgcctgatgcatcctctcg

SEQ ID NO: 98716 - DNA, 25 bp, Mus musculus
gaaatttggtctaaagctacagatc

SEQ ID NO: 98717 - DNA, 25 bp, Mus musculus
gaaatttgtcatggtcgtggattcc

SEQ ID NO: 98718 - DNA, 25 bp, Mus musculus
gaaattttgggagttgcagctacgc

SEQ ID NO: 98719 - DNA, 25 bp, Mus musculus
gaaatttttcaagctcgtgggcaga

SEQ ID NO: 98720 - DNA, 25 bp, Mus musculus
gaacaaaagctcgaagcaaatgccg

SEQ ID NO: 98721 - DNA, 25 bp, Mus musculus
gaacaaaagtgacttcagccaggcc

SEQ ID NO: 98722 - DNA, 25 bp, Mus musculus
gaacaaacaacatacatactcaagc

SEQ ID NO: 98723 - DNA, 25 bp, Mus musculus
gaacaaacaggtagccatgggcaga

SEQ ID NO: 98724 - DNA, 25 bp, Mus musculus
gaacaaactgtgtgtaacatagtca

SEQ ID NO: 98725 - DNA, 25 bp, Mus musculus
gaacaaacttgcctagcttcgagtg

SEQ ID NO: 98726 - DNA, 25 bp, Mus musculus
gaacaaagacgggatgctgatcgcg

SEQ ID NO: 98727 - DNA, 25 bp, Mus musculus
gaacaaagcaagacttcaagcagtg

SEQ ID NO: 98728 - DNA, 25 bp, Mus musculus
gaacaaaggcatgctgtcggaactg

SEQ ID NO: 98729 - DNA, 25 bp, Mus musculus
gaacaaaggcctgatgatcatcgac

SEQ ID NO: 98730 - DNA, 25 bp, Mus musculus
gaacaaagtcatcgagcagctagga

SEQ ID NO: 98731 - DNA, 25 bp, Mus musculus
gaacaaagtggtggtcatcacagat

SEQ ID NO: 98732 - DNA, 25 bp, Mus musculus
gaacaaatcccagaatgacagcggt

SEQ ID NO: 98733 - DNA, 25 bp, Mus musculus
gaacaaatcgtcagtgcctggagca

SEQ ID NO: 98734 - DNA, 25 bp, Mus musculus
gaacaaatgcctttcagaatctcga

SEQ ID NO: 98735 - DNA, 25 bp, Mus musculus
gaacaacaaagcgagaaaccgagct

SEQ ID NO: 98736 - DNA, 25 bp, Mus musculus
gaacaacaactgaaggtcccctaag

SEQ ID NO: 98737 - DNA, 25 bp, Mus musculus
gaacaacaagatgtagcgtgcggcc

SEQ ID NO: 98738 - DNA, 25 bp, Mus musculus
gaacaacaagcattacacgtgcacc

SEQ ID NO: 98739 - DNA, 25 bp, Mus musculus
gaacaacaatcaaactcctacccgg

SEQ ID NO: 98740 - DNA, 25 bp, Mus musculus
gaacaacagcgaggacgccgaggac

SEQ ID NO: 98741 - DNA, 25 bp, Mus musculus
gaacaacatcaccaatcggacggcc

SEQ ID NO: 98742 - DNA, 25 bp, Mus musculus
gaacaacatggcagacgtgtcagcc

SEQ ID NO: 98743 - DNA, 25 bp, Mus musculus
gaacaaccacgtctgctattgggag

SEQ ID NO: 98744 - DNA, 25 bp, Mus musculus
gaacaacctcgtgaaaagcaggcca

SEQ ID NO: 98745 - DNA, 25 bp, Mus musculus
gaacaacctggctgcgtatagacag

SEQ ID NO: 98746 - DNA, 25 bp, Mus musculus
gaacaaccttctactcctgcgggac

SEQ ID NO: 98747 - DNA, 25 bp, Mus musculus
gaacaacgactctgacgagaccgag

SEQ ID NO: 98748 - DNA, 25 bp, Mus musculus
gaacaacgatacgtgcagcatgccc

SEQ ID NO: 98749 - DNA, 25 bp, Mus musculus
gaacaacgattgctcatcccctgag

SEQ ID NO: 98750 - DNA, 25 bp, Mus musculus
gaacaacggatcaactttggtctct

SEQ ID NO: 98751 - DNA, 25 bp, Mus musculus
gaacaactcctgaagaacaactggg

SEQ ID NO: 98752 - DNA, 25 bp, Mus musculus
gaacaactctgtggctgtaggagcc

SEQ ID NO: 98753 - DNA, 25 bp, Mus musculus
gaacaactgctacatctggatggag

SEQ ID NO: 98754 - DNA, 25 bp, Mus musculus
gaacaactgtcctacctgctcaagt

SEQ ID NO: 98755 - DNA, 25 bp, Mus musculus
gaacaacttgtactgcgactgccac

SEQ ID NO: 98756 - DNA, 25 bp, Mus musculus
gaacaactttgtcatctttgaaggc

SEQ ID NO: 98757 - DNA, 25 bp, Mus musculus
gaacaacttttgttgccgcctggaa

SEQ ID NO: 98758 - DNA, 25 bp, Mus musculus
gaacaagaacaagctccaggtcctc

SEQ ID NO: 98759 - DNA, 25 bp, Mus musculus
gaacaagaagccaccctgggttcct

SEQ ID NO: 98760 - DNA, 25 bp, Mus musculus
gaacaagaaggatctgaggcggcac

SEQ ID NO: 98761 - DNA, 25 bp, Mus musculus
gaacaagaccaaacacgacgtgaag

SEQ ID NO: 98762 - DNA, 25 bp, Mus musculus
gaacaagaccaggactgcatggcag

SEQ ID NO: 98763 - DNA, 25 bp, Mus musculus
gaacaagagcttgatcgtgtgatcg

SEQ ID NO: 98764 - DNA, 25 bp, Mus musculus
gaacaagcccctgtatcagatgcgg

SEQ ID NO: 98765 - DNA, 25 bp, Mus musculus
gaacaagcctggatagccaacggca

SEQ ID NO: 98766 - DNA, 25 bp, Mus musculus
gaacaagcgatgcatgaagaccctc

SEQ ID NO: 98767 - DNA, 25 bp, Mus musculus
gaacaagcggatggctgacagcctg

SEQ ID NO: 98768 - DNA, 25 bp, Mus musculus
gaacaagctaccaaacagtgagatc

SEQ ID NO: 98769 - DNA, 25 bp, Mus musculus
gaacaagcttcagcttccagaagga

SEQ ID NO: 98770 - DNA, 25 bp, Mus musculus
gaacaaggaaagcacctcggagcct

SEQ ID NO: 98771 - DNA, 25 bp, Mus musculus
gaacaaggactttgtgcgccccaaa

SEQ ID NO: 98772 - DNA, 25 bp, Mus musculus
gaacaaggagtctgtcccagaaagc

SEQ ID NO: 98773 - DNA, 25 bp, Mus musculus
gaacaaggattcatgggcaacaccg

SEQ ID NO: 98774 - DNA, 25 bp, Mus musculus
gaacaaggccttatctaccgctgcg

SEQ ID NO: 98775 - DNA, 25 bp, Mus musculus
gaacaaggcggacttccaaggcatc

SEQ ID NO: 98776 - DNA, 25 bp, Mus musculus
gaacaagggatgcttcctgaagacc

SEQ ID NO: 98777 - DNA, 25 bp, Mus musculus
gaacaagtcacagcccatttcgagg

SEQ ID NO: 98778 - DNA, 25 bp, Mus musculus
gaacaagtcctgatggaactaaaaa

SEQ ID NO: 98779 - DNA, 25 bp, Mus musculus
gaacaagtggtcaatgccctggaag

SEQ ID NO: 98780 - DNA, 25 bp, Mus musculus
gaacaagtgtaaagacctgcgtcgt

SEQ ID NO: 98781 - DNA, 25 bp, Mus musculus
gaacaagttagtaccctgtaccaga

SEQ ID NO: 98782 - DNA, 25 bp, Mus musculus
gaacaagttagtcgctgccagcaac

SEQ ID NO: 98783 - DNA, 25 bp, Mus musculus
gaacaagttgtctccatcttcatca

SEQ ID NO: 98784 - DNA, 25 bp, Mus musculus
gaacaatcaaggtacaagtgctgga

SEQ ID NO: 98785 - DNA, 25 bp, Mus musculus
gaacaatcagaagtggctccaagtg

SEQ ID NO: 98786 - DNA, 25 bp, Mus musculus
gaacaatccagatttctaacccagg

SEQ ID NO: 98787 - DNA, 25 bp, Mus musculus
gaacaatcgatgtgtccgtgccaaa

SEQ ID NO: 98788 - DNA, 25 bp, Mus musculus
gaacaatcgccagcatgtcgaccaa

SEQ ID NO: 98789 - DNA, 25 bp, Mus musculus
gaacaatctgatctaccaggtggac

SEQ ID NO: 98790 - DNA, 25 bp, Mus musculus
gaacaatctttgcttacccatctgc

SEQ ID NO: 98791 - DNA, 25 bp, Mus musculus
gaacaatgaggtcccttttcttcct

SEQ ID NO: 98792 - DNA, 25 bp, Mus musculus
gaacaatgctcacatcctcgatggg

SEQ ID NO: 98793 - DNA, 25 bp, Mus musculus
gaacaatggcggctgcttgcactac

SEQ ID NO: 98794 - DNA, 25 bp, Mus musculus
gaacaatgtgttgctgtcgctctca

SEQ ID NO: 98795 - DNA, 25 bp, Mus musculus
gaacaattccccttcggaggcacag

SEQ ID NO: 98796 - DNA, 25 bp, Mus musculus
gaacaattctcagctacgcatcgag

SEQ ID NO: 98797 - DNA, 25 bp, Mus musculus
gaacaattttacactccaggacggc

SEQ ID NO: 98798 - DNA, 25 bp, Mus musculus
gaacacaacccatttcagctcagat

SEQ ID NO: 98799 - DNA, 25 bp, Mus musculus
gaacacaagacagaagggcgtgctt

SEQ ID NO: 98800 - DNA, 25 bp, Mus musculus
gaacacaagtacatgcatctacagt

SEQ ID NO: 98801 - DNA, 25 bp, Mus musculus
gaacacaatggctacacgggtggat

SEQ ID NO: 98802 - DNA, 25 bp, Mus musculus
gaacacacagggtcacgtgggacac

SEQ ID NO: 98803 - DNA, 25 bp, Mus musculus
gaacacactgtggtatgccagctca

SEQ ID NO: 98804 - DNA, 25 bp, Mus musculus
gaacacagatgtggtagcaacgctg

SEQ ID NO: 98805 - DNA, 25 bp, Mus musculus
gaacacagctttgggccttaacatt

SEQ ID NO: 98806 - DNA, 25 bp, Mus musculus
gaacacaggagaccttcgagtcagc

SEQ ID NO: 98807 - DNA, 25 bp, Mus musculus
gaacacaggattgtacgagatctct

SEQ ID NO: 98808 - DNA, 25 bp, Mus musculus
gaacacaggcttggaactcagggag

SEQ ID NO: 98809 - DNA, 25 bp, Mus musculus
gaacacagtcctcttatccatacaa

SEQ ID NO: 98810 - DNA, 25 bp, Mus musculus
gaacacataagggaaatggtgaagc

SEQ ID NO: 98811 - DNA, 25 bp, Mus musculus
gaacacatacattatggacaaaggc

SEQ ID NO: 98812 - DNA, 25 bp, Mus musculus
gaacacatcttcttccaagtggtgg

SEQ ID NO: 98813 - DNA, 25 bp, Mus musculus
gaacacatgccggtgaataaccctt

SEQ ID NO: 98814 - DNA, 25 bp, Mus musculus
gaacacatttcttttaccacgtcaa

SEQ ID NO: 98815 - DNA, 25 bp, Mus musculus
gaacaccaagttcttagtgcgggct

SEQ ID NO: 98816 - DNA, 25 bp, Mus musculus
gaacaccatgatcaaccttggctta

SEQ ID NO: 98817 - DNA, 25 bp, Mus musculus
gaacaccatgtccttgaagattcag

SEQ ID NO: 98818 - DNA, 25 bp, Mus musculus
gaacaccccatttcatgactcgtag

SEQ ID NO: 98819 - DNA, 25 bp, Mus musculus
gaacaccgtggtgatcaagcctgcc

SEQ ID NO: 98820 - DNA, 25 bp, Mus musculus
gaacacctattcttctgtgggagga

SEQ ID NO: 98821 - DNA, 25 bp, Mus musculus
gaacacctatttgagtccagagcca

SEQ ID NO: 98822 - DNA, 25 bp, Mus musculus
gaacacctgcacaagatggcgtcct

SEQ ID NO: 98823 - DNA, 25 bp, Mus musculus
gaacacctgctcatgtacctggaga

SEQ ID NO: 98824 - DNA, 25 bp, Mus musculus
gaacacctggctgtcatgcatgaga

SEQ ID NO: 98825 - DNA, 25 bp, Mus musculus
gaacacctgggcaagtaggcggact

SEQ ID NO: 98826 - DNA, 25 bp, Mus musculus
gaacaccttacccagcaacttgctg

SEQ ID NO: 98827 - DNA, 25 bp, Mus musculus
gaacaccttagattgtgagtcaccg

SEQ ID NO: 98828 - DNA, 25 bp, Mus musculus
gaacaccttccggaactgctgagag

SEQ ID NO: 98829 - DNA, 25 bp, Mus musculus
gaacaccttggacagtgccctgagt

SEQ ID NO: 98830 - DNA, 25 bp, Mus musculus
gaacacctttgtgctgatggttgaa

SEQ ID NO: 98831 - DNA, 25 bp, Mus musculus
gaacacgaaccgacagctgctattg

SEQ ID NO: 98832 - DNA, 25 bp, Mus musculus
gaacacgacttaccagttggcccag

SEQ ID NO: 98833 - DNA, 25 bp, Mus musculus
gaacacgagagcttcgaagagccga

SEQ ID NO: 98834 - DNA, 25 bp, Mus musculus
gaacacgcggtttctggtgcagaac

SEQ ID NO: 98835 - DNA, 25 bp, Mus musculus
gaacacggcgatttgtgccttgcca

SEQ ID NO: 98836 - DNA, 25 bp, Mus musculus
gaacacgggttcattggctgccgca

SEQ ID NO: 98837 - DNA, 25 bp, Mus musculus
gaacacgtcgttggatcagaactcc

SEQ ID NO: 98838 - DNA, 25 bp, Mus musculus
gaacacgtgaggctccaaaattgag

SEQ ID NO: 98839 - DNA, 25 bp, Mus musculus
gaacacgtgagtgactgtgagcgcc

SEQ ID NO: 98840 - DNA, 25 bp, Mus musculus
gaacacgtgcgctctggacaggcct

SEQ ID NO: 98841 - DNA, 25 bp, Mus musculus
gaacactaaagaggcgacggagcct

SEQ ID NO: 98842 - DNA, 25 bp, Mus musculus
gaacactaacaacagggcttctggg

SEQ ID NO: 98843 - DNA, 25 bp, Mus musculus
gaacactacaaccagcacaactctg

SEQ ID NO: 98844 - DNA, 25 bp, Mus musculus
gaacactacgatttcctgttcaagc

SEQ ID NO: 98845 - DNA, 25 bp, Mus musculus
gaacactcgcgctttcttccggaaa

SEQ ID NO: 98846 - DNA, 25 bp, Mus musculus
gaacactcgggagcctctcttggaa

SEQ ID NO: 98847 - DNA, 25 bp, Mus musculus
gaacactctgaacaaggtcttaaag

SEQ ID NO: 98848 - DNA, 25 bp, Mus musculus
gaacactgccttatggccaggatag

SEQ ID NO: 98849 - DNA, 25 bp, Mus musculus
gaacactgcggagcgctcaggatgc

SEQ ID NO: 98850 - DNA, 25 bp, Mus musculus
gaacactggaacgtcctcacaggga

SEQ ID NO: 98851 - DNA, 25 bp, Mus musculus
gaacactggatatcccctcagaatg

SEQ ID NO: 98852 - DNA, 25 bp, Mus musculus
gaacactggatggtgactacaacaa

SEQ ID NO: 98853 - DNA, 25 bp, Mus musculus
gaacactggtttcccatggcatgtg

SEQ ID NO: 98854 - DNA, 25 bp, Mus musculus
gaacactgttaatttcacaccagag

SEQ ID NO: 98855 - DNA, 25 bp, Mus musculus
gaacacttactacaacagacaggag

SEQ ID NO: 98856 - DNA, 25 bp, Mus musculus
gaacacttccttcgttggacggaga

SEQ ID NO: 98857 - DNA, 25 bp, Mus musculus
gaacacttctggctgttacacgacc

SEQ ID NO: 98858 - DNA, 25 bp, Mus musculus
gaacacttgaccctgtagacggagt

SEQ ID NO: 98859 - DNA, 25 bp, Mus musculus
gaacacttgacctggtggaaacacc

SEQ ID NO: 98860 - DNA, 25 bp, Mus musculus
gaacacttgtgccaaaagcacctgg

SEQ ID NO: 98861 - DNA, 25 bp, Mus musculus
gaacactttagacggccggattgga

SEQ ID NO: 98862 - DNA, 25 bp, Mus musculus
gaacagaaaccattcacaccagctt

SEQ ID NO: 98863 - DNA, 25 bp, Mus musculus
gaacagaaaggacgttacagactct

SEQ ID NO: 98864 - DNA, 25 bp, Mus musculus
gaacagaaatggtctccgtcgccag

SEQ ID NO: 98865 - DNA, 25 bp, Mus musculus
gaacagaacaggtcgtgaagccagc

SEQ ID NO: 98866 - DNA, 25 bp, Mus musculus
gaacagaactccgtgggcgcattgt

SEQ ID NO: 98867 - DNA, 25 bp, Mus musculus
gaacagaagcgctggctactggtgt

SEQ ID NO: 98868 - DNA, 25 bp, Mus musculus
gaacagaagctcaatagccccagta

SEQ ID NO: 98869 - DNA, 25 bp, Mus musculus
gaacagaaggagctctcaaaggcgc

SEQ ID NO: 98870 - DNA, 25 bp, Mus musculus
gaacagaatcacatgatccgcaccc

SEQ ID NO: 98871 - DNA, 25 bp, Mus musculus
gaacagaatccggatgacgcacagt

SEQ ID NO: 98872 - DNA, 25 bp, Mus musculus
gaacagacaaaagtaccgcggtggc

SEQ ID NO: 98873 - DNA, 25 bp, Mus musculus
gaacagacagcgcaaacttggaaca

SEQ ID NO: 98874 - DNA, 25 bp, Mus musculus
gaacagaccgatctccttggaggac

SEQ ID NO: 98875 - DNA, 25 bp, Mus musculus
gaacagacctagagcttcaccaaga

SEQ ID NO: 98876 - DNA, 25 bp, Mus musculus
gaacagacctgagcactctaatgga

SEQ ID NO: 98877 - DNA, 25 bp, Mus musculus
gaacagactaccagaatcgagcagc

SEQ ID NO: 98878 - DNA, 25 bp, Mus musculus
gaacagactgctttgtgtgtctcca

SEQ ID NO: 98879 - DNA, 25 bp, Mus musculus
gaacagagaatccttaaggctctcc

SEQ ID NO: 98880 - DNA, 25 bp, Mus musculus
gaacagagagtcaccatagtgctgg

SEQ ID NO: 98881 - DNA, 25 bp, Mus musculus
gaacagagccatagtacaagccgtg

SEQ ID NO: 98882 - DNA, 25 bp, Mus musculus
gaacagagcgtcctgtcaactcggc

SEQ ID NO: 98883 - DNA, 25 bp, Mus musculus
gaacagaggatttacgacctaacca

SEQ ID NO: 98884 - DNA, 25 bp, Mus musculus
gaacagaggcgtcaaagtggattac

SEQ ID NO: 98885 - DNA, 25 bp, Mus musculus
gaacagagtgaagaaaaccaagccc

SEQ ID NO: 98886 - DNA, 25 bp, Mus musculus
gaacagatgtcccaggtgccctggc

SEQ ID NO: 98887 - DNA, 25 bp, Mus musculus
gaacagatgttcgagacctttgact

SEQ ID NO: 98888 - DNA, 25 bp, Mus musculus
gaacagattataaatttggaagcag

SEQ ID NO: 98889 - DNA, 25 bp, Mus musculus
gaacagattggattgaaagaagccc

SEQ ID NO: 98890 - DNA, 25 bp, Mus musculus
gaacagcaaggcttttaccgccaag

SEQ ID NO: 98891 - DNA, 25 bp, Mus musculus
gaacagcacttgaaggagaagcccc

SEQ ID NO: 98892 - DNA, 25 bp, Mus musculus
gaacagcagaaagtagcccagagga

SEQ ID NO: 98893 - DNA, 25 bp, Mus musculus
gaacagcaggagaggatacttagtc

SEQ ID NO: 98894 - DNA, 25 bp, Mus musculus
gaacagccacatcatcctgtgtggt

SEQ ID NO: 98895 - DNA, 25 bp, Mus musculus
gaacagcccatgtgtcacaccagag

SEQ ID NO: 98896 - DNA, 25 bp, Mus musculus
gaacagcccgggtgttcctgcagga

SEQ ID NO: 98897 - DNA, 25 bp, Mus musculus
gaacagccgtggtatgtggctgaca

SEQ ID NO: 98898 - DNA, 25 bp, Mus musculus
gaacagcctctgatcttcaagaacg

SEQ ID NO: 98899 - DNA, 25 bp, Mus musculus
gaacagcctctgcttagagttgaag

SEQ ID NO: 98900 - DNA, 25 bp, Mus musculus
gaacagcctgcagggtttgacaccc

SEQ ID NO: 98901 - DNA, 25 bp, Mus musculus
gaacagcctggtaatttacaaaggg

SEQ ID NO: 98902 - DNA, 25 bp, Mus musculus
gaacagcgacggcaccttagtggct

SEQ ID NO: 98903 - DNA, 25 bp, Mus musculus
gaacagcggtttggtgtgtctcaca

SEQ ID NO: 98904 - DNA, 25 bp, Mus musculus
gaacagctaaacagggagctctgct

SEQ ID NO: 98905 - DNA, 25 bp, Mus musculus
gaacagctaaagttgggagaggccc

SEQ ID NO: 98906 - DNA, 25 bp, Mus musculus
gaacagctaatccaccgaagaaaag

SEQ ID NO: 98907 - DNA, 25 bp, Mus musculus
gaacagctactcagtgttgcccgtg

SEQ ID NO: 98908 - DNA, 25 bp, Mus musculus
gaacagctcggcatttagaatggga

SEQ ID NO: 98909 - DNA, 25 bp, Mus musculus
gaacagctgaatgcacacgtggagg

SEQ ID NO: 98910 - DNA, 25 bp, Mus musculus
gaacagctgcaacagggaaagccta

SEQ ID NO: 98911 - DNA, 25 bp, Mus musculus
gaacagctgccagtacccagggctt

SEQ ID NO: 98912 - DNA, 25 bp, Mus musculus
gaacagctggagaatggccctaaca

SEQ ID NO: 98913 - DNA, 25 bp, Mus musculus
gaacagctttctccgagtcacggca

SEQ ID NO: 98914 - DNA, 25 bp, Mus musculus
gaacaggaacagaaccactacctgg

SEQ ID NO: 98915 - DNA, 25 bp, Mus musculus
gaacaggaagcttcgcttcgggacc

SEQ ID NO: 98916 - DNA, 25 bp, Mus musculus
gaacaggaatacaacaaactcaccg

SEQ ID NO: 98917 - DNA, 25 bp, Mus musculus
gaacaggagctggacgctaattccg

SEQ ID NO: 98918 - DNA, 25 bp, Mus musculus
gaacaggaggccatctctgatgtcc

SEQ ID NO: 98919 - DNA, 25 bp, Mus musculus
gaacaggcactctgataggctgcta

SEQ ID NO: 98920 - DNA, 25 bp, Mus musculus
gaacaggccaatgtactgctcagct

SEQ ID NO: 98921 - DNA, 25 bp, Mus musculus
gaacaggctcctgcttttggcccga

SEQ ID NO: 98922 - DNA, 25 bp, Mus musculus
gaacagggtatcatcgacagtgcct

SEQ ID NO: 98923 - DNA, 25 bp, Mus musculus
gaacagggtggaaacacctctccca

SEQ ID NO: 98924 - DNA, 25 bp, Mus musculus
gaacaggtaccgagatgtcagccct

SEQ ID NO: 98925 - DNA, 25 bp, Mus musculus
gaacaggtagtcttgccttgcaaac

SEQ ID NO: 98926 - DNA, 25 bp, Mus musculus
gaacaggtggccagtttccaggaag

SEQ ID NO: 98927 - DNA, 25 bp, Mus musculus
gaacagtaccagtttgtgcaccacg

SEQ ID NO: 98928 - DNA, 25 bp, Mus musculus
gaacagtacggtgacagcggtgaca

SEQ ID NO: 98929 - DNA, 25 bp, Mus musculus
gaacagtactgcttagtggccagcc

SEQ ID NO: 98930 - DNA, 25 bp, Mus musculus
gaacagtagtttggacaggcctacc

SEQ ID NO: 98931 - DNA, 25 bp, Mus musculus
gaacagtatcgtggctcagtcagca

SEQ ID NO: 98932 - DNA, 25 bp, Mus musculus
gaacagtatgtggtacctccaggga

SEQ ID NO: 98933 - DNA, 25 bp, Mus musculus
gaacagtcaagaggagtaaggcctg

SEQ ID NO: 98934 - DNA, 25 bp, Mus musculus
gaacagtcctttcaggagggcccca

SEQ ID NO: 98935 - DNA, 25 bp, Mus musculus
gaacagtcgagggaatacatggtcc

SEQ ID NO: 98936 - DNA, 25 bp, Mus musculus
gaacagtcgctatttcaggacctgg

SEQ ID NO: 98937 - DNA, 25 bp, Mus musculus
gaacagtctgcatgttgctgacccc

SEQ ID NO: 98938 - DNA, 25 bp, Mus musculus
gaacagtgacgaccacatctcagtg

SEQ ID NO: 98939 - DNA, 25 bp, Mus musculus
gaacagtgaggagcttcggtctcag

SEQ ID NO: 98940 - DNA, 25 bp, Mus musculus
gaacagtgccgaaaaatagctgcca

SEQ ID NO: 98941 - DNA, 25 bp, Mus musculus
gaacagtgcgcgtgcttgagcatcc

SEQ ID NO: 98942 - DNA, 25 bp, Mus musculus
gaacagtgctctattcaagttggga

SEQ ID NO: 98943 - DNA, 25 bp, Mus musculus
gaacagtgcttcgtatgtgctcagt

SEQ ID NO: 98944 - DNA, 25 bp, Mus musculus
gaacagtggcaaattcctccggaga

SEQ ID NO: 98945 - DNA, 25 bp, Mus musculus
gaacagtgggaaatttcttcgacgg

SEQ ID NO: 98946 - DNA, 25 bp, Mus musculus
gaacagtgtggtaagaaccgaggct

SEQ ID NO: 98947 - DNA, 25 bp, Mus musculus
gaacagttatttcctgacccatggc

SEQ ID NO: 98948 - DNA, 25 bp, Mus musculus
gaacagttcacatgagagctcacgg

SEQ ID NO: 98949 - DNA, 25 bp, Mus musculus
gaacagttcagcaccctctggagga

SEQ ID NO: 98950 - DNA, 25 bp, Mus musculus
gaacagttgggactattcagggacc

SEQ ID NO: 98951 - DNA, 25 bp, Mus musculus
gaacagttgttcatgacatcgccct

SEQ ID NO: 98952 - DNA, 25 bp, Mus musculus
gaacagtttaataatgccacgccca

SEQ ID NO: 98953 - DNA, 25 bp, Mus musculus
gaacagtttccacattgccagtaga

SEQ ID NO: 98954 - DNA, 25 bp, Mus musculus
gaacagtttctgatgttgcctcaac

SEQ ID NO: 98955 - DNA, 25 bp, Mus musculus
gaacagttttgctcacttgccagac

SEQ ID NO: 98956 - DNA, 25 bp, Mus musculus
gaacataaattgaatgggaaagtca

SEQ ID NO: 98957 - DNA, 25 bp, Mus musculus
gaacataagctggatactccgggca

SEQ ID NO: 98958 - DNA, 25 bp, Mus musculus
gaacataatggccttgtcggatgga

SEQ ID NO: 98959 - DNA, 25 bp, Mus musculus
gaacatacacctgtgggctgtgcga

SEQ ID NO: 98960 - DNA, 25 bp, Mus musculus
gaacatagaactccaacgtaaccgt

SEQ ID NO: 98961 - DNA, 25 bp, Mus musculus
gaacatagggtgcagagaccagcct

SEQ ID NO: 98962 - DNA, 25 bp, Mus musculus
gaacatagtggaggcttacgacccc

SEQ ID NO: 98963 - DNA, 25 bp, Mus musculus
gaacatatgtggacgacttgggaca

SEQ ID NO: 98964 - DNA, 25 bp, Mus musculus
gaacatatgttccttgggatgccac

SEQ ID NO: 98965 - DNA, 25 bp, Mus musculus
gaacatatgttcttggtctccagca

SEQ ID NO: 98966 - DNA, 25 bp, Mus musculus
gaacatattcataataactgatcac

SEQ ID NO: 98967 - DNA, 25 bp, Mus musculus
gaacatattgttcggatgctgctgg

SEQ ID NO: 98968 - DNA, 25 bp, Mus musculus
gaacatcaaaactcctcattcctga

SEQ ID NO: 98969 - DNA, 25 bp, Mus musculus
gaacatcaaagtgcctgggaacctg

SEQ ID NO: 98970 - DNA, 25 bp, Mus musculus
gaacatcaatctgacctgccaggga

SEQ ID NO: 98971 - DNA, 25 bp, Mus musculus
gaacatcacaagtgcctgatttgag

SEQ ID NO: 98972 - DNA, 25 bp, Mus musculus
gaacatcacgcagattgtgggccac

SEQ ID NO: 98973 - DNA, 25 bp, Mus musculus
gaacatcagcatcgatgagcgcagg

SEQ ID NO: 98974 - DNA, 25 bp, Mus musculus
gaacatcagtgccagacgcttcacc

SEQ ID NO: 98975 - DNA, 25 bp, Mus musculus
gaacatcattgtggcaacccctggg

SEQ ID NO: 98976 - DNA, 25 bp, Mus musculus
gaacatccatcaatgcaacacaaag

SEQ ID NO: 98977 - DNA, 25 bp, Mus musculus
gaacatcccaggtcactgagtggag

SEQ ID NO: 98978 - DNA, 25 bp, Mus musculus
gaacatccgccagtcggtgggcata

SEQ ID NO: 98979 - DNA, 25 bp, Mus musculus
gaacatcctgatcgacctatgccgg

SEQ ID NO: 98980 - DNA, 25 bp, Mus musculus
gaacatcctgcaggtccagagcctg

SEQ ID NO: 98981 - DNA, 25 bp, Mus musculus
gaacatcctggtgcaaacgctgtca

SEQ ID NO: 98982 - DNA, 25 bp, Mus musculus
gaacatcctgtgagcaaggtggcca

SEQ ID NO: 98983 - DNA, 25 bp, Mus musculus
gaacatccttccatcgcagagtcag

SEQ ID NO: 98984 - DNA, 25 bp, Mus musculus
gaacatcggacacttggaacagcgc

SEQ ID NO: 98985 - DNA, 25 bp, Mus musculus
gaacatcgtaggctgcaggatccag

SEQ ID NO: 98986 - DNA, 25 bp, Mus musculus
gaacatcgtccgagattggcttgag

SEQ ID NO: 98987 - DNA, 25 bp, Mus musculus
gaacatcgtgacagccatgaaggca

SEQ ID NO: 98988 - DNA, 25 bp, Mus musculus
gaacatctccgtttagggttgttag

SEQ ID NO: 98989 - DNA, 25 bp, Mus musculus
gaacatctcctactgctgaagccat

SEQ ID NO: 98990 - DNA, 25 bp, Mus musculus
gaacatctggaaggtgtcatcgacc

SEQ ID NO: 98991 - DNA, 25 bp, Mus musculus
gaacatctgtattatcccggccacc

SEQ ID NO: 98992 - DNA, 25 bp, Mus musculus
gaacatcttcttgcagagggagctg

SEQ ID NO: 98993 - DNA, 25 bp, Mus musculus
gaacatgaacctgctggccattcag

SEQ ID NO: 98994 - DNA, 25 bp, Mus musculus
gaacatgagttccaccgatgccaat

SEQ ID NO: 98995 - DNA, 25 bp, Mus musculus
gaacatgcctcaattcacttgtggg

SEQ ID NO: 98996 - DNA, 25 bp, Mus musculus
gaacatgctaccgaatgctcctggc

SEQ ID NO: 98997 - DNA, 25 bp, Mus musculus
gaacatggagctcaacgtgctggac

SEQ ID NO: 98998 - DNA, 25 bp, Mus musculus
gaacatggatgtcctcaggtgccca

SEQ ID NO: 98999 - DNA, 25 bp, Mus musculus
gaacatggcagcgtatgcacctacc

SEQ ID NO: 99000 - DNA, 25 bp, Mus musculus
gaacatggccaatgacattgatgag

SEQ ID NO: 99001 - DNA, 25 bp, Mus musculus
gaacatggccagtccagagtcaggg

SEQ ID NO: 99002 - DNA, 25 bp, Mus musculus
gaacatggccctctccattgcggag

SEQ ID NO: 99003 - DNA, 25 bp, Mus musculus
gaacatggccgctgcctgatagaag

SEQ ID NO: 99004 - DNA, 25 bp, Mus musculus
gaacatggcgagtatgagggcaacc

SEQ ID NO: 99005 - DNA, 25 bp, Mus musculus
gaacatggctcaagaaactaatcac

SEQ ID NO: 99006 - DNA, 25 bp, Mus musculus
gaacatggtgcctgtcaaggaccgg

SEQ ID NO: 99007 - DNA, 25 bp, Mus musculus
gaacatgtgactcttccaggtcccg

SEQ ID NO: 99008 - DNA, 25 bp, Mus musculus
gaacatgtgcaagttaaagcccctt

SEQ ID NO: 99009 - DNA, 25 bp, Mus musculus
gaacatgtgcgcatggtggacccca

SEQ ID NO: 99010 - DNA, 25 bp, Mus musculus
gaacatgttaactgctcttctggcc

SEQ ID NO: 99011 - DNA, 25 bp, Mus musculus
gaacattcaagatcaggccaaacac

SEQ ID NO: 99012 - DNA, 25 bp, Mus musculus
gaacattcatattgctctggctaca

SEQ ID NO: 99013 - DNA, 25 bp, Mus musculus
gaacattcctgctggcaagacctca

SEQ ID NO: 99014 - DNA, 25 bp, Mus musculus
gaacattccttctccaagggctgga

SEQ ID NO: 99015 - DNA, 25 bp, Mus musculus
gaacattcttgcagctcccaaaaac

SEQ ID NO: 99016 - DNA, 25 bp, Mus musculus
gaacattctttctgagctgctgtga

SEQ ID NO: 99017 - DNA, 25 bp, Mus musculus
gaacattgaaagagcacgatacctg

SEQ ID NO: 99018 - DNA, 25 bp, Mus musculus
gaacattgctggttggtcctgtcca

SEQ ID NO: 99019 - DNA, 25 bp, Mus musculus
gaacattggaaagtggtctcctgcc

SEQ ID NO: 99020 - DNA, 25 bp, Mus musculus
gaacattggcgacctgatccaggag

SEQ ID NO: 99021 - DNA, 25 bp, Mus musculus
gaacattggtgttacagctgtggcc

SEQ ID NO: 99022 - DNA, 25 bp, Mus musculus
gaacattgtcaagcgctgtggcctg

SEQ ID NO: 99023 - DNA, 25 bp, Mus musculus
gaacattgtccatcctgtgtgaagg

SEQ ID NO: 99024 - DNA, 25 bp, Mus musculus
gaacattgtggtggctgctgcagat

SEQ ID NO: 99025 - DNA, 25 bp, Mus musculus
gaacatttaagatctgagcactcat

SEQ ID NO: 99026 - DNA, 25 bp, Mus musculus
gaacatttgcgaactggccgcacgg

SEQ ID NO: 99027 - DNA, 25 bp, Mus musculus
gaaccaaaagatctggcggtgccac

SEQ ID NO: 99028 - DNA, 25 bp, Mus musculus
gaaccaaaatgtcctgagccttcca

SEQ ID NO: 99029 - DNA, 25 bp, Mus musculus
gaaccaaactcttaaatgggccaga

SEQ ID NO: 99030 - DNA, 25 bp, Mus musculus
gaaccaaagcctctaaggcctggag

SEQ ID NO: 99031 - DNA, 25 bp, Mus musculus
gaaccaactaaaggaactgcctgaa

SEQ ID NO: 99032 - DNA, 25 bp, Mus musculus
gaaccaagatctttaagcgcaccgc

SEQ ID NO: 99033 - DNA, 25 bp, Mus musculus
gaaccaaggcactgagaggcatcta

SEQ ID NO: 99034 - DNA, 25 bp, Mus musculus
gaaccaagtctttgcctacgtggag

SEQ ID NO: 99035 - DNA, 25 bp, Mus musculus
gaaccaagtttcatgatagatccag

SEQ ID NO: 99036 - DNA, 25 bp, Mus musculus
gaaccaatcaggctaagaagtcatg

SEQ ID NO: 99037 - DNA, 25 bp, Mus musculus
gaaccaatcgttccagtcgcagtag

SEQ ID NO: 99038 - DNA, 25 bp, Mus musculus
gaaccaatctcttccggagtcccag

SEQ ID NO: 99039 - DNA, 25 bp, Mus musculus
gaaccaatgattgcagcttgtagga

SEQ ID NO: 99040 - DNA, 25 bp, Mus musculus
gaaccaatggagttaagtgggcact

SEQ ID NO: 99041 - DNA, 25 bp, Mus musculus
gaaccaattctagggcaagaaaact

SEQ ID NO: 99042 - DNA, 25 bp, Mus musculus
gaaccacagaatgagataatccacc

SEQ ID NO: 99043 - DNA, 25 bp, Mus musculus
gaaccacagggttacatccaggcag

SEQ ID NO: 99044 - DNA, 25 bp, Mus musculus
gaaccacatgatgcctcggatgact

SEQ ID NO: 99045 - DNA, 25 bp, Mus musculus
gaaccacatgctgccctaaaggtag

SEQ ID NO: 99046 - DNA, 25 bp, Mus musculus
gaaccacatggccagagaacatgct

SEQ ID NO: 99047 - DNA, 25 bp, Mus musculus
gaaccaccattgagggcgtttaaga

SEQ ID NO: 99048 - DNA, 25 bp, Mus musculus
gaaccacccacaaggatggcagagg

SEQ ID NO: 99049 - DNA, 25 bp, Mus musculus
gaaccacccctgcttacagctttgg

SEQ ID NO: 99050 - DNA, 25 bp, Mus musculus
gaaccacctaagctggaagaaatgg

SEQ ID NO: 99051 - DNA, 25 bp, Mus musculus
gaaccacctcgaagcacaagctgtg

SEQ ID NO: 99052 - DNA, 25 bp, Mus musculus
gaaccacctgcttatgggcccatgt

SEQ ID NO: 99053 - DNA, 25 bp, Mus musculus
gaaccaccttgagtcaggacaacga

SEQ ID NO: 99054 - DNA, 25 bp, Mus musculus
gaaccacgagcaagaggcaagactt

SEQ ID NO: 99055 - DNA, 25 bp, Mus musculus
gaaccacgggacagcaagaatcaag

SEQ ID NO: 99056 - DNA, 25 bp, Mus musculus
gaaccacgggactggcaaccatagt

SEQ ID NO: 99057 - DNA, 25 bp, Mus musculus
gaaccacgtaggcacttttcgaagg

SEQ ID NO: 99058 - DNA, 25 bp, Mus musculus
gaaccacgtcggcatcattgtgaag

SEQ ID NO: 99059 - DNA, 25 bp, Mus musculus
gaaccacgttgttagtgcactgccc

SEQ ID NO: 99060 - DNA, 25 bp, Mus musculus
gaaccactgagatgaggagacctcc

SEQ ID NO: 99061 - DNA, 25 bp, Mus musculus
gaaccactgaggcaaggctgtagca

SEQ ID NO: 99062 - DNA, 25 bp, Mus musculus
gaaccactgcggaactatgacatcg

SEQ ID NO: 99063 - DNA, 25 bp, Mus musculus
gaaccagacacaccagggatcttcg

SEQ ID NO: 99064 - DNA, 25 bp, Mus musculus
gaaccagacatcaggaggctcgctg

SEQ ID NO: 99065 - DNA, 25 bp, Mus musculus
gaaccagagcccctagagtcagagg

SEQ ID NO: 99066 - DNA, 25 bp, Mus musculus
gaaccagagggaatgacgaagccca

SEQ ID NO: 99067 - DNA, 25 bp, Mus musculus
gaaccagatatctgtgcgggctgcc

SEQ ID NO: 99068 - DNA, 25 bp, Mus musculus
gaaccagatccacactggaatggaa

SEQ ID NO: 99069 - DNA, 25 bp, Mus musculus
gaaccagatgcaatgggcccaaaag

SEQ ID NO: 99070 - DNA, 25 bp, Mus musculus
gaaccagcacctgttaagaccatga

SEQ ID NO: 99071 - DNA, 25 bp, Mus musculus
gaaccagcacctttgagaggaagcc

SEQ ID NO: 99072 - DNA, 25 bp, Mus musculus
gaaccagctaatcccaacatgcctg

SEQ ID NO: 99073 - DNA, 25 bp, Mus musculus
gaaccagctgcgatccagaaacctt

SEQ ID NO: 99074 - DNA, 25 bp, Mus musculus
gaaccagctgcgcatgtacctgact

SEQ ID NO: 99075 - DNA, 25 bp, Mus musculus
gaaccagctggaccggattacagac

SEQ ID NO: 99076 - DNA, 25 bp, Mus musculus
gaaccagctggatctgctcatccgg

SEQ ID NO: 99077 - DNA, 25 bp, Mus musculus
gaaccagctggctcctagactaagg

SEQ ID NO: 99078 - DNA, 25 bp, Mus musculus
gaaccagggcaagtttcaggacgtg

SEQ ID NO: 99079 - DNA, 25 bp, Mus musculus
gaaccaggtagcgagattcaacgac

SEQ ID NO: 99080 - DNA, 25 bp, Mus musculus
gaaccaggtcatctttccagtcagc

SEQ ID NO: 99081 - DNA, 25 bp, Mus musculus
gaaccaggtcctttgagtgcctcga

SEQ ID NO: 99082 - DNA, 25 bp, Mus musculus
gaaccaggtgatcctgctccagcct

SEQ ID NO: 99083 - DNA, 25 bp, Mus musculus
gaaccagtacccagatgaagcaaag

SEQ ID NO: 99084 - DNA, 25 bp, Mus musculus
gaaccagtcggcaaatacgtgagga

SEQ ID NO: 99085 - DNA, 25 bp, Mus musculus
gaaccagtgatgtttccggagccat

SEQ ID NO: 99086 - DNA, 25 bp, Mus musculus
gaaccatcactacacgaaattggag

SEQ ID NO: 99087 - DNA, 25 bp, Mus musculus
gaaccatcatcaacgaattgggctg

SEQ ID NO: 99088 - DNA, 25 bp, Mus musculus
gaaccatctcccaaggaagtcagca

SEQ ID NO: 99089 - DNA, 25 bp, Mus musculus
gaaccatgagcgcatccctttcagg

SEQ ID NO: 99090 - DNA, 25 bp, Mus musculus
gaaccatgccggatctcctactact

SEQ ID NO: 99091 - DNA, 25 bp, Mus musculus
gaaccatgcctttttccaggaggaa

SEQ ID NO: 99092 - DNA, 25 bp, Mus musculus
gaaccatgcttactgtgggaaccct

SEQ ID NO: 99093 - DNA, 25 bp, Mus musculus
gaaccattgtcagcagaacagccaa

SEQ ID NO: 99094 - DNA, 25 bp, Mus musculus
gaacccaacaatgctgcacatggtg

SEQ ID NO: 99095 - DNA, 25 bp, Mus musculus
gaacccaaccttgtgcctgtgcgag

SEQ ID NO: 99096 - DNA, 25 bp, Mus musculus
gaacccaaggaggagtttcgctacg

SEQ ID NO: 99097 - DNA, 25 bp, Mus musculus
gaacccaaggtatcaacatgtcaag

SEQ ID NO: 99098 - DNA, 25 bp, Mus musculus
gaacccaatggtggcaggtttccag

SEQ ID NO: 99099 - DNA, 25 bp, Mus musculus
gaacccacgcggcaagattggcctg

SEQ ID NO: 99100 - DNA, 25 bp, Mus musculus
gaacccagaacctgctgtgtaccag

SEQ ID NO: 99101 - DNA, 25 bp, Mus musculus
gaacccagagatgaaagaaaattaa

SEQ ID NO: 99102 - DNA, 25 bp, Mus musculus
gaacccagccgagtgcaagcagcag

SEQ ID NO: 99103 - DNA, 25 bp, Mus musculus
gaacccagcgccaagtctaacaagt

SEQ ID NO: 99104 - DNA, 25 bp, Mus musculus
gaacccagcttcttcggtatttcgg

SEQ ID NO: 99105 - DNA, 25 bp, Mus musculus
gaacccagcttgtggacaggactct

SEQ ID NO: 99106 - DNA, 25 bp, Mus musculus
gaacccaggatggacccagaatctg

SEQ ID NO: 99107 - DNA, 25 bp, Mus musculus
gaacccagtatcagagtaatgcttg

SEQ ID NO: 99108 - DNA, 25 bp, Mus musculus
gaacccatatggctcacagacgtcc

SEQ ID NO: 99109 - DNA, 25 bp, Mus musculus
gaacccattcccagcttggaggcaa

SEQ ID NO: 99110 - DNA, 25 bp, Mus musculus
gaaccccaacgctttcgagacggat

SEQ ID NO: 99111 - DNA, 25 bp, Mus musculus
gaaccccaactacagagactctttt

SEQ ID NO: 99112 - DNA, 25 bp, Mus musculus
gaaccccattgaggccagtgtgctg

SEQ ID NO: 99113 - DNA, 25 bp, Mus musculus
gaaccccgaagaccctgttgaagtg

SEQ ID NO: 99114 - DNA, 25 bp, Mus musculus
gaaccccgctatgtggtgtccatgg

SEQ ID NO: 99115 - DNA, 25 bp, Mus musculus
gaaccccgtccataagtgctctgtg

SEQ ID NO: 99116 - DNA, 25 bp, Mus musculus
gaacccctcatgtgcctgtctatag

SEQ ID NO: 99117 - DNA, 25 bp, Mus musculus
gaacccctggcatttctagagcact

SEQ ID NO: 99118 - DNA, 25 bp, Mus musculus
gaaccccttcttaacgagcaatatg

SEQ ID NO: 99119 - DNA, 25 bp, Mus musculus
gaacccgacctcagagcagattgaa

SEQ ID NO: 99120 - DNA, 25 bp, Mus musculus
gaacccgagaccaacgtaggcaatg

SEQ ID NO: 99121 - DNA, 25 bp, Mus musculus
gaacccgctgtgaaatgtccctgta

SEQ ID NO: 99122 - DNA, 25 bp, Mus musculus
gaacccgtcatgctaagggctctgg

SEQ ID NO: 99123 - DNA, 25 bp, Mus musculus
gaaccctacatggatgagaacttca

SEQ ID NO: 99124 - DNA, 25 bp, Mus musculus
gaaccctcggtaggataagtgtgag

SEQ ID NO: 99125 - DNA, 25 bp, Mus musculus
gaaccctctggcattgtggtcgccc

SEQ ID NO: 99126 - DNA, 25 bp, Mus musculus
gaaccctctgtagatggagcacgag

SEQ ID NO: 99127 - DNA, 25 bp, Mus musculus
gaaccctgacatcactaaggctgga

SEQ ID NO: 99128 - DNA, 25 bp, Mus musculus
gaaccctgaggtgtcttggacaaaa

SEQ ID NO: 99129 - DNA, 25 bp, Mus musculus
gaaccctgctatgcggaagtgctga

SEQ ID NO: 99130 - DNA, 25 bp, Mus musculus
gaaccctgggctcccgtggagtact

SEQ ID NO: 99131 - DNA, 25 bp, Mus musculus
gaaccctggtctagtgagcaaagtg

SEQ ID NO: 99132 - DNA, 25 bp, Mus musculus
gaaccctgtctatctctggtagccc

SEQ ID NO: 99133 - DNA, 25 bp, Mus musculus
gaaccctgtctccagcttgtggcta

SEQ ID NO: 99134 - DNA, 25 bp, Mus musculus
gaaccctgtggttccatatcagaaa

SEQ ID NO: 99135 - DNA, 25 bp, Mus musculus
gaaccctgtttatagccccgtgcaa

SEQ ID NO: 99136 - DNA, 25 bp, Mus musculus
gaacccttcatcgacgccaagtatg

SEQ ID NO: 99137 - DNA, 25 bp, Mus musculus
gaacccttgacttctacggagtgga

SEQ ID NO: 99138 - DNA, 25 bp, Mus musculus
gaacccttgagctgggtcttgaagg

SEQ ID NO: 99139 - DNA, 25 bp, Mus musculus
gaacccttggaggaacatggcaact

SEQ ID NO: 99140 - DNA, 25 bp, Mus musculus
gaaccctttgactcggagaccagga

SEQ ID NO: 99141 - DNA, 25 bp, Mus musculus
gaaccctttgacttcactctggatg

SEQ ID NO: 99142 - DNA, 25 bp, Mus musculus
gaacccttttgatcaagatgcagtg

SEQ ID NO: 99143 - DNA, 25 bp, Mus musculus
gaaccgaagtaaaacagatgcctga

SEQ ID NO: 99144 - DNA, 25 bp, Mus musculus
gaaccgactgcccttcgggagacta

SEQ ID NO: 99145 - DNA, 25 bp, Mus musculus
gaaccgagtgtgtgcttgcgaagct

SEQ ID NO: 99146 - DNA, 25 bp, Mus musculus
gaaccgatacacaaccatgaagcag

SEQ ID NO: 99147 - DNA, 25 bp, Mus musculus
gaaccgcacggctgtcgaaatactg

SEQ ID NO: 99148 - DNA, 25 bp, Mus musculus
gaaccgcagttccagttcgcacgtg

SEQ ID NO: 99149 - DNA, 25 bp, Mus musculus
gaaccgcccatgatctattctgaat

SEQ ID NO: 99150 - DNA, 25 bp, Mus musculus
gaaccgccgtctgacttagccagtg

SEQ ID NO: 99151 - DNA, 25 bp, Mus musculus
gaaccgcctggtgataggaggcccc

SEQ ID NO: 99152 - DNA, 25 bp, Mus musculus
gaaccgcgagctggttgcaacctat

SEQ ID NO: 99153 - DNA, 25 bp, Mus musculus
gaaccgcgctacacattgctggtgg

SEQ ID NO: 99154 - DNA, 25 bp, Mus musculus
gaaccgctgatgcttaagatcccca

SEQ ID NO: 99155 - DNA, 25 bp, Mus musculus
gaaccgctggttggaacatccctat

SEQ ID NO: 99156 - DNA, 25 bp, Mus musculus
gaaccgctgtatagtctgagacctg

SEQ ID NO: 99157 - DNA, 25 bp, Mus musculus
gaaccgcttggcaggacagaaccat

SEQ ID NO: 99158 - DNA, 25 bp, Mus musculus
gaaccggacattccctgacaacgtg

SEQ ID NO: 99159 - DNA, 25 bp, Mus musculus
gaaccggacctctgcgcaatttaga

SEQ ID NO: 99160 - DNA, 25 bp, Mus musculus
gaaccggcagatgcttcaggagttg

SEQ ID NO: 99161 - DNA, 25 bp, Mus musculus
gaaccggctgtgtcgcttggtgact

SEQ ID NO: 99162 - DNA, 25 bp, Mus musculus
gaaccgggagatgctggaacttcta

SEQ ID NO: 99163 - DNA, 25 bp, Mus musculus
gaaccgggcaaatggaaggtcgctt

SEQ ID NO: 99164 - DNA, 25 bp, Mus musculus
gaaccgggtcattatctatcaagaa

SEQ ID NO: 99165 - DNA, 25 bp, Mus musculus
gaaccggttattcagggaagatgac

SEQ ID NO: 99166 - DNA, 25 bp, Mus musculus
gaaccgtaagcttatacaggaccag

SEQ ID NO: 99167 - DNA, 25 bp, Mus musculus
gaaccgtgaatgaactcgcaggcag

SEQ ID NO: 99168 - DNA, 25 bp, Mus musculus
gaaccgtggcatgttcatgaaacct

SEQ ID NO: 99169 - DNA, 25 bp, Mus musculus
gaaccgtgggaatgagtctctgcca

SEQ ID NO: 99170 - DNA, 25 bp, Mus musculus
gaaccgtgtcctgcagaactctagg

SEQ ID NO: 99171 - DNA, 25 bp, Mus musculus
gaaccgttttagctgctcactctgg

SEQ ID NO: 99172 - DNA, 25 bp, Mus musculus
gaacctacacttttttgcaccagag

SEQ ID NO: 99173 - DNA, 25 bp, Mus musculus
gaacctacggagatgctgactctaa

SEQ ID NO: 99174 - DNA, 25 bp, Mus musculus
gaacctacggcagcttgggtccaag

SEQ ID NO: 99175 - DNA, 25 bp, Mus musculus
gaacctacgtctgtggcagtaccgc

SEQ ID NO: 99176 - DNA, 25 bp, Mus musculus
gaacctagagcctttcactgtgtga

SEQ ID NO: 99177 - DNA, 25 bp, Mus musculus
gaacctattgaatctgggaagctgc

SEQ ID NO: 99178 - DNA, 25 bp, Mus musculus
gaacctattgcgagggaagcgagac

SEQ ID NO: 99179 - DNA, 25 bp, Mus musculus
gaacctcaactctgcatacagacca

SEQ ID NO: 99180 - DNA, 25 bp, Mus musculus
gaacctcagcagagatgacggacag

SEQ ID NO: 99181 - DNA, 25 bp, Mus musculus
gaacctcagctcgttaggcaggaag

SEQ ID NO: 99182 - DNA, 25 bp, Mus musculus
gaacctcaggcttgacctgcagagg

SEQ ID NO: 99183 - DNA, 25 bp, Mus musculus
gaacctcagtggatgtatggacccc

SEQ ID NO: 99184 - DNA, 25 bp, Mus musculus
gaacctcatagacttcacccaggaa

SEQ ID NO: 99185 - DNA, 25 bp, Mus musculus
gaacctcatggatgtgctgcagcgg

SEQ ID NO: 99186 - DNA, 25 bp, Mus musculus
gaacctcattcagatccacggcagg

SEQ ID NO: 99187 - DNA, 25 bp, Mus musculus
gaacctcctcttatgggacctcggg

SEQ ID NO: 99188 - DNA, 25 bp, Mus musculus
gaacctcctggtcagtgcctttgtg

SEQ ID NO: 99189 - DNA, 25 bp, Mus musculus
gaacctcgagttctgactgatatgg

SEQ ID NO: 99190 - DNA, 25 bp, Mus musculus
gaacctcgggaggagctcaaggtct

SEQ ID NO: 99191 - DNA, 25 bp, Mus musculus
gaacctcgtcttattgaggctcagg

SEQ ID NO: 99192 - DNA, 25 bp, Mus musculus
gaacctctgccccaaacactagaga

SEQ ID NO: 99193 - DNA, 25 bp, Mus musculus
gaacctctggctgtcgctgatgcta

SEQ ID NO: 99194 - DNA, 25 bp, Mus musculus
gaacctctgggaaaagcaatctgtg

SEQ ID NO: 99195 - DNA, 25 bp, Mus musculus
gaacctcttggtcggaaaactcata

SEQ ID NO: 99196 - DNA, 25 bp, Mus musculus
gaacctgaaactgatgatgaacctg

SEQ ID NO: 99197 - DNA, 25 bp, Mus musculus
gaacctgaaccagcatctgaccgtg

SEQ ID NO: 99198 - DNA, 25 bp, Mus musculus
gaacctgaatgaagtcgtgtctgcc

SEQ ID NO: 99199 - DNA, 25 bp, Mus musculus
gaacctgacagaactcgatctaatg

SEQ ID NO: 99200 - DNA, 25 bp, Mus musculus
gaacctgacgatttacacgggcctg

SEQ ID NO: 99201 - DNA, 25 bp, Mus musculus
gaacctgactctagtggacctgcca

SEQ ID NO: 99202 - DNA, 25 bp, Mus musculus
gaacctgagctcatggcggatagac

SEQ ID NO: 99203 - DNA, 25 bp, Mus musculus
gaacctgagggagctaactgaagcc

SEQ ID NO: 99204 - DNA, 25 bp, Mus musculus
gaacctgagtggcttccgtgaatcc

SEQ ID NO: 99205 - DNA, 25 bp, Mus musculus
gaacctgcaactggagagccttcgc

SEQ ID NO: 99206 - DNA, 25 bp, Mus musculus
gaacctgcaggtatctgacacagca

SEQ ID NO: 99207 - DNA, 25 bp, Mus musculus
gaacctgccagtctctgaggtatga

SEQ ID NO: 99208 - DNA, 25 bp, Mus musculus
gaacctgcccttgcgcagatgcaga

SEQ ID NO: 99209 - DNA, 25 bp, Mus musculus
gaacctgcctgggaattatgcctgt

SEQ ID NO: 99210 - DNA, 25 bp, Mus musculus
gaacctgctagcagccgaggccaag

SEQ ID NO: 99211 - DNA, 25 bp, Mus musculus
gaacctgctcgagggccaggatgct

SEQ ID NO: 99212 - DNA, 25 bp, Mus musculus
gaacctgctgatgttggactccgaa

SEQ ID NO: 99213 - DNA, 25 bp, Mus musculus
gaacctgctgcacatggacttccag

SEQ ID NO: 99214 - DNA, 25 bp, Mus musculus
gaacctggaacagtccactgaacgg

SEQ ID NO: 99215 - DNA, 25 bp, Mus musculus
gaacctggaagaggcgaagcacaag

SEQ ID NO: 99216 - DNA, 25 bp, Mus musculus
gaacctggagttccaaggtcccctg

SEQ ID NO: 99217 - DNA, 25 bp, Mus musculus
gaacctggataagcaaacgtctgtg

SEQ ID NO: 99218 - DNA, 25 bp, Mus musculus
gaacctggatgactgtgcagctgcc

SEQ ID NO: 99219 - DNA, 25 bp, Mus musculus
gaacctggcccagaagacgaactct

SEQ ID NO: 99220 - DNA, 25 bp, Mus musculus
gaacctggcgcgcaagatcgcctct

SEQ ID NO: 99221 - DNA, 25 bp, Mus musculus
gaacctggctgtatgtgcatgctcc

SEQ ID NO: 99222 - DNA, 25 bp, Mus musculus
gaacctgggcattggcaagatcact

SEQ ID NO: 99223 - DNA, 25 bp, Mus musculus
gaacctggtagaggctgattactcc

SEQ ID NO: 99224 - DNA, 25 bp, Mus musculus
gaacctggtgaaaggaggatccaca

SEQ ID NO: 99225 - DNA, 25 bp, Mus musculus
gaacctggtgtatgggaaggccaat

SEQ ID NO: 99226 - DNA, 25 bp, Mus musculus
gaacctgtctccagcgctctgagag

SEQ ID NO: 99227 - DNA, 25 bp, Mus musculus
gaacctgtctgtgcactgggccttg

SEQ ID NO: 99228 - DNA, 25 bp, Mus musculus
gaacctgtgccgagaagaagccaaa

SEQ ID NO: 99229 - DNA, 25 bp, Mus musculus
gaacctgtgctttgcagtaggccta

SEQ ID NO: 99230 - DNA, 25 bp, Mus musculus
gaacctgtggacgtactggaagcct

SEQ ID NO: 99231 - DNA, 25 bp, Mus musculus
gaacctgtggagtacatgaacttat

SEQ ID NO: 99232 - DNA, 25 bp, Mus musculus
gaacctgtggatgaatcgtatgccc

SEQ ID NO: 99233 - DNA, 25 bp, Mus musculus
gaacctgttatcctggacttgagag

SEQ ID NO: 99234 - DNA, 25 bp, Mus musculus
gaacctgttgttttgggcactgtta

SEQ ID NO: 99235 - DNA, 25 bp, Mus musculus
gaaccttaaagtgattgccctggca

SEQ ID NO: 99236 - DNA, 25 bp, Mus musculus
gaaccttaatgagaacagcaacggg

SEQ ID NO: 99237 - DNA, 25 bp, Mus musculus
gaaccttaatgctaacttgcccttg

SEQ ID NO: 99238 - DNA, 25 bp, Mus musculus
gaaccttagcttctgggatgcccct

SEQ ID NO: 99239 - DNA, 25 bp, Mus musculus
gaaccttcgcatcagggaaaacaga

SEQ ID NO: 99240 - DNA, 25 bp, Mus musculus
gaaccttcgttgactatgcccagaa

SEQ ID NO: 99241 - DNA, 25 bp, Mus musculus
gaaccttggcctgaaaatgcgacct

SEQ ID NO: 99242 - DNA, 25 bp, Mus musculus
gaaccttggcctgaccaggctggct

SEQ ID NO: 99243 - DNA, 25 bp, Mus musculus
gaaccttgtgtgctctcatcgggcc

SEQ ID NO: 99244 - DNA, 25 bp, Mus musculus
gaaccttgtttctcttcaactgaga

SEQ ID NO: 99245 - DNA, 25 bp, Mus musculus
gaacctttaggtctcttttgctcga

SEQ ID NO: 99246 - DNA, 25 bp, Mus musculus
gaacctttgagcacagcggaagcac

SEQ ID NO: 99247 - DNA, 25 bp, Mus musculus
gaacctttggatgatgagtatgaca

SEQ ID NO: 99248 - DNA, 25 bp, Mus musculus
gaacgaaatgcctgcctattgccgg

SEQ ID NO: 99249 - DNA, 25 bp, Mus musculus
gaacgaacctatctctgctgcaatg

SEQ ID NO: 99250 - DNA, 25 bp, Mus musculus
gaacgaagctcagtaacacaaactc

SEQ ID NO: 99251 - DNA, 25 bp, Mus musculus
gaacgacaggattcgattccaggcc

SEQ ID NO: 99252 - DNA, 25 bp, Mus musculus
gaacgacatacgctatcagagactg

SEQ ID NO: 99253 - DNA, 25 bp, Mus musculus
gaacgacatcgccatcatcaagttg

SEQ ID NO: 99254 - DNA, 25 bp, Mus musculus
gaacgacgagcttcagtcacggaaa

SEQ ID NO: 99255 - DNA, 25 bp, Mus musculus
gaacgacgtgcgctttacagatact

SEQ ID NO: 99256 - DNA, 25 bp, Mus musculus
gaacgactacgtgcacgcgctggtg

SEQ ID NO: 99257 - DNA, 25 bp, Mus musculus
gaacgactcatttgccagcgtgaag

SEQ ID NO: 99258 - DNA, 25 bp, Mus musculus
gaacgactgctggatcgaaaccagg

SEQ ID NO: 99259 - DNA, 25 bp, Mus musculus
gaacgactttgtcagtgccgagatg

SEQ ID NO: 99260 - DNA, 25 bp, Mus musculus
gaacgagaaatggaaatcccttgac

SEQ ID NO: 99261 - DNA, 25 bp, Mus musculus
gaacgagaaggccagagactgcctg

SEQ ID NO: 99262 - DNA, 25 bp, Mus musculus
gaacgagacattgcgatggcgacca

SEQ ID NO: 99263 - DNA, 25 bp, Mus musculus
gaacgagcaggctattccttggaga

SEQ ID NO: 99264 - DNA, 25 bp, Mus musculus
gaacgagccaagatcgatgacccca

SEQ ID NO: 99265 - DNA, 25 bp, Mus musculus
gaacgagccgatcgacctgtcaaag

SEQ ID NO: 99266 - DNA, 25 bp, Mus musculus
gaacgagctgggagatgcaactgcc

SEQ ID NO: 99267 - DNA, 25 bp, Mus musculus
gaacgaggccctgaagtacctgaat

SEQ ID NO: 99268 - DNA, 25 bp, Mus musculus
gaacgaggcctgactggaccatcag

SEQ ID NO: 99269 - DNA, 25 bp, Mus musculus
gaacgaggctcttcgaaggcacata

SEQ ID NO: 99270 - DNA, 25 bp, Mus musculus
gaacgaggttcaggatcccgtggaa

SEQ ID NO: 99271 - DNA, 25 bp, Mus musculus
gaacgagtagcttttgtgtccagag

SEQ ID NO: 99272 - DNA, 25 bp, Mus musculus
gaacgagtcttcactcctgctggag

SEQ ID NO: 99273 - DNA, 25 bp, Mus musculus
gaacgagtcttgttagccctacatg

SEQ ID NO: 99274 - DNA, 25 bp, Mus musculus
gaacgagtgcgaaactgagaatccc

SEQ ID NO: 99275 - DNA, 25 bp, Mus musculus
gaacgatgacccttccaaaatggtt

SEQ ID NO: 99276 - DNA, 25 bp, Mus musculus
gaacgattcgtgtacggtggctgcc

SEQ ID NO: 99277 - DNA, 25 bp, Mus musculus
gaacgattgctttgccccatcagga

SEQ ID NO: 99278 - DNA, 25 bp, Mus musculus
gaacgattgtaaaaatagagccacc

SEQ ID NO: 99279 - DNA, 25 bp, Mus musculus
gaacgcaagttcagcccctggattg

SEQ ID NO: 99280 - DNA, 25 bp, Mus musculus
gaacgcaattctcttggcacctggg

SEQ ID NO: 99281 - DNA, 25 bp, Mus musculus
gaacgcaccattacagtgaaaggca

SEQ ID NO: 99282 - DNA, 25 bp, Mus musculus
gaacgcacggaggtgcttcgctcct

SEQ ID NO: 99283 - DNA, 25 bp, Mus musculus
gaacgcactgggtttcttagagaac

SEQ ID NO: 99284 - DNA, 25 bp, Mus musculus
gaacgcactttgactctgcaggaga

SEQ ID NO: 99285 - DNA, 25 bp, Mus musculus
gaacgcaggtctgtgccttagagaa

SEQ ID NO: 99286 - DNA, 25 bp, Mus musculus
gaacgcattccagattggaggccat

SEQ ID NO: 99287 - DNA, 25 bp, Mus musculus
gaacgcatttgcagatcaccctcat

SEQ ID NO: 99288 - DNA, 25 bp, Mus musculus
gaacgccaaggagtgttcctgccaa

SEQ ID NO: 99289 - DNA, 25 bp, Mus musculus
gaacgccagacctgccttagaagag

SEQ ID NO: 99290 - DNA, 25 bp, Mus musculus
gaacgccatcatgaacaagaactcg

SEQ ID NO: 99291 - DNA, 25 bp, Mus musculus
gaacgccatccttattggaatgagc

SEQ ID NO: 99292 - DNA, 25 bp, Mus musculus
gaacgcctgccgattaggtattacc

SEQ ID NO: 99293 - DNA, 25 bp, Mus musculus
gaacgccttgcacagtatgagtcca

SEQ ID NO: 99294 - DNA, 25 bp, Mus musculus
gaacgcgctgggtagcagaactgaa

SEQ ID NO: 99295 - DNA, 25 bp, Mus musculus
gaacgcggagtcactactagaggct

SEQ ID NO: 99296 - DNA, 25 bp, Mus musculus
gaacgcgtcacctatgcagaactga

SEQ ID NO: 99297 - DNA, 25 bp, Mus musculus
gaacgcgtcggtgtgcactgtgaac

SEQ ID NO: 99298 - DNA, 25 bp, Mus musculus
gaacgcgttctcagctcgaactctg

SEQ ID NO: 99299 - DNA, 25 bp, Mus musculus
gaacgcgtttgctatgactctgacc

SEQ ID NO: 99300 - DNA, 25 bp, Mus musculus
gaacgcgttttcctactgcactggg

SEQ ID NO: 99301 - DNA, 25 bp, Mus musculus
gaacgctactactgcttccagggta

SEQ ID NO: 99302 - DNA, 25 bp, Mus musculus
gaacgctatgttcacactttcaagg

SEQ ID NO: 99303 - DNA, 25 bp, Mus musculus
gaacgctgcacctttcaggacagtg

SEQ ID NO: 99304 - DNA, 25 bp, Mus musculus
gaacgctgggaactctacgacatca

SEQ ID NO: 99305 - DNA, 25 bp, Mus musculus
gaacgctgtggactccaaaccactg

SEQ ID NO: 99306 - DNA, 25 bp, Mus musculus
gaacgcttcctgactttcaaggcct

SEQ ID NO: 99307 - DNA, 25 bp, Mus musculus
gaacggaacagagatagaatggtcc

SEQ ID NO: 99308 - DNA, 25 bp, Mus musculus
gaacggaagaaaagtcttacatgga

SEQ ID NO: 99309 - DNA, 25 bp, Mus musculus
gaacggagaagccagacatctgctc

SEQ ID NO: 99310 - DNA, 25 bp, Mus musculus
gaacggatccgcagtgtcttggatg

SEQ ID NO: 99311 - DNA, 25 bp, Mus musculus
gaacggatcgatgtgttcagccccg

SEQ ID NO: 99312 - DNA, 25 bp, Mus musculus
gaacggattgctgcggatgaagaca

SEQ ID NO: 99313 - DNA, 25 bp, Mus musculus
gaacggcacgtgatcttcgccagga

SEQ ID NO: 99314 - DNA, 25 bp, Mus musculus
gaacggcatgatcatcaacgtgctg

SEQ ID NO: 99315 - DNA, 25 bp, Mus musculus
gaacggcattggcattctgacgcta

SEQ ID NO: 99316 - DNA, 25 bp, Mus musculus
gaacggcccacatatccagagctta

SEQ ID NO: 99317 - DNA, 25 bp, Mus musculus
gaacggccggatgctctctagttgt

SEQ ID NO: 99318 - DNA, 25 bp, Mus musculus
gaacggcctcacctgaacctttggt

SEQ ID NO: 99319 - DNA, 25 bp, Mus musculus
gaacggcttccccaagaagttgcta

SEQ ID NO: 99320 - DNA, 25 bp, Mus musculus
gaacgggacagcacgctttgaatgc

SEQ ID NO: 99321 - DNA, 25 bp, Mus musculus
gaacgggaccatggaagacaaacca

SEQ ID NO: 99322 - DNA, 25 bp, Mus musculus
gaacgggatgcagtgaaggacctcc

SEQ ID NO: 99323 - DNA, 25 bp, Mus musculus
gaacgggccaacagcctagacaatg

SEQ ID NO: 99324 - DNA, 25 bp, Mus musculus
gaacgggcctccttcatcactgatg

SEQ ID NO: 99325 - DNA, 25 bp, Mus musculus
gaacgggctgattcaactggtgcca

SEQ ID NO: 99326 - DNA, 25 bp, Mus musculus
gaacggtaccccatgttcacagtgg

SEQ ID NO: 99327 - DNA, 25 bp, Mus musculus
gaacggtataaatttgacatccccg

SEQ ID NO: 99328 - DNA, 25 bp, Mus musculus
gaacggtattcagtgggcctcctgg

SEQ ID NO: 99329 - DNA, 25 bp, Mus musculus
gaacggtattcttggagtcagctga

SEQ ID NO: 99330 - DNA, 25 bp, Mus musculus
gaacggtctcaacctctggtcgcaa

SEQ ID NO: 99331 - DNA, 25 bp, Mus musculus
gaacggtgatccacagtgcagacat

SEQ ID NO: 99332 - DNA, 25 bp, Mus musculus
gaacggtggaaaagctcagtgcatg

SEQ ID NO: 99333 - DNA, 25 bp, Mus musculus
gaacggtgtcctcatagacagcatg

SEQ ID NO: 99334 - DNA, 25 bp, Mus musculus
gaacggtgtctactccaaaggtcag

SEQ ID NO: 99335 - DNA, 25 bp, Mus musculus
gaacgtactgtagaggtcgcatgct

SEQ ID NO: 99336 - DNA, 25 bp, Mus musculus
gaacgtcatctttgctgctcagaag

SEQ ID NO: 99337 - DNA, 25 bp, Mus musculus
gaacgtcatgagcatagcgatccca

SEQ ID NO: 99338 - DNA, 25 bp, Mus musculus
gaacgtcattgaagcattgcgcgaa

SEQ ID NO: 99339 - DNA, 25 bp, Mus musculus
gaacgtccacagctactttgcagag

SEQ ID NO: 99340 - DNA, 25 bp, Mus musculus
gaacgtctaaggagtgtgcggaaca

SEQ ID NO: 99341 - DNA, 25 bp, Mus musculus
gaacgtctagggtgtgatattgccc

SEQ ID NO: 99342 - DNA, 25 bp, Mus musculus
gaacgtctcggaggtcaggtccatg

SEQ ID NO: 99343 - DNA, 25 bp, Mus musculus
gaacgtctgcgagagtttgcatgca

SEQ ID NO: 99344 - DNA, 25 bp, Mus musculus
gaacgtcttcatgagtcacacacag

SEQ ID NO: 99345 - DNA, 25 bp, Mus musculus
gaacgtcttctatgaggacagcgtg

SEQ ID NO: 99346 - DNA, 25 bp, Mus musculus
gaacgtgaccctgaaaagtgctgct

SEQ ID NO: 99347 - DNA, 25 bp, Mus musculus
gaacgtgagattgtgcgcgacatca

SEQ ID NO: 99348 - DNA, 25 bp, Mus musculus
gaacgtgagctcttactcggcaaag

SEQ ID NO: 99349 - DNA, 25 bp, Mus musculus
gaacgtgcagcgatccacaactacc

SEQ ID NO: 99350 - DNA, 25 bp, Mus musculus
gaacgtgcattgtgattggcctgta

SEQ ID NO: 99351 - DNA, 25 bp, Mus musculus
gaacgtgcccgtaacgggcaactct

SEQ ID NO: 99352 - DNA, 25 bp, Mus musculus
gaacgtgcggagaaacgacagactc

SEQ ID NO: 99353 - DNA, 25 bp, Mus musculus
gaacgtgctgcaaaacttgacagga

SEQ ID NO: 99354 - DNA, 25 bp, Mus musculus
gaacgtggagttggcctttctggca

SEQ ID NO: 99355 - DNA, 25 bp, Mus musculus
gaacgtggcagacactgccccgtgt

SEQ ID NO: 99356 - DNA, 25 bp, Mus musculus
gaacgtgggcgtctagctgcttctc

SEQ ID NO: 99357 - DNA, 25 bp, Mus musculus
gaacgtggttcctgactcgactgga

SEQ ID NO: 99358 - DNA, 25 bp, Mus musculus
gaacgtgtgccgatgtcttccgctt

SEQ ID NO: 99359 - DNA, 25 bp, Mus musculus
gaacgttacaagtccagtgtcgcta

SEQ ID NO: 99360 - DNA, 25 bp, Mus musculus
gaacgttccccagcttttggactga

SEQ ID NO: 99361 - DNA, 25 bp, Mus musculus
gaacgttcctcaggccttcatatgc

SEQ ID NO: 99362 - DNA, 25 bp, Mus musculus
gaacgttctgcgtgatcctcgggct

SEQ ID NO: 99363 - DNA, 25 bp, Mus musculus
gaacgttgttgtctccccacatggg

SEQ ID NO: 99364 - DNA, 25 bp, Mus musculus
gaacgttttctctgcatttgcccgg

SEQ ID NO: 99365 - DNA, 25 bp, Mus musculus
gaactaaaccgtagagggcaacagg

SEQ ID NO: 99366 - DNA, 25 bp, Mus musculus
gaactaacagtagctctcctctggg

SEQ ID NO: 99367 - DNA, 25 bp, Mus musculus
gaactaagactgttggtgcgggaca

SEQ ID NO: 99368 - DNA, 25 bp, Mus musculus
gaactaagtgcaacaaaagatgtcc

SEQ ID NO: 99369 - DNA, 25 bp, Mus musculus
gaactacagaagaagctacaggaag

SEQ ID NO: 99370 - DNA, 25 bp, Mus musculus
gaactacagcagattggtgaccaga

SEQ ID NO: 99371 - DNA, 25 bp, Mus musculus
gaactacatataaacctgccactgg

SEQ ID NO: 99372 - DNA, 25 bp, Mus musculus
gaactaccggaacttggtctctgtg

SEQ ID NO: 99373 - DNA, 25 bp, Mus musculus
gaactacgtgactcccattgaagac

SEQ ID NO: 99374 - DNA, 25 bp, Mus musculus
gaactacgtttcaagaccgcggaga

SEQ ID NO: 99375 - DNA, 25 bp, Mus musculus
gaactactatccagtgacgcaatga

SEQ ID NO: 99376 - DNA, 25 bp, Mus musculus
gaactactgccagctaagtggaaca

SEQ ID NO: 99377 - DNA, 25 bp, Mus musculus
gaactactggtctaatctcctggga

SEQ ID NO: 99378 - DNA, 25 bp, Mus musculus
gaactacttcacttggacacggaga

SEQ ID NO: 99379 - DNA, 25 bp, Mus musculus
gaactacttcattggtggctgcgcg

SEQ ID NO: 99380 - DNA, 25 bp, Mus musculus
gaactacttcggcaaaaccagaggg

SEQ ID NO: 99381 - DNA, 25 bp, Mus musculus
gaactagaaaatgagcggtgggccc

SEQ ID NO: 99382 - DNA, 25 bp, Mus musculus
gaactagatgaccagatccaggcca

SEQ ID NO: 99383 - DNA, 25 bp, Mus musculus
gaactagcatattactttactctta

SEQ ID NO: 99384 - DNA, 25 bp, Mus musculus
gaactagctctggtttcggatgcgg

SEQ ID NO: 99385 - DNA, 25 bp, Mus musculus
gaactagctgtaacttgaacaagga

SEQ ID NO: 99386 - DNA, 25 bp, Mus musculus
gaactagcttgggttgctgaaacca

SEQ ID NO: 99387 - DNA, 25 bp, Mus musculus
gaactaggaattggatgcttgcctt

SEQ ID NO: 99388 - DNA, 25 bp, Mus musculus
gaactagggctgaatgtcacatgaa

SEQ ID NO: 99389 - DNA, 25 bp, Mus musculus
gaactagtttgtctgccttgccata

SEQ ID NO: 99390 - DNA, 25 bp, Mus musculus
gaactatacctgctcggactctgag

SEQ ID NO: 99391 - DNA, 25 bp, Mus musculus
gaactatatccaggtgacaccgcag

SEQ ID NO: 99392 - DNA, 25 bp, Mus musculus
gaactatcaccgtccataagaccga

SEQ ID NO: 99393 - DNA, 25 bp, Mus musculus
gaactatgaacaaagaatacgcgag

SEQ ID NO: 99394 - DNA, 25 bp, Mus musculus
gaactatgcagaaagcgggacggct

SEQ ID NO: 99395 - DNA, 25 bp, Mus musculus
gaactatgtttttatcactttgtgg

SEQ ID NO: 99396 - DNA, 25 bp, Mus musculus
gaactattattcttcagagacggaa

SEQ ID NO: 99397 - DNA, 25 bp, Mus musculus
gaactattcgtgttgctgagctaaa

SEQ ID NO: 99398 - DNA, 25 bp, Mus musculus
gaactattgttaatacctggctcac

SEQ ID NO: 99399 - DNA, 25 bp, Mus musculus
gaactatttccggtttgctggacag

SEQ ID NO: 99400 - DNA, 25 bp, Mus musculus
gaactcaaaaacacaccaactgctg

SEQ ID NO: 99401 - DNA, 25 bp, Mus musculus
gaactcaaaacatacctcgggacgt

SEQ ID NO: 99402 - DNA, 25 bp, Mus musculus
gaactcaactgatgctctctgggat

SEQ ID NO: 99403 - DNA, 25 bp, Mus musculus
gaactcaagcggcattacaacctgg

SEQ ID NO: 99404 - DNA, 25 bp, Mus musculus
gaactcaggctaatggcgaccatgc

SEQ ID NO: 99405 - DNA, 25 bp, Mus musculus
gaactcaggcttttccgagcgagga

SEQ ID NO: 99406 - DNA, 25 bp, Mus musculus
gaactcatagccttgctgctggagg

SEQ ID NO: 99407 - DNA, 25 bp, Mus musculus
gaactcatctttgctggaggagccc

SEQ ID NO: 99408 - DNA, 25 bp, Mus musculus
gaactcatgatggttggagacctcc

SEQ ID NO: 99409 - DNA, 25 bp, Mus musculus
gaactcattgaagactggcgccaga

SEQ ID NO: 99410 - DNA, 25 bp, Mus musculus
gaactccaaagatcgcgaagacgct

SEQ ID NO: 99411 - DNA, 25 bp, Mus musculus
gaactccaaagatcgtgtgtacatc

SEQ ID NO: 99412 - DNA, 25 bp, Mus musculus
gaactccaaagtggactgcaacggg

SEQ ID NO: 99413 - DNA, 25 bp, Mus musculus
gaactccaagagtgatcgaggcatg

SEQ ID NO: 99414 - DNA, 25 bp, Mus musculus
gaactccagcatgtgtctagaggac

SEQ ID NO: 99415 - DNA, 25 bp, Mus musculus
gaactccagccttgagatgacgaca

SEQ ID NO: 99416 - DNA, 25 bp, Mus musculus
gaactccgtctatgtcaacttcctg

SEQ ID NO: 99417 - DNA, 25 bp, Mus musculus
gaactccgtgaactcgagaggcaga

SEQ ID NO: 99418 - DNA, 25 bp, Mus musculus
gaactccgtggaggtttatgcctgg

SEQ ID NO: 99419 - DNA, 25 bp, Mus musculus
gaactcctgctgcaaaagccgagca

SEQ ID NO: 99420 - DNA, 25 bp, Mus musculus
gaactcctggccaacaaaatccaga

SEQ ID NO: 99421 - DNA, 25 bp, Mus musculus
gaactcctggtccactgaagggaaa

SEQ ID NO: 99422 - DNA, 25 bp, Mus musculus
gaactcctgtccgtggtgattgccg

SEQ ID NO: 99423 - DNA, 25 bp, Mus musculus
gaactcctgtgtgctggcttgcctt

SEQ ID NO: 99424 - DNA, 25 bp, Mus musculus
gaactccttcagagctaaccatagc

SEQ ID NO: 99425 - DNA, 25 bp, Mus musculus
gaactcgaaactttgctgcctgtaa

SEQ ID NO: 99426 - DNA, 25 bp, Mus musculus
gaactcgaattctttgtggaccatc

SEQ ID NO: 99427 - DNA, 25 bp, Mus musculus
gaactcgatggtgaacttgctctgc

SEQ ID NO: 99428 - DNA, 25 bp, Mus musculus
gaactcgcagagaaataccgggacc

SEQ ID NO: 99429 - DNA, 25 bp, Mus musculus
gaactcggaaaacccttcaagccat

SEQ ID NO: 99430 - DNA, 25 bp, Mus musculus
gaactcgggccattcactctatgaa

SEQ ID NO: 99431 - DNA, 25 bp, Mus musculus
gaactcggtgttggagatcctctac

SEQ ID NO: 99432 - DNA, 25 bp, Mus musculus
gaactcgtacgggtctgcttggaac

SEQ ID NO: 99433 - DNA, 25 bp, Mus musculus
gaactcgtgaggtacatttctacaa

SEQ ID NO: 99434 - DNA, 25 bp, Mus musculus
gaactcgtgcttagaatggctgctc

SEQ ID NO: 99435 - DNA, 25 bp, Mus musculus
gaactcgttcttttgagtccccatg

SEQ ID NO: 99436 - DNA, 25 bp, Mus musculus
gaactctacctagggctccgctttg

SEQ ID NO: 99437 - DNA, 25 bp, Mus musculus
gaactctactctgactatagggaga

SEQ ID NO: 99438 - DNA, 25 bp, Mus musculus
gaactctactttagcctcctgtgta

SEQ ID NO: 99439 - DNA, 25 bp, Mus musculus
gaactctaggtacagtaaggcctgg

SEQ ID NO: 99440 - DNA, 25 bp, Mus musculus
gaactctatcttccaaaggcgcgct

SEQ ID NO: 99441 - DNA, 25 bp, Mus musculus
gaactctcacccctcaggacagata

SEQ ID NO: 99442 - DNA, 25 bp, Mus musculus
gaactctcagcaagggaatctagaa

SEQ ID NO: 99443 - DNA, 25 bp, Mus musculus
gaactctcctataatgcctccaggg

SEQ ID NO: 99444 - DNA, 25 bp, Mus musculus
gaactctgacgtgcatccttgacaa

SEQ ID NO: 99445 - DNA, 25 bp, Mus musculus
gaactctgaggcacagtcatactga

SEQ ID NO: 99446 - DNA, 25 bp, Mus musculus
gaactctgccattaaggagcctggg

SEQ ID NO: 99447 - DNA, 25 bp, Mus musculus
gaactctgcgccaccgatgagatga

SEQ ID NO: 99448 - DNA, 25 bp, Mus musculus
gaactctggatgacttctacgtgaa

SEQ ID NO: 99449 - DNA, 25 bp, Mus musculus
gaactctggcacttgggtagcatcc

SEQ ID NO: 99450 - DNA, 25 bp, Mus musculus
gaactctgtctactgaaattatctt

SEQ ID NO: 99451 - DNA, 25 bp, Mus musculus
gaactctgtgatggttatggcaaca

SEQ ID NO: 99452 - DNA, 25 bp, Mus musculus
gaactcttagtacccaggaaatgga

SEQ ID NO: 99453 - DNA, 25 bp, Mus musculus
gaactcttcctaggacaacggtggg

SEQ ID NO: 99454 - DNA, 25 bp, Mus musculus
gaactcttctgactggcgatgacac

SEQ ID NO: 99455 - DNA, 25 bp, Mus musculus
gaactcttggactaattgctgctag

SEQ ID NO: 99456 - DNA, 25 bp, Mus musculus
gaactctttgaattccggcggacag

SEQ ID NO: 99457 - DNA, 25 bp, Mus musculus
gaactgaaaagtgaagagatcccga

SEQ ID NO: 99458 - DNA, 25 bp, Mus musculus
gaactgaaagatttgatcatggaag

SEQ ID NO: 99459 - DNA, 25 bp, Mus musculus
gaactgaaatctcaaagaccggagg

SEQ ID NO: 99460 - DNA, 25 bp, Mus musculus
gaactgaaattcttgagctggaccc

SEQ ID NO: 99461 - DNA, 25 bp, Mus musculus
gaactgaacagcatgggcatctggt

SEQ ID NO: 99462 - DNA, 25 bp, Mus musculus
gaactgaacaggtgggagatgccca

SEQ ID NO: 99463 - DNA, 25 bp, Mus musculus
gaactgaacgtcacggtggtcacct

SEQ ID NO: 99464 - DNA, 25 bp, Mus musculus
gaactgaagaccgatttgcacctgg

SEQ ID NO: 99465 - DNA, 25 bp, Mus musculus
gaactgaagaggtcctgtcgcctga

SEQ ID NO: 99466 - DNA, 25 bp, Mus musculus
gaactgaagattgtcctggccgcga

SEQ ID NO: 99467 - DNA, 25 bp, Mus musculus
gaactgaagcatctcatcctggaag

SEQ ID NO: 99468 - DNA, 25 bp, Mus musculus
gaactgaagccattgtcgtgaaccc

SEQ ID NO: 99469 - DNA, 25 bp, Mus musculus
gaactgaaggacaagagtcgcctgc

SEQ ID NO: 99470 - DNA, 25 bp, Mus musculus
gaactgaatctatagaaaaggaggg

SEQ ID NO: 99471 - DNA, 25 bp, Mus musculus
gaactgacagagcttgaacttcccg

SEQ ID NO: 99472 - DNA, 25 bp, Mus musculus
gaactgacccatggctatgacgact

SEQ ID NO: 99473 - DNA, 25 bp, Mus musculus
gaactgacctgctgcaagtggcggc

SEQ ID NO: 99474 - DNA, 25 bp, Mus musculus
gaactgacctgtctcgtgacttagc

SEQ ID NO: 99475 - DNA, 25 bp, Mus musculus
gaactgacgactatgctgggactca

SEQ ID NO: 99476 - DNA, 25 bp, Mus musculus
gaactgacgaggagtgctcaagccc

SEQ ID NO: 99477 - DNA, 25 bp, Mus musculus
gaactgacgctgtacaatccggaac

SEQ ID NO: 99478 - DNA, 25 bp, Mus musculus
gaactgactccatcatattctctga

SEQ ID NO: 99479 - DNA, 25 bp, Mus musculus
gaactgactgtttaaatggccgtat

SEQ ID NO: 99480 - DNA, 25 bp, Mus musculus
gaactgagagctttagaaggcatag

SEQ ID NO: 99481 - DNA, 25 bp, Mus musculus
gaactgagcagagtccaaacctggg

SEQ ID NO: 99482 - DNA, 25 bp, Mus musculus
gaactgagcccaaagtcacatagag

SEQ ID NO: 99483 - DNA, 25 bp, Mus musculus
gaactgagggtgaactccaaagcaa

SEQ ID NO: 99484 - DNA, 25 bp, Mus musculus
gaactgatccaagatgattgccact

SEQ ID NO: 99485 - DNA, 25 bp, Mus musculus
gaactgatctccatacgtgcctgac

SEQ ID NO: 99486 - DNA, 25 bp, Mus musculus
gaactgatgttgctagttcccaacc

SEQ ID NO: 99487 - DNA, 25 bp, Mus musculus
gaactgcacgagttcaccgacctga

SEQ ID NO: 99488 - DNA, 25 bp, Mus musculus
gaactgcactgataacctttgacca

SEQ ID NO: 99489 - DNA, 25 bp, Mus musculus
gaactgcacttgtgagagcccacac

SEQ ID NO: 99490 - DNA, 25 bp, Mus musculus
gaactgcagatcacaaacgtggtgg

SEQ ID NO: 99491 - DNA, 25 bp, Mus musculus
gaactgcagcaacaaggaatgcctg

SEQ ID NO: 99492 - DNA, 25 bp, Mus musculus
gaactgcagcagtctcgaatccgca

SEQ ID NO: 99493 - DNA, 25 bp, Mus musculus
gaactgcagggccagcgctctcgaa

SEQ ID NO: 99494 - DNA, 25 bp, Mus musculus
gaactgcatctagtgctgtcccaga

SEQ ID NO: 99495 - DNA, 25 bp, Mus musculus
gaactgcattgtcaccacgcatggg

SEQ ID NO: 99496 - DNA, 25 bp, Mus musculus
gaactgccaaccgtgggatggacca

SEQ ID NO: 99497 - DNA, 25 bp, Mus musculus
gaactgccactgacctgattgggcg

SEQ ID NO: 99498 - DNA, 25 bp, Mus musculus
gaactgcccaggaagggtgctctta

SEQ ID NO: 99499 - DNA, 25 bp, Mus musculus
gaactgcccggaggcgggcgtcggg

SEQ ID NO: 99500 - DNA, 25 bp, Mus musculus
gaactgccgcaatcgtgtggtgcaa

SEQ ID NO: 99501 - DNA, 25 bp, Mus musculus
gaactgccttcatccatcaccgtga

SEQ ID NO: 99502 - DNA, 25 bp, Mus musculus
gaactgcctttagcggtgcacctgg

SEQ ID NO: 99503 - DNA, 25 bp, Mus musculus
gaactgcgaacacataaaatcattt

SEQ ID NO: 99504 - DNA, 25 bp, Mus musculus
gaactgcgacacatcgacctggtgg

SEQ ID NO: 99505 - DNA, 25 bp, Mus musculus
gaactgcgacatcctgtgacgcgaa

SEQ ID NO: 99506 - DNA, 25 bp, Mus musculus
gaactgcgccacgtcatgacaaact

SEQ ID NO: 99507 - DNA, 25 bp, Mus musculus
gaactgctatctatggagaaagcaa

SEQ ID NO: 99508 - DNA, 25 bp, Mus musculus
gaactgctgcagagtgccagtgcca

SEQ ID NO: 99509 - DNA, 25 bp, Mus musculus
gaactgctgcagcatgggtgccacc

SEQ ID NO: 99510 - DNA, 25 bp, Mus musculus
gaactgctggagtacatgaggaagc

SEQ ID NO: 99511 - DNA, 25 bp, Mus musculus
gaactgctggccgtcatgactgcaa

SEQ ID NO: 99512 - DNA, 25 bp, Mus musculus
gaactgctttggacacctttgctgc

SEQ ID NO: 99513 - DNA, 25 bp, Mus musculus
gaactgctttggacagcctaagacc

SEQ ID NO: 99514 - DNA, 25 bp, Mus musculus
gaactggaaactgctcaagaccgta

SEQ ID NO: 99515 - DNA, 25 bp, Mus musculus
gaactggaagggatcgtggtactca

SEQ ID NO: 99516 - DNA, 25 bp, Mus musculus
gaactggaatgacactttctgggaa

SEQ ID NO: 99517 - DNA, 25 bp, Mus musculus
gaactggaccacgtatctgtgctga

SEQ ID NO: 99518 - DNA, 25 bp, Mus musculus
gaactggacggcctgttaaatacgc

SEQ ID NO: 99519 - DNA, 25 bp, Mus musculus
gaactggactctaaatgggccctga

SEQ ID NO: 99520 - DNA, 25 bp, Mus musculus
gaactggagaacataataggacaga

SEQ ID NO: 99521 - DNA, 25 bp, Mus musculus
gaactggagacttccctgaggacaa

SEQ ID NO: 99522 - DNA, 25 bp, Mus musculus
gaactggagcaagcatgatttataa

SEQ ID NO: 99523 - DNA, 25 bp, Mus musculus
gaactggagtgcacggtatctgtca

SEQ ID NO: 99524 - DNA, 25 bp, Mus musculus
gaactggagttatccacggtgcgcc

SEQ ID NO: 99525 - DNA, 25 bp, Mus musculus
gaactggataatgaaaccgtgatgg

SEQ ID NO: 99526 - DNA, 25 bp, Mus musculus
gaactggatcctcacgtcagagact

SEQ ID NO: 99527 - DNA, 25 bp, Mus musculus
gaactggcagtatcaagaaaccatc

SEQ ID NO: 99528 - DNA, 25 bp, Mus musculus
gaactggccatccataaccgaggga

SEQ ID NO: 99529 - DNA, 25 bp, Mus musculus
gaactggcccaaatccggaaggaag

SEQ ID NO: 99530 - DNA, 25 bp, Mus musculus
gaactggccccaaatgacaggtgct

SEQ ID NO: 99531 - DNA, 25 bp, Mus musculus
gaactggcgacacgtatacaaggct

SEQ ID NO: 99532 - DNA, 25 bp, Mus musculus
gaactggcggtgaaatatgcagacc

SEQ ID NO: 99533 - DNA, 25 bp, Mus musculus
gaactggctcatctacacctatgga

SEQ ID NO: 99534 - DNA, 25 bp, Mus musculus
gaactggctgagtgcataggctccg

SEQ ID NO: 99535 - DNA, 25 bp, Mus musculus
gaactgggaaccactgatcgcaccc

SEQ ID NO: 99536 - DNA, 25 bp, Mus musculus
gaactgggagctacctatctggaac

SEQ ID NO: 99537 - DNA, 25 bp, Mus musculus
gaactgggcaactttgacgcagcca

SEQ ID NO: 99538 - DNA, 25 bp, Mus musculus
gaactgggcagcacttcgatcacca

SEQ ID NO: 99539 - DNA, 25 bp, Mus musculus
gaactggtacacgtattgccccgag

SEQ ID NO: 99540 - DNA, 25 bp, Mus musculus
gaactggtaggagcctagcacccta

SEQ ID NO: 99541 - DNA, 25 bp, Mus musculus
gaactggtccatgtctcagagaaga

SEQ ID NO: 99542 - DNA, 25 bp, Mus musculus
gaactggtccttcgatgagaatgcc

SEQ ID NO: 99543 - DNA, 25 bp, Mus musculus
gaactgtaagctggctgctagggcc

SEQ ID NO: 99544 - DNA, 25 bp, Mus musculus
gaactgtaccagctgtccaaagaca

SEQ ID NO: 99545 - DNA, 25 bp, Mus musculus
gaactgtactaaaaggttgcagcac

SEQ ID NO: 99546 - DNA, 25 bp, Mus musculus
gaactgtcagtgtggaagggcctac

SEQ ID NO: 99547 - DNA, 25 bp, Mus musculus
gaactgtcatcccatccaacaatga

SEQ ID NO: 99548 - DNA, 25 bp, Mus musculus
gaactgtcgcagagaagtgctccag

SEQ ID NO: 99549 - DNA, 25 bp, Mus musculus
gaactgtcgtgcgtatgccttttat

SEQ ID NO: 99550 - DNA, 25 bp, Mus musculus
gaactgtctgctatgacgccgctgc

SEQ ID NO: 99551 - DNA, 25 bp, Mus musculus
gaactgtgcagaaacgctggtccag

SEQ ID NO: 99552 - DNA, 25 bp, Mus musculus
gaactgtggctccttgtgtgctact

SEQ ID NO: 99553 - DNA, 25 bp, Mus musculus
gaactgtgggcagagacgaacttcc

SEQ ID NO: 99554 - DNA, 25 bp, Mus musculus
gaactgtgtcaccagccagatccag

SEQ ID NO: 99555 - DNA, 25 bp, Mus musculus
gaactgttaggaagcactatgggca

SEQ ID NO: 99556 - DNA, 25 bp, Mus musculus
gaactgttccaattataccgtgcgc

SEQ ID NO: 99557 - DNA, 25 bp, Mus musculus
gaactgttccctgaaggatcctggt

SEQ ID NO: 99558 - DNA, 25 bp, Mus musculus
gaactgttctgcaaatggacgagct

SEQ ID NO: 99559 - DNA, 25 bp, Mus musculus
gaactgttggtgagccctgtgttgt

SEQ ID NO: 99560 - DNA, 25 bp, Mus musculus
gaactgttgtcagtatggcaacgga

SEQ ID NO: 99561 - DNA, 25 bp, Mus musculus
gaactgtttacatggtggccaggga

SEQ ID NO: 99562 - DNA, 25 bp, Mus musculus
gaactgtttacctcagcagctagca

SEQ ID NO: 99563 - DNA, 25 bp, Mus musculus
gaacttaacttggatcgcctcctga

SEQ ID NO: 99564 - DNA, 25 bp, Mus musculus
gaacttaataactacatgccagcct

SEQ ID NO: 99565 - DNA, 25 bp, Mus musculus
gaacttaccccttcgagctctggaa

SEQ ID NO: 99566 - DNA, 25 bp, Mus musculus
gaacttaccggattcctcatgggaa

SEQ ID NO: 99567 - DNA, 25 bp, Mus musculus
gaacttactgcttggctcaaacgga

SEQ ID NO: 99568 - DNA, 25 bp, Mus musculus
gaacttagagcctgccttcccagag

SEQ ID NO: 99569 - DNA, 25 bp, Mus musculus
gaacttagccatggagcctgagagc

SEQ ID NO: 99570 - DNA, 25 bp, Mus musculus
gaacttagtgttcaggatggctccg

SEQ ID NO: 99571 - DNA, 25 bp, Mus musculus
gaacttatctacgaaggacgacgct

SEQ ID NO: 99572 - DNA, 25 bp, Mus musculus
gaacttatgaaagtgactggcctga

SEQ ID NO: 99573 - DNA, 25 bp, Mus musculus
gaacttattgcgaactttgctgcca

SEQ ID NO: 99574 - DNA, 25 bp, Mus musculus
gaacttcaaaggagtcaacttcgcc

SEQ ID NO: 99575 - DNA, 25 bp, Mus musculus
gaacttcaggagactaatgcggcgc

SEQ ID NO: 99576 - DNA, 25 bp, Mus musculus
gaacttccacaggtgaaaccaagga

SEQ ID NO: 99577 - DNA, 25 bp, Mus musculus
gaacttccatgggactaatacgcgg

SEQ ID NO: 99578 - DNA, 25 bp, Mus musculus
gaacttcccaagaggagctgcgcat

SEQ ID NO: 99579 - DNA, 25 bp, Mus musculus
gaacttcccgagtgtaaaaggcagg

SEQ ID NO: 99580 - DNA, 25 bp, Mus musculus
gaacttccgagaaaaagcgagctga

SEQ ID NO: 99581 - DNA, 25 bp, Mus musculus
gaacttccgccaggagctgattcac

SEQ ID NO: 99582 - DNA, 25 bp, Mus musculus
gaacttcctctctcagcagcaaaat

SEQ ID NO: 99583 - DNA, 25 bp, Mus musculus
gaacttcctgaggacgcccgaggtg

SEQ ID NO: 99584 - DNA, 25 bp, Mus musculus
gaacttcgaactctgcagctgcctg

SEQ ID NO: 99585 - DNA, 25 bp, Mus musculus
gaacttcgcatcaataccaagggtg

SEQ ID NO: 99586 - DNA, 25 bp, Mus musculus
gaacttcgcctttgacgtggtgcac

SEQ ID NO: 99587 - DNA, 25 bp, Mus musculus
gaacttcgcgccgaaaggagagcca

SEQ ID NO: 99588 - DNA, 25 bp, Mus musculus
gaacttcggagagccagctgctgga

SEQ ID NO: 99589 - DNA, 25 bp, Mus musculus
gaacttcggcatccttctgggcgtg

SEQ ID NO: 99590 - DNA, 25 bp, Mus musculus
gaacttcgtgtccatgagaatgaga

SEQ ID NO: 99591 - DNA, 25 bp, Mus musculus
gaacttctcaaacatatgcacgctg

SEQ ID NO: 99592 - DNA, 25 bp, Mus musculus
gaacttctcaacgtgatccaggact

SEQ ID NO: 99593 - DNA, 25 bp, Mus musculus
gaacttctcggacagcttcggtggc

SEQ ID NO: 99594 - DNA, 25 bp, Mus musculus
gaacttctcgggtagctgacacgac

SEQ ID NO: 99595 - DNA, 25 bp, Mus musculus
gaacttctgacttctgtcccaggga

SEQ ID NO: 99596 - DNA, 25 bp, Mus musculus
gaacttctgcaggtgtgactgaact

SEQ ID NO: 99597 - DNA, 25 bp, Mus musculus
gaacttctggaaaataaggccatcc

SEQ ID NO: 99598 - DNA, 25 bp, Mus musculus
gaacttctggagcaccagtgagcag

SEQ ID NO: 99599 - DNA, 25 bp, Mus musculus
gaacttctgggagaggatcttccac

SEQ ID NO: 99600 - DNA, 25 bp, Mus musculus
gaacttctgtaggaaccctgatggg

SEQ ID NO: 99601 - DNA, 25 bp, Mus musculus
gaacttctgtgctgggatctccggc

SEQ ID NO: 99602 - DNA, 25 bp, Mus musculus
gaacttctgtttgaccagctgcatg

SEQ ID NO: 99603 - DNA, 25 bp, Mus musculus
gaacttcttaataggacggccagga

SEQ ID NO: 99604 - DNA, 25 bp, Mus musculus
gaacttcttcactgacgtctacgac

SEQ ID NO: 99605 - DNA, 25 bp, Mus musculus
gaacttgaaaatgcctctcctgcag

SEQ ID NO: 99606 - DNA, 25 bp, Mus musculus
gaacttgacaaagagctcccggtgc

SEQ ID NO: 99607 - DNA, 25 bp, Mus musculus
gaacttgacaagcagataagtgacc

SEQ ID NO: 99608 - DNA, 25 bp, Mus musculus
gaacttgacaagtacgaacccagaa

SEQ ID NO: 99609 - DNA, 25 bp, Mus musculus
gaacttgactagcacgcaagaggcc

SEQ ID NO: 99610 - DNA, 25 bp, Mus musculus
gaacttgccaaagctgcacggaacg

SEQ ID NO: 99611 - DNA, 25 bp, Mus musculus
gaacttgccgaagcggtcaaaccca

SEQ ID NO: 99612 - DNA, 25 bp, Mus musculus
gaacttgctaccaaaggaggccttg

SEQ ID NO: 99613 - DNA, 25 bp, Mus musculus
gaacttggaaatggtcagcctgcta

SEQ ID NO: 99614 - DNA, 25 bp, Mus musculus
gaacttggaacgagtcagtgacggc

SEQ ID NO: 99615 - DNA, 25 bp, Mus musculus
gaacttggaatggagcagccctcag

SEQ ID NO: 99616 - DNA, 25 bp, Mus musculus
gaacttggagtcgtatgacagccac

SEQ ID NO: 99617 - DNA, 25 bp, Mus musculus
gaacttggcaactgagacaaatgag

SEQ ID NO: 99618 - DNA, 25 bp, Mus musculus
gaacttggcccaaaggtcctatgtg

SEQ ID NO: 99619 - DNA, 25 bp, Mus musculus
gaacttggctactgaggacctggtc

SEQ ID NO: 99620 - DNA, 25 bp, Mus musculus
gaacttgggagcatacatcatcgac

SEQ ID NO: 99621 - DNA, 25 bp, Mus musculus
gaacttgggcatcattaacgaggac

SEQ ID NO: 99622 - DNA, 25 bp, Mus musculus
gaacttgggctttcctgataggtcc

SEQ ID NO: 99623 - DNA, 25 bp, Mus musculus
gaacttgtacaaataggacctgcct

SEQ ID NO: 99624 - DNA, 25 bp, Mus musculus
gaacttgttgcaggtaagacgctgg

SEQ ID NO: 99625 - DNA, 25 bp, Mus musculus
gaactttacgactggctctatctgg

SEQ ID NO: 99626 - DNA, 25 bp, Mus musculus
gaactttagaacaagcccggcagct

SEQ ID NO: 99627 - DNA, 25 bp, Mus musculus
gaactttcagaacagcttcaatgga

SEQ ID NO: 99628 - DNA, 25 bp, Mus musculus
gaactttctgaatctcaggcgggtg

SEQ ID NO: 99629 - DNA, 25 bp, Mus musculus
gaactttgccgcctgtggctcagac

SEQ ID NO: 99630 - DNA, 25 bp, Mus musculus
gaactttgtggacaagctccaggag

SEQ ID NO: 99631 - DNA, 25 bp, Mus musculus
gaacttttaactgacatcggactcc

SEQ ID NO: 99632 - DNA, 25 bp, Mus musculus
gaacttttccatccgggactcttcg

SEQ ID NO: 99633 - DNA, 25 bp, Mus musculus
gaacttttcgcgctcactactggag

SEQ ID NO: 99634 - DNA, 25 bp, Mus musculus
gaacttttggaaacgtgactgcact

SEQ ID NO: 99635 - DNA, 25 bp, Mus musculus
gaagaaaaacaagttcagagaccgc

SEQ ID NO: 99636 - DNA, 25 bp, Mus musculus
gaagaaaaacatgtctcaccactgg

SEQ ID NO: 99637 - DNA, 25 bp, Mus musculus
gaagaaaaagaagcggcctggatcc

SEQ ID NO: 99638 - DNA, 25 bp, Mus musculus
gaagaaaaccataaggacgcggact

SEQ ID NO: 99639 - DNA, 25 bp, Mus musculus
gaagaaaaccccagtgaagtcggag

SEQ ID NO: 99640 - DNA, 25 bp, Mus musculus
gaagaaaacctgtctgcctccgtca

SEQ ID NO: 99641 - DNA, 25 bp, Mus musculus
gaagaaaactctgatgctagcgtcg

SEQ ID NO: 99642 - DNA, 25 bp, Mus musculus
gaagaaaagacacccctgcaagtgg

SEQ ID NO: 99643 - DNA, 25 bp, Mus musculus
gaagaaaagacctgccaaatggaga

SEQ ID NO: 99644 - DNA, 25 bp, Mus musculus
gaagaaaagactggcatgactatga

SEQ ID NO: 99645 - DNA, 25 bp, Mus musculus
gaagaaaagattgacagctacctgg

SEQ ID NO: 99646 - DNA, 25 bp, Mus musculus
gaagaaaagcaactaggaacaatga

SEQ ID NO: 99647 - DNA, 25 bp, Mus musculus
gaagaaaaggccatgagctgtctcc

SEQ ID NO: 99648 - DNA, 25 bp, Mus musculus
gaagaaaatccgtcaagttatccga

SEQ ID NO: 99649 - DNA, 25 bp, Mus musculus
gaagaaaatctggacagactgatcc

SEQ ID NO: 99650 - DNA, 25 bp, Mus musculus
gaagaaaatgccacagacaagctcc

SEQ ID NO: 99651 - DNA, 25 bp, Mus musculus
gaagaaaattatgtccaggacagca

SEQ ID NO: 99652 - DNA, 25 bp, Mus musculus
gaagaaacaccaaatcagcatgcag

SEQ ID NO: 99653 - DNA, 25 bp, Mus musculus
gaagaaaccagcgaagccaaaatgc

SEQ ID NO: 99654 - DNA, 25 bp, Mus musculus
gaagaaaccagtaggagacacggcc

SEQ ID NO: 99655 - DNA, 25 bp, Mus musculus
gaagaaacgcagacagctagtggcc

SEQ ID NO: 99656 - DNA, 25 bp, Mus musculus
gaagaaacggagtcctaagccctgc

SEQ ID NO: 99657 - DNA, 25 bp, Mus musculus
gaagaaacgtctgcgctgctggacc

SEQ ID NO: 99658 - DNA, 25 bp, Mus musculus
gaagaaactcctcaagcagctgaaa

SEQ ID NO: 99659 - DNA, 25 bp, Mus musculus
gaagaaacttctgcacaacattcag

SEQ ID NO: 99660 - DNA, 25 bp, Mus musculus
gaagaaagaatgtatcaaggaaccc

SEQ ID NO: 99661 - DNA, 25 bp, Mus musculus
gaagaaagaccacagagaaaagcac

SEQ ID NO: 99662 - DNA, 25 bp, Mus musculus
gaagaaagaccatgcttaggccagt

SEQ ID NO: 99663 - DNA, 25 bp, Mus musculus
gaagaaagatcactcaccctgtgtc

SEQ ID NO: 99664 - DNA, 25 bp, Mus musculus
gaagaaagatccatgtctgcaccag

SEQ ID NO: 99665 - DNA, 25 bp, Mus musculus
gaagaaagattggaacacgtgacag

SEQ ID NO: 99666 - DNA, 25 bp, Mus musculus
gaagaaagcactcatcgtgggacac

SEQ ID NO: 99667 - DNA, 25 bp, Mus musculus
gaagaaagcttccttgccagaaaaa

SEQ ID NO: 99668 - DNA, 25 bp, Mus musculus
gaagaaaggcttcaacaacagttac

SEQ ID NO: 99669 - DNA, 25 bp, Mus musculus
gaagaaagtcccgaggagggtcatc

SEQ ID NO: 99670 - DNA, 25 bp, Mus musculus
gaagaaagtgatcaaagctggcaag

SEQ ID NO: 99671 - DNA, 25 bp, Mus musculus
gaagaaagtgattgcatcaatgact

SEQ ID NO: 99672 - DNA, 25 bp, Mus musculus
gaagaaagtgcctcaccagcaaggt

SEQ ID NO: 99673 - DNA, 25 bp, Mus musculus
gaagaaagttgctgagcagaccttc

SEQ ID NO: 99674 - DNA, 25 bp, Mus musculus
gaagaaagtttgtttggtatggcat

SEQ ID NO: 99675 - DNA, 25 bp, Mus musculus
gaagaaatagccaactatgaagatg

SEQ ID NO: 99676 - DNA, 25 bp, Mus musculus
gaagaaatcacattgcctgcttgga

SEQ ID NO: 99677 - DNA, 25 bp, Mus musculus
gaagaaatcaccattccagctgacg

SEQ ID NO: 99678 - DNA, 25 bp, Mus musculus
gaagaaatccaacaccgaagagcgg

SEQ ID NO: 99679 - DNA, 25 bp, Mus musculus
gaagaaattcaagttcagccgctat

SEQ ID NO: 99680 - DNA, 25 bp, Mus musculus
gaagaaattccaacctcatgcaggc

SEQ ID NO: 99681 - DNA, 25 bp, Mus musculus
gaagaaattccgagccaatcccgtt

SEQ ID NO: 99682 - DNA, 25 bp, Mus musculus
gaagaaattgcagcccacagtcaga

SEQ ID NO: 99683 - DNA, 25 bp, Mus musculus
gaagaacaaaatgggagaacctggg

SEQ ID NO: 99684 - DNA, 25 bp, Mus musculus
gaagaacaacgaggaaagcatgcag

SEQ ID NO: 99685 - DNA, 25 bp, Mus musculus
gaagaacaagtatgacgccagctcc

SEQ ID NO: 99686 - DNA, 25 bp, Mus musculus
gaagaacacaaatcatgtcccgagg

SEQ ID NO: 99687 - DNA, 25 bp, Mus musculus
gaagaacacaacatgctgcgatgcg

SEQ ID NO: 99688 - DNA, 25 bp, Mus musculus
gaagaacacaatcgccttggagaag

SEQ ID NO: 99689 - DNA, 25 bp, Mus musculus
gaagaacacccactgtttgagcgtg

SEQ ID NO: 99690 - DNA, 25 bp, Mus musculus
gaagaacactctggctcctactggt

SEQ ID NO: 99691 - DNA, 25 bp, Mus musculus
gaagaacactgcagtcactagcctg

SEQ ID NO: 99692 - DNA, 25 bp, Mus musculus
gaagaacagcacctccatcgttgat

SEQ ID NO: 99693 - DNA, 25 bp, Mus musculus
gaagaacaggaccttggattgacag

SEQ ID NO: 99694 - DNA, 25 bp, Mus musculus
gaagaacagtccagcacttcaaggg

SEQ ID NO: 99695 - DNA, 25 bp, Mus musculus
gaagaacatcagtctcccggtggca

SEQ ID NO: 99696 - DNA, 25 bp, Mus musculus
gaagaacattgaccacacgctgtgg

SEQ ID NO: 99697 - DNA, 25 bp, Mus musculus
gaagaaccagatgtaagcggccaca

SEQ ID NO: 99698 - DNA, 25 bp, Mus musculus
gaagaaccagtagtcttggcactag

SEQ ID NO: 99699 - DNA, 25 bp, Mus musculus
gaagaacccattagggccacctggt

SEQ ID NO: 99700 - DNA, 25 bp, Mus musculus
gaagaacccgcatcaaagcataaga

SEQ ID NO: 99701 - DNA, 25 bp, Mus musculus
gaagaacccttcatcttgagccgtg

SEQ ID NO: 99702 - DNA, 25 bp, Mus musculus
gaagaaccggatggtgttgctacag

SEQ ID NO: 99703 - DNA, 25 bp, Mus musculus
gaagaaccggcaccaggatgtcatg

SEQ ID NO: 99704 - DNA, 25 bp, Mus musculus
gaagaacctcactgcgagtcatcca

SEQ ID NO: 99705 - DNA, 25 bp, Mus musculus
gaagaacctgcctctcgagttggac

SEQ ID NO: 99706 - DNA, 25 bp, Mus musculus
gaagaacctgttgggcgtgccctct

SEQ ID NO: 99707 - DNA, 25 bp, Mus musculus
gaagaaccttctaactccctcatgg

SEQ ID NO: 99708 - DNA, 25 bp, Mus musculus
gaagaaccttctggcagtgagcagc

SEQ ID NO: 99709 - DNA, 25 bp, Mus musculus
gaagaacctttggacagagtggcct

SEQ ID NO: 99710 - DNA, 25 bp, Mus musculus
gaagaacgacttgacctgttgcctg

SEQ ID NO: 99711 - DNA, 25 bp, Mus musculus
gaagaacgacttgcgaagtgtcact

SEQ ID NO: 99712 - DNA, 25 bp, Mus musculus
gaagaacgagatgccttcaggagca

SEQ ID NO: 99713 - DNA, 25 bp, Mus musculus
gaagaacgagccatgcttgcaaaag

SEQ ID NO: 99714 - DNA, 25 bp, Mus musculus
gaagaacgccgccaatcagaaagga

SEQ ID NO: 99715 - DNA, 25 bp, Mus musculus
gaagaacggactgagacaccaagtg

SEQ ID NO: 99716 - DNA, 25 bp, Mus musculus
gaagaacggctgaagctggcacagc

SEQ ID NO: 99717 - DNA, 25 bp, Mus musculus
gaagaacggtctggtgaagatcaag

SEQ ID NO: 99718 - DNA, 25 bp, Mus musculus
gaagaacgtccagaaaaagtaccag

SEQ ID NO: 99719 - DNA, 25 bp, Mus musculus
gaagaacgttttcccactcgagcag

SEQ ID NO: 99720 - DNA, 25 bp, Mus musculus
gaagaactactactcaaagccatgg

SEQ ID NO: 99721 - DNA, 25 bp, Mus musculus
gaagaactagatcttcagctggccc

SEQ ID NO: 99722 - DNA, 25 bp, Mus musculus
gaagaactcagaaatacagggagcg

SEQ ID NO: 99723 - DNA, 25 bp, Mus musculus
gaagaactcctacaaaacctacagc

SEQ ID NO: 99724 - DNA, 25 bp, Mus musculus
gaagaactgccacgagagcgcagaa

SEQ ID NO: 99725 - DNA, 25 bp, Mus musculus
gaagaactgctataggtacctgcct

SEQ ID NO: 99726 - DNA, 25 bp, Mus musculus
gaagaactggtacatcagcccgaac

SEQ ID NO: 99727 - DNA, 25 bp, Mus musculus
gaagaactggtttgtgggcctcaag

SEQ ID NO: 99728 - DNA, 25 bp, Mus musculus
gaagaactgtgtgctgagctcctgc

SEQ ID NO: 99729 - DNA, 25 bp, Mus musculus
gaagaacttagacttcctatagagg

SEQ ID NO: 99730 - DNA, 25 bp, Mus musculus
gaagaacttccagatcatccacggc

SEQ ID NO: 99731 - DNA, 25 bp, Mus musculus
gaagaacttccaggacatcatgcga

SEQ ID NO: 99732 - DNA, 25 bp, Mus musculus
gaagaacttccttcgcgtgggccgt

SEQ ID NO: 99733 - DNA, 25 bp, Mus musculus
gaagaacttctatcctggcgtggca

SEQ ID NO: 99734 - DNA, 25 bp, Mus musculus
gaagaacttgaaaggcagccccata

SEQ ID NO: 99735 - DNA, 25 bp, Mus musculus
gaagaacttgccagtagcgatccca

SEQ ID NO: 99736 - DNA, 25 bp, Mus musculus
gaagaacttggtgtcatcatcaaca

SEQ ID NO: 99737 - DNA, 25 bp, Mus musculus
gaagaactttgagagaccaagccgc

SEQ ID NO: 99738 - DNA, 25 bp, Mus musculus
gaagaagaaaagtgaaaagttcaag

SEQ ID NO: 99739 - DNA, 25 bp, Mus musculus
gaagaagaaaatcgcatgctgcccc

SEQ ID NO: 99740 - DNA, 25 bp, Mus musculus
gaagaagaaacacaccttggtcatg

SEQ ID NO: 99741 - DNA, 25 bp, Mus musculus
gaagaagaaagaacatctggtgcta

SEQ ID NO: 99742 - DNA, 25 bp, Mus musculus
gaagaagaaatgacgtggtgtgaac

SEQ ID NO: 99743 - DNA, 25 bp, Mus musculus
gaagaagaaccttgcctagaacccg

SEQ ID NO: 99744 - DNA, 25 bp, Mus musculus
gaagaagaagatccgtagtctgagt

SEQ ID NO: 99745 - DNA, 25 bp, Mus musculus
gaagaagaagtcaatgttgccaccg

SEQ ID NO: 99746 - DNA, 25 bp, Mus musculus
gaagaagacatctgctctggagaag

SEQ ID NO: 99747 - DNA, 25 bp, Mus musculus
gaagaagaccgtgtgcagcagatgc

SEQ ID NO: 99748 - DNA, 25 bp, Mus musculus
gaagaagacctcacatgcccaattt

SEQ ID NO: 99749 - DNA, 25 bp, Mus musculus
gaagaagacgacttacagcggatcc

SEQ ID NO: 99750 - DNA, 25 bp, Mus musculus
gaagaagactctccgctttggcgtg

SEQ ID NO: 99751 - DNA, 25 bp, Mus musculus
gaagaagagaaaagctcccggagtg

SEQ ID NO: 99752 - DNA, 25 bp, Mus musculus
gaagaagagaagtccacactccggc

SEQ ID NO: 99753 - DNA, 25 bp, Mus musculus
gaagaagagaatcgaataccccagc

SEQ ID NO: 99754 - DNA, 25 bp, Mus musculus
gaagaagagacaccacagcttccac

SEQ ID NO: 99755 - DNA, 25 bp, Mus musculus
gaagaagagatactactaccgggac

SEQ ID NO: 99756 - DNA, 25 bp, Mus musculus
gaagaagagtcctcatcccaggaag

SEQ ID NO: 99757 - DNA, 25 bp, Mus musculus
gaagaagagtctcaaatggacatgc

SEQ ID NO: 99758 - DNA, 25 bp, Mus musculus
gaagaagatccgcagcctcatgaag

SEQ ID NO: 99759 - DNA, 25 bp, Mus musculus
gaagaagatctcaaaggctacctgg

SEQ ID NO: 99760 - DNA, 25 bp, Mus musculus
gaagaagatgttcccaagcgcaaga

SEQ ID NO: 99761 - DNA, 25 bp, Mus musculus
gaagaagcaagccacttgcagcccc

SEQ ID NO: 99762 - DNA, 25 bp, Mus musculus
gaagaagcacctcagagtcagacgg

SEQ ID NO: 99763 - DNA, 25 bp, Mus musculus
gaagaagccagctacaccacttaag

SEQ ID NO: 99764 - DNA, 25 bp, Mus musculus
gaagaagcccaccatgtatcctgag

SEQ ID NO: 99765 - DNA, 25 bp, Mus musculus
gaagaagcctttatccagtctctgg

SEQ ID NO: 99766 - DNA, 25 bp, Mus musculus
gaagaagcgcttcgaccacaatgag

SEQ ID NO: 99767 - DNA, 25 bp, Mus musculus
gaagaagcgctttgcttacctgtct

SEQ ID NO: 99768 - DNA, 25 bp, Mus musculus
gaagaagcgtgtacaaacctgggtc

SEQ ID NO: 99769 - DNA, 25 bp, Mus musculus
gaagaagctgttatccagagtggga

SEQ ID NO: 99770 - DNA, 25 bp, Mus musculus
gaagaaggaaaactcaagcgccgga

SEQ ID NO: 99771 - DNA, 25 bp, Mus musculus
gaagaaggaccgtgcctacccggtg

SEQ ID NO: 99772 - DNA, 25 bp, Mus musculus
gaagaaggagacgatggctcgaccc

SEQ ID NO: 99773 - DNA, 25 bp, Mus musculus
gaagaaggaggtgaaatcacaagaa

SEQ ID NO: 99774 - DNA, 25 bp, Mus musculus
gaagaaggcaacatgtggcacagtc

SEQ ID NO: 99775 - DNA, 25 bp, Mus musculus
gaagaaggcattaccaccgaagccg

SEQ ID NO: 99776 - DNA, 25 bp, Mus musculus
gaagaaggctgttgacggtgtcacc

SEQ ID NO: 99777 - DNA, 25 bp, Mus musculus
gaagaagggacaacatgctgccgag

SEQ ID NO: 99778 - DNA, 25 bp, Mus musculus
gaagaagggtctccatacagtccgg

SEQ ID NO: 99779 - DNA, 25 bp, Mus musculus
gaagaaggtcctccagcagatgaag

SEQ ID NO: 99780 - DNA, 25 bp, Mus musculus
gaagaaggtgaacccctgctaaccg

SEQ ID NO: 99781 - DNA, 25 bp, Mus musculus
gaagaaggtttgactgtggccacag

SEQ ID NO: 99782 - DNA, 25 bp, Mus musculus
gaagaagtacctcacacaggctcag

SEQ ID NO: 99783 - DNA, 25 bp, Mus musculus
gaagaagtactgttctggcaccggc

SEQ ID NO: 99784 - DNA, 25 bp, Mus musculus
gaagaagtagtcaaactgccagcat

SEQ ID NO: 99785 - DNA, 25 bp, Mus musculus
gaagaagtatctacagggcctcgga

SEQ ID NO: 99786 - DNA, 25 bp, Mus musculus
gaagaagtcgtctgtggacagccag

SEQ ID NO: 99787 - DNA, 25 bp, Mus musculus
gaagaagtcttccaccgaggacaag

SEQ ID NO: 99788 - DNA, 25 bp, Mus musculus
gaagaagtggtaaatgacaggagct

SEQ ID NO: 99789 - DNA, 25 bp, Mus musculus
gaagaagttccctaggccgtggcac

SEQ ID NO: 99790 - DNA, 25 bp, Mus musculus
gaagaagttcgtgctccaattcctc

SEQ ID NO: 99791 - DNA, 25 bp, Mus musculus
gaagaagttggccaagaagtcccaa

SEQ ID NO: 99792 - DNA, 25 bp, Mus musculus
gaagaagttttgtgccagtggacca

SEQ ID NO: 99793 - DNA, 25 bp, Mus musculus
gaagaatacaaagtcccagatggga

SEQ ID NO: 99794 - DNA, 25 bp, Mus musculus
gaagaatacatgtttcagagaaaca

SEQ ID NO: 99795 - DNA, 25 bp, Mus musculus
gaagaatacgtggtctatgagcccg

SEQ ID NO: 99796 - DNA, 25 bp, Mus musculus
gaagaatacgtgttagccgctggga

SEQ ID NO: 99797 - DNA, 25 bp, Mus musculus
gaagaatatcaagatggtttccagt

SEQ ID NO: 99798 - DNA, 25 bp, Mus musculus
gaagaatatgtgtttgcggccctga

SEQ ID NO: 99799 - DNA, 25 bp, Mus musculus
gaagaatattctcaccatggcctgt

SEQ ID NO: 99800 - DNA, 25 bp, Mus musculus
gaagaatcaagctcacagccccaaa

SEQ ID NO: 99801 - DNA, 25 bp, Mus musculus
gaagaatccttcaacgctgtacaag

SEQ ID NO: 99802 - DNA, 25 bp, Mus musculus
gaagaatcgagtacctgcagagcca

SEQ ID NO: 99803 - DNA, 25 bp, Mus musculus
gaagaatcgcgtaaccagctcagct

SEQ ID NO: 99804 - DNA, 25 bp, Mus musculus
gaagaatgacagagaacgagagcgc

SEQ ID NO: 99805 - DNA, 25 bp, Mus musculus
gaagaatgccaatgctgaggtaccc

SEQ ID NO: 99806 - DNA, 25 bp, Mus musculus
gaagaatgcccatcacagtatccgc

SEQ ID NO: 99807 - DNA, 25 bp, Mus musculus
gaagaatgcctgttgatccacccaa

SEQ ID NO: 99808 - DNA, 25 bp, Mus musculus
gaagaatggagttagagctgaatgt

SEQ ID NO: 99809 - DNA, 25 bp, Mus musculus
gaagaatggcctctcccgggattat

SEQ ID NO: 99810 - DNA, 25 bp, Mus musculus
gaagaatgggagctctacaaagccc

SEQ ID NO: 99811 - DNA, 25 bp, Mus musculus
gaagaatgtcagctcaggtcccgat

SEQ ID NO: 99812 - DNA, 25 bp, Mus musculus
gaagaatgttggagtatgacccagc

SEQ ID NO: 99813 - DNA, 25 bp, Mus musculus
gaagaattaagactcgcacagcgtc

SEQ ID NO: 99814 - DNA, 25 bp, Mus musculus
gaagaattatattcctacctaaagg

SEQ ID NO: 99815 - DNA, 25 bp, Mus musculus
gaagaattcaatgagctgctgtcca

SEQ ID NO: 99816 - DNA, 25 bp, Mus musculus
gaagaattccctttgcccatgccat

SEQ ID NO: 99817 - DNA, 25 bp, Mus musculus
gaagaattgcctccagttgctcatg

SEQ ID NO: 99818 - DNA, 25 bp, Mus musculus
gaagaattgggaccttttctacgct

SEQ ID NO: 99819 - DNA, 25 bp, Mus musculus
gaagaatttatcctagctatgcacc

SEQ ID NO: 99820 - DNA, 25 bp, Mus musculus
gaagaatttcttccctccaggaacg

SEQ ID NO: 99821 - DNA, 25 bp, Mus musculus
gaagacaaatatcccaagcctgcgg

SEQ ID NO: 99822 - DNA, 25 bp, Mus musculus
gaagacaagaattacacaggctgca

SEQ ID NO: 99823 - DNA, 25 bp, Mus musculus
gaagacaagaccctccaaaagaaat

SEQ ID NO: 99824 - DNA, 25 bp, Mus musculus
gaagacaaggccttccagtttggag

SEQ ID NO: 99825 - DNA, 25 bp, Mus musculus
gaagacaagtatgacctcagccagc

SEQ ID NO: 99826 - DNA, 25 bp, Mus musculus
gaagacaagtcggaacaagcaggga

SEQ ID NO: 99827 - DNA, 25 bp, Mus musculus
gaagacacacaacgtctgcgcgtca

SEQ ID NO: 99828 - DNA, 25 bp, Mus musculus
gaagacacacccagatacatgcgtg

SEQ ID NO: 99829 - DNA, 25 bp, Mus musculus
gaagacacagatactaccctggatg

SEQ ID NO: 99830 - DNA, 25 bp, Mus musculus
gaagacacagcgaaggatctccagc

SEQ ID NO: 99831 - DNA, 25 bp, Mus musculus
gaagacacccaacactgtggagagg

SEQ ID NO: 99832 - DNA, 25 bp, Mus musculus
gaagacaccctttctatcatgggaa

SEQ ID NO: 99833 - DNA, 25 bp, Mus musculus
gaagacacctgaggcatttccatgg

SEQ ID NO: 99834 - DNA, 25 bp, Mus musculus
gaagacacgataaaggaagcccggc

SEQ ID NO: 99835 - DNA, 25 bp, Mus musculus
gaagacacgcttattgaaggcctcc

SEQ ID NO: 99836 - DNA, 25 bp, Mus musculus
gaagacacggaatgagtggacagcc

SEQ ID NO: 99837 - DNA, 25 bp, Mus musculus
gaagacacggtgacttaaagagccc

SEQ ID NO: 99838 - DNA, 25 bp, Mus musculus
gaagacacgtcatcggccatgttga

SEQ ID NO: 99839 - DNA, 25 bp, Mus musculus
gaagacacttcacatgttccacgat

SEQ ID NO: 99840 - DNA, 25 bp, Mus musculus
gaagacagacaacatgttcactgga

SEQ ID NO: 99841 - DNA, 25 bp, Mus musculus
gaagacagactgagtttctccggct

SEQ ID NO: 99842 - DNA, 25 bp, Mus musculus
gaagacagcacgtcgggaacagctt

SEQ ID NO: 99843 - DNA, 25 bp, Mus musculus
gaagacagcactcaaagaagatggc

SEQ ID NO: 99844 - DNA, 25 bp, Mus musculus
gaagacagcacttacacgtatgtca

SEQ ID NO: 99845 - DNA, 25 bp, Mus musculus
gaagacaggaggtgtgcacatccca

SEQ ID NO: 99846 - DNA, 25 bp, Mus musculus
gaagacagtctacctggccggaagt

SEQ ID NO: 99847 - DNA, 25 bp, Mus musculus
gaagacagttatccgcaagccaagg

SEQ ID NO: 99848 - DNA, 25 bp, Mus musculus
gaagacagttccaaaacccagacag

SEQ ID NO: 99849 - DNA, 25 bp, Mus musculus
gaagacagttgattcaggagtccaa

SEQ ID NO: 99850 - DNA, 25 bp, Mus musculus
gaagacataagacaaggccgtggca

SEQ ID NO: 99851 - DNA, 25 bp, Mus musculus
gaagacatcaatggctgtccaaaga

SEQ ID NO: 99852 - DNA, 25 bp, Mus musculus
gaagacatcaccctgattctggaga

SEQ ID NO: 99853 - DNA, 25 bp, Mus musculus
gaagacatcatcctacctcagacag

SEQ ID NO: 99854 - DNA, 25 bp, Mus musculus
gaagacatcatctggccaggccaaa

SEQ ID NO: 99855 - DNA, 25 bp, Mus musculus
gaagacatcccctagtcctgctgag

SEQ ID NO: 99856 - DNA, 25 bp, Mus musculus
gaagacatctcttggcagcctgaag

SEQ ID NO: 99857 - DNA, 25 bp, Mus musculus
gaagacatctctttacacccgctga

SEQ ID NO: 99858 - DNA, 25 bp, Mus musculus
gaagacatctgcagaagcctgtttg

SEQ ID NO: 99859 - DNA, 25 bp, Mus musculus
gaagacatgagacaaaggtgcaccg

SEQ ID NO: 99860 - DNA, 25 bp, Mus musculus
gaagacatgcggaaggctggttcta

SEQ ID NO: 99861 - DNA, 25 bp, Mus musculus
gaagacatgggactccctcggtgca

SEQ ID NO: 99862 - DNA, 25 bp, Mus musculus
gaagacatgtcactctggctgcaga

SEQ ID NO: 99863 - DNA, 25 bp, Mus musculus
gaagacatgttggtccagctgatca

SEQ ID NO: 99864 - DNA, 25 bp, Mus musculus
gaagacatgtttccctatgagggcc

SEQ ID NO: 99865 - DNA, 25 bp, Mus musculus
gaagacattcacaggacacagagaa

SEQ ID NO: 99866 - DNA, 25 bp, Mus musculus
gaagacattccattcacaagagctg

SEQ ID NO: 99867 - DNA, 25 bp, Mus musculus
gaagacattcttcagtattttcatg

SEQ ID NO: 99868 - DNA, 25 bp, Mus musculus
gaagacattgactacgaagaaggga

SEQ ID NO: 99869 - DNA, 25 bp, Mus musculus
gaagacattggcttccgctgtcgcc

SEQ ID NO: 99870 - DNA, 25 bp, Mus musculus
gaagacattttcatgccgtcggctg

SEQ ID NO: 99871 - DNA, 25 bp, Mus musculus
gaagaccaactgaaactgattactg

SEQ ID NO: 99872 - DNA, 25 bp, Mus musculus
gaagaccaagcacaggctgcagaat

SEQ ID NO: 99873 - DNA, 25 bp, Mus musculus
gaagaccaagtatagcagcccagtg

SEQ ID NO: 99874 - DNA, 25 bp, Mus musculus
gaagaccaatagtactgccgaggcc

SEQ ID NO: 99875 - DNA, 25 bp, Mus musculus
gaagaccacatcaccagcaaatttg

SEQ ID NO: 99876 - DNA, 25 bp, Mus musculus
gaagaccacgacattccgattggga

SEQ ID NO: 99877 - DNA, 25 bp, Mus musculus
gaagaccacgtactgcctgggcatg

SEQ ID NO: 99878 - DNA, 25 bp, Mus musculus
gaagaccactaaagacagacaggca

SEQ ID NO: 99879 - DNA, 25 bp, Mus musculus
gaagaccactggcatcactgctcag

SEQ ID NO: 99880 - DNA, 25 bp, Mus musculus
gaagaccagaaccatctccaactgc

SEQ ID NO: 99881 - DNA, 25 bp, Mus musculus
gaagaccagattcagagtgtatcca

SEQ ID NO: 99882 - DNA, 25 bp, Mus musculus
gaagaccagcaagatctcagacctg

SEQ ID NO: 99883 - DNA, 25 bp, Mus musculus
gaagaccagggcaagaatcagctcg

SEQ ID NO: 99884 - DNA, 25 bp, Mus musculus
gaagaccatggtggagctttcccaa

SEQ ID NO: 99885 - DNA, 25 bp, Mus musculus
gaagacccaactggtgccaaggaat

SEQ ID NO: 99886 - DNA, 25 bp, Mus musculus
gaagacccaactgtggccaaggctg

SEQ ID NO: 99887 - DNA, 25 bp, Mus musculus
gaagacccagtatctccttatgaga

SEQ ID NO: 99888 - DNA, 25 bp, Mus musculus
gaagacccagtcttccttagaactt

SEQ ID NO: 99889 - DNA, 25 bp, Mus musculus
gaagacccagttcgtggtgcacctg

SEQ ID NO: 99890 - DNA, 25 bp, Mus musculus
gaagaccccagcactaacgtcatgc

SEQ ID NO: 99891 - DNA, 25 bp, Mus musculus
gaagacccgtacctgaatgaccgct

SEQ ID NO: 99892 - DNA, 25 bp, Mus musculus
gaagacccgtctagctgcttcacgt

SEQ ID NO: 99893 - DNA, 25 bp, Mus musculus
gaagaccctattctagagcacccgc

SEQ ID NO: 99894 - DNA, 25 bp, Mus musculus
gaagaccctcgagaaatggtcagat

SEQ ID NO: 99895 - DNA, 25 bp, Mus musculus
gaagaccgaaatgacccaatgctgc

SEQ ID NO: 99896 - DNA, 25 bp, Mus musculus
gaagaccgagcaatttttgtcactg

SEQ ID NO: 99897 - DNA, 25 bp, Mus musculus
gaagaccgtgctcatggtagcagaa

SEQ ID NO: 99898 - DNA, 25 bp, Mus musculus
gaagaccgtgtccatcaaagtgaga

SEQ ID NO: 99899 - DNA, 25 bp, Mus musculus
gaagacctcagtagtgttcaacaag

SEQ ID NO: 99900 - DNA, 25 bp, Mus musculus
gaagacctcatctgcagaaatgcct

SEQ ID NO: 99901 - DNA, 25 bp, Mus musculus
gaagacctccctgaagtttaaagct

SEQ ID NO: 99902 - DNA, 25 bp, Mus musculus
gaagacctcgctggcagatcaggag

SEQ ID NO: 99903 - DNA, 25 bp, Mus musculus
gaagacctctcttacgtgaaccgaa

SEQ ID NO: 99904 - DNA, 25 bp, Mus musculus
gaagacctgcctggatgggaaccac

SEQ ID NO: 99905 - DNA, 25 bp, Mus musculus
gaagacctggaaaaccgtatccctg

SEQ ID NO: 99906 - DNA, 25 bp, Mus musculus
gaagacctggaatgctaacggctgc

SEQ ID NO: 99907 - DNA, 25 bp, Mus musculus
gaagacctggacttagagtgtgcca

SEQ ID NO: 99908 - DNA, 25 bp, Mus musculus
gaagacctggccgattggctcaatg

SEQ ID NO: 99909 - DNA, 25 bp, Mus musculus
gaagacctggtgcagagatcctcct

SEQ ID NO: 99910 - DNA, 25 bp, Mus musculus
gaagacctgttcagccttattgaga

SEQ ID NO: 99911 - DNA, 25 bp, Mus musculus
gaagaccttggtggtgttcaggccc

SEQ ID NO: 99912 - DNA, 25 bp, Mus musculus
gaagacgaacatcgcagaccttgtg

SEQ ID NO: 99913 - DNA, 25 bp, Mus musculus
gaagacgaagagtttggagcacctc

SEQ ID NO: 99914 - DNA, 25 bp, Mus musculus
gaagacgaagccctagacgaatgga

SEQ ID NO: 99915 - DNA, 25 bp, Mus musculus
gaagacgacgattagacctccagga

SEQ ID NO: 99916 - DNA, 25 bp, Mus musculus
gaagacgacggagacctgatcaccg

SEQ ID NO: 99917 - DNA, 25 bp, Mus musculus
gaagacgagctgctgcatgcttaca

SEQ ID NO: 99918 - DNA, 25 bp, Mus musculus
gaagacgatgatgcagaggctgcct

SEQ ID NO: 99919 - DNA, 25 bp, Mus musculus
gaagacgatgctgtgtatgaggacc

SEQ ID NO: 99920 - DNA, 25 bp, Mus musculus
gaagacgcaggttcaacatcaatga

SEQ ID NO: 99921 - DNA, 25 bp, Mus musculus
gaagacgccactgtaccggaatcag

SEQ ID NO: 99922 - DNA, 25 bp, Mus musculus
gaagacgccatgcagatcatggaac

SEQ ID NO: 99923 - DNA, 25 bp, Mus musculus
gaagacgccctatgcctgtactgag

SEQ ID NO: 99924 - DNA, 25 bp, Mus musculus
gaagacgccttactttaccagagca

SEQ ID NO: 99925 - DNA, 25 bp, Mus musculus
gaagacgcgggcctcaaaaagtgta

SEQ ID NO: 99926 - DNA, 25 bp, Mus musculus
gaagacggagctgtagtgaacaccc

SEQ ID NO: 99927 - DNA, 25 bp, Mus musculus
gaagacggcgccgtatgtggtctca

SEQ ID NO: 99928 - DNA, 25 bp, Mus musculus
gaagacggtctgcatacctgagcca

SEQ ID NO: 99929 - DNA, 25 bp, Mus musculus
gaagacgtagctcactttggccaag

SEQ ID NO: 99930 - DNA, 25 bp, Mus musculus
gaagacgtcaattcctctgctcagc

SEQ ID NO: 99931 - DNA, 25 bp, Mus musculus
gaagacgtcacccactgccatggtt

SEQ ID NO: 99932 - DNA, 25 bp, Mus musculus
gaagacgtgagcgaaatgaccagcg

SEQ ID NO: 99933 - DNA, 25 bp, Mus musculus
gaagacgttggcatttagcatcccc

SEQ ID NO: 99934 - DNA, 25 bp, Mus musculus
gaagactaaagactggaactccacc

SEQ ID NO: 99935 - DNA, 25 bp, Mus musculus
gaagactacagcttcacggcttacg

SEQ ID NO: 99936 - DNA, 25 bp, Mus musculus
gaagactatgaagacagcactgcag

SEQ ID NO: 99937 - DNA, 25 bp, Mus musculus
gaagactattggaggcacaggacac

SEQ ID NO: 99938 - DNA, 25 bp, Mus musculus
gaagactcagaggtgttcaagatgc

SEQ ID NO: 99939 - DNA, 25 bp, Mus musculus
gaagactcagctttactccagatgg

SEQ ID NO: 99940 - DNA, 25 bp, Mus musculus
gaagactcatcagctggacaaggtg

SEQ ID NO: 99941 - DNA, 25 bp, Mus musculus
gaagactccacccaattgcagaatg

SEQ ID NO: 99942 - DNA, 25 bp, Mus musculus
gaagactccacttctcggactgcag

SEQ ID NO: 99943 - DNA, 25 bp, Mus musculus
gaagactcctattcgttcctggcac

SEQ ID NO: 99944 - DNA, 25 bp, Mus musculus
gaagactcggttcatcatccatggc

SEQ ID NO: 99945 - DNA, 25 bp, Mus musculus
gaagactcgttcaagccatcaggaa

SEQ ID NO: 99946 - DNA, 25 bp, Mus musculus
gaagactctacaattctacaaatgg

SEQ ID NO: 99947 - DNA, 25 bp, Mus musculus
gaagactctctacaggaaatcagca

SEQ ID NO: 99948 - DNA, 25 bp, Mus musculus
gaagactgccttccggttggagtat

SEQ ID NO: 99949 - DNA, 25 bp, Mus musculus
gaagactgctgtggctccaggtgct

SEQ ID NO: 99950 - DNA, 25 bp, Mus musculus
gaagactggagacctcattcctggg

SEQ ID NO: 99951 - DNA, 25 bp, Mus musculus
gaagactggtattctcctggcatct

SEQ ID NO: 99952 - DNA, 25 bp, Mus musculus
gaagactggtcagagctacctagcg

SEQ ID NO: 99953 - DNA, 25 bp, Mus musculus
gaagactggtggaattgacctgtcc

SEQ ID NO: 99954 - DNA, 25 bp, Mus musculus
gaagactgtgtgctcgccgaaagtc

SEQ ID NO: 99955 - DNA, 25 bp, Mus musculus
gaagacttacgatccctctggtgac

SEQ ID NO: 99956 - DNA, 25 bp, Mus musculus
gaagacttcattgctagtggcagcg

SEQ ID NO: 99957 - DNA, 25 bp, Mus musculus
gaagacttccccttggctgaaaaag

SEQ ID NO: 99958 - DNA, 25 bp, Mus musculus
gaagacttcgctgatgaacagagcc

SEQ ID NO: 99959 - DNA, 25 bp, Mus musculus
gaagacttggaactggccattgcac

SEQ ID NO: 99960 - DNA, 25 bp, Mus musculus
gaagacttgtaaatggatgctgcaa

SEQ ID NO: 99961 - DNA, 25 bp, Mus musculus
gaagactttccgaacagagcgtcct

SEQ ID NO: 99962 - DNA, 25 bp, Mus musculus
gaagactttctacaggacagccatg

SEQ ID NO: 99963 - DNA, 25 bp, Mus musculus
gaagactttgctaagccagagaacg

SEQ ID NO: 99964 - DNA, 25 bp, Mus musculus
gaagagaaacccgaagaacacaaga

SEQ ID NO: 99965 - DNA, 25 bp, Mus musculus
gaagagaaaggttcgagaccgagct

SEQ ID NO: 99966 - DNA, 25 bp, Mus musculus
gaagagaaatgcctgcaggagcctt

SEQ ID NO: 99967 - DNA, 25 bp, Mus musculus
gaagagaacccttatgactcgatgg

SEQ ID NO: 99968 - DNA, 25 bp, Mus musculus
gaagagaacgttcgccgcatagctg

SEQ ID NO: 99969 - DNA, 25 bp, Mus musculus
gaagagaacttctggccctggtgaa

SEQ ID NO: 99970 - DNA, 25 bp, Mus musculus
gaagagaagaataagaaagccaggc

SEQ ID NO: 99971 - DNA, 25 bp, Mus musculus
gaagagaagacgacaatcaagcgca

SEQ ID NO: 99972 - DNA, 25 bp, Mus musculus
gaagagaagcatcggctacgacgac

SEQ ID NO: 99973 - DNA, 25 bp, Mus musculus
gaagagaagcccaaagccgtagtta

SEQ ID NO: 99974 - DNA, 25 bp, Mus musculus
gaagagaagcccgatgaatggaacc

SEQ ID NO: 99975 - DNA, 25 bp, Mus musculus
gaagagaaggagaattgtcacctgg

SEQ ID NO: 99976 - DNA, 25 bp, Mus musculus
gaagagaagtcgtgagaaacagtgc

SEQ ID NO: 99977 - DNA, 25 bp, Mus musculus
gaagagaatatcaggctccgccatc

SEQ ID NO: 99978 - DNA, 25 bp, Mus musculus
gaagagaatattgatgtcaccagca

SEQ ID NO: 99979 - DNA, 25 bp, Mus musculus
gaagagacaagctggcccttgggtc

SEQ ID NO: 99980 - DNA, 25 bp, Mus musculus
gaagagacaccctctgggtcacagg

SEQ ID NO: 99981 - DNA, 25 bp, Mus musculus
gaagagacccttgcacaatgcctga

SEQ ID NO: 99982 - DNA, 25 bp, Mus musculus
gaagagacctcatggccggcttttg

SEQ ID NO: 99983 - DNA, 25 bp, Mus musculus
gaagagacgacagcttgacgaacag

SEQ ID NO: 99984 - DNA, 25 bp, Mus musculus
gaagagacgcttaccacagaaggca

SEQ ID NO: 99985 - DNA, 25 bp, Mus musculus
gaagagactcgcaggattgcacgga

SEQ ID NO: 99986 - DNA, 25 bp, Mus musculus
gaagagagaaaggttctcctggaac

SEQ ID NO: 99987 - DNA, 25 bp, Mus musculus
gaagagagaccctcgtgactggact

SEQ ID NO: 99988 - DNA, 25 bp, Mus musculus
gaagagagatctcctcctaagtgga

SEQ ID NO: 99989 - DNA, 25 bp, Mus musculus
gaagagagatttccagccatccaca

SEQ ID NO: 99990 - DNA, 25 bp, Mus musculus
gaagagagccttcagtcaactgcca

SEQ ID NO: 99991 - DNA, 25 bp, Mus musculus
gaagagagcggttctactcacccat

SEQ ID NO: 99992 - DNA, 25 bp, Mus musculus
gaagagagctctggtaccctgtgct

SEQ ID NO: 99993 - DNA, 25 bp, Mus musculus
gaagagaggatctgccatgcggtca

SEQ ID NO: 99994 - DNA, 25 bp, Mus musculus
gaagagaggcacgtgagtcatcaga

SEQ ID NO: 99995 - DNA, 25 bp, Mus musculus
gaagagaggctgaacaggcatgatc

SEQ ID NO: 99996 - DNA, 25 bp, Mus musculus
gaagagagtcacagactgggcactc

SEQ ID NO: 99997 - DNA, 25 bp, Mus musculus
gaagagagtgtccaaggccactgtc

SEQ ID NO: 99998 - DNA, 25 bp, Mus musculus
gaagagataagtttagtccccggcg

SEQ ID NO: 99999 - DNA, 25 bp, Mus musculus
gaagagatacttcagcatctgcaga

SEQ ID NO: 100000 - DNA, 25 bp, Mus musculus
gaagagatagcagagccactggtcc

SEQ ID NO: 100001 - DNA, 25 bp, Mus musculus
gaagagatagtgtcacttgtcccac

SEQ ID NO: 100002 - DNA, 25 bp, Mus musculus
gaagagatcatgctagcctttagcc

SEQ ID NO: 100003 - DNA, 25 bp, Mus musculus
gaagagatccagttcttaaggaaga

SEQ ID NO: 100004 - DNA, 25 bp, Mus musculus
gaagagatcccatcaggaagccaag

SEQ ID NO: 100005 - DNA, 25 bp, Mus musculus
gaagagatccgaatctgtgcccagc

SEQ ID NO: 100006 - DNA, 25 bp, Mus musculus
gaagagatcgcgaaagacctgctgt

SEQ ID NO: 100007 - DNA, 25 bp, Mus musculus
gaagagatctacattaaccagctgg

SEQ ID NO: 100008 - DNA, 25 bp, Mus musculus
gaagagatctccagcagcatcgaca

SEQ ID NO: 100009 - DNA, 25 bp, Mus musculus
gaagagatctccttctgcaccagag

SEQ ID NO: 100010 - DNA, 25 bp, Mus musculus
gaagagatgataaagatggcccact

SEQ ID NO: 100011 - DNA, 25 bp, Mus musculus
gaagagatgccggtttgttgaatca

SEQ ID NO: 100012 - DNA, 25 bp, Mus musculus
gaagagatggctaaaatcgcctgca

SEQ ID NO: 100013 - DNA, 25 bp, Mus musculus
gaagagattcgttaagcctgaggag

SEQ ID NO: 100014 - DNA, 25 bp, Mus musculus
gaagagattgaaagccacccttggc

SEQ ID NO: 100015 - DNA, 25 bp, Mus musculus
gaagagattgacctggctttccagc

SEQ ID NO: 100016 - DNA, 25 bp, Mus musculus
gaagagattgctcgtatcgcccgga

SEQ ID NO: 100017 - DNA, 25 bp, Mus musculus
gaagagattgctgatgcccgagagc

SEQ ID NO: 100018 - DNA, 25 bp, Mus musculus
gaagagattgcttccaccgacctga

SEQ ID NO: 100019 - DNA, 25 bp, Mus musculus
gaagagcacagacctaactgaaggg

SEQ ID NO: 100020 - DNA, 25 bp, Mus musculus
gaagagcacatcattccgaccagga

SEQ ID NO: 100021 - DNA, 25 bp, Mus musculus
gaagagcaccttcgtttgttgaact

SEQ ID NO: 100022 - DNA, 25 bp, Mus musculus
gaagagcacttgcagctactacgag

SEQ ID NO: 100023 - DNA, 25 bp, Mus musculus
gaagagcatcgacctcatccagaag

SEQ ID NO: 100024 - DNA, 25 bp, Mus musculus
gaagagcatgttccacaccagggtc

SEQ ID NO: 100025 - DNA, 25 bp, Mus musculus
gaagagcattgcaccgcagtgctgg

SEQ ID NO: 100026 - DNA, 25 bp, Mus musculus
gaagagcatttagaattctccacca

SEQ ID NO: 100027 - DNA, 25 bp, Mus musculus
gaagagccaagctggaagatacaca

SEQ ID NO: 100028 - DNA, 25 bp, Mus musculus
gaagagccagagtgtcagaatctca

SEQ ID NO: 100029 - DNA, 25 bp, Mus musculus
gaagagccatcctgacgtctgaaag

SEQ ID NO: 100030 - DNA, 25 bp, Mus musculus
gaagagccatgtgcaaaggttccgc

SEQ ID NO: 100031 - DNA, 25 bp, Mus musculus
gaagagcccagcgacactaaggata

SEQ ID NO: 100032 - DNA, 25 bp, Mus musculus
gaagagcccatcgtggacacttgcc

SEQ ID NO: 100033 - DNA, 25 bp, Mus musculus
gaagagccccttatagtcacgaagt

SEQ ID NO: 100034 - DNA, 25 bp, Mus musculus
gaagagccctttggttcccagaagt

SEQ ID NO: 100035 - DNA, 25 bp, Mus musculus
gaagagccgaagagctccggttcgc

SEQ ID NO: 100036 - DNA, 25 bp, Mus musculus
gaagagcctagtacctctcacagtg

SEQ ID NO: 100037 - DNA, 25 bp, Mus musculus
gaagagcgaatgtttaaagaaaatc

SEQ ID NO: 100038 - DNA, 25 bp, Mus musculus
gaagagcgcccgactcaggtattga

SEQ ID NO: 100039 - DNA, 25 bp, Mus musculus
gaagagcgctcctgatgtctatgta

SEQ ID NO: 100040 - DNA, 25 bp, Mus musculus
gaagagcggccaaataaagaagaca

SEQ ID NO: 100041 - DNA, 25 bp, Mus musculus
gaagagcgggtgctgctgacaggtc

SEQ ID NO: 100042 - DNA, 25 bp, Mus musculus
gaagagcgtcttgtctgcagtaact

SEQ ID NO: 100043 - DNA, 25 bp, Mus musculus
gaagagctcacgcagatggtctcca

SEQ ID NO: 100044 - DNA, 25 bp, Mus musculus
gaagagctccggagacttcgagaac

SEQ ID NO: 100045 - DNA, 25 bp, Mus musculus
gaagagctctcacccagcattgaca

SEQ ID NO: 100046 - DNA, 25 bp, Mus musculus
gaagagctgcatcagacatacctag

SEQ ID NO: 100047 - DNA, 25 bp, Mus musculus
gaagagctgccctctgccaatgggt

SEQ ID NO: 100048 - DNA, 25 bp, Mus musculus
gaagagcttcatcaggaccaagggc

SEQ ID NO: 100049 - DNA, 25 bp, Mus musculus
gaagagcttcatgcaaaagtcacct

SEQ ID NO: 100050 - DNA, 25 bp, Mus musculus
gaagagcttctcacagtgaaaggaa

SEQ ID NO: 100051 - DNA, 25 bp, Mus musculus
gaagagcttgctaggagtcaaagag

SEQ ID NO: 100052 - DNA, 25 bp, Mus musculus
gaagagcttgtcaggaccgcagaag

SEQ ID NO: 100053 - DNA, 25 bp, Mus musculus
gaagagctttcacaggattcagcaa

SEQ ID NO: 100054 - DNA, 25 bp, Mus musculus
gaagaggaaggcatcagtggccatc

SEQ ID NO: 100055 - DNA, 25 bp, Mus musculus
gaagaggacctgactcctttccgag

SEQ ID NO: 100056 - DNA, 25 bp, Mus musculus
gaagaggacgttcttgagaccacgc

SEQ ID NO: 100057 - DNA, 25 bp, Mus musculus
gaagaggactatcctttccacgagg

SEQ ID NO: 100058 - DNA, 25 bp, Mus musculus
gaagaggactatgctaatgtcagaa

SEQ ID NO: 100059 - DNA, 25 bp, Mus musculus
gaagaggatacgtcaggccaagagc

SEQ ID NO: 100060 - DNA, 25 bp, Mus musculus
gaagaggatcaatggattctgcacc

SEQ ID NO: 100061 - DNA, 25 bp, Mus musculus
gaagaggatgaaccaacgttagaag

SEQ ID NO: 100062 - DNA, 25 bp, Mus musculus
gaagaggccacgttttgatcaccat

SEQ ID NO: 100063 - DNA, 25 bp, Mus musculus
gaagaggccagatgaggttcctgat

SEQ ID NO: 100064 - DNA, 25 bp, Mus musculus
gaagaggccgttacaagctaccaga

SEQ ID NO: 100065 - DNA, 25 bp, Mus musculus
gaagaggcctagctttgtagaagaa

SEQ ID NO: 100066 - DNA, 25 bp, Mus musculus
gaagaggccttctggatagacaaga

SEQ ID NO: 100067 - DNA, 25 bp, Mus musculus
gaagaggcgcttcacaaatacgaca

SEQ ID NO: 100068 - DNA, 25 bp, Mus musculus
gaagaggctccacaacagttttccg

SEQ ID NO: 100069 - DNA, 25 bp, Mus musculus
gaagaggctcctagctgtttcagta

SEQ ID NO: 100070 - DNA, 25 bp, Mus musculus
gaagaggctgagaagattccagtca

SEQ ID NO: 100071 - DNA, 25 bp, Mus musculus
gaagaggcttcaccccaaaaaccat

SEQ ID NO: 100072 - DNA, 25 bp, Mus musculus
gaagaggcttttcatcactggtccc

SEQ ID NO: 100073 - DNA, 25 bp, Mus musculus
gaagagggacacttggccgtgtact

SEQ ID NO: 100074 - DNA, 25 bp, Mus musculus
gaagagggatcgagcatttcctgga

SEQ ID NO: 100075 - DNA, 25 bp, Mus musculus
gaagagggcaacaattcagtttcac

SEQ ID NO: 100076 - DNA, 25 bp, Mus musculus
gaagagggcagtgatcaacacccgg

SEQ ID NO: 100077 - DNA, 25 bp, Mus musculus
gaagagggcctgtccgtcagttcat

SEQ ID NO: 100078 - DNA, 25 bp, Mus musculus
gaagagggctccaaaggtgggaagt

SEQ ID NO: 100079 - DNA, 25 bp, Mus musculus
gaagagggtaccagccatgatggat

SEQ ID NO: 100080 - DNA, 25 bp, Mus musculus
gaagaggtacttcctcctgagcata

SEQ ID NO: 100081 - DNA, 25 bp, Mus musculus
gaagaggtagcaacttgccccagcc

SEQ ID NO: 100082 - DNA, 25 bp, Mus musculus
gaagaggtagctcttaagaagcagt

SEQ ID NO: 100083 - DNA, 25 bp, Mus musculus
gaagaggtccattgcagacagcgag

SEQ ID NO: 100084 - DNA, 25 bp, Mus musculus
gaagaggtgcatgtaagctccaacg

SEQ ID NO: 100085 - DNA, 25 bp, Mus musculus
gaagagtacaagaatttccggcctg

SEQ ID NO: 100086 - DNA, 25 bp, Mus musculus
gaagagtacacaagttgaagacaca

SEQ ID NO: 100087 - DNA, 25 bp, Mus musculus
gaagagtacagaggagcaagttccc

SEQ ID NO: 100088 - DNA, 25 bp, Mus musculus
gaagagtaccccagaaccagtggac

SEQ ID NO: 100089 - DNA, 25 bp, Mus musculus
gaagagtacgataccctgggaacac

SEQ ID NO: 100090 - DNA, 25 bp, Mus musculus
gaagagtagtgtctctgagtcctcc

SEQ ID NO: 100091 - DNA, 25 bp, Mus musculus
gaagagtatagtgccatgcgggacc

SEQ ID NO: 100092 - DNA, 25 bp, Mus musculus
gaagagtatctgcaagcccaagtca

SEQ ID NO: 100093 - DNA, 25 bp, Mus musculus
gaagagtccaccctctggctttgac

SEQ ID NO: 100094 - DNA, 25 bp, Mus musculus
gaagagtccacgttcttcccttggt

SEQ ID NO: 100095 - DNA, 25 bp, Mus musculus
gaagagtcccaagtctttcagtgcc

SEQ ID NO: 100096 - DNA, 25 bp, Mus musculus
gaagagtcggagattagtcagtgca

SEQ ID NO: 100097 - DNA, 25 bp, Mus musculus
gaagagtctcaaatggacatgcaag

SEQ ID NO: 100098 - DNA, 25 bp, Mus musculus
gaagagtctcctcaatgctgcctgg

SEQ ID NO: 100099 - DNA, 25 bp, Mus musculus
gaagagtctctcatacattcgcatc

SEQ ID NO: 100100 - DNA, 25 bp, Mus musculus
gaagagtctgactgatccacagcag

SEQ ID NO: 100101 - DNA, 25 bp, Mus musculus
gaagagtgaacctgacgatttcctg

SEQ ID NO: 100102 - DNA, 25 bp, Mus musculus
gaagagtgcagaaggagacgtggct

SEQ ID NO: 100103 - DNA, 25 bp, Mus musculus
gaagagtgccctgacttccggtaag

SEQ ID NO: 100104 - DNA, 25 bp, Mus musculus
gaagagtggccagatggaaagcccc

SEQ ID NO: 100105 - DNA, 25 bp, Mus musculus
gaagagtgtcctgccgagaagttaa

SEQ ID NO: 100106 - DNA, 25 bp, Mus musculus
gaagagtgtcgtggccataaaagag

SEQ ID NO: 100107 - DNA, 25 bp, Mus musculus
gaagagtgttcttttctgtcagcaa

SEQ ID NO: 100108 - DNA, 25 bp, Mus musculus
gaagagtgtttgatgagtggcacca

SEQ ID NO: 100109 - DNA, 25 bp, Mus musculus
gaagagttagtatcagagcctgcct

SEQ ID NO: 100110 - DNA, 25 bp, Mus musculus
gaagagttcccacaggagatgctga

SEQ ID NO: 100111 - DNA, 25 bp, Mus musculus
gaagagttccttgaacacgaggccc

SEQ ID NO: 100112 - DNA, 25 bp, Mus musculus
gaagagttgcatatcatcgcgcagg

SEQ ID NO: 100113 - DNA, 25 bp, Mus musculus
gaagagttgcgctcattatccacaa

SEQ ID NO: 100114 - DNA, 25 bp, Mus musculus
gaagagttgcttttccagtacccag

SEQ ID NO: 100115 - DNA, 25 bp, Mus musculus
gaagagttgttggtaattgctagct

SEQ ID NO: 100116 - DNA, 25 bp, Mus musculus
gaagagtttgtacattacctccaag

SEQ ID NO: 100117 - DNA, 25 bp, Mus musculus
gaagataaaccatggcggaaacctg

SEQ ID NO: 100118 - DNA, 25 bp, Mus musculus
gaagataaaggccaccttccagggc

SEQ ID NO: 100119 - DNA, 25 bp, Mus musculus
gaagataaattagagcagagtcaga

SEQ ID NO: 100120 - DNA, 25 bp, Mus musculus
gaagataactacaaaagactcagag

SEQ ID NO: 100121 - DNA, 25 bp, Mus musculus
gaagataactcaaatgatgggaccc

SEQ ID NO: 100122 - DNA, 25 bp, Mus musculus
gaagataatgactatggccgagccg

SEQ ID NO: 100123 - DNA, 25 bp, Mus musculus
gaagataccccatagcacgagtgtt

SEQ ID NO: 100124 - DNA, 25 bp, Mus musculus
gaagatacgacagaaaaaccaggcg

SEQ ID NO: 100125 - DNA, 25 bp, Mus musculus
gaagatagaagatgctggaggccct

SEQ ID NO: 100126 - DNA, 25 bp, Mus musculus
gaagatagccagctttctagacaag

SEQ ID NO: 100127 - DNA, 25 bp, Mus musculus
gaagataggctttgcctgcccagtc

SEQ ID NO: 100128 - DNA, 25 bp, Mus musculus
gaagatatagcaaggccagggctca

SEQ ID NO: 100129 - DNA, 25 bp, Mus musculus
gaagatatcattcacggcagtggga

SEQ ID NO: 100130 - DNA, 25 bp, Mus musculus
gaagatatcctcctgagagttgtct

SEQ ID NO: 100131 - DNA, 25 bp, Mus musculus
gaagatatcgaaggcattctgcaga

SEQ ID NO: 100132 - DNA, 25 bp, Mus musculus
gaagatatctacctctaatggcagt

SEQ ID NO: 100133 - DNA, 25 bp, Mus musculus
gaagatatgactgcccgaatcagca

SEQ ID NO: 100134 - DNA, 25 bp, Mus musculus
gaagatatgatacccacagtgggct

SEQ ID NO: 100135 - DNA, 25 bp, Mus musculus
gaagatattgggacattggacctca

SEQ ID NO: 100136 - DNA, 25 bp, Mus musculus
gaagatattttccacatgccgagcc

SEQ ID NO: 100137 - DNA, 25 bp, Mus musculus
gaagatcaacctcctttgaaagaag

SEQ ID NO: 100138 - DNA, 25 bp, Mus musculus
gaagatcaacctgaagcatcgtggg

SEQ ID NO: 100139 - DNA, 25 bp, Mus musculus
gaagatcaagatcgagtcctcaggg

SEQ ID NO: 100140 - DNA, 25 bp, Mus musculus
gaagatcaagttcagctggctaggc

SEQ ID NO: 100141 - DNA, 25 bp, Mus musculus
gaagatcaattgaatgctgcacaga

SEQ ID NO: 100142 - DNA, 25 bp, Mus musculus
gaagatcaccagaagctctaagcta

SEQ ID NO: 100143 - DNA, 25 bp, Mus musculus
gaagatcaccatgtctccacggagc

SEQ ID NO: 100144 - DNA, 25 bp, Mus musculus
gaagatcagaagaatccatcgaata

SEQ ID NO: 100145 - DNA, 25 bp, Mus musculus
gaagatcagagtcctcaggcaacct

SEQ ID NO: 100146 - DNA, 25 bp, Mus musculus
gaagatcagcacagactccagaatg

SEQ ID NO: 100147 - DNA, 25 bp, Mus musculus
gaagatcagtgtgctctggaccctg

SEQ ID NO: 100148 - DNA, 25 bp, Mus musculus
gaagatcatccgtaatgtgggcaag

SEQ ID NO: 100149 - DNA, 25 bp, Mus musculus
gaagatcattgagacactgtcacag

SEQ ID NO: 100150 - DNA, 25 bp, Mus musculus
gaagatccacattgccgatggccct

SEQ ID NO: 100151 - DNA, 25 bp, Mus musculus
gaagatccactttccctgtagagcg

SEQ ID NO: 100152 - DNA, 25 bp, Mus musculus
gaagatcccacggttgctggtagga

SEQ ID NO: 100153 - DNA, 25 bp, Mus musculus
gaagatcccagttatcaccagagta

SEQ ID NO: 100154 - DNA, 25 bp, Mus musculus
gaagatcccgtacagatgtccatga

SEQ ID NO: 100155 - DNA, 25 bp, Mus musculus
gaagatccctgtcctggtgcagagc

SEQ ID NO: 100156 - DNA, 25 bp, Mus musculus
gaagatccctgttttgcatcgcaga

SEQ ID NO: 100157 - DNA, 25 bp, Mus musculus
gaagatccgctttggcagtgaccct

SEQ ID NO: 100158 - DNA, 25 bp, Mus musculus
gaagatccgtgagattgtcctcagc

SEQ ID NO: 100159 - DNA, 25 bp, Mus musculus
gaagatccgtgctattcaggctgag

SEQ ID NO: 100160 - DNA, 25 bp, Mus musculus
gaagatcctcaagtattcttagctg

SEQ ID NO: 100161 - DNA, 25 bp, Mus musculus
gaagatcctctcttcagtggcgtga

SEQ ID NO: 100162 - DNA, 25 bp, Mus musculus
gaagatcctggaccctaacagtggg

SEQ ID NO: 100163 - DNA, 25 bp, Mus musculus
gaagatcctggtgaaaaccttggag

SEQ ID NO: 100164 - DNA, 25 bp, Mus musculus
gaagatcggattctcatggcacatg

SEQ ID NO: 100165 - DNA, 25 bp, Mus musculus
gaagatcgtggctcccatcagtgac

SEQ ID NO: 100166 - DNA, 25 bp, Mus musculus
gaagatctacagtactctggctggc

SEQ ID NO: 100167 - DNA, 25 bp, Mus musculus
gaagatctaccacatcattaaggaa

SEQ ID NO: 100168 - DNA, 25 bp, Mus musculus
gaagatctacgcacgcatcagcatg

SEQ ID NO: 100169 - DNA, 25 bp, Mus musculus
gaagatctcaacgactgggttgccg

SEQ ID NO: 100170 - DNA, 25 bp, Mus musculus
gaagatctcaatccccgctggaatg

SEQ ID NO: 100171 - DNA, 25 bp, Mus musculus
gaagatctcagatccagagtgcaga

SEQ ID NO: 100172 - DNA, 25 bp, Mus musculus
gaagatctccaaacaaaaggtgtcc

SEQ ID NO: 100173 - DNA, 25 bp, Mus musculus
gaagatctcccaatatgcttgccag

SEQ ID NO: 100174 - DNA, 25 bp, Mus musculus
gaagatctcccctgaacaacactgg

SEQ ID NO: 100175 - DNA, 25 bp, Mus musculus
gaagatctcgcacgtcgggtgaacc

SEQ ID NO: 100176 - DNA, 25 bp, Mus musculus
gaagatctgcctctaagtcccaggt

SEQ ID NO: 100177 - DNA, 25 bp, Mus musculus
gaagatctggaagagctatgtcctg

SEQ ID NO: 100178 - DNA, 25 bp, Mus musculus
gaagatcttccgcttccaggacaca

SEQ ID NO: 100179 - DNA, 25 bp, Mus musculus
gaagatcttgaattccacagcccat

SEQ ID NO: 100180 - DNA, 25 bp, Mus musculus
gaagatctttccacatcctggcagt

SEQ ID NO: 100181 - DNA, 25 bp, Mus musculus
gaagatgaagaactgagcccaacgt

SEQ ID NO: 100182 - DNA, 25 bp, Mus musculus
gaagatgacagggacaggtgcccac

SEQ ID NO: 100183 - DNA, 25 bp, Mus musculus
gaagatgacatcctgcaaacccatg

SEQ ID NO: 100184 - DNA, 25 bp, Mus musculus
gaagatgaccagctaccctttggtg

SEQ ID NO: 100185 - DNA, 25 bp, Mus musculus
gaagatgaccctcaacctaatgaga

SEQ ID NO: 100186 - DNA, 25 bp, Mus musculus
gaagatgacgagtcagaggactccc

SEQ ID NO: 100187 - DNA, 25 bp, Mus musculus
gaagatgactgcatgtttccctcca

SEQ ID NO: 100188 - DNA, 25 bp, Mus musculus
gaagatgactgcgtggtccacctgg

SEQ ID NO: 100189 - DNA, 25 bp, Mus musculus
gaagatgagatctttaacaagcccg

SEQ ID NO: 100190 - DNA, 25 bp, Mus musculus
gaagatgagcacaaccagaatggga

SEQ ID NO: 100191 - DNA, 25 bp, Mus musculus
gaagatgagcactctgtgaactaca

SEQ ID NO: 100192 - DNA, 25 bp, Mus musculus
gaagatgaggaggtcgctgagagct

SEQ ID NO: 100193 - DNA, 25 bp, Mus musculus
gaagatgagtgtgatcgtcccaggc

SEQ ID NO: 100194 - DNA, 25 bp, Mus musculus
gaagatgagttttccccgctcaaga

SEQ ID NO: 100195 - DNA, 25 bp, Mus musculus
gaagatgatattgtgaccccaggta

SEQ ID NO: 100196 - DNA, 25 bp, Mus musculus
gaagatgatgaggatttgccccacc

SEQ ID NO: 100197 - DNA, 25 bp, Mus musculus
gaagatgatgagtgacgctagtgac

SEQ ID NO: 100198 - DNA, 25 bp, Mus musculus
gaagatgatggcattaagaaggccc

SEQ ID NO: 100199 - DNA, 25 bp, Mus musculus
gaagatgccaaatcccttacctgtg

SEQ ID NO: 100200 - DNA, 25 bp, Mus musculus
gaagatgccacccaagcgcatagct

SEQ ID NO: 100201 - DNA, 25 bp, Mus musculus
gaagatgccagaaagtaactccgca

SEQ ID NO: 100202 - DNA, 25 bp, Mus musculus
gaagatgccgatctcccaggaaagc

SEQ ID NO: 100203 - DNA, 25 bp, Mus musculus
gaagatgccgcttctcccaagtgtg

SEQ ID NO: 100204 - DNA, 25 bp, Mus musculus
gaagatgcctaagggactcagacag

SEQ ID NO: 100205 - DNA, 25 bp, Mus musculus
gaagatgcgtttggctctgcagaca

SEQ ID NO: 100206 - DNA, 25 bp, Mus musculus
gaagatgctcatcgaagccgtcatg

SEQ ID NO: 100207 - DNA, 25 bp, Mus musculus
gaagatgctgccctttaccggtacc

SEQ ID NO: 100208 - DNA, 25 bp, Mus musculus
gaagatgcttgattacctgcagggc

SEQ ID NO: 100209 - DNA, 25 bp, Mus musculus
gaagatggaatatttcaggccaaac

SEQ ID NO: 100210 - DNA, 25 bp, Mus musculus
gaagatggacacattgacaaagagc

SEQ ID NO: 100211 - DNA, 25 bp, Mus musculus
gaagatggaccctctaacaatgcga

SEQ ID NO: 100212 - DNA, 25 bp, Mus musculus
gaagatggagccacgcttgctgatg

SEQ ID NO: 100213 - DNA, 25 bp, Mus musculus
gaagatggaggagctttccctggcc

SEQ ID NO: 100214 - DNA, 25 bp, Mus musculus
gaagatggcctcctgttccgtgtcc

SEQ ID NO: 100215 - DNA, 25 bp, Mus musculus
gaagatggctgaatactatgctgac

SEQ ID NO: 100216 - DNA, 25 bp, Mus musculus
gaagatgggactcgatccaacacag

SEQ ID NO: 100217 - DNA, 25 bp, Mus musculus
gaagatggtataccctcaggctgac

SEQ ID NO: 100218 - DNA, 25 bp, Mus musculus
gaagatggtcctacaacagaagtcc

SEQ ID NO: 100219 - DNA, 25 bp, Mus musculus
gaagatggtcctcccacaaaacagg

SEQ ID NO: 100220 - DNA, 25 bp, Mus musculus
gaagatgtcaaagggatccacaggg

SEQ ID NO: 100221 - DNA, 25 bp, Mus musculus
gaagatgtcatacaggttccacgaa

SEQ ID NO: 100222 - DNA, 25 bp, Mus musculus
gaagatgtcatctgaagctgccgtc

SEQ ID NO: 100223 - DNA, 25 bp, Mus musculus
gaagatgtcctcaatacccagtgtg

SEQ ID NO: 100224 - DNA, 25 bp, Mus musculus
gaagatgtcctgcagaatgtcaacc

SEQ ID NO: 100225 - DNA, 25 bp, Mus musculus
gaagatgtctcaatacctggatagc

SEQ ID NO: 100226 - DNA, 25 bp, Mus musculus
gaagatgtctggaacaacacttgag

SEQ ID NO: 100227 - DNA, 25 bp, Mus musculus
gaagatgtgctaccacgccaatggc

SEQ ID NO: 100228 - DNA, 25 bp, Mus musculus
gaagatgttcccctgtcctgtgtta

SEQ ID NO: 100229 - DNA, 25 bp, Mus musculus
gaagatgtttcagtcccaacgagga

SEQ ID NO: 100230 - DNA, 25 bp, Mus musculus
gaagatgtttgtagatgtgcccgac

SEQ ID NO: 100231 - DNA, 25 bp, Mus musculus
gaagattatcccgtagaaattcacg

SEQ ID NO: 100232 - DNA, 25 bp, Mus musculus
gaagattcaagaacgaaatcagtgt

SEQ ID NO: 100233 - DNA, 25 bp, Mus musculus
gaagattcagccctgttggaacagg

SEQ ID NO: 100234 - DNA, 25 bp, Mus musculus
gaagattcagtcagtctcaatggca

SEQ ID NO: 100235 - DNA, 25 bp, Mus musculus
gaagattcatttcctatctcctcaa

SEQ ID NO: 100236 - DNA, 25 bp, Mus musculus
gaagattccagccagactggcaaca

SEQ ID NO: 100237 - DNA, 25 bp, Mus musculus
gaagattccgaccttggctgagtac

SEQ ID NO: 100238 - DNA, 25 bp, Mus musculus
gaagattccgccactaactgtagat

SEQ ID NO: 100239 - DNA, 25 bp, Mus musculus
gaagattcctcaggtactacaggcc

SEQ ID NO: 100240 - DNA, 25 bp, Mus musculus
gaagattccttgcaaagccagtgca

SEQ ID NO: 100241 - DNA, 25 bp, Mus musculus
gaagattcgcgagctagagggccat

SEQ ID NO: 100242 - DNA, 25 bp, Mus musculus
gaagattcggagtcgcctggaacac

SEQ ID NO: 100243 - DNA, 25 bp, Mus musculus
gaagattctccatctcctgaaggac

SEQ ID NO: 100244 - DNA, 25 bp, Mus musculus
gaagattctcctgctgtgcgtggca

SEQ ID NO: 100245 - DNA, 25 bp, Mus musculus
gaagattctgcgatggacagccagt

SEQ ID NO: 100246 - DNA, 25 bp, Mus musculus
gaagattcttccgatgacattgctg

SEQ ID NO: 100247 - DNA, 25 bp, Mus musculus
gaagattgaagctgactcacgcacc

SEQ ID NO: 100248 - DNA, 25 bp, Mus musculus
gaagattgacaagaaactggaccct

SEQ ID NO: 100249 - DNA, 25 bp, Mus musculus
gaagattgatattgccagtcggtcc

SEQ ID NO: 100250 - DNA, 25 bp, Mus musculus
gaagattgctaacgacaacagcctc

SEQ ID NO: 100251 - DNA, 25 bp, Mus musculus
gaagattgctcctgagatgccagcg

SEQ ID NO: 100252 - DNA, 25 bp, Mus musculus
gaagattgctttcaacgggtctgcc

SEQ ID NO: 100253 - DNA, 25 bp, Mus musculus
gaagattgtagatgaccccaaagct

SEQ ID NO: 100254 - DNA, 25 bp, Mus musculus
gaagattgtcccactccaagtaagc

SEQ ID NO: 100255 - DNA, 25 bp, Mus musculus
gaagattgtcctggccgcgacctga

SEQ ID NO: 100256 - DNA, 25 bp, Mus musculus
gaagatttagaagcagtctttgctg

SEQ ID NO: 100257 - DNA, 25 bp, Mus musculus
gaagatttcattcatagagcccgcc

SEQ ID NO: 100258 - DNA, 25 bp, Mus musculus
gaagatttcccttccaggacaaatg

SEQ ID NO: 100259 - DNA, 25 bp, Mus musculus
gaagatttctcctctccagtgaagc

SEQ ID NO: 100260 - DNA, 25 bp, Mus musculus
gaagatttgccgtacctttccacca

SEQ ID NO: 100261 - DNA, 25 bp, Mus musculus
gaagatttgctccatgccctgaggg

SEQ ID NO: 100262 - DNA, 25 bp, Mus musculus
gaagatttgtgacccgggcctcaca

SEQ ID NO: 100263 - DNA, 25 bp, Mus musculus
gaagattttattctgctggccagtg

SEQ ID NO: 100264 - DNA, 25 bp, Mus musculus
gaagattttgctaagtcgcgtgcca

SEQ ID NO: 100265 - DNA, 25 bp, Mus musculus
gaagattttggtgcccacgatgcca

SEQ ID NO: 100266 - DNA, 25 bp, Mus musculus
gaagcaaaaaccaataagaaatatg

SEQ ID NO: 100267 - DNA, 25 bp, Mus musculus
gaagcaaaacccgagaccattaatg

SEQ ID NO: 100268 - DNA, 25 bp, Mus musculus
gaagcaaaatcagcaagaccagcac

SEQ ID NO: 100269 - DNA, 25 bp, Mus musculus
gaagcaaactggttccggaatccct

SEQ ID NO: 100270 - DNA, 25 bp, Mus musculus
gaagcaaagactcagggccaggaaa

SEQ ID NO: 100271 - DNA, 25 bp, Mus musculus
gaagcaaattatcctgagacggtga

SEQ ID NO: 100272 - DNA, 25 bp, Mus musculus
gaagcaaattctgtggccgtggatg

SEQ ID NO: 100273 - DNA, 25 bp, Mus musculus
gaagcaaccgtaccctgaaagcatc

SEQ ID NO: 100274 - DNA, 25 bp, Mus musculus
gaagcaacgagttcatcataaccca

SEQ ID NO: 100275 - DNA, 25 bp, Mus musculus
gaagcaacggttggcccaaatcaga

SEQ ID NO: 100276 - DNA, 25 bp, Mus musculus
gaagcaactcccaggtgtgagcagt

SEQ ID NO: 100277 - DNA, 25 bp, Mus musculus
gaagcaactcgcaagcgggagctga

SEQ ID NO: 100278 - DNA, 25 bp, Mus musculus
gaagcaactggatcctactcagcgg

SEQ ID NO: 100279 - DNA, 25 bp, Mus musculus
gaagcaactggccttagccctttat

SEQ ID NO: 100280 - DNA, 25 bp, Mus musculus
gaagcaacttcgtcatcggcagcag

SEQ ID NO: 100281 - DNA, 25 bp, Mus musculus
gaagcaagaagttatcagcaccagc

SEQ ID NO: 100282 - DNA, 25 bp, Mus musculus
gaagcaagaattcagtgacccgtcg

SEQ ID NO: 100283 - DNA, 25 bp, Mus musculus
gaagcaagacccaaggacagtgaga

SEQ ID NO: 100284 - DNA, 25 bp, Mus musculus
gaagcaagacttaccccaagagggt

SEQ ID NO: 100285 - DNA, 25 bp, Mus musculus
gaagcaagagataaggctggcctcc

SEQ ID NO: 100286 - DNA, 25 bp, Mus musculus
gaagcaagagtaccttctgaaggac

SEQ ID NO: 100287 - DNA, 25 bp, Mus musculus
gaagcaagcacccatttccatcggt

SEQ ID NO: 100288 - DNA, 25 bp, Mus musculus
gaagcaagccactctgacctgggtg

SEQ ID NO: 100289 - DNA, 25 bp, Mus musculus
gaagcaagcctctgtcatttggaac

SEQ ID NO: 100290 - DNA, 25 bp, Mus musculus
gaagcaagcctgttgcgccatttcc

SEQ ID NO: 100291 - DNA, 25 bp, Mus musculus
gaagcaagcctttgtgcaacgagac

SEQ ID NO: 100292 - DNA, 25 bp, Mus musculus
gaagcaaggtgtacctgtggtcccc

SEQ ID NO: 100293 - DNA, 25 bp, Mus musculus
gaagcaagtctctctctagtgtgga

SEQ ID NO: 100294 - DNA, 25 bp, Mus musculus
gaagcaagtggcagaaaaagtccca

SEQ ID NO: 100295 - DNA, 25 bp, Mus musculus
gaagcacaaaaggacttggccactg

SEQ ID NO: 100296 - DNA, 25 bp, Mus musculus
gaagcacaagtcagagcctcagtac

SEQ ID NO: 100297 - DNA, 25 bp, Mus musculus
gaagcacacactactgagaaccagg

SEQ ID NO: 100298 - DNA, 25 bp, Mus musculus
gaagcacagagtactagccgggagc

SEQ ID NO: 100299 - DNA, 25 bp, Mus musculus
gaagcacagcatcgtttacaatcct

SEQ ID NO: 100300 - DNA, 25 bp, Mus musculus
gaagcacagccagacggatcttgtg

SEQ ID NO: 100301 - DNA, 25 bp, Mus musculus
gaagcacagctattccctggagaag

SEQ ID NO: 100302 - DNA, 25 bp, Mus musculus
gaagcacagtctttgggaccctgca

SEQ ID NO: 100303 - DNA, 25 bp, Mus musculus
gaagcacatgccatacaaccatcag

SEQ ID NO: 100304 - DNA, 25 bp, Mus musculus
gaagcacattcaagtcctgggccgt

SEQ ID NO: 100305 - DNA, 25 bp, Mus musculus
gaagcaccagctgaaacacagggag

SEQ ID NO: 100306 - DNA, 25 bp, Mus musculus
gaagcaccagtctcagggaatcagc

SEQ ID NO: 100307 - DNA, 25 bp, Mus musculus
gaagcaccattcacttcaacagcca

SEQ ID NO: 100308 - DNA, 25 bp, Mus musculus
gaagcacccagttgacatccgactt

SEQ ID NO: 100309 - DNA, 25 bp, Mus musculus
gaagcacccgttattcacaggttgc

SEQ ID NO: 100310 - DNA, 25 bp, Mus musculus
gaagcaccctccaccattgtgatag

SEQ ID NO: 100311 - DNA, 25 bp, Mus musculus
gaagcaccgctgtacctgttctcta

SEQ ID NO: 100312 - DNA, 25 bp, Mus musculus
gaagcacctaatcactgtcaagttg

SEQ ID NO: 100313 - DNA, 25 bp, Mus musculus
gaagcacggcaaggatgacgtcacc

SEQ ID NO: 100314 - DNA, 25 bp, Mus musculus
gaagcacgtcttggaacagagcacc

SEQ ID NO: 100315 - DNA, 25 bp, Mus musculus
gaagcactactttgttgcctagaga

SEQ ID NO: 100316 - DNA, 25 bp, Mus musculus
gaagcactcagacttttggacagaa

SEQ ID NO: 100317 - DNA, 25 bp, Mus musculus
gaagcactgcgcaagatgggactac

SEQ ID NO: 100318 - DNA, 25 bp, Mus musculus
gaagcactgctgagtcataacctgg

SEQ ID NO: 100319 - DNA, 25 bp, Mus musculus
gaagcactggcctttgccagggact

SEQ ID NO: 100320 - DNA, 25 bp, Mus musculus
gaagcactgtaaaacctaacacctg

SEQ ID NO: 100321 - DNA, 25 bp, Mus musculus
gaagcacttccgagacacggttggc

SEQ ID NO: 100322 - DNA, 25 bp, Mus musculus
gaagcagaaacaagggtggatgttc

SEQ ID NO: 100323 - DNA, 25 bp, Mus musculus
gaagcagaaagaaaacggcctcgca

SEQ ID NO: 100324 - DNA, 25 bp, Mus musculus
gaagcagaactcgtttcaggcagcc

SEQ ID NO: 100325 - DNA, 25 bp, Mus musculus
gaagcagaactgcaagagctcatga

SEQ ID NO: 100326 - DNA, 25 bp, Mus musculus
gaagcagaagccgttgagtcagccg

SEQ ID NO: 100327 - DNA, 25 bp, Mus musculus
gaagcagacacgttgctctgtgaga

SEQ ID NO: 100328 - DNA, 25 bp, Mus musculus
gaagcagacactggtcaagctgcct

SEQ ID NO: 100329 - DNA, 25 bp, Mus musculus
gaagcagactcctaccagtgatgga

SEQ ID NO: 100330 - DNA, 25 bp, Mus musculus
gaagcagactgacttaggattcttg

SEQ ID NO: 100331 - DNA, 25 bp, Mus musculus
gaagcagagaaagtccaagcagccc

SEQ ID NO: 100332 - DNA, 25 bp, Mus musculus
gaagcagagaatagccaacgagtcc

SEQ ID NO: 100333 - DNA, 25 bp, Mus musculus
gaagcagagcctcttgagagccgct

SEQ ID NO: 100334 - DNA, 25 bp, Mus musculus
gaagcagaggagtatcatgaagaac

SEQ ID NO: 100335 - DNA, 25 bp, Mus musculus
gaagcagaggtcataaaggactcac

SEQ ID NO: 100336 - DNA, 25 bp, Mus musculus
gaagcagaggtcatatcattaggtc

SEQ ID NO: 100337 - DNA, 25 bp, Mus musculus
gaagcagaggtctcagcgtcatcca

SEQ ID NO: 100338 - DNA, 25 bp, Mus musculus
gaagcagagtgctagacagcctggc

SEQ ID NO: 100339 - DNA, 25 bp, Mus musculus
gaagcagagttctacaacattggtc

SEQ ID NO: 100340 - DNA, 25 bp, Mus musculus
gaagcagagtttccctcaggcacta

SEQ ID NO: 100341 - DNA, 25 bp, Mus musculus
gaagcagatcataattccgcagagg

SEQ ID NO: 100342 - DNA, 25 bp, Mus musculus
gaagcagatggcaatgtcacaggca

SEQ ID NO: 100343 - DNA, 25 bp, Mus musculus
gaagcagattgccaagtgccagcaa

SEQ ID NO: 100344 - DNA, 25 bp, Mus musculus
gaagcagatttcagctcagcagaag

SEQ ID NO: 100345 - DNA, 25 bp, Mus musculus
gaagcagatttctcggtcccggaag

SEQ ID NO: 100346 - DNA, 25 bp, Mus musculus
gaagcagattttgcgtcgagatgac

SEQ ID NO: 100347 - DNA, 25 bp, Mus musculus
gaagcagcaattagatttaaagatc

SEQ ID NO: 100348 - DNA, 25 bp, Mus musculus
gaagcagcacaagacctccaagtgt

SEQ ID NO: 100349 - DNA, 25 bp, Mus musculus
gaagcagcacattggcctgggacag

SEQ ID NO: 100350 - DNA, 25 bp, Mus musculus
gaagcagcacgagaatttgacaagg

SEQ ID NO: 100351 - DNA, 25 bp, Mus musculus
gaagcagcatgttggtcagccagcg

SEQ ID NO: 100352 - DNA, 25 bp, Mus musculus
gaagcagcattctctagggaaaaga

SEQ ID NO: 100353 - DNA, 25 bp, Mus musculus
gaagcagccagctacagagagtcta

SEQ ID NO: 100354 - DNA, 25 bp, Mus musculus
gaagcagcccctcgaggattactca

SEQ ID NO: 100355 - DNA, 25 bp, Mus musculus
gaagcagcccgactagaaatcaacg

SEQ ID NO: 100356 - DNA, 25 bp, Mus musculus
gaagcagccgcagtagatctcgaag

SEQ ID NO: 100357 - DNA, 25 bp, Mus musculus
gaagcagccgccttttgagatctac

SEQ ID NO: 100358 - DNA, 25 bp, Mus musculus
gaagcagcctcttaggtaccacagt

SEQ ID NO: 100359 - DNA, 25 bp, Mus musculus
gaagcagcctttgcagttccacgtg

SEQ ID NO: 100360 - DNA, 25 bp, Mus musculus
gaagcagctacactatgggaaagac

SEQ ID NO: 100361 - DNA, 25 bp, Mus musculus
gaagcagctactggaagacatccag

SEQ ID NO: 100362 - DNA, 25 bp, Mus musculus
gaagcagctctccacggtgatgcga

SEQ ID NO: 100363 - DNA, 25 bp, Mus musculus
gaagcagctgcccatcttggagcct

SEQ ID NO: 100364 - DNA, 25 bp, Mus musculus
gaagcagctggccatggaacaaaag

SEQ ID NO: 100365 - DNA, 25 bp, Mus musculus
gaagcagctgggacaatgactttgt

SEQ ID NO: 100366 - DNA, 25 bp, Mus musculus
gaagcagctttgtaggttcaggaac

SEQ ID NO: 100367 - DNA, 25 bp, Mus musculus
gaagcaggaactccccacttttgga

SEQ ID NO: 100368 - DNA, 25 bp, Mus musculus
gaagcaggacacacttctaaagctt

SEQ ID NO: 100369 - DNA, 25 bp, Mus musculus
gaagcaggagatattctggatctga

SEQ ID NO: 100370 - DNA, 25 bp, Mus musculus
gaagcaggagccaaaaacaccagtg

SEQ ID NO: 100371 - DNA, 25 bp, Mus musculus
gaagcaggccctggactagggaaaa

SEQ ID NO: 100372 - DNA, 25 bp, Mus musculus
gaagcagggctatgagaacctatgc

SEQ ID NO: 100373 - DNA, 25 bp, Mus musculus
gaagcaggtccacctaagaggttga

SEQ ID NO: 100374 - DNA, 25 bp, Mus musculus
gaagcagtacaagcagacgatagga

SEQ ID NO: 100375 - DNA, 25 bp, Mus musculus
gaagcagtaccttcatcggcaggag

SEQ ID NO: 100376 - DNA, 25 bp, Mus musculus
gaagcagtatgcacacctggagtgg

SEQ ID NO: 100377 - DNA, 25 bp, Mus musculus
gaagcagtgggctctatccaagaca

SEQ ID NO: 100378 - DNA, 25 bp, Mus musculus
gaagcagtgtatacctgggctagcc

SEQ ID NO: 100379 - DNA, 25 bp, Mus musculus
gaagcagtgtccagaccgctatctc

SEQ ID NO: 100380 - DNA, 25 bp, Mus musculus
gaagcagttcctactcctgcggagg

SEQ ID NO: 100381 - DNA, 25 bp, Mus musculus
gaagcagttggcatgtcacacaggt

SEQ ID NO: 100382 - DNA, 25 bp, Mus musculus
gaagcagtttccattgtatgaagaa

SEQ ID NO: 100383 - DNA, 25 bp, Mus musculus
gaagcagtttgagcacctggaccct

SEQ ID NO: 100384 - DNA, 25 bp, Mus musculus
gaagcataagcgagacgatggtcct

SEQ ID NO: 100385 - DNA, 25 bp, Mus musculus
gaagcataattaggtcagctggacc

SEQ ID NO: 100386 - DNA, 25 bp, Mus musculus
gaagcatatattcaagcccgggact

SEQ ID NO: 100387 - DNA, 25 bp, Mus musculus
gaagcatctatgcagctcctcgaga

SEQ ID NO: 100388 - DNA, 25 bp, Mus musculus
gaagcatgcagctggcgttctggct

SEQ ID NO: 100389 - DNA, 25 bp, Mus musculus
gaagcatgctaaagccacagcagca

SEQ ID NO: 100390 - DNA, 25 bp, Mus musculus
gaagcatggcgctcattatactcga

SEQ ID NO: 100391 - DNA, 25 bp, Mus musculus
gaagcatgggcagtataacaagttt

SEQ ID NO: 100392 - DNA, 25 bp, Mus musculus
gaagcatggtgaagctgaacagcaa

SEQ ID NO: 100393 - DNA, 25 bp, Mus musculus
gaagcatgtctcgagagtccgggct

SEQ ID NO: 100394 - DNA, 25 bp, Mus musculus
gaagcatgtgcctactctgccagca

SEQ ID NO: 100395 - DNA, 25 bp, Mus musculus
gaagcattactggttcacatcctgg

SEQ ID NO: 100396 - DNA, 25 bp, Mus musculus
gaagcattagctgaacagaccgtct

SEQ ID NO: 100397 - DNA, 25 bp, Mus musculus
gaagcattgaggaggatcacacaca

SEQ ID NO: 100398 - DNA, 25 bp, Mus musculus
gaagcattgtctatgttaataccaa

SEQ ID NO: 100399 - DNA, 25 bp, Mus musculus
gaagcatttcgggatcgctgcaatc

SEQ ID NO: 100400 - DNA, 25 bp, Mus musculus
gaagcattttcaggcttgcacggaa

SEQ ID NO: 100401 - DNA, 25 bp, Mus musculus
gaagccaaaaatcgagaattaatag

SEQ ID NO: 100402 - DNA, 25 bp, Mus musculus
gaagccaaatgggactgtgtctcca

SEQ ID NO: 100403 - DNA, 25 bp, Mus musculus
gaagccaagaaaagaaccagataag

SEQ ID NO: 100404 - DNA, 25 bp, Mus musculus
gaagccaagcacttgtcccgaggaa

SEQ ID NO: 100405 - DNA, 25 bp, Mus musculus
gaagccaagcttcactttaaaagtg

SEQ ID NO: 100406 - DNA, 25 bp, Mus musculus
gaagccaagtctattccaggcagta

SEQ ID NO: 100407 - DNA, 25 bp, Mus musculus
gaagccaatgatgttagtcccagat

SEQ ID NO: 100408 - DNA, 25 bp, Mus musculus
gaagccaatggatcccgtgctggag

SEQ ID NO: 100409 - DNA, 25 bp, Mus musculus
gaagccaatgttgatgccgccacaa

SEQ ID NO: 100410 - DNA, 25 bp, Mus musculus
gaagccaatttcctgaacgtccagg

SEQ ID NO: 100411 - DNA, 25 bp, Mus musculus
gaagccacaatgttcttggcccatg

SEQ ID NO: 100412 - DNA, 25 bp, Mus musculus
gaagccacaattggcggccatgagc

SEQ ID NO: 100413 - DNA, 25 bp, Mus musculus
gaagccacagagaatagggagccgt

SEQ ID NO: 100414 - DNA, 25 bp, Mus musculus
gaagccaccgatgtgtctgacgaag

SEQ ID NO: 100415 - DNA, 25 bp, Mus musculus
gaagccactactctagcaggcgtca

SEQ ID NO: 100416 - DNA, 25 bp, Mus musculus
gaagccactgtcacggttcctggag

SEQ ID NO: 100417 - DNA, 25 bp, Mus musculus
gaagccagaaaacattctcttggac

SEQ ID NO: 100418 - DNA, 25 bp, Mus musculus
gaagccagaaacttttgagtcactg

SEQ ID NO: 100419 - DNA, 25 bp, Mus musculus
gaagccagaatagtatcttctcagt

SEQ ID NO: 100420 - DNA, 25 bp, Mus musculus
gaagccagacatcaggtagagacca

SEQ ID NO: 100421 - DNA, 25 bp, Mus musculus
gaagccagagacagcctcactctgc

SEQ ID NO: 100422 - DNA, 25 bp, Mus musculus
gaagccagagtttagtccaacactg

SEQ ID NO: 100423 - DNA, 25 bp, Mus musculus
gaagccagcaatggatccagagcag

SEQ ID NO: 100424 - DNA, 25 bp, Mus musculus
gaagccagccagttttgacaaagta

SEQ ID NO: 100425 - DNA, 25 bp, Mus musculus
gaagccaggagccaaactaggaagt

SEQ ID NO: 100426 - DNA, 25 bp, Mus musculus
gaagccaggcatgaaatagtctgtg

SEQ ID NO: 100427 - DNA, 25 bp, Mus musculus
gaagccaggctagtgttgcccagag

SEQ ID NO: 100428 - DNA, 25 bp, Mus musculus
gaagccaggcttgtcctctaggtct

SEQ ID NO: 100429 - DNA, 25 bp, Mus musculus
gaagccagtacaagaagatgatgac

SEQ ID NO: 100430 - DNA, 25 bp, Mus musculus
gaagccagtcaaagagaaccagagt

SEQ ID NO: 100431 - DNA, 25 bp, Mus musculus
gaagccagtccaaagtcaagtacag

SEQ ID NO: 100432 - DNA, 25 bp, Mus musculus
gaagccagtctttaatcattcggac

SEQ ID NO: 100433 - DNA, 25 bp, Mus musculus
gaagccagtgaaatccaagccaagt

SEQ ID NO: 100434 - DNA, 25 bp, Mus musculus
gaagccagtgttttccgcatagaga

SEQ ID NO: 100435 - DNA, 25 bp, Mus musculus
gaagccagttggaacccaagactta

SEQ ID NO: 100436 - DNA, 25 bp, Mus musculus
gaagccataaggcatccaatcagga

SEQ ID NO: 100437 - DNA, 25 bp, Mus musculus
gaagccatatccaaagaagcccctg

SEQ ID NO: 100438 - DNA, 25 bp, Mus musculus
gaagccatatttctacaacccagag

SEQ ID NO: 100439 - DNA, 25 bp, Mus musculus
gaagccatcctaaggctcctctgga

SEQ ID NO: 100440 - DNA, 25 bp, Mus musculus
gaagccatcctgaagcgctaccagg

SEQ ID NO: 100441 - DNA, 25 bp, Mus musculus
gaagccatcgcatcttttgaaggaa

SEQ ID NO: 100442 - DNA, 25 bp, Mus musculus
gaagccatctgttccatgtgcaacg

SEQ ID NO: 100443 - DNA, 25 bp, Mus musculus
gaagccatgaagctgtgcctagcca

SEQ ID NO: 100444 - DNA, 25 bp, Mus musculus
gaagccatgcacagggaactagact

SEQ ID NO: 100445 - DNA, 25 bp, Mus musculus
gaagccatgtttgcacttccagcag

SEQ ID NO: 100446 - DNA, 25 bp, Mus musculus
gaagccatgtttggacgcgctccag

SEQ ID NO: 100447 - DNA, 25 bp, Mus musculus
gaagccatgtttttacagcagcccg

SEQ ID NO: 100448 - DNA, 25 bp, Mus musculus
gaagccattgcctggttaatagttg

SEQ ID NO: 100449 - DNA, 25 bp, Mus musculus
gaagccattgggtgagtcctctctg

SEQ ID NO: 100450 - DNA, 25 bp, Mus musculus
gaagccattgtggacgccgtaggaa

SEQ ID NO: 100451 - DNA, 25 bp, Mus musculus
gaagcccaaagaatacgctctgaga

SEQ ID NO: 100452 - DNA, 25 bp, Mus musculus
gaagcccaaggcctttattcactgg

SEQ ID NO: 100453 - DNA, 25 bp, Mus musculus
gaagcccacaagtgtgctgacacca

SEQ ID NO: 100454 - DNA, 25 bp, Mus musculus
gaagcccacagcgaagataaaagga

SEQ ID NO: 100455 - DNA, 25 bp, Mus musculus
gaagcccacgggacctttgtaacag

SEQ ID NO: 100456 - DNA, 25 bp, Mus musculus
gaagcccactttctgtctttaagag

SEQ ID NO: 100457 - DNA, 25 bp, Mus musculus
gaagcccagaacactcatgagtcaa

SEQ ID NO: 100458 - DNA, 25 bp, Mus musculus
gaagcccagcctatcgtccagatta

SEQ ID NO: 100459 - DNA, 25 bp, Mus musculus
gaagcccagcgtactcaagtctaag

SEQ ID NO: 100460 - DNA, 25 bp, Mus musculus
gaagcccagggcttttcgcagtggt

SEQ ID NO: 100461 - DNA, 25 bp, Mus musculus
gaagcccatcaaggttccagcaatg

SEQ ID NO: 100462 - DNA, 25 bp, Mus musculus
gaagcccatcgaagccagtatcaga

SEQ ID NO: 100463 - DNA, 25 bp, Mus musculus
gaagcccatctacatcgttaccgag

SEQ ID NO: 100464 - DNA, 25 bp, Mus musculus
gaagcccatttgaggagtcactgaa

SEQ ID NO: 100465 - DNA, 25 bp, Mus musculus
gaagccccacagattgccttacgct

SEQ ID NO: 100466 - DNA, 25 bp, Mus musculus
gaagccccaggaatttgtcaaccgg

SEQ ID NO: 100467 - DNA, 25 bp, Mus musculus
gaagccccaggagtgtctgtcatag

SEQ ID NO: 100468 - DNA, 25 bp, Mus musculus
gaagccccgctaaggacaataaaag

SEQ ID NO: 100469 - DNA, 25 bp, Mus musculus
gaagcccctagttcaagagaagcag

SEQ ID NO: 100470 - DNA, 25 bp, Mus musculus
gaagcccctgctgacatgggagcac

SEQ ID NO: 100471 - DNA, 25 bp, Mus musculus
gaagcccctgggtgataatttgatg

SEQ ID NO: 100472 - DNA, 25 bp, Mus musculus
gaagcccctgtacatagtgacggag

SEQ ID NO: 100473 - DNA, 25 bp, Mus musculus
gaagccccttctgacgtctattgtg

SEQ ID NO: 100474 - DNA, 25 bp, Mus musculus
gaagcccctttctgggacgtagaga

SEQ ID NO: 100475 - DNA, 25 bp, Mus musculus
gaagcccgagatgtttgagaaccca

SEQ ID NO: 100476 - DNA, 25 bp, Mus musculus
gaagcccgagcatttggtgtcacta

SEQ ID NO: 100477 - DNA, 25 bp, Mus musculus
gaagcccgatccattattatgcaga

SEQ ID NO: 100478 - DNA, 25 bp, Mus musculus
gaagcccgcagattccggaagtgag

SEQ ID NO: 100479 - DNA, 25 bp, Mus musculus
gaagcccgccttgcgctaactaatg

SEQ ID NO: 100480 - DNA, 25 bp, Mus musculus
gaagcccgtcaagtttcagctggag

SEQ ID NO: 100481 - DNA, 25 bp, Mus musculus
gaagccctaaacttggattacctgg

SEQ ID NO: 100482 - DNA, 25 bp, Mus musculus
gaagccctataagtggtgcccagtg

SEQ ID NO: 100483 - DNA, 25 bp, Mus musculus
gaagccctatagatgcgaccagtgt

SEQ ID NO: 100484 - DNA, 25 bp, Mus musculus
gaagccctcaagtgctcaaagagtg

SEQ ID NO: 100485 - DNA, 25 bp, Mus musculus
gaagccctccataggtattatcaga

SEQ ID NO: 100486 - DNA, 25 bp, Mus musculus
gaagccctcggtggtgtacagattt

SEQ ID NO: 100487 - DNA, 25 bp, Mus musculus
gaagccctcttgcaagaccgtggtg

SEQ ID NO: 100488 - DNA, 25 bp, Mus musculus
gaagccctgaaagagaactcctatg

SEQ ID NO: 100489 - DNA, 25 bp, Mus musculus
gaagccctgaagaatgagcacaact

SEQ ID NO: 100490 - DNA, 25 bp, Mus musculus
gaagccctgcttcatatggaatctc

SEQ ID NO: 100491 - DNA, 25 bp, Mus musculus
gaagccctggaaaaagccttggtca

SEQ ID NO: 100492 - DNA, 25 bp, Mus musculus
gaagccctggctcatttgccacaga

SEQ ID NO: 100493 - DNA, 25 bp, Mus musculus
gaagccctggtagatcagctctgga

SEQ ID NO: 100494 - DNA, 25 bp, Mus musculus
gaagcccttcaaggcggtcttcggt

SEQ ID NO: 100495 - DNA, 25 bp, Mus musculus
gaagcccttggtaacctcgtggaag

SEQ ID NO: 100496 - DNA, 25 bp, Mus musculus
gaagccgaaggccaactgattaaga

SEQ ID NO: 100497 - DNA, 25 bp, Mus musculus
gaagccgacaaaaagcaagctgaag

SEQ ID NO: 100498 - DNA, 25 bp, Mus musculus
gaagccgacaacagctgcatctacg

SEQ ID NO: 100499 - DNA, 25 bp, Mus musculus
gaagccgagagcaaactgaaacaag

SEQ ID NO: 100500 - DNA, 25 bp, Mus musculus
gaagccgatctcatttctaagcaag

SEQ ID NO: 100501 - DNA, 25 bp, Mus musculus
gaagccgatgctatgaccttggatg

SEQ ID NO: 100502 - DNA, 25 bp, Mus musculus
gaagccgcagggagaagctgttctc

SEQ ID NO: 100503 - DNA, 25 bp, Mus musculus
gaagccgcagggtctcaatgctcag

SEQ ID NO: 100504 - DNA, 25 bp, Mus musculus
gaagccgcatcctcagttagcctgg

SEQ ID NO: 100505 - DNA, 25 bp, Mus musculus
gaagccgccttctacagctaaaaag

SEQ ID NO: 100506 - DNA, 25 bp, Mus musculus
gaagccgcgaaagtgacaagctgct

SEQ ID NO: 100507 - DNA, 25 bp, Mus musculus
gaagccgctcgtaggatcaaaacag

SEQ ID NO: 100508 - DNA, 25 bp, Mus musculus
gaagccgcttatgtgtatcgctcag

SEQ ID NO: 100509 - DNA, 25 bp, Mus musculus
gaagccgtatcaccctaaactagaa

SEQ ID NO: 100510 - DNA, 25 bp, Mus musculus
gaagccgtccctggatgatctgaaa

SEQ ID NO: 100511 - DNA, 25 bp, Mus musculus
gaagccgtcgttgattacactaaag

SEQ ID NO: 100512 - DNA, 25 bp, Mus musculus
gaagccgttatccaggattctacca

SEQ ID NO: 100513 - DNA, 25 bp, Mus musculus
gaagccgttgagtcagccgtgtgcc

SEQ ID NO: 100514 - DNA, 25 bp, Mus musculus
gaagccgtttcaaggaccagacagg

SEQ ID NO: 100515 - DNA, 25 bp, Mus musculus
gaagcctaaacatagtcgatcgcgc

SEQ ID NO: 100516 - DNA, 25 bp, Mus musculus
gaagcctagaccacacactaaagcg

SEQ ID NO: 100517 - DNA, 25 bp, Mus musculus
gaagcctagccctctgattgtcatg

SEQ ID NO: 100518 - DNA, 25 bp, Mus musculus
gaagcctatggcacctgtcaagtta

SEQ ID NO: 100519 - DNA, 25 bp, Mus musculus
gaagcctcaccaacctcagggaaaa

SEQ ID NO: 100520 - DNA, 25 bp, Mus musculus
gaagcctcactttctgggccataga

SEQ ID NO: 100521 - DNA, 25 bp, Mus musculus
gaagcctcagcaaatggtcctgtaa

SEQ ID NO: 100522 - DNA, 25 bp, Mus musculus
gaagcctccttagtcgatctcaaca

SEQ ID NO: 100523 - DNA, 25 bp, Mus musculus
gaagcctcgttgtgatttcctccga

SEQ ID NO: 100524 - DNA, 25 bp, Mus musculus
gaagcctctcttgaatgacagccag

SEQ ID NO: 100525 - DNA, 25 bp, Mus musculus
gaagcctctgttcacggaagccagt

SEQ ID NO: 100526 - DNA, 25 bp, Mus musculus
gaagcctgaaaaagctcgcctcaga

SEQ ID NO: 100527 - DNA, 25 bp, Mus musculus
gaagcctgcagaccttcagaacctg

SEQ ID NO: 100528 - DNA, 25 bp, Mus musculus
gaagcctggacttgaccggcatcgt

SEQ ID NO: 100529 - DNA, 25 bp, Mus musculus
gaagcctggagacactatcattgag

SEQ ID NO: 100530 - DNA, 25 bp, Mus musculus
gaagcctgtaatggacgtggcgccc

SEQ ID NO: 100531 - DNA, 25 bp, Mus musculus
gaagcctgtcacgttcgactgcaca

SEQ ID NO: 100532 - DNA, 25 bp, Mus musculus
gaagcctgtccgagatggtgtgcct

SEQ ID NO: 100533 - DNA, 25 bp, Mus musculus
gaagcctgtgttgaccttccagaca

SEQ ID NO: 100534 - DNA, 25 bp, Mus musculus
gaagcctgttattgtcaccgcacca

SEQ ID NO: 100535 - DNA, 25 bp, Mus musculus
gaagcctgttgtggatcctgctgct

SEQ ID NO: 100536 - DNA, 25 bp, Mus musculus
gaagccttagaagttggttacagca

SEQ ID NO: 100537 - DNA, 25 bp, Mus musculus
gaagccttctccctcttcgacaagg

SEQ ID NO: 100538 - DNA, 25 bp, Mus musculus
gaagccttctttgactccgaacgtg

SEQ ID NO: 100539 - DNA, 25 bp, Mus musculus
gaagccttctttgcaatgactcgat

SEQ ID NO: 100540 - DNA, 25 bp, Mus musculus
gaagccttgagaagccgacttgtga

SEQ ID NO: 100541 - DNA, 25 bp, Mus musculus
gaagccttgatggacgtcatgcctt

SEQ ID NO: 100542 - DNA, 25 bp, Mus musculus
gaagccttgcccctgtcaatcacag

SEQ ID NO: 100543 - DNA, 25 bp, Mus musculus
gaagccttggccatagacactttgc

SEQ ID NO: 100544 - DNA, 25 bp, Mus musculus
gaagcctttgcaggtatcaaaagtc

SEQ ID NO: 100545 - DNA, 25 bp, Mus musculus
gaagcctttggctaccatgaccagc

SEQ ID NO: 100546 - DNA, 25 bp, Mus musculus
gaagcctttgtgctcaatcctgcca

SEQ ID NO: 100547 - DNA, 25 bp, Mus musculus
gaagcgaagtctttcctcaagcaaa

SEQ ID NO: 100548 - DNA, 25 bp, Mus musculus
gaagcgaccattgcctctaggagcc

SEQ ID NO: 100549 - DNA, 25 bp, Mus musculus
gaagcgagaggatgccatcacccag

SEQ ID NO: 100550 - DNA, 25 bp, Mus musculus
gaagcgagctttcagagagacagca

SEQ ID NO: 100551 - DNA, 25 bp, Mus musculus
gaagcgatcacggactcctgagaga

SEQ ID NO: 100552 - DNA, 25 bp, Mus musculus
gaagcgatccagcacagctctgtca

SEQ ID NO: 100553 - DNA, 25 bp, Mus musculus
gaagcgatcgccaaaatccggtcac

SEQ ID NO: 100554 - DNA, 25 bp, Mus musculus
gaagcgatctgctcagtttgagcac

SEQ ID NO: 100555 - DNA, 25 bp, Mus musculus
gaagcgatgaagactttaccaggaa

SEQ ID NO: 100556 - DNA, 25 bp, Mus musculus
gaagcgattatctgcagtcccgctg

SEQ ID NO: 100557 - DNA, 25 bp, Mus musculus
gaagcgattgaaagttactaccaga

SEQ ID NO: 100558 - DNA, 25 bp, Mus musculus
gaagcgatttagtcaggcctggaac

SEQ ID NO: 100559 - DNA, 25 bp, Mus musculus
gaagcgcaatgcattgctgaccaag

SEQ ID NO: 100560 - DNA, 25 bp, Mus musculus
gaagcgcagtccgaatccggaagaa

SEQ ID NO: 100561 - DNA, 25 bp, Mus musculus
gaagcgcatcctctatgccacctgg

SEQ ID NO: 100562 - DNA, 25 bp, Mus musculus
gaagcgcccagctcagatgacctta

SEQ ID NO: 100563 - DNA, 25 bp, Mus musculus
gaagcgccgcaacttggacatcaac

SEQ ID NO: 100564 - DNA, 25 bp, Mus musculus
gaagcgcctgtttctcttgactgta

SEQ ID NO: 100565 - DNA, 25 bp, Mus musculus
gaagcgccttgacctcacaacatct

SEQ ID NO: 100566 - DNA, 25 bp, Mus musculus
gaagcgcgactctatcggaatgaga

SEQ ID NO: 100567 - DNA, 25 bp, Mus musculus
gaagcgcgagcagtacagtgtatcc

SEQ ID NO: 100568 - DNA, 25 bp, Mus musculus
gaagcgcgctgtatttccacatcgg

SEQ ID NO: 100569 - DNA, 25 bp, Mus musculus
gaagcgcggacctaggacttccatc

SEQ ID NO: 100570 - DNA, 25 bp, Mus musculus
gaagcgcggacctttcaacaagagc

SEQ ID NO: 100571 - DNA, 25 bp, Mus musculus
gaagcgctatctgctctacaaatga

SEQ ID NO: 100572 - DNA, 25 bp, Mus musculus
gaagcgctccagaaaatacggcaga

SEQ ID NO: 100573 - DNA, 25 bp, Mus musculus
gaagcgctccgaaactgtcacagga

SEQ ID NO: 100574 - DNA, 25 bp, Mus musculus
gaagcgctgaatggtctacgccagg

SEQ ID NO: 100575 - DNA, 25 bp, Mus musculus
gaagcgctgtcatcacttttgtgga

SEQ ID NO: 100576 - DNA, 25 bp, Mus musculus
gaagcgcttaagaacgacctggtgg

SEQ ID NO: 100577 - DNA, 25 bp, Mus musculus
gaagcgctttacacgttcggacgag

SEQ ID NO: 100578 - DNA, 25 bp, Mus musculus
gaagcggaagcacttcaatgagcga

SEQ ID NO: 100579 - DNA, 25 bp, Mus musculus
gaagcggagatcctacaatgttcac

SEQ ID NO: 100580 - DNA, 25 bp, Mus musculus
gaagcggaggtttcaagtcttccgg

SEQ ID NO: 100581 - DNA, 25 bp, Mus musculus
gaagcggcataagtggtcagtcctg

SEQ ID NO: 100582 - DNA, 25 bp, Mus musculus
gaagcggcatccttggtttggcgta

SEQ ID NO: 100583 - DNA, 25 bp, Mus musculus
gaagcggccaacctctgtcaaagta

SEQ ID NO: 100584 - DNA, 25 bp, Mus musculus
gaagcggccaggactgaatcgcaag

SEQ ID NO: 100585 - DNA, 25 bp, Mus musculus
gaagcggcccgctaagatctatgtg

SEQ ID NO: 100586 - DNA, 25 bp, Mus musculus
gaagcggcgcggtcagggtcggaag

SEQ ID NO: 100587 - DNA, 25 bp, Mus musculus
gaagcggctccgtgatttacttagc

SEQ ID NO: 100588 - DNA, 25 bp, Mus musculus
gaagcggctctgacttccaacatgg

SEQ ID NO: 100589 - DNA, 25 bp, Mus musculus
gaagcggctctgcattaagtttatc

SEQ ID NO: 100590 - DNA, 25 bp, Mus musculus
gaagcggctgctttccctgaagttg

SEQ ID NO: 100591 - DNA, 25 bp, Mus musculus
gaagcggcttaacactcgagagttc

SEQ ID NO: 100592 - DNA, 25 bp, Mus musculus
gaagcgggaacctctgtaacaggcg

SEQ ID NO: 100593 - DNA, 25 bp, Mus musculus
gaagcgggcatgatcgtcactgatg

SEQ ID NO: 100594 - DNA, 25 bp, Mus musculus
gaagcgggttacgatgtacggcaac

SEQ ID NO: 100595 - DNA, 25 bp, Mus musculus
gaagcggtggaagcgctcatgtcca

SEQ ID NO: 100596 - DNA, 25 bp, Mus musculus
gaagcggttcagtcaggtctcacac

SEQ ID NO: 100597 - DNA, 25 bp, Mus musculus
gaagcggttgcctttctccaagcga

SEQ ID NO: 100598 - DNA, 25 bp, Mus musculus
gaagcgtcaagggtcgcaaatccca

SEQ ID NO: 100599 - DNA, 25 bp, Mus musculus
gaagcgtctcatcatctctgaccgg

SEQ ID NO: 100600 - DNA, 25 bp, Mus musculus
gaagcgtgaaagatgctccccgatg

SEQ ID NO: 100601 - DNA, 25 bp, Mus musculus
gaagcgtgcatcagctggaacacct

SEQ ID NO: 100602 - DNA, 25 bp, Mus musculus
gaagcgtggcgcttcggcgggcaca

SEQ ID NO: 100603 - DNA, 25 bp, Mus musculus
gaagcgtgtacaacttaggctcaag

SEQ ID NO: 100604 - DNA, 25 bp, Mus musculus
gaagcgtgtcttcctcgcacttaag

SEQ ID NO: 100605 - DNA, 25 bp, Mus musculus
gaagcgttccctaatgctgttgccc

SEQ ID NO: 100606 - DNA, 25 bp, Mus musculus
gaagcgttcggatttgtgccctgag

SEQ ID NO: 100607 - DNA, 25 bp, Mus musculus
gaagcgttctgcatggccatcgtgg

SEQ ID NO: 100608 - DNA, 25 bp, Mus musculus
gaagcgtttgaacagcctcagacca

SEQ ID NO: 100609 - DNA, 25 bp, Mus musculus
gaagctaaaatcctggtgggccaca

SEQ ID NO: 100610 - DNA, 25 bp, Mus musculus
gaagctaaacaagcatactcgtccc

SEQ ID NO: 100611 - DNA, 25 bp, Mus musculus
gaagctaaactactccactggaatg

SEQ ID NO: 100612 - DNA, 25 bp, Mus musculus
gaagctaaagaacacagaaatggtc

SEQ ID NO: 100613 - DNA, 25 bp, Mus musculus
gaagctaaagcagatcgagcacact

SEQ ID NO: 100614 - DNA, 25 bp, Mus musculus
gaagctaaccccaagctgaacatgg

SEQ ID NO: 100615 - DNA, 25 bp, Mus musculus
gaagctaacccttgcccatgtgaca

SEQ ID NO: 100616 - DNA, 25 bp, Mus musculus
gaagctaactccgtcaaggctggcg

SEQ ID NO: 100617 - DNA, 25 bp, Mus musculus
gaagctaactcgaccactggtgctc

SEQ ID NO: 100618 - DNA, 25 bp, Mus musculus
gaagctaagataaggaggcccgaac

SEQ ID NO: 100619 - DNA, 25 bp, Mus musculus
gaagctacaagcgaaaaatgggaag

SEQ ID NO: 100620 - DNA, 25 bp, Mus musculus
gaagctacaagctgaagccaaaatg

SEQ ID NO: 100621 - DNA, 25 bp, Mus musculus
gaagctacatgctgttccccaaggg

SEQ ID NO: 100622 - DNA, 25 bp, Mus musculus
gaagctactatgtgcctgtgaccag

SEQ ID NO: 100623 - DNA, 25 bp, Mus musculus
gaagctactcctgccctgatctagg

SEQ ID NO: 100624 - DNA, 25 bp, Mus musculus
gaagctacttcacggagacagcagg

SEQ ID NO: 100625 - DNA, 25 bp, Mus musculus
gaagctacttgagcggatccgccgt

SEQ ID NO: 100626 - DNA, 25 bp, Mus musculus
gaagctagaagagatctgtgccctg

SEQ ID NO: 100627 - DNA, 25 bp, Mus musculus
gaagctagacgaaagggaagccggc

SEQ ID NO: 100628 - DNA, 25 bp, Mus musculus
gaagctaggagagattgtgacaacc

SEQ ID NO: 100629 - DNA, 25 bp, Mus musculus
gaagctagggccttgcactctgaga

SEQ ID NO: 100630 - DNA, 25 bp, Mus musculus
gaagctaggtgagttcggcatccga

SEQ ID NO: 100631 - DNA, 25 bp, Mus musculus
gaagctaggtggaagctcgtcccag

SEQ ID NO: 100632 - DNA, 25 bp, Mus musculus
gaagctagtacttcccagcatcctg

SEQ ID NO: 100633 - DNA, 25 bp, Mus musculus
gaagctagtgtttgtgaaccctccc

SEQ ID NO: 100634 - DNA, 25 bp, Mus musculus
gaagctagttcgcttcctgccggca

SEQ ID NO: 100635 - DNA, 25 bp, Mus musculus
gaagctataactcgcctggtgacag

SEQ ID NO: 100636 - DNA, 25 bp, Mus musculus
gaagctatcagagtgtccaaggttg

SEQ ID NO: 100637 - DNA, 25 bp, Mus musculus
gaagctattgacctctactcggcgc

SEQ ID NO: 100638 - DNA, 25 bp, Mus musculus
gaagctcaaggacccactgctgatg

SEQ ID NO: 100639 - DNA, 25 bp, Mus musculus
gaagctcaaggagagttgcctcaaa

SEQ ID NO: 100640 - DNA, 25 bp, Mus musculus
gaagctcacaggagtctacgccagt

SEQ ID NO: 100641 - DNA, 25 bp, Mus musculus
gaagctcaccgggtctcttgctggg

SEQ ID NO: 100642 - DNA, 25 bp, Mus musculus
gaagctcactcactaacaccgtggg

SEQ ID NO: 100643 - DNA, 25 bp, Mus musculus
gaagctcagaagattgtatacatgc

SEQ ID NO: 100644 - DNA, 25 bp, Mus musculus
gaagctcagactggccaagattggc

SEQ ID NO: 100645 - DNA, 25 bp, Mus musculus
gaagctcagcctctcgatttggacg

SEQ ID NO: 100646 - DNA, 25 bp, Mus musculus
gaagctcaggaaaaaggcgaccact

SEQ ID NO: 100647 - DNA, 25 bp, Mus musculus
gaagctcagtaacacaaactccact

SEQ ID NO: 100648 - DNA, 25 bp, Mus musculus
gaagctcattgcgtctgtggccggc

SEQ ID NO: 100649 - DNA, 25 bp, Mus musculus
gaagctcattgtggagaccgatact

SEQ ID NO: 100650 - DNA, 25 bp, Mus musculus
gaagctccagcaagagtccagaatg

SEQ ID NO: 100651 - DNA, 25 bp, Mus musculus
gaagctccagcttgcactcttggcc

SEQ ID NO: 100652 - DNA, 25 bp, Mus musculus
gaagctccaggcagttcgagtgacc

SEQ ID NO: 100653 - DNA, 25 bp, Mus musculus
gaagctcccagatttggaccagaca

SEQ ID NO: 100654 - DNA, 25 bp, Mus musculus
gaagctcccgcgctctagatgtaaa

SEQ ID NO: 100655 - DNA, 25 bp, Mus musculus
gaagctccggaagctccggcagaag

SEQ ID NO: 100656 - DNA, 25 bp, Mus musculus
gaagctccgggatgctctgagacgc

SEQ ID NO: 100657 - DNA, 25 bp, Mus musculus
gaagctccgggttttcagccagcat

SEQ ID NO: 100658 - DNA, 25 bp, Mus musculus
gaagctcgggctgtcaaaattgtgc

SEQ ID NO: 100659 - DNA, 25 bp, Mus musculus
gaagctctcaagtacataggtgcac

SEQ ID NO: 100660 - DNA, 25 bp, Mus musculus
gaagctctccgactctacctggaag

SEQ ID NO: 100661 - DNA, 25 bp, Mus musculus
gaagctctcggacacatatacctgc

SEQ ID NO: 100662 - DNA, 25 bp, Mus musculus
gaagctctctgtgctggtaactgag

SEQ ID NO: 100663 - DNA, 25 bp, Mus musculus
gaagctctgaagagaaacttcctgg

SEQ ID NO: 100664 - DNA, 25 bp, Mus musculus
gaagctctgtcagatcatcgggcag

SEQ ID NO: 100665 - DNA, 25 bp, Mus musculus
gaagctcttagaaatcgccaccaag

SEQ ID NO: 100666 - DNA, 25 bp, Mus musculus
gaagctcttagagtacctgcctgag

SEQ ID NO: 100667 - DNA, 25 bp, Mus musculus
gaagctcttcccagacatgttgcca

SEQ ID NO: 100668 - DNA, 25 bp, Mus musculus
gaagctcttctgctaggccggtgcc

SEQ ID NO: 100669 - DNA, 25 bp, Mus musculus
gaagctcttggagatgcgcagcagt

SEQ ID NO: 100670 - DNA, 25 bp, Mus musculus
gaagctcttgggatcggtagtctac

SEQ ID NO: 100671 - DNA, 25 bp, Mus musculus
gaagctgaaactccaatcagatcgc

SEQ ID NO: 100672 - DNA, 25 bp, Mus musculus
gaagctgaagaccagaaccatctcc

SEQ ID NO: 100673 - DNA, 25 bp, Mus musculus
gaagctgaagatggaccgagtcaag

SEQ ID NO: 100674 - DNA, 25 bp, Mus musculus
gaagctgacaaaacggagtggccac

SEQ ID NO: 100675 - DNA, 25 bp, Mus musculus
gaagctgacaggcataagtgaccca

SEQ ID NO: 100676 - DNA, 25 bp, Mus musculus
gaagctgaccaatcacaaggcctgt

SEQ ID NO: 100677 - DNA, 25 bp, Mus musculus
gaagctgaccacttcaaggttgcgg

SEQ ID NO: 100678 - DNA, 25 bp, Mus musculus
gaagctgaccctcgcctatgaaggc

SEQ ID NO: 100679 - DNA, 25 bp, Mus musculus
gaagctgacgtctccgtgtatggca

SEQ ID NO: 100680 - DNA, 25 bp, Mus musculus
gaagctgagaccacgttctctggga

SEQ ID NO: 100681 - DNA, 25 bp, Mus musculus
gaagctgaggtcgtcaccgtggaaa

SEQ ID NO: 100682 - DNA, 25 bp, Mus musculus
gaagctgagtctgaatcctatttac

SEQ ID NO: 100683 - DNA, 25 bp, Mus musculus
gaagctgatctggtgaagaagccca

SEQ ID NO: 100684 - DNA, 25 bp, Mus musculus
gaagctgatgactttgaatccgcaa

SEQ ID NO: 100685 - DNA, 25 bp, Mus musculus
gaagctgatgccactctaaagagag

SEQ ID NO: 100686 - DNA, 25 bp, Mus musculus
gaagctgatgggatctatgccgcct

SEQ ID NO: 100687 - DNA, 25 bp, Mus musculus
gaagctgcaattgatagcggaccct

SEQ ID NO: 100688 - DNA, 25 bp, Mus musculus
gaagctgcagcagtatcgccaggtg

SEQ ID NO: 100689 - DNA, 25 bp, Mus musculus
gaagctgcatcttatcacccggaac

SEQ ID NO: 100690 - DNA, 25 bp, Mus musculus
gaagctgccgtacagtctctaaagg

SEQ ID NO: 100691 - DNA, 25 bp, Mus musculus
gaagctgccgtatccaatggtccat

SEQ ID NO: 100692 - DNA, 25 bp, Mus musculus
gaagctgccgtcaagtccatcaagg

SEQ ID NO: 100693 - DNA, 25 bp, Mus musculus
gaagctgcctgtccagaaacataga

SEQ ID NO: 100694 - DNA, 25 bp, Mus musculus
gaagctgcggcttacagtagtggac

SEQ ID NO: 100695 - DNA, 25 bp, Mus musculus
gaagctgctaaagaatgtcgacgtc

SEQ ID NO: 100696 - DNA, 25 bp, Mus musculus
gaagctgctaacacttggaggactg

SEQ ID NO: 100697 - DNA, 25 bp, Mus musculus
gaagctgctactcgaaacatggaga

SEQ ID NO: 100698 - DNA, 25 bp, Mus musculus
gaagctgctcaggtccacgttggtg

SEQ ID NO: 100699 - DNA, 25 bp, Mus musculus
gaagctgctccttgtcaccgatgga

SEQ ID NO: 100700 - DNA, 25 bp, Mus musculus
gaagctgctgaaccctgtgaaggct

SEQ ID NO: 100701 - DNA, 25 bp, Mus musculus
gaagctgctggatctgagcgaccta

SEQ ID NO: 100702 - DNA, 25 bp, Mus musculus
gaagctgcttaacgtcctgcctgtg

SEQ ID NO: 100703 - DNA, 25 bp, Mus musculus
gaagctgcttaatgccaggcgacga

SEQ ID NO: 100704 - DNA, 25 bp, Mus musculus
gaagctggaatttgccccttacgag

SEQ ID NO: 100705 - DNA, 25 bp, Mus musculus
gaagctggagaacgtcttacttgac

SEQ ID NO: 100706 - DNA, 25 bp, Mus musculus
gaagctggagctcctcgtctcatga

SEQ ID NO: 100707 - DNA, 25 bp, Mus musculus
gaagctggagtctacgatgagtctg

SEQ ID NO: 100708 - DNA, 25 bp, Mus musculus
gaagctggcatctgatgtcagtaaa

SEQ ID NO: 100709 - DNA, 25 bp, Mus musculus
gaagctggcgagttgcactctgttg

SEQ ID NO: 100710 - DNA, 25 bp, Mus musculus
gaagctggctgtgaagtcttctcca

SEQ ID NO: 100711 - DNA, 25 bp, Mus musculus
gaagctgggacttcccatgcgagct

SEQ ID NO: 100712 - DNA, 25 bp, Mus musculus
gaagctgggcctagaaactcacaga

SEQ ID NO: 100713 - DNA, 25 bp, Mus musculus
gaagctgggttcactggaggtacaa

SEQ ID NO: 100714 - DNA, 25 bp, Mus musculus
gaagctggtacatcaaggctccatg

SEQ ID NO: 100715 - DNA, 25 bp, Mus musculus
gaagctggtcaactactactcctgt

SEQ ID NO: 100716 - DNA, 25 bp, Mus musculus
gaagctggtgcctctgaatcaggag

SEQ ID NO: 100717 - DNA, 25 bp, Mus musculus
gaagctggtgctcaaggtgggagga

SEQ ID NO: 100718 - DNA, 25 bp, Mus musculus
gaagctggtgcttggcctgcacaac

SEQ ID NO: 100719 - DNA, 25 bp, Mus musculus
gaagctgtccatgaggtcctgatgc

SEQ ID NO: 100720 - DNA, 25 bp, Mus musculus
gaagctgtccgagtggatgaccctg

SEQ ID NO: 100721 - DNA, 25 bp, Mus musculus
gaagctgtctatggaggactccaag

SEQ ID NO: 100722 - DNA, 25 bp, Mus musculus
gaagctgtggaagagaggcaccacc

SEQ ID NO: 100723 - DNA, 25 bp, Mus musculus
gaagctgtggctctctggcctaaca

SEQ ID NO: 100724 - DNA, 25 bp, Mus musculus
gaagctgtgtacgaacgactctgtg

SEQ ID NO: 100725 - DNA, 25 bp, Mus musculus
gaagctgttatctctgtgaaaggaa

SEQ ID NO: 100726 - DNA, 25 bp, Mus musculus
gaagctgttcgtgggtatgctcaac

SEQ ID NO: 100727 - DNA, 25 bp, Mus musculus
gaagctgttctcaccgctactctga

SEQ ID NO: 100728 - DNA, 25 bp, Mus musculus
gaagcttaatctgcggaagccgcgg

SEQ ID NO: 100729 - DNA, 25 bp, Mus musculus
gaagcttacacacatacctgggagg

SEQ ID NO: 100730 - DNA, 25 bp, Mus musculus
gaagcttagacgacatcgccatgga

SEQ ID NO: 100731 - DNA, 25 bp, Mus musculus
gaagcttagcagaaaacacccagag

SEQ ID NO: 100732 - DNA, 25 bp, Mus musculus
gaagcttaggcaaaagtgaacacca

SEQ ID NO: 100733 - DNA, 25 bp, Mus musculus
gaagcttattgcaccagcgccagtt

SEQ ID NO: 100734 - DNA, 25 bp, Mus musculus
gaagcttcaatcaggacagatgttg

SEQ ID NO: 100735 - DNA, 25 bp, Mus musculus
gaagcttcactgcaatgggccgcaa

SEQ ID NO: 100736 - DNA, 25 bp, Mus musculus
gaagcttcagccttgacgacagact

SEQ ID NO: 100737 - DNA, 25 bp, Mus musculus
gaagcttcaggagatggatgcccag

SEQ ID NO: 100738 - DNA, 25 bp, Mus musculus
gaagcttccatcacagggagaggca

SEQ ID NO: 100739 - DNA, 25 bp, Mus musculus
gaagcttcccaagaatgagccccag

SEQ ID NO: 100740 - DNA, 25 bp, Mus musculus
gaagcttcccaagttcgagattgag

SEQ ID NO: 100741 - DNA, 25 bp, Mus musculus
gaagcttcccagaatgcatagtcat

SEQ ID NO: 100742 - DNA, 25 bp, Mus musculus
gaagcttccctagtgcagcagcaga

SEQ ID NO: 100743 - DNA, 25 bp, Mus musculus
gaagcttccctcagatgaaagtggc

SEQ ID NO: 100744 - DNA, 25 bp, Mus musculus
gaagcttcttgatgggcatccagca

SEQ ID NO: 100745 - DNA, 25 bp, Mus musculus
gaagcttctttgacgatggcccagg

SEQ ID NO: 100746 - DNA, 25 bp, Mus musculus
gaagcttgaaaggacgtccccataa

SEQ ID NO: 100747 - DNA, 25 bp, Mus musculus
gaagcttgagcattaccaccgaaag

SEQ ID NO: 100748 - DNA, 25 bp, Mus musculus
gaagcttgcagggactcaacgcact

SEQ ID NO: 100749 - DNA, 25 bp, Mus musculus
gaagcttgccaaacagctatgcaga

SEQ ID NO: 100750 - DNA, 25 bp, Mus musculus
gaagcttggagaattaacagggaca

SEQ ID NO: 100751 - DNA, 25 bp, Mus musculus
gaagcttggattcacacctggccca

SEQ ID NO: 100752 - DNA, 25 bp, Mus musculus
gaagcttggcttaaggctgcacgcc

SEQ ID NO: 100753 - DNA, 25 bp, Mus musculus
gaagcttgtagagttgcaccctatg

SEQ ID NO: 100754 - DNA, 25 bp, Mus musculus
gaagcttgtgcgtcctttctgtcca

SEQ ID NO: 100755 - DNA, 25 bp, Mus musculus
gaagcttgtggagttcgaccttaaa

SEQ ID NO: 100756 - DNA, 25 bp, Mus musculus
gaagctttaaaagctgcctcagaaa

SEQ ID NO: 100757 - DNA, 25 bp, Mus musculus
gaagctttacaactctccttgcctg

SEQ ID NO: 100758 - DNA, 25 bp, Mus musculus
gaagctttcaagtcaagagtaagac

SEQ ID NO: 100759 - DNA, 25 bp, Mus musculus
gaagctttgatgtcacccagaggcg

SEQ ID NO: 100760 - DNA, 25 bp, Mus musculus
gaagctttgcaataaatggcacccc

SEQ ID NO: 100761 - DNA, 25 bp, Mus musculus
gaagctttgcttacactctggagcc

SEQ ID NO: 100762 - DNA, 25 bp, Mus musculus
gaagcttttagaagcggcacgagcc

SEQ ID NO: 100763 - DNA, 25 bp, Mus musculus
gaaggaaaggccatcgcaggcatca

SEQ ID NO: 100764 - DNA, 25 bp, Mus musculus
gaaggaaagtgagtgactgcctctt

SEQ ID NO: 100765 - DNA, 25 bp, Mus musculus
gaaggaaatattgccaccgagggct

SEQ ID NO: 100766 - DNA, 25 bp, Mus musculus
gaaggaacaatctcggtctcgcagg

SEQ ID NO: 100767 - DNA, 25 bp, Mus musculus
gaaggaacaggtgatccgctaccag

SEQ ID NO: 100768 - DNA, 25 bp, Mus musculus
gaaggaacctctgctatgtacaaac

SEQ ID NO: 100769 - DNA, 25 bp, Mus musculus
gaaggaacggactctactgacctgg

SEQ ID NO: 100770 - DNA, 25 bp, Mus musculus
gaaggaacggcctctaggactaact

SEQ ID NO: 100771 - DNA, 25 bp, Mus musculus
gaaggaactctgtgagcagtacggc

SEQ ID NO: 100772 - DNA, 25 bp, Mus musculus
gaaggaactgcagaacatcagctca

SEQ ID NO: 100773 - DNA, 25 bp, Mus musculus
gaaggaagactccatccgagcagga

SEQ ID NO: 100774 - DNA, 25 bp, Mus musculus
gaaggaagcaatgtgagaaattaaa

SEQ ID NO: 100775 - DNA, 25 bp, Mus musculus
gaaggaagcccctgagaactggcag

SEQ ID NO: 100776 - DNA, 25 bp, Mus musculus
gaaggaagccgaagctgacaagctg

SEQ ID NO: 100777 - DNA, 25 bp, Mus musculus
gaaggaagcctgtaatgcagaaagc

SEQ ID NO: 100778 - DNA, 25 bp, Mus musculus
gaaggaagctacctgagctgcacca

SEQ ID NO: 100779 - DNA, 25 bp, Mus musculus
gaaggaagctaggaaagataccgga

SEQ ID NO: 100780 - DNA, 25 bp, Mus musculus
gaaggaaggcttctattccagcctg

SEQ ID NO: 100781 - DNA, 25 bp, Mus musculus
gaaggaagtatacctgaaacagaag

SEQ ID NO: 100782 - DNA, 25 bp, Mus musculus
gaaggaagttccataagccgatcac

SEQ ID NO: 100783 - DNA, 25 bp, Mus musculus
gaaggaagttcttagcacgaagcca

SEQ ID NO: 100784 - DNA, 25 bp, Mus musculus
gaaggaatcgatgtctcagggccaa

SEQ ID NO: 100785 - DNA, 25 bp, Mus musculus
gaaggaatctgctatgaggcttaac

SEQ ID NO: 100786 - DNA, 25 bp, Mus musculus
gaaggaattaacaagtgcgctgacc

SEQ ID NO: 100787 - DNA, 25 bp, Mus musculus
gaaggaattacagactccaggctca

SEQ ID NO: 100788 - DNA, 25 bp, Mus musculus
gaaggacaaaatcgctcaggagaga

SEQ ID NO: 100789 - DNA, 25 bp, Mus musculus
gaaggacaccatggtcaagagatac

SEQ ID NO: 100790 - DNA, 25 bp, Mus musculus
gaaggacaccgattatggattggca

SEQ ID NO: 100791 - DNA, 25 bp, Mus musculus
gaaggacactaggtttgacagatac

SEQ ID NO: 100792 - DNA, 25 bp, Mus musculus
gaaggacactctcccagaatcacgg

SEQ ID NO: 100793 - DNA, 25 bp, Mus musculus
gaaggacagaagtctgcctaaggct

SEQ ID NO: 100794 - DNA, 25 bp, Mus musculus
gaaggacagacgcaaagaagaaaag

SEQ ID NO: 100795 - DNA, 25 bp, Mus musculus
gaaggacattgccaacgagaacgaa

SEQ ID NO: 100796 - DNA, 25 bp, Mus musculus
gaaggacattgggttcctggacgac

SEQ ID NO: 100797 - DNA, 25 bp, Mus musculus
gaaggaccagtgtaccaggaacgat

SEQ ID NO: 100798 - DNA, 25 bp, Mus musculus
gaaggaccatgcagctgcctgggat

SEQ ID NO: 100799 - DNA, 25 bp, Mus musculus
gaaggacccagaaatctacacagag

SEQ ID NO: 100800 - DNA, 25 bp, Mus musculus
gaaggaccccgatactcgtgtggct

SEQ ID NO: 100801 - DNA, 25 bp, Mus musculus
gaaggaccctgacctcttctgggat

SEQ ID NO: 100802 - DNA, 25 bp, Mus musculus
gaaggaccgatgctttgccactcaa

SEQ ID NO: 100803 - DNA, 25 bp, Mus musculus
gaaggaccgtctttgtcacatgagt

SEQ ID NO: 100804 - DNA, 25 bp, Mus musculus
gaaggacctactgaaagccaatgtg

SEQ ID NO: 100805 - DNA, 25 bp, Mus musculus
gaaggacctctttgcagaatgtgcc

SEQ ID NO: 100806 - DNA, 25 bp, Mus musculus
gaaggacctgacctactcgtgtcgt

SEQ ID NO: 100807 - DNA, 25 bp, Mus musculus
gaaggacctgatagcccgagtagtg

SEQ ID NO: 100808 - DNA, 25 bp, Mus musculus
gaaggacctggacgaacttctggat

SEQ ID NO: 100809 - DNA, 25 bp, Mus musculus
gaaggaccttcccacggaggccaag

SEQ ID NO: 100810 - DNA, 25 bp, Mus musculus
gaaggacgcagtaaggaacttgacc

SEQ ID NO: 100811 - DNA, 25 bp, Mus musculus
gaaggacgccttcaaaatcgagtgc

SEQ ID NO: 100812 - DNA, 25 bp, Mus musculus
gaaggacgctcaccagatcaataga

SEQ ID NO: 100813 - DNA, 25 bp, Mus musculus
gaaggacgcttctcgagaaatgtgc

SEQ ID NO: 100814 - DNA, 25 bp, Mus musculus
gaaggacgctttacaaacctgccaa

SEQ ID NO: 100815 - DNA, 25 bp, Mus musculus
gaaggacgctttgcagatctccagg

SEQ ID NO: 100816 - DNA, 25 bp, Mus musculus
gaaggacggttcctctgggcctcca

SEQ ID NO: 100817 - DNA, 25 bp, Mus musculus
gaaggacgtcgttctggattgcctg

SEQ ID NO: 100818 - DNA, 25 bp, Mus musculus
gaaggacgtcttagtggccacagat

SEQ ID NO: 100819 - DNA, 25 bp, Mus musculus
gaaggactaagactcagcacccgtt

SEQ ID NO: 100820 - DNA, 25 bp, Mus musculus
gaaggactacccctatgagcgcatg

SEQ ID NO: 100821 - DNA, 25 bp, Mus musculus
gaaggactacttcggtctgacctac

SEQ ID NO: 100822 - DNA, 25 bp, Mus musculus
gaaggactcctcaggccaagaagct

SEQ ID NO: 100823 - DNA, 25 bp, Mus musculus
gaaggactccttccaccacaatgtg

SEQ ID NO: 100824 - DNA, 25 bp, Mus musculus
gaaggactctaagaccctcaagtgg

SEQ ID NO: 100825 - DNA, 25 bp, Mus musculus
gaaggactgagtctccagtcagtaa

SEQ ID NO: 100826 - DNA, 25 bp, Mus musculus
gaaggactgatagaggacttccctg

SEQ ID NO: 100827 - DNA, 25 bp, Mus musculus
gaaggactgtgagattaagcagccg

SEQ ID NO: 100828 - DNA, 25 bp, Mus musculus
gaaggacttcacacaagctcagcgg

SEQ ID NO: 100829 - DNA, 25 bp, Mus musculus
gaaggacttcccaagatgccatgca

SEQ ID NO: 100830 - DNA, 25 bp, Mus musculus
gaaggacttctggagcatccgccta

SEQ ID NO: 100831 - DNA, 25 bp, Mus musculus
gaaggagaagctacaactgaccgat

SEQ ID NO: 100832 - DNA, 25 bp, Mus musculus
gaaggagaagttgaagaccacgttc

SEQ ID NO: 100833 - DNA, 25 bp, Mus musculus
gaaggagaattgtcacctggagcag

SEQ ID NO: 100834 - DNA, 25 bp, Mus musculus
gaaggagacatggaccatggcttaa

SEQ ID NO: 100835 - DNA, 25 bp, Mus musculus
gaaggagaccattaaaggattccag

SEQ ID NO: 100836 - DNA, 25 bp, Mus musculus
gaaggagaccttctgacctgatacc

SEQ ID NO: 100837 - DNA, 25 bp, Mus musculus
gaaggagactactcttagcccagag

SEQ ID NO: 100838 - DNA, 25 bp, Mus musculus
gaaggagactctattatggctggga

SEQ ID NO: 100839 - DNA, 25 bp, Mus musculus
gaaggagatcattgccgtcagctgt

SEQ ID NO: 100840 - DNA, 25 bp, Mus musculus
gaaggagatggctcttctagcagcc

SEQ ID NO: 100841 - DNA, 25 bp, Mus musculus
gaaggagatgtctgctcaccagtac

SEQ ID NO: 100842 - DNA, 25 bp, Mus musculus
gaaggagccaaagcacaaaaaagcc

SEQ ID NO: 100843 - DNA, 25 bp, Mus musculus
gaaggagcccagacgatgattgaac

SEQ ID NO: 100844 - DNA, 25 bp, Mus musculus
gaaggagcccttctctgaatacagc

SEQ ID NO: 100845 - DNA, 25 bp, Mus musculus
gaaggagcctttggaattcgaacac

SEQ ID NO: 100846 - DNA, 25 bp, Mus musculus
gaaggagctcatcttcacaggccgg

SEQ ID NO: 100847 - DNA, 25 bp, Mus musculus
gaaggaggacatgtacgacgagatc

SEQ ID NO: 100848 - DNA, 25 bp, Mus musculus
gaaggaggactagagtctttaagcc

SEQ ID NO: 100849 - DNA, 25 bp, Mus musculus
gaaggaggccagaagtttgcaagaa

SEQ ID NO: 100850 - DNA, 25 bp, Mus musculus
gaaggaggcgaccgactgatctctt

SEQ ID NO: 100851 - DNA, 25 bp, Mus musculus
gaaggagggacttaccacaaggagc

SEQ ID NO: 100852 - DNA, 25 bp, Mus musculus
gaaggagtacccatacctgagcacg

SEQ ID NO: 100853 - DNA, 25 bp, Mus musculus
gaaggagtagaaatagacgccacac

SEQ ID NO: 100854 - DNA, 25 bp, Mus musculus
gaaggagtcatcttccatgtcgcta

SEQ ID NO: 100855 - DNA, 25 bp, Mus musculus
gaaggagtccaaagcctcagagtcg

SEQ ID NO: 100856 - DNA, 25 bp, Mus musculus
gaaggagtccttcgagacgttcatc

SEQ ID NO: 100857 - DNA, 25 bp, Mus musculus
gaaggagtccttgctcttgcactca

SEQ ID NO: 100858 - DNA, 25 bp, Mus musculus
gaaggagtcggaggcatggctggtg

SEQ ID NO: 100859 - DNA, 25 bp, Mus musculus
gaaggagtctccgttccactgctag

SEQ ID NO: 100860 - DNA, 25 bp, Mus musculus
gaaggagtctctgataatgcaccac

SEQ ID NO: 100861 - DNA, 25 bp, Mus musculus
gaaggagtgcagatgcccttggctc

SEQ ID NO: 100862 - DNA, 25 bp, Mus musculus
gaaggagtggtattttggcaacgca

SEQ ID NO: 100863 - DNA, 25 bp, Mus musculus
gaaggagttcctaagcgagctgcag

SEQ ID NO: 100864 - DNA, 25 bp, Mus musculus
gaaggagtttgaccatccacacgtg

SEQ ID NO: 100865 - DNA, 25 bp, Mus musculus
gaaggatagctcagtgtccagcctg

SEQ ID NO: 100866 - DNA, 25 bp, Mus musculus
gaaggatcacatggtgaggctacac

SEQ ID NO: 100867 - DNA, 25 bp, Mus musculus
gaaggatcatagttacaaggctgct

SEQ ID NO: 100868 - DNA, 25 bp, Mus musculus
gaaggatcatcgaatggcccctgtc

SEQ ID NO: 100869 - DNA, 25 bp, Mus musculus
gaaggatccatgtctgtgccgagag

SEQ ID NO: 100870 - DNA, 25 bp, Mus musculus
gaaggatcctccagctaacgtccag

SEQ ID NO: 100871 - DNA, 25 bp, Mus musculus
gaaggatcctgctccgttagggaag

SEQ ID NO: 100872 - DNA, 25 bp, Mus musculus
gaaggatctattctctctgatgata

SEQ ID NO: 100873 - DNA, 25 bp, Mus musculus
gaaggatctattgatggttcattga

SEQ ID NO: 100874 - DNA, 25 bp, Mus musculus
gaaggatctcatgagaacgacaggc

SEQ ID NO: 100875 - DNA, 25 bp, Mus musculus
gaaggatctccagtgcatgcagagc

SEQ ID NO: 100876 - DNA, 25 bp, Mus musculus
gaaggatctcgaagttactgcacag

SEQ ID NO: 100877 - DNA, 25 bp, Mus musculus
gaaggatcttatgcaacagtgtaca

SEQ ID NO: 100878 - DNA, 25 bp, Mus musculus
gaaggatcttcatgcagatcatgct

SEQ ID NO: 100879 - DNA, 25 bp, Mus musculus
gaaggatggacaaatgtctccgcac

SEQ ID NO: 100880 - DNA, 25 bp, Mus musculus
gaaggatggactacactcaccaacc

SEQ ID NO: 100881 - DNA, 25 bp, Mus musculus
gaaggatggagtgaaggtccccaca

SEQ ID NO: 100882 - DNA, 25 bp, Mus musculus
gaaggatggccctccaggattgcgt

SEQ ID NO: 100883 - DNA, 25 bp, Mus musculus
gaaggatggcgagttctctacctgc

SEQ ID NO: 100884 - DNA, 25 bp, Mus musculus
gaaggatggcgttggtaccctacca

SEQ ID NO: 100885 - DNA, 25 bp, Mus musculus
gaaggattacaacaactatggctgc

SEQ ID NO: 100886 - DNA, 25 bp, Mus musculus
gaaggattccctgtcatcgagacca

SEQ ID NO: 100887 - DNA, 25 bp, Mus musculus
gaaggattcgattccgccaacggga

SEQ ID NO: 100888 - DNA, 25 bp, Mus musculus
gaaggattctccttttccgacgcgc

SEQ ID NO: 100889 - DNA, 25 bp, Mus musculus
gaaggattgaaaaccgctgctaagc

SEQ ID NO: 100890 - DNA, 25 bp, Mus musculus
gaaggatttctactctaagctggga

SEQ ID NO: 100891 - DNA, 25 bp, Mus musculus
gaaggattttatcccagcccacagc

SEQ ID NO: 100892 - DNA, 25 bp, Mus musculus
gaaggcaacaactaaggccccaggt

SEQ ID NO: 100893 - DNA, 25 bp, Mus musculus
gaaggcaactctggatgctggacac

SEQ ID NO: 100894 - DNA, 25 bp, Mus musculus
gaaggcaacttctactctgaaaatg

SEQ ID NO: 100895 - DNA, 25 bp, Mus musculus
gaaggcaagaaagcatcgttgagaa

SEQ ID NO: 100896 - DNA, 25 bp, Mus musculus
gaaggcacagatggaattacaggac

SEQ ID NO: 100897 - DNA, 25 bp, Mus musculus
gaaggcaccaacagagtgtctcggg

SEQ ID NO: 100898 - DNA, 25 bp, Mus musculus
gaaggcaccccagtgaaggtctctg

SEQ ID NO: 100899 - DNA, 25 bp, Mus musculus
gaaggcaccgcttgttctcaaagac

SEQ ID NO: 100900 - DNA, 25 bp, Mus musculus
gaaggcacggtatcagttggaacaa

SEQ ID NO: 100901 - DNA, 25 bp, Mus musculus
gaaggcactgaatttaccgcggcca

SEQ ID NO: 100902 - DNA, 25 bp, Mus musculus
gaaggcagaacttctgcaaggagga

SEQ ID NO: 100903 - DNA, 25 bp, Mus musculus
gaaggcagagaagccttgaactctc

SEQ ID NO: 100904 - DNA, 25 bp, Mus musculus
gaaggcagccacagtaggaagtcac

SEQ ID NO: 100905 - DNA, 25 bp, Mus musculus
gaaggcagcctatcatcaatggagg

SEQ ID NO: 100906 - DNA, 25 bp, Mus musculus
gaaggcagcgtgcttgacattctcc

SEQ ID NO: 100907 - DNA, 25 bp, Mus musculus
gaaggcaggcagtacttcgatttcc

SEQ ID NO: 100908 - DNA, 25 bp, Mus musculus
gaaggcaggctagactttgcagcgt

SEQ ID NO: 100909 - DNA, 25 bp, Mus musculus
gaaggcagggccagtatttaccagt

SEQ ID NO: 100910 - DNA, 25 bp, Mus musculus
gaaggcagtccaccccacctttttg

SEQ ID NO: 100911 - DNA, 25 bp, Mus musculus
gaaggcagtcctcacagaacagtct

SEQ ID NO: 100912 - DNA, 25 bp, Mus musculus
gaaggcagtcgttcagtctcagaat

SEQ ID NO: 100913 - DNA, 25 bp, Mus musculus
gaaggcagtgttgtcttctaccagc

SEQ ID NO: 100914 - DNA, 25 bp, Mus musculus
gaaggcatatcagctgtctgggatc

SEQ ID NO: 100915 - DNA, 25 bp, Mus musculus
gaaggcatcagtggccatccatcta

SEQ ID NO: 100916 - DNA, 25 bp, Mus musculus
gaaggcatccaagcagtgtcttatc

SEQ ID NO: 100917 - DNA, 25 bp, Mus musculus
gaaggcatcctcttccacgctggaa

SEQ ID NO: 100918 - DNA, 25 bp, Mus musculus
gaaggcatctataagtacaactcgg

SEQ ID NO: 100919 - DNA, 25 bp, Mus musculus
gaaggcatctgctgcattatcgctg

SEQ ID NO: 100920 - DNA, 25 bp, Mus musculus
gaaggcatcttcatgaagcccagtg

SEQ ID NO: 100921 - DNA, 25 bp, Mus musculus
gaaggcatgaccgtgatgaccggcc

SEQ ID NO: 100922 - DNA, 25 bp, Mus musculus
gaaggcatggaagcatcacgactgg

SEQ ID NO: 100923 - DNA, 25 bp, Mus musculus
gaaggcatggccagagtcctgaaca

SEQ ID NO: 100924 - DNA, 25 bp, Mus musculus
gaaggcatgtccgtttacctgtcaa

SEQ ID NO: 100925 - DNA, 25 bp, Mus musculus
gaaggcatgttctgctgtacgccca

SEQ ID NO: 100926 - DNA, 25 bp, Mus musculus
gaaggccaagacctactggaagcag

SEQ ID NO: 100927 - DNA, 25 bp, Mus musculus
gaaggccaagagtatgctgtcatgc

SEQ ID NO: 100928 - DNA, 25 bp, Mus musculus
gaaggccaagcaattacttcatggg

SEQ ID NO: 100929 - DNA, 25 bp, Mus musculus
gaaggccacatgaagagcctaaaag

SEQ ID NO: 100930 - DNA, 25 bp, Mus musculus
gaaggccaggcagtctatcaggaga

SEQ ID NO: 100931 - DNA, 25 bp, Mus musculus
gaaggccagtgcatgctctgactta

SEQ ID NO: 100932 - DNA, 25 bp, Mus musculus
gaaggccatataactgctggactgg

SEQ ID NO: 100933 - DNA, 25 bp, Mus musculus
gaaggccatctgtgactaccggcag

SEQ ID NO: 100934 - DNA, 25 bp, Mus musculus
gaaggcccaagagcattctggaaag

SEQ ID NO: 100935 - DNA, 25 bp, Mus musculus
gaaggcccctcacgttaagatcctg

SEQ ID NO: 100936 - DNA, 25 bp, Mus musculus
gaaggcccctctggcttacaaaagg

SEQ ID NO: 100937 - DNA, 25 bp, Mus musculus
gaaggccctcgagacattctggatg

SEQ ID NO: 100938 - DNA, 25 bp, Mus musculus
gaaggcccttcaaatagcaccgact

SEQ ID NO: 100939 - DNA, 25 bp, Mus musculus
gaaggcccttctggaacaactggtg

SEQ ID NO: 100940 - DNA, 25 bp, Mus musculus
gaaggccgatgcttactctttgatg

SEQ ID NO: 100941 - DNA, 25 bp, Mus musculus
gaaggccgcctttgatgtgtgcaag

SEQ ID NO: 100942 - DNA, 25 bp, Mus musculus
gaaggccgtcaagcagccaggaata

SEQ ID NO: 100943 - DNA, 25 bp, Mus musculus
gaaggcctacctcagtcactaagtt

SEQ ID NO: 100944 - DNA, 25 bp, Mus musculus
gaaggcctcactcacgggatacagg

SEQ ID NO: 100945 - DNA, 25 bp, Mus musculus
gaaggcctcagttccccgaggaaga

SEQ ID NO: 100946 - DNA, 25 bp, Mus musculus
gaaggcctccagtcttaccagttgg

SEQ ID NO: 100947 - DNA, 25 bp, Mus musculus
gaaggcctccctgagttagaaaaga

SEQ ID NO: 100948 - DNA, 25 bp, Mus musculus
gaaggcctcttagatccaaacgtca

SEQ ID NO: 100949 - DNA, 25 bp, Mus musculus
gaaggcctgagatcgatcattcaca

SEQ ID NO: 100950 - DNA, 25 bp, Mus musculus
gaaggcctgccaatttaagcgctcc

SEQ ID NO: 100951 - DNA, 25 bp, Mus musculus
gaaggcctgcgctttctggaacaag

SEQ ID NO: 100952 - DNA, 25 bp, Mus musculus
gaaggcctgggcctgtcagatacac

SEQ ID NO: 100953 - DNA, 25 bp, Mus musculus
gaaggccttccgcaaggagctacag

SEQ ID NO: 100954 - DNA, 25 bp, Mus musculus
gaaggcgacaagcaacttataaggg

SEQ ID NO: 100955 - DNA, 25 bp, Mus musculus
gaaggcgacgacgacatctagacgc

SEQ ID NO: 100956 - DNA, 25 bp, Mus musculus
gaaggcgactatttttcccgagcca

SEQ ID NO: 100957 - DNA, 25 bp, Mus musculus
gaaggcgccagggaatcatcaatga

SEQ ID NO: 100958 - DNA, 25 bp, Mus musculus
gaaggcgccgtgacttcggtgaatc

SEQ ID NO: 100959 - DNA, 25 bp, Mus musculus
gaaggcgcgacttatctatgaggac

SEQ ID NO: 100960 - DNA, 25 bp, Mus musculus
gaaggcgcttgctccacaaagatgg

SEQ ID NO: 100961 - DNA, 25 bp, Mus musculus
gaaggcggacaaggatcctcagaat

SEQ ID NO: 100962 - DNA, 25 bp, Mus musculus
gaaggcggcagttcactacacggtc

SEQ ID NO: 100963 - DNA, 25 bp, Mus musculus
gaaggcggcatcaaaaggcgtcgct

SEQ ID NO: 100964 - DNA, 25 bp, Mus musculus
gaaggcggccacttaattgacagca

SEQ ID NO: 100965 - DNA, 25 bp, Mus musculus
gaaggcgtacagactgactcctaaa

SEQ ID NO: 100966 - DNA, 25 bp, Mus musculus
gaaggcgtccagagacagagcaaga

SEQ ID NO: 100967 - DNA, 25 bp, Mus musculus
gaaggctacgatcctacagtggaga

SEQ ID NO: 100968 - DNA, 25 bp, Mus musculus
gaaggctacgcatctggaaagtggt

SEQ ID NO: 100969 - DNA, 25 bp, Mus musculus
gaaggctatctcaccaagcagggag

SEQ ID NO: 100970 - DNA, 25 bp, Mus musculus
gaaggctcaagacacagagctcgct

SEQ ID NO: 100971 - DNA, 25 bp, Mus musculus
gaaggctcataaggatttgattcag

SEQ ID NO: 100972 - DNA, 25 bp, Mus musculus
gaaggctcatggtatttataagcaa

SEQ ID NO: 100973 - DNA, 25 bp, Mus musculus
gaaggctccattgacagaagcaggc

SEQ ID NO: 100974 - DNA, 25 bp, Mus musculus
gaaggctccttgagaaagcgccagc

SEQ ID NO: 100975 - DNA, 25 bp, Mus musculus
gaaggctctagctattgcccacaag

SEQ ID NO: 100976 - DNA, 25 bp, Mus musculus
gaaggctctgcagtggcacccagac

SEQ ID NO: 100977 - DNA, 25 bp, Mus musculus
gaaggctctggaatacccctctgga

SEQ ID NO: 100978 - DNA, 25 bp, Mus musculus
gaaggctctgtagtctgatgggcac

SEQ ID NO: 100979 - DNA, 25 bp, Mus musculus
gaaggctgctgtgatccatgccctg

SEQ ID NO: 100980 - DNA, 25 bp, Mus musculus
gaaggctggaatcgccatgaggctg

SEQ ID NO: 100981 - DNA, 25 bp, Mus musculus
gaaggctggaatgtccacagcgcaa

SEQ ID NO: 100982 - DNA, 25 bp, Mus musculus
gaaggctggcactcagatcgagaat

SEQ ID NO: 100983 - DNA, 25 bp, Mus musculus
gaaggctggccttctctacgaatgc

SEQ ID NO: 100984 - DNA, 25 bp, Mus musculus
gaaggctggctgcacttgtttgacc

SEQ ID NO: 100985 - DNA, 25 bp, Mus musculus
gaaggctgtaggagacactcctata

SEQ ID NO: 100986 - DNA, 25 bp, Mus musculus
gaaggctgtgtgctagctgcatcct

SEQ ID NO: 100987 - DNA, 25 bp, Mus musculus
gaaggcttaccagagttcacgacag

SEQ ID NO: 100988 - DNA, 25 bp, Mus musculus
gaaggcttcaataggcaacatcgca

SEQ ID NO: 100989 - DNA, 25 bp, Mus musculus
gaaggcttcagagcatgtccctgta

SEQ ID NO: 100990 - DNA, 25 bp, Mus musculus
gaaggcttctcggagccatcaggag

SEQ ID NO: 100991 - DNA, 25 bp, Mus musculus
gaaggcttcttctcggtctttgcca

SEQ ID NO: 100992 - DNA, 25 bp, Mus musculus
gaagggaaacgatcctcaggcctga

SEQ ID NO: 100993 - DNA, 25 bp, Mus musculus
gaagggaaagcctcttaagaagctt

SEQ ID NO: 100994 - DNA, 25 bp, Mus musculus
gaagggaacccttactactctagtg

SEQ ID NO: 100995 - DNA, 25 bp, Mus musculus
gaagggaaccttcgagactcctttg

SEQ ID NO: 100996 - DNA, 25 bp, Mus musculus
gaagggaagaacatctctgctcagc

SEQ ID NO: 100997 - DNA, 25 bp, Mus musculus
gaagggaagtacactgccatgtctc

SEQ ID NO: 100998 - DNA, 25 bp, Mus musculus
gaagggaatcgccattgccctgctg

SEQ ID NO: 100999 - DNA, 25 bp, Mus musculus
gaagggacagtgtcactgagaagcc

SEQ ID NO: 101000 - DNA, 25 bp, Mus musculus
gaagggacattaagaacggacaggc

SEQ ID NO: 101001 - DNA, 25 bp, Mus musculus
gaagggaccaaggaagcacatgacc

SEQ ID NO: 101002 - DNA, 25 bp, Mus musculus
gaagggaccctctacactatgacag

SEQ ID NO: 101003 - DNA, 25 bp, Mus musculus
gaagggacctatgcctacagaacac

SEQ ID NO: 101004 - DNA, 25 bp, Mus musculus
gaagggactcaggattgccaaaggc

SEQ ID NO: 101005 - DNA, 25 bp, Mus musculus
gaagggagactgtgggaacccatct

SEQ ID NO: 101006 - DNA, 25 bp, Mus musculus
gaagggaggcacactttctggcaaa

SEQ ID NO: 101007 - DNA, 25 bp, Mus musculus
gaagggagtcgctatgctgctgacc

SEQ ID NO: 101008 - DNA, 25 bp, Mus musculus
gaagggatgtgctttcaggctgact

SEQ ID NO: 101009 - DNA, 25 bp, Mus musculus
gaagggattccttcagcttacctgg

SEQ ID NO: 101010 - DNA, 25 bp, Mus musculus
gaagggcaagccactcatgttgaat

SEQ ID NO: 101011 - DNA, 25 bp, Mus musculus
gaagggcacaacttcaacagctggg

SEQ ID NO: 101012 - DNA, 25 bp, Mus musculus
gaagggcatggatacccaatgtccc

SEQ ID NO: 101013 - DNA, 25 bp, Mus musculus
gaagggccaaggtgtatccaacagg

SEQ ID NO: 101014 - DNA, 25 bp, Mus musculus
gaagggccatccaaaccaagggcat

SEQ ID NO: 101015 - DNA, 25 bp, Mus musculus
gaagggcctatcaaagcaactggac

SEQ ID NO: 101016 - DNA, 25 bp, Mus musculus
gaagggcctctggtcaacacatctg

SEQ ID NO: 101017 - DNA, 25 bp, Mus musculus
gaagggcctcttccttaagcatgtg

SEQ ID NO: 101018 - DNA, 25 bp, Mus musculus
gaagggcgccattactgccgtgaga

SEQ ID NO: 101019 - DNA, 25 bp, Mus musculus
gaagggcggaagtccttgccaagac

SEQ ID NO: 101020 - DNA, 25 bp, Mus musculus
gaagggcgtcgatctgctcctagaa

SEQ ID NO: 101021 - DNA, 25 bp, Mus musculus
gaagggcgttttcacttttgtcaca

SEQ ID NO: 101022 - DNA, 25 bp, Mus musculus
gaagggctaaactcaggctgcaaca

SEQ ID NO: 101023 - DNA, 25 bp, Mus musculus
gaagggctcaccagtactgcagctg

SEQ ID NO: 101024 - DNA, 25 bp, Mus musculus
gaagggctcatcaccaccaatgtgg

SEQ ID NO: 101025 - DNA, 25 bp, Mus musculus
gaagggctctgaactctggactctg

SEQ ID NO: 101026 - DNA, 25 bp, Mus musculus
gaagggctgacaccagatgacgtcc

SEQ ID NO: 101027 - DNA, 25 bp, Mus musculus
gaagggctggattgatctccacaga

SEQ ID NO: 101028 - DNA, 25 bp, Mus musculus
gaagggctgtttcactgacttccac

SEQ ID NO: 101029 - DNA, 25 bp, Mus musculus
gaagggcttcctgcacaagtcacag

SEQ ID NO: 101030 - DNA, 25 bp, Mus musculus
gaagggctttcttacaggacaacag

SEQ ID NO: 101031 - DNA, 25 bp, Mus musculus
gaagggtaaactcaggcacctcaag

SEQ ID NO: 101032 - DNA, 25 bp, Mus musculus
gaagggtacgagatgtccaaggccc

SEQ ID NO: 101033 - DNA, 25 bp, Mus musculus
gaagggtcagcacaacgttcggctc

SEQ ID NO: 101034 - DNA, 25 bp, Mus musculus
gaagggtccagatgatctcctgcta

SEQ ID NO: 101035 - DNA, 25 bp, Mus musculus
gaagggtccatcaagaattctccgc

SEQ ID NO: 101036 - DNA, 25 bp, Mus musculus
gaagggtcccaagttgacacaatag

SEQ ID NO: 101037 - DNA, 25 bp, Mus musculus
gaagggtccccacaaaggaatagca

SEQ ID NO: 101038 - DNA, 25 bp, Mus musculus
gaagggtcgatctccgcgagcttgt

SEQ ID NO: 101039 - DNA, 25 bp, Mus musculus
gaagggtgcccttcccttggacaca

SEQ ID NO: 101040 - DNA, 25 bp, Mus musculus
gaagggttagtgtccctcacctcga

SEQ ID NO: 101041 - DNA, 25 bp, Mus musculus
gaagggttcaacttacaagcggcgg

SEQ ID NO: 101042 - DNA, 25 bp, Mus musculus
gaagggttcaatggccatcaggcca

SEQ ID NO: 101043 - DNA, 25 bp, Mus musculus
gaagggttccctgaagaacggcagc

SEQ ID NO: 101044 - DNA, 25 bp, Mus musculus
gaagggttcctgaatgcctcatgaa

SEQ ID NO: 101045 - DNA, 25 bp, Mus musculus
gaagggttctacttcactcccaagg

SEQ ID NO: 101046 - DNA, 25 bp, Mus musculus
gaaggtacaaagagaaacagcggga

SEQ ID NO: 101047 - DNA, 25 bp, Mus musculus
gaaggtaccgacgtcatcatgctga

SEQ ID NO: 101048 - DNA, 25 bp, Mus musculus
gaaggtacgtttctaccgcaatggg

SEQ ID NO: 101049 - DNA, 25 bp, Mus musculus
gaaggtactatggactgctataaca

SEQ ID NO: 101050 - DNA, 25 bp, Mus musculus
gaaggtagacactttctgctggaac

SEQ ID NO: 101051 - DNA, 25 bp, Mus musculus
gaaggtagctgctggcgttcgtcac

SEQ ID NO: 101052 - DNA, 25 bp, Mus musculus
gaaggtatcgtcacaagtagcagca

SEQ ID NO: 101053 - DNA, 25 bp, Mus musculus
gaaggtatctgctttgatccagaaa

SEQ ID NO: 101054 - DNA, 25 bp, Mus musculus
gaaggtatgcgtgtcctccggacgc

SEQ ID NO: 101055 - DNA, 25 bp, Mus musculus
gaaggtattcagtcggagcacccac

SEQ ID NO: 101056 - DNA, 25 bp, Mus musculus
gaaggtcaaaacctgcaactccgac

SEQ ID NO: 101057 - DNA, 25 bp, Mus musculus
gaaggtcaagaaatgggcaagctcc

SEQ ID NO: 101058 - DNA, 25 bp, Mus musculus
gaaggtcaattatggccagagcaca

SEQ ID NO: 101059 - DNA, 25 bp, Mus musculus
gaaggtcacccccagaagatgccat

SEQ ID NO: 101060 - DNA, 25 bp, Mus musculus
gaaggtcacccctttgaggccatgg

SEQ ID NO: 101061 - DNA, 25 bp, Mus musculus
gaaggtcatcagaccagcagggcag

SEQ ID NO: 101062 - DNA, 25 bp, Mus musculus
gaaggtcatcttcggcagtggcaca

SEQ ID NO: 101063 - DNA, 25 bp, Mus musculus
gaaggtcattggtcgctggtcaccc

SEQ ID NO: 101064 - DNA, 25 bp, Mus musculus
gaaggtccctgtggagcaacgactg

SEQ ID NO: 101065 - DNA, 25 bp, Mus musculus
gaaggtcctcagaatgtaacagtcc

SEQ ID NO: 101066 - DNA, 25 bp, Mus musculus
gaaggtcctgattgataatcctgct

SEQ ID NO: 101067 - DNA, 25 bp, Mus musculus
gaaggtcctgtctaaagctcaaagt

SEQ ID NO: 101068 - DNA, 25 bp, Mus musculus
gaaggtccttcatttggttacacag

SEQ ID NO: 101069 - DNA, 25 bp, Mus musculus
gaaggtcggcatgcaaatccctcga

SEQ ID NO: 101070 - DNA, 25 bp, Mus musculus
gaaggtcgggctttgctgcccgccc

SEQ ID NO: 101071 - DNA, 25 bp, Mus musculus
gaaggtctaataccagccccatggg

SEQ ID NO: 101072 - DNA, 25 bp, Mus musculus
gaaggtctacagctctgaagagaaa

SEQ ID NO: 101073 - DNA, 25 bp, Mus musculus
gaaggtctagttgattgtgatggaa

SEQ ID NO: 101074 - DNA, 25 bp, Mus musculus
gaaggtctcattaccatatgcagag

SEQ ID NO: 101075 - DNA, 25 bp, Mus musculus
gaaggtctcgcagcttgacatacag

SEQ ID NO: 101076 - DNA, 25 bp, Mus musculus
gaaggtctctaagaactcaactggg

SEQ ID NO: 101077 - DNA, 25 bp, Mus musculus
gaaggtctgtaagcagcactacaag

SEQ ID NO: 101078 - DNA, 25 bp, Mus musculus
gaaggtcttcaaccctgtttggcag

SEQ ID NO: 101079 - DNA, 25 bp, Mus musculus
gaaggtcttcgatctggctctgcag

SEQ ID NO: 101080 - DNA, 25 bp, Mus musculus
gaaggtcttcggatcactatcatcc

SEQ ID NO: 101081 - DNA, 25 bp, Mus musculus
gaaggtcttgatggtgttccagcca

SEQ ID NO: 101082 - DNA, 25 bp, Mus musculus
gaaggtgaaccccagctatataggc

SEQ ID NO: 101083 - DNA, 25 bp, Mus musculus
gaaggtgaacgatcaggccaacacg

SEQ ID NO: 101084 - DNA, 25 bp, Mus musculus
gaaggtgaagcttgtgatgcacccc

SEQ ID NO: 101085 - DNA, 25 bp, Mus musculus
gaaggtgaattcatcccagagacca

SEQ ID NO: 101086 - DNA, 25 bp, Mus musculus
gaaggtgacgcggaagggaagtact

SEQ ID NO: 101087 - DNA, 25 bp, Mus musculus
gaaggtgactttcagcacaaaggac

SEQ ID NO: 101088 - DNA, 25 bp, Mus musculus
gaaggtgatcgccagccttccagac

SEQ ID NO: 101089 - DNA, 25 bp, Mus musculus
gaaggtgattataaccctggaagga

SEQ ID NO: 101090 - DNA, 25 bp, Mus musculus
gaaggtgattattctcccagaggac

SEQ ID NO: 101091 - DNA, 25 bp, Mus musculus
gaaggtgcaccagcttgccatgacg

SEQ ID NO: 101092 - DNA, 25 bp, Mus musculus
gaaggtgcccatgcgtatcatagag

SEQ ID NO: 101093 - DNA, 25 bp, Mus musculus
gaaggtgcctactttgctaacggac

SEQ ID NO: 101094 - DNA, 25 bp, Mus musculus
gaaggtgcgacctctgagtgccagt

SEQ ID NO: 101095 - DNA, 25 bp, Mus musculus
gaaggtggacttacttgaacagagt

SEQ ID NO: 101096 - DNA, 25 bp, Mus musculus
gaaggtggcaaagaactcaaggaac

SEQ ID NO: 101097 - DNA, 25 bp, Mus musculus
gaaggtggcaatatacaaggctctg

SEQ ID NO: 101098 - DNA, 25 bp, Mus musculus
gaaggtggcctctgacacagaagac

SEQ ID NO: 101099 - DNA, 25 bp, Mus musculus
gaaggtggcctgaacgtaaccctga

SEQ ID NO: 101100 - DNA, 25 bp, Mus musculus
gaaggtggctatcccgagatcgtaa

SEQ ID NO: 101101 - DNA, 25 bp, Mus musculus
gaaggtgtaccccaacgttgctgag

SEQ ID NO: 101102 - DNA, 25 bp, Mus musculus
gaaggtgtcatacaactgctgcagt

SEQ ID NO: 101103 - DNA, 25 bp, Mus musculus
gaaggtgtcctttgcaagtctctgg

SEQ ID NO: 101104 - DNA, 25 bp, Mus musculus
gaaggtgtcttgctgcaggtaacta

SEQ ID NO: 101105 - DNA, 25 bp, Mus musculus
gaaggtgttccgttcccagtgcctg

SEQ ID NO: 101106 - DNA, 25 bp, Mus musculus
gaaggtgtttcccattagaaccgct

SEQ ID NO: 101107 - DNA, 25 bp, Mus musculus
gaaggtgtttgctaaggtgctccga

SEQ ID NO: 101108 - DNA, 25 bp, Mus musculus
gaaggttcatacaagagtgtgtcac

SEQ ID NO: 101109 - DNA, 25 bp, Mus musculus
gaaggttcctgacatgacactacat

SEQ ID NO: 101110 - DNA, 25 bp, Mus musculus
gaaggttcgatcctgttccagcgca

SEQ ID NO: 101111 - DNA, 25 bp, Mus musculus
gaaggttcgcaataacatctggagc

SEQ ID NO: 101112 - DNA, 25 bp, Mus musculus
gaaggttcgggctccgctctcacag

SEQ ID NO: 101113 - DNA, 25 bp, Mus musculus
gaaggttctcctctggttggtcctg

SEQ ID NO: 101114 - DNA, 25 bp, Mus musculus
gaaggttctcgaagcatccgctcta

SEQ ID NO: 101115 - DNA, 25 bp, Mus musculus
gaaggttgaactactgcctgccctg

SEQ ID NO: 101116 - DNA, 25 bp, Mus musculus
gaaggttgaactcgctaggctcagt

SEQ ID NO: 101117 - DNA, 25 bp, Mus musculus
gaaggttgattccatcctgcctgga

SEQ ID NO: 101118 - DNA, 25 bp, Mus musculus
gaaggttggccctgccatcaaggac

SEQ ID NO: 101119 - DNA, 25 bp, Mus musculus
gaaggtttatcacaactaccgccag

SEQ ID NO: 101120 - DNA, 25 bp, Mus musculus
gaaggtttatgccaccctggaggcc

SEQ ID NO: 101121 - DNA, 25 bp, Mus musculus
gaaggtttcccagctgtcgcatgaa

SEQ ID NO: 101122 - DNA, 25 bp, Mus musculus
gaaggtttgaagatgagcccagatg

SEQ ID NO: 101123 - DNA, 25 bp, Mus musculus
gaaggtttgtccagtcaccaggagc

SEQ ID NO: 101124 - DNA, 25 bp, Mus musculus
gaaggttttcgccattgctcaggcc

SEQ ID NO: 101125 - DNA, 25 bp, Mus musculus
gaagtaaacaagctctgtccagatg

SEQ ID NO: 101126 - DNA, 25 bp, Mus musculus
gaagtaaacgagattccaggaacca

SEQ ID NO: 101127 - DNA, 25 bp, Mus musculus
gaagtaaagacatcagccgaagcca

SEQ ID NO: 101128 - DNA, 25 bp, Mus musculus
gaagtaaatgcccagacgtaatggt

SEQ ID NO: 101129 - DNA, 25 bp, Mus musculus
gaagtaaccatcaagcgagggcctg

SEQ ID NO: 101130 - DNA, 25 bp, Mus musculus
gaagtaaccccttcaatggagtggc

SEQ ID NO: 101131 - DNA, 25 bp, Mus musculus
gaagtaacccttgtagagcagagac

SEQ ID NO: 101132 - DNA, 25 bp, Mus musculus
gaagtaactcttccgcgcgttgcca

SEQ ID NO: 101133 - DNA, 25 bp, Mus musculus
gaagtaagattgtgaccagcagcga

SEQ ID NO: 101134 - DNA, 25 bp, Mus musculus
gaagtaagcctcatgtgcacccgtg

SEQ ID NO: 101135 - DNA, 25 bp, Mus musculus
gaagtaaggttttggcagacaggac

SEQ ID NO: 101136 - DNA, 25 bp, Mus musculus
gaagtaatctgaagccagcccgtga

SEQ ID NO: 101137 - DNA, 25 bp, Mus musculus
gaagtaatggaacaaagcggcctgc

SEQ ID NO: 101138 - DNA, 25 bp, Mus musculus
gaagtaattctcaccaaaagacctc

SEQ ID NO: 101139 - DNA, 25 bp, Mus musculus
gaagtacaatgacatcgacctgacc

SEQ ID NO: 101140 - DNA, 25 bp, Mus musculus
gaagtacacatgcatgtcactaata

SEQ ID NO: 101141 - DNA, 25 bp, Mus musculus
gaagtacagcaaacattccggtcag

SEQ ID NO: 101142 - DNA, 25 bp, Mus musculus
gaagtacagcaactccatctccgtg

SEQ ID NO: 101143 - DNA, 25 bp, Mus musculus
gaagtacagctctccagggcaagga

SEQ ID NO: 101144 - DNA, 25 bp, Mus musculus
gaagtacagtacgtcgccctgagga

SEQ ID NO: 101145 - DNA, 25 bp, Mus musculus
gaagtaccaccatagtgatcgccta

SEQ ID NO: 101146 - DNA, 25 bp, Mus musculus
gaagtaccagggatcgaaggagccc

SEQ ID NO: 101147 - DNA, 25 bp, Mus musculus
gaagtaccatttctccttgttcacg

SEQ ID NO: 101148 - DNA, 25 bp, Mus musculus
gaagtaccctgacccttttgagact

SEQ ID NO: 101149 - DNA, 25 bp, Mus musculus
gaagtaccgagtgggagactccagc

SEQ ID NO: 101150 - DNA, 25 bp, Mus musculus
gaagtacctccgagaatacgcctgg

SEQ ID NO: 101151 - DNA, 25 bp, Mus musculus
gaagtacctcggtttcagacagcgg

SEQ ID NO: 101152 - DNA, 25 bp, Mus musculus
gaagtacctgacctccaatgtggct

SEQ ID NO: 101153 - DNA, 25 bp, Mus musculus
gaagtacctgcatccatgatgaagc

SEQ ID NO: 101154 - DNA, 25 bp, Mus musculus
gaagtacctgctgcgattgctagac

SEQ ID NO: 101155 - DNA, 25 bp, Mus musculus
gaagtacctggatgtgaagtttgag

SEQ ID NO: 101156 - DNA, 25 bp, Mus musculus
gaagtaccttcaggccatcatggac

SEQ ID NO: 101157 - DNA, 25 bp, Mus musculus
gaagtacgagtctgcctatggaaca

SEQ ID NO: 101158 - DNA, 25 bp, Mus musculus
gaagtacggcgtctcatctgggaaa

SEQ ID NO: 101159 - DNA, 25 bp, Mus musculus
gaagtacgtcatcaacatctcgctg

SEQ ID NO: 101160 - DNA, 25 bp, Mus musculus
gaagtacgttaacgtgggagatcta

SEQ ID NO: 101161 - DNA, 25 bp, Mus musculus
gaagtactacacctcgaagatcagc

SEQ ID NO: 101162 - DNA, 25 bp, Mus musculus
gaagtactatttctgccggtctgag

SEQ ID NO: 101163 - DNA, 25 bp, Mus musculus
gaagtactctcactagcccttgtca

SEQ ID NO: 101164 - DNA, 25 bp, Mus musculus
gaagtactctctttgaagggcggac

SEQ ID NO: 101165 - DNA, 25 bp, Mus musculus
gaagtactgactggtgctgctcctg

SEQ ID NO: 101166 - DNA, 25 bp, Mus musculus
gaagtactgcgctccccgtaactct

SEQ ID NO: 101167 - DNA, 25 bp, Mus musculus
gaagtactgctacaaagctcctgct

SEQ ID NO: 101168 - DNA, 25 bp, Mus musculus
gaagtactggcgtcatactcaggct

SEQ ID NO: 101169 - DNA, 25 bp, Mus musculus
gaagtactgtatgggtgaccgccct

SEQ ID NO: 101170 - DNA, 25 bp, Mus musculus
gaagtacttgctccgcctggatgtc

SEQ ID NO: 101171 - DNA, 25 bp, Mus musculus
gaagtagaaaacgaagcccactgct

SEQ ID NO: 101172 - DNA, 25 bp, Mus musculus
gaagtagaaccagcgcacagagact

SEQ ID NO: 101173 - DNA, 25 bp, Mus musculus
gaagtagaccttgctgagccagaag

SEQ ID NO: 101174 - DNA, 25 bp, Mus musculus
gaagtagactcaagccaagagcaca

SEQ ID NO: 101175 - DNA, 25 bp, Mus musculus
gaagtagagagtttacgacctccca

SEQ ID NO: 101176 - DNA, 25 bp, Mus musculus
gaagtagatcctaatgagcagctgg

SEQ ID NO: 101177 - DNA, 25 bp, Mus musculus
gaagtagcatcgatgtcctcgcagc

SEQ ID NO: 101178 - DNA, 25 bp, Mus musculus
gaagtagccaccattgcatccgagg

SEQ ID NO: 101179 - DNA, 25 bp, Mus musculus
gaagtagccgtgttggttgtccatc

SEQ ID NO: 101180 - DNA, 25 bp, Mus musculus
gaagtagccttccagactaaagtgg

SEQ ID NO: 101181 - DNA, 25 bp, Mus musculus
gaagtaggactagccatccgaagca

SEQ ID NO: 101182 - DNA, 25 bp, Mus musculus
gaagtaggagtggtacaagatcccc

SEQ ID NO: 101183 - DNA, 25 bp, Mus musculus
gaagtaggccttcaacatggcggct

SEQ ID NO: 101184 - DNA, 25 bp, Mus musculus
gaagtagggtgaaaagcggctacaa

SEQ ID NO: 101185 - DNA, 25 bp, Mus musculus
gaagtaggtacttcttatggctgct

SEQ ID NO: 101186 - DNA, 25 bp, Mus musculus
gaagtaggtgttcttgccatcgcca

SEQ ID NO: 101187 - DNA, 25 bp, Mus musculus
gaagtagtcaatgttgtagaagttg

SEQ ID NO: 101188 - DNA, 25 bp, Mus musculus
gaagtagtcagatttcgctaagggc

SEQ ID NO: 101189 - DNA, 25 bp, Mus musculus
gaagtagtgggactgcactccgaca

SEQ ID NO: 101190 - DNA, 25 bp, Mus musculus
gaagtagtttcctacccagcccaga

SEQ ID NO: 101191 - DNA, 25 bp, Mus musculus
gaagtataggctgtgttgtcacgcc

SEQ ID NO: 101192 - DNA, 25 bp, Mus musculus
gaagtatcatccagaggtatgggca

SEQ ID NO: 101193 - DNA, 25 bp, Mus musculus
gaagtatccacactgcgcaaggacg

SEQ ID NO: 101194 - DNA, 25 bp, Mus musculus
gaagtatccatgacagccttgaggc

SEQ ID NO: 101195 - DNA, 25 bp, Mus musculus
gaagtatcccaatgctgagctggcc

SEQ ID NO: 101196 - DNA, 25 bp, Mus musculus
gaagtatcctctccagcagggcaag

SEQ ID NO: 101197 - DNA, 25 bp, Mus musculus
gaagtatctaaggatcccaagggcc

SEQ ID NO: 101198 - DNA, 25 bp, Mus musculus
gaagtatctcaaaaagtcgctcccg

SEQ ID NO: 101199 - DNA, 25 bp, Mus musculus
gaagtatctggtcaaccctgaggga

SEQ ID NO: 101200 - DNA, 25 bp, Mus musculus
gaagtatgaccccaagacacaggag

SEQ ID NO: 101201 - DNA, 25 bp, Mus musculus
gaagtatgaggagctcttcccggcc

SEQ ID NO: 101202 - DNA, 25 bp, Mus musculus
gaagtatgcagccttgtaccagcct

SEQ ID NO: 101203 - DNA, 25 bp, Mus musculus
gaagtatgcgctacctgcgtgcagg

SEQ ID NO: 101204 - DNA, 25 bp, Mus musculus
gaagtatgctgaccatcaagatcga

SEQ ID NO: 101205 - DNA, 25 bp, Mus musculus
gaagtatggccgtaagtggagcaca

SEQ ID NO: 101206 - DNA, 25 bp, Mus musculus
gaagtattcctacctcaacgtggtg

SEQ ID NO: 101207 - DNA, 25 bp, Mus musculus
gaagtattgcactggctcaggccca

SEQ ID NO: 101208 - DNA, 25 bp, Mus musculus
gaagtattgcgagtcacccatgaac

SEQ ID NO: 101209 - DNA, 25 bp, Mus musculus
gaagtattgtaaggcgcagtcagga

SEQ ID NO: 101210 - DNA, 25 bp, Mus musculus
gaagtcaaactcaaaatggcacctg

SEQ ID NO: 101211 - DNA, 25 bp, Mus musculus
gaagtcaaagagtattcaacactgg

SEQ ID NO: 101212 - DNA, 25 bp, Mus musculus
gaagtcaactgtactgccatggcca

SEQ ID NO: 101213 - DNA, 25 bp, Mus musculus
gaagtcaacttgtattcagccggca

SEQ ID NO: 101214 - DNA, 25 bp, Mus musculus
gaagtcaagggctctacactcaggc

SEQ ID NO: 101215 - DNA, 25 bp, Mus musculus
gaagtcaatgaagtctacatctccc

SEQ ID NO: 101216 - DNA, 25 bp, Mus musculus
gaagtcacaggttgccctgaagatc

SEQ ID NO: 101217 - DNA, 25 bp, Mus musculus
gaagtcacccaagtagtcggagcag

SEQ ID NO: 101218 - DNA, 25 bp, Mus musculus
gaagtcacctcagaagattgccaag

SEQ ID NO: 101219 - DNA, 25 bp, Mus musculus
gaagtcacctgacagagcatggccc

SEQ ID NO: 101220 - DNA, 25 bp, Mus musculus
gaagtcaccttggaggctaacccca

SEQ ID NO: 101221 - DNA, 25 bp, Mus musculus
gaagtcacgagtccctttgcagcaa

SEQ ID NO: 101222 - DNA, 25 bp, Mus musculus
gaagtcacgcagacagacaagcatg

SEQ ID NO: 101223 - DNA, 25 bp, Mus musculus
gaagtcacggaaaagctcacgcaaa

SEQ ID NO: 101224 - DNA, 25 bp, Mus musculus
gaagtcagaaatccacattcccgat

SEQ ID NO: 101225 - DNA, 25 bp, Mus musculus
gaagtcagacatgaagaagcgcaga

SEQ ID NO: 101226 - DNA, 25 bp, Mus musculus
gaagtcagagacaacccaggaaact

SEQ ID NO: 101227 - DNA, 25 bp, Mus musculus
gaagtcagatcacgctccaagaatg

SEQ ID NO: 101228 - DNA, 25 bp, Mus musculus
gaagtcagcacctctacaaggaacg

SEQ ID NO: 101229 - DNA, 25 bp, Mus musculus
gaagtcaggccgtacatcaacatta

SEQ ID NO: 101230 - DNA, 25 bp, Mus musculus
gaagtcagtgctagtcgggaacatc

SEQ ID NO: 101231 - DNA, 25 bp, Mus musculus
gaagtcatccctgcggagtgtggaa

SEQ ID NO: 101232 - DNA, 25 bp, Mus musculus
gaagtcatccggagctgaaggcaga

SEQ ID NO: 101233 - DNA, 25 bp, Mus musculus
gaagtcatgaacgaaatctgggcca

SEQ ID NO: 101234 - DNA, 25 bp, Mus musculus
gaagtcattcctgtaatggagctgc

SEQ ID NO: 101235 - DNA, 25 bp, Mus musculus
gaagtcattggtgaaaacagcatgc

SEQ ID NO: 101236 - DNA, 25 bp, Mus musculus
gaagtcattgtctactgccggcagg

SEQ ID NO: 101237 - DNA, 25 bp, Mus musculus
gaagtccaaagtgcacgagagtctg

SEQ ID NO: 101238 - DNA, 25 bp, Mus musculus
gaagtccacattccatcatagcaag

SEQ ID NO: 101239 - DNA, 25 bp, Mus musculus
gaagtccacgacatccccatgatag

SEQ ID NO: 101240 - DNA, 25 bp, Mus musculus
gaagtccactattgatctgacctgc

SEQ ID NO: 101241 - DNA, 25 bp, Mus musculus
gaagtccactgaaagaaggtcactc

SEQ ID NO: 101242 - DNA, 25 bp, Mus musculus
gaagtccaggattcactccggaaga

SEQ ID NO: 101243 - DNA, 25 bp, Mus musculus
gaagtccagtcttgagtgaggtcta

SEQ ID NO: 101244 - DNA, 25 bp, Mus musculus
gaagtcccaagtcgcacattgacag

SEQ ID NO: 101245 - DNA, 25 bp, Mus musculus
gaagtcccacggagcaagctctgaa

SEQ ID NO: 101246 - DNA, 25 bp, Mus musculus
gaagtcccagcatgagaatcagagc

SEQ ID NO: 101247 - DNA, 25 bp, Mus musculus
gaagtcccaggcactagtaaccatg

SEQ ID NO: 101248 - DNA, 25 bp, Mus musculus
gaagtccccgatctgatccagaagg

SEQ ID NO: 101249 - DNA, 25 bp, Mus musculus
gaagtccccgtgttcgtcatgtcgg

SEQ ID NO: 101250 - DNA, 25 bp, Mus musculus
gaagtccccttgataatgagctcca

SEQ ID NO: 101251 - DNA, 25 bp, Mus musculus
gaagtcccgcttccttgagaacaag

SEQ ID NO: 101252 - DNA, 25 bp, Mus musculus
gaagtcccggaagcccactgtgcta

SEQ ID NO: 101253 - DNA, 25 bp, Mus musculus
gaagtccctctctgaagcatcagtg

SEQ ID NO: 101254 - DNA, 25 bp, Mus musculus
gaagtccgactagagaccgcgggta

SEQ ID NO: 101255 - DNA, 25 bp, Mus musculus
gaagtccgcgggtcccgtgagtcct

SEQ ID NO: 101256 - DNA, 25 bp, Mus musculus
gaagtcctacagaagggcgtggcct

SEQ ID NO: 101257 - DNA, 25 bp, Mus musculus
gaagtcctagacttggagggcacag

SEQ ID NO: 101258 - DNA, 25 bp, Mus musculus
gaagtcctgcatgtcgcaagcgtgg

SEQ ID NO: 101259 - DNA, 25 bp, Mus musculus
gaagtcctggaaaagagcttgctca

SEQ ID NO: 101260 - DNA, 25 bp, Mus musculus
gaagtcctgggagtataaaacgaga

SEQ ID NO: 101261 - DNA, 25 bp, Mus musculus
gaagtccttattgaagatcccgagc

SEQ ID NO: 101262 - DNA, 25 bp, Mus musculus
gaagtccttccggaatctgcgagcg

SEQ ID NO: 101263 - DNA, 25 bp, Mus musculus
gaagtccttgacagatcatccgagt

SEQ ID NO: 101264 - DNA, 25 bp, Mus musculus
gaagtccttggtatcatcttatgag

SEQ ID NO: 101265 - DNA, 25 bp, Mus musculus
gaagtcctttaacatgcagaggaag

SEQ ID NO: 101266 - DNA, 25 bp, Mus musculus
gaagtcgaacaccttcagacaggac

SEQ ID NO: 101267 - DNA, 25 bp, Mus musculus
gaagtcgatctgtccttcagttttc

SEQ ID NO: 101268 - DNA, 25 bp, Mus musculus
gaagtcgcacaagtcgtcagaggga

SEQ ID NO: 101269 - DNA, 25 bp, Mus musculus
gaagtcgccaacaaggtcaccatgg

SEQ ID NO: 101270 - DNA, 25 bp, Mus musculus
gaagtcgccaagatttgctccctgg

SEQ ID NO: 101271 - DNA, 25 bp, Mus musculus
gaagtcgccatgttgtatcctgagc

SEQ ID NO: 101272 - DNA, 25 bp, Mus musculus
gaagtcgcccatgacctgtcgaaga

SEQ ID NO: 101273 - DNA, 25 bp, Mus musculus
gaagtcgccctgaacaagttgctgg

SEQ ID NO: 101274 - DNA, 25 bp, Mus musculus
gaagtcggctgactacgtcaacctg

SEQ ID NO: 101275 - DNA, 25 bp, Mus musculus
gaagtcgtccccttgaacattggag

SEQ ID NO: 101276 - DNA, 25 bp, Mus musculus
gaagtcgtggctttctctgaccgaa

SEQ ID NO: 101277 - DNA, 25 bp, Mus musculus
gaagtcgttcaggagaaagtcccac

SEQ ID NO: 101278 - DNA, 25 bp, Mus musculus
gaagtctaaagctaagccaaacggc

SEQ ID NO: 101279 - DNA, 25 bp, Mus musculus
gaagtctagcatcctggtccacaag

SEQ ID NO: 101280 - DNA, 25 bp, Mus musculus
gaagtctaggaccagacgcggtcca

SEQ ID NO: 101281 - DNA, 25 bp, Mus musculus
gaagtctagtcagcccagtcaagag

SEQ ID NO: 101282 - DNA, 25 bp, Mus musculus
gaagtctcaaaccaagagagcttgc

SEQ ID NO: 101283 - DNA, 25 bp, Mus musculus
gaagtctcacgatggcagaacctag

SEQ ID NO: 101284 - DNA, 25 bp, Mus musculus
gaagtctcaggaacctcactccaga

SEQ ID NO: 101285 - DNA, 25 bp, Mus musculus
gaagtctccatcaacagaagcctgg

SEQ ID NO: 101286 - DNA, 25 bp, Mus musculus
gaagtctcccactccagaactcatt

SEQ ID NO: 101287 - DNA, 25 bp, Mus musculus
gaagtctctgcagcgtggagaagac

SEQ ID NO: 101288 - DNA, 25 bp, Mus musculus
gaagtctgaaagaaccctgagggaa

SEQ ID NO: 101289 - DNA, 25 bp, Mus musculus
gaagtctgacgccttgagacctctg

SEQ ID NO: 101290 - DNA, 25 bp, Mus musculus
gaagtctgagactgcctgggtacct

SEQ ID NO: 101291 - DNA, 25 bp, Mus musculus
gaagtctgcgcaccaagttgtctct

SEQ ID NO: 101292 - DNA, 25 bp, Mus musculus
gaagtctgctggtgattcatgatac

SEQ ID NO: 101293 - DNA, 25 bp, Mus musculus
gaagtctgctgtgaattcctactcc

SEQ ID NO: 101294 - DNA, 25 bp, Mus musculus
gaagtctggcagtgtttatctcgtt

SEQ ID NO: 101295 - DNA, 25 bp, Mus musculus
gaagtctgtagtgagtgaccgccta

SEQ ID NO: 101296 - DNA, 25 bp, Mus musculus
gaagtcttccatgatattcggcagc

SEQ ID NO: 101297 - DNA, 25 bp, Mus musculus
gaagtcttccccaaaaaccatgctg

SEQ ID NO: 101298 - DNA, 25 bp, Mus musculus
gaagtcttccttatctaaacccagg

SEQ ID NO: 101299 - DNA, 25 bp, Mus musculus
gaagtcttctccagtcaaagtggga

SEQ ID NO: 101300 - DNA, 25 bp, Mus musculus
gaagtcttggaagtctgtccccgcc

SEQ ID NO: 101301 - DNA, 25 bp, Mus musculus
gaagtcttgtttgagagccctgaac

SEQ ID NO: 101302 - DNA, 25 bp, Mus musculus
gaagtctttactggcagggctcagc

SEQ ID NO: 101303 - DNA, 25 bp, Mus musculus
gaagtctttgacctcaacatgaaga

SEQ ID NO: 101304 - DNA, 25 bp, Mus musculus
gaagtctttggtgaggcatgcagca

SEQ ID NO: 101305 - DNA, 25 bp, Mus musculus
gaagtgaaattcacagaagagcaca

SEQ ID NO: 101306 - DNA, 25 bp, Mus musculus
gaagtgaacttgactctcatgaaga

SEQ ID NO: 101307 - DNA, 25 bp, Mus musculus
gaagtgaagctgatcgggttcgccc

SEQ ID NO: 101308 - DNA, 25 bp, Mus musculus
gaagtgaagtttgctcgcacacctg

SEQ ID NO: 101309 - DNA, 25 bp, Mus musculus
gaagtgaatatgctagaagaaccaa

SEQ ID NO: 101310 - DNA, 25 bp, Mus musculus
gaagtgacagctttcgtcctggaga

SEQ ID NO: 101311 - DNA, 25 bp, Mus musculus
gaagtgacccgactcttgaccatgg

SEQ ID NO: 101312 - DNA, 25 bp, Mus musculus
gaagtgacgtttcctgctcgggtcc

SEQ ID NO: 101313 - DNA, 25 bp, Mus musculus
gaagtgactgttctagacccggcag

SEQ ID NO: 101314 - DNA, 25 bp, Mus musculus
gaagtgactttcacactggtgacag

SEQ ID NO: 101315 - DNA, 25 bp, Mus musculus
gaagtgagaaagttgccggcgtccc

SEQ ID NO: 101316 - DNA, 25 bp, Mus musculus
gaagtgagaacattttggagaaggc

SEQ ID NO: 101317 - DNA, 25 bp, Mus musculus
gaagtgagacccatggacggagtcc

SEQ ID NO: 101318 - DNA, 25 bp, Mus musculus
gaagtgagactcaagcacccaagtg

SEQ ID NO: 101319 - DNA, 25 bp, Mus musculus
gaagtgagccagcaccgaaggtaac

SEQ ID NO: 101320 - DNA, 25 bp, Mus musculus
gaagtgagcccctctaatgccaagg

SEQ ID NO: 101321 - DNA, 25 bp, Mus musculus
gaagtgaggccctaatgacccttga

SEQ ID NO: 101322 - DNA, 25 bp, Mus musculus
gaagtgaggtcctttcctaggccct

SEQ ID NO: 101323 - DNA, 25 bp, Mus musculus
gaagtgagtcggagcatctccaagt

SEQ ID NO: 101324 - DNA, 25 bp, Mus musculus
gaagtgataccttaaacggactgaa

SEQ ID NO: 101325 - DNA, 25 bp, Mus musculus
gaagtgatcactgcgtggtgccagc

SEQ ID NO: 101326 - DNA, 25 bp, Mus musculus
gaagtgatcattccactactgagca

SEQ ID NO: 101327 - DNA, 25 bp, Mus musculus
gaagtgatctactacgacccgtgtg

SEQ ID NO: 101328 - DNA, 25 bp, Mus musculus
gaagtgatctcatccgtcgaagtgt

SEQ ID NO: 101329 - DNA, 25 bp, Mus musculus
gaagtgatgcccaagatctgccggc

SEQ ID NO: 101330 - DNA, 25 bp, Mus musculus
gaagtgatgcggctcctactcctgt

SEQ ID NO: 101331 - DNA, 25 bp, Mus musculus
gaagtgatgttacctgccaagccag

SEQ ID NO: 101332 - DNA, 25 bp, Mus musculus
gaagtgattaaacatgagtatcatg

SEQ ID NO: 101333 - DNA, 25 bp, Mus musculus
gaagtgattagacgctgtcaacaga

SEQ ID NO: 101334 - DNA, 25 bp, Mus musculus
gaagtgattcctttcatcaagcctg

SEQ ID NO: 101335 - DNA, 25 bp, Mus musculus
gaagtgattgacaccggctatggca

SEQ ID NO: 101336 - DNA, 25 bp, Mus musculus
gaagtgcactgtgatgaggccgcca

SEQ ID NO: 101337 - DNA, 25 bp, Mus musculus
gaagtgcaggacagtgggcaaacca

SEQ ID NO: 101338 - DNA, 25 bp, Mus musculus
gaagtgcaggtctactacaggacca

SEQ ID NO: 101339 - DNA, 25 bp, Mus musculus
gaagtgcagtcattcagaacaagca

SEQ ID NO: 101340 - DNA, 25 bp, Mus musculus
gaagtgcatccaattccactacggg

SEQ ID NO: 101341 - DNA, 25 bp, Mus musculus
gaagtgcattctgaagccccaggaa

SEQ ID NO: 101342 - DNA, 25 bp, Mus musculus
gaagtgccaagaacaaatgccagcg

SEQ ID NO: 101343 - DNA, 25 bp, Mus musculus
gaagtgccacaaaaagttccctcag

SEQ ID NO: 101344 - DNA, 25 bp, Mus musculus
gaagtgccagtaaccatcgttgtca

SEQ ID NO: 101345 - DNA, 25 bp, Mus musculus
gaagtgcccaggtacttttgtctgt

SEQ ID NO: 101346 - DNA, 25 bp, Mus musculus
gaagtgcccattagcctggccaaaa

SEQ ID NO: 101347 - DNA, 25 bp, Mus musculus
gaagtgccccggagatcaagtacaa

SEQ ID NO: 101348 - DNA, 25 bp, Mus musculus
gaagtgcccctattgcagtcgctgt

SEQ ID NO: 101349 - DNA, 25 bp, Mus musculus
gaagtgccctatgtttttggtgtcc

SEQ ID NO: 101350 - DNA, 25 bp, Mus musculus
gaagtgccgcatcgacacggagatc

SEQ ID NO: 101351 - DNA, 25 bp, Mus musculus
gaagtgcctggctaccttgtgtctc

SEQ ID NO: 101352 - DNA, 25 bp, Mus musculus
gaagtgcctgtgcagcttcccggat

SEQ ID NO: 101353 - DNA, 25 bp, Mus musculus
gaagtgcctgtttccgaggaaccct

SEQ ID NO: 101354 - DNA, 25 bp, Mus musculus
gaagtgcgaattgacaggctcatcc

SEQ ID NO: 101355 - DNA, 25 bp, Mus musculus
gaagtgcgagccaggcctttctcag

SEQ ID NO: 101356 - DNA, 25 bp, Mus musculus
gaagtgcgcacttacgtgttcacag

SEQ ID NO: 101357 - DNA, 25 bp, Mus musculus
gaagtgcgcctattgctgagccaac

SEQ ID NO: 101358 - DNA, 25 bp, Mus musculus
gaagtgcgcttccacctgtcagagc

SEQ ID NO: 101359 - DNA, 25 bp, Mus musculus
gaagtgcgtctctccaacttggaag

SEQ ID NO: 101360 - DNA, 25 bp, Mus musculus
gaagtgctaagacacccgaggatat

SEQ ID NO: 101361 - DNA, 25 bp, Mus musculus
gaagtgctacagaagaggaaccgcc

SEQ ID NO: 101362 - DNA, 25 bp, Mus musculus
gaagtgctcaaagatggctgctgtg

SEQ ID NO: 101363 - DNA, 25 bp, Mus musculus
gaagtgctcaagacctacaatgtgg

SEQ ID NO: 101364 - DNA, 25 bp, Mus musculus
gaagtgctccgcaggttaacatcgt

SEQ ID NO: 101365 - DNA, 25 bp, Mus musculus
gaagtgctccgggaacacaaggaca

SEQ ID NO: 101366 - DNA, 25 bp, Mus musculus
gaagtgctcgaacgaacctgttgga

SEQ ID NO: 101367 - DNA, 25 bp, Mus musculus
gaagtgctctgggtctgtgccaacc

SEQ ID NO: 101368 - DNA, 25 bp, Mus musculus
gaagtgctgaaaaacagggcccggc

SEQ ID NO: 101369 - DNA, 25 bp, Mus musculus
gaagtgctgctacggatatattctc

SEQ ID NO: 101370 - DNA, 25 bp, Mus musculus
gaagtgctgttcttgggcatgaacc

SEQ ID NO: 101371 - DNA, 25 bp, Mus musculus
gaagtgcttctgtggcttgtgaaaa

SEQ ID NO: 101372 - DNA, 25 bp, Mus musculus
gaagtgcttgctcctgaagcctcag

SEQ ID NO: 101373 - DNA, 25 bp, Mus musculus
gaagtgctttgacaagttctgcgcc

SEQ ID NO: 101374 - DNA, 25 bp, Mus musculus
gaagtgcttttccatttcctaactg

SEQ ID NO: 101375 - DNA, 25 bp, Mus musculus
gaagtggaaccctcagacatcaagc

SEQ ID NO: 101376 - DNA, 25 bp, Mus musculus
gaagtggacacacaaataactgggc

SEQ ID NO: 101377 - DNA, 25 bp, Mus musculus
gaagtggaccgagacatagaacaaa

SEQ ID NO: 101378 - DNA, 25 bp, Mus musculus
gaagtggaccttaagctgcctggag

SEQ ID NO: 101379 - DNA, 25 bp, Mus musculus
gaagtggataaatggatcgacttta

SEQ ID NO: 101380 - DNA, 25 bp, Mus musculus
gaagtggatgagacccgcaagtgct

SEQ ID NO: 101381 - DNA, 25 bp, Mus musculus
gaagtggatggattcgaaaagccca

SEQ ID NO: 101382 - DNA, 25 bp, Mus musculus
gaagtggcaacaacactcgctgctg

SEQ ID NO: 101383 - DNA, 25 bp, Mus musculus
gaagtggcccagctaattcagcaga

SEQ ID NO: 101384 - DNA, 25 bp, Mus musculus
gaagtggccggcaggcggccctggg

SEQ ID NO: 101385 - DNA, 25 bp, Mus musculus
gaagtggcgctggttgtacatccgt

SEQ ID NO: 101386 - DNA, 25 bp, Mus musculus
gaagtggcggcatcgctggctcggc

SEQ ID NO: 101387 - DNA, 25 bp, Mus musculus
gaagtggctatctcctacaacggaa

SEQ ID NO: 101388 - DNA, 25 bp, Mus musculus
gaagtggctctgtccatccaggagg

SEQ ID NO: 101389 - DNA, 25 bp, Mus musculus
gaagtggcttcctaggtgacatgga

SEQ ID NO: 101390 - DNA, 25 bp, Mus musculus
gaagtgggacatctagaagctgcct

SEQ ID NO: 101391 - DNA, 25 bp, Mus musculus
gaagtgggaggatctcctgccaaca

SEQ ID NO: 101392 - DNA, 25 bp, Mus musculus
gaagtgggcggtgcctgtatccctc

SEQ ID NO: 101393 - DNA, 25 bp, Mus musculus
gaagtggtcactgtcacaaacggga

SEQ ID NO: 101394 - DNA, 25 bp, Mus musculus
gaagtggtgaaattctgctgctcct

SEQ ID NO: 101395 - DNA, 25 bp, Mus musculus
gaagtggttctcaaattcccagagg

SEQ ID NO: 101396 - DNA, 25 bp, Mus musculus
gaagtggtttactggtcacccaaga

SEQ ID NO: 101397 - DNA, 25 bp, Mus musculus
gaagtgtaccgcgtaaccaagcgtg

SEQ ID NO: 101398 - DNA, 25 bp, Mus musculus
gaagtgtactctctggtgtaccaca

SEQ ID NO: 101399 - DNA, 25 bp, Mus musculus
gaagtgtagccaagaccagtcgaca

SEQ ID NO: 101400 - DNA, 25 bp, Mus musculus
gaagtgtcaatcctgcgccgagtga

SEQ ID NO: 101401 - DNA, 25 bp, Mus musculus
gaagtgtcactcttctggaagccaa

SEQ ID NO: 101402 - DNA, 25 bp, Mus musculus
gaagtgtcactttccacagtggagt

SEQ ID NO: 101403 - DNA, 25 bp, Mus musculus
gaagtgtccgacctagagaaatatg

SEQ ID NO: 101404 - DNA, 25 bp, Mus musculus
gaagtgtccggccagctcattctta

SEQ ID NO: 101405 - DNA, 25 bp, Mus musculus
gaagtgtcgcgctctgaagctgcag

SEQ ID NO: 101406 - DNA, 25 bp, Mus musculus
gaagtgtcgtgtttcccaggactca

SEQ ID NO: 101407 - DNA, 25 bp, Mus musculus
gaagtgtcttattccgtgactacgg

SEQ ID NO: 101408 - DNA, 25 bp, Mus musculus
gaagtgtcttgagagtcgagtcgca

SEQ ID NO: 101409 - DNA, 25 bp, Mus musculus
gaagtgtcttggagcccacccaagg

SEQ ID NO: 101410 - DNA, 25 bp, Mus musculus
gaagtgtgaccagtattggcccagc

SEQ ID NO: 101411 - DNA, 25 bp, Mus musculus
gaagtgtgagcccattgccatgaca

SEQ ID NO: 101412 - DNA, 25 bp, Mus musculus
gaagtgtgccaaagtctacggacgg

SEQ ID NO: 101413 - DNA, 25 bp, Mus musculus
gaagtgtggccagaagtcgagtccc

SEQ ID NO: 101414 - DNA, 25 bp, Mus musculus
gaagtgtgtcttctaggttctccag

SEQ ID NO: 101415 - DNA, 25 bp, Mus musculus
gaagtgtgtgacctatactggccaa

SEQ ID NO: 101416 - DNA, 25 bp, Mus musculus
gaagtgtgtttcagacgctgctgga

SEQ ID NO: 101417 - DNA, 25 bp, Mus musculus
gaagtgttatccatgcaccagatcc

SEQ ID NO: 101418 - DNA, 25 bp, Mus musculus
gaagtgttcaaatccatggccctgc

SEQ ID NO: 101419 - DNA, 25 bp, Mus musculus
gaagtgttcaccacgttcaaacagg

SEQ ID NO: 101420 - DNA, 25 bp, Mus musculus
gaagtgttccgtccttgctatcagc

SEQ ID NO: 101421 - DNA, 25 bp, Mus musculus
gaagtgttggacagtagtgcaagcc

SEQ ID NO: 101422 - DNA, 25 bp, Mus musculus
gaagtgttggcgaaccctcaagatg

SEQ ID NO: 101423 - DNA, 25 bp, Mus musculus
gaagtgttggcgctcatcttccgtg

SEQ ID NO: 101424 - DNA, 25 bp, Mus musculus
gaagtgtttgcagctatctccacag

SEQ ID NO: 101425 - DNA, 25 bp, Mus musculus
gaagttaaagtcaagcaaatcctga

SEQ ID NO: 101426 - DNA, 25 bp, Mus musculus
gaagttaagcctgttgccacggagc

SEQ ID NO: 101427 - DNA, 25 bp, Mus musculus
gaagttaatctttgatccccaggct

SEQ ID NO: 101428 - DNA, 25 bp, Mus musculus
gaagttacacctgcatagccacgaa

SEQ ID NO: 101429 - DNA, 25 bp, Mus musculus
gaagttacagtttgctctgggagag

SEQ ID NO: 101430 - DNA, 25 bp, Mus musculus
gaagttaccgtgactgacatcaccg

SEQ ID NO: 101431 - DNA, 25 bp, Mus musculus
gaagttacttaaggaagagattcaa

SEQ ID NO: 101432 - DNA, 25 bp, Mus musculus
gaagttacttcggattcgccgtgga

SEQ ID NO: 101433 - DNA, 25 bp, Mus musculus
gaagttagccttttcctgacagcca

SEQ ID NO: 101434 - DNA, 25 bp, Mus musculus
gaagttaggccatattcgcactgag

SEQ ID NO: 101435 - DNA, 25 bp, Mus musculus
gaagttatcacagacgaaagcgaga

SEQ ID NO: 101436 - DNA, 25 bp, Mus musculus
gaagttatcagagagaatgaccatc

SEQ ID NO: 101437 - DNA, 25 bp, Mus musculus
gaagttatccagagtctccctgtgt

SEQ ID NO: 101438 - DNA, 25 bp, Mus musculus
gaagttatccagtcggctcaaggca

SEQ ID NO: 101439 - DNA, 25 bp, Mus musculus
gaagttatcctctgatgacactgaa

SEQ ID NO: 101440 - DNA, 25 bp, Mus musculus
gaagttatgtgccacgcaagacagg

SEQ ID NO: 101441 - DNA, 25 bp, Mus musculus
gaagttcaaagctctacatggctgg

SEQ ID NO: 101442 - DNA, 25 bp, Mus musculus
gaagttcacagtaacctaggaggcc

SEQ ID NO: 101443 - DNA, 25 bp, Mus musculus
gaagttcaccttccacagcaaggag

SEQ ID NO: 101444 - DNA, 25 bp, Mus musculus
gaagttcagaaccaatcatccgaag

SEQ ID NO: 101445 - DNA, 25 bp, Mus musculus
gaagttcagagaccagatgtcccgc

SEQ ID NO: 101446 - DNA, 25 bp, Mus musculus
gaagttcagcgagagcatgctccgt

SEQ ID NO: 101447 - DNA, 25 bp, Mus musculus
gaagttcaggtgacgatgatgctca

SEQ ID NO: 101448 - DNA, 25 bp, Mus musculus
gaagttcatgcccattgtgtacaca

SEQ ID NO: 101449 - DNA, 25 bp, Mus musculus
gaagttcattgaagcttgcctccga

SEQ ID NO: 101450 - DNA, 25 bp, Mus musculus
gaagttccacagctttgggtacgct

SEQ ID NO: 101451 - DNA, 25 bp, Mus musculus
gaagttcccgagcatcatggtgtac

SEQ ID NO: 101452 - DNA, 25 bp, Mus musculus
gaagttcccgccttttcactagtga

SEQ ID NO: 101453 - DNA, 25 bp, Mus musculus
gaagttccgggtgccaaagatcgct

SEQ ID NO: 101454 - DNA, 25 bp, Mus musculus
gaagttcgatgttcctagcatggag

SEQ ID NO: 101455 - DNA, 25 bp, Mus musculus
gaagttcgggatcacatgcaggact

SEQ ID NO: 101456 - DNA, 25 bp, Mus musculus
gaagttcgggattggctggcctcca

SEQ ID NO: 101457 - DNA, 25 bp, Mus musculus
gaagttctaaaatacctgcgcagca

SEQ ID NO: 101458 - DNA, 25 bp, Mus musculus
gaagttctacattcaaggcggcgac

SEQ ID NO: 101459 - DNA, 25 bp, Mus musculus
gaagttctaccactaccatggcctg

SEQ ID NO: 101460 - DNA, 25 bp, Mus musculus
gaagttctcaaccactgcgcaaagg

SEQ ID NO: 101461 - DNA, 25 bp, Mus musculus
gaagttctcagacaatgactgcagg

SEQ ID NO: 101462 - DNA, 25 bp, Mus musculus
gaagttctcatgtatgtgcccacag

SEQ ID NO: 101463 - DNA, 25 bp, Mus musculus
gaagttctccagtaaagtccagagc

SEQ ID NO: 101464 - DNA, 25 bp, Mus musculus
gaagttctccgagcacttcagcatc

SEQ ID NO: 101465 - DNA, 25 bp, Mus musculus
gaagttctcggtgcgtgactgcagc

SEQ ID NO: 101466 - DNA, 25 bp, Mus musculus
gaagttctcgtaacatttccggcag

SEQ ID NO: 101467 - DNA, 25 bp, Mus musculus
gaagttctgcatagatgccagtcaa

SEQ ID NO: 101468 - DNA, 25 bp, Mus musculus
gaagttctttgacagcgcctgcacg

SEQ ID NO: 101469 - DNA, 25 bp, Mus musculus
gaagttgacaccttcctgagtagga

SEQ ID NO: 101470 - DNA, 25 bp, Mus musculus
gaagttgactacacctgaatgtccc

SEQ ID NO: 101471 - DNA, 25 bp, Mus musculus
gaagttgagcaggtcagcgagtcca

SEQ ID NO: 101472 - DNA, 25 bp, Mus musculus
gaagttgaggcgtgcaatcaagcag

SEQ ID NO: 101473 - DNA, 25 bp, Mus musculus
gaagttgatcatgcagctcatccca

SEQ ID NO: 101474 - DNA, 25 bp, Mus musculus
gaagttgatcctgttctcaccgtgg

SEQ ID NO: 101475 - DNA, 25 bp, Mus musculus
gaagttgatgaagcgtgaccaggtc

SEQ ID NO: 101476 - DNA, 25 bp, Mus musculus
gaagttgatgaagttgacgctgccc

SEQ ID NO: 101477 - DNA, 25 bp, Mus musculus
gaagttgattccaagtactcagcta

SEQ ID NO: 101478 - DNA, 25 bp, Mus musculus
gaagttgcatgactcctaccagctg

SEQ ID NO: 101479 - DNA, 25 bp, Mus musculus
gaagttgcctgtacggttgccggaa

SEQ ID NO: 101480 - DNA, 25 bp, Mus musculus
gaagttgcgttcctgacctcagtag

SEQ ID NO: 101481 - DNA, 25 bp, Mus musculus
gaagttgctcgaaaacttgcctccg

SEQ ID NO: 101482 - DNA, 25 bp, Mus musculus
gaagttgctgtacccacgttgttga

SEQ ID NO: 101483 - DNA, 25 bp, Mus musculus
gaagttgcttctagattccccaccc

SEQ ID NO: 101484 - DNA, 25 bp, Mus musculus
gaagttggaggaacagaacagcatc

SEQ ID NO: 101485 - DNA, 25 bp, Mus musculus
gaagttggcttcctgctcaagacac

SEQ ID NO: 101486 - DNA, 25 bp, Mus musculus
gaagttggtgtccttcgacaacagc

SEQ ID NO: 101487 - DNA, 25 bp, Mus musculus
gaagttgtacatggtgccctggccg

SEQ ID NO: 101488 - DNA, 25 bp, Mus musculus
gaagttgtcccacaccaaggtcagt

SEQ ID NO: 101489 - DNA, 25 bp, Mus musculus
gaagttgtcctagacgatgacagag

SEQ ID NO: 101490 - DNA, 25 bp, Mus musculus
gaagttgtcttcacaaagctgggag

SEQ ID NO: 101491 - DNA, 25 bp, Mus musculus
gaagttgtttgaccctgtgcagtcg

SEQ ID NO: 101492 - DNA, 25 bp, Mus musculus
gaagtttaaacagtgccctacagag

SEQ ID NO: 101493 - DNA, 25 bp, Mus musculus
gaagtttaagctctacctgaccata

SEQ ID NO: 101494 - DNA, 25 bp, Mus musculus
gaagtttaatactccagccctgaag

SEQ ID NO: 101495 - DNA, 25 bp, Mus musculus
gaagtttacgatgatgtggatgcct

SEQ ID NO: 101496 - DNA, 25 bp, Mus musculus
gaagtttatcggaactctatgccag

SEQ ID NO: 101497 - DNA, 25 bp, Mus musculus
gaagtttcatctctggagaacgcat

SEQ ID NO: 101498 - DNA, 25 bp, Mus musculus
gaagtttcccctaggagacggctcg

SEQ ID NO: 101499 - DNA, 25 bp, Mus musculus
gaagtttcgcattgtctacgcacag

SEQ ID NO: 101500 - DNA, 25 bp, Mus musculus
gaagtttctgtcagctcctcctaga

SEQ ID NO: 101501 - DNA, 25 bp, Mus musculus
gaagtttgaatcacctgctacgcac

SEQ ID NO: 101502 - DNA, 25 bp, Mus musculus
gaagtttgactacgtgtttgctgag

SEQ ID NO: 101503 - DNA, 25 bp, Mus musculus
gaagtttgcacccaagaagcagggt

SEQ ID NO: 101504 - DNA, 25 bp, Mus musculus
gaagtttgcatccagcttttataac

SEQ ID NO: 101505 - DNA, 25 bp, Mus musculus
gaagtttgccagtgagattactccc

SEQ ID NO: 101506 - DNA, 25 bp, Mus musculus
gaagtttgccatgactctgtatgag

SEQ ID NO: 101507 - DNA, 25 bp, Mus musculus
gaagtttgcctccaggcttactgag

SEQ ID NO: 101508 - DNA, 25 bp, Mus musculus
gaagtttgctatccggaagtccagg

SEQ ID NO: 101509 - DNA, 25 bp, Mus musculus
gaagtttggccaagccattagcctg

SEQ ID NO: 101510 - DNA, 25 bp, Mus musculus
gaagtttgggacctatcttggcaac

SEQ ID NO: 101511 - DNA, 25 bp, Mus musculus
gaagtttggtgagcggcctccaccc

SEQ ID NO: 101512 - DNA, 25 bp, Mus musculus
gaagtttgtctactcctcacggctc

SEQ ID NO: 101513 - DNA, 25 bp, Mus musculus
gaagtttgtctcgatcgcctcggaa

SEQ ID NO: 101514 - DNA, 25 bp, Mus musculus
gaagttttcctcttgacaggccagc

SEQ ID NO: 101515 - DNA, 25 bp, Mus musculus
gaataaaaaacccatgagcctcgcc

SEQ ID NO: 101516 - DNA, 25 bp, Mus musculus
gaataaaaacttggctgctgctttg

SEQ ID NO: 101517 - DNA, 25 bp, Mus musculus
gaataaaaggctgcggtctctccag

SEQ ID NO: 101518 - DNA, 25 bp, Mus musculus
gaataaaagtgtcacgggtaaagct

SEQ ID NO: 101519 - DNA, 25 bp, Mus musculus
gaataaacagccagccaacatcttg

SEQ ID NO: 101520 - DNA, 25 bp, Mus musculus
gaataaactcacctatacacccatt

SEQ ID NO: 101521 - DNA, 25 bp, Mus musculus
gaataaagaaagcagcatgccctgt

SEQ ID NO: 101522 - DNA, 25 bp, Mus musculus
gaataaagtcctactgggcagtgag

SEQ ID NO: 101523 - DNA, 25 bp, Mus musculus
gaataaagtttctgaccctccggca

SEQ ID NO: 101524 - DNA, 25 bp, Mus musculus
gaataaatagcacagaagcccggac

SEQ ID NO: 101525 - DNA, 25 bp, Mus musculus
gaataaccgccttcgcatggagctg

SEQ ID NO: 101526 - DNA, 25 bp, Mus musculus
gaataacctatatatcgccggacgc

SEQ ID NO: 101527 - DNA, 25 bp, Mus musculus
gaataacctggaaatgctctggctg

SEQ ID NO: 101528 - DNA, 25 bp, Mus musculus
gaataacttgctgctctgctgccag

SEQ ID NO: 101529 - DNA, 25 bp, Mus musculus
gaataagacatgtttcaagcacagt

SEQ ID NO: 101530 - DNA, 25 bp, Mus musculus
gaataagagatgtactgcccacctg

SEQ ID NO: 101531 - DNA, 25 bp, Mus musculus
gaataagattgaggaatttctcgaa

SEQ ID NO: 101532 - DNA, 25 bp, Mus musculus
gaataagattttgagcagcgtccag

SEQ ID NO: 101533 - DNA, 25 bp, Mus musculus
gaataagcacgtgtaccctaggaac

SEQ ID NO: 101534 - DNA, 25 bp, Mus musculus
gaataagcactacaacctggagacc

SEQ ID NO: 101535 - DNA, 25 bp, Mus musculus
gaataaggcctacgtcctcctggcc

SEQ ID NO: 101536 - DNA, 25 bp, Mus musculus
gaataaggccttggtacggcaacgg

SEQ ID NO: 101537 - DNA, 25 bp, Mus musculus
gaataaggctccttctggcccaaag

SEQ ID NO: 101538 - DNA, 25 bp, Mus musculus
gaataaggtccatctcttcccagga

SEQ ID NO: 101539 - DNA, 25 bp, Mus musculus
gaataagtattttcgggacacatca

SEQ ID NO: 101540 - DNA, 25 bp, Mus musculus
gaataagtcccctcttcaggcgctt

SEQ ID NO: 101541 - DNA, 25 bp, Mus musculus
gaataagtcctatgaatcgtccacc

SEQ ID NO: 101542 - DNA, 25 bp, Mus musculus
gaataataagtacatcgtgacaggc

SEQ ID NO: 101543 - DNA, 25 bp, Mus musculus
gaataatgaaaacctagtccaagat

SEQ ID NO: 101544 - DNA, 25 bp, Mus musculus
gaataatgaagaccgtgagcaccgc

SEQ ID NO: 101545 - DNA, 25 bp, Mus musculus
gaataatgaccacgcatggacacag

SEQ ID NO: 101546 - DNA, 25 bp, Mus musculus
gaataatgagctcgcctaccttgga

SEQ ID NO: 101547 - DNA, 25 bp, Mus musculus
gaataatgagggatcgctgctggcc

SEQ ID NO: 101548 - DNA, 25 bp, Mus musculus
gaataatgtagtcttcatcaggacg

SEQ ID NO: 101549 - DNA, 25 bp, Mus musculus
gaataattaaggtattcaccccagg

SEQ ID NO: 101550 - DNA, 25 bp, Mus musculus
gaataattcgctatccggacagtca

SEQ ID NO: 101551 - DNA, 25 bp, Mus musculus
gaataattcgggtggatcacgctgg

SEQ ID NO: 101552 - DNA, 25 bp, Mus musculus
gaatacaaacgtggagctgtatcag

SEQ ID NO: 101553 - DNA, 25 bp, Mus musculus
gaatacaacatcatcgacaacaacg

SEQ ID NO: 101554 - DNA, 25 bp, Mus musculus
gaatacaaggagaccaccgaggagt

SEQ ID NO: 101555 - DNA, 25 bp, Mus musculus
gaatacaattcaaaccccaaggagc

SEQ ID NO: 101556 - DNA, 25 bp, Mus musculus
gaatacaccatttgctttctgccac

SEQ ID NO: 101557 - DNA, 25 bp, Mus musculus
gaatacaccgttgtccataaacatt

SEQ ID NO: 101558 - DNA, 25 bp, Mus musculus
gaatacactcacaagtctcccaggg

SEQ ID NO: 101559 - DNA, 25 bp, Mus musculus
gaatacactgaggagcctgctacac

SEQ ID NO: 101560 - DNA, 25 bp, Mus musculus
gaatacagaaatcatcacagcccag

SEQ ID NO: 101561 - DNA, 25 bp, Mus musculus
gaatacagctttgatagccgccaca

SEQ ID NO: 101562 - DNA, 25 bp, Mus musculus
gaatacaggaatgactacatgggct

SEQ ID NO: 101563 - DNA, 25 bp, Mus musculus
gaatacagtccccattagcaaaggc

SEQ ID NO: 101564 - DNA, 25 bp, Mus musculus
gaatacagttacgtcgcatgacacc

SEQ ID NO: 101565 - DNA, 25 bp, Mus musculus
gaatacatcgaacgagagccagcgg

SEQ ID NO: 101566 - DNA, 25 bp, Mus musculus
gaatacatcgcgtacgtgctcgtcc

SEQ ID NO: 101567 - DNA, 25 bp, Mus musculus
gaatacattgatctagtcagcagtg

SEQ ID NO: 101568 - DNA, 25 bp, Mus musculus
gaatacattttgatggagcccagca

SEQ ID NO: 101569 - DNA, 25 bp, Mus musculus
gaataccaagcattagaaacctccg

SEQ ID NO: 101570 - DNA, 25 bp, Mus musculus
gaataccagaaaacctgtgaggatc

SEQ ID NO: 101571 - DNA, 25 bp, Mus musculus
gaataccagagagctagagaccgaa

SEQ ID NO: 101572 - DNA, 25 bp, Mus musculus
gaataccagagtccttccgtgggtc

SEQ ID NO: 101573 - DNA, 25 bp, Mus musculus
gaataccaggatcttgtgagcgtca

SEQ ID NO: 101574 - DNA, 25 bp, Mus musculus
gaataccagttgtaaagcctcggca

SEQ ID NO: 101575 - DNA, 25 bp, Mus musculus
gaataccatggaagaccagctctgg

SEQ ID NO: 101576 - DNA, 25 bp, Mus musculus
gaatacccagcggaagattttacag

SEQ ID NO: 101577 - DNA, 25 bp, Mus musculus
gaatacccagtattgccaaggacaa

SEQ ID NO: 101578 - DNA, 25 bp, Mus musculus
gaatacccagtgctgtttcctgtgc

SEQ ID NO: 101579 - DNA, 25 bp, Mus musculus
gaatacccatcgtagtgggccagcg

SEQ ID NO: 101580 - DNA, 25 bp, Mus musculus
gaataccgccacttggaattgctgg

SEQ ID NO: 101581 - DNA, 25 bp, Mus musculus
gaatacctaggtggaggttcagcat

SEQ ID NO: 101582 - DNA, 25 bp, Mus musculus
gaatacctcatgagcaaggaccggc

SEQ ID NO: 101583 - DNA, 25 bp, Mus musculus
gaatacctgcatctacagaacccag

SEQ ID NO: 101584 - DNA, 25 bp, Mus musculus
gaatacctgcgcaagtgccttcgct

SEQ ID NO: 101585 - DNA, 25 bp, Mus musculus
gaatacctggcaggccacatggcag

SEQ ID NO: 101586 - DNA, 25 bp, Mus musculus
gaatacgaactagctgctcggcaag

SEQ ID NO: 101587 - DNA, 25 bp, Mus musculus
gaatacgacggcatcaaggcaacct

SEQ ID NO: 101588 - DNA, 25 bp, Mus musculus
gaatacgagcgttccaagcagcgtg

SEQ ID NO: 101589 - DNA, 25 bp, Mus musculus
gaatacgattcattacacagtccgg

SEQ ID NO: 101590 - DNA, 25 bp, Mus musculus
gaatacgcacaggttacataggccg

SEQ ID NO: 101591 - DNA, 25 bp, Mus musculus
gaatacgcgagcaacaggaacagct

SEQ ID NO: 101592 - DNA, 25 bp, Mus musculus
gaatacggagcctctacagtgagcc

SEQ ID NO: 101593 - DNA, 25 bp, Mus musculus
gaatacgggaaaatgtgtcgttctt

SEQ ID NO: 101594 - DNA, 25 bp, Mus musculus
gaatacgtgtactgaagaaaggacc

SEQ ID NO: 101595 - DNA, 25 bp, Mus musculus
gaatactacggaatgagtagagaaa

SEQ ID NO: 101596 - DNA, 25 bp, Mus musculus
gaatactcggagctctaggtccaag

SEQ ID NO: 101597 - DNA, 25 bp, Mus musculus
gaatactcgtgggtacaaggccctt

SEQ ID NO: 101598 - DNA, 25 bp, Mus musculus
gaatactgacccctagctttgaagg

SEQ ID NO: 101599 - DNA, 25 bp, Mus musculus
gaatactgccagatactacgccaag

SEQ ID NO: 101600 - DNA, 25 bp, Mus musculus
gaatactgggtctgagcaatgcaac

SEQ ID NO: 101601 - DNA, 25 bp, Mus musculus
gaatactgggttctcgtggctcgaa

SEQ ID NO: 101602 - DNA, 25 bp, Mus musculus
gaatactgtgaagttcctctggact

SEQ ID NO: 101603 - DNA, 25 bp, Mus musculus
gaatacttacacaactacggcatcg

SEQ ID NO: 101604 - DNA, 25 bp, Mus musculus
gaatacttagatcttccccgtgcaa

SEQ ID NO: 101605 - DNA, 25 bp, Mus musculus
gaatacttcggcttgcaacatggcg

SEQ ID NO: 101606 - DNA, 25 bp, Mus musculus
gaatagaatccctcattgaccggga

SEQ ID NO: 101607 - DNA, 25 bp, Mus musculus
gaatagagcctctgccaaggagctg

SEQ ID NO: 101608 - DNA, 25 bp, Mus musculus
gaatagcagttctgagcctcaggca

SEQ ID NO: 101609 - DNA, 25 bp, Mus musculus
gaatagcatcgcatccttgccggct

SEQ ID NO: 101610 - DNA, 25 bp, Mus musculus
gaatagccctacttaccattggagg

SEQ ID NO: 101611 - DNA, 25 bp, Mus musculus
gaatagccggcacccgttttctcgg

SEQ ID NO: 101612 - DNA, 25 bp, Mus musculus
gaatagcctccatcacgtgcttcag

SEQ ID NO: 101613 - DNA, 25 bp, Mus musculus
gaatagcgtccctgacatccgtggt

SEQ ID NO: 101614 - DNA, 25 bp, Mus musculus
gaatagcgttgcttccctcgccaaa

SEQ ID NO: 101615 - DNA, 25 bp, Mus musculus
gaatagctcctaaccacttggtggg

SEQ ID NO: 101616 - DNA, 25 bp, Mus musculus
gaataggaactatagtcactgctgc

SEQ ID NO: 101617 - DNA, 25 bp, Mus musculus
gaataggaagaagccactggtcccg

SEQ ID NO: 101618 - DNA, 25 bp, Mus musculus
gaataggaagatggcagcaaatcct

SEQ ID NO: 101619 - DNA, 25 bp, Mus musculus
gaataggagctcatgggaagccgtc

SEQ ID NO: 101620 - DNA, 25 bp, Mus musculus
gaataggcaacagaggcacttgggc

SEQ ID NO: 101621 - DNA, 25 bp, Mus musculus
gaataggcaagttatcgacggcgga

SEQ ID NO: 101622 - DNA, 25 bp, Mus musculus
gaataggccggtccaatcagacaga

SEQ ID NO: 101623 - DNA, 25 bp, Mus musculus
gaataggcctttgcccacttgcaga

SEQ ID NO: 101624 - DNA, 25 bp, Mus musculus
gaatagtagcttccttacactggag

SEQ ID NO: 101625 - DNA, 25 bp, Mus musculus
gaatagtagttgtgtcctgcccagt

SEQ ID NO: 101626 - DNA, 25 bp, Mus musculus
gaatagtccgggttggagatcctga

SEQ ID NO: 101627 - DNA, 25 bp, Mus musculus
gaatagtgaggaacactctcagcgc

SEQ ID NO: 101628 - DNA, 25 bp, Mus musculus
gaatagtggtagtgggccccttgaa

SEQ ID NO: 101629 - DNA, 25 bp, Mus musculus
gaatataaaactcctgtgaagcaga

SEQ ID NO: 101630 - DNA, 25 bp, Mus musculus
gaatataaaagggacgcctggctcc

SEQ ID NO: 101631 - DNA, 25 bp, Mus musculus
gaatataaccaaccaagctcctgcc

SEQ ID NO: 101632 - DNA, 25 bp, Mus musculus
gaatataaggacaaaccggacgcca

SEQ ID NO: 101633 - DNA, 25 bp, Mus musculus
gaatataatccagccaccgtcatgt

SEQ ID NO: 101634 - DNA, 25 bp, Mus musculus
gaatataatccatccatggtacgag

SEQ ID NO: 101635 - DNA, 25 bp, Mus musculus
gaatatagagctggcagtgaagagc

SEQ ID NO: 101636 - DNA, 25 bp, Mus musculus
gaatatagattgtcctccgggtcgg

SEQ ID NO: 101637 - DNA, 25 bp, Mus musculus
gaatatagcactgcggagcatgccg

SEQ ID NO: 101638 - DNA, 25 bp, Mus musculus
gaatatatatccgatggcccgcagc

SEQ ID NO: 101639 - DNA, 25 bp, Mus musculus
gaatatatcagagctatgagtgcag

SEQ ID NO: 101640 - DNA, 25 bp, Mus musculus
gaatatatcggttcccatcggctgg

SEQ ID NO: 101641 - DNA, 25 bp, Mus musculus
gaatatattttcaggctcggccaga

SEQ ID NO: 101642 - DNA, 25 bp, Mus musculus
gaatatcaccatccagaatgtcgag

SEQ ID NO: 101643 - DNA, 25 bp, Mus musculus
gaatatcacttctcgcctaccagag

SEQ ID NO: 101644 - DNA, 25 bp, Mus musculus
gaatatcagtctatgctcagcagca

SEQ ID NO: 101645 - DNA, 25 bp, Mus musculus
gaatatcatcaaaacgcatgcctgc

SEQ ID NO: 101646 - DNA, 25 bp, Mus musculus
gaatatcatcagttgccacccattg

SEQ ID NO: 101647 - DNA, 25 bp, Mus musculus
gaatatcatctagagcttgggtggc

SEQ ID NO: 101648 - DNA, 25 bp, Mus musculus
gaatatcatgctggtggctctacgc

SEQ ID NO: 101649 - DNA, 25 bp, Mus musculus
gaatatccaagcaacgtgcagctgc

SEQ ID NO: 101650 - DNA, 25 bp, Mus musculus
gaatatccgactactcctggaggag

SEQ ID NO: 101651 - DNA, 25 bp, Mus musculus
gaatatcgagatgttcctgacagcc

SEQ ID NO: 101652 - DNA, 25 bp, Mus musculus
gaatatctcccgaggaccagagcaa

SEQ ID NO: 101653 - DNA, 25 bp, Mus musculus
gaatatgaacctgatcgcaaaaaag

SEQ ID NO: 101654 - DNA, 25 bp, Mus musculus
gaatatgaactttttgcagacccat

SEQ ID NO: 101655 - DNA, 25 bp, Mus musculus
gaatatgactccaaattctgaccct

SEQ ID NO: 101656 - DNA, 25 bp, Mus musculus
gaatatgactttgacgagccagccc

SEQ ID NO: 101657 - DNA, 25 bp, Mus musculus
gaatatgagtccgtgctgtgtgtga

SEQ ID NO: 101658 - DNA, 25 bp, Mus musculus
gaatatgatacagggattgcaccca

SEQ ID NO: 101659 - DNA, 25 bp, Mus musculus
gaatatgatcctgctttggctcagc

SEQ ID NO: 101660 - DNA, 25 bp, Mus musculus
gaatatgatgcttaggttgtggaaa

SEQ ID NO: 101661 - DNA, 25 bp, Mus musculus
gaatatgcacctgcgcttgtttgag

SEQ ID NO: 101662 - DNA, 25 bp, Mus musculus
gaatatgcacgcttcatccggaagg

SEQ ID NO: 101663 - DNA, 25 bp, Mus musculus
gaatatgcatatgttacacctcgga

SEQ ID NO: 101664 - DNA, 25 bp, Mus musculus
gaatatgccagcaggcttccaaaag

SEQ ID NO: 101665 - DNA, 25 bp, Mus musculus
gaatatgccctacgacctgtgtgag

SEQ ID NO: 101666 - DNA, 25 bp, Mus musculus
gaatatgcctgaagacaacggtctg

SEQ ID NO: 101667 - DNA, 25 bp, Mus musculus
gaatatgcctgcatccagaagcaca

SEQ ID NO: 101668 - DNA, 25 bp, Mus musculus
gaatatggacactcaggatctgcag

SEQ ID NO: 101669 - DNA, 25 bp, Mus musculus
gaatatggatggaagcaaccctgcc

SEQ ID NO: 101670 - DNA, 25 bp, Mus musculus
gaatatggcatatggatctcatcca

SEQ ID NO: 101671 - DNA, 25 bp, Mus musculus
gaatatggcctcctcgatgtggacg

SEQ ID NO: 101672 - DNA, 25 bp, Mus musculus
gaatatggctgcacagataccggaa

SEQ ID NO: 101673 - DNA, 25 bp, Mus musculus
gaatatggcttaagtttaccgcttg

SEQ ID NO: 101674 - DNA, 25 bp, Mus musculus
gaatatgggatctgtcgctggagct

SEQ ID NO: 101675 - DNA, 25 bp, Mus musculus
gaatatgggtcccacggccttctgg

SEQ ID NO: 101676 - DNA, 25 bp, Mus musculus
gaatatggtcaaatctctgcccgga

SEQ ID NO: 101677 - DNA, 25 bp, Mus musculus
gaatatgtcacaaaagaccacccag

SEQ ID NO: 101678 - DNA, 25 bp, Mus musculus
gaatatgtccggcattatccccggg

SEQ ID NO: 101679 - DNA, 25 bp, Mus musculus
gaatatgtttatccagaagccagag

SEQ ID NO: 101680 - DNA, 25 bp, Mus musculus
gaatattaactcacgccagcaggtg

SEQ ID NO: 101681 - DNA, 25 bp, Mus musculus
gaatattaatccacccgcagaagca

SEQ ID NO: 101682 - DNA, 25 bp, Mus musculus
gaatattactgcagagacccgggag

SEQ ID NO: 101683 - DNA, 25 bp, Mus musculus
gaatattatccactggcctggctgc

SEQ ID NO: 101684 - DNA, 25 bp, Mus musculus
gaatattcccataatcctccagtct

SEQ ID NO: 101685 - DNA, 25 bp, Mus musculus
gaatattgaccccaaagactcctgt

SEQ ID NO: 101686 - DNA, 25 bp, Mus musculus
gaatattgcccagcttctgccacag

SEQ ID NO: 101687 - DNA, 25 bp, Mus musculus
gaatattgcttcgatggaccactgt

SEQ ID NO: 101688 - DNA, 25 bp, Mus musculus
gaatattgggagtgacctgccaccc

SEQ ID NO: 101689 - DNA, 25 bp, Mus musculus
gaatattgtttcctcccctgcttaa

SEQ ID NO: 101690 - DNA, 25 bp, Mus musculus
gaatatttatgatgttggccccacc

SEQ ID NO: 101691 - DNA, 25 bp, Mus musculus
gaatatttgctaacctcccgattgg

SEQ ID NO: 101692 - DNA, 25 bp, Mus musculus
gaatatttgctctgtggacacctgc

SEQ ID NO: 101693 - DNA, 25 bp, Mus musculus
gaatatttgcttgtagtgccaccag

SEQ ID NO: 101694 - DNA, 25 bp, Mus musculus
gaatattttaatgaagctccctcaa

SEQ ID NO: 101695 - DNA, 25 bp, Mus musculus
gaatattttgcactgcagcacgctg

SEQ ID NO: 101696 - DNA, 25 bp, Mus musculus
gaatcaaaagcagccctgtcttcca

SEQ ID NO: 101697 - DNA, 25 bp, Mus musculus
gaatcaaaatcgactcaagaaaggg

SEQ ID NO: 101698 - DNA, 25 bp, Mus musculus
gaatcaaacagctggacatcgagac

SEQ ID NO: 101699 - DNA, 25 bp, Mus musculus
gaatcaaagaaaccatgctcgctaa

SEQ ID NO: 101700 - DNA, 25 bp, Mus musculus
gaatcaaaggtggaacattcaaccc

SEQ ID NO: 101701 - DNA, 25 bp, Mus musculus
gaatcaaatcctgcgcactatggct

SEQ ID NO: 101702 - DNA, 25 bp, Mus musculus
gaatcaacaccgcagactcgagagt

SEQ ID NO: 101703 - DNA, 25 bp, Mus musculus
gaatcaacggaaaaatgcgaagctg

SEQ ID NO: 101704 - DNA, 25 bp, Mus musculus
gaatcaagacccctgacttcagagc

SEQ ID NO: 101705 - DNA, 25 bp, Mus musculus
gaatcaagcgccatagtcaccgtag

SEQ ID NO: 101706 - DNA, 25 bp, Mus musculus
gaatcaagtgcccaaaggtggtcat

SEQ ID NO: 101707 - DNA, 25 bp, Mus musculus
gaatcaagtgctgtagactggccaa

SEQ ID NO: 101708 - DNA, 25 bp, Mus musculus
gaatcaatcattagttgcccaggga

SEQ ID NO: 101709 - DNA, 25 bp, Mus musculus
gaatcaatctcccaagggtaattcc

SEQ ID NO: 101710 - DNA, 25 bp, Mus musculus
gaatcaatgccagtctacgagtcag

SEQ ID NO: 101711 - DNA, 25 bp, Mus musculus
gaatcaatgtcagtccacacctgtg

SEQ ID NO: 101712 - DNA, 25 bp, Mus musculus
gaatcacagcccgaactgggaacct

SEQ ID NO: 101713 - DNA, 25 bp, Mus musculus
gaatcacaggcctctggtccctggc

SEQ ID NO: 101714 - DNA, 25 bp, Mus musculus
gaatcacagggcagaggtggtctcc

SEQ ID NO: 101715 - DNA, 25 bp, Mus musculus
gaatcacaggttcacgcatccggtt

SEQ ID NO: 101716 - DNA, 25 bp, Mus musculus
gaatcaccaagagatggcccaggga

SEQ ID NO: 101717 - DNA, 25 bp, Mus musculus
gaatcaccaaggtcgactggcagca

SEQ ID NO: 101718 - DNA, 25 bp, Mus musculus
gaatcacccacatacctctgtactt

SEQ ID NO: 101719 - DNA, 25 bp, Mus musculus
gaatcaccggatagtcaggaatttg

SEQ ID NO: 101720 - DNA, 25 bp, Mus musculus
gaatcaccttaacagcacatgaggg

SEQ ID NO: 101721 - DNA, 25 bp, Mus musculus
gaatcacgactaccatgctgaaagg

SEQ ID NO: 101722 - DNA, 25 bp, Mus musculus
gaatcacggagagctgctgaacgcg

SEQ ID NO: 101723 - DNA, 25 bp, Mus musculus
gaatcactggccactggtgcatcca

SEQ ID NO: 101724 - DNA, 25 bp, Mus musculus
gaatcactggctgcaataaacatcg

SEQ ID NO: 101725 - DNA, 25 bp, Mus musculus
gaatcagaaagatgacactccatgc

SEQ ID NO: 101726 - DNA, 25 bp, Mus musculus
gaatcagacggctcttcaggcggtg

SEQ ID NO: 101727 - DNA, 25 bp, Mus musculus
gaatcagactggaactgtgacaggg

SEQ ID NO: 101728 - DNA, 25 bp, Mus musculus
gaatcagagcccactcggctgagct

SEQ ID NO: 101729 - DNA, 25 bp, Mus musculus
gaatcagagcttgcaagccagccgt

SEQ ID NO: 101730 - DNA, 25 bp, Mus musculus
gaatcagcaatcagtcgcaaagcgg

SEQ ID NO: 101731 - DNA, 25 bp, Mus musculus
gaatcagccagtgctggttctgagc

SEQ ID NO: 101732 - DNA, 25 bp, Mus musculus
gaatcagcgctttaacatccacaac

SEQ ID NO: 101733 - DNA, 25 bp, Mus musculus
gaatcagcggatgtagtggccttca

SEQ ID NO: 101734 - DNA, 25 bp, Mus musculus
gaatcagcggctactcagagggcca

SEQ ID NO: 101735 - DNA, 25 bp, Mus musculus
gaatcagctcgtcaccctggagact

SEQ ID NO: 101736 - DNA, 25 bp, Mus musculus
gaatcagctggcttttgtgacaggc

SEQ ID NO: 101737 - DNA, 25 bp, Mus musculus
gaatcagggaccagctttactacag

SEQ ID NO: 101738 - DNA, 25 bp, Mus musculus
gaatcagtcacaaaaacctgcctgg

SEQ ID NO: 101739 - DNA, 25 bp, Mus musculus
gaatcagtgacttggagctggcaaa

SEQ ID NO: 101740 - DNA, 25 bp, Mus musculus
gaatcagtgaggtcttcggccctgg

SEQ ID NO: 101741 - DNA, 25 bp, Mus musculus
gaatcagttcagcaggtagcccaga

SEQ ID NO: 101742 - DNA, 25 bp, Mus musculus
gaatcataaccaccagctgaagggt

SEQ ID NO: 101743 - DNA, 25 bp, Mus musculus
gaatcatacgtctgcaagtgtctgg

SEQ ID NO: 101744 - DNA, 25 bp, Mus musculus
gaatcatcaaacagacacaaaactg

SEQ ID NO: 101745 - DNA, 25 bp, Mus musculus
gaatcatcagggtctggaatcctta

SEQ ID NO: 101746 - DNA, 25 bp, Mus musculus
gaatcatcattcaagacctgtcaga

SEQ ID NO: 101747 - DNA, 25 bp, Mus musculus
gaatcatccagtcggacatgctctg

SEQ ID NO: 101748 - DNA, 25 bp, Mus musculus
gaatcatccgcatagccatcctgga

SEQ ID NO: 101749 - DNA, 25 bp, Mus musculus
gaatcatccttcacggaggacagtg

SEQ ID NO: 101750 - DNA, 25 bp, Mus musculus
gaatcatcgtccgaattggcagcgg

SEQ ID NO: 101751 - DNA, 25 bp, Mus musculus
gaatcatctgcttctgacggacgct

SEQ ID NO: 101752 - DNA, 25 bp, Mus musculus
gaatcatgcccactgacaaggagcc

SEQ ID NO: 101753 - DNA, 25 bp, Mus musculus
gaatcatgctatttcgctgcccaga

SEQ ID NO: 101754 - DNA, 25 bp, Mus musculus
gaatcatgctccacctgctagaagg

SEQ ID NO: 101755 - DNA, 25 bp, Mus musculus
gaatcatgggacatgtggcacccca

SEQ ID NO: 101756 - DNA, 25 bp, Mus musculus
gaatcatgggtacatccgtggccta

SEQ ID NO: 101757 - DNA, 25 bp, Mus musculus
gaatcattgagtcctgccaggaagc

SEQ ID NO: 101758 - DNA, 25 bp, Mus musculus
gaatcattgatttacccaaggccag

SEQ ID NO: 101759 - DNA, 25 bp, Mus musculus
gaatcattgctacgctccagtcctg

SEQ ID NO: 101760 - DNA, 25 bp, Mus musculus
gaatcattggaggagacacggttgt

SEQ ID NO: 101761 - DNA, 25 bp, Mus musculus
gaatcatttaccaggcacacaagcg

SEQ ID NO: 101762 - DNA, 25 bp, Mus musculus
gaatccaaaagccagtgcatcgagg

SEQ ID NO: 101763 - DNA, 25 bp, Mus musculus
gaatccaaagagcaggttcggaccc

SEQ ID NO: 101764 - DNA, 25 bp, Mus musculus
gaatccaagttagccgcttgcagga

SEQ ID NO: 101765 - DNA, 25 bp, Mus musculus
gaatccacgcaagaggatgctctgc

SEQ ID NO: 101766 - DNA, 25 bp, Mus musculus
gaatccacggttgtctgcttgtaaa

SEQ ID NO: 101767 - DNA, 25 bp, Mus musculus
gaatccactgacttttgtgccagct

SEQ ID NO: 101768 - DNA, 25 bp, Mus musculus
gaatccagacggaggccaaatacgc

SEQ ID NO: 101769 - DNA, 25 bp, Mus musculus
gaatccagaggctcgcagactgaac

SEQ ID NO: 101770 - DNA, 25 bp, Mus musculus
gaatccagccctcctccacttacct

SEQ ID NO: 101771 - DNA, 25 bp, Mus musculus
gaatccaggcgcaggcgttcagctt

SEQ ID NO: 101772 - DNA, 25 bp, Mus musculus
gaatccaggctaatggcatccagcg

SEQ ID NO: 101773 - DNA, 25 bp, Mus musculus
gaatccagggatgccggatgccgtt

SEQ ID NO: 101774 - DNA, 25 bp, Mus musculus
gaatccaggtgtgtctgcaagcccc

SEQ ID NO: 101775 - DNA, 25 bp, Mus musculus
gaatccagtgggaatagttggcccg

SEQ ID NO: 101776 - DNA, 25 bp, Mus musculus
gaatccagtggtggagccgttgtcc

SEQ ID NO: 101777 - DNA, 25 bp, Mus musculus
gaatccagtgtcataccagaaacca

SEQ ID NO: 101778 - DNA, 25 bp, Mus musculus
gaatccatcatcatctaccggtcag

SEQ ID NO: 101779 - DNA, 25 bp, Mus musculus
gaatccatcgcaaagtgagaccaca

SEQ ID NO: 101780 - DNA, 25 bp, Mus musculus
gaatccatggcagtgttcgaacaac

SEQ ID NO: 101781 - DNA, 25 bp, Mus musculus
gaatccattgagctgacatgcccca

SEQ ID NO: 101782 - DNA, 25 bp, Mus musculus
gaatcccaaagccattgacacctgg

SEQ ID NO: 101783 - DNA, 25 bp, Mus musculus
gaatcccaatgctgaagatagtgtt

SEQ ID NO: 101784 - DNA, 25 bp, Mus musculus
gaatcccagctctgccagttactag

SEQ ID NO: 101785 - DNA, 25 bp, Mus musculus
gaatcccagtcagaacgtccagtct

SEQ ID NO: 101786 - DNA, 25 bp, Mus musculus
gaatcccagtggctttgctcatccg

SEQ ID NO: 101787 - DNA, 25 bp, Mus musculus
gaatcccatggaatctttgttggcc

SEQ ID NO: 101788 - DNA, 25 bp, Mus musculus
gaatcccctgtgaatcaagacttgg

SEQ ID NO: 101789 - DNA, 25 bp, Mus musculus
gaatccccttctggtcggaggaaag

SEQ ID NO: 101790 - DNA, 25 bp, Mus musculus
gaatcccgctcgctgaagagagtac

SEQ ID NO: 101791 - DNA, 25 bp, Mus musculus
gaatcccgtcgtggagtggtcgtcc

SEQ ID NO: 101792 - DNA, 25 bp, Mus musculus
gaatcccgtgctttgtactaccata

SEQ ID NO: 101793 - DNA, 25 bp, Mus musculus
gaatccctacctatgaagaccagtg

SEQ ID NO: 101794 - DNA, 25 bp, Mus musculus
gaatccctgctctgctctacctgaa

SEQ ID NO: 101795 - DNA, 25 bp, Mus musculus
gaatccctgggaacgaataaagcat

SEQ ID NO: 101796 - DNA, 25 bp, Mus musculus
gaatccctgggacttgtcacactga

SEQ ID NO: 101797 - DNA, 25 bp, Mus musculus
gaatcccttcaaggagaaaggcact

SEQ ID NO: 101798 - DNA, 25 bp, Mus musculus
gaatccgaacccatggaattgtggg

SEQ ID NO: 101799 - DNA, 25 bp, Mus musculus
gaatccgaggagaacagcagagact

SEQ ID NO: 101800 - DNA, 25 bp, Mus musculus
gaatccgagtgagactgttcgccga

SEQ ID NO: 101801 - DNA, 25 bp, Mus musculus
gaatccgatactggaacgcctggca

SEQ ID NO: 101802 - DNA, 25 bp, Mus musculus
gaatccgcaagagccgtgtctcagg

SEQ ID NO: 101803 - DNA, 25 bp, Mus musculus
gaatccggaactcatagagcagctg

SEQ ID NO: 101804 - DNA, 25 bp, Mus musculus
gaatccgggaagagcactattgtca

SEQ ID NO: 101805 - DNA, 25 bp, Mus musculus
gaatccgtagaagctagccctgtgg

SEQ ID NO: 101806 - DNA, 25 bp, Mus musculus
gaatccgtgaacagttgtgaccagt

SEQ ID NO: 101807 - DNA, 25 bp, Mus musculus
gaatccgtgacctagaagataaaac

SEQ ID NO: 101808 - DNA, 25 bp, Mus musculus
gaatccgttcgaaagctgtcctctg

SEQ ID NO: 101809 - DNA, 25 bp, Mus musculus
gaatcctaagcagctcccactggaa

SEQ ID NO: 101810 - DNA, 25 bp, Mus musculus
gaatcctacggtgacatgaacgtgg

SEQ ID NO: 101811 - DNA, 25 bp, Mus musculus
gaatcctagatgtggacctgtgcgg

SEQ ID NO: 101812 - DNA, 25 bp, Mus musculus
gaatcctcaacagatgccgctgtaa

SEQ ID NO: 101813 - DNA, 25 bp, Mus musculus
gaatcctccaagtgatgcagtacag

SEQ ID NO: 101814 - DNA, 25 bp, Mus musculus
gaatcctccatttgcctagccttgg

SEQ ID NO: 101815 - DNA, 25 bp, Mus musculus
gaatcctctaacaatgggccatcag

SEQ ID NO: 101816 - DNA, 25 bp, Mus musculus
gaatcctctacgcttgggcttccag

SEQ ID NO: 101817 - DNA, 25 bp, Mus musculus
gaatcctgcatattggacacgccaa

SEQ ID NO: 101818 - DNA, 25 bp, Mus musculus
gaatcctgcatttttgaagaagtcc

SEQ ID NO: 101819 - DNA, 25 bp, Mus musculus
gaatcctggattctgttgacgaagc

SEQ ID NO: 101820 - DNA, 25 bp, Mus musculus
gaatcctggcatgctccacatagcg

SEQ ID NO: 101821 - DNA, 25 bp, Mus musculus
gaatccttaccagtacagtgcgcag

SEQ ID NO: 101822 - DNA, 25 bp, Mus musculus
gaatccttcgctgttcggagcagag

SEQ ID NO: 101823 - DNA, 25 bp, Mus musculus
gaatccttcggcaggttttccatgc

SEQ ID NO: 101824 - DNA, 25 bp, Mus musculus
gaatccttctcctcgttgtcccgga

SEQ ID NO: 101825 - DNA, 25 bp, Mus musculus
gaatccttgtgaattggaccccagg

SEQ ID NO: 101826 - DNA, 25 bp, Mus musculus
gaatcgaaacctgtatgcaaagctg

SEQ ID NO: 101827 - DNA, 25 bp, Mus musculus
gaatcgaaccacattcaacagcagc

SEQ ID NO: 101828 - DNA, 25 bp, Mus musculus
gaatcgacgatgcaagctgctgccc

SEQ ID NO: 101829 - DNA, 25 bp, Mus musculus
gaatcgagaaagttcagacacggct

SEQ ID NO: 101830 - DNA, 25 bp, Mus musculus
gaatcgagatcagccatccagagga

SEQ ID NO: 101831 - DNA, 25 bp, Mus musculus
gaatcgagcataagcacgtcctgaa

SEQ ID NO: 101832 - DNA, 25 bp, Mus musculus
gaatcgaggatttggcgctgcagaa

SEQ ID NO: 101833 - DNA, 25 bp, Mus musculus
gaatcgagtgaagcctctaaaggcc

SEQ ID NO: 101834 - DNA, 25 bp, Mus musculus
gaatcgatatctgcctccggaagcg

SEQ ID NO: 101835 - DNA, 25 bp, Mus musculus
gaatcgcagaagaatttggtcacat

SEQ ID NO: 101836 - DNA, 25 bp, Mus musculus
gaatcgccatgaggctgagcggaca

SEQ ID NO: 101837 - DNA, 25 bp, Mus musculus
gaatcgcctgcttatgctgtgacgc

SEQ ID NO: 101838 - DNA, 25 bp, Mus musculus
gaatcgctcttcacactgcactcaa

SEQ ID NO: 101839 - DNA, 25 bp, Mus musculus
gaatcgctgcactggatgccgagaa

SEQ ID NO: 101840 - DNA, 25 bp, Mus musculus
gaatcgctgcccgaggaaatcgtga

SEQ ID NO: 101841 - DNA, 25 bp, Mus musculus
gaatcgctgggctgccataagtcag

SEQ ID NO: 101842 - DNA, 25 bp, Mus musculus
gaatcgctttatgacaccggttaga

SEQ ID NO: 101843 - DNA, 25 bp, Mus musculus
gaatcggaacaacctgactgaccct

SEQ ID NO: 101844 - DNA, 25 bp, Mus musculus
gaatcggcagtggaaaagaacacga

SEQ ID NO: 101845 - DNA, 25 bp, Mus musculus
gaatcgggcactcagctatttgcag

SEQ ID NO: 101846 - DNA, 25 bp, Mus musculus
gaatcggtgtttctcgtgctgcagc

SEQ ID NO: 101847 - DNA, 25 bp, Mus musculus
gaatcggttaccatctcaagagtgg

SEQ ID NO: 101848 - DNA, 25 bp, Mus musculus
gaatcggttccaattccgaagccct

SEQ ID NO: 101849 - DNA, 25 bp, Mus musculus
gaatcgtcacgggacaagtgtgcca

SEQ ID NO: 101850 - DNA, 25 bp, Mus musculus
gaatcgtccacctctaagtgacaag

SEQ ID NO: 101851 - DNA, 25 bp, Mus musculus
gaatcgtcgcaccttcttaaagcgg

SEQ ID NO: 101852 - DNA, 25 bp, Mus musculus
gaatcgtctataagagggaccggag

SEQ ID NO: 101853 - DNA, 25 bp, Mus musculus
gaatcgtctgaggtacacaccccat

SEQ ID NO: 101854 - DNA, 25 bp, Mus musculus
gaatcgtcttgcaggacggaaccat

SEQ ID NO: 101855 - DNA, 25 bp, Mus musculus
gaatcgtgctcgttatatgccacag

SEQ ID NO: 101856 - DNA, 25 bp, Mus musculus
gaatcgtttccattctgccagcaca

SEQ ID NO: 101857 - DNA, 25 bp, Mus musculus
gaatctaaaacattgagccctggtg

SEQ ID NO: 101858 - DNA, 25 bp, Mus musculus
gaatctaaccttcaactgcagctgg

SEQ ID NO: 101859 - DNA, 25 bp, Mus musculus
gaatctaagcagtgcggtgaggccc

SEQ ID NO: 101860 - DNA, 25 bp, Mus musculus
gaatctacaattccagcggttgcga

SEQ ID NO: 101861 - DNA, 25 bp, Mus musculus
gaatctacagctaccagatggccct

SEQ ID NO: 101862 - DNA, 25 bp, Mus musculus
gaatctactgctgtcgtcacagagc

SEQ ID NO: 101863 - DNA, 25 bp, Mus musculus
gaatctagaagagcagagaagcact

SEQ ID NO: 101864 - DNA, 25 bp, Mus musculus
gaatctagccaaatctgtcaccagg

SEQ ID NO: 101865 - DNA, 25 bp, Mus musculus
gaatctagtgaggactgtgacacag

SEQ ID NO: 101866 - DNA, 25 bp, Mus musculus
gaatctattctttaccagtgggtgg

SEQ ID NO: 101867 - DNA, 25 bp, Mus musculus
gaatctcagcctataatctggcaaa

SEQ ID NO: 101868 - DNA, 25 bp, Mus musculus
gaatctcagtaatgcacatcttggc

SEQ ID NO: 101869 - DNA, 25 bp, Mus musculus
gaatctcatcctggctatgctcggg

SEQ ID NO: 101870 - DNA, 25 bp, Mus musculus
gaatctccaagtgcaggctcaggct

SEQ ID NO: 101871 - DNA, 25 bp, Mus musculus
gaatctccgcaaaccgaagatgagg

SEQ ID NO: 101872 - DNA, 25 bp, Mus musculus
gaatctccgccgaagctgcaactat

SEQ ID NO: 101873 - DNA, 25 bp, Mus musculus
gaatctcctatacctgtgatcccgg

SEQ ID NO: 101874 - DNA, 25 bp, Mus musculus
gaatctcctttatgcaacgaagccc

SEQ ID NO: 101875 - DNA, 25 bp, Mus musculus
gaatctcgaattaaggccactgtga

SEQ ID NO: 101876 - DNA, 25 bp, Mus musculus
gaatctcgaattccctctctggctg

SEQ ID NO: 101877 - DNA, 25 bp, Mus musculus
gaatctcgaggttggccagttctga

SEQ ID NO: 101878 - DNA, 25 bp, Mus musculus
gaatctcgccttgctctactggaac

SEQ ID NO: 101879 - DNA, 25 bp, Mus musculus
gaatctcggcggtgagcttagccac

SEQ ID NO: 101880 - DNA, 25 bp, Mus musculus
gaatctctggcaaaatggccctgaa

SEQ ID NO: 101881 - DNA, 25 bp, Mus musculus
gaatctctgttctgggtacatggga

SEQ ID NO: 101882 - DNA, 25 bp, Mus musculus
gaatctcttaggagctttatataga

SEQ ID NO: 101883 - DNA, 25 bp, Mus musculus
gaatctcttgcactgtcgctcatgg

SEQ ID NO: 101884 - DNA, 25 bp, Mus musculus
gaatctcttgcattgtacgtgggaa

SEQ ID NO: 101885 - DNA, 25 bp, Mus musculus
gaatctgaacccatcctctgtttgg

SEQ ID NO: 101886 - DNA, 25 bp, Mus musculus
gaatctgaagcagaattctccctct

SEQ ID NO: 101887 - DNA, 25 bp, Mus musculus
gaatctgaagccactctgagccata

SEQ ID NO: 101888 - DNA, 25 bp, Mus musculus
gaatctgaagcttccttagtgctag

SEQ ID NO: 101889 - DNA, 25 bp, Mus musculus
gaatctgaaggtggagatcggccta

SEQ ID NO: 101890 - DNA, 25 bp, Mus musculus
gaatctgaccaatggagcacagtgg

SEQ ID NO: 101891 - DNA, 25 bp, Mus musculus
gaatctgacgaaccttttaggcctg

SEQ ID NO: 101892 - DNA, 25 bp, Mus musculus
gaatctgacgaggatagcctgggca

SEQ ID NO: 101893 - DNA, 25 bp, Mus musculus
gaatctgagctctttggacggacga

SEQ ID NO: 101894 - DNA, 25 bp, Mus musculus
gaatctgaggcttcgagatgagaga

SEQ ID NO: 101895 - DNA, 25 bp, Mus musculus
gaatctgagtccactcagaaggccg

SEQ ID NO: 101896 - DNA, 25 bp, Mus musculus
gaatctgatattaaaagcgctcccc

SEQ ID NO: 101897 - DNA, 25 bp, Mus musculus
gaatctgcaaatacgaggagtcctg

SEQ ID NO: 101898 - DNA, 25 bp, Mus musculus
gaatctgcacttgacacgtccctgg

SEQ ID NO: 101899 - DNA, 25 bp, Mus musculus
gaatctgcatctagcacaagtggtc

SEQ ID NO: 101900 - DNA, 25 bp, Mus musculus
gaatctgctacaccatctttgacct

SEQ ID NO: 101901 - DNA, 25 bp, Mus musculus
gaatctgctatgaggcttaactgct

SEQ ID NO: 101902 - DNA, 25 bp, Mus musculus
gaatctgctgctccgaaaatgctgc

SEQ ID NO: 101903 - DNA, 25 bp, Mus musculus
gaatctggaacgttcatcactgaca

SEQ ID NO: 101904 - DNA, 25 bp, Mus musculus
gaatctggccaacaagcgctttgta

SEQ ID NO: 101905 - DNA, 25 bp, Mus musculus
gaatctggccttcatcgacgagtcc

SEQ ID NO: 101906 - DNA, 25 bp, Mus musculus
gaatctggctgataaacaaggacct

SEQ ID NO: 101907 - DNA, 25 bp, Mus musculus
gaatctgggtcctaatcctgagtcc

SEQ ID NO: 101908 - DNA, 25 bp, Mus musculus
gaatctggtgcaaaacacaagggac

SEQ ID NO: 101909 - DNA, 25 bp, Mus musculus
gaatctggtttgtacccggtgacgc

SEQ ID NO: 101910 - DNA, 25 bp, Mus musculus
gaatctgtcccttggaggtggccct

SEQ ID NO: 101911 - DNA, 25 bp, Mus musculus
gaatctgtgatctgctcagctctgg

SEQ ID NO: 101912 - DNA, 25 bp, Mus musculus
gaatctgtgcgctatctgctgctga

SEQ ID NO: 101913 - DNA, 25 bp, Mus musculus
gaatctgttagctctggtgggccca

SEQ ID NO: 101914 - DNA, 25 bp, Mus musculus
gaatctgtttacgaccgatgaggaa

SEQ ID NO: 101915 - DNA, 25 bp, Mus musculus
gaatcttagagtctgcaggtggcca

SEQ ID NO: 101916 - DNA, 25 bp, Mus musculus
gaatcttagcctacagaaacaccgc

SEQ ID NO: 101917 - DNA, 25 bp, Mus musculus
gaatcttccgtgtacctgaccctgg

SEQ ID NO: 101918 - DNA, 25 bp, Mus musculus
gaatcttcctcatctgatgtcactg

SEQ ID NO: 101919 - DNA, 25 bp, Mus musculus
gaatcttcggcaagacggctctgcg

SEQ ID NO: 101920 - DNA, 25 bp, Mus musculus
gaatcttcgggctgtcatccaggtg

SEQ ID NO: 101921 - DNA, 25 bp, Mus musculus
gaatcttctaatctctgacctcaag

SEQ ID NO: 101922 - DNA, 25 bp, Mus musculus
gaatcttctgtagagctgcctgcca

SEQ ID NO: 101923 - DNA, 25 bp, Mus musculus
gaatcttctgttttcagcccaacag

SEQ ID NO: 101924 - DNA, 25 bp, Mus musculus
gaatcttcttcggaggatcacccgg

SEQ ID NO: 101925 - DNA, 25 bp, Mus musculus
gaatcttgaagacctcctaggccca

SEQ ID NO: 101926 - DNA, 25 bp, Mus musculus
gaatcttgcagcgtagtgctgccaa

SEQ ID NO: 101927 - DNA, 25 bp, Mus musculus
gaatcttgcggaggacacacgtaca

SEQ ID NO: 101928 - DNA, 25 bp, Mus musculus
gaatcttggagagactgtctgcggt

SEQ ID NO: 101929 - DNA, 25 bp, Mus musculus
gaatcttgtaccctcatctgctcgt

SEQ ID NO: 101930 - DNA, 25 bp, Mus musculus
gaatctttagaagttggttccaaca

SEQ ID NO: 101931 - DNA, 25 bp, Mus musculus
gaatctttcccagagctttcagcct

SEQ ID NO: 101932 - DNA, 25 bp, Mus musculus
gaatcttttggctaggactcatcgc

SEQ ID NO: 101933 - DNA, 25 bp, Mus musculus
gaatctttttgatgcggaaaggagc

SEQ ID NO: 101934 - DNA, 25 bp, Mus musculus
gaatgaaaggcagaagggctcagct

SEQ ID NO: 101935 - DNA, 25 bp, Mus musculus
gaatgaaaggctccagcaagaactg

SEQ ID NO: 101936 - DNA, 25 bp, Mus musculus
gaatgaaagtctcacagacaccgct

SEQ ID NO: 101937 - DNA, 25 bp, Mus musculus
gaatgaaatcccacacagagacttg

SEQ ID NO: 101938 - DNA, 25 bp, Mus musculus
gaatgaacactaccgaacaactggg

SEQ ID NO: 101939 - DNA, 25 bp, Mus musculus
gaatgaacaggatgctgcccatgag

SEQ ID NO: 101940 - DNA, 25 bp, Mus musculus
gaatgaacatccctggtcacacagg

SEQ ID NO: 101941 - DNA, 25 bp, Mus musculus
gaatgaacgcctcactctctgctag

SEQ ID NO: 101942 - DNA, 25 bp, Mus musculus
gaatgaagaaaaccggcacactctg

SEQ ID NO: 101943 - DNA, 25 bp, Mus musculus
gaatgaagacttccgccacctggtc

SEQ ID NO: 101944 - DNA, 25 bp, Mus musculus
gaatgaagagaaatcacccctggag

SEQ ID NO: 101945 - DNA, 25 bp, Mus musculus
gaatgaagagatgtctggcctccct

SEQ ID NO: 101946 - DNA, 25 bp, Mus musculus
gaatgaagagccatacgggcacctt

SEQ ID NO: 101947 - DNA, 25 bp, Mus musculus
gaatgaagatgaatggcctgaccag

SEQ ID NO: 101948 - DNA, 25 bp, Mus musculus
gaatgaagatttgtgcctgagtgcc

SEQ ID NO: 101949 - DNA, 25 bp, Mus musculus
gaatgaagcccataggactccagga

SEQ ID NO: 101950 - DNA, 25 bp, Mus musculus
gaatgaagcgcagttcagtttccac

SEQ ID NO: 101951 - DNA, 25 bp, Mus musculus
gaatgaatacctgtgggacccggag

SEQ ID NO: 101952 - DNA, 25 bp, Mus musculus
gaatgaatcgtcaacactgtgctgg

SEQ ID NO: 101953 - DNA, 25 bp, Mus musculus
gaatgaatgatgtcctccctaacag

SEQ ID NO: 101954 - DNA, 25 bp, Mus musculus
gaatgaatgggttctgagcgatccc

SEQ ID NO: 101955 - DNA, 25 bp, Mus musculus
gaatgaatgtcggactggcctcgga

SEQ ID NO: 101956 - DNA, 25 bp, Mus musculus
gaatgaattcaaccaaatcgcctgc

SEQ ID NO: 101957 - DNA, 25 bp, Mus musculus
gaatgaattcaacttcccagatccc

SEQ ID NO: 101958 - DNA, 25 bp, Mus musculus
gaatgaatttctcactcgggagctg

SEQ ID NO: 101959 - DNA, 25 bp, Mus musculus
gaatgacaaccctacagcatgccct

SEQ ID NO: 101960 - DNA, 25 bp, Mus musculus
gaatgacaacggttcagagcacagt

SEQ ID NO: 101961 - DNA, 25 bp, Mus musculus
gaatgacaacgtgttctgcgcccag

SEQ ID NO: 101962 - DNA, 25 bp, Mus musculus
gaatgacaagctgactgaatacccc

SEQ ID NO: 101963 - DNA, 25 bp, Mus musculus
gaatgacaatgaagcctttaccgag

SEQ ID NO: 101964 - DNA, 25 bp, Mus musculus
gaatgacactcggtcccggatagtg

SEQ ID NO: 101965 - DNA, 25 bp, Mus musculus
gaatgacagagccatccgagtcgca

SEQ ID NO: 101966 - DNA, 25 bp, Mus musculus
gaatgacagccttaccctgacacag

SEQ ID NO: 101967 - DNA, 25 bp, Mus musculus
gaatgaccactttgacacctacgca

SEQ ID NO: 101968 - DNA, 25 bp, Mus musculus
gaatgacccacctcctggaatgact

SEQ ID NO: 101969 - DNA, 25 bp, Mus musculus
gaatgaccccagcatcaaggataag

SEQ ID NO: 101970 - DNA, 25 bp, Mus musculus
gaatgacccgctccgttttaagcct

SEQ ID NO: 101971 - DNA, 25 bp, Mus musculus
gaatgacctagagacccaactggag

SEQ ID NO: 101972 - DNA, 25 bp, Mus musculus
gaatgacctcattgctaaggttgac

SEQ ID NO: 101973 - DNA, 25 bp, Mus musculus
gaatgacctggactacatggacgcc

SEQ ID NO: 101974 - DNA, 25 bp, Mus musculus
gaatgacctggacttctacctaaaa

SEQ ID NO: 101975 - DNA, 25 bp, Mus musculus
gaatgacctgttacgaatatttgaa

SEQ ID NO: 101976 - DNA, 25 bp, Mus musculus
gaatgaccttctggtagttgccact

SEQ ID NO: 101977 - DNA, 25 bp, Mus musculus
gaatgacgaagttcaccaggacacg

SEQ ID NO: 101978 - DNA, 25 bp, Mus musculus
gaatgacgtcatccatgctcggcag

SEQ ID NO: 101979 - DNA, 25 bp, Mus musculus
gaatgacgtgtttgactccctgggc

SEQ ID NO: 101980 - DNA, 25 bp, Mus musculus
gaatgactccgatctctttgggctg

SEQ ID NO: 101981 - DNA, 25 bp, Mus musculus
gaatgactctggagcctaccgtgca

SEQ ID NO: 101982 - DNA, 25 bp, Mus musculus
gaatgactgtgacgatgacccacgc

SEQ ID NO: 101983 - DNA, 25 bp, Mus musculus
gaatgacttcctctacagggagtgg

SEQ ID NO: 101984 - DNA, 25 bp, Mus musculus
gaatgagaaccttagcaatgacctg

SEQ ID NO: 101985 - DNA, 25 bp, Mus musculus
gaatgagacatgatcctgggctggc

SEQ ID NO: 101986 - DNA, 25 bp, Mus musculus
gaatgagaccagctactctcgcctg

SEQ ID NO: 101987 - DNA, 25 bp, Mus musculus
gaatgagagtgaaatgcctgtaccc

SEQ ID NO: 101988 - DNA, 25 bp, Mus musculus
gaatgagatcaccaagctgcggaaa

SEQ ID NO: 101989 - DNA, 25 bp, Mus musculus
gaatgagcatctggatacagcgcca

SEQ ID NO: 101990 - DNA, 25 bp, Mus musculus
gaatgagcccgtcgctagctggcat

SEQ ID NO: 101991 - DNA, 25 bp, Mus musculus
gaatgagcgaaaatgtccctgcgcc

SEQ ID NO: 101992 - DNA, 25 bp, Mus musculus
gaatgagcgactgagcactaggcct

SEQ ID NO: 101993 - DNA, 25 bp, Mus musculus
gaatgagcgcctggagtgggaactg

SEQ ID NO: 101994 - DNA, 25 bp, Mus musculus
gaatgagcgctatgacgccgtgcag

SEQ ID NO: 101995 - DNA, 25 bp, Mus musculus
gaatgagctgcaggcatactagggc

SEQ ID NO: 101996 - DNA, 25 bp, Mus musculus
gaatgaggctaccttctgcaacagt

SEQ ID NO: 101997 - DNA, 25 bp, Mus musculus
gaatgaggctgccagtaccaagaag

SEQ ID NO: 101998 - DNA, 25 bp, Mus musculus
gaatgagtcaccctgagcctcagag

SEQ ID NO: 101999 - DNA, 25 bp, Mus musculus
gaatgagtccattaacttggcagcc

SEQ ID NO: 102000 - DNA, 25 bp, Mus musculus
gaatgagtgattgatgcccaagacc

SEQ ID NO: 102001 - DNA, 25 bp, Mus musculus
gaatgagtggacagcctctcctgct

SEQ ID NO: 102002 - DNA, 25 bp, Mus musculus
gaatgagtgttgctatcctgggacc

SEQ ID NO: 102003 - DNA, 25 bp, Mus musculus
gaatgagttcgttgccgtgaccagc

SEQ ID NO: 102004 - DNA, 25 bp, Mus musculus
gaatgatatcgccatcaatgaactc

SEQ ID NO: 102005 - DNA, 25 bp, Mus musculus
gaatgatcctaccagaagcacagag

SEQ ID NO: 102006 - DNA, 25 bp, Mus musculus
gaatgatcctatatttgagcgcggc

SEQ ID NO: 102007 - DNA, 25 bp, Mus musculus
gaatgatgctcaggttaaaccctct

SEQ ID NO: 102008 - DNA, 25 bp, Mus musculus
gaatgatggccaggtaaatggctca

SEQ ID NO: 102009 - DNA, 25 bp, Mus musculus
gaatgatggtcctcacagtgcctta

SEQ ID NO: 102010 - DNA, 25 bp, Mus musculus
gaatgatgtatctaaactggcagcc

SEQ ID NO: 102011 - DNA, 25 bp, Mus musculus
gaatgatgtcatccaggcccggaaa

SEQ ID NO: 102012 - DNA, 25 bp, Mus musculus
gaatgcaaaacctggcagcactgtt

SEQ ID NO: 102013 - DNA, 25 bp, Mus musculus
gaatgcaactcttgtatcccgagcc

SEQ ID NO: 102014 - DNA, 25 bp, Mus musculus
gaatgcaagcacatcagagggtggt

SEQ ID NO: 102015 - DNA, 25 bp, Mus musculus
gaatgcaagcggattctcacgggcc

SEQ ID NO: 102016 - DNA, 25 bp, Mus musculus
gaatgcaaggctgagctccgagaac

SEQ ID NO: 102017 - DNA, 25 bp, Mus musculus
gaatgcaataagtgactccggtccc

SEQ ID NO: 102018 - DNA, 25 bp, Mus musculus
gaatgcaattctgccaccatgatgg

SEQ ID NO: 102019 - DNA, 25 bp, Mus musculus
gaatgcacactctggaagccaatgg

SEQ ID NO: 102020 - DNA, 25 bp, Mus musculus
gaatgcacacttatcctgactgagg

SEQ ID NO: 102021 - DNA, 25 bp, Mus musculus
gaatgcactattactgacacccggc

SEQ ID NO: 102022 - DNA, 25 bp, Mus musculus
gaatgcactgctctccgtggaagcg

SEQ ID NO: 102023 - DNA, 25 bp, Mus musculus
gaatgcagaaacgacctgggaccct

SEQ ID NO: 102024 - DNA, 25 bp, Mus musculus
gaatgcagacatcactctcaggacc

SEQ ID NO: 102025 - DNA, 25 bp, Mus musculus
gaatgcagcaatggagtcttctggt

SEQ ID NO: 102026 - DNA, 25 bp, Mus musculus
gaatgcagcaggctctatctcagag

SEQ ID NO: 102027 - DNA, 25 bp, Mus musculus
gaatgcagcggtcttagcactcaga

SEQ ID NO: 102028 - DNA, 25 bp, Mus musculus
gaatgcaggcatcttacagagtact

SEQ ID NO: 102029 - DNA, 25 bp, Mus musculus
gaatgcaggtccagccacattggtc

SEQ ID NO: 102030 - DNA, 25 bp, Mus musculus
gaatgcagtaaaccccacagtagtg

SEQ ID NO: 102031 - DNA, 25 bp, Mus musculus
gaatgcagtcttctggacccattac

SEQ ID NO: 102032 - DNA, 25 bp, Mus musculus
gaatgcatccatcctttcagagggc

SEQ ID NO: 102033 - DNA, 25 bp, Mus musculus
gaatgcatcgagtgaaaagccctga

SEQ ID NO: 102034 - DNA, 25 bp, Mus musculus
gaatgcatcttccatcattcacgca

SEQ ID NO: 102035 - DNA, 25 bp, Mus musculus
gaatgcatgacttccggagaacggt

SEQ ID NO: 102036 - DNA, 25 bp, Mus musculus
gaatgcatgccaaacatcgtggcca

SEQ ID NO: 102037 - DNA, 25 bp, Mus musculus
gaatgcatgccacatcacccagtga

SEQ ID NO: 102038 - DNA, 25 bp, Mus musculus
gaatgcattcgatctgaatccagca

SEQ ID NO: 102039 - DNA, 25 bp, Mus musculus
gaatgcatttgtacagcgctgccaa

SEQ ID NO: 102040 - DNA, 25 bp, Mus musculus
gaatgccaaagctgaacccagagtg

SEQ ID NO: 102041 - DNA, 25 bp, Mus musculus
gaatgccaagatgctctcgaaacag

SEQ ID NO: 102042 - DNA, 25 bp, Mus musculus
gaatgccaccctggagaaaattgtg

SEQ ID NO: 102043 - DNA, 25 bp, Mus musculus
gaatgccacgcacatcaagccaatg

SEQ ID NO: 102044 - DNA, 25 bp, Mus musculus
gaatgccactgattttgagaaaacg

SEQ ID NO: 102045 - DNA, 25 bp, Mus musculus
gaatgccagactaagtgtcccgtga

SEQ ID NO: 102046 - DNA, 25 bp, Mus musculus
gaatgccagagcaggatccctagtg

SEQ ID NO: 102047 - DNA, 25 bp, Mus musculus
gaatgccatcggtgcagagtacagt

SEQ ID NO: 102048 - DNA, 25 bp, Mus musculus
gaatgccatctactttaagggaatg

SEQ ID NO: 102049 - DNA, 25 bp, Mus musculus
gaatgccatggcctatccaagagga

SEQ ID NO: 102050 - DNA, 25 bp, Mus musculus
gaatgcccaacaagccagaaacggc

SEQ ID NO: 102051 - DNA, 25 bp, Mus musculus
gaatgcccaaggaatatatcgcccg

SEQ ID NO: 102052 - DNA, 25 bp, Mus musculus
gaatgcccagctttccggagattgt

SEQ ID NO: 102053 - DNA, 25 bp, Mus musculus
gaatgcccgctgagactgggtacca

SEQ ID NO: 102054 - DNA, 25 bp, Mus musculus
gaatgcccggacctttgctggaaac

SEQ ID NO: 102055 - DNA, 25 bp, Mus musculus
gaatgccctcgtcttctgcttgtgg

SEQ ID NO: 102056 - DNA, 25 bp, Mus musculus
gaatgccctctggatagaaacagca

SEQ ID NO: 102057 - DNA, 25 bp, Mus musculus
gaatgccgaatcaaacaggatctga

SEQ ID NO: 102058 - DNA, 25 bp, Mus musculus
gaatgcctacctttcgatgtttcaa

SEQ ID NO: 102059 - DNA, 25 bp, Mus musculus
gaatgcctagaccatgcacagagag

SEQ ID NO: 102060 - DNA, 25 bp, Mus musculus
gaatgcctcaagagagtgggcctga

SEQ ID NO: 102061 - DNA, 25 bp, Mus musculus
gaatgcctcatgtccaaactagtgg

SEQ ID NO: 102062 - DNA, 25 bp, Mus musculus
gaatgcctcgactatagaaagaagc

SEQ ID NO: 102063 - DNA, 25 bp, Mus musculus
gaatgcctgtgctatgaaggctaca

SEQ ID NO: 102064 - DNA, 25 bp, Mus musculus
gaatgccttggaagaacggttctct

SEQ ID NO: 102065 - DNA, 25 bp, Mus musculus
gaatgcctttgaggacatggcccag

SEQ ID NO: 102066 - DNA, 25 bp, Mus musculus
gaatgcgattaagctacggcccagg

SEQ ID NO: 102067 - DNA, 25 bp, Mus musculus
gaatgcggtacacctaccagcagag

SEQ ID NO: 102068 - DNA, 25 bp, Mus musculus
gaatgcggtgtaccactgactgacc

SEQ ID NO: 102069 - DNA, 25 bp, Mus musculus
gaatgcgtcgtcctcagatatcaag

SEQ ID NO: 102070 - DNA, 25 bp, Mus musculus
gaatgctagctggatttgttacaac

SEQ ID NO: 102071 - DNA, 25 bp, Mus musculus
gaatgctatgtctaagttggaacaa

SEQ ID NO: 102072 - DNA, 25 bp, Mus musculus
gaatgctccatcatccagcgggagg

SEQ ID NO: 102073 - DNA, 25 bp, Mus musculus
gaatgctgagatggagtttgaaccc

SEQ ID NO: 102074 - DNA, 25 bp, Mus musculus
gaatgctgcatattgagagacacca

SEQ ID NO: 102075 - DNA, 25 bp, Mus musculus
gaatgctgccctgttaactgggtgg

SEQ ID NO: 102076 - DNA, 25 bp, Mus musculus
gaatgctgcggttcagctccgtgaa

SEQ ID NO: 102077 - DNA, 25 bp, Mus musculus
gaatgctgctgagtatctgctgagc

SEQ ID NO: 102078 - DNA, 25 bp, Mus musculus
gaatgctgcttgactcccgttgtga

SEQ ID NO: 102079 - DNA, 25 bp, Mus musculus
gaatgctggagtggcagatcgctat

SEQ ID NO: 102080 - DNA, 25 bp, Mus musculus
gaatgctgtagaaacaggaccccag

SEQ ID NO: 102081 - DNA, 25 bp, Mus musculus
gaatgctgtcaatcaaaacggctgc

SEQ ID NO: 102082 - DNA, 25 bp, Mus musculus
gaatgctgtgttcgatatcctggtg

SEQ ID NO: 102083 - DNA, 25 bp, Mus musculus
gaatgctgttgtcctcacggtgaaa

SEQ ID NO: 102084 - DNA, 25 bp, Mus musculus
gaatgcttgatattgcctaacttca

SEQ ID NO: 102085 - DNA, 25 bp, Mus musculus
gaatgctttgcaagcctccagggct

SEQ ID NO: 102086 - DNA, 25 bp, Mus musculus
gaatggaaaatttagagagcacgcc

SEQ ID NO: 102087 - DNA, 25 bp, Mus musculus
gaatggaaccagtacagccagcgaa

SEQ ID NO: 102088 - DNA, 25 bp, Mus musculus
gaatggaactgaaaatctgacgaca

SEQ ID NO: 102089 - DNA, 25 bp, Mus musculus
gaatggaagaataactacccgcgcc

SEQ ID NO: 102090 - DNA, 25 bp, Mus musculus
gaatggaagtaacgactctgacaga

SEQ ID NO: 102091 - DNA, 25 bp, Mus musculus
gaatggaattcctcacggagccaaa

SEQ ID NO: 102092 - DNA, 25 bp, Mus musculus
gaatggacagacgtcagaacacata

SEQ ID NO: 102093 - DNA, 25 bp, Mus musculus
gaatggacatgttcccgcagtgaaa

SEQ ID NO: 102094 - DNA, 25 bp, Mus musculus
gaatggacccgctaagtgaagagga

SEQ ID NO: 102095 - DNA, 25 bp, Mus musculus
gaatggactgaactctatggaagga

SEQ ID NO: 102096 - DNA, 25 bp, Mus musculus
gaatggactgcttaacaagaccccg

SEQ ID NO: 102097 - DNA, 25 bp, Mus musculus
gaatggacttgttctagaatcaagg

SEQ ID NO: 102098 - DNA, 25 bp, Mus musculus
gaatggagacggtgcctatctctac

SEQ ID NO: 102099 - DNA, 25 bp, Mus musculus
gaatggagtccaggctcagatggca

SEQ ID NO: 102100 - DNA, 25 bp, Mus musculus
gaatggatatccacttcgaggaggg

SEQ ID NO: 102101 - DNA, 25 bp, Mus musculus
gaatggatcagcgttcccggaagaa

SEQ ID NO: 102102 - DNA, 25 bp, Mus musculus
gaatggatctgcgtctcagctcagc

SEQ ID NO: 102103 - DNA, 25 bp, Mus musculus
gaatggatgcccctctaaagagcaa

SEQ ID NO: 102104 - DNA, 25 bp, Mus musculus
gaatggattccaccaatgctgatgc

SEQ ID NO: 102105 - DNA, 25 bp, Mus musculus
gaatggatttcctctccacccagtg

SEQ ID NO: 102106 - DNA, 25 bp, Mus musculus
gaatggcaagaattcacaaccctgg

SEQ ID NO: 102107 - DNA, 25 bp, Mus musculus
gaatggcaccgtcgcttagctgctg

SEQ ID NO: 102108 - DNA, 25 bp, Mus musculus
gaatggcagcaaagaagttcccctg

SEQ ID NO: 102109 - DNA, 25 bp, Mus musculus
gaatggcagcaacctcccatctgtg

SEQ ID NO: 102110 - DNA, 25 bp, Mus musculus
gaatggcatcttgtcgacccctgca

SEQ ID NO: 102111 - DNA, 25 bp, Mus musculus
gaatggccatggtacaaagatttca

SEQ ID NO: 102112 - DNA, 25 bp, Mus musculus
gaatggccattgtcatagcacagag

SEQ ID NO: 102113 - DNA, 25 bp, Mus musculus
gaatggccctgcacagaagttacgg

SEQ ID NO: 102114 - DNA, 25 bp, Mus musculus
gaatggccgacctcagtcttgtgga

SEQ ID NO: 102115 - DNA, 25 bp, Mus musculus
gaatggcctagtacatatctggagc

SEQ ID NO: 102116 - DNA, 25 bp, Mus musculus
gaatggcctggtagcactgatgaac

SEQ ID NO: 102117 - DNA, 25 bp, Mus musculus
gaatggcgctaggattgaaagcact

SEQ ID NO: 102118 - DNA, 25 bp, Mus musculus
gaatggcgctcttttgatcactgga

SEQ ID NO: 102119 - DNA, 25 bp, Mus musculus
gaatggcgtctgtgggttgctaact

SEQ ID NO: 102120 - DNA, 25 bp, Mus musculus
gaatggcgttcagcaaaggatttcg

SEQ ID NO: 102121 - DNA, 25 bp, Mus musculus
gaatggctacagctccctgggtaag

SEQ ID NO: 102122 - DNA, 25 bp, Mus musculus
gaatggctactgaattctgacaggc

SEQ ID NO: 102123 - DNA, 25 bp, Mus musculus
gaatggctagatcaggttcatgcac

SEQ ID NO: 102124 - DNA, 25 bp, Mus musculus
gaatggctctcttcgctggaggcaa

SEQ ID NO: 102125 - DNA, 25 bp, Mus musculus
gaatggctgcctcaaaatgacctgc

SEQ ID NO: 102126 - DNA, 25 bp, Mus musculus
gaatggcttcagtccaaggatgccc

SEQ ID NO: 102127 - DNA, 25 bp, Mus musculus
gaatgggacacagtcactcctgaag

SEQ ID NO: 102128 - DNA, 25 bp, Mus musculus
gaatgggacactttcttcggtcacc

SEQ ID NO: 102129 - DNA, 25 bp, Mus musculus
gaatgggacagtgcagtataaacac

SEQ ID NO: 102130 - DNA, 25 bp, Mus musculus
gaatgggaccatgcacggcttcgtc

SEQ ID NO: 102131 - DNA, 25 bp, Mus musculus
gaatgggaggcaccttgcctaagta

SEQ ID NO: 102132 - DNA, 25 bp, Mus musculus
gaatgggattccagagctgccccag

SEQ ID NO: 102133 - DNA, 25 bp, Mus musculus
gaatgggcacttctaagactacctg

SEQ ID NO: 102134 - DNA, 25 bp, Mus musculus
gaatgggcagacttgatctcagcac

SEQ ID NO: 102135 - DNA, 25 bp, Mus musculus
gaatgggcatcgaacacatgttccc

SEQ ID NO: 102136 - DNA, 25 bp, Mus musculus
gaatgggccaagaccaaagacccag

SEQ ID NO: 102137 - DNA, 25 bp, Mus musculus
gaatgggccacggattcagcacact

SEQ ID NO: 102138 - DNA, 25 bp, Mus musculus
gaatgggcccaactaatcctgatga

SEQ ID NO: 102139 - DNA, 25 bp, Mus musculus
gaatgggcctctgcaggaaacctca

SEQ ID NO: 102140 - DNA, 25 bp, Mus musculus
gaatgggctccttgatcggccagac

SEQ ID NO: 102141 - DNA, 25 bp, Mus musculus
gaatgggtccctctttgccttccga

SEQ ID NO: 102142 - DNA, 25 bp, Mus musculus
gaatgggtgaagtgcagactgctca

SEQ ID NO: 102143 - DNA, 25 bp, Mus musculus
gaatggtatcctacttcccagagca

SEQ ID NO: 102144 - DNA, 25 bp, Mus musculus
gaatggtcatttcgtgtcaggagca

SEQ ID NO: 102145 - DNA, 25 bp, Mus musculus
gaatggtccctccaatgatgccggg

SEQ ID NO: 102146 - DNA, 25 bp, Mus musculus
gaatggtgatatctgcggccactac

SEQ ID NO: 102147 - DNA, 25 bp, Mus musculus
gaatggtgccagatctttgacggga

SEQ ID NO: 102148 - DNA, 25 bp, Mus musculus
gaatggtgcccagtagaaggttacc

SEQ ID NO: 102149 - DNA, 25 bp, Mus musculus
gaatggtgccctatctacctgagct

SEQ ID NO: 102150 - DNA, 25 bp, Mus musculus
gaatggtggcctggtcaccggtaac

SEQ ID NO: 102151 - DNA, 25 bp, Mus musculus
gaatggtggctctcctaggaaccgg

SEQ ID NO: 102152 - DNA, 25 bp, Mus musculus
gaatggttacaacataggcctccag

SEQ ID NO: 102153 - DNA, 25 bp, Mus musculus
gaatggttacatcagtgcggcagaa

SEQ ID NO: 102154 - DNA, 25 bp, Mus musculus
gaatgtaaagttccgtgttgtccgc

SEQ ID NO: 102155 - DNA, 25 bp, Mus musculus
gaatgtaactcaaagctggacccca

SEQ ID NO: 102156 - DNA, 25 bp, Mus musculus
gaatgtaactgtggagggccccacc

SEQ ID NO: 102157 - DNA, 25 bp, Mus musculus
gaatgtacagagtgtgaccctcctc

SEQ ID NO: 102158 - DNA, 25 bp, Mus musculus
gaatgtacagtatcagaccggtggt

SEQ ID NO: 102159 - DNA, 25 bp, Mus musculus
gaatgtacccttgtgcatgctgacc

SEQ ID NO: 102160 - DNA, 25 bp, Mus musculus
gaatgtagtcaaacggcctcgagta

SEQ ID NO: 102161 - DNA, 25 bp, Mus musculus
gaatgtcaaaccactagctctgcca

SEQ ID NO: 102162 - DNA, 25 bp, Mus musculus
gaatgtcaaccttcagatggctgag

SEQ ID NO: 102163 - DNA, 25 bp, Mus musculus
gaatgtcacacgagaggaatcaccc

SEQ ID NO: 102164 - DNA, 25 bp, Mus musculus
gaatgtcaccgagtacgtcgtccga

SEQ ID NO: 102165 - DNA, 25 bp, Mus musculus
gaatgtcaccggaatggagctcgaa

SEQ ID NO: 102166 - DNA, 25 bp, Mus musculus
gaatgtcacctttcgttgactgaag

SEQ ID NO: 102167 - DNA, 25 bp, Mus musculus
gaatgtcacgtcaacttcatccgaa

SEQ ID NO: 102168 - DNA, 25 bp, Mus musculus
gaatgtcactctaacccttgtcgga

SEQ ID NO: 102169 - DNA, 25 bp, Mus musculus
gaatgtcagcctcgtgatctcacgg

SEQ ID NO: 102170 - DNA, 25 bp, Mus musculus
gaatgtcaggagacacagaaaggaa

SEQ ID NO: 102171 - DNA, 25 bp, Mus musculus
gaatgtcatgacctatctcaccagc

SEQ ID NO: 102172 - DNA, 25 bp, Mus musculus
gaatgtcattctccagcggactgtg

SEQ ID NO: 102173 - DNA, 25 bp, Mus musculus
gaatgtccatggatttgtttctcat

SEQ ID NO: 102174 - DNA, 25 bp, Mus musculus
gaatgtcccctttgatgccgtggta

SEQ ID NO: 102175 - DNA, 25 bp, Mus musculus
gaatgtccgagcacgtgcagaggta

SEQ ID NO: 102176 - DNA, 25 bp, Mus musculus
gaatgtccgccaaggagctctgtga

SEQ ID NO: 102177 - DNA, 25 bp, Mus musculus
gaatgtcgcgtttcggactacagcg

SEQ ID NO: 102178 - DNA, 25 bp, Mus musculus
gaatgtctcaatctcggatgaaggg

SEQ ID NO: 102179 - DNA, 25 bp, Mus musculus
gaatgtctccaatcgcacctgggac

SEQ ID NO: 102180 - DNA, 25 bp, Mus musculus
gaatgtctgcaagtccttccgagag

SEQ ID NO: 102181 - DNA, 25 bp, Mus musculus
gaatgtctgcacagtcagtggaaga

SEQ ID NO: 102182 - DNA, 25 bp, Mus musculus
gaatgtctgccctgtgggtttgcac

SEQ ID NO: 102183 - DNA, 25 bp, Mus musculus
gaatgtgaacttccaggacccagcc

SEQ ID NO: 102184 - DNA, 25 bp, Mus musculus
gaatgtgaccagcatgagctccctg

SEQ ID NO: 102185 - DNA, 25 bp, Mus musculus
gaatgtgaccccaagcatggtggct

SEQ ID NO: 102186 - DNA, 25 bp, Mus musculus
gaatgtgacggtctctgtctcccca

SEQ ID NO: 102187 - DNA, 25 bp, Mus musculus
gaatgtgactatgcttgacctctgc

SEQ ID NO: 102188 - DNA, 25 bp, Mus musculus
gaatgtgactatttctgaccgctca

SEQ ID NO: 102189 - DNA, 25 bp, Mus musculus
gaatgtgagcaacatctgggacata

SEQ ID NO: 102190 - DNA, 25 bp, Mus musculus
gaatgtgagtgccataacctggagc

SEQ ID NO: 102191 - DNA, 25 bp, Mus musculus
gaatgtgcagagtagcttagccaag

SEQ ID NO: 102192 - DNA, 25 bp, Mus musculus
gaatgtgcatatgctgacgcctgag

SEQ ID NO: 102193 - DNA, 25 bp, Mus musculus
gaatgtgcccgatgacgtactgcag

SEQ ID NO: 102194 - DNA, 25 bp, Mus musculus
gaatgtgccgctgtcatccagaggg

SEQ ID NO: 102195 - DNA, 25 bp, Mus musculus
gaatgtgctctatgtcaactgtgag

SEQ ID NO: 102196 - DNA, 25 bp, Mus musculus
gaatgtggaagacgtccttaccagc

SEQ ID NO: 102197 - DNA, 25 bp, Mus musculus
gaatgtggacctgagtagcatcacc

SEQ ID NO: 102198 - DNA, 25 bp, Mus musculus
gaatgtggagaaaaacccgctctac

SEQ ID NO: 102199 - DNA, 25 bp, Mus musculus
gaatgtggcagtaagcactggcctg

SEQ ID NO: 102200 - DNA, 25 bp, Mus musculus
gaatgtggccattactgccctggag

SEQ ID NO: 102201 - DNA, 25 bp, Mus musculus
gaatgtggtggcctatcctcagctg

SEQ ID NO: 102202 - DNA, 25 bp, Mus musculus
gaatgtggttggacagcacctgcag

SEQ ID NO: 102203 - DNA, 25 bp, Mus musculus
gaatgtgtatccaaatgtcatccca

SEQ ID NO: 102204 - DNA, 25 bp, Mus musculus
gaatgtgtcaaatcagcccatcctg

SEQ ID NO: 102205 - DNA, 25 bp, Mus musculus
gaatgtgtccgtcatcctctgcgga

SEQ ID NO: 102206 - DNA, 25 bp, Mus musculus
gaatgtgtcgttaacccaacaagga

SEQ ID NO: 102207 - DNA, 25 bp, Mus musculus
gaatgtgtctacttactcatggtca

SEQ ID NO: 102208 - DNA, 25 bp, Mus musculus
gaatgtgttctttatcagccgcctg

SEQ ID NO: 102209 - DNA, 25 bp, Mus musculus
gaatgttacacccagaggcgcctgt

SEQ ID NO: 102210 - DNA, 25 bp, Mus musculus
gaatgttactcgagaagactcacca

SEQ ID NO: 102211 - DNA, 25 bp, Mus musculus
gaatgttattccgttcctggctgcc

SEQ ID NO: 102212 - DNA, 25 bp, Mus musculus
gaatgttcctactggagggtccgca

SEQ ID NO: 102213 - DNA, 25 bp, Mus musculus
gaatgttccttcgagcagctggagc

SEQ ID NO: 102214 - DNA, 25 bp, Mus musculus
gaatgttctcagtcttggagcacct

SEQ ID NO: 102215 - DNA, 25 bp, Mus musculus
gaatgttctcattccaaacccaaga

SEQ ID NO: 102216 - DNA, 25 bp, Mus musculus
gaatgttgcttcacagacttctgca

SEQ ID NO: 102217 - DNA, 25 bp, Mus musculus
gaatgttgttctggatgacactaga

SEQ ID NO: 102218 - DNA, 25 bp, Mus musculus
gaatgtttcactggtgtgcacccaa

SEQ ID NO: 102219 - DNA, 25 bp, Mus musculus
gaatgtttgcaatctacgggcctga

SEQ ID NO: 102220 - DNA, 25 bp, Mus musculus
gaatgtttgccgaccctcacagcaa

SEQ ID NO: 102221 - DNA, 25 bp, Mus musculus
gaatgttttctggaagtttgttgtc

SEQ ID NO: 102222 - DNA, 25 bp, Mus musculus
gaatgttttgagctacttcgggtac

SEQ ID NO: 102223 - DNA, 25 bp, Mus musculus
gaattaaaatacctatcccgaccag

SEQ ID NO: 102224 - DNA, 25 bp, Mus musculus
gaattaaaatgagaccctgattgcc

SEQ ID NO: 102225 - DNA, 25 bp, Mus musculus
gaattaaaatgagccacctccgaga

SEQ ID NO: 102226 - DNA, 25 bp, Mus musculus
gaattaaagggactggctaaccacg

SEQ ID NO: 102227 - DNA, 25 bp, Mus musculus
gaattaaattgttctcccgcctgcc

SEQ ID NO: 102228 - DNA, 25 bp, Mus musculus
gaattaacaatacccgaacctctga

SEQ ID NO: 102229 - DNA, 25 bp, Mus musculus
gaattaactttgaggctaggacact

SEQ ID NO: 102230 - DNA, 25 bp, Mus musculus
gaattaagaaacagaggaccgatct

SEQ ID NO: 102231 - DNA, 25 bp, Mus musculus
gaattaagtgcagatctacgcccta

SEQ ID NO: 102232 - DNA, 25 bp, Mus musculus
gaattaagtggacagctcgacatca

SEQ ID NO: 102233 - DNA, 25 bp, Mus musculus
gaattacacgcacttcgatgactgg

SEQ ID NO: 102234 - DNA, 25 bp, Mus musculus
gaattacagcacagcgataagcccg

SEQ ID NO: 102235 - DNA, 25 bp, Mus musculus
gaattacagccatctggatttcctg

SEQ ID NO: 102236 - DNA, 25 bp, Mus musculus
gaattacatcatttagccactgtgt

SEQ ID NO: 102237 - DNA, 25 bp, Mus musculus
gaattaccagacaaagaatgtcagg

SEQ ID NO: 102238 - DNA, 25 bp, Mus musculus
gaattacccagaacaaaaggttgtg

SEQ ID NO: 102239 - DNA, 25 bp, Mus musculus
gaattacgaagaagacgcgcggtca

SEQ ID NO: 102240 - DNA, 25 bp, Mus musculus
gaattacgtgctgaccaaatgcgag

SEQ ID NO: 102241 - DNA, 25 bp, Mus musculus
gaattactcacggttcctcactgca

SEQ ID NO: 102242 - DNA, 25 bp, Mus musculus
gaattactgtgtggttacatccagc

SEQ ID NO: 102243 - DNA, 25 bp, Mus musculus
gaattacttgtccttgcgcggcgag

SEQ ID NO: 102244 - DNA, 25 bp, Mus musculus
gaattagaaccgaggctgcgcagac

SEQ ID NO: 102245 - DNA, 25 bp, Mus musculus
gaattagacacactcccttgctgcg

SEQ ID NO: 102246 - DNA, 25 bp, Mus musculus
gaattagccatcaggagggtctcca

SEQ ID NO: 102247 - DNA, 25 bp, Mus musculus
gaattagctggcgtcacagtgtgga

SEQ ID NO: 102248 - DNA, 25 bp, Mus musculus
gaattaggtcagaggaaagaatccg

SEQ ID NO: 102249 - DNA, 25 bp, Mus musculus
gaattaggtccacttcgatgtccac

SEQ ID NO: 102250 - DNA, 25 bp, Mus musculus
gaattagtccgagtggagcgagcga

SEQ ID NO: 102251 - DNA, 25 bp, Mus musculus
gaattagttgttcgatggcacagct

SEQ ID NO: 102252 - DNA, 25 bp, Mus musculus
gaattataactgtgcggcttcacca

SEQ ID NO: 102253 - DNA, 25 bp, Mus musculus
gaattatcagcttcgctggaggccc

SEQ ID NO: 102254 - DNA, 25 bp, Mus musculus
gaattatccttgatgcaccctgcag

SEQ ID NO: 102255 - DNA, 25 bp, Mus musculus
gaattatgccaggtgaaggcaccca

SEQ ID NO: 102256 - DNA, 25 bp, Mus musculus
gaattatgcctccaccttcacgtgg

SEQ ID NO: 102257 - DNA, 25 bp, Mus musculus
gaattatgtttgatgcgggcagcac

SEQ ID NO: 102258 - DNA, 25 bp, Mus musculus
gaattattaaacctggaaggccttg

SEQ ID NO: 102259 - DNA, 25 bp, Mus musculus
gaattattgccgcaaccctgacggg

SEQ ID NO: 102260 - DNA, 25 bp, Mus musculus
gaattattggctgctggcgtggacc

SEQ ID NO: 102261 - DNA, 25 bp, Mus musculus
gaattatttaagctggctccggaga

SEQ ID NO: 102262 - DNA, 25 bp, Mus musculus
gaattcaaagtgagaccgtcctccg

SEQ ID NO: 102263 - DNA, 25 bp, Mus musculus
gaattcaaccaaatcgcctgcatcc

SEQ ID NO: 102264 - DNA, 25 bp, Mus musculus
gaattcaaccgcaagcttagggagg

SEQ ID NO: 102265 - DNA, 25 bp, Mus musculus
gaattcaactctttttggccaggct

SEQ ID NO: 102266 - DNA, 25 bp, Mus musculus
gaattcaagcatgatgaccggctca

SEQ ID NO: 102267 - DNA, 25 bp, Mus musculus
gaattcaagtcatctcacgtctgtt

SEQ ID NO: 102268 - DNA, 25 bp, Mus musculus
gaattcaagtggatacggaacgaca

SEQ ID NO: 102269 - DNA, 25 bp, Mus musculus
gaattcaatcctgcgctacctggct

SEQ ID NO: 102270 - DNA, 25 bp, Mus musculus
gaattcacaaaggaggtccagccag

SEQ ID NO: 102271 - DNA, 25 bp, Mus musculus
gaattcacaaagtctccctgcctgg

SEQ ID NO: 102272 - DNA, 25 bp, Mus musculus
gaattcactctgctactctcggctg

SEQ ID NO: 102273 - DNA, 25 bp, Mus musculus
gaattcagacgagccaaggtttgca

SEQ ID NO: 102274 - DNA, 25 bp, Mus musculus
gaattcagcaggtgtataccagaca

SEQ ID NO: 102275 - DNA, 25 bp, Mus musculus
gaattcagcgggagagcacttcgag

SEQ ID NO: 102276 - DNA, 25 bp, Mus musculus
gaattcagctccttaaaatcggcag

SEQ ID NO: 102277 - DNA, 25 bp, Mus musculus
gaattcagggcttcatccatgccag

SEQ ID NO: 102278 - DNA, 25 bp, Mus musculus
gaattcagttgcaaagcgatacagc

SEQ ID NO: 102279 - DNA, 25 bp, Mus musculus
gaattcatacccttgttgggctgca

SEQ ID NO: 102280 - DNA, 25 bp, Mus musculus
gaattcatcattaagaccgtccagc

SEQ ID NO: 102281 - DNA, 25 bp, Mus musculus
gaattcatgaccgtccactgctggg

SEQ ID NO: 102282 - DNA, 25 bp, Mus musculus
gaattcatgacgattcttgggccca

SEQ ID NO: 102283 - DNA, 25 bp, Mus musculus
gaattcatgactgctgtgctaaaga

SEQ ID NO: 102284 - DNA, 25 bp, Mus musculus
gaattcattggagagacctccccag

SEQ ID NO: 102285 - DNA, 25 bp, Mus musculus
gaattccacacagtgcacatctgca

SEQ ID NO: 102286 - DNA, 25 bp, Mus musculus
gaattccacttcagatcagagccct

SEQ ID NO: 102287 - DNA, 25 bp, Mus musculus
gaattccagctaatgtgatccgagg

SEQ ID NO: 102288 - DNA, 25 bp, Mus musculus
gaattcccacagatggatcgctctg

SEQ ID NO: 102289 - DNA, 25 bp, Mus musculus
gaattcccaggttgcatctctctgg

SEQ ID NO: 102290 - DNA, 25 bp, Mus musculus
gaattccctggatgaaggccgtcac

SEQ ID NO: 102291 - DNA, 25 bp, Mus musculus
gaattccctgggaggctcatcaaca

SEQ ID NO: 102292 - DNA, 25 bp, Mus musculus
gaattccgaaaggatgtggagccct

SEQ ID NO: 102293 - DNA, 25 bp, Mus musculus
gaattccggagcttctgcgacgagt

SEQ ID NO: 102294 - DNA, 25 bp, Mus musculus
gaattcctatcaaaaacgtccagag

SEQ ID NO: 102295 - DNA, 25 bp, Mus musculus
gaattcctggatgcataccccgtgg

SEQ ID NO: 102296 - DNA, 25 bp, Mus musculus
gaattccttccaaagtgcagcgttg

SEQ ID NO: 102297 - DNA, 25 bp, Mus musculus
gaattcgacgtcaattaactacctt

SEQ ID NO: 102298 - DNA, 25 bp, Mus musculus
gaattcgagacccaaaccaaggagg

SEQ ID NO: 102299 - DNA, 25 bp, Mus musculus
gaattcgagatccaaatcagggagg

SEQ ID NO: 102300 - DNA, 25 bp, Mus musculus
gaattcgcagatttggccacagccg

SEQ ID NO: 102301 - DNA, 25 bp, Mus musculus
gaattcgcgtagaaggaaagctcag

SEQ ID NO: 102302 - DNA, 25 bp, Mus musculus
gaattcgcgttctgcttttccaagc

SEQ ID NO: 102303 - DNA, 25 bp, Mus musculus
gaattcgctgcccaaagtggcctat

SEQ ID NO: 102304 - DNA, 25 bp, Mus musculus
gaattcggcttcttcctgacgtgga

SEQ ID NO: 102305 - DNA, 25 bp, Mus musculus
gaattctcctaacaaaggtgtgctg

SEQ ID NO: 102306 - DNA, 25 bp, Mus musculus
gaattctcctgtattggcggctatg

SEQ ID NO: 102307 - DNA, 25 bp, Mus musculus
gaattctccttggatgtggcaaagg

SEQ ID NO: 102308 - DNA, 25 bp, Mus musculus
gaattctgatacttactgcgctggg

SEQ ID NO: 102309 - DNA, 25 bp, Mus musculus
gaattctgcagtaccccagctgaga

SEQ ID NO: 102310 - DNA, 25 bp, Mus musculus
gaattctgccatgggtgctccctgc

SEQ ID NO: 102311 - DNA, 25 bp, Mus musculus
gaattctgccctttccacaacgtca

SEQ ID NO: 102312 - DNA, 25 bp, Mus musculus
gaattctggaaaccgtcaggctagc

SEQ ID NO: 102313 - DNA, 25 bp, Mus musculus
gaattctgtacctgggcgggcagct

SEQ ID NO: 102314 - DNA, 25 bp, Mus musculus
gaattctgtattcgaggctggtgca

SEQ ID NO: 102315 - DNA, 25 bp, Mus musculus
gaattcttcgtgttgaccgagcgct

SEQ ID NO: 102316 - DNA, 25 bp, Mus musculus
gaattcttgaaactggacagacaga

SEQ ID NO: 102317 - DNA, 25 bp, Mus musculus
gaattcttgcacatagcgggccatg

SEQ ID NO: 102318 - DNA, 25 bp, Mus musculus
gaattctttcgacccactgagcagg

SEQ ID NO: 102319 - DNA, 25 bp, Mus musculus
gaattcttttctgcgttagctccag

SEQ ID NO: 102320 - DNA, 25 bp, Mus musculus
gaattctttttgaaagccgcctgtg

SEQ ID NO: 102321 - DNA, 25 bp, Mus musculus
gaattgaaatgcaccagcgattgtc

SEQ ID NO: 102322 - DNA, 25 bp, Mus musculus
gaattgaagaaaataacgagcctga

SEQ ID NO: 102323 - DNA, 25 bp, Mus musculus
gaattgaagagttcaaaccgcctga

SEQ ID NO: 102324 - DNA, 25 bp, Mus musculus
gaattgaagtcgaggaaggacctag

SEQ ID NO: 102325 - DNA, 25 bp, Mus musculus
gaattgaccagaatgctagcagaag

SEQ ID NO: 102326 - DNA, 25 bp, Mus musculus
gaattgaccggctaactcggctgtg

SEQ ID NO: 102327 - DNA, 25 bp, Mus musculus
gaattgactgggaagcttaatgaag

SEQ ID NO: 102328 - DNA, 25 bp, Mus musculus
gaattgagccaccttgaacagtctg

SEQ ID NO: 102329 - DNA, 25 bp, Mus musculus
gaattgaggcaagattatagacgat

SEQ ID NO: 102330 - DNA, 25 bp, Mus musculus
gaattgagggacttctgtaggagac

SEQ ID NO: 102331 - DNA, 25 bp, Mus musculus
gaattgagtaaacttgtgccaccag

SEQ ID NO: 102332 - DNA, 25 bp, Mus musculus
gaattgatcgttcagcactacacag

SEQ ID NO: 102333 - DNA, 25 bp, Mus musculus
gaattgcacaactgcaggaggctct

SEQ ID NO: 102334 - DNA, 25 bp, Mus musculus
gaattgcaccgagaacagcacggag

SEQ ID NO: 102335 - DNA, 25 bp, Mus musculus
gaattgcagcactggtcccaatgga

SEQ ID NO: 102336 - DNA, 25 bp, Mus musculus
gaattgcagtttccgatcagcctgg

SEQ ID NO: 102337 - DNA, 25 bp, Mus musculus
gaattgccaaattgacaaaacgcag

SEQ ID NO: 102338 - DNA, 25 bp, Mus musculus
gaattgccacagagtttaaccagct

SEQ ID NO: 102339 - DNA, 25 bp, Mus musculus
gaattgcccattctgcagaaaccag

SEQ ID NO: 102340 - DNA, 25 bp, Mus musculus
gaattgccgcctgtttgttacgatg

SEQ ID NO: 102341 - DNA, 25 bp, Mus musculus
gaattgccgggcatctaatggccag

SEQ ID NO: 102342 - DNA, 25 bp, Mus musculus
gaattgcgtctctatctggctcaga

SEQ ID NO: 102343 - DNA, 25 bp, Mus musculus
gaattgctgagtaaccctgactaca

SEQ ID NO: 102344 - DNA, 25 bp, Mus musculus
gaattgctgggcgttcaaaggttcc

SEQ ID NO: 102345 - DNA, 25 bp, Mus musculus
gaattgctggtctctgtaacagggc

SEQ ID NO: 102346 - DNA, 25 bp, Mus musculus
gaattggaacagaaccaacagtcgt

SEQ ID NO: 102347 - DNA, 25 bp, Mus musculus
gaattggaacgctgcacctttcagg

SEQ ID NO: 102348 - DNA, 25 bp, Mus musculus
gaattggaatcggaaccggtgtcca

SEQ ID NO: 102349 - DNA, 25 bp, Mus musculus
gaattggacatcgatctaaaggaca

SEQ ID NO: 102350 - DNA, 25 bp, Mus musculus
gaattggagaatctttaacctgccc

SEQ ID NO: 102351 - DNA, 25 bp, Mus musculus
gaattggatcagcaaaccccaggag

SEQ ID NO: 102352 - DNA, 25 bp, Mus musculus
gaattggatgacgatttcacagcca

SEQ ID NO: 102353 - DNA, 25 bp, Mus musculus
gaattggcaaaaactgtaggtataa

SEQ ID NO: 102354 - DNA, 25 bp, Mus musculus
gaattggcagcatcagcaagaggaa

SEQ ID NO: 102355 - DNA, 25 bp, Mus musculus
gaattggccccacaatctgctgacg

SEQ ID NO: 102356 - DNA, 25 bp, Mus musculus
gaattggccctacagcccctttgga

SEQ ID NO: 102357 - DNA, 25 bp, Mus musculus
gaattggcgctatgctactggtgga

SEQ ID NO: 102358 - DNA, 25 bp, Mus musculus
gaattgggaatctccactccagagg

SEQ ID NO: 102359 - DNA, 25 bp, Mus musculus
gaattgggccaggaccagtagaact

SEQ ID NO: 102360 - DNA, 25 bp, Mus musculus
gaattgggctcacaccagaagcagc

SEQ ID NO: 102361 - DNA, 25 bp, Mus musculus
gaattggttcttgggtcacctaggc

SEQ ID NO: 102362 - DNA, 25 bp, Mus musculus
gaattggttgctgactttatccagg

SEQ ID NO: 102363 - DNA, 25 bp, Mus musculus
gaattgtactagtggccctggcgga

SEQ ID NO: 102364 - DNA, 25 bp, Mus musculus
gaattgtcaacaactgaggtggccc

SEQ ID NO: 102365 - DNA, 25 bp, Mus musculus
gaattgtcacctggagcagaatcgg

SEQ ID NO: 102366 - DNA, 25 bp, Mus musculus
gaattgtccaggagctatgaccagc

SEQ ID NO: 102367 - DNA, 25 bp, Mus musculus
gaattgtccggaggccttgcttcag

SEQ ID NO: 102368 - DNA, 25 bp, Mus musculus
gaattgtgctccttccgctgcagtg

SEQ ID NO: 102369 - DNA, 25 bp, Mus musculus
gaattgtgttttgccactcccggcg

SEQ ID NO: 102370 - DNA, 25 bp, Mus musculus
gaattgttattccagggactgccac

SEQ ID NO: 102371 - DNA, 25 bp, Mus musculus
gaattgttggcacactccatcagag

SEQ ID NO: 102372 - DNA, 25 bp, Mus musculus
gaattgttgggtacatcgcctgcac

SEQ ID NO: 102373 - DNA, 25 bp, Mus musculus
gaatttaaatcgaagactgtctgct

SEQ ID NO: 102374 - DNA, 25 bp, Mus musculus
gaatttaagaacgatctgctgcctg

SEQ ID NO: 102375 - DNA, 25 bp, Mus musculus
gaatttacagtaacactccaggtta

SEQ ID NO: 102376 - DNA, 25 bp, Mus musculus
gaatttaccaagtacccactggcca

SEQ ID NO: 102377 - DNA, 25 bp, Mus musculus
gaatttaccccagcggctgactcca

SEQ ID NO: 102378 - DNA, 25 bp, Mus musculus
gaatttactgtggagctggagtcca

SEQ ID NO: 102379 - DNA, 25 bp, Mus musculus
gaatttaggctacagatgcccactg

SEQ ID NO: 102380 - DNA, 25 bp, Mus musculus
gaatttagtgtcattagcagctccg

SEQ ID NO: 102381 - DNA, 25 bp, Mus musculus
gaatttatatcctgcagccataggc

SEQ ID NO: 102382 - DNA, 25 bp, Mus musculus
gaatttatcgtagtctcacagtcgc

SEQ ID NO: 102383 - DNA, 25 bp, Mus musculus
gaatttcaacaagggatcagccagg

SEQ ID NO: 102384 - DNA, 25 bp, Mus musculus
gaatttcaagctcgaaatcaatgcg

SEQ ID NO: 102385 - DNA, 25 bp, Mus musculus
gaatttcaccatgaacgacaggcac

SEQ ID NO: 102386 - DNA, 25 bp, Mus musculus
gaatttcagggctcaccccaggata

SEQ ID NO: 102387 - DNA, 25 bp, Mus musculus
gaatttcagtgtacggagtgctata

SEQ ID NO: 102388 - DNA, 25 bp, Mus musculus
gaatttccagaagcacatgcgctat

SEQ ID NO: 102389 - DNA, 25 bp, Mus musculus
gaatttccagtacgaccatgaggcg

SEQ ID NO: 102390 - DNA, 25 bp, Mus musculus
gaatttccgagtgattgccttgggc

SEQ ID NO: 102391 - DNA, 25 bp, Mus musculus
gaatttccgcacacccaactttggg

SEQ ID NO: 102392 - DNA, 25 bp, Mus musculus
gaatttccgtgaagatcgtggcccg

SEQ ID NO: 102393 - DNA, 25 bp, Mus musculus
gaatttcctcctggacttgaggctg

SEQ ID NO: 102394 - DNA, 25 bp, Mus musculus
gaatttcctctgcaagagcctcagg

SEQ ID NO: 102395 - DNA, 25 bp, Mus musculus
gaatttctagcagagggccaagacg

SEQ ID NO: 102396 - DNA, 25 bp, Mus musculus
gaatttctccagcttgccagtgcca

SEQ ID NO: 102397 - DNA, 25 bp, Mus musculus
gaatttctggccacgcttatctttg

SEQ ID NO: 102398 - DNA, 25 bp, Mus musculus
gaatttctgtatgatgacctccaag

SEQ ID NO: 102399 - DNA, 25 bp, Mus musculus
gaatttcttgcacactctatcctgg

SEQ ID NO: 102400 - DNA, 25 bp, Mus musculus
gaatttcttgcgtggtcgacctaaa

SEQ ID NO: 102401 - DNA, 25 bp, Mus musculus
gaatttgaatcaaagcgccgcgagc

SEQ ID NO: 102402 - DNA, 25 bp, Mus musculus
gaatttgacaaactcagcccagagg

SEQ ID NO: 102403 - DNA, 25 bp, Mus musculus
gaatttgagatatccctgaaagccc

SEQ ID NO: 102404 - DNA, 25 bp, Mus musculus
gaatttgagtgcacatctgtggaag

SEQ ID NO: 102405 - DNA, 25 bp, Mus musculus
gaatttgatggagcaggaaagtccc

SEQ ID NO: 102406 - DNA, 25 bp, Mus musculus
gaatttgcaagtaacggcatggagg

SEQ ID NO: 102407 - DNA, 25 bp, Mus musculus
gaatttgcacagaccacaaggcatg

SEQ ID NO: 102408 - DNA, 25 bp, Mus musculus
gaatttgcaccagaacttaatcagg

SEQ ID NO: 102409 - DNA, 25 bp, Mus musculus
gaatttgcacgtgtttgtccccgac

SEQ ID NO: 102410 - DNA, 25 bp, Mus musculus
gaatttgcagttcctgactaccgct

SEQ ID NO: 102411 - DNA, 25 bp, Mus musculus
gaatttgctatcttccctaacggac

SEQ ID NO: 102412 - DNA, 25 bp, Mus musculus
gaatttgctccagcggctgctgcaa

SEQ ID NO: 102413 - DNA, 25 bp, Mus musculus
gaatttgctcttgcagccgatgaca

SEQ ID NO: 102414 - DNA, 25 bp, Mus musculus
gaatttgctgctatgctgatgccac

SEQ ID NO: 102415 - DNA, 25 bp, Mus musculus
gaatttgctggctcgtaaaggcact

SEQ ID NO: 102416 - DNA, 25 bp, Mus musculus
gaatttggactagccatcttcagta

SEQ ID NO: 102417 - DNA, 25 bp, Mus musculus
gaatttggagcctcgttcccttgcg

SEQ ID NO: 102418 - DNA, 25 bp, Mus musculus
gaatttggcggcaaggttcccactg

SEQ ID NO: 102419 - DNA, 25 bp, Mus musculus
gaatttgggcatagttcagaacagc

SEQ ID NO: 102420 - DNA, 25 bp, Mus musculus
gaatttggtctcagtcagccgcgta

SEQ ID NO: 102421 - DNA, 25 bp, Mus musculus
gaatttggtgaacctctgcctcaga

SEQ ID NO: 102422 - DNA, 25 bp, Mus musculus
gaatttgtcatcactagcctgaagg

SEQ ID NO: 102423 - DNA, 25 bp, Mus musculus
gaatttgtggcaaccttcaagggca

SEQ ID NO: 102424 - DNA, 25 bp, Mus musculus
gaatttgttcagtctcacgtcgtcc

SEQ ID NO: 102425 - DNA, 25 bp, Mus musculus
gaattttaatatcgacagagcccca

SEQ ID NO: 102426 - DNA, 25 bp, Mus musculus
gaattttcacaaatccggtacgatg

SEQ ID NO: 102427 - DNA, 25 bp, Mus musculus
gaattttcaggccattcacagcgag

SEQ ID NO: 102428 - DNA, 25 bp, Mus musculus
gaattttccttggttctgcagccgc

SEQ ID NO: 102429 - DNA, 25 bp, Mus musculus
gaattttctagagggatgctgacca

SEQ ID NO: 102430 - DNA, 25 bp, Mus musculus
gaattttctccaaagtagctggcca

SEQ ID NO: 102431 - DNA, 25 bp, Mus musculus
gaattttgatgggtacagtgcctgc

SEQ ID NO: 102432 - DNA, 25 bp, Mus musculus
gaatttttcagtcaaggctgcgctc

SEQ ID NO: 102433 - DNA, 25 bp, Mus musculus
gacaaaaaggacagcacttcagcag

SEQ ID NO: 102434 - DNA, 25 bp, Mus musculus
gacaaaaattgtctacaacccgtgg

SEQ ID NO: 102435 - DNA, 25 bp, Mus musculus
gacaaaacctttttgctgcagtgct

SEQ ID NO: 102436 - DNA, 25 bp, Mus musculus
gacaaaacggccagaacaagctctt

SEQ ID NO: 102437 - DNA, 25 bp, Mus musculus
gacaaaactgatctggagagcctcg

SEQ ID NO: 102438 - DNA, 25 bp, Mus musculus
gacaaaagacatggatgagccctct

SEQ ID NO: 102439 - DNA, 25 bp, Mus musculus
gacaaaagagcctgcacatacgggt

SEQ ID NO: 102440 - DNA, 25 bp, Mus musculus
gacaaaagaggtgctgactattcaa

SEQ ID NO: 102441 - DNA, 25 bp, Mus musculus
gacaaaaggcgttcggtagtcaccg

SEQ ID NO: 102442 - DNA, 25 bp, Mus musculus
gacaaaagtgtctgcaaatgaaggt

SEQ ID NO: 102443 - DNA, 25 bp, Mus musculus
gacaaaagttcgagtgtgctcacct

SEQ ID NO: 102444 - DNA, 25 bp, Mus musculus
gacaaaagttcgtagcagacctgcg

SEQ ID NO: 102445 - DNA, 25 bp, Mus musculus
gacaaaattatcagtggcctccggg

SEQ ID NO: 102446 - DNA, 25 bp, Mus musculus
gacaaaattcattatacctgagtac

SEQ ID NO: 102447 - DNA, 25 bp, Mus musculus
gacaaaattcttgaaccacctgaag

SEQ ID NO: 102448 - DNA, 25 bp, Mus musculus
gacaaacacgtgatgcggaaggagc

SEQ ID NO: 102449 - DNA, 25 bp, Mus musculus
gacaaacagcgttacttaggcaaag

SEQ ID NO: 102450 - DNA, 25 bp, Mus musculus
gacaaaccgactactcctaagaccg

SEQ ID NO: 102451 - DNA, 25 bp, Mus musculus
gacaaacggaagaggtctttacaga

SEQ ID NO: 102452 - DNA, 25 bp, Mus musculus
gacaaactaatgtcctgagggccat

SEQ ID NO: 102453 - DNA, 25 bp, Mus musculus
gacaaactcacttgcgtacagagag

SEQ ID NO: 102454 - DNA, 25 bp, Mus musculus
gacaaactcttgctctcccttaggg

SEQ ID NO: 102455 - DNA, 25 bp, Mus musculus
gacaaactgctcagcgtctgcatga

SEQ ID NO: 102456 - DNA, 25 bp, Mus musculus
gacaaacttccagagtccctagagg

SEQ ID NO: 102457 - DNA, 25 bp, Mus musculus
gacaaactttgcagtaagcggacag

SEQ ID NO: 102458 - DNA, 25 bp, Mus musculus
gacaaagaacttgatgatgccttgg

SEQ ID NO: 102459 - DNA, 25 bp, Mus musculus
gacaaagacacctctcgctgggaga

SEQ ID NO: 102460 - DNA, 25 bp, Mus musculus
gacaaagagtgacgatgatgtctct

SEQ ID NO: 102461 - DNA, 25 bp, Mus musculus
gacaaagagtggatggctgccctgc

SEQ ID NO: 102462 - DNA, 25 bp, Mus musculus
gacaaagccaatcgtggagaaacac

SEQ ID NO: 102463 - DNA, 25 bp, Mus musculus
gacaaagcctcgtatgtggcctggg

SEQ ID NO: 102464 - DNA, 25 bp, Mus musculus
gacaaagctgcacctcctgaaaaag

SEQ ID NO: 102465 - DNA, 25 bp, Mus musculus
gacaaagtaatgttttatggccgga

SEQ ID NO: 102466 - DNA, 25 bp, Mus musculus
gacaaagtagccgagcatgggacac

SEQ ID NO: 102467 - DNA, 25 bp, Mus musculus
gacaaagtatttggctcactgagca

SEQ ID NO: 102468 - DNA, 25 bp, Mus musculus
gacaaagtctgggtgtaccctcctg

SEQ ID NO: 102469 - DNA, 25 bp, Mus musculus
gacaaagtgcttttctatggccgga

SEQ ID NO: 102470 - DNA, 25 bp, Mus musculus
gacaaagtggaagacgtgaaagccc

SEQ ID NO: 102471 - DNA, 25 bp, Mus musculus
gacaaagtggcgttcacaggctcca

SEQ ID NO: 102472 - DNA, 25 bp, Mus musculus
gacaaatactgtcaaacggaccacc

SEQ ID NO: 102473 - DNA, 25 bp, Mus musculus
gacaaatactgtgagggtaccccga

SEQ ID NO: 102474 - DNA, 25 bp, Mus musculus
gacaaatatggaagtcaacagccag

SEQ ID NO: 102475 - DNA, 25 bp, Mus musculus
gacaaatcctttatccagcgttcaa

SEQ ID NO: 102476 - DNA, 25 bp, Mus musculus
gacaaatctcccaggactttggaag

SEQ ID NO: 102477 - DNA, 25 bp, Mus musculus
gacaaatctgctcttggacctgaag

SEQ ID NO: 102478 - DNA, 25 bp, Mus musculus
gacaaatgagttatggctgggccac

SEQ ID NO: 102479 - DNA, 25 bp, Mus musculus
gacaaatgcctgtcgcgggagaaga

SEQ ID NO: 102480 - DNA, 25 bp, Mus musculus
gacaaatgctgtgtgacgactctga

SEQ ID NO: 102481 - DNA, 25 bp, Mus musculus
gacaaatggaagtgctacgatgccc

SEQ ID NO: 102482 - DNA, 25 bp, Mus musculus
gacaaatgtcccatgtgctacaccg

SEQ ID NO: 102483 - DNA, 25 bp, Mus musculus
gacaaattccatgaactgggcacgg

SEQ ID NO: 102484 - DNA, 25 bp, Mus musculus
gacaaatttcgaagagagcgcagcg

SEQ ID NO: 102485 - DNA, 25 bp, Mus musculus
gacaaatttgccaagagccggccca

SEQ ID NO: 102486 - DNA, 25 bp, Mus musculus
gacaacaaggatgggtcgtaccgcg

SEQ ID NO: 102487 - DNA, 25 bp, Mus musculus
gacaacaagggctcatgcttccaga

SEQ ID NO: 102488 - DNA, 25 bp, Mus musculus
gacaacaagtccttccgagtcctgg

SEQ ID NO: 102489 - DNA, 25 bp, Mus musculus
gacaacaatattgagccagaagaag

SEQ ID NO: 102490 - DNA, 25 bp, Mus musculus
gacaacaccactgattttcaacggg

SEQ ID NO: 102491 - DNA, 25 bp, Mus musculus
gacaacactcttttactgcgaaggg

SEQ ID NO: 102492 - DNA, 25 bp, Mus musculus
gacaacagagccgaaccctttgatt

SEQ ID NO: 102493 - DNA, 25 bp, Mus musculus
gacaacagatggctttgagacccac

SEQ ID NO: 102494 - DNA, 25 bp, Mus musculus
gacaacagcaagaggaacaacagga

SEQ ID NO: 102495 - DNA, 25 bp, Mus musculus
gacaacagccctctgacatggcagg

SEQ ID NO: 102496 - DNA, 25 bp, Mus musculus
gacaacagcttgctcttcatggaga

SEQ ID NO: 102497 - DNA, 25 bp, Mus musculus
gacaacaggagtgcccttgacgggc

SEQ ID NO: 102498 - DNA, 25 bp, Mus musculus
gacaacaggcatcatcgagaccaag

SEQ ID NO: 102499 - DNA, 25 bp, Mus musculus
gacaacagtgacgaagagaactgcc

SEQ ID NO: 102500 - DNA, 25 bp, Mus musculus
gacaacatacagaggaacgcggcct

SEQ ID NO: 102501 - DNA, 25 bp, Mus musculus
gacaacatagttacctgcggatctc

SEQ ID NO: 102502 - DNA, 25 bp, Mus musculus
gacaacatccatttacacccagagg

SEQ ID NO: 102503 - DNA, 25 bp, Mus musculus
gacaacatgaaatggtgcggcacca

SEQ ID NO: 102504 - DNA, 25 bp, Mus musculus
gacaacatttctgctcgcaaattct

SEQ ID NO: 102505 - DNA, 25 bp, Mus musculus
gacaaccaagcatatggacttttcg

SEQ ID NO: 102506 - DNA, 25 bp, Mus musculus
gacaaccagagggattgccagcctg

SEQ ID NO: 102507 - DNA, 25 bp, Mus musculus
gacaaccagtccgattactcagtgg

SEQ ID NO: 102508 - DNA, 25 bp, Mus musculus
gacaacccaaagatccagctgacgt

SEQ ID NO: 102509 - DNA, 25 bp, Mus musculus
gacaaccccgcagcaaaggttctag

SEQ ID NO: 102510 - DNA, 25 bp, Mus musculus
gacaacccgaattctcagtggcacg

SEQ ID NO: 102511 - DNA, 25 bp, Mus musculus
gacaaccgacttcctctggtcagag

SEQ ID NO: 102512 - DNA, 25 bp, Mus musculus
gacaaccgccagcatcaatgggaag

SEQ ID NO: 102513 - DNA, 25 bp, Mus musculus
gacaacctactcagggagttaccgg

SEQ ID NO: 102514 - DNA, 25 bp, Mus musculus
gacaacctcctaggaaggctcatag

SEQ ID NO: 102515 - DNA, 25 bp, Mus musculus
gacaacctgcagctggtaccatggg

SEQ ID NO: 102516 - DNA, 25 bp, Mus musculus
gacaacctgctaaacctggaccatg

SEQ ID NO: 102517 - DNA, 25 bp, Mus musculus
gacaacctgctggagatcttcgggc

SEQ ID NO: 102518 - DNA, 25 bp, Mus musculus
gacaacctggcgattgtgactcagt

SEQ ID NO: 102519 - DNA, 25 bp, Mus musculus
gacaacctggtcctgattaacaaga

SEQ ID NO: 102520 - DNA, 25 bp, Mus musculus
gacaaccttgtttcttcagttcaca

SEQ ID NO: 102521 - DNA, 25 bp, Mus musculus
gacaacgaatctagaagcgcaggcg

SEQ ID NO: 102522 - DNA, 25 bp, Mus musculus
gacaacgacaagtacattgccctgg

SEQ ID NO: 102523 - DNA, 25 bp, Mus musculus
gacaacgatggccaagcggaattcc

SEQ ID NO: 102524 - DNA, 25 bp, Mus musculus
gacaacgcgccgaaaaagaagttct

SEQ ID NO: 102525 - DNA, 25 bp, Mus musculus
gacaacgctgttgcctttgacactg

SEQ ID NO: 102526 - DNA, 25 bp, Mus musculus
gacaacggacaactaaaaccatggc

SEQ ID NO: 102527 - DNA, 25 bp, Mus musculus
gacaacggacagttcttaagccgga

SEQ ID NO: 102528 - DNA, 25 bp, Mus musculus
gacaacggacgaaggagacagagca

SEQ ID NO: 102529 - DNA, 25 bp, Mus musculus
gacaacggagtctgcatagccaaaa

SEQ ID NO: 102530 - DNA, 25 bp, Mus musculus
gacaacggtagatgagttggtcttc

SEQ ID NO: 102531 - DNA, 25 bp, Mus musculus
gacaacggtggaatgaacatctcaa

SEQ ID NO: 102532 - DNA, 25 bp, Mus musculus
gacaacgtctcaatgggcaataaca

SEQ ID NO: 102533 - DNA, 25 bp, Mus musculus
gacaacgtggactatattctcccta

SEQ ID NO: 102534 - DNA, 25 bp, Mus musculus
gacaactactgcagctttcgggaag

SEQ ID NO: 102535 - DNA, 25 bp, Mus musculus
gacaactagtgggaaggctgcaaca

SEQ ID NO: 102536 - DNA, 25 bp, Mus musculus
gacaactctactctggctgtggaca

SEQ ID NO: 102537 - DNA, 25 bp, Mus musculus
gacaactgctattcggtgggcagcg

SEQ ID NO: 102538 - DNA, 25 bp, Mus musculus
gacaactggacagaaaggctcttga

SEQ ID NO: 102539 - DNA, 25 bp, Mus musculus
gacaactggccaagctggccctcat

SEQ ID NO: 102540 - DNA, 25 bp, Mus musculus
gacaactgggaggagcttcacaacc

SEQ ID NO: 102541 - DNA, 25 bp, Mus musculus
gacaactgtagtggttcctgcagag

SEQ ID NO: 102542 - DNA, 25 bp, Mus musculus
gacaactgtcagaacttacggccat

SEQ ID NO: 102543 - DNA, 25 bp, Mus musculus
gacaactgttcacgtcagcactaag

SEQ ID NO: 102544 - DNA, 25 bp, Mus musculus
gacaacttcaagattatgagcagcc

SEQ ID NO: 102545 - DNA, 25 bp, Mus musculus
gacaacttccataacgccattcgtg

SEQ ID NO: 102546 - DNA, 25 bp, Mus musculus
gacaacttgcattccgtcaaccggg

SEQ ID NO: 102547 - DNA, 25 bp, Mus musculus
gacaacttgctggaaggctatgaca

SEQ ID NO: 102548 - DNA, 25 bp, Mus musculus
gacaacttttttgtgaaggacacca

SEQ ID NO: 102549 - DNA, 25 bp, Mus musculus
gacaagaaacttcaggtggtagccc

SEQ ID NO: 102550 - DNA, 25 bp, Mus musculus
gacaagaacttcaacgctgtgggct

SEQ ID NO: 102551 - DNA, 25 bp, Mus musculus
gacaagaacttgaggacaccatatc

SEQ ID NO: 102552 - DNA, 25 bp, Mus musculus
gacaagaatacgaatcagtgcaaag

SEQ ID NO: 102553 - DNA, 25 bp, Mus musculus
gacaagaatccccagaacatcagag

SEQ ID NO: 102554 - DNA, 25 bp, Mus musculus
gacaagaatttcgaaggccgtgcac

SEQ ID NO: 102555 - DNA, 25 bp, Mus musculus
gacaagaccccaaaacatcgaaacg

SEQ ID NO: 102556 - DNA, 25 bp, Mus musculus
gacaagaccttggatgaagaggcct

SEQ ID NO: 102557 - DNA, 25 bp, Mus musculus
gacaagacgtttttcatagctgcca

SEQ ID NO: 102558 - DNA, 25 bp, Mus musculus
gacaagactgaccacctgtcctggg

SEQ ID NO: 102559 - DNA, 25 bp, Mus musculus
gacaagactgcgagactttcgggat

SEQ ID NO: 102560 - DNA, 25 bp, Mus musculus
gacaagactgggtttgctgccgctc

SEQ ID NO: 102561 - DNA, 25 bp, Mus musculus
gacaagagacttcatagcagcaaca

SEQ ID NO: 102562 - DNA, 25 bp, Mus musculus
gacaagagaggcaggcgtgaaatcc

SEQ ID NO: 102563 - DNA, 25 bp, Mus musculus
gacaagagccgcgaatatgaccagc

SEQ ID NO: 102564 - DNA, 25 bp, Mus musculus
gacaagagctgtagggaaaaccacc

SEQ ID NO: 102565 - DNA, 25 bp, Mus musculus
gacaagaggataggtcatggcaacc

SEQ ID NO: 102566 - DNA, 25 bp, Mus musculus
gacaagagtgtatagccctccagag

SEQ ID NO: 102567 - DNA, 25 bp, Mus musculus
gacaagatatggtgagcatcctcca

SEQ ID NO: 102568 - DNA, 25 bp, Mus musculus
gacaagatcacagactctagggcag

SEQ ID NO: 102569 - DNA, 25 bp, Mus musculus
gacaagatccaagacttttcaggca

SEQ ID NO: 102570 - DNA, 25 bp, Mus musculus
gacaagatgaagattccaccggagg

SEQ ID NO: 102571 - DNA, 25 bp, Mus musculus
gacaagatgatgaagactcctgcag

SEQ ID NO: 102572 - DNA, 25 bp, Mus musculus
gacaagatgcccttggccactggga

SEQ ID NO: 102573 - DNA, 25 bp, Mus musculus
gacaagatgggcaacagtgttaagg

SEQ ID NO: 102574 - DNA, 25 bp, Mus musculus
gacaagattccatccaatctgcgga

SEQ ID NO: 102575 - DNA, 25 bp, Mus musculus
gacaagattcccctatttatgaaaa

SEQ ID NO: 102576 - DNA, 25 bp, Mus musculus
gacaagcagatgagccgagatgagc

SEQ ID NO: 102577 - DNA, 25 bp, Mus musculus
gacaagcagcagaatgacgcagggc

SEQ ID NO: 102578 - DNA, 25 bp, Mus musculus
gacaagcagggcatctctaaacagg

SEQ ID NO: 102579 - DNA, 25 bp, Mus musculus
gacaagcatgcaggcctaaagggag

SEQ ID NO: 102580 - DNA, 25 bp, Mus musculus
gacaagcccgctgacagaaaggaag

SEQ ID NO: 102581 - DNA, 25 bp, Mus musculus
gacaagcccgttgctgttgagaaga

SEQ ID NO: 102582 - DNA, 25 bp, Mus musculus
gacaagcccttgaagacacaatgag

SEQ ID NO: 102583 - DNA, 25 bp, Mus musculus
gacaagccggataaccgctcttgag

SEQ ID NO: 102584 - DNA, 25 bp, Mus musculus
gacaagcctgtctccagtgtagcaa

SEQ ID NO: 102585 - DNA, 25 bp, Mus musculus
gacaagcgccccttcattgaggagg

SEQ ID NO: 102586 - DNA, 25 bp, Mus musculus
gacaagcgctttgagtgtgcccaat

SEQ ID NO: 102587 - DNA, 25 bp, Mus musculus
gacaagctaaaagagagacatcgag

SEQ ID NO: 102588 - DNA, 25 bp, Mus musculus
gacaagctagacaacgagaagaaag

SEQ ID NO: 102589 - DNA, 25 bp, Mus musculus
gacaagctatacaatctgagggacc

SEQ ID NO: 102590 - DNA, 25 bp, Mus musculus
gacaagctcaaaaccagaaatcgtg

SEQ ID NO: 102591 - DNA, 25 bp, Mus musculus
gacaagctcccaggctgtgttcgga

SEQ ID NO: 102592 - DNA, 25 bp, Mus musculus
gacaagctcttggtgtactactacg

SEQ ID NO: 102593 - DNA, 25 bp, Mus musculus
gacaagctgaccatcctgcgcatgg

SEQ ID NO: 102594 - DNA, 25 bp, Mus musculus
gacaagctgcagtcactcatggagc

SEQ ID NO: 102595 - DNA, 25 bp, Mus musculus
gacaagctggagtcaagcgaaggca

SEQ ID NO: 102596 - DNA, 25 bp, Mus musculus
gacaagctggcacagatacgtgacg

SEQ ID NO: 102597 - DNA, 25 bp, Mus musculus
gacaagctggttggttacatcacaa

SEQ ID NO: 102598 - DNA, 25 bp, Mus musculus
gacaagctgtacaacgaagcccgga

SEQ ID NO: 102599 - DNA, 25 bp, Mus musculus
gacaagctgtccatggtgatgtacc

SEQ ID NO: 102600 - DNA, 25 bp, Mus musculus
gacaagctgtccatttggtacgacg

SEQ ID NO: 102601 - DNA, 25 bp, Mus musculus
gacaagctgtgcatgattctgggaa

SEQ ID NO: 102602 - DNA, 25 bp, Mus musculus
gacaagcttctgtatttcaccgagg

SEQ ID NO: 102603 - DNA, 25 bp, Mus musculus
gacaaggacaagaatgtacgccaga

SEQ ID NO: 102604 - DNA, 25 bp, Mus musculus
gacaaggacatcaacatcgtgcagt

SEQ ID NO: 102605 - DNA, 25 bp, Mus musculus
gacaaggaccttgatgggcaactgg

SEQ ID NO: 102606 - DNA, 25 bp, Mus musculus
gacaaggagcgcttcatcagagaga

SEQ ID NO: 102607 - DNA, 25 bp, Mus musculus
gacaaggcagactccgttcttagga

SEQ ID NO: 102608 - DNA, 25 bp, Mus musculus
gacaaggcccaactagcagaaagca

SEQ ID NO: 102609 - DNA, 25 bp, Mus musculus
gacaaggcctagaagagctccagaa

SEQ ID NO: 102610 - DNA, 25 bp, Mus musculus
gacaaggctcgctctgtgctacact

SEQ ID NO: 102611 - DNA, 25 bp, Mus musculus
gacaagggacaaactggagctgagc

SEQ ID NO: 102612 - DNA, 25 bp, Mus musculus
gacaagggcaagatgcaattcctcc

SEQ ID NO: 102613 - DNA, 25 bp, Mus musculus
gacaagggcctagtcctgagagtcc

SEQ ID NO: 102614 - DNA, 25 bp, Mus musculus
gacaagggcgactccaaggaaacgc

SEQ ID NO: 102615 - DNA, 25 bp, Mus musculus
gacaagggcttgcttctactgctga

SEQ ID NO: 102616 - DNA, 25 bp, Mus musculus
gacaaggtacagaaaaaaggccgtg

SEQ ID NO: 102617 - DNA, 25 bp, Mus musculus
gacaaggtctgcgtattcagcacag

SEQ ID NO: 102618 - DNA, 25 bp, Mus musculus
gacaaggtgatatgtggcctgacac

SEQ ID NO: 102619 - DNA, 25 bp, Mus musculus
gacaaggttgaagcattcctggcca

SEQ ID NO: 102620 - DNA, 25 bp, Mus musculus
gacaaggtttctcctaccagggtcg

SEQ ID NO: 102621 - DNA, 25 bp, Mus musculus
gacaagtacatgcatgcaggttcca

SEQ ID NO: 102622 - DNA, 25 bp, Mus musculus
gacaagtacccaaagcgaaaggcca

SEQ ID NO: 102623 - DNA, 25 bp, Mus musculus
gacaagtactgtgtggcctacggcg

SEQ ID NO: 102624 - DNA, 25 bp, Mus musculus
gacaagtacttcatgatcggtggga

SEQ ID NO: 102625 - DNA, 25 bp, Mus musculus
gacaagtagtattcctgcagggctg

SEQ ID NO: 102626 - DNA, 25 bp, Mus musculus
gacaagtattacatggcttcccctg

SEQ ID NO: 102627 - DNA, 25 bp, Mus musculus
gacaagtccgtgagcatcatcataa

SEQ ID NO: 102628 - DNA, 25 bp, Mus musculus
gacaagtctgtaggatggctgatca

SEQ ID NO: 102629 - DNA, 25 bp, Mus musculus
gacaagtgacaccttagacgaagag

SEQ ID NO: 102630 - DNA, 25 bp, Mus musculus
gacaagtgcctcatagacctaggga

SEQ ID NO: 102631 - DNA, 25 bp, Mus musculus
gacaagtgccttggcaggtagtgca

SEQ ID NO: 102632 - DNA, 25 bp, Mus musculus
gacaagtgctaggaagcaatcccat

SEQ ID NO: 102633 - DNA, 25 bp, Mus musculus
gacaagtgggacttcatgcatccaa

SEQ ID NO: 102634 - DNA, 25 bp, Mus musculus
gacaagtgttctactatgccgaaga

SEQ ID NO: 102635 - DNA, 25 bp, Mus musculus
gacaagttcacacggttctgccagt

SEQ ID NO: 102636 - DNA, 25 bp, Mus musculus
gacaagttggccactgaatatatga

SEQ ID NO: 102637 - DNA, 25 bp, Mus musculus
gacaataagcttcagacggttgcca

SEQ ID NO: 102638 - DNA, 25 bp, Mus musculus
gacaatagaactggcttgaaggtct

SEQ ID NO: 102639 - DNA, 25 bp, Mus musculus
gacaatagtacccttgagcgaggac

SEQ ID NO: 102640 - DNA, 25 bp, Mus musculus
gacaatatgggctatgcggcttacc

SEQ ID NO: 102641 - DNA, 25 bp, Mus musculus
gacaatcaagtcagcatcatcgaga

SEQ ID NO: 102642 - DNA, 25 bp, Mus musculus
gacaatcattttcctctgcctgaag

SEQ ID NO: 102643 - DNA, 25 bp, Mus musculus
gacaatcccgctgaagactggtgga

SEQ ID NO: 102644 - DNA, 25 bp, Mus musculus
gacaatcctagcgactttatctggc

SEQ ID NO: 102645 - DNA, 25 bp, Mus musculus
gacaatccttgtcacgcggttggac

SEQ ID NO: 102646 - DNA, 25 bp, Mus musculus
gacaatcgtggacaattcctcggct

SEQ ID NO: 102647 - DNA, 25 bp, Mus musculus
gacaatctctgctgagtgcccaatg

SEQ ID NO: 102648 - DNA, 25 bp, Mus musculus
gacaatctctggtgggatgctttca

SEQ ID NO: 102649 - DNA, 25 bp, Mus musculus
gacaatctgcagaagcgggtcacag

SEQ ID NO: 102650 - DNA, 25 bp, Mus musculus
gacaatgacctgttccagcgagggt

SEQ ID NO: 102651 - DNA, 25 bp, Mus musculus
gacaatgactcctcgcaactgatga

SEQ ID NO: 102652 - DNA, 25 bp, Mus musculus
gacaatgatggctggaggtcgccct

SEQ ID NO: 102653 - DNA, 25 bp, Mus musculus
gacaatgattggtccttagccccga

SEQ ID NO: 102654 - DNA, 25 bp, Mus musculus
gacaatgcagttcatcagccaccga

SEQ ID NO: 102655 - DNA, 25 bp, Mus musculus
gacaatgccaccacatcagactggg

SEQ ID NO: 102656 - DNA, 25 bp, Mus musculus
gacaatgccttagcctggatcttcc

SEQ ID NO: 102657 - DNA, 25 bp, Mus musculus
gacaatgcgggctatgacagtgcag

SEQ ID NO: 102658 - DNA, 25 bp, Mus musculus
gacaatgcgttggtgctagatgccc

SEQ ID NO: 102659 - DNA, 25 bp, Mus musculus
gacaatgctctggaagacctcatgg

SEQ ID NO: 102660 - DNA, 25 bp, Mus musculus
gacaatgcttccaagtggtcaccac

SEQ ID NO: 102661 - DNA, 25 bp, Mus musculus
gacaatggacaagaagttcggctcc

SEQ ID NO: 102662 - DNA, 25 bp, Mus musculus
gacaatggcaagtcccaggtctcct

SEQ ID NO: 102663 - DNA, 25 bp, Mus musculus
gacaatggccttggcaagtcagcct

SEQ ID NO: 102664 - DNA, 25 bp, Mus musculus
gacaatggctaataggattcccacg

SEQ ID NO: 102665 - DNA, 25 bp, Mus musculus
gacaatgggaacatgtaaggccgca

SEQ ID NO: 102666 - DNA, 25 bp, Mus musculus
gacaatgggacacaagatgacagtc

SEQ ID NO: 102667 - DNA, 25 bp, Mus musculus
gacaatggtgccgacgactggcgta

SEQ ID NO: 102668 - DNA, 25 bp, Mus musculus
gacaatggtggctactacatcacga

SEQ ID NO: 102669 - DNA, 25 bp, Mus musculus
gacaatgtaggattgcactgcacct

SEQ ID NO: 102670 - DNA, 25 bp, Mus musculus
gacaatgtcattgtcccgggaaccc

SEQ ID NO: 102671 - DNA, 25 bp, Mus musculus
gacaatgtgacggaatcttcagtga

SEQ ID NO: 102672 - DNA, 25 bp, Mus musculus
gacaatgtgctgtaccagggcctgg

SEQ ID NO: 102673 - DNA, 25 bp, Mus musculus
gacaatgtggatcgctgttttgaaa

SEQ ID NO: 102674 - DNA, 25 bp, Mus musculus
gacaatgtggcaaatatcctggcga

SEQ ID NO: 102675 - DNA, 25 bp, Mus musculus
gacaatgttgatgcagcgttcgccc

SEQ ID NO: 102676 - DNA, 25 bp, Mus musculus
gacaattaccggtgctgtgtcagca

SEQ ID NO: 102677 - DNA, 25 bp, Mus musculus
gacaattcaaacagcggcatgccag

SEQ ID NO: 102678 - DNA, 25 bp, Mus musculus
gacaattccttcagcagatcgcgga

SEQ ID NO: 102679 - DNA, 25 bp, Mus musculus
gacaattgaccttcgtccagcagtg

SEQ ID NO: 102680 - DNA, 25 bp, Mus musculus
gacaattgctggaatgactttcacc

SEQ ID NO: 102681 - DNA, 25 bp, Mus musculus
gacaattggctcagtctgggtcact

SEQ ID NO: 102682 - DNA, 25 bp, Mus musculus
gacaattgggtctagcaggatgctt

SEQ ID NO: 102683 - DNA, 25 bp, Mus musculus
gacacaaaggtcttgaaggccccaa

SEQ ID NO: 102684 - DNA, 25 bp, Mus musculus
gacacaaccttcactaacagcagag

SEQ ID NO: 102685 - DNA, 25 bp, Mus musculus
gacacaagggaagctgacttgcaca

SEQ ID NO: 102686 - DNA, 25 bp, Mus musculus
gacacaaggtgctctccaaagaagg

SEQ ID NO: 102687 - DNA, 25 bp, Mus musculus
gacacaattctcatctgggacttcc

SEQ ID NO: 102688 - DNA, 25 bp, Mus musculus
gacacaattgtacgcctgcatcagc

SEQ ID NO: 102689 - DNA, 25 bp, Mus musculus
gacacacactggatggtgctgcatg

SEQ ID NO: 102690 - DNA, 25 bp, Mus musculus
gacacacaggatctataagcagaag

SEQ ID NO: 102691 - DNA, 25 bp, Mus musculus
gacacacagtggacagtgcggacct

SEQ ID NO: 102692 - DNA, 25 bp, Mus musculus
gacacacccaaagatagagctctgt

SEQ ID NO: 102693 - DNA, 25 bp, Mus musculus
gacacacccgcagaaataaagacag

SEQ ID NO: 102694 - DNA, 25 bp, Mus musculus
gacacaccctgaccgtgttggagca

SEQ ID NO: 102695 - DNA, 25 bp, Mus musculus
gacacacgaattatctctcaggcag

SEQ ID NO: 102696 - DNA, 25 bp, Mus musculus
gacacacggcaaatcttgagctaga

SEQ ID NO: 102697 - DNA, 25 bp, Mus musculus
gacacacgggctctagtggctgact

SEQ ID NO: 102698 - DNA, 25 bp, Mus musculus
gacacacgttatgcggtttttccat

SEQ ID NO: 102699 - DNA, 25 bp, Mus musculus
gacacactgtctgggtatggcgatg

SEQ ID NO: 102700 - DNA, 25 bp, Mus musculus
gacacagaaagttcaaacacgccag

SEQ ID NO: 102701 - DNA, 25 bp, Mus musculus
gacacagaacaaggatataaaccag

SEQ ID NO: 102702 - DNA, 25 bp, Mus musculus
gacacagacgcgctcatctgctgga

SEQ ID NO: 102703 - DNA, 25 bp, Mus musculus
gacacagactctggcatcctgggaa

SEQ ID NO: 102704 - DNA, 25 bp, Mus musculus
gacacagagataagcggctcagttt

SEQ ID NO: 102705 - DNA, 25 bp, Mus musculus
gacacagagatttttgaagcccaag

SEQ ID NO: 102706 - DNA, 25 bp, Mus musculus
gacacagagcagttagcgccacggg

SEQ ID NO: 102707 - DNA, 25 bp, Mus musculus
gacacagagcgctactggaaagagc

SEQ ID NO: 102708 - DNA, 25 bp, Mus musculus
gacacagaggaaagccacgacagta

SEQ ID NO: 102709 - DNA, 25 bp, Mus musculus
gacacagaggaccagaaccgttact

SEQ ID NO: 102710 - DNA, 25 bp, Mus musculus
gacacagcactgttgtggatccttg

SEQ ID NO: 102711 - DNA, 25 bp, Mus musculus
gacacagcagctatcgagaacagaa

SEQ ID NO: 102712 - DNA, 25 bp, Mus musculus
gacacagcagttgggtattcaggaa

SEQ ID NO: 102713 - DNA, 25 bp, Mus musculus
gacacagccatttgacgtcgccgag

SEQ ID NO: 102714 - DNA, 25 bp, Mus musculus
gacacagccccagaagtaggacagt

SEQ ID NO: 102715 - DNA, 25 bp, Mus musculus
gacacagcccggaagtttgttaaag

SEQ ID NO: 102716 - DNA, 25 bp, Mus musculus
gacacagctactctcgtgccaaagt

SEQ ID NO: 102717 - DNA, 25 bp, Mus musculus
gacacagctgcccacgaagattatg

SEQ ID NO: 102718 - DNA, 25 bp, Mus musculus
gacacagcttttcattgcaggcagg

SEQ ID NO: 102719 - DNA, 25 bp, Mus musculus
gacacaggagggtagtaaaggcacc

SEQ ID NO: 102720 - DNA, 25 bp, Mus musculus
gacacaggccctttccttcaggaag

SEQ ID NO: 102721 - DNA, 25 bp, Mus musculus
gacacaggcgctcacgagtttctcc

SEQ ID NO: 102722 - DNA, 25 bp, Mus musculus
gacacagggacaatacctcctgaaa

SEQ ID NO: 102723 - DNA, 25 bp, Mus musculus
gacacagggagtctgaaggctctaa

SEQ ID NO: 102724 - DNA, 25 bp, Mus musculus
gacacagggtcacgacaaacaccct

SEQ ID NO: 102725 - DNA, 25 bp, Mus musculus
gacacaggtatttgtgccacaacag

SEQ ID NO: 102726 - DNA, 25 bp, Mus musculus
gacacaggttacagcgcctggcaca

SEQ ID NO: 102727 - DNA, 25 bp, Mus musculus
gacacagtatgcatcaaaagcagag

SEQ ID NO: 102728 - DNA, 25 bp, Mus musculus
gacacagtccagatacggctgaagg

SEQ ID NO: 102729 - DNA, 25 bp, Mus musculus
gacacagtgaaccattccagagagg

SEQ ID NO: 102730 - DNA, 25 bp, Mus musculus
gacacagtgagtgatgcggacctcc

SEQ ID NO: 102731 - DNA, 25 bp, Mus musculus
gacacagtgatctgacctgtcccag

SEQ ID NO: 102732 - DNA, 25 bp, Mus musculus
gacacagtgcaatcgagacgtcccg

SEQ ID NO: 102733 - DNA, 25 bp, Mus musculus
gacacagtgctgtttgggcctcctc

SEQ ID NO: 102734 - DNA, 25 bp, Mus musculus
gacacagtggaaagtgtgacacgtg

SEQ ID NO: 102735 - DNA, 25 bp, Mus musculus
gacacagtgttcagccataggctaa

SEQ ID NO: 102736 - DNA, 25 bp, Mus musculus
gacacatagtctaagcaacggccct

SEQ ID NO: 102737 - DNA, 25 bp, Mus musculus
gacacatagttcttctcatcgtgaa

SEQ ID NO: 102738 - DNA, 25 bp, Mus musculus
gacacatatcctgtgaggcctcgaa

SEQ ID NO: 102739 - DNA, 25 bp, Mus musculus
gacacatcccttgtgaggaagtcaa

SEQ ID NO: 102740 - DNA, 25 bp, Mus musculus
gacacatccttcatgttccagcgag

SEQ ID NO: 102741 - DNA, 25 bp, Mus musculus
gacacatctagggtgagggagttat

SEQ ID NO: 102742 - DNA, 25 bp, Mus musculus
gacacatgaggatgcacacaggaga

SEQ ID NO: 102743 - DNA, 25 bp, Mus musculus
gacacatgtatatcgtccggacacc

SEQ ID NO: 102744 - DNA, 25 bp, Mus musculus
gacacatgtctgagagtccaaacag

SEQ ID NO: 102745 - DNA, 25 bp, Mus musculus
gacacatgtggagaaacatcttcag

SEQ ID NO: 102746 - DNA, 25 bp, Mus musculus
gacacattatctaaggtttcccggg

SEQ ID NO: 102747 - DNA, 25 bp, Mus musculus
gacacattattgatctgggctagag

SEQ ID NO: 102748 - DNA, 25 bp, Mus musculus
gacacattgctggtacgcagctgga

SEQ ID NO: 102749 - DNA, 25 bp, Mus musculus
gacacattttcgaatccaggcagcc

SEQ ID NO: 102750 - DNA, 25 bp, Mus musculus
gacaccaaaccatctgaggctcgct

SEQ ID NO: 102751 - DNA, 25 bp, Mus musculus
gacaccaagactacgaagacattct

SEQ ID NO: 102752 - DNA, 25 bp, Mus musculus
gacaccaaggagatctacacgcact

SEQ ID NO: 102753 - DNA, 25 bp, Mus musculus
gacaccaaggccctgaactgcagtg

SEQ ID NO: 102754 - DNA, 25 bp, Mus musculus
gacaccagcagcttaatagacccag

SEQ ID NO: 102755 - DNA, 25 bp, Mus musculus
gacaccagccaaagaggaggatgct

SEQ ID NO: 102756 - DNA, 25 bp, Mus musculus
gacaccagtcttgggattcctctga

SEQ ID NO: 102757 - DNA, 25 bp, Mus musculus
gacaccatcagcaagttccggagga

SEQ ID NO: 102758 - DNA, 25 bp, Mus musculus
gacaccatgaccaaatgtgccgagc

SEQ ID NO: 102759 - DNA, 25 bp, Mus musculus
gacaccatgcagctgaccgtgaagg

SEQ ID NO: 102760 - DNA, 25 bp, Mus musculus
gacaccatgccggagggcgaaggtg

SEQ ID NO: 102761 - DNA, 25 bp, Mus musculus
gacaccatggaactcttcatcgaaa

SEQ ID NO: 102762 - DNA, 25 bp, Mus musculus
gacaccatgtagtagagccggctgc

SEQ ID NO: 102763 - DNA, 25 bp, Mus musculus
gacaccattacaaagaaagccggac

SEQ ID NO: 102764 - DNA, 25 bp, Mus musculus
gacaccattatcgagcagatgcgca

SEQ ID NO: 102765 - DNA, 25 bp, Mus musculus
gacacccagtgagtccaggaagaag

SEQ ID NO: 102766 - DNA, 25 bp, Mus musculus
gacaccccgatctacagccaggtgg

SEQ ID NO: 102767 - DNA, 25 bp, Mus musculus
gacaccccggactctgctaaggaat

SEQ ID NO: 102768 - DNA, 25 bp, Mus musculus
gacacccctaacaaaatggaagact

SEQ ID NO: 102769 - DNA, 25 bp, Mus musculus
gacacccgactatgtgacactctga

SEQ ID NO: 102770 - DNA, 25 bp, Mus musculus
gacacccgatctttctcaagctgag

SEQ ID NO: 102771 - DNA, 25 bp, Mus musculus
gacaccctggccagaatggagctga

SEQ ID NO: 102772 - DNA, 25 bp, Mus musculus
gacacccttatatgcaggacagcga

SEQ ID NO: 102773 - DNA, 25 bp, Mus musculus
gacaccgaatgcagaagaatcttgg

SEQ ID NO: 102774 - DNA, 25 bp, Mus musculus
gacaccgagtggaatgacatcctac

SEQ ID NO: 102775 - DNA, 25 bp, Mus musculus
gacaccgagtttccaggcgttgttg

SEQ ID NO: 102776 - DNA, 25 bp, Mus musculus
gacaccgccgtgttcaaggatgcta

SEQ ID NO: 102777 - DNA, 25 bp, Mus musculus
gacaccggaacgtttagaatctatg

SEQ ID NO: 102778 - DNA, 25 bp, Mus musculus
gacaccggcaggaatatacgagaaa

SEQ ID NO: 102779 - DNA, 25 bp, Mus musculus
gacaccggtggtcatcgattacaca

SEQ ID NO: 102780 - DNA, 25 bp, Mus musculus
gacaccgtatcagctcaatgtggac

SEQ ID NO: 102781 - DNA, 25 bp, Mus musculus
gacaccgtggaggaagctttctaca

SEQ ID NO: 102782 - DNA, 25 bp, Mus musculus
gacacctacgttgctgtgaggacca

SEQ ID NO: 102783 - DNA, 25 bp, Mus musculus
gacacctatatcaacattagagagg

SEQ ID NO: 102784 - DNA, 25 bp, Mus musculus
gacacctatggagcttgctatgata

SEQ ID NO: 102785 - DNA, 25 bp, Mus musculus
gacacctccgtttgtggacgctgga

SEQ ID NO: 102786 - DNA, 25 bp, Mus musculus
gacacctgagggtagagtcctttcg

SEQ ID NO: 102787 - DNA, 25 bp, Mus musculus
gacacctgcagcattcttgggcaag

SEQ ID NO: 102788 - DNA, 25 bp, Mus musculus
gacacctgcgtcatgcagcttggga

SEQ ID NO: 102789 - DNA, 25 bp, Mus musculus
gacacctgggcttctgaagttgctc

SEQ ID NO: 102790 - DNA, 25 bp, Mus musculus
gacacctggtttctgatggcatatg

SEQ ID NO: 102791 - DNA, 25 bp, Mus musculus
gacacctgtaactcaaagaacctga

SEQ ID NO: 102792 - DNA, 25 bp, Mus musculus
gacaccttcagagaaattgttggct

SEQ ID NO: 102793 - DNA, 25 bp, Mus musculus
gacaccttgtcgtcgctgtcgggat

SEQ ID NO: 102794 - DNA, 25 bp, Mus musculus
gacaccttgttgtccgtgccgggag

SEQ ID NO: 102795 - DNA, 25 bp, Mus musculus
gacacctttacaggatcagcagcgg

SEQ ID NO: 102796 - DNA, 25 bp, Mus musculus
gacacctttcactgtgcccggctgg

SEQ ID NO: 102797 - DNA, 25 bp, Mus musculus
gacacgaaggtctgcacatctctca

SEQ ID NO: 102798 - DNA, 25 bp, Mus musculus
gacacgacccttgagtgacagttct

SEQ ID NO: 102799 - DNA, 25 bp, Mus musculus
gacacgcacattgtcagggatggca

SEQ ID NO: 102800 - DNA, 25 bp, Mus musculus
gacacgccagtttggactcttgcgc

SEQ ID NO: 102801 - DNA, 25 bp, Mus musculus
gacacgctagctaggagtcggcagc

SEQ ID NO: 102802 - DNA, 25 bp, Mus musculus
gacacgctcaagatcccatacaagt

SEQ ID NO: 102803 - DNA, 25 bp, Mus musculus
gacacgctcagcaaagatggcttta

SEQ ID NO: 102804 - DNA, 25 bp, Mus musculus
gacacgctcagctatcagatacaat

SEQ ID NO: 102805 - DNA, 25 bp, Mus musculus
gacacgctggaggacatttacaacc

SEQ ID NO: 102806 - DNA, 25 bp, Mus musculus
gacacgctgtcaacggaagaacgga

SEQ ID NO: 102807 - DNA, 25 bp, Mus musculus
gacacgctgtgcttcgataaggacg

SEQ ID NO: 102808 - DNA, 25 bp, Mus musculus
gacacggaacagataagaacggatt

SEQ ID NO: 102809 - DNA, 25 bp, Mus musculus
gacacggaagcctgaaaaagctcgc

SEQ ID NO: 102810 - DNA, 25 bp, Mus musculus
gacacggacgaggttgagattgcca

SEQ ID NO: 102811 - DNA, 25 bp, Mus musculus
gacacggagtgcttgaatgttcagt

SEQ ID NO: 102812 - DNA, 25 bp, Mus musculus
gacacggataaagagcggacattgc

SEQ ID NO: 102813 - DNA, 25 bp, Mus musculus
gacacggatgtccttgggcactaaa

SEQ ID NO: 102814 - DNA, 25 bp, Mus musculus
gacacggcaggcctcagatcgaaaa

SEQ ID NO: 102815 - DNA, 25 bp, Mus musculus
gacacggcctgctttccggagggat

SEQ ID NO: 102816 - DNA, 25 bp, Mus musculus
gacacggctgtgatccaaggagaca

SEQ ID NO: 102817 - DNA, 25 bp, Mus musculus
gacacgggaacattggtacctcaca

SEQ ID NO: 102818 - DNA, 25 bp, Mus musculus
gacacgggtcgacacaatattggag

SEQ ID NO: 102819 - DNA, 25 bp, Mus musculus
gacacggtacgagtcaaggctctct

SEQ ID NO: 102820 - DNA, 25 bp, Mus musculus
gacacggtgaaaccccatctgaagt

SEQ ID NO: 102821 - DNA, 25 bp, Mus musculus
gacacggtgctcaagatcacagact

SEQ ID NO: 102822 - DNA, 25 bp, Mus musculus
gacacggtggccacaatgatctcct

SEQ ID NO: 102823 - DNA, 25 bp, Mus musculus
gacacggtgtcccagctagattcgg

SEQ ID NO: 102824 - DNA, 25 bp, Mus musculus
gacacggttgttcctcactcaagac

SEQ ID NO: 102825 - DNA, 25 bp, Mus musculus
gacacgtacctgctcatcagtgaag

SEQ ID NO: 102826 - DNA, 25 bp, Mus musculus
gacacgtcagtggagcttgaggccc

SEQ ID NO: 102827 - DNA, 25 bp, Mus musculus
gacacgtctgaagaggatagcagcc

SEQ ID NO: 102828 - DNA, 25 bp, Mus musculus
gacacgtgatctggaaccggctgtg

SEQ ID NO: 102829 - DNA, 25 bp, Mus musculus
gacacgtgccaggactaaccatgga

SEQ ID NO: 102830 - DNA, 25 bp, Mus musculus
gacacgtggagcaagaaggacaacc

SEQ ID NO: 102831 - DNA, 25 bp, Mus musculus
gacacgtgtcgtggcctttatcaaa

SEQ ID NO: 102832 - DNA, 25 bp, Mus musculus
gacacgtttatccagaggatcacca

SEQ ID NO: 102833 - DNA, 25 bp, Mus musculus
gacactacatgtgatctgcctggtg

SEQ ID NO: 102834 - DNA, 25 bp, Mus musculus
gacactaccttatggctacgccgga

SEQ ID NO: 102835 - DNA, 25 bp, Mus musculus
gacactaccttcgaatgtgggctaa

SEQ ID NO: 102836 - DNA, 25 bp, Mus musculus
gacactagaaaagcttggctttccc

SEQ ID NO: 102837 - DNA, 25 bp, Mus musculus
gacactagtgctgacggttgacctc

SEQ ID NO: 102838 - DNA, 25 bp, Mus musculus
gacactatacattgcacccctgagg

SEQ ID NO: 102839 - DNA, 25 bp, Mus musculus
gacactatgtccaaaggaattcagc

SEQ ID NO: 102840 - DNA, 25 bp, Mus musculus
gacactcatgcgtctacagggagga

SEQ ID NO: 102841 - DNA, 25 bp, Mus musculus
gacactcgaattcagatgggcatgc

SEQ ID NO: 102842 - DNA, 25 bp, Mus musculus
gacactcgcaatgtagcctttgaga

SEQ ID NO: 102843 - DNA, 25 bp, Mus musculus
gacactcgcagaagacaatatggcc

SEQ ID NO: 102844 - DNA, 25 bp, Mus musculus
gacactcgggtgacgtgatgagcct

SEQ ID NO: 102845 - DNA, 25 bp, Mus musculus
gacactctccgacttgatggcctag

SEQ ID NO: 102846 - DNA, 25 bp, Mus musculus
gacactctcgaggatattgcaaact

SEQ ID NO: 102847 - DNA, 25 bp, Mus musculus
gacactctgaagtacatcctggagc

SEQ ID NO: 102848 - DNA, 25 bp, Mus musculus
gacactgaaatttggcccagcccga

SEQ ID NO: 102849 - DNA, 25 bp, Mus musculus
gacactgaagcaagataaccatggg

SEQ ID NO: 102850 - DNA, 25 bp, Mus musculus
gacactgaagtcactgctggcccat

SEQ ID NO: 102851 - DNA, 25 bp, Mus musculus
gacactgaagtgacatggttggcag

SEQ ID NO: 102852 - DNA, 25 bp, Mus musculus
gacactgaccactgaggaccagtca

SEQ ID NO: 102853 - DNA, 25 bp, Mus musculus
gacactgatcctggtcctggctgga

SEQ ID NO: 102854 - DNA, 25 bp, Mus musculus
gacactgatgggtctgaggagcaca

SEQ ID NO: 102855 - DNA, 25 bp, Mus musculus
gacactgcaacaccctcagggtata

SEQ ID NO: 102856 - DNA, 25 bp, Mus musculus
gacactgcaccgcaaagtgcccagt

SEQ ID NO: 102857 - DNA, 25 bp, Mus musculus
gacactgccacagcaacagaacagg

SEQ ID NO: 102858 - DNA, 25 bp, Mus musculus
gacactgccccgtgtgcagagttat

SEQ ID NO: 102859 - DNA, 25 bp, Mus musculus
gacactggattatcaggcccggagg

SEQ ID NO: 102860 - DNA, 25 bp, Mus musculus
gacactggcaggttacccaacttga

SEQ ID NO: 102861 - DNA, 25 bp, Mus musculus
gacactggccaagatgagagcgcac

SEQ ID NO: 102862 - DNA, 25 bp, Mus musculus
gacactggccaagctaaccaaggag

SEQ ID NO: 102863 - DNA, 25 bp, Mus musculus
gacactggctgatctgcaactggag

SEQ ID NO: 102864 - DNA, 25 bp, Mus musculus
gacactgggcaccatttggtccaaa

SEQ ID NO: 102865 - DNA, 25 bp, Mus musculus
gacactgggcatgcaagttcgctac

SEQ ID NO: 102866 - DNA, 25 bp, Mus musculus
gacactggtctctacggttggaagc

SEQ ID NO: 102867 - DNA, 25 bp, Mus musculus
gacactggtgtagatggtcattttt

SEQ ID NO: 102868 - DNA, 25 bp, Mus musculus
gacactggtgtctgcgagagctgct

SEQ ID NO: 102869 - DNA, 25 bp, Mus musculus
gacactgtaccagatgcataatgct

SEQ ID NO: 102870 - DNA, 25 bp, Mus musculus
gacactgtactgacttcggctgagg

SEQ ID NO: 102871 - DNA, 25 bp, Mus musculus
gacactgtctatctctgctctgttg

SEQ ID NO: 102872 - DNA, 25 bp, Mus musculus
gacactgtgaagaacctctgggagc

SEQ ID NO: 102873 - DNA, 25 bp, Mus musculus
gacactgtgcaccagctgtgctatg

SEQ ID NO: 102874 - DNA, 25 bp, Mus musculus
gacactgtttcgacctgagcaggag

SEQ ID NO: 102875 - DNA, 25 bp, Mus musculus
gacacttacgctgtggtgcagaagc

SEQ ID NO: 102876 - DNA, 25 bp, Mus musculus
gacacttcagggatgcttccaactg

SEQ ID NO: 102877 - DNA, 25 bp, Mus musculus
gacacttcccttttttgctagccaa

SEQ ID NO: 102878 - DNA, 25 bp, Mus musculus
gacacttcggtggtcctgacagaga

SEQ ID NO: 102879 - DNA, 25 bp, Mus musculus
gacacttcttcaaggctaccagcag

SEQ ID NO: 102880 - DNA, 25 bp, Mus musculus
gacacttgatcgttgggagtcagcc

SEQ ID NO: 102881 - DNA, 25 bp, Mus musculus
gacacttgctaccagtccatgaggg

SEQ ID NO: 102882 - DNA, 25 bp, Mus musculus
gacacttgctggcatggtctcctcg

SEQ ID NO: 102883 - DNA, 25 bp, Mus musculus
gacacttggaaaatgtgcaccctga

SEQ ID NO: 102884 - DNA, 25 bp, Mus musculus
gacactttaggctttccacgctaca

SEQ ID NO: 102885 - DNA, 25 bp, Mus musculus
gacactttccgggtggagttcctcg

SEQ ID NO: 102886 - DNA, 25 bp, Mus musculus
gacactttgaagagctgagacccac

SEQ ID NO: 102887 - DNA, 25 bp, Mus musculus
gacactttgcacttagaagcctagg

SEQ ID NO: 102888 - DNA, 25 bp, Mus musculus
gacactttgccccattgagacattg

SEQ ID NO: 102889 - DNA, 25 bp, Mus musculus
gacactttgggacacagaggactta

SEQ ID NO: 102890 - DNA, 25 bp, Mus musculus
gacagaaactcttccgtggtcggcc

SEQ ID NO: 102891 - DNA, 25 bp, Mus musculus
gacagaaatgaagcaagaagcccca

SEQ ID NO: 102892 - DNA, 25 bp, Mus musculus
gacagaaccaagagtaaagagccgc

SEQ ID NO: 102893 - DNA, 25 bp, Mus musculus
gacagaactacggagagtgcaccct

SEQ ID NO: 102894 - DNA, 25 bp, Mus musculus
gacagaactcaggtcgtccgtgttt

SEQ ID NO: 102895 - DNA, 25 bp, Mus musculus
gacagaactgggagaatattcccta

SEQ ID NO: 102896 - DNA, 25 bp, Mus musculus
gacagaagagtttcacagaacagcc

SEQ ID NO: 102897 - DNA, 25 bp, Mus musculus
gacagaagatgacgttgccctacac

SEQ ID NO: 102898 - DNA, 25 bp, Mus musculus
gacagaagcccgatcgtcagatgag

SEQ ID NO: 102899 - DNA, 25 bp, Mus musculus
gacagaagcggaagtatcccctgga

SEQ ID NO: 102900 - DNA, 25 bp, Mus musculus
gacagaagctctgcggtcgttcaac

SEQ ID NO: 102901 - DNA, 25 bp, Mus musculus
gacagaaggtcaatgccagctggct

SEQ ID NO: 102902 - DNA, 25 bp, Mus musculus
gacagaagtgctgaattacacgacc

SEQ ID NO: 102903 - DNA, 25 bp, Mus musculus
gacagaagtttgtgccggaagccct

SEQ ID NO: 102904 - DNA, 25 bp, Mus musculus
gacagaatcagcgaggtcctcacta

SEQ ID NO: 102905 - DNA, 25 bp, Mus musculus
gacagaatcatcagagggaaccagc

SEQ ID NO: 102906 - DNA, 25 bp, Mus musculus
gacagaatcgcatctgtggatttct

SEQ ID NO: 102907 - DNA, 25 bp, Mus musculus
gacagaatctgtgaatgagcccata

SEQ ID NO: 102908 - DNA, 25 bp, Mus musculus
gacagaattttccacccaggaagat

SEQ ID NO: 102909 - DNA, 25 bp, Mus musculus
gacagacaatgctcaggcttcagtg

SEQ ID NO: 102910 - DNA, 25 bp, Mus musculus
gacagacactttgtggccatgggct

SEQ ID NO: 102911 - DNA, 25 bp, Mus musculus
gacagaccacgccttcaagaaggag

SEQ ID NO: 102912 - DNA, 25 bp, Mus musculus
gacagaccagttcctgagggatgca

SEQ ID NO: 102913 - DNA, 25 bp, Mus musculus
gacagacccggacatcataatcagt

SEQ ID NO: 102914 - DNA, 25 bp, Mus musculus
gacagaccctttctgtgcctgggag

SEQ ID NO: 102915 - DNA, 25 bp, Mus musculus
gacagacgaagagattgacctggct

SEQ ID NO: 102916 - DNA, 25 bp, Mus musculus
gacagacgacgggaatatcagttat

SEQ ID NO: 102917 - DNA, 25 bp, Mus musculus
gacagacggctgtaagaactgcaca

SEQ ID NO: 102918 - DNA, 25 bp, Mus musculus
gacagacgtcagaacacatacatta

SEQ ID NO: 102919 - DNA, 25 bp, Mus musculus
gacagactaggccagcacgtaccaa

SEQ ID NO: 102920 - DNA, 25 bp, Mus musculus
gacagactctcgagcctgccagtat

SEQ ID NO: 102921 - DNA, 25 bp, Mus musculus
gacagactctctgggagcttctcag

SEQ ID NO: 102922 - DNA, 25 bp, Mus musculus
gacagactgctcgacatgggctttg

SEQ ID NO: 102923 - DNA, 25 bp, Mus musculus
gacagacttagaacccctggaggga

SEQ ID NO: 102924 - DNA, 25 bp, Mus musculus
gacagagaatacactgaggagcctg

SEQ ID NO: 102925 - DNA, 25 bp, Mus musculus
gacagagaccatcaaagcagtgcca

SEQ ID NO: 102926 - DNA, 25 bp, Mus musculus
gacagagacgactggcaagaccagg

SEQ ID NO: 102927 - DNA, 25 bp, Mus musculus
gacagagaggccaaactgaggaaga

SEQ ID NO: 102928 - DNA, 25 bp, Mus musculus
gacagagcaaacttcaacaatgaga

SEQ ID NO: 102929 - DNA, 25 bp, Mus musculus
gacagagcactcatcaacagcatgg

SEQ ID NO: 102930 - DNA, 25 bp, Mus musculus
gacagagccagaataacagccggaa

SEQ ID NO: 102931 - DNA, 25 bp, Mus musculus
gacagagccttaccttacagaaaac

SEQ ID NO: 102932 - DNA, 25 bp, Mus musculus
gacagagcgtgttccccagtttaaa

SEQ ID NO: 102933 - DNA, 25 bp, Mus musculus
gacagagctgacttctaggacaccc

SEQ ID NO: 102934 - DNA, 25 bp, Mus musculus
gacagaggacacaacggatgctcca

SEQ ID NO: 102935 - DNA, 25 bp, Mus musculus
gacagaggaccaatgcacagaagta

SEQ ID NO: 102936 - DNA, 25 bp, Mus musculus
gacagaggacgctgctaaggatcct

SEQ ID NO: 102937 - DNA, 25 bp, Mus musculus
gacagaggatcaagcctagccagga

SEQ ID NO: 102938 - DNA, 25 bp, Mus musculus
gacagagggcttactggacaaactg

SEQ ID NO: 102939 - DNA, 25 bp, Mus musculus
gacagagtcattgaaaacccacagg

SEQ ID NO: 102940 - DNA, 25 bp, Mus musculus
gacagagtcgacagcttcaacgagg

SEQ ID NO: 102941 - DNA, 25 bp, Mus musculus
gacagagtcgatgagaacaacccag

SEQ ID NO: 102942 - DNA, 25 bp, Mus musculus
gacagagtcgtaactggcaaaccca

SEQ ID NO: 102943 - DNA, 25 bp, Mus musculus
gacagagtgccgactttatgccccg

SEQ ID NO: 102944 - DNA, 25 bp, Mus musculus
gacagagttcctgcggacttacgct

SEQ ID NO: 102945 - DNA, 25 bp, Mus musculus
gacagagttgttgttccggcacggc

SEQ ID NO: 102946 - DNA, 25 bp, Mus musculus
gacagagttttcttcattaaggcaa

SEQ ID NO: 102947 - DNA, 25 bp, Mus musculus
gacagataagctcttccccgtcgtg

SEQ ID NO: 102948 - DNA, 25 bp, Mus musculus
gacagatacagcgacaatgatgaag

SEQ ID NO: 102949 - DNA, 25 bp, Mus musculus
gacagataccggctagacgatggcc

SEQ ID NO: 102950 - DNA, 25 bp, Mus musculus
gacagatagagtctggtcaccagca

SEQ ID NO: 102951 - DNA, 25 bp, Mus musculus
gacagatatttacaaaggcaagccc

SEQ ID NO: 102952 - DNA, 25 bp, Mus musculus
gacagatcaggaaggagatcaactc

SEQ ID NO: 102953 - DNA, 25 bp, Mus musculus
gacagatcgttacgaccagaggaga

SEQ ID NO: 102954 - DNA, 25 bp, Mus musculus
gacagatctagaagtggttttggcc

SEQ ID NO: 102955 - DNA, 25 bp, Mus musculus
gacagatctccgctcacttcatggg

SEQ ID NO: 102956 - DNA, 25 bp, Mus musculus
gacagatctgccactgaagtagaca

SEQ ID NO: 102957 - DNA, 25 bp, Mus musculus
gacagatctggagcaagtacctaag

SEQ ID NO: 102958 - DNA, 25 bp, Mus musculus
gacagatctggatgttatacgagaa

SEQ ID NO: 102959 - DNA, 25 bp, Mus musculus
gacagatctggtcgcctggtgatcc

SEQ ID NO: 102960 - DNA, 25 bp, Mus musculus
gacagatcttcgaacagacctgagc

SEQ ID NO: 102961 - DNA, 25 bp, Mus musculus
gacagatgacaatgttccttcccct

SEQ ID NO: 102962 - DNA, 25 bp, Mus musculus
gacagatgcatgtctccagcgtgga

SEQ ID NO: 102963 - DNA, 25 bp, Mus musculus
gacagatggcgtcaccattggagac

SEQ ID NO: 102964 - DNA, 25 bp, Mus musculus
gacagatgtctgtcatggaaggaga

SEQ ID NO: 102965 - DNA, 25 bp, Mus musculus
gacagatgtgaccaagaccttcgca

SEQ ID NO: 102966 - DNA, 25 bp, Mus musculus
gacagatgttccttaagaccggcaa

SEQ ID NO: 102967 - DNA, 25 bp, Mus musculus
gacagattagccatcgcagggacct

SEQ ID NO: 102968 - DNA, 25 bp, Mus musculus
gacagattcagtgatcaagcacctg

SEQ ID NO: 102969 - DNA, 25 bp, Mus musculus
gacagattcggattctccagagcag

SEQ ID NO: 102970 - DNA, 25 bp, Mus musculus
gacagattctcagctaccgtggatg

SEQ ID NO: 102971 - DNA, 25 bp, Mus musculus
gacagattgcggagcgtctactcga

SEQ ID NO: 102972 - DNA, 25 bp, Mus musculus
gacagattttgctctcccaggacag

SEQ ID NO: 102973 - DNA, 25 bp, Mus musculus
gacagcaaagaagataacgcccggc

SEQ ID NO: 102974 - DNA, 25 bp, Mus musculus
gacagcaagcagattcgacaggagg

SEQ ID NO: 102975 - DNA, 25 bp, Mus musculus
gacagcacaatttccagtggacgct

SEQ ID NO: 102976 - DNA, 25 bp, Mus musculus
gacagcacacaacatgggtcagcta

SEQ ID NO: 102977 - DNA, 25 bp, Mus musculus
gacagcacaggatgccttccaagga

SEQ ID NO: 102978 - DNA, 25 bp, Mus musculus
gacagcacccttgtgcccaggataa

SEQ ID NO: 102979 - DNA, 25 bp, Mus musculus
gacagcacctcaatggcctagggct

SEQ ID NO: 102980 - DNA, 25 bp, Mus musculus
gacagcacctcatcccctggatggg

SEQ ID NO: 102981 - DNA, 25 bp, Mus musculus
gacagcagagatgaaaccgattggg

SEQ ID NO: 102982 - DNA, 25 bp, Mus musculus
gacagcagaggtgtgttccaggcca

SEQ ID NO: 102983 - DNA, 25 bp, Mus musculus
gacagcagcccgaaacttaatcgag

SEQ ID NO: 102984 - DNA, 25 bp, Mus musculus
gacagcagcccttcgaggtctttag

SEQ ID NO: 102985 - DNA, 25 bp, Mus musculus
gacagcagcctgaacttagccctga

SEQ ID NO: 102986 - DNA, 25 bp, Mus musculus
gacagcagcgccatggaggagcttg

SEQ ID NO: 102987 - DNA, 25 bp, Mus musculus
gacagcagctctctatggacggttg

SEQ ID NO: 102988 - DNA, 25 bp, Mus musculus
gacagcagctgaggcgttaacccat

SEQ ID NO: 102989 - DNA, 25 bp, Mus musculus
gacagcagcttctagaggattcttg

SEQ ID NO: 102990 - DNA, 25 bp, Mus musculus
gacagcaggacatccctccttggga

SEQ ID NO: 102991 - DNA, 25 bp, Mus musculus
gacagcaggtgctctcaggtgccat

SEQ ID NO: 102992 - DNA, 25 bp, Mus musculus
gacagcagtcctccattaaggtaga

SEQ ID NO: 102993 - DNA, 25 bp, Mus musculus
gacagcatagctgaacggagtcaca

SEQ ID NO: 102994 - DNA, 25 bp, Mus musculus
gacagcatcgtcaacccaactggct

SEQ ID NO: 102995 - DNA, 25 bp, Mus musculus
gacagcatgaagaaccgaatccctg

SEQ ID NO: 102996 - DNA, 25 bp, Mus musculus
gacagcatgaagaactgggctcctc

SEQ ID NO: 102997 - DNA, 25 bp, Mus musculus
gacagcatgaagtcgttcttccgaa

SEQ ID NO: 102998 - DNA, 25 bp, Mus musculus
gacagcatgatcctacaagaccact

SEQ ID NO: 102999 - DNA, 25 bp, Mus musculus
gacagcattcccagttaggtcgcag

SEQ ID NO: 103000 - DNA, 25 bp, Mus musculus
gacagccaaacgaaacctgaagcgg

SEQ ID NO: 103001 - DNA, 25 bp, Mus musculus
gacagccagcaatgggagaagttca

SEQ ID NO: 103002 - DNA, 25 bp, Mus musculus
gacagccaggagcaagaatgaagac

SEQ ID NO: 103003 - DNA, 25 bp, Mus musculus
gacagccaggtccttaccatcaatc

SEQ ID NO: 103004 - DNA, 25 bp, Mus musculus
gacagccagtgaagtagtatctaaa

SEQ ID NO: 103005 - DNA, 25 bp, Mus musculus
gacagcccaggcctagaaaccttgg

SEQ ID NO: 103006 - DNA, 25 bp, Mus musculus
gacagcccaggtttgacaggtgaag

SEQ ID NO: 103007 - DNA, 25 bp, Mus musculus
gacagccccaccactctcacggagg

SEQ ID NO: 103008 - DNA, 25 bp, Mus musculus
gacagccccagtagtttcttcgaaa

SEQ ID NO: 103009 - DNA, 25 bp, Mus musculus
gacagccccggctactgagtttgca

SEQ ID NO: 103010 - DNA, 25 bp, Mus musculus
gacagcccctggaagcaaaatgtgt

SEQ ID NO: 103011 - DNA, 25 bp, Mus musculus
gacagcccgctggataaaattcgag

SEQ ID NO: 103012 - DNA, 25 bp, Mus musculus
gacagcccttgatgaggccctgaag

SEQ ID NO: 103013 - DNA, 25 bp, Mus musculus
gacagccggcaagagtggactttca

SEQ ID NO: 103014 - DNA, 25 bp, Mus musculus
gacagccgtacattggtgaccatga

SEQ ID NO: 103015 - DNA, 25 bp, Mus musculus
gacagcctagaagcatgggatctcg

SEQ ID NO: 103016 - DNA, 25 bp, Mus musculus
gacagcctcaagaaagagtcggaag

SEQ ID NO: 103017 - DNA, 25 bp, Mus musculus
gacagcctcactaaggaatctgctg

SEQ ID NO: 103018 - DNA, 25 bp, Mus musculus
gacagcctctcacaggagtaccaga

SEQ ID NO: 103019 - DNA, 25 bp, Mus musculus
gacagcctgaccattgaagaacgag

SEQ ID NO: 103020 - DNA, 25 bp, Mus musculus
gacagcctgagactgaaggtcactg

SEQ ID NO: 103021 - DNA, 25 bp, Mus musculus
gacagcctgcatccttcatccgaat

SEQ ID NO: 103022 - DNA, 25 bp, Mus musculus
gacagcctggatggaacaggccacc

SEQ ID NO: 103023 - DNA, 25 bp, Mus musculus
gacagcctgtgttcgaggatatgac

SEQ ID NO: 103024 - DNA, 25 bp, Mus musculus
gacagccttctgcaactcggacctg

SEQ ID NO: 103025 - DNA, 25 bp, Mus musculus
gacagccttcttatgaatgggagca

SEQ ID NO: 103026 - DNA, 25 bp, Mus musculus
gacagcgacgtctttctgcactggg

SEQ ID NO: 103027 - DNA, 25 bp, Mus musculus
gacagcgactgcctcagcatgggta

SEQ ID NO: 103028 - DNA, 25 bp, Mus musculus
gacagcgagaatgaattgcctaact

SEQ ID NO: 103029 - DNA, 25 bp, Mus musculus
gacagcgagattattcagaagagcc

SEQ ID NO: 103030 - DNA, 25 bp, Mus musculus
gacagcgcccgagtctatgagaacg

SEQ ID NO: 103031 - DNA, 25 bp, Mus musculus
gacagcggcatcatcctgcagtctg

SEQ ID NO: 103032 - DNA, 25 bp, Mus musculus
gacagcggctcaaggtcatctatgg

SEQ ID NO: 103033 - DNA, 25 bp, Mus musculus
gacagcgggttctgcttcttagtga

SEQ ID NO: 103034 - DNA, 25 bp, Mus musculus
gacagcgtatgttcaaccagcggag

SEQ ID NO: 103035 - DNA, 25 bp, Mus musculus
gacagcgtcaaaggtggattttcca

SEQ ID NO: 103036 - DNA, 25 bp, Mus musculus
gacagcgtgcattttgacagagacc

SEQ ID NO: 103037 - DNA, 25 bp, Mus musculus
gacagcgttctgtcatctcagcaaa

SEQ ID NO: 103038 - DNA, 25 bp, Mus musculus
gacagctaacagtgcatcccgagtg

SEQ ID NO: 103039 - DNA, 25 bp, Mus musculus
gacagctacagcaacacggcaaagc

SEQ ID NO: 103040 - DNA, 25 bp, Mus musculus
gacagctacgtggagcctctgaaac

SEQ ID NO: 103041 - DNA, 25 bp, Mus musculus
gacagctatgtggagacgtcagcca

SEQ ID NO: 103042 - DNA, 25 bp, Mus musculus
gacagctcaagcgattctcagtcct

SEQ ID NO: 103043 - DNA, 25 bp, Mus musculus
gacagctcaatgtttacacccgtgg

SEQ ID NO: 103044 - DNA, 25 bp, Mus musculus
gacagctcattggatgtaaccccag

SEQ ID NO: 103045 - DNA, 25 bp, Mus musculus
gacagctccagaaagaaacgtgata

SEQ ID NO: 103046 - DNA, 25 bp, Mus musculus
gacagctccagaatgcctatggcag

SEQ ID NO: 103047 - DNA, 25 bp, Mus musculus
gacagctccgtgctctaaagtgaca

SEQ ID NO: 103048 - DNA, 25 bp, Mus musculus
gacagctcggactggatcgtctggc

SEQ ID NO: 103049 - DNA, 25 bp, Mus musculus
gacagctcgtcagcattgagacaga

SEQ ID NO: 103050 - DNA, 25 bp, Mus musculus
gacagctcttacttcagcagcgatg

SEQ ID NO: 103051 - DNA, 25 bp, Mus musculus
gacagctgacatggaagaactcgga

SEQ ID NO: 103052 - DNA, 25 bp, Mus musculus
gacagctgaccttggcactgggcgt

SEQ ID NO: 103053 - DNA, 25 bp, Mus musculus
gacagctgactgacgctcgcagcta

SEQ ID NO: 103054 - DNA, 25 bp, Mus musculus
gacagctgagagagacctgtacacc

SEQ ID NO: 103055 - DNA, 25 bp, Mus musculus
gacagctgccgctcaagggattgga

SEQ ID NO: 103056 - DNA, 25 bp, Mus musculus
gacagctgcgatagctgcaaggaag

SEQ ID NO: 103057 - DNA, 25 bp, Mus musculus
gacagctggaggtagaaatcatccg

SEQ ID NO: 103058 - DNA, 25 bp, Mus musculus
gacagctggtttcagtcagtgccac

SEQ ID NO: 103059 - DNA, 25 bp, Mus musculus
gacagctgtcacgaaggctttcttc

SEQ ID NO: 103060 - DNA, 25 bp, Mus musculus
gacagctgtctttcccagagggcat

SEQ ID NO: 103061 - DNA, 25 bp, Mus musculus
gacagctgttgtaaccccatgagca

SEQ ID NO: 103062 - DNA, 25 bp, Mus musculus
gacagcttcctaccgtggcagagta

SEQ ID NO: 103063 - DNA, 25 bp, Mus musculus
gacagcttctacttcgtggatgacc

SEQ ID NO: 103064 - DNA, 25 bp, Mus musculus
gacagcttctgtgaacacgatgccg

SEQ ID NO: 103065 - DNA, 25 bp, Mus musculus
gacaggaacagctccctcgggtgtt

SEQ ID NO: 103066 - DNA, 25 bp, Mus musculus
gacaggaaccctgctcttggaggtg

SEQ ID NO: 103067 - DNA, 25 bp, Mus musculus
gacaggaaggaaacaatggccctca

SEQ ID NO: 103068 - DNA, 25 bp, Mus musculus
gacaggaagtttcgagttcccagaa

SEQ ID NO: 103069 - DNA, 25 bp, Mus musculus
gacaggaatcttcatgcacggcaag

SEQ ID NO: 103070 - DNA, 25 bp, Mus musculus
gacaggacaccaccctctgaagagg

SEQ ID NO: 103071 - DNA, 25 bp, Mus musculus
gacaggacacgtatggtgaccccat

SEQ ID NO: 103072 - DNA, 25 bp, Mus musculus
gacaggacaggctatacagttcaga

SEQ ID NO: 103073 - DNA, 25 bp, Mus musculus
gacaggacgcacaagccaaggattt

SEQ ID NO: 103074 - DNA, 25 bp, Mus musculus
gacaggacgcccgtgttctgggcct

SEQ ID NO: 103075 - DNA, 25 bp, Mus musculus
gacaggacgctttatgattggagga

SEQ ID NO: 103076 - DNA, 25 bp, Mus musculus
gacaggactgccattcggtctgaca

SEQ ID NO: 103077 - DNA, 25 bp, Mus musculus
gacaggagcttctagactgtaccag

SEQ ID NO: 103078 - DNA, 25 bp, Mus musculus
gacaggagtttacggctattgacaa

SEQ ID NO: 103079 - DNA, 25 bp, Mus musculus
gacaggatcgttatgcaagaactcc

SEQ ID NO: 103080 - DNA, 25 bp, Mus musculus
gacaggatgcaagctgcggtcacag

SEQ ID NO: 103081 - DNA, 25 bp, Mus musculus
gacaggatgcttacacggatctcat

SEQ ID NO: 103082 - DNA, 25 bp, Mus musculus
gacaggattcgttggctaccgtccc

SEQ ID NO: 103083 - DNA, 25 bp, Mus musculus
gacaggcaagacataagcagctccc

SEQ ID NO: 103084 - DNA, 25 bp, Mus musculus
gacaggcaatgtctgggaaccctcc

SEQ ID NO: 103085 - DNA, 25 bp, Mus musculus
gacaggcacatgcaaatacccacat

SEQ ID NO: 103086 - DNA, 25 bp, Mus musculus
gacaggcactgaagctcgatttggc

SEQ ID NO: 103087 - DNA, 25 bp, Mus musculus
gacaggcagattcctaggaccaggc

SEQ ID NO: 103088 - DNA, 25 bp, Mus musculus
gacaggcagtctagagggaaaccag

SEQ ID NO: 103089 - DNA, 25 bp, Mus musculus
gacaggcattgcagctgcctccata

SEQ ID NO: 103090 - DNA, 25 bp, Mus musculus
gacaggcggcctcttaacattacag

SEQ ID NO: 103091 - DNA, 25 bp, Mus musculus
gacaggctcaatgtctaaacaggag

SEQ ID NO: 103092 - DNA, 25 bp, Mus musculus
gacaggctccgtgttacaggctgca

SEQ ID NO: 103093 - DNA, 25 bp, Mus musculus
gacaggctgggaaatgatggaacac

SEQ ID NO: 103094 - DNA, 25 bp, Mus musculus
gacagggagactttcagccaagcat

SEQ ID NO: 103095 - DNA, 25 bp, Mus musculus
gacagggagagaaaaacggccacat

SEQ ID NO: 103096 - DNA, 25 bp, Mus musculus
gacagggagtgaagtctttcggctc

SEQ ID NO: 103097 - DNA, 25 bp, Mus musculus
gacagggcagcatctgagtggctac

SEQ ID NO: 103098 - DNA, 25 bp, Mus musculus
gacagggccatgaaggatctttgga

SEQ ID NO: 103099 - DNA, 25 bp, Mus musculus
gacagggccctcataggatttcagc

SEQ ID NO: 103100 - DNA, 25 bp, Mus musculus
gacagggcctccttctctagagcac

SEQ ID NO: 103101 - DNA, 25 bp, Mus musculus
gacagggcgctaattactgagcaga

SEQ ID NO: 103102 - DNA, 25 bp, Mus musculus
gacaggtcagctacattcgctggga

SEQ ID NO: 103103 - DNA, 25 bp, Mus musculus
gacaggtcccgattctgaggtgaag

SEQ ID NO: 103104 - DNA, 25 bp, Mus musculus
gacaggtcctgctctcaacacaaga

SEQ ID NO: 103105 - DNA, 25 bp, Mus musculus
gacaggtcttcatgctgtcgctgac

SEQ ID NO: 103106 - DNA, 25 bp, Mus musculus
gacaggtgacccgttctcaggagaa

SEQ ID NO: 103107 - DNA, 25 bp, Mus musculus
gacaggtgctccaacagtgcagaca

SEQ ID NO: 103108 - DNA, 25 bp, Mus musculus
gacaggttcttctgagtgcggctga

SEQ ID NO: 103109 - DNA, 25 bp, Mus musculus
gacaggttgtcatcgctttggtgcc

SEQ ID NO: 103110 - DNA, 25 bp, Mus musculus
gacagtaaacaagcctcaactgcct

SEQ ID NO: 103111 - DNA, 25 bp, Mus musculus
gacagtaacaagtcctcagagggtg

SEQ ID NO: 103112 - DNA, 25 bp, Mus musculus
gacagtaacccgtgatgagcccttc

SEQ ID NO: 103113 - DNA, 25 bp, Mus musculus
gacagtaactctgagcccaatgtgg

SEQ ID NO: 103114 - DNA, 25 bp, Mus musculus
gacagtaagatctggtcgctctacg

SEQ ID NO: 103115 - DNA, 25 bp, Mus musculus
gacagtaatttgctagtcatggccc

SEQ ID NO: 103116 - DNA, 25 bp, Mus musculus
gacagtacagcatctggtgacctca

SEQ ID NO: 103117 - DNA, 25 bp, Mus musculus
gacagtacaggagaccaaagtgccc

SEQ ID NO: 103118 - DNA, 25 bp, Mus musculus
gacagtacagttctaaggaccagca

SEQ ID NO: 103119 - DNA, 25 bp, Mus musculus
gacagtacatttgaattccgctgaa

SEQ ID NO: 103120 - DNA, 25 bp, Mus musculus
gacagtaccgtcgagtgccagacat

SEQ ID NO: 103121 - DNA, 25 bp, Mus musculus
gacagtacttcgttttcaagaacct

SEQ ID NO: 103122 - DNA, 25 bp, Mus musculus
gacagtagataccaacgctctgctg

SEQ ID NO: 103123 - DNA, 25 bp, Mus musculus
gacagtagcttctcttgaatgtgaa

SEQ ID NO: 103124 - DNA, 25 bp, Mus musculus
gacagtagtgcaagccctggagaat

SEQ ID NO: 103125 - DNA, 25 bp, Mus musculus
gacagtataatgaagccggtctccc

SEQ ID NO: 103126 - DNA, 25 bp, Mus musculus
gacagtatgtgtcatctctgggcca

SEQ ID NO: 103127 - DNA, 25 bp, Mus musculus
gacagtatttgaggccctgagcccc

SEQ ID NO: 103128 - DNA, 25 bp, Mus musculus
gacagtcaactgtagcccagcataa

SEQ ID NO: 103129 - DNA, 25 bp, Mus musculus
gacagtcagcttgcggactcagaga

SEQ ID NO: 103130 - DNA, 25 bp, Mus musculus
gacagtcattctgcacccaaggtat

SEQ ID NO: 103131 - DNA, 25 bp, Mus musculus
gacagtcattgagttccggcataag

SEQ ID NO: 103132 - DNA, 25 bp, Mus musculus
gacagtccagacaataaataccggg

SEQ ID NO: 103133 - DNA, 25 bp, Mus musculus
gacagtccatttggcctcgggacca

SEQ ID NO: 103134 - DNA, 25 bp, Mus musculus
gacagtccccaagagctctcgatga

SEQ ID NO: 103135 - DNA, 25 bp, Mus musculus
gacagtcccctggaagtgccaagag

SEQ ID NO: 103136 - DNA, 25 bp, Mus musculus
gacagtccctgataaagtctggaag

SEQ ID NO: 103137 - DNA, 25 bp, Mus musculus
gacagtccggatgagattgacatca

SEQ ID NO: 103138 - DNA, 25 bp, Mus musculus
gacagtccggctagtatcttccctg

SEQ ID NO: 103139 - DNA, 25 bp, Mus musculus
gacagtcgcctcctcatcattaaag

SEQ ID NO: 103140 - DNA, 25 bp, Mus musculus
gacagtctagaccagcacgaagctt

SEQ ID NO: 103141 - DNA, 25 bp, Mus musculus
gacagtctcaaatttatcctgatgg

SEQ ID NO: 103142 - DNA, 25 bp, Mus musculus
gacagtctcatcgatctcaaggact

SEQ ID NO: 103143 - DNA, 25 bp, Mus musculus
gacagtctcctgttcgagtccagag

SEQ ID NO: 103144 - DNA, 25 bp, Mus musculus
gacagtctgcaggtggaagtcgcct

SEQ ID NO: 103145 - DNA, 25 bp, Mus musculus
gacagtctgcagtgagaactcaact

SEQ ID NO: 103146 - DNA, 25 bp, Mus musculus
gacagtctgtggttgcccttcatag

SEQ ID NO: 103147 - DNA, 25 bp, Mus musculus
gacagtgaaatcaacaggcttcgaa

SEQ ID NO: 103148 - DNA, 25 bp, Mus musculus
gacagtgacaagaagtggccctcag

SEQ ID NO: 103149 - DNA, 25 bp, Mus musculus
gacagtgaccctcatggagtttctc

SEQ ID NO: 103150 - DNA, 25 bp, Mus musculus
gacagtgaccctccgatcagtgaga

SEQ ID NO: 103151 - DNA, 25 bp, Mus musculus
gacagtgacctcgttaagcatgaag

SEQ ID NO: 103152 - DNA, 25 bp, Mus musculus
gacagtgagaccgatgacattggct

SEQ ID NO: 103153 - DNA, 25 bp, Mus musculus
gacagtgatggcattgtggcccact

SEQ ID NO: 103154 - DNA, 25 bp, Mus musculus
gacagtgattggtacacctcccgaa

SEQ ID NO: 103155 - DNA, 25 bp, Mus musculus
gacagtgcaatttctggtaccacag

SEQ ID NO: 103156 - DNA, 25 bp, Mus musculus
gacagtgcacttgattgaccccgag

SEQ ID NO: 103157 - DNA, 25 bp, Mus musculus
gacagtgccgtcctcaagcttgctg

SEQ ID NO: 103158 - DNA, 25 bp, Mus musculus
gacagtgcgtctaagtgatggtcac

SEQ ID NO: 103159 - DNA, 25 bp, Mus musculus
gacagtgctactctgcttgagaaga

SEQ ID NO: 103160 - DNA, 25 bp, Mus musculus
gacagtgctatcaggagggacctcg

SEQ ID NO: 103161 - DNA, 25 bp, Mus musculus
gacagtgctggcaatggacccgaaa

SEQ ID NO: 103162 - DNA, 25 bp, Mus musculus
gacagtgctggtacaactatccgta

SEQ ID NO: 103163 - DNA, 25 bp, Mus musculus
gacagtgcttgcagaatttcttcgg

SEQ ID NO: 103164 - DNA, 25 bp, Mus musculus
gacagtggacatgtgaggcctctcc

SEQ ID NO: 103165 - DNA, 25 bp, Mus musculus
gacagtggaccaatactattacggc

SEQ ID NO: 103166 - DNA, 25 bp, Mus musculus
gacagtggattttctatggcgccaa

SEQ ID NO: 103167 - DNA, 25 bp, Mus musculus
gacagtggcctttccacagcgctag

SEQ ID NO: 103168 - DNA, 25 bp, Mus musculus
gacagtggcgtacctcatgcagaag

SEQ ID NO: 103169 - DNA, 25 bp, Mus musculus
gacagtggttcccagacaagctcag

SEQ ID NO: 103170 - DNA, 25 bp, Mus musculus
gacagtgtcggtcagccaatgctga

SEQ ID NO: 103171 - DNA, 25 bp, Mus musculus
gacagtgtctggaagtcaagccaca

SEQ ID NO: 103172 - DNA, 25 bp, Mus musculus
gacagtgtgccaggaccgatttaat

SEQ ID NO: 103173 - DNA, 25 bp, Mus musculus
gacagtgtgctaagtatgttcccca

SEQ ID NO: 103174 - DNA, 25 bp, Mus musculus
gacagtgtggatgaccgactcaaca

SEQ ID NO: 103175 - DNA, 25 bp, Mus musculus
gacagtgtgtactcgggtgtgcagc

SEQ ID NO: 103176 - DNA, 25 bp, Mus musculus
gacagtgtgtgtcggtatgacctca

SEQ ID NO: 103177 - DNA, 25 bp, Mus musculus
gacagtgtgttaagcaacgccggca

SEQ ID NO: 103178 - DNA, 25 bp, Mus musculus
gacagttaaactgtgggaccccaga

SEQ ID NO: 103179 - DNA, 25 bp, Mus musculus
gacagttacgatgctgacgccagca

SEQ ID NO: 103180 - DNA, 25 bp, Mus musculus
gacagttacggagttttatgctaga

SEQ ID NO: 103181 - DNA, 25 bp, Mus musculus
gacagttccactgacgactctgagg

SEQ ID NO: 103182 - DNA, 25 bp, Mus musculus
gacagttcggctgacatggcaccaa

SEQ ID NO: 103183 - DNA, 25 bp, Mus musculus
gacagttctatttgattgcctccag

SEQ ID NO: 103184 - DNA, 25 bp, Mus musculus
gacagttctgatcagactgcgttat

SEQ ID NO: 103185 - DNA, 25 bp, Mus musculus
gacagttctgtgaaaccaggcctgg

SEQ ID NO: 103186 - DNA, 25 bp, Mus musculus
gacagttcttccgacagcgacagtt

SEQ ID NO: 103187 - DNA, 25 bp, Mus musculus
gacagttgcagttgatacctcaggg

SEQ ID NO: 103188 - DNA, 25 bp, Mus musculus
gacagttgctcaagtggatcgacac

SEQ ID NO: 103189 - DNA, 25 bp, Mus musculus
gacagttggcagactaagtgggacc

SEQ ID NO: 103190 - DNA, 25 bp, Mus musculus
gacagttggctgtgttgaactcgca

SEQ ID NO: 103191 - DNA, 25 bp, Mus musculus
gacagtttagcaagggcatggaccg

SEQ ID NO: 103192 - DNA, 25 bp, Mus musculus
gacagtttcatcaagaccagtgcga

SEQ ID NO: 103193 - DNA, 25 bp, Mus musculus
gacagtttgcaacgcagtggaccga

SEQ ID NO: 103194 - DNA, 25 bp, Mus musculus
gacagtttgcctatttccagactgc

SEQ ID NO: 103195 - DNA, 25 bp, Mus musculus
gacagtttgtacaccgaaggaatcc

SEQ ID NO: 103196 - DNA, 25 bp, Mus musculus
gacataaagtctggcccttgctcgc

SEQ ID NO: 103197 - DNA, 25 bp, Mus musculus
gacataaccgtggaacaagccttca

SEQ ID NO: 103198 - DNA, 25 bp, Mus musculus
gacataaggcggtgacatggcgcac

SEQ ID NO: 103199 - DNA, 25 bp, Mus musculus
gacatacagcgcctaaagaatgaca

SEQ ID NO: 103200 - DNA, 25 bp, Mus musculus
gacatacagtgcaccccagttttga

SEQ ID NO: 103201 - DNA, 25 bp, Mus musculus
gacatacattgaaacagcagacctg

SEQ ID NO: 103202 - DNA, 25 bp, Mus musculus
gacataccctatgccactgctagag

SEQ ID NO: 103203 - DNA, 25 bp, Mus musculus
gacataccgccaattaccccaaatt

SEQ ID NO: 103204 - DNA, 25 bp, Mus musculus
gacatacctgccatctaaaaagaag

SEQ ID NO: 103205 - DNA, 25 bp, Mus musculus
gacataccttatgagtacctgcggc

SEQ ID NO: 103206 - DNA, 25 bp, Mus musculus
gacataccttttatgtgccctggga

SEQ ID NO: 103207 - DNA, 25 bp, Mus musculus
gacatactacatctacgaccttcag

SEQ ID NO: 103208 - DNA, 25 bp, Mus musculus
gacatacttgaagctaaacaacaaa

SEQ ID NO: 103209 - DNA, 25 bp, Mus musculus
gacatacttgaagggccagagctgg

SEQ ID NO: 103210 - DNA, 25 bp, Mus musculus
gacatagaagatagctcctgccgag

SEQ ID NO: 103211 - DNA, 25 bp, Mus musculus
gacatagaccctcaaagtttccaga

SEQ ID NO: 103212 - DNA, 25 bp, Mus musculus
gacatagagatccttgagcacggag

SEQ ID NO: 103213 - DNA, 25 bp, Mus musculus
gacatagagcattacattccagacg

SEQ ID NO: 103214 - DNA, 25 bp, Mus musculus
gacatagatgcagtccttgcccaga

SEQ ID NO: 103215 - DNA, 25 bp, Mus musculus
gacatagcaagtacagaccgaggcc

SEQ ID NO: 103216 - DNA, 25 bp, Mus musculus
gacatagctgtgaaactgggaaccg

SEQ ID NO: 103217 - DNA, 25 bp, Mus musculus
gacataggactcatcctgcttagga

SEQ ID NO: 103218 - DNA, 25 bp, Mus musculus
gacataggcttggtggcccgtctct

SEQ ID NO: 103219 - DNA, 25 bp, Mus musculus
gacataggttctctactgccaccgg

SEQ ID NO: 103220 - DNA, 25 bp, Mus musculus
gacatagttcgagatggcaggctct

SEQ ID NO: 103221 - DNA, 25 bp, Mus musculus
gacatatagaaattgtgcaggacct

SEQ ID NO: 103222 - DNA, 25 bp, Mus musculus
gacatatatcatgaccatggcggtg

SEQ ID NO: 103223 - DNA, 25 bp, Mus musculus
gacatatatccacaagaagtgctcg

SEQ ID NO: 103224 - DNA, 25 bp, Mus musculus
gacatatcaacgcaaccgctttggg

SEQ ID NO: 103225 - DNA, 25 bp, Mus musculus
gacatatgaaacatctctgctggta

SEQ ID NO: 103226 - DNA, 25 bp, Mus musculus
gacatatgcaaagataaaggccctg

SEQ ID NO: 103227 - DNA, 25 bp, Mus musculus
gacatatttctacccttgcccctgt

SEQ ID NO: 103228 - DNA, 25 bp, Mus musculus
gacatatttgaagtggctgcctgag

SEQ ID NO: 103229 - DNA, 25 bp, Mus musculus
gacatcaaactgctcttcctgcgct

SEQ ID NO: 103230 - DNA, 25 bp, Mus musculus
gacatcaacaaacggagagaaccca

SEQ ID NO: 103231 - DNA, 25 bp, Mus musculus
gacatcaactgacttgggtgcaagg

SEQ ID NO: 103232 - DNA, 25 bp, Mus musculus
gacatcaagccctttaccacagttg

SEQ ID NO: 103233 - DNA, 25 bp, Mus musculus
gacatcacaacacaaattacaaggc

SEQ ID NO: 103234 - DNA, 25 bp, Mus musculus
gacatcacagaacactcagtgctga

SEQ ID NO: 103235 - DNA, 25 bp, Mus musculus
gacatcaccccaggtcatcaaggag

SEQ ID NO: 103236 - DNA, 25 bp, Mus musculus
gacatcaccctgattctggagagaa

SEQ ID NO: 103237 - DNA, 25 bp, Mus musculus
gacatcacctattcgctcttctggg

SEQ ID NO: 103238 - DNA, 25 bp, Mus musculus
gacatcagaaaagcatatcgtaagc

SEQ ID NO: 103239 - DNA, 25 bp, Mus musculus
gacatcagaacaccctagaaggcgt

SEQ ID NO: 103240 - DNA, 25 bp, Mus musculus
gacatcagaagaggagcagggcatc

SEQ ID NO: 103241 - DNA, 25 bp, Mus musculus
gacatcagaccactgcattgcgaag

SEQ ID NO: 103242 - DNA, 25 bp, Mus musculus
gacatcagagccatggagaacggag

SEQ ID NO: 103243 - DNA, 25 bp, Mus musculus
gacatcagcaaacccacactggaga

SEQ ID NO: 103244 - DNA, 25 bp, Mus musculus
gacatcagcaaatacataccaggga

SEQ ID NO: 103245 - DNA, 25 bp, Mus musculus
gacatcagcttcagagacatccagg

SEQ ID NO: 103246 - DNA, 25 bp, Mus musculus
gacatcagtgctgttatcctggacg

SEQ ID NO: 103247 - DNA, 25 bp, Mus musculus
gacatcatcatcaaggcgcttcctg

SEQ ID NO: 103248 - DNA, 25 bp, Mus musculus
gacatcatccttgcggcctttgaca

SEQ ID NO: 103249 - DNA, 25 bp, Mus musculus
gacatcatctcatctgaaggtgacg

SEQ ID NO: 103250 - DNA, 25 bp, Mus musculus
gacatcatgctcagacattgcagag

SEQ ID NO: 103251 - DNA, 25 bp, Mus musculus
gacatcatggagttattacaaaagg

SEQ ID NO: 103252 - DNA, 25 bp, Mus musculus
gacatccagaatgacgctcagtttg

SEQ ID NO: 103253 - DNA, 25 bp, Mus musculus
gacatccaggaaatagcgctcaggg

SEQ ID NO: 103254 - DNA, 25 bp, Mus musculus
gacatccaggttggagagcatgcca

SEQ ID NO: 103255 - DNA, 25 bp, Mus musculus
gacatccatagcagtgtttctcgag

SEQ ID NO: 103256 - DNA, 25 bp, Mus musculus
gacatccattctatgcacagactgg

SEQ ID NO: 103257 - DNA, 25 bp, Mus musculus
gacatcccagggactgctatggact

SEQ ID NO: 103258 - DNA, 25 bp, Mus musculus
gacatcccatttggagagcaccaga

SEQ ID NO: 103259 - DNA, 25 bp, Mus musculus
gacatccccgtcttccatttgaatg

SEQ ID NO: 103260 - DNA, 25 bp, Mus musculus
gacatccctgtgtgtgcttagccac

SEQ ID NO: 103261 - DNA, 25 bp, Mus musculus
gacatccgccttttctggagtgagg

SEQ ID NO: 103262 - DNA, 25 bp, Mus musculus
gacatcctacgtaaaaagggcatcc

SEQ ID NO: 103263 - DNA, 25 bp, Mus musculus
gacatccttggagctgctgagacag

SEQ ID NO: 103264 - DNA, 25 bp, Mus musculus
gacatcgacaagcagtacgttggct

SEQ ID NO: 103265 - DNA, 25 bp, Mus musculus
gacatcgagacccaggctggcattg

SEQ ID NO: 103266 - DNA, 25 bp, Mus musculus
gacatcgagaggctgatacaccaga

SEQ ID NO: 103267 - DNA, 25 bp, Mus musculus
gacatcgccagcatcgacatggttt

SEQ ID NO: 103268 - DNA, 25 bp, Mus musculus
gacatcgcgcatgtgttggccgagc

SEQ ID NO: 103269 - DNA, 25 bp, Mus musculus
gacatcgctagcacaggcaaagacg

SEQ ID NO: 103270 - DNA, 25 bp, Mus musculus
gacatcgctgtcctagttctgtact

SEQ ID NO: 103271 - DNA, 25 bp, Mus musculus
gacatcggcgtctaccagtactatg

SEQ ID NO: 103272 - DNA, 25 bp, Mus musculus
gacatcgtcccaggttttggccagg

SEQ ID NO: 103273 - DNA, 25 bp, Mus musculus
gacatcgttcgaagcaggcatcaaa

SEQ ID NO: 103274 - DNA, 25 bp, Mus musculus
gacatcgttgcgtgtcgggctgcca

SEQ ID NO: 103275 - DNA, 25 bp, Mus musculus
gacatcgtttatcgctaccacaagg

SEQ ID NO: 103276 - DNA, 25 bp, Mus musculus
gacatctagcaaggaggactcgaag

SEQ ID NO: 103277 - DNA, 25 bp, Mus musculus
gacatctatgtggatggtagccatc

SEQ ID NO: 103278 - DNA, 25 bp, Mus musculus
gacatctctacggaaatgtgccggg

SEQ ID NO: 103279 - DNA, 25 bp, Mus musculus
gacatctgctcgagaacgccaagaa

SEQ ID NO: 103280 - DNA, 25 bp, Mus musculus
gacatctggaacgtcactggtgcca

SEQ ID NO: 103281 - DNA, 25 bp, Mus musculus
gacatctgggtgtgctacgtgacct

SEQ ID NO: 103282 - DNA, 25 bp, Mus musculus
gacatcttcgggaaatccaaggagg

SEQ ID NO: 103283 - DNA, 25 bp, Mus musculus
gacatcttggaaatcagcactatgg

SEQ ID NO: 103284 - DNA, 25 bp, Mus musculus
gacatcttggaggaccatgctcagc

SEQ ID NO: 103285 - DNA, 25 bp, Mus musculus
gacatcttggcgatcgcttggaagc

SEQ ID NO: 103286 - DNA, 25 bp, Mus musculus
gacatcttgtgacaaacaacccggg

SEQ ID NO: 103287 - DNA, 25 bp, Mus musculus
gacatctttggcacatcaatttgtg

SEQ ID NO: 103288 - DNA, 25 bp, Mus musculus
gacatgaaacgggatctggacagca

SEQ ID NO: 103289 - DNA, 25 bp, Mus musculus
gacatgaaagtcctcgatgacctga

SEQ ID NO: 103290 - DNA, 25 bp, Mus musculus
gacatgaacacccacaaggctaagg

SEQ ID NO: 103291 - DNA, 25 bp, Mus musculus
gacatgaagatactaacagagatga

SEQ ID NO: 103292 - DNA, 25 bp, Mus musculus
gacatgaagatgtgaagaaggcgct

SEQ ID NO: 103293 - DNA, 25 bp, Mus musculus
gacatgaagcagtaccacgggtccg

SEQ ID NO: 103294 - DNA, 25 bp, Mus musculus
gacatgaagcgccataagaaactag

SEQ ID NO: 103295 - DNA, 25 bp, Mus musculus
gacatgacagggaaatgtcttcctt

SEQ ID NO: 103296 - DNA, 25 bp, Mus musculus
gacatgacatttttacgcttcctga

SEQ ID NO: 103297 - DNA, 25 bp, Mus musculus
gacatgaccagcagacagcatcact

SEQ ID NO: 103298 - DNA, 25 bp, Mus musculus
gacatgagaaggaacgcaagctgga

SEQ ID NO: 103299 - DNA, 25 bp, Mus musculus
gacatgagcaagtacctctatgctg

SEQ ID NO: 103300 - DNA, 25 bp, Mus musculus
gacatgagcagcaaaaacctggtta

SEQ ID NO: 103301 - DNA, 25 bp, Mus musculus
gacatgagggctgccaacctttggc

SEQ ID NO: 103302 - DNA, 25 bp, Mus musculus
gacatgagtaatgaacgcgtcacct

SEQ ID NO: 103303 - DNA, 25 bp, Mus musculus
gacatgagttcctgctgcagtcgga

SEQ ID NO: 103304 - DNA, 25 bp, Mus musculus
gacatgatcctgtctgcgtctcgag

SEQ ID NO: 103305 - DNA, 25 bp, Mus musculus
gacatgatcttagacctggaacctg

SEQ ID NO: 103306 - DNA, 25 bp, Mus musculus
gacatgattatgtggtaaaaggaga

SEQ ID NO: 103307 - DNA, 25 bp, Mus musculus
gacatgcactttcgaagtctgcgca

SEQ ID NO: 103308 - DNA, 25 bp, Mus musculus
gacatgcagacgtccggtgtgttgc

SEQ ID NO: 103309 - DNA, 25 bp, Mus musculus
gacatgccaacttaccagatccgag

SEQ ID NO: 103310 - DNA, 25 bp, Mus musculus
gacatgccatgactactttgctggg

SEQ ID NO: 103311 - DNA, 25 bp, Mus musculus
gacatgcccaggctgtacatctttg

SEQ ID NO: 103312 - DNA, 25 bp, Mus musculus
gacatgcccgagtatgaaaacttca

SEQ ID NO: 103313 - DNA, 25 bp, Mus musculus
gacatgccggaggacacctaggtcc

SEQ ID NO: 103314 - DNA, 25 bp, Mus musculus
gacatgcctaccctgaaagcagctg

SEQ ID NO: 103315 - DNA, 25 bp, Mus musculus
gacatgcctggtgcgagctttcaac

SEQ ID NO: 103316 - DNA, 25 bp, Mus musculus
gacatgcgctggtcgtgtgagcacc

SEQ ID NO: 103317 - DNA, 25 bp, Mus musculus
gacatgcggcatcatcgagtgagat

SEQ ID NO: 103318 - DNA, 25 bp, Mus musculus
gacatgcggctgactgaactagctg

SEQ ID NO: 103319 - DNA, 25 bp, Mus musculus
gacatgcggtggaacaagggaacca

SEQ ID NO: 103320 - DNA, 25 bp, Mus musculus
gacatgctactgataagcactgcag

SEQ ID NO: 103321 - DNA, 25 bp, Mus musculus
gacatgctcaacagcagcgcgatgg

SEQ ID NO: 103322 - DNA, 25 bp, Mus musculus
gacatgctggagtgcgaccgtttcc

SEQ ID NO: 103323 - DNA, 25 bp, Mus musculus
gacatgctgtgtggtgctattggct

SEQ ID NO: 103324 - DNA, 25 bp, Mus musculus
gacatgcttgctgccggactcttgg

SEQ ID NO: 103325 - DNA, 25 bp, Mus musculus
gacatggacacatcggacacacagt

SEQ ID NO: 103326 - DNA, 25 bp, Mus musculus
gacatggacatggtcatggtcacgg

SEQ ID NO: 103327 - DNA, 25 bp, Mus musculus
gacatggacgagtgtagcagcaccc

SEQ ID NO: 103328 - DNA, 25 bp, Mus musculus
gacatggatctgcttcaccgagtgg

SEQ ID NO: 103329 - DNA, 25 bp, Mus musculus
gacatggcgctaactggcactcaaa

SEQ ID NO: 103330 - DNA, 25 bp, Mus musculus
gacatggcggcacactttgaagaga

SEQ ID NO: 103331 - DNA, 25 bp, Mus musculus
gacatggcgtgcaatgctcggaacc

SEQ ID NO: 103332 - DNA, 25 bp, Mus musculus
gacatggctcttgttcagactggga

SEQ ID NO: 103333 - DNA, 25 bp, Mus musculus
gacatggctgcccagtgtgtcacga

SEQ ID NO: 103334 - DNA, 25 bp, Mus musculus
gacatggctgtcctccacaaaggtc

SEQ ID NO: 103335 - DNA, 25 bp, Mus musculus
gacatgggacttcctacctcgctgg

SEQ ID NO: 103336 - DNA, 25 bp, Mus musculus
gacatgggctacgtgcatagagacc

SEQ ID NO: 103337 - DNA, 25 bp, Mus musculus
gacatggtgatcgagcactgcatcc

SEQ ID NO: 103338 - DNA, 25 bp, Mus musculus
gacatggtgggcactttcacagaca

SEQ ID NO: 103339 - DNA, 25 bp, Mus musculus
gacatggtgtgcctaaaccacggga

SEQ ID NO: 103340 - DNA, 25 bp, Mus musculus
gacatgtagttgagttgcagcggaa

SEQ ID NO: 103341 - DNA, 25 bp, Mus musculus
gacatgtattagagctcaccagagg

SEQ ID NO: 103342 - DNA, 25 bp, Mus musculus
gacatgtccagcatgaatcccgaat

SEQ ID NO: 103343 - DNA, 25 bp, Mus musculus
gacatgtccgaagtgaagagccgaa

SEQ ID NO: 103344 - DNA, 25 bp, Mus musculus
gacatgtcgccagctgacgaggaag

SEQ ID NO: 103345 - DNA, 25 bp, Mus musculus
gacatgtctacttacaccctggagg

SEQ ID NO: 103346 - DNA, 25 bp, Mus musculus
gacatgtctcagtactggcctcgat

SEQ ID NO: 103347 - DNA, 25 bp, Mus musculus
gacatgtctgctaagaccaccaggc

SEQ ID NO: 103348 - DNA, 25 bp, Mus musculus
gacatgtgcgagtttctgaaccacg

SEQ ID NO: 103349 - DNA, 25 bp, Mus musculus
gacatgtgtttaatattcctcctgc

SEQ ID NO: 103350 - DNA, 25 bp, Mus musculus
gacatgttccatgtgactggcagat

SEQ ID NO: 103351 - DNA, 25 bp, Mus musculus
gacatgttcgactgtgtgtacccca

SEQ ID NO: 103352 - DNA, 25 bp, Mus musculus
gacatgttgacttctcctgacgcgg

SEQ ID NO: 103353 - DNA, 25 bp, Mus musculus
gacattaaaagctgatctgacacag

SEQ ID NO: 103354 - DNA, 25 bp, Mus musculus
gacattaacagttggctccggccct

SEQ ID NO: 103355 - DNA, 25 bp, Mus musculus
gacattaaggaagggagaccgtcca

SEQ ID NO: 103356 - DNA, 25 bp, Mus musculus
gacattacaattgatgagcccaacg

SEQ ID NO: 103357 - DNA, 25 bp, Mus musculus
gacattacttgggaactgagcctca

SEQ ID NO: 103358 - DNA, 25 bp, Mus musculus
gacattagaaaaatccgcaggctga

SEQ ID NO: 103359 - DNA, 25 bp, Mus musculus
gacattagtccggttctgctgcaga

SEQ ID NO: 103360 - DNA, 25 bp, Mus musculus
gacattagttccatccagagacgga

SEQ ID NO: 103361 - DNA, 25 bp, Mus musculus
gacattatagatggacgacccaccg

SEQ ID NO: 103362 - DNA, 25 bp, Mus musculus
gacattatgtgctacgttttcagag

SEQ ID NO: 103363 - DNA, 25 bp, Mus musculus
gacattattgacgttgaggacctca

SEQ ID NO: 103364 - DNA, 25 bp, Mus musculus
gacattcacccacatttatctatta

SEQ ID NO: 103365 - DNA, 25 bp, Mus musculus
gacattcagatggaggaccaccacc

SEQ ID NO: 103366 - DNA, 25 bp, Mus musculus
gacattcaggcgcacaagttcattg

SEQ ID NO: 103367 - DNA, 25 bp, Mus musculus
gacattcatactgattcttcccgga

SEQ ID NO: 103368 - DNA, 25 bp, Mus musculus
gacattcatgaagcattcgggacct

SEQ ID NO: 103369 - DNA, 25 bp, Mus musculus
gacattccaacagcacaagcaaggg

SEQ ID NO: 103370 - DNA, 25 bp, Mus musculus
gacattcccaagaacggcaagctga

SEQ ID NO: 103371 - DNA, 25 bp, Mus musculus
gacattcccaggatccatgctcgga

SEQ ID NO: 103372 - DNA, 25 bp, Mus musculus
gacattcctcgctctgagggcgcac

SEQ ID NO: 103373 - DNA, 25 bp, Mus musculus
gacattcctgcagattttgtgaccc

SEQ ID NO: 103374 - DNA, 25 bp, Mus musculus
gacattcctggaccatctcaaaggg

SEQ ID NO: 103375 - DNA, 25 bp, Mus musculus
gacattcgacaagtgggcagatcaa

SEQ ID NO: 103376 - DNA, 25 bp, Mus musculus
gacattcggagcgactggacaaacc

SEQ ID NO: 103377 - DNA, 25 bp, Mus musculus
gacattcggcaagacagttggaccg

SEQ ID NO: 103378 - DNA, 25 bp, Mus musculus
gacattcggcagaaggtccagctca

SEQ ID NO: 103379 - DNA, 25 bp, Mus musculus
gacattctcagaacacgagcatctt

SEQ ID NO: 103380 - DNA, 25 bp, Mus musculus
gacattctctcgaatcctcaccggt

SEQ ID NO: 103381 - DNA, 25 bp, Mus musculus
gacattctgcttcgccaacaacgga

SEQ ID NO: 103382 - DNA, 25 bp, Mus musculus
gacattctgggaaggattcctagca

SEQ ID NO: 103383 - DNA, 25 bp, Mus musculus
gacattgaaaacaggtgtgcccaga

SEQ ID NO: 103384 - DNA, 25 bp, Mus musculus
gacattgaagaaagaggccccagga

SEQ ID NO: 103385 - DNA, 25 bp, Mus musculus
gacattgaagtagccaacagcccag

SEQ ID NO: 103386 - DNA, 25 bp, Mus musculus
gacattgacaatgccatgaggacct

SEQ ID NO: 103387 - DNA, 25 bp, Mus musculus
gacattgaccagtgcctcaggaagg

SEQ ID NO: 103388 - DNA, 25 bp, Mus musculus
gacattgacctaagccctgacttgg

SEQ ID NO: 103389 - DNA, 25 bp, Mus musculus
gacattgactccctgcgaaaactgt

SEQ ID NO: 103390 - DNA, 25 bp, Mus musculus
gacattgagagccaactggacgccc

SEQ ID NO: 103391 - DNA, 25 bp, Mus musculus
gacattgagcccgttgaaggaagat

SEQ ID NO: 103392 - DNA, 25 bp, Mus musculus
gacattgaggagaaagaccggttac

SEQ ID NO: 103393 - DNA, 25 bp, Mus musculus
gacattgaggcgctcattggcccgc

SEQ ID NO: 103394 - DNA, 25 bp, Mus musculus
gacattgattcggatggcgtcttca

SEQ ID NO: 103395 - DNA, 25 bp, Mus musculus
gacattgccgccaagtacaaggagc

SEQ ID NO: 103396 - DNA, 25 bp, Mus musculus
gacattgcgagtcatgaaccacgga

SEQ ID NO: 103397 - DNA, 25 bp, Mus musculus
gacattgctcgcatagctactgacg

SEQ ID NO: 103398 - DNA, 25 bp, Mus musculus
gacattggaaactacacctgcctcg

SEQ ID NO: 103399 - DNA, 25 bp, Mus musculus
gacattggagttgctgccaccactg

SEQ ID NO: 103400 - DNA, 25 bp, Mus musculus
gacattggagtttggctcaagagcc

SEQ ID NO: 103401 - DNA, 25 bp, Mus musculus
gacattggtcccttgagatcaccgg

SEQ ID NO: 103402 - DNA, 25 bp, Mus musculus
gacattggtcctgatcccttgcctg

SEQ ID NO: 103403 - DNA, 25 bp, Mus musculus
gacattggttctgcaagagttcccc

SEQ ID NO: 103404 - DNA, 25 bp, Mus musculus
gacattgtaaacactgaagagacag

SEQ ID NO: 103405 - DNA, 25 bp, Mus musculus
gacattgtgatcaacgcaaacccag

SEQ ID NO: 103406 - DNA, 25 bp, Mus musculus
gacattgtgattgcgtacggccaga

SEQ ID NO: 103407 - DNA, 25 bp, Mus musculus
gacattgttgctggacgtctgccct

SEQ ID NO: 103408 - DNA, 25 bp, Mus musculus
gacattgttttcctgccccaaccgg

SEQ ID NO: 103409 - DNA, 25 bp, Mus musculus
gacatttaaggacttgggttcctcg

SEQ ID NO: 103410 - DNA, 25 bp, Mus musculus
gacatttactattctgcaggccaag

SEQ ID NO: 103411 - DNA, 25 bp, Mus musculus
gacatttagtcaagttcaggcctca

SEQ ID NO: 103412 - DNA, 25 bp, Mus musculus
gacatttcagcggattacacgttga

SEQ ID NO: 103413 - DNA, 25 bp, Mus musculus
gacatttcagggactagggcactca

SEQ ID NO: 103414 - DNA, 25 bp, Mus musculus
gacatttccaaatgcacccagggca

SEQ ID NO: 103415 - DNA, 25 bp, Mus musculus
gacatttcgatgatcctggctgaag

SEQ ID NO: 103416 - DNA, 25 bp, Mus musculus
gacatttctacgcttggacacctgg

SEQ ID NO: 103417 - DNA, 25 bp, Mus musculus
gacatttggagggtttggcagctca

SEQ ID NO: 103418 - DNA, 25 bp, Mus musculus
gacatttggcttactggccccgctg

SEQ ID NO: 103419 - DNA, 25 bp, Mus musculus
gacatttttcttgggagctgaacaa

SEQ ID NO: 103420 - DNA, 25 bp, Mus musculus
gacatttttgaggatctgcccggag

SEQ ID NO: 103421 - DNA, 25 bp, Mus musculus
gaccaaaacctctgatgactctggg

SEQ ID NO: 103422 - DNA, 25 bp, Mus musculus
gaccaaaatcctccaaagactcggg

SEQ ID NO: 103423 - DNA, 25 bp, Mus musculus
gaccaaaattactggaagacccatc

SEQ ID NO: 103424 - DNA, 25 bp, Mus musculus
gaccaaaattcgaacaagtgaacct

SEQ ID NO: 103425 - DNA, 25 bp, Mus musculus
gaccaaagcccctagacaagtatga

SEQ ID NO: 103426 - DNA, 25 bp, Mus musculus
gaccaaagcggatgtcggatgctca

SEQ ID NO: 103427 - DNA, 25 bp, Mus musculus
gaccaaatatcgagtgggaacaaaa

SEQ ID NO: 103428 - DNA, 25 bp, Mus musculus
gaccaaatatcgtacaagggctgtg

SEQ ID NO: 103429 - DNA, 25 bp, Mus musculus
gaccaaatcagatgccactggccag

SEQ ID NO: 103430 - DNA, 25 bp, Mus musculus
gaccaaatctactctgagttccgtg

SEQ ID NO: 103431 - DNA, 25 bp, Mus musculus
gaccaacagaataggcaactatggc

SEQ ID NO: 103432 - DNA, 25 bp, Mus musculus
gaccaacatgatcccagctgaacag

SEQ ID NO: 103433 - DNA, 25 bp, Mus musculus
gaccaacatgatccctggaagcagg

SEQ ID NO: 103434 - DNA, 25 bp, Mus musculus
gaccaaccccgatacagtgatacat

SEQ ID NO: 103435 - DNA, 25 bp, Mus musculus
gaccaaccggttgggcatggctaaa

SEQ ID NO: 103436 - DNA, 25 bp, Mus musculus
gaccaacctggtgaatgtttgccta

SEQ ID NO: 103437 - DNA, 25 bp, Mus musculus
gaccaactccccaaccgtgattgtg

SEQ ID NO: 103438 - DNA, 25 bp, Mus musculus
gaccaactggccaactgtgaggaca

SEQ ID NO: 103439 - DNA, 25 bp, Mus musculus
gaccaactgtaggagactgcatgac

SEQ ID NO: 103440 - DNA, 25 bp, Mus musculus
gaccaagacaggcaacgagctgatg

SEQ ID NO: 103441 - DNA, 25 bp, Mus musculus
gaccaagaccaagtgatcccagcat

SEQ ID NO: 103442 - DNA, 25 bp, Mus musculus
gaccaagagtatgttccagaggacc

SEQ ID NO: 103443 - DNA, 25 bp, Mus musculus
gaccaagcagctgcttcactgtatg

SEQ ID NO: 103444 - DNA, 25 bp, Mus musculus
gaccaagcgccgatttgtgaagaag

SEQ ID NO: 103445 - DNA, 25 bp, Mus musculus
gaccaagctgctgggcagtagccac

SEQ ID NO: 103446 - DNA, 25 bp, Mus musculus
gaccaaggagcatgacggtgtcagc

SEQ ID NO: 103447 - DNA, 25 bp, Mus musculus
gaccaaggtgatgacggtgacaact

SEQ ID NO: 103448 - DNA, 25 bp, Mus musculus
gaccaaggtgcctgcatgtcactca

SEQ ID NO: 103449 - DNA, 25 bp, Mus musculus
gaccaaggttactagtgccaaacac

SEQ ID NO: 103450 - DNA, 25 bp, Mus musculus
gaccaagtacgtccataaggtttgc

SEQ ID NO: 103451 - DNA, 25 bp, Mus musculus
gaccaatacgaaacggtgcctctgg

SEQ ID NO: 103452 - DNA, 25 bp, Mus musculus
gaccaatcccgacctgaggagagct

SEQ ID NO: 103453 - DNA, 25 bp, Mus musculus
gaccaatctgctctacatgagaccc

SEQ ID NO: 103454 - DNA, 25 bp, Mus musculus
gaccaatgatggtggcctggcagct

SEQ ID NO: 103455 - DNA, 25 bp, Mus musculus
gaccaatgcctcagccgtatggaga

SEQ ID NO: 103456 - DNA, 25 bp, Mus musculus
gaccaatgcgcaagagttaccgcgg

SEQ ID NO: 103457 - DNA, 25 bp, Mus musculus
gaccaatgtctcctgcacttacggg

SEQ ID NO: 103458 - DNA, 25 bp, Mus musculus
gaccaattaccgctgtcgctttcgc

SEQ ID NO: 103459 - DNA, 25 bp, Mus musculus
gaccaattattatccaagggccggg

SEQ ID NO: 103460 - DNA, 25 bp, Mus musculus
gaccaatttgcacgaccatcagaga

SEQ ID NO: 103461 - DNA, 25 bp, Mus musculus
gaccacaagatcttagccacagcag

SEQ ID NO: 103462 - DNA, 25 bp, Mus musculus
gaccacacagcgaacctcgaggtaa

SEQ ID NO: 103463 - DNA, 25 bp, Mus musculus
gaccacacttctgtctgatggcagc

SEQ ID NO: 103464 - DNA, 25 bp, Mus musculus
gaccacagacttgatttggagagct

SEQ ID NO: 103465 - DNA, 25 bp, Mus musculus
gaccacagccgaagcaccaaagctg

SEQ ID NO: 103466 - DNA, 25 bp, Mus musculus
gaccacagcgttcttcttataatta

SEQ ID NO: 103467 - DNA, 25 bp, Mus musculus
gaccacagtgtcctcagtcacacga

SEQ ID NO: 103468 - DNA, 25 bp, Mus musculus
gaccacagttttagagaccatcggc

SEQ ID NO: 103469 - DNA, 25 bp, Mus musculus
gaccacatggagaattcgaagcgcg

SEQ ID NO: 103470 - DNA, 25 bp, Mus musculus
gaccacatggtttgagctcagcaag

SEQ ID NO: 103471 - DNA, 25 bp, Mus musculus
gaccacatgtgaaaacgagctgcct

SEQ ID NO: 103472 - DNA, 25 bp, Mus musculus
gaccacatgtgctaagggacctctg

SEQ ID NO: 103473 - DNA, 25 bp, Mus musculus
gaccaccagtgggtggagccttcag

SEQ ID NO: 103474 - DNA, 25 bp, Mus musculus
gaccaccatcgattccttggagttg

SEQ ID NO: 103475 - DNA, 25 bp, Mus musculus
gaccaccgaagggacgatgatgctg

SEQ ID NO: 103476 - DNA, 25 bp, Mus musculus
gaccacctcagggacaggaacagtg

SEQ ID NO: 103477 - DNA, 25 bp, Mus musculus
gaccacctggactattcaacaaatg

SEQ ID NO: 103478 - DNA, 25 bp, Mus musculus
gaccacctgggataggactgcctgg

SEQ ID NO: 103479 - DNA, 25 bp, Mus musculus
gaccacgaacgggagagacacagag

SEQ ID NO: 103480 - DNA, 25 bp, Mus musculus
gaccacgggcctcatggagtactgc

SEQ ID NO: 103481 - DNA, 25 bp, Mus musculus
gaccacgttgagtttcagcatccga

SEQ ID NO: 103482 - DNA, 25 bp, Mus musculus
gaccactatgctttggacgaccacc

SEQ ID NO: 103483 - DNA, 25 bp, Mus musculus
gaccactctggactgttctgtaaag

SEQ ID NO: 103484 - DNA, 25 bp, Mus musculus
gaccactgactgtaaggactcttct

SEQ ID NO: 103485 - DNA, 25 bp, Mus musculus
gaccactgtgctgtgcgctgtgaga

SEQ ID NO: 103486 - DNA, 25 bp, Mus musculus
gaccacttggtgaagcatggcgacg

SEQ ID NO: 103487 - DNA, 25 bp, Mus musculus
gaccagaaagccagtatccagattt

SEQ ID NO: 103488 - DNA, 25 bp, Mus musculus
gaccagaagccatgcacaaaactac

SEQ ID NO: 103489 - DNA, 25 bp, Mus musculus
gaccagacctgacctgattggagaa

SEQ ID NO: 103490 - DNA, 25 bp, Mus musculus
gaccagacctggatcttgtttcttc

SEQ ID NO: 103491 - DNA, 25 bp, Mus musculus
gaccagactgcaagctagagggaca

SEQ ID NO: 103492 - DNA, 25 bp, Mus musculus
gaccagacttctgcgactactcgtg

SEQ ID NO: 103493 - DNA, 25 bp, Mus musculus
gaccagactttgtgctcatccgaca

SEQ ID NO: 103494 - DNA, 25 bp, Mus musculus
gaccagagagacaactggaggcctt

SEQ ID NO: 103495 - DNA, 25 bp, Mus musculus
gaccagagcacgttcattggccgag

SEQ ID NO: 103496 - DNA, 25 bp, Mus musculus
gaccagagctgtccttcgggaaaga

SEQ ID NO: 103497 - DNA, 25 bp, Mus musculus
gaccagaggcactttgtgaatccta

SEQ ID NO: 103498 - DNA, 25 bp, Mus musculus
gaccagagtgcgctgtcaacagaag

SEQ ID NO: 103499 - DNA, 25 bp, Mus musculus
gaccagagtttgtccgtggctataa

SEQ ID NO: 103500 - DNA, 25 bp, Mus musculus
gaccagatctttcttacgaggtaaa

SEQ ID NO: 103501 - DNA, 25 bp, Mus musculus
gaccagatgctcctggacacgctga

SEQ ID NO: 103502 - DNA, 25 bp, Mus musculus
gaccagatggcgcacagttcatttt

SEQ ID NO: 103503 - DNA, 25 bp, Mus musculus
gaccagcacatcaagcaggtttgca

SEQ ID NO: 103504 - DNA, 25 bp, Mus musculus
gaccagcagcttcagttaccgggaa

SEQ ID NO: 103505 - DNA, 25 bp, Mus musculus
gaccagcaggaggatgactatggac

SEQ ID NO: 103506 - DNA, 25 bp, Mus musculus
gaccagcaggctctagtgggaaaaa

SEQ ID NO: 103507 - DNA, 25 bp, Mus musculus
gaccagcccctgaaaattgccagag

SEQ ID NO: 103508 - DNA, 25 bp, Mus musculus
gaccagccggagacttgaccttgaa

SEQ ID NO: 103509 - DNA, 25 bp, Mus musculus
gaccagcgccgtggctacaaaaatg

SEQ ID NO: 103510 - DNA, 25 bp, Mus musculus
gaccagcggagcgaaaatggagcta

SEQ ID NO: 103511 - DNA, 25 bp, Mus musculus
gaccagcggccactatcgtcatgaa

SEQ ID NO: 103512 - DNA, 25 bp, Mus musculus
gaccagcggttctctgcacgtagca

SEQ ID NO: 103513 - DNA, 25 bp, Mus musculus
gaccagctagtagtcatgcacccta

SEQ ID NO: 103514 - DNA, 25 bp, Mus musculus
gaccagctcatcaaggagttcctaa

SEQ ID NO: 103515 - DNA, 25 bp, Mus musculus
gaccagctcatcaccaagtgcaatg

SEQ ID NO: 103516 - DNA, 25 bp, Mus musculus
gaccagctctctgcgcttcaatgga

SEQ ID NO: 103517 - DNA, 25 bp, Mus musculus
gaccagctctggctgtgtcatcaag

SEQ ID NO: 103518 - DNA, 25 bp, Mus musculus
gaccagctggatgtgggcgactaca

SEQ ID NO: 103519 - DNA, 25 bp, Mus musculus
gaccagctgggcatgtttacacaca

SEQ ID NO: 103520 - DNA, 25 bp, Mus musculus
gaccagcttggtgaccatggccttt

SEQ ID NO: 103521 - DNA, 25 bp, Mus musculus
gaccagctttggacctgtgtcagat

SEQ ID NO: 103522 - DNA, 25 bp, Mus musculus
gaccaggacccatacacagtttttg

SEQ ID NO: 103523 - DNA, 25 bp, Mus musculus
gaccaggaccgagaccacgggctga

SEQ ID NO: 103524 - DNA, 25 bp, Mus musculus
gaccaggactggacggatgctgcta

SEQ ID NO: 103525 - DNA, 25 bp, Mus musculus
gaccaggagataagcagagacaaca

SEQ ID NO: 103526 - DNA, 25 bp, Mus musculus
gaccaggagcagctaaagggttctc

SEQ ID NO: 103527 - DNA, 25 bp, Mus musculus
gaccaggagtcaagttcagcgtaga

SEQ ID NO: 103528 - DNA, 25 bp, Mus musculus
gaccaggatcccaactggagggcct

SEQ ID NO: 103529 - DNA, 25 bp, Mus musculus
gaccaggatgtcatacagagttaga

SEQ ID NO: 103530 - DNA, 25 bp, Mus musculus
gaccaggcagagctagatcaaattg

SEQ ID NO: 103531 - DNA, 25 bp, Mus musculus
gaccaggcagcgctctatgagaagt

SEQ ID NO: 103532 - DNA, 25 bp, Mus musculus
gaccagggagatgagttttctgata

SEQ ID NO: 103533 - DNA, 25 bp, Mus musculus
gaccaggtctagtactgtagccccg

SEQ ID NO: 103534 - DNA, 25 bp, Mus musculus
gaccagtaactttgtcccatgttct

SEQ ID NO: 103535 - DNA, 25 bp, Mus musculus
gaccagtaccggaagggcatcatct

SEQ ID NO: 103536 - DNA, 25 bp, Mus musculus
gaccagtcacggttgtcaggagcct

SEQ ID NO: 103537 - DNA, 25 bp, Mus musculus
gaccagtcatttgtgcccattacga

SEQ ID NO: 103538 - DNA, 25 bp, Mus musculus
gaccagtcctaaaaagtgagcctga

SEQ ID NO: 103539 - DNA, 25 bp, Mus musculus
gaccagtgagggtttgccaaagcgc

SEQ ID NO: 103540 - DNA, 25 bp, Mus musculus
gaccagtgatttttatgggagggcc

SEQ ID NO: 103541 - DNA, 25 bp, Mus musculus
gaccagtgcgacacaggttccagct

SEQ ID NO: 103542 - DNA, 25 bp, Mus musculus
gaccagtgctgtcccgtgtgtccag

SEQ ID NO: 103543 - DNA, 25 bp, Mus musculus
gaccagtggcaagatcaagaaattt

SEQ ID NO: 103544 - DNA, 25 bp, Mus musculus
gaccagtggccaaaaatcagctaga

SEQ ID NO: 103545 - DNA, 25 bp, Mus musculus
gaccagtgggtgcatgacaagatca

SEQ ID NO: 103546 - DNA, 25 bp, Mus musculus
gaccagtggttgcaggatgctttcc

SEQ ID NO: 103547 - DNA, 25 bp, Mus musculus
gaccagtgtcatatcccagagtgaa

SEQ ID NO: 103548 - DNA, 25 bp, Mus musculus
gaccagttcagaatgtgattgcccc

SEQ ID NO: 103549 - DNA, 25 bp, Mus musculus
gaccagttcatccagctttccaaag

SEQ ID NO: 103550 - DNA, 25 bp, Mus musculus
gaccagttccatggcaccgagtatg

SEQ ID NO: 103551 - DNA, 25 bp, Mus musculus
gaccagttctgatgagtaccctcct

SEQ ID NO: 103552 - DNA, 25 bp, Mus musculus
gaccagtttcccttctccagttttg

SEQ ID NO: 103553 - DNA, 25 bp, Mus musculus
gaccagtttcgccagcagtgggaac

SEQ ID NO: 103554 - DNA, 25 bp, Mus musculus
gaccataaaaaagttgctgcttgtg

SEQ ID NO: 103555 - DNA, 25 bp, Mus musculus
gaccataagcggatctcaaagttag

SEQ ID NO: 103556 - DNA, 25 bp, Mus musculus
gaccatcagagttaacgacagcaga

SEQ ID NO: 103557 - DNA, 25 bp, Mus musculus
gaccatcatgtatacctcgaaggga

SEQ ID NO: 103558 - DNA, 25 bp, Mus musculus
gaccatccgcctactgatgcatgga

SEQ ID NO: 103559 - DNA, 25 bp, Mus musculus
gaccatcctggtattggcgcttagg

SEQ ID NO: 103560 - DNA, 25 bp, Mus musculus
gaccatcgccgaagctgctcaagtt

SEQ ID NO: 103561 - DNA, 25 bp, Mus musculus
gaccatcgtatttaaccacatccgg

SEQ ID NO: 103562 - DNA, 25 bp, Mus musculus
gaccatctacatagtcaaggcctag

SEQ ID NO: 103563 - DNA, 25 bp, Mus musculus
gaccatctatgaaacggcggctcgg

SEQ ID NO: 103564 - DNA, 25 bp, Mus musculus
gaccatctcagacggttgccccaaa

SEQ ID NO: 103565 - DNA, 25 bp, Mus musculus
gaccatctccatcgccaaggcgggg

SEQ ID NO: 103566 - DNA, 25 bp, Mus musculus
gaccatctgagcaggtttccagaaa

SEQ ID NO: 103567 - DNA, 25 bp, Mus musculus
gaccatctgatgattcataggcaca

SEQ ID NO: 103568 - DNA, 25 bp, Mus musculus
gaccatctttgttgttgagctgccg

SEQ ID NO: 103569 - DNA, 25 bp, Mus musculus
gaccatgaacatgatccagctagat

SEQ ID NO: 103570 - DNA, 25 bp, Mus musculus
gaccatgaattagtgacctggaaag

SEQ ID NO: 103571 - DNA, 25 bp, Mus musculus
gaccatgagagcgtggaacattcca

SEQ ID NO: 103572 - DNA, 25 bp, Mus musculus
gaccatgagcctacctgaggacagt

SEQ ID NO: 103573 - DNA, 25 bp, Mus musculus
gaccatgatcttctgggcaccgagg

SEQ ID NO: 103574 - DNA, 25 bp, Mus musculus
gaccatgatgccaagttccagatct

SEQ ID NO: 103575 - DNA, 25 bp, Mus musculus
gaccatgcccatcagttcagttaga

SEQ ID NO: 103576 - DNA, 25 bp, Mus musculus
gaccatgccttcctttgttcatgaa

SEQ ID NO: 103577 - DNA, 25 bp, Mus musculus
gaccatgcgaatgttgtaaaggcct

SEQ ID NO: 103578 - DNA, 25 bp, Mus musculus
gaccatgctggagattacactctgc

SEQ ID NO: 103579 - DNA, 25 bp, Mus musculus
gaccatggacagtgcactcaagaag

SEQ ID NO: 103580 - DNA, 25 bp, Mus musculus
gaccatggactatgagacctctgag

SEQ ID NO: 103581 - DNA, 25 bp, Mus musculus
gaccatggactttggcagtgactaa

SEQ ID NO: 103582 - DNA, 25 bp, Mus musculus
gaccatggagactgctgagaagctg

SEQ ID NO: 103583 - DNA, 25 bp, Mus musculus
gaccatggcatctagggcctctgaa

SEQ ID NO: 103584 - DNA, 25 bp, Mus musculus
gaccatggccaaaaccctagagagc

SEQ ID NO: 103585 - DNA, 25 bp, Mus musculus
gaccatgggatgtcggcaaagctca

SEQ ID NO: 103586 - DNA, 25 bp, Mus musculus
gaccatggttctgaagttcgttcct

SEQ ID NO: 103587 - DNA, 25 bp, Mus musculus
gaccatgtacaacagctggagacag

SEQ ID NO: 103588 - DNA, 25 bp, Mus musculus
gaccatgtatacaccaagcctctag

SEQ ID NO: 103589 - DNA, 25 bp, Mus musculus
gaccatgtccagatgatagtgctag

SEQ ID NO: 103590 - DNA, 25 bp, Mus musculus
gaccatgtgcttcctgagctgaaca

SEQ ID NO: 103591 - DNA, 25 bp, Mus musculus
gaccatgtggatccaacagctttta

SEQ ID NO: 103592 - DNA, 25 bp, Mus musculus
gaccatgtgtagctacccagatgag

SEQ ID NO: 103593 - DNA, 25 bp, Mus musculus
gaccattaaaggattccagcagatt

SEQ ID NO: 103594 - DNA, 25 bp, Mus musculus
gaccattcagatgggatccttccga

SEQ ID NO: 103595 - DNA, 25 bp, Mus musculus
gaccattcaggagacgggcttgcaa

SEQ ID NO: 103596 - DNA, 25 bp, Mus musculus
gaccattccagtttccacaggcctg

SEQ ID NO: 103597 - DNA, 25 bp, Mus musculus
gaccattccgtttcacaggcaaaag

SEQ ID NO: 103598 - DNA, 25 bp, Mus musculus
gaccattctggccatcgtgactaca

SEQ ID NO: 103599 - DNA, 25 bp, Mus musculus
gaccattgatagctggatgaacacc

SEQ ID NO: 103600 - DNA, 25 bp, Mus musculus
gaccattggcgtgaaagacggccgt

SEQ ID NO: 103601 - DNA, 25 bp, Mus musculus
gaccattgttgatgaccccgagggc

SEQ ID NO: 103602 - DNA, 25 bp, Mus musculus
gaccatttcagacgagacctcggag

SEQ ID NO: 103603 - DNA, 25 bp, Mus musculus
gacccaaaccgaggaagtaactgtg

SEQ ID NO: 103604 - DNA, 25 bp, Mus musculus
gacccaacctgtggctatggtaaaa

SEQ ID NO: 103605 - DNA, 25 bp, Mus musculus
gacccaacgcgatgcctgtggtgaa

SEQ ID NO: 103606 - DNA, 25 bp, Mus musculus
gacccaacgttgagaccatcaagtg

SEQ ID NO: 103607 - DNA, 25 bp, Mus musculus
gacccaactcaattcgaggaggagg

SEQ ID NO: 103608 - DNA, 25 bp, Mus musculus
gacccaagcagaaccgtgatcagtg

SEQ ID NO: 103609 - DNA, 25 bp, Mus musculus
gacccaagcagctccgtaacaaggg

SEQ ID NO: 103610 - DNA, 25 bp, Mus musculus
gacccaaggttaaagatgctgtgca

SEQ ID NO: 103611 - DNA, 25 bp, Mus musculus
gacccaagtgtgttctcagataagc

SEQ ID NO: 103612 - DNA, 25 bp, Mus musculus
gacccaatgccaccaggccggatga

SEQ ID NO: 103613 - DNA, 25 bp, Mus musculus
gacccaattcgatttctgccgtgca

SEQ ID NO: 103614 - DNA, 25 bp, Mus musculus
gacccacaaagtcaggtatgcttga

SEQ ID NO: 103615 - DNA, 25 bp, Mus musculus
gacccacagtggtgcttcagccaag

SEQ ID NO: 103616 - DNA, 25 bp, Mus musculus
gacccacagtgtgagaccagagctg

SEQ ID NO: 103617 - DNA, 25 bp, Mus musculus
gacccacggcctgagtgatgagcac

SEQ ID NO: 103618 - DNA, 25 bp, Mus musculus
gacccactgaacaaggaggctgctg

SEQ ID NO: 103619 - DNA, 25 bp, Mus musculus
gacccactgctcaactggaggctga

SEQ ID NO: 103620 - DNA, 25 bp, Mus musculus
gacccagaaagtgttcggcaccatg

SEQ ID NO: 103621 - DNA, 25 bp, Mus musculus
gacccagaataaaggcaaagcacag

SEQ ID NO: 103622 - DNA, 25 bp, Mus musculus
gacccagagactccttgaacaacta

SEQ ID NO: 103623 - DNA, 25 bp, Mus musculus
gacccagagcagagggccttgttcc

SEQ ID NO: 103624 - DNA, 25 bp, Mus musculus
gacccagagctgattaaacaatgca

SEQ ID NO: 103625 - DNA, 25 bp, Mus musculus
gacccagaggagattcgcatgctca

SEQ ID NO: 103626 - DNA, 25 bp, Mus musculus
gacccagcctctgggattaatcccg

SEQ ID NO: 103627 - DNA, 25 bp, Mus musculus
gacccagcgctatctagaagtgcag

SEQ ID NO: 103628 - DNA, 25 bp, Mus musculus
gacccaggaccatgatgagaacgtg

SEQ ID NO: 103629 - DNA, 25 bp, Mus musculus
gacccaggaggctagatttctcagg

SEQ ID NO: 103630 - DNA, 25 bp, Mus musculus
gacccaggcttcttctgccggaaga

SEQ ID NO: 103631 - DNA, 25 bp, Mus musculus
gacccagggaaattcaaggaggcag

SEQ ID NO: 103632 - DNA, 25 bp, Mus musculus
gacccagggctgaattgtggatccc

SEQ ID NO: 103633 - DNA, 25 bp, Mus musculus
gacccaggtccttggttcacatgga

SEQ ID NO: 103634 - DNA, 25 bp, Mus musculus
gacccaggttctagagcaaagcatc

SEQ ID NO: 103635 - DNA, 25 bp, Mus musculus
gacccagtgggatcaatgagaacat

SEQ ID NO: 103636 - DNA, 25 bp, Mus musculus
gacccagttgagatgatttagccct

SEQ ID NO: 103637 - DNA, 25 bp, Mus musculus
gacccagttggcgtactttacagac

SEQ ID NO: 103638 - DNA, 25 bp, Mus musculus
gacccagtttcttggctgtctgtga

SEQ ID NO: 103639 - DNA, 25 bp, Mus musculus
gacccatactaaggaactgcagcat

SEQ ID NO: 103640 - DNA, 25 bp, Mus musculus
gacccatcaaagcaagatgagctga

SEQ ID NO: 103641 - DNA, 25 bp, Mus musculus
gacccatccgtcagtggttccagga

SEQ ID NO: 103642 - DNA, 25 bp, Mus musculus
gacccatcctgtgggagtgcctcgt

SEQ ID NO: 103643 - DNA, 25 bp, Mus musculus
gacccattaggaagaaagatctgca

SEQ ID NO: 103644 - DNA, 25 bp, Mus musculus
gacccattatcgtcttgttgccaat

SEQ ID NO: 103645 - DNA, 25 bp, Mus musculus
gacccattggaacaagcaaaggtgg

SEQ ID NO: 103646 - DNA, 25 bp, Mus musculus
gacccattggctggcattgcctaga

SEQ ID NO: 103647 - DNA, 25 bp, Mus musculus
gaccccaagatgcacagctacggtg

SEQ ID NO: 103648 - DNA, 25 bp, Mus musculus
gaccccaattatagagcaggcaagg

SEQ ID NO: 103649 - DNA, 25 bp, Mus musculus
gaccccaattgcgtcactgtgacag

SEQ ID NO: 103650 - DNA, 25 bp, Mus musculus
gaccccacctgagatgtcttctttt

SEQ ID NO: 103651 - DNA, 25 bp, Mus musculus
gaccccatggaggaagtttttcaca

SEQ ID NO: 103652 - DNA, 25 bp, Mus musculus
gaccccattgtggaacatctaggca

SEQ ID NO: 103653 - DNA, 25 bp, Mus musculus
gaccccgaaaagaacctgtcctgag

SEQ ID NO: 103654 - DNA, 25 bp, Mus musculus
gaccccgaaggatgactgggctgcc

SEQ ID NO: 103655 - DNA, 25 bp, Mus musculus
gaccccgaccaggattttgacaaag

SEQ ID NO: 103656 - DNA, 25 bp, Mus musculus
gaccccgaggagttgttcaggaaga

SEQ ID NO: 103657 - DNA, 25 bp, Mus musculus
gaccccgagggtctctttttgcaag

SEQ ID NO: 103658 - DNA, 25 bp, Mus musculus
gaccccgatatcctgaagacctgtg

SEQ ID NO: 103659 - DNA, 25 bp, Mus musculus
gaccccgcaatgtgggagagctttg

SEQ ID NO: 103660 - DNA, 25 bp, Mus musculus
gaccccgcgaatggaaaagtgcatg

SEQ ID NO: 103661 - DNA, 25 bp, Mus musculus
gaccccgcgcaaacgtctgagatga

SEQ ID NO: 103662 - DNA, 25 bp, Mus musculus
gaccccggagctgcaaagacttgct

SEQ ID NO: 103663 - DNA, 25 bp, Mus musculus
gaccccggttttcaggaagatcaga

SEQ ID NO: 103664 - DNA, 25 bp, Mus musculus
gaccccgtcagtagatttctgtcta

SEQ ID NO: 103665 - DNA, 25 bp, Mus musculus
gaccccgtccatgatatcgcgtttg

SEQ ID NO: 103666 - DNA, 25 bp, Mus musculus
gaccccgtgacgtgggttcagtcca

SEQ ID NO: 103667 - DNA, 25 bp, Mus musculus
gaccccgtggctgcactctatgaag

SEQ ID NO: 103668 - DNA, 25 bp, Mus musculus
gaccccgttcagtggacttctccag

SEQ ID NO: 103669 - DNA, 25 bp, Mus musculus
gacccctaaggatgacctccggttg

SEQ ID NO: 103670 - DNA, 25 bp, Mus musculus
gacccctagctttgaaggtattagc

SEQ ID NO: 103671 - DNA, 25 bp, Mus musculus
gacccctcagaggaaatgccaaaga

SEQ ID NO: 103672 - DNA, 25 bp, Mus musculus
gacccctcatgcctcgaggacctct

SEQ ID NO: 103673 - DNA, 25 bp, Mus musculus
gacccctgaagtgagacccgtgatt

SEQ ID NO: 103674 - DNA, 25 bp, Mus musculus
gacccctgccagcttcaaaacggat

SEQ ID NO: 103675 - DNA, 25 bp, Mus musculus
gaccccttcttcaaggtccctgtga

SEQ ID NO: 103676 - DNA, 25 bp, Mus musculus
gacccgaaactccttttaatgctgg

SEQ ID NO: 103677 - DNA, 25 bp, Mus musculus
gacccgaaggaaaagcagacatgtg

SEQ ID NO: 103678 - DNA, 25 bp, Mus musculus
gacccgacagaatacacagggcctg

SEQ ID NO: 103679 - DNA, 25 bp, Mus musculus
gacccgagccctgaaacgaggagat

SEQ ID NO: 103680 - DNA, 25 bp, Mus musculus
gacccgagtggactacttgctgaag

SEQ ID NO: 103681 - DNA, 25 bp, Mus musculus
gacccgcgagaaccagcaagatgta

SEQ ID NO: 103682 - DNA, 25 bp, Mus musculus
gacccgcggttcattggattctgca

SEQ ID NO: 103683 - DNA, 25 bp, Mus musculus
gacccgcgtatttggacacactgaa

SEQ ID NO: 103684 - DNA, 25 bp, Mus musculus
gacccgctgaaggacattgcccaat

SEQ ID NO: 103685 - DNA, 25 bp, Mus musculus
gacccggagtcatggagcctagtga

SEQ ID NO: 103686 - DNA, 25 bp, Mus musculus
gacccggatctggttctctccatag

SEQ ID NO: 103687 - DNA, 25 bp, Mus musculus
gacccggcgaagtcagcatctggag

SEQ ID NO: 103688 - DNA, 25 bp, Mus musculus
gacccggctctgcatcgtaaactgg

SEQ ID NO: 103689 - DNA, 25 bp, Mus musculus
gacccgggacctgggcagagaagtg

SEQ ID NO: 103690 - DNA, 25 bp, Mus musculus
gacccgggcattttctacagcgaca

SEQ ID NO: 103691 - DNA, 25 bp, Mus musculus
gacccgggccattaaggagcaactg

SEQ ID NO: 103692 - DNA, 25 bp, Mus musculus
gacccggtaggatccttcctgcggg

SEQ ID NO: 103693 - DNA, 25 bp, Mus musculus
gacccggtgtactgccttcctggat

SEQ ID NO: 103694 - DNA, 25 bp, Mus musculus
gacccggtgtcgcttgggatccaaa

SEQ ID NO: 103695 - DNA, 25 bp, Mus musculus
gacccgtcgttggagagtcaaacag

SEQ ID NO: 103696 - DNA, 25 bp, Mus musculus
gacccgtctatgatccgtggcagtg

SEQ ID NO: 103697 - DNA, 25 bp, Mus musculus
gacccgtgaacccactgagactgga

SEQ ID NO: 103698 - DNA, 25 bp, Mus musculus
gaccctaaacagagcagcagtgcag

SEQ ID NO: 103699 - DNA, 25 bp, Mus musculus
gaccctaaagcccacagatttttgg

SEQ ID NO: 103700 - DNA, 25 bp, Mus musculus
gaccctaagaagtcttggacaagcc

SEQ ID NO: 103701 - DNA, 25 bp, Mus musculus
gaccctaagtatgatgggcagtgcc

SEQ ID NO: 103702 - DNA, 25 bp, Mus musculus
gaccctacagggaactcagcgggaa

SEQ ID NO: 103703 - DNA, 25 bp, Mus musculus
gaccctagagcaacggacatgtgat

SEQ ID NO: 103704 - DNA, 25 bp, Mus musculus
gaccctaggatggagtccgcatgtg

SEQ ID NO: 103705 - DNA, 25 bp, Mus musculus
gaccctaggcgcttggctttggaca

SEQ ID NO: 103706 - DNA, 25 bp, Mus musculus
gaccctatccccagtgagctggtga

SEQ ID NO: 103707 - DNA, 25 bp, Mus musculus
gaccctatgtactcttgtgaggcca

SEQ ID NO: 103708 - DNA, 25 bp, Mus musculus
gaccctcaaggctgataaacagtaa

SEQ ID NO: 103709 - DNA, 25 bp, Mus musculus
gaccctcaataacttcctccagtgg

SEQ ID NO: 103710 - DNA, 25 bp, Mus musculus
gaccctcaatgtgctggagaccgga

SEQ ID NO: 103711 - DNA, 25 bp, Mus musculus
gaccctcagatagtgatatgccaag

SEQ ID NO: 103712 - DNA, 25 bp, Mus musculus
gaccctcagggttgcgacttcgctt

SEQ ID NO: 103713 - DNA, 25 bp, Mus musculus
gaccctcagtgtggccaggtgtgac

SEQ ID NO: 103714 - DNA, 25 bp, Mus musculus
gaccctccaggttacattccagaag

SEQ ID NO: 103715 - DNA, 25 bp, Mus musculus
gaccctcctaagtacagcgtggcta

SEQ ID NO: 103716 - DNA, 25 bp, Mus musculus
gaccctcgcaaacggaagttctctg

SEQ ID NO: 103717 - DNA, 25 bp, Mus musculus
gaccctcgccaggagtttgacacaa

SEQ ID NO: 103718 - DNA, 25 bp, Mus musculus
gaccctctatatctgcagcgagtgt

SEQ ID NO: 103719 - DNA, 25 bp, Mus musculus
gaccctctggcgcatttacatgctt

SEQ ID NO: 103720 - DNA, 25 bp, Mus musculus
gaccctctggtgtttgcaactgtgg

SEQ ID NO: 103721 - DNA, 25 bp, Mus musculus
gaccctgaaagaaggatgggacact

SEQ ID NO: 103722 - DNA, 25 bp, Mus musculus
gaccctgaaatccagcccatgaagg

SEQ ID NO: 103723 - DNA, 25 bp, Mus musculus
gaccctgaacacaaaccggaggctc

SEQ ID NO: 103724 - DNA, 25 bp, Mus musculus
gaccctgacctttgggcgagatgga

SEQ ID NO: 103725 - DNA, 25 bp, Mus musculus
gaccctgagcagatttgcttacaat

SEQ ID NO: 103726 - DNA, 25 bp, Mus musculus
gaccctgagccgtaatgatcctgca

SEQ ID NO: 103727 - DNA, 25 bp, Mus musculus
gaccctgagcgagaccttggaattc

SEQ ID NO: 103728 - DNA, 25 bp, Mus musculus
gaccctgaggccattcacatgatga

SEQ ID NO: 103729 - DNA, 25 bp, Mus musculus
gaccctgatagtgccgttgatgacc

SEQ ID NO: 103730 - DNA, 25 bp, Mus musculus
gaccctgatctcagttggaggacaa

SEQ ID NO: 103731 - DNA, 25 bp, Mus musculus
gaccctgatgcttggtgcgacctga

SEQ ID NO: 103732 - DNA, 25 bp, Mus musculus
gaccctgatggaccacactggagaa

SEQ ID NO: 103733 - DNA, 25 bp, Mus musculus
gaccctgcctagaaaggatgctaat

SEQ ID NO: 103734 - DNA, 25 bp, Mus musculus
gaccctgcggaattcttcgtgttga

SEQ ID NO: 103735 - DNA, 25 bp, Mus musculus
gaccctgcggatactatgttatgaa

SEQ ID NO: 103736 - DNA, 25 bp, Mus musculus
gaccctgctaaaaagccagaccgca

SEQ ID NO: 103737 - DNA, 25 bp, Mus musculus
gaccctggaacgctatcatggaaac

SEQ ID NO: 103738 - DNA, 25 bp, Mus musculus
gaccctggaggaggccataagcgta

SEQ ID NO: 103739 - DNA, 25 bp, Mus musculus
gaccctggaggctggctatcctagc

SEQ ID NO: 103740 - DNA, 25 bp, Mus musculus
gaccctggatgagctgaaatgcacg

SEQ ID NO: 103741 - DNA, 25 bp, Mus musculus
gaccctgtgaaagccaatgctgcag

SEQ ID NO: 103742 - DNA, 25 bp, Mus musculus
gaccctgtgcccaaagactgtcgga

SEQ ID NO: 103743 - DNA, 25 bp, Mus musculus
gaccctgtgctggagatgtcctgtc

SEQ ID NO: 103744 - DNA, 25 bp, Mus musculus
gaccctgtgtccaaagtgctgctaa

SEQ ID NO: 103745 - DNA, 25 bp, Mus musculus
gacccttcatagcatgtcctggatg

SEQ ID NO: 103746 - DNA, 25 bp, Mus musculus
gacccttcattcgaatgtcctggga

SEQ ID NO: 103747 - DNA, 25 bp, Mus musculus
gacccttccgatccagtgaggccta

SEQ ID NO: 103748 - DNA, 25 bp, Mus musculus
gacccttgaagagcaatcagcctgt

SEQ ID NO: 103749 - DNA, 25 bp, Mus musculus
gacccttgagtgacagttctatttg

SEQ ID NO: 103750 - DNA, 25 bp, Mus musculus
gacccttgcactggagcctcagttg

SEQ ID NO: 103751 - DNA, 25 bp, Mus musculus
gacccttgggtagagcgaacgtcac

SEQ ID NO: 103752 - DNA, 25 bp, Mus musculus
gacccttgttttggacagatacgcc

SEQ ID NO: 103753 - DNA, 25 bp, Mus musculus
gaccctttgccgcttcctggtttgg

SEQ ID NO: 103754 - DNA, 25 bp, Mus musculus
gaccctttgggaagattgtacacca

SEQ ID NO: 103755 - DNA, 25 bp, Mus musculus
gaccgaaagaaaaaagtcttcatcg

SEQ ID NO: 103756 - DNA, 25 bp, Mus musculus
gaccgaaatagttatccaggatgcc

SEQ ID NO: 103757 - DNA, 25 bp, Mus musculus
gaccgaatagtctgcatttttaaaa

SEQ ID NO: 103758 - DNA, 25 bp, Mus musculus
gaccgaatggccgaatctttgtacg

SEQ ID NO: 103759 - DNA, 25 bp, Mus musculus
gaccgacacaagatgctcagttaga

SEQ ID NO: 103760 - DNA, 25 bp, Mus musculus
gaccgacgaggagctggtaaccatg

SEQ ID NO: 103761 - DNA, 25 bp, Mus musculus
gaccgacggctcagtgaagaggcct

SEQ ID NO: 103762 - DNA, 25 bp, Mus musculus
gaccgactggcgaacaaatacactg

SEQ ID NO: 103763 - DNA, 25 bp, Mus musculus
gaccgagacagggacaaggaccggg

SEQ ID NO: 103764 - DNA, 25 bp, Mus musculus
gaccgagactaggaacggaccttga

SEQ ID NO: 103765 - DNA, 25 bp, Mus musculus
gaccgagatatgagttgttacacct

SEQ ID NO: 103766 - DNA, 25 bp, Mus musculus
gaccgagcacaagggtaagcgagac

SEQ ID NO: 103767 - DNA, 25 bp, Mus musculus
gaccgagcctgaactgctggaggac

SEQ ID NO: 103768 - DNA, 25 bp, Mus musculus
gaccgagctctgaggaaacagcagc

SEQ ID NO: 103769 - DNA, 25 bp, Mus musculus
gaccgaggagccatagtgaggaact

SEQ ID NO: 103770 - DNA, 25 bp, Mus musculus
gaccgaggccactttgtacatatga

SEQ ID NO: 103771 - DNA, 25 bp, Mus musculus
gaccgagtctcgcttcaaacagtgg

SEQ ID NO: 103772 - DNA, 25 bp, Mus musculus
gaccgatccacgtagcatctcagct

SEQ ID NO: 103773 - DNA, 25 bp, Mus musculus
gaccgatccttggatccagggtagg

SEQ ID NO: 103774 - DNA, 25 bp, Mus musculus
gaccgatctggctaggccaggccag

SEQ ID NO: 103775 - DNA, 25 bp, Mus musculus
gaccgatgtgtatccaagtacttgg

SEQ ID NO: 103776 - DNA, 25 bp, Mus musculus
gaccgatttctctgggttgggccaa

SEQ ID NO: 103777 - DNA, 25 bp, Mus musculus
gaccgcagatcaccgaactcttaga

SEQ ID NO: 103778 - DNA, 25 bp, Mus musculus
gaccgcagcatggacatggtatcca

SEQ ID NO: 103779 - DNA, 25 bp, Mus musculus
gaccgcagctgtgatacgggagcct

SEQ ID NO: 103780 - DNA, 25 bp, Mus musculus
gaccgcaggacccattcaactttag

SEQ ID NO: 103781 - DNA, 25 bp, Mus musculus
gaccgcagtgggataaatctaaaag

SEQ ID NO: 103782 - DNA, 25 bp, Mus musculus
gaccgccatgatcgaagatgccagc

SEQ ID NO: 103783 - DNA, 25 bp, Mus musculus
gaccgcgctcttgttttcagttgaa

SEQ ID NO: 103784 - DNA, 25 bp, Mus musculus
gaccgcggcaacagcctagtgcctt

SEQ ID NO: 103785 - DNA, 25 bp, Mus musculus
gaccgcggtataaacattgagagcc

SEQ ID NO: 103786 - DNA, 25 bp, Mus musculus
gaccgcgtggtcgtcattcgtttcg

SEQ ID NO: 103787 - DNA, 25 bp, Mus musculus
gaccgctacatggacgcctggaata

SEQ ID NO: 103788 - DNA, 25 bp, Mus musculus
gaccgctacttgcttctctgccaag

SEQ ID NO: 103789 - DNA, 25 bp, Mus musculus
gaccgctatggaaagaatgacagcc

SEQ ID NO: 103790 - DNA, 25 bp, Mus musculus
gaccgctggcgcagtatgactgtag

SEQ ID NO: 103791 - DNA, 25 bp, Mus musculus
gaccgcttggagttgctagcttacc

SEQ ID NO: 103792 - DNA, 25 bp, Mus musculus
gaccggaagcgcgttgaaactgcac

SEQ ID NO: 103793 - DNA, 25 bp, Mus musculus
gaccggacggtgactctgggcattt

SEQ ID NO: 103794 - DNA, 25 bp, Mus musculus
gaccggagaagtgcagcaacctgct

SEQ ID NO: 103795 - DNA, 25 bp, Mus musculus
gaccggagtgtttctagttactcac

SEQ ID NO: 103796 - DNA, 25 bp, Mus musculus
gaccggagttattgacggacctgca

SEQ ID NO: 103797 - DNA, 25 bp, Mus musculus
gaccggcaagttcatgagcacatcc

SEQ ID NO: 103798 - DNA, 25 bp, Mus musculus
gaccggcacagcaagacgcagattt

SEQ ID NO: 103799 - DNA, 25 bp, Mus musculus
gaccggcaggctttggtcaaaaagc

SEQ ID NO: 103800 - DNA, 25 bp, Mus musculus
gaccggcagttccaggagctcaatg

SEQ ID NO: 103801 - DNA, 25 bp, Mus musculus
gaccggccttctctaagggcaataa

SEQ ID NO: 103802 - DNA, 25 bp, Mus musculus
gaccggcgactcatttcctggaacg

SEQ ID NO: 103803 - DNA, 25 bp, Mus musculus
gaccggcgagacgaatcagcagtta

SEQ ID NO: 103804 - DNA, 25 bp, Mus musculus
gaccggcgtggccatctgcagcttc

SEQ ID NO: 103805 - DNA, 25 bp, Mus musculus
gaccggctagagattaccaactgct

SEQ ID NO: 103806 - DNA, 25 bp, Mus musculus
gaccggctcctttatgcacttttgg

SEQ ID NO: 103807 - DNA, 25 bp, Mus musculus
gaccggctgctgagacgaaagcttc

SEQ ID NO: 103808 - DNA, 25 bp, Mus musculus
gaccggctggtgatgcataacaaag

SEQ ID NO: 103809 - DNA, 25 bp, Mus musculus
gaccgggacagagactatagtcggc

SEQ ID NO: 103810 - DNA, 25 bp, Mus musculus
gaccgggagatctaccagctcaaga

SEQ ID NO: 103811 - DNA, 25 bp, Mus musculus
gaccgggcatataaactgaagcaag

SEQ ID NO: 103812 - DNA, 25 bp, Mus musculus
gaccggtcgttacacaacactggtt

SEQ ID NO: 103813 - DNA, 25 bp, Mus musculus
gaccggtgccagctgaagttcgtac

SEQ ID NO: 103814 - DNA, 25 bp, Mus musculus
gaccggttgatctctctgaagcgta

SEQ ID NO: 103815 - DNA, 25 bp, Mus musculus
gaccgtaaccctcgcttgcaatggc

SEQ ID NO: 103816 - DNA, 25 bp, Mus musculus
gaccgtcacaggaaaaattgagcga

SEQ ID NO: 103817 - DNA, 25 bp, Mus musculus
gaccgtcagaccgtatctatggcca

SEQ ID NO: 103818 - DNA, 25 bp, Mus musculus
gaccgtcgtgggtgatatcattgcc

SEQ ID NO: 103819 - DNA, 25 bp, Mus musculus
gaccgtctgcgcaagtggatgttcg

SEQ ID NO: 103820 - DNA, 25 bp, Mus musculus
gaccgtctggccagtgaaattgtgg

SEQ ID NO: 103821 - DNA, 25 bp, Mus musculus
gaccgtctggttcctgagctggaca

SEQ ID NO: 103822 - DNA, 25 bp, Mus musculus
gaccgtgacttcctggttcagagga

SEQ ID NO: 103823 - DNA, 25 bp, Mus musculus
gaccgtgcactctgtgaagctcgtg

SEQ ID NO: 103824 - DNA, 25 bp, Mus musculus
gaccgtgcgcaagcgcagtgcggcg

SEQ ID NO: 103825 - DNA, 25 bp, Mus musculus
gaccgtgcgtgtgtggaagatcccc

SEQ ID NO: 103826 - DNA, 25 bp, Mus musculus
gaccgtgctggcttcttaataggcg

SEQ ID NO: 103827 - DNA, 25 bp, Mus musculus
gaccgtggagttgcaactgcttaaa

SEQ ID NO: 103828 - DNA, 25 bp, Mus musculus
gaccgtggatgagagctgtttccca

SEQ ID NO: 103829 - DNA, 25 bp, Mus musculus
gaccgtggattggagatgacgcaca

SEQ ID NO: 103830 - DNA, 25 bp, Mus musculus
gaccgtggccatgcttcttaagaac

SEQ ID NO: 103831 - DNA, 25 bp, Mus musculus
gaccgtggctcaagacaggctatcg

SEQ ID NO: 103832 - DNA, 25 bp, Mus musculus
gaccgtgtgatcaatgtgaacgcca

SEQ ID NO: 103833 - DNA, 25 bp, Mus musculus
gaccgtgtgcacactctatgcccag

SEQ ID NO: 103834 - DNA, 25 bp, Mus musculus
gaccgtgtgcagaagaaaactttca

SEQ ID NO: 103835 - DNA, 25 bp, Mus musculus
gaccgtgtggtatgctccgcgatgt

SEQ ID NO: 103836 - DNA, 25 bp, Mus musculus
gaccgttaatgcctgaaagcttgga

SEQ ID NO: 103837 - DNA, 25 bp, Mus musculus
gaccgttagggttgtgccgaagcca

SEQ ID NO: 103838 - DNA, 25 bp, Mus musculus
gaccgttcaggaagtatggactccc

SEQ ID NO: 103839 - DNA, 25 bp, Mus musculus
gaccgttgcctacaagaaaatctta

SEQ ID NO: 103840 - DNA, 25 bp, Mus musculus
gaccgtttaagcagataccagattg

SEQ ID NO: 103841 - DNA, 25 bp, Mus musculus
gacctaacgaactttacactcctga

SEQ ID NO: 103842 - DNA, 25 bp, Mus musculus
gacctaactcggtgtgggctagcct

SEQ ID NO: 103843 - DNA, 25 bp, Mus musculus
gacctaagcttgagtgtgcagcgtg

SEQ ID NO: 103844 - DNA, 25 bp, Mus musculus
gacctaagtgtgaaataccctggag

SEQ ID NO: 103845 - DNA, 25 bp, Mus musculus
gacctaatgaggttccccagcagct

SEQ ID NO: 103846 - DNA, 25 bp, Mus musculus
gacctacagcgaggtgatgggccac

SEQ ID NO: 103847 - DNA, 25 bp, Mus musculus
gacctaccaagtgagggactgctga

SEQ ID NO: 103848 - DNA, 25 bp, Mus musculus
gacctaccgagaaggcaaactggcc

SEQ ID NO: 103849 - DNA, 25 bp, Mus musculus
gacctacgacgggaaaacctgtgca

SEQ ID NO: 103850 - DNA, 25 bp, Mus musculus
gacctacgccagtggtgtcaaaccc

SEQ ID NO: 103851 - DNA, 25 bp, Mus musculus
gacctacgggcagccattgtcctgt

SEQ ID NO: 103852 - DNA, 25 bp, Mus musculus
gacctacggtcattctcagaatcca

SEQ ID NO: 103853 - DNA, 25 bp, Mus musculus
gacctacggtgtggcaaatccagca

SEQ ID NO: 103854 - DNA, 25 bp, Mus musculus
gacctactactacgctgtggctgtg

SEQ ID NO: 103855 - DNA, 25 bp, Mus musculus
gacctacttgtcaacgcatacgcca

SEQ ID NO: 103856 - DNA, 25 bp, Mus musculus
gacctagagcccctgagtggaaagt

SEQ ID NO: 103857 - DNA, 25 bp, Mus musculus
gacctagagcgtctggtgactccag

SEQ ID NO: 103858 - DNA, 25 bp, Mus musculus
gacctagagctcttcgaggcgtttg

SEQ ID NO: 103859 - DNA, 25 bp, Mus musculus
gacctaggatccctggccttggaga

SEQ ID NO: 103860 - DNA, 25 bp, Mus musculus
gacctaggctgagcccagtagaaga

SEQ ID NO: 103861 - DNA, 25 bp, Mus musculus
gacctagtaagagaagtagatccta

SEQ ID NO: 103862 - DNA, 25 bp, Mus musculus
gacctagtccatttggagtggctga

SEQ ID NO: 103863 - DNA, 25 bp, Mus musculus
gacctatatccgtgaactctcgtgt

SEQ ID NO: 103864 - DNA, 25 bp, Mus musculus
gacctatattcgagagtggctgatt

SEQ ID NO: 103865 - DNA, 25 bp, Mus musculus
gacctatcagagcatgtatggccgg

SEQ ID NO: 103866 - DNA, 25 bp, Mus musculus
gacctatccactgcacctggttggg

SEQ ID NO: 103867 - DNA, 25 bp, Mus musculus
gacctatccctagaaggcattgcgg

SEQ ID NO: 103868 - DNA, 25 bp, Mus musculus
gacctatctgatgcagcctttgcgg

SEQ ID NO: 103869 - DNA, 25 bp, Mus musculus
gacctatcttcagtgatcgatgcca

SEQ ID NO: 103870 - DNA, 25 bp, Mus musculus
gacctatcttggcttctcgactggg

SEQ ID NO: 103871 - DNA, 25 bp, Mus musculus
gacctatgtgggaagaccgcttgca

SEQ ID NO: 103872 - DNA, 25 bp, Mus musculus
gacctattgggtggatctgtggaca

SEQ ID NO: 103873 - DNA, 25 bp, Mus musculus
gacctcaaagccctgggtgaccagt

SEQ ID NO: 103874 - DNA, 25 bp, Mus musculus
gacctcaagaccgagtggccgaagt

SEQ ID NO: 103875 - DNA, 25 bp, Mus musculus
gacctcaagagtcgcaatgtgctgg

SEQ ID NO: 103876 - DNA, 25 bp, Mus musculus
gacctcaagctcctaggaggcacgg

SEQ ID NO: 103877 - DNA, 25 bp, Mus musculus
gacctcaatcgggtggacttcgcaa

SEQ ID NO: 103878 - DNA, 25 bp, Mus musculus
gacctcaatgatggaagggctgcca

SEQ ID NO: 103879 - DNA, 25 bp, Mus musculus
gacctcacacttcactactgagctg

SEQ ID NO: 103880 - DNA, 25 bp, Mus musculus
gacctcacttatggacattgacacg

SEQ ID NO: 103881 - DNA, 25 bp, Mus musculus
gacctcagatatggtgtgcccagga

SEQ ID NO: 103882 - DNA, 25 bp, Mus musculus
gacctcaggaagagtgacgtggttc

SEQ ID NO: 103883 - DNA, 25 bp, Mus musculus
gacctcagggtattgctggacaacg

SEQ ID NO: 103884 - DNA, 25 bp, Mus musculus
gacctcataccttgcacagaactgg

SEQ ID NO: 103885 - DNA, 25 bp, Mus musculus
gacctcatggatctcattggggaag

SEQ ID NO: 103886 - DNA, 25 bp, Mus musculus
gacctcatggcgaaaagccaatctt

SEQ ID NO: 103887 - DNA, 25 bp, Mus musculus
gacctcatgggctaggcagtgtcca

SEQ ID NO: 103888 - DNA, 25 bp, Mus musculus
gacctcatggtttaagtgggaataa

SEQ ID NO: 103889 - DNA, 25 bp, Mus musculus
gacctcatgtcctgtggcaccaaag

SEQ ID NO: 103890 - DNA, 25 bp, Mus musculus
gacctcattaggttactgccagtga

SEQ ID NO: 103891 - DNA, 25 bp, Mus musculus
gacctccaggagaagattgcgcatg

SEQ ID NO: 103892 - DNA, 25 bp, Mus musculus
gacctccaggccgtgacggtagcag

SEQ ID NO: 103893 - DNA, 25 bp, Mus musculus
gacctccattgggaatggtgtctgg

SEQ ID NO: 103894 - DNA, 25 bp, Mus musculus
gacctcccaccaggtctttctggtc

SEQ ID NO: 103895 - DNA, 25 bp, Mus musculus
gacctccgatatacagtaccagttg

SEQ ID NO: 103896 - DNA, 25 bp, Mus musculus
gacctccggcgattgtgcattctca

SEQ ID NO: 103897 - DNA, 25 bp, Mus musculus
gacctccgtcacatcactgaactgg

SEQ ID NO: 103898 - DNA, 25 bp, Mus musculus
gacctcctggactcaagggtgccaa

SEQ ID NO: 103899 - DNA, 25 bp, Mus musculus
gacctcctggagtgaccgcttacag

SEQ ID NO: 103900 - DNA, 25 bp, Mus musculus
gacctcctggcgttcacgctgttgc

SEQ ID NO: 103901 - DNA, 25 bp, Mus musculus
gacctcctggtttgatggacaagct

SEQ ID NO: 103902 - DNA, 25 bp, Mus musculus
gacctcctgtgtacacatgatggaa

SEQ ID NO: 103903 - DNA, 25 bp, Mus musculus
gacctcgacctagaagaagctttag

SEQ ID NO: 103904 - DNA, 25 bp, Mus musculus
gacctcgcggagcactttgaacgaa

SEQ ID NO: 103905 - DNA, 25 bp, Mus musculus
gacctcgctaagtgctaaaaagtga

SEQ ID NO: 103906 - DNA, 25 bp, Mus musculus
gacctcggactctgaggagcattca

SEQ ID NO: 103907 - DNA, 25 bp, Mus musculus
gacctcggagataagcagcctttga

SEQ ID NO: 103908 - DNA, 25 bp, Mus musculus
gacctcgtgaagaaccacctgatgt

SEQ ID NO: 103909 - DNA, 25 bp, Mus musculus
gacctctcggacatgaacagcgatg

SEQ ID NO: 103910 - DNA, 25 bp, Mus musculus
gacctctcggctggacaagttcaaa

SEQ ID NO: 103911 - DNA, 25 bp, Mus musculus
gacctctgatggcaaatcacctgca

SEQ ID NO: 103912 - DNA, 25 bp, Mus musculus
gacctctgatttttccgtggcatga

SEQ ID NO: 103913 - DNA, 25 bp, Mus musculus
gacctctgcggccatgacaagtgcc

SEQ ID NO: 103914 - DNA, 25 bp, Mus musculus
gacctctgctacatcgcggctgtga

SEQ ID NO: 103915 - DNA, 25 bp, Mus musculus
gacctctgctcgtcccgctttgtaa

SEQ ID NO: 103916 - DNA, 25 bp, Mus musculus
gacctctggctttgagacatgccca

SEQ ID NO: 103917 - DNA, 25 bp, Mus musculus
gacctctgtctcacgtgtggagctg

SEQ ID NO: 103918 - DNA, 25 bp, Mus musculus
gacctctgtgaggaagtgcgagaca

SEQ ID NO: 103919 - DNA, 25 bp, Mus musculus
gacctcttagaaggacacagtcgac

SEQ ID NO: 103920 - DNA, 25 bp, Mus musculus
gacctcttcagctaggacaagcgag

SEQ ID NO: 103921 - DNA, 25 bp, Mus musculus
gacctcttgattccattttgaaaga

SEQ ID NO: 103922 - DNA, 25 bp, Mus musculus
gacctctttggaggcagaaatcgcc

SEQ ID NO: 103923 - DNA, 25 bp, Mus musculus
gacctgaaagaaggctagttagaca

SEQ ID NO: 103924 - DNA, 25 bp, Mus musculus
gacctgaagaagcatggttgcaccg

SEQ ID NO: 103925 - DNA, 25 bp, Mus musculus
gacctgaagcctaggcctgtggaga

SEQ ID NO: 103926 - DNA, 25 bp, Mus musculus
gacctgaagcgctgtacctactatg

SEQ ID NO: 103927 - DNA, 25 bp, Mus musculus
gacctgaagtcaggccaggagtttg

SEQ ID NO: 103928 - DNA, 25 bp, Mus musculus
gacctgaatggagaatgccagccaa

SEQ ID NO: 103929 - DNA, 25 bp, Mus musculus
gacctgacactcaggccggacgaga

SEQ ID NO: 103930 - DNA, 25 bp, Mus musculus
gacctgacagccttgaggacgacct

SEQ ID NO: 103931 - DNA, 25 bp, Mus musculus
gacctgaccttcgttcacctgggaa

SEQ ID NO: 103932 - DNA, 25 bp, Mus musculus
gacctgactctgtgtggacgcaaag

SEQ ID NO: 103933 - DNA, 25 bp, Mus musculus
gacctgagcaagatgggtatcacca

SEQ ID NO: 103934 - DNA, 25 bp, Mus musculus
gacctgaggccaagagagcaaagct

SEQ ID NO: 103935 - DNA, 25 bp, Mus musculus
gacctgagtgacgagcaaaactgtg

SEQ ID NO: 103936 - DNA, 25 bp, Mus musculus
gacctgatacccagagcacaggctg

SEQ ID NO: 103937 - DNA, 25 bp, Mus musculus
gacctgatcatgaagcggatggagc

SEQ ID NO: 103938 - DNA, 25 bp, Mus musculus
gacctgatcctatgggctcgctgag

SEQ ID NO: 103939 - DNA, 25 bp, Mus musculus
gacctgatgaagaacaacccttggg

SEQ ID NO: 103940 - DNA, 25 bp, Mus musculus
gacctgatggctactgtggtacaca

SEQ ID NO: 103941 - DNA, 25 bp, Mus musculus
gacctgattagcatgggatccaacg

SEQ ID NO: 103942 - DNA, 25 bp, Mus musculus
gacctgattgtgtttgtgattaacc

SEQ ID NO: 103943 - DNA, 25 bp, Mus musculus
gacctgcaccaaaacagccaacgtt

SEQ ID NO: 103944 - DNA, 25 bp, Mus musculus
gacctgcactacataggactcactg

SEQ ID NO: 103945 - DNA, 25 bp, Mus musculus
gacctgcaggatggaaaacgcctcc

SEQ ID NO: 103946 - DNA, 25 bp, Mus musculus
gacctgccacagactttagaaccaa

SEQ ID NO: 103947 - DNA, 25 bp, Mus musculus
gacctgcccgagtacaacgatgact

SEQ ID NO: 103948 - DNA, 25 bp, Mus musculus
gacctgcccgcagatgaagtgtttg

SEQ ID NO: 103949 - DNA, 25 bp, Mus musculus
gacctgcccgcatgtgaactcagta

SEQ ID NO: 103950 - DNA, 25 bp, Mus musculus
gacctgccgcttttggagtggctga

SEQ ID NO: 103951 - DNA, 25 bp, Mus musculus
gacctgccgggagaactacacatta

SEQ ID NO: 103952 - DNA, 25 bp, Mus musculus
gacctgcctgctgagttactagacg

SEQ ID NO: 103953 - DNA, 25 bp, Mus musculus
gacctgcgcctggaagatctattta

SEQ ID NO: 103954 - DNA, 25 bp, Mus musculus
gacctgcgcggcctgcggtttccta

SEQ ID NO: 103955 - DNA, 25 bp, Mus musculus
gacctgcggaggatctacttatgag

SEQ ID NO: 103956 - DNA, 25 bp, Mus musculus
gacctgcgtgagtttccaggcgacc

SEQ ID NO: 103957 - DNA, 25 bp, Mus musculus
gacctgcgtgcatcagagtcttcaa

SEQ ID NO: 103958 - DNA, 25 bp, Mus musculus
gacctgctcagcgatgggaaatgaa

SEQ ID NO: 103959 - DNA, 25 bp, Mus musculus
gacctgctgatgagtcctgctagaa

SEQ ID NO: 103960 - DNA, 25 bp, Mus musculus
gacctgctgcacattggactcaaaa

SEQ ID NO: 103961 - DNA, 25 bp, Mus musculus
gacctgctgcgctgtaagatcctga

SEQ ID NO: 103962 - DNA, 25 bp, Mus musculus
gacctgctggtatccctgttcggag

SEQ ID NO: 103963 - DNA, 25 bp, Mus musculus
gacctggaagcgaatgataaagccc

SEQ ID NO: 103964 - DNA, 25 bp, Mus musculus
gacctggacaggctcaatgatgatg

SEQ ID NO: 103965 - DNA, 25 bp, Mus musculus
gacctggaccagttgataacccaca

SEQ ID NO: 103966 - DNA, 25 bp, Mus musculus
gacctggacctggttgaaaagggct

SEQ ID NO: 103967 - DNA, 25 bp, Mus musculus
gacctggacgaacgaagtgctcaag

SEQ ID NO: 103968 - DNA, 25 bp, Mus musculus
gacctggacggaaatcttctggact

SEQ ID NO: 103969 - DNA, 25 bp, Mus musculus
gacctggactggcatgtacggcact

SEQ ID NO: 103970 - DNA, 25 bp, Mus musculus
gacctggagaggctaagaaaacacc

SEQ ID NO: 103971 - DNA, 25 bp, Mus musculus
gacctggagcctgactatagcacgg

SEQ ID NO: 103972 - DNA, 25 bp, Mus musculus
gacctggagctactgagaaagcata

SEQ ID NO: 103973 - DNA, 25 bp, Mus musculus
gacctggaggacgtgctgtatttca

SEQ ID NO: 103974 - DNA, 25 bp, Mus musculus
gacctggagttgctggctaccttac

SEQ ID NO: 103975 - DNA, 25 bp, Mus musculus
gacctggatgaacagtggcgccaaa

SEQ ID NO: 103976 - DNA, 25 bp, Mus musculus
gacctggatgtggtacgaaggccac

SEQ ID NO: 103977 - DNA, 25 bp, Mus musculus
gacctggcacgctgacagtaccttg

SEQ ID NO: 103978 - DNA, 25 bp, Mus musculus
gacctggccgtggactttgacaact

SEQ ID NO: 103979 - DNA, 25 bp, Mus musculus
gacctggcggcgtttgctgctcttt

SEQ ID NO: 103980 - DNA, 25 bp, Mus musculus
gacctggctggataggtatgggcca

SEQ ID NO: 103981 - DNA, 25 bp, Mus musculus
gacctggctttccagcagtcgggca

SEQ ID NO: 103982 - DNA, 25 bp, Mus musculus
gacctgggacttttcgggctgtaca

SEQ ID NO: 103983 - DNA, 25 bp, Mus musculus
gacctgggagaccatgcagcatgaa

SEQ ID NO: 103984 - DNA, 25 bp, Mus musculus
gacctgggagcgacctctgcgtcca

SEQ ID NO: 103985 - DNA, 25 bp, Mus musculus
gacctgggtgtcaagatctcggaac

SEQ ID NO: 103986 - DNA, 25 bp, Mus musculus
gacctgggttactgagaatccgaaa

SEQ ID NO: 103987 - DNA, 25 bp, Mus musculus
gacctggtactggtcaagagttttc

SEQ ID NO: 103988 - DNA, 25 bp, Mus musculus
gacctggtcctgaaacttcgggaga

SEQ ID NO: 103989 - DNA, 25 bp, Mus musculus
gacctggtctacatgctgaatggct

SEQ ID NO: 103990 - DNA, 25 bp, Mus musculus
gacctggtctccaaagctgaagcct

SEQ ID NO: 103991 - DNA, 25 bp, Mus musculus
gacctggtctgtcatttcccatggg

SEQ ID NO: 103992 - DNA, 25 bp, Mus musculus
gacctggtgaacgtcggattggccc

SEQ ID NO: 103993 - DNA, 25 bp, Mus musculus
gacctggtgctacgcaagaacgaga

SEQ ID NO: 103994 - DNA, 25 bp, Mus musculus
gacctggtgggcaaccgtagatttg

SEQ ID NO: 103995 - DNA, 25 bp, Mus musculus
gacctggtgtctcgagtaaagccct

SEQ ID NO: 103996 - DNA, 25 bp, Mus musculus
gacctggttgggtggccagactaaa

SEQ ID NO: 103997 - DNA, 25 bp, Mus musculus
gacctgtaaccgagtccatgtggca

SEQ ID NO: 103998 - DNA, 25 bp, Mus musculus
gacctgtacatgttctggccaagag

SEQ ID NO: 103999 - DNA, 25 bp, Mus musculus
gacctgtcactctgttttctagttg

SEQ ID NO: 104000 - DNA, 25 bp, Mus musculus
gacctgtcattgcaagctgagacca

SEQ ID NO: 104001 - DNA, 25 bp, Mus musculus
gacctgtctacctcttgggctgtga

SEQ ID NO: 104002 - DNA, 25 bp, Mus musculus
gacctgtctacctgaggagctccag

SEQ ID NO: 104003 - DNA, 25 bp, Mus musculus
gacctgtctctaggcaggaaaggag

SEQ ID NO: 104004 - DNA, 25 bp, Mus musculus
gacctgtgagtggattcatgactcc

SEQ ID NO: 104005 - DNA, 25 bp, Mus musculus
gacctgtgccgggatcttcggagcc

SEQ ID NO: 104006 - DNA, 25 bp, Mus musculus
gacctgtggccaagttcttagtagc

SEQ ID NO: 104007 - DNA, 25 bp, Mus musculus
gacctgtggtggttccacgaggact

SEQ ID NO: 104008 - DNA, 25 bp, Mus musculus
gacctgtgtcggattctgaagctgc

SEQ ID NO: 104009 - DNA, 25 bp, Mus musculus
gacctgtgtgcccagtcctttacaa

SEQ ID NO: 104010 - DNA, 25 bp, Mus musculus
gacctgttatcgacaagaccttgaa

SEQ ID NO: 104011 - DNA, 25 bp, Mus musculus
gacctgttctgggatgtgacgctga

SEQ ID NO: 104012 - DNA, 25 bp, Mus musculus
gacctgttgcaagagagctccagac

SEQ ID NO: 104013 - DNA, 25 bp, Mus musculus
gacctgttggaagtcctctcgggac

SEQ ID NO: 104014 - DNA, 25 bp, Mus musculus
gaccttaagcccctgagtagtgagg

SEQ ID NO: 104015 - DNA, 25 bp, Mus musculus
gaccttaatcttgagctccggactt

SEQ ID NO: 104016 - DNA, 25 bp, Mus musculus
gaccttaattcaaaaaatggagagc

SEQ ID NO: 104017 - DNA, 25 bp, Mus musculus
gaccttacatctgtgctgagtggga

SEQ ID NO: 104018 - DNA, 25 bp, Mus musculus
gaccttactgactacattgctggag

SEQ ID NO: 104019 - DNA, 25 bp, Mus musculus
gaccttagccaaagaagcccatgtg

SEQ ID NO: 104020 - DNA, 25 bp, Mus musculus
gaccttatagacacggaacgcttcc

SEQ ID NO: 104021 - DNA, 25 bp, Mus musculus
gaccttattgttgcagacctctgac

SEQ ID NO: 104022 - DNA, 25 bp, Mus musculus
gaccttattttatctgcgggtgaag

SEQ ID NO: 104023 - DNA, 25 bp, Mus musculus
gaccttcagatagactcatgtggca

SEQ ID NO: 104024 - DNA, 25 bp, Mus musculus
gaccttcaggatcgcaaaatgccaa

SEQ ID NO: 104025 - DNA, 25 bp, Mus musculus
gaccttcatcgaccgcctggaggtg

SEQ ID NO: 104026 - DNA, 25 bp, Mus musculus
gaccttcctgatggccttacgtgga

SEQ ID NO: 104027 - DNA, 25 bp, Mus musculus
gaccttcgatgtgtgtgtcaatcag

SEQ ID NO: 104028 - DNA, 25 bp, Mus musculus
gaccttcgtctgcaccgctctatgg

SEQ ID NO: 104029 - DNA, 25 bp, Mus musculus
gaccttctccgcaactgtgaatggg

SEQ ID NO: 104030 - DNA, 25 bp, Mus musculus
gaccttctggaaggcataactggct

SEQ ID NO: 104031 - DNA, 25 bp, Mus musculus
gaccttctggcgttggagtcaatga

SEQ ID NO: 104032 - DNA, 25 bp, Mus musculus
gaccttgaatctgtcccggaaccag

SEQ ID NO: 104033 - DNA, 25 bp, Mus musculus
gaccttgagaccctatcggagccta

SEQ ID NO: 104034 - DNA, 25 bp, Mus musculus
gaccttgagcctaaacctatagcct

SEQ ID NO: 104035 - DNA, 25 bp, Mus musculus
gaccttgaggatggtgaaagagccc

SEQ ID NO: 104036 - DNA, 25 bp, Mus musculus
gaccttgatattaaccgacctggga

SEQ ID NO: 104037 - DNA, 25 bp, Mus musculus
gaccttgctactttgggaggatttc

SEQ ID NO: 104038 - DNA, 25 bp, Mus musculus
gaccttgctcccagagaagaaggag

SEQ ID NO: 104039 - DNA, 25 bp, Mus musculus
gaccttgctttggaactgactacta

SEQ ID NO: 104040 - DNA, 25 bp, Mus musculus
gaccttggaggagtacagaactacc

SEQ ID NO: 104041 - DNA, 25 bp, Mus musculus
gaccttggattgtgttgggcctcga

SEQ ID NO: 104042 - DNA, 25 bp, Mus musculus
gaccttggcactgggcgttctcctg

SEQ ID NO: 104043 - DNA, 25 bp, Mus musculus
gaccttgggagagacagcacgaaat

SEQ ID NO: 104044 - DNA, 25 bp, Mus musculus
gaccttgggttatggagcagagaaa

SEQ ID NO: 104045 - DNA, 25 bp, Mus musculus
gaccttggtactgtggatggactcg

SEQ ID NO: 104046 - DNA, 25 bp, Mus musculus
gaccttgtagaccagagcatccaga

SEQ ID NO: 104047 - DNA, 25 bp, Mus musculus
gaccttgttgctatacagcgccgga

SEQ ID NO: 104048 - DNA, 25 bp, Mus musculus
gaccttgttgtttgtctcgaccctg

SEQ ID NO: 104049 - DNA, 25 bp, Mus musculus
gacctttacactatgggtgacccag

SEQ ID NO: 104050 - DNA, 25 bp, Mus musculus
gacctttaccgtatcagcgagctgg

SEQ ID NO: 104051 - DNA, 25 bp, Mus musculus
gacctttactgtcacaagccgccag

SEQ ID NO: 104052 - DNA, 25 bp, Mus musculus
gacctttatagtgctccagttgagg

SEQ ID NO: 104053 - DNA, 25 bp, Mus musculus
gacctttatgcttggacagatggaa

SEQ ID NO: 104054 - DNA, 25 bp, Mus musculus
gacctttatggcaagtgcacccaga

SEQ ID NO: 104055 - DNA, 25 bp, Mus musculus
gacctttcggcgaaccgcagaacca

SEQ ID NO: 104056 - DNA, 25 bp, Mus musculus
gacctttctaagatgatggccctga

SEQ ID NO: 104057 - DNA, 25 bp, Mus musculus
gacctttgaccctatccttgttgag

SEQ ID NO: 104058 - DNA, 25 bp, Mus musculus
gacctttggaaagatgaaaccacgc

SEQ ID NO: 104059 - DNA, 25 bp, Mus musculus
gacctttggagatcgcctagcaacc

SEQ ID NO: 104060 - DNA, 25 bp, Mus musculus
gacctttggatgtggaaatttacac

SEQ ID NO: 104061 - DNA, 25 bp, Mus musculus
gaccttttccgtatcatcccaggca

SEQ ID NO: 104062 - DNA, 25 bp, Mus musculus
gaccttttgaagtgatggcgcaaca

SEQ ID NO: 104063 - DNA, 25 bp, Mus musculus
gaccttttggcatggcccaaacagg

SEQ ID NO: 104064 - DNA, 25 bp, Mus musculus
gacgaaaaactcctgccccagcttt

SEQ ID NO: 104065 - DNA, 25 bp, Mus musculus
gacgaaatgacccttgcgctgacga

SEQ ID NO: 104066 - DNA, 25 bp, Mus musculus
gacgaaattcctcggcctaagatga

SEQ ID NO: 104067 - DNA, 25 bp, Mus musculus
gacgaacagtgatgaactcccaggc

SEQ ID NO: 104068 - DNA, 25 bp, Mus musculus
gacgaactgaaacggtacaaactgg

SEQ ID NO: 104069 - DNA, 25 bp, Mus musculus
gacgaacttttcctgcagctggcta

SEQ ID NO: 104070 - DNA, 25 bp, Mus musculus
gacgaagaaagccatcaaataccag

SEQ ID NO: 104071 - DNA, 25 bp, Mus musculus
gacgaagagaattttgaagaagcca

SEQ ID NO: 104072 - DNA, 25 bp, Mus musculus
gacgaagagagtatgagtagtgtta

SEQ ID NO: 104073 - DNA, 25 bp, Mus musculus
gacgaagagctcgaggagatcaaga

SEQ ID NO: 104074 - DNA, 25 bp, Mus musculus
gacgaagcctatgataccatggtgg

SEQ ID NO: 104075 - DNA, 25 bp, Mus musculus
gacgaaggatgctgccttgaaagca

SEQ ID NO: 104076 - DNA, 25 bp, Mus musculus
gacgaagggcactgatgtctcttct

SEQ ID NO: 104077 - DNA, 25 bp, Mus musculus
gacgaaggtggcatatcccctggga

SEQ ID NO: 104078 - DNA, 25 bp, Mus musculus
gacgaaggtggtgctacctccaagg

SEQ ID NO: 104079 - DNA, 25 bp, Mus musculus
gacgaatatgacgagaacagttcgt

SEQ ID NO: 104080 - DNA, 25 bp, Mus musculus
gacgaatcttgtcaagcaagctggg

SEQ ID NO: 104081 - DNA, 25 bp, Mus musculus
gacgaatggcagaagaattactgtg

SEQ ID NO: 104082 - DNA, 25 bp, Mus musculus
gacgacaaagttgcgccggcgtcct

SEQ ID NO: 104083 - DNA, 25 bp, Mus musculus
gacgacacccagtatggacctacag

SEQ ID NO: 104084 - DNA, 25 bp, Mus musculus
gacgacaccgatgagtcccactgtg

SEQ ID NO: 104085 - DNA, 25 bp, Mus musculus
gacgacagagagaggaataagtgga

SEQ ID NO: 104086 - DNA, 25 bp, Mus musculus
gacgacaggcggatacaaaagctat

SEQ ID NO: 104087 - DNA, 25 bp, Mus musculus
gacgacatccgagggaagtgcactg

SEQ ID NO: 104088 - DNA, 25 bp, Mus musculus
gacgacatgcctggagttcttctcc

SEQ ID NO: 104089 - DNA, 25 bp, Mus musculus
gacgaccaccagataattcctttta

SEQ ID NO: 104090 - DNA, 25 bp, Mus musculus
gacgaccaggaggtggaagagctga

SEQ ID NO: 104091 - DNA, 25 bp, Mus musculus
gacgaccatgccgaacttttgcgct

SEQ ID NO: 104092 - DNA, 25 bp, Mus musculus
gacgaccccagtgataaaaagccag

SEQ ID NO: 104093 - DNA, 25 bp, Mus musculus
gacgaccgcacacgctttgtttgga

SEQ ID NO: 104094 - DNA, 25 bp, Mus musculus
gacgaccgtggttctgtctgcttga

SEQ ID NO: 104095 - DNA, 25 bp, Mus musculus
gacgacctccatgacttccgtagag

SEQ ID NO: 104096 - DNA, 25 bp, Mus musculus
gacgacctggtagattctctctaac

SEQ ID NO: 104097 - DNA, 25 bp, Mus musculus
gacgaccttgtcactgagtttggag

SEQ ID NO: 104098 - DNA, 25 bp, Mus musculus
gacgacctttaacgtccaggatgga

SEQ ID NO: 104099 - DNA, 25 bp, Mus musculus
gacgacgagtcggacccgttcgaca

SEQ ID NO: 104100 - DNA, 25 bp, Mus musculus
gacgacgatgatgacagcagcgaga

SEQ ID NO: 104101 - DNA, 25 bp, Mus musculus
gacgacgctaacagaacgggtgcta

SEQ ID NO: 104102 - DNA, 25 bp, Mus musculus
gacgacgtcagtgacaacagcgctg

SEQ ID NO: 104103 - DNA, 25 bp, Mus musculus
gacgacgtccgtggctgagagttta

SEQ ID NO: 104104 - DNA, 25 bp, Mus musculus
gacgactgggagaccatatctgcct

SEQ ID NO: 104105 - DNA, 25 bp, Mus musculus
gacgacttcacagaggaacgcctgg

SEQ ID NO: 104106 - DNA, 25 bp, Mus musculus
gacgacttcctaaggtatgcatgga

SEQ ID NO: 104107 - DNA, 25 bp, Mus musculus
gacgacttgagatgtatgcccggga

SEQ ID NO: 104108 - DNA, 25 bp, Mus musculus
gacgacttgatcaaaagggccctcc

SEQ ID NO: 104109 - DNA, 25 bp, Mus musculus
gacgactttagtgttcaccagctga

SEQ ID NO: 104110 - DNA, 25 bp, Mus musculus
gacgagaattcagaaagaccctgcc

SEQ ID NO: 104111 - DNA, 25 bp, Mus musculus
gacgagacctgcagcggtggcagaa

SEQ ID NO: 104112 - DNA, 25 bp, Mus musculus
gacgagatgtgctgagttttgccca

SEQ ID NO: 104113 - DNA, 25 bp, Mus musculus
gacgagcaagttcctactgtccggc

SEQ ID NO: 104114 - DNA, 25 bp, Mus musculus
gacgagccatcagtgaagaccatga

SEQ ID NO: 104115 - DNA, 25 bp, Mus musculus
gacgagcccctgacgcggttagatg

SEQ ID NO: 104116 - DNA, 25 bp, Mus musculus
gacgagccggatgagtttctacagg

SEQ ID NO: 104117 - DNA, 25 bp, Mus musculus
gacgagcgcttgtccgtgggtagtc

SEQ ID NO: 104118 - DNA, 25 bp, Mus musculus
gacgagctcatgaaaaagatcagcc

SEQ ID NO: 104119 - DNA, 25 bp, Mus musculus
gacgagctctatctggaacccttga

SEQ ID NO: 104120 - DNA, 25 bp, Mus musculus
gacgagctgatcttactgtgccaaa

SEQ ID NO: 104121 - DNA, 25 bp, Mus musculus
gacgagctgcctaccacgtagaaga

SEQ ID NO: 104122 - DNA, 25 bp, Mus musculus
gacgagctttgcacttactatcaga

SEQ ID NO: 104123 - DNA, 25 bp, Mus musculus
gacgaggacggaggccgttctccac

SEQ ID NO: 104124 - DNA, 25 bp, Mus musculus
gacgaggacttcaaattacaggacc

SEQ ID NO: 104125 - DNA, 25 bp, Mus musculus
gacgaggcttcctgctctggtacag

SEQ ID NO: 104126 - DNA, 25 bp, Mus musculus
gacgagggctcttacacatgcagtg

SEQ ID NO: 104127 - DNA, 25 bp, Mus musculus
gacgaggtcaccttcaaaagtgaca

SEQ ID NO: 104128 - DNA, 25 bp, Mus musculus
gacgaggtgttctcaactcaaggcc

SEQ ID NO: 104129 - DNA, 25 bp, Mus musculus
gacgaggtttacattctccgatgca

SEQ ID NO: 104130 - DNA, 25 bp, Mus musculus
gacgagtacttgttggccaggttca

SEQ ID NO: 104131 - DNA, 25 bp, Mus musculus
gacgagtagacaagaacgtgcccct

SEQ ID NO: 104132 - DNA, 25 bp, Mus musculus
gacgagtcagcctgcatcgcctata

SEQ ID NO: 104133 - DNA, 25 bp, Mus musculus
gacgagtctatcttccttaagacac

SEQ ID NO: 104134 - DNA, 25 bp, Mus musculus
gacgagtgccacagccatgctatgc

SEQ ID NO: 104135 - DNA, 25 bp, Mus musculus
gacgagtggccttaagcagtcaccg

SEQ ID NO: 104136 - DNA, 25 bp, Mus musculus
gacgagtgtgctcagcatagttgcc

SEQ ID NO: 104137 - DNA, 25 bp, Mus musculus
gacgatacattttcagacacgctga

SEQ ID NO: 104138 - DNA, 25 bp, Mus musculus
gacgatagttccaagaagccccagt

SEQ ID NO: 104139 - DNA, 25 bp, Mus musculus
gacgatatcgctgcgctggtcgtcg

SEQ ID NO: 104140 - DNA, 25 bp, Mus musculus
gacgatattgtcaaccccagattgg

SEQ ID NO: 104141 - DNA, 25 bp, Mus musculus
gacgatcaaggcctggttatccacc

SEQ ID NO: 104142 - DNA, 25 bp, Mus musculus
gacgatcacacagaccttgccattg

SEQ ID NO: 104143 - DNA, 25 bp, Mus musculus
gacgatcagggtctcaggattcaca

SEQ ID NO: 104144 - DNA, 25 bp, Mus musculus
gacgatccagcactatctgcggtga

SEQ ID NO: 104145 - DNA, 25 bp, Mus musculus
gacgatccggctgtcattagcttga

SEQ ID NO: 104146 - DNA, 25 bp, Mus musculus
gacgatctgccatgccttacggtgt

SEQ ID NO: 104147 - DNA, 25 bp, Mus musculus
gacgatcttcagacgtgtggaacct

SEQ ID NO: 104148 - DNA, 25 bp, Mus musculus
gacgatgaagaaattgagcggcgcc

SEQ ID NO: 104149 - DNA, 25 bp, Mus musculus
gacgatgacaagaacaacgacggct

SEQ ID NO: 104150 - DNA, 25 bp, Mus musculus
gacgatgacggattaccacacgggt

SEQ ID NO: 104151 - DNA, 25 bp, Mus musculus
gacgatgagatcctagacagctgct

SEQ ID NO: 104152 - DNA, 25 bp, Mus musculus
gacgatgatatcacgcatgttgaag

SEQ ID NO: 104153 - DNA, 25 bp, Mus musculus
gacgatgcgctctttgccctgtgag

SEQ ID NO: 104154 - DNA, 25 bp, Mus musculus
gacgatggcaacactctctatgtgg

SEQ ID NO: 104155 - DNA, 25 bp, Mus musculus
gacgatggccaccatgtcttcggca

SEQ ID NO: 104156 - DNA, 25 bp, Mus musculus
gacgatgggaccactgagaagctga

SEQ ID NO: 104157 - DNA, 25 bp, Mus musculus
gacgatggtgtgtatgctgtgcccc

SEQ ID NO: 104158 - DNA, 25 bp, Mus musculus
gacgatgtcatgctcttctatacca

SEQ ID NO: 104159 - DNA, 25 bp, Mus musculus
gacgattatgttcgagtaacccagc

SEQ ID NO: 104160 - DNA, 25 bp, Mus musculus
gacgatttggaagagcctcgctcct

SEQ ID NO: 104161 - DNA, 25 bp, Mus musculus
gacgatttggtacacagacgacaca

SEQ ID NO: 104162 - DNA, 25 bp, Mus musculus
gacgcaacgctgtgcgattccgaag

SEQ ID NO: 104163 - DNA, 25 bp, Mus musculus
gacgcaatactctttcttctaagga

SEQ ID NO: 104164 - DNA, 25 bp, Mus musculus
gacgcacaccgcagcattgagaagt

SEQ ID NO: 104165 - DNA, 25 bp, Mus musculus
gacgcacctgttctctatctgggaa

SEQ ID NO: 104166 - DNA, 25 bp, Mus musculus
gacgcacgtagcacgcattggacca

SEQ ID NO: 104167 - DNA, 25 bp, Mus musculus
gacgcactacagaaatggcttcagc

SEQ ID NO: 104168 - DNA, 25 bp, Mus musculus
gacgcactggagcacattatggaac

SEQ ID NO: 104169 - DNA, 25 bp, Mus musculus
gacgcagaacctttcaaccctgaca

SEQ ID NO: 104170 - DNA, 25 bp, Mus musculus
gacgcagagcaaagccatgaccatg

SEQ ID NO: 104171 - DNA, 25 bp, Mus musculus
gacgcagagcctttgcacttttccc

SEQ ID NO: 104172 - DNA, 25 bp, Mus musculus
gacgcagcagctgctgaagaccgcg

SEQ ID NO: 104173 - DNA, 25 bp, Mus musculus
gacgcagccacagtcagtgagatcg

SEQ ID NO: 104174 - DNA, 25 bp, Mus musculus
gacgcagcgtcatctatatccacgg

SEQ ID NO: 104175 - DNA, 25 bp, Mus musculus
gacgcagctgaagagttccatccct

SEQ ID NO: 104176 - DNA, 25 bp, Mus musculus
gacgcaggccgagattatcaaacaa

SEQ ID NO: 104177 - DNA, 25 bp, Mus musculus
gacgcaggctcgactggaagcttta

SEQ ID NO: 104178 - DNA, 25 bp, Mus musculus
gacgcagggaggtttccgtcctgtc

SEQ ID NO: 104179 - DNA, 25 bp, Mus musculus
gacgcaggtgtcatcggtgagcacc

SEQ ID NO: 104180 - DNA, 25 bp, Mus musculus
gacgcagtgacagattcctcagggt

SEQ ID NO: 104181 - DNA, 25 bp, Mus musculus
gacgcagtgatgtatgcctccacgg

SEQ ID NO: 104182 - DNA, 25 bp, Mus musculus
gacgcagtgtctgagtcatcttgca

SEQ ID NO: 104183 - DNA, 25 bp, Mus musculus
gacgcagtttcatctcattcctgag

SEQ ID NO: 104184 - DNA, 25 bp, Mus musculus
gacgcatcgcgtctggatcttcgaa

SEQ ID NO: 104185 - DNA, 25 bp, Mus musculus
gacgcatcgctcagaaagtacttcg

SEQ ID NO: 104186 - DNA, 25 bp, Mus musculus
gacgcatcggattagaaggctgcct

SEQ ID NO: 104187 - DNA, 25 bp, Mus musculus
gacgcatcgttgatggccatgagac

SEQ ID NO: 104188 - DNA, 25 bp, Mus musculus
gacgcatgtgctacgccatcattca

SEQ ID NO: 104189 - DNA, 25 bp, Mus musculus
gacgcattgctaacacccatttgaa

SEQ ID NO: 104190 - DNA, 25 bp, Mus musculus
gacgccaatttactcactgacaccg

SEQ ID NO: 104191 - DNA, 25 bp, Mus musculus
gacgccacaacctgctggcagtggt

SEQ ID NO: 104192 - DNA, 25 bp, Mus musculus
gacgccactccattgggcagctttc

SEQ ID NO: 104193 - DNA, 25 bp, Mus musculus
gacgccagcatcttcgatagtcacg

SEQ ID NO: 104194 - DNA, 25 bp, Mus musculus
gacgccaggctcaggtttgaacagg

SEQ ID NO: 104195 - DNA, 25 bp, Mus musculus
gacgccagtacctgctacgtttgaa

SEQ ID NO: 104196 - DNA, 25 bp, Mus musculus
gacgccatccgggaattcgccatgg

SEQ ID NO: 104197 - DNA, 25 bp, Mus musculus
gacgccatgagtaggtacaccagcc

SEQ ID NO: 104198 - DNA, 25 bp, Mus musculus
gacgccatgcgcctgtactatgttt

SEQ ID NO: 104199 - DNA, 25 bp, Mus musculus
gacgccatggagatctgctctgagc

SEQ ID NO: 104200 - DNA, 25 bp, Mus musculus
gacgccattgagacgaacattcaag

SEQ ID NO: 104201 - DNA, 25 bp, Mus musculus
gacgccgatgtaacgctgattctca

SEQ ID NO: 104202 - DNA, 25 bp, Mus musculus
gacgccgcgggcatggactattcgt

SEQ ID NO: 104203 - DNA, 25 bp, Mus musculus
gacgccgctgtgagtcagtcatcaa

SEQ ID NO: 104204 - DNA, 25 bp, Mus musculus
gacgccgggctgtcattctgaaatt

SEQ ID NO: 104205 - DNA, 25 bp, Mus musculus
gacgccgtcacagcttgcaaagaag

SEQ ID NO: 104206 - DNA, 25 bp, Mus musculus
gacgcctcgctacagatgaacagca

SEQ ID NO: 104207 - DNA, 25 bp, Mus musculus
gacgcctgctcctgaatgtcctagg

SEQ ID NO: 104208 - DNA, 25 bp, Mus musculus
gacgccttatgtggtgactcgctac

SEQ ID NO: 104209 - DNA, 25 bp, Mus musculus
gacgccttcacggatctcaagaatg

SEQ ID NO: 104210 - DNA, 25 bp, Mus musculus
gacgccttgagtgacgacagcatga

SEQ ID NO: 104211 - DNA, 25 bp, Mus musculus
gacgcgaaaacttgaaaacgcccat

SEQ ID NO: 104212 - DNA, 25 bp, Mus musculus
gacgcgatattacagagcccctgag

SEQ ID NO: 104213 - DNA, 25 bp, Mus musculus
gacgcgcaccatcgaggacgtttct

SEQ ID NO: 104214 - DNA, 25 bp, Mus musculus
gacgcgcactgtgaagacttgactg

SEQ ID NO: 104215 - DNA, 25 bp, Mus musculus
gacgcgcagctcatgggaagaaaca

SEQ ID NO: 104216 - DNA, 25 bp, Mus musculus
gacgcgcatctggagcaagatccaa

SEQ ID NO: 104217 - DNA, 25 bp, Mus musculus
gacgcgcccaggaaaagacttagag

SEQ ID NO: 104218 - DNA, 25 bp, Mus musculus
gacgcggcttgtggagatcgataac

SEQ ID NO: 104219 - DNA, 25 bp, Mus musculus
gacgcgggggaggcgcgcggcacgg

SEQ ID NO: 104220 - DNA, 25 bp, Mus musculus
gacgcggttgtaccggttgccaact

SEQ ID NO: 104221 - DNA, 25 bp, Mus musculus
gacgcgtacacctataaggaccgag

SEQ ID NO: 104222 - DNA, 25 bp, Mus musculus
gacgcgtaccgtggatatactcaaa

SEQ ID NO: 104223 - DNA, 25 bp, Mus musculus
gacgcgtacgcccacaaatgtttga

SEQ ID NO: 104224 - DNA, 25 bp, Mus musculus
gacgcgtaggccaccggacgggagg

SEQ ID NO: 104225 - DNA, 25 bp, Mus musculus
gacgcgtatagaacattaatcttcg

SEQ ID NO: 104226 - DNA, 25 bp, Mus musculus
gacgctaatctccacaacactgttg

SEQ ID NO: 104227 - DNA, 25 bp, Mus musculus
gacgctacagtccagcacatgggag

SEQ ID NO: 104228 - DNA, 25 bp, Mus musculus
gacgctagactagggaatgccccgt

SEQ ID NO: 104229 - DNA, 25 bp, Mus musculus
gacgctcaatgaatgggactccagg

SEQ ID NO: 104230 - DNA, 25 bp, Mus musculus
gacgctcatggctctgctttccgga

SEQ ID NO: 104231 - DNA, 25 bp, Mus musculus
gacgctcgaaggctcccagactcag

SEQ ID NO: 104232 - DNA, 25 bp, Mus musculus
gacgctctacgaactggatattgaa

SEQ ID NO: 104233 - DNA, 25 bp, Mus musculus
gacgctctcggagcagagacagaga

SEQ ID NO: 104234 - DNA, 25 bp, Mus musculus
gacgctctgtcgtggactctctgga

SEQ ID NO: 104235 - DNA, 25 bp, Mus musculus
gacgctgaaccactaccaggacatg

SEQ ID NO: 104236 - DNA, 25 bp, Mus musculus
gacgctgagcagcaactacaagcct

SEQ ID NO: 104237 - DNA, 25 bp, Mus musculus
gacgctgaggatccacgaaaggctt

SEQ ID NO: 104238 - DNA, 25 bp, Mus musculus
gacgctgattgtgcgcatcctgaag

SEQ ID NO: 104239 - DNA, 25 bp, Mus musculus
gacgctgcagactatccctttgaag

SEQ ID NO: 104240 - DNA, 25 bp, Mus musculus
gacgctgccctttctgacctggaga

SEQ ID NO: 104241 - DNA, 25 bp, Mus musculus
gacgctgcgttaacatcattgggag

SEQ ID NO: 104242 - DNA, 25 bp, Mus musculus
gacgctggaaaaatgtgggcacaac

SEQ ID NO: 104243 - DNA, 25 bp, Mus musculus
gacgctggagcgcagagcatgagga

SEQ ID NO: 104244 - DNA, 25 bp, Mus musculus
gacgctggcccacttgatcaatgga

SEQ ID NO: 104245 - DNA, 25 bp, Mus musculus
gacgctgtcagcatgtatgcacggg

SEQ ID NO: 104246 - DNA, 25 bp, Mus musculus
gacgctgttgttactgccttcccat

SEQ ID NO: 104247 - DNA, 25 bp, Mus musculus
gacgcttatgtaactgtgcacatca

SEQ ID NO: 104248 - DNA, 25 bp, Mus musculus
gacgcttcacttttcttcgaggaca

SEQ ID NO: 104249 - DNA, 25 bp, Mus musculus
gacgcttctccatgttggctatgct

SEQ ID NO: 104250 - DNA, 25 bp, Mus musculus
gacgctttacggactctggcggaag

SEQ ID NO: 104251 - DNA, 25 bp, Mus musculus
gacggaaaccgacccgcttagagct

SEQ ID NO: 104252 - DNA, 25 bp, Mus musculus
gacggaaatcgttgctaatctgtgg

SEQ ID NO: 104253 - DNA, 25 bp, Mus musculus
gacggaaccgctacaaggaagagat

SEQ ID NO: 104254 - DNA, 25 bp, Mus musculus
gacggaagcacacacctttaggaga

SEQ ID NO: 104255 - DNA, 25 bp, Mus musculus
gacggaagcgcagagcggacggaag

SEQ ID NO: 104256 - DNA, 25 bp, Mus musculus
gacggaatttcaacaagcaagccac

SEQ ID NO: 104257 - DNA, 25 bp, Mus musculus
gacggacagacgtggaagatctacc

SEQ ID NO: 104258 - DNA, 25 bp, Mus musculus
gacggacctactgcgagcagagcag

SEQ ID NO: 104259 - DNA, 25 bp, Mus musculus
gacggacgctcatgccaactgtgaa

SEQ ID NO: 104260 - DNA, 25 bp, Mus musculus
gacggacggaatgacttctattgct

SEQ ID NO: 104261 - DNA, 25 bp, Mus musculus
gacggactctacagctcaagcggag

SEQ ID NO: 104262 - DNA, 25 bp, Mus musculus
gacggactgagaggacacaggttac

SEQ ID NO: 104263 - DNA, 25 bp, Mus musculus
gacggagaccttcagcgtggaatct

SEQ ID NO: 104264 - DNA, 25 bp, Mus musculus
gacggagatacaggcaggattcccc

SEQ ID NO: 104265 - DNA, 25 bp, Mus musculus
gacggagcgagcacggcaagtgctg

SEQ ID NO: 104266 - DNA, 25 bp, Mus musculus
gacggaggaggtgatgttcaatccc

SEQ ID NO: 104267 - DNA, 25 bp, Mus musculus
gacggaggatggctcattccctgaa

SEQ ID NO: 104268 - DNA, 25 bp, Mus musculus
gacggataccacagaacccaaggta

SEQ ID NO: 104269 - DNA, 25 bp, Mus musculus
gacggatcagtcactcacagaggca

SEQ ID NO: 104270 - DNA, 25 bp, Mus musculus
gacggatcctgggtagcctatgaag

SEQ ID NO: 104271 - DNA, 25 bp, Mus musculus
gacggatctcgtagctgtttgggac

SEQ ID NO: 104272 - DNA, 25 bp, Mus musculus
gacggattccgatctaccggctgga

SEQ ID NO: 104273 - DNA, 25 bp, Mus musculus
gacggattgtcccacggttctcaga

SEQ ID NO: 104274 - DNA, 25 bp, Mus musculus
gacggatttcatggctcaagagcga

SEQ ID NO: 104275 - DNA, 25 bp, Mus musculus
gacggcaaatatcacgtggtgcgct

SEQ ID NO: 104276 - DNA, 25 bp, Mus musculus
gacggcaacgtctcctattggcaca

SEQ ID NO: 104277 - DNA, 25 bp, Mus musculus
gacggcaagtgcgaatgcagccccg

SEQ ID NO: 104278 - DNA, 25 bp, Mus musculus
gacggcactttccttgtccgggaga

SEQ ID NO: 104279 - DNA, 25 bp, Mus musculus
gacggcagatgcaactacttcgtag

SEQ ID NO: 104280 - DNA, 25 bp, Mus musculus
gacggcaggattatcctctttgaca

SEQ ID NO: 104281 - DNA, 25 bp, Mus musculus
gacggccagaccgaactcaggcttt

SEQ ID NO: 104282 - DNA, 25 bp, Mus musculus
gacggccagtggcttttctcccaaa

SEQ ID NO: 104283 - DNA, 25 bp, Mus musculus
gacggcccagaagacaacagtattc

SEQ ID NO: 104284 - DNA, 25 bp, Mus musculus
gacggccccgtgtatgagaaatgca

SEQ ID NO: 104285 - DNA, 25 bp, Mus musculus
gacggccgcccattacaagaggtca

SEQ ID NO: 104286 - DNA, 25 bp, Mus musculus
gacggccggtccttgggcctcacga

SEQ ID NO: 104287 - DNA, 25 bp, Mus musculus
gacggcctgcgtgttgtaaataaag

SEQ ID NO: 104288 - DNA, 25 bp, Mus musculus
gacggccttggatggtaaatatcag

SEQ ID NO: 104289 - DNA, 25 bp, Mus musculus
gacggcgacgactataagagcagca

SEQ ID NO: 104290 - DNA, 25 bp, Mus musculus
gacggcgcatacttcggcactggtt

SEQ ID NO: 104291 - DNA, 25 bp, Mus musculus
gacggcgggcaagtctactatcacg

SEQ ID NO: 104292 - DNA, 25 bp, Mus musculus
gacggcgttggttcgagaagacctt

SEQ ID NO: 104293 - DNA, 25 bp, Mus musculus
gacggctacatcgactacgctgagt

SEQ ID NO: 104294 - DNA, 25 bp, Mus musculus
gacggctactttggagaccctctgg

SEQ ID NO: 104295 - DNA, 25 bp, Mus musculus
gacggctatgtctacacatgggcta

SEQ ID NO: 104296 - DNA, 25 bp, Mus musculus
gacggctcagagcaacagtgccaag

SEQ ID NO: 104297 - DNA, 25 bp, Mus musculus
gacggctcgtctacaagtttggcaa

SEQ ID NO: 104298 - DNA, 25 bp, Mus musculus
gacggctgacctttgtggacgactg

SEQ ID NO: 104299 - DNA, 25 bp, Mus musculus
gacggctggctttttgcacatccct

SEQ ID NO: 104300 - DNA, 25 bp, Mus musculus
gacggcttagtgtaggatcctctcg

SEQ ID NO: 104301 - DNA, 25 bp, Mus musculus
gacggcttcctgaggagacggccct

SEQ ID NO: 104302 - DNA, 25 bp, Mus musculus
gacggcttggcaatctggtacacaa

SEQ ID NO: 104303 - DNA, 25 bp, Mus musculus
gacggctttagagctgactacctga

SEQ ID NO: 104304 - DNA, 25 bp, Mus musculus
gacggctttcaacgactggagcaag

SEQ ID NO: 104305 - DNA, 25 bp, Mus musculus
gacgggaaaacctactgcaagcggg

SEQ ID NO: 104306 - DNA, 25 bp, Mus musculus
gacgggaaacttgaggacctaccat

SEQ ID NO: 104307 - DNA, 25 bp, Mus musculus
gacgggacacggagaaagcttatca

SEQ ID NO: 104308 - DNA, 25 bp, Mus musculus
gacgggacatctccaacacgcttat

SEQ ID NO: 104309 - DNA, 25 bp, Mus musculus
gacgggaccaacgtgaacaactggc

SEQ ID NO: 104310 - DNA, 25 bp, Mus musculus
gacgggaccaccacctatgtgaacg

SEQ ID NO: 104311 - DNA, 25 bp, Mus musculus
gacgggacccatttccagaagaact

SEQ ID NO: 104312 - DNA, 25 bp, Mus musculus
gacgggactacacctttgatgctgg

SEQ ID NO: 104313 - DNA, 25 bp, Mus musculus
gacgggactattgaaggctgtgacc

SEQ ID NO: 104314 - DNA, 25 bp, Mus musculus
gacgggactctgcaatccggaagca

SEQ ID NO: 104315 - DNA, 25 bp, Mus musculus
gacgggatgctacttcgtgaagcca

SEQ ID NO: 104316 - DNA, 25 bp, Mus musculus
gacgggcactttccatgactcacgg

SEQ ID NO: 104317 - DNA, 25 bp, Mus musculus
gacgggcagcttcacattaggcaga

SEQ ID NO: 104318 - DNA, 25 bp, Mus musculus
gacgggcctctcagtactaccagga

SEQ ID NO: 104319 - DNA, 25 bp, Mus musculus
gacgggctccatcaagtggacttta

SEQ ID NO: 104320 - DNA, 25 bp, Mus musculus
gacgggctgagctattacactgtga

SEQ ID NO: 104321 - DNA, 25 bp, Mus musculus
gacgggtcaaccactgtcctgagaa

SEQ ID NO: 104322 - DNA, 25 bp, Mus musculus
gacgggttacaacaagctctgcgat

SEQ ID NO: 104323 - DNA, 25 bp, Mus musculus
gacgggttcagacacaggttcgaca

SEQ ID NO: 104324 - DNA, 25 bp, Mus musculus
gacggtatgctggaatggctttgac

SEQ ID NO: 104325 - DNA, 25 bp, Mus musculus
gacggtcagtttgtagccatggcag

SEQ ID NO: 104326 - DNA, 25 bp, Mus musculus
gacggtcatactcaggttgtggctc

SEQ ID NO: 104327 - DNA, 25 bp, Mus musculus
gacggtccaggatgcgctaagtagc

SEQ ID NO: 104328 - DNA, 25 bp, Mus musculus
gacggtcccaaagcttcctgtgtaa

SEQ ID NO: 104329 - DNA, 25 bp, Mus musculus
gacggtcgacaagctgttgaaaggc

SEQ ID NO: 104330 - DNA, 25 bp, Mus musculus
gacggtctcaaacgccatactctaa

SEQ ID NO: 104331 - DNA, 25 bp, Mus musculus
gacggtctctctcagttcctactca

SEQ ID NO: 104332 - DNA, 25 bp, Mus musculus
gacggtgaacgggaaaatgtctcca

SEQ ID NO: 104333 - DNA, 25 bp, Mus musculus
gacggtgcctgtgctgacgagacta

SEQ ID NO: 104334 - DNA, 25 bp, Mus musculus
gacggtgcggtctttctagctgcct

SEQ ID NO: 104335 - DNA, 25 bp, Mus musculus
gacggtgctaccattctcaagaaca

SEQ ID NO: 104336 - DNA, 25 bp, Mus musculus
gacggtgctgatagagaccacggca

SEQ ID NO: 104337 - DNA, 25 bp, Mus musculus
gacggtgtatccctttgactttgca

SEQ ID NO: 104338 - DNA, 25 bp, Mus musculus
gacggtgtcaacatctccaaggagg

SEQ ID NO: 104339 - DNA, 25 bp, Mus musculus
gacggtgtccgctttccagcaacat

SEQ ID NO: 104340 - DNA, 25 bp, Mus musculus
gacggttattcgctctcagtgactg

SEQ ID NO: 104341 - DNA, 25 bp, Mus musculus
gacggttcaagcttcccagacatgt

SEQ ID NO: 104342 - DNA, 25 bp, Mus musculus
gacggttcaggagccgccaaggatt

SEQ ID NO: 104343 - DNA, 25 bp, Mus musculus
gacggtttacagcattcagagaaga

SEQ ID NO: 104344 - DNA, 25 bp, Mus musculus
gacgtaacagggttccaggaatctc

SEQ ID NO: 104345 - DNA, 25 bp, Mus musculus
gacgtaaccaacatcctgcaagctg

SEQ ID NO: 104346 - DNA, 25 bp, Mus musculus
gacgtaatcagagtgtggagcccaa

SEQ ID NO: 104347 - DNA, 25 bp, Mus musculus
gacgtaatccaatcccatgggaggc

SEQ ID NO: 104348 - DNA, 25 bp, Mus musculus
gacgtacagcgacttagccagcact

SEQ ID NO: 104349 - DNA, 25 bp, Mus musculus
gacgtaccagcgtatggagaaccca

SEQ ID NO: 104350 - DNA, 25 bp, Mus musculus
gacgtactgcagaagagagcacctg

SEQ ID NO: 104351 - DNA, 25 bp, Mus musculus
gacgtactgcagatactcaagatcc

SEQ ID NO: 104352 - DNA, 25 bp, Mus musculus
gacgtagaagcatggttattctgca

SEQ ID NO: 104353 - DNA, 25 bp, Mus musculus
gacgtcaagttaaaattcaagccgc

SEQ ID NO: 104354 - DNA, 25 bp, Mus musculus
gacgtcaccctcatagctggagaca

SEQ ID NO: 104355 - DNA, 25 bp, Mus musculus
gacgtcagaacacatacattatgga

SEQ ID NO: 104356 - DNA, 25 bp, Mus musculus
gacgtcagaagaatcccagtgggcc

SEQ ID NO: 104357 - DNA, 25 bp, Mus musculus
gacgtcagcggcatagcttcctgtg

SEQ ID NO: 104358 - DNA, 25 bp, Mus musculus
gacgtcagcgtctaccggattccgc

SEQ ID NO: 104359 - DNA, 25 bp, Mus musculus
gacgtcagcttaattcaggaactag

SEQ ID NO: 104360 - DNA, 25 bp, Mus musculus
gacgtcagtcagtcggtagagccaa

SEQ ID NO: 104361 - DNA, 25 bp, Mus musculus
gacgtcatcactgggcgccgcagtg

SEQ ID NO: 104362 - DNA, 25 bp, Mus musculus
gacgtcattcactttcctccggcag

SEQ ID NO: 104363 - DNA, 25 bp, Mus musculus
gacgtcattttagtcgctggcgacc

SEQ ID NO: 104364 - DNA, 25 bp, Mus musculus
gacgtccagggttatgctgccaaga

SEQ ID NO: 104365 - DNA, 25 bp, Mus musculus
gacgtcccagagataggcagaggct

SEQ ID NO: 104366 - DNA, 25 bp, Mus musculus
gacgtcccggatggcactctggtca

SEQ ID NO: 104367 - DNA, 25 bp, Mus musculus
gacgtccctgttgacccaggtgtgg

SEQ ID NO: 104368 - DNA, 25 bp, Mus musculus
gacgtccgacggctgaaaacaatca

SEQ ID NO: 104369 - DNA, 25 bp, Mus musculus
gacgtccggcttctgcgaatcaaga

SEQ ID NO: 104370 - DNA, 25 bp, Mus musculus
gacgtcctgcatcggacatactcgg

SEQ ID NO: 104371 - DNA, 25 bp, Mus musculus
gacgtcgaccctttgtctatccctg

SEQ ID NO: 104372 - DNA, 25 bp, Mus musculus
gacgtcgccggagacggtggctgtg

SEQ ID NO: 104373 - DNA, 25 bp, Mus musculus
gacgtctgatgaacctcatgcggga

SEQ ID NO: 104374 - DNA, 25 bp, Mus musculus
gacgtctgtcaaatgtatctctgcc

SEQ ID NO: 104375 - DNA, 25 bp, Mus musculus
gacgtctgtcctctccaagtgcgca

SEQ ID NO: 104376 - DNA, 25 bp, Mus musculus
gacgtgacggaagactttctggcca

SEQ ID NO: 104377 - DNA, 25 bp, Mus musculus
gacgtgagagccatgtctgtgaccc

SEQ ID NO: 104378 - DNA, 25 bp, Mus musculus
gacgtgatgaccgagaaggagctcc

SEQ ID NO: 104379 - DNA, 25 bp, Mus musculus
gacgtgcaatttattccgttgtggg

SEQ ID NO: 104380 - DNA, 25 bp, Mus musculus
gacgtgcactttgatacccatgagg

SEQ ID NO: 104381 - DNA, 25 bp, Mus musculus
gacgtgcattggcttcagcatgaag

SEQ ID NO: 104382 - DNA, 25 bp, Mus musculus
gacgtgccgcctttagatcgagaaa

SEQ ID NO: 104383 - DNA, 25 bp, Mus musculus
gacgtgcgagaaactcaaaggcctg

SEQ ID NO: 104384 - DNA, 25 bp, Mus musculus
gacgtgcggctctgtggccatctga

SEQ ID NO: 104385 - DNA, 25 bp, Mus musculus
gacgtgctcatgaagctgtcgggaa

SEQ ID NO: 104386 - DNA, 25 bp, Mus musculus
gacgtgctgtttcttcctgtgctcg

SEQ ID NO: 104387 - DNA, 25 bp, Mus musculus
gacgtggacctgacaaacgatcggt

SEQ ID NO: 104388 - DNA, 25 bp, Mus musculus
gacgtggagaagttcatgcccattg

SEQ ID NO: 104389 - DNA, 25 bp, Mus musculus
gacgtggagcacaccagaagtgact

SEQ ID NO: 104390 - DNA, 25 bp, Mus musculus
gacgtggagctatttcctatgacag

SEQ ID NO: 104391 - DNA, 25 bp, Mus musculus
gacgtggcacgcatatccagaggat

SEQ ID NO: 104392 - DNA, 25 bp, Mus musculus
gacgtggccataagatcagcgacta

SEQ ID NO: 104393 - DNA, 25 bp, Mus musculus
gacgtggcccagatgtatgagaata

SEQ ID NO: 104394 - DNA, 25 bp, Mus musculus
gacgtggctccaccctagctataaa

SEQ ID NO: 104395 - DNA, 25 bp, Mus musculus
gacgtggtaatgaaggccagctcca

SEQ ID NO: 104396 - DNA, 25 bp, Mus musculus
gacgtggtcgcccagttcaatgcag

SEQ ID NO: 104397 - DNA, 25 bp, Mus musculus
gacgtggtgattatgcttctaggca

SEQ ID NO: 104398 - DNA, 25 bp, Mus musculus
gacgtgtatatgactagcaagctag

SEQ ID NO: 104399 - DNA, 25 bp, Mus musculus
gacgtgtccaaatgtgcccgctatg

SEQ ID NO: 104400 - DNA, 25 bp, Mus musculus
gacgtgtcccagaatgtgtcctcgg

SEQ ID NO: 104401 - DNA, 25 bp, Mus musculus
gacgtgtcgcttcacaacttcagtg

SEQ ID NO: 104402 - DNA, 25 bp, Mus musculus
gacgtgtggcatttctggactggcc

SEQ ID NO: 104403 - DNA, 25 bp, Mus musculus
gacgtgttccggaacagccttttcg

SEQ ID NO: 104404 - DNA, 25 bp, Mus musculus
gacgtgttcggaaacctacagaagg

SEQ ID NO: 104405 - DNA, 25 bp, Mus musculus
gacgttaacattcgctcctactcca

SEQ ID NO: 104406 - DNA, 25 bp, Mus musculus
gacgttagcacagcgtttgcatgag

SEQ ID NO: 104407 - DNA, 25 bp, Mus musculus
gacgttcatgccagtctccagtgga

SEQ ID NO: 104408 - DNA, 25 bp, Mus musculus
gacgttccagccctaccaaaaggat

SEQ ID NO: 104409 - DNA, 25 bp, Mus musculus
gacgttccaggccaagtgatgtgat

SEQ ID NO: 104410 - DNA, 25 bp, Mus musculus
gacgttctgcttgtccacttccgaa

SEQ ID NO: 104411 - DNA, 25 bp, Mus musculus
gacgttgacccgatcctgtaaagac

SEQ ID NO: 104412 - DNA, 25 bp, Mus musculus
gacgttgattcagatgaccgccaga

SEQ ID NO: 104413 - DNA, 25 bp, Mus musculus
gacgttgctctgtacgaagtgcacc

SEQ ID NO: 104414 - DNA, 25 bp, Mus musculus
gacgttggacccatgatggcatcga

SEQ ID NO: 104415 - DNA, 25 bp, Mus musculus
gacgtttccaaagtcctgctgggac

SEQ ID NO: 104416 - DNA, 25 bp, Mus musculus
gacgtttgtgatgacatggtggcaa

SEQ ID NO: 104417 - DNA, 25 bp, Mus musculus
gacgtttgtgtcttgccaggagcag

SEQ ID NO: 104418 - DNA, 25 bp, Mus musculus
gactaaagcgttacattcgagcctg

SEQ ID NO: 104419 - DNA, 25 bp, Mus musculus
gactaaaggaggaaccatttcccat

SEQ ID NO: 104420 - DNA, 25 bp, Mus musculus
gactaaagggaaaatattcactgag

SEQ ID NO: 104421 - DNA, 25 bp, Mus musculus
gactaaatggaagcgacagacggcc

SEQ ID NO: 104422 - DNA, 25 bp, Mus musculus
gactaaattcggagaaggtatctgc

SEQ ID NO: 104423 - DNA, 25 bp, Mus musculus
gactaaattcggaggcaagctgggc

SEQ ID NO: 104424 - DNA, 25 bp, Mus musculus
gactaacagacttcggcccaccatg

SEQ ID NO: 104425 - DNA, 25 bp, Mus musculus
gactaacctgatggagcacactgag

SEQ ID NO: 104426 - DNA, 25 bp, Mus musculus
gactaacgcacaactcctctttggg

SEQ ID NO: 104427 - DNA, 25 bp, Mus musculus
gactaactatgctgagtgacccctg

SEQ ID NO: 104428 - DNA, 25 bp, Mus musculus
gactaactgactaacgatgccaccg

SEQ ID NO: 104429 - DNA, 25 bp, Mus musculus
gactaactgcgggtcttgggcgcct

SEQ ID NO: 104430 - DNA, 25 bp, Mus musculus
gactaacttcactagtgccactggg

SEQ ID NO: 104431 - DNA, 25 bp, Mus musculus
gactaagaacagcagtgacacaggc

SEQ ID NO: 104432 - DNA, 25 bp, Mus musculus
gactaagagtctgcatatcggagac

SEQ ID NO: 104433 - DNA, 25 bp, Mus musculus
gactaagtggtacatcccggaacct

SEQ ID NO: 104434 - DNA, 25 bp, Mus musculus
gactaatgtgaagctccccagtggg

SEQ ID NO: 104435 - DNA, 25 bp, Mus musculus
gactaattggtatcgattccctgga

SEQ ID NO: 104436 - DNA, 25 bp, Mus musculus
gactacaaagtgcaagcctggctgg

SEQ ID NO: 104437 - DNA, 25 bp, Mus musculus
gactacaaatctctccaggacatca

SEQ ID NO: 104438 - DNA, 25 bp, Mus musculus
gactacaagcacctcataccaggga

SEQ ID NO: 104439 - DNA, 25 bp, Mus musculus
gactacaagccctatggagacctgg

SEQ ID NO: 104440 - DNA, 25 bp, Mus musculus
gactacaagcggaggagtggccatt

SEQ ID NO: 104441 - DNA, 25 bp, Mus musculus
gactacaaggagagctgcccaagtg

SEQ ID NO: 104442 - DNA, 25 bp, Mus musculus
gactacaaggctaagcatggtagct

SEQ ID NO: 104443 - DNA, 25 bp, Mus musculus
gactacaataaggtggctctcaagg

SEQ ID NO: 104444 - DNA, 25 bp, Mus musculus
gactacacgatggtaccagacacag

SEQ ID NO: 104445 - DNA, 25 bp, Mus musculus
gactacagaacggaagccagtggct

SEQ ID NO: 104446 - DNA, 25 bp, Mus musculus
gactacagcgatgatgacactcagg

SEQ ID NO: 104447 - DNA, 25 bp, Mus musculus
gactacagcgtgattggacgttccc

SEQ ID NO: 104448 - DNA, 25 bp, Mus musculus
gactacagcttcacggcttacgcca

SEQ ID NO: 104449 - DNA, 25 bp, Mus musculus
gactacaggttaagctgggaccccg

SEQ ID NO: 104450 - DNA, 25 bp, Mus musculus
gactacatgttattgccgctggaag

SEQ ID NO: 104451 - DNA, 25 bp, Mus musculus
gactaccagaagctacacgatgcct

SEQ ID NO: 104452 - DNA, 25 bp, Mus musculus
gactaccagaatcgagcagctttcc

SEQ ID NO: 104453 - DNA, 25 bp, Mus musculus
gactaccagaggatgtatgggacac

SEQ ID NO: 104454 - DNA, 25 bp, Mus musculus
gactaccaggtagacagcgcaatct

SEQ ID NO: 104455 - DNA, 25 bp, Mus musculus
gactaccatagtgccgtgcagaaag

SEQ ID NO: 104456 - DNA, 25 bp, Mus musculus
gactaccccgaattactggccagtt

SEQ ID NO: 104457 - DNA, 25 bp, Mus musculus
gactacctcaagaaaactacccagg

SEQ ID NO: 104458 - DNA, 25 bp, Mus musculus
gactacctggtgatgcggaaaacct

SEQ ID NO: 104459 - DNA, 25 bp, Mus musculus
gactacctgtaaaatgcagaagctt

SEQ ID NO: 104460 - DNA, 25 bp, Mus musculus
gactacctttcttcaccaatcactt

SEQ ID NO: 104461 - DNA, 25 bp, Mus musculus
gactacgaccgctaagttatccaca

SEQ ID NO: 104462 - DNA, 25 bp, Mus musculus
gactacgacgttggactgaatgata

SEQ ID NO: 104463 - DNA, 25 bp, Mus musculus
gactacgaggaccagaacactgcct

SEQ ID NO: 104464 - DNA, 25 bp, Mus musculus
gactacggcaaatcaggccacactg

SEQ ID NO: 104465 - DNA, 25 bp, Mus musculus
gactacggctcctagctctggtgga

SEQ ID NO: 104466 - DNA, 25 bp, Mus musculus
gactacgtggctgggaacaagctcc

SEQ ID NO: 104467 - DNA, 25 bp, Mus musculus
gactacgttttggtggccggccact

SEQ ID NO: 104468 - DNA, 25 bp, Mus musculus
gactactaagagctgatgacctcca

SEQ ID NO: 104469 - DNA, 25 bp, Mus musculus
gactactaagggagccaagatcaag

SEQ ID NO: 104470 - DNA, 25 bp, Mus musculus
gactactagccaatgtgagcaggga

SEQ ID NO: 104471 - DNA, 25 bp, Mus musculus
gactactagtgttggcctgcttggc

SEQ ID NO: 104472 - DNA, 25 bp, Mus musculus
gactactccatttgcacttcaggga

SEQ ID NO: 104473 - DNA, 25 bp, Mus musculus
gactactctaagatcgccgagcagc

SEQ ID NO: 104474 - DNA, 25 bp, Mus musculus
gactactgctgcaccaaatccagga

SEQ ID NO: 104475 - DNA, 25 bp, Mus musculus
gactactgttgaaaaacctctgctg

SEQ ID NO: 104476 - DNA, 25 bp, Mus musculus
gactacttcatgtgtttcaaccagc

SEQ ID NO: 104477 - DNA, 25 bp, Mus musculus
gactacttccgcttcagaaacttgg

SEQ ID NO: 104478 - DNA, 25 bp, Mus musculus
gactacttggactgtgcttcgacga

SEQ ID NO: 104479 - DNA, 25 bp, Mus musculus
gactactttgtcaatggaggccaag

SEQ ID NO: 104480 - DNA, 25 bp, Mus musculus
gactacttttctctgggctatgccc

SEQ ID NO: 104481 - DNA, 25 bp, Mus musculus
gactagagagcaccccagctgctgg

SEQ ID NO: 104482 - DNA, 25 bp, Mus musculus
gactagagagtagcctcacactgcg

SEQ ID NO: 104483 - DNA, 25 bp, Mus musculus
gactagagatcaattgccaggaccc

SEQ ID NO: 104484 - DNA, 25 bp, Mus musculus
gactagatggagtgaaaacccttca

SEQ ID NO: 104485 - DNA, 25 bp, Mus musculus
gactagatggtgtctgtggactaca

SEQ ID NO: 104486 - DNA, 25 bp, Mus musculus
gactagcatctctcagtgggttcca

SEQ ID NO: 104487 - DNA, 25 bp, Mus musculus
gactagcccctggacgctttgacta

SEQ ID NO: 104488 - DNA, 25 bp, Mus musculus
gactagccgcccagaggccgccgag

SEQ ID NO: 104489 - DNA, 25 bp, Mus musculus
gactagcggctcattcagcaccatg

SEQ ID NO: 104490 - DNA, 25 bp, Mus musculus
gactagctctgactggacattcgat

SEQ ID NO: 104491 - DNA, 25 bp, Mus musculus
gactaggatcccgatttagatacag

SEQ ID NO: 104492 - DNA, 25 bp, Mus musculus
gactaggcctcctgtgccaatacca

SEQ ID NO: 104493 - DNA, 25 bp, Mus musculus
gactagggcctgagatcatattctg

SEQ ID NO: 104494 - DNA, 25 bp, Mus musculus
gactaggtaactcaagcattgcggg

SEQ ID NO: 104495 - DNA, 25 bp, Mus musculus
gactaggtccagaactgtgtgtagc

SEQ ID NO: 104496 - DNA, 25 bp, Mus musculus
gactaggtggccagaaaaatcgaaa

SEQ ID NO: 104497 - DNA, 25 bp, Mus musculus
gactagtaggccatttcattcacgt

SEQ ID NO: 104498 - DNA, 25 bp, Mus musculus
gactagtcacaaacttgaaggaggt

SEQ ID NO: 104499 - DNA, 25 bp, Mus musculus
gactagtgtactcagcaatgccgac

SEQ ID NO: 104500 - DNA, 25 bp, Mus musculus
gactagttttgaatcccagctctgc

SEQ ID NO: 104501 - DNA, 25 bp, Mus musculus
gactataacaaacgatggtgccacc

SEQ ID NO: 104502 - DNA, 25 bp, Mus musculus
gactataacggactgcccgtgctca

SEQ ID NO: 104503 - DNA, 25 bp, Mus musculus
gactatatcatgaacccaccgttgg

SEQ ID NO: 104504 - DNA, 25 bp, Mus musculus
gactatattctctcctggtacggga

SEQ ID NO: 104505 - DNA, 25 bp, Mus musculus
gactatattgtgcaccagaggatcc

SEQ ID NO: 104506 - DNA, 25 bp, Mus musculus
gactatattttgctgccggacgaaa

SEQ ID NO: 104507 - DNA, 25 bp, Mus musculus
gactatcaatgtactttcctactgc

SEQ ID NO: 104508 - DNA, 25 bp, Mus musculus
gactatcacaggactggagcccaag

SEQ ID NO: 104509 - DNA, 25 bp, Mus musculus
gactatcacattgaggcgggtgcca

SEQ ID NO: 104510 - DNA, 25 bp, Mus musculus
gactatcagtcacaaccctaatttc

SEQ ID NO: 104511 - DNA, 25 bp, Mus musculus
gactatcagtccgtgtgcgatccag

SEQ ID NO: 104512 - DNA, 25 bp, Mus musculus
gactatccagttgatgggctgcctg

SEQ ID NO: 104513 - DNA, 25 bp, Mus musculus
gactatcccaatggcacctggctgg

SEQ ID NO: 104514 - DNA, 25 bp, Mus musculus
gactatcctggagctaggcagtgga

SEQ ID NO: 104515 - DNA, 25 bp, Mus musculus
gactatcgccgcactgtcacagaga

SEQ ID NO: 104516 - DNA, 25 bp, Mus musculus
gactatcgcgagcttcctcaaaaga

SEQ ID NO: 104517 - DNA, 25 bp, Mus musculus
gactatctgtgtaccctggactacc

SEQ ID NO: 104518 - DNA, 25 bp, Mus musculus
gactatgaaaaagagttcactccca

SEQ ID NO: 104519 - DNA, 25 bp, Mus musculus
gactatgaagctgaagggattgcca

SEQ ID NO: 104520 - DNA, 25 bp, Mus musculus
gactatgacaggtcttcccagcacg

SEQ ID NO: 104521 - DNA, 25 bp, Mus musculus
gactatgacagtgtggcctccgatg

SEQ ID NO: 104522 - DNA, 25 bp, Mus musculus
gactatgacatctgcaaatcctggg

SEQ ID NO: 104523 - DNA, 25 bp, Mus musculus
gactatgacgagaaaggctacctcc

SEQ ID NO: 104524 - DNA, 25 bp, Mus musculus
gactatgactggactgaagccacca

SEQ ID NO: 104525 - DNA, 25 bp, Mus musculus
gactatgataccttccccgaggtgc

SEQ ID NO: 104526 - DNA, 25 bp, Mus musculus
gactatgatgcctttgcgccgtacc

SEQ ID NO: 104527 - DNA, 25 bp, Mus musculus
gactatgccgaagctggctgacaca

SEQ ID NO: 104528 - DNA, 25 bp, Mus musculus
gactatgcctatacgggaaaaacaa

SEQ ID NO: 104529 - DNA, 25 bp, Mus musculus
gactatgcggccatccgtgacaact

SEQ ID NO: 104530 - DNA, 25 bp, Mus musculus
gactatggactgaagtcggccctcc

SEQ ID NO: 104531 - DNA, 25 bp, Mus musculus
gactatggcaatgagctgccgccgg

SEQ ID NO: 104532 - DNA, 25 bp, Mus musculus
gactatggcgctcaacaagaatcac

SEQ ID NO: 104533 - DNA, 25 bp, Mus musculus
gactatggctcacatatcgccggga

SEQ ID NO: 104534 - DNA, 25 bp, Mus musculus
gactatgggtacaacggcaagcaca

SEQ ID NO: 104535 - DNA, 25 bp, Mus musculus
gactatggtcaaggaatgaacccca

SEQ ID NO: 104536 - DNA, 25 bp, Mus musculus
gactatggtccctggtgcctgctct

SEQ ID NO: 104537 - DNA, 25 bp, Mus musculus
gactatgtgcttagcgtctccgaaa

SEQ ID NO: 104538 - DNA, 25 bp, Mus musculus
gactatgtgtcaaagaaacccaaac

SEQ ID NO: 104539 - DNA, 25 bp, Mus musculus
gactattcaaaagcaagatgtcgtc

SEQ ID NO: 104540 - DNA, 25 bp, Mus musculus
gactattcgtacgacgaggacctgg

SEQ ID NO: 104541 - DNA, 25 bp, Mus musculus
gactattgtggagcttcctgatgaa

SEQ ID NO: 104542 - DNA, 25 bp, Mus musculus
gactatttcagcactgtggcagcgg

SEQ ID NO: 104543 - DNA, 25 bp, Mus musculus
gactatttggttctggccagcgcgt

SEQ ID NO: 104544 - DNA, 25 bp, Mus musculus
gactattttgtcatctgcgggctgg

SEQ ID NO: 104545 - DNA, 25 bp, Mus musculus
gactcaaatggtcgcctagctaggc

SEQ ID NO: 104546 - DNA, 25 bp, Mus musculus
gactcaacattaactaccaggatgc

SEQ ID NO: 104547 - DNA, 25 bp, Mus musculus
gactcaacgaaagactccaacggtt

SEQ ID NO: 104548 - DNA, 25 bp, Mus musculus
gactcaagactacagaatccatcaa

SEQ ID NO: 104549 - DNA, 25 bp, Mus musculus
gactcaagagtgcaaggacaagccc

SEQ ID NO: 104550 - DNA, 25 bp, Mus musculus
gactcaagcgaagtgacggtcatcg

SEQ ID NO: 104551 - DNA, 25 bp, Mus musculus
gactcaagctgagggacgcagttcg

SEQ ID NO: 104552 - DNA, 25 bp, Mus musculus
gactcaaggagcaactgcggcaatt

SEQ ID NO: 104553 - DNA, 25 bp, Mus musculus
gactcaaggtctggcaaaagatgct

SEQ ID NO: 104554 - DNA, 25 bp, Mus musculus
gactcaagtacagacaaggagccag

SEQ ID NO: 104555 - DNA, 25 bp, Mus musculus
gactcaatgagggacttagccactt

SEQ ID NO: 104556 - DNA, 25 bp, Mus musculus
gactcaatggagtcaacacccctgc

SEQ ID NO: 104557 - DNA, 25 bp, Mus musculus
gactcaattattctaggccgaccta

SEQ ID NO: 104558 - DNA, 25 bp, Mus musculus
gactcaatttctgtccttcaagaca

SEQ ID NO: 104559 - DNA, 25 bp, Mus musculus
gactcacagatcgagaaggaacgag

SEQ ID NO: 104560 - DNA, 25 bp, Mus musculus
gactcacagatttcaagccaggcta

SEQ ID NO: 104561 - DNA, 25 bp, Mus musculus
gactcacaggtcacaaacggtgctg

SEQ ID NO: 104562 - DNA, 25 bp, Mus musculus
gactcacatagggtgcagcaaccag

SEQ ID NO: 104563 - DNA, 25 bp, Mus musculus
gactcaccaagtgaagacccagtct

SEQ ID NO: 104564 - DNA, 25 bp, Mus musculus
gactcaccctgatgactctgtaaaa

SEQ ID NO: 104565 - DNA, 25 bp, Mus musculus
gactcaccgtgggaaaactggacaa

SEQ ID NO: 104566 - DNA, 25 bp, Mus musculus
gactcacctgcaaatgtagatgctg

SEQ ID NO: 104567 - DNA, 25 bp, Mus musculus
gactcacggctggaagcttctcatg

SEQ ID NO: 104568 - DNA, 25 bp, Mus musculus
gactcacggtctttgtgggagccta

SEQ ID NO: 104569 - DNA, 25 bp, Mus musculus
gactcactctccgagggcgatgtgt

SEQ ID NO: 104570 - DNA, 25 bp, Mus musculus
gactcactgatttactggaagacac

SEQ ID NO: 104571 - DNA, 25 bp, Mus musculus
gactcactggaaagatgcaaagcaa

SEQ ID NO: 104572 - DNA, 25 bp, Mus musculus
gactcactgtgatgggaacccagga

SEQ ID NO: 104573 - DNA, 25 bp, Mus musculus
gactcactgtgggaaaagcagcgtt

SEQ ID NO: 104574 - DNA, 25 bp, Mus musculus
gactcagaggctcacttcaactgca

SEQ ID NO: 104575 - DNA, 25 bp, Mus musculus
gactcagatctgtcctctcacgtgg

SEQ ID NO: 104576 - DNA, 25 bp, Mus musculus
gactcagcacagcagttagttcatg

SEQ ID NO: 104577 - DNA, 25 bp, Mus musculus
gactcagcagccacttcgaggtgtg

SEQ ID NO: 104578 - DNA, 25 bp, Mus musculus
gactcagcaggtgatccagtgcgcc

SEQ ID NO: 104579 - DNA, 25 bp, Mus musculus
gactcagcggcgacagtcccaagcg

SEQ ID NO: 104580 - DNA, 25 bp, Mus musculus
gactcagctctttgggtttgcccga

SEQ ID NO: 104581 - DNA, 25 bp, Mus musculus
gactcagcttgcagggaaggtttca

SEQ ID NO: 104582 - DNA, 25 bp, Mus musculus
gactcaggcacggtacttggacaag

SEQ ID NO: 104583 - DNA, 25 bp, Mus musculus
gactcaggccaacagtgccactggt

SEQ ID NO: 104584 - DNA, 25 bp, Mus musculus
gactcaggcccatgaggtggcagca

SEQ ID NO: 104585 - DNA, 25 bp, Mus musculus
gactcagggactcagcagagactgc

SEQ ID NO: 104586 - DNA, 25 bp, Mus musculus
gactcaggtgctggccatgtctcag

SEQ ID NO: 104587 - DNA, 25 bp, Mus musculus
gactcagtacactcttcgtctgtgg

SEQ ID NO: 104588 - DNA, 25 bp, Mus musculus
gactcagtcccatcactccaaggag

SEQ ID NO: 104589 - DNA, 25 bp, Mus musculus
gactcagtgagctggaagttatccc

SEQ ID NO: 104590 - DNA, 25 bp, Mus musculus
gactcagtggaaaccgaaggcgagc

SEQ ID NO: 104591 - DNA, 25 bp, Mus musculus
gactcagttcacatcccaaggaatg

SEQ ID NO: 104592 - DNA, 25 bp, Mus musculus
gactcatactatgggcttcttggaa

SEQ ID NO: 104593 - DNA, 25 bp, Mus musculus
gactcatccacgagccccattaaaa

SEQ ID NO: 104594 - DNA, 25 bp, Mus musculus
gactcatcccaggaaactgccatgg

SEQ ID NO: 104595 - DNA, 25 bp, Mus musculus
gactcatcctgaaatacggcgtgtg

SEQ ID NO: 104596 - DNA, 25 bp, Mus musculus
gactcatgaactcaccaatcctgga

SEQ ID NO: 104597 - DNA, 25 bp, Mus musculus
gactcatgcaaaattctgaactcag

SEQ ID NO: 104598 - DNA, 25 bp, Mus musculus
gactcatggaaagttggcccaaacc

SEQ ID NO: 104599 - DNA, 25 bp, Mus musculus
gactcatggaaatgaactgaccgga

SEQ ID NO: 104600 - DNA, 25 bp, Mus musculus
gactcatgtggtgcctgccctaggc

SEQ ID NO: 104601 - DNA, 25 bp, Mus musculus
gactcattgccttcgacatctgttg

SEQ ID NO: 104602 - DNA, 25 bp, Mus musculus
gactcatttcactagccagcagctg

SEQ ID NO: 104603 - DNA, 25 bp, Mus musculus
gactccaacaacgtggtcctcattg

SEQ ID NO: 104604 - DNA, 25 bp, Mus musculus
gactccaacatgctggtgcgctgtg

SEQ ID NO: 104605 - DNA, 25 bp, Mus musculus
gactccaagacaaaaccagccaagg

SEQ ID NO: 104606 - DNA, 25 bp, Mus musculus
gactccaagcatatggccccaggag

SEQ ID NO: 104607 - DNA, 25 bp, Mus musculus
gactccacgactcttgaacatcaga

SEQ ID NO: 104608 - DNA, 25 bp, Mus musculus
gactccagccggagccagagaaggt

SEQ ID NO: 104609 - DNA, 25 bp, Mus musculus
gactccagctactacgacgatcgct

SEQ ID NO: 104610 - DNA, 25 bp, Mus musculus
gactccagctatgctgcccgggtgg

SEQ ID NO: 104611 - DNA, 25 bp, Mus musculus
gactccagggaatggtagcacactt

SEQ ID NO: 104612 - DNA, 25 bp, Mus musculus
gactccagggagaaatgatgaagct

SEQ ID NO: 104613 - DNA, 25 bp, Mus musculus
gactccagggcagtaaggcttttta

SEQ ID NO: 104614 - DNA, 25 bp, Mus musculus
gactccaggtgggattcggtaccga

SEQ ID NO: 104615 - DNA, 25 bp, Mus musculus
gactccagtggtaagtctttaatac

SEQ ID NO: 104616 - DNA, 25 bp, Mus musculus
gactccatatgctttctcctaggca

SEQ ID NO: 104617 - DNA, 25 bp, Mus musculus
gactccatccaagcacagaagaatg

SEQ ID NO: 104618 - DNA, 25 bp, Mus musculus
gactccatggaatcaaagacacagc

SEQ ID NO: 104619 - DNA, 25 bp, Mus musculus
gactccatggcaaccctgggacttg

SEQ ID NO: 104620 - DNA, 25 bp, Mus musculus
gactccatggctacaacgggatgct

SEQ ID NO: 104621 - DNA, 25 bp, Mus musculus
gactcccaaagtgctttggtagcta

SEQ ID NO: 104622 - DNA, 25 bp, Mus musculus
gactcccagctggtcgtagaagcct

SEQ ID NO: 104623 - DNA, 25 bp, Mus musculus
gactcccagtatctggccacaggaa

SEQ ID NO: 104624 - DNA, 25 bp, Mus musculus
gactcccatcaatgaagccagctga

SEQ ID NO: 104625 - DNA, 25 bp, Mus musculus
gactcccatgtgcttggaggtcaaa

SEQ ID NO: 104626 - DNA, 25 bp, Mus musculus
gactccccggatgatgccatcggaa

SEQ ID NO: 104627 - DNA, 25 bp, Mus musculus
gactcccgagttcaaggaaggtaga

SEQ ID NO: 104628 - DNA, 25 bp, Mus musculus
gactcccggcaagaaaacgattgtg

SEQ ID NO: 104629 - DNA, 25 bp, Mus musculus
gactcccgggagctgtcagaaatcg

SEQ ID NO: 104630 - DNA, 25 bp, Mus musculus
gactcccgttgatgagcctgactga

SEQ ID NO: 104631 - DNA, 25 bp, Mus musculus
gactccctactctttccctactatg

SEQ ID NO: 104632 - DNA, 25 bp, Mus musculus
gactccctcaaaccaaagtatccaa

SEQ ID NO: 104633 - DNA, 25 bp, Mus musculus
gactccctcggtactaatagtgatg

SEQ ID NO: 104634 - DNA, 25 bp, Mus musculus
gactccctgggctgtgatcgattag

SEQ ID NO: 104635 - DNA, 25 bp, Mus musculus
gactccgaggaaaaagagcccttgg

SEQ ID NO: 104636 - DNA, 25 bp, Mus musculus
gactccgaggtgtgcaaattcagcc

SEQ ID NO: 104637 - DNA, 25 bp, Mus musculus
gactccgccggatcagaaatgtcgc

SEQ ID NO: 104638 - DNA, 25 bp, Mus musculus
gactcctaccggaaacaggtggtca

SEQ ID NO: 104639 - DNA, 25 bp, Mus musculus
gactcctcagtgtgggctatagaca

SEQ ID NO: 104640 - DNA, 25 bp, Mus musculus
gactcctcggattttccgggcgccg

SEQ ID NO: 104641 - DNA, 25 bp, Mus musculus
gactcctctgatgatggcgtgcaca

SEQ ID NO: 104642 - DNA, 25 bp, Mus musculus
gactcctctgggtcttgagctaaaa

SEQ ID NO: 104643 - DNA, 25 bp, Mus musculus
gactcctgagccacatcaagaatgt

SEQ ID NO: 104644 - DNA, 25 bp, Mus musculus
gactcctggagaaacctcattgaac

SEQ ID NO: 104645 - DNA, 25 bp, Mus musculus
gactcctggcacagcggacgtttgt

SEQ ID NO: 104646 - DNA, 25 bp, Mus musculus
gactcctgggcaacgtgtttctgca

SEQ ID NO: 104647 - DNA, 25 bp, Mus musculus
gactcctgggtcagcattcctgagc

SEQ ID NO: 104648 - DNA, 25 bp, Mus musculus
gactcctgtaaaaagcaaggaagac

SEQ ID NO: 104649 - DNA, 25 bp, Mus musculus
gactcctgtatgtggaagcagcacc

SEQ ID NO: 104650 - DNA, 25 bp, Mus musculus
gactcctgtcctaggcagcttctga

SEQ ID NO: 104651 - DNA, 25 bp, Mus musculus
gactccttcagacacagggcacagt

SEQ ID NO: 104652 - DNA, 25 bp, Mus musculus
gactccttgccaggaattctcagaa

SEQ ID NO: 104653 - DNA, 25 bp, Mus musculus
gactccttgtagctggcatttggca

SEQ ID NO: 104654 - DNA, 25 bp, Mus musculus
gactccttgtataaagacttcgatg

SEQ ID NO: 104655 - DNA, 25 bp, Mus musculus
gactcgaaactcagggaaggacttg

SEQ ID NO: 104656 - DNA, 25 bp, Mus musculus
gactcgaactaagtcccaggacagt

SEQ ID NO: 104657 - DNA, 25 bp, Mus musculus
gactcgaagcacagcagacacgaag

SEQ ID NO: 104658 - DNA, 25 bp, Mus musculus
gactcgaccaagatctcggtcacga

SEQ ID NO: 104659 - DNA, 25 bp, Mus musculus
gactcgacgagagaccctgactcgg

SEQ ID NO: 104660 - DNA, 25 bp, Mus musculus
gactcgatgtgcacagaatctccag

SEQ ID NO: 104661 - DNA, 25 bp, Mus musculus
gactcgccgcctatgttcgcaggtg

SEQ ID NO: 104662 - DNA, 25 bp, Mus musculus
gactcgcgatttcaaacctggagac

SEQ ID NO: 104663 - DNA, 25 bp, Mus musculus
gactcgcggcgatttctgaatggct

SEQ ID NO: 104664 - DNA, 25 bp, Mus musculus
gactcgctgctggacaaccgattga

SEQ ID NO: 104665 - DNA, 25 bp, Mus musculus
gactcgctggatggctacataagca

SEQ ID NO: 104666 - DNA, 25 bp, Mus musculus
gactcggcaagtctgaccgcttaca

SEQ ID NO: 104667 - DNA, 25 bp, Mus musculus
gactcggcctgagaaggtgagcctt

SEQ ID NO: 104668 - DNA, 25 bp, Mus musculus
gactcggctgtacaaggatcagaaa

SEQ ID NO: 104669 - DNA, 25 bp, Mus musculus
gactcgggatccgtgcaatgcagcc

SEQ ID NO: 104670 - DNA, 25 bp, Mus musculus
gactcggtgactgcctgaggagcat

SEQ ID NO: 104671 - DNA, 25 bp, Mus musculus
gactcggtgcatccctgtgttgata

SEQ ID NO: 104672 - DNA, 25 bp, Mus musculus
gactcggtggcttttcctgaacagg

SEQ ID NO: 104673 - DNA, 25 bp, Mus musculus
gactcggttatcttcctcagtgccc

SEQ ID NO: 104674 - DNA, 25 bp, Mus musculus
gactcggttgttgccaaggctacaa

SEQ ID NO: 104675 - DNA, 25 bp, Mus musculus
gactcgtaccttatgaaccactttg

SEQ ID NO: 104676 - DNA, 25 bp, Mus musculus
gactcgtatcagcactatttctacg

SEQ ID NO: 104677 - DNA, 25 bp, Mus musculus
gactcgtcgccgcaggattctactt

SEQ ID NO: 104678 - DNA, 25 bp, Mus musculus
gactcgtcgggaagcatgtacatgc

SEQ ID NO: 104679 - DNA, 25 bp, Mus musculus
gactcgtgagatttaccagccctgt

SEQ ID NO: 104680 - DNA, 25 bp, Mus musculus
gactcgtggcttctcggtatgctga

SEQ ID NO: 104681 - DNA, 25 bp, Mus musculus
gactcgtgtgtaatgtgtgccacca

SEQ ID NO: 104682 - DNA, 25 bp, Mus musculus
gactcgtgttcgctctcagggattt

SEQ ID NO: 104683 - DNA, 25 bp, Mus musculus
gactctaaggagctggactctcacc

SEQ ID NO: 104684 - DNA, 25 bp, Mus musculus
gactctaatgagctgaccaggacca

SEQ ID NO: 104685 - DNA, 25 bp, Mus musculus
gactctacaattctacaaatggtag

SEQ ID NO: 104686 - DNA, 25 bp, Mus musculus
gactctacgcagctacttttcccag

SEQ ID NO: 104687 - DNA, 25 bp, Mus musculus
gactctactgcggtgtggaatcaaa

SEQ ID NO: 104688 - DNA, 25 bp, Mus musculus
gactctaggctacaatgaaaggaca

SEQ ID NO: 104689 - DNA, 25 bp, Mus musculus
gactctaggtacatggacggagcca

SEQ ID NO: 104690 - DNA, 25 bp, Mus musculus
gactctagtatcaaggaatcccggc

SEQ ID NO: 104691 - DNA, 25 bp, Mus musculus
gactctatcagactgacccctcggg

SEQ ID NO: 104692 - DNA, 25 bp, Mus musculus
gactctatgatgacagcagcgctcg

SEQ ID NO: 104693 - DNA, 25 bp, Mus musculus
gactctatgcttgactacgacgagg

SEQ ID NO: 104694 - DNA, 25 bp, Mus musculus
gactctatggagcaatttggacaag

SEQ ID NO: 104695 - DNA, 25 bp, Mus musculus
gactctattccaagctcaggctggg

SEQ ID NO: 104696 - DNA, 25 bp, Mus musculus
gactctcacaactgacagggtctgg

SEQ ID NO: 104697 - DNA, 25 bp, Mus musculus
gactctcagaagcacatcgacttct

SEQ ID NO: 104698 - DNA, 25 bp, Mus musculus
gactctcattagaccgacctaccgg

SEQ ID NO: 104699 - DNA, 25 bp, Mus musculus
gactctccagatattcaccccgtgg

SEQ ID NO: 104700 - DNA, 25 bp, Mus musculus
gactctcccaagtgcaattgacagg

SEQ ID NO: 104701 - DNA, 25 bp, Mus musculus
gactctccctctcggaaggccgaga

SEQ ID NO: 104702 - DNA, 25 bp, Mus musculus
gactctccctgcgtggctactgtgt

SEQ ID NO: 104703 - DNA, 25 bp, Mus musculus
gactctcgaaaaattgaccaggagg

SEQ ID NO: 104704 - DNA, 25 bp, Mus musculus
gactctcggtgctaactaaggtttg

SEQ ID NO: 104705 - DNA, 25 bp, Mus musculus
gactctcgtcagcaagatggagcca

SEQ ID NO: 104706 - DNA, 25 bp, Mus musculus
gactctctgctctgatctccaggca

SEQ ID NO: 104707 - DNA, 25 bp, Mus musculus
gactctgaaacgatacctcggtgga

SEQ ID NO: 104708 - DNA, 25 bp, Mus musculus
gactctgacaccctcaggcagacat

SEQ ID NO: 104709 - DNA, 25 bp, Mus musculus
gactctgaccctgtgaaagcctgga

SEQ ID NO: 104710 - DNA, 25 bp, Mus musculus
gactctgacctgatagacctcctgg

SEQ ID NO: 104711 - DNA, 25 bp, Mus musculus
gactctgacgggaggctgatcttca

SEQ ID NO: 104712 - DNA, 25 bp, Mus musculus
gactctgacgtcaggctccagggag

SEQ ID NO: 104713 - DNA, 25 bp, Mus musculus
gactctgactcgtgttctttttaaa

SEQ ID NO: 104714 - DNA, 25 bp, Mus musculus
gactctgactctggacaaagggaca

SEQ ID NO: 104715 - DNA, 25 bp, Mus musculus
gactctgacttgtcctttctcgtga

SEQ ID NO: 104716 - DNA, 25 bp, Mus musculus
gactctgagactaatgcagggccta

SEQ ID NO: 104717 - DNA, 25 bp, Mus musculus
gactctgaggttgtgcacgccatca

SEQ ID NO: 104718 - DNA, 25 bp, Mus musculus
gactctgatcagttcaagcgggagg

SEQ ID NO: 104719 - DNA, 25 bp, Mus musculus
gactctgatgaccaccgaggtgact

SEQ ID NO: 104720 - DNA, 25 bp, Mus musculus
gactctgcagttagaaaagctgacc

SEQ ID NO: 104721 - DNA, 25 bp, Mus musculus
gactctgcgagtccatttagcggag

SEQ ID NO: 104722 - DNA, 25 bp, Mus musculus
gactctgcggctttcttcagcacca

SEQ ID NO: 104723 - DNA, 25 bp, Mus musculus
gactctgctccttactccggtttgg

SEQ ID NO: 104724 - DNA, 25 bp, Mus musculus
gactctgctgtccagccagctggaa

SEQ ID NO: 104725 - DNA, 25 bp, Mus musculus
gactctggaaaagattggcagccga

SEQ ID NO: 104726 - DNA, 25 bp, Mus musculus
gactctggagaccaggacgagcaca

SEQ ID NO: 104727 - DNA, 25 bp, Mus musculus
gactctggatactgtctgcctggga

SEQ ID NO: 104728 - DNA, 25 bp, Mus musculus
gactctggcaattcgacatccgtga

SEQ ID NO: 104729 - DNA, 25 bp, Mus musculus
gactctggcctaaggattcggagaa

SEQ ID NO: 104730 - DNA, 25 bp, Mus musculus
gactctggcggaccactgaattgcc

SEQ ID NO: 104731 - DNA, 25 bp, Mus musculus
gactctgggctaatcgtgcctggga

SEQ ID NO: 104732 - DNA, 25 bp, Mus musculus
gactctgggcttgaacttgataaca

SEQ ID NO: 104733 - DNA, 25 bp, Mus musculus
gactctggttaataatcctgctctg

SEQ ID NO: 104734 - DNA, 25 bp, Mus musculus
gactctgtagcgaaactctgggaga

SEQ ID NO: 104735 - DNA, 25 bp, Mus musculus
gactctgtcacacctaccttcagtg

SEQ ID NO: 104736 - DNA, 25 bp, Mus musculus
gactctgtctccatctaatctcaaa

SEQ ID NO: 104737 - DNA, 25 bp, Mus musculus
gactcttacatagacgggcgcatcg

SEQ ID NO: 104738 - DNA, 25 bp, Mus musculus
gactcttcaccgcttcgtgattgga

SEQ ID NO: 104739 - DNA, 25 bp, Mus musculus
gactcttcagtgacatctctctgtg

SEQ ID NO: 104740 - DNA, 25 bp, Mus musculus
gactcttcatgatttagtagggcac

SEQ ID NO: 104741 - DNA, 25 bp, Mus musculus
gactcttcggctacaaagtctggcc

SEQ ID NO: 104742 - DNA, 25 bp, Mus musculus
gactcttctaaggacagcagagcag

SEQ ID NO: 104743 - DNA, 25 bp, Mus musculus
gactcttgatattctgaagcacttt

SEQ ID NO: 104744 - DNA, 25 bp, Mus musculus
gactcttgccccagtgttctgaggg

SEQ ID NO: 104745 - DNA, 25 bp, Mus musculus
gactcttgcctgttcgtgcagcgcg

SEQ ID NO: 104746 - DNA, 25 bp, Mus musculus
gactctttaagcctcatcatgacta

SEQ ID NO: 104747 - DNA, 25 bp, Mus musculus
gactctttccgtatctcctgggcca

SEQ ID NO: 104748 - DNA, 25 bp, Mus musculus
gactctttctcctgcatctgccggg

SEQ ID NO: 104749 - DNA, 25 bp, Mus musculus
gactgaaaaacaggagacatctgtc

SEQ ID NO: 104750 - DNA, 25 bp, Mus musculus
gactgaaagatgttgctcgccgcat

SEQ ID NO: 104751 - DNA, 25 bp, Mus musculus
gactgaaagctgtaagcactggaac

SEQ ID NO: 104752 - DNA, 25 bp, Mus musculus
gactgaacaatgacacaggcatggc

SEQ ID NO: 104753 - DNA, 25 bp, Mus musculus
gactgaacgaggaaatagcaatgga

SEQ ID NO: 104754 - DNA, 25 bp, Mus musculus
gactgaactcatagaggaccgctaa

SEQ ID NO: 104755 - DNA, 25 bp, Mus musculus
gactgaactcctgttggctgcctgc

SEQ ID NO: 104756 - DNA, 25 bp, Mus musculus
gactgaagagctacagaacaagcta

SEQ ID NO: 104757 - DNA, 25 bp, Mus musculus
gactgaagattatggaatactacga

SEQ ID NO: 104758 - DNA, 25 bp, Mus musculus
gactgaagcgctcatgacagagcta

SEQ ID NO: 104759 - DNA, 25 bp, Mus musculus
gactgaagtgcccaggtacttttgt

SEQ ID NO: 104760 - DNA, 25 bp, Mus musculus
gactgaatacaaggagagcttcggg

SEQ ID NO: 104761 - DNA, 25 bp, Mus musculus
gactgaatagcccaagcccttcgta

SEQ ID NO: 104762 - DNA, 25 bp, Mus musculus
gactgaatatcatctccaacctgga

SEQ ID NO: 104763 - DNA, 25 bp, Mus musculus
gactgaatccgaggacatggcccaa

SEQ ID NO: 104764 - DNA, 25 bp, Mus musculus
gactgaatctgagtgtagaccacac

SEQ ID NO: 104765 - DNA, 25 bp, Mus musculus
gactgaatgctgatcttcggcccac

SEQ ID NO: 104766 - DNA, 25 bp, Mus musculus
gactgacaactttgggctgagccag

SEQ ID NO: 104767 - DNA, 25 bp, Mus musculus
gactgacaagcagcgaatcatttgg

SEQ ID NO: 104768 - DNA, 25 bp, Mus musculus
gactgacagacaataaagcgatgct

SEQ ID NO: 104769 - DNA, 25 bp, Mus musculus
gactgacagacgaagagattgacct

SEQ ID NO: 104770 - DNA, 25 bp, Mus musculus
gactgacagaggagacaactttgca

SEQ ID NO: 104771 - DNA, 25 bp, Mus musculus
gactgacagtctacctgcaagttga

SEQ ID NO: 104772 - DNA, 25 bp, Mus musculus
gactgacatcccttctgacattgag

SEQ ID NO: 104773 - DNA, 25 bp, Mus musculus
gactgaccacatcctagagaccaag

SEQ ID NO: 104774 - DNA, 25 bp, Mus musculus
gactgacccgtatactgcagcagga

SEQ ID NO: 104775 - DNA, 25 bp, Mus musculus
gactgacgacctgaaaacgctatgg

SEQ ID NO: 104776 - DNA, 25 bp, Mus musculus
gactgacgagtctgctgcaacagca

SEQ ID NO: 104777 - DNA, 25 bp, Mus musculus
gactgacgtctacctgttgaacatg

SEQ ID NO: 104778 - DNA, 25 bp, Mus musculus
gactgactcctcaatctcattccta

SEQ ID NO: 104779 - DNA, 25 bp, Mus musculus
gactgactctgtgattgccaccaag

SEQ ID NO: 104780 - DNA, 25 bp, Mus musculus
gactgactgctcacacactggagga

SEQ ID NO: 104781 - DNA, 25 bp, Mus musculus
gactgactggcctgctaagaacaca

SEQ ID NO: 104782 - DNA, 25 bp, Mus musculus
gactgactgtgtagagggccctgta

SEQ ID NO: 104783 - DNA, 25 bp, Mus musculus
gactgactgttgctctgtccatctt

SEQ ID NO: 104784 - DNA, 25 bp, Mus musculus
gactgacttcctgactaccctggta

SEQ ID NO: 104785 - DNA, 25 bp, Mus musculus
gactgactttggagcaagcatggag

SEQ ID NO: 104786 - DNA, 25 bp, Mus musculus
gactgagaagatgacaaccgtgctg

SEQ ID NO: 104787 - DNA, 25 bp, Mus musculus
gactgagatacttgccctaaagagc

SEQ ID NO: 104788 - DNA, 25 bp, Mus musculus
gactgagcagctgttgggtttctaa

SEQ ID NO: 104789 - DNA, 25 bp, Mus musculus
gactgagccactaataactgggacc

SEQ ID NO: 104790 - DNA, 25 bp, Mus musculus
gactgagccgaaccaacgaagaact

SEQ ID NO: 104791 - DNA, 25 bp, Mus musculus
gactgagcgatggactgaatctgca

SEQ ID NO: 104792 - DNA, 25 bp, Mus musculus
gactgagcgggtggacttcacagct

SEQ ID NO: 104793 - DNA, 25 bp, Mus musculus
gactgagctagtaagagtgtcacaa

SEQ ID NO: 104794 - DNA, 25 bp, Mus musculus
gactgaggaaagcagaactctggcc

SEQ ID NO: 104795 - DNA, 25 bp, Mus musculus
gactgaggagaccttgctactttgg

SEQ ID NO: 104796 - DNA, 25 bp, Mus musculus
gactgaggcgctgaagcattctgta

SEQ ID NO: 104797 - DNA, 25 bp, Mus musculus
gactgaggctgcacccattccttag

SEQ ID NO: 104798 - DNA, 25 bp, Mus musculus
gactgaggcttccaccagagtgcca

SEQ ID NO: 104799 - DNA, 25 bp, Mus musculus
gactgagttcaagcacccaaaaggt

SEQ ID NO: 104800 - DNA, 25 bp, Mus musculus
gactgatcacctttgaaagccttga

SEQ ID NO: 104801 - DNA, 25 bp, Mus musculus
gactgatgacgaaaaactgatgcca

SEQ ID NO: 104802 - DNA, 25 bp, Mus musculus
gactgatggcatacagacctggacc

SEQ ID NO: 104803 - DNA, 25 bp, Mus musculus
gactgatgtatttggagctatggaa

SEQ ID NO: 104804 - DNA, 25 bp, Mus musculus
gactgatgtggaatctgtgatcacc

SEQ ID NO: 104805 - DNA, 25 bp, Mus musculus
gactgattgccagagcacctgagcc

SEQ ID NO: 104806 - DNA, 25 bp, Mus musculus
gactgcaaacctctctgtgagaagg

SEQ ID NO: 104807 - DNA, 25 bp, Mus musculus
gactgcaacctctgcggaagagctg

SEQ ID NO: 104808 - DNA, 25 bp, Mus musculus
gactgcaactcttgacttgtcaggg

SEQ ID NO: 104809 - DNA, 25 bp, Mus musculus
gactgcacgccatctacggagagtg

SEQ ID NO: 104810 - DNA, 25 bp, Mus musculus
gactgcagaagacgccatgcagatc

SEQ ID NO: 104811 - DNA, 25 bp, Mus musculus
gactgcagaagagcgtcaagaactg

SEQ ID NO: 104812 - DNA, 25 bp, Mus musculus
gactgcagcatcttcatcaagatta

SEQ ID NO: 104813 - DNA, 25 bp, Mus musculus
gactgcagccgcattttcatggtca

SEQ ID NO: 104814 - DNA, 25 bp, Mus musculus
gactgcagctgtaccgagtgatcga

SEQ ID NO: 104815 - DNA, 25 bp, Mus musculus
gactgcagtaaaggaatttggccac

SEQ ID NO: 104816 - DNA, 25 bp, Mus musculus
gactgcagtatcttaggtgcccgga

SEQ ID NO: 104817 - DNA, 25 bp, Mus musculus
gactgcagtctggacaggatggctt

SEQ ID NO: 104818 - DNA, 25 bp, Mus musculus
gactgcagtgggtacagctttaacc

SEQ ID NO: 104819 - DNA, 25 bp, Mus musculus
gactgcatcatgcacgggtacatgc

SEQ ID NO: 104820 - DNA, 25 bp, Mus musculus
gactgcatcgatctgtggtcctcta

SEQ ID NO: 104821 - DNA, 25 bp, Mus musculus
gactgcatgactgatcgccttttgg

SEQ ID NO: 104822 - DNA, 25 bp, Mus musculus
gactgccactgttaaggaagccacg

SEQ ID NO: 104823 - DNA, 25 bp, Mus musculus
gactgccagccagatctcaagagga

SEQ ID NO: 104824 - DNA, 25 bp, Mus musculus
gactgccaggcacaatgaaggttct

SEQ ID NO: 104825 - DNA, 25 bp, Mus musculus
gactgccaggcacattaactgtaca

SEQ ID NO: 104826 - DNA, 25 bp, Mus musculus
gactgccatggtcgctgcttgccaa

SEQ ID NO: 104827 - DNA, 25 bp, Mus musculus
gactgcccagaggaccgcaaatttg

SEQ ID NO: 104828 - DNA, 25 bp, Mus musculus
gactgcccatcgagaagagatagcc

SEQ ID NO: 104829 - DNA, 25 bp, Mus musculus
gactgccccggaggacaatggagtc

SEQ ID NO: 104830 - DNA, 25 bp, Mus musculus
gactgcccctaggagggactggtct

SEQ ID NO: 104831 - DNA, 25 bp, Mus musculus
gactgccgcatctacgtgggtaacc

SEQ ID NO: 104832 - DNA, 25 bp, Mus musculus
gactgccgtggaacagatctacccg

SEQ ID NO: 104833 - DNA, 25 bp, Mus musculus
gactgcctacatacacatggccggg

SEQ ID NO: 104834 - DNA, 25 bp, Mus musculus
gactgcctccgagtggaagctggca

SEQ ID NO: 104835 - DNA, 25 bp, Mus musculus
gactgccttgtgtccatcggaacca

SEQ ID NO: 104836 - DNA, 25 bp, Mus musculus
gactgcctttatactacggaccccg

SEQ ID NO: 104837 - DNA, 25 bp, Mus musculus
gactgcgcacaggagaattgcccta

SEQ ID NO: 104838 - DNA, 25 bp, Mus musculus
gactgcgcagtatcaaccagggctt

SEQ ID NO: 104839 - DNA, 25 bp, Mus musculus
gactgcgccgtcgtggttccttttt

SEQ ID NO: 104840 - DNA, 25 bp, Mus musculus
gactgcgcgttgttgccatccaggg

SEQ ID NO: 104841 - DNA, 25 bp, Mus musculus
gactgcgctacctggagtcacttga

SEQ ID NO: 104842 - DNA, 25 bp, Mus musculus
gactgcgcttcggatgtgttaccaa

SEQ ID NO: 104843 - DNA, 25 bp, Mus musculus
gactgcggagtgaacctctcagaca

SEQ ID NO: 104844 - DNA, 25 bp, Mus musculus
gactgcggtttcttgagccaggccc

SEQ ID NO: 104845 - DNA, 25 bp, Mus musculus
gactgcgtaggctgtggttctcccc

SEQ ID NO: 104846 - DNA, 25 bp, Mus musculus
gactgcgtattcacagagatcgtgc

SEQ ID NO: 104847 - DNA, 25 bp, Mus musculus
gactgcgtgaccttcaggaggaact

SEQ ID NO: 104848 - DNA, 25 bp, Mus musculus
gactgcgtggtgttgcgtagtaaca

SEQ ID NO: 104849 - DNA, 25 bp, Mus musculus
gactgcgtgtctgtcctgctctgtg

SEQ ID NO: 104850 - DNA, 25 bp, Mus musculus
gactgctaggagatccccacttgga

SEQ ID NO: 104851 - DNA, 25 bp, Mus musculus
gactgctccaccgagccatgtggga

SEQ ID NO: 104852 - DNA, 25 bp, Mus musculus
gactgctcgccatcaagggtgcaca

SEQ ID NO: 104853 - DNA, 25 bp, Mus musculus
gactgctgaaagacatccgagaact

SEQ ID NO: 104854 - DNA, 25 bp, Mus musculus
gactgctgatggctgtcttctcgga

SEQ ID NO: 104855 - DNA, 25 bp, Mus musculus
gactgctgctgaagatcatctgcta

SEQ ID NO: 104856 - DNA, 25 bp, Mus musculus
gactgctgtagaaagcttcctgaca

SEQ ID NO: 104857 - DNA, 25 bp, Mus musculus
gactgctgtctcaagtccccgtgag

SEQ ID NO: 104858 - DNA, 25 bp, Mus musculus
gactgcttacatgacgtgcgggctg

SEQ ID NO: 104859 - DNA, 25 bp, Mus musculus
gactgcttagcacagccgagctggt

SEQ ID NO: 104860 - DNA, 25 bp, Mus musculus
gactgcttcccaacattttcttgga

SEQ ID NO: 104861 - DNA, 25 bp, Mus musculus
gactgcttccgctgacaaatttgtg

SEQ ID NO: 104862 - DNA, 25 bp, Mus musculus
gactgcttccttagttccacgggcg

SEQ ID NO: 104863 - DNA, 25 bp, Mus musculus
gactgctttatgctggactccggca

SEQ ID NO: 104864 - DNA, 25 bp, Mus musculus
gactgctttggagaatacgtggact

SEQ ID NO: 104865 - DNA, 25 bp, Mus musculus
gactggaacactggtcctagctgta

SEQ ID NO: 104866 - DNA, 25 bp, Mus musculus
gactggaaccctatgcgagatctgc

SEQ ID NO: 104867 - DNA, 25 bp, Mus musculus
gactggaactcagtgaatgacctta

SEQ ID NO: 104868 - DNA, 25 bp, Mus musculus
gactggaactcttcacctgcttgat

SEQ ID NO: 104869 - DNA, 25 bp, Mus musculus
gactggaagctgcttaggccttttc

SEQ ID NO: 104870 - DNA, 25 bp, Mus musculus
gactggaccatcgaacgggtggctt

SEQ ID NO: 104871 - DNA, 25 bp, Mus musculus
gactggacgcacttccaaggaagct

SEQ ID NO: 104872 - DNA, 25 bp, Mus musculus
gactggactgaaaatactgcaagcc

SEQ ID NO: 104873 - DNA, 25 bp, Mus musculus
gactggagcagctggtcaaattgca

SEQ ID NO: 104874 - DNA, 25 bp, Mus musculus
gactggagccatgtacttcataggg

SEQ ID NO: 104875 - DNA, 25 bp, Mus musculus
gactggagtctggtgcctatgcctg

SEQ ID NO: 104876 - DNA, 25 bp, Mus musculus
gactggagttactgatagttgagag

SEQ ID NO: 104877 - DNA, 25 bp, Mus musculus
gactggataagttccctgattcgct

SEQ ID NO: 104878 - DNA, 25 bp, Mus musculus
gactggataattgccggttctgccc

SEQ ID NO: 104879 - DNA, 25 bp, Mus musculus
gactggatcaaagaccagctgtatt

SEQ ID NO: 104880 - DNA, 25 bp, Mus musculus
gactggatgtccatagtgacccctg

SEQ ID NO: 104881 - DNA, 25 bp, Mus musculus
gactggattcaaaacgtgctgcggg

SEQ ID NO: 104882 - DNA, 25 bp, Mus musculus
gactggcaagggactagaataagag

SEQ ID NO: 104883 - DNA, 25 bp, Mus musculus
gactggcaccagagcattttcatta

SEQ ID NO: 104884 - DNA, 25 bp, Mus musculus
gactggcacgaatccaagagtggaa

SEQ ID NO: 104885 - DNA, 25 bp, Mus musculus
gactggcagacataccacaacgaga

SEQ ID NO: 104886 - DNA, 25 bp, Mus musculus
gactggcagcggactgtcatcgaca

SEQ ID NO: 104887 - DNA, 25 bp, Mus musculus
gactggcatatttctctgagcaagc

SEQ ID NO: 104888 - DNA, 25 bp, Mus musculus
gactggcatgactatgagagcattc

SEQ ID NO: 104889 - DNA, 25 bp, Mus musculus
gactggcatgtcgttctcccgaaag

SEQ ID NO: 104890 - DNA, 25 bp, Mus musculus
gactggcattgtacagctagctgga

SEQ ID NO: 104891 - DNA, 25 bp, Mus musculus
gactggcccaaaaagcgtatcgcaa

SEQ ID NO: 104892 - DNA, 25 bp, Mus musculus
gactggccccagtgattgtacctta

SEQ ID NO: 104893 - DNA, 25 bp, Mus musculus
gactggcctgctatgttggtccaag

SEQ ID NO: 104894 - DNA, 25 bp, Mus musculus
gactggcctttaccaactcactttg

SEQ ID NO: 104895 - DNA, 25 bp, Mus musculus
gactggcgctatcaccgttatcttg

SEQ ID NO: 104896 - DNA, 25 bp, Mus musculus
gactggctactgtaaagcagctgaa

SEQ ID NO: 104897 - DNA, 25 bp, Mus musculus
gactggctcaccaatgaggctggct

SEQ ID NO: 104898 - DNA, 25 bp, Mus musculus
gactggctgaatcctgctcagagga

SEQ ID NO: 104899 - DNA, 25 bp, Mus musculus
gactggctgactgtgaaaaatggac

SEQ ID NO: 104900 - DNA, 25 bp, Mus musculus
gactggctgctactcaaagttgtgg

SEQ ID NO: 104901 - DNA, 25 bp, Mus musculus
gactggcttcttggagacttacttg

SEQ ID NO: 104902 - DNA, 25 bp, Mus musculus
gactgggaaaatcaagctccttggc

SEQ ID NO: 104903 - DNA, 25 bp, Mus musculus
gactgggacaaaaccatgcgtttca

SEQ ID NO: 104904 - DNA, 25 bp, Mus musculus
gactgggaccatctgtacaccgagg

SEQ ID NO: 104905 - DNA, 25 bp, Mus musculus
gactgggaccccacttgcatgaaga

SEQ ID NO: 104906 - DNA, 25 bp, Mus musculus
gactgggatggcaaggaagccacca

SEQ ID NO: 104907 - DNA, 25 bp, Mus musculus
gactgggccctgcaagcaaacataa

SEQ ID NO: 104908 - DNA, 25 bp, Mus musculus
gactgggcctgtatgctgctagaga

SEQ ID NO: 104909 - DNA, 25 bp, Mus musculus
gactgggcgggaaaacctcttagcg

SEQ ID NO: 104910 - DNA, 25 bp, Mus musculus
gactgggctatctcaggaatggagc

SEQ ID NO: 104911 - DNA, 25 bp, Mus musculus
gactgggctttggtgcgacatcatg

SEQ ID NO: 104912 - DNA, 25 bp, Mus musculus
gactgggtaccagtgccagagcacg

SEQ ID NO: 104913 - DNA, 25 bp, Mus musculus
gactgggttctcatgcggtactaac

SEQ ID NO: 104914 - DNA, 25 bp, Mus musculus
gactggtagccattaaacttgagac

SEQ ID NO: 104915 - DNA, 25 bp, Mus musculus
gactggtatcaaaccgagtctcacg

SEQ ID NO: 104916 - DNA, 25 bp, Mus musculus
gactggtatgcaatcagcactctga

SEQ ID NO: 104917 - DNA, 25 bp, Mus musculus
gactggtattcaagaaccctcagaa

SEQ ID NO: 104918 - DNA, 25 bp, Mus musculus
gactggtcccaagaattcatcgccg

SEQ ID NO: 104919 - DNA, 25 bp, Mus musculus
gactggtcctccatagtgcaacatg

SEQ ID NO: 104920 - DNA, 25 bp, Mus musculus
gactggtgctccaagctgaagttca

SEQ ID NO: 104921 - DNA, 25 bp, Mus musculus
gactggtggcagtgtgcagggacgg

SEQ ID NO: 104922 - DNA, 25 bp, Mus musculus
gactggtggtctctgacactctgga

SEQ ID NO: 104923 - DNA, 25 bp, Mus musculus
gactggtgtccccacaatgatgaag

SEQ ID NO: 104924 - DNA, 25 bp, Mus musculus
gactggttccaaatacgaagctgca

SEQ ID NO: 104925 - DNA, 25 bp, Mus musculus
gactggttccatttcaagcctctgc

SEQ ID NO: 104926 - DNA, 25 bp, Mus musculus
gactggttcgaaacacccgaaggct

SEQ ID NO: 104927 - DNA, 25 bp, Mus musculus
gactggttgcccttactccctgtat

SEQ ID NO: 104928 - DNA, 25 bp, Mus musculus
gactggttgtaggatcagcttccat

SEQ ID NO: 104929 - DNA, 25 bp, Mus musculus
gactggtttgactaccatggccaca

SEQ ID NO: 104930 - DNA, 25 bp, Mus musculus
gactgtaaaactgaaagcaagactg

SEQ ID NO: 104931 - DNA, 25 bp, Mus musculus
gactgtaactcgaaatcctcccggg

SEQ ID NO: 104932 - DNA, 25 bp, Mus musculus
gactgtactgtgaagctctggcctc

SEQ ID NO: 104933 - DNA, 25 bp, Mus musculus
gactgtagaactagctgtgacctga

SEQ ID NO: 104934 - DNA, 25 bp, Mus musculus
gactgtaggccaggatgcactctcc

SEQ ID NO: 104935 - DNA, 25 bp, Mus musculus
gactgtagtgtagcaggtgcactgc

SEQ ID NO: 104936 - DNA, 25 bp, Mus musculus
gactgtatccatctcatcaacgagg

SEQ ID NO: 104937 - DNA, 25 bp, Mus musculus
gactgtattcatagtaaattgagca

SEQ ID NO: 104938 - DNA, 25 bp, Mus musculus
gactgtattgagctccccagttggg

SEQ ID NO: 104939 - DNA, 25 bp, Mus musculus
gactgtcaaggtgcacgtggtagcc

SEQ ID NO: 104940 - DNA, 25 bp, Mus musculus
gactgtcaccagttgctactgaaag

SEQ ID NO: 104941 - DNA, 25 bp, Mus musculus
gactgtcacccaaagcacctctgtg

SEQ ID NO: 104942 - DNA, 25 bp, Mus musculus
gactgtcaccgagctgtgttccctg

SEQ ID NO: 104943 - DNA, 25 bp, Mus musculus
gactgtcactagaggagcttttggg

SEQ ID NO: 104944 - DNA, 25 bp, Mus musculus
gactgtcagtgcaggccttcctcgt

SEQ ID NO: 104945 - DNA, 25 bp, Mus musculus
gactgtcatgcccaagtgcttgagc

SEQ ID NO: 104946 - DNA, 25 bp, Mus musculus
gactgtcatggaagatacgcccaga

SEQ ID NO: 104947 - DNA, 25 bp, Mus musculus
gactgtccagccctcctttgaagtg

SEQ ID NO: 104948 - DNA, 25 bp, Mus musculus
gactgtcccgtaagcaaactgcacc

SEQ ID NO: 104949 - DNA, 25 bp, Mus musculus
gactgtccctcggaaaaactggtgg

SEQ ID NO: 104950 - DNA, 25 bp, Mus musculus
gactgtcctgacattttgagttcca

SEQ ID NO: 104951 - DNA, 25 bp, Mus musculus
gactgtccttccaagatcttaggca

SEQ ID NO: 104952 - DNA, 25 bp, Mus musculus
gactgtcggccatagcgtggtctcc

SEQ ID NO: 104953 - DNA, 25 bp, Mus musculus
gactgtcgggtctgagctgtcgcat

SEQ ID NO: 104954 - DNA, 25 bp, Mus musculus
gactgtcgtgtaggaacatggacca

SEQ ID NO: 104955 - DNA, 25 bp, Mus musculus
gactgtctaccctctgtccaagtgc

SEQ ID NO: 104956 - DNA, 25 bp, Mus musculus
gactgtctgagctatgggcgaaaaa

SEQ ID NO: 104957 - DNA, 25 bp, Mus musculus
gactgtctggctgagaaagcccagg

SEQ ID NO: 104958 - DNA, 25 bp, Mus musculus
gactgtctgtattggaaaggaggcc

SEQ ID NO: 104959 - DNA, 25 bp, Mus musculus
gactgtcttggtcatctgtggcccc

SEQ ID NO: 104960 - DNA, 25 bp, Mus musculus
gactgtgaatcaccagctatgtgaa

SEQ ID NO: 104961 - DNA, 25 bp, Mus musculus
gactgtgaatcagaacgcctcaacg

SEQ ID NO: 104962 - DNA, 25 bp, Mus musculus
gactgtgaccttggtgacaacatga

SEQ ID NO: 104963 - DNA, 25 bp, Mus musculus
gactgtgagcatggatacccaggcc

SEQ ID NO: 104964 - DNA, 25 bp, Mus musculus
gactgtgaggcgcaacggattccta

SEQ ID NO: 104965 - DNA, 25 bp, Mus musculus
gactgtgaggtgctgaccacactca

SEQ ID NO: 104966 - DNA, 25 bp, Mus musculus
gactgtgatctggacgtggcttgca

SEQ ID NO: 104967 - DNA, 25 bp, Mus musculus
gactgtgcaactacctcgagaggga

SEQ ID NO: 104968 - DNA, 25 bp, Mus musculus
gactgtgcacagtttctgccaaaga

SEQ ID NO: 104969 - DNA, 25 bp, Mus musculus
gactgtgcagtataaatccgccgac

SEQ ID NO: 104970 - DNA, 25 bp, Mus musculus
gactgtgcatccctgtaatacctga

SEQ ID NO: 104971 - DNA, 25 bp, Mus musculus
gactgtgcccacttttcttacgatg

SEQ ID NO: 104972 - DNA, 25 bp, Mus musculus
gactgtgccctgatccatgctggaa

SEQ ID NO: 104973 - DNA, 25 bp, Mus musculus
gactgtgcgaattgtcaagcatgcc

SEQ ID NO: 104974 - DNA, 25 bp, Mus musculus
gactgtgcggaccattttgagcaga

SEQ ID NO: 104975 - DNA, 25 bp, Mus musculus
gactgtgctccaaggatccacctac

SEQ ID NO: 104976 - DNA, 25 bp, Mus musculus
gactgtgggtgatacctccctgagg

SEQ ID NO: 104977 - DNA, 25 bp, Mus musculus
gactgtggtgtttttactgagcgta

SEQ ID NO: 104978 - DNA, 25 bp, Mus musculus
gactgtggttaacatctcatctctg

SEQ ID NO: 104979 - DNA, 25 bp, Mus musculus
gactgtgtataaagcgtccaacctg

SEQ ID NO: 104980 - DNA, 25 bp, Mus musculus
gactgtgtattcagcaaggaagcag

SEQ ID NO: 104981 - DNA, 25 bp, Mus musculus
gactgtgtctatggtcgctccgcgg

SEQ ID NO: 104982 - DNA, 25 bp, Mus musculus
gactgtgtctctcctcacaaggtgg

SEQ ID NO: 104983 - DNA, 25 bp, Mus musculus
gactgtgtcttcacatacgactgca

SEQ ID NO: 104984 - DNA, 25 bp, Mus musculus
gactgtgtgccctatcatcgacggg

SEQ ID NO: 104985 - DNA, 25 bp, Mus musculus
gactgtgtgcccttttcaggaacgt

SEQ ID NO: 104986 - DNA, 25 bp, Mus musculus
gactgtgtgttaccaagacccatga

SEQ ID NO: 104987 - DNA, 25 bp, Mus musculus
gactgtgtgttagcacgggacccct

SEQ ID NO: 104988 - DNA, 25 bp, Mus musculus
gactgtgttcagacctatattcgag

SEQ ID NO: 104989 - DNA, 25 bp, Mus musculus
gactgttacctgtagctgaagctgg

SEQ ID NO: 104990 - DNA, 25 bp, Mus musculus
gactgttctacctgttcgcgcgcct

SEQ ID NO: 104991 - DNA, 25 bp, Mus musculus
gactgttgaaccatggctgcgatca

SEQ ID NO: 104992 - DNA, 25 bp, Mus musculus
gactgttgatctcctcatgcaagag

SEQ ID NO: 104993 - DNA, 25 bp, Mus musculus
gactgttgcaacgacatgcccgtct

SEQ ID NO: 104994 - DNA, 25 bp, Mus musculus
gactgttgcagttcatcatcctcag

SEQ ID NO: 104995 - DNA, 25 bp, Mus musculus
gactgttgtcctagatgggctcctg

SEQ ID NO: 104996 - DNA, 25 bp, Mus musculus
gactgtttccacgacttctgcactg

SEQ ID NO: 104997 - DNA, 25 bp, Mus musculus
gacttaaaaggcaccgtcttgccac

SEQ ID NO: 104998 - DNA, 25 bp, Mus musculus
gacttaacagtagcgcttcagccag

SEQ ID NO: 104999 - DNA, 25 bp, Mus musculus
gacttaagaacccagactatgaggc

SEQ ID NO: 105000 - DNA, 25 bp, Mus musculus
gacttaagacttattgggccactgc

SEQ ID NO: 105001 - DNA, 25 bp, Mus musculus
gacttaagcaaactacaaacgagga

SEQ ID NO: 105002 - DNA, 25 bp, Mus musculus
gacttaatgaggctgggaatcccga

SEQ ID NO: 105003 - DNA, 25 bp, Mus musculus
gacttacaagactacaaggcccatg

SEQ ID NO: 105004 - DNA, 25 bp, Mus musculus
gacttacacgagtgggtggaacacc

SEQ ID NO: 105005 - DNA, 25 bp, Mus musculus
gacttaccatctcccagagcaggat

SEQ ID NO: 105006 - DNA, 25 bp, Mus musculus
gacttacccgcctttgagatggata

SEQ ID NO: 105007 - DNA, 25 bp, Mus musculus
gacttacctaagttgccagtgcccc

SEQ ID NO: 105008 - DNA, 25 bp, Mus musculus
gacttaccttaaatgtgcgggctgc

SEQ ID NO: 105009 - DNA, 25 bp, Mus musculus
gacttacgcagccttaagaagccgg

SEQ ID NO: 105010 - DNA, 25 bp, Mus musculus
gacttactgaactaaaacgccagtg

SEQ ID NO: 105011 - DNA, 25 bp, Mus musculus
gacttactgccaccaaactctatga

SEQ ID NO: 105012 - DNA, 25 bp, Mus musculus
gacttactgctggtatctctggctg

SEQ ID NO: 105013 - DNA, 25 bp, Mus musculus
gacttagaagatgaactggaaccag

SEQ ID NO: 105014 - DNA, 25 bp, Mus musculus
gacttagaccctcagtagctcgggc

SEQ ID NO: 105015 - DNA, 25 bp, Mus musculus
gacttagactatgacatcgaagagg

SEQ ID NO: 105016 - DNA, 25 bp, Mus musculus
gacttagagcgtctacgggatccag

SEQ ID NO: 105017 - DNA, 25 bp, Mus musculus
gacttagcccacagtacccctgggt

SEQ ID NO: 105018 - DNA, 25 bp, Mus musculus
gacttagctccagacttgccttggg

SEQ ID NO: 105019 - DNA, 25 bp, Mus musculus
gacttagtagctgagattctgcact

SEQ ID NO: 105020 - DNA, 25 bp, Mus musculus
gacttagtatcacagaagccaccca

SEQ ID NO: 105021 - DNA, 25 bp, Mus musculus
gacttagtcatccaagactggacca

SEQ ID NO: 105022 - DNA, 25 bp, Mus musculus
gacttatcgaacagccttgaggaga

SEQ ID NO: 105023 - DNA, 25 bp, Mus musculus
gacttatctgaagtggctgccagct

SEQ ID NO: 105024 - DNA, 25 bp, Mus musculus
gacttatggtggcaattcaaacggg

SEQ ID NO: 105025 - DNA, 25 bp, Mus musculus
gacttattttcctggctagggtgga

SEQ ID NO: 105026 - DNA, 25 bp, Mus musculus
gacttcaaaaccaatggtctacttg

SEQ ID NO: 105027 - DNA, 25 bp, Mus musculus
gacttcaaaaggatctctccgttcc

SEQ ID NO: 105028 - DNA, 25 bp, Mus musculus
gacttcaacggcttctcggcaatgg

SEQ ID NO: 105029 - DNA, 25 bp, Mus musculus
gacttcaactcctcatgggcgtctg

SEQ ID NO: 105030 - DNA, 25 bp, Mus musculus
gacttcaagcttccccgggcggatg

SEQ ID NO: 105031 - DNA, 25 bp, Mus musculus
gacttcaaggcaggtgtggctttct

SEQ ID NO: 105032 - DNA, 25 bp, Mus musculus
gacttcaaggccaaagtaactcggg

SEQ ID NO: 105033 - DNA, 25 bp, Mus musculus
gacttcaaggtcgtccatctcggta

SEQ ID NO: 105034 - DNA, 25 bp, Mus musculus
gacttcaagtacgtgctgttgcccg

SEQ ID NO: 105035 - DNA, 25 bp, Mus musculus
gacttcaatcaagctcggcagacga

SEQ ID NO: 105036 - DNA, 25 bp, Mus musculus
gacttcaatgaggaatgtccccggc

SEQ ID NO: 105037 - DNA, 25 bp, Mus musculus
gacttcacccgtagccttgcagtga

SEQ ID NO: 105038 - DNA, 25 bp, Mus musculus
gacttcagagactatggcagacggc

SEQ ID NO: 105039 - DNA, 25 bp, Mus musculus
gacttcagaggagtaaacaaggaga

SEQ ID NO: 105040 - DNA, 25 bp, Mus musculus
gacttcagcaccaggtccagagggt

SEQ ID NO: 105041 - DNA, 25 bp, Mus musculus
gacttcagcggtactagtgacccct

SEQ ID NO: 105042 - DNA, 25 bp, Mus musculus
gacttcagctaaagaagggttactc

SEQ ID NO: 105043 - DNA, 25 bp, Mus musculus
gacttcagctatgaggagctctgcc

SEQ ID NO: 105044 - DNA, 25 bp, Mus musculus
gacttcagctgcaaagaggaaccag

SEQ ID NO: 105045 - DNA, 25 bp, Mus musculus
gacttcaggaagaatctgactgtgc

SEQ ID NO: 105046 - DNA, 25 bp, Mus musculus
gacttcataaataggcagctcggag

SEQ ID NO: 105047 - DNA, 25 bp, Mus musculus
gacttcataagccacagagccagga

SEQ ID NO: 105048 - DNA, 25 bp, Mus musculus
gacttcataatccagaacctcggtg

SEQ ID NO: 105049 - DNA, 25 bp, Mus musculus
gacttcatcactgagtactgtgaca

SEQ ID NO: 105050 - DNA, 25 bp, Mus musculus
gacttcatcagggaccgcatgcgat

SEQ ID NO: 105051 - DNA, 25 bp, Mus musculus
gacttcatcatgttaaagggctgca

SEQ ID NO: 105052 - DNA, 25 bp, Mus musculus
gacttcatcgctggactttccgtgg

SEQ ID NO: 105053 - DNA, 25 bp, Mus musculus
gacttcatctaccagctctactcag

SEQ ID NO: 105054 - DNA, 25 bp, Mus musculus
gacttcatctccatgcagtgccggg

SEQ ID NO: 105055 - DNA, 25 bp, Mus musculus
gacttcatctgaacataaaactgct

SEQ ID NO: 105056 - DNA, 25 bp, Mus musculus
gacttcatgccaaagctcgtcaaga

SEQ ID NO: 105057 - DNA, 25 bp, Mus musculus
gacttcatggaaaatctggcaccct

SEQ ID NO: 105058 - DNA, 25 bp, Mus musculus
gacttcatggatgaccccaaatgga

SEQ ID NO: 105059 - DNA, 25 bp, Mus musculus
gacttcattgccacagggaacagga

SEQ ID NO: 105060 - DNA, 25 bp, Mus musculus
gacttccaacgggactgagacctgg

SEQ ID NO: 105061 - DNA, 25 bp, Mus musculus
gacttccaccgaggctttgaggctg

SEQ ID NO: 105062 - DNA, 25 bp, Mus musculus
gacttccactctgacaaagctggga

SEQ ID NO: 105063 - DNA, 25 bp, Mus musculus
gacttccagacccttgctgctgaaa

SEQ ID NO: 105064 - DNA, 25 bp, Mus musculus
gacttccagccagggtacaaggcta

SEQ ID NO: 105065 - DNA, 25 bp, Mus musculus
gacttccagctgctttttaacaatg

SEQ ID NO: 105066 - DNA, 25 bp, Mus musculus
gacttccaggaaagcaacaggatgt

SEQ ID NO: 105067 - DNA, 25 bp, Mus musculus
gacttccagggaacaccaaccttca

SEQ ID NO: 105068 - DNA, 25 bp, Mus musculus
gacttccagtggtgcttctcgcagg

SEQ ID NO: 105069 - DNA, 25 bp, Mus musculus
gacttcccaggatacagttgttctc

SEQ ID NO: 105070 - DNA, 25 bp, Mus musculus
gacttcccagtagcccagagaggag

SEQ ID NO: 105071 - DNA, 25 bp, Mus musculus
gacttcccatgaactctagttggca

SEQ ID NO: 105072 - DNA, 25 bp, Mus musculus
gacttccccttgagcgccatgttgg

SEQ ID NO: 105073 - DNA, 25 bp, Mus musculus
gacttcccgaagaggagaccgagct

SEQ ID NO: 105074 - DNA, 25 bp, Mus musculus
gacttcccgctcagtcagaacaact

SEQ ID NO: 105075 - DNA, 25 bp, Mus musculus
gacttccctgaaaagcccggagtgg

SEQ ID NO: 105076 - DNA, 25 bp, Mus musculus
gacttccgagaggaccaggatgctg

SEQ ID NO: 105077 - DNA, 25 bp, Mus musculus
gacttccgaggtgatctgagagcag

SEQ ID NO: 105078 - DNA, 25 bp, Mus musculus
gacttccggaagaggaccctgacat

SEQ ID NO: 105079 - DNA, 25 bp, Mus musculus
gacttccgggatctgcttgacgcgt

SEQ ID NO: 105080 - DNA, 25 bp, Mus musculus
gacttcctgcttggtgcgtaccaga

SEQ ID NO: 105081 - DNA, 25 bp, Mus musculus
gacttcgacgaagagggcaaatctg

SEQ ID NO: 105082 - DNA, 25 bp, Mus musculus
gacttcgactcgtatcagcactatt

SEQ ID NO: 105083 - DNA, 25 bp, Mus musculus
gacttcgaggactacattcgctatg

SEQ ID NO: 105084 - DNA, 25 bp, Mus musculus
gacttcgagtactgcaagcgggacc

SEQ ID NO: 105085 - DNA, 25 bp, Mus musculus
gacttcgagtgggtctacagcgacc

SEQ ID NO: 105086 - DNA, 25 bp, Mus musculus
gacttcgatggtgatactgaaccac

SEQ ID NO: 105087 - DNA, 25 bp, Mus musculus
gacttcgctgtctcaacggtaccgg

SEQ ID NO: 105088 - DNA, 25 bp, Mus musculus
gacttcggaacaagctgcagagcca

SEQ ID NO: 105089 - DNA, 25 bp, Mus musculus
gacttcggagggtagcttgcacctg

SEQ ID NO: 105090 - DNA, 25 bp, Mus musculus
gacttcggcctgaacatatcaaaaa

SEQ ID NO: 105091 - DNA, 25 bp, Mus musculus
gacttcggctctccatgcagcagtg

SEQ ID NO: 105092 - DNA, 25 bp, Mus musculus
gacttcggcttcacaaaggtcgtcg

SEQ ID NO: 105093 - DNA, 25 bp, Mus musculus
gacttcgtaagcaaggagatgttcg

SEQ ID NO: 105094 - DNA, 25 bp, Mus musculus
gacttcgtcagccacaacgtccgaa

SEQ ID NO: 105095 - DNA, 25 bp, Mus musculus
gacttcgtcaggttcaagatccgtg

SEQ ID NO: 105096 - DNA, 25 bp, Mus musculus
gacttcgtgcgcaaacctgactatg

SEQ ID NO: 105097 - DNA, 25 bp, Mus musculus
gacttcgtgcgctaccactacgtgg

SEQ ID NO: 105098 - DNA, 25 bp, Mus musculus
gacttctcaaagctagacccaggca

SEQ ID NO: 105099 - DNA, 25 bp, Mus musculus
gacttctcagacatgaatggtcgtg

SEQ ID NO: 105100 - DNA, 25 bp, Mus musculus
gacttctcagagacaaggatcttgc

SEQ ID NO: 105101 - DNA, 25 bp, Mus musculus
gacttctcggcaaactgctgcggaa

SEQ ID NO: 105102 - DNA, 25 bp, Mus musculus
gacttctgcaacaatatcacactgc

SEQ ID NO: 105103 - DNA, 25 bp, Mus musculus
gacttctgcgcttctacactgagga

SEQ ID NO: 105104 - DNA, 25 bp, Mus musculus
gacttctgctatcttcctggccatg

SEQ ID NO: 105105 - DNA, 25 bp, Mus musculus
gacttctggacccttgtgaaaagga

SEQ ID NO: 105106 - DNA, 25 bp, Mus musculus
gacttctggcctactagtgtgtccc

SEQ ID NO: 105107 - DNA, 25 bp, Mus musculus
gacttctgggacttctgcctcggga

SEQ ID NO: 105108 - DNA, 25 bp, Mus musculus
gacttctgggtttgcagcattggcc

SEQ ID NO: 105109 - DNA, 25 bp, Mus musculus
gacttctttgtaatactggctcaag

SEQ ID NO: 105110 - DNA, 25 bp, Mus musculus
gacttgaacccaagccgtgagcgct

SEQ ID NO: 105111 - DNA, 25 bp, Mus musculus
gacttgaacttacaggctcagggca

SEQ ID NO: 105112 - DNA, 25 bp, Mus musculus
gacttgaagctgaccgtagacgggc

SEQ ID NO: 105113 - DNA, 25 bp, Mus musculus
gacttgactatagactccatggtgg

SEQ ID NO: 105114 - DNA, 25 bp, Mus musculus
gacttgagaaaaaaggccatggaag

SEQ ID NO: 105115 - DNA, 25 bp, Mus musculus
gacttgagcattccaaagagagcca

SEQ ID NO: 105116 - DNA, 25 bp, Mus musculus
gacttgagcttagacatgccaggca

SEQ ID NO: 105117 - DNA, 25 bp, Mus musculus
gacttgagtatttccgacctcacgg

SEQ ID NO: 105118 - DNA, 25 bp, Mus musculus
gacttgatattatttcctctggaca

SEQ ID NO: 105119 - DNA, 25 bp, Mus musculus
gacttgatgatgaatgtgaacacca

SEQ ID NO: 105120 - DNA, 25 bp, Mus musculus
gacttgatggacagagggaacccag

SEQ ID NO: 105121 - DNA, 25 bp, Mus musculus
gacttgcaactttcttcaggagctg

SEQ ID NO: 105122 - DNA, 25 bp, Mus musculus
gacttgcaccgttgcccgggatgaa

SEQ ID NO: 105123 - DNA, 25 bp, Mus musculus
gacttgcactaagaagaagcctatg

SEQ ID NO: 105124 - DNA, 25 bp, Mus musculus
gacttgcagcgagataaggcccgat

SEQ ID NO: 105125 - DNA, 25 bp, Mus musculus
gacttgcagctctattctgggaggc

SEQ ID NO: 105126 - DNA, 25 bp, Mus musculus
gacttgcaggtcacaggtagtggcc

SEQ ID NO: 105127 - DNA, 25 bp, Mus musculus
gacttgcattttggacgtcaaccca

SEQ ID NO: 105128 - DNA, 25 bp, Mus musculus
gacttgcccagctatacccttggtg

SEQ ID NO: 105129 - DNA, 25 bp, Mus musculus
gacttgccgtatagacagacgcgga

SEQ ID NO: 105130 - DNA, 25 bp, Mus musculus
gacttgcctcagactagagcaggac

SEQ ID NO: 105131 - DNA, 25 bp, Mus musculus
gacttgcctcctgaacaatggtcgc

SEQ ID NO: 105132 - DNA, 25 bp, Mus musculus
gacttgcctggccatcctgagttca

SEQ ID NO: 105133 - DNA, 25 bp, Mus musculus
gacttgcggtcagtcagaacaaacg

SEQ ID NO: 105134 - DNA, 25 bp, Mus musculus
gacttgctctgctgcatgtctggag

SEQ ID NO: 105135 - DNA, 25 bp, Mus musculus
gacttgctgcacaaaatccacgtag

SEQ ID NO: 105136 - DNA, 25 bp, Mus musculus
gacttgctgctaaacagggttcaga

SEQ ID NO: 105137 - DNA, 25 bp, Mus musculus
gacttgctgctgaatgcctatcgcc

SEQ ID NO: 105138 - DNA, 25 bp, Mus musculus
gacttggacccatgtgttagaatga

SEQ ID NO: 105139 - DNA, 25 bp, Mus musculus
gacttggacgcttctgcggcacctt

SEQ ID NO: 105140 - DNA, 25 bp, Mus musculus
gacttggactgtggatcccctgact

SEQ ID NO: 105141 - DNA, 25 bp, Mus musculus
gacttggagacagactgcagcctgg

SEQ ID NO: 105142 - DNA, 25 bp, Mus musculus
gacttggagcatcttttctaggaag

SEQ ID NO: 105143 - DNA, 25 bp, Mus musculus
gacttggaggctgtccctatgcaaa

SEQ ID NO: 105144 - DNA, 25 bp, Mus musculus
gacttggagtggtcaccggcttgca

SEQ ID NO: 105145 - DNA, 25 bp, Mus musculus
gacttggatcgaattctgactctca

SEQ ID NO: 105146 - DNA, 25 bp, Mus musculus
gacttggatctcattgacaatctgg

SEQ ID NO: 105147 - DNA, 25 bp, Mus musculus
gacttggcatagagaagggcaccat

SEQ ID NO: 105148 - DNA, 25 bp, Mus musculus
gacttggcatgagaaatacggaccg

SEQ ID NO: 105149 - DNA, 25 bp, Mus musculus
gacttggcgaacagaaagcccttcg

SEQ ID NO: 105150 - DNA, 25 bp, Mus musculus
gacttggctgagattgtgtcccgga

SEQ ID NO: 105151 - DNA, 25 bp, Mus musculus
gacttggctgccagcgatgactaca

SEQ ID NO: 105152 - DNA, 25 bp, Mus musculus
gacttggctgtaccagagaccacca

SEQ ID NO: 105153 - DNA, 25 bp, Mus musculus
gacttgggaacaactggacgtcttc

SEQ ID NO: 105154 - DNA, 25 bp, Mus musculus
gacttgggacctgcaaactgatgtc

SEQ ID NO: 105155 - DNA, 25 bp, Mus musculus
gacttgggagagctgaccagtaact

SEQ ID NO: 105156 - DNA, 25 bp, Mus musculus
gacttgggagctgctatttggccca

SEQ ID NO: 105157 - DNA, 25 bp, Mus musculus
gacttgggcctcctcgagatgagcc

SEQ ID NO: 105158 - DNA, 25 bp, Mus musculus
gacttggtagcctgggtgacggctg

SEQ ID NO: 105159 - DNA, 25 bp, Mus musculus
gacttggtcaactgattcctggaca

SEQ ID NO: 105160 - DNA, 25 bp, Mus musculus
gacttggtcaccaaagccagggaag

SEQ ID NO: 105161 - DNA, 25 bp, Mus musculus
gacttggtgaagagcactttgggac

SEQ ID NO: 105162 - DNA, 25 bp, Mus musculus
gacttggtgccatagctagtctggg

SEQ ID NO: 105163 - DNA, 25 bp, Mus musculus
gacttgtaaagcctgagacctgcct

SEQ ID NO: 105164 - DNA, 25 bp, Mus musculus
gacttgtacttcacgctgtttggcc

SEQ ID NO: 105165 - DNA, 25 bp, Mus musculus
gacttgtagcttgttgcctaacagg

SEQ ID NO: 105166 - DNA, 25 bp, Mus musculus
gacttgtccccatggtctcagatgg

SEQ ID NO: 105167 - DNA, 25 bp, Mus musculus
gacttgtgctgctaagttaaggcca

SEQ ID NO: 105168 - DNA, 25 bp, Mus musculus
gacttgtgcttttgaccgtggcctg

SEQ ID NO: 105169 - DNA, 25 bp, Mus musculus
gacttgtggtctctgtgggaacttc

SEQ ID NO: 105170 - DNA, 25 bp, Mus musculus
gacttgttcaactggcctacgtgga

SEQ ID NO: 105171 - DNA, 25 bp, Mus musculus
gacttgttcacgaagaaatgccctg

SEQ ID NO: 105172 - DNA, 25 bp, Mus musculus
gacttgttcagtaacgtgcccttcc

SEQ ID NO: 105173 - DNA, 25 bp, Mus musculus
gacttgttcgggttctccagcatgg

SEQ ID NO: 105174 - DNA, 25 bp, Mus musculus
gacttgttgagccactgcgtgctac

SEQ ID NO: 105175 - DNA, 25 bp, Mus musculus
gacttgttgatcatcatggcccaga

SEQ ID NO: 105176 - DNA, 25 bp, Mus musculus
gacttgttgccatccttgcagtggg

SEQ ID NO: 105177 - DNA, 25 bp, Mus musculus
gacttgtttgacattgaggacggca

SEQ ID NO: 105178 - DNA, 25 bp, Mus musculus
gacttgttttcagaggcccaggact

SEQ ID NO: 105179 - DNA, 25 bp, Mus musculus
gactttaacaaggaaattacgcata

SEQ ID NO: 105180 - DNA, 25 bp, Mus musculus
gactttaaggagcacgtgatcagca

SEQ ID NO: 105181 - DNA, 25 bp, Mus musculus
gactttaagggtaccggacctgcag

SEQ ID NO: 105182 - DNA, 25 bp, Mus musculus
gactttaattgctgtggtcttgctg

SEQ ID NO: 105183 - DNA, 25 bp, Mus musculus
gactttacccgcagtccgcggtcag

SEQ ID NO: 105184 - DNA, 25 bp, Mus musculus
gactttacgtccagtcggcatacgg

SEQ ID NO: 105185 - DNA, 25 bp, Mus musculus
gactttacttgtcatcagggcacag

SEQ ID NO: 105186 - DNA, 25 bp, Mus musculus
gactttagaacaccagagggcgctc

SEQ ID NO: 105187 - DNA, 25 bp, Mus musculus
gactttagcgtgtccacaaccggga

SEQ ID NO: 105188 - DNA, 25 bp, Mus musculus
gactttatccccatgtactgctggg

SEQ ID NO: 105189 - DNA, 25 bp, Mus musculus
gactttatgcagaaccgcctttccg

SEQ ID NO: 105190 - DNA, 25 bp, Mus musculus
gactttatggcaatgggagccgcag

SEQ ID NO: 105191 - DNA, 25 bp, Mus musculus
gactttcaacgagacactgtctgtg

SEQ ID NO: 105192 - DNA, 25 bp, Mus musculus
gactttcaccaagcgcaagttcgga

SEQ ID NO: 105193 - DNA, 25 bp, Mus musculus
gactttcaccttctgctaattggag

SEQ ID NO: 105194 - DNA, 25 bp, Mus musculus
gactttcacggacattggatttcga

SEQ ID NO: 105195 - DNA, 25 bp, Mus musculus
gactttcacggcaacttcagggaga

SEQ ID NO: 105196 - DNA, 25 bp, Mus musculus
gactttcactacgataaattcattc

SEQ ID NO: 105197 - DNA, 25 bp, Mus musculus
gactttcacttcgataagtaagctg

SEQ ID NO: 105198 - DNA, 25 bp, Mus musculus
gactttcagtggcaagtttcaacca

SEQ ID NO: 105199 - DNA, 25 bp, Mus musculus
gactttcatcggaaacttccacgga

SEQ ID NO: 105200 - DNA, 25 bp, Mus musculus
gactttccagagaaggattgccctg

SEQ ID NO: 105201 - DNA, 25 bp, Mus musculus
gactttcccaaatactggagccagg

SEQ ID NO: 105202 - DNA, 25 bp, Mus musculus
gactttccgaacagagcgtcctgtc

SEQ ID NO: 105203 - DNA, 25 bp, Mus musculus
gactttccgtgggactcaccgtcat

SEQ ID NO: 105204 - DNA, 25 bp, Mus musculus
gactttcctgaacacttgagagcca

SEQ ID NO: 105205 - DNA, 25 bp, Mus musculus
gactttcctgctagcaaaagcaagc

SEQ ID NO: 105206 - DNA, 25 bp, Mus musculus
gactttcgacagcaaataggcctgg

SEQ ID NO: 105207 - DNA, 25 bp, Mus musculus
gactttcgatttcagtgccctggca

SEQ ID NO: 105208 - DNA, 25 bp, Mus musculus
gactttcgtaggctgccttcctggt

SEQ ID NO: 105209 - DNA, 25 bp, Mus musculus
gactttcgtcgtactcgtgacagcg

SEQ ID NO: 105210 - DNA, 25 bp, Mus musculus
gactttctaaaatcggcctcatgag

SEQ ID NO: 105211 - DNA, 25 bp, Mus musculus
gactttctagcaacttcccatgtgg

SEQ ID NO: 105212 - DNA, 25 bp, Mus musculus
gactttcttaacaacctggccacgg

SEQ ID NO: 105213 - DNA, 25 bp, Mus musculus
gactttgaaggactcgtgatgacac

SEQ ID NO: 105214 - DNA, 25 bp, Mus musculus
gactttgaagtggtccctactgagg

SEQ ID NO: 105215 - DNA, 25 bp, Mus musculus
gactttgactgccatcttgatgaca

SEQ ID NO: 105216 - DNA, 25 bp, Mus musculus
gactttgagcatacgattcatgtgg

SEQ ID NO: 105217 - DNA, 25 bp, Mus musculus
gactttgaggagacaatggacgcac

SEQ ID NO: 105218 - DNA, 25 bp, Mus musculus
gactttgagggcaatttccagagga

SEQ ID NO: 105219 - DNA, 25 bp, Mus musculus
gactttgcaacagtggccagcatgg

SEQ ID NO: 105220 - DNA, 25 bp, Mus musculus
gactttgcagcgtggaacacggcca

SEQ ID NO: 105221 - DNA, 25 bp, Mus musculus
gactttgcccagacagttattggcc

SEQ ID NO: 105222 - DNA, 25 bp, Mus musculus
gactttgcccattcctgctgacgga

SEQ ID NO: 105223 - DNA, 25 bp, Mus musculus
gactttgcctgagactgattcctgg

SEQ ID NO: 105224 - DNA, 25 bp, Mus musculus
gactttgctatcctgctccgggctg

SEQ ID NO: 105225 - DNA, 25 bp, Mus musculus
gactttgctcatcgtaagacatcac

SEQ ID NO: 105226 - DNA, 25 bp, Mus musculus
gactttgctgactcagaaatcagga

SEQ ID NO: 105227 - DNA, 25 bp, Mus musculus
gactttgctgccaaggccagactgg

SEQ ID NO: 105228 - DNA, 25 bp, Mus musculus
gactttggactggtgtcttcatcct

SEQ ID NO: 105229 - DNA, 25 bp, Mus musculus
gactttggagcaagattccgaggca

SEQ ID NO: 105230 - DNA, 25 bp, Mus musculus
gactttggcagcatcttggaacgga

SEQ ID NO: 105231 - DNA, 25 bp, Mus musculus
gactttggccatcattatttcaccg

SEQ ID NO: 105232 - DNA, 25 bp, Mus musculus
gactttgtacgaaacttcatgcgca

SEQ ID NO: 105233 - DNA, 25 bp, Mus musculus
gactttgtccaaggcaacggtgcag

SEQ ID NO: 105234 - DNA, 25 bp, Mus musculus
gactttgtcgccagtgctcatcagc

SEQ ID NO: 105235 - DNA, 25 bp, Mus musculus
gactttgtgaacatccagctgtacc

SEQ ID NO: 105236 - DNA, 25 bp, Mus musculus
gactttgtgatcatccgtcggccga

SEQ ID NO: 105237 - DNA, 25 bp, Mus musculus
gacttttagtcctcgaattcggcct

SEQ ID NO: 105238 - DNA, 25 bp, Mus musculus
gacttttatctggtgaatggacttg

SEQ ID NO: 105239 - DNA, 25 bp, Mus musculus
gacttttattccaggcctccgttag

SEQ ID NO: 105240 - DNA, 25 bp, Mus musculus
gacttttcactggaagaggccttgc

SEQ ID NO: 105241 - DNA, 25 bp, Mus musculus
gacttttccctctgtgcctgtagga

SEQ ID NO: 105242 - DNA, 25 bp, Mus musculus
gacttttctgagtgacgcctctgac

SEQ ID NO: 105243 - DNA, 25 bp, Mus musculus
gacttttcttaggatcagatcgaag

SEQ ID NO: 105244 - DNA, 25 bp, Mus musculus
gacttttgagccattggactggccc

SEQ ID NO: 105245 - DNA, 25 bp, Mus musculus
gacttttgataacagcgcagtgccc

SEQ ID NO: 105246 - DNA, 25 bp, Mus musculus
gacttttgatggtgaagtcaagaca

SEQ ID NO: 105247 - DNA, 25 bp, Mus musculus
gacttttgcaatcagagataacagc

SEQ ID NO: 105248 - DNA, 25 bp, Mus musculus
gacttttgccaagcgtcagaaggaa

SEQ ID NO: 105249 - DNA, 25 bp, Mus musculus
gacttttgctgaggcactggccacc

SEQ ID NO: 105250 - DNA, 25 bp, Mus musculus
gacttttggacgtcttcacgccggc

SEQ ID NO: 105251 - DNA, 25 bp, Mus musculus
gactttttggcatacaggtcccaga

SEQ ID NO: 105252 - DNA, 25 bp, Mus musculus
gagaaaaaccgggttgcagctcaga

SEQ ID NO: 105253 - DNA, 25 bp, Mus musculus
gagaaaaagattatgctctacatgt

SEQ ID NO: 105254 - DNA, 25 bp, Mus musculus
gagaaaaagccagaaacggccgtgt

SEQ ID NO: 105255 - DNA, 25 bp, Mus musculus
gagaaaaagccccacccaatatgga

SEQ ID NO: 105256 - DNA, 25 bp, Mus musculus
gagaaaaaggtgtgcctggcatccc

SEQ ID NO: 105257 - DNA, 25 bp, Mus musculus
gagaaaaatcgccaagtggagttcc

SEQ ID NO: 105258 - DNA, 25 bp, Mus musculus
gagaaaacagaaacgctggcctcct

SEQ ID NO: 105259 - DNA, 25 bp, Mus musculus
gagaaaacccaagagcctggtaaag

SEQ ID NO: 105260 - DNA, 25 bp, Mus musculus
gagaaaaccgggaactcagagtcca

SEQ ID NO: 105261 - DNA, 25 bp, Mus musculus
gagaaaaccttctccgtgtgtgaga

SEQ ID NO: 105262 - DNA, 25 bp, Mus musculus
gagaaaactccaggctacataaagt

SEQ ID NO: 105263 - DNA, 25 bp, Mus musculus
gagaaaactggatgcgtcaaatcat

SEQ ID NO: 105264 - DNA, 25 bp, Mus musculus
gagaaaagctttgggcgaaggcacc

SEQ ID NO: 105265 - DNA, 25 bp, Mus musculus
gagaaaagtactcgcgcaagcttgg

SEQ ID NO: 105266 - DNA, 25 bp, Mus musculus
gagaaaagtgccataggagaccagc

SEQ ID NO: 105267 - DNA, 25 bp, Mus musculus
gagaaaagttcagtaccgcaaaggc

SEQ ID NO: 105268 - DNA, 25 bp, Mus musculus
gagaaaataagggatgaaccaaaga

SEQ ID NO: 105269 - DNA, 25 bp, Mus musculus
gagaaaatccgccttccagagtttg

SEQ ID NO: 105270 - DNA, 25 bp, Mus musculus
gagaaaatgaacaggatgcggcagc

SEQ ID NO: 105271 - DNA, 25 bp, Mus musculus
gagaaaatgccaggaatattcctct

SEQ ID NO: 105272 - DNA, 25 bp, Mus musculus
gagaaaatgtcaaatccttctggga

SEQ ID NO: 105273 - DNA, 25 bp, Mus musculus
gagaaaattagtcagacggccccgg

SEQ ID NO: 105274 - DNA, 25 bp, Mus musculus
gagaaaatttcatacctgccagtca

SEQ ID NO: 105275 - DNA, 25 bp, Mus musculus
gagaaaattttgagcagacgccatt

SEQ ID NO: 105276 - DNA, 25 bp, Mus musculus
gagaaacaataggacggaagcgtcg

SEQ ID NO: 105277 - DNA, 25 bp, Mus musculus
gagaaacacctcaaagaacggaaga

SEQ ID NO: 105278 - DNA, 25 bp, Mus musculus
gagaaacagatactcagtgaccagt

SEQ ID NO: 105279 - DNA, 25 bp, Mus musculus
gagaaacaggtcatggacactcgaa

SEQ ID NO: 105280 - DNA, 25 bp, Mus musculus
gagaaaccctacagacgtcggcagt

SEQ ID NO: 105281 - DNA, 25 bp, Mus musculus
gagaaaccgtggaagggtcgtccat

SEQ ID NO: 105282 - DNA, 25 bp, Mus musculus
gagaaacctttgtgcccttggcaga

SEQ ID NO: 105283 - DNA, 25 bp, Mus musculus
gagaaacgagctcccaaatttgtgg

SEQ ID NO: 105284 - DNA, 25 bp, Mus musculus
gagaaacgctaccaaatgtgaagaa

SEQ ID NO: 105285 - DNA, 25 bp, Mus musculus
gagaaacgttatgatccagcccagg

SEQ ID NO: 105286 - DNA, 25 bp, Mus musculus
gagaaactcagacagcatagcgacc

SEQ ID NO: 105287 - DNA, 25 bp, Mus musculus
gagaaactcattgctggtaccctgg

SEQ ID NO: 105288 - DNA, 25 bp, Mus musculus
gagaaactccagcttgggccagaga

SEQ ID NO: 105289 - DNA, 25 bp, Mus musculus
gagaaactgaaacgctgcattcgca

SEQ ID NO: 105290 - DNA, 25 bp, Mus musculus
gagaaactgaacttgcccattgaaa

SEQ ID NO: 105291 - DNA, 25 bp, Mus musculus
gagaaactgaagtcggcctgcagaa

SEQ ID NO: 105292 - DNA, 25 bp, Mus musculus
gagaaactgccaaccttaaaaaatg

SEQ ID NO: 105293 - DNA, 25 bp, Mus musculus
gagaaactgctggagcctctgataa

SEQ ID NO: 105294 - DNA, 25 bp, Mus musculus
gagaaactggctgaaggactagaca

SEQ ID NO: 105295 - DNA, 25 bp, Mus musculus
gagaaactttggtgggcgccttcca

SEQ ID NO: 105296 - DNA, 25 bp, Mus musculus
gagaaacttttctgcatcgacctga

SEQ ID NO: 105297 - DNA, 25 bp, Mus musculus
gagaaagaattcctgcctatcctac

SEQ ID NO: 105298 - DNA, 25 bp, Mus musculus
gagaaagacctgctcagctccgtga

SEQ ID NO: 105299 - DNA, 25 bp, Mus musculus
gagaaagacttgaagcgcatctggc

SEQ ID NO: 105300 - DNA, 25 bp, Mus musculus
gagaaagagcttctgctagccaggc

SEQ ID NO: 105301 - DNA, 25 bp, Mus musculus
gagaaagatcttggccgacttcagg

SEQ ID NO: 105302 - DNA, 25 bp, Mus musculus
gagaaagatgtcttagtcagccctt

SEQ ID NO: 105303 - DNA, 25 bp, Mus musculus
gagaaagattacgacagcgccctga

SEQ ID NO: 105304 - DNA, 25 bp, Mus musculus
gagaaagccgtcctgatagccagca

SEQ ID NO: 105305 - DNA, 25 bp, Mus musculus
gagaaagcgcatctccctgggatga

SEQ ID NO: 105306 - DNA, 25 bp, Mus musculus
gagaaagctcagcatacagtgtgta

SEQ ID NO: 105307 - DNA, 25 bp, Mus musculus
gagaaagcttgttccctgaagacca

SEQ ID NO: 105308 - DNA, 25 bp, Mus musculus
gagaaaggaaagcgcgaggagacgc

SEQ ID NO: 105309 - DNA, 25 bp, Mus musculus
gagaaaggaaccctcaagccaggat

SEQ ID NO: 105310 - DNA, 25 bp, Mus musculus
gagaaaggaccaccggccatgttgc

SEQ ID NO: 105311 - DNA, 25 bp, Mus musculus
gagaaaggctccgtcatgatacaga

SEQ ID NO: 105312 - DNA, 25 bp, Mus musculus
gagaaaggtgggattgttcttaaat

SEQ ID NO: 105313 - DNA, 25 bp, Mus musculus
gagaaagtccaagtccagccgagac

SEQ ID NO: 105314 - DNA, 25 bp, Mus musculus
gagaaagtgaaaccaacagctgcaa

SEQ ID NO: 105315 - DNA, 25 bp, Mus musculus
gagaaagtgcacagaccagctcctg

SEQ ID NO: 105316 - DNA, 25 bp, Mus musculus
gagaaagtgcgaaaaccagaagacc

SEQ ID NO: 105317 - DNA, 25 bp, Mus musculus
gagaaagttacttcaccctactggg

SEQ ID NO: 105318 - DNA, 25 bp, Mus musculus
gagaaataaaaactgtctggaaggg

SEQ ID NO: 105319 - DNA, 25 bp, Mus musculus
gagaaatataagcttccggttccac

SEQ ID NO: 105320 - DNA, 25 bp, Mus musculus
gagaaatcaccactagaccatgctg

SEQ ID NO: 105321 - DNA, 25 bp, Mus musculus
gagaaatcatcaccctacagttggg

SEQ ID NO: 105322 - DNA, 25 bp, Mus musculus
gagaaatccatttccctggtccagg

SEQ ID NO: 105323 - DNA, 25 bp, Mus musculus
gagaaatcctgcctgctgactttgg

SEQ ID NO: 105324 - DNA, 25 bp, Mus musculus
gagaaatcctgtcccaaaacagaag

SEQ ID NO: 105325 - DNA, 25 bp, Mus musculus
gagaaatccttaccaaagcaacttt

SEQ ID NO: 105326 - DNA, 25 bp, Mus musculus
gagaaatcggaaaacctggctaaag

SEQ ID NO: 105327 - DNA, 25 bp, Mus musculus
gagaaatctaacaagctgctgctgg

SEQ ID NO: 105328 - DNA, 25 bp, Mus musculus
gagaaatcttcaaaccccgagggat

SEQ ID NO: 105329 - DNA, 25 bp, Mus musculus
gagaaatgtaggacacaccaggcat

SEQ ID NO: 105330 - DNA, 25 bp, Mus musculus
gagaaattcaccacctttagcaagg

SEQ ID NO: 105331 - DNA, 25 bp, Mus musculus
gagaaattccattccagactgaggc

SEQ ID NO: 105332 - DNA, 25 bp, Mus musculus
gagaaattcccactcattgagcaga

SEQ ID NO: 105333 - DNA, 25 bp, Mus musculus
gagaaattctcgcacagccgagtgg

SEQ ID NO: 105334 - DNA, 25 bp, Mus musculus
gagaaattgaaaaagcggcgacctg

SEQ ID NO: 105335 - DNA, 25 bp, Mus musculus
gagaaattgatgaacgaaaccgccc

SEQ ID NO: 105336 - DNA, 25 bp, Mus musculus
gagaaatttcaaggttcagatggga

SEQ ID NO: 105337 - DNA, 25 bp, Mus musculus
gagaacaaaagtacagagtcccggc

SEQ ID NO: 105338 - DNA, 25 bp, Mus musculus
gagaacaacccctttgacaacgacg

SEQ ID NO: 105339 - DNA, 25 bp, Mus musculus
gagaacaactcagggtcagacgtcc

SEQ ID NO: 105340 - DNA, 25 bp, Mus musculus
gagaacaccgtgctttccagtggtc

SEQ ID NO: 105341 - DNA, 25 bp, Mus musculus
gagaacacctgctactgtggagctg

SEQ ID NO: 105342 - DNA, 25 bp, Mus musculus
gagaacactagggtcagcttgccat

SEQ ID NO: 105343 - DNA, 25 bp, Mus musculus
gagaacactctgtaccatgtgcaag

SEQ ID NO: 105344 - DNA, 25 bp, Mus musculus
gagaacacttctcctacaggaccct

SEQ ID NO: 105345 - DNA, 25 bp, Mus musculus
gagaacacttgaagacaccgggagc

SEQ ID NO: 105346 - DNA, 25 bp, Mus musculus
gagaacagatcaacataggaggcct

SEQ ID NO: 105347 - DNA, 25 bp, Mus musculus
gagaacagatctagctccaatgtgg

SEQ ID NO: 105348 - DNA, 25 bp, Mus musculus
gagaacagcaagaaacgggtccgta

SEQ ID NO: 105349 - DNA, 25 bp, Mus musculus
gagaacagccttaatgacccagacc

SEQ ID NO: 105350 - DNA, 25 bp, Mus musculus
gagaacagctacgaacattgcctgg

SEQ ID NO: 105351 - DNA, 25 bp, Mus musculus
gagaacagtttcattgaccttggag

SEQ ID NO: 105352 - DNA, 25 bp, Mus musculus
gagaacatcttccattcaatggcag

SEQ ID NO: 105353 - DNA, 25 bp, Mus musculus
gagaacattccagtgaggccgattg

SEQ ID NO: 105354 - DNA, 25 bp, Mus musculus
gagaacatttacatcagcgtgggct

SEQ ID NO: 105355 - DNA, 25 bp, Mus musculus
gagaacatttcagatccggtccggc

SEQ ID NO: 105356 - DNA, 25 bp, Mus musculus
gagaaccaacacactgcctatagtt

SEQ ID NO: 105357 - DNA, 25 bp, Mus musculus
gagaaccacgtcttcaacctggaga

SEQ ID NO: 105358 - DNA, 25 bp, Mus musculus
gagaaccacgtgaagactgaaccta

SEQ ID NO: 105359 - DNA, 25 bp, Mus musculus
gagaaccactgtccctagtttggag

SEQ ID NO: 105360 - DNA, 25 bp, Mus musculus
gagaaccagattctctgcagccagg

SEQ ID NO: 105361 - DNA, 25 bp, Mus musculus
gagaaccagtttgtagccgtcacca

SEQ ID NO: 105362 - DNA, 25 bp, Mus musculus
gagaaccatcttcatcaaccagcct

SEQ ID NO: 105363 - DNA, 25 bp, Mus musculus
gagaaccatgagtggcaacaacttg

SEQ ID NO: 105364 - DNA, 25 bp, Mus musculus
gagaacccaagctgccatctggtgg

SEQ ID NO: 105365 - DNA, 25 bp, Mus musculus
gagaaccccaattcatcagccggaa

SEQ ID NO: 105366 - DNA, 25 bp, Mus musculus
gagaacccctacgtgaaagtggaca

SEQ ID NO: 105367 - DNA, 25 bp, Mus musculus
gagaacccggtgaaatgacacaggc

SEQ ID NO: 105368 - DNA, 25 bp, Mus musculus
gagaaccctttctaccgctgtctat

SEQ ID NO: 105369 - DNA, 25 bp, Mus musculus
gagaaccgatttgataccctggaag

SEQ ID NO: 105370 - DNA, 25 bp, Mus musculus
gagaaccggcactttccgtggacgc

SEQ ID NO: 105371 - DNA, 25 bp, Mus musculus
gagaaccggcctcttttcagctgga

SEQ ID NO: 105372 - DNA, 25 bp, Mus musculus
gagaaccgtcgctctgaggccttaa

SEQ ID NO: 105373 - DNA, 25 bp, Mus musculus
gagaacctcatcctcttggagcaag

SEQ ID NO: 105374 - DNA, 25 bp, Mus musculus
gagaacctcttcttctccgcggtgc

SEQ ID NO: 105375 - DNA, 25 bp, Mus musculus
gagaacctgactccttgcgctgtga

SEQ ID NO: 105376 - DNA, 25 bp, Mus musculus
gagaacctgcctggacttgtctaaa

SEQ ID NO: 105377 - DNA, 25 bp, Mus musculus
gagaacctggccgtcttgacactcg

SEQ ID NO: 105378 - DNA, 25 bp, Mus musculus
gagaacctgggtactggtcccactg

SEQ ID NO: 105379 - DNA, 25 bp, Mus musculus
gagaacctgtgtgctcagctcttaa

SEQ ID NO: 105380 - DNA, 25 bp, Mus musculus
gagaaccttctcaagcgcttcctgg

SEQ ID NO: 105381 - DNA, 25 bp, Mus musculus
gagaacgagccccaaaacatgatgg

SEQ ID NO: 105382 - DNA, 25 bp, Mus musculus
gagaacgatttcgatcgcctggcaa

SEQ ID NO: 105383 - DNA, 25 bp, Mus musculus
gagaacgcagagtgaccaacatcct

SEQ ID NO: 105384 - DNA, 25 bp, Mus musculus
gagaacgcccgaactaagctggagt

SEQ ID NO: 105385 - DNA, 25 bp, Mus musculus
gagaacgcctggtgtcatgaccaag

SEQ ID NO: 105386 - DNA, 25 bp, Mus musculus
gagaacgcgggctctatttgagcgc

SEQ ID NO: 105387 - DNA, 25 bp, Mus musculus
gagaacggctcaggtgtatgacaca

SEQ ID NO: 105388 - DNA, 25 bp, Mus musculus
gagaacgggacagcacgctttgaat

SEQ ID NO: 105389 - DNA, 25 bp, Mus musculus
gagaacgtcatcattcccagggagg

SEQ ID NO: 105390 - DNA, 25 bp, Mus musculus
gagaacgtcctcacccaataaagaa

SEQ ID NO: 105391 - DNA, 25 bp, Mus musculus
gagaacgttcgaaacggcacccaag

SEQ ID NO: 105392 - DNA, 25 bp, Mus musculus
gagaactaaagtggaacgcgcgagc

SEQ ID NO: 105393 - DNA, 25 bp, Mus musculus
gagaactaactgagatcactgcctg

SEQ ID NO: 105394 - DNA, 25 bp, Mus musculus
gagaactaatcaataaaatcaagga

SEQ ID NO: 105395 - DNA, 25 bp, Mus musculus
gagaactacaagacgccaggctatg

SEQ ID NO: 105396 - DNA, 25 bp, Mus musculus
gagaactacgagaacttgacttcag

SEQ ID NO: 105397 - DNA, 25 bp, Mus musculus
gagaactactgggatgctgcacaga

SEQ ID NO: 105398 - DNA, 25 bp, Mus musculus
gagaactactgtcctgaagcccaga

SEQ ID NO: 105399 - DNA, 25 bp, Mus musculus
gagaactatagcagcctggtatcct

SEQ ID NO: 105400 - DNA, 25 bp, Mus musculus
gagaactatctggtccgctggtcaa

SEQ ID NO: 105401 - DNA, 25 bp, Mus musculus
gagaactcacgactggctgctgaag

SEQ ID NO: 105402 - DNA, 25 bp, Mus musculus
gagaactcggtctgcaggaacctga

SEQ ID NO: 105403 - DNA, 25 bp, Mus musculus
gagaactcgtaccaagtagccaagg

SEQ ID NO: 105404 - DNA, 25 bp, Mus musculus
gagaactctttatttggcctgaccc

SEQ ID NO: 105405 - DNA, 25 bp, Mus musculus
gagaactgcgagacttatgaggccc

SEQ ID NO: 105406 - DNA, 25 bp, Mus musculus
gagaactgctacgactctgtgccca

SEQ ID NO: 105407 - DNA, 25 bp, Mus musculus
gagaactggccatgctacgaagaca

SEQ ID NO: 105408 - DNA, 25 bp, Mus musculus
gagaactggctacatcaagacttgg

SEQ ID NO: 105409 - DNA, 25 bp, Mus musculus
gagaactgtaaaaccgtgtaccaag

SEQ ID NO: 105410 - DNA, 25 bp, Mus musculus
gagaactgtgggtcgcctaggcttt

SEQ ID NO: 105411 - DNA, 25 bp, Mus musculus
gagaactgttggtggcttataggca

SEQ ID NO: 105412 - DNA, 25 bp, Mus musculus
gagaacttaacatgtctgacaggga

SEQ ID NO: 105413 - DNA, 25 bp, Mus musculus
gagaacttcatctctagagcctttg

SEQ ID NO: 105414 - DNA, 25 bp, Mus musculus
gagaacttccaggacaaactcgggt

SEQ ID NO: 105415 - DNA, 25 bp, Mus musculus
gagaacttctctgcctatccacggg

SEQ ID NO: 105416 - DNA, 25 bp, Mus musculus
gagaacttgcatgaccaggtacagg

SEQ ID NO: 105417 - DNA, 25 bp, Mus musculus
gagaacttgcctttcgggagtccca

SEQ ID NO: 105418 - DNA, 25 bp, Mus musculus
gagaacttggacctcaatggcagca

SEQ ID NO: 105419 - DNA, 25 bp, Mus musculus
gagaactttcacacactcagcaagt

SEQ ID NO: 105420 - DNA, 25 bp, Mus musculus
gagaactttcgaagaccacagacag

SEQ ID NO: 105421 - DNA, 25 bp, Mus musculus
gagaactttgaaacttcagactcaa

SEQ ID NO: 105422 - DNA, 25 bp, Mus musculus
gagaagaacactgaagctgcccgtg

SEQ ID NO: 105423 - DNA, 25 bp, Mus musculus
gagaagaacgaggagacagcgctcc

SEQ ID NO: 105424 - DNA, 25 bp, Mus musculus
gagaagaactccacaatcaggcaga

SEQ ID NO: 105425 - DNA, 25 bp, Mus musculus
gagaagaactctatggcaccagaaa

SEQ ID NO: 105426 - DNA, 25 bp, Mus musculus
gagaagaagaagtccaccatctggc

SEQ ID NO: 105427 - DNA, 25 bp, Mus musculus
gagaagaagcaagtcaccacggacc

SEQ ID NO: 105428 - DNA, 25 bp, Mus musculus
gagaagaagttccatacggctatgc

SEQ ID NO: 105429 - DNA, 25 bp, Mus musculus
gagaagaagttgactctcagagcca

SEQ ID NO: 105430 - DNA, 25 bp, Mus musculus
gagaagaagttggacagcgctgcca

SEQ ID NO: 105431 - DNA, 25 bp, Mus musculus
gagaagaattttggatgcccaggct

SEQ ID NO: 105432 - DNA, 25 bp, Mus musculus
gagaagacctctctgatgtaactga

SEQ ID NO: 105433 - DNA, 25 bp, Mus musculus
gagaagacgacaatcaagcgcaaag

SEQ ID NO: 105434 - DNA, 25 bp, Mus musculus
gagaagacggttctggtcaaccgca

SEQ ID NO: 105435 - DNA, 25 bp, Mus musculus
gagaagacgtccagtgactacgagg

SEQ ID NO: 105436 - DNA, 25 bp, Mus musculus
gagaagacgttatcctgcctggacc

SEQ ID NO: 105437 - DNA, 25 bp, Mus musculus
gagaagactcaacacgcattgggcg

SEQ ID NO: 105438 - DNA, 25 bp, Mus musculus
gagaagactccatgcctgagagcct

SEQ ID NO: 105439 - DNA, 25 bp, Mus musculus
gagaagagactggtccagaggactc

SEQ ID NO: 105440 - DNA, 25 bp, Mus musculus
gagaagagccttcttaccaagcagg

SEQ ID NO: 105441 - DNA, 25 bp, Mus musculus
gagaagaggaaaaataggtcctccg

SEQ ID NO: 105442 - DNA, 25 bp, Mus musculus
gagaagagtattccagtcccttgag

SEQ ID NO: 105443 - DNA, 25 bp, Mus musculus
gagaagagtctcgtcaacttggaca

SEQ ID NO: 105444 - DNA, 25 bp, Mus musculus
gagaagagtgaaccataaagacccc

SEQ ID NO: 105445 - DNA, 25 bp, Mus musculus
gagaagatcacctgtgttgaaacag

SEQ ID NO: 105446 - DNA, 25 bp, Mus musculus
gagaagatcatttcaacgcagaggg

SEQ ID NO: 105447 - DNA, 25 bp, Mus musculus
gagaagatccatcagtctggagcca

SEQ ID NO: 105448 - DNA, 25 bp, Mus musculus
gagaagatccctgctatcctgtgat

SEQ ID NO: 105449 - DNA, 25 bp, Mus musculus
gagaagatctcagcaaccgtggtag

SEQ ID NO: 105450 - DNA, 25 bp, Mus musculus
gagaagatctccacacaacaggtga

SEQ ID NO: 105451 - DNA, 25 bp, Mus musculus
gagaagatgcctcccaacaaggaag

SEQ ID NO: 105452 - DNA, 25 bp, Mus musculus
gagaagatgcttcaaaaactggaac

SEQ ID NO: 105453 - DNA, 25 bp, Mus musculus
gagaagcacgtaaggttggctttac

SEQ ID NO: 105454 - DNA, 25 bp, Mus musculus
gagaagcactccacaatgccagact

SEQ ID NO: 105455 - DNA, 25 bp, Mus musculus
gagaagcagcccatgaatgcagcgg

SEQ ID NO: 105456 - DNA, 25 bp, Mus musculus
gagaagcagctgaatacgcctaagc

SEQ ID NO: 105457 - DNA, 25 bp, Mus musculus
gagaagcaggcagataaatcggagt

SEQ ID NO: 105458 - DNA, 25 bp, Mus musculus
gagaagccaactttgtcccagggag

SEQ ID NO: 105459 - DNA, 25 bp, Mus musculus
gagaagccaattccaaaccagtagt

SEQ ID NO: 105460 - DNA, 25 bp, Mus musculus
gagaagcccaggttcaagagcatcg

SEQ ID NO: 105461 - DNA, 25 bp, Mus musculus
gagaagccccatttccaaggtcaga

SEQ ID NO: 105462 - DNA, 25 bp, Mus musculus
gagaagcccctcttgatccaggagt

SEQ ID NO: 105463 - DNA, 25 bp, Mus musculus
gagaagcccctgaactgtgatgatg

SEQ ID NO: 105464 - DNA, 25 bp, Mus musculus
gagaagcccgggtcactgattttta

SEQ ID NO: 105465 - DNA, 25 bp, Mus musculus
gagaagccctgccaacatgggacaa

SEQ ID NO: 105466 - DNA, 25 bp, Mus musculus
gagaagcccttggatatcgccagga

SEQ ID NO: 105467 - DNA, 25 bp, Mus musculus
gagaagccctttgctgtggaagaca

SEQ ID NO: 105468 - DNA, 25 bp, Mus musculus
gagaagccgacatccagattcctgg

SEQ ID NO: 105469 - DNA, 25 bp, Mus musculus
gagaagccggcttgaccatgatgcc

SEQ ID NO: 105470 - DNA, 25 bp, Mus musculus
gagaagcctacctggtgtacacaga

SEQ ID NO: 105471 - DNA, 25 bp, Mus musculus
gagaagcctccaagttcaggcaagc

SEQ ID NO: 105472 - DNA, 25 bp, Mus musculus
gagaagcctctgcaactcctgggca

SEQ ID NO: 105473 - DNA, 25 bp, Mus musculus
gagaagcctgtgatctgcgccttgg

SEQ ID NO: 105474 - DNA, 25 bp, Mus musculus
gagaagccttgatattgatactgcg

SEQ ID NO: 105475 - DNA, 25 bp, Mus musculus
gagaagcgagctgacatccaactga

SEQ ID NO: 105476 - DNA, 25 bp, Mus musculus
gagaagcgcccgttgtacctcacca

SEQ ID NO: 105477 - DNA, 25 bp, Mus musculus
gagaagcgctgggaccgtgttaaaa

SEQ ID NO: 105478 - DNA, 25 bp, Mus musculus
gagaagcggtttccaggcaaagcca

SEQ ID NO: 105479 - DNA, 25 bp, Mus musculus
gagaagctccggactgttgtcacac

SEQ ID NO: 105480 - DNA, 25 bp, Mus musculus
gagaagctcgatgaacctcatgaga

SEQ ID NO: 105481 - DNA, 25 bp, Mus musculus
gagaagctcgttatccattgcaaag

SEQ ID NO: 105482 - DNA, 25 bp, Mus musculus
gagaagctcttctaccgggtgttga

SEQ ID NO: 105483 - DNA, 25 bp, Mus musculus
gagaagctgctgtccgatggcatgc

SEQ ID NO: 105484 - DNA, 25 bp, Mus musculus
gagaagctggaacaaaagtccccgg

SEQ ID NO: 105485 - DNA, 25 bp, Mus musculus
gagaagctggaacacctggagaacc

SEQ ID NO: 105486 - DNA, 25 bp, Mus musculus
gagaagctggataactaccacaggg

SEQ ID NO: 105487 - DNA, 25 bp, Mus musculus
gagaagctggcctccacgtcgtcgt

SEQ ID NO: 105488 - DNA, 25 bp, Mus musculus
gagaagctggcctcggagaatgcca

SEQ ID NO: 105489 - DNA, 25 bp, Mus musculus
gagaagctgtgctccttacacgacg

SEQ ID NO: 105490 - DNA, 25 bp, Mus musculus
gagaagctgtttgacctggttcgaa

SEQ ID NO: 105491 - DNA, 25 bp, Mus musculus
gagaagcttaactagggcgcctgac

SEQ ID NO: 105492 - DNA, 25 bp, Mus musculus
gagaagcttcaaccaaccgagggtg

SEQ ID NO: 105493 - DNA, 25 bp, Mus musculus
gagaagcttgcagaggtcctcagca

SEQ ID NO: 105494 - DNA, 25 bp, Mus musculus
gagaaggaaccactaagccacgttg

SEQ ID NO: 105495 - DNA, 25 bp, Mus musculus
gagaaggaccggcaacaccgagacc

SEQ ID NO: 105496 - DNA, 25 bp, Mus musculus
gagaaggacttgatcccaaagctgt

SEQ ID NO: 105497 - DNA, 25 bp, Mus musculus
gagaaggagaattgtcacctggagc

SEQ ID NO: 105498 - DNA, 25 bp, Mus musculus
gagaaggagatcatcaacagagtga

SEQ ID NO: 105499 - DNA, 25 bp, Mus musculus
gagaaggatagcctggatccatctt

SEQ ID NO: 105500 - DNA, 25 bp, Mus musculus
gagaaggattcctgttgtcccgtac

SEQ ID NO: 105501 - DNA, 25 bp, Mus musculus
gagaaggcctaaggaaccctggaga

SEQ ID NO: 105502 - DNA, 25 bp, Mus musculus
gagaaggctctccaagtcctgagga

SEQ ID NO: 105503 - DNA, 25 bp, Mus musculus
gagaagggcagaacgcatcttgcag

SEQ ID NO: 105504 - DNA, 25 bp, Mus musculus
gagaagggccagtattgcgacgcca

SEQ ID NO: 105505 - DNA, 25 bp, Mus musculus
gagaaggtaaccaacgtgcagatcc

SEQ ID NO: 105506 - DNA, 25 bp, Mus musculus
gagaaggtacagcttccggaagact

SEQ ID NO: 105507 - DNA, 25 bp, Mus musculus
gagaaggtatctgcacagtgcctca

SEQ ID NO: 105508 - DNA, 25 bp, Mus musculus
gagaaggtccactatcatcagcaac

SEQ ID NO: 105509 - DNA, 25 bp, Mus musculus
gagaaggtgaacatcgtcccactca

SEQ ID NO: 105510 - DNA, 25 bp, Mus musculus
gagaaggtgccagaaagatccaaaa

SEQ ID NO: 105511 - DNA, 25 bp, Mus musculus
gagaaggtttcagtctacaggccaa

SEQ ID NO: 105512 - DNA, 25 bp, Mus musculus
gagaagtaaaagaaagcctgccttg

SEQ ID NO: 105513 - DNA, 25 bp, Mus musculus
gagaagtatgccaagtacctgcccc

SEQ ID NO: 105514 - DNA, 25 bp, Mus musculus
gagaagtcagttggtcctccagaga

SEQ ID NO: 105515 - DNA, 25 bp, Mus musculus
gagaagtcatcgtgcgctggttcaa

SEQ ID NO: 105516 - DNA, 25 bp, Mus musculus
gagaagtcttctgaacatatctgtc

SEQ ID NO: 105517 - DNA, 25 bp, Mus musculus
gagaagtgaacagggcccggtacat

SEQ ID NO: 105518 - DNA, 25 bp, Mus musculus
gagaagtgcaacatgaccagggaca

SEQ ID NO: 105519 - DNA, 25 bp, Mus musculus
gagaagtgccaccagtctactgaaa

SEQ ID NO: 105520 - DNA, 25 bp, Mus musculus
gagaagtgcttcgtatcaggccggt

SEQ ID NO: 105521 - DNA, 25 bp, Mus musculus
gagaagtggtccagcaagatcgact

SEQ ID NO: 105522 - DNA, 25 bp, Mus musculus
gagaagttcaacagccgctttcgga

SEQ ID NO: 105523 - DNA, 25 bp, Mus musculus
gagaagttcaatgggcagaaacaaa

SEQ ID NO: 105524 - DNA, 25 bp, Mus musculus
gagaagttctaaggtggctggcaca

SEQ ID NO: 105525 - DNA, 25 bp, Mus musculus
gagaagttctcacagttaagccacc

SEQ ID NO: 105526 - DNA, 25 bp, Mus musculus
gagaagttgcatttgccgactgagg

SEQ ID NO: 105527 - DNA, 25 bp, Mus musculus
gagaagttggccctgaaatgtcacc

SEQ ID NO: 105528 - DNA, 25 bp, Mus musculus
gagaagtttcatgggaaagtgtccc

SEQ ID NO: 105529 - DNA, 25 bp, Mus musculus
gagaataaaattcccagcagcccaa

SEQ ID NO: 105530 - DNA, 25 bp, Mus musculus
gagaataacatcaaccaatggactg

SEQ ID NO: 105531 - DNA, 25 bp, Mus musculus
gagaataagtagtttcctggcccaa

SEQ ID NO: 105532 - DNA, 25 bp, Mus musculus
gagaataataaaaagtccagcacta

SEQ ID NO: 105533 - DNA, 25 bp, Mus musculus
gagaatacagaagagctacactgtt

SEQ ID NO: 105534 - DNA, 25 bp, Mus musculus
gagaatacggaacagagtcacagtg

SEQ ID NO: 105535 - DNA, 25 bp, Mus musculus
gagaatactatatgcttcaggagca

SEQ ID NO: 105536 - DNA, 25 bp, Mus musculus
gagaatactcctggctctgaaaacc

SEQ ID NO: 105537 - DNA, 25 bp, Mus musculus
gagaatagacctctgttgttgaccc

SEQ ID NO: 105538 - DNA, 25 bp, Mus musculus
gagaatagcagcgtctacgccgagg

SEQ ID NO: 105539 - DNA, 25 bp, Mus musculus
gagaatagccatgacttatgagcgt

SEQ ID NO: 105540 - DNA, 25 bp, Mus musculus
gagaatatacacatggtatcctcag

SEQ ID NO: 105541 - DNA, 25 bp, Mus musculus
gagaatatcactaacccaggctggc

SEQ ID NO: 105542 - DNA, 25 bp, Mus musculus
gagaatatgatgcacagcttaggcg

SEQ ID NO: 105543 - DNA, 25 bp, Mus musculus
gagaatatgcggttcctgtccagtc

SEQ ID NO: 105544 - DNA, 25 bp, Mus musculus
gagaatatggccctcctgtcacagg

SEQ ID NO: 105545 - DNA, 25 bp, Mus musculus
gagaatattggcagctcctccgagc

SEQ ID NO: 105546 - DNA, 25 bp, Mus musculus
gagaatattttacatcagccgctac

SEQ ID NO: 105547 - DNA, 25 bp, Mus musculus
gagaatcaaagctccatcccggaac

SEQ ID NO: 105548 - DNA, 25 bp, Mus musculus
gagaatcaagctctgtcccagaatg

SEQ ID NO: 105549 - DNA, 25 bp, Mus musculus
gagaatcacatcagttcgtcctgaa

SEQ ID NO: 105550 - DNA, 25 bp, Mus musculus
gagaatcagcttatggacaaccgca

SEQ ID NO: 105551 - DNA, 25 bp, Mus musculus
gagaatcatggtccgttccctacgc

SEQ ID NO: 105552 - DNA, 25 bp, Mus musculus
gagaatcatgttggcggtgcacaga

SEQ ID NO: 105553 - DNA, 25 bp, Mus musculus
gagaatccctgtgttcagacctgtg

SEQ ID NO: 105554 - DNA, 25 bp, Mus musculus
gagaatccctttggagaacctgcag

SEQ ID NO: 105555 - DNA, 25 bp, Mus musculus
gagaatccgcctgtccgtggagaaa

SEQ ID NO: 105556 - DNA, 25 bp, Mus musculus
gagaatcctttttgacaagccttgg

SEQ ID NO: 105557 - DNA, 25 bp, Mus musculus
gagaatcgccttccacagaaaccag

SEQ ID NO: 105558 - DNA, 25 bp, Mus musculus
gagaatcggataaagatggcgaaag

SEQ ID NO: 105559 - DNA, 25 bp, Mus musculus
gagaatcgtgccaataagaagccaa

SEQ ID NO: 105560 - DNA, 25 bp, Mus musculus
gagaatcgttacaatcacaggccca

SEQ ID NO: 105561 - DNA, 25 bp, Mus musculus
gagaatctccatgtccgatacgtgg

SEQ ID NO: 105562 - DNA, 25 bp, Mus musculus
gagaatctccattaccaaactgcag

SEQ ID NO: 105563 - DNA, 25 bp, Mus musculus
gagaatctccgaccctaaggacttg

SEQ ID NO: 105564 - DNA, 25 bp, Mus musculus
gagaatctgatgctgagctccgagc

SEQ ID NO: 105565 - DNA, 25 bp, Mus musculus
gagaatctggagatctgggcccaca

SEQ ID NO: 105566 - DNA, 25 bp, Mus musculus
gagaatctggtctgggtaaatccac

SEQ ID NO: 105567 - DNA, 25 bp, Mus musculus
gagaatctgttaagaagatgcgcga

SEQ ID NO: 105568 - DNA, 25 bp, Mus musculus
gagaatcttaccttcagtggctgag

SEQ ID NO: 105569 - DNA, 25 bp, Mus musculus
gagaatcttctcatcgaccagcagg

SEQ ID NO: 105570 - DNA, 25 bp, Mus musculus
gagaatgaacgtcgcacaacctctg

SEQ ID NO: 105571 - DNA, 25 bp, Mus musculus
gagaatgaccagctgatccgctgta

SEQ ID NO: 105572 - DNA, 25 bp, Mus musculus
gagaatgagctgaccctgcgtcagg

SEQ ID NO: 105573 - DNA, 25 bp, Mus musculus
gagaatgatccagctacacaacggg

SEQ ID NO: 105574 - DNA, 25 bp, Mus musculus
gagaatgatgtcgtcaccggcctta

SEQ ID NO: 105575 - DNA, 25 bp, Mus musculus
gagaatgcacaggtcatgacagcca

SEQ ID NO: 105576 - DNA, 25 bp, Mus musculus
gagaatgcagacaagatgggcgcta

SEQ ID NO: 105577 - DNA, 25 bp, Mus musculus
gagaatgcagttggacccaatgcca

SEQ ID NO: 105578 - DNA, 25 bp, Mus musculus
gagaatgccagacacacacgtggtg

SEQ ID NO: 105579 - DNA, 25 bp, Mus musculus
gagaatgccggcttgcacacagatg

SEQ ID NO: 105580 - DNA, 25 bp, Mus musculus
gagaatgcctccagcggtggtgaca

SEQ ID NO: 105581 - DNA, 25 bp, Mus musculus
gagaatgctcgtgtgctagactgga

SEQ ID NO: 105582 - DNA, 25 bp, Mus musculus
gagaatggagagactgagcgaacct

SEQ ID NO: 105583 - DNA, 25 bp, Mus musculus
gagaatggagcaacacgtagaggca

SEQ ID NO: 105584 - DNA, 25 bp, Mus musculus
gagaatggccactatttgtaccgca

SEQ ID NO: 105585 - DNA, 25 bp, Mus musculus
gagaatggctctgccttcgggagct

SEQ ID NO: 105586 - DNA, 25 bp, Mus musculus
gagaatggctgctcagatccccttg

SEQ ID NO: 105587 - DNA, 25 bp, Mus musculus
gagaatgtcaacagaaacatcagca

SEQ ID NO: 105588 - DNA, 25 bp, Mus musculus
gagaatgtccaaaaccggcacgagt

SEQ ID NO: 105589 - DNA, 25 bp, Mus musculus
gagaatgtccactgtaaccctgtca

SEQ ID NO: 105590 - DNA, 25 bp, Mus musculus
gagaatgtcctacggacccgcagta

SEQ ID NO: 105591 - DNA, 25 bp, Mus musculus
gagaatgtcgcatcgtcttcaggcc

SEQ ID NO: 105592 - DNA, 25 bp, Mus musculus
gagaatgtgctcgtctgcaagccca

SEQ ID NO: 105593 - DNA, 25 bp, Mus musculus
gagaatgtggccgttcacctgtcca

SEQ ID NO: 105594 - DNA, 25 bp, Mus musculus
gagaattacaacatgaacgatgccc

SEQ ID NO: 105595 - DNA, 25 bp, Mus musculus
gagaattacaggaacggtggcgaca

SEQ ID NO: 105596 - DNA, 25 bp, Mus musculus
gagaattacatcactgcactgcagg

SEQ ID NO: 105597 - DNA, 25 bp, Mus musculus
gagaattcacgtgtcccctctgtag

SEQ ID NO: 105598 - DNA, 25 bp, Mus musculus
gagaattcatgtcctatcctccagg

SEQ ID NO: 105599 - DNA, 25 bp, Mus musculus
gagaattccagttgtgtccagttca

SEQ ID NO: 105600 - DNA, 25 bp, Mus musculus
gagaattctgtcttcgccactcaat

SEQ ID NO: 105601 - DNA, 25 bp, Mus musculus
gagaattgtgtctacccttccagcc

SEQ ID NO: 105602 - DNA, 25 bp, Mus musculus
gagaatttagagctaccaatggatg

SEQ ID NO: 105603 - DNA, 25 bp, Mus musculus
gagaatttcttccaccctcagggca

SEQ ID NO: 105604 - DNA, 25 bp, Mus musculus
gagaatttgctgcacgcagtagcga

SEQ ID NO: 105605 - DNA, 25 bp, Mus musculus
gagaattttacagagcgggtgcagt

SEQ ID NO: 105606 - DNA, 25 bp, Mus musculus
gagaattttacagcagccatccctg

SEQ ID NO: 105607 - DNA, 25 bp, Mus musculus
gagacaaaccaaccgtcactcctgt

SEQ ID NO: 105608 - DNA, 25 bp, Mus musculus
gagacaaagagctcctaaaggctga

SEQ ID NO: 105609 - DNA, 25 bp, Mus musculus
gagacaacaagaagggacgggtcac

SEQ ID NO: 105610 - DNA, 25 bp, Mus musculus
gagacaaccactttaagactgactg

SEQ ID NO: 105611 - DNA, 25 bp, Mus musculus
gagacaaccccaggttcaacctgat

SEQ ID NO: 105612 - DNA, 25 bp, Mus musculus
gagacaacgagttccacagtgaaat

SEQ ID NO: 105613 - DNA, 25 bp, Mus musculus
gagacaactgatcatctatgggaaa

SEQ ID NO: 105614 - DNA, 25 bp, Mus musculus
gagacaactgtcctgaagctcgagt

SEQ ID NO: 105615 - DNA, 25 bp, Mus musculus
gagacaagcctctgataaggaagaa

SEQ ID NO: 105616 - DNA, 25 bp, Mus musculus
gagacaagcgaatggtatttgaccc

SEQ ID NO: 105617 - DNA, 25 bp, Mus musculus
gagacaaggcctcacatgggctaga

SEQ ID NO: 105618 - DNA, 25 bp, Mus musculus
gagacaagttcttcctgcgtgtgac

SEQ ID NO: 105619 - DNA, 25 bp, Mus musculus
gagacaagtttgtgctacgctttgc

SEQ ID NO: 105620 - DNA, 25 bp, Mus musculus
gagacacaatggagaacttctggtg

SEQ ID NO: 105621 - DNA, 25 bp, Mus musculus
gagacacaccattgactccagtggg

SEQ ID NO: 105622 - DNA, 25 bp, Mus musculus
gagacacaggtcattcgggagaccc

SEQ ID NO: 105623 - DNA, 25 bp, Mus musculus
gagacacattcttctttcagccgag

SEQ ID NO: 105624 - DNA, 25 bp, Mus musculus
gagacaccactgtgcgcttctggga

SEQ ID NO: 105625 - DNA, 25 bp, Mus musculus
gagacaccagtcatcaagcaagaaa

SEQ ID NO: 105626 - DNA, 25 bp, Mus musculus
gagacaccagtgttggcaccttgag

SEQ ID NO: 105627 - DNA, 25 bp, Mus musculus
gagacaccatcttccaacggctctg

SEQ ID NO: 105628 - DNA, 25 bp, Mus musculus
gagacacctatatgcacgtgggcag

SEQ ID NO: 105629 - DNA, 25 bp, Mus musculus
gagacacctatggagtcaggccctt

SEQ ID NO: 105630 - DNA, 25 bp, Mus musculus
gagacaccttttctggatcgatgca

SEQ ID NO: 105631 - DNA, 25 bp, Mus musculus
gagacacgctgaagccagagatgca

SEQ ID NO: 105632 - DNA, 25 bp, Mus musculus
gagacacggctgtggcttacggaca

SEQ ID NO: 105633 - DNA, 25 bp, Mus musculus
gagacacgggcatccttgactccat

SEQ ID NO: 105634 - DNA, 25 bp, Mus musculus
gagacacgggccaccatgaatttgg

SEQ ID NO: 105635 - DNA, 25 bp, Mus musculus
gagacacggtggtctgcttcttcca

SEQ ID NO: 105636 - DNA, 25 bp, Mus musculus
gagacacgtttctgagacacccgac

SEQ ID NO: 105637 - DNA, 25 bp, Mus musculus
gagacactagagaccgcagggaact

SEQ ID NO: 105638 - DNA, 25 bp, Mus musculus
gagacactcccttggcacagtctga

SEQ ID NO: 105639 - DNA, 25 bp, Mus musculus
gagacactctaaacgcagtagccct

SEQ ID NO: 105640 - DNA, 25 bp, Mus musculus
gagacactctcggaaaaacgctaag

SEQ ID NO: 105641 - DNA, 25 bp, Mus musculus
gagacactgggctttggcctcctag

SEQ ID NO: 105642 - DNA, 25 bp, Mus musculus
gagacactgtgcagagggtgaccac

SEQ ID NO: 105643 - DNA, 25 bp, Mus musculus
gagacacttgagactgggtcagcaa

SEQ ID NO: 105644 - DNA, 25 bp, Mus musculus
gagacagaagccgtgcagggcaatt

SEQ ID NO: 105645 - DNA, 25 bp, Mus musculus
gagacagaatcactcccagagcctg

SEQ ID NO: 105646 - DNA, 25 bp, Mus musculus
gagacagacgatgcttgcccagtca

SEQ ID NO: 105647 - DNA, 25 bp, Mus musculus
gagacagactggaagcttcggctcc

SEQ ID NO: 105648 - DNA, 25 bp, Mus musculus
gagacagagcatcacaatggcatag

SEQ ID NO: 105649 - DNA, 25 bp, Mus musculus
gagacagatagctaaatacctcccc

SEQ ID NO: 105650 - DNA, 25 bp, Mus musculus
gagacagatgtcagtgaactccagc

SEQ ID NO: 105651 - DNA, 25 bp, Mus musculus
gagacagcaaacttccctctaagga

SEQ ID NO: 105652 - DNA, 25 bp, Mus musculus
gagacagcaattgtgtgaccaggat

SEQ ID NO: 105653 - DNA, 25 bp, Mus musculus
gagacagcatagaagtgaaggatga

SEQ ID NO: 105654 - DNA, 25 bp, Mus musculus
gagacagccaaggtcccagtgcttg

SEQ ID NO: 105655 - DNA, 25 bp, Mus musculus
gagacagccatgttcataaactatg

SEQ ID NO: 105656 - DNA, 25 bp, Mus musculus
gagacagccgccgtatttgaggatg

SEQ ID NO: 105657 - DNA, 25 bp, Mus musculus
gagacagcgctacacttgttccgaa

SEQ ID NO: 105658 - DNA, 25 bp, Mus musculus
gagacagctcaagaagttgtgagac

SEQ ID NO: 105659 - DNA, 25 bp, Mus musculus
gagacaggatgcgacttcctcggag

SEQ ID NO: 105660 - DNA, 25 bp, Mus musculus
gagacagtaccttgctccaggacaa

SEQ ID NO: 105661 - DNA, 25 bp, Mus musculus
gagacagtatcttggccacaggtgc

SEQ ID NO: 105662 - DNA, 25 bp, Mus musculus
gagacagtctatcccagcctgagtg

SEQ ID NO: 105663 - DNA, 25 bp, Mus musculus
gagacagtgtctacccaggaactct

SEQ ID NO: 105664 - DNA, 25 bp, Mus musculus
gagacagttttttatcttggtcaac

SEQ ID NO: 105665 - DNA, 25 bp, Mus musculus
gagacatactcgagggttcttccca

SEQ ID NO: 105666 - DNA, 25 bp, Mus musculus
gagacatcaggcatctaaggatcgc

SEQ ID NO: 105667 - DNA, 25 bp, Mus musculus
gagacatccccgtgaatcccttgtg

SEQ ID NO: 105668 - DNA, 25 bp, Mus musculus
gagacatccctctgatatgctcaga

SEQ ID NO: 105669 - DNA, 25 bp, Mus musculus
gagacatccgcctcctctcagatga

SEQ ID NO: 105670 - DNA, 25 bp, Mus musculus
gagacatcgaattgcagtagccgga

SEQ ID NO: 105671 - DNA, 25 bp, Mus musculus
gagacatgcactatcctccagggac

SEQ ID NO: 105672 - DNA, 25 bp, Mus musculus
gagacatgcctcatagcagccgcta

SEQ ID NO: 105673 - DNA, 25 bp, Mus musculus
gagacatgctggtgacacaggccct

SEQ ID NO: 105674 - DNA, 25 bp, Mus musculus
gagacatggatgtcctgctgaccca

SEQ ID NO: 105675 - DNA, 25 bp, Mus musculus
gagacatggtctcaccctggtcagt

SEQ ID NO: 105676 - DNA, 25 bp, Mus musculus
gagacattcaccagagggcaaacga

SEQ ID NO: 105677 - DNA, 25 bp, Mus musculus
gagacattgtttgactggcctgaca

SEQ ID NO: 105678 - DNA, 25 bp, Mus musculus
gagacatttcgaccttccagtcctt

SEQ ID NO: 105679 - DNA, 25 bp, Mus musculus
gagacattttgaagcctcctgtgga

SEQ ID NO: 105680 - DNA, 25 bp, Mus musculus
gagaccaacagacagatgcctcaag

SEQ ID NO: 105681 - DNA, 25 bp, Mus musculus
gagaccaactacctcttcatgggag

SEQ ID NO: 105682 - DNA, 25 bp, Mus musculus
gagaccaacttagaacagcttaggg

SEQ ID NO: 105683 - DNA, 25 bp, Mus musculus
gagaccaagaagctaatcataaagt

SEQ ID NO: 105684 - DNA, 25 bp, Mus musculus
gagaccaagcatcgcatcagcatgg

SEQ ID NO: 105685 - DNA, 25 bp, Mus musculus
gagaccaaggttgacccgcagatag

SEQ ID NO: 105686 - DNA, 25 bp, Mus musculus
gagaccaatcttgcaacaatccggg

SEQ ID NO: 105687 - DNA, 25 bp, Mus musculus
gagaccaattccaggctggactccg

SEQ ID NO: 105688 - DNA, 25 bp, Mus musculus
gagaccacaagtatgaataccacag

SEQ ID NO: 105689 - DNA, 25 bp, Mus musculus
gagaccacctatctcttaatactag

SEQ ID NO: 105690 - DNA, 25 bp, Mus musculus
gagaccacgttaagaaaccccagag

SEQ ID NO: 105691 - DNA, 25 bp, Mus musculus
gagaccactgaggactgcattgaaa

SEQ ID NO: 105692 - DNA, 25 bp, Mus musculus
gagaccacttttgaggacagggaca

SEQ ID NO: 105693 - DNA, 25 bp, Mus musculus
gagaccaggacgatgcagctagcat

SEQ ID NO: 105694 - DNA, 25 bp, Mus musculus
gagaccaggtcaaagctgcaggaga

SEQ ID NO: 105695 - DNA, 25 bp, Mus musculus
gagaccatcataagggacagcgcta

SEQ ID NO: 105696 - DNA, 25 bp, Mus musculus
gagaccatcgacaagatgcggcgtg

SEQ ID NO: 105697 - DNA, 25 bp, Mus musculus
gagacccagcaactgacaaaaatgg

SEQ ID NO: 105698 - DNA, 25 bp, Mus musculus
gagacccaggaagctccagacttag

SEQ ID NO: 105699 - DNA, 25 bp, Mus musculus
gagacccaggtcagcatcttggaca

SEQ ID NO: 105700 - DNA, 25 bp, Mus musculus
gagacccagttgtgctccgaagaac

SEQ ID NO: 105701 - DNA, 25 bp, Mus musculus
gagacccatggagaagtctgcccag

SEQ ID NO: 105702 - DNA, 25 bp, Mus musculus
gagaccccatcgtggcgcgatcatg

SEQ ID NO: 105703 - DNA, 25 bp, Mus musculus
gagaccccgagatcctaacacatgt

SEQ ID NO: 105704 - DNA, 25 bp, Mus musculus
gagacccgagagcacctctttaagg

SEQ ID NO: 105705 - DNA, 25 bp, Mus musculus
gagacccgcgactgcgagtttggcc

SEQ ID NO: 105706 - DNA, 25 bp, Mus musculus
gagaccctcaaggatttagccatgg

SEQ ID NO: 105707 - DNA, 25 bp, Mus musculus
gagaccctgctccttctgttcatgg

SEQ ID NO: 105708 - DNA, 25 bp, Mus musculus
gagaccctggcacttcgagagttta

SEQ ID NO: 105709 - DNA, 25 bp, Mus musculus
gagaccctgggactactatctgatg

SEQ ID NO: 105710 - DNA, 25 bp, Mus musculus
gagacccttgtcctcttcttgtgaa

SEQ ID NO: 105711 - DNA, 25 bp, Mus musculus
gagacccttgttgtggcagatgcca

SEQ ID NO: 105712 - DNA, 25 bp, Mus musculus
gagaccgagtcacattcaacgggag

SEQ ID NO: 105713 - DNA, 25 bp, Mus musculus
gagaccgcgtggaacgctgccaaag

SEQ ID NO: 105714 - DNA, 25 bp, Mus musculus
gagaccgctccagacacagatgtgg

SEQ ID NO: 105715 - DNA, 25 bp, Mus musculus
gagaccgtcactgctagtacacaag

SEQ ID NO: 105716 - DNA, 25 bp, Mus musculus
gagaccgtctgcgagtgtacctaca

SEQ ID NO: 105717 - DNA, 25 bp, Mus musculus
gagaccgtggctgaggcaatcactg

SEQ ID NO: 105718 - DNA, 25 bp, Mus musculus
gagaccgtgtgcagaagaaaacttt

SEQ ID NO: 105719 - DNA, 25 bp, Mus musculus
gagacctaacttatcatgaacgtga

SEQ ID NO: 105720 - DNA, 25 bp, Mus musculus
gagacctaagaaccactctgagagc

SEQ ID NO: 105721 - DNA, 25 bp, Mus musculus
gagacctaatcagctaagaccagag

SEQ ID NO: 105722 - DNA, 25 bp, Mus musculus
gagacctacagtgtgatagctcaag

SEQ ID NO: 105723 - DNA, 25 bp, Mus musculus
gagacctactagctgatcccacaag

SEQ ID NO: 105724 - DNA, 25 bp, Mus musculus
gagacctagagttcccggcatgcat

SEQ ID NO: 105725 - DNA, 25 bp, Mus musculus
gagacctcatccttctacctatggg

SEQ ID NO: 105726 - DNA, 25 bp, Mus musculus
gagacctccgataccaaaatgaaga

SEQ ID NO: 105727 - DNA, 25 bp, Mus musculus
gagacctcgttgactggtggacgca

SEQ ID NO: 105728 - DNA, 25 bp, Mus musculus
gagacctctggaacaggcattggag

SEQ ID NO: 105729 - DNA, 25 bp, Mus musculus
gagacctctgtccatgtcacagctg

SEQ ID NO: 105730 - DNA, 25 bp, Mus musculus
gagacctgacaattggactctctgc

SEQ ID NO: 105731 - DNA, 25 bp, Mus musculus
gagacctgcaggctgataaccaaag

SEQ ID NO: 105732 - DNA, 25 bp, Mus musculus
gagacctggagttgttcgacttggt

SEQ ID NO: 105733 - DNA, 25 bp, Mus musculus
gagacctggccatgacctacaaaca

SEQ ID NO: 105734 - DNA, 25 bp, Mus musculus
gagacctggcctttgaaattcctga

SEQ ID NO: 105735 - DNA, 25 bp, Mus musculus
gagacctgggaatcggagcaaactt

SEQ ID NO: 105736 - DNA, 25 bp, Mus musculus
gagacctgtgacctagacaacgaca

SEQ ID NO: 105737 - DNA, 25 bp, Mus musculus
gagacctgtgatagcaagttccaca

SEQ ID NO: 105738 - DNA, 25 bp, Mus musculus
gagaccttaacatacctcaatcaag

SEQ ID NO: 105739 - DNA, 25 bp, Mus musculus
gagaccttaccccaagctgtttgga

SEQ ID NO: 105740 - DNA, 25 bp, Mus musculus
gagaccttcatgcagtgggaccagt

SEQ ID NO: 105741 - DNA, 25 bp, Mus musculus
gagaccttctcatgtggaccctgag

SEQ ID NO: 105742 - DNA, 25 bp, Mus musculus
gagaccttgacctggaaagcggcct

SEQ ID NO: 105743 - DNA, 25 bp, Mus musculus
gagaccttgggcatcattggactag

SEQ ID NO: 105744 - DNA, 25 bp, Mus musculus
gagacctttcatctctgcacgagaa

SEQ ID NO: 105745 - DNA, 25 bp, Mus musculus
gagacgagagtcctgtgtcccagct

SEQ ID NO: 105746 - DNA, 25 bp, Mus musculus
gagacgaggcagtttcccaaattca

SEQ ID NO: 105747 - DNA, 25 bp, Mus musculus
gagacgagtggtgggagaaccagcc

SEQ ID NO: 105748 - DNA, 25 bp, Mus musculus
gagacgatatcgaggagctcccaga

SEQ ID NO: 105749 - DNA, 25 bp, Mus musculus
gagacgcaagcttatttcaatggga

SEQ ID NO: 105750 - DNA, 25 bp, Mus musculus
gagacgcatttcctgagctgaagaa

SEQ ID NO: 105751 - DNA, 25 bp, Mus musculus
gagacgccccagcaagcctgttttg

SEQ ID NO: 105752 - DNA, 25 bp, Mus musculus
gagacgccccaggacatctgagtgt

SEQ ID NO: 105753 - DNA, 25 bp, Mus musculus
gagacgcccgtgtttcctggcaacg

SEQ ID NO: 105754 - DNA, 25 bp, Mus musculus
gagacgcgcagcattaccaatacta

SEQ ID NO: 105755 - DNA, 25 bp, Mus musculus
gagacgctccgttcccatgtggata

SEQ ID NO: 105756 - DNA, 25 bp, Mus musculus
gagacgctcctaattgggaacccaa

SEQ ID NO: 105757 - DNA, 25 bp, Mus musculus
gagacgctctacgatgtcctgcatg

SEQ ID NO: 105758 - DNA, 25 bp, Mus musculus
gagacgctgctgaccagaactttga

SEQ ID NO: 105759 - DNA, 25 bp, Mus musculus
gagacgctgttcttggagagcacca

SEQ ID NO: 105760 - DNA, 25 bp, Mus musculus
gagacgcttgggttcgggatatcaa

SEQ ID NO: 105761 - DNA, 25 bp, Mus musculus
gagacgcttttctgcctggatcaac

SEQ ID NO: 105762 - DNA, 25 bp, Mus musculus
gagacggacgttgagagaacgagga

SEQ ID NO: 105763 - DNA, 25 bp, Mus musculus
gagacggagagttcggtggagcccg

SEQ ID NO: 105764 - DNA, 25 bp, Mus musculus
gagacggcaccggtcattacctgtg

SEQ ID NO: 105765 - DNA, 25 bp, Mus musculus
gagacggctcataggattctccatc

SEQ ID NO: 105766 - DNA, 25 bp, Mus musculus
gagacgggcccgagtataaagccac

SEQ ID NO: 105767 - DNA, 25 bp, Mus musculus
gagacgggcgacgattcctatgaac

SEQ ID NO: 105768 - DNA, 25 bp, Mus musculus
gagacggtcatctgttccagccggg

SEQ ID NO: 105769 - DNA, 25 bp, Mus musculus
gagacgtcagctaccacaggacttg

SEQ ID NO: 105770 - DNA, 25 bp, Mus musculus
gagacgtccctcatgctagagtgga

SEQ ID NO: 105771 - DNA, 25 bp, Mus musculus
gagacgtcgtatgaagaagcccttg

SEQ ID NO: 105772 - DNA, 25 bp, Mus musculus
gagacgtctcactctcgaggcagca

SEQ ID NO: 105773 - DNA, 25 bp, Mus musculus
gagacgtgactaacacatttccatg

SEQ ID NO: 105774 - DNA, 25 bp, Mus musculus
gagacgtgacttgagacacctgccc

SEQ ID NO: 105775 - DNA, 25 bp, Mus musculus
gagacgtgcagaagacgctcggact

SEQ ID NO: 105776 - DNA, 25 bp, Mus musculus
gagacgtgcctgcacattggccaga

SEQ ID NO: 105777 - DNA, 25 bp, Mus musculus
gagacgtgtttcagaacggatggca

SEQ ID NO: 105778 - DNA, 25 bp, Mus musculus
gagacgttcctggtgttgcagacgc

SEQ ID NO: 105779 - DNA, 25 bp, Mus musculus
gagacgtttgtccttcccagatagc

SEQ ID NO: 105780 - DNA, 25 bp, Mus musculus
gagactacagaccataaccaacgtg

SEQ ID NO: 105781 - DNA, 25 bp, Mus musculus
gagactaccaaagacctggctctga

SEQ ID NO: 105782 - DNA, 25 bp, Mus musculus
gagactaccgagagtgtccctgagt

SEQ ID NO: 105783 - DNA, 25 bp, Mus musculus
gagactacctggctacacatgtgca

SEQ ID NO: 105784 - DNA, 25 bp, Mus musculus
gagactacggtgtcccttgtcattg

SEQ ID NO: 105785 - DNA, 25 bp, Mus musculus
gagactagagagcaccccagctgct

SEQ ID NO: 105786 - DNA, 25 bp, Mus musculus
gagactagcatcaccaagccttttg

SEQ ID NO: 105787 - DNA, 25 bp, Mus musculus
gagactagctctctgtccagtgtca

SEQ ID NO: 105788 - DNA, 25 bp, Mus musculus
gagactatcctgatatggcaaagga

SEQ ID NO: 105789 - DNA, 25 bp, Mus musculus
gagactatctcatctcctgtagtga

SEQ ID NO: 105790 - DNA, 25 bp, Mus musculus
gagactatgacccagaactgcacgg

SEQ ID NO: 105791 - DNA, 25 bp, Mus musculus
gagactatgcatttggccgctgcca

SEQ ID NO: 105792 - DNA, 25 bp, Mus musculus
gagactatgttgctgcccagaagga

SEQ ID NO: 105793 - DNA, 25 bp, Mus musculus
gagactattggcgtttccaccccag

SEQ ID NO: 105794 - DNA, 25 bp, Mus musculus
gagactatttggagattcagccctg

SEQ ID NO: 105795 - DNA, 25 bp, Mus musculus
gagactcagaaagcacccgacatga

SEQ ID NO: 105796 - DNA, 25 bp, Mus musculus
gagactcagctacagacttctaaag

SEQ ID NO: 105797 - DNA, 25 bp, Mus musculus
gagactcaggccaagattagaaagg

SEQ ID NO: 105798 - DNA, 25 bp, Mus musculus
gagactccagccacaacgagttgta

SEQ ID NO: 105799 - DNA, 25 bp, Mus musculus
gagactccagtcaaccaggcttgta

SEQ ID NO: 105800 - DNA, 25 bp, Mus musculus
gagactccctggaaaacacgctggg

SEQ ID NO: 105801 - DNA, 25 bp, Mus musculus
gagactccggcctctatgcttgtac

SEQ ID NO: 105802 - DNA, 25 bp, Mus musculus
gagactcctctcatgagacacaggg

SEQ ID NO: 105803 - DNA, 25 bp, Mus musculus
gagactccttcagacccagagagag

SEQ ID NO: 105804 - DNA, 25 bp, Mus musculus
gagactccttgagtatctggtcccc

SEQ ID NO: 105805 - DNA, 25 bp, Mus musculus
gagactcctttgatatcatcaagcg

SEQ ID NO: 105806 - DNA, 25 bp, Mus musculus
gagactcgaattcagctgaccaggc

SEQ ID NO: 105807 - DNA, 25 bp, Mus musculus
gagactcgccaagcactaacctgag

SEQ ID NO: 105808 - DNA, 25 bp, Mus musculus
gagactcgggaaacctcaaggtgtc

SEQ ID NO: 105809 - DNA, 25 bp, Mus musculus
gagactcgggtcaaggagagccact

SEQ ID NO: 105810 - DNA, 25 bp, Mus musculus
gagactcggtcaaaatggaactgca

SEQ ID NO: 105811 - DNA, 25 bp, Mus musculus
gagactctagcgtggatgatcctgc

SEQ ID NO: 105812 - DNA, 25 bp, Mus musculus
gagactctctcaactgggctctgtg

SEQ ID NO: 105813 - DNA, 25 bp, Mus musculus
gagactctgagcatcatccctgggt

SEQ ID NO: 105814 - DNA, 25 bp, Mus musculus
gagactctgatcgtcatgccactgg

SEQ ID NO: 105815 - DNA, 25 bp, Mus musculus
gagactctgcctacgtggagccaaa

SEQ ID NO: 105816 - DNA, 25 bp, Mus musculus
gagactctggactctcaggctgtca

SEQ ID NO: 105817 - DNA, 25 bp, Mus musculus
gagactctggagcaccttcaggaga

SEQ ID NO: 105818 - DNA, 25 bp, Mus musculus
gagactctgtccatgggaagccctc

SEQ ID NO: 105819 - DNA, 25 bp, Mus musculus
gagactcttcgaggagcactttggg

SEQ ID NO: 105820 - DNA, 25 bp, Mus musculus
gagactcttctctggctacaacaag

SEQ ID NO: 105821 - DNA, 25 bp, Mus musculus
gagactcttggactcatagggcaga

SEQ ID NO: 105822 - DNA, 25 bp, Mus musculus
gagactcttttagggcaagctttga

SEQ ID NO: 105823 - DNA, 25 bp, Mus musculus
gagactgacatctgcttagcctgaa

SEQ ID NO: 105824 - DNA, 25 bp, Mus musculus
gagactgagctgtactgaagcccac

SEQ ID NO: 105825 - DNA, 25 bp, Mus musculus
gagactgaggtcagcaagagttgcc

SEQ ID NO: 105826 - DNA, 25 bp, Mus musculus
gagactgcaaagactacccgtcagt

SEQ ID NO: 105827 - DNA, 25 bp, Mus musculus
gagactgcacaacacaatagccctg

SEQ ID NO: 105828 - DNA, 25 bp, Mus musculus
gagactgccatgacactaccaagtg

SEQ ID NO: 105829 - DNA, 25 bp, Mus musculus
gagactgccttgttctcaaccaggg

SEQ ID NO: 105830 - DNA, 25 bp, Mus musculus
gagactgcggattcttgggacacct

SEQ ID NO: 105831 - DNA, 25 bp, Mus musculus
gagactgctgactatgccatccgag

SEQ ID NO: 105832 - DNA, 25 bp, Mus musculus
gagactgctgctgcgtgaaggtaac

SEQ ID NO: 105833 - DNA, 25 bp, Mus musculus
gagactgcttagaattaatccggac

SEQ ID NO: 105834 - DNA, 25 bp, Mus musculus
gagactggcacatcgctggacagcc

SEQ ID NO: 105835 - DNA, 25 bp, Mus musculus
gagactggccctgcataaaatgaac

SEQ ID NO: 105836 - DNA, 25 bp, Mus musculus
gagactggcctacagcacattagag

SEQ ID NO: 105837 - DNA, 25 bp, Mus musculus
gagactgggaaccgcgtccccttag

SEQ ID NO: 105838 - DNA, 25 bp, Mus musculus
gagactgggtactgaatattgacgg

SEQ ID NO: 105839 - DNA, 25 bp, Mus musculus
gagactgggtctggtaaaacaacac

SEQ ID NO: 105840 - DNA, 25 bp, Mus musculus
gagactggtcctatgaggtacccaa

SEQ ID NO: 105841 - DNA, 25 bp, Mus musculus
gagactggttgactcctctgaaatc

SEQ ID NO: 105842 - DNA, 25 bp, Mus musculus
gagactgtactgacttttgctgaag

SEQ ID NO: 105843 - DNA, 25 bp, Mus musculus
gagactgtcacctaaatcaccgcaa

SEQ ID NO: 105844 - DNA, 25 bp, Mus musculus
gagactgtcagtccaagaacggcca

SEQ ID NO: 105845 - DNA, 25 bp, Mus musculus
gagactgtcccctgtggctgaggaa

SEQ ID NO: 105846 - DNA, 25 bp, Mus musculus
gagactgtcttgaagctcttggcca

SEQ ID NO: 105847 - DNA, 25 bp, Mus musculus
gagactgtgccatggagtcgcctcc

SEQ ID NO: 105848 - DNA, 25 bp, Mus musculus
gagactgtggctttaagagcgcgca

SEQ ID NO: 105849 - DNA, 25 bp, Mus musculus
gagactgtgtcccagctatggccag

SEQ ID NO: 105850 - DNA, 25 bp, Mus musculus
gagactgttaatgacatggacgcca

SEQ ID NO: 105851 - DNA, 25 bp, Mus musculus
gagactgttgtctttaggagcccaa

SEQ ID NO: 105852 - DNA, 25 bp, Mus musculus
gagactgttgttgaaatagccgacc

SEQ ID NO: 105853 - DNA, 25 bp, Mus musculus
gagacttaactatattcactgggta

SEQ ID NO: 105854 - DNA, 25 bp, Mus musculus
gagacttaactggtcaagccaagac

SEQ ID NO: 105855 - DNA, 25 bp, Mus musculus
gagacttaaggcactctgggcagac

SEQ ID NO: 105856 - DNA, 25 bp, Mus musculus
gagacttataagcagacccggcagg

SEQ ID NO: 105857 - DNA, 25 bp, Mus musculus
gagacttcaaaggacgcaaatggga

SEQ ID NO: 105858 - DNA, 25 bp, Mus musculus
gagacttcaccgactgcagttgcag

SEQ ID NO: 105859 - DNA, 25 bp, Mus musculus
gagacttcagcagccttagccagaa

SEQ ID NO: 105860 - DNA, 25 bp, Mus musculus
gagacttcagccagtaccctggtgt

SEQ ID NO: 105861 - DNA, 25 bp, Mus musculus
gagacttcatttcccgtgacctagg

SEQ ID NO: 105862 - DNA, 25 bp, Mus musculus
gagacttccggattaacgctgttga

SEQ ID NO: 105863 - DNA, 25 bp, Mus musculus
gagacttctctcctcaatggtgaca

SEQ ID NO: 105864 - DNA, 25 bp, Mus musculus
gagacttctgtctgtgagcaaagca

SEQ ID NO: 105865 - DNA, 25 bp, Mus musculus
gagacttcttcacagggtccctgcg

SEQ ID NO: 105866 - DNA, 25 bp, Mus musculus
gagacttctttcttcaccggtgtga

SEQ ID NO: 105867 - DNA, 25 bp, Mus musculus
gagacttgacaagcagcaaccggat

SEQ ID NO: 105868 - DNA, 25 bp, Mus musculus
gagacttgtccgctttgcccgagat

SEQ ID NO: 105869 - DNA, 25 bp, Mus musculus
gagactttatttcttccaggcacag

SEQ ID NO: 105870 - DNA, 25 bp, Mus musculus
gagactttccgactgctgcatgcaa

SEQ ID NO: 105871 - DNA, 25 bp, Mus musculus
gagactttcgactactcccagctgg

SEQ ID NO: 105872 - DNA, 25 bp, Mus musculus
gagactttctctccttagacctggg

SEQ ID NO: 105873 - DNA, 25 bp, Mus musculus
gagactttggcttctcactgcggcg

SEQ ID NO: 105874 - DNA, 25 bp, Mus musculus
gagactttgtcagctgtaacaccct

SEQ ID NO: 105875 - DNA, 25 bp, Mus musculus
gagacttttctcgattaaccgccct

SEQ ID NO: 105876 - DNA, 25 bp, Mus musculus
gagagaaaagctagccacagtcaac

SEQ ID NO: 105877 - DNA, 25 bp, Mus musculus
gagagaaacgctaccaaatgtgaag

SEQ ID NO: 105878 - DNA, 25 bp, Mus musculus
gagagaaacttcataaacttaggca

SEQ ID NO: 105879 - DNA, 25 bp, Mus musculus
gagagaaaggaaatccaggcattgg

SEQ ID NO: 105880 - DNA, 25 bp, Mus musculus
gagagaaaggagacgctcccgctct

SEQ ID NO: 105881 - DNA, 25 bp, Mus musculus
gagagaacacttacagaacttggaa

SEQ ID NO: 105882 - DNA, 25 bp, Mus musculus
gagagaaccactgcctcgtacagat

SEQ ID NO: 105883 - DNA, 25 bp, Mus musculus
gagagaactttaaactgctgtatga

SEQ ID NO: 105884 - DNA, 25 bp, Mus musculus
gagagaagacatcatgacccaggga

SEQ ID NO: 105885 - DNA, 25 bp, Mus musculus
gagagaaggctaaaccgcagctcgt

SEQ ID NO: 105886 - DNA, 25 bp, Mus musculus
gagagaataccacactacactgcca

SEQ ID NO: 105887 - DNA, 25 bp, Mus musculus
gagagaatcccacctagaactgagg

SEQ ID NO: 105888 - DNA, 25 bp, Mus musculus
gagagaatggcacagaacttcagca

SEQ ID NO: 105889 - DNA, 25 bp, Mus musculus
gagagaattatcactttggctggac

SEQ ID NO: 105890 - DNA, 25 bp, Mus musculus
gagagaattctttttcccaacagtg

SEQ ID NO: 105891 - DNA, 25 bp, Mus musculus
gagagaattgtggtccattgcaaca

SEQ ID NO: 105892 - DNA, 25 bp, Mus musculus
gagagacaagcagtaaaagcagtgt

SEQ ID NO: 105893 - DNA, 25 bp, Mus musculus
gagagaccagccagacgaaggtgct

SEQ ID NO: 105894 - DNA, 25 bp, Mus musculus
gagagacccggaagatgatcagcac

SEQ ID NO: 105895 - DNA, 25 bp, Mus musculus
gagagaccctactgggagatgacca

SEQ ID NO: 105896 - DNA, 25 bp, Mus musculus
gagagaccgaaatgccttgaagaca

SEQ ID NO: 105897 - DNA, 25 bp, Mus musculus
gagagacctctgtgacttaccgaga

SEQ ID NO: 105898 - DNA, 25 bp, Mus musculus
gagagactacaaacaggtcactgcg

SEQ ID NO: 105899 - DNA, 25 bp, Mus musculus
gagagactaggcctcatcacctgga

SEQ ID NO: 105900 - DNA, 25 bp, Mus musculus
gagagactgatgactgcctacaaca

SEQ ID NO: 105901 - DNA, 25 bp, Mus musculus
gagagactgcatgtaagctcgctcg

SEQ ID NO: 105902 - DNA, 25 bp, Mus musculus
gagagagaaacccaccacagtaaag

SEQ ID NO: 105903 - DNA, 25 bp, Mus musculus
gagagagacaacttcccaaagggag

SEQ ID NO: 105904 - DNA, 25 bp, Mus musculus
gagagagacaatcaccgacaaaacg

SEQ ID NO: 105905 - DNA, 25 bp, Mus musculus
gagagagacaccttcctatcaaact

SEQ ID NO: 105906 - DNA, 25 bp, Mus musculus
gagagagaccaacttaatgcagacc

SEQ ID NO: 105907 - DNA, 25 bp, Mus musculus
gagagagagtttcatcgtcacctaa

SEQ ID NO: 105908 - DNA, 25 bp, Mus musculus
gagagagatccctattcccaggcca

SEQ ID NO: 105909 - DNA, 25 bp, Mus musculus
gagagagatgattatccagcctggc

SEQ ID NO: 105910 - DNA, 25 bp, Mus musculus
gagagagatgtcacttggccctgga

SEQ ID NO: 105911 - DNA, 25 bp, Mus musculus
gagagagccccagaatatacggaac

SEQ ID NO: 105912 - DNA, 25 bp, Mus musculus
gagagagcctcgtggacttccatcc

SEQ ID NO: 105913 - DNA, 25 bp, Mus musculus
gagagagctcattccagggccttta

SEQ ID NO: 105914 - DNA, 25 bp, Mus musculus
gagagaggcggcatttctcccgtcc

SEQ ID NO: 105915 - DNA, 25 bp, Mus musculus
gagagaggtataacattccagaccc

SEQ ID NO: 105916 - DNA, 25 bp, Mus musculus
gagagaggtgcttgtctagccccaa

SEQ ID NO: 105917 - DNA, 25 bp, Mus musculus
gagagaggttcatcagacacactgc

SEQ ID NO: 105918 - DNA, 25 bp, Mus musculus
gagagagtatatcctgagcctagtc

SEQ ID NO: 105919 - DNA, 25 bp, Mus musculus
gagagagttctcacatctgcgactt

SEQ ID NO: 105920 - DNA, 25 bp, Mus musculus
gagagatacatcaaacccacttgtg

SEQ ID NO: 105921 - DNA, 25 bp, Mus musculus
gagagatccatctttaccatttcag

SEQ ID NO: 105922 - DNA, 25 bp, Mus musculus
gagagatcgcatccctgttgaagct

SEQ ID NO: 105923 - DNA, 25 bp, Mus musculus
gagagatctgcagataaaacctggg

SEQ ID NO: 105924 - DNA, 25 bp, Mus musculus
gagagatctgtgtcattggacccaa

SEQ ID NO: 105925 - DNA, 25 bp, Mus musculus
gagagatcttcgaggcaagtcagag

SEQ ID NO: 105926 - DNA, 25 bp, Mus musculus
gagagatgactcagaaaccaagagc

SEQ ID NO: 105927 - DNA, 25 bp, Mus musculus
gagagatgcatgtccggccgatgct

SEQ ID NO: 105928 - DNA, 25 bp, Mus musculus
gagagatgcccctaaaagtcacagg

SEQ ID NO: 105929 - DNA, 25 bp, Mus musculus
gagagatgttatcacctccaaagtt

SEQ ID NO: 105930 - DNA, 25 bp, Mus musculus
gagagatttacagacgacccctgtt

SEQ ID NO: 105931 - DNA, 25 bp, Mus musculus
gagagcaacaacttccaccatctgg

SEQ ID NO: 105932 - DNA, 25 bp, Mus musculus
gagagcaactgcgtctctgcgcctg

SEQ ID NO: 105933 - DNA, 25 bp, Mus musculus
gagagcaacttctaggagccggtga

SEQ ID NO: 105934 - DNA, 25 bp, Mus musculus
gagagcaagaaagacctactggaga

SEQ ID NO: 105935 - DNA, 25 bp, Mus musculus
gagagcaagattccccaaactccaa

SEQ ID NO: 105936 - DNA, 25 bp, Mus musculus
gagagcaagttcaacccctcagctg

SEQ ID NO: 105937 - DNA, 25 bp, Mus musculus
gagagcaatatttcactaagtgcag

SEQ ID NO: 105938 - DNA, 25 bp, Mus musculus
gagagcaatgctgtgtctctgcagc

SEQ ID NO: 105939 - DNA, 25 bp, Mus musculus
gagagcacaaaagcgttctgggaac

SEQ ID NO: 105940 - DNA, 25 bp, Mus musculus
gagagcacagggtactgggacccct

SEQ ID NO: 105941 - DNA, 25 bp, Mus musculus
gagagcaccacacggatgagtttga

SEQ ID NO: 105942 - DNA, 25 bp, Mus musculus
gagagcaccacttcatgtcagacct

SEQ ID NO: 105943 - DNA, 25 bp, Mus musculus
gagagcacgaacaagtctagagagc

SEQ ID NO: 105944 - DNA, 25 bp, Mus musculus
gagagcactgacttcggcctgaaca

SEQ ID NO: 105945 - DNA, 25 bp, Mus musculus
gagagcactgttactaccacggaag

SEQ ID NO: 105946 - DNA, 25 bp, Mus musculus
gagagcagaacttaccgcctggaga

SEQ ID NO: 105947 - DNA, 25 bp, Mus musculus
gagagcagcaacctcattgggcgct

SEQ ID NO: 105948 - DNA, 25 bp, Mus musculus
gagagcagcagagaaccatgactga

SEQ ID NO: 105949 - DNA, 25 bp, Mus musculus
gagagcagcttttgcagcatcaacg

SEQ ID NO: 105950 - DNA, 25 bp, Mus musculus
gagagcagtcccctgactactcacg

SEQ ID NO: 105951 - DNA, 25 bp, Mus musculus
gagagcagtgttttacgcagagcgc

SEQ ID NO: 105952 - DNA, 25 bp, Mus musculus
gagagcagttcgacttcaacgctga

SEQ ID NO: 105953 - DNA, 25 bp, Mus musculus
gagagcatcctcacagacttacagg

SEQ ID NO: 105954 - DNA, 25 bp, Mus musculus
gagagcatccttaacccagatgggt

SEQ ID NO: 105955 - DNA, 25 bp, Mus musculus
gagagcatcgtcttaccctgccaag

SEQ ID NO: 105956 - DNA, 25 bp, Mus musculus
gagagcatgtaccacgccttgggct

SEQ ID NO: 105957 - DNA, 25 bp, Mus musculus
gagagcattcagagagatgctttgc

SEQ ID NO: 105958 - DNA, 25 bp, Mus musculus
gagagccaaggtatacacaaaccct

SEQ ID NO: 105959 - DNA, 25 bp, Mus musculus
gagagccaagtacttcatttacacc

SEQ ID NO: 105960 - DNA, 25 bp, Mus musculus
gagagccaattggaactccgagagc

SEQ ID NO: 105961 - DNA, 25 bp, Mus musculus
gagagccacggacaactgcgttgat

SEQ ID NO: 105962 - DNA, 25 bp, Mus musculus
gagagccacgtgacgccattgactg

SEQ ID NO: 105963 - DNA, 25 bp, Mus musculus
gagagccagacgtcttttgggtcca

SEQ ID NO: 105964 - DNA, 25 bp, Mus musculus
gagagccagccagaattcctaggag

SEQ ID NO: 105965 - DNA, 25 bp, Mus musculus
gagagccagcttttcctccagagaa

SEQ ID NO: 105966 - DNA, 25 bp, Mus musculus
gagagccagtggacaaacatcctgt

SEQ ID NO: 105967 - DNA, 25 bp, Mus musculus
gagagccatataagtcagtccaaca

SEQ ID NO: 105968 - DNA, 25 bp, Mus musculus
gagagccatggcactcaaggtccta

SEQ ID NO: 105969 - DNA, 25 bp, Mus musculus
gagagcccaggtgtttgcaacagaa

SEQ ID NO: 105970 - DNA, 25 bp, Mus musculus
gagagcccatttcattcctgcgtag

SEQ ID NO: 105971 - DNA, 25 bp, Mus musculus
gagagccctctgaaaggtctcaggt

SEQ ID NO: 105972 - DNA, 25 bp, Mus musculus
gagagccctgcatatagcccaagtc

SEQ ID NO: 105973 - DNA, 25 bp, Mus musculus
gagagccctgccgaaaacatggaaa

SEQ ID NO: 105974 - DNA, 25 bp, Mus musculus
gagagccgcgaaaagcaactagtag

SEQ ID NO: 105975 - DNA, 25 bp, Mus musculus
gagagccgctattggtcagccgtca

SEQ ID NO: 105976 - DNA, 25 bp, Mus musculus
gagagccgggatatggacctcaact

SEQ ID NO: 105977 - DNA, 25 bp, Mus musculus
gagagcctagaagctgtggcccagc

SEQ ID NO: 105978 - DNA, 25 bp, Mus musculus
gagagcctctgatttggaagcccca

SEQ ID NO: 105979 - DNA, 25 bp, Mus musculus
gagagcctgcgattcctgcacgtga

SEQ ID NO: 105980 - DNA, 25 bp, Mus musculus
gagagcctggctgaacctcatgtga

SEQ ID NO: 105981 - DNA, 25 bp, Mus musculus
gagagcctgtccttcgtggagctgc

SEQ ID NO: 105982 - DNA, 25 bp, Mus musculus
gagagcctgttgtacttagttgcca

SEQ ID NO: 105983 - DNA, 25 bp, Mus musculus
gagagcctttacctacagcactgtg

SEQ ID NO: 105984 - DNA, 25 bp, Mus musculus
gagagcgagactccagtagacacca

SEQ ID NO: 105985 - DNA, 25 bp, Mus musculus
gagagcgagagatatggaaccagat

SEQ ID NO: 105986 - DNA, 25 bp, Mus musculus
gagagcgcgaccacggcgtagccat

SEQ ID NO: 105987 - DNA, 25 bp, Mus musculus
gagagcgctcatagaaacttccaga

SEQ ID NO: 105988 - DNA, 25 bp, Mus musculus
gagagcgctcatcttgctgccagca

SEQ ID NO: 105989 - DNA, 25 bp, Mus musculus
gagagcgggccttcttcatcaatgc

SEQ ID NO: 105990 - DNA, 25 bp, Mus musculus
gagagcgtccagtctggacacgaga

SEQ ID NO: 105991 - DNA, 25 bp, Mus musculus
gagagctaccacctagacagcatgg

SEQ ID NO: 105992 - DNA, 25 bp, Mus musculus
gagagctaccatctacctttgggca

SEQ ID NO: 105993 - DNA, 25 bp, Mus musculus
gagagctcagatgaagacccggaca

SEQ ID NO: 105994 - DNA, 25 bp, Mus musculus
gagagctccagcgtgtactccataa

SEQ ID NO: 105995 - DNA, 25 bp, Mus musculus
gagagctccgatctcagagaagaag

SEQ ID NO: 105996 - DNA, 25 bp, Mus musculus
gagagctccgcaggggccagatcct

SEQ ID NO: 105997 - DNA, 25 bp, Mus musculus
gagagctccgttttgcagaacctga

SEQ ID NO: 105998 - DNA, 25 bp, Mus musculus
gagagctcctatgtgtactgcagca

SEQ ID NO: 105999 - DNA, 25 bp, Mus musculus
gagagctcgaggtttgccctggcaa

SEQ ID NO: 106000 - DNA, 25 bp, Mus musculus
gagagctcgtcttccgtcctaggga

SEQ ID NO: 106001 - DNA, 25 bp, Mus musculus
gagagctctccggacaaccaatttg

SEQ ID NO: 106002 - DNA, 25 bp, Mus musculus
gagagctcttctaccttacgtccaa

SEQ ID NO: 106003 - DNA, 25 bp, Mus musculus
gagagctgaccagtaactttgtccc

SEQ ID NO: 106004 - DNA, 25 bp, Mus musculus
gagagctgcctcaatcaaacatggt

SEQ ID NO: 106005 - DNA, 25 bp, Mus musculus
gagagctggtctcctccccgtccct

SEQ ID NO: 106006 - DNA, 25 bp, Mus musculus
gagagctgtccgtttgtgggcacca

SEQ ID NO: 106007 - DNA, 25 bp, Mus musculus
gagagcttacgtcatcacgggcatg

SEQ ID NO: 106008 - DNA, 25 bp, Mus musculus
gagagcttccgcctgggatcagaac

SEQ ID NO: 106009 - DNA, 25 bp, Mus musculus
gagagcttcctgtgtaccagcgggc

SEQ ID NO: 106010 - DNA, 25 bp, Mus musculus
gagagcttgagtttgatccagcgac

SEQ ID NO: 106011 - DNA, 25 bp, Mus musculus
gagagctttcttcgactgtccagtg

SEQ ID NO: 106012 - DNA, 25 bp, Mus musculus
gagagctttgccagcgcctggtacg

SEQ ID NO: 106013 - DNA, 25 bp, Mus musculus
gagaggaaacagtccagagccagag

SEQ ID NO: 106014 - DNA, 25 bp, Mus musculus
gagaggaaactggatcaaaccatca

SEQ ID NO: 106015 - DNA, 25 bp, Mus musculus
gagaggaaatccagaattatcacca

SEQ ID NO: 106016 - DNA, 25 bp, Mus musculus
gagaggaaccggttcgcgagggact

SEQ ID NO: 106017 - DNA, 25 bp, Mus musculus
gagaggaactactcaagcaggcaag

SEQ ID NO: 106018 - DNA, 25 bp, Mus musculus
gagaggaactattgacagacacgag

SEQ ID NO: 106019 - DNA, 25 bp, Mus musculus
gagaggaactctaacactccatggg

SEQ ID NO: 106020 - DNA, 25 bp, Mus musculus
gagaggaagatttaccacactggag

SEQ ID NO: 106021 - DNA, 25 bp, Mus musculus
gagaggaatctatcatcggagcatg

SEQ ID NO: 106022 - DNA, 25 bp, Mus musculus
gagaggaccctatgaacacgtaaag

SEQ ID NO: 106023 - DNA, 25 bp, Mus musculus
gagaggactaaagtctacccctcca

SEQ ID NO: 106024 - DNA, 25 bp, Mus musculus
gagaggactcttgtgactgcatcag

SEQ ID NO: 106025 - DNA, 25 bp, Mus musculus
gagaggagaccacaacagaacactg

SEQ ID NO: 106026 - DNA, 25 bp, Mus musculus
gagaggagacgaagcaagcagatca

SEQ ID NO: 106027 - DNA, 25 bp, Mus musculus
gagaggagactacaacagcgaacga

SEQ ID NO: 106028 - DNA, 25 bp, Mus musculus
gagaggatccaagccgactgctgaa

SEQ ID NO: 106029 - DNA, 25 bp, Mus musculus
gagaggatgaattgtagcccaacct

SEQ ID NO: 106030 - DNA, 25 bp, Mus musculus
gagaggatgctatccctggctcctg

SEQ ID NO: 106031 - DNA, 25 bp, Mus musculus
gagaggatgcttcaaaaactcccaa

SEQ ID NO: 106032 - DNA, 25 bp, Mus musculus
gagaggattatcacaccggtagcag

SEQ ID NO: 106033 - DNA, 25 bp, Mus musculus
gagaggcaggacatggatccacctg

SEQ ID NO: 106034 - DNA, 25 bp, Mus musculus
gagaggcaggacttcatcttcacca

SEQ ID NO: 106035 - DNA, 25 bp, Mus musculus
gagaggcatcggacgccacctcgct

SEQ ID NO: 106036 - DNA, 25 bp, Mus musculus
gagaggccaccaaagattctctgga

SEQ ID NO: 106037 - DNA, 25 bp, Mus musculus
gagaggccagctcgagcagataact

SEQ ID NO: 106038 - DNA, 25 bp, Mus musculus
gagaggccatagacattccaaagag

SEQ ID NO: 106039 - DNA, 25 bp, Mus musculus
gagaggcccagctttggaggcaaaa

SEQ ID NO: 106040 - DNA, 25 bp, Mus musculus
gagaggccgatctacctgacgaaca

SEQ ID NO: 106041 - DNA, 25 bp, Mus musculus
gagaggcctccatttgatcgatcga

SEQ ID NO: 106042 - DNA, 25 bp, Mus musculus
gagaggccttctcacttccggttcc

SEQ ID NO: 106043 - DNA, 25 bp, Mus musculus
gagaggctgcttttctgacttggat

SEQ ID NO: 106044 - DNA, 25 bp, Mus musculus
gagaggctgttctgccagcaaggca

SEQ ID NO: 106045 - DNA, 25 bp, Mus musculus
gagaggcttgtcactgaaacccggg

SEQ ID NO: 106046 - DNA, 25 bp, Mus musculus
gagaggctttcccatgccctttgga

SEQ ID NO: 106047 - DNA, 25 bp, Mus musculus
gagaggcttttcgatgagacccact

SEQ ID NO: 106048 - DNA, 25 bp, Mus musculus
gagagggactacatgcccaggctct

SEQ ID NO: 106049 - DNA, 25 bp, Mus musculus
gagagggacttcctttgagacccag

SEQ ID NO: 106050 - DNA, 25 bp, Mus musculus
gagagggcactcttacagcacgaga

SEQ ID NO: 106051 - DNA, 25 bp, Mus musculus
gagagggccctgaactactttgctg

SEQ ID NO: 106052 - DNA, 25 bp, Mus musculus
gagaggtactaccacatttgtgcca

SEQ ID NO: 106053 - DNA, 25 bp, Mus musculus
gagaggtcacttaagccaggacaga

SEQ ID NO: 106054 - DNA, 25 bp, Mus musculus
gagaggtgcaccagaaactgctggc

SEQ ID NO: 106055 - DNA, 25 bp, Mus musculus
gagaggtggaaacatgcgggactac

SEQ ID NO: 106056 - DNA, 25 bp, Mus musculus
gagaggtggtcagtttcaccccgga

SEQ ID NO: 106057 - DNA, 25 bp, Mus musculus
gagaggttgctacttcccagcaggc

SEQ ID NO: 106058 - DNA, 25 bp, Mus musculus
gagaggtttatgctaccacttcgca

SEQ ID NO: 106059 - DNA, 25 bp, Mus musculus
gagaggttttcacagacgttataat

SEQ ID NO: 106060 - DNA, 25 bp, Mus musculus
gagagtaaaagtgtcaatgatgtcc

SEQ ID NO: 106061 - DNA, 25 bp, Mus musculus
gagagtaactttcgccaggtgctgc

SEQ ID NO: 106062 - DNA, 25 bp, Mus musculus
gagagtaaggaaaacgaagcggtgg

SEQ ID NO: 106063 - DNA, 25 bp, Mus musculus
gagagtaattctcacaaattgtggg

SEQ ID NO: 106064 - DNA, 25 bp, Mus musculus
gagagtactcttgaccccacgaaga

SEQ ID NO: 106065 - DNA, 25 bp, Mus musculus
gagagtagtactgcaaaagggacca

SEQ ID NO: 106066 - DNA, 25 bp, Mus musculus
gagagtatgccaccgacgaagatga

SEQ ID NO: 106067 - DNA, 25 bp, Mus musculus
gagagtcagtagatccagtgggcca

SEQ ID NO: 106068 - DNA, 25 bp, Mus musculus
gagagtcagtggatcagctcagcct

SEQ ID NO: 106069 - DNA, 25 bp, Mus musculus
gagagtcagttgaaagtcacgctag

SEQ ID NO: 106070 - DNA, 25 bp, Mus musculus
gagagtcataatcacgggaaccacg

SEQ ID NO: 106071 - DNA, 25 bp, Mus musculus
gagagtccaaagctcccagataagt

SEQ ID NO: 106072 - DNA, 25 bp, Mus musculus
gagagtccccggaaggatgatgcaa

SEQ ID NO: 106073 - DNA, 25 bp, Mus musculus
gagagtccgggctttatataggcga

SEQ ID NO: 106074 - DNA, 25 bp, Mus musculus
gagagtcctcaagatcatccgggag

SEQ ID NO: 106075 - DNA, 25 bp, Mus musculus
gagagtcctgagtattatccacacg

SEQ ID NO: 106076 - DNA, 25 bp, Mus musculus
gagagtcctgcttgtccgctaacgg

SEQ ID NO: 106077 - DNA, 25 bp, Mus musculus
gagagtcgtgccttccacataggga

SEQ ID NO: 106078 - DNA, 25 bp, Mus musculus
gagagtcgtgttgtatcctagcaac

SEQ ID NO: 106079 - DNA, 25 bp, Mus musculus
gagagtctcatcgagctccataaca

SEQ ID NO: 106080 - DNA, 25 bp, Mus musculus
gagagtctgcagttgaaagcccact

SEQ ID NO: 106081 - DNA, 25 bp, Mus musculus
gagagtcttactgagcaggtggcca

SEQ ID NO: 106082 - DNA, 25 bp, Mus musculus
gagagtgaaactgtagagcaagatg

SEQ ID NO: 106083 - DNA, 25 bp, Mus musculus
gagagtgaacaaactgatctgtgtc

SEQ ID NO: 106084 - DNA, 25 bp, Mus musculus
gagagtgaaccagacgctacggcat

SEQ ID NO: 106085 - DNA, 25 bp, Mus musculus
gagagtgaactttccatccggatag

SEQ ID NO: 106086 - DNA, 25 bp, Mus musculus
gagagtgacatctgccctcaggaca

SEQ ID NO: 106087 - DNA, 25 bp, Mus musculus
gagagtgacgccactcaccagagga

SEQ ID NO: 106088 - DNA, 25 bp, Mus musculus
gagagtgaggcaataagaaccagaa

SEQ ID NO: 106089 - DNA, 25 bp, Mus musculus
gagagtgcctcagctatgaccaata

SEQ ID NO: 106090 - DNA, 25 bp, Mus musculus
gagagtgcctcgcagcttgagccca

SEQ ID NO: 106091 - DNA, 25 bp, Mus musculus
gagagtggagccttatccttggacc

SEQ ID NO: 106092 - DNA, 25 bp, Mus musculus
gagagtgtactcctgaagacctgtg

SEQ ID NO: 106093 - DNA, 25 bp, Mus musculus
gagagtgtagctgtaatagaagcag

SEQ ID NO: 106094 - DNA, 25 bp, Mus musculus
gagagtgtccaccttgtacgtcatt

SEQ ID NO: 106095 - DNA, 25 bp, Mus musculus
gagagtgtgcttgtctccactggaa

SEQ ID NO: 106096 - DNA, 25 bp, Mus musculus
gagagtgtggcttcatccgcctcaa

SEQ ID NO: 106097 - DNA, 25 bp, Mus musculus
gagagtgttaatggctgcttataag

SEQ ID NO: 106098 - DNA, 25 bp, Mus musculus
gagagttacaaagccgcaacgggag

SEQ ID NO: 106099 - DNA, 25 bp, Mus musculus
gagagttacattgcagttctcacca

SEQ ID NO: 106100 - DNA, 25 bp, Mus musculus
gagagttacgcccaaagagcatcaa

SEQ ID NO: 106101 - DNA, 25 bp, Mus musculus
gagagttattcttgcatccaacaga

SEQ ID NO: 106102 - DNA, 25 bp, Mus musculus
gagagttcaacatcgctggcttccc

SEQ ID NO: 106103 - DNA, 25 bp, Mus musculus
gagagttccctccacagaatgtctg

SEQ ID NO: 106104 - DNA, 25 bp, Mus musculus
gagagttccgtacccgcaaaaagct

SEQ ID NO: 106105 - DNA, 25 bp, Mus musculus
gagagttcctgtcaccttgggagca

SEQ ID NO: 106106 - DNA, 25 bp, Mus musculus
gagagttctagccatcctgggcctc

SEQ ID NO: 106107 - DNA, 25 bp, Mus musculus
gagagttcttccaacagtcagagcg

SEQ ID NO: 106108 - DNA, 25 bp, Mus musculus
gagagttgcctcagcctcatcaagt

SEQ ID NO: 106109 - DNA, 25 bp, Mus musculus
gagagttggtctcagaatccccagg

SEQ ID NO: 106110 - DNA, 25 bp, Mus musculus
gagagtttcctagaagcctgtcgga

SEQ ID NO: 106111 - DNA, 25 bp, Mus musculus
gagagtttgatcagggctccgatga

SEQ ID NO: 106112 - DNA, 25 bp, Mus musculus
gagagttttattctttagatcctaa

SEQ ID NO: 106113 - DNA, 25 bp, Mus musculus
gagataaagagtccctcatactaca

SEQ ID NO: 106114 - DNA, 25 bp, Mus musculus
gagataacaaaaaccagctccatgg

SEQ ID NO: 106115 - DNA, 25 bp, Mus musculus
gagataaccatctcgcacctgggca

SEQ ID NO: 106116 - DNA, 25 bp, Mus musculus
gagataacgacaagaagaaccccag

SEQ ID NO: 106117 - DNA, 25 bp, Mus musculus
gagataatcagctcttccagtggga

SEQ ID NO: 106118 - DNA, 25 bp, Mus musculus
gagataatgcttcctatcctctgtc

SEQ ID NO: 106119 - DNA, 25 bp, Mus musculus
gagataatgtcagcagtcagagaag

SEQ ID NO: 106120 - DNA, 25 bp, Mus musculus
gagatacaacgtagctgactgcagc

SEQ ID NO: 106121 - DNA, 25 bp, Mus musculus
gagatacaagagcaagagacacttc

SEQ ID NO: 106122 - DNA, 25 bp, Mus musculus
gagatacagctagaaccacaggcca

SEQ ID NO: 106123 - DNA, 25 bp, Mus musculus
gagatacatgctgcgggaacgacaa

SEQ ID NO: 106124 - DNA, 25 bp, Mus musculus
gagataccagagaggcctagaaagg

SEQ ID NO: 106125 - DNA, 25 bp, Mus musculus
gagatacccagatgccagaagacct

SEQ ID NO: 106126 - DNA, 25 bp, Mus musculus
gagatacctaagtcccgaagggcca

SEQ ID NO: 106127 - DNA, 25 bp, Mus musculus
gagatacctcagtgcacagaagcct

SEQ ID NO: 106128 - DNA, 25 bp, Mus musculus
gagatacctttcagaccccatggag

SEQ ID NO: 106129 - DNA, 25 bp, Mus musculus
gagatacgtacacaccagtcctgga

SEQ ID NO: 106130 - DNA, 25 bp, Mus musculus
gagatactctgtccgttctcagcga

SEQ ID NO: 106131 - DNA, 25 bp, Mus musculus
gagatagacacgctgcagttccggc

SEQ ID NO: 106132 - DNA, 25 bp, Mus musculus
gagatagatggttcgtcgagtgcca

SEQ ID NO: 106133 - DNA, 25 bp, Mus musculus
gagatagcatcgtgaaagcctttgt

SEQ ID NO: 106134 - DNA, 25 bp, Mus musculus
gagatagctactaccagcctacggg

SEQ ID NO: 106135 - DNA, 25 bp, Mus musculus
gagatagtcctactgttccacgcca

SEQ ID NO: 106136 - DNA, 25 bp, Mus musculus
gagatagtcttattctggcccaaac

SEQ ID NO: 106137 - DNA, 25 bp, Mus musculus
gagatagtgaagatccgcctgcagg

SEQ ID NO: 106138 - DNA, 25 bp, Mus musculus
gagatagtgagatttatgttaaaag

SEQ ID NO: 106139 - DNA, 25 bp, Mus musculus
gagatatcagtttagggtcacagct

SEQ ID NO: 106140 - DNA, 25 bp, Mus musculus
gagatatcctgcaaaagttggcgcc

SEQ ID NO: 106141 - DNA, 25 bp, Mus musculus
gagatatctcgacagcgcttcaggc

SEQ ID NO: 106142 - DNA, 25 bp, Mus musculus
gagatatgatacactagcccagatg

SEQ ID NO: 106143 - DNA, 25 bp, Mus musculus
gagatatttctgtcggctgttggca

SEQ ID NO: 106144 - DNA, 25 bp, Mus musculus
gagatcaaccctgtcaaggtgagca

SEQ ID NO: 106145 - DNA, 25 bp, Mus musculus
gagatcaagagaagagccaatatcg

SEQ ID NO: 106146 - DNA, 25 bp, Mus musculus
gagatcacaccaacctcctctagaa

SEQ ID NO: 106147 - DNA, 25 bp, Mus musculus
gagatcacagacctgagacggaccc

SEQ ID NO: 106148 - DNA, 25 bp, Mus musculus
gagatcaccaacctgctgcatggag

SEQ ID NO: 106149 - DNA, 25 bp, Mus musculus
gagatcacggactacagaacccaag

SEQ ID NO: 106150 - DNA, 25 bp, Mus musculus
gagatcagaccgtagtccttgaaga

SEQ ID NO: 106151 - DNA, 25 bp, Mus musculus
gagatcagcagagaaaccttccagg

SEQ ID NO: 106152 - DNA, 25 bp, Mus musculus
gagatcagccacgaggtaatgtcca

SEQ ID NO: 106153 - DNA, 25 bp, Mus musculus
gagatcagcctgatggacctggcca

SEQ ID NO: 106154 - DNA, 25 bp, Mus musculus
gagatcatacagaacttcgtgcggg

SEQ ID NO: 106155 - DNA, 25 bp, Mus musculus
gagatcatcggagactgctgctacg

SEQ ID NO: 106156 - DNA, 25 bp, Mus musculus
gagatcatctttggagaccctggaa

SEQ ID NO: 106157 - DNA, 25 bp, Mus musculus
gagatcatgatagtccaggcaaaag

SEQ ID NO: 106158 - DNA, 25 bp, Mus musculus
gagatcatgatgaagattgaggagt

SEQ ID NO: 106159 - DNA, 25 bp, Mus musculus
gagatcatgatgtgccagccaggga

SEQ ID NO: 106160 - DNA, 25 bp, Mus musculus
gagatcatgtccatgggctacgagc

SEQ ID NO: 106161 - DNA, 25 bp, Mus musculus
gagatccaagtaccaccacagagtc

SEQ ID NO: 106162 - DNA, 25 bp, Mus musculus
gagatccactatgaagacgggaagc

SEQ ID NO: 106163 - DNA, 25 bp, Mus musculus
gagatccagatgagcgagtacgacg

SEQ ID NO: 106164 - DNA, 25 bp, Mus musculus
gagatccagtttgggcacctccaga

SEQ ID NO: 106165 - DNA, 25 bp, Mus musculus
gagatccatcccctagactgactga

SEQ ID NO: 106166 - DNA, 25 bp, Mus musculus
gagatcccaagcaacgtcagacagg

SEQ ID NO: 106167 - DNA, 25 bp, Mus musculus
gagatcccacaggttaacatcatga

SEQ ID NO: 106168 - DNA, 25 bp, Mus musculus
gagatcccatgcatcctggtggcca

SEQ ID NO: 106169 - DNA, 25 bp, Mus musculus
gagatcccggacaaggagttccaga

SEQ ID NO: 106170 - DNA, 25 bp, Mus musculus
gagatccgagcctcactacctggtg

SEQ ID NO: 106171 - DNA, 25 bp, Mus musculus
gagatccgcaatcacacgggcaagt

SEQ ID NO: 106172 - DNA, 25 bp, Mus musculus
gagatccgttctgtccgtgtgggca

SEQ ID NO: 106173 - DNA, 25 bp, Mus musculus
gagatccgttggcatcaaactgcag

SEQ ID NO: 106174 - DNA, 25 bp, Mus musculus
gagatcctctatgaagatgagcccc

SEQ ID NO: 106175 - DNA, 25 bp, Mus musculus
gagatcctgcccagcttcgaagaga

SEQ ID NO: 106176 - DNA, 25 bp, Mus musculus
gagatcctggagtacaacttcaaca

SEQ ID NO: 106177 - DNA, 25 bp, Mus musculus
gagatcgagagtgctttccgggccc

SEQ ID NO: 106178 - DNA, 25 bp, Mus musculus
gagatcgatgaaatgatcaaagagg

SEQ ID NO: 106179 - DNA, 25 bp, Mus musculus
gagatcgccaagatgggcactgcag

SEQ ID NO: 106180 - DNA, 25 bp, Mus musculus
gagatcgctcgaacgcagaagaaca

SEQ ID NO: 106181 - DNA, 25 bp, Mus musculus
gagatcgtggccattaccaggagca

SEQ ID NO: 106182 - DNA, 25 bp, Mus musculus
gagatcgttcaggatgatgacccac

SEQ ID NO: 106183 - DNA, 25 bp, Mus musculus
gagatctacattaaccagctggaag

SEQ ID NO: 106184 - DNA, 25 bp, Mus musculus
gagatctaccagctcaagaccccta

SEQ ID NO: 106185 - DNA, 25 bp, Mus musculus
gagatctagccctgcagaggcacaa

SEQ ID NO: 106186 - DNA, 25 bp, Mus musculus
gagatctcccgcatgcgttcgggaa

SEQ ID NO: 106187 - DNA, 25 bp, Mus musculus
gagatctgcgttccgtgagcaccag

SEQ ID NO: 106188 - DNA, 25 bp, Mus musculus
gagatctggcttcatttcgacgctg

SEQ ID NO: 106189 - DNA, 25 bp, Mus musculus
gagatcttccgcagagcagcaagga

SEQ ID NO: 106190 - DNA, 25 bp, Mus musculus
gagatcttccgcttctataaactga

SEQ ID NO: 106191 - DNA, 25 bp, Mus musculus
gagatcttctgcagagaccagcgag

SEQ ID NO: 106192 - DNA, 25 bp, Mus musculus
gagatcttcttcaagagacgtctga

SEQ ID NO: 106193 - DNA, 25 bp, Mus musculus
gagatcttgggagttctgaacagca

SEQ ID NO: 106194 - DNA, 25 bp, Mus musculus
gagatgaagaagtaggcctgcctgc

SEQ ID NO: 106195 - DNA, 25 bp, Mus musculus
gagatgaatctaagaggctcccttc

SEQ ID NO: 106196 - DNA, 25 bp, Mus musculus
gagatgaattccagttcacctggga

SEQ ID NO: 106197 - DNA, 25 bp, Mus musculus
gagatgaccacagttctgcaggcag

SEQ ID NO: 106198 - DNA, 25 bp, Mus musculus
gagatgaccttgatcagcacaccaa

SEQ ID NO: 106199 - DNA, 25 bp, Mus musculus
gagatgacggctggaatgacaccaa

SEQ ID NO: 106200 - DNA, 25 bp, Mus musculus
gagatgacttgattgtgaccccgtt

SEQ ID NO: 106201 - DNA, 25 bp, Mus musculus
gagatgagctgtgttttactggcca

SEQ ID NO: 106202 - DNA, 25 bp, Mus musculus
gagatgaggatgatacctcctccca

SEQ ID NO: 106203 - DNA, 25 bp, Mus musculus
gagatgaggtttggagctacagccc

SEQ ID NO: 106204 - DNA, 25 bp, Mus musculus
gagatgatatcaagctccagctgga

SEQ ID NO: 106205 - DNA, 25 bp, Mus musculus
gagatgatattaaccggcgctacga

SEQ ID NO: 106206 - DNA, 25 bp, Mus musculus
gagatgatcatctggagcgtcccag

SEQ ID NO: 106207 - DNA, 25 bp, Mus musculus
gagatgatcattccacaagccggca

SEQ ID NO: 106208 - DNA, 25 bp, Mus musculus
gagatgatccgaggcgtcttcttcc

SEQ ID NO: 106209 - DNA, 25 bp, Mus musculus
gagatgatcttggaccctcactgga

SEQ ID NO: 106210 - DNA, 25 bp, Mus musculus
gagatgattatgtgctgctcccagc

SEQ ID NO: 106211 - DNA, 25 bp, Mus musculus
gagatgattcgcacccatttgtagg

SEQ ID NO: 106212 - DNA, 25 bp, Mus musculus
gagatgattctggagtataaaaacc

SEQ ID NO: 106213 - DNA, 25 bp, Mus musculus
gagatgcagctagccatcgctaagg

SEQ ID NO: 106214 - DNA, 25 bp, Mus musculus
gagatgcaggaaaatgacgcctcca

SEQ ID NO: 106215 - DNA, 25 bp, Mus musculus
gagatgcaggccttgacacagacct

SEQ ID NO: 106216 - DNA, 25 bp, Mus musculus
gagatgcagttttcctcgcagaacg

SEQ ID NO: 106217 - DNA, 25 bp, Mus musculus
gagatgccaaggagtgtcaaccctt

SEQ ID NO: 106218 - DNA, 25 bp, Mus musculus
gagatgccactgtcccaagagactt

SEQ ID NO: 106219 - DNA, 25 bp, Mus musculus
gagatgccagcccagtccgtttgct

SEQ ID NO: 106220 - DNA, 25 bp, Mus musculus
gagatgccatcacccaaaaagctgc

SEQ ID NO: 106221 - DNA, 25 bp, Mus musculus
gagatgcctctgtgggtctgccaga

SEQ ID NO: 106222 - DNA, 25 bp, Mus musculus
gagatgcgcagattcactccccagt

SEQ ID NO: 106223 - DNA, 25 bp, Mus musculus
gagatgcgtccctgcccggcgtttg

SEQ ID NO: 106224 - DNA, 25 bp, Mus musculus
gagatgctaaaaaggcacccactgt

SEQ ID NO: 106225 - DNA, 25 bp, Mus musculus
gagatgctaacaagggaggtcccct

SEQ ID NO: 106226 - DNA, 25 bp, Mus musculus
gagatgctaccccagagtcttgcag

SEQ ID NO: 106227 - DNA, 25 bp, Mus musculus
gagatgctaccgaggcaaccttgct

SEQ ID NO: 106228 - DNA, 25 bp, Mus musculus
gagatgctagtctgcctgcacaagg

SEQ ID NO: 106229 - DNA, 25 bp, Mus musculus
gagatgctcaacagaaccaaggatg

SEQ ID NO: 106230 - DNA, 25 bp, Mus musculus
gagatgctcaagatgccttcctgtg

SEQ ID NO: 106231 - DNA, 25 bp, Mus musculus
gagatgctcagaccctacggtgcct

SEQ ID NO: 106232 - DNA, 25 bp, Mus musculus
gagatgctcattgtgggacggttca

SEQ ID NO: 106233 - DNA, 25 bp, Mus musculus
gagatgctccccaaagtagaagaca

SEQ ID NO: 106234 - DNA, 25 bp, Mus musculus
gagatgctcgaagggaaactggcca

SEQ ID NO: 106235 - DNA, 25 bp, Mus musculus
gagatgctcggcctgtacacagaga

SEQ ID NO: 106236 - DNA, 25 bp, Mus musculus
gagatgctgctacagaacctgactg

SEQ ID NO: 106237 - DNA, 25 bp, Mus musculus
gagatgctgtgtgcaggtaccccac

SEQ ID NO: 106238 - DNA, 25 bp, Mus musculus
gagatgcttacaggagaacccgcag

SEQ ID NO: 106239 - DNA, 25 bp, Mus musculus
gagatgcttacgaaaatcccagtgc

SEQ ID NO: 106240 - DNA, 25 bp, Mus musculus
gagatgcttgcgaaaacggtctaca

SEQ ID NO: 106241 - DNA, 25 bp, Mus musculus
gagatgcttttttcaagactttgtc

SEQ ID NO: 106242 - DNA, 25 bp, Mus musculus
gagatggaaagactgtcgccaccca

SEQ ID NO: 106243 - DNA, 25 bp, Mus musculus
gagatggacgacaacggcaactctg

SEQ ID NO: 106244 - DNA, 25 bp, Mus musculus
gagatggatgaacacatgcgaagca

SEQ ID NO: 106245 - DNA, 25 bp, Mus musculus
gagatggcaattcaccctgaccctg

SEQ ID NO: 106246 - DNA, 25 bp, Mus musculus
gagatggcaccattaccaccaagga

SEQ ID NO: 106247 - DNA, 25 bp, Mus musculus
gagatggcagcaatcaagacttggg

SEQ ID NO: 106248 - DNA, 25 bp, Mus musculus
gagatggccaccctttgagcttaag

SEQ ID NO: 106249 - DNA, 25 bp, Mus musculus
gagatggccaggtctccctaggaga

SEQ ID NO: 106250 - DNA, 25 bp, Mus musculus
gagatggcccgagtgctcatggaac

SEQ ID NO: 106251 - DNA, 25 bp, Mus musculus
gagatggccttgattgcccctcaaa

SEQ ID NO: 106252 - DNA, 25 bp, Mus musculus
gagatggcggcccaagactttttcc

SEQ ID NO: 106253 - DNA, 25 bp, Mus musculus
gagatggctgtcaagcgtaacccac

SEQ ID NO: 106254 - DNA, 25 bp, Mus musculus
gagatggctgtgatcggaaactacg

SEQ ID NO: 106255 - DNA, 25 bp, Mus musculus
gagatgggcaattctattcctggac

SEQ ID NO: 106256 - DNA, 25 bp, Mus musculus
gagatgggccagatctataccaggc

SEQ ID NO: 106257 - DNA, 25 bp, Mus musculus
gagatgggtcttccctaccagggac

SEQ ID NO: 106258 - DNA, 25 bp, Mus musculus
gagatggtcccagtcatcagcagtg

SEQ ID NO: 106259 - DNA, 25 bp, Mus musculus
gagatggtgcagacagatatcagcc

SEQ ID NO: 106260 - DNA, 25 bp, Mus musculus
gagatggtgtactgcctggaacaag

SEQ ID NO: 106261 - DNA, 25 bp, Mus musculus
gagatggttgcgtagagcagcccac

SEQ ID NO: 106262 - DNA, 25 bp, Mus musculus
gagatgtacaacaaccaggaggccg

SEQ ID NO: 106263 - DNA, 25 bp, Mus musculus
gagatgtacatttgcaccccaggga

SEQ ID NO: 106264 - DNA, 25 bp, Mus musculus
gagatgtataacgatgccaggaggc

SEQ ID NO: 106265 - DNA, 25 bp, Mus musculus
gagatgtattcagtggaagaagctg

SEQ ID NO: 106266 - DNA, 25 bp, Mus musculus
gagatgtccaaactaaccagcaact

SEQ ID NO: 106267 - DNA, 25 bp, Mus musculus
gagatgtccagttgcggcgcttgta

SEQ ID NO: 106268 - DNA, 25 bp, Mus musculus
gagatgtccataggccaaactgctg

SEQ ID NO: 106269 - DNA, 25 bp, Mus musculus
gagatgtcgccatgctccaatgtag

SEQ ID NO: 106270 - DNA, 25 bp, Mus musculus
gagatgtctgtcaccctgatgcggg

SEQ ID NO: 106271 - DNA, 25 bp, Mus musculus
gagatgtcttcttttgcttgctgga

SEQ ID NO: 106272 - DNA, 25 bp, Mus musculus
gagatgtgacgatagaccgcaggca

SEQ ID NO: 106273 - DNA, 25 bp, Mus musculus
gagatgtgcgcaagattcggctgac

SEQ ID NO: 106274 - DNA, 25 bp, Mus musculus
gagatgtgctagagagaagccgcct

SEQ ID NO: 106275 - DNA, 25 bp, Mus musculus
gagatgtgtccctaccttccttaca

SEQ ID NO: 106276 - DNA, 25 bp, Mus musculus
gagatgttctgaaggtgtttccaat

SEQ ID NO: 106277 - DNA, 25 bp, Mus musculus
gagatgttgcattcttgctccgaca

SEQ ID NO: 106278 - DNA, 25 bp, Mus musculus
gagattacactctgctccaagacca

SEQ ID NO: 106279 - DNA, 25 bp, Mus musculus
gagattacctgggagcgcatcgact

SEQ ID NO: 106280 - DNA, 25 bp, Mus musculus
gagattaggcgcttcacactcacga

SEQ ID NO: 106281 - DNA, 25 bp, Mus musculus
gagattatgctaacgccagtgaccg

SEQ ID NO: 106282 - DNA, 25 bp, Mus musculus
gagattatggctcccatgtacccaa

SEQ ID NO: 106283 - DNA, 25 bp, Mus musculus
gagattattccctggcaaatgcaag

SEQ ID NO: 106284 - DNA, 25 bp, Mus musculus
gagattcacctgctcttcgaccagc

SEQ ID NO: 106285 - DNA, 25 bp, Mus musculus
gagattcagtcaagagcattgccaa

SEQ ID NO: 106286 - DNA, 25 bp, Mus musculus
gagattccatcgttagtgctgaggc

SEQ ID NO: 106287 - DNA, 25 bp, Mus musculus
gagattccgtccagacttcaagcgc

SEQ ID NO: 106288 - DNA, 25 bp, Mus musculus
gagattcctaccgagccaatgcaga

SEQ ID NO: 106289 - DNA, 25 bp, Mus musculus
gagattcctctcctgaagcagttct

SEQ ID NO: 106290 - DNA, 25 bp, Mus musculus
gagattcgggtcaaggcttaaggcc

SEQ ID NO: 106291 - DNA, 25 bp, Mus musculus
gagattcgtttgctgctcctgagaa

SEQ ID NO: 106292 - DNA, 25 bp, Mus musculus
gagattctccatgctcaaacactga

SEQ ID NO: 106293 - DNA, 25 bp, Mus musculus
gagattctgaaagctgcaggctgtg

SEQ ID NO: 106294 - DNA, 25 bp, Mus musculus
gagattctgacagatcctcggagca

SEQ ID NO: 106295 - DNA, 25 bp, Mus musculus
gagattctgacccagtgttgtgcag

SEQ ID NO: 106296 - DNA, 25 bp, Mus musculus
gagattctgctacagtcgctcaggg

SEQ ID NO: 106297 - DNA, 25 bp, Mus musculus
gagattgaagctagccactcggaga

SEQ ID NO: 106298 - DNA, 25 bp, Mus musculus
gagattgaccaccagcgcatgtcgg

SEQ ID NO: 106299 - DNA, 25 bp, Mus musculus
gagattgacctggtcaaccgcgacc

SEQ ID NO: 106300 - DNA, 25 bp, Mus musculus
gagattgactacacgttccaccagg

SEQ ID NO: 106301 - DNA, 25 bp, Mus musculus
gagattgagcagttcagcatagaga

SEQ ID NO: 106302 - DNA, 25 bp, Mus musculus
gagattgagccacctcctcgttgca

SEQ ID NO: 106303 - DNA, 25 bp, Mus musculus
gagattgagttaccagctgcaccga

SEQ ID NO: 106304 - DNA, 25 bp, Mus musculus
gagattgagttggtcatccaccggc

SEQ ID NO: 106305 - DNA, 25 bp, Mus musculus
gagattgcaaatcaaaccggagcac

SEQ ID NO: 106306 - DNA, 25 bp, Mus musculus
gagattgcacctttcaccctgggag

SEQ ID NO: 106307 - DNA, 25 bp, Mus musculus
gagattgccaacatgctccagtggg

SEQ ID NO: 106308 - DNA, 25 bp, Mus musculus
gagattgccattgacaacacagcct

SEQ ID NO: 106309 - DNA, 25 bp, Mus musculus
gagattgcccacattgccctggaga

SEQ ID NO: 106310 - DNA, 25 bp, Mus musculus
gagattgcccaccagtgcctatagg

SEQ ID NO: 106311 - DNA, 25 bp, Mus musculus
gagattgccgtgtaccctgcctttg

SEQ ID NO: 106312 - DNA, 25 bp, Mus musculus
gagattgccttcaaagacctggatg

SEQ ID NO: 106313 - DNA, 25 bp, Mus musculus
gagattgtagacttcctgactggag

SEQ ID NO: 106314 - DNA, 25 bp, Mus musculus
gagattgtcacccagctgcaggagt

SEQ ID NO: 106315 - DNA, 25 bp, Mus musculus
gagattgtccggctcaaacctgtgc

SEQ ID NO: 106316 - DNA, 25 bp, Mus musculus
gagattgtgaacgtgctgagcctga

SEQ ID NO: 106317 - DNA, 25 bp, Mus musculus
gagatttcacagcattcaaaggtca

SEQ ID NO: 106318 - DNA, 25 bp, Mus musculus
gagatttcagaagcacctgcaggtg

SEQ ID NO: 106319 - DNA, 25 bp, Mus musculus
gagatttccaacaagcactctatga

SEQ ID NO: 106320 - DNA, 25 bp, Mus musculus
gagatttcccaagaagctgatgaca

SEQ ID NO: 106321 - DNA, 25 bp, Mus musculus
gagatttccttcaagctgggagagg

SEQ ID NO: 106322 - DNA, 25 bp, Mus musculus
gagatttctaatagctctggtcgct

SEQ ID NO: 106323 - DNA, 25 bp, Mus musculus
gagatttctccgaacagggtgcaga

SEQ ID NO: 106324 - DNA, 25 bp, Mus musculus
gagatttctggtgctgaaccccgca

SEQ ID NO: 106325 - DNA, 25 bp, Mus musculus
gagatttgcagttgaggcccaggct

SEQ ID NO: 106326 - DNA, 25 bp, Mus musculus
gagatttgctcatgtttttccgaag

SEQ ID NO: 106327 - DNA, 25 bp, Mus musculus
gagatttgctttcagggcctccctg

SEQ ID NO: 106328 - DNA, 25 bp, Mus musculus
gagattttcatcaagcaggacggag

SEQ ID NO: 106329 - DNA, 25 bp, Mus musculus
gagattttcttggacatgtttgaag

SEQ ID NO: 106330 - DNA, 25 bp, Mus musculus
gagattttgctccttcgtcaagcag

SEQ ID NO: 106331 - DNA, 25 bp, Mus musculus
gagattttgggaattgacgagcacc

SEQ ID NO: 106332 - DNA, 25 bp, Mus musculus
gagcaaaaaagagaagccctggccc

SEQ ID NO: 106333 - DNA, 25 bp, Mus musculus
gagcaaaagctcacctcggctaata

SEQ ID NO: 106334 - DNA, 25 bp, Mus musculus
gagcaaaatcaaagtccctgcagtg

SEQ ID NO: 106335 - DNA, 25 bp, Mus musculus
gagcaaactggactgcaatgccaag

SEQ ID NO: 106336 - DNA, 25 bp, Mus musculus
gagcaaagaacttcggcccttaggg

SEQ ID NO: 106337 - DNA, 25 bp, Mus musculus
gagcaaagatgcctccaggcagcag

SEQ ID NO: 106338 - DNA, 25 bp, Mus musculus
gagcaaagcaaccacgcttcagaag

SEQ ID NO: 106339 - DNA, 25 bp, Mus musculus
gagcaaagccaaagctgtgaaagag

SEQ ID NO: 106340 - DNA, 25 bp, Mus musculus
gagcaaaggctttagagaaatcacc

SEQ ID NO: 106341 - DNA, 25 bp, Mus musculus
gagcaaagtgccgaggtcatcgagc

SEQ ID NO: 106342 - DNA, 25 bp, Mus musculus
gagcaaatagcttctttctcccttg

SEQ ID NO: 106343 - DNA, 25 bp, Mus musculus
gagcaaatatgtctgcccggaggca

SEQ ID NO: 106344 - DNA, 25 bp, Mus musculus
gagcaaatgcctatgtcaccgagga

SEQ ID NO: 106345 - DNA, 25 bp, Mus musculus
gagcaaattggctgcggccaagaaa

SEQ ID NO: 106346 - DNA, 25 bp, Mus musculus
gagcaacacaatctatcaggaggaa

SEQ ID NO: 106347 - DNA, 25 bp, Mus musculus
gagcaacactggtttttgccatgga

SEQ ID NO: 106348 - DNA, 25 bp, Mus musculus
gagcaacccgaagctgtagacactg

SEQ ID NO: 106349 - DNA, 25 bp, Mus musculus
gagcaaccctgcattaactatggag

SEQ ID NO: 106350 - DNA, 25 bp, Mus musculus
gagcaactccctggaatgatgaggc

SEQ ID NO: 106351 - DNA, 25 bp, Mus musculus
gagcaactgctggatggtcccgaag

SEQ ID NO: 106352 - DNA, 25 bp, Mus musculus
gagcaacttgacatatgacagccct

SEQ ID NO: 106353 - DNA, 25 bp, Mus musculus
gagcaagaaataagctactgcaccc

SEQ ID NO: 106354 - DNA, 25 bp, Mus musculus
gagcaagaactcacatccgcctcag

SEQ ID NO: 106355 - DNA, 25 bp, Mus musculus
gagcaagaaggagagttggcaccca

SEQ ID NO: 106356 - DNA, 25 bp, Mus musculus
gagcaagaatcaagcacagcgaggg

SEQ ID NO: 106357 - DNA, 25 bp, Mus musculus
gagcaagaccttcccttctgcaaag

SEQ ID NO: 106358 - DNA, 25 bp, Mus musculus
gagcaagagacacttcttcaaggct

SEQ ID NO: 106359 - DNA, 25 bp, Mus musculus
gagcaagatagacaagaaagtaatc

SEQ ID NO: 106360 - DNA, 25 bp, Mus musculus
gagcaagatatacagcagggccttc

SEQ ID NO: 106361 - DNA, 25 bp, Mus musculus
gagcaagatctgtatgtccgcctca

SEQ ID NO: 106362 - DNA, 25 bp, Mus musculus
gagcaagcaccccaagtttgaggag

SEQ ID NO: 106363 - DNA, 25 bp, Mus musculus
gagcaagcagttcttacagtccaaa

SEQ ID NO: 106364 - DNA, 25 bp, Mus musculus
gagcaagccacgcagtccttgagag

SEQ ID NO: 106365 - DNA, 25 bp, Mus musculus
gagcaagccctatgtctcgtggccg

SEQ ID NO: 106366 - DNA, 25 bp, Mus musculus
gagcaagcgtttacagagcacctca

SEQ ID NO: 106367 - DNA, 25 bp, Mus musculus
gagcaagctgcagtcatctccaagt

SEQ ID NO: 106368 - DNA, 25 bp, Mus musculus
gagcaaggcgattgagaaaaacctc

SEQ ID NO: 106369 - DNA, 25 bp, Mus musculus
gagcaagtagagaccaagccctgca

SEQ ID NO: 106370 - DNA, 25 bp, Mus musculus
gagcaagtagctactccacaggagg

SEQ ID NO: 106371 - DNA, 25 bp, Mus musculus
gagcaagtcagagatcgtcagccga

SEQ ID NO: 106372 - DNA, 25 bp, Mus musculus
gagcaagtcagtgaatatctgggtg

SEQ ID NO: 106373 - DNA, 25 bp, Mus musculus
gagcaagtcgccaaacaacaacagt

SEQ ID NO: 106374 - DNA, 25 bp, Mus musculus
gagcaagtggtatgagcagcctctt

SEQ ID NO: 106375 - DNA, 25 bp, Mus musculus
gagcaagttctcctaaaggcccagg

SEQ ID NO: 106376 - DNA, 25 bp, Mus musculus
gagcaataatcgcaccaggagtcct

SEQ ID NO: 106377 - DNA, 25 bp, Mus musculus
gagcaatctctgatcctgtctacta

SEQ ID NO: 106378 - DNA, 25 bp, Mus musculus
gagcaatggagcatcatcccacaag

SEQ ID NO: 106379 - DNA, 25 bp, Mus musculus
gagcaatggctagcagtttcgagtg

SEQ ID NO: 106380 - DNA, 25 bp, Mus musculus
gagcaatggcttcctatgggtcaca

SEQ ID NO: 106381 - DNA, 25 bp, Mus musculus
gagcaattgctatgtctctgggaca

SEQ ID NO: 106382 - DNA, 25 bp, Mus musculus
gagcaatttattgtcaaggcgggaa

SEQ ID NO: 106383 - DNA, 25 bp, Mus musculus
gagcacaaaatggactcaggttgga

SEQ ID NO: 106384 - DNA, 25 bp, Mus musculus
gagcacaaccacagataaccacaat

SEQ ID NO: 106385 - DNA, 25 bp, Mus musculus
gagcacaagccacaaccaggaattt

SEQ ID NO: 106386 - DNA, 25 bp, Mus musculus
gagcacaagcggcatctggaattca

SEQ ID NO: 106387 - DNA, 25 bp, Mus musculus
gagcacactgtgaaacctggatctg

SEQ ID NO: 106388 - DNA, 25 bp, Mus musculus
gagcacagagctcttcaagctcaag

SEQ ID NO: 106389 - DNA, 25 bp, Mus musculus
gagcacagtgcgcttcgcccgcaaa

SEQ ID NO: 106390 - DNA, 25 bp, Mus musculus
gagcacagtttgactatgatcccca

SEQ ID NO: 106391 - DNA, 25 bp, Mus musculus
gagcacatacgggatcttaacatag

SEQ ID NO: 106392 - DNA, 25 bp, Mus musculus
gagcacatcgtctggctaagcctgt

SEQ ID NO: 106393 - DNA, 25 bp, Mus musculus
gagcacatgtttgtcatcaggagca

SEQ ID NO: 106394 - DNA, 25 bp, Mus musculus
gagcaccaaccatgaaagatccaag

SEQ ID NO: 106395 - DNA, 25 bp, Mus musculus
gagcaccaagttggcgggagcctat

SEQ ID NO: 106396 - DNA, 25 bp, Mus musculus
gagcaccacggacactttctttaag

SEQ ID NO: 106397 - DNA, 25 bp, Mus musculus
gagcacccagatcgagcctgtgtga

SEQ ID NO: 106398 - DNA, 25 bp, Mus musculus
gagcaccccgaattcctgaaggcag

SEQ ID NO: 106399 - DNA, 25 bp, Mus musculus
gagcaccgccccattacttgattag

SEQ ID NO: 106400 - DNA, 25 bp, Mus musculus
gagcaccgtcgcaggaatcagctga

SEQ ID NO: 106401 - DNA, 25 bp, Mus musculus
gagcaccgttgcctggttcctgaca

SEQ ID NO: 106402 - DNA, 25 bp, Mus musculus
gagcacctacaaggagacctatcgg

SEQ ID NO: 106403 - DNA, 25 bp, Mus musculus
gagcaccttctgacttccgctaggg

SEQ ID NO: 106404 - DNA, 25 bp, Mus musculus
gagcacgaccgggacactttacttg

SEQ ID NO: 106405 - DNA, 25 bp, Mus musculus
gagcacgcaaccaggactcgtggcc

SEQ ID NO: 106406 - DNA, 25 bp, Mus musculus
gagcacgtacgtttagcccatttat

SEQ ID NO: 106407 - DNA, 25 bp, Mus musculus
gagcactagccccatgcagaatatg

SEQ ID NO: 106408 - DNA, 25 bp, Mus musculus
gagcactctaggagacccagttgga

SEQ ID NO: 106409 - DNA, 25 bp, Mus musculus
gagcactgcatccaaacacgggctt

SEQ ID NO: 106410 - DNA, 25 bp, Mus musculus
gagcactgtacccttttgaagcaag

SEQ ID NO: 106411 - DNA, 25 bp, Mus musculus
gagcacttaggctcctgtcccggga

SEQ ID NO: 106412 - DNA, 25 bp, Mus musculus
gagcacttcacaggccaggacttaa

SEQ ID NO: 106413 - DNA, 25 bp, Mus musculus
gagcacttcctccagttggcagaca

SEQ ID NO: 106414 - DNA, 25 bp, Mus musculus
gagcacttttgtcaaccgcatgaag

SEQ ID NO: 106415 - DNA, 25 bp, Mus musculus
gagcagaagagaagcggcgatccat

SEQ ID NO: 106416 - DNA, 25 bp, Mus musculus
gagcagaagatgacgttgagttccc

SEQ ID NO: 106417 - DNA, 25 bp, Mus musculus
gagcagaaggatgcatcatcggatt

SEQ ID NO: 106418 - DNA, 25 bp, Mus musculus
gagcagaagtatcagaccagcgcca

SEQ ID NO: 106419 - DNA, 25 bp, Mus musculus
gagcagaagttgttcatctcccctg

SEQ ID NO: 106420 - DNA, 25 bp, Mus musculus
gagcagaataaggaaagggcccctc

SEQ ID NO: 106421 - DNA, 25 bp, Mus musculus
gagcagaccatgtgcagagccttct

SEQ ID NO: 106422 - DNA, 25 bp, Mus musculus
gagcagaccggctttcttgagagaa

SEQ ID NO: 106423 - DNA, 25 bp, Mus musculus
gagcagacctcagcggcagctttgt

SEQ ID NO: 106424 - DNA, 25 bp, Mus musculus
gagcagactggcattcagcgtttag

SEQ ID NO: 106425 - DNA, 25 bp, Mus musculus
gagcagagaaaagagctctttagaa

SEQ ID NO: 106426 - DNA, 25 bp, Mus musculus
gagcagagacaacgacactacctgg

SEQ ID NO: 106427 - DNA, 25 bp, Mus musculus
gagcagagtctcattccaagctggg

SEQ ID NO: 106428 - DNA, 25 bp, Mus musculus
gagcagatcatttgggacgacccga

SEQ ID NO: 106429 - DNA, 25 bp, Mus musculus
gagcagatccaaactcggcagcttg

SEQ ID NO: 106430 - DNA, 25 bp, Mus musculus
gagcagatccttagcctgacagcga

SEQ ID NO: 106431 - DNA, 25 bp, Mus musculus
gagcagatgctgagaacggccctgt

SEQ ID NO: 106432 - DNA, 25 bp, Mus musculus
gagcagatggatggcactgtcaccc

SEQ ID NO: 106433 - DNA, 25 bp, Mus musculus
gagcagatggctacaactataaccg

SEQ ID NO: 106434 - DNA, 25 bp, Mus musculus
gagcagcaatgcaacagacctcacc

SEQ ID NO: 106435 - DNA, 25 bp, Mus musculus
gagcagcacactagtaaccctacta

SEQ ID NO: 106436 - DNA, 25 bp, Mus musculus
gagcagcacggttgtaactgctcca

SEQ ID NO: 106437 - DNA, 25 bp, Mus musculus
gagcagcagaaggaatcggagtcac

SEQ ID NO: 106438 - DNA, 25 bp, Mus musculus
gagcagcagcagtaaatcctttcac

SEQ ID NO: 106439 - DNA, 25 bp, Mus musculus
gagcagcagcctgatgcattctgaa

SEQ ID NO: 106440 - DNA, 25 bp, Mus musculus
gagcagcagtaaacctgaccctggt

SEQ ID NO: 106441 - DNA, 25 bp, Mus musculus
gagcagcagtgcagtgccaccacca

SEQ ID NO: 106442 - DNA, 25 bp, Mus musculus
gagcagcatcatcattgtcaaccgg

SEQ ID NO: 106443 - DNA, 25 bp, Mus musculus
gagcagccaagtccaaacagtgaag

SEQ ID NO: 106444 - DNA, 25 bp, Mus musculus
gagcagcccaccagtattggccgta

SEQ ID NO: 106445 - DNA, 25 bp, Mus musculus
gagcagcccactctctaatcaggat

SEQ ID NO: 106446 - DNA, 25 bp, Mus musculus
gagcagccgcaggaactacattgta

SEQ ID NO: 106447 - DNA, 25 bp, Mus musculus
gagcagcgcaacaacagaagaggat

SEQ ID NO: 106448 - DNA, 25 bp, Mus musculus
gagcagcgcctagaacacatcatga

SEQ ID NO: 106449 - DNA, 25 bp, Mus musculus
gagcagcgttcaggtgtctcagacc

SEQ ID NO: 106450 - DNA, 25 bp, Mus musculus
gagcagctcctcaaacagatggtgt

SEQ ID NO: 106451 - DNA, 25 bp, Mus musculus
gagcagctcttcgaccgcatgtgta

SEQ ID NO: 106452 - DNA, 25 bp, Mus musculus
gagcagctgaacactctcctgaagg

SEQ ID NO: 106453 - DNA, 25 bp, Mus musculus
gagcagctgacaccccttgtcaggt

SEQ ID NO: 106454 - DNA, 25 bp, Mus musculus
gagcagctgcagagtctcaccctct

SEQ ID NO: 106455 - DNA, 25 bp, Mus musculus
gagcagctggaggttctgcaccctg

SEQ ID NO: 106456 - DNA, 25 bp, Mus musculus
gagcagctggatgattggaaccgca

SEQ ID NO: 106457 - DNA, 25 bp, Mus musculus
gagcagctggcacatcctgcgtcct

SEQ ID NO: 106458 - DNA, 25 bp, Mus musculus
gagcagcttacaccatcacagcaag

SEQ ID NO: 106459 - DNA, 25 bp, Mus musculus
gagcagcttcggaggcaatacacag

SEQ ID NO: 106460 - DNA, 25 bp, Mus musculus
gagcagctttgccaccggcttatgg

SEQ ID NO: 106461 - DNA, 25 bp, Mus musculus
gagcagctttgtaaggatgtcccct

SEQ ID NO: 106462 - DNA, 25 bp, Mus musculus
gagcaggacacgtctggctcttgct

SEQ ID NO: 106463 - DNA, 25 bp, Mus musculus
gagcaggagctcatagcccagttca

SEQ ID NO: 106464 - DNA, 25 bp, Mus musculus
gagcaggagtctaaggctgaactgc

SEQ ID NO: 106465 - DNA, 25 bp, Mus musculus
gagcaggagtttcgccaatgtcact

SEQ ID NO: 106466 - DNA, 25 bp, Mus musculus
gagcaggatacaaagcagccatagt

SEQ ID NO: 106467 - DNA, 25 bp, Mus musculus
gagcaggcacgatggattccttcaa

SEQ ID NO: 106468 - DNA, 25 bp, Mus musculus
gagcaggccggtttcacgatgtcta

SEQ ID NO: 106469 - DNA, 25 bp, Mus musculus
gagcaggcgtccatctggctgttgc

SEQ ID NO: 106470 - DNA, 25 bp, Mus musculus
gagcaggctgctgtcttttccttgg

SEQ ID NO: 106471 - DNA, 25 bp, Mus musculus
gagcagggaccctaatgtgattaca

SEQ ID NO: 106472 - DNA, 25 bp, Mus musculus
gagcagggcatttcttcagctaatg

SEQ ID NO: 106473 - DNA, 25 bp, Mus musculus
gagcagggctactacacagaggatt

SEQ ID NO: 106474 - DNA, 25 bp, Mus musculus
gagcagggctccacacggatgtttt

SEQ ID NO: 106475 - DNA, 25 bp, Mus musculus
gagcagggctccatcatcatcgaat

SEQ ID NO: 106476 - DNA, 25 bp, Mus musculus
gagcaggtgcctcactatcgacaag

SEQ ID NO: 106477 - DNA, 25 bp, Mus musculus
gagcagtactcccaaaagtgcctgg

SEQ ID NO: 106478 - DNA, 25 bp, Mus musculus
gagcagtatcgagccatggtgacca

SEQ ID NO: 106479 - DNA, 25 bp, Mus musculus
gagcagtatctatggtcgcccggga

SEQ ID NO: 106480 - DNA, 25 bp, Mus musculus
gagcagtccagataccaaagcaaga

SEQ ID NO: 106481 - DNA, 25 bp, Mus musculus
gagcagtcccaaagccatggtgcag

SEQ ID NO: 106482 - DNA, 25 bp, Mus musculus
gagcagtccggacttcccagaggat

SEQ ID NO: 106483 - DNA, 25 bp, Mus musculus
gagcagtctggacctttcatctgga

SEQ ID NO: 106484 - DNA, 25 bp, Mus musculus
gagcagtgagtgcatccactggaca

SEQ ID NO: 106485 - DNA, 25 bp, Mus musculus
gagcagtgcggttcttatcctgagc

SEQ ID NO: 106486 - DNA, 25 bp, Mus musculus
gagcagtgctttgccgtattccagc

SEQ ID NO: 106487 - DNA, 25 bp, Mus musculus
gagcagtggcaaagcgagaataccc

SEQ ID NO: 106488 - DNA, 25 bp, Mus musculus
gagcagtggcggtcttgtcaagcat

SEQ ID NO: 106489 - DNA, 25 bp, Mus musculus
gagcagttcaccatcttccaattct

SEQ ID NO: 106490 - DNA, 25 bp, Mus musculus
gagcagttcatcctctcccaggtgg

SEQ ID NO: 106491 - DNA, 25 bp, Mus musculus
gagcagttcgtgaacagtgtccgac

SEQ ID NO: 106492 - DNA, 25 bp, Mus musculus
gagcagttgttctttgaccgaggac

SEQ ID NO: 106493 - DNA, 25 bp, Mus musculus
gagcagtttccccttatgccagcag

SEQ ID NO: 106494 - DNA, 25 bp, Mus musculus
gagcataagacccaagtgtccctga

SEQ ID NO: 106495 - DNA, 25 bp, Mus musculus
gagcatacacttgcccgagacttgg

SEQ ID NO: 106496 - DNA, 25 bp, Mus musculus
gagcatacatcttcagcgactgtca

SEQ ID NO: 106497 - DNA, 25 bp, Mus musculus
gagcatagaaagcactcccctggct

SEQ ID NO: 106498 - DNA, 25 bp, Mus musculus
gagcatagtctgtcagctgtaccag

SEQ ID NO: 106499 - DNA, 25 bp, Mus musculus
gagcatatgcagaaggccatgcgac

SEQ ID NO: 106500 - DNA, 25 bp, Mus musculus
gagcatcaaccttttcctggcacag

SEQ ID NO: 106501 - DNA, 25 bp, Mus musculus
gagcatcaagctcatcaccgaagaa

SEQ ID NO: 106502 - DNA, 25 bp, Mus musculus
gagcatcacagctacagacggcctg

SEQ ID NO: 106503 - DNA, 25 bp, Mus musculus
gagcatcactcttcacagcgtcatg

SEQ ID NO: 106504 - DNA, 25 bp, Mus musculus
gagcatcaggagacatgaatcttcc

SEQ ID NO: 106505 - DNA, 25 bp, Mus musculus
gagcatcagttctcagtgaaaagca

SEQ ID NO: 106506 - DNA, 25 bp, Mus musculus
gagcatcatctcacaaggactccgg

SEQ ID NO: 106507 - DNA, 25 bp, Mus musculus
gagcatccaagcatcagtaagcagg

SEQ ID NO: 106508 - DNA, 25 bp, Mus musculus
gagcatccatctacgggcagtttgt

SEQ ID NO: 106509 - DNA, 25 bp, Mus musculus
gagcatcccagcatgtccgtttatg

SEQ ID NO: 106510 - DNA, 25 bp, Mus musculus
gagcatcccgtgacattgcacagct

SEQ ID NO: 106511 - DNA, 25 bp, Mus musculus
gagcatccggctcaaacaggaacag

SEQ ID NO: 106512 - DNA, 25 bp, Mus musculus
gagcatcgcagttacagtgatcgag

SEQ ID NO: 106513 - DNA, 25 bp, Mus musculus
gagcatcggaatttcaaacctgtag

SEQ ID NO: 106514 - DNA, 25 bp, Mus musculus
gagcatcggagaaatactgtagaga

SEQ ID NO: 106515 - DNA, 25 bp, Mus musculus
gagcatcgtaaggtacccatggaag

SEQ ID NO: 106516 - DNA, 25 bp, Mus musculus
gagcatcgtcctccaaagattgccg

SEQ ID NO: 106517 - DNA, 25 bp, Mus musculus
gagcatctcgctctggcggtggccg

SEQ ID NO: 106518 - DNA, 25 bp, Mus musculus
gagcatctgcatcatcaggaggagc

SEQ ID NO: 106519 - DNA, 25 bp, Mus musculus
gagcatctgccactactgaggaaca

SEQ ID NO: 106520 - DNA, 25 bp, Mus musculus
gagcatctggaaggaagaacccatc

SEQ ID NO: 106521 - DNA, 25 bp, Mus musculus
gagcatctggccacgtaagcagtca

SEQ ID NO: 106522 - DNA, 25 bp, Mus musculus
gagcatctgtaacacaggcatccgg

SEQ ID NO: 106523 - DNA, 25 bp, Mus musculus
gagcatcttgccgactatctggagg

SEQ ID NO: 106524 - DNA, 25 bp, Mus musculus
gagcatcttggaacagaacttcctg

SEQ ID NO: 106525 - DNA, 25 bp, Mus musculus
gagcatctttctgaagcgctcccag

SEQ ID NO: 106526 - DNA, 25 bp, Mus musculus
gagcatgaccatcgaaaacgcatgg

SEQ ID NO: 106527 - DNA, 25 bp, Mus musculus
gagcatgactcctgttgaaagccga

SEQ ID NO: 106528 - DNA, 25 bp, Mus musculus
gagcatgcagattgtccctttagac

SEQ ID NO: 106529 - DNA, 25 bp, Mus musculus
gagcatggaccaacgccttcttaag

SEQ ID NO: 106530 - DNA, 25 bp, Mus musculus
gagcatggaggagattaagaaggtc

SEQ ID NO: 106531 - DNA, 25 bp, Mus musculus
gagcatggccatctagggaacaaca

SEQ ID NO: 106532 - DNA, 25 bp, Mus musculus
gagcatggctagtggatttacaaca

SEQ ID NO: 106533 - DNA, 25 bp, Mus musculus
gagcatggctggatcctggtcacca

SEQ ID NO: 106534 - DNA, 25 bp, Mus musculus
gagcatgggcctgatttcccctgga

SEQ ID NO: 106535 - DNA, 25 bp, Mus musculus
gagcatggtgtagacaccctcagcc

SEQ ID NO: 106536 - DNA, 25 bp, Mus musculus
gagcatgtgcagctgtttgacctga

SEQ ID NO: 106537 - DNA, 25 bp, Mus musculus
gagcatgtgccgacctggcttcaga

SEQ ID NO: 106538 - DNA, 25 bp, Mus musculus
gagcattccagaaaacccaatcttg

SEQ ID NO: 106539 - DNA, 25 bp, Mus musculus
gagcattctcacctatgtgtcacaa

SEQ ID NO: 106540 - DNA, 25 bp, Mus musculus
gagcattctggaagagttttccgcc

SEQ ID NO: 106541 - DNA, 25 bp, Mus musculus
gagcattgccaagctatgggacagc

SEQ ID NO: 106542 - DNA, 25 bp, Mus musculus
gagcattgccaaggacatgtccctg

SEQ ID NO: 106543 - DNA, 25 bp, Mus musculus
gagcattgccagagagcccagcgct

SEQ ID NO: 106544 - DNA, 25 bp, Mus musculus
gagcattgcctacctagacccagga

SEQ ID NO: 106545 - DNA, 25 bp, Mus musculus
gagcattgctgtgactctgtccatc

SEQ ID NO: 106546 - DNA, 25 bp, Mus musculus
gagcattggcctgtataatctggtc

SEQ ID NO: 106547 - DNA, 25 bp, Mus musculus
gagcattggcttaacccagtccgtg

SEQ ID NO: 106548 - DNA, 25 bp, Mus musculus
gagcatttagcaaagggccggacaa

SEQ ID NO: 106549 - DNA, 25 bp, Mus musculus
gagccaaacagaacatggaagactt

SEQ ID NO: 106550 - DNA, 25 bp, Mus musculus
gagccaaacatgtgtccgtggagaa

SEQ ID NO: 106551 - DNA, 25 bp, Mus musculus
gagccaaagcttgactcatcccagt

SEQ ID NO: 106552 - DNA, 25 bp, Mus musculus
gagccaacagtgtctgaatctggac

SEQ ID NO: 106553 - DNA, 25 bp, Mus musculus
gagccaacattgaagagtgacccat

SEQ ID NO: 106554 - DNA, 25 bp, Mus musculus
gagccaacgtcaagcatctgaaaat

SEQ ID NO: 106555 - DNA, 25 bp, Mus musculus
gagccaagaccgtctccggaaggtg

SEQ ID NO: 106556 - DNA, 25 bp, Mus musculus
gagccaaggctactccaaccgtatg

SEQ ID NO: 106557 - DNA, 25 bp, Mus musculus
gagccaagtacttcatttacaccac

SEQ ID NO: 106558 - DNA, 25 bp, Mus musculus
gagccaagtatgttagatcccaggg

SEQ ID NO: 106559 - DNA, 25 bp, Mus musculus
gagccaagtattggagagccacccc

SEQ ID NO: 106560 - DNA, 25 bp, Mus musculus
gagccaagtgcagctgtcttagagg

SEQ ID NO: 106561 - DNA, 25 bp, Mus musculus
gagccaagtggtaaactccaggaga

SEQ ID NO: 106562 - DNA, 25 bp, Mus musculus
gagccaagttcctttcgattcaaga

SEQ ID NO: 106563 - DNA, 25 bp, Mus musculus
gagccaatccctatgagatgatccg

SEQ ID NO: 106564 - DNA, 25 bp, Mus musculus
gagccaatgtgacaggtttccaact

SEQ ID NO: 106565 - DNA, 25 bp, Mus musculus
gagccaatgtgcagctttggaattg

SEQ ID NO: 106566 - DNA, 25 bp, Mus musculus
gagccacaagtttcacagccacaag

SEQ ID NO: 106567 - DNA, 25 bp, Mus musculus
gagccacagcaatttaactccagag

SEQ ID NO: 106568 - DNA, 25 bp, Mus musculus
gagccacagtaccaaccaggagaaa

SEQ ID NO: 106569 - DNA, 25 bp, Mus musculus
gagccacagtttgcccaaggctgtt

SEQ ID NO: 106570 - DNA, 25 bp, Mus musculus
gagccacatatagacagaagacaat

SEQ ID NO: 106571 - DNA, 25 bp, Mus musculus
gagccaccagagctattcccgaaag

SEQ ID NO: 106572 - DNA, 25 bp, Mus musculus
gagccacgccttctctcacgtatga

SEQ ID NO: 106573 - DNA, 25 bp, Mus musculus
gagccacgcgccacagatcaatttt

SEQ ID NO: 106574 - DNA, 25 bp, Mus musculus
gagccacgggcagttctttgaccag

SEQ ID NO: 106575 - DNA, 25 bp, Mus musculus
gagccacgtggagaaggacttcatt

SEQ ID NO: 106576 - DNA, 25 bp, Mus musculus
gagccactccaaaagactgagagcc

SEQ ID NO: 106577 - DNA, 25 bp, Mus musculus
gagccactgacttggagacaccctg

SEQ ID NO: 106578 - DNA, 25 bp, Mus musculus
gagccactgcgtgctacgtgtacaa

SEQ ID NO: 106579 - DNA, 25 bp, Mus musculus
gagccacttcagttagacaccctgg

SEQ ID NO: 106580 - DNA, 25 bp, Mus musculus
gagccagaagatcccagcagtagat

SEQ ID NO: 106581 - DNA, 25 bp, Mus musculus
gagccagaagctatcaacatgagga

SEQ ID NO: 106582 - DNA, 25 bp, Mus musculus
gagccagaatgtatccacgtgatgc

SEQ ID NO: 106583 - DNA, 25 bp, Mus musculus
gagccagacaggttacggacatacc

SEQ ID NO: 106584 - DNA, 25 bp, Mus musculus
gagccagactctttcaaccacaagg

SEQ ID NO: 106585 - DNA, 25 bp, Mus musculus
gagccagagccaccgatgaacagtg

SEQ ID NO: 106586 - DNA, 25 bp, Mus musculus
gagccagagccttgacctcatacct

SEQ ID NO: 106587 - DNA, 25 bp, Mus musculus
gagccagagctgacatcagggccta

SEQ ID NO: 106588 - DNA, 25 bp, Mus musculus
gagccagcatccaaaccagatgtga

SEQ ID NO: 106589 - DNA, 25 bp, Mus musculus
gagccagcatcctgtgggaagacag

SEQ ID NO: 106590 - DNA, 25 bp, Mus musculus
gagccagccacgatggagttgcaga

SEQ ID NO: 106591 - DNA, 25 bp, Mus musculus
gagccagccatgaatcctttccaga

SEQ ID NO: 106592 - DNA, 25 bp, Mus musculus
gagccagcctctgcatgaggtagtg

SEQ ID NO: 106593 - DNA, 25 bp, Mus musculus
gagccagcgctgcacatttgccggt

SEQ ID NO: 106594 - DNA, 25 bp, Mus musculus
gagccagctccctatggaaggcctg

SEQ ID NO: 106595 - DNA, 25 bp, Mus musculus
gagccagctgcgatgcatttcagag

SEQ ID NO: 106596 - DNA, 25 bp, Mus musculus
gagccaggagcctacgactggtcct

SEQ ID NO: 106597 - DNA, 25 bp, Mus musculus
gagccaggcagccactgtctgaaaa

SEQ ID NO: 106598 - DNA, 25 bp, Mus musculus
gagccaggcccatcacttactaaag

SEQ ID NO: 106599 - DNA, 25 bp, Mus musculus
gagccaggctgttgtctgtgcccta

SEQ ID NO: 106600 - DNA, 25 bp, Mus musculus
gagccagggctcgtcatgatatttg

SEQ ID NO: 106601 - DNA, 25 bp, Mus musculus
gagccagtatttgaagaagttccga

SEQ ID NO: 106602 - DNA, 25 bp, Mus musculus
gagccagtcaacaccaaagcgaatt

SEQ ID NO: 106603 - DNA, 25 bp, Mus musculus
gagccagtcaatgccgcatcctttg

SEQ ID NO: 106604 - DNA, 25 bp, Mus musculus
gagccagtcacttcttcacggttac

SEQ ID NO: 106605 - DNA, 25 bp, Mus musculus
gagccagtccgagcgcgtggcggag

SEQ ID NO: 106606 - DNA, 25 bp, Mus musculus
gagccagtcctgcttgaagaaccag

SEQ ID NO: 106607 - DNA, 25 bp, Mus musculus
gagccagttcaagaggcggtcaaca

SEQ ID NO: 106608 - DNA, 25 bp, Mus musculus
gagccagtttcggataccactctta

SEQ ID NO: 106609 - DNA, 25 bp, Mus musculus
gagccatacatagtccagacctctg

SEQ ID NO: 106610 - DNA, 25 bp, Mus musculus
gagccatatggtagcatcgttcagc

SEQ ID NO: 106611 - DNA, 25 bp, Mus musculus
gagccatcactggaggctgcccttg

SEQ ID NO: 106612 - DNA, 25 bp, Mus musculus
gagccatcctcctggttgtacccaa

SEQ ID NO: 106613 - DNA, 25 bp, Mus musculus
gagccatcctgcttgtgaattgtag

SEQ ID NO: 106614 - DNA, 25 bp, Mus musculus
gagccatcgcttgagagtctacgga

SEQ ID NO: 106615 - DNA, 25 bp, Mus musculus
gagccatgagccaaagcagggattt

SEQ ID NO: 106616 - DNA, 25 bp, Mus musculus
gagccatgaggaaaaaactgggccc

SEQ ID NO: 106617 - DNA, 25 bp, Mus musculus
gagccatgaggctgggttcagcaat

SEQ ID NO: 106618 - DNA, 25 bp, Mus musculus
gagccatgggaggagcattgccttt

SEQ ID NO: 106619 - DNA, 25 bp, Mus musculus
gagccatgtcacttgtcagcaacga

SEQ ID NO: 106620 - DNA, 25 bp, Mus musculus
gagccatgtgggaaaagctcacctt

SEQ ID NO: 106621 - DNA, 25 bp, Mus musculus
gagccattaaacagctgcttcgtgg

SEQ ID NO: 106622 - DNA, 25 bp, Mus musculus
gagccattcgcaggagtgattaacc

SEQ ID NO: 106623 - DNA, 25 bp, Mus musculus
gagccattgatgttgagcgcctgaa

SEQ ID NO: 106624 - DNA, 25 bp, Mus musculus
gagccatttcctccgtggtgtccga

SEQ ID NO: 106625 - DNA, 25 bp, Mus musculus
gagccatttgcaacagacgacttag

SEQ ID NO: 106626 - DNA, 25 bp, Mus musculus
gagcccaaacctatgattattggca

SEQ ID NO: 106627 - DNA, 25 bp, Mus musculus
gagcccaaaggagcttggcccaggt

SEQ ID NO: 106628 - DNA, 25 bp, Mus musculus
gagcccaactgcctcttcaaagtag

SEQ ID NO: 106629 - DNA, 25 bp, Mus musculus
gagcccaagagagctgtggtctgca

SEQ ID NO: 106630 - DNA, 25 bp, Mus musculus
gagcccaccttctgcttaaatagga

SEQ ID NO: 106631 - DNA, 25 bp, Mus musculus
gagcccactggctcggaggcttcag

SEQ ID NO: 106632 - DNA, 25 bp, Mus musculus
gagcccactgggaaaagatgccatt

SEQ ID NO: 106633 - DNA, 25 bp, Mus musculus
gagcccactgtggaagcaagtccaa

SEQ ID NO: 106634 - DNA, 25 bp, Mus musculus
gagcccagaggtgcaaagtggcctt

SEQ ID NO: 106635 - DNA, 25 bp, Mus musculus
gagcccagcgctccttcaatccctc

SEQ ID NO: 106636 - DNA, 25 bp, Mus musculus
gagcccaggaagatttcaggatgaa

SEQ ID NO: 106637 - DNA, 25 bp, Mus musculus
gagcccaggctgtctttgcctgcct

SEQ ID NO: 106638 - DNA, 25 bp, Mus musculus
gagcccagtgtctggcctccaaaga

SEQ ID NO: 106639 - DNA, 25 bp, Mus musculus
gagcccagtgttcccaggtaggagg

SEQ ID NO: 106640 - DNA, 25 bp, Mus musculus
gagcccatcacggtcaagttcgcaa

SEQ ID NO: 106641 - DNA, 25 bp, Mus musculus
gagcccatcgagcaggtcttgccaa

SEQ ID NO: 106642 - DNA, 25 bp, Mus musculus
gagcccatggaagatttgtgcccca

SEQ ID NO: 106643 - DNA, 25 bp, Mus musculus
gagcccatgtggtattgactgccag

SEQ ID NO: 106644 - DNA, 25 bp, Mus musculus
gagcccattacgtgactgtcccgag

SEQ ID NO: 106645 - DNA, 25 bp, Mus musculus
gagccccaagaaggatttcacacag

SEQ ID NO: 106646 - DNA, 25 bp, Mus musculus
gagccccacagagttattccagcaa

SEQ ID NO: 106647 - DNA, 25 bp, Mus musculus
gagccccacataaagcgtccaatga

SEQ ID NO: 106648 - DNA, 25 bp, Mus musculus
gagccccaggaacagtccagaaaaa

SEQ ID NO: 106649 - DNA, 25 bp, Mus musculus
gagccccgaggagaatgaatttgtg

SEQ ID NO: 106650 - DNA, 25 bp, Mus musculus
gagccccgcagtcctcttgagaaag

SEQ ID NO: 106651 - DNA, 25 bp, Mus musculus
gagcccctcagagtgcaggctgtga

SEQ ID NO: 106652 - DNA, 25 bp, Mus musculus
gagcccctgcacttcaaggactgcg

SEQ ID NO: 106653 - DNA, 25 bp, Mus musculus
gagcccctgctgacttaagagagac

SEQ ID NO: 106654 - DNA, 25 bp, Mus musculus
gagcccctgctgagcgtcttaaaaa

SEQ ID NO: 106655 - DNA, 25 bp, Mus musculus
gagcccctggagcttgtcataaaag

SEQ ID NO: 106656 - DNA, 25 bp, Mus musculus
gagcccctgtatgtgaatgccaaac

SEQ ID NO: 106657 - DNA, 25 bp, Mus musculus
gagcccgcaatctggatcagcagga

SEQ ID NO: 106658 - DNA, 25 bp, Mus musculus
gagcccgctactttggtgacacaga

SEQ ID NO: 106659 - DNA, 25 bp, Mus musculus
gagcccggacggtgcccctaggccg

SEQ ID NO: 106660 - DNA, 25 bp, Mus musculus
gagcccgggcttcataaaaccttga

SEQ ID NO: 106661 - DNA, 25 bp, Mus musculus
gagcccgtggcctttaaagtgcgat

SEQ ID NO: 106662 - DNA, 25 bp, Mus musculus
gagccctaagatggaagtcacaaga

SEQ ID NO: 106663 - DNA, 25 bp, Mus musculus
gagccctcttacttcgaattatgga

SEQ ID NO: 106664 - DNA, 25 bp, Mus musculus
gagccctgaaactgtacttccgaga

SEQ ID NO: 106665 - DNA, 25 bp, Mus musculus
gagccctgcctgattgaagctgcca

SEQ ID NO: 106666 - DNA, 25 bp, Mus musculus
gagccctgcgactgggcccagcagt

SEQ ID NO: 106667 - DNA, 25 bp, Mus musculus
gagccctggccatgaagattccttt

SEQ ID NO: 106668 - DNA, 25 bp, Mus musculus
gagccctgggagaaacctggcagta

SEQ ID NO: 106669 - DNA, 25 bp, Mus musculus
gagccctgtacacaagtctgagaaa

SEQ ID NO: 106670 - DNA, 25 bp, Mus musculus
gagccctgtgtaagcaactgagtga

SEQ ID NO: 106671 - DNA, 25 bp, Mus musculus
gagccctgttgaaccttcatggcca

SEQ ID NO: 106672 - DNA, 25 bp, Mus musculus
gagcccttcattctgagctgtaggc

SEQ ID NO: 106673 - DNA, 25 bp, Mus musculus
gagcccttggtggacacttgtctga

SEQ ID NO: 106674 - DNA, 25 bp, Mus musculus
gagcccttggttacgcagactcgga

SEQ ID NO: 106675 - DNA, 25 bp, Mus musculus
gagccgaagtactcaggctgcccta

SEQ ID NO: 106676 - DNA, 25 bp, Mus musculus
gagccgaagttaacgcccaggatga

SEQ ID NO: 106677 - DNA, 25 bp, Mus musculus
gagccgactcatgaagctggagaac

SEQ ID NO: 106678 - DNA, 25 bp, Mus musculus
gagccgagaaaagtactcgcgcaag

SEQ ID NO: 106679 - DNA, 25 bp, Mus musculus
gagccgatgacaaaggacccatgag

SEQ ID NO: 106680 - DNA, 25 bp, Mus musculus
gagccgatgccccaaggctttgtcc

SEQ ID NO: 106681 - DNA, 25 bp, Mus musculus
gagccgcagctatctcctgagaatg

SEQ ID NO: 106682 - DNA, 25 bp, Mus musculus
gagccgcattgaagagaacaccagc

SEQ ID NO: 106683 - DNA, 25 bp, Mus musculus
gagccgcccctgtgtgcattaggaa

SEQ ID NO: 106684 - DNA, 25 bp, Mus musculus
gagccgcctgaagaatgagatcgag

SEQ ID NO: 106685 - DNA, 25 bp, Mus musculus
gagccgcggcgctcttcagggataa

SEQ ID NO: 106686 - DNA, 25 bp, Mus musculus
gagccgctataacccaatctgtgga

SEQ ID NO: 106687 - DNA, 25 bp, Mus musculus
gagccgctccaaagatcgtggccag

SEQ ID NO: 106688 - DNA, 25 bp, Mus musculus
gagccggaactttgatgcagaagcc

SEQ ID NO: 106689 - DNA, 25 bp, Mus musculus
gagccggaagacctttcccttcgcg

SEQ ID NO: 106690 - DNA, 25 bp, Mus musculus
gagccggatcctaaagagtcagaca

SEQ ID NO: 106691 - DNA, 25 bp, Mus musculus
gagccggcctggtggattgccatac

SEQ ID NO: 106692 - DNA, 25 bp, Mus musculus
gagccgggagtttgtgattcctcaa

SEQ ID NO: 106693 - DNA, 25 bp, Mus musculus
gagccgggccgagcctgacgtctgt

SEQ ID NO: 106694 - DNA, 25 bp, Mus musculus
gagccggtcgtatggtgttccccgc

SEQ ID NO: 106695 - DNA, 25 bp, Mus musculus
gagccgtacggcctgacatacattg

SEQ ID NO: 106696 - DNA, 25 bp, Mus musculus
gagccgtccaaagtaaagcccaagt

SEQ ID NO: 106697 - DNA, 25 bp, Mus musculus
gagccgtccctgctcgactaggctg

SEQ ID NO: 106698 - DNA, 25 bp, Mus musculus
gagccgtgaatctgccaaactccat

SEQ ID NO: 106699 - DNA, 25 bp, Mus musculus
gagccgttcagtccaatgcattgat

SEQ ID NO: 106700 - DNA, 25 bp, Mus musculus
gagccgtttcctggtagcaatgcca

SEQ ID NO: 106701 - DNA, 25 bp, Mus musculus
gagcctaagatgtgcacgcctgaaa

SEQ ID NO: 106702 - DNA, 25 bp, Mus musculus
gagcctacccctagtgtacagcaga

SEQ ID NO: 106703 - DNA, 25 bp, Mus musculus
gagcctactggagaagatcattgcc

SEQ ID NO: 106704 - DNA, 25 bp, Mus musculus
gagcctagtaccagttcagcaagcg

SEQ ID NO: 106705 - DNA, 25 bp, Mus musculus
gagcctataaaagccggacggtgcg

SEQ ID NO: 106706 - DNA, 25 bp, Mus musculus
gagcctatgcaccttacctttaatg

SEQ ID NO: 106707 - DNA, 25 bp, Mus musculus
gagcctatgtgcgactgaagccagt

SEQ ID NO: 106708 - DNA, 25 bp, Mus musculus
gagcctcaacagaaagctcctttag

SEQ ID NO: 106709 - DNA, 25 bp, Mus musculus
gagcctcaatctgggtcacaaagcg

SEQ ID NO: 106710 - DNA, 25 bp, Mus musculus
gagcctcacagacaatggccaagtg

SEQ ID NO: 106711 - DNA, 25 bp, Mus musculus
gagcctcaccacttgctttcaacat

SEQ ID NO: 106712 - DNA, 25 bp, Mus musculus
gagcctcaggtgtcaaatggaccga

SEQ ID NO: 106713 - DNA, 25 bp, Mus musculus
gagcctccagatgcactagaagcag

SEQ ID NO: 106714 - DNA, 25 bp, Mus musculus
gagcctccctctagctgtacgtgaa

SEQ ID NO: 106715 - DNA, 25 bp, Mus musculus
gagcctccctgtgaaagacttggcg

SEQ ID NO: 106716 - DNA, 25 bp, Mus musculus
gagcctccgtgtgcccaggatgtct

SEQ ID NO: 106717 - DNA, 25 bp, Mus musculus
gagcctccttcggttggtcaaacac

SEQ ID NO: 106718 - DNA, 25 bp, Mus musculus
gagcctcgaaatttgctgcacagaa

SEQ ID NO: 106719 - DNA, 25 bp, Mus musculus
gagcctcgagctgtgacggctgcaa

SEQ ID NO: 106720 - DNA, 25 bp, Mus musculus
gagcctcggctttagacagggagca

SEQ ID NO: 106721 - DNA, 25 bp, Mus musculus
gagcctcgtactcgctcttcagggc

SEQ ID NO: 106722 - DNA, 25 bp, Mus musculus
gagcctcgtgcatggatcttctagc

SEQ ID NO: 106723 - DNA, 25 bp, Mus musculus
gagcctctctcagcagatgactggg

SEQ ID NO: 106724 - DNA, 25 bp, Mus musculus
gagcctctgcccgagaacattagaa

SEQ ID NO: 106725 - DNA, 25 bp, Mus musculus
gagcctctgctctgattgtttggga

SEQ ID NO: 106726 - DNA, 25 bp, Mus musculus
gagcctcttggatatgctgcccgaa

SEQ ID NO: 106727 - DNA, 25 bp, Mus musculus
gagcctgaaagcaaagtttcggaag

SEQ ID NO: 106728 - DNA, 25 bp, Mus musculus
gagcctgaagctaccgtggactctg

SEQ ID NO: 106729 - DNA, 25 bp, Mus musculus
gagcctgagatctacgagcccaatt

SEQ ID NO: 106730 - DNA, 25 bp, Mus musculus
gagcctgaggccattccagagagaa

SEQ ID NO: 106731 - DNA, 25 bp, Mus musculus
gagcctgaggtctgaaaaacaatct

SEQ ID NO: 106732 - DNA, 25 bp, Mus musculus
gagcctgagtcttccatcacgtctg

SEQ ID NO: 106733 - DNA, 25 bp, Mus musculus
gagcctgatacatctccagcaacag

SEQ ID NO: 106734 - DNA, 25 bp, Mus musculus
gagcctgccgacgaagattgacgca

SEQ ID NO: 106735 - DNA, 25 bp, Mus musculus
gagcctgccttggtacattcgtgaa

SEQ ID NO: 106736 - DNA, 25 bp, Mus musculus
gagcctgcggccctactatcaaggg

SEQ ID NO: 106737 - DNA, 25 bp, Mus musculus
gagcctggagaagacctgacacttt

SEQ ID NO: 106738 - DNA, 25 bp, Mus musculus
gagcctggctctctaaacgtgaaga

SEQ ID NO: 106739 - DNA, 25 bp, Mus musculus
gagcctgggacatcgactatctgca

SEQ ID NO: 106740 - DNA, 25 bp, Mus musculus
gagcctgggaggagacattcaaaac

SEQ ID NO: 106741 - DNA, 25 bp, Mus musculus
gagcctgggcagagacctagtttca

SEQ ID NO: 106742 - DNA, 25 bp, Mus musculus
gagcctgggccctacttcatggaac

SEQ ID NO: 106743 - DNA, 25 bp, Mus musculus
gagcctgggctgctaaagtcatcag

SEQ ID NO: 106744 - DNA, 25 bp, Mus musculus
gagcctgggtcctgcgagtttagcc

SEQ ID NO: 106745 - DNA, 25 bp, Mus musculus
gagcctggtctacctgtaccgtgag

SEQ ID NO: 106746 - DNA, 25 bp, Mus musculus
gagcctgtaaggtgttccatggtac

SEQ ID NO: 106747 - DNA, 25 bp, Mus musculus
gagcctgtgactatcagccacacaa

SEQ ID NO: 106748 - DNA, 25 bp, Mus musculus
gagcctgtgctcaagtggagaaatg

SEQ ID NO: 106749 - DNA, 25 bp, Mus musculus
gagcctgtgttgtgggaatcccgct

SEQ ID NO: 106750 - DNA, 25 bp, Mus musculus
gagcctgttgccaggaacacttcca

SEQ ID NO: 106751 - DNA, 25 bp, Mus musculus
gagccttagactttactgattctca

SEQ ID NO: 106752 - DNA, 25 bp, Mus musculus
gagccttatggagctgtctaccaga

SEQ ID NO: 106753 - DNA, 25 bp, Mus musculus
gagccttcagtagcaggcagctgga

SEQ ID NO: 106754 - DNA, 25 bp, Mus musculus
gagccttccatgatctagagcccag

SEQ ID NO: 106755 - DNA, 25 bp, Mus musculus
gagccttccgcatctcaagtacatg

SEQ ID NO: 106756 - DNA, 25 bp, Mus musculus
gagccttcgcatgaagcttccgaaa

SEQ ID NO: 106757 - DNA, 25 bp, Mus musculus
gagccttcgtgatccccacagtagt

SEQ ID NO: 106758 - DNA, 25 bp, Mus musculus
gagccttctgtaagcactgacctgg

SEQ ID NO: 106759 - DNA, 25 bp, Mus musculus
gagccttctgtcaaagacctggccg

SEQ ID NO: 106760 - DNA, 25 bp, Mus musculus
gagccttgatctcaggaggagaaaa

SEQ ID NO: 106761 - DNA, 25 bp, Mus musculus
gagccttggtgtacccttaacaaca

SEQ ID NO: 106762 - DNA, 25 bp, Mus musculus
gagccttgtcagacctgtcctttgg

SEQ ID NO: 106763 - DNA, 25 bp, Mus musculus
gagcctttccttgccatcgtgcggt

SEQ ID NO: 106764 - DNA, 25 bp, Mus musculus
gagccttttacgaacatgcgccgaa

SEQ ID NO: 106765 - DNA, 25 bp, Mus musculus
gagcgaaccatcgaaggagcaaaga

SEQ ID NO: 106766 - DNA, 25 bp, Mus musculus
gagcgaagccctctgtatgcgacag

SEQ ID NO: 106767 - DNA, 25 bp, Mus musculus
gagcgaagtgtgacgcccagaccca

SEQ ID NO: 106768 - DNA, 25 bp, Mus musculus
gagcgacaagccaattccagctgga

SEQ ID NO: 106769 - DNA, 25 bp, Mus musculus
gagcgacagtttgtgtcttagcaac

SEQ ID NO: 106770 - DNA, 25 bp, Mus musculus
gagcgaccgctgacttgcagaggaa

SEQ ID NO: 106771 - DNA, 25 bp, Mus musculus
gagcgacctatagatatcagcctgt

SEQ ID NO: 106772 - DNA, 25 bp, Mus musculus
gagcgacgggtacaaccacaatagg

SEQ ID NO: 106773 - DNA, 25 bp, Mus musculus
gagcgacttctaggatcccttagct

SEQ ID NO: 106774 - DNA, 25 bp, Mus musculus
gagcgagatctcagctttaaagagc

SEQ ID NO: 106775 - DNA, 25 bp, Mus musculus
gagcgagccaacaaaaactgccgga

SEQ ID NO: 106776 - DNA, 25 bp, Mus musculus
gagcgagctcgattgaaaactgtga

SEQ ID NO: 106777 - DNA, 25 bp, Mus musculus
gagcgagctgcctcaaatgcctgga

SEQ ID NO: 106778 - DNA, 25 bp, Mus musculus
gagcgagctgtgtttgcagacagaa

SEQ ID NO: 106779 - DNA, 25 bp, Mus musculus
gagcgaggagctgacctatctcaag

SEQ ID NO: 106780 - DNA, 25 bp, Mus musculus
gagcgagtgttttctggcattcagc

SEQ ID NO: 106781 - DNA, 25 bp, Mus musculus
gagcgatcactaggatctccccagg

SEQ ID NO: 106782 - DNA, 25 bp, Mus musculus
gagcgatgagtttgagggttccttc

SEQ ID NO: 106783 - DNA, 25 bp, Mus musculus
gagcgatgtgcctcaggcagagatc

SEQ ID NO: 106784 - DNA, 25 bp, Mus musculus
gagcgcaagatccaccgagatatca

SEQ ID NO: 106785 - DNA, 25 bp, Mus musculus
gagcgcagaacctgtcaagatgact

SEQ ID NO: 106786 - DNA, 25 bp, Mus musculus
gagcgcagagaaagaagccgagaac

SEQ ID NO: 106787 - DNA, 25 bp, Mus musculus
gagcgcatcagacccatggttcgag

SEQ ID NO: 106788 - DNA, 25 bp, Mus musculus
gagcgcatcccagagtacaggctga

SEQ ID NO: 106789 - DNA, 25 bp, Mus musculus
gagcgcatcctcactcagaacagag

SEQ ID NO: 106790 - DNA, 25 bp, Mus musculus
gagcgcatgatgtccctgtcagaag

SEQ ID NO: 106791 - DNA, 25 bp, Mus musculus
gagcgccaggcagacgttagttcca

SEQ ID NO: 106792 - DNA, 25 bp, Mus musculus
gagcgccccgagagcaactgcgtct

SEQ ID NO: 106793 - DNA, 25 bp, Mus musculus
gagcgcccgactcaggtattgagtt

SEQ ID NO: 106794 - DNA, 25 bp, Mus musculus
gagcgcctcaaaagctcgggtttct

SEQ ID NO: 106795 - DNA, 25 bp, Mus musculus
gagcgcctcagcctgggtcttagca

SEQ ID NO: 106796 - DNA, 25 bp, Mus musculus
gagcgcctggccctggactatattg

SEQ ID NO: 106797 - DNA, 25 bp, Mus musculus
gagcgcctggctacagccttgcaaa

SEQ ID NO: 106798 - DNA, 25 bp, Mus musculus
gagcgccttgtcttctttctgcaga

SEQ ID NO: 106799 - DNA, 25 bp, Mus musculus
gagcgcgacctcttgcctggtggaa

SEQ ID NO: 106800 - DNA, 25 bp, Mus musculus
gagcgcgatggaccgagggccccag

SEQ ID NO: 106801 - DNA, 25 bp, Mus musculus
gagcgcgtcactagctcggaagccc

SEQ ID NO: 106802 - DNA, 25 bp, Mus musculus
gagcgctaattaaaacacacctgta

SEQ ID NO: 106803 - DNA, 25 bp, Mus musculus
gagcgctaccctgtttttctggaga

SEQ ID NO: 106804 - DNA, 25 bp, Mus musculus
gagcgctactctcgtagattccgga

SEQ ID NO: 106805 - DNA, 25 bp, Mus musculus
gagcgctcctggacaaagagttgca

SEQ ID NO: 106806 - DNA, 25 bp, Mus musculus
gagcgctggccttctacctggctta

SEQ ID NO: 106807 - DNA, 25 bp, Mus musculus
gagcgcttcaaacaaccccgtttat

SEQ ID NO: 106808 - DNA, 25 bp, Mus musculus
gagcgcttcattccattctccaagg

SEQ ID NO: 106809 - DNA, 25 bp, Mus musculus
gagcggaccccaacctggtgttgga

SEQ ID NO: 106810 - DNA, 25 bp, Mus musculus
gagcggacccgtgctgatggccaca

SEQ ID NO: 106811 - DNA, 25 bp, Mus musculus
gagcggaccttctccttctgtggca

SEQ ID NO: 106812 - DNA, 25 bp, Mus musculus
gagcggagattgtccggctcaaacc

SEQ ID NO: 106813 - DNA, 25 bp, Mus musculus
gagcggagccctgtacgactgctta

SEQ ID NO: 106814 - DNA, 25 bp, Mus musculus
gagcggagcctaggcgctgcagcgt

SEQ ID NO: 106815 - DNA, 25 bp, Mus musculus
gagcggagcctatttgggtgaccaa

SEQ ID NO: 106816 - DNA, 25 bp, Mus musculus
gagcggagtttcagtctgcggacac

SEQ ID NO: 106817 - DNA, 25 bp, Mus musculus
gagcggatcttaggacccatcccag

SEQ ID NO: 106818 - DNA, 25 bp, Mus musculus
gagcggatttccatgtgggtgccca

SEQ ID NO: 106819 - DNA, 25 bp, Mus musculus
gagcggcaagtcgtctatccagaaa

SEQ ID NO: 106820 - DNA, 25 bp, Mus musculus
gagcggcacacccttattacagaga

SEQ ID NO: 106821 - DNA, 25 bp, Mus musculus
gagcggcagctgtctctcatcagtg

SEQ ID NO: 106822 - DNA, 25 bp, Mus musculus
gagcggccatgatcctgagagagtc

SEQ ID NO: 106823 - DNA, 25 bp, Mus musculus
gagcggcccttgacgacttctgaaa

SEQ ID NO: 106824 - DNA, 25 bp, Mus musculus
gagcggccgccttgctttcatctgg

SEQ ID NO: 106825 - DNA, 25 bp, Mus musculus
gagcggcgccataagtgcagcattt

SEQ ID NO: 106826 - DNA, 25 bp, Mus musculus
gagcggctactggactacagcagaa

SEQ ID NO: 106827 - DNA, 25 bp, Mus musculus
gagcggctgcaaagtgaagaaatac

SEQ ID NO: 106828 - DNA, 25 bp, Mus musculus
gagcggctgcggacgatttacaacc

SEQ ID NO: 106829 - DNA, 25 bp, Mus musculus
gagcggcttcgtcaacgccatacga

SEQ ID NO: 106830 - DNA, 25 bp, Mus musculus
gagcgggaacacagtagccattgac

SEQ ID NO: 106831 - DNA, 25 bp, Mus musculus
gagcgggagtcacccctacttcctg

SEQ ID NO: 106832 - DNA, 25 bp, Mus musculus
gagcgggatcgttatgcctacaaaa

SEQ ID NO: 106833 - DNA, 25 bp, Mus musculus
gagcgggcatgcactgagagtccca

SEQ ID NO: 106834 - DNA, 25 bp, Mus musculus
gagcgggcgctctattactggaaca

SEQ ID NO: 106835 - DNA, 25 bp, Mus musculus
gagcgggtatcaagcactccatggg

SEQ ID NO: 106836 - DNA, 25 bp, Mus musculus
gagcgggttcccgatcgatagccac

SEQ ID NO: 106837 - DNA, 25 bp, Mus musculus
gagcgggtttcttctccaaaccagg

SEQ ID NO: 106838 - DNA, 25 bp, Mus musculus
gagcggtcctgaggtttgcctcacc

SEQ ID NO: 106839 - DNA, 25 bp, Mus musculus
gagcggtgctatccacatctgggac

SEQ ID NO: 106840 - DNA, 25 bp, Mus musculus
gagcggtttcaagtcaagaatcccc

SEQ ID NO: 106841 - DNA, 25 bp, Mus musculus
gagcgtacgtggacttaactcacca

SEQ ID NO: 106842 - DNA, 25 bp, Mus musculus
gagcgtagcatctgcgtttccagga

SEQ ID NO: 106843 - DNA, 25 bp, Mus musculus
gagcgtcagcgccttttttcacaag

SEQ ID NO: 106844 - DNA, 25 bp, Mus musculus
gagcgtctttcctcgtcgctgtttg

SEQ ID NO: 106845 - DNA, 25 bp, Mus musculus
gagcgtgccaacctgcaaacgaaag

SEQ ID NO: 106846 - DNA, 25 bp, Mus musculus
gagcgtgctcctccagtcacagagg

SEQ ID NO: 106847 - DNA, 25 bp, Mus musculus
gagcgtgctgcaacaataagactgg

SEQ ID NO: 106848 - DNA, 25 bp, Mus musculus
gagcgtgctgcaggacttactgagg

SEQ ID NO: 106849 - DNA, 25 bp, Mus musculus
gagcgtggacaacatccagttcctg

SEQ ID NO: 106850 - DNA, 25 bp, Mus musculus
gagcgtggcactaacttcaactttg

SEQ ID NO: 106851 - DNA, 25 bp, Mus musculus
gagcgtgggtactcccaggcacagt

SEQ ID NO: 106852 - DNA, 25 bp, Mus musculus
gagcgttcgggtctctggtagagga

SEQ ID NO: 106853 - DNA, 25 bp, Mus musculus
gagcgttgcatgtgtcttgaagaga

SEQ ID NO: 106854 - DNA, 25 bp, Mus musculus
gagcgttgcgtcatcttcgattagc

SEQ ID NO: 106855 - DNA, 25 bp, Mus musculus
gagcgttggatctggcactggaacc

SEQ ID NO: 106856 - DNA, 25 bp, Mus musculus
gagctaactgaactgaatgtgggca

SEQ ID NO: 106857 - DNA, 25 bp, Mus musculus
gagctaactgaagcctagctcctgc

SEQ ID NO: 106858 - DNA, 25 bp, Mus musculus
gagctaatactccaaggcgcctgtc

SEQ ID NO: 106859 - DNA, 25 bp, Mus musculus
gagctacaactcgaggctgtgcgca

SEQ ID NO: 106860 - DNA, 25 bp, Mus musculus
gagctacagcttcaggacggcaaga

SEQ ID NO: 106861 - DNA, 25 bp, Mus musculus
gagctaccaatggatgattctgaag

SEQ ID NO: 106862 - DNA, 25 bp, Mus musculus
gagctaccacgactgcgcgattact

SEQ ID NO: 106863 - DNA, 25 bp, Mus musculus
gagctacgggagagcagcatgtaaa

SEQ ID NO: 106864 - DNA, 25 bp, Mus musculus
gagctactctccaaggtacatctgc

SEQ ID NO: 106865 - DNA, 25 bp, Mus musculus
gagctactgctcgttcagcacagtg

SEQ ID NO: 106866 - DNA, 25 bp, Mus musculus
gagctacttcctttctgcgctctcg

SEQ ID NO: 106867 - DNA, 25 bp, Mus musculus
gagctacttgggactgcagaaacac

SEQ ID NO: 106868 - DNA, 25 bp, Mus musculus
gagctagagttccttgtcggtcaga

SEQ ID NO: 106869 - DNA, 25 bp, Mus musculus
gagctagccagccaaggactttgaa

SEQ ID NO: 106870 - DNA, 25 bp, Mus musculus
gagctagcctatgttgttcccacga

SEQ ID NO: 106871 - DNA, 25 bp, Mus musculus
gagctagctcacgagctggccactg

SEQ ID NO: 106872 - DNA, 25 bp, Mus musculus
gagctagctgagatgctgcctcctg

SEQ ID NO: 106873 - DNA, 25 bp, Mus musculus
gagctaggagctctcgccaagtaat

SEQ ID NO: 106874 - DNA, 25 bp, Mus musculus
gagctatccattgatgtcagtgccc

SEQ ID NO: 106875 - DNA, 25 bp, Mus musculus
gagctatccggtgccatccttgtcg

SEQ ID NO: 106876 - DNA, 25 bp, Mus musculus
gagctatcggttgtctgcggccgta

SEQ ID NO: 106877 - DNA, 25 bp, Mus musculus
gagctatcttaaccctccagaaaga

SEQ ID NO: 106878 - DNA, 25 bp, Mus musculus
gagctatgacggcacactgcgatgt

SEQ ID NO: 106879 - DNA, 25 bp, Mus musculus
gagctcaaccccaatggcaacgcta

SEQ ID NO: 106880 - DNA, 25 bp, Mus musculus
gagctcaacggtttaccctcagaga

SEQ ID NO: 106881 - DNA, 25 bp, Mus musculus
gagctcaaggaaagactgtagggac

SEQ ID NO: 106882 - DNA, 25 bp, Mus musculus
gagctcaataaactaccatcttctt

SEQ ID NO: 106883 - DNA, 25 bp, Mus musculus
gagctcaccgttgttggtttgctgg

SEQ ID NO: 106884 - DNA, 25 bp, Mus musculus
gagctcactccctatgtcaatgtaa

SEQ ID NO: 106885 - DNA, 25 bp, Mus musculus
gagctcagcgatgcccttgggatca

SEQ ID NO: 106886 - DNA, 25 bp, Mus musculus
gagctcatcagggtagccggatcta

SEQ ID NO: 106887 - DNA, 25 bp, Mus musculus
gagctcatccggagtcaggctgtga

SEQ ID NO: 106888 - DNA, 25 bp, Mus musculus
gagctcatggacagagatggcgcct

SEQ ID NO: 106889 - DNA, 25 bp, Mus musculus
gagctcattcgtcatcttcctcgtg

SEQ ID NO: 106890 - DNA, 25 bp, Mus musculus
gagctccaggccatgaactttgaag

SEQ ID NO: 106891 - DNA, 25 bp, Mus musculus
gagctccaggtgctcctcggcttcg

SEQ ID NO: 106892 - DNA, 25 bp, Mus musculus
gagctccatcagctgatcaagcaaa

SEQ ID NO: 106893 - DNA, 25 bp, Mus musculus
gagctcccggctgctaacgtcatgt

SEQ ID NO: 106894 - DNA, 25 bp, Mus musculus
gagctcccgggctctagtgtcctgg

SEQ ID NO: 106895 - DNA, 25 bp, Mus musculus
gagctccgagccctgaaacagagaa

SEQ ID NO: 106896 - DNA, 25 bp, Mus musculus
gagctccgagttggacgccttatga

SEQ ID NO: 106897 - DNA, 25 bp, Mus musculus
gagctccggcacgttggctctgcag

SEQ ID NO: 106898 - DNA, 25 bp, Mus musculus
gagctcctcggagaacagtgtcctt

SEQ ID NO: 106899 - DNA, 25 bp, Mus musculus
gagctcctcgtctcatgataactca

SEQ ID NO: 106900 - DNA, 25 bp, Mus musculus
gagctcctgcgagcaaggatcttgc

SEQ ID NO: 106901 - DNA, 25 bp, Mus musculus
gagctcctggagtctagtcaccgtg

SEQ ID NO: 106902 - DNA, 25 bp, Mus musculus
gagctcctgggcaagaacacctttg

SEQ ID NO: 106903 - DNA, 25 bp, Mus musculus
gagctcctggtctcccatgaagatg

SEQ ID NO: 106904 - DNA, 25 bp, Mus musculus
gagctccttgaagtcccctggaaga

SEQ ID NO: 106905 - DNA, 25 bp, Mus musculus
gagctcgacctggaaacgtgggatt

SEQ ID NO: 106906 - DNA, 25 bp, Mus musculus
gagctcgacgccatgagtaggtaca

SEQ ID NO: 106907 - DNA, 25 bp, Mus musculus
gagctcgctctctctggtctgggag

SEQ ID NO: 106908 - DNA, 25 bp, Mus musculus
gagctcggctacctcaataaaatgg

SEQ ID NO: 106909 - DNA, 25 bp, Mus musculus
gagctcggctcccattttcacggtg

SEQ ID NO: 106910 - DNA, 25 bp, Mus musculus
gagctcgtgtaaatgccaaggacaa

SEQ ID NO: 106911 - DNA, 25 bp, Mus musculus
gagctctacggaccgctcatgctgg

SEQ ID NO: 106912 - DNA, 25 bp, Mus musculus
gagctctagagcttcgctaacgggt

SEQ ID NO: 106913 - DNA, 25 bp, Mus musculus
gagctctcagatgcccacatgacgt

SEQ ID NO: 106914 - DNA, 25 bp, Mus musculus
gagctctcagctccagaaaaggcaa

SEQ ID NO: 106915 - DNA, 25 bp, Mus musculus
gagctctctcaatacatgggactgt

SEQ ID NO: 106916 - DNA, 25 bp, Mus musculus
gagctctctccaggacaagtgcttg

SEQ ID NO: 106917 - DNA, 25 bp, Mus musculus
gagctctctgcagataggcacagtc

SEQ ID NO: 106918 - DNA, 25 bp, Mus musculus
gagctctgacttgtactctcctgag

SEQ ID NO: 106919 - DNA, 25 bp, Mus musculus
gagctctgagcttattgggtgccac

SEQ ID NO: 106920 - DNA, 25 bp, Mus musculus
gagctctgagggacatggcgcttct

SEQ ID NO: 106921 - DNA, 25 bp, Mus musculus
gagctctgagtattgatggcctgtg

SEQ ID NO: 106922 - DNA, 25 bp, Mus musculus
gagctctgatgggaactgtgcaaca

SEQ ID NO: 106923 - DNA, 25 bp, Mus musculus
gagctctgcagaaggttgtaccggc

SEQ ID NO: 106924 - DNA, 25 bp, Mus musculus
gagctctgctctgttgaaaatcata

SEQ ID NO: 106925 - DNA, 25 bp, Mus musculus
gagctctggaagctttggttttgca

SEQ ID NO: 106926 - DNA, 25 bp, Mus musculus
gagctctggacaaagtattccgacc

SEQ ID NO: 106927 - DNA, 25 bp, Mus musculus
gagctctggtctgaagatctatgcc

SEQ ID NO: 106928 - DNA, 25 bp, Mus musculus
gagctgaaaatttgcaggctccagc

SEQ ID NO: 106929 - DNA, 25 bp, Mus musculus
gagctgaaaccctgtggcgccattt

SEQ ID NO: 106930 - DNA, 25 bp, Mus musculus
gagctgaagaatatgcctattacat

SEQ ID NO: 106931 - DNA, 25 bp, Mus musculus
gagctgaagccttaccatatccacg

SEQ ID NO: 106932 - DNA, 25 bp, Mus musculus
gagctgaagctagaaaaccaccagg

SEQ ID NO: 106933 - DNA, 25 bp, Mus musculus
gagctgacactaaactacccgaagg

SEQ ID NO: 106934 - DNA, 25 bp, Mus musculus
gagctgacactttccttggcataga

SEQ ID NO: 106935 - DNA, 25 bp, Mus musculus
gagctgaccaaacccaaggagctgt

SEQ ID NO: 106936 - DNA, 25 bp, Mus musculus
gagctgactccgaggtccattggga

SEQ ID NO: 106937 - DNA, 25 bp, Mus musculus
gagctgagaaagctgaagacacccg

SEQ ID NO: 106938 - DNA, 25 bp, Mus musculus
gagctgagagctactgccttgtccg

SEQ ID NO: 106939 - DNA, 25 bp, Mus musculus
gagctgagcccacttctgaaacaca

SEQ ID NO: 106940 - DNA, 25 bp, Mus musculus
gagctgaggctaccacgacgtaaag

SEQ ID NO: 106941 - DNA, 25 bp, Mus musculus
gagctgagtgccttgtagaaatccg

SEQ ID NO: 106942 - DNA, 25 bp, Mus musculus
gagctgatgagttctggatcctgca

SEQ ID NO: 106943 - DNA, 25 bp, Mus musculus
gagctgatgctgaggacctccttgg

SEQ ID NO: 106944 - DNA, 25 bp, Mus musculus
gagctgatggaacaagtgccgcaca

SEQ ID NO: 106945 - DNA, 25 bp, Mus musculus
gagctgatggacacctttcggcctg

SEQ ID NO: 106946 - DNA, 25 bp, Mus musculus
gagctgattcggtacctagagccag

SEQ ID NO: 106947 - DNA, 25 bp, Mus musculus
gagctgcaccgccatatagaggaag

SEQ ID NO: 106948 - DNA, 25 bp, Mus musculus
gagctgcacgccatttcccttgaac

SEQ ID NO: 106949 - DNA, 25 bp, Mus musculus
gagctgcaggtgtggtataccaagc

SEQ ID NO: 106950 - DNA, 25 bp, Mus musculus
gagctgcatgccgtatcttctagaa

SEQ ID NO: 106951 - DNA, 25 bp, Mus musculus
gagctgcatgtgagttggcacaaca

SEQ ID NO: 106952 - DNA, 25 bp, Mus musculus
gagctgccatgtcttccgacttcga

SEQ ID NO: 106953 - DNA, 25 bp, Mus musculus
gagctgcccgctggatcaacattga

SEQ ID NO: 106954 - DNA, 25 bp, Mus musculus
gagctgccctaaggacatcactgtt

SEQ ID NO: 106955 - DNA, 25 bp, Mus musculus
gagctgccctgggtcaaacagagga

SEQ ID NO: 106956 - DNA, 25 bp, Mus musculus
gagctgcctgctgtcatggactgaa

SEQ ID NO: 106957 - DNA, 25 bp, Mus musculus
gagctgcgccgagattgacctgttc

SEQ ID NO: 106958 - DNA, 25 bp, Mus musculus
gagctgcgctctacggtggaagaac

SEQ ID NO: 106959 - DNA, 25 bp, Mus musculus
gagctgcgggttatcgacctcaggt

SEQ ID NO: 106960 - DNA, 25 bp, Mus musculus
gagctgctatagaagtacgggattt

SEQ ID NO: 106961 - DNA, 25 bp, Mus musculus
gagctgctcatcaggaatcagacaa

SEQ ID NO: 106962 - DNA, 25 bp, Mus musculus
gagctgctgacaccatgagtaactg

SEQ ID NO: 106963 - DNA, 25 bp, Mus musculus
gagctgcttaggagatgaatccctt

SEQ ID NO: 106964 - DNA, 25 bp, Mus musculus
gagctgcttcggctaagtcttcggt

SEQ ID NO: 106965 - DNA, 25 bp, Mus musculus
gagctgcttgcgaaataaacacgaa

SEQ ID NO: 106966 - DNA, 25 bp, Mus musculus
gagctggacatgacacagacttgga

SEQ ID NO: 106967 - DNA, 25 bp, Mus musculus
gagctggaccctgaaagcctcttag

SEQ ID NO: 106968 - DNA, 25 bp, Mus musculus
gagctggagaccacattctgcattt

SEQ ID NO: 106969 - DNA, 25 bp, Mus musculus
gagctggagacttgcatggttaacc

SEQ ID NO: 106970 - DNA, 25 bp, Mus musculus
gagctggagcaagagtccaccttta

SEQ ID NO: 106971 - DNA, 25 bp, Mus musculus
gagctggagtcagatggcagcacta

SEQ ID NO: 106972 - DNA, 25 bp, Mus musculus
gagctggatctgcagcgctactcca

SEQ ID NO: 106973 - DNA, 25 bp, Mus musculus
gagctggatgccttgctaggccacg

SEQ ID NO: 106974 - DNA, 25 bp, Mus musculus
gagctggcagctgactgtcacttga

SEQ ID NO: 106975 - DNA, 25 bp, Mus musculus
gagctggcctcagagttttctccta

SEQ ID NO: 106976 - DNA, 25 bp, Mus musculus
gagctggctacagatgcaacatcgc

SEQ ID NO: 106977 - DNA, 25 bp, Mus musculus
gagctgggcacagtcctttgacaag

SEQ ID NO: 106978 - DNA, 25 bp, Mus musculus
gagctgggccttgattgaccctgga

SEQ ID NO: 106979 - DNA, 25 bp, Mus musculus
gagctgggtcattctagtgccccgg

SEQ ID NO: 106980 - DNA, 25 bp, Mus musculus
gagctggtgatcaactacgatgccc

SEQ ID NO: 106981 - DNA, 25 bp, Mus musculus
gagctgtaaccagcagcaaccagcg

SEQ ID NO: 106982 - DNA, 25 bp, Mus musculus
gagctgtacaccagcagccaagcag

SEQ ID NO: 106983 - DNA, 25 bp, Mus musculus
gagctgtaccacgaacagtgcttcg

SEQ ID NO: 106984 - DNA, 25 bp, Mus musculus
gagctgtacgaggaagtgcgtcccc

SEQ ID NO: 106985 - DNA, 25 bp, Mus musculus
gagctgtatattcactggtgtggca

SEQ ID NO: 106986 - DNA, 25 bp, Mus musculus
gagctgtatcaacaccttaaggagg

SEQ ID NO: 106987 - DNA, 25 bp, Mus musculus
gagctgtatcagagccttatgtgga

SEQ ID NO: 106988 - DNA, 25 bp, Mus musculus
gagctgtatgtcaacgcctgcaaga

SEQ ID NO: 106989 - DNA, 25 bp, Mus musculus
gagctgtattgtgagacgcacgcga

SEQ ID NO: 106990 - DNA, 25 bp, Mus musculus
gagctgtcaaaatatagagtcccaa

SEQ ID NO: 106991 - DNA, 25 bp, Mus musculus
gagctgtcggaggtcttcatgaaaa

SEQ ID NO: 106992 - DNA, 25 bp, Mus musculus
gagctgtctgcgtgtgaaccctaag

SEQ ID NO: 106993 - DNA, 25 bp, Mus musculus
gagctgtgccccaaagatgatgaag

SEQ ID NO: 106994 - DNA, 25 bp, Mus musculus
gagctgtgcggtctgttaaagaaac

SEQ ID NO: 106995 - DNA, 25 bp, Mus musculus
gagctgtgctttcgctttcccttcc

SEQ ID NO: 106996 - DNA, 25 bp, Mus musculus
gagctgtggcatcaaaacctgcagg

SEQ ID NO: 106997 - DNA, 25 bp, Mus musculus
gagctgtggcccagtttatcaagca

SEQ ID NO: 106998 - DNA, 25 bp, Mus musculus
gagctgtggcgcttcctcagaccct

SEQ ID NO: 106999 - DNA, 25 bp, Mus musculus
gagctgtggctctgcgctgtcttta

SEQ ID NO: 107000 - DNA, 25 bp, Mus musculus
gagctgtgtacagaggtttgccgct

SEQ ID NO: 107001 - DNA, 25 bp, Mus musculus
gagctgtgtccatccagacgggcta

SEQ ID NO: 107002 - DNA, 25 bp, Mus musculus
gagctgtgtgcatcccctggaggaa

SEQ ID NO: 107003 - DNA, 25 bp, Mus musculus
gagctgttggttttgctggacccca

SEQ ID NO: 107004 - DNA, 25 bp, Mus musculus
gagctgtttgtaatcaccctggtgg

SEQ ID NO: 107005 - DNA, 25 bp, Mus musculus
gagcttaccacaagaacccctgatg

SEQ ID NO: 107006 - DNA, 25 bp, Mus musculus
gagcttacctctgttgctcgggcca

SEQ ID NO: 107007 - DNA, 25 bp, Mus musculus
gagcttacctttgagtgattcggat

SEQ ID NO: 107008 - DNA, 25 bp, Mus musculus
gagcttactgtgaaacctgttggga

SEQ ID NO: 107009 - DNA, 25 bp, Mus musculus
gagcttactgtgtgacctcagcaat

SEQ ID NO: 107010 - DNA, 25 bp, Mus musculus
gagcttagatggagacctcgacccc

SEQ ID NO: 107011 - DNA, 25 bp, Mus musculus
gagcttatgtacgaggtcaccctta

SEQ ID NO: 107012 - DNA, 25 bp, Mus musculus
gagcttcaagtattccgaggtcaca

SEQ ID NO: 107013 - DNA, 25 bp, Mus musculus
gagcttcacctacgaattcaaggca

SEQ ID NO: 107014 - DNA, 25 bp, Mus musculus
gagcttcactgtaaggccctgagag

SEQ ID NO: 107015 - DNA, 25 bp, Mus musculus
gagcttcagctccaattcagagggc

SEQ ID NO: 107016 - DNA, 25 bp, Mus musculus
gagcttccacaaagtcctagacccg

SEQ ID NO: 107017 - DNA, 25 bp, Mus musculus
gagcttcgagctccccgagattaag

SEQ ID NO: 107018 - DNA, 25 bp, Mus musculus
gagcttcgcggtacagaggacttga

SEQ ID NO: 107019 - DNA, 25 bp, Mus musculus
gagcttcggctcaatgccgagctga

SEQ ID NO: 107020 - DNA, 25 bp, Mus musculus
gagcttcggcttcgagaacacctgg

SEQ ID NO: 107021 - DNA, 25 bp, Mus musculus
gagcttctcaggtaggcgtagttgc

SEQ ID NO: 107022 - DNA, 25 bp, Mus musculus
gagcttctcgagtcaattgacatga

SEQ ID NO: 107023 - DNA, 25 bp, Mus musculus
gagcttctgcaagatggccaccagg

SEQ ID NO: 107024 - DNA, 25 bp, Mus musculus
gagcttctggacaaggcctcgagaa

SEQ ID NO: 107025 - DNA, 25 bp, Mus musculus
gagcttctgtcctgtgctgcatggg

SEQ ID NO: 107026 - DNA, 25 bp, Mus musculus
gagcttgccgtgagcatcagcagga

SEQ ID NO: 107027 - DNA, 25 bp, Mus musculus
gagcttggcgactaggaccttgtgc

SEQ ID NO: 107028 - DNA, 25 bp, Mus musculus
gagcttggctcactcccagaaagca

SEQ ID NO: 107029 - DNA, 25 bp, Mus musculus
gagcttgtaactggagaccccgtcc

SEQ ID NO: 107030 - DNA, 25 bp, Mus musculus
gagcttgtgaaatgccggctgcaga

SEQ ID NO: 107031 - DNA, 25 bp, Mus musculus
gagcttgtgcagtataagtggcccc

SEQ ID NO: 107032 - DNA, 25 bp, Mus musculus
gagcttgtgtttatctccctggaag

SEQ ID NO: 107033 - DNA, 25 bp, Mus musculus
gagcttgttagttccgggtccttga

SEQ ID NO: 107034 - DNA, 25 bp, Mus musculus
gagcttgttccccagccggatgatg

SEQ ID NO: 107035 - DNA, 25 bp, Mus musculus
gagctttccgctgtggctacaaggg

SEQ ID NO: 107036 - DNA, 25 bp, Mus musculus
gagctttcctgacatcggttacgca

SEQ ID NO: 107037 - DNA, 25 bp, Mus musculus
gagctttcgttaaggagcacttcga

SEQ ID NO: 107038 - DNA, 25 bp, Mus musculus
gagctttcttaccagactctcaaac

SEQ ID NO: 107039 - DNA, 25 bp, Mus musculus
gagctttggagccaccttgttagag

SEQ ID NO: 107040 - DNA, 25 bp, Mus musculus
gagctttggccgaactgctgcggac

SEQ ID NO: 107041 - DNA, 25 bp, Mus musculus
gagctttgtgggttgtcataattcc

SEQ ID NO: 107042 - DNA, 25 bp, Mus musculus
gagcttttcgacttcctggccgaga

SEQ ID NO: 107043 - DNA, 25 bp, Mus musculus
gaggaaaactcagccacacgagtcg

SEQ ID NO: 107044 - DNA, 25 bp, Mus musculus
gaggaaaatgtatcaggacgctaga

SEQ ID NO: 107045 - DNA, 25 bp, Mus musculus
gaggaaaattgttctccaaccctag

SEQ ID NO: 107046 - DNA, 25 bp, Mus musculus
gaggaaacaactcgaagatctcaat

SEQ ID NO: 107047 - DNA, 25 bp, Mus musculus
gaggaaacacggctcaacattgaca

SEQ ID NO: 107048 - DNA, 25 bp, Mus musculus
gaggaaacagcatcaccccaaggtt

SEQ ID NO: 107049 - DNA, 25 bp, Mus musculus
gaggaaaccctcaagctgtgccggg

SEQ ID NO: 107050 - DNA, 25 bp, Mus musculus
gaggaaaccctgtgtatcagtagag

SEQ ID NO: 107051 - DNA, 25 bp, Mus musculus
gaggaaacgccctgtagctctggaa

SEQ ID NO: 107052 - DNA, 25 bp, Mus musculus
gaggaaacgtgttcttctccacgac

SEQ ID NO: 107053 - DNA, 25 bp, Mus musculus
gaggaaacgttccagggattcgcct

SEQ ID NO: 107054 - DNA, 25 bp, Mus musculus
gaggaaactgcacaatagtacagta

SEQ ID NO: 107055 - DNA, 25 bp, Mus musculus
gaggaaaggcatttctctgcgtacc

SEQ ID NO: 107056 - DNA, 25 bp, Mus musculus
gaggaaatccagtcagtccgacgcc

SEQ ID NO: 107057 - DNA, 25 bp, Mus musculus
gaggaaatcgtttggcttggccaac

SEQ ID NO: 107058 - DNA, 25 bp, Mus musculus
gaggaaatctctactagcccaggag

SEQ ID NO: 107059 - DNA, 25 bp, Mus musculus
gaggaaatctcttcatggatattaa

SEQ ID NO: 107060 - DNA, 25 bp, Mus musculus
gaggaacaaaatccaccggctccat

SEQ ID NO: 107061 - DNA, 25 bp, Mus musculus
gaggaacaaggatgaatatgactca

SEQ ID NO: 107062 - DNA, 25 bp, Mus musculus
gaggaacaagtcataacaccgatcg

SEQ ID NO: 107063 - DNA, 25 bp, Mus musculus
gaggaacacggaggccttgctataa

SEQ ID NO: 107064 - DNA, 25 bp, Mus musculus
gaggaacagctctttagcctgcaga

SEQ ID NO: 107065 - DNA, 25 bp, Mus musculus
gaggaacagtcgataccagctaaag

SEQ ID NO: 107066 - DNA, 25 bp, Mus musculus
gaggaaccacttgtgatttggaccc

SEQ ID NO: 107067 - DNA, 25 bp, Mus musculus
gaggaaccatctcgtgacagctcag

SEQ ID NO: 107068 - DNA, 25 bp, Mus musculus
gaggaacccctgaacttctcaagga

SEQ ID NO: 107069 - DNA, 25 bp, Mus musculus
gaggaacccttagtaccctagtgca

SEQ ID NO: 107070 - DNA, 25 bp, Mus musculus
gaggaacctcagcatgaaagtggac

SEQ ID NO: 107071 - DNA, 25 bp, Mus musculus
gaggaacctccccagaatatgaagc

SEQ ID NO: 107072 - DNA, 25 bp, Mus musculus
gaggaaccttttcacccaacatggg

SEQ ID NO: 107073 - DNA, 25 bp, Mus musculus
gaggaactactgctatcccaggcgc

SEQ ID NO: 107074 - DNA, 25 bp, Mus musculus
gaggaactaggctccaacacaggga

SEQ ID NO: 107075 - DNA, 25 bp, Mus musculus
gaggaactcatcaagcagggactgc

SEQ ID NO: 107076 - DNA, 25 bp, Mus musculus
gaggaactgcacgtcattgatgtca

SEQ ID NO: 107077 - DNA, 25 bp, Mus musculus
gaggaactgtagcaccagaacccat

SEQ ID NO: 107078 - DNA, 25 bp, Mus musculus
gaggaagaaatgtttcgccccaaca

SEQ ID NO: 107079 - DNA, 25 bp, Mus musculus
gaggaagacctttgtatcgcaagca

SEQ ID NO: 107080 - DNA, 25 bp, Mus musculus
gaggaagacttcagctatgaggagc

SEQ ID NO: 107081 - DNA, 25 bp, Mus musculus
gaggaagagaatacagataccagac

SEQ ID NO: 107082 - DNA, 25 bp, Mus musculus
gaggaagagatccaaatgggcactc

SEQ ID NO: 107083 - DNA, 25 bp, Mus musculus
gaggaagagtggtgaagtggaggag

SEQ ID NO: 107084 - DNA, 25 bp, Mus musculus
gaggaagcaatgacccaggacttga

SEQ ID NO: 107085 - DNA, 25 bp, Mus musculus
gaggaagcagaaatccaggcagagc

SEQ ID NO: 107086 - DNA, 25 bp, Mus musculus
gaggaagcagtatgacgcttacggc

SEQ ID NO: 107087 - DNA, 25 bp, Mus musculus
gaggaagccttggaaactctacaaa

SEQ ID NO: 107088 - DNA, 25 bp, Mus musculus
gaggaagcggaactccatctacgtc

SEQ ID NO: 107089 - DNA, 25 bp, Mus musculus
gaggaagcggttacggctgtacaga

SEQ ID NO: 107090 - DNA, 25 bp, Mus musculus
gaggaagctacctacatccaggaaa

SEQ ID NO: 107091 - DNA, 25 bp, Mus musculus
gaggaagctcagtcctggtggtgag

SEQ ID NO: 107092 - DNA, 25 bp, Mus musculus
gaggaagctcatgagtggaaccaga

SEQ ID NO: 107093 - DNA, 25 bp, Mus musculus
gaggaagctctattgaagccggaga

SEQ ID NO: 107094 - DNA, 25 bp, Mus musculus
gaggaagtaatgttaagagaactca

SEQ ID NO: 107095 - DNA, 25 bp, Mus musculus
gaggaagtcacagccgagctgccta

SEQ ID NO: 107096 - DNA, 25 bp, Mus musculus
gaggaagtcccagaaaatggcagag

SEQ ID NO: 107097 - DNA, 25 bp, Mus musculus
gaggaagtgaacatccctagccggc

SEQ ID NO: 107098 - DNA, 25 bp, Mus musculus
gaggaatacaccacaggcatggcag

SEQ ID NO: 107099 - DNA, 25 bp, Mus musculus
gaggaatattttgtgacccagggac

SEQ ID NO: 107100 - DNA, 25 bp, Mus musculus
gaggaatcctttttagccgcggtgc

SEQ ID NO: 107101 - DNA, 25 bp, Mus musculus
gaggaatgatgctgtagaggctcaa

SEQ ID NO: 107102 - DNA, 25 bp, Mus musculus
gaggaatgccaatgaccttctcgac

SEQ ID NO: 107103 - DNA, 25 bp, Mus musculus
gaggaatgctctgtttcaccggcca

SEQ ID NO: 107104 - DNA, 25 bp, Mus musculus
gaggaatgtaaagcactgggccact

SEQ ID NO: 107105 - DNA, 25 bp, Mus musculus
gaggaatgtacattgcacggcagct

SEQ ID NO: 107106 - DNA, 25 bp, Mus musculus
gaggaatgtccccatgacgggctcc

SEQ ID NO: 107107 - DNA, 25 bp, Mus musculus
gaggaatgttctcatcaccagtgcc

SEQ ID NO: 107108 - DNA, 25 bp, Mus musculus
gaggaattcagagttaggacagcca

SEQ ID NO: 107109 - DNA, 25 bp, Mus musculus
gaggaattctctactgctacatgcg

SEQ ID NO: 107110 - DNA, 25 bp, Mus musculus
gaggaattgccacaccgccagtgta

SEQ ID NO: 107111 - DNA, 25 bp, Mus musculus
gaggaattgctgaggagcctagtac

SEQ ID NO: 107112 - DNA, 25 bp, Mus musculus
gaggaattggagtcaccgtgctgtc

SEQ ID NO: 107113 - DNA, 25 bp, Mus musculus
gaggaattgttggaatgcccggaca

SEQ ID NO: 107114 - DNA, 25 bp, Mus musculus
gaggaatttagacccgacttgatag

SEQ ID NO: 107115 - DNA, 25 bp, Mus musculus
gaggacaaagttgaagatgatgcta

SEQ ID NO: 107116 - DNA, 25 bp, Mus musculus
gaggacaacaagtactgcgccgact

SEQ ID NO: 107117 - DNA, 25 bp, Mus musculus
gaggacaacaccttcaaagacaggc

SEQ ID NO: 107118 - DNA, 25 bp, Mus musculus
gaggacaagcagatgaccctggaga

SEQ ID NO: 107119 - DNA, 25 bp, Mus musculus
gaggacacagccttttcacctgtga

SEQ ID NO: 107120 - DNA, 25 bp, Mus musculus
gaggacacccttgcttctgtagaag

SEQ ID NO: 107121 - DNA, 25 bp, Mus musculus
gaggacaccgagttctttgagaaga

SEQ ID NO: 107122 - DNA, 25 bp, Mus musculus
gaggacacgctaacacgcgaactgg

SEQ ID NO: 107123 - DNA, 25 bp, Mus musculus
gaggacactgctccgaaatctccac

SEQ ID NO: 107124 - DNA, 25 bp, Mus musculus
gaggacacttgcaaatctggaccca

SEQ ID NO: 107125 - DNA, 25 bp, Mus musculus
gaggacagcctgtgctaactagggc

SEQ ID NO: 107126 - DNA, 25 bp, Mus musculus
gaggacagcgcactgcagtacatga

SEQ ID NO: 107127 - DNA, 25 bp, Mus musculus
gaggacagctccttcttgcagcttc

SEQ ID NO: 107128 - DNA, 25 bp, Mus musculus
gaggacaggtacagcatcaacttgg

SEQ ID NO: 107129 - DNA, 25 bp, Mus musculus
gaggacataatcaaagacatcgaga

SEQ ID NO: 107130 - DNA, 25 bp, Mus musculus
gaggacatacctgtgcgaacagtgg

SEQ ID NO: 107131 - DNA, 25 bp, Mus musculus
gaggacatagaagcaggccccttgt

SEQ ID NO: 107132 - DNA, 25 bp, Mus musculus
gaggacatcaatgcttgcacgctga

SEQ ID NO: 107133 - DNA, 25 bp, Mus musculus
gaggacatcacatatcgactgccgg

SEQ ID NO: 107134 - DNA, 25 bp, Mus musculus
gaggacatccatctcagggaactgg

SEQ ID NO: 107135 - DNA, 25 bp, Mus musculus
gaggacatctttgccagtggacgaa

SEQ ID NO: 107136 - DNA, 25 bp, Mus musculus
gaggacattttacagccagagacag

SEQ ID NO: 107137 - DNA, 25 bp, Mus musculus
gaggaccaccccttcgagtatcgga

SEQ ID NO: 107138 - DNA, 25 bp, Mus musculus
gaggaccacctaatgagcgccatga

SEQ ID NO: 107139 - DNA, 25 bp, Mus musculus
gaggaccagaaaaaccaacgtgatc

SEQ ID NO: 107140 - DNA, 25 bp, Mus musculus
gaggaccagcttcttccggtgcagt

SEQ ID NO: 107141 - DNA, 25 bp, Mus musculus
gaggaccagttatcctcactgggaa

SEQ ID NO: 107142 - DNA, 25 bp, Mus musculus
gaggaccagttccacatcagtgtca

SEQ ID NO: 107143 - DNA, 25 bp, Mus musculus
gaggaccatgggagtgatgttcaca

SEQ ID NO: 107144 - DNA, 25 bp, Mus musculus
gaggaccctttgcttttaccagatg

SEQ ID NO: 107145 - DNA, 25 bp, Mus musculus
gaggaccgactccatctatgaggca

SEQ ID NO: 107146 - DNA, 25 bp, Mus musculus
gaggaccgaggtctaacttcagcag

SEQ ID NO: 107147 - DNA, 25 bp, Mus musculus
gaggacctcaacaactaccgtgctg

SEQ ID NO: 107148 - DNA, 25 bp, Mus musculus
gaggacctcaccgtcagagtagaaa

SEQ ID NO: 107149 - DNA, 25 bp, Mus musculus
gaggacctccggagacctgtgaaaa

SEQ ID NO: 107150 - DNA, 25 bp, Mus musculus
gaggacctcggcaggaactgtgcaa

SEQ ID NO: 107151 - DNA, 25 bp, Mus musculus
gaggacctgcgcacagaacttatgc

SEQ ID NO: 107152 - DNA, 25 bp, Mus musculus
gaggacctgcgccatagtctgatgc

SEQ ID NO: 107153 - DNA, 25 bp, Mus musculus
gaggacctgttgttgccatcttggg

SEQ ID NO: 107154 - DNA, 25 bp, Mus musculus
gaggacgaccttaaaggaggttgct

SEQ ID NO: 107155 - DNA, 25 bp, Mus musculus
gaggacgatcatcagccgaagccat

SEQ ID NO: 107156 - DNA, 25 bp, Mus musculus
gaggacgcagagcacttttgaccca

SEQ ID NO: 107157 - DNA, 25 bp, Mus musculus
gaggacgcagcttgcatcgcctata

SEQ ID NO: 107158 - DNA, 25 bp, Mus musculus
gaggacgctgcatcaacttgtggca

SEQ ID NO: 107159 - DNA, 25 bp, Mus musculus
gaggacggaaacctagcaccaaagc

SEQ ID NO: 107160 - DNA, 25 bp, Mus musculus
gaggacggactcagacaagttctgg

SEQ ID NO: 107161 - DNA, 25 bp, Mus musculus
gaggacggcattatctacacccagg

SEQ ID NO: 107162 - DNA, 25 bp, Mus musculus
gaggacgggagttcagttcctaaca

SEQ ID NO: 107163 - DNA, 25 bp, Mus musculus
gaggacgggctcgtttaccagctac

SEQ ID NO: 107164 - DNA, 25 bp, Mus musculus
gaggacgtaaccatccacactgtgt

SEQ ID NO: 107165 - DNA, 25 bp, Mus musculus
gaggactacaaccacatccacggtg

SEQ ID NO: 107166 - DNA, 25 bp, Mus musculus
gaggactaccagagccgtcactttg

SEQ ID NO: 107167 - DNA, 25 bp, Mus musculus
gaggactaccagatcgttgagcgcc

SEQ ID NO: 107168 - DNA, 25 bp, Mus musculus
gaggactatccctacggaccagtgg

SEQ ID NO: 107169 - DNA, 25 bp, Mus musculus
gaggactcaaacgacacatgcttct

SEQ ID NO: 107170 - DNA, 25 bp, Mus musculus
gaggactcagagaccgacattgtgc

SEQ ID NO: 107171 - DNA, 25 bp, Mus musculus
gaggactccatctatagaaccactc

SEQ ID NO: 107172 - DNA, 25 bp, Mus musculus
gaggactccccaactattgaggctg

SEQ ID NO: 107173 - DNA, 25 bp, Mus musculus
gaggactcggagacatatttctacc

SEQ ID NO: 107174 - DNA, 25 bp, Mus musculus
gaggactctccaagttaggcacaga

SEQ ID NO: 107175 - DNA, 25 bp, Mus musculus
gaggactctcggaagaccaggaagt

SEQ ID NO: 107176 - DNA, 25 bp, Mus musculus
gaggactctgcgaccatcagtgtgt

SEQ ID NO: 107177 - DNA, 25 bp, Mus musculus
gaggactctttatctctcggtggat

SEQ ID NO: 107178 - DNA, 25 bp, Mus musculus
gaggactggatctgctgtgcctgcc

SEQ ID NO: 107179 - DNA, 25 bp, Mus musculus
gaggactggcatgaactcgcactag

SEQ ID NO: 107180 - DNA, 25 bp, Mus musculus
gaggactggctctacatgggctgca

SEQ ID NO: 107181 - DNA, 25 bp, Mus musculus
gaggactgggagaaaatccaagcac

SEQ ID NO: 107182 - DNA, 25 bp, Mus musculus
gaggacttcaaactgggcaccatta

SEQ ID NO: 107183 - DNA, 25 bp, Mus musculus
gaggacttcagggatgggctcaaac

SEQ ID NO: 107184 - DNA, 25 bp, Mus musculus
gaggacttccggctacactttagga

SEQ ID NO: 107185 - DNA, 25 bp, Mus musculus
gaggacttcttctgtgagcccagca

SEQ ID NO: 107186 - DNA, 25 bp, Mus musculus
gaggactttcagaccaccgaactta

SEQ ID NO: 107187 - DNA, 25 bp, Mus musculus
gaggactttcagcagggcgcttacc

SEQ ID NO: 107188 - DNA, 25 bp, Mus musculus
gaggactttgtacccttcacaggag

SEQ ID NO: 107189 - DNA, 25 bp, Mus musculus
gaggagaaaaaacaccagtttcagg

SEQ ID NO: 107190 - DNA, 25 bp, Mus musculus
gaggagaaagactacacagtggccc

SEQ ID NO: 107191 - DNA, 25 bp, Mus musculus
gaggagaaatctcatcccaggcaga

SEQ ID NO: 107192 - DNA, 25 bp, Mus musculus
gaggagaacggctacaacacatacg

SEQ ID NO: 107193 - DNA, 25 bp, Mus musculus
gaggagaattagtccgagtggagcg

SEQ ID NO: 107194 - DNA, 25 bp, Mus musculus
gaggagaatttcctgcccctccagg

SEQ ID NO: 107195 - DNA, 25 bp, Mus musculus
gaggagacaaacacgactctgaagc

SEQ ID NO: 107196 - DNA, 25 bp, Mus musculus
gaggagacaaccaatagacccagga

SEQ ID NO: 107197 - DNA, 25 bp, Mus musculus
gaggagaccaaaggccgttactgca

SEQ ID NO: 107198 - DNA, 25 bp, Mus musculus
gaggagaccgtccagcttctcagag

SEQ ID NO: 107199 - DNA, 25 bp, Mus musculus
gaggagacggcaacaaatcagcagc

SEQ ID NO: 107200 - DNA, 25 bp, Mus musculus
gaggagacgttcatcgacaacctga

SEQ ID NO: 107201 - DNA, 25 bp, Mus musculus
gaggagagaaggtcatcttgctgtc

SEQ ID NO: 107202 - DNA, 25 bp, Mus musculus
gaggagagcccactgaggatcaaaa

SEQ ID NO: 107203 - DNA, 25 bp, Mus musculus
gaggagagcggctcagacctcgcta

SEQ ID NO: 107204 - DNA, 25 bp, Mus musculus
gaggagagtccccatgttcttccca

SEQ ID NO: 107205 - DNA, 25 bp, Mus musculus
gaggagagtgagaggatccagctca

SEQ ID NO: 107206 - DNA, 25 bp, Mus musculus
gaggagatataagagcgtaactggc

SEQ ID NO: 107207 - DNA, 25 bp, Mus musculus
gaggagatcatgacttacatcgagc

SEQ ID NO: 107208 - DNA, 25 bp, Mus musculus
gaggagatccgtcgaatcaaccaga

SEQ ID NO: 107209 - DNA, 25 bp, Mus musculus
gaggagatgatttgccgcaggactt

SEQ ID NO: 107210 - DNA, 25 bp, Mus musculus
gaggagattttcacaacgaacacca

SEQ ID NO: 107211 - DNA, 25 bp, Mus musculus
gaggagcaaagtcaatccgagcccc

SEQ ID NO: 107212 - DNA, 25 bp, Mus musculus
gaggagcaagccaggctcaagatga

SEQ ID NO: 107213 - DNA, 25 bp, Mus musculus
gaggagcaaggactcactgagccac

SEQ ID NO: 107214 - DNA, 25 bp, Mus musculus
gaggagcagctgaccttggtaagac

SEQ ID NO: 107215 - DNA, 25 bp, Mus musculus
gaggagcatcattattctgcagcct

SEQ ID NO: 107216 - DNA, 25 bp, Mus musculus
gaggagccaaaacacttcagctcag

SEQ ID NO: 107217 - DNA, 25 bp, Mus musculus
gaggagccaatccagcagcttgtgc

SEQ ID NO: 107218 - DNA, 25 bp, Mus musculus
gaggagccagctgtctcagccatgg

SEQ ID NO: 107219 - DNA, 25 bp, Mus musculus
gaggagcccgtatggatttcacaca

SEQ ID NO: 107220 - DNA, 25 bp, Mus musculus
gaggagccctgccatcaaaaagagt

SEQ ID NO: 107221 - DNA, 25 bp, Mus musculus
gaggagccgtccatatgctgagaca

SEQ ID NO: 107222 - DNA, 25 bp, Mus musculus
gaggagccgtgtttaatgatgacaa

SEQ ID NO: 107223 - DNA, 25 bp, Mus musculus
gaggagcctcctgtcttaccaggga

SEQ ID NO: 107224 - DNA, 25 bp, Mus musculus
gaggagcctccttttgacagcatca

SEQ ID NO: 107225 - DNA, 25 bp, Mus musculus
gaggagcctgtggagacaacattca

SEQ ID NO: 107226 - DNA, 25 bp, Mus musculus
gaggagcgcgccatggcggtgtccg

SEQ ID NO: 107227 - DNA, 25 bp, Mus musculus
gaggagcggctagtcatctcacatg

SEQ ID NO: 107228 - DNA, 25 bp, Mus musculus
gaggagcgtaccatgatcgatccca

SEQ ID NO: 107229 - DNA, 25 bp, Mus musculus
gaggagcgtactctttggcaaagcc

SEQ ID NO: 107230 - DNA, 25 bp, Mus musculus
gaggagcgtgtcatcaacgaagagt

SEQ ID NO: 107231 - DNA, 25 bp, Mus musculus
gaggagctactttccagagccggca

SEQ ID NO: 107232 - DNA, 25 bp, Mus musculus
gaggagctcagcaaactgcggcgct

SEQ ID NO: 107233 - DNA, 25 bp, Mus musculus
gaggagctcccgacagtagcctcaa

SEQ ID NO: 107234 - DNA, 25 bp, Mus musculus
gaggagctccctgcagtgtacacag

SEQ ID NO: 107235 - DNA, 25 bp, Mus musculus
gaggagctccgaacatctctgagga

SEQ ID NO: 107236 - DNA, 25 bp, Mus musculus
gaggagctcctgctgaatggcaaaa

SEQ ID NO: 107237 - DNA, 25 bp, Mus musculus
gaggagctctccaagtgcatgcaag

SEQ ID NO: 107238 - DNA, 25 bp, Mus musculus
gaggagctcttctgtttcctgtgca

SEQ ID NO: 107239 - DNA, 25 bp, Mus musculus
gaggagctgcctgaaacgctttctg

SEQ ID NO: 107240 - DNA, 25 bp, Mus musculus
gaggagctgcgcagactctgcctga

SEQ ID NO: 107241 - DNA, 25 bp, Mus musculus
gaggagctggataacagaagtttag

SEQ ID NO: 107242 - DNA, 25 bp, Mus musculus
gaggagcttattttctgaccaaggc

SEQ ID NO: 107243 - DNA, 25 bp, Mus musculus
gaggaggacactgctccgaaatctc

SEQ ID NO: 107244 - DNA, 25 bp, Mus musculus
gaggaggacccttaccacaagaaga

SEQ ID NO: 107245 - DNA, 25 bp, Mus musculus
gaggaggagaccaacatgatccctg

SEQ ID NO: 107246 - DNA, 25 bp, Mus musculus
gaggaggagatcctgcatagctccc

SEQ ID NO: 107247 - DNA, 25 bp, Mus musculus
gaggaggagatttaggcccagaccc

SEQ ID NO: 107248 - DNA, 25 bp, Mus musculus
gaggaggaggccatcaagcgctctc

SEQ ID NO: 107249 - DNA, 25 bp, Mus musculus
gaggaggattgctttgctcatcctg

SEQ ID NO: 107250 - DNA, 25 bp, Mus musculus
gaggaggcaagcattacagaccagc

SEQ ID NO: 107251 - DNA, 25 bp, Mus musculus
gaggaggcagatccccctctacata

SEQ ID NO: 107252 - DNA, 25 bp, Mus musculus
gaggaggcatgtgtctacaaccata

SEQ ID NO: 107253 - DNA, 25 bp, Mus musculus
gaggaggccctcaaggaattcagca

SEQ ID NO: 107254 - DNA, 25 bp, Mus musculus
gaggaggctgtgaggagcgacaaga

SEQ ID NO: 107255 - DNA, 25 bp, Mus musculus
gaggaggcttcaggttcagacacca

SEQ ID NO: 107256 - DNA, 25 bp, Mus musculus
gaggagggcactggaacactgatcc

SEQ ID NO: 107257 - DNA, 25 bp, Mus musculus
gaggaggtccctctgttgaccccga

SEQ ID NO: 107258 - DNA, 25 bp, Mus musculus
gaggagtactgcaggtcggctaata

SEQ ID NO: 107259 - DNA, 25 bp, Mus musculus
gaggagtcaaaaagccgatgcccgt

SEQ ID NO: 107260 - DNA, 25 bp, Mus musculus
gaggagtccatggtgcagaacttag

SEQ ID NO: 107261 - DNA, 25 bp, Mus musculus
gaggagtcccagcttgtcttctatg

SEQ ID NO: 107262 - DNA, 25 bp, Mus musculus
gaggagtcctcaaagcagttacaca

SEQ ID NO: 107263 - DNA, 25 bp, Mus musculus
gaggagtcctgagaaagtcattagt

SEQ ID NO: 107264 - DNA, 25 bp, Mus musculus
gaggagtcggcggccatcttgttct

SEQ ID NO: 107265 - DNA, 25 bp, Mus musculus
gaggagtctagtgaaatggaacaga

SEQ ID NO: 107266 - DNA, 25 bp, Mus musculus
gaggagtctctttatcagaagaaaa

SEQ ID NO: 107267 - DNA, 25 bp, Mus musculus
gaggagtgccaataccagttccgga

SEQ ID NO: 107268 - DNA, 25 bp, Mus musculus
gaggagtgcccagccctcaccgaca

SEQ ID NO: 107269 - DNA, 25 bp, Mus musculus
gaggagtgggtaccgaaaggtgaca

SEQ ID NO: 107270 - DNA, 25 bp, Mus musculus
gaggagttcgccttcgcagtgcgct

SEQ ID NO: 107271 - DNA, 25 bp, Mus musculus
gaggagttggcagctctcttcgcgc

SEQ ID NO: 107272 - DNA, 25 bp, Mus musculus
gaggatactacagtgcgggccagta

SEQ ID NO: 107273 - DNA, 25 bp, Mus musculus
gaggatagctcagttcttcgcaaga

SEQ ID NO: 107274 - DNA, 25 bp, Mus musculus
gaggatatcaccttcgagataagca

SEQ ID NO: 107275 - DNA, 25 bp, Mus musculus
gaggatatgatcagaagatgcctgt

SEQ ID NO: 107276 - DNA, 25 bp, Mus musculus
gaggatattcaaatgggtgcctgtg

SEQ ID NO: 107277 - DNA, 25 bp, Mus musculus
gaggatattttcactggcgccgcgg

SEQ ID NO: 107278 - DNA, 25 bp, Mus musculus
gaggatcaatccgaccagcgtgtca

SEQ ID NO: 107279 - DNA, 25 bp, Mus musculus
gaggatcaccattcctgtgcgagac

SEQ ID NO: 107280 - DNA, 25 bp, Mus musculus
gaggatcacctgtaatcaacgctgg

SEQ ID NO: 107281 - DNA, 25 bp, Mus musculus
gaggatcagatcatgcatgcgccat

SEQ ID NO: 107282 - DNA, 25 bp, Mus musculus
gaggatcatgtctacacctggaggg

SEQ ID NO: 107283 - DNA, 25 bp, Mus musculus
gaggatccaggaagccaaagtcttg

SEQ ID NO: 107284 - DNA, 25 bp, Mus musculus
gaggatcccaacttcaagaaaattg

SEQ ID NO: 107285 - DNA, 25 bp, Mus musculus
gaggatcccacacttttctgagctg

SEQ ID NO: 107286 - DNA, 25 bp, Mus musculus
gaggatcccgtcactgtagagtata

SEQ ID NO: 107287 - DNA, 25 bp, Mus musculus
gaggatccctgtgagcgtctactgt

SEQ ID NO: 107288 - DNA, 25 bp, Mus musculus
gaggatccgggcaccccagattgga

SEQ ID NO: 107289 - DNA, 25 bp, Mus musculus
gaggatcggctgatatcaccctaag

SEQ ID NO: 107290 - DNA, 25 bp, Mus musculus
gaggatcgtctgtcactggccaaca

SEQ ID NO: 107291 - DNA, 25 bp, Mus musculus
gaggatctatgaaaccaccgtggag

SEQ ID NO: 107292 - DNA, 25 bp, Mus musculus
gaggatctccaatgccaacgagtca

SEQ ID NO: 107293 - DNA, 25 bp, Mus musculus
gaggatctgacgagctactctcagg

SEQ ID NO: 107294 - DNA, 25 bp, Mus musculus
gaggatctgattactgctgcgacca

SEQ ID NO: 107295 - DNA, 25 bp, Mus musculus
gaggatctgcccatcaagtacgctg

SEQ ID NO: 107296 - DNA, 25 bp, Mus musculus
gaggatctgccgtccaaacttgaag

SEQ ID NO: 107297 - DNA, 25 bp, Mus musculus
gaggatctgcgaactctgtttgcca

SEQ ID NO: 107298 - DNA, 25 bp, Mus musculus
gaggatctgggtgactctctacagc

SEQ ID NO: 107299 - DNA, 25 bp, Mus musculus
gaggatctggtggactcactctccg

SEQ ID NO: 107300 - DNA, 25 bp, Mus musculus
gaggatctgtccaagctggcggtca

SEQ ID NO: 107301 - DNA, 25 bp, Mus musculus
gaggatctttccagagctgtgcaca

SEQ ID NO: 107302 - DNA, 25 bp, Mus musculus
gaggatctttttctatgacgcagag

SEQ ID NO: 107303 - DNA, 25 bp, Mus musculus
gaggatgaacacgtagagctcagag

SEQ ID NO: 107304 - DNA, 25 bp, Mus musculus
gaggatgaggactctctgaaaggat

SEQ ID NO: 107305 - DNA, 25 bp, Mus musculus
gaggatgcagacaaccagcgtaatg

SEQ ID NO: 107306 - DNA, 25 bp, Mus musculus
gaggatgcccaacagctttcagaca

SEQ ID NO: 107307 - DNA, 25 bp, Mus musculus
gaggatggcagcactgtcgctgaca

SEQ ID NO: 107308 - DNA, 25 bp, Mus musculus
gaggatgggactcctggacccatcc

SEQ ID NO: 107309 - DNA, 25 bp, Mus musculus
gaggatgtatactcgcctggagccc

SEQ ID NO: 107310 - DNA, 25 bp, Mus musculus
gaggatgtccaactctaggctgcag

SEQ ID NO: 107311 - DNA, 25 bp, Mus musculus
gaggatgtccggaagatgtttgaac

SEQ ID NO: 107312 - DNA, 25 bp, Mus musculus
gaggatgtggaagatcccgtgtacc

SEQ ID NO: 107313 - DNA, 25 bp, Mus musculus
gaggattcatccactctgccgtagg

SEQ ID NO: 107314 - DNA, 25 bp, Mus musculus
gaggattccaaagagagctacccca

SEQ ID NO: 107315 - DNA, 25 bp, Mus musculus
gaggattgaggaaactgctctcaaa

SEQ ID NO: 107316 - DNA, 25 bp, Mus musculus
gaggatttatgacacgcagctgccc

SEQ ID NO: 107317 - DNA, 25 bp, Mus musculus
gaggatttcatgactcgcctgagcc

SEQ ID NO: 107318 - DNA, 25 bp, Mus musculus
gaggatttccccaagcaaggaccaa

SEQ ID NO: 107319 - DNA, 25 bp, Mus musculus
gaggatttcctcagacacaatgcta

SEQ ID NO: 107320 - DNA, 25 bp, Mus musculus
gaggatttctactatgacgacagga

SEQ ID NO: 107321 - DNA, 25 bp, Mus musculus
gaggcaaaaccaagtggaactctga

SEQ ID NO: 107322 - DNA, 25 bp, Mus musculus
gaggcaaaggccatctcctgaggga

SEQ ID NO: 107323 - DNA, 25 bp, Mus musculus
gaggcaaatctcctcagtgtcactg

SEQ ID NO: 107324 - DNA, 25 bp, Mus musculus
gaggcaacccttgagcgactgaaga

SEQ ID NO: 107325 - DNA, 25 bp, Mus musculus
gaggcaacctgatgatcctctgaca

SEQ ID NO: 107326 - DNA, 25 bp, Mus musculus
gaggcaagactttatcaccaacttc

SEQ ID NO: 107327 - DNA, 25 bp, Mus musculus
gaggcaagatgtgtccccagtctca

SEQ ID NO: 107328 - DNA, 25 bp, Mus musculus
gaggcaagcatggaatctgaagtcc

SEQ ID NO: 107329 - DNA, 25 bp, Mus musculus
gaggcaagcatgtatacccaggtct

SEQ ID NO: 107330 - DNA, 25 bp, Mus musculus
gaggcaagccttgccaagatcaagg

SEQ ID NO: 107331 - DNA, 25 bp, Mus musculus
gaggcaagcgcaaagctgattctga

SEQ ID NO: 107332 - DNA, 25 bp, Mus musculus
gaggcaagtcccattctgcacgaga

SEQ ID NO: 107333 - DNA, 25 bp, Mus musculus
gaggcaatactctggcgtgcacacg

SEQ ID NO: 107334 - DNA, 25 bp, Mus musculus
gaggcaattctgcagaccactggaa

SEQ ID NO: 107335 - DNA, 25 bp, Mus musculus
gaggcacacaccatatggtaaccaa

SEQ ID NO: 107336 - DNA, 25 bp, Mus musculus
gaggcacagaggatctcagcttcac

SEQ ID NO: 107337 - DNA, 25 bp, Mus musculus
gaggcacataagatgctcaccagcg

SEQ ID NO: 107338 - DNA, 25 bp, Mus musculus
gaggcaccatgtaccaaatcccagg

SEQ ID NO: 107339 - DNA, 25 bp, Mus musculus
gaggcacccaatatccaggcttcag

SEQ ID NO: 107340 - DNA, 25 bp, Mus musculus
gaggcacctccgtgtggtaccatgt

SEQ ID NO: 107341 - DNA, 25 bp, Mus musculus
gaggcacctgttatcctaccgagac

SEQ ID NO: 107342 - DNA, 25 bp, Mus musculus
gaggcacctttagagtgcaactgcc

SEQ ID NO: 107343 - DNA, 25 bp, Mus musculus
gaggcacgtctctattcaagaagca

SEQ ID NO: 107344 - DNA, 25 bp, Mus musculus
gaggcactaggtcccatcaagttag

SEQ ID NO: 107345 - DNA, 25 bp, Mus musculus
gaggcactcaatggtctacgagctg

SEQ ID NO: 107346 - DNA, 25 bp, Mus musculus
gaggcacttggaggcaaatcagaat

SEQ ID NO: 107347 - DNA, 25 bp, Mus musculus
gaggcagaaaccataaagcccctga

SEQ ID NO: 107348 - DNA, 25 bp, Mus musculus
gaggcagaactctcctgcagggagt

SEQ ID NO: 107349 - DNA, 25 bp, Mus musculus
gaggcagaataaacctaccccatgt

SEQ ID NO: 107350 - DNA, 25 bp, Mus musculus
gaggcagaccttcatcgtcggaaag

SEQ ID NO: 107351 - DNA, 25 bp, Mus musculus
gaggcagatgaagccaccctggctc

SEQ ID NO: 107352 - DNA, 25 bp, Mus musculus
gaggcagcagctaatcgaagttgaa

SEQ ID NO: 107353 - DNA, 25 bp, Mus musculus
gaggcagccccatcgaaaagtacat

SEQ ID NO: 107354 - DNA, 25 bp, Mus musculus
gaggcagccttggaaccatcaatgg

SEQ ID NO: 107355 - DNA, 25 bp, Mus musculus
gaggcagcgcctgcgacgacgacga

SEQ ID NO: 107356 - DNA, 25 bp, Mus musculus
gaggcagcgccttccagaaacagtt

SEQ ID NO: 107357 - DNA, 25 bp, Mus musculus
gaggcagctaagtacgttcatggca

SEQ ID NO: 107358 - DNA, 25 bp, Mus musculus
gaggcagctcctcatgatattggcc

SEQ ID NO: 107359 - DNA, 25 bp, Mus musculus
gaggcagctgtgtcggcttcagaca

SEQ ID NO: 107360 - DNA, 25 bp, Mus musculus
gaggcaggaagctaacgttttccag

SEQ ID NO: 107361 - DNA, 25 bp, Mus musculus
gaggcaggaccggacttccagataa

SEQ ID NO: 107362 - DNA, 25 bp, Mus musculus
gaggcaggattgaccacggacatca

SEQ ID NO: 107363 - DNA, 25 bp, Mus musculus
gaggcaggccacgtctttgaggatt

SEQ ID NO: 107364 - DNA, 25 bp, Mus musculus
gaggcaggctactcacctgtggtca

SEQ ID NO: 107365 - DNA, 25 bp, Mus musculus
gaggcagtaagaaaggttcaataga

SEQ ID NO: 107366 - DNA, 25 bp, Mus musculus
gaggcagtccatccaagaaaaacag

SEQ ID NO: 107367 - DNA, 25 bp, Mus musculus
gaggcagtggcttggataaatacag

SEQ ID NO: 107368 - DNA, 25 bp, Mus musculus
gaggcagtgttctttcagtcacaca

SEQ ID NO: 107369 - DNA, 25 bp, Mus musculus
gaggcatagctcaaccactaggata

SEQ ID NO: 107370 - DNA, 25 bp, Mus musculus
gaggcatatcaagcttcctgcagag

SEQ ID NO: 107371 - DNA, 25 bp, Mus musculus
gaggcatcaatctcctgacagcggg

SEQ ID NO: 107372 - DNA, 25 bp, Mus musculus
gaggcatcagagtctaccacggatg

SEQ ID NO: 107373 - DNA, 25 bp, Mus musculus
gaggcatcctctagctgcaaaggca

SEQ ID NO: 107374 - DNA, 25 bp, Mus musculus
gaggcatcgtcagtcaggtcaaagt

SEQ ID NO: 107375 - DNA, 25 bp, Mus musculus
gaggcatctgctggaaaacattcta

SEQ ID NO: 107376 - DNA, 25 bp, Mus musculus
gaggcatgacgtatgacgcactcca

SEQ ID NO: 107377 - DNA, 25 bp, Mus musculus
gaggcatggaaagccctcggtgact

SEQ ID NO: 107378 - DNA, 25 bp, Mus musculus
gaggcatggctggtgtgtcctcgga

SEQ ID NO: 107379 - DNA, 25 bp, Mus musculus
gaggcattacgagagtcccaaggga

SEQ ID NO: 107380 - DNA, 25 bp, Mus musculus
gaggcattatgacaccaccaaagag

SEQ ID NO: 107381 - DNA, 25 bp, Mus musculus
gaggccaagcggattcctgaagaca

SEQ ID NO: 107382 - DNA, 25 bp, Mus musculus
gaggccaagggcttagaccgaatta

SEQ ID NO: 107383 - DNA, 25 bp, Mus musculus
gaggccaaggtgcaacagctcatga

SEQ ID NO: 107384 - DNA, 25 bp, Mus musculus
gaggccaataaagagcgccagcgac

SEQ ID NO: 107385 - DNA, 25 bp, Mus musculus
gaggccacagacattcagcaggtgc

SEQ ID NO: 107386 - DNA, 25 bp, Mus musculus
gaggccacagcggtcaacacattat

SEQ ID NO: 107387 - DNA, 25 bp, Mus musculus
gaggccaccagatcgttcaaaaatg

SEQ ID NO: 107388 - DNA, 25 bp, Mus musculus
gaggccaccattagagaggacccag

SEQ ID NO: 107389 - DNA, 25 bp, Mus musculus
gaggccaccctgtaactgtgactga

SEQ ID NO: 107390 - DNA, 25 bp, Mus musculus
gaggccagccatgcaagaacaagag

SEQ ID NO: 107391 - DNA, 25 bp, Mus musculus
gaggccaggatccagaagctactcg

SEQ ID NO: 107392 - DNA, 25 bp, Mus musculus
gaggccagggctatagctcaggacc

SEQ ID NO: 107393 - DNA, 25 bp, Mus musculus
gaggccagtaccctgtccatttggg

SEQ ID NO: 107394 - DNA, 25 bp, Mus musculus
gaggccatcaaatacttccgggaga

SEQ ID NO: 107395 - DNA, 25 bp, Mus musculus
gaggccatcactctcaccatctggg

SEQ ID NO: 107396 - DNA, 25 bp, Mus musculus
gaggccatcccaatcctgagggctg

SEQ ID NO: 107397 - DNA, 25 bp, Mus musculus
gaggccatctcaccactcaagaatg

SEQ ID NO: 107398 - DNA, 25 bp, Mus musculus
gaggccatgcagaagtacttcagtg

SEQ ID NO: 107399 - DNA, 25 bp, Mus musculus
gaggccatggctctgaagtccacta

SEQ ID NO: 107400 - DNA, 25 bp, Mus musculus
gaggccattagtgaggaacttccct

SEQ ID NO: 107401 - DNA, 25 bp, Mus musculus
gaggcccaacaatcaagatctctgg

SEQ ID NO: 107402 - DNA, 25 bp, Mus musculus
gaggcccaatcctcttggacaatgt

SEQ ID NO: 107403 - DNA, 25 bp, Mus musculus
gaggccccgcgcagtgctgccaacg

SEQ ID NO: 107404 - DNA, 25 bp, Mus musculus
gaggccccggattctactgaagcag

SEQ ID NO: 107405 - DNA, 25 bp, Mus musculus
gaggccccgtgggtgcgtgtgctgc

SEQ ID NO: 107406 - DNA, 25 bp, Mus musculus
gaggcccctccatcaaggacaagta

SEQ ID NO: 107407 - DNA, 25 bp, Mus musculus
gaggcccctgaacacttggaagatt

SEQ ID NO: 107408 - DNA, 25 bp, Mus musculus
gaggcccgcatctgccgcttgttga

SEQ ID NO: 107409 - DNA, 25 bp, Mus musculus
gaggcccggcctgttgtttgtgaaa

SEQ ID NO: 107410 - DNA, 25 bp, Mus musculus
gaggccctctcactcctgagtctag

SEQ ID NO: 107411 - DNA, 25 bp, Mus musculus
gaggccctgcttcgaaaattcatgg

SEQ ID NO: 107412 - DNA, 25 bp, Mus musculus
gaggccctgcttgtgtttaatccca

SEQ ID NO: 107413 - DNA, 25 bp, Mus musculus
gaggccgaggcccagttctatgaac

SEQ ID NO: 107414 - DNA, 25 bp, Mus musculus
gaggccgcaggatgatatccgcctg

SEQ ID NO: 107415 - DNA, 25 bp, Mus musculus
gaggccgcccattacttcacagagg

SEQ ID NO: 107416 - DNA, 25 bp, Mus musculus
gaggccgcctggagatcgccagctt

SEQ ID NO: 107417 - DNA, 25 bp, Mus musculus
gaggccggatgattcttctagttgt

SEQ ID NO: 107418 - DNA, 25 bp, Mus musculus
gaggccgggtcctccctgtcgacta

SEQ ID NO: 107419 - DNA, 25 bp, Mus musculus
gaggccgtcactactctgaaaacaa

SEQ ID NO: 107420 - DNA, 25 bp, Mus musculus
gaggccgtgacctcccagctttaca

SEQ ID NO: 107421 - DNA, 25 bp, Mus musculus
gaggccgttcattctttgggagtaa

SEQ ID NO: 107422 - DNA, 25 bp, Mus musculus
gaggcctacctaccgaagaagaatg

SEQ ID NO: 107423 - DNA, 25 bp, Mus musculus
gaggcctatgtgacccctaaggatg

SEQ ID NO: 107424 - DNA, 25 bp, Mus musculus
gaggcctccatgtcccatgtggaca

SEQ ID NO: 107425 - DNA, 25 bp, Mus musculus
gaggcctctccattaagaaggatga

SEQ ID NO: 107426 - DNA, 25 bp, Mus musculus
gaggcctcttcgctgtattctatga

SEQ ID NO: 107427 - DNA, 25 bp, Mus musculus
gaggcctgcagtgccctggagttct

SEQ ID NO: 107428 - DNA, 25 bp, Mus musculus
gaggcctgcctactacagttcaatg

SEQ ID NO: 107429 - DNA, 25 bp, Mus musculus
gaggcctgcggccacacttgcttat

SEQ ID NO: 107430 - DNA, 25 bp, Mus musculus
gaggcctgtgtctcggctctgctca

SEQ ID NO: 107431 - DNA, 25 bp, Mus musculus
gaggccttacctatgcagcgactgt

SEQ ID NO: 107432 - DNA, 25 bp, Mus musculus
gaggccttccgtaattcagcacaga

SEQ ID NO: 107433 - DNA, 25 bp, Mus musculus
gaggccttctactgccgtttgaaag

SEQ ID NO: 107434 - DNA, 25 bp, Mus musculus
gaggccttctcggatgctgatgcta

SEQ ID NO: 107435 - DNA, 25 bp, Mus musculus
gaggccttctctccgcgactcgtcg

SEQ ID NO: 107436 - DNA, 25 bp, Mus musculus
gaggccttgcttcgatgtagtgaca

SEQ ID NO: 107437 - DNA, 25 bp, Mus musculus
gaggccttggacaggatcgtccatc

SEQ ID NO: 107438 - DNA, 25 bp, Mus musculus
gaggccttgtgtttagaaaaccaga

SEQ ID NO: 107439 - DNA, 25 bp, Mus musculus
gaggcctttattccagatgacagca

SEQ ID NO: 107440 - DNA, 25 bp, Mus musculus
gaggcctttcccctagagttcaaga

SEQ ID NO: 107441 - DNA, 25 bp, Mus musculus
gaggcctttcgtctccctgttgtga

SEQ ID NO: 107442 - DNA, 25 bp, Mus musculus
gaggcgacttctgaggagctgttca

SEQ ID NO: 107443 - DNA, 25 bp, Mus musculus
gaggcgatttgtcgtctgttatccc

SEQ ID NO: 107444 - DNA, 25 bp, Mus musculus
gaggcgcgcggcacggggagcggcc

SEQ ID NO: 107445 - DNA, 25 bp, Mus musculus
gaggcgctatctcaacgagctgaag

SEQ ID NO: 107446 - DNA, 25 bp, Mus musculus
gaggcgctgcagctctacaatcaga

SEQ ID NO: 107447 - DNA, 25 bp, Mus musculus
gaggcgcttcctcgttatgagccaa

SEQ ID NO: 107448 - DNA, 25 bp, Mus musculus
gaggcggaccctgatcctagagaga

SEQ ID NO: 107449 - DNA, 25 bp, Mus musculus
gaggcggattttctctgtccgccgt

SEQ ID NO: 107450 - DNA, 25 bp, Mus musculus
gaggcggcgctcatccaacagatga

SEQ ID NO: 107451 - DNA, 25 bp, Mus musculus
gaggcggctggttgcactacttacg

SEQ ID NO: 107452 - DNA, 25 bp, Mus musculus
gaggcggcttcgatctggcttttca

SEQ ID NO: 107453 - DNA, 25 bp, Mus musculus
gaggcgggaccctgagcttccctcg

SEQ ID NO: 107454 - DNA, 25 bp, Mus musculus
gaggcggtcaacagccaacaatgta

SEQ ID NO: 107455 - DNA, 25 bp, Mus musculus
gaggcggttcaatattaagctagga

SEQ ID NO: 107456 - DNA, 25 bp, Mus musculus
gaggcgtcggaaacacactcaggtg

SEQ ID NO: 107457 - DNA, 25 bp, Mus musculus
gaggcgtgatcctaggtgtagctct

SEQ ID NO: 107458 - DNA, 25 bp, Mus musculus
gaggcgtgatgctcccaaagtcggt

SEQ ID NO: 107459 - DNA, 25 bp, Mus musculus
gaggctaagtcaccatccctgctga

SEQ ID NO: 107460 - DNA, 25 bp, Mus musculus
gaggctacagctatggcacaggcac

SEQ ID NO: 107461 - DNA, 25 bp, Mus musculus
gaggctaccaggaaagcagtctcct

SEQ ID NO: 107462 - DNA, 25 bp, Mus musculus
gaggctaccctgatgagagcgagac

SEQ ID NO: 107463 - DNA, 25 bp, Mus musculus
gaggctagagtccagtttcacccat

SEQ ID NO: 107464 - DNA, 25 bp, Mus musculus
gaggctagctcagtgcttgcatcct

SEQ ID NO: 107465 - DNA, 25 bp, Mus musculus
gaggctaggaagctctaagcaaccc

SEQ ID NO: 107466 - DNA, 25 bp, Mus musculus
gaggctatacgtccaagattgcagg

SEQ ID NO: 107467 - DNA, 25 bp, Mus musculus
gaggctatccttgacaatgacttca

SEQ ID NO: 107468 - DNA, 25 bp, Mus musculus
gaggctatgagtatcccagggacac

SEQ ID NO: 107469 - DNA, 25 bp, Mus musculus
gaggctattcagtaacctgaaggac

SEQ ID NO: 107470 - DNA, 25 bp, Mus musculus
gaggctattctacatgggccataaa

SEQ ID NO: 107471 - DNA, 25 bp, Mus musculus
gaggctcaagcactccaggaagcca

SEQ ID NO: 107472 - DNA, 25 bp, Mus musculus
gaggctcaaggaacactaggctgct

SEQ ID NO: 107473 - DNA, 25 bp, Mus musculus
gaggctcaatccagaccagtgtgaa

SEQ ID NO: 107474 - DNA, 25 bp, Mus musculus
gaggctcacgcactgactattaggc

SEQ ID NO: 107475 - DNA, 25 bp, Mus musculus
gaggctcagagcgtacctaagtgaa

SEQ ID NO: 107476 - DNA, 25 bp, Mus musculus
gaggctcaggacaatgacttcccca

SEQ ID NO: 107477 - DNA, 25 bp, Mus musculus
gaggctccaatatctcgagtttgcg

SEQ ID NO: 107478 - DNA, 25 bp, Mus musculus
gaggctccagattcaaccacggtta

SEQ ID NO: 107479 - DNA, 25 bp, Mus musculus
gaggctccaggtccaattaacttca

SEQ ID NO: 107480 - DNA, 25 bp, Mus musculus
gaggctcccgagtgttctcctttaa

SEQ ID NO: 107481 - DNA, 25 bp, Mus musculus
gaggctcccttctgctgccagtttg

SEQ ID NO: 107482 - DNA, 25 bp, Mus musculus
gaggctccggagatagaagctccca

SEQ ID NO: 107483 - DNA, 25 bp, Mus musculus
gaggctccgtcttcaaccagttcag

SEQ ID NO: 107484 - DNA, 25 bp, Mus musculus
gaggctccgtgcaacgcatctgtga

SEQ ID NO: 107485 - DNA, 25 bp, Mus musculus
gaggctcctcccatcagaattgcaa

SEQ ID NO: 107486 - DNA, 25 bp, Mus musculus
gaggctcgcaggtcatctttaccaa

SEQ ID NO: 107487 - DNA, 25 bp, Mus musculus
gaggctctgcagagacccatgcttc

SEQ ID NO: 107488 - DNA, 25 bp, Mus musculus
gaggctctgctctatgcgcttgtgc

SEQ ID NO: 107489 - DNA, 25 bp, Mus musculus
gaggctctgcttaccctgtcagaag

SEQ ID NO: 107490 - DNA, 25 bp, Mus musculus
gaggctcttctcaactccaaggaag

SEQ ID NO: 107491 - DNA, 25 bp, Mus musculus
gaggctcttgccagtaataacccac

SEQ ID NO: 107492 - DNA, 25 bp, Mus musculus
gaggctcttgctgatgacctagaag

SEQ ID NO: 107493 - DNA, 25 bp, Mus musculus
gaggctctttcacacctggtataaa

SEQ ID NO: 107494 - DNA, 25 bp, Mus musculus
gaggctgagagtattgtcgtccaca

SEQ ID NO: 107495 - DNA, 25 bp, Mus musculus
gaggctgagcaatgtccgtgtagaa

SEQ ID NO: 107496 - DNA, 25 bp, Mus musculus
gaggctgagggaaccgagcatttca

SEQ ID NO: 107497 - DNA, 25 bp, Mus musculus
gaggctgatctttcaccttcgctga

SEQ ID NO: 107498 - DNA, 25 bp, Mus musculus
gaggctgccattagctgccttcatt

SEQ ID NO: 107499 - DNA, 25 bp, Mus musculus
gaggctgccgattcactcgtgtgca

SEQ ID NO: 107500 - DNA, 25 bp, Mus musculus
gaggctgcggcttgcgcttctcctg

SEQ ID NO: 107501 - DNA, 25 bp, Mus musculus
gaggctgcgggttgagcattcaccc

SEQ ID NO: 107502 - DNA, 25 bp, Mus musculus
gaggctgctccaggcattcttagaa

SEQ ID NO: 107503 - DNA, 25 bp, Mus musculus
gaggctgctgagcttcgacaatgaa

SEQ ID NO: 107504 - DNA, 25 bp, Mus musculus
gaggctggtgctgagctcgccaact

SEQ ID NO: 107505 - DNA, 25 bp, Mus musculus
gaggctgtcctggtccaatatgtgg

SEQ ID NO: 107506 - DNA, 25 bp, Mus musculus
gaggctgtcggtgtcaaacaaccag

SEQ ID NO: 107507 - DNA, 25 bp, Mus musculus
gaggcttaattcctgacacgccaga

SEQ ID NO: 107508 - DNA, 25 bp, Mus musculus
gaggcttactcagacacgtgttcta

SEQ ID NO: 107509 - DNA, 25 bp, Mus musculus
gaggcttcctttcgaccatgttggg

SEQ ID NO: 107510 - DNA, 25 bp, Mus musculus
gaggcttcgccgtcgccgaggcctt

SEQ ID NO: 107511 - DNA, 25 bp, Mus musculus
gaggcttctccgagtacgtgctgtg

SEQ ID NO: 107512 - DNA, 25 bp, Mus musculus
gaggcttgcaaagacatcctgctgt

SEQ ID NO: 107513 - DNA, 25 bp, Mus musculus
gaggcttgccagactaaatcagcag

SEQ ID NO: 107514 - DNA, 25 bp, Mus musculus
gaggcttgtatctccccttgtgcta

SEQ ID NO: 107515 - DNA, 25 bp, Mus musculus
gaggctttaggtactttgagtctga

SEQ ID NO: 107516 - DNA, 25 bp, Mus musculus
gaggctttcacgctttgacaacgac

SEQ ID NO: 107517 - DNA, 25 bp, Mus musculus
gaggcttttaacgtcccagtgttct

SEQ ID NO: 107518 - DNA, 25 bp, Mus musculus
gaggcttttctgtatgtgggcacca

SEQ ID NO: 107519 - DNA, 25 bp, Mus musculus
gagggaaaaactacgaggcctccat

SEQ ID NO: 107520 - DNA, 25 bp, Mus musculus
gagggaaatctagtcagtctgccgc

SEQ ID NO: 107521 - DNA, 25 bp, Mus musculus
gagggaacagcatccccagaaagtg

SEQ ID NO: 107522 - DNA, 25 bp, Mus musculus
gagggaacccaaactcccagctaag

SEQ ID NO: 107523 - DNA, 25 bp, Mus musculus
gagggaacggtacgccaataaatgt

SEQ ID NO: 107524 - DNA, 25 bp, Mus musculus
gagggaagtcctcatctctgcagcc

SEQ ID NO: 107525 - DNA, 25 bp, Mus musculus
gagggaatcccatggctgtcgtcag

SEQ ID NO: 107526 - DNA, 25 bp, Mus musculus
gagggacagacagaggcctcactct

SEQ ID NO: 107527 - DNA, 25 bp, Mus musculus
gagggacagccccaatgttgaagct

SEQ ID NO: 107528 - DNA, 25 bp, Mus musculus
gagggacagcgctgaagactctagc

SEQ ID NO: 107529 - DNA, 25 bp, Mus musculus
gagggaccaaccatgcactgcaatg

SEQ ID NO: 107530 - DNA, 25 bp, Mus musculus
gagggaccaattccttctagccgac

SEQ ID NO: 107531 - DNA, 25 bp, Mus musculus
gagggaccacgctgttcttttacac

SEQ ID NO: 107532 - DNA, 25 bp, Mus musculus
gagggacctcagtgccaatttgggc

SEQ ID NO: 107533 - DNA, 25 bp, Mus musculus
gagggacgagacacggcttttcctg

SEQ ID NO: 107534 - DNA, 25 bp, Mus musculus
gagggacgcgctgacatcatgatcg

SEQ ID NO: 107535 - DNA, 25 bp, Mus musculus
gagggacggcgagcacgaataaata

SEQ ID NO: 107536 - DNA, 25 bp, Mus musculus
gagggactcactctacaaagagaac

SEQ ID NO: 107537 - DNA, 25 bp, Mus musculus
gagggactccctaggaacagaggca

SEQ ID NO: 107538 - DNA, 25 bp, Mus musculus
gagggactcgtcaggcgacctgcaa

SEQ ID NO: 107539 - DNA, 25 bp, Mus musculus
gagggacttgtaatctgctgcagcc

SEQ ID NO: 107540 - DNA, 25 bp, Mus musculus
gagggagacacatgaggcacttgcc

SEQ ID NO: 107541 - DNA, 25 bp, Mus musculus
gagggagagctactcacaggtcacc

SEQ ID NO: 107542 - DNA, 25 bp, Mus musculus
gagggagatcctcgctacatggccc

SEQ ID NO: 107543 - DNA, 25 bp, Mus musculus
gagggagcatcagttctacgagacc

SEQ ID NO: 107544 - DNA, 25 bp, Mus musculus
gagggagccgcttcttagcctgtcc

SEQ ID NO: 107545 - DNA, 25 bp, Mus musculus
gagggaggccatcttaacccagcag

SEQ ID NO: 107546 - DNA, 25 bp, Mus musculus
gagggaggcctcttctcaatagcaa

SEQ ID NO: 107547 - DNA, 25 bp, Mus musculus
gagggagtcccagaaagaaccatgc

SEQ ID NO: 107548 - DNA, 25 bp, Mus musculus
gagggagttcttcgccaacagcata

SEQ ID NO: 107549 - DNA, 25 bp, Mus musculus
gagggatccatgtcgtctcccctgc

SEQ ID NO: 107550 - DNA, 25 bp, Mus musculus
gagggatctgcttgcgcaaattatt

SEQ ID NO: 107551 - DNA, 25 bp, Mus musculus
gagggattctgagctttctggaaca

SEQ ID NO: 107552 - DNA, 25 bp, Mus musculus
gagggatttcaccacagacaggcgt

SEQ ID NO: 107553 - DNA, 25 bp, Mus musculus
gagggcaaccgcttccattaccggc

SEQ ID NO: 107554 - DNA, 25 bp, Mus musculus
gagggcaacctatccacagaaagag

SEQ ID NO: 107555 - DNA, 25 bp, Mus musculus
gagggcaagattttacatggagacc

SEQ ID NO: 107556 - DNA, 25 bp, Mus musculus
gagggcaagggcttccttcagaaga

SEQ ID NO: 107557 - DNA, 25 bp, Mus musculus
gagggcacacgttgcatcacagtaa

SEQ ID NO: 107558 - DNA, 25 bp, Mus musculus
gagggcaccctgaaataccactggg

SEQ ID NO: 107559 - DNA, 25 bp, Mus musculus
gagggcagacagtgccaacagctga

SEQ ID NO: 107560 - DNA, 25 bp, Mus musculus
gagggcagtcgcttccactatggct

SEQ ID NO: 107561 - DNA, 25 bp, Mus musculus
gagggccagcttgttcttagcagta

SEQ ID NO: 107562 - DNA, 25 bp, Mus musculus
gagggccatgccaacatagtagaag

SEQ ID NO: 107563 - DNA, 25 bp, Mus musculus
gagggccatggccacactcgcttgt

SEQ ID NO: 107564 - DNA, 25 bp, Mus musculus
gagggccctgtatgcacaagccttt

SEQ ID NO: 107565 - DNA, 25 bp, Mus musculus
gagggccgatcatggttaacagcaa

SEQ ID NO: 107566 - DNA, 25 bp, Mus musculus
gagggccggcgaggtccggatgtga

SEQ ID NO: 107567 - DNA, 25 bp, Mus musculus
gagggcctgacaagaaccatatgat

SEQ ID NO: 107568 - DNA, 25 bp, Mus musculus
gagggccttgtctaatcatacagcg

SEQ ID NO: 107569 - DNA, 25 bp, Mus musculus
gagggccttttcacatccaagacag

SEQ ID NO: 107570 - DNA, 25 bp, Mus musculus
gagggcgacgaccaaggactttcct

SEQ ID NO: 107571 - DNA, 25 bp, Mus musculus
gagggcgatgtgtaccccaatggcc

SEQ ID NO: 107572 - DNA, 25 bp, Mus musculus
gagggcggccgtgaacatcgaattc

SEQ ID NO: 107573 - DNA, 25 bp, Mus musculus
gagggcgtccctctcgctgttcata

SEQ ID NO: 107574 - DNA, 25 bp, Mus musculus
gagggcgtccgcaatatcaagagca

SEQ ID NO: 107575 - DNA, 25 bp, Mus musculus
gagggcgtctcaaatgctgttcggc

SEQ ID NO: 107576 - DNA, 25 bp, Mus musculus
gagggctacaagctgtctctcgaac

SEQ ID NO: 107577 - DNA, 25 bp, Mus musculus
gagggctagctaaccacaattgggt

SEQ ID NO: 107578 - DNA, 25 bp, Mus musculus
gagggctatttcatggacaatgaag

SEQ ID NO: 107579 - DNA, 25 bp, Mus musculus
gagggctcacctggatcagttcaaa

SEQ ID NO: 107580 - DNA, 25 bp, Mus musculus
gagggctccaaaggtgggaagtgaa

SEQ ID NO: 107581 - DNA, 25 bp, Mus musculus
gagggctcctcgtgtactctacatg

SEQ ID NO: 107582 - DNA, 25 bp, Mus musculus
gagggctcgccacagttcaggcaca

SEQ ID NO: 107583 - DNA, 25 bp, Mus musculus
gagggctgcttctctagtcccgaaa

SEQ ID NO: 107584 - DNA, 25 bp, Mus musculus
gagggcttacaaggacatgaccaca

SEQ ID NO: 107585 - DNA, 25 bp, Mus musculus
gagggcttcccacttctgtgtccga

SEQ ID NO: 107586 - DNA, 25 bp, Mus musculus
gagggcttctaaccaaatgtttttg

SEQ ID NO: 107587 - DNA, 25 bp, Mus musculus
gagggcttctttgccacacttggag

SEQ ID NO: 107588 - DNA, 25 bp, Mus musculus
gagggcttggaggtctcaaaagacc

SEQ ID NO: 107589 - DNA, 25 bp, Mus musculus
gagggctttgttaaatcccagaggg

SEQ ID NO: 107590 - DNA, 25 bp, Mus musculus
gaggggaaatatgatgaataaagac

SEQ ID NO: 107591 - DNA, 25 bp, Mus musculus
gagggtaaccatagcctggactaag

SEQ ID NO: 107592 - DNA, 25 bp, Mus musculus
gagggtaactgcagccttcgtagca

SEQ ID NO: 107593 - DNA, 25 bp, Mus musculus
gagggtactacaggtcatcatccag

SEQ ID NO: 107594 - DNA, 25 bp, Mus musculus
gagggtagagccacaatccgaggat

SEQ ID NO: 107595 - DNA, 25 bp, Mus musculus
gagggtcactgcaaacaacttggag

SEQ ID NO: 107596 - DNA, 25 bp, Mus musculus
gagggtccctgcacaactcagatgt

SEQ ID NO: 107597 - DNA, 25 bp, Mus musculus
gagggtccgctcaccatgggtttca

SEQ ID NO: 107598 - DNA, 25 bp, Mus musculus
gagggtcctgaaaccaagcctgtgt

SEQ ID NO: 107599 - DNA, 25 bp, Mus musculus
gagggtgacaaattccctggaactg

SEQ ID NO: 107600 - DNA, 25 bp, Mus musculus
gagggtgaccctaacgcttcctgtg

SEQ ID NO: 107601 - DNA, 25 bp, Mus musculus
gagggtgcagctcaaaatcatcagc

SEQ ID NO: 107602 - DNA, 25 bp, Mus musculus
gagggtgccaagtccgggcctatat

SEQ ID NO: 107603 - DNA, 25 bp, Mus musculus
gagggtgccaccaactgtgtatgcc

SEQ ID NO: 107604 - DNA, 25 bp, Mus musculus
gagggtgccgtatccaagtctctgt

SEQ ID NO: 107605 - DNA, 25 bp, Mus musculus
gagggtgccttagcgacctcctgga

SEQ ID NO: 107606 - DNA, 25 bp, Mus musculus
gagggtgcgagctgaccaagaaaca

SEQ ID NO: 107607 - DNA, 25 bp, Mus musculus
gagggtggcctgaaatcctttgagc

SEQ ID NO: 107608 - DNA, 25 bp, Mus musculus
gagggttcattcctcaagctgggcc

SEQ ID NO: 107609 - DNA, 25 bp, Mus musculus
gaggtaaaagtcgatggccagtcca

SEQ ID NO: 107610 - DNA, 25 bp, Mus musculus
gaggtaaccccaatgtccactttga

SEQ ID NO: 107611 - DNA, 25 bp, Mus musculus
gaggtaactcagtgcctgccatggt

SEQ ID NO: 107612 - DNA, 25 bp, Mus musculus
gaggtaattcctcacatggctaagg

SEQ ID NO: 107613 - DNA, 25 bp, Mus musculus
gaggtacatggtgatccccaagaga

SEQ ID NO: 107614 - DNA, 25 bp, Mus musculus
gaggtaccacccaatagacatagag

SEQ ID NO: 107615 - DNA, 25 bp, Mus musculus
gaggtaccagactatcacaaagcag

SEQ ID NO: 107616 - DNA, 25 bp, Mus musculus
gaggtacccgagaaagcttgtcaca

SEQ ID NO: 107617 - DNA, 25 bp, Mus musculus
gaggtactaagacatcgaaggcagc

SEQ ID NO: 107618 - DNA, 25 bp, Mus musculus
gaggtactgctgagcctggacgaca

SEQ ID NO: 107619 - DNA, 25 bp, Mus musculus
gaggtacttgaacctgcttcagcca

SEQ ID NO: 107620 - DNA, 25 bp, Mus musculus
gaggtagaccttttgtcacggcaga

SEQ ID NO: 107621 - DNA, 25 bp, Mus musculus
gaggtagcaacttgccccagcccaa

SEQ ID NO: 107622 - DNA, 25 bp, Mus musculus
gaggtagcacaaacgccatactgac

SEQ ID NO: 107623 - DNA, 25 bp, Mus musculus
gaggtagcggtgatgagggcagaga

SEQ ID NO: 107624 - DNA, 25 bp, Mus musculus
gaggtagctctaagataatatccca

SEQ ID NO: 107625 - DNA, 25 bp, Mus musculus
gaggtagtgtacttcagtgctgcca

SEQ ID NO: 107626 - DNA, 25 bp, Mus musculus
gaggtatacatcaccacagccttgg

SEQ ID NO: 107627 - DNA, 25 bp, Mus musculus
gaggtatcagtctctggccatgcca

SEQ ID NO: 107628 - DNA, 25 bp, Mus musculus
gaggtattcacaaagagatactccg

SEQ ID NO: 107629 - DNA, 25 bp, Mus musculus
gaggtatttagccttgcatacggac

SEQ ID NO: 107630 - DNA, 25 bp, Mus musculus
gaggtcaagtcaacgacagggccta

SEQ ID NO: 107631 - DNA, 25 bp, Mus musculus
gaggtcacgctctcagtaatcgaca

SEQ ID NO: 107632 - DNA, 25 bp, Mus musculus
gaggtcagcagggacaccctgagaa

SEQ ID NO: 107633 - DNA, 25 bp, Mus musculus
gaggtcagtgggaggaattcacaac

SEQ ID NO: 107634 - DNA, 25 bp, Mus musculus
gaggtcatcacgctcttcacaggag

SEQ ID NO: 107635 - DNA, 25 bp, Mus musculus
gaggtcatggccactcagacgaaga

SEQ ID NO: 107636 - DNA, 25 bp, Mus musculus
gaggtcattgccatccccatttggt

SEQ ID NO: 107637 - DNA, 25 bp, Mus musculus
gaggtccaacgtgcagaggctgaac

SEQ ID NO: 107638 - DNA, 25 bp, Mus musculus
gaggtccaactccagagtgcagaga

SEQ ID NO: 107639 - DNA, 25 bp, Mus musculus
gaggtccacatgtccacgacaggaa

SEQ ID NO: 107640 - DNA, 25 bp, Mus musculus
gaggtccacttgcttgatgagatcc

SEQ ID NO: 107641 - DNA, 25 bp, Mus musculus
gaggtccactttagggcaggctgca

SEQ ID NO: 107642 - DNA, 25 bp, Mus musculus
gaggtccagccccaagtctgagatt

SEQ ID NO: 107643 - DNA, 25 bp, Mus musculus
gaggtccctcgcctttcagtcctgt

SEQ ID NO: 107644 - DNA, 25 bp, Mus musculus
gaggtccgtgtgcttctcacctgaa

SEQ ID NO: 107645 - DNA, 25 bp, Mus musculus
gaggtcctcaccaaagtcctacagg

SEQ ID NO: 107646 - DNA, 25 bp, Mus musculus
gaggtcctgacccattacaatgtca

SEQ ID NO: 107647 - DNA, 25 bp, Mus musculus
gaggtcctgcgaatgcctgggttcc

SEQ ID NO: 107648 - DNA, 25 bp, Mus musculus
gaggtcctggacttaacttacaaca

SEQ ID NO: 107649 - DNA, 25 bp, Mus musculus
gaggtcctggccagcgaagctattc

SEQ ID NO: 107650 - DNA, 25 bp, Mus musculus
gaggtcctgggatcacactcagagg

SEQ ID NO: 107651 - DNA, 25 bp, Mus musculus
gaggtcgatccattgccattgcccg

SEQ ID NO: 107652 - DNA, 25 bp, Mus musculus
gaggtcgatgctaccgatggcccat

SEQ ID NO: 107653 - DNA, 25 bp, Mus musculus
gaggtcgctgtctatctgtctcccc

SEQ ID NO: 107654 - DNA, 25 bp, Mus musculus
gaggtcgttcaaattctggccagca

SEQ ID NO: 107655 - DNA, 25 bp, Mus musculus
gaggtcgttcctgaccacttgagaa

SEQ ID NO: 107656 - DNA, 25 bp, Mus musculus
gaggtctactgtaacatccctgatg

SEQ ID NO: 107657 - DNA, 25 bp, Mus musculus
gaggtctccgtcgaatgcagcaggt

SEQ ID NO: 107658 - DNA, 25 bp, Mus musculus
gaggtctcgatgtgtcttcctgcga

SEQ ID NO: 107659 - DNA, 25 bp, Mus musculus
gaggtctcggcacattctgtcgcga

SEQ ID NO: 107660 - DNA, 25 bp, Mus musculus
gaggtctcgtgtaagctgtgctgca

SEQ ID NO: 107661 - DNA, 25 bp, Mus musculus
gaggtctgctgcttgaagagctcca

SEQ ID NO: 107662 - DNA, 25 bp, Mus musculus
gaggtcttcatcaaccgcgaccgag

SEQ ID NO: 107663 - DNA, 25 bp, Mus musculus
gaggtcttccctatgctgccacaat

SEQ ID NO: 107664 - DNA, 25 bp, Mus musculus
gaggtcttctcaagccactactgtt

SEQ ID NO: 107665 - DNA, 25 bp, Mus musculus
gaggtgaaacaaaccccattcctga

SEQ ID NO: 107666 - DNA, 25 bp, Mus musculus
gaggtgaagcacttttgtcccaacg

SEQ ID NO: 107667 - DNA, 25 bp, Mus musculus
gaggtgaccttagtgaaccacggct

SEQ ID NO: 107668 - DNA, 25 bp, Mus musculus
gaggtgacgcctgcaaagacgactt

SEQ ID NO: 107669 - DNA, 25 bp, Mus musculus
gaggtgactgcttatagccccttgg

SEQ ID NO: 107670 - DNA, 25 bp, Mus musculus
gaggtgagaagtcagaggccaaggc

SEQ ID NO: 107671 - DNA, 25 bp, Mus musculus
gaggtgagcccctgtgctggatatt

SEQ ID NO: 107672 - DNA, 25 bp, Mus musculus
gaggtgatatccaagcagccctgga

SEQ ID NO: 107673 - DNA, 25 bp, Mus musculus
gaggtgatcacagttcgagttcagg

SEQ ID NO: 107674 - DNA, 25 bp, Mus musculus
gaggtgatcgacttctctcacgggc

SEQ ID NO: 107675 - DNA, 25 bp, Mus musculus
gaggtgcagatcaacaacgaggaca

SEQ ID NO: 107676 - DNA, 25 bp, Mus musculus
gaggtgcagctaaaacacgaacagg

SEQ ID NO: 107677 - DNA, 25 bp, Mus musculus
gaggtgccaacaatgatgaaggtaa

SEQ ID NO: 107678 - DNA, 25 bp, Mus musculus
gaggtgccatcacaaatgcttgaaa

SEQ ID NO: 107679 - DNA, 25 bp, Mus musculus
gaggtgcccctcctgaaaaagtagg

SEQ ID NO: 107680 - DNA, 25 bp, Mus musculus
gaggtgcctaccatctgggatgtca

SEQ ID NO: 107681 - DNA, 25 bp, Mus musculus
gaggtgcgcatccaagactttgtgc

SEQ ID NO: 107682 - DNA, 25 bp, Mus musculus
gaggtgctcaagatgtccacggaag

SEQ ID NO: 107683 - DNA, 25 bp, Mus musculus
gaggtgctcagcagcacaccctgct

SEQ ID NO: 107684 - DNA, 25 bp, Mus musculus
gaggtgctccctacaaaggctcaga

SEQ ID NO: 107685 - DNA, 25 bp, Mus musculus
gaggtgctttcatcgatcagagcca

SEQ ID NO: 107686 - DNA, 25 bp, Mus musculus
gaggtggaaggtagagaccaattcc

SEQ ID NO: 107687 - DNA, 25 bp, Mus musculus
gaggtggacatcacacttccagaga

SEQ ID NO: 107688 - DNA, 25 bp, Mus musculus
gaggtggagctcacacatcgcatgc

SEQ ID NO: 107689 - DNA, 25 bp, Mus musculus
gaggtggatctctatactgccaaag

SEQ ID NO: 107690 - DNA, 25 bp, Mus musculus
gaggtggcaccggatataaaatgtc

SEQ ID NO: 107691 - DNA, 25 bp, Mus musculus
gaggtggccattccaacaaagctat

SEQ ID NO: 107692 - DNA, 25 bp, Mus musculus
gaggtgggcctctcatacttaatga

SEQ ID NO: 107693 - DNA, 25 bp, Mus musculus
gaggtggtacaggtcctcgccgtca

SEQ ID NO: 107694 - DNA, 25 bp, Mus musculus
gaggtggtccaagagcacgtgatcc

SEQ ID NO: 107695 - DNA, 25 bp, Mus musculus
gaggtggtccctgaacgtgaagcca

SEQ ID NO: 107696 - DNA, 25 bp, Mus musculus
gaggtggtggctacactgtccgaaa

SEQ ID NO: 107697 - DNA, 25 bp, Mus musculus
gaggtgtaccttgccacttgcctga

SEQ ID NO: 107698 - DNA, 25 bp, Mus musculus
gaggtgtcccctcctaaagcttgtg

SEQ ID NO: 107699 - DNA, 25 bp, Mus musculus
gaggtgtcgctcaccatcgaccact

SEQ ID NO: 107700 - DNA, 25 bp, Mus musculus
gaggtgtcgggatatcaaactacgc

SEQ ID NO: 107701 - DNA, 25 bp, Mus musculus
gaggtgtgaccagcctacatttcaa

SEQ ID NO: 107702 - DNA, 25 bp, Mus musculus
gaggtgttacccattcacagtgaag

SEQ ID NO: 107703 - DNA, 25 bp, Mus musculus
gaggtgttgaagatctgccgctccc

SEQ ID NO: 107704 - DNA, 25 bp, Mus musculus
gaggttacagagatcctgcgcctgg

SEQ ID NO: 107705 - DNA, 25 bp, Mus musculus
gaggttatccgcctgtccctcttct

SEQ ID NO: 107706 - DNA, 25 bp, Mus musculus
gaggttcaagtacaacggcagcgcc

SEQ ID NO: 107707 - DNA, 25 bp, Mus musculus
gaggttcacgtaggcctacagctca

SEQ ID NO: 107708 - DNA, 25 bp, Mus musculus
gaggttcagaacattaactcccagc

SEQ ID NO: 107709 - DNA, 25 bp, Mus musculus
gaggttcagggaaagacactctcca

SEQ ID NO: 107710 - DNA, 25 bp, Mus musculus
gaggttccacctgaagagatgccca

SEQ ID NO: 107711 - DNA, 25 bp, Mus musculus
gaggttcccactgagagattagaga

SEQ ID NO: 107712 - DNA, 25 bp, Mus musculus
gaggttcctctattctcagttccga

SEQ ID NO: 107713 - DNA, 25 bp, Mus musculus
gaggttcgctactacctgcgccaga

SEQ ID NO: 107714 - DNA, 25 bp, Mus musculus
gaggttcggcgtctgcagaaccact

SEQ ID NO: 107715 - DNA, 25 bp, Mus musculus
gaggttcgggcagtcgcctgtctaa

SEQ ID NO: 107716 - DNA, 25 bp, Mus musculus
gaggttctagaatgccccgtgatgc

SEQ ID NO: 107717 - DNA, 25 bp, Mus musculus
gaggttctgcaaccgtgtcatttgg

SEQ ID NO: 107718 - DNA, 25 bp, Mus musculus
gaggttgaaaatggcctacatgccg

SEQ ID NO: 107719 - DNA, 25 bp, Mus musculus
gaggttgagacattttcgggcccga

SEQ ID NO: 107720 - DNA, 25 bp, Mus musculus
gaggttgagtccgaagaagacccta

SEQ ID NO: 107721 - DNA, 25 bp, Mus musculus
gaggttgcatcctgactcttcagat

SEQ ID NO: 107722 - DNA, 25 bp, Mus musculus
gaggttgcatctgctcgtccggacc

SEQ ID NO: 107723 - DNA, 25 bp, Mus musculus
gaggttgcccacacgcttactgaga

SEQ ID NO: 107724 - DNA, 25 bp, Mus musculus
gaggttgcccctgactttggctgga

SEQ ID NO: 107725 - DNA, 25 bp, Mus musculus
gaggttgtcacagtgccttcgctat

SEQ ID NO: 107726 - DNA, 25 bp, Mus musculus
gaggttgtgccaccagcaatgtacc

SEQ ID NO: 107727 - DNA, 25 bp, Mus musculus
gaggtttcagcccataccgtggagc

SEQ ID NO: 107728 - DNA, 25 bp, Mus musculus
gaggtttcagttcagtctacaggac

SEQ ID NO: 107729 - DNA, 25 bp, Mus musculus
gaggtttcccctcgagagaagcagc

SEQ ID NO: 107730 - DNA, 25 bp, Mus musculus
gaggtttcggcagttccgctaccaa

SEQ ID NO: 107731 - DNA, 25 bp, Mus musculus
gaggttttctataacccggtgcagg

SEQ ID NO: 107732 - DNA, 25 bp, Mus musculus
gagtaaaccagctacgctcagggtc

SEQ ID NO: 107733 - DNA, 25 bp, Mus musculus
gagtaaacgcattccgatctacgag

SEQ ID NO: 107734 - DNA, 25 bp, Mus musculus
gagtaaacgttgcactgagcctgaa

SEQ ID NO: 107735 - DNA, 25 bp, Mus musculus
gagtaaagccctacgctcgaatgga

SEQ ID NO: 107736 - DNA, 25 bp, Mus musculus
gagtaaatacgaagcccagggttca

SEQ ID NO: 107737 - DNA, 25 bp, Mus musculus
gagtaaatgctcaagctgctgcgta

SEQ ID NO: 107738 - DNA, 25 bp, Mus musculus
gagtaacacgacagtgcccaatgcc

SEQ ID NO: 107739 - DNA, 25 bp, Mus musculus
gagtaacatctacatccaggagccg

SEQ ID NO: 107740 - DNA, 25 bp, Mus musculus
gagtaaccgcttcctaaaccatttg

SEQ ID NO: 107741 - DNA, 25 bp, Mus musculus
gagtaactacaatggacgctgagct

SEQ ID NO: 107742 - DNA, 25 bp, Mus musculus
gagtaactagttttgatccctttgg

SEQ ID NO: 107743 - DNA, 25 bp, Mus musculus
gagtaactcagatgtgattcgacaa

SEQ ID NO: 107744 - DNA, 25 bp, Mus musculus
gagtaactcgtcctcatccactggg

SEQ ID NO: 107745 - DNA, 25 bp, Mus musculus
gagtaactgctcttggtggcttcca

SEQ ID NO: 107746 - DNA, 25 bp, Mus musculus
gagtaagactttacgctcaatcaca

SEQ ID NO: 107747 - DNA, 25 bp, Mus musculus
gagtaataagtacccacaggcagtc

SEQ ID NO: 107748 - DNA, 25 bp, Mus musculus
gagtaatatcgccaagctgcagcta

SEQ ID NO: 107749 - DNA, 25 bp, Mus musculus
gagtaatgagctaacccgggcagtg

SEQ ID NO: 107750 - DNA, 25 bp, Mus musculus
gagtaatgcccttgacatgccgagg

SEQ ID NO: 107751 - DNA, 25 bp, Mus musculus
gagtaatgcttgacctcgggaaaca

SEQ ID NO: 107752 - DNA, 25 bp, Mus musculus
gagtaatgtgactgaccaactgtac

SEQ ID NO: 107753 - DNA, 25 bp, Mus musculus
gagtacaaaaacatcagcttcacag

SEQ ID NO: 107754 - DNA, 25 bp, Mus musculus
gagtacaaggaaaagcagggacttc

SEQ ID NO: 107755 - DNA, 25 bp, Mus musculus
gagtacaccgttcaccttccattgg

SEQ ID NO: 107756 - DNA, 25 bp, Mus musculus
gagtacagcaccttcaacttctgga

SEQ ID NO: 107757 - DNA, 25 bp, Mus musculus
gagtacagcccgagttcctacagac

SEQ ID NO: 107758 - DNA, 25 bp, Mus musculus
gagtacaggcttcatggcacaggaa

SEQ ID NO: 107759 - DNA, 25 bp, Mus musculus
gagtacatcctgtccttcgagacca

SEQ ID NO: 107760 - DNA, 25 bp, Mus musculus
gagtacatgaacttatctgtattag

SEQ ID NO: 107761 - DNA, 25 bp, Mus musculus
gagtacatgctccttacagaacgag

SEQ ID NO: 107762 - DNA, 25 bp, Mus musculus
gagtacatgcttaacgccatcccca

SEQ ID NO: 107763 - DNA, 25 bp, Mus musculus
gagtacatggacctggatgagttcc

SEQ ID NO: 107764 - DNA, 25 bp, Mus musculus
gagtacatggccgtgaaatccctgg

SEQ ID NO: 107765 - DNA, 25 bp, Mus musculus
gagtacattccccagcacattggcg

SEQ ID NO: 107766 - DNA, 25 bp, Mus musculus
gagtacattgcctttgaccagcctg

SEQ ID NO: 107767 - DNA, 25 bp, Mus musculus
gagtacccatatctaatctccctgg

SEQ ID NO: 107768 - DNA, 25 bp, Mus musculus
gagtacccctacaagtgccgtgagt

SEQ ID NO: 107769 - DNA, 25 bp, Mus musculus
gagtaccctcatggattgccccaaa

SEQ ID NO: 107770 - DNA, 25 bp, Mus musculus
gagtaccgacctcaacatccaggag

SEQ ID NO: 107771 - DNA, 25 bp, Mus musculus
gagtaccgcaccataatcacagagg

SEQ ID NO: 107772 - DNA, 25 bp, Mus musculus
gagtaccgcgtcagtgtgattgcca

SEQ ID NO: 107773 - DNA, 25 bp, Mus musculus
gagtaccggcgccattcactccgag

SEQ ID NO: 107774 - DNA, 25 bp, Mus musculus
gagtacctaaggtgctcaattccaa

SEQ ID NO: 107775 - DNA, 25 bp, Mus musculus
gagtacctcaactttatccgcggtg

SEQ ID NO: 107776 - DNA, 25 bp, Mus musculus
gagtacctctccctgatgcatgctg

SEQ ID NO: 107777 - DNA, 25 bp, Mus musculus
gagtacctgatcgagaagctgctga

SEQ ID NO: 107778 - DNA, 25 bp, Mus musculus
gagtacctgattggccagcacgtga

SEQ ID NO: 107779 - DNA, 25 bp, Mus musculus
gagtacctgcaaggcgcatgatgaa

SEQ ID NO: 107780 - DNA, 25 bp, Mus musculus
gagtacctgcagaaaagatccgagc

SEQ ID NO: 107781 - DNA, 25 bp, Mus musculus
gagtacctttccagggtctgaacac

SEQ ID NO: 107782 - DNA, 25 bp, Mus musculus
gagtaccttttcttgagtgtcgctg

SEQ ID NO: 107783 - DNA, 25 bp, Mus musculus
gagtacgaggccatcaatctcaggg

SEQ ID NO: 107784 - DNA, 25 bp, Mus musculus
gagtacgatcctgttgaggcccgac

SEQ ID NO: 107785 - DNA, 25 bp, Mus musculus
gagtacgcaaggtttgaatccccac

SEQ ID NO: 107786 - DNA, 25 bp, Mus musculus
gagtacgccgccgtcaactttgtgt

SEQ ID NO: 107787 - DNA, 25 bp, Mus musculus
gagtacggactcttccagatcagtg

SEQ ID NO: 107788 - DNA, 25 bp, Mus musculus
gagtacgtctctatctgccttagtg

SEQ ID NO: 107789 - DNA, 25 bp, Mus musculus
gagtactactccttccatgaatcgg

SEQ ID NO: 107790 - DNA, 25 bp, Mus musculus
gagtactatgctcacacaattagag

SEQ ID NO: 107791 - DNA, 25 bp, Mus musculus
gagtactcagcaacacaaccgaagt

SEQ ID NO: 107792 - DNA, 25 bp, Mus musculus
gagtactcggattcaggaagccagc

SEQ ID NO: 107793 - DNA, 25 bp, Mus musculus
gagtactgagcctccccatgggtgg

SEQ ID NO: 107794 - DNA, 25 bp, Mus musculus
gagtactggatatgggactgcctca

SEQ ID NO: 107795 - DNA, 25 bp, Mus musculus
gagtactttccgctgttcctcgcca

SEQ ID NO: 107796 - DNA, 25 bp, Mus musculus
gagtagaaggatagctgtcacccga

SEQ ID NO: 107797 - DNA, 25 bp, Mus musculus
gagtagactccagcataccttcaga

SEQ ID NO: 107798 - DNA, 25 bp, Mus musculus
gagtagagattgaacacccctgaag

SEQ ID NO: 107799 - DNA, 25 bp, Mus musculus
gagtagcaactgtagccgacacgga

SEQ ID NO: 107800 - DNA, 25 bp, Mus musculus
gagtagccagaaactgagtcctgtc

SEQ ID NO: 107801 - DNA, 25 bp, Mus musculus
gagtagccagcctttcagacgtgag

SEQ ID NO: 107802 - DNA, 25 bp, Mus musculus
gagtaggcatggaagcaggctcttt

SEQ ID NO: 107803 - DNA, 25 bp, Mus musculus
gagtagggcaaatagtcaaggagaa

SEQ ID NO: 107804 - DNA, 25 bp, Mus musculus
gagtagggtctttgggcccaccaag

SEQ ID NO: 107805 - DNA, 25 bp, Mus musculus
gagtaggtagcgattctcacccggg

SEQ ID NO: 107806 - DNA, 25 bp, Mus musculus
gagtagtatggctcgtcagcgccgt

SEQ ID NO: 107807 - DNA, 25 bp, Mus musculus
gagtagtcttccagcctctcaggta

SEQ ID NO: 107808 - DNA, 25 bp, Mus musculus
gagtagtgttactccaagagggcca

SEQ ID NO: 107809 - DNA, 25 bp, Mus musculus
gagtagtgttactcggcatagaaca

SEQ ID NO: 107810 - DNA, 25 bp, Mus musculus
gagtagttaacgttcatccgccaac

SEQ ID NO: 107811 - DNA, 25 bp, Mus musculus
gagtagtttacaagagcccctcaga

SEQ ID NO: 107812 - DNA, 25 bp, Mus musculus
gagtataaccacagacccaacgatg

SEQ ID NO: 107813 - DNA, 25 bp, Mus musculus
gagtataatcccctaggctccaagg

SEQ ID NO: 107814 - DNA, 25 bp, Mus musculus
gagtataccactctctcaggagcag

SEQ ID NO: 107815 - DNA, 25 bp, Mus musculus
gagtatagattggtcgttcccaaag

SEQ ID NO: 107816 - DNA, 25 bp, Mus musculus
gagtatatgcatcatctcctggccc

SEQ ID NO: 107817 - DNA, 25 bp, Mus musculus
gagtatatgcgatccttgccaggac

SEQ ID NO: 107818 - DNA, 25 bp, Mus musculus
gagtatcactccagcatgattgcag

SEQ ID NO: 107819 - DNA, 25 bp, Mus musculus
gagtatcagaataagggccgagcga

SEQ ID NO: 107820 - DNA, 25 bp, Mus musculus
gagtatccagcatgctgtcccgacg

SEQ ID NO: 107821 - DNA, 25 bp, Mus musculus
gagtatccccttaagcctggtgaga

SEQ ID NO: 107822 - DNA, 25 bp, Mus musculus
gagtatcccgggtcacagctttgcg

SEQ ID NO: 107823 - DNA, 25 bp, Mus musculus
gagtatcttccggaactctttgtac

SEQ ID NO: 107824 - DNA, 25 bp, Mus musculus
gagtatgaacactccatctgtatca

SEQ ID NO: 107825 - DNA, 25 bp, Mus musculus
gagtatgaacctcccgagagtccgg

SEQ ID NO: 107826 - DNA, 25 bp, Mus musculus
gagtatgaaggcaaggaaacagctt

SEQ ID NO: 107827 - DNA, 25 bp, Mus musculus
gagtatgaggacagccagtctccag

SEQ ID NO: 107828 - DNA, 25 bp, Mus musculus
gagtatgagtagtgttactcggcat

SEQ ID NO: 107829 - DNA, 25 bp, Mus musculus
gagtatgcccaatctcggttccagt

SEQ ID NO: 107830 - DNA, 25 bp, Mus musculus
gagtatgcctacgtgctgagagtcg

SEQ ID NO: 107831 - DNA, 25 bp, Mus musculus
gagtatggcccgcttctcagagaga

SEQ ID NO: 107832 - DNA, 25 bp, Mus musculus
gagtatggtctacacacagtcagag

SEQ ID NO: 107833 - DNA, 25 bp, Mus musculus
gagtatggttcttcctccgagaaag

SEQ ID NO: 107834 - DNA, 25 bp, Mus musculus
gagtatgtcgtccagcatggtgccc

SEQ ID NO: 107835 - DNA, 25 bp, Mus musculus
gagtatgtctccaaaccttttgaat

SEQ ID NO: 107836 - DNA, 25 bp, Mus musculus
gagtatgtctgcagtccttcaagat

SEQ ID NO: 107837 - DNA, 25 bp, Mus musculus
gagtattacgaaagcctcagcgagc

SEQ ID NO: 107838 - DNA, 25 bp, Mus musculus
gagtattcaacccagtcttacacgg

SEQ ID NO: 107839 - DNA, 25 bp, Mus musculus
gagtattgccgatgtccattgccag

SEQ ID NO: 107840 - DNA, 25 bp, Mus musculus
gagtattggctcttccaccagaaag

SEQ ID NO: 107841 - DNA, 25 bp, Mus musculus
gagtatttacaaacatggagtaccc

SEQ ID NO: 107842 - DNA, 25 bp, Mus musculus
gagtatttccggcacgaagacagca

SEQ ID NO: 107843 - DNA, 25 bp, Mus musculus
gagtatttggccacagttccggacc

SEQ ID NO: 107844 - DNA, 25 bp, Mus musculus
gagtcaaaattaaaggaaagctcac

SEQ ID NO: 107845 - DNA, 25 bp, Mus musculus
gagtcaaaggtttcctcagccagga

SEQ ID NO: 107846 - DNA, 25 bp, Mus musculus
gagtcaacacgattgctatgcggct

SEQ ID NO: 107847 - DNA, 25 bp, Mus musculus
gagtcaacagagcaaccaaaccatg

SEQ ID NO: 107848 - DNA, 25 bp, Mus musculus
gagtcaacatggagctctcggcggt

SEQ ID NO: 107849 - DNA, 25 bp, Mus musculus
gagtcaaccagaaagagattgggta

SEQ ID NO: 107850 - DNA, 25 bp, Mus musculus
gagtcaaccttagaacccggcgagt

SEQ ID NO: 107851 - DNA, 25 bp, Mus musculus
gagtcaacggtggaacacacgcatg

SEQ ID NO: 107852 - DNA, 25 bp, Mus musculus
gagtcaagcatctctgctactacca

SEQ ID NO: 107853 - DNA, 25 bp, Mus musculus
gagtcaagcccatgtctgcacctag

SEQ ID NO: 107854 - DNA, 25 bp, Mus musculus
gagtcaagtccggatcaagggcaag

SEQ ID NO: 107855 - DNA, 25 bp, Mus musculus
gagtcaagtctgagttccggcagaa

SEQ ID NO: 107856 - DNA, 25 bp, Mus musculus
gagtcaatagcatggacctgcccca

SEQ ID NO: 107857 - DNA, 25 bp, Mus musculus
gagtcaatgtgaaccagagtgccca

SEQ ID NO: 107858 - DNA, 25 bp, Mus musculus
gagtcaattgtacgctttgccttgc

SEQ ID NO: 107859 - DNA, 25 bp, Mus musculus
gagtcacaatcctctaggcccttag

SEQ ID NO: 107860 - DNA, 25 bp, Mus musculus
gagtcacacgagaaacttccggcag

SEQ ID NO: 107861 - DNA, 25 bp, Mus musculus
gagtcacagacttggaaagttctcc

SEQ ID NO: 107862 - DNA, 25 bp, Mus musculus
gagtcacagtgtgtatcagcacttg

SEQ ID NO: 107863 - DNA, 25 bp, Mus musculus
gagtcacatcgctagcaaacctcat

SEQ ID NO: 107864 - DNA, 25 bp, Mus musculus
gagtcaccaatggattctcagcctg

SEQ ID NO: 107865 - DNA, 25 bp, Mus musculus
gagtcaccgaaggattctccttttc

SEQ ID NO: 107866 - DNA, 25 bp, Mus musculus
gagtcacggttctctatatagccca

SEQ ID NO: 107867 - DNA, 25 bp, Mus musculus
gagtcactaacaccgcggtgctcca

SEQ ID NO: 107868 - DNA, 25 bp, Mus musculus
gagtcactagttccacttgtacaga

SEQ ID NO: 107869 - DNA, 25 bp, Mus musculus
gagtcactcatgaaccacctggaag

SEQ ID NO: 107870 - DNA, 25 bp, Mus musculus
gagtcactgactagaactacccctg

SEQ ID NO: 107871 - DNA, 25 bp, Mus musculus
gagtcactgatgaagctggtatccg

SEQ ID NO: 107872 - DNA, 25 bp, Mus musculus
gagtcactgattccactcagagggt

SEQ ID NO: 107873 - DNA, 25 bp, Mus musculus
gagtcactggtggaaacattttcat

SEQ ID NO: 107874 - DNA, 25 bp, Mus musculus
gagtcactggttcctcttgctgctg

SEQ ID NO: 107875 - DNA, 25 bp, Mus musculus
gagtcactggttcgagcccttgagc

SEQ ID NO: 107876 - DNA, 25 bp, Mus musculus
gagtcactgtttccctgtgcacaaa

SEQ ID NO: 107877 - DNA, 25 bp, Mus musculus
gagtcactgttttggaagccaccca

SEQ ID NO: 107878 - DNA, 25 bp, Mus musculus
gagtcacttagtcctttgcacagcc

SEQ ID NO: 107879 - DNA, 25 bp, Mus musculus
gagtcagaacgtcagcatggagtct

SEQ ID NO: 107880 - DNA, 25 bp, Mus musculus
gagtcagagaatccaaacccagggt

SEQ ID NO: 107881 - DNA, 25 bp, Mus musculus
gagtcagagcttgtatcccatgaga

SEQ ID NO: 107882 - DNA, 25 bp, Mus musculus
gagtcagaggacatgctgagcgcct

SEQ ID NO: 107883 - DNA, 25 bp, Mus musculus
gagtcagagtcaggcattttctgta

SEQ ID NO: 107884 - DNA, 25 bp, Mus musculus
gagtcagattccacaatagtctatt

SEQ ID NO: 107885 - DNA, 25 bp, Mus musculus
gagtcagcagctctcttggcctctg

SEQ ID NO: 107886 - DNA, 25 bp, Mus musculus
gagtcagcatcaacaataaccacgg

SEQ ID NO: 107887 - DNA, 25 bp, Mus musculus
gagtcagccggcagtttcctaaaag

SEQ ID NO: 107888 - DNA, 25 bp, Mus musculus
gagtcagcgttggaggttcacagca

SEQ ID NO: 107889 - DNA, 25 bp, Mus musculus
gagtcagctgctctgttccccaggt

SEQ ID NO: 107890 - DNA, 25 bp, Mus musculus
gagtcaggctctactccagcttcca

SEQ ID NO: 107891 - DNA, 25 bp, Mus musculus
gagtcagtcacgttgtcacaaccag

SEQ ID NO: 107892 - DNA, 25 bp, Mus musculus
gagtcagtcgaagctctcctcagcg

SEQ ID NO: 107893 - DNA, 25 bp, Mus musculus
gagtcagtcgccttgattcagaatg

SEQ ID NO: 107894 - DNA, 25 bp, Mus musculus
gagtcagtctattccaaaagccagc

SEQ ID NO: 107895 - DNA, 25 bp, Mus musculus
gagtcagtgagcttcacacagagcg

SEQ ID NO: 107896 - DNA, 25 bp, Mus musculus
gagtcagtgtctaggcgtccagctt

SEQ ID NO: 107897 - DNA, 25 bp, Mus musculus
gagtcagtttacatcgtggacccca

SEQ ID NO: 107898 - DNA, 25 bp, Mus musculus
gagtcatcagaccttacaggttgcg

SEQ ID NO: 107899 - DNA, 25 bp, Mus musculus
gagtcatccaaggaagacagctgaa

SEQ ID NO: 107900 - DNA, 25 bp, Mus musculus
gagtcatccccaggcactgagtggg

SEQ ID NO: 107901 - DNA, 25 bp, Mus musculus
gagtcatcccgaatccgcaaactgg

SEQ ID NO: 107902 - DNA, 25 bp, Mus musculus
gagtcatcgcctgcacagaactgga

SEQ ID NO: 107903 - DNA, 25 bp, Mus musculus
gagtcatcgtcctggataccgacgt

SEQ ID NO: 107904 - DNA, 25 bp, Mus musculus
gagtcatctacttttgtctgcaaga

SEQ ID NO: 107905 - DNA, 25 bp, Mus musculus
gagtcatctcgatccgaagagcgga

SEQ ID NO: 107906 - DNA, 25 bp, Mus musculus
gagtcatgaaggacatcagggcaat

SEQ ID NO: 107907 - DNA, 25 bp, Mus musculus
gagtcatgatctgtactccctgtca

SEQ ID NO: 107908 - DNA, 25 bp, Mus musculus
gagtcatggtcttcatcctgacagg

SEQ ID NO: 107909 - DNA, 25 bp, Mus musculus
gagtcattcgatgcccagtttgcag

SEQ ID NO: 107910 - DNA, 25 bp, Mus musculus
gagtcattgctgtgggagtcttcct

SEQ ID NO: 107911 - DNA, 25 bp, Mus musculus
gagtcatttcccagtagagtgccct

SEQ ID NO: 107912 - DNA, 25 bp, Mus musculus
gagtccaaaaagaaaccctgcttag

SEQ ID NO: 107913 - DNA, 25 bp, Mus musculus
gagtccaaccctaaagatccagcag

SEQ ID NO: 107914 - DNA, 25 bp, Mus musculus
gagtccacggtatgcatcccaaaga

SEQ ID NO: 107915 - DNA, 25 bp, Mus musculus
gagtccacgtcctacaagttctgca

SEQ ID NO: 107916 - DNA, 25 bp, Mus musculus
gagtccacttagcagagccttctgg

SEQ ID NO: 107917 - DNA, 25 bp, Mus musculus
gagtccagttctaccttagtcccta

SEQ ID NO: 107918 - DNA, 25 bp, Mus musculus
gagtccatctgtgttggtaaagccc

SEQ ID NO: 107919 - DNA, 25 bp, Mus musculus
gagtccatgaagacgtacgcagagg

SEQ ID NO: 107920 - DNA, 25 bp, Mus musculus
gagtcccaaacagtagtcagcagtg

SEQ ID NO: 107921 - DNA, 25 bp, Mus musculus
gagtcccaccttcgaggatggcaag

SEQ ID NO: 107922 - DNA, 25 bp, Mus musculus
gagtcccactcatcaacagagcagg

SEQ ID NO: 107923 - DNA, 25 bp, Mus musculus
gagtcccagggaggaattatggtcc

SEQ ID NO: 107924 - DNA, 25 bp, Mus musculus
gagtcccattgtgttgtcatcagcc

SEQ ID NO: 107925 - DNA, 25 bp, Mus musculus
gagtccccatgattttctgcatact

SEQ ID NO: 107926 - DNA, 25 bp, Mus musculus
gagtccccggcatgttgtagagcct

SEQ ID NO: 107927 - DNA, 25 bp, Mus musculus
gagtcccctgggtccctgtcaactg

SEQ ID NO: 107928 - DNA, 25 bp, Mus musculus
gagtcccctttgagattctgacaga

SEQ ID NO: 107929 - DNA, 25 bp, Mus musculus
gagtcccgagaacagaaaaccacag

SEQ ID NO: 107930 - DNA, 25 bp, Mus musculus
gagtcccgagagtacagagatgccc

SEQ ID NO: 107931 - DNA, 25 bp, Mus musculus
gagtccctaccatccagtctgtgag

SEQ ID NO: 107932 - DNA, 25 bp, Mus musculus
gagtccctcatgaaagaggcctggt

SEQ ID NO: 107933 - DNA, 25 bp, Mus musculus
gagtccctcggccactggaatatat

SEQ ID NO: 107934 - DNA, 25 bp, Mus musculus
gagtccctgagacagcacgtcttag

SEQ ID NO: 107935 - DNA, 25 bp, Mus musculus
gagtccctggaattggctgttggca

SEQ ID NO: 107936 - DNA, 25 bp, Mus musculus
gagtccctgtcacaacaaaacagat

SEQ ID NO: 107937 - DNA, 25 bp, Mus musculus
gagtccctgtcgtcgtggctgtgaa

SEQ ID NO: 107938 - DNA, 25 bp, Mus musculus
gagtccgaatctacttgagcaaggg

SEQ ID NO: 107939 - DNA, 25 bp, Mus musculus
gagtccggctggagcacttctacat

SEQ ID NO: 107940 - DNA, 25 bp, Mus musculus
gagtccgtgaatctacagcaaagca

SEQ ID NO: 107941 - DNA, 25 bp, Mus musculus
gagtcctacaagacggtcctcgata

SEQ ID NO: 107942 - DNA, 25 bp, Mus musculus
gagtcctaccaactcagaatgtgtg

SEQ ID NO: 107943 - DNA, 25 bp, Mus musculus
gagtcctacggctgcggttgcaaga

SEQ ID NO: 107944 - DNA, 25 bp, Mus musculus
gagtcctatttcagcaccagcttta

SEQ ID NO: 107945 - DNA, 25 bp, Mus musculus
gagtcctccgagcagtggcaagctt

SEQ ID NO: 107946 - DNA, 25 bp, Mus musculus
gagtcctcgccatgtcatttctacc

SEQ ID NO: 107947 - DNA, 25 bp, Mus musculus
gagtcctctgcaggagtccatgctg

SEQ ID NO: 107948 - DNA, 25 bp, Mus musculus
gagtcctctgctcccagaatcaggc

SEQ ID NO: 107949 - DNA, 25 bp, Mus musculus
gagtcctgaagacaactgtgcctca

SEQ ID NO: 107950 - DNA, 25 bp, Mus musculus
gagtcctgcaggagtccagcaagaa

SEQ ID NO: 107951 - DNA, 25 bp, Mus musculus
gagtcctgcggctaggagcgcttcc

SEQ ID NO: 107952 - DNA, 25 bp, Mus musculus
gagtcctggctagcacctttggtaa

SEQ ID NO: 107953 - DNA, 25 bp, Mus musculus
gagtcctggctcttgtgtttggaag

SEQ ID NO: 107954 - DNA, 25 bp, Mus musculus
gagtcctgtcagcacaaagagaagc

SEQ ID NO: 107955 - DNA, 25 bp, Mus musculus
gagtcctgtcccagcaatttgtcga

SEQ ID NO: 107956 - DNA, 25 bp, Mus musculus
gagtccttgccatctcactgtgtga

SEQ ID NO: 107957 - DNA, 25 bp, Mus musculus
gagtccttgccgtgatagagccatg

SEQ ID NO: 107958 - DNA, 25 bp, Mus musculus
gagtcgaagcacacctgtacgggac

SEQ ID NO: 107959 - DNA, 25 bp, Mus musculus
gagtcgaggtctattggctagcaaa

SEQ ID NO: 107960 - DNA, 25 bp, Mus musculus
gagtcgccagagctagcaagacctt

SEQ ID NO: 107961 - DNA, 25 bp, Mus musculus
gagtcgcctgcgctaccctattaat

SEQ ID NO: 107962 - DNA, 25 bp, Mus musculus
gagtcgcgctccaggtcaaaatcgg

SEQ ID NO: 107963 - DNA, 25 bp, Mus musculus
gagtcgctcaccctctgacaaaaga

SEQ ID NO: 107964 - DNA, 25 bp, Mus musculus
gagtcgctcagctcgcatctggagg

SEQ ID NO: 107965 - DNA, 25 bp, Mus musculus
gagtcgctgaagaaaatcgaagagc

SEQ ID NO: 107966 - DNA, 25 bp, Mus musculus
gagtcggatgctctccaggaagcca

SEQ ID NO: 107967 - DNA, 25 bp, Mus musculus
gagtcggccgctcctgaatacagag

SEQ ID NO: 107968 - DNA, 25 bp, Mus musculus
gagtcggcctacacaaagtcttcaa

SEQ ID NO: 107969 - DNA, 25 bp, Mus musculus
gagtcgggaactctggaatctcagc

SEQ ID NO: 107970 - DNA, 25 bp, Mus musculus
gagtcgggctaggattgcattacag

SEQ ID NO: 107971 - DNA, 25 bp, Mus musculus
gagtcggtaccttctggccatggag

SEQ ID NO: 107972 - DNA, 25 bp, Mus musculus
gagtcgtatgaaccacctgaaggag

SEQ ID NO: 107973 - DNA, 25 bp, Mus musculus
gagtcgtccctctcactgctattgg

SEQ ID NO: 107974 - DNA, 25 bp, Mus musculus
gagtcgtgaccatcgaacgcagcaa

SEQ ID NO: 107975 - DNA, 25 bp, Mus musculus
gagtcgtgtacgagctgaacagcta

SEQ ID NO: 107976 - DNA, 25 bp, Mus musculus
gagtcgtgtcaactcttcttcggtt

SEQ ID NO: 107977 - DNA, 25 bp, Mus musculus
gagtcgtgtgctcctctctcgaagc

SEQ ID NO: 107978 - DNA, 25 bp, Mus musculus
gagtcgtttgcaaaagccctgagaa

SEQ ID NO: 107979 - DNA, 25 bp, Mus musculus
gagtctaacacctcaggaaacggtt

SEQ ID NO: 107980 - DNA, 25 bp, Mus musculus
gagtctaagaaaccacaatcaagtg

SEQ ID NO: 107981 - DNA, 25 bp, Mus musculus
gagtctacacaggtgctgcgggaac

SEQ ID NO: 107982 - DNA, 25 bp, Mus musculus
gagtctaccacggatgaaaacgaag

SEQ ID NO: 107983 - DNA, 25 bp, Mus musculus
gagtctagacagtatgttcatatgg

SEQ ID NO: 107984 - DNA, 25 bp, Mus musculus
gagtctagggtctcatccataaagc

SEQ ID NO: 107985 - DNA, 25 bp, Mus musculus
gagtctatcaaggtcagcacaaaaa

SEQ ID NO: 107986 - DNA, 25 bp, Mus musculus
gagtctatcctcaagtctgccaagg

SEQ ID NO: 107987 - DNA, 25 bp, Mus musculus
gagtctatgccgctgctgatcctta

SEQ ID NO: 107988 - DNA, 25 bp, Mus musculus
gagtctattgatgacccgcaggaaa

SEQ ID NO: 107989 - DNA, 25 bp, Mus musculus
gagtctcaaacttgactaggacccc

SEQ ID NO: 107990 - DNA, 25 bp, Mus musculus
gagtctcaaatggacatgcaaggct

SEQ ID NO: 107991 - DNA, 25 bp, Mus musculus
gagtctcaccctcttcttacaggca

SEQ ID NO: 107992 - DNA, 25 bp, Mus musculus
gagtctcacgtaatcatcaccctta

SEQ ID NO: 107993 - DNA, 25 bp, Mus musculus
gagtctcagttcagcgttggcagca

SEQ ID NO: 107994 - DNA, 25 bp, Mus musculus
gagtctccaagtcacggtctcgagc

SEQ ID NO: 107995 - DNA, 25 bp, Mus musculus
gagtctccagatatgcaaatgggca

SEQ ID NO: 107996 - DNA, 25 bp, Mus musculus
gagtctccattcagtgaccctagca

SEQ ID NO: 107997 - DNA, 25 bp, Mus musculus
gagtctcccaacatcagagggtgcc

SEQ ID NO: 107998 - DNA, 25 bp, Mus musculus
gagtctcctctacactgcagggcgg

SEQ ID NO: 107999 - DNA, 25 bp, Mus musculus
gagtctcctctgacaatgggcagcg

SEQ ID NO: 108000 - DNA, 25 bp, Mus musculus
gagtctctagcaaagtccacgcagg

SEQ ID NO: 108001 - DNA, 25 bp, Mus musculus
gagtctctgctcatgaggcccaaca

SEQ ID NO: 108002 - DNA, 25 bp, Mus musculus
gagtctctgctttactgtggcccag

SEQ ID NO: 108003 - DNA, 25 bp, Mus musculus
gagtctctgtttgcagtttcgggag

SEQ ID NO: 108004 - DNA, 25 bp, Mus musculus
gagtctcttaaagctccaggtactg

SEQ ID NO: 108005 - DNA, 25 bp, Mus musculus
gagtctcttcatacgggccactgga

SEQ ID NO: 108006 - DNA, 25 bp, Mus musculus
gagtctctttagacggcagccagag

SEQ ID NO: 108007 - DNA, 25 bp, Mus musculus
gagtctgaaaagcatccggaagtac

SEQ ID NO: 108008 - DNA, 25 bp, Mus musculus
gagtctgaacatccaaggccaatga

SEQ ID NO: 108009 - DNA, 25 bp, Mus musculus
gagtctgaactcatcctgcttggaa

SEQ ID NO: 108010 - DNA, 25 bp, Mus musculus
gagtctgaagcgaatgaagcccctg

SEQ ID NO: 108011 - DNA, 25 bp, Mus musculus
gagtctgagtctgtggaatgtctac

SEQ ID NO: 108012 - DNA, 25 bp, Mus musculus
gagtctgatcagctccttggaggcc

SEQ ID NO: 108013 - DNA, 25 bp, Mus musculus
gagtctgatcctgaatgaggcatta

SEQ ID NO: 108014 - DNA, 25 bp, Mus musculus
gagtctgcaaaaccttcccgatggc

SEQ ID NO: 108015 - DNA, 25 bp, Mus musculus
gagtctgcccgtgtatccatggtcg

SEQ ID NO: 108016 - DNA, 25 bp, Mus musculus
gagtctgccgttcgatctgataccc

SEQ ID NO: 108017 - DNA, 25 bp, Mus musculus
gagtctgcctgccaacagagctgat

SEQ ID NO: 108018 - DNA, 25 bp, Mus musculus
gagtctgccttctactccatcgtgg

SEQ ID NO: 108019 - DNA, 25 bp, Mus musculus
gagtctgctctggattaccgcctgg

SEQ ID NO: 108020 - DNA, 25 bp, Mus musculus
gagtctggcagcttcaattgggatg

SEQ ID NO: 108021 - DNA, 25 bp, Mus musculus
gagtctgtcagaggccaaacttcca

SEQ ID NO: 108022 - DNA, 25 bp, Mus musculus
gagtctgtcagtaccggtgtcgata

SEQ ID NO: 108023 - DNA, 25 bp, Mus musculus
gagtctgtctggcacaaactacacg

SEQ ID NO: 108024 - DNA, 25 bp, Mus musculus
gagtctgtctgttaggcgaacccca

SEQ ID NO: 108025 - DNA, 25 bp, Mus musculus
gagtctgttagcgatctgaggctga

SEQ ID NO: 108026 - DNA, 25 bp, Mus musculus
gagtcttaccagtgcatccctatga

SEQ ID NO: 108027 - DNA, 25 bp, Mus musculus
gagtcttcgatatggagctccaccc

SEQ ID NO: 108028 - DNA, 25 bp, Mus musculus
gagtcttcggccttagtggatgata

SEQ ID NO: 108029 - DNA, 25 bp, Mus musculus
gagtcttctccaggcaagcaccttg

SEQ ID NO: 108030 - DNA, 25 bp, Mus musculus
gagtcttctggtagtctctttcctt

SEQ ID NO: 108031 - DNA, 25 bp, Mus musculus
gagtcttgatcataccctagccggg

SEQ ID NO: 108032 - DNA, 25 bp, Mus musculus
gagtcttgcgatgggcacagaaaac

SEQ ID NO: 108033 - DNA, 25 bp, Mus musculus
gagtctttaagccttatcaattaat

SEQ ID NO: 108034 - DNA, 25 bp, Mus musculus
gagtctttgcgcttgggcacaccag

SEQ ID NO: 108035 - DNA, 25 bp, Mus musculus
gagtctttggctgggtaccctagca

SEQ ID NO: 108036 - DNA, 25 bp, Mus musculus
gagtcttttgcacgtcacctgcagg

SEQ ID NO: 108037 - DNA, 25 bp, Mus musculus
gagtgaacaagacgctaacccgtag

SEQ ID NO: 108038 - DNA, 25 bp, Mus musculus
gagtgaacccactctctgttctgga

SEQ ID NO: 108039 - DNA, 25 bp, Mus musculus
gagtgaacccatctgtgaacggaca

SEQ ID NO: 108040 - DNA, 25 bp, Mus musculus
gagtgaacccgactgctactgatgg

SEQ ID NO: 108041 - DNA, 25 bp, Mus musculus
gagtgaacccgatgtgctggatgca

SEQ ID NO: 108042 - DNA, 25 bp, Mus musculus
gagtgaacggtgtgccactggatcc

SEQ ID NO: 108043 - DNA, 25 bp, Mus musculus
gagtgaacttcaactacagcccaga

SEQ ID NO: 108044 - DNA, 25 bp, Mus musculus
gagtgaacttctcctacatctgaag

SEQ ID NO: 108045 - DNA, 25 bp, Mus musculus
gagtgaagaccacctatgacagcag

SEQ ID NO: 108046 - DNA, 25 bp, Mus musculus
gagtgaagcgccatcagaaaatgtc

SEQ ID NO: 108047 - DNA, 25 bp, Mus musculus
gagtgaatcctgataccatcctgag

SEQ ID NO: 108048 - DNA, 25 bp, Mus musculus
gagtgaatttaggtggctcatccca

SEQ ID NO: 108049 - DNA, 25 bp, Mus musculus
gagtgaccacgctcttcctgtgaga

SEQ ID NO: 108050 - DNA, 25 bp, Mus musculus
gagtgaccagtacacggtgtgcaca

SEQ ID NO: 108051 - DNA, 25 bp, Mus musculus
gagtgaccgcaaaaacatggacctg

SEQ ID NO: 108052 - DNA, 25 bp, Mus musculus
gagtgacctcagcatccttcagatg

SEQ ID NO: 108053 - DNA, 25 bp, Mus musculus
gagtgacctggctcatccttgaagc

SEQ ID NO: 108054 - DNA, 25 bp, Mus musculus
gagtgaccttaagatctggcaacgg

SEQ ID NO: 108055 - DNA, 25 bp, Mus musculus
gagtgacgagggttattccagtgcc

SEQ ID NO: 108056 - DNA, 25 bp, Mus musculus
gagtgactcacttccctatccagag

SEQ ID NO: 108057 - DNA, 25 bp, Mus musculus
gagtgactccacagaagccaagatg

SEQ ID NO: 108058 - DNA, 25 bp, Mus musculus
gagtgactcctacccaaaagtggac

SEQ ID NO: 108059 - DNA, 25 bp, Mus musculus
gagtgactctgtgtcccgatacgga

SEQ ID NO: 108060 - DNA, 25 bp, Mus musculus
gagtgactgagctgatagaagccac

SEQ ID NO: 108061 - DNA, 25 bp, Mus musculus
gagtgactttacaagcacagtagct

SEQ ID NO: 108062 - DNA, 25 bp, Mus musculus
gagtgagcacgaccaagcaatggct

SEQ ID NO: 108063 - DNA, 25 bp, Mus musculus
gagtgagccatacatagtccagacc

SEQ ID NO: 108064 - DNA, 25 bp, Mus musculus
gagtgagccggtttccgtccagaag

SEQ ID NO: 108065 - DNA, 25 bp, Mus musculus
gagtgagcctcctgtgcagtgcaga

SEQ ID NO: 108066 - DNA, 25 bp, Mus musculus
gagtgagctactttatgtccaaggg

SEQ ID NO: 108067 - DNA, 25 bp, Mus musculus
gagtgagcttcgtagcgccccttat

SEQ ID NO: 108068 - DNA, 25 bp, Mus musculus
gagtgaggaggccatcctgcttggg

SEQ ID NO: 108069 - DNA, 25 bp, Mus musculus
gagtgaggggagacggagagttcgg

SEQ ID NO: 108070 - DNA, 25 bp, Mus musculus
gagtgaggtgctttaacatggagaa

SEQ ID NO: 108071 - DNA, 25 bp, Mus musculus
gagtgataatgctcatatgtccgca

SEQ ID NO: 108072 - DNA, 25 bp, Mus musculus
gagtgatccagtgtctcccgtggtg

SEQ ID NO: 108073 - DNA, 25 bp, Mus musculus
gagtgatccctgtgcttctccggct

SEQ ID NO: 108074 - DNA, 25 bp, Mus musculus
gagtgatgaaaagcacccacctgaa

SEQ ID NO: 108075 - DNA, 25 bp, Mus musculus
gagtgatgaacggttccggacccgc

SEQ ID NO: 108076 - DNA, 25 bp, Mus musculus
gagtgatgcctacccgatgacagaa

SEQ ID NO: 108077 - DNA, 25 bp, Mus musculus
gagtgatgggccctggtcccatctc

SEQ ID NO: 108078 - DNA, 25 bp, Mus musculus
gagtgattgttaatccagaccacag

SEQ ID NO: 108079 - DNA, 25 bp, Mus musculus
gagtgcaaacgcacccagggtgtgt

SEQ ID NO: 108080 - DNA, 25 bp, Mus musculus
gagtgcacacacctatgggaaacct

SEQ ID NO: 108081 - DNA, 25 bp, Mus musculus
gagtgcacagccagcgtcttaacag

SEQ ID NO: 108082 - DNA, 25 bp, Mus musculus
gagtgcaccagtgaacagcttcctt

SEQ ID NO: 108083 - DNA, 25 bp, Mus musculus
gagtgcactgcatcatgtccctggg

SEQ ID NO: 108084 - DNA, 25 bp, Mus musculus
gagtgcagaagctaccaagagggcc

SEQ ID NO: 108085 - DNA, 25 bp, Mus musculus
gagtgcagagctctgctccgcttgc

SEQ ID NO: 108086 - DNA, 25 bp, Mus musculus
gagtgcagctgttccaagaactggc

SEQ ID NO: 108087 - DNA, 25 bp, Mus musculus
gagtgcagtccttcccattggtgaa

SEQ ID NO: 108088 - DNA, 25 bp, Mus musculus
gagtgcatcgttcgcctctatgaca

SEQ ID NO: 108089 - DNA, 25 bp, Mus musculus
gagtgcatgtactcgctgctggaga

SEQ ID NO: 108090 - DNA, 25 bp, Mus musculus
gagtgccaaatttcccagctgatga

SEQ ID NO: 108091 - DNA, 25 bp, Mus musculus
gagtgccactacttcatctgtgacg

SEQ ID NO: 108092 - DNA, 25 bp, Mus musculus
gagtgccagctgtatgatgtccatc

SEQ ID NO: 108093 - DNA, 25 bp, Mus musculus
gagtgccatattgctggaaccagga

SEQ ID NO: 108094 - DNA, 25 bp, Mus musculus
gagtgcccgtctacacgagaagaag

SEQ ID NO: 108095 - DNA, 25 bp, Mus musculus
gagtgccctacagtgttgtccccag

SEQ ID NO: 108096 - DNA, 25 bp, Mus musculus
gagtgcccttttggaacctcaagtg

SEQ ID NO: 108097 - DNA, 25 bp, Mus musculus
gagtgccgacacacaagcccttttg

SEQ ID NO: 108098 - DNA, 25 bp, Mus musculus
gagtgccgcctgcttgcctacatat

SEQ ID NO: 108099 - DNA, 25 bp, Mus musculus
gagtgccgctccagtttaatcagtg

SEQ ID NO: 108100 - DNA, 25 bp, Mus musculus
gagtgccggcgtttcaccacagatg

SEQ ID NO: 108101 - DNA, 25 bp, Mus musculus
gagtgcctggtgttattcctgtaaa

SEQ ID NO: 108102 - DNA, 25 bp, Mus musculus
gagtgcgcgatccaaacactgcagc

SEQ ID NO: 108103 - DNA, 25 bp, Mus musculus
gagtgcgcgcaacactcgcgacttt

SEQ ID NO: 108104 - DNA, 25 bp, Mus musculus
gagtgcgctgtatctaatcaattgg

SEQ ID NO: 108105 - DNA, 25 bp, Mus musculus
gagtgcgtccctgaaagcaccgagg

SEQ ID NO: 108106 - DNA, 25 bp, Mus musculus
gagtgcgtctatacagtgtccccag

SEQ ID NO: 108107 - DNA, 25 bp, Mus musculus
gagtgcgtggtctcagggttctcct

SEQ ID NO: 108108 - DNA, 25 bp, Mus musculus
gagtgctaccaggacaacttctcca

SEQ ID NO: 108109 - DNA, 25 bp, Mus musculus
gagtgctaggacaacgaccatccag

SEQ ID NO: 108110 - DNA, 25 bp, Mus musculus
gagtgctaggatgaatgaacttccc

SEQ ID NO: 108111 - DNA, 25 bp, Mus musculus
gagtgctgacacctttgagttgaag

SEQ ID NO: 108112 - DNA, 25 bp, Mus musculus
gagtgctgagtgaactccacaagat

SEQ ID NO: 108113 - DNA, 25 bp, Mus musculus
gagtgctgcatctccattttaccga

SEQ ID NO: 108114 - DNA, 25 bp, Mus musculus
gagtgctgcggcttctaatgaaccc

SEQ ID NO: 108115 - DNA, 25 bp, Mus musculus
gagtgctggctcagtttcctcccac

SEQ ID NO: 108116 - DNA, 25 bp, Mus musculus
gagtgctgtgcatctgtcccggtta

SEQ ID NO: 108117 - DNA, 25 bp, Mus musculus
gagtgcttggccctttgaggtctca

SEQ ID NO: 108118 - DNA, 25 bp, Mus musculus
gagtgcttgtatgaggctctgagac

SEQ ID NO: 108119 - DNA, 25 bp, Mus musculus
gagtgctttcttgacctgggcctag

SEQ ID NO: 108120 - DNA, 25 bp, Mus musculus
gagtgcttttcgactgcatgaatca

SEQ ID NO: 108121 - DNA, 25 bp, Mus musculus
gagtggaagacaacgttcgacgccc

SEQ ID NO: 108122 - DNA, 25 bp, Mus musculus
gagtggaatcgagataccttgccaa

SEQ ID NO: 108123 - DNA, 25 bp, Mus musculus
gagtggacaaaatggcgaagatcgc

SEQ ID NO: 108124 - DNA, 25 bp, Mus musculus
gagtggacggaagctatccaagccg

SEQ ID NO: 108125 - DNA, 25 bp, Mus musculus
gagtggactccttcgtgatccgcga

SEQ ID NO: 108126 - DNA, 25 bp, Mus musculus
gagtggactgcgagtgtttttcccc

SEQ ID NO: 108127 - DNA, 25 bp, Mus musculus
gagtggactgcgttcccgcctgctt

SEQ ID NO: 108128 - DNA, 25 bp, Mus musculus
gagtggagcatcaaagatcttggcc

SEQ ID NO: 108129 - DNA, 25 bp, Mus musculus
gagtggatccagacgctgaagtaca

SEQ ID NO: 108130 - DNA, 25 bp, Mus musculus
gagtggatctacaatggcttcagca

SEQ ID NO: 108131 - DNA, 25 bp, Mus musculus
gagtggatctcagggcccaatgtgc

SEQ ID NO: 108132 - DNA, 25 bp, Mus musculus
gagtggcaccctccaagagagactg

SEQ ID NO: 108133 - DNA, 25 bp, Mus musculus
gagtggcagccaaactgagtcagag

SEQ ID NO: 108134 - DNA, 25 bp, Mus musculus
gagtggccaagctcgtgttccagag

SEQ ID NO: 108135 - DNA, 25 bp, Mus musculus
gagtggccacgctgctagacagtat

SEQ ID NO: 108136 - DNA, 25 bp, Mus musculus
gagtggccacggagctcatcatgag

SEQ ID NO: 108137 - DNA, 25 bp, Mus musculus
gagtggccactcatccaattgtaat

SEQ ID NO: 108138 - DNA, 25 bp, Mus musculus
gagtggccagagatctccctactga

SEQ ID NO: 108139 - DNA, 25 bp, Mus musculus
gagtggccagattcgaaaccttgag

SEQ ID NO: 108140 - DNA, 25 bp, Mus musculus
gagtggccctcatatcgtccttgcg

SEQ ID NO: 108141 - DNA, 25 bp, Mus musculus
gagtggccgcattggtctgtaccct

SEQ ID NO: 108142 - DNA, 25 bp, Mus musculus
gagtggcctagtagcccttactgat

SEQ ID NO: 108143 - DNA, 25 bp, Mus musculus
gagtggcgatccagttcctaaagga

SEQ ID NO: 108144 - DNA, 25 bp, Mus musculus
gagtggctaacgtctcagctgcaga

SEQ ID NO: 108145 - DNA, 25 bp, Mus musculus
gagtggctactgttcccaaagcagc

SEQ ID NO: 108146 - DNA, 25 bp, Mus musculus
gagtggctggaactgattgtttcta

SEQ ID NO: 108147 - DNA, 25 bp, Mus musculus
gagtggcttccacaaccagcactgg

SEQ ID NO: 108148 - DNA, 25 bp, Mus musculus
gagtggcttgaaattgatgaaaaga

SEQ ID NO: 108149 - DNA, 25 bp, Mus musculus
gagtgggaaatcatcaacaatacct

SEQ ID NO: 108150 - DNA, 25 bp, Mus musculus
gagtgggaaccactacgccatgaag

SEQ ID NO: 108151 - DNA, 25 bp, Mus musculus
gagtgggaccgcatgatttcagaca

SEQ ID NO: 108152 - DNA, 25 bp, Mus musculus
gagtgggcatcggtcaacaaggaaa

SEQ ID NO: 108153 - DNA, 25 bp, Mus musculus
gagtgggtagtataattaaggtcca

SEQ ID NO: 108154 - DNA, 25 bp, Mus musculus
gagtggtcaaagcatccttccaggc

SEQ ID NO: 108155 - DNA, 25 bp, Mus musculus
gagtggtcaccatctcacaacctga

SEQ ID NO: 108156 - DNA, 25 bp, Mus musculus
gagtggtcagtcctctttcgggaca

SEQ ID NO: 108157 - DNA, 25 bp, Mus musculus
gagtggtcatgaaccccagtgaggt

SEQ ID NO: 108158 - DNA, 25 bp, Mus musculus
gagtggtccggaacagagacatgct

SEQ ID NO: 108159 - DNA, 25 bp, Mus musculus
gagtggtcgccttccatgagtctgg

SEQ ID NO: 108160 - DNA, 25 bp, Mus musculus
gagtggtctaccatctggaggcaac

SEQ ID NO: 108161 - DNA, 25 bp, Mus musculus
gagtggtctgtaagctccatcagcc

SEQ ID NO: 108162 - DNA, 25 bp, Mus musculus
gagtggtgaccctccttgaagaccg

SEQ ID NO: 108163 - DNA, 25 bp, Mus musculus
gagtggtgctcagagaaaagaccca

SEQ ID NO: 108164 - DNA, 25 bp, Mus musculus
gagtggtgctcctgtttcctataga

SEQ ID NO: 108165 - DNA, 25 bp, Mus musculus
gagtggtggaaaagcgccttctcct

SEQ ID NO: 108166 - DNA, 25 bp, Mus musculus
gagtggttccacagatggaaatgcc

SEQ ID NO: 108167 - DNA, 25 bp, Mus musculus
gagtggtttacagccaaagatccca

SEQ ID NO: 108168 - DNA, 25 bp, Mus musculus
gagtggtttagacaccctgacagca

SEQ ID NO: 108169 - DNA, 25 bp, Mus musculus
gagtgtaacaccatctgcacgcggc

SEQ ID NO: 108170 - DNA, 25 bp, Mus musculus
gagtgtacaggctcaggccctagag

SEQ ID NO: 108171 - DNA, 25 bp, Mus musculus
gagtgtaccaaatgtctacccggca

SEQ ID NO: 108172 - DNA, 25 bp, Mus musculus
gagtgtagcattaaccggttccagc

SEQ ID NO: 108173 - DNA, 25 bp, Mus musculus
gagtgtaggtacgttctccgtggcc

SEQ ID NO: 108174 - DNA, 25 bp, Mus musculus
gagtgtatcctgtgcctggtaggcc

SEQ ID NO: 108175 - DNA, 25 bp, Mus musculus
gagtgtcaacaaagaaatggagcct

SEQ ID NO: 108176 - DNA, 25 bp, Mus musculus
gagtgtcaatgacctgttcaggtgc

SEQ ID NO: 108177 - DNA, 25 bp, Mus musculus
gagtgtcaggttacgctccggctct

SEQ ID NO: 108178 - DNA, 25 bp, Mus musculus
gagtgtccactaacttgtgaggcac

SEQ ID NO: 108179 - DNA, 25 bp, Mus musculus
gagtgtccacttctgcagcgatggc

SEQ ID NO: 108180 - DNA, 25 bp, Mus musculus
gagtgtccctcttagctgctgcaga

SEQ ID NO: 108181 - DNA, 25 bp, Mus musculus
gagtgtcctagcaagaaagtttcca

SEQ ID NO: 108182 - DNA, 25 bp, Mus musculus
gagtgtcgcccagtgcgtcctttgc

SEQ ID NO: 108183 - DNA, 25 bp, Mus musculus
gagtgtcgctgcttcccttaaaagg

SEQ ID NO: 108184 - DNA, 25 bp, Mus musculus
gagtgtcgctgtgatgttttctaaa

SEQ ID NO: 108185 - DNA, 25 bp, Mus musculus
gagtgtcggcccttcacattgtggt

SEQ ID NO: 108186 - DNA, 25 bp, Mus musculus
gagtgtcggctcatcatccacctgg

SEQ ID NO: 108187 - DNA, 25 bp, Mus musculus
gagtgtctatgtccttgccaacgag

SEQ ID NO: 108188 - DNA, 25 bp, Mus musculus
gagtgtctcagctcggcagatggca

SEQ ID NO: 108189 - DNA, 25 bp, Mus musculus
gagtgtctcatcttcttcaggataa

SEQ ID NO: 108190 - DNA, 25 bp, Mus musculus
gagtgtctcatgtagccactcaggc

SEQ ID NO: 108191 - DNA, 25 bp, Mus musculus
gagtgtctgacaattgggatctgcc

SEQ ID NO: 108192 - DNA, 25 bp, Mus musculus
gagtgtcttcccattgccacagtga

SEQ ID NO: 108193 - DNA, 25 bp, Mus musculus
gagtgtgaccctcctctaaaccctg

SEQ ID NO: 108194 - DNA, 25 bp, Mus musculus
gagtgtgagctgaatccccgaatcc

SEQ ID NO: 108195 - DNA, 25 bp, Mus musculus
gagtgtgccaacagctgcctaggct

SEQ ID NO: 108196 - DNA, 25 bp, Mus musculus
gagtgtgccacacggaagattttca

SEQ ID NO: 108197 - DNA, 25 bp, Mus musculus
gagtgtgccccagataactgcgtct

SEQ ID NO: 108198 - DNA, 25 bp, Mus musculus
gagtgtgcctccatgctggcagtca

SEQ ID NO: 108199 - DNA, 25 bp, Mus musculus
gagtgtgcctctaacccatgtgcag

SEQ ID NO: 108200 - DNA, 25 bp, Mus musculus
gagtgtgctccaccttcaagtcgga

SEQ ID NO: 108201 - DNA, 25 bp, Mus musculus
gagtgtggcaaggtagaatcacccc

SEQ ID NO: 108202 - DNA, 25 bp, Mus musculus
gagtgtggcgcatgcatcctttggt

SEQ ID NO: 108203 - DNA, 25 bp, Mus musculus
gagtgtggtggcgacaaatcagaca

SEQ ID NO: 108204 - DNA, 25 bp, Mus musculus
gagtgtgtcccaaactaaaaagcca

SEQ ID NO: 108205 - DNA, 25 bp, Mus musculus
gagtgtgtcgccttgagcctgtgac

SEQ ID NO: 108206 - DNA, 25 bp, Mus musculus
gagtgttatgactacctgtttgaca

SEQ ID NO: 108207 - DNA, 25 bp, Mus musculus
gagtgttccaggacctacaggtgca

SEQ ID NO: 108208 - DNA, 25 bp, Mus musculus
gagtgttccgatgcctctgtcgaag

SEQ ID NO: 108209 - DNA, 25 bp, Mus musculus
gagtgttcggaatttacagaccagc

SEQ ID NO: 108210 - DNA, 25 bp, Mus musculus
gagtgttcgttgtggctaagcgcca

SEQ ID NO: 108211 - DNA, 25 bp, Mus musculus
gagtgttctccagagccaagcttgg

SEQ ID NO: 108212 - DNA, 25 bp, Mus musculus
gagtgttgagcaaaatagcccttgg

SEQ ID NO: 108213 - DNA, 25 bp, Mus musculus
gagtgttgcctcttcgtgccatacg

SEQ ID NO: 108214 - DNA, 25 bp, Mus musculus
gagtgttgccttatgccttccagaa

SEQ ID NO: 108215 - DNA, 25 bp, Mus musculus
gagtgtttgcatgtgtctcctaaaa

SEQ ID NO: 108216 - DNA, 25 bp, Mus musculus
gagtgtttgcctgcttcaaccacga

SEQ ID NO: 108217 - DNA, 25 bp, Mus musculus
gagttaaaaataaaggatgaccagt

SEQ ID NO: 108218 - DNA, 25 bp, Mus musculus
gagttaaacaaagacagggatgtgg

SEQ ID NO: 108219 - DNA, 25 bp, Mus musculus
gagttaaatccaatgcgcgtgctgc

SEQ ID NO: 108220 - DNA, 25 bp, Mus musculus
gagttaaccaagcatcgtcagaccg

SEQ ID NO: 108221 - DNA, 25 bp, Mus musculus
gagttaacggaattggacagcccat

SEQ ID NO: 108222 - DNA, 25 bp, Mus musculus
gagttaaggcctagaagcactcaga

SEQ ID NO: 108223 - DNA, 25 bp, Mus musculus
gagttaagtattcggagaaacagga

SEQ ID NO: 108224 - DNA, 25 bp, Mus musculus
gagttaataacactcgacgggtcaa

SEQ ID NO: 108225 - DNA, 25 bp, Mus musculus
gagttaatcacgcacatcttggatg

SEQ ID NO: 108226 - DNA, 25 bp, Mus musculus
gagttaattaaagttcacaggtgcc

SEQ ID NO: 108227 - DNA, 25 bp, Mus musculus
gagttacagttagaagaattcccca

SEQ ID NO: 108228 - DNA, 25 bp, Mus musculus
gagttacatctgtgccctcatcgcc

SEQ ID NO: 108229 - DNA, 25 bp, Mus musculus
gagttacctattgctgtgcggccag

SEQ ID NO: 108230 - DNA, 25 bp, Mus musculus
gagttacgacgaagccaaggacgat

SEQ ID NO: 108231 - DNA, 25 bp, Mus musculus
gagttactgctattcggccggaaga

SEQ ID NO: 108232 - DNA, 25 bp, Mus musculus
gagttactgtgttccctcataaagg

SEQ ID NO: 108233 - DNA, 25 bp, Mus musculus
gagttacttcttattcagcagcagc

SEQ ID NO: 108234 - DNA, 25 bp, Mus musculus
gagttagaacggagcgatgccacag

SEQ ID NO: 108235 - DNA, 25 bp, Mus musculus
gagttagcgttcgaattcacccggc

SEQ ID NO: 108236 - DNA, 25 bp, Mus musculus
gagttagtttttctgggctgcccct

SEQ ID NO: 108237 - DNA, 25 bp, Mus musculus
gagttatatgaaagtgctaaaaagc

SEQ ID NO: 108238 - DNA, 25 bp, Mus musculus
gagttatccaaatcccaccgtgtca

SEQ ID NO: 108239 - DNA, 25 bp, Mus musculus
gagttatcggcagcaacttcgctcc

SEQ ID NO: 108240 - DNA, 25 bp, Mus musculus
gagttatctatgcaaccggtgtcac

SEQ ID NO: 108241 - DNA, 25 bp, Mus musculus
gagttatgccaaaaggtcgccctcc

SEQ ID NO: 108242 - DNA, 25 bp, Mus musculus
gagttatgccacagacaatgagaaa

SEQ ID NO: 108243 - DNA, 25 bp, Mus musculus
gagttattttcatgcaaacggcctg

SEQ ID NO: 108244 - DNA, 25 bp, Mus musculus
gagttcaaatgccaccattgcgagg

SEQ ID NO: 108245 - DNA, 25 bp, Mus musculus
gagttcaagatgacagacccggacg

SEQ ID NO: 108246 - DNA, 25 bp, Mus musculus
gagttcaagcatctcaacccaagga

SEQ ID NO: 108247 - DNA, 25 bp, Mus musculus
gagttcaaggccgttcatattctgc

SEQ ID NO: 108248 - DNA, 25 bp, Mus musculus
gagttcacacctgactgagggtcca

SEQ ID NO: 108249 - DNA, 25 bp, Mus musculus
gagttcaccctggaacggagccaga

SEQ ID NO: 108250 - DNA, 25 bp, Mus musculus
gagttcaccgtctcctggtacaaag

SEQ ID NO: 108251 - DNA, 25 bp, Mus musculus
gagttcactaaatggccagctgcag

SEQ ID NO: 108252 - DNA, 25 bp, Mus musculus
gagttcactctgtctgtggagagca

SEQ ID NO: 108253 - DNA, 25 bp, Mus musculus
gagttcaggatagatgaccaaggca

SEQ ID NO: 108254 - DNA, 25 bp, Mus musculus
gagttcagtagctgtcgagccttcg

SEQ ID NO: 108255 - DNA, 25 bp, Mus musculus
gagttcagtcccaagaatcagaggc

SEQ ID NO: 108256 - DNA, 25 bp, Mus musculus
gagttcatgcgcctattcggtggca

SEQ ID NO: 108257 - DNA, 25 bp, Mus musculus
gagttcattgaacttgtccggcaga

SEQ ID NO: 108258 - DNA, 25 bp, Mus musculus
gagttccaccaggacttgtcaaggc

SEQ ID NO: 108259 - DNA, 25 bp, Mus musculus
gagttccagcaagccaaacaggatg

SEQ ID NO: 108260 - DNA, 25 bp, Mus musculus
gagttccaggaatttctgctgacga

SEQ ID NO: 108261 - DNA, 25 bp, Mus musculus
gagttccagtaccaagccatgggcg

SEQ ID NO: 108262 - DNA, 25 bp, Mus musculus
gagttccagtgctccttcaagaaac

SEQ ID NO: 108263 - DNA, 25 bp, Mus musculus
gagttcccagtcaacaatgaagcag

SEQ ID NO: 108264 - DNA, 25 bp, Mus musculus
gagttcccattgacacggacgatga

SEQ ID NO: 108265 - DNA, 25 bp, Mus musculus
gagttccccaacgtggtccagatgg

SEQ ID NO: 108266 - DNA, 25 bp, Mus musculus
gagttcccgtagctccacgctttga

SEQ ID NO: 108267 - DNA, 25 bp, Mus musculus
gagttccctacctgcgattgtgtcg

SEQ ID NO: 108268 - DNA, 25 bp, Mus musculus
gagttccgcagtctgatgacccggc

SEQ ID NO: 108269 - DNA, 25 bp, Mus musculus
gagttccgggagtgtgactacaata

SEQ ID NO: 108270 - DNA, 25 bp, Mus musculus
gagttccgtgtcctgtacgcagcct

SEQ ID NO: 108271 - DNA, 25 bp, Mus musculus
gagttcctcgaagtcacatgcatca

SEQ ID NO: 108272 - DNA, 25 bp, Mus musculus
gagttcctcgtcgttcctactgcta

SEQ ID NO: 108273 - DNA, 25 bp, Mus musculus
gagttcctgaggatcttcgtactag

SEQ ID NO: 108274 - DNA, 25 bp, Mus musculus
gagttcctgcagtgggagccatgaa

SEQ ID NO: 108275 - DNA, 25 bp, Mus musculus
gagttcctggaaggctacgatccta

SEQ ID NO: 108276 - DNA, 25 bp, Mus musculus
gagttcctggatcctatcaccctgg

SEQ ID NO: 108277 - DNA, 25 bp, Mus musculus
gagttcctgggtaatgctgtcaacg

SEQ ID NO: 108278 - DNA, 25 bp, Mus musculus
gagttcctttacagcggctcgttgg

SEQ ID NO: 108279 - DNA, 25 bp, Mus musculus
gagttcgagttcctgatgcgacagc

SEQ ID NO: 108280 - DNA, 25 bp, Mus musculus
gagttcggaccaagcacacttcagg

SEQ ID NO: 108281 - DNA, 25 bp, Mus musculus
gagttcggcgctgtgttccatgtcc

SEQ ID NO: 108282 - DNA, 25 bp, Mus musculus
gagttcgggcggaatactgccagca

SEQ ID NO: 108283 - DNA, 25 bp, Mus musculus
gagttcgtgtataaggtgtagccta

SEQ ID NO: 108284 - DNA, 25 bp, Mus musculus
gagttcgtgtcatcgagcctcgcaa

SEQ ID NO: 108285 - DNA, 25 bp, Mus musculus
gagttcgtgttccaagtgcccaagg

SEQ ID NO: 108286 - DNA, 25 bp, Mus musculus
gagttctaaacgttggaggccagcg

SEQ ID NO: 108287 - DNA, 25 bp, Mus musculus
gagttctaagtgacatcgcccttgg

SEQ ID NO: 108288 - DNA, 25 bp, Mus musculus
gagttctcagcttttccggccctgg

SEQ ID NO: 108289 - DNA, 25 bp, Mus musculus
gagttctcattagacccgaggtcca

SEQ ID NO: 108290 - DNA, 25 bp, Mus musculus
gagttctcggcactattccccttta

SEQ ID NO: 108291 - DNA, 25 bp, Mus musculus
gagttctgaacctaggtgaccacaa

SEQ ID NO: 108292 - DNA, 25 bp, Mus musculus
gagttctgaactaggtacccacagg

SEQ ID NO: 108293 - DNA, 25 bp, Mus musculus
gagttctgcaacatcctctccaggg

SEQ ID NO: 108294 - DNA, 25 bp, Mus musculus
gagttctgccgaaagcactctgctt

SEQ ID NO: 108295 - DNA, 25 bp, Mus musculus
gagttctgggtctgggtctctccga

SEQ ID NO: 108296 - DNA, 25 bp, Mus musculus
gagttcttacttggagggccaggca

SEQ ID NO: 108297 - DNA, 25 bp, Mus musculus
gagttcttcaatgataccaccacgg

SEQ ID NO: 108298 - DNA, 25 bp, Mus musculus
gagttcttccgcagtaaccccatga

SEQ ID NO: 108299 - DNA, 25 bp, Mus musculus
gagttcttcgcttcacaaataaagg

SEQ ID NO: 108300 - DNA, 25 bp, Mus musculus
gagttcttctagcttccgtggagga

SEQ ID NO: 108301 - DNA, 25 bp, Mus musculus
gagttcttctccaatacaacagacg

SEQ ID NO: 108302 - DNA, 25 bp, Mus musculus
gagttgaacatctccctcgacgagt

SEQ ID NO: 108303 - DNA, 25 bp, Mus musculus
gagttgaaggacacaggccagtcgt

SEQ ID NO: 108304 - DNA, 25 bp, Mus musculus
gagttgactgaaatgtcagagtcct

SEQ ID NO: 108305 - DNA, 25 bp, Mus musculus
gagttgagcctcgagcctgtggaac

SEQ ID NO: 108306 - DNA, 25 bp, Mus musculus
gagttgagcgcttcaaacaaccccg

SEQ ID NO: 108307 - DNA, 25 bp, Mus musculus
gagttgaggacatgccgagcatcac

SEQ ID NO: 108308 - DNA, 25 bp, Mus musculus
gagttgagggtctcattcccaggac

SEQ ID NO: 108309 - DNA, 25 bp, Mus musculus
gagttgcctgagagaatcgctgcgc

SEQ ID NO: 108310 - DNA, 25 bp, Mus musculus
gagttgcctttctcaaaatgaagag

SEQ ID NO: 108311 - DNA, 25 bp, Mus musculus
gagttgcgccttctgtcccaaggag

SEQ ID NO: 108312 - DNA, 25 bp, Mus musculus
gagttgctttgcacatggccagagg

SEQ ID NO: 108313 - DNA, 25 bp, Mus musculus
gagttggaaatttacttctcaccag

SEQ ID NO: 108314 - DNA, 25 bp, Mus musculus
gagttggacactcccaggcttcatg

SEQ ID NO: 108315 - DNA, 25 bp, Mus musculus
gagttggagagacagcaaatccttc

SEQ ID NO: 108316 - DNA, 25 bp, Mus musculus
gagttggagtgagctagaatcagaa

SEQ ID NO: 108317 - DNA, 25 bp, Mus musculus
gagttggatcgatcttcctgcggaa

SEQ ID NO: 108318 - DNA, 25 bp, Mus musculus
gagttggccgcctctctaggactga

SEQ ID NO: 108319 - DNA, 25 bp, Mus musculus
gagttggcgtgctctttgtagctct

SEQ ID NO: 108320 - DNA, 25 bp, Mus musculus
gagttggcgttcgagggctgaaagt

SEQ ID NO: 108321 - DNA, 25 bp, Mus musculus
gagttggctctgacaacctgaggcc

SEQ ID NO: 108322 - DNA, 25 bp, Mus musculus
gagttgggcgattactactaggtcc

SEQ ID NO: 108323 - DNA, 25 bp, Mus musculus
gagttggtcaagctccagagacgcc

SEQ ID NO: 108324 - DNA, 25 bp, Mus musculus
gagttggtcttctttgtgaatggca

SEQ ID NO: 108325 - DNA, 25 bp, Mus musculus
gagttgtccaaacaagatcccaagt

SEQ ID NO: 108326 - DNA, 25 bp, Mus musculus
gagttgtccgctcatgctccagaag

SEQ ID NO: 108327 - DNA, 25 bp, Mus musculus
gagttgtcctcgctgggcttccaga

SEQ ID NO: 108328 - DNA, 25 bp, Mus musculus
gagttgtggtaccattcattgcaaa

SEQ ID NO: 108329 - DNA, 25 bp, Mus musculus
gagttgttcccggttcccgctgtgc

SEQ ID NO: 108330 - DNA, 25 bp, Mus musculus
gagttgttgccgtagagccttcact

SEQ ID NO: 108331 - DNA, 25 bp, Mus musculus
gagttgttggcacagtatccgctaa

SEQ ID NO: 108332 - DNA, 25 bp, Mus musculus
gagttgtttactatctgagcaagca

SEQ ID NO: 108333 - DNA, 25 bp, Mus musculus
gagtttaactccacgagatgcctgg

SEQ ID NO: 108334 - DNA, 25 bp, Mus musculus
gagtttaagcaccttgcccagagga

SEQ ID NO: 108335 - DNA, 25 bp, Mus musculus
gagtttaagttcatccttggccaca

SEQ ID NO: 108336 - DNA, 25 bp, Mus musculus
gagtttagccatggcgctcagcttt

SEQ ID NO: 108337 - DNA, 25 bp, Mus musculus
gagtttaggacaaagtgcagccatc

SEQ ID NO: 108338 - DNA, 25 bp, Mus musculus
gagtttagtccttcagaactcttca

SEQ ID NO: 108339 - DNA, 25 bp, Mus musculus
gagtttatgctatctcaggatgccg

SEQ ID NO: 108340 - DNA, 25 bp, Mus musculus
gagtttattcctctcctggatggtg

SEQ ID NO: 108341 - DNA, 25 bp, Mus musculus
gagtttcaagagagtggaccaccgt

SEQ ID NO: 108342 - DNA, 25 bp, Mus musculus
gagtttcaagatgatccggtcgcag

SEQ ID NO: 108343 - DNA, 25 bp, Mus musculus
gagtttcacctcctgagatcctgag

SEQ ID NO: 108344 - DNA, 25 bp, Mus musculus
gagtttcacgctgcacgaaggtgtg

SEQ ID NO: 108345 - DNA, 25 bp, Mus musculus
gagtttcagtctgcggacacgcgtg

SEQ ID NO: 108346 - DNA, 25 bp, Mus musculus
gagtttcgctatgccaagatgccag

SEQ ID NO: 108347 - DNA, 25 bp, Mus musculus
gagtttcgtcgaagctggctgcccg

SEQ ID NO: 108348 - DNA, 25 bp, Mus musculus
gagtttctcagcgaagcagcatgca

SEQ ID NO: 108349 - DNA, 25 bp, Mus musculus
gagtttctcatcgaatgcagcccag

SEQ ID NO: 108350 - DNA, 25 bp, Mus musculus
gagtttctccgtgccagcttgcagg

SEQ ID NO: 108351 - DNA, 25 bp, Mus musculus
gagtttctgaagctgtgacgcccct

SEQ ID NO: 108352 - DNA, 25 bp, Mus musculus
gagtttcttattcacaccatcgctg

SEQ ID NO: 108353 - DNA, 25 bp, Mus musculus
gagtttgaaaccctctacaatgagc

SEQ ID NO: 108354 - DNA, 25 bp, Mus musculus
gagtttgaaccctgagacctaggaa

SEQ ID NO: 108355 - DNA, 25 bp, Mus musculus
gagtttgacaacgtctacgacccct

SEQ ID NO: 108356 - DNA, 25 bp, Mus musculus
gagtttgacttcgacgttcccgagg

SEQ ID NO: 108357 - DNA, 25 bp, Mus musculus
gagtttgagacatacctgcggagga

SEQ ID NO: 108358 - DNA, 25 bp, Mus musculus
gagtttgagaccatgaggcagttcc

SEQ ID NO: 108359 - DNA, 25 bp, Mus musculus
gagtttgaggcagggagcatcacct

SEQ ID NO: 108360 - DNA, 25 bp, Mus musculus
gagtttgaggtgtatggacccatca

SEQ ID NO: 108361 - DNA, 25 bp, Mus musculus
gagtttgcaaaatgcatgctcccac

SEQ ID NO: 108362 - DNA, 25 bp, Mus musculus
gagtttgccaccttgatcatcgaca

SEQ ID NO: 108363 - DNA, 25 bp, Mus musculus
gagttttaaccggagactgagcgtg

SEQ ID NO: 108364 - DNA, 25 bp, Mus musculus
gagttttagagattttcccagggca

SEQ ID NO: 108365 - DNA, 25 bp, Mus musculus
gagttttagccctaggagtgggtca

SEQ ID NO: 108366 - DNA, 25 bp, Mus musculus
gagttttagtagcttccagagcagc

SEQ ID NO: 108367 - DNA, 25 bp, Mus musculus
gagttttagttattgcaccctggca

SEQ ID NO: 108368 - DNA, 25 bp, Mus musculus
gagttttcatacgtcaatgtatgca

SEQ ID NO: 108369 - DNA, 25 bp, Mus musculus
gagttttcatggctccaagcaggga

SEQ ID NO: 108370 - DNA, 25 bp, Mus musculus
gagttttccaaacctatgatccgga

SEQ ID NO: 108371 - DNA, 25 bp, Mus musculus
gagttttcccatttccagaggtcag

SEQ ID NO: 108372 - DNA, 25 bp, Mus musculus
gagttttcgcccttcccagtggata

SEQ ID NO: 108373 - DNA, 25 bp, Mus musculus
gagttttctaacttaggaagccaca

SEQ ID NO: 108374 - DNA, 25 bp, Mus musculus
gagttttcttgtgaagcccgcaaca

SEQ ID NO: 108375 - DNA, 25 bp, Mus musculus
gagttttgcaatgtgaagttctgca

SEQ ID NO: 108376 - DNA, 25 bp, Mus musculus
gagttttgcatcagcctgcggcagc

SEQ ID NO: 108377 - DNA, 25 bp, Mus musculus
gagttttgcctcaggatttgagaca

SEQ ID NO: 108378 - DNA, 25 bp, Mus musculus
gagtttttcctcatccgggacacga

SEQ ID NO: 108379 - DNA, 25 bp, Mus musculus
gataaaaacattggtgagcaactca

SEQ ID NO: 108380 - DNA, 25 bp, Mus musculus
gataaaaatgggaaaggcttgagac

SEQ ID NO: 108381 - DNA, 25 bp, Mus musculus
gataaaacagacatccaaaagcgac

SEQ ID NO: 108382 - DNA, 25 bp, Mus musculus
gataaaacagagaaaacacgtcttc

SEQ ID NO: 108383 - DNA, 25 bp, Mus musculus
gataaaaccaccaaccagtctagag

SEQ ID NO: 108384 - DNA, 25 bp, Mus musculus
gataaaagatatcatcccactgaga

SEQ ID NO: 108385 - DNA, 25 bp, Mus musculus
gataaaagatcgcttcatggccccg

SEQ ID NO: 108386 - DNA, 25 bp, Mus musculus
gataaaagccagtgggaggccctgc

SEQ ID NO: 108387 - DNA, 25 bp, Mus musculus
gataaaaggatctctgctgggctca

SEQ ID NO: 108388 - DNA, 25 bp, Mus musculus
gataaaatctcaaagggcgtagtcc

SEQ ID NO: 108389 - DNA, 25 bp, Mus musculus
gataaaatggccagcaaccagccct

SEQ ID NO: 108390 - DNA, 25 bp, Mus musculus
gataaacaccggcaacgtcactgaa

SEQ ID NO: 108391 - DNA, 25 bp, Mus musculus
gataaacactggactgtaacaaccc

SEQ ID NO: 108392 - DNA, 25 bp, Mus musculus
gataaaccgggctggtactcccaag

SEQ ID NO: 108393 - DNA, 25 bp, Mus musculus
gataaacctgatgctaagagcccca

SEQ ID NO: 108394 - DNA, 25 bp, Mus musculus
gataaacgcttattctccgagtttg

SEQ ID NO: 108395 - DNA, 25 bp, Mus musculus
gataaactccccagtgactacagcg

SEQ ID NO: 108396 - DNA, 25 bp, Mus musculus
gataaactgcagagcctgcaggccc

SEQ ID NO: 108397 - DNA, 25 bp, Mus musculus
gataaactgccttcgggtagatgct

SEQ ID NO: 108398 - DNA, 25 bp, Mus musculus
gataaacttcatttcaccccgcgga

SEQ ID NO: 108399 - DNA, 25 bp, Mus musculus
gataaacttcgaggacagagtcact

SEQ ID NO: 108400 - DNA, 25 bp, Mus musculus
gataaacttctttctctgcagcgag

SEQ ID NO: 108401 - DNA, 25 bp, Mus musculus
gataaacttgcttgatcaggatgga

SEQ ID NO: 108402 - DNA, 25 bp, Mus musculus
gataaagaaaacatgcgccgggtat

SEQ ID NO: 108403 - DNA, 25 bp, Mus musculus
gataaagagcaggatgagccgagcc

SEQ ID NO: 108404 - DNA, 25 bp, Mus musculus
gataaagaggagctccacgcactgt

SEQ ID NO: 108405 - DNA, 25 bp, Mus musculus
gataaagcctatgcaaccctgaagc

SEQ ID NO: 108406 - DNA, 25 bp, Mus musculus
gataaaggaccctgatgctgccaag

SEQ ID NO: 108407 - DNA, 25 bp, Mus musculus
gataaaggagaggaaagcaaaccaa

SEQ ID NO: 108408 - DNA, 25 bp, Mus musculus
gataaaggccaaacaattccagagg

SEQ ID NO: 108409 - DNA, 25 bp, Mus musculus
gataaaggtgactagttccagaaga

SEQ ID NO: 108410 - DNA, 25 bp, Mus musculus
gataaagtctgccttctcggctgtg

SEQ ID NO: 108411 - DNA, 25 bp, Mus musculus
gataaagtcttttccaccaatgggc

SEQ ID NO: 108412 - DNA, 25 bp, Mus musculus
gataaataacccaacactggcctca

SEQ ID NO: 108413 - DNA, 25 bp, Mus musculus
gataaatgaagtggaacctcctgcc

SEQ ID NO: 108414 - DNA, 25 bp, Mus musculus
gataaattcagccttaccctgtgga

SEQ ID NO: 108415 - DNA, 25 bp, Mus musculus
gataacaactctcgcttgtggcaga

SEQ ID NO: 108416 - DNA, 25 bp, Mus musculus
gataacactgctgcgggagatctca

SEQ ID NO: 108417 - DNA, 25 bp, Mus musculus
gataacatcatgaagcacctgcgga

SEQ ID NO: 108418 - DNA, 25 bp, Mus musculus
gataacatgctcttacgaagctctg

SEQ ID NO: 108419 - DNA, 25 bp, Mus musculus
gataaccattgaccgctacctgaag

SEQ ID NO: 108420 - DNA, 25 bp, Mus musculus
gataaccctagacatggctcaagtg

SEQ ID NO: 108421 - DNA, 25 bp, Mus musculus
gataaccgaggatggccacatatgc

SEQ ID NO: 108422 - DNA, 25 bp, Mus musculus
gataacctagggaaccccaactgtg

SEQ ID NO: 108423 - DNA, 25 bp, Mus musculus
gataacctagttgactttctgcaga

SEQ ID NO: 108424 - DNA, 25 bp, Mus musculus
gataacctgatggtcactccagccg

SEQ ID NO: 108425 - DNA, 25 bp, Mus musculus
gataacctgtgttcgtcctggaggg

SEQ ID NO: 108426 - DNA, 25 bp, Mus musculus
gataacgcactgttcacacccaggg

SEQ ID NO: 108427 - DNA, 25 bp, Mus musculus
gataacgccagggagggtcatcctg

SEQ ID NO: 108428 - DNA, 25 bp, Mus musculus
gataacgcctgagtcctgaattgct

SEQ ID NO: 108429 - DNA, 25 bp, Mus musculus
gataacgctaactgcaacaatactt

SEQ ID NO: 108430 - DNA, 25 bp, Mus musculus
gataacgtggagagagctgatgcct

SEQ ID NO: 108431 - DNA, 25 bp, Mus musculus
gataactagcttggcagactcttca

SEQ ID NO: 108432 - DNA, 25 bp, Mus musculus
gataactcaagccatcgagcgcctg

SEQ ID NO: 108433 - DNA, 25 bp, Mus musculus
gataactccctgtggctggaagaca

SEQ ID NO: 108434 - DNA, 25 bp, Mus musculus
gataactgcaaacacggaaaacggg

SEQ ID NO: 108435 - DNA, 25 bp, Mus musculus
gataactgccccacgctcttggttg

SEQ ID NO: 108436 - DNA, 25 bp, Mus musculus
gataactgcctttaacgatggcctg

SEQ ID NO: 108437 - DNA, 25 bp, Mus musculus
gataactgtggacatcacggctgaa

SEQ ID NO: 108438 - DNA, 25 bp, Mus musculus
gataacttgcaatcgtggccgatgg

SEQ ID NO: 108439 - DNA, 25 bp, Mus musculus
gataagaaatcagaactactgccag

SEQ ID NO: 108440 - DNA, 25 bp, Mus musculus
gataagaagctggatcactgcctcc

SEQ ID NO: 108441 - DNA, 25 bp, Mus musculus
gataagaagcttatggagtcccttg

SEQ ID NO: 108442 - DNA, 25 bp, Mus musculus
gataagaaggctctagtacgctcca

SEQ ID NO: 108443 - DNA, 25 bp, Mus musculus
gataagaccagagttggcctgtcac

SEQ ID NO: 108444 - DNA, 25 bp, Mus musculus
gataagacgtctttccaaggagacc

SEQ ID NO: 108445 - DNA, 25 bp, Mus musculus
gataagatcctgctttttcggcacg

SEQ ID NO: 108446 - DNA, 25 bp, Mus musculus
gataagatgctgtcccacgatccag

SEQ ID NO: 108447 - DNA, 25 bp, Mus musculus
gataagcagcgagccctagaagaaa

SEQ ID NO: 108448 - DNA, 25 bp, Mus musculus
gataagcatatccttgtcacggtgg

SEQ ID NO: 108449 - DNA, 25 bp, Mus musculus
gataagccgattgacaacgacgcgg

SEQ ID NO: 108450 - DNA, 25 bp, Mus musculus
gataagctctatgtctcgtgggtgg

SEQ ID NO: 108451 - DNA, 25 bp, Mus musculus
gataagctgatgaagcccgaggaag

SEQ ID NO: 108452 - DNA, 25 bp, Mus musculus
gataagcttatcagcgtggaggacc

SEQ ID NO: 108453 - DNA, 25 bp, Mus musculus
gataagcttcagacctggacggtgt

SEQ ID NO: 108454 - DNA, 25 bp, Mus musculus
gataaggactcacaagggctgacac

SEQ ID NO: 108455 - DNA, 25 bp, Mus musculus
gataaggatcagaaaccggcacaat

SEQ ID NO: 108456 - DNA, 25 bp, Mus musculus
gataaggatctcaggacatgggcac

SEQ ID NO: 108457 - DNA, 25 bp, Mus musculus
gataaggctgaagaacaacccatgg

SEQ ID NO: 108458 - DNA, 25 bp, Mus musculus
gataaggctggttcatggacacctg

SEQ ID NO: 108459 - DNA, 25 bp, Mus musculus
gataagggcctagcccgatggagca

SEQ ID NO: 108460 - DNA, 25 bp, Mus musculus
gataaggtagctaaaaagatgctcc

SEQ ID NO: 108461 - DNA, 25 bp, Mus musculus
gataaggtcaagatggactccagga

SEQ ID NO: 108462 - DNA, 25 bp, Mus musculus
gataaggtcctctcagacatgaagc

SEQ ID NO: 108463 - DNA, 25 bp, Mus musculus
gataagtacgcagcttgccgtggcc

SEQ ID NO: 108464 - DNA, 25 bp, Mus musculus
gataagtatctgtatgccatgcggc

SEQ ID NO: 108465 - DNA, 25 bp, Mus musculus
gataagtcgcttctgttagccaggg

SEQ ID NO: 108466 - DNA, 25 bp, Mus musculus
gataagtgacgacacaccactggag

SEQ ID NO: 108467 - DNA, 25 bp, Mus musculus
gataagtgatggagtgcgctagccc

SEQ ID NO: 108468 - DNA, 25 bp, Mus musculus
gataagtgcttgttctgctcgtggc

SEQ ID NO: 108469 - DNA, 25 bp, Mus musculus
gataagtttaatgccgtagccactg

SEQ ID NO: 108470 - DNA, 25 bp, Mus musculus
gataagtttgtcaactgccatgagc

SEQ ID NO: 108471 - DNA, 25 bp, Mus musculus
gataataaaagctctgcctgcgtgt

SEQ ID NO: 108472 - DNA, 25 bp, Mus musculus
gataatacattgcttcagcgctgcc

SEQ ID NO: 108473 - DNA, 25 bp, Mus musculus
gataataccagagcgatttcttgcc

SEQ ID NO: 108474 - DNA, 25 bp, Mus musculus
gataatactctcgagctgtgccctg

SEQ ID NO: 108475 - DNA, 25 bp, Mus musculus
gataatagtgattgccacggccagt

SEQ ID NO: 108476 - DNA, 25 bp, Mus musculus
gataatagttctgactggagctggg

SEQ ID NO: 108477 - DNA, 25 bp, Mus musculus
gataatatcacccacgtccctggag

SEQ ID NO: 108478 - DNA, 25 bp, Mus musculus
gataatatgcctgtcacgtggtgct

SEQ ID NO: 108479 - DNA, 25 bp, Mus musculus
gataatattaacactgctcgggcca

SEQ ID NO: 108480 - DNA, 25 bp, Mus musculus
gataatcaacgtccagctctgaagg

SEQ ID NO: 108481 - DNA, 25 bp, Mus musculus
gataatcacctaggcccaacttcgg

SEQ ID NO: 108482 - DNA, 25 bp, Mus musculus
gataatcatctggacgacattcgga

SEQ ID NO: 108483 - DNA, 25 bp, Mus musculus
gataatcggcttagaccaggactgg

SEQ ID NO: 108484 - DNA, 25 bp, Mus musculus
gataatcggttcagcaacaaacaga

SEQ ID NO: 108485 - DNA, 25 bp, Mus musculus
gataatcgtcgggtctccacgggtc

SEQ ID NO: 108486 - DNA, 25 bp, Mus musculus
gataatctatttactggcacacaaa

SEQ ID NO: 108487 - DNA, 25 bp, Mus musculus
gataatctctatggtcggaaagtca

SEQ ID NO: 108488 - DNA, 25 bp, Mus musculus
gataatcttgccaccagggacttca

SEQ ID NO: 108489 - DNA, 25 bp, Mus musculus
gataatgaagacgatgcaatggagt

SEQ ID NO: 108490 - DNA, 25 bp, Mus musculus
gataatgaagcttccggaccatccc

SEQ ID NO: 108491 - DNA, 25 bp, Mus musculus
gataatgacagcgagacccaaagcc

SEQ ID NO: 108492 - DNA, 25 bp, Mus musculus
gataatgagccctgtgcctggcgct

SEQ ID NO: 108493 - DNA, 25 bp, Mus musculus
gataatgcacaacgttacgacctcg

SEQ ID NO: 108494 - DNA, 25 bp, Mus musculus
gataatgcgagagccaaccaggaag

SEQ ID NO: 108495 - DNA, 25 bp, Mus musculus
gataatgctcgtatccaggagaagc

SEQ ID NO: 108496 - DNA, 25 bp, Mus musculus
gataatggcacaccggactctgtgg

SEQ ID NO: 108497 - DNA, 25 bp, Mus musculus
gataatggcctgcatgattgtgaac

SEQ ID NO: 108498 - DNA, 25 bp, Mus musculus
gataatggcttcctgcaaacgtccg

SEQ ID NO: 108499 - DNA, 25 bp, Mus musculus
gataattacgagaccgctgagggcg

SEQ ID NO: 108500 - DNA, 25 bp, Mus musculus
gataattcacgaggagctccagctg

SEQ ID NO: 108501 - DNA, 25 bp, Mus musculus
gataattccacgaggaccagacggg

SEQ ID NO: 108502 - DNA, 25 bp, Mus musculus
gataattcccatagtgaacgggcag

SEQ ID NO: 108503 - DNA, 25 bp, Mus musculus
gataattctaaccaggcagccggag

SEQ ID NO: 108504 - DNA, 25 bp, Mus musculus
gataattctccccttcgtgtaggtg

SEQ ID NO: 108505 - DNA, 25 bp, Mus musculus
gataatttgctcatcccagcaccaa

SEQ ID NO: 108506 - DNA, 25 bp, Mus musculus
gataatttggccctcagctttggag

SEQ ID NO: 108507 - DNA, 25 bp, Mus musculus
gataattttagtttccctgggcctg

SEQ ID NO: 108508 - DNA, 25 bp, Mus musculus
gatacaaactttgcaccgattggtg

SEQ ID NO: 108509 - DNA, 25 bp, Mus musculus
gatacaaagcaatgaaggaagctct

SEQ ID NO: 108510 - DNA, 25 bp, Mus musculus
gatacaaaggtccaggtacatcctg

SEQ ID NO: 108511 - DNA, 25 bp, Mus musculus
gatacaaccgcaaagccatactgag

SEQ ID NO: 108512 - DNA, 25 bp, Mus musculus
gatacaagacagttcaccaatagac

SEQ ID NO: 108513 - DNA, 25 bp, Mus musculus
gatacaagcgctgagggataccgag

SEQ ID NO: 108514 - DNA, 25 bp, Mus musculus
gatacaattccaagaaagcccggcg

SEQ ID NO: 108515 - DNA, 25 bp, Mus musculus
gatacacacagagaatatggccgtt

SEQ ID NO: 108516 - DNA, 25 bp, Mus musculus
gatacaccaggagggttgtcaccag

SEQ ID NO: 108517 - DNA, 25 bp, Mus musculus
gatacaccaggataccagactgcct

SEQ ID NO: 108518 - DNA, 25 bp, Mus musculus
gatacacgattctcattcaacggga

SEQ ID NO: 108519 - DNA, 25 bp, Mus musculus
gatacacgcctcaccatcaagaagt

SEQ ID NO: 108520 - DNA, 25 bp, Mus musculus
gatacacgtcaccaaactatctgtg

SEQ ID NO: 108521 - DNA, 25 bp, Mus musculus
gatacactgacttctgaagatgcag

SEQ ID NO: 108522 - DNA, 25 bp, Mus musculus
gatacactttgcgaactgctccctg

SEQ ID NO: 108523 - DNA, 25 bp, Mus musculus
gatacagacagtccgagtagtggcc

SEQ ID NO: 108524 - DNA, 25 bp, Mus musculus
gatacagaccagcagatccgatagg

SEQ ID NO: 108525 - DNA, 25 bp, Mus musculus
gatacagagcattcctcactccagg

SEQ ID NO: 108526 - DNA, 25 bp, Mus musculus
gatacagatacagggcgacatcact

SEQ ID NO: 108527 - DNA, 25 bp, Mus musculus
gatacagatattatggaaccacgaa

SEQ ID NO: 108528 - DNA, 25 bp, Mus musculus
gatacagggctgaaaggcaccactg

SEQ ID NO: 108529 - DNA, 25 bp, Mus musculus
gatacagtgacacctgaagccaaag

SEQ ID NO: 108530 - DNA, 25 bp, Mus musculus
gatacagttcttgcaggacctacgg

SEQ ID NO: 108531 - DNA, 25 bp, Mus musculus
gatacataaaatattggtctatgcc

SEQ ID NO: 108532 - DNA, 25 bp, Mus musculus
gatacataaatcttgggccccggga

SEQ ID NO: 108533 - DNA, 25 bp, Mus musculus
gatacataaatgtgaggacccaaga

SEQ ID NO: 108534 - DNA, 25 bp, Mus musculus
gatacatcgaagctaatgcaggccc

SEQ ID NO: 108535 - DNA, 25 bp, Mus musculus
gatacatgattaccatttttgacca

SEQ ID NO: 108536 - DNA, 25 bp, Mus musculus
gatacatgcaacagcacaatatccc

SEQ ID NO: 108537 - DNA, 25 bp, Mus musculus
gatacatgctgctgccagacgggtc

SEQ ID NO: 108538 - DNA, 25 bp, Mus musculus
gatacatgcttaccgtctctctaga

SEQ ID NO: 108539 - DNA, 25 bp, Mus musculus
gatacattcctcgatcggactggcc

SEQ ID NO: 108540 - DNA, 25 bp, Mus musculus
gatacatttgcagactccctccgat

SEQ ID NO: 108541 - DNA, 25 bp, Mus musculus
gatacattttctaagtcggatccaa

SEQ ID NO: 108542 - DNA, 25 bp, Mus musculus
gatacattttgacttgcccctcgaa

SEQ ID NO: 108543 - DNA, 25 bp, Mus musculus
gataccaaaggaatggaggagaaag

SEQ ID NO: 108544 - DNA, 25 bp, Mus musculus
gataccacgacaagaacatctacag

SEQ ID NO: 108545 - DNA, 25 bp, Mus musculus
gataccagattccagggatcctcag

SEQ ID NO: 108546 - DNA, 25 bp, Mus musculus
gataccaggattctaagcttcagga

SEQ ID NO: 108547 - DNA, 25 bp, Mus musculus
gataccagggcacaagtaccagtct

SEQ ID NO: 108548 - DNA, 25 bp, Mus musculus
gataccagtagaaaaagtcgccaga

SEQ ID NO: 108549 - DNA, 25 bp, Mus musculus
gataccatagtggacgtggaccgga

SEQ ID NO: 108550 - DNA, 25 bp, Mus musculus
gataccatatgccacccaggaggta

SEQ ID NO: 108551 - DNA, 25 bp, Mus musculus
gataccatcagcagagagagagccg

SEQ ID NO: 108552 - DNA, 25 bp, Mus musculus
gataccatgcggtgcggatccggaa

SEQ ID NO: 108553 - DNA, 25 bp, Mus musculus
gataccattgaccagatgctaaggg

SEQ ID NO: 108554 - DNA, 25 bp, Mus musculus
gataccattggcgacgtgcggaaac

SEQ ID NO: 108555 - DNA, 25 bp, Mus musculus
gatacccaaattgtgcttcatggct

SEQ ID NO: 108556 - DNA, 25 bp, Mus musculus
gatacccacaaggaaagtcagctga

SEQ ID NO: 108557 - DNA, 25 bp, Mus musculus
gatacccatacttctgattcagcag

SEQ ID NO: 108558 - DNA, 25 bp, Mus musculus
gataccccaggtctcgcttcagttt

SEQ ID NO: 108559 - DNA, 25 bp, Mus musculus
gataccccgacagacagagatggtg

SEQ ID NO: 108560 - DNA, 25 bp, Mus musculus
gataccccggtggatatcaactgcc

SEQ ID NO: 108561 - DNA, 25 bp, Mus musculus
gatacccggttctggacatggataa

SEQ ID NO: 108562 - DNA, 25 bp, Mus musculus
gataccctcagaaacagatgcggct

SEQ ID NO: 108563 - DNA, 25 bp, Mus musculus
gataccctctgggaatgccagtcag

SEQ ID NO: 108564 - DNA, 25 bp, Mus musculus
gataccctgaacttggtgaagcgga

SEQ ID NO: 108565 - DNA, 25 bp, Mus musculus
gataccctgcgtgtggtcatcgacc

SEQ ID NO: 108566 - DNA, 25 bp, Mus musculus
gataccctggtcttgctgacactgc

SEQ ID NO: 108567 - DNA, 25 bp, Mus musculus
gataccgaatctataaggcccgaaa

SEQ ID NO: 108568 - DNA, 25 bp, Mus musculus
gataccgagactttccacggccaga

SEQ ID NO: 108569 - DNA, 25 bp, Mus musculus
gataccgagcatccagactgagcag

SEQ ID NO: 108570 - DNA, 25 bp, Mus musculus
gataccgatcgctcactcggccact

SEQ ID NO: 108571 - DNA, 25 bp, Mus musculus
gataccgccattcctggagacaaag

SEQ ID NO: 108572 - DNA, 25 bp, Mus musculus
gataccggactacttcttcagccaa

SEQ ID NO: 108573 - DNA, 25 bp, Mus musculus
gataccggtggcctcattcctggaa

SEQ ID NO: 108574 - DNA, 25 bp, Mus musculus
gataccgtgggaagaaccatcccca

SEQ ID NO: 108575 - DNA, 25 bp, Mus musculus
gatacctagcaatccatggaatgga

SEQ ID NO: 108576 - DNA, 25 bp, Mus musculus
gatacctaggtccagtttgcaggcc

SEQ ID NO: 108577 - DNA, 25 bp, Mus musculus
gatacctcctcccactactaagaaa

SEQ ID NO: 108578 - DNA, 25 bp, Mus musculus
gatacctggccagtatgaggagccc

SEQ ID NO: 108579 - DNA, 25 bp, Mus musculus
gataccttcgctcagcatggcggcg

SEQ ID NO: 108580 - DNA, 25 bp, Mus musculus
gatacgaactctgaagacaccacag

SEQ ID NO: 108581 - DNA, 25 bp, Mus musculus
gatacgacccgttaccaagtgctgc

SEQ ID NO: 108582 - DNA, 25 bp, Mus musculus
gatacgacgctgtttgcagagttcc

SEQ ID NO: 108583 - DNA, 25 bp, Mus musculus
gatacgagaaagcagatcccgcaca

SEQ ID NO: 108584 - DNA, 25 bp, Mus musculus
gatacgatccagtgtgccaagaaaa

SEQ ID NO: 108585 - DNA, 25 bp, Mus musculus
gatacgcatcccagcacaagaagcg

SEQ ID NO: 108586 - DNA, 25 bp, Mus musculus
gatacgcatgcagatagcagcctca

SEQ ID NO: 108587 - DNA, 25 bp, Mus musculus
gatacggaacgacagtgagcttacc

SEQ ID NO: 108588 - DNA, 25 bp, Mus musculus
gatacggaagtagcctgctgttgcc

SEQ ID NO: 108589 - DNA, 25 bp, Mus musculus
gatacggattcttgctgcctgagag

SEQ ID NO: 108590 - DNA, 25 bp, Mus musculus
gatacggcctcactgggaaacagca

SEQ ID NO: 108591 - DNA, 25 bp, Mus musculus
gatacgggcacgtaccagtgcttgg

SEQ ID NO: 108592 - DNA, 25 bp, Mus musculus
gatacgggccacagttaatagccag

SEQ ID NO: 108593 - DNA, 25 bp, Mus musculus
gatacgtgcacgaccgcttcttggt

SEQ ID NO: 108594 - DNA, 25 bp, Mus musculus
gatacgtggcgcttcctggaaaacc

SEQ ID NO: 108595 - DNA, 25 bp, Mus musculus
gatacgttatggtgggcttggcctc

SEQ ID NO: 108596 - DNA, 25 bp, Mus musculus
gatacgttggaccagcaccatgaag

SEQ ID NO: 108597 - DNA, 25 bp, Mus musculus
gatactaaacctcagcaacaaagct

SEQ ID NO: 108598 - DNA, 25 bp, Mus musculus
gatactaagtcagctctgcccagag

SEQ ID NO: 108599 - DNA, 25 bp, Mus musculus
gatactaatgctgctccctcttggg

SEQ ID NO: 108600 - DNA, 25 bp, Mus musculus
gatactaccacaagatgttccctgt

SEQ ID NO: 108601 - DNA, 25 bp, Mus musculus
gatactacccacttgctagccaaag

SEQ ID NO: 108602 - DNA, 25 bp, Mus musculus
gatactatcagtattctccctgatg

SEQ ID NO: 108603 - DNA, 25 bp, Mus musculus
gatactatctgacattcctaacggg

SEQ ID NO: 108604 - DNA, 25 bp, Mus musculus
gatactcaaataacgtgttccctgg

SEQ ID NO: 108605 - DNA, 25 bp, Mus musculus
gatactcaagatccactgcagcgac

SEQ ID NO: 108606 - DNA, 25 bp, Mus musculus
gatactcactttgctcgtgccctgg

SEQ ID NO: 108607 - DNA, 25 bp, Mus musculus
gatactcgaggtggatgtcgcgtcc

SEQ ID NO: 108608 - DNA, 25 bp, Mus musculus
gatactcgatcctatggtgtccaca

SEQ ID NO: 108609 - DNA, 25 bp, Mus musculus
gatactcgctcatctctgggacagt

SEQ ID NO: 108610 - DNA, 25 bp, Mus musculus
gatactcgtctttgatgcctccttg

SEQ ID NO: 108611 - DNA, 25 bp, Mus musculus
gatactctgatcctgcaatggctgc

SEQ ID NO: 108612 - DNA, 25 bp, Mus musculus
gatactgaacaatgccttccggctg

SEQ ID NO: 108613 - DNA, 25 bp, Mus musculus
gatactgaacaggacctagatgggc

SEQ ID NO: 108614 - DNA, 25 bp, Mus musculus
gatactgaagggatcgacacgtcct

SEQ ID NO: 108615 - DNA, 25 bp, Mus musculus
gatactgagtactttgacgccatgg

SEQ ID NO: 108616 - DNA, 25 bp, Mus musculus
gatactgcaaggttcaaggatgaat

SEQ ID NO: 108617 - DNA, 25 bp, Mus musculus
gatactgcaccacttcttgaggatg

SEQ ID NO: 108618 - DNA, 25 bp, Mus musculus
gatactgccgcctcctaaggatcgt

SEQ ID NO: 108619 - DNA, 25 bp, Mus musculus
gatactgcgaagtctatgttagctc

SEQ ID NO: 108620 - DNA, 25 bp, Mus musculus
gatactggtgtatgcgtaacacggc

SEQ ID NO: 108621 - DNA, 25 bp, Mus musculus
gatactgtaacaaaacggctgaagc

SEQ ID NO: 108622 - DNA, 25 bp, Mus musculus
gatactgtagccaagccaaaccgtg

SEQ ID NO: 108623 - DNA, 25 bp, Mus musculus
gatactgtcccctagttcctgtaaa

SEQ ID NO: 108624 - DNA, 25 bp, Mus musculus
gatactgtctcagtaacaaaccact

SEQ ID NO: 108625 - DNA, 25 bp, Mus musculus
gatactgtctctttgaagcaccctg

SEQ ID NO: 108626 - DNA, 25 bp, Mus musculus
gatactgtgcactttggacgccagg

SEQ ID NO: 108627 - DNA, 25 bp, Mus musculus
gatactgttgctgggcataggccat

SEQ ID NO: 108628 - DNA, 25 bp, Mus musculus
gatactgtttttggaccagaaagta

SEQ ID NO: 108629 - DNA, 25 bp, Mus musculus
gatacttacatgaaggcctctacac

SEQ ID NO: 108630 - DNA, 25 bp, Mus musculus
gatacttaccgcagaaggcagatgc

SEQ ID NO: 108631 - DNA, 25 bp, Mus musculus
gatacttatggattcccagtggacc

SEQ ID NO: 108632 - DNA, 25 bp, Mus musculus
gatacttcaagcgtgtggtgttggc

SEQ ID NO: 108633 - DNA, 25 bp, Mus musculus
gatacttggaaagcagatgacctca

SEQ ID NO: 108634 - DNA, 25 bp, Mus musculus
gatacttggtgaattgggatgtcca

SEQ ID NO: 108635 - DNA, 25 bp, Mus musculus
gatactttacagttttgccaccgcc

SEQ ID NO: 108636 - DNA, 25 bp, Mus musculus
gatactttcaaagcaagcttcccaa

SEQ ID NO: 108637 - DNA, 25 bp, Mus musculus
gatactttcttcgaggaggatgcct

SEQ ID NO: 108638 - DNA, 25 bp, Mus musculus
gatacttttggaagcagagtccgag

SEQ ID NO: 108639 - DNA, 25 bp, Mus musculus
gatagaaaacaagactccccaggga

SEQ ID NO: 108640 - DNA, 25 bp, Mus musculus
gatagaaaacgggactgctctgcac

SEQ ID NO: 108641 - DNA, 25 bp, Mus musculus
gatagaaaccttcctagtcctgggt

SEQ ID NO: 108642 - DNA, 25 bp, Mus musculus
gatagaaatgctttaagttcgctct

SEQ ID NO: 108643 - DNA, 25 bp, Mus musculus
gatagaacaatcacccgcaggatgg

SEQ ID NO: 108644 - DNA, 25 bp, Mus musculus
gatagaactgcaggctcagcacagc

SEQ ID NO: 108645 - DNA, 25 bp, Mus musculus
gatagaagagcagcgtgcaatgcct

SEQ ID NO: 108646 - DNA, 25 bp, Mus musculus
gatagaagagtacacggtggccacc

SEQ ID NO: 108647 - DNA, 25 bp, Mus musculus
gatagaaggaagtcaaggcaccatt

SEQ ID NO: 108648 - DNA, 25 bp, Mus musculus
gatagaatccatgcaagggcgctgg

SEQ ID NO: 108649 - DNA, 25 bp, Mus musculus
gatagaattcaaatgtaccaaacac

SEQ ID NO: 108650 - DNA, 25 bp, Mus musculus
gatagacaaatgtgaaactccccag

SEQ ID NO: 108651 - DNA, 25 bp, Mus musculus
gatagacactttcaggatcgaagca

SEQ ID NO: 108652 - DNA, 25 bp, Mus musculus
gatagacagtttaggcttcctgaac

SEQ ID NO: 108653 - DNA, 25 bp, Mus musculus
gatagaccatgaacgccagaaaacc

SEQ ID NO: 108654 - DNA, 25 bp, Mus musculus
gatagacgattatagcaccaccacc

SEQ ID NO: 108655 - DNA, 25 bp, Mus musculus
gatagacgcggttgggagtcctaca

SEQ ID NO: 108656 - DNA, 25 bp, Mus musculus
gatagagaacgagagtgcagagctc

SEQ ID NO: 108657 - DNA, 25 bp, Mus musculus
gatagagactcttcatgcaatggga

SEQ ID NO: 108658 - DNA, 25 bp, Mus musculus
gatagagcaaagctgagtgaactgt

SEQ ID NO: 108659 - DNA, 25 bp, Mus musculus
gatagagccaatgctggaaacccct

SEQ ID NO: 108660 - DNA, 25 bp, Mus musculus
gatagagccacatgccttaggtcca

SEQ ID NO: 108661 - DNA, 25 bp, Mus musculus
gatagagcccaagatcaagcagcca

SEQ ID NO: 108662 - DNA, 25 bp, Mus musculus
gatagagcgcttcagtagaacccca

SEQ ID NO: 108663 - DNA, 25 bp, Mus musculus
gatagagctagaaggctcccagacc

SEQ ID NO: 108664 - DNA, 25 bp, Mus musculus
gatagagggactcacgggcctctcc

SEQ ID NO: 108665 - DNA, 25 bp, Mus musculus
gatagagtacttcctgtcagagtca

SEQ ID NO: 108666 - DNA, 25 bp, Mus musculus
gatagagtttatcatcaagcagctg

SEQ ID NO: 108667 - DNA, 25 bp, Mus musculus
gatagatatcctgacacgcttcaag

SEQ ID NO: 108668 - DNA, 25 bp, Mus musculus
gatagatcagctggcctacgtctca

SEQ ID NO: 108669 - DNA, 25 bp, Mus musculus
gatagatgaataaacttccagaatc

SEQ ID NO: 108670 - DNA, 25 bp, Mus musculus
gatagatgactcttacagggagatc

SEQ ID NO: 108671 - DNA, 25 bp, Mus musculus
gatagatgagctggtcgatgtctac

SEQ ID NO: 108672 - DNA, 25 bp, Mus musculus
gatagatggactctcctctcctgga

SEQ ID NO: 108673 - DNA, 25 bp, Mus musculus
gatagatggcttggacttctgcaga

SEQ ID NO: 108674 - DNA, 25 bp, Mus musculus
gatagatggtcctgtagcagcagca

SEQ ID NO: 108675 - DNA, 25 bp, Mus musculus
gatagattcctcctgcttgatgtgg

SEQ ID NO: 108676 - DNA, 25 bp, Mus musculus
gatagcaccatttttcagaacccca

SEQ ID NO: 108677 - DNA, 25 bp, Mus musculus
gatagcaccccaggaagcttggaag

SEQ ID NO: 108678 - DNA, 25 bp, Mus musculus
gatagcagacctccaaacatggttg

SEQ ID NO: 108679 - DNA, 25 bp, Mus musculus
gatagcagcgcttcagttcctagga

SEQ ID NO: 108680 - DNA, 25 bp, Mus musculus
gatagcagcgtattcttcagccacg

SEQ ID NO: 108681 - DNA, 25 bp, Mus musculus
gatagcagctgtcctaggattggcc

SEQ ID NO: 108682 - DNA, 25 bp, Mus musculus
gatagcagtcactcacgattaggag

SEQ ID NO: 108683 - DNA, 25 bp, Mus musculus
gatagcagtcatcagcctcactgga

SEQ ID NO: 108684 - DNA, 25 bp, Mus musculus
gatagccacacctgggagcggatgt

SEQ ID NO: 108685 - DNA, 25 bp, Mus musculus
gatagccacatgcaaaagcagctgg

SEQ ID NO: 108686 - DNA, 25 bp, Mus musculus
gatagccaccaatttgcaacggcgc

SEQ ID NO: 108687 - DNA, 25 bp, Mus musculus
gatagccatctcacctttgaagtcg

SEQ ID NO: 108688 - DNA, 25 bp, Mus musculus
gatagccatggaagatagtcccacc

SEQ ID NO: 108689 - DNA, 25 bp, Mus musculus
gatagccatgtcttaagcaccaacg

SEQ ID NO: 108690 - DNA, 25 bp, Mus musculus
gatagcccaagaaatcgctgagaag

SEQ ID NO: 108691 - DNA, 25 bp, Mus musculus
gatagcccgaatagatttcctacag

SEQ ID NO: 108692 - DNA, 25 bp, Mus musculus
gatagccctacttacaacagccagg

SEQ ID NO: 108693 - DNA, 25 bp, Mus musculus
gatagccgactgagcccagatgtgg

SEQ ID NO: 108694 - DNA, 25 bp, Mus musculus
gatagcctatgtgcgggacttcaag

SEQ ID NO: 108695 - DNA, 25 bp, Mus musculus
gatagccttgaagcatgggttttca

SEQ ID NO: 108696 - DNA, 25 bp, Mus musculus
gatagcggccacagagctggagaaa

SEQ ID NO: 108697 - DNA, 25 bp, Mus musculus
gatagcggtgctgcgtatgaactca

SEQ ID NO: 108698 - DNA, 25 bp, Mus musculus
gatagctaaataagtggagggccca

SEQ ID NO: 108699 - DNA, 25 bp, Mus musculus
gatagctaaccacctgcaagaattg

SEQ ID NO: 108700 - DNA, 25 bp, Mus musculus
gatagctcccagtttcagtgcacaa

SEQ ID NO: 108701 - DNA, 25 bp, Mus musculus
gatagctctgacgatgagacatccc

SEQ ID NO: 108702 - DNA, 25 bp, Mus musculus
gatagctctggcagtgacactgagg

SEQ ID NO: 108703 - DNA, 25 bp, Mus musculus
gatagctggatccacatcacggaag

SEQ ID NO: 108704 - DNA, 25 bp, Mus musculus
gatagctgtcaccttctgcctcaag

SEQ ID NO: 108705 - DNA, 25 bp, Mus musculus
gatagctgtcctgtctgctgagaaa

SEQ ID NO: 108706 - DNA, 25 bp, Mus musculus
gatagcttctcccaggtaccagatg

SEQ ID NO: 108707 - DNA, 25 bp, Mus musculus
gatagctttggagacctatcctctg

SEQ ID NO: 108708 - DNA, 25 bp, Mus musculus
gataggaatttaggccacagtgtcc

SEQ ID NO: 108709 - DNA, 25 bp, Mus musculus
gataggactgctgaactgcgaagcc

SEQ ID NO: 108710 - DNA, 25 bp, Mus musculus
gataggagaccactagacatggagc

SEQ ID NO: 108711 - DNA, 25 bp, Mus musculus
gataggatggaaataccatgactct

SEQ ID NO: 108712 - DNA, 25 bp, Mus musculus
gataggattcgatgtcgtcaccctg

SEQ ID NO: 108713 - DNA, 25 bp, Mus musculus
gataggattgttgcagataacgcca

SEQ ID NO: 108714 - DNA, 25 bp, Mus musculus
gataggcatctttgctaagagggct

SEQ ID NO: 108715 - DNA, 25 bp, Mus musculus
gataggccagcatctctacacgtag

SEQ ID NO: 108716 - DNA, 25 bp, Mus musculus
gataggcccacaggagttggacaca

SEQ ID NO: 108717 - DNA, 25 bp, Mus musculus
gataggccggccttctacagtgcac

SEQ ID NO: 108718 - DNA, 25 bp, Mus musculus
gataggcctggattctccactgagg

SEQ ID NO: 108719 - DNA, 25 bp, Mus musculus
gataggcttctagacagctgcgtcc

SEQ ID NO: 108720 - DNA, 25 bp, Mus musculus
gatagggagaccatcgccttctaca

SEQ ID NO: 108721 - DNA, 25 bp, Mus musculus
gataggtgtgatcttaactgccgga

SEQ ID NO: 108722 - DNA, 25 bp, Mus musculus
gatagtaaggttcctggctacacac

SEQ ID NO: 108723 - DNA, 25 bp, Mus musculus
gatagtaggaagcatggcgaccacc

SEQ ID NO: 108724 - DNA, 25 bp, Mus musculus
gatagtatactgtgacccaagtgac

SEQ ID NO: 108725 - DNA, 25 bp, Mus musculus
gatagtattgctgcataccccgtgc

SEQ ID NO: 108726 - DNA, 25 bp, Mus musculus
gatagtccatccacagaaacgcatg

SEQ ID NO: 108727 - DNA, 25 bp, Mus musculus
gatagtcccgtgcaaagtgtttctg

SEQ ID NO: 108728 - DNA, 25 bp, Mus musculus
gatagtcctgggttggttgccacag

SEQ ID NO: 108729 - DNA, 25 bp, Mus musculus
gatagtcgccataccagtaaatgct

SEQ ID NO: 108730 - DNA, 25 bp, Mus musculus
gatagtgaccaggactctgctgagg

SEQ ID NO: 108731 - DNA, 25 bp, Mus musculus
gatagtgacttgatgttgcccagac

SEQ ID NO: 108732 - DNA, 25 bp, Mus musculus
gatagtgagatttatgttaaaagct

SEQ ID NO: 108733 - DNA, 25 bp, Mus musculus
gatagtgcaatagctcagaacccgc

SEQ ID NO: 108734 - DNA, 25 bp, Mus musculus
gatagtgcgatacaggaagtctcca

SEQ ID NO: 108735 - DNA, 25 bp, Mus musculus
gatagtgctcgtgaaatcctgcgaa

SEQ ID NO: 108736 - DNA, 25 bp, Mus musculus
gatagtgtttgcaggccatgagcat

SEQ ID NO: 108737 - DNA, 25 bp, Mus musculus
gatagttaaccacctgagaccagct

SEQ ID NO: 108738 - DNA, 25 bp, Mus musculus
gatagttggaccacagtgtctcccc

SEQ ID NO: 108739 - DNA, 25 bp, Mus musculus
gatagtttaaccaagcagcccgagg

SEQ ID NO: 108740 - DNA, 25 bp, Mus musculus
gatagtttctccacatttgatacgc

SEQ ID NO: 108741 - DNA, 25 bp, Mus musculus
gatagtttgcgaaagggaatgcccc

SEQ ID NO: 108742 - DNA, 25 bp, Mus musculus
gatataaattgtaatgcctgccagg

SEQ ID NO: 108743 - DNA, 25 bp, Mus musculus
gatataaccggattcaacatgggca

SEQ ID NO: 108744 - DNA, 25 bp, Mus musculus
gatataagagcgtaactggctgtca

SEQ ID NO: 108745 - DNA, 25 bp, Mus musculus
gatataatttccctcaatgcagtga

SEQ ID NO: 108746 - DNA, 25 bp, Mus musculus
gatatacactttctctcacaggctg

SEQ ID NO: 108747 - DNA, 25 bp, Mus musculus
gatatacagtcctcgagaaattcgg

SEQ ID NO: 108748 - DNA, 25 bp, Mus musculus
gatatacccaggcactcatggctcc

SEQ ID NO: 108749 - DNA, 25 bp, Mus musculus
gatatacccgtcttgttgcaggccg

SEQ ID NO: 108750 - DNA, 25 bp, Mus musculus
gatataccgcattgtttctcagaag

SEQ ID NO: 108751 - DNA, 25 bp, Mus musculus
gatatactgcgtgcgctgtacctgc

SEQ ID NO: 108752 - DNA, 25 bp, Mus musculus
gatatagaagtcacagacagtcgct

SEQ ID NO: 108753 - DNA, 25 bp, Mus musculus
gatatagctctaagccgggtcctgg

SEQ ID NO: 108754 - DNA, 25 bp, Mus musculus
gatatagtctgcaccgtcgatgcca

SEQ ID NO: 108755 - DNA, 25 bp, Mus musculus
gatatagttctctaccatggtcagg

SEQ ID NO: 108756 - DNA, 25 bp, Mus musculus
gatatagtttggctcatcggaacag

SEQ ID NO: 108757 - DNA, 25 bp, Mus musculus
gatatattccgtcctccaagaaagg

SEQ ID NO: 108758 - DNA, 25 bp, Mus musculus
gatatattgaaaatccacgcaggac

SEQ ID NO: 108759 - DNA, 25 bp, Mus musculus
gatatatttcccaatcagcctggtg

SEQ ID NO: 108760 - DNA, 25 bp, Mus musculus
gatatcaagagggtcatggcggcta

SEQ ID NO: 108761 - DNA, 25 bp, Mus musculus
gatatcaagatggatcgcccggaat

SEQ ID NO: 108762 - DNA, 25 bp, Mus musculus
gatatcaagcgcatggatgaccctg

SEQ ID NO: 108763 - DNA, 25 bp, Mus musculus
gatatcaatgagatggagtcccctc

SEQ ID NO: 108764 - DNA, 25 bp, Mus musculus
gatatcaccagcgttctcaagcgat

SEQ ID NO: 108765 - DNA, 25 bp, Mus musculus
gatatcaccataaaagcagagcctc

SEQ ID NO: 108766 - DNA, 25 bp, Mus musculus
gatatcaccgaagggactgtcgtcc

SEQ ID NO: 108767 - DNA, 25 bp, Mus musculus
gatatcacctaccttcgaatctcag

SEQ ID NO: 108768 - DNA, 25 bp, Mus musculus
gatatcacgcaataagatcctggcc

SEQ ID NO: 108769 - DNA, 25 bp, Mus musculus
gatatcagcactaaacatcgtggga

SEQ ID NO: 108770 - DNA, 25 bp, Mus musculus
gatatcagccctaaacatcgttggg

SEQ ID NO: 108771 - DNA, 25 bp, Mus musculus
gatatcagccgggaaaatggcctgg

SEQ ID NO: 108772 - DNA, 25 bp, Mus musculus
gatatcagttctgggcaagcacact

SEQ ID NO: 108773 - DNA, 25 bp, Mus musculus
gatatcatctctcctctgctgtctg

SEQ ID NO: 108774 - DNA, 25 bp, Mus musculus
gatatccaccaacatatggccagtg

SEQ ID NO: 108775 - DNA, 25 bp, Mus musculus
gatatccagaaagacacggcagttg

SEQ ID NO: 108776 - DNA, 25 bp, Mus musculus
gatatcccgagactacggagtgctg

SEQ ID NO: 108777 - DNA, 25 bp, Mus musculus
gatatccgaaccaaggacatcgagg

SEQ ID NO: 108778 - DNA, 25 bp, Mus musculus
gatatccgcagtatcagtacactca

SEQ ID NO: 108779 - DNA, 25 bp, Mus musculus
gatatccgtgcccttgctcatctac

SEQ ID NO: 108780 - DNA, 25 bp, Mus musculus
gatatcctaagaaaacttctggcag

SEQ ID NO: 108781 - DNA, 25 bp, Mus musculus
gatatcctcgataagctctcgcgcc

SEQ ID NO: 108782 - DNA, 25 bp, Mus musculus
gatatcctgggacttgccttgtgcc

SEQ ID NO: 108783 - DNA, 25 bp, Mus musculus
gatatccttagactaactcctgagc

SEQ ID NO: 108784 - DNA, 25 bp, Mus musculus
gatatcgaagtgacatcttctcctg

SEQ ID NO: 108785 - DNA, 25 bp, Mus musculus
gatatcgcgacccaaggctggttca

SEQ ID NO: 108786 - DNA, 25 bp, Mus musculus
gatatcgctgcgctggtcgtcgaca

SEQ ID NO: 108787 - DNA, 25 bp, Mus musculus
gatatcgcttcagatgccttcgcta

SEQ ID NO: 108788 - DNA, 25 bp, Mus musculus
gatatctacaggaacttgggcagtg

SEQ ID NO: 108789 - DNA, 25 bp, Mus musculus
gatatctacgacactcagaccttgg

SEQ ID NO: 108790 - DNA, 25 bp, Mus musculus
gatatctccctaactggaggctctg

SEQ ID NO: 108791 - DNA, 25 bp, Mus musculus
gatatctcgctggttgtgcctaaag

SEQ ID NO: 108792 - DNA, 25 bp, Mus musculus
gatatctgaaaacctaggcaccctg

SEQ ID NO: 108793 - DNA, 25 bp, Mus musculus
gatatctgtccatttagagggccca

SEQ ID NO: 108794 - DNA, 25 bp, Mus musculus
gatatcttctggtgacaagcgggtg

SEQ ID NO: 108795 - DNA, 25 bp, Mus musculus
gatatcttgcccatgtttgccaaag

SEQ ID NO: 108796 - DNA, 25 bp, Mus musculus
gatatcttgtgaatcagactggcca

SEQ ID NO: 108797 - DNA, 25 bp, Mus musculus
gatatgaacggtctagaggcactcc

SEQ ID NO: 108798 - DNA, 25 bp, Mus musculus
gatatgaactgcatacgccaggccc

SEQ ID NO: 108799 - DNA, 25 bp, Mus musculus
gatatgaagaccaaaatcccactgg

SEQ ID NO: 108800 - DNA, 25 bp, Mus musculus
gatatgaagctctcagacactgtcg

SEQ ID NO: 108801 - DNA, 25 bp, Mus musculus
gatatgaaggaccaagtccacggct

SEQ ID NO: 108802 - DNA, 25 bp, Mus musculus
gatatgacattacaactgccgctgc

SEQ ID NO: 108803 - DNA, 25 bp, Mus musculus
gatatgacccaatccagtgaagctg

SEQ ID NO: 108804 - DNA, 25 bp, Mus musculus
gatatgactaccttgccaaaacctg

SEQ ID NO: 108805 - DNA, 25 bp, Mus musculus
gatatgactcctacctatgggctga

SEQ ID NO: 108806 - DNA, 25 bp, Mus musculus
gatatgagtgttcctgagccaccgc

SEQ ID NO: 108807 - DNA, 25 bp, Mus musculus
gatatgatgtctctgaacagccagc

SEQ ID NO: 108808 - DNA, 25 bp, Mus musculus
gatatgattcgtaactggagccacc

SEQ ID NO: 108809 - DNA, 25 bp, Mus musculus
gatatgcaatcaacccatcccgtga

SEQ ID NO: 108810 - DNA, 25 bp, Mus musculus
gatatgcacaagtgccttgccagaa

SEQ ID NO: 108811 - DNA, 25 bp, Mus musculus
gatatgcagctttcgaggatctgtc

SEQ ID NO: 108812 - DNA, 25 bp, Mus musculus
gatatgcagtaccttactcccaaag

SEQ ID NO: 108813 - DNA, 25 bp, Mus musculus
gatatgcagtggaactatgctccca

SEQ ID NO: 108814 - DNA, 25 bp, Mus musculus
gatatgcatcagtacagccagtggc

SEQ ID NO: 108815 - DNA, 25 bp, Mus musculus
gatatgccaagcagagggcagaatg

SEQ ID NO: 108816 - DNA, 25 bp, Mus musculus
gatatgccacataggatgctccaaa

SEQ ID NO: 108817 - DNA, 25 bp, Mus musculus
gatatgccagcctaggtgacacagg

SEQ ID NO: 108818 - DNA, 25 bp, Mus musculus
gatatgccagttgaaggcctcgaga

SEQ ID NO: 108819 - DNA, 25 bp, Mus musculus
gatatgcctatgtcacactgtcact

SEQ ID NO: 108820 - DNA, 25 bp, Mus musculus
gatatgcctgaagaaagctctgagg

SEQ ID NO: 108821 - DNA, 25 bp, Mus musculus
gatatgctgaatgtccccatcctgg

SEQ ID NO: 108822 - DNA, 25 bp, Mus musculus
gatatgctgcaacccaaagtcagga

SEQ ID NO: 108823 - DNA, 25 bp, Mus musculus
gatatggccagcaagtctactaaga

SEQ ID NO: 108824 - DNA, 25 bp, Mus musculus
gatatggccagtagcacaggacatg

SEQ ID NO: 108825 - DNA, 25 bp, Mus musculus
gatatggccctagaactcaagaaac

SEQ ID NO: 108826 - DNA, 25 bp, Mus musculus
gatatggccctgctagctgactgtg

SEQ ID NO: 108827 - DNA, 25 bp, Mus musculus
gatatggcgttgacccaagggctct

SEQ ID NO: 108828 - DNA, 25 bp, Mus musculus
gatatggctgtgtccttccgcggcc

SEQ ID NO: 108829 - DNA, 25 bp, Mus musculus
gatatggtcaccaaggtcctgctgt

SEQ ID NO: 108830 - DNA, 25 bp, Mus musculus
gatatggtcaccatcgccacaggac

SEQ ID NO: 108831 - DNA, 25 bp, Mus musculus
gatatgtcagatatgccgacctagg

SEQ ID NO: 108832 - DNA, 25 bp, Mus musculus
gatatgtgctcctgatacggctctc

SEQ ID NO: 108833 - DNA, 25 bp, Mus musculus
gatatgtgggcaacgttcttctgca

SEQ ID NO: 108834 - DNA, 25 bp, Mus musculus
gatatgttaggagacgctgcaagcc

SEQ ID NO: 108835 - DNA, 25 bp, Mus musculus
gatatgttgagtggcttcccggctg

SEQ ID NO: 108836 - DNA, 25 bp, Mus musculus
gatattaaacaccatggcagcctgg

SEQ ID NO: 108837 - DNA, 25 bp, Mus musculus
gatattaactcgtccgtggaaagcc

SEQ ID NO: 108838 - DNA, 25 bp, Mus musculus
gatattacaaatgaagaccatcaaa

SEQ ID NO: 108839 - DNA, 25 bp, Mus musculus
gatattacagccacacactagtaga

SEQ ID NO: 108840 - DNA, 25 bp, Mus musculus
gatattacagccagtgatctaagtg

SEQ ID NO: 108841 - DNA, 25 bp, Mus musculus
gatattacgtggacgatgccctgca

SEQ ID NO: 108842 - DNA, 25 bp, Mus musculus
gatattactgttttgcgccacctag

SEQ ID NO: 108843 - DNA, 25 bp, Mus musculus
gatattcacatccaaagcgggcagc

SEQ ID NO: 108844 - DNA, 25 bp, Mus musculus
gatattcaggaagtgctgccggtcc

SEQ ID NO: 108845 - DNA, 25 bp, Mus musculus
gatattccctctggctcttatgtag

SEQ ID NO: 108846 - DNA, 25 bp, Mus musculus
gatattcctaatggtgcaaccttgc

SEQ ID NO: 108847 - DNA, 25 bp, Mus musculus
gatattctaactcaggaaagccgga

SEQ ID NO: 108848 - DNA, 25 bp, Mus musculus
gatattctcgaatagcccagagcag

SEQ ID NO: 108849 - DNA, 25 bp, Mus musculus
gatattctctacgtattccagggca

SEQ ID NO: 108850 - DNA, 25 bp, Mus musculus
gatattctgtttgccatgtccactc

SEQ ID NO: 108851 - DNA, 25 bp, Mus musculus
gatattcttactaggcaccagtggc

SEQ ID NO: 108852 - DNA, 25 bp, Mus musculus
gatattcttttctcctcggactcag

SEQ ID NO: 108853 - DNA, 25 bp, Mus musculus
gatattgaagcgctaggctgcagca

SEQ ID NO: 108854 - DNA, 25 bp, Mus musculus
gatattgactatccattgagatgga

SEQ ID NO: 108855 - DNA, 25 bp, Mus musculus
gatattgagttagagctttcagccc

SEQ ID NO: 108856 - DNA, 25 bp, Mus musculus
gatattgcagtggaaagtctggctc

SEQ ID NO: 108857 - DNA, 25 bp, Mus musculus
gatattgccatcaactgggccggtg

SEQ ID NO: 108858 - DNA, 25 bp, Mus musculus
gatattgcccgaagcatgggagcca

SEQ ID NO: 108859 - DNA, 25 bp, Mus musculus
gatattgcgacctactctgcctggt

SEQ ID NO: 108860 - DNA, 25 bp, Mus musculus
gatattgctctacggatcgtgaccc

SEQ ID NO: 108861 - DNA, 25 bp, Mus musculus
gatattgctgcagaattggccagga

SEQ ID NO: 108862 - DNA, 25 bp, Mus musculus
gatattggccacaaactctgagttg

SEQ ID NO: 108863 - DNA, 25 bp, Mus musculus
gatattggcgatcctaggtagcaga

SEQ ID NO: 108864 - DNA, 25 bp, Mus musculus
gatattggcgctatttcgggccggc

SEQ ID NO: 108865 - DNA, 25 bp, Mus musculus
gatattgggccaactgaagacaggg

SEQ ID NO: 108866 - DNA, 25 bp, Mus musculus
gatattgggtatctcgaccggtcct

SEQ ID NO: 108867 - DNA, 25 bp, Mus musculus
gatattgtaccctgactgagtccag

SEQ ID NO: 108868 - DNA, 25 bp, Mus musculus
gatattgtccttttggagcagggca

SEQ ID NO: 108869 - DNA, 25 bp, Mus musculus
gatattgttacacctaaggctcctg

SEQ ID NO: 108870 - DNA, 25 bp, Mus musculus
gatattgttagttcagcagcccgca

SEQ ID NO: 108871 - DNA, 25 bp, Mus musculus
gatattgttgacatgcacgcagctg

SEQ ID NO: 108872 - DNA, 25 bp, Mus musculus
gatatttacatctgggcacccttgg

SEQ ID NO: 108873 - DNA, 25 bp, Mus musculus
gatatttcagaaaggcgagtctcct

SEQ ID NO: 108874 - DNA, 25 bp, Mus musculus
gatatttcctcttccacgtcggtca

SEQ ID NO: 108875 - DNA, 25 bp, Mus musculus
gatatttctggtttgaagcccctca

SEQ ID NO: 108876 - DNA, 25 bp, Mus musculus
gatatttgacagacaaatggcagag

SEQ ID NO: 108877 - DNA, 25 bp, Mus musculus
gatatttgcaataatcccgccatgg

SEQ ID NO: 108878 - DNA, 25 bp, Mus musculus
gatatttgcgcatggtgtggaggag

SEQ ID NO: 108879 - DNA, 25 bp, Mus musculus
gatattttcactggcgccgcggcag

SEQ ID NO: 108880 - DNA, 25 bp, Mus musculus
gatcaaaacctgaagctagctctag

SEQ ID NO: 108881 - DNA, 25 bp, Mus musculus
gatcaaaatcgctaaccctggcgct

SEQ ID NO: 108882 - DNA, 25 bp, Mus musculus
gatcaaacagtgctcattcttcatg

SEQ ID NO: 108883 - DNA, 25 bp, Mus musculus
gatcaaaccatcatgcggaagcggg

SEQ ID NO: 108884 - DNA, 25 bp, Mus musculus
gatcaaaccgcttctaaatgataag

SEQ ID NO: 108885 - DNA, 25 bp, Mus musculus
gatcaaactttactcaggctcctgc

SEQ ID NO: 108886 - DNA, 25 bp, Mus musculus
gatcaaagccatctcgtctgcggtg

SEQ ID NO: 108887 - DNA, 25 bp, Mus musculus
gatcaaatcgtgtgtgtccctcccg

SEQ ID NO: 108888 - DNA, 25 bp, Mus musculus
gatcaaatctggcaacgagggtcga

SEQ ID NO: 108889 - DNA, 25 bp, Mus musculus
gatcaaatgcaaagctgcggtgcta

SEQ ID NO: 108890 - DNA, 25 bp, Mus musculus
gatcaaattatatgacatggcagat

SEQ ID NO: 108891 - DNA, 25 bp, Mus musculus
gatcaacaagggacactaccagagg

SEQ ID NO: 108892 - DNA, 25 bp, Mus musculus
gatcaacaatgtggagagccgagac

SEQ ID NO: 108893 - DNA, 25 bp, Mus musculus
gatcaacactttcctagctactgcg

SEQ ID NO: 108894 - DNA, 25 bp, Mus musculus
gatcaacagctctcacttggcaggg

SEQ ID NO: 108895 - DNA, 25 bp, Mus musculus
gatcaacatgagcttcgtcccagag

SEQ ID NO: 108896 - DNA, 25 bp, Mus musculus
gatcaaccatgagctccgttgcagt

SEQ ID NO: 108897 - DNA, 25 bp, Mus musculus
gatcaaccctgatgctagtgctgcc

SEQ ID NO: 108898 - DNA, 25 bp, Mus musculus
gatcaacctcgtcgactgggcagag

SEQ ID NO: 108899 - DNA, 25 bp, Mus musculus
gatcaacctgcttcctgaccgagtg

SEQ ID NO: 108900 - DNA, 25 bp, Mus musculus
gatcaactgaggaagcttcaagcca

SEQ ID NO: 108901 - DNA, 25 bp, Mus musculus
gatcaactgcctgctgaaggagcgg

SEQ ID NO: 108902 - DNA, 25 bp, Mus musculus
gatcaactggatccagcaggtgctg

SEQ ID NO: 108903 - DNA, 25 bp, Mus musculus
gatcaacttcagcaagcccgaggct

SEQ ID NO: 108904 - DNA, 25 bp, Mus musculus
gatcaacttccgtggagaatggctt

SEQ ID NO: 108905 - DNA, 25 bp, Mus musculus
gatcaagaacgacatagagaaagcc

SEQ ID NO: 108906 - DNA, 25 bp, Mus musculus
gatcaagaggcaccaaccaactgga

SEQ ID NO: 108907 - DNA, 25 bp, Mus musculus
gatcaagatcgtgtctgccgtgcgg

SEQ ID NO: 108908 - DNA, 25 bp, Mus musculus
gatcaagatggaaaaattgggctca

SEQ ID NO: 108909 - DNA, 25 bp, Mus musculus
gatcaagattgcacagacagcccga

SEQ ID NO: 108910 - DNA, 25 bp, Mus musculus
gatcaagcacttcgaccctcggaaa

SEQ ID NO: 108911 - DNA, 25 bp, Mus musculus
gatcaaggaacaaaccaggaaccgt

SEQ ID NO: 108912 - DNA, 25 bp, Mus musculus
gatcaaggagctcactaatgcttac

SEQ ID NO: 108913 - DNA, 25 bp, Mus musculus
gatcaaggcctgtatgtgtcatcca

SEQ ID NO: 108914 - DNA, 25 bp, Mus musculus
gatcaaggtgtttgttctggacgag

SEQ ID NO: 108915 - DNA, 25 bp, Mus musculus
gatcaaggttctgctgtgccccatg

SEQ ID NO: 108916 - DNA, 25 bp, Mus musculus
gatcaagtctcgcagcatgtgctcg

SEQ ID NO: 108917 - DNA, 25 bp, Mus musculus
gatcaagttcctcgcatgcagccaa

SEQ ID NO: 108918 - DNA, 25 bp, Mus musculus
gatcaagttgggaattctcctccag

SEQ ID NO: 108919 - DNA, 25 bp, Mus musculus
gatcaagtttgtggtcctggcagac

SEQ ID NO: 108920 - DNA, 25 bp, Mus musculus
gatcaatagggaaacacaggtagcc

SEQ ID NO: 108921 - DNA, 25 bp, Mus musculus
gatcaatcgcttacgtgagcagaag

SEQ ID NO: 108922 - DNA, 25 bp, Mus musculus
gatcaatcgttttgcttggccgaag

SEQ ID NO: 108923 - DNA, 25 bp, Mus musculus
gatcaatgacgtgaccagagcttgg

SEQ ID NO: 108924 - DNA, 25 bp, Mus musculus
gatcaatggcgtatggaatctgtcc

SEQ ID NO: 108925 - DNA, 25 bp, Mus musculus
gatcaatggctcatccaaccgggag

SEQ ID NO: 108926 - DNA, 25 bp, Mus musculus
gatcaatgtggacccagacagcaag

SEQ ID NO: 108927 - DNA, 25 bp, Mus musculus
gatcaattggttgaggccgcgctct

SEQ ID NO: 108928 - DNA, 25 bp, Mus musculus
gatcaatttcctttccctttgcgca

SEQ ID NO: 108929 - DNA, 25 bp, Mus musculus
gatcacaaatagagcagctgcccct

SEQ ID NO: 108930 - DNA, 25 bp, Mus musculus
gatcacaaatggaactgaagccctt

SEQ ID NO: 108931 - DNA, 25 bp, Mus musculus
gatcacaaccaaaagcctcatcgag

SEQ ID NO: 108932 - DNA, 25 bp, Mus musculus
gatcacaatcatagacagtccatgc

SEQ ID NO: 108933 - DNA, 25 bp, Mus musculus
gatcacacatcttcgagctctgcca

SEQ ID NO: 108934 - DNA, 25 bp, Mus musculus
gatcacagacttcggccttgcccga

SEQ ID NO: 108935 - DNA, 25 bp, Mus musculus
gatcacagagtatcagagccgcaag

SEQ ID NO: 108936 - DNA, 25 bp, Mus musculus
gatcacagccgcacatgagcttgga

SEQ ID NO: 108937 - DNA, 25 bp, Mus musculus
gatcacaggtgtgtcttgccgggac

SEQ ID NO: 108938 - DNA, 25 bp, Mus musculus
gatcacagtggctcacgtcctggga

SEQ ID NO: 108939 - DNA, 25 bp, Mus musculus
gatcacatgctccatggtgcgcacg

SEQ ID NO: 108940 - DNA, 25 bp, Mus musculus
gatcaccaatctatgagcccaggag

SEQ ID NO: 108941 - DNA, 25 bp, Mus musculus
gatcaccacaaagacaggcggttcg

SEQ ID NO: 108942 - DNA, 25 bp, Mus musculus
gatcaccaccttgaaaacgaacttg

SEQ ID NO: 108943 - DNA, 25 bp, Mus musculus
gatcaccactgtccttgggtcaaca

SEQ ID NO: 108944 - DNA, 25 bp, Mus musculus
gatcaccagctttgcgtcctcagca

SEQ ID NO: 108945 - DNA, 25 bp, Mus musculus
gatcacccggaatcagtgccagctg

SEQ ID NO: 108946 - DNA, 25 bp, Mus musculus
gatcacccgggaagatgacagagac

SEQ ID NO: 108947 - DNA, 25 bp, Mus musculus
gatcaccggtttccgactgagcctg

SEQ ID NO: 108948 - DNA, 25 bp, Mus musculus
gatcaccgtgtagctgaggcgctga

SEQ ID NO: 108949 - DNA, 25 bp, Mus musculus
gatcacctaacgtaatggacctttg

SEQ ID NO: 108950 - DNA, 25 bp, Mus musculus
gatcacgatgacaacctcccaaaag

SEQ ID NO: 108951 - DNA, 25 bp, Mus musculus
gatcacgatgttccggatgctgagc

SEQ ID NO: 108952 - DNA, 25 bp, Mus musculus
gatcacgggaaagccaataccatgg

SEQ ID NO: 108953 - DNA, 25 bp, Mus musculus
gatcacggtggcagcttccagggta

SEQ ID NO: 108954 - DNA, 25 bp, Mus musculus
gatcacgtgttactgcagaaagccc

SEQ ID NO: 108955 - DNA, 25 bp, Mus musculus
gatcactcacctgcgcaggaacaat

SEQ ID NO: 108956 - DNA, 25 bp, Mus musculus
gatcactccctgcatctaagcaaag

SEQ ID NO: 108957 - DNA, 25 bp, Mus musculus
gatcactcgattggctgtgtgggct

SEQ ID NO: 108958 - DNA, 25 bp, Mus musculus
gatcactctgatgaaagccaggagg

SEQ ID NO: 108959 - DNA, 25 bp, Mus musculus
gatcactgacgctgcccgccataaa

SEQ ID NO: 108960 - DNA, 25 bp, Mus musculus
gatcactgtggctacggcagagaca

SEQ ID NO: 108961 - DNA, 25 bp, Mus musculus
gatcagaacccagccgagtgcaagc

SEQ ID NO: 108962 - DNA, 25 bp, Mus musculus
gatcagaactacgtgaaagtcttgg

SEQ ID NO: 108963 - DNA, 25 bp, Mus musculus
gatcagaagaacattagacgaagag

SEQ ID NO: 108964 - DNA, 25 bp, Mus musculus
gatcagaagaactttgggtccctac

SEQ ID NO: 108965 - DNA, 25 bp, Mus musculus
gatcagaagaatccatcgaataccc

SEQ ID NO: 108966 - DNA, 25 bp, Mus musculus
gatcagaatccgcaggtgcactcac

SEQ ID NO: 108967 - DNA, 25 bp, Mus musculus
gatcagacagaaagcctcacggtag

SEQ ID NO: 108968 - DNA, 25 bp, Mus musculus
gatcagagaccattacagcagcagc

SEQ ID NO: 108969 - DNA, 25 bp, Mus musculus
gatcagagatcaacgggtaatcaga

SEQ ID NO: 108970 - DNA, 25 bp, Mus musculus
gatcagagccaataggagttaaggc

SEQ ID NO: 108971 - DNA, 25 bp, Mus musculus
gatcagagccttaagtcagagacag

SEQ ID NO: 108972 - DNA, 25 bp, Mus musculus
gatcagaggcgcatcgaatggcaga

SEQ ID NO: 108973 - DNA, 25 bp, Mus musculus
gatcagagtaggaacaagggcagct

SEQ ID NO: 108974 - DNA, 25 bp, Mus musculus
gatcagagtgacagtgacccgcgat

SEQ ID NO: 108975 - DNA, 25 bp, Mus musculus
gatcagatccgattgaagtgtatcc

SEQ ID NO: 108976 - DNA, 25 bp, Mus musculus
gatcagatcctagattcagtgctgg

SEQ ID NO: 108977 - DNA, 25 bp, Mus musculus
gatcagatctgattggcccacctgg

SEQ ID NO: 108978 - DNA, 25 bp, Mus musculus
gatcagattcaagggcttcgtgagg

SEQ ID NO: 108979 - DNA, 25 bp, Mus musculus
gatcagcaatgtgagctccgggtgc

SEQ ID NO: 108980 - DNA, 25 bp, Mus musculus
gatcagcagcgccttgttcaattgg

SEQ ID NO: 108981 - DNA, 25 bp, Mus musculus
gatcagcagtgagaagcctgtcctt

SEQ ID NO: 108982 - DNA, 25 bp, Mus musculus
gatcagcataagaggccagatcccc

SEQ ID NO: 108983 - DNA, 25 bp, Mus musculus
gatcagccagaccaacctgtagaag

SEQ ID NO: 108984 - DNA, 25 bp, Mus musculus
gatcagccagatgttgtccgggcgc

SEQ ID NO: 108985 - DNA, 25 bp, Mus musculus
gatcagcccctgacattgttaaaag

SEQ ID NO: 108986 - DNA, 25 bp, Mus musculus
gatcagccctttggacgtcatcaag

SEQ ID NO: 108987 - DNA, 25 bp, Mus musculus
gatcagccgaagacggttccagcaa

SEQ ID NO: 108988 - DNA, 25 bp, Mus musculus
gatcagcgctaaggagatgcagcac

SEQ ID NO: 108989 - DNA, 25 bp, Mus musculus
gatcagctctacgatgcagtttttg

SEQ ID NO: 108990 - DNA, 25 bp, Mus musculus
gatcagctgagcttggccctggctt

SEQ ID NO: 108991 - DNA, 25 bp, Mus musculus
gatcagctggccactatctgcccaa

SEQ ID NO: 108992 - DNA, 25 bp, Mus musculus
gatcagcttgaagacactactggag

SEQ ID NO: 108993 - DNA, 25 bp, Mus musculus
gatcaggacagttgggcatcgctca

SEQ ID NO: 108994 - DNA, 25 bp, Mus musculus
gatcaggaggaagtgagaaccatct

SEQ ID NO: 108995 - DNA, 25 bp, Mus musculus
gatcaggagtgcctacaagagcacc

SEQ ID NO: 108996 - DNA, 25 bp, Mus musculus
gatcaggctctgctcccttgaggaa

SEQ ID NO: 108997 - DNA, 25 bp, Mus musculus
gatcaggtactcttggcagccaaag

SEQ ID NO: 108998 - DNA, 25 bp, Mus musculus
gatcaggtggaaggcagtaaagtcc

SEQ ID NO: 108999 - DNA, 25 bp, Mus musculus
gatcaggtgtaaggctgcagtcgcc

SEQ ID NO: 109000 - DNA, 25 bp, Mus musculus
gatcaggttcatgcactgattcatc

SEQ ID NO: 109001 - DNA, 25 bp, Mus musculus
gatcagtaaggctgcagcttttagc

SEQ ID NO: 109002 - DNA, 25 bp, Mus musculus
gatcagtatataataaagcgctttg

SEQ ID NO: 109003 - DNA, 25 bp, Mus musculus
gatcagtcccctggatagggcaaca

SEQ ID NO: 109004 - DNA, 25 bp, Mus musculus
gatcagtccctatgcctctgtcaaa

SEQ ID NO: 109005 - DNA, 25 bp, Mus musculus
gatcagtgcctttggctacctcgag

SEQ ID NO: 109006 - DNA, 25 bp, Mus musculus
gatcagtggatctgcgctcatgcca

SEQ ID NO: 109007 - DNA, 25 bp, Mus musculus
gatcagtggcgactggaagaaccac

SEQ ID NO: 109008 - DNA, 25 bp, Mus musculus
gatcagtgtcaggatttgtcacccg

SEQ ID NO: 109009 - DNA, 25 bp, Mus musculus
gatcagttaatgaaagaagtcttgg

SEQ ID NO: 109010 - DNA, 25 bp, Mus musculus
gatcagttcttaagagcagccccag

SEQ ID NO: 109011 - DNA, 25 bp, Mus musculus
gatcagttgcatccgtcaagttggc

SEQ ID NO: 109012 - DNA, 25 bp, Mus musculus
gatcataaactcaaggccaggctgt

SEQ ID NO: 109013 - DNA, 25 bp, Mus musculus
gatcataaagtgagactcctcccca

SEQ ID NO: 109014 - DNA, 25 bp, Mus musculus
gatcataatccagcgctcgggtcac

SEQ ID NO: 109015 - DNA, 25 bp, Mus musculus
gatcataatgttttgctccccgacc

SEQ ID NO: 109016 - DNA, 25 bp, Mus musculus
gatcatacagagcataaggatgggc

SEQ ID NO: 109017 - DNA, 25 bp, Mus musculus
gatcatatgatgtccagccccagtg

SEQ ID NO: 109018 - DNA, 25 bp, Mus musculus
gatcatcaacaatcactgtgcccgg

SEQ ID NO: 109019 - DNA, 25 bp, Mus musculus
gatcatcaaccatctaatcaaaatg

SEQ ID NO: 109020 - DNA, 25 bp, Mus musculus
gatcatcaacctgcctgtagaagaa

SEQ ID NO: 109021 - DNA, 25 bp, Mus musculus
gatcatcaagcgtcaactacaggcc

SEQ ID NO: 109022 - DNA, 25 bp, Mus musculus
gatcatcacagccagtgggttccca

SEQ ID NO: 109023 - DNA, 25 bp, Mus musculus
gatcatcacccagagcaccaatggt

SEQ ID NO: 109024 - DNA, 25 bp, Mus musculus
gatcatcagaccgtacctcagggct

SEQ ID NO: 109025 - DNA, 25 bp, Mus musculus
gatcatcatccgagctttccgcaca

SEQ ID NO: 109026 - DNA, 25 bp, Mus musculus
gatcatcatgtacactggctctcca

SEQ ID NO: 109027 - DNA, 25 bp, Mus musculus
gatcatccgtgaggcgtacaagaag

SEQ ID NO: 109028 - DNA, 25 bp, Mus musculus
gatcatcctccagagtattcagcgg

SEQ ID NO: 109029 - DNA, 25 bp, Mus musculus
gatcatcgaagaacagtctgggcct

SEQ ID NO: 109030 - DNA, 25 bp, Mus musculus
gatcatcgacgaggaggaatttctg

SEQ ID NO: 109031 - DNA, 25 bp, Mus musculus
gatcatcgccaacgatcgagggcat

SEQ ID NO: 109032 - DNA, 25 bp, Mus musculus
gatcatcggctatgagctccaagga

SEQ ID NO: 109033 - DNA, 25 bp, Mus musculus
gatcatcttcaaagtcggccgagtt

SEQ ID NO: 109034 - DNA, 25 bp, Mus musculus
gatcatctttacagttcctcgggaa

SEQ ID NO: 109035 - DNA, 25 bp, Mus musculus
gatcatctttagcatctgccgggtg

SEQ ID NO: 109036 - DNA, 25 bp, Mus musculus
gatcatgaagatcacagggacgccc

SEQ ID NO: 109037 - DNA, 25 bp, Mus musculus
gatcatgaagcagacagggtacctg

SEQ ID NO: 109038 - DNA, 25 bp, Mus musculus
gatcatgaccagtctttctgagcag

SEQ ID NO: 109039 - DNA, 25 bp, Mus musculus
gatcatgaggaactacagctacgag

SEQ ID NO: 109040 - DNA, 25 bp, Mus musculus
gatcatgcctgacccagtgacagag

SEQ ID NO: 109041 - DNA, 25 bp, Mus musculus
gatcatgctattcgtgcctgtcacg

SEQ ID NO: 109042 - DNA, 25 bp, Mus musculus
gatcatgctgcaagccacattggaa

SEQ ID NO: 109043 - DNA, 25 bp, Mus musculus
gatcatggagcctcttttccgacag

SEQ ID NO: 109044 - DNA, 25 bp, Mus musculus
gatcatgggctgtgacgcatgcctt

SEQ ID NO: 109045 - DNA, 25 bp, Mus musculus
gatcatgtaggagcaaagtggcccc

SEQ ID NO: 109046 - DNA, 25 bp, Mus musculus
gatcatgtctgctaacaagggctgg

SEQ ID NO: 109047 - DNA, 25 bp, Mus musculus
gatcatgtgtgccagtggtgacacc

SEQ ID NO: 109048 - DNA, 25 bp, Mus musculus
gatcatgtttacctccaggaccggg

SEQ ID NO: 109049 - DNA, 25 bp, Mus musculus
gatcatgtttgacgctgggagcacc

SEQ ID NO: 109050 - DNA, 25 bp, Mus musculus
gatcattaacattccagtgagatac

SEQ ID NO: 109051 - DNA, 25 bp, Mus musculus
gatcattaagacacatctgcccttg

SEQ ID NO: 109052 - DNA, 25 bp, Mus musculus
gatcattaggctgtccccacgatag

SEQ ID NO: 109053 - DNA, 25 bp, Mus musculus
gatcattatcgccaagattgctcag

SEQ ID NO: 109054 - DNA, 25 bp, Mus musculus
gatcattcagacacctggcctgtgg

SEQ ID NO: 109055 - DNA, 25 bp, Mus musculus
gatcattccagtcaaacgaggcgaa

SEQ ID NO: 109056 - DNA, 25 bp, Mus musculus
gatcattctccaaaggcaactcctg

SEQ ID NO: 109057 - DNA, 25 bp, Mus musculus
gatcattgacttggaagaggccgag

SEQ ID NO: 109058 - DNA, 25 bp, Mus musculus
gatcattgcaaacgccatgtgtgga

SEQ ID NO: 109059 - DNA, 25 bp, Mus musculus
gatcattgccaagtccaacgtctag

SEQ ID NO: 109060 - DNA, 25 bp, Mus musculus
gatcattgcctgctgaatcggccag

SEQ ID NO: 109061 - DNA, 25 bp, Mus musculus
gatcattgtcactgactacaccccg

SEQ ID NO: 109062 - DNA, 25 bp, Mus musculus
gatcatttatgtgggctcagctgag

SEQ ID NO: 109063 - DNA, 25 bp, Mus musculus
gatcatttcaagatgttgggacaac

SEQ ID NO: 109064 - DNA, 25 bp, Mus musculus
gatcatttgcgttctcagtgacaca

SEQ ID NO: 109065 - DNA, 25 bp, Mus musculus
gatccaaaacaagtggctgcggccg

SEQ ID NO: 109066 - DNA, 25 bp, Mus musculus
gatccaaaacgggacctggacagaa

SEQ ID NO: 109067 - DNA, 25 bp, Mus musculus
gatccaaaaggaggaccagcttgcc

SEQ ID NO: 109068 - DNA, 25 bp, Mus musculus
gatccaaacacaagacggtcagagg

SEQ ID NO: 109069 - DNA, 25 bp, Mus musculus
gatccaaattctcctgaacgagtag

SEQ ID NO: 109070 - DNA, 25 bp, Mus musculus
gatccaacatggagaatacgctttg

SEQ ID NO: 109071 - DNA, 25 bp, Mus musculus
gatccaacgcatgcctggagtggtg

SEQ ID NO: 109072 - DNA, 25 bp, Mus musculus
gatccaagaacgtgggcatgccgat

SEQ ID NO: 109073 - DNA, 25 bp, Mus musculus
gatccaagctgtcaagaaggcccag

SEQ ID NO: 109074 - DNA, 25 bp, Mus musculus
gatccaagtgccctccaagaaagtg

SEQ ID NO: 109075 - DNA, 25 bp, Mus musculus
gatccacacctcttgtgaacttcca

SEQ ID NO: 109076 - DNA, 25 bp, Mus musculus
gatccacacgtaaagataagcccag

SEQ ID NO: 109077 - DNA, 25 bp, Mus musculus
gatccacagtcatgaaagggcctgg

SEQ ID NO: 109078 - DNA, 25 bp, Mus musculus
gatccacagttgtctgaggcccaaa

SEQ ID NO: 109079 - DNA, 25 bp, Mus musculus
gatccacctgatggctggccgagta

SEQ ID NO: 109080 - DNA, 25 bp, Mus musculus
gatccacgagaaggagtccgcagtc

SEQ ID NO: 109081 - DNA, 25 bp, Mus musculus
gatccacgtgtaccagtttccagaa

SEQ ID NO: 109082 - DNA, 25 bp, Mus musculus
gatccactctttctctacggctggg

SEQ ID NO: 109083 - DNA, 25 bp, Mus musculus
gatccactgtgagggcacacggttc

SEQ ID NO: 109084 - DNA, 25 bp, Mus musculus
gatccactttggcacagaggtcact

SEQ ID NO: 109085 - DNA, 25 bp, Mus musculus
gatccagaaaagtggaccgtccagc

SEQ ID NO: 109086 - DNA, 25 bp, Mus musculus
gatccagaaactactaaccatgggt

SEQ ID NO: 109087 - DNA, 25 bp, Mus musculus
gatccagaacaatgggacctcggct

SEQ ID NO: 109088 - DNA, 25 bp, Mus musculus
gatccagaatcgcatcacagccaag

SEQ ID NO: 109089 - DNA, 25 bp, Mus musculus
gatccagacacccagactattaagg

SEQ ID NO: 109090 - DNA, 25 bp, Mus musculus
gatccagacatgtccagagctgctg

SEQ ID NO: 109091 - DNA, 25 bp, Mus musculus
gatccagaccattgcgcagtacaag

SEQ ID NO: 109092 - DNA, 25 bp, Mus musculus
gatccagaccgtgtcatcactgctg

SEQ ID NO: 109093 - DNA, 25 bp, Mus musculus
gatccagactcagaagagttcagag

SEQ ID NO: 109094 - DNA, 25 bp, Mus musculus
gatccagaggagtcatttgccagag

SEQ ID NO: 109095 - DNA, 25 bp, Mus musculus
gatccagatcagtcgaagggacccc

SEQ ID NO: 109096 - DNA, 25 bp, Mus musculus
gatccagatgacgtcatagcgttag

SEQ ID NO: 109097 - DNA, 25 bp, Mus musculus
gatccagcagtacagtttcgggcct

SEQ ID NO: 109098 - DNA, 25 bp, Mus musculus
gatccagcattacagagtcaccatt

SEQ ID NO: 109099 - DNA, 25 bp, Mus musculus
gatccagccattacgagtgcagcga

SEQ ID NO: 109100 - DNA, 25 bp, Mus musculus
gatccagcccatacagaagaatttg

SEQ ID NO: 109101 - DNA, 25 bp, Mus musculus
gatccagccctgaccctaaaggcat

SEQ ID NO: 109102 - DNA, 25 bp, Mus musculus
gatccagctcagtgtgtccttcagg

SEQ ID NO: 109103 - DNA, 25 bp, Mus musculus
gatccagctgcaagaaaaacgttag

SEQ ID NO: 109104 - DNA, 25 bp, Mus musculus
gatccaggacatcatgaacaagcaa

SEQ ID NO: 109105 - DNA, 25 bp, Mus musculus
gatccaggaggtcctatgctcgccc

SEQ ID NO: 109106 - DNA, 25 bp, Mus musculus
gatccaggcactaaagagagctagc

SEQ ID NO: 109107 - DNA, 25 bp, Mus musculus
gatccaggcccttttcaggaagaag

SEQ ID NO: 109108 - DNA, 25 bp, Mus musculus
gatccaggcctgacgacatgttcca

SEQ ID NO: 109109 - DNA, 25 bp, Mus musculus
gatccaggcttaaggtcaaaacatg

SEQ ID NO: 109110 - DNA, 25 bp, Mus musculus
gatccagggcccatctatgttcgag

SEQ ID NO: 109111 - DNA, 25 bp, Mus musculus
gatccaggtcgatttacaaaccgag

SEQ ID NO: 109112 - DNA, 25 bp, Mus musculus
gatccaggtgaaaccggcagacagt

SEQ ID NO: 109113 - DNA, 25 bp, Mus musculus
gatccaggtgtctgagggtttccac

SEQ ID NO: 109114 - DNA, 25 bp, Mus musculus
gatccagtacgctatgaacgtggcc

SEQ ID NO: 109115 - DNA, 25 bp, Mus musculus
gatccagtagcagagacagccattc

SEQ ID NO: 109116 - DNA, 25 bp, Mus musculus
gatccagtattctagtcaagtgcag

SEQ ID NO: 109117 - DNA, 25 bp, Mus musculus
gatccagtgcttggaccaggtagca

SEQ ID NO: 109118 - DNA, 25 bp, Mus musculus
gatccagtggtttcctctcaacaag

SEQ ID NO: 109119 - DNA, 25 bp, Mus musculus
gatccagttgcctgtacagagagct

SEQ ID NO: 109120 - DNA, 25 bp, Mus musculus
gatccagttttctggtggtctccag

SEQ ID NO: 109121 - DNA, 25 bp, Mus musculus
gatccagtttttcggacccaaggag

SEQ ID NO: 109122 - DNA, 25 bp, Mus musculus
gatccatcccaaataaggttagaag

SEQ ID NO: 109123 - DNA, 25 bp, Mus musculus
gatccatcttttgtgcacgcgtcgc

SEQ ID NO: 109124 - DNA, 25 bp, Mus musculus
gatccatgacttgcgggaacaaatg

SEQ ID NO: 109125 - DNA, 25 bp, Mus musculus
gatccatgagaatgagaagcgcctg

SEQ ID NO: 109126 - DNA, 25 bp, Mus musculus
gatccatgcaggtgattgtctttcc

SEQ ID NO: 109127 - DNA, 25 bp, Mus musculus
gatccatgcctatcgaaagctgctg

SEQ ID NO: 109128 - DNA, 25 bp, Mus musculus
gatccatgcggaagtgaagctgtac

SEQ ID NO: 109129 - DNA, 25 bp, Mus musculus
gatccatgtggttgatgagcacact

SEQ ID NO: 109130 - DNA, 25 bp, Mus musculus
gatccattcagtcaaggttcctgca

SEQ ID NO: 109131 - DNA, 25 bp, Mus musculus
gatccattcagtcgtttccagccca

SEQ ID NO: 109132 - DNA, 25 bp, Mus musculus
gatccatttactaccctggctgcaa

SEQ ID NO: 109133 - DNA, 25 bp, Mus musculus
gatccatttactgcagggagacctg

SEQ ID NO: 109134 - DNA, 25 bp, Mus musculus
gatccatttcatgtgcccactggca

SEQ ID NO: 109135 - DNA, 25 bp, Mus musculus
gatccatttctcgaaagaatacggg

SEQ ID NO: 109136 - DNA, 25 bp, Mus musculus
gatcccaaccctgagaactttgtgg

SEQ ID NO: 109137 - DNA, 25 bp, Mus musculus
gatcccaagttagccctcactggag

SEQ ID NO: 109138 - DNA, 25 bp, Mus musculus
gatcccaatgctcagggcgatgcct

SEQ ID NO: 109139 - DNA, 25 bp, Mus musculus
gatcccaccgttgtgtctttggaaa

SEQ ID NO: 109140 - DNA, 25 bp, Mus musculus
gatcccagaaacaggtccacaggtt

SEQ ID NO: 109141 - DNA, 25 bp, Mus musculus
gatcccagaggacgttcaggtagca

SEQ ID NO: 109142 - DNA, 25 bp, Mus musculus
gatcccagagggatgcagacaccct

SEQ ID NO: 109143 - DNA, 25 bp, Mus musculus
gatcccagagtcactgagacgcttt

SEQ ID NO: 109144 - DNA, 25 bp, Mus musculus
gatcccagagtgcttgatgccatgc

SEQ ID NO: 109145 - DNA, 25 bp, Mus musculus
gatcccagggaaagtgctatgcaca

SEQ ID NO: 109146 - DNA, 25 bp, Mus musculus
gatcccaggttcttggcctttgcca

SEQ ID NO: 109147 - DNA, 25 bp, Mus musculus
gatcccagtgtgttggacttcccga

SEQ ID NO: 109148 - DNA, 25 bp, Mus musculus
gatcccagttggaacataccaggca

SEQ ID NO: 109149 - DNA, 25 bp, Mus musculus
gatcccatacatcattcacactgtg

SEQ ID NO: 109150 - DNA, 25 bp, Mus musculus
gatcccatatattctaacgtttgcc

SEQ ID NO: 109151 - DNA, 25 bp, Mus musculus
gatcccatgaaggtgaaggcttacc

SEQ ID NO: 109152 - DNA, 25 bp, Mus musculus
gatcccatgtgacctatctctgagc

SEQ ID NO: 109153 - DNA, 25 bp, Mus musculus
gatcccattggatgcctcagtgctt

SEQ ID NO: 109154 - DNA, 25 bp, Mus musculus
gatccccacgtgagtatcggaaacg

SEQ ID NO: 109155 - DNA, 25 bp, Mus musculus
gatccccagatgatgagctgctgta

SEQ ID NO: 109156 - DNA, 25 bp, Mus musculus
gatccccagtctctgtataggccac

SEQ ID NO: 109157 - DNA, 25 bp, Mus musculus
gatccccatgacagaagcggtcgag

SEQ ID NO: 109158 - DNA, 25 bp, Mus musculus
gatccccgagatatcactgagcaag

SEQ ID NO: 109159 - DNA, 25 bp, Mus musculus
gatccccgagctccggataccggtg

SEQ ID NO: 109160 - DNA, 25 bp, Mus musculus
gatccccggcatgagagagttgtca

SEQ ID NO: 109161 - DNA, 25 bp, Mus musculus
gatcccctggattataccacaaagg

SEQ ID NO: 109162 - DNA, 25 bp, Mus musculus
gatccccttgggttgcatcgaggct

SEQ ID NO: 109163 - DNA, 25 bp, Mus musculus
gatcccggaccaaagactgagatga

SEQ ID NO: 109164 - DNA, 25 bp, Mus musculus
gatcccggcgcctacagatgcagcg

SEQ ID NO: 109165 - DNA, 25 bp, Mus musculus
gatcccgggtggagctaatgcattc

SEQ ID NO: 109166 - DNA, 25 bp, Mus musculus
gatcccgtggaagctgtaaaagata

SEQ ID NO: 109167 - DNA, 25 bp, Mus musculus
gatccctaaacatcccaatgtgctg

SEQ ID NO: 109168 - DNA, 25 bp, Mus musculus
gatccctacttggacatagcactgg

SEQ ID NO: 109169 - DNA, 25 bp, Mus musculus
gatccctaggtcctggtcggaaaag

SEQ ID NO: 109170 - DNA, 25 bp, Mus musculus
gatccctgcggtggaattggtcaca

SEQ ID NO: 109171 - DNA, 25 bp, Mus musculus
gatccctggatgacctggtgaaggt

SEQ ID NO: 109172 - DNA, 25 bp, Mus musculus
gatcccttccattgtcatagaagat

SEQ ID NO: 109173 - DNA, 25 bp, Mus musculus
gatcccttgctgtgaggtcaacctg

SEQ ID NO: 109174 - DNA, 25 bp, Mus musculus
gatccctttgccctacacattcagg

SEQ ID NO: 109175 - DNA, 25 bp, Mus musculus
gatccgaactctttacgaccacgtg

SEQ ID NO: 109176 - DNA, 25 bp, Mus musculus
gatccgaaggaaagtacgccaagcc

SEQ ID NO: 109177 - DNA, 25 bp, Mus musculus
gatccgaagggagtttcagaccagt

SEQ ID NO: 109178 - DNA, 25 bp, Mus musculus
gatccgacgcctcggtgcaaagtgt

SEQ ID NO: 109179 - DNA, 25 bp, Mus musculus
gatccgactgtggaactacgcgcag

SEQ ID NO: 109180 - DNA, 25 bp, Mus musculus
gatccgagactatgtggagtcccag

SEQ ID NO: 109181 - DNA, 25 bp, Mus musculus
gatccgagagaagggctccgagttc

SEQ ID NO: 109182 - DNA, 25 bp, Mus musculus
gatccgagatgccagcttactgcag

SEQ ID NO: 109183 - DNA, 25 bp, Mus musculus
gatccgagcaataggcaaaatggcc

SEQ ID NO: 109184 - DNA, 25 bp, Mus musculus
gatccgagctcctactactgctttg

SEQ ID NO: 109185 - DNA, 25 bp, Mus musculus
gatccgaggagaaccacagtacctg

SEQ ID NO: 109186 - DNA, 25 bp, Mus musculus
gatccgaggtcatctgcagcatacg

SEQ ID NO: 109187 - DNA, 25 bp, Mus musculus
gatccgagtgcccatcaaagatgag

SEQ ID NO: 109188 - DNA, 25 bp, Mus musculus
gatccgatgtggtgccttcatgtcc

SEQ ID NO: 109189 - DNA, 25 bp, Mus musculus
gatccgattacaaagaccagccgtg

SEQ ID NO: 109190 - DNA, 25 bp, Mus musculus
gatccgattccagatgttcctgcag

SEQ ID NO: 109191 - DNA, 25 bp, Mus musculus
gatccgcagacgtgtaaatgttcct

SEQ ID NO: 109192 - DNA, 25 bp, Mus musculus
gatccgcagcactgtcctgcagggc

SEQ ID NO: 109193 - DNA, 25 bp, Mus musculus
gatccgcagtgttcaaggcggccgc

SEQ ID NO: 109194 - DNA, 25 bp, Mus musculus
gatccgccgcggagttacgtgaaag

SEQ ID NO: 109195 - DNA, 25 bp, Mus musculus
gatccgcgacttgcgaaaaaggcta

SEQ ID NO: 109196 - DNA, 25 bp, Mus musculus
gatccgctcggtggctattggtgct

SEQ ID NO: 109197 - DNA, 25 bp, Mus musculus
gatccgctgtgatgaggaaacccag

SEQ ID NO: 109198 - DNA, 25 bp, Mus musculus
gatccggaacaaggcagcgtgaaca

SEQ ID NO: 109199 - DNA, 25 bp, Mus musculus
gatccggcacagtgacccagagagt

SEQ ID NO: 109200 - DNA, 25 bp, Mus musculus
gatccggcagaagtaccggtccaag

SEQ ID NO: 109201 - DNA, 25 bp, Mus musculus
gatccggcgcggatcagagacactg

SEQ ID NO: 109202 - DNA, 25 bp, Mus musculus
gatccggcgtgtccaacagttggct

SEQ ID NO: 109203 - DNA, 25 bp, Mus musculus
gatccggctggaaaacaccacatga

SEQ ID NO: 109204 - DNA, 25 bp, Mus musculus
gatccgggacaccaagtacgtgcag

SEQ ID NO: 109205 - DNA, 25 bp, Mus musculus
gatccgggcccaacattcgactatt

SEQ ID NO: 109206 - DNA, 25 bp, Mus musculus
gatccgggcccagtttgcagtctac

SEQ ID NO: 109207 - DNA, 25 bp, Mus musculus
gatccgggcccatgtgacgtcatgt

SEQ ID NO: 109208 - DNA, 25 bp, Mus musculus
gatccgggcggtttagcttctgcta

SEQ ID NO: 109209 - DNA, 25 bp, Mus musculus
gatccgtattgaggccaatgaagcc

SEQ ID NO: 109210 - DNA, 25 bp, Mus musculus
gatccgtccaacaataagaaccgct

SEQ ID NO: 109211 - DNA, 25 bp, Mus musculus
gatccgtccagtcaaaaaccagcaa

SEQ ID NO: 109212 - DNA, 25 bp, Mus musculus
gatccgtcttcatgtgcttcctgag

SEQ ID NO: 109213 - DNA, 25 bp, Mus musculus
gatccgtgctacagaattcgcctgg

SEQ ID NO: 109214 - DNA, 25 bp, Mus musculus
gatccgtgttcagttggagtccagc

SEQ ID NO: 109215 - DNA, 25 bp, Mus musculus
gatcctaaagatcgcccgtctgctg

SEQ ID NO: 109216 - DNA, 25 bp, Mus musculus
gatcctaagatgaaagcctacctgg

SEQ ID NO: 109217 - DNA, 25 bp, Mus musculus
gatcctaagcagaattgaaactgct

SEQ ID NO: 109218 - DNA, 25 bp, Mus musculus
gatcctaaggcctcacgtagcactg

SEQ ID NO: 109219 - DNA, 25 bp, Mus musculus
gatcctaagtgcgagtaggtttgaa

SEQ ID NO: 109220 - DNA, 25 bp, Mus musculus
gatcctaatgtgaatattgtgccca

SEQ ID NO: 109221 - DNA, 25 bp, Mus musculus
gatcctacacaagcacgaagttcct

SEQ ID NO: 109222 - DNA, 25 bp, Mus musculus
gatcctacatgagatggaggcccgc

SEQ ID NO: 109223 - DNA, 25 bp, Mus musculus
gatcctactcggaaaggctcagtgg

SEQ ID NO: 109224 - DNA, 25 bp, Mus musculus
gatcctagcaacctgggaccttcgg

SEQ ID NO: 109225 - DNA, 25 bp, Mus musculus
gatcctaggactgaagagcttgtca

SEQ ID NO: 109226 - DNA, 25 bp, Mus musculus
gatcctagtgaagaccggtggaccc

SEQ ID NO: 109227 - DNA, 25 bp, Mus musculus
gatcctatgagggagaaagcagctt

SEQ ID NO: 109228 - DNA, 25 bp, Mus musculus
gatcctatggaaggagagcagacct

SEQ ID NO: 109229 - DNA, 25 bp, Mus musculus
gatcctattccagccaaatgcaggg

SEQ ID NO: 109230 - DNA, 25 bp, Mus musculus
gatcctcatcgcacaggtgaccgta

SEQ ID NO: 109231 - DNA, 25 bp, Mus musculus
gatcctccagagagtccagtaccag

SEQ ID NO: 109232 - DNA, 25 bp, Mus musculus
gatcctcgacgagatggaccagagc

SEQ ID NO: 109233 - DNA, 25 bp, Mus musculus
gatcctcggataattgcggctaaca

SEQ ID NO: 109234 - DNA, 25 bp, Mus musculus
gatcctcgtgctcaaaacgctgaga

SEQ ID NO: 109235 - DNA, 25 bp, Mus musculus
gatcctctaggtgggaagcaggctc

SEQ ID NO: 109236 - DNA, 25 bp, Mus musculus
gatcctctcgaatgaagcctgtgta

SEQ ID NO: 109237 - DNA, 25 bp, Mus musculus
gatcctctggaacctgatggctgtg

SEQ ID NO: 109238 - DNA, 25 bp, Mus musculus
gatcctctgtcagcgcttatggcgg

SEQ ID NO: 109239 - DNA, 25 bp, Mus musculus
gatcctgaaaatccgccagtctgag

SEQ ID NO: 109240 - DNA, 25 bp, Mus musculus
gatcctgaaactcgccaagcaatgg

SEQ ID NO: 109241 - DNA, 25 bp, Mus musculus
gatcctgaagctcaaagacctgaag

SEQ ID NO: 109242 - DNA, 25 bp, Mus musculus
gatcctgacataaacccttgcttgt

SEQ ID NO: 109243 - DNA, 25 bp, Mus musculus
gatcctgaccttatccctgcagagg

SEQ ID NO: 109244 - DNA, 25 bp, Mus musculus
gatcctgagactgatgaacacttca

SEQ ID NO: 109245 - DNA, 25 bp, Mus musculus
gatcctgatgtgtctcccatgaaag

SEQ ID NO: 109246 - DNA, 25 bp, Mus musculus
gatcctgcaaacttccctgggtgag

SEQ ID NO: 109247 - DNA, 25 bp, Mus musculus
gatcctgcaggataccctagtggct

SEQ ID NO: 109248 - DNA, 25 bp, Mus musculus
gatcctgccttggacctcacgtttg

SEQ ID NO: 109249 - DNA, 25 bp, Mus musculus
gatcctgcggaattacggcctgaag

SEQ ID NO: 109250 - DNA, 25 bp, Mus musculus
gatcctgcggattgcccgggacttg

SEQ ID NO: 109251 - DNA, 25 bp, Mus musculus
gatcctgctagggaaagccaccctg

SEQ ID NO: 109252 - DNA, 25 bp, Mus musculus
gatcctggacaacaagaacggcacc

SEQ ID NO: 109253 - DNA, 25 bp, Mus musculus
gatcctggaccggtatctgctcaag

SEQ ID NO: 109254 - DNA, 25 bp, Mus musculus
gatcctggatgtccttctcgagaaa

SEQ ID NO: 109255 - DNA, 25 bp, Mus musculus
gatcctggcatggaaggacccatag

SEQ ID NO: 109256 - DNA, 25 bp, Mus musculus
gatcctggctgagtatctcaacctg

SEQ ID NO: 109257 - DNA, 25 bp, Mus musculus
gatcctggctgtgatccaaggctcc

SEQ ID NO: 109258 - DNA, 25 bp, Mus musculus
gatcctgggtttaggcggctcatca

SEQ ID NO: 109259 - DNA, 25 bp, Mus musculus
gatcctggtgtcttggtttccgtcc

SEQ ID NO: 109260 - DNA, 25 bp, Mus musculus
gatcctgtacagaaactcttcgtgg

SEQ ID NO: 109261 - DNA, 25 bp, Mus musculus
gatcctgtcgattggccttaaagag

SEQ ID NO: 109262 - DNA, 25 bp, Mus musculus
gatcctgtgaatggagacatcccct

SEQ ID NO: 109263 - DNA, 25 bp, Mus musculus
gatcctgtgggaccatctaggtaca

SEQ ID NO: 109264 - DNA, 25 bp, Mus musculus
gatcctgttcctgcacatcgcggtg

SEQ ID NO: 109265 - DNA, 25 bp, Mus musculus
gatccttaccaacaaggaggctgaa

SEQ ID NO: 109266 - DNA, 25 bp, Mus musculus
gatccttacgatgttgctcatgctg

SEQ ID NO: 109267 - DNA, 25 bp, Mus musculus
gatccttaggccttctgagctgctg

SEQ ID NO: 109268 - DNA, 25 bp, Mus musculus
gatccttcaaacagggagccatgct

SEQ ID NO: 109269 - DNA, 25 bp, Mus musculus
gatccttccaaggaaccagtgtgaa

SEQ ID NO: 109270 - DNA, 25 bp, Mus musculus
gatccttcgcgaggagttcaccagc

SEQ ID NO: 109271 - DNA, 25 bp, Mus musculus
gatccttcgtcattcttgtcccagc

SEQ ID NO: 109272 - DNA, 25 bp, Mus musculus
gatccttctttcttgcctgctggca

SEQ ID NO: 109273 - DNA, 25 bp, Mus musculus
gatccttgaagtctagccacctgag

SEQ ID NO: 109274 - DNA, 25 bp, Mus musculus
gatccttgaattcgcagaccgtctg

SEQ ID NO: 109275 - DNA, 25 bp, Mus musculus
gatccttgagatgtcggttccctgg

SEQ ID NO: 109276 - DNA, 25 bp, Mus musculus
gatccttgagtacacctggctcgag

SEQ ID NO: 109277 - DNA, 25 bp, Mus musculus
gatccttgctgctgggctctgtaca

SEQ ID NO: 109278 - DNA, 25 bp, Mus musculus
gatccttggaaacccactggacaga

SEQ ID NO: 109279 - DNA, 25 bp, Mus musculus
gatccttggactccagcaaccagtg

SEQ ID NO: 109280 - DNA, 25 bp, Mus musculus
gatcctttcgaagctcagtgggccg

SEQ ID NO: 109281 - DNA, 25 bp, Mus musculus
gatcctttgagtccaggagaccttg

SEQ ID NO: 109282 - DNA, 25 bp, Mus musculus
gatcctttgcagaaatgactacatt

SEQ ID NO: 109283 - DNA, 25 bp, Mus musculus
gatcctttggtgatcgccctgcaag

SEQ ID NO: 109284 - DNA, 25 bp, Mus musculus
gatcgaaaaccttgcaccagactga

SEQ ID NO: 109285 - DNA, 25 bp, Mus musculus
gatcgaaagtaagacgggctgctgt

SEQ ID NO: 109286 - DNA, 25 bp, Mus musculus
gatcgaaccagaatgggcctacgga

SEQ ID NO: 109287 - DNA, 25 bp, Mus musculus
gatcgaacccgaggatgagcatagg

SEQ ID NO: 109288 - DNA, 25 bp, Mus musculus
gatcgaacgcgaggtgagcatcctg

SEQ ID NO: 109289 - DNA, 25 bp, Mus musculus
gatcgaagagcaaacagtgaaagcc

SEQ ID NO: 109290 - DNA, 25 bp, Mus musculus
gatcgaagcctgttccacgctatgg

SEQ ID NO: 109291 - DNA, 25 bp, Mus musculus
gatcgacaggtatctggaggaccag

SEQ ID NO: 109292 - DNA, 25 bp, Mus musculus
gatcgacctcgaagagtctagaccc

SEQ ID NO: 109293 - DNA, 25 bp, Mus musculus
gatcgacctgggagaccatactgag

SEQ ID NO: 109294 - DNA, 25 bp, Mus musculus
gatcgacgccgccaaattacactgc

SEQ ID NO: 109295 - DNA, 25 bp, Mus musculus
gatcgactaactcaaaccagagagg

SEQ ID NO: 109296 - DNA, 25 bp, Mus musculus
gatcgactctcagtgtttcggccag

SEQ ID NO: 109297 - DNA, 25 bp, Mus musculus
gatcgacttcgtgagtgccgaggca

SEQ ID NO: 109298 - DNA, 25 bp, Mus musculus
gatcgacttgctgaaaataaggccc

SEQ ID NO: 109299 - DNA, 25 bp, Mus musculus
gatcgactttgcctcagactcagta

SEQ ID NO: 109300 - DNA, 25 bp, Mus musculus
gatcgagaaagccaagcacatgcct

SEQ ID NO: 109301 - DNA, 25 bp, Mus musculus
gatcgagacagcgaagaagaactgg

SEQ ID NO: 109302 - DNA, 25 bp, Mus musculus
gatcgagccatcattgtcaacggag

SEQ ID NO: 109303 - DNA, 25 bp, Mus musculus
gatcgagcggatgttcaagaagaga

SEQ ID NO: 109304 - DNA, 25 bp, Mus musculus
gatcgaggacggcacagtgactctc

SEQ ID NO: 109305 - DNA, 25 bp, Mus musculus
gatcgagggatgcagtacagtcaca

SEQ ID NO: 109306 - DNA, 25 bp, Mus musculus
gatcgagtccgtgataacatctgcg

SEQ ID NO: 109307 - DNA, 25 bp, Mus musculus
gatcgagttgctctcggacatagcc

SEQ ID NO: 109308 - DNA, 25 bp, Mus musculus
gatcgagtttatggtgaatccaagt

SEQ ID NO: 109309 - DNA, 25 bp, Mus musculus
gatcgatcctggacactgactgcac

SEQ ID NO: 109310 - DNA, 25 bp, Mus musculus
gatcgatggtgtagaaactcttggg

SEQ ID NO: 109311 - DNA, 25 bp, Mus musculus
gatcgcaacaatgtcctcaaccggg

SEQ ID NO: 109312 - DNA, 25 bp, Mus musculus
gatcgcaccctggaaacactgaaaa

SEQ ID NO: 109313 - DNA, 25 bp, Mus musculus
gatcgcagaaacgtggtgaccttaa

SEQ ID NO: 109314 - DNA, 25 bp, Mus musculus
gatcgcatctcgtcaaacaccagag

SEQ ID NO: 109315 - DNA, 25 bp, Mus musculus
gatcgccaaagtggaactctccctg

SEQ ID NO: 109316 - DNA, 25 bp, Mus musculus
gatcgccaagcggtgagcaggccgt

SEQ ID NO: 109317 - DNA, 25 bp, Mus musculus
gatcgccaagttgtcacctagaaag

SEQ ID NO: 109318 - DNA, 25 bp, Mus musculus
gatcgccagcttttcctacaaccag

SEQ ID NO: 109319 - DNA, 25 bp, Mus musculus
gatcgccatgctcacagtgctgcta

SEQ ID NO: 109320 - DNA, 25 bp, Mus musculus
gatcgcctccaagagagcaatgacc

SEQ ID NO: 109321 - DNA, 25 bp, Mus musculus
gatcgcctcgggaccagtttccttg

SEQ ID NO: 109322 - DNA, 25 bp, Mus musculus
gatcgcctctcaaggagtcttgtga

SEQ ID NO: 109323 - DNA, 25 bp, Mus musculus
gatcgcctctcgcaacgagtttgac

SEQ ID NO: 109324 - DNA, 25 bp, Mus musculus
gatcgccttacagcaggtttccatg

SEQ ID NO: 109325 - DNA, 25 bp, Mus musculus
gatcgcggtaccaagacatcctcgt

SEQ ID NO: 109326 - DNA, 25 bp, Mus musculus
gatcgctactttgggacagatgcag

SEQ ID NO: 109327 - DNA, 25 bp, Mus musculus
gatcgctccctgcaattaaaggcgg

SEQ ID NO: 109328 - DNA, 25 bp, Mus musculus
gatcgctccgagtgtgtagttgccc

SEQ ID NO: 109329 - DNA, 25 bp, Mus musculus
gatcgctggaatgtgtgtcgcacga

SEQ ID NO: 109330 - DNA, 25 bp, Mus musculus
gatcgcttacacttgagaagaacta

SEQ ID NO: 109331 - DNA, 25 bp, Mus musculus
gatcgcttctacctgggccagtggc

SEQ ID NO: 109332 - DNA, 25 bp, Mus musculus
gatcgcttggaagagtccctcgagg

SEQ ID NO: 109333 - DNA, 25 bp, Mus musculus
gatcgctttgatgaccacaagggcc

SEQ ID NO: 109334 - DNA, 25 bp, Mus musculus
gatcggaactgtatgtgggcaaaga

SEQ ID NO: 109335 - DNA, 25 bp, Mus musculus
gatcggaactgtgggctcattgctg

SEQ ID NO: 109336 - DNA, 25 bp, Mus musculus
gatcggaagagcagaatgagtgact

SEQ ID NO: 109337 - DNA, 25 bp, Mus musculus
gatcggactttcacatagtggtaga

SEQ ID NO: 109338 - DNA, 25 bp, Mus musculus
gatcggatttcccatcgacggcaga

SEQ ID NO: 109339 - DNA, 25 bp, Mus musculus
gatcggcatggctatatctgggacc

SEQ ID NO: 109340 - DNA, 25 bp, Mus musculus
gatcggcatttctctcacctctcaa

SEQ ID NO: 109341 - DNA, 25 bp, Mus musculus
gatcggcttgcagccttgcagggca

SEQ ID NO: 109342 - DNA, 25 bp, Mus musculus
gatcgggacccgcagctaaaatcat

SEQ ID NO: 109343 - DNA, 25 bp, Mus musculus
gatcgggagtccaagttactcaggg

SEQ ID NO: 109344 - DNA, 25 bp, Mus musculus
gatcgggccagagacagtgatgacc

SEQ ID NO: 109345 - DNA, 25 bp, Mus musculus
gatcgggttggaaagctaactcagc

SEQ ID NO: 109346 - DNA, 25 bp, Mus musculus
gatcggtcattgtttcccagcctgc

SEQ ID NO: 109347 - DNA, 25 bp, Mus musculus
gatcggtgaactggtcctggacaac

SEQ ID NO: 109348 - DNA, 25 bp, Mus musculus
gatcggtgtccaagcagaaaccctg

SEQ ID NO: 109349 - DNA, 25 bp, Mus musculus
gatcggtgtgatccctagtaaaaag

SEQ ID NO: 109350 - DNA, 25 bp, Mus musculus
gatcggttctgccacgtgcttgctg

SEQ ID NO: 109351 - DNA, 25 bp, Mus musculus
gatcggttttggcatactgctcagc

SEQ ID NO: 109352 - DNA, 25 bp, Mus musculus
gatcgtatgttcacaaatcccctgg

SEQ ID NO: 109353 - DNA, 25 bp, Mus musculus
gatcgtccccgtaactgctgaccga

SEQ ID NO: 109354 - DNA, 25 bp, Mus musculus
gatcgtcctgggtggcttctcgcag

SEQ ID NO: 109355 - DNA, 25 bp, Mus musculus
gatcgtctcacactggactacaggg

SEQ ID NO: 109356 - DNA, 25 bp, Mus musculus
gatcgtgaaatctaaggctgcttgg

SEQ ID NO: 109357 - DNA, 25 bp, Mus musculus
gatcgtgaattgcagaagaagaaag

SEQ ID NO: 109358 - DNA, 25 bp, Mus musculus
gatcgtgatcccaacagacctggag

SEQ ID NO: 109359 - DNA, 25 bp, Mus musculus
gatcgtgccctggtaacgacaagga

SEQ ID NO: 109360 - DNA, 25 bp, Mus musculus
gatcgtgccgtggacttgaccgtga

SEQ ID NO: 109361 - DNA, 25 bp, Mus musculus
gatcgtgctgcttttcccgctggac

SEQ ID NO: 109362 - DNA, 25 bp, Mus musculus
gatcgtggtcacctggacagtcctg

SEQ ID NO: 109363 - DNA, 25 bp, Mus musculus
gatcgtgtgcatggaaggccttctc

SEQ ID NO: 109364 - DNA, 25 bp, Mus musculus
gatcgttacctttcaggcccaggtg

SEQ ID NO: 109365 - DNA, 25 bp, Mus musculus
gatcgttcctgcacgtaggaagccg

SEQ ID NO: 109366 - DNA, 25 bp, Mus musculus
gatcgttgccaaaactacgtaatgg

SEQ ID NO: 109367 - DNA, 25 bp, Mus musculus
gatcgttttccagagctcagtgtca

SEQ ID NO: 109368 - DNA, 25 bp, Mus musculus
gatctaaagacaagcccagaggcag

SEQ ID NO: 109369 - DNA, 25 bp, Mus musculus
gatctaaagcaaagcgttcccgcca

SEQ ID NO: 109370 - DNA, 25 bp, Mus musculus
gatctaagaacctccaccagggctg

SEQ ID NO: 109371 - DNA, 25 bp, Mus musculus
gatctaagatgtccactgaggcgca

SEQ ID NO: 109372 - DNA, 25 bp, Mus musculus
gatctacaaaatgatgcagggagga

SEQ ID NO: 109373 - DNA, 25 bp, Mus musculus
gatctacaagtccaatctcggcgtg

SEQ ID NO: 109374 - DNA, 25 bp, Mus musculus
gatctacaggacttatcaaaccgag

SEQ ID NO: 109375 - DNA, 25 bp, Mus musculus
gatctacagtgcatcgagcggaagc

SEQ ID NO: 109376 - DNA, 25 bp, Mus musculus
gatctacattaaccagctggaagct

SEQ ID NO: 109377 - DNA, 25 bp, Mus musculus
gatctaccacatcattaaggaagac

SEQ ID NO: 109378 - DNA, 25 bp, Mus musculus
gatctaccactcacgtcaggaaggc

SEQ ID NO: 109379 - DNA, 25 bp, Mus musculus
gatctaccgacagaaagctaccagg

SEQ ID NO: 109380 - DNA, 25 bp, Mus musculus
gatctacctccatagagatgtccgg

SEQ ID NO: 109381 - DNA, 25 bp, Mus musculus
gatctacgagactctggcgctggcg

SEQ ID NO: 109382 - DNA, 25 bp, Mus musculus
gatctacgagcgcatgaaccagtct

SEQ ID NO: 109383 - DNA, 25 bp, Mus musculus
gatctacgccgctgaagcacagcct

SEQ ID NO: 109384 - DNA, 25 bp, Mus musculus
gatctacggaaaatgcagcttcgag

SEQ ID NO: 109385 - DNA, 25 bp, Mus musculus
gatctactactggtcctgggatagg

SEQ ID NO: 109386 - DNA, 25 bp, Mus musculus
gatctactctctcataccacagctg

SEQ ID NO: 109387 - DNA, 25 bp, Mus musculus
gatctacttccgacagaccctaaga

SEQ ID NO: 109388 - DNA, 25 bp, Mus musculus
gatctagaatgtcagcacctcctcg

SEQ ID NO: 109389 - DNA, 25 bp, Mus musculus
gatctagacctcaccaagaaagcag

SEQ ID NO: 109390 - DNA, 25 bp, Mus musculus
gatctagccagacagaagttcagct

SEQ ID NO: 109391 - DNA, 25 bp, Mus musculus
gatctagtgtgccagcgttcagcag

SEQ ID NO: 109392 - DNA, 25 bp, Mus musculus
gatctagttgtttgttggtggccgc

SEQ ID NO: 109393 - DNA, 25 bp, Mus musculus
gatctatcagtcttacctgcccaga

SEQ ID NO: 109394 - DNA, 25 bp, Mus musculus
gatctatgagtgacaggacggtgct

SEQ ID NO: 109395 - DNA, 25 bp, Mus musculus
gatctatgccaactgatacccaaat

SEQ ID NO: 109396 - DNA, 25 bp, Mus musculus
gatctatgtccatacggccacggga

SEQ ID NO: 109397 - DNA, 25 bp, Mus musculus
gatctcaaacagagggaaaggcttt

SEQ ID NO: 109398 - DNA, 25 bp, Mus musculus
gatctcaacaccaggctgaagaaga

SEQ ID NO: 109399 - DNA, 25 bp, Mus musculus
gatctcaaggaaagcagggtcagcg

SEQ ID NO: 109400 - DNA, 25 bp, Mus musculus
gatctcaattactgtcgagaggaaa

SEQ ID NO: 109401 - DNA, 25 bp, Mus musculus
gatctcaccagaagcttacgaacgg

SEQ ID NO: 109402 - DNA, 25 bp, Mus musculus
gatctcacgggtgcctgaggacaca

SEQ ID NO: 109403 - DNA, 25 bp, Mus musculus
gatctcagaaggaaaatgggtcaaa

SEQ ID NO: 109404 - DNA, 25 bp, Mus musculus
gatctcagacctgactgaacagctg

SEQ ID NO: 109405 - DNA, 25 bp, Mus musculus
gatctcagctgggaccgggatatca

SEQ ID NO: 109406 - DNA, 25 bp, Mus musculus
gatctcaggtgtttggtcatcccgg

SEQ ID NO: 109407 - DNA, 25 bp, Mus musculus
gatctcataaaggaggctatccttg

SEQ ID NO: 109408 - DNA, 25 bp, Mus musculus
gatctcatccagagtgacatcgccg

SEQ ID NO: 109409 - DNA, 25 bp, Mus musculus
gatctcatgagcatcagcggtcaca

SEQ ID NO: 109410 - DNA, 25 bp, Mus musculus
gatctcatggtgcagtctgaagccc

SEQ ID NO: 109411 - DNA, 25 bp, Mus musculus
gatctcattgaagtggtcctgtcag

SEQ ID NO: 109412 - DNA, 25 bp, Mus musculus
gatctcattggcttcggctgctacc

SEQ ID NO: 109413 - DNA, 25 bp, Mus musculus
gatctccaactcttggaaacaaaat

SEQ ID NO: 109414 - DNA, 25 bp, Mus musculus
gatctccaagaagaatgcggccagg

SEQ ID NO: 109415 - DNA, 25 bp, Mus musculus
gatctccaagttggaagaaggattt

SEQ ID NO: 109416 - DNA, 25 bp, Mus musculus
gatctccagctcagatcttgcttag

SEQ ID NO: 109417 - DNA, 25 bp, Mus musculus
gatctccatgtgtgaaaaatgaagc

SEQ ID NO: 109418 - DNA, 25 bp, Mus musculus
gatctcccgagtgtcgtcggctcag

SEQ ID NO: 109419 - DNA, 25 bp, Mus musculus
gatctccgacatgtcaccgtggtgg

SEQ ID NO: 109420 - DNA, 25 bp, Mus musculus
gatctccgactacatgaagaccagt

SEQ ID NO: 109421 - DNA, 25 bp, Mus musculus
gatctccgtagatgaagctctccag

SEQ ID NO: 109422 - DNA, 25 bp, Mus musculus
gatctcctaaaattgaacgggctgc

SEQ ID NO: 109423 - DNA, 25 bp, Mus musculus
gatctcctactactgggcctgattg

SEQ ID NO: 109424 - DNA, 25 bp, Mus musculus
gatctcctcgcctgaatcgggcaga

SEQ ID NO: 109425 - DNA, 25 bp, Mus musculus
gatctccttctgtgctgcggcgact

SEQ ID NO: 109426 - DNA, 25 bp, Mus musculus
gatctcgatgagagagagccaccgt

SEQ ID NO: 109427 - DNA, 25 bp, Mus musculus
gatctcgctgggaaggccttgctga

SEQ ID NO: 109428 - DNA, 25 bp, Mus musculus
gatctcgcttagtgaggagtccgca

SEQ ID NO: 109429 - DNA, 25 bp, Mus musculus
gatctcggacgctcagtgggaagat

SEQ ID NO: 109430 - DNA, 25 bp, Mus musculus
gatctctacccaagacaagtcagct

SEQ ID NO: 109431 - DNA, 25 bp, Mus musculus
gatctctccaacatcaggtgctgtg

SEQ ID NO: 109432 - DNA, 25 bp, Mus musculus
gatctctctgggactggtgacctct

SEQ ID NO: 109433 - DNA, 25 bp, Mus musculus
gatctctgagacagctggtacccgg

SEQ ID NO: 109434 - DNA, 25 bp, Mus musculus
gatctctgagatgttgcccgtgtga

SEQ ID NO: 109435 - DNA, 25 bp, Mus musculus
gatctctgagctcctctgcacaaga

SEQ ID NO: 109436 - DNA, 25 bp, Mus musculus
gatctctgtcagtaggaagccaact

SEQ ID NO: 109437 - DNA, 25 bp, Mus musculus
gatctcttcaatggtcgatatcatg

SEQ ID NO: 109438 - DNA, 25 bp, Mus musculus
gatctcttggaagctctgtgacccc

SEQ ID NO: 109439 - DNA, 25 bp, Mus musculus
gatctcttggttggaacaagaagag

SEQ ID NO: 109440 - DNA, 25 bp, Mus musculus
gatctcttgtgctgcgatcactgcc

SEQ ID NO: 109441 - DNA, 25 bp, Mus musculus
gatctgaaaatcgaccacacgggct

SEQ ID NO: 109442 - DNA, 25 bp, Mus musculus
gatctgaagagcctgaccatggacc

SEQ ID NO: 109443 - DNA, 25 bp, Mus musculus
gatctgaagccaacggtctggacct

SEQ ID NO: 109444 - DNA, 25 bp, Mus musculus
gatctgaatcctacaagctcctgcc

SEQ ID NO: 109445 - DNA, 25 bp, Mus musculus
gatctgaatcgaactctcagccgga

SEQ ID NO: 109446 - DNA, 25 bp, Mus musculus
gatctgacccagctactgtgatgga

SEQ ID NO: 109447 - DNA, 25 bp, Mus musculus
gatctgacgctcaacaagtgcctgg

SEQ ID NO: 109448 - DNA, 25 bp, Mus musculus
gatctgactgcgaaaagacttctgc

SEQ ID NO: 109449 - DNA, 25 bp, Mus musculus
gatctgagacagttatagcttggca

SEQ ID NO: 109450 - DNA, 25 bp, Mus musculus
gatctgagaccacgaatcaccatgg

SEQ ID NO: 109451 - DNA, 25 bp, Mus musculus
gatctgagactggaaaacttctggc

SEQ ID NO: 109452 - DNA, 25 bp, Mus musculus
gatctgagcgcctagtccagcttgg

SEQ ID NO: 109453 - DNA, 25 bp, Mus musculus
gatctgagcggttggcatcctggac

SEQ ID NO: 109454 - DNA, 25 bp, Mus musculus
gatctgaggcattagatggctccca

SEQ ID NO: 109455 - DNA, 25 bp, Mus musculus
gatctgagtagagtcctggacagcg

SEQ ID NO: 109456 - DNA, 25 bp, Mus musculus
gatctgatagtgattcaatctcgga

SEQ ID NO: 109457 - DNA, 25 bp, Mus musculus
gatctgatcagctatggaacgggcc

SEQ ID NO: 109458 - DNA, 25 bp, Mus musculus
gatctgatggtgttcagggactcca

SEQ ID NO: 109459 - DNA, 25 bp, Mus musculus
gatctgcactgaatggctgacctga

SEQ ID NO: 109460 - DNA, 25 bp, Mus musculus
gatctgcagagatccctttctgctg

SEQ ID NO: 109461 - DNA, 25 bp, Mus musculus
gatctgcagatccaaacgttcactg

SEQ ID NO: 109462 - DNA, 25 bp, Mus musculus
gatctgcagcgcgactttcaggcca

SEQ ID NO: 109463 - DNA, 25 bp, Mus musculus
gatctgccaacgtgtgacagctgca

SEQ ID NO: 109464 - DNA, 25 bp, Mus musculus
gatctgccataacctgggagtgtgc

SEQ ID NO: 109465 - DNA, 25 bp, Mus musculus
gatctgccccgggtacaaggaggct

SEQ ID NO: 109466 - DNA, 25 bp, Mus musculus
gatctgccttacgtgcacggtggtg

SEQ ID NO: 109467 - DNA, 25 bp, Mus musculus
gatctgcgcggagggatttctatcc

SEQ ID NO: 109468 - DNA, 25 bp, Mus musculus
gatctgcgctgcaatctagcctgtg

SEQ ID NO: 109469 - DNA, 25 bp, Mus musculus
gatctgcgtgtgctggatacccaaa

SEQ ID NO: 109470 - DNA, 25 bp, Mus musculus
gatctgctatctaacaatgtcatgg

SEQ ID NO: 109471 - DNA, 25 bp, Mus musculus
gatctgctctaagactgaacctggg

SEQ ID NO: 109472 - DNA, 25 bp, Mus musculus
gatctgctgtgcctgccagaagact

SEQ ID NO: 109473 - DNA, 25 bp, Mus musculus
gatctggaacaacccaactgtgccg

SEQ ID NO: 109474 - DNA, 25 bp, Mus musculus
gatctggaattgagccatggcacca

SEQ ID NO: 109475 - DNA, 25 bp, Mus musculus
gatctggaccacaaactgaaacctt

SEQ ID NO: 109476 - DNA, 25 bp, Mus musculus
gatctggaccgagtcaaggcaaagg

SEQ ID NO: 109477 - DNA, 25 bp, Mus musculus
gatctggactctcacctaggctaca

SEQ ID NO: 109478 - DNA, 25 bp, Mus musculus
gatctggagctgaacccctttgacg

SEQ ID NO: 109479 - DNA, 25 bp, Mus musculus
gatctggatgacaaccagtctcgac

SEQ ID NO: 109480 - DNA, 25 bp, Mus musculus
gatctggatgagtcgcacacggaag

SEQ ID NO: 109481 - DNA, 25 bp, Mus musculus
gatctggatttcaggagccccagga

SEQ ID NO: 109482 - DNA, 25 bp, Mus musculus
gatctggcagtgttgggctacctta

SEQ ID NO: 109483 - DNA, 25 bp, Mus musculus
gatctggccacgactccagctacta

SEQ ID NO: 109484 - DNA, 25 bp, Mus musculus
gatctggcccactacgaatgctgtg

SEQ ID NO: 109485 - DNA, 25 bp, Mus musculus
gatctggctagattggacactccct

SEQ ID NO: 109486 - DNA, 25 bp, Mus musculus
gatctggctagggtcgaatgctgaa

SEQ ID NO: 109487 - DNA, 25 bp, Mus musculus
gatctgggcctagagaccgtgtacg

SEQ ID NO: 109488 - DNA, 25 bp, Mus musculus
gatctgggctctggaactgaaggct

SEQ ID NO: 109489 - DNA, 25 bp, Mus musculus
gatctggtcagtcccacctctgggt

SEQ ID NO: 109490 - DNA, 25 bp, Mus musculus
gatctggtcggagtgtcttcgcctg

SEQ ID NO: 109491 - DNA, 25 bp, Mus musculus
gatctggtggactcactctccgagg

SEQ ID NO: 109492 - DNA, 25 bp, Mus musculus
gatctggtgggctacttcggccttt

SEQ ID NO: 109493 - DNA, 25 bp, Mus musculus
gatctgtcagccgaggttcctacca

SEQ ID NO: 109494 - DNA, 25 bp, Mus musculus
gatctgtccagggtgcaacaagcct

SEQ ID NO: 109495 - DNA, 25 bp, Mus musculus
gatctgtgccttagagagacctgta

SEQ ID NO: 109496 - DNA, 25 bp, Mus musculus
gatctgtggccttctgtgggtagca

SEQ ID NO: 109497 - DNA, 25 bp, Mus musculus
gatctgtggttagttgtcccgccaa

SEQ ID NO: 109498 - DNA, 25 bp, Mus musculus
gatctgttagagaccacttgtagca

SEQ ID NO: 109499 - DNA, 25 bp, Mus musculus
gatctgttgaacacaccggaaacct

SEQ ID NO: 109500 - DNA, 25 bp, Mus musculus
gatctgttgcaggagttggactcac

SEQ ID NO: 109501 - DNA, 25 bp, Mus musculus
gatcttatcaataacttgctacaag

SEQ ID NO: 109502 - DNA, 25 bp, Mus musculus
gatcttatcatcatacgctggagtc

SEQ ID NO: 109503 - DNA, 25 bp, Mus musculus
gatcttatgctatacacagagctgc

SEQ ID NO: 109504 - DNA, 25 bp, Mus musculus
gatcttcaagacagctacggccagg

SEQ ID NO: 109505 - DNA, 25 bp, Mus musculus
gatcttcatcaataacacacagctg

SEQ ID NO: 109506 - DNA, 25 bp, Mus musculus
gatcttcatggagctaccagctgtg

SEQ ID NO: 109507 - DNA, 25 bp, Mus musculus
gatcttccagaaggagccactgttc

SEQ ID NO: 109508 - DNA, 25 bp, Mus musculus
gatcttccccacgtctacatgagga

SEQ ID NO: 109509 - DNA, 25 bp, Mus musculus
gatcttccccttgagagagacgccg

SEQ ID NO: 109510 - DNA, 25 bp, Mus musculus
gatcttccctttcccgagagtgtgg

SEQ ID NO: 109511 - DNA, 25 bp, Mus musculus
gatcttccgggacctgtgctttgca

SEQ ID NO: 109512 - DNA, 25 bp, Mus musculus
gatcttcctgcctacgagaggctca

SEQ ID NO: 109513 - DNA, 25 bp, Mus musculus
gatcttccttcagccctcagtgtgg

SEQ ID NO: 109514 - DNA, 25 bp, Mus musculus
gatcttcgaggtcgctgacaacacc

SEQ ID NO: 109515 - DNA, 25 bp, Mus musculus
gatcttcgatttcctgggctaccag

SEQ ID NO: 109516 - DNA, 25 bp, Mus musculus
gatcttcgcggccaaaacgcgctaa

SEQ ID NO: 109517 - DNA, 25 bp, Mus musculus
gatcttcggacaaattccccaggag

SEQ ID NO: 109518 - DNA, 25 bp, Mus musculus
gatcttcgggtgtgaaaagccaaac

SEQ ID NO: 109519 - DNA, 25 bp, Mus musculus
gatcttctcgaaggcctcacaggaa

SEQ ID NO: 109520 - DNA, 25 bp, Mus musculus
gatcttctctggtcccgcaaaactt

SEQ ID NO: 109521 - DNA, 25 bp, Mus musculus
gatcttctgcatccacgctggctag

SEQ ID NO: 109522 - DNA, 25 bp, Mus musculus
gatcttctgtggagtaccgatgcaa

SEQ ID NO: 109523 - DNA, 25 bp, Mus musculus
gatcttcttccagtgagcccgtgga

SEQ ID NO: 109524 - DNA, 25 bp, Mus musculus
gatcttgaactttggcctctgtgga

SEQ ID NO: 109525 - DNA, 25 bp, Mus musculus
gatcttgacccctacaggcgctttg

SEQ ID NO: 109526 - DNA, 25 bp, Mus musculus
gatcttgagcgaagtgtccacccgt

SEQ ID NO: 109527 - DNA, 25 bp, Mus musculus
gatcttgatcttgaaccccaggaca

SEQ ID NO: 109528 - DNA, 25 bp, Mus musculus
gatcttgcaggaacgggctaaactt

SEQ ID NO: 109529 - DNA, 25 bp, Mus musculus
gatcttgcctgtgatcaacacccag

SEQ ID NO: 109530 - DNA, 25 bp, Mus musculus
gatcttgctactaagtggacagcca

SEQ ID NO: 109531 - DNA, 25 bp, Mus musculus
gatcttgctattccagcgactatgg

SEQ ID NO: 109532 - DNA, 25 bp, Mus musculus
gatcttggaaatcaatggcacgccc

SEQ ID NO: 109533 - DNA, 25 bp, Mus musculus
gatcttggaagagtcaccctgtggg

SEQ ID NO: 109534 - DNA, 25 bp, Mus musculus
gatcttggacaggacctcttggcta

SEQ ID NO: 109535 - DNA, 25 bp, Mus musculus
gatcttggcagctcttggaactggg

SEQ ID NO: 109536 - DNA, 25 bp, Mus musculus
gatcttggccaacgacatagacccc

SEQ ID NO: 109537 - DNA, 25 bp, Mus musculus
gatcttggccgcagcttttcctgca

SEQ ID NO: 109538 - DNA, 25 bp, Mus musculus
gatcttgggatccagaatgcctgcc

SEQ ID NO: 109539 - DNA, 25 bp, Mus musculus
gatcttgtaagcagcctcagccgaa

SEQ ID NO: 109540 - DNA, 25 bp, Mus musculus
gatcttgtcaaaaacgggcagtcca

SEQ ID NO: 109541 - DNA, 25 bp, Mus musculus
gatctttagatcacaccgcagaggc

SEQ ID NO: 109542 - DNA, 25 bp, Mus musculus
gatctttattgcacagccagcttgg

SEQ ID NO: 109543 - DNA, 25 bp, Mus musculus
gatctttccaaaggccccgctgtta

SEQ ID NO: 109544 - DNA, 25 bp, Mus musculus
gatctttgaacttggacctcgaggg

SEQ ID NO: 109545 - DNA, 25 bp, Mus musculus
gatctttggctactggagaatgatg

SEQ ID NO: 109546 - DNA, 25 bp, Mus musculus
gatgaaaaagcaaaaccgctactgt

SEQ ID NO: 109547 - DNA, 25 bp, Mus musculus
gatgaaaaaggcatccaatcctgtg

SEQ ID NO: 109548 - DNA, 25 bp, Mus musculus
gatgaaaacaatgggctttccctgg

SEQ ID NO: 109549 - DNA, 25 bp, Mus musculus
gatgaaaacagagatcccgtgagga

SEQ ID NO: 109550 - DNA, 25 bp, Mus musculus
gatgaaaacgatcgcctgggctgtc

SEQ ID NO: 109551 - DNA, 25 bp, Mus musculus
gatgaaaactactcggcagaactga

SEQ ID NO: 109552 - DNA, 25 bp, Mus musculus
gatgaaaaggtctactgccctcccg

SEQ ID NO: 109553 - DNA, 25 bp, Mus musculus
gatgaaaattgtggccctactacta

SEQ ID NO: 109554 - DNA, 25 bp, Mus musculus
gatgaaacagctgtaagctactgga

SEQ ID NO: 109555 - DNA, 25 bp, Mus musculus
gatgaaactccttctgctggctgct

SEQ ID NO: 109556 - DNA, 25 bp, Mus musculus
gatgaaagccatcaacagcttgggt

SEQ ID NO: 109557 - DNA, 25 bp, Mus musculus
gatgaaagtcatgctggctcagaga

SEQ ID NO: 109558 - DNA, 25 bp, Mus musculus
gatgaaagttgacctcagcccaaag

SEQ ID NO: 109559 - DNA, 25 bp, Mus musculus
gatgaaatatgacccggtggcctcc

SEQ ID NO: 109560 - DNA, 25 bp, Mus musculus
gatgaaatcaagaataactctgagg

SEQ ID NO: 109561 - DNA, 25 bp, Mus musculus
gatgaaatccctggagcagtctggt

SEQ ID NO: 109562 - DNA, 25 bp, Mus musculus
gatgaaatcgattgtctccccggcc

SEQ ID NO: 109563 - DNA, 25 bp, Mus musculus
gatgaaatcgccatatgtccttatg

SEQ ID NO: 109564 - DNA, 25 bp, Mus musculus
gatgaaatcggtgcgtacctggccg

SEQ ID NO: 109565 - DNA, 25 bp, Mus musculus
gatgaaatcttaagacttgccctgg

SEQ ID NO: 109566 - DNA, 25 bp, Mus musculus
gatgaaattcctaagctaccgcgta

SEQ ID NO: 109567 - DNA, 25 bp, Mus musculus
gatgaaattgtggacctcacctgtg

SEQ ID NO: 109568 - DNA, 25 bp, Mus musculus
gatgaacaagatgaataagagtcgc

SEQ ID NO: 109569 - DNA, 25 bp, Mus musculus
gatgaacagcaactacccagctttg

SEQ ID NO: 109570 - DNA, 25 bp, Mus musculus
gatgaacagcatcagtggacaagct

SEQ ID NO: 109571 - DNA, 25 bp, Mus musculus
gatgaacagcttttgatgcctcctg

SEQ ID NO: 109572 - DNA, 25 bp, Mus musculus
gatgaacagggtcccaagcactgga

SEQ ID NO: 109573 - DNA, 25 bp, Mus musculus
gatgaacagtaacaaccgagactct

SEQ ID NO: 109574 - DNA, 25 bp, Mus musculus
gatgaacatcctggaccttggcggc

SEQ ID NO: 109575 - DNA, 25 bp, Mus musculus
gatgaacatgaccatcacaggctgc

SEQ ID NO: 109576 - DNA, 25 bp, Mus musculus
gatgaaccacatcttctgaggctag

SEQ ID NO: 109577 - DNA, 25 bp, Mus musculus
gatgaacccaagtacggagtcgcca

SEQ ID NO: 109578 - DNA, 25 bp, Mus musculus
gatgaacccatagacttgcgctgtg

SEQ ID NO: 109579 - DNA, 25 bp, Mus musculus
gatgaacctgcttcgagacaaaagt

SEQ ID NO: 109580 - DNA, 25 bp, Mus musculus
gatgaacgagctatcgagatgtacc

SEQ ID NO: 109581 - DNA, 25 bp, Mus musculus
gatgaactaattgaagaaaccgtta

SEQ ID NO: 109582 - DNA, 25 bp, Mus musculus
gatgaactatccgagagctccctga

SEQ ID NO: 109583 - DNA, 25 bp, Mus musculus
gatgaactcagcgacatccagactg

SEQ ID NO: 109584 - DNA, 25 bp, Mus musculus
gatgaactcataagccctgcctttg

SEQ ID NO: 109585 - DNA, 25 bp, Mus musculus
gatgaactctacacccgattgttgc

SEQ ID NO: 109586 - DNA, 25 bp, Mus musculus
gatgaactgatgaagacaaggcctt

SEQ ID NO: 109587 - DNA, 25 bp, Mus musculus
gatgaactgccagcagaccagacag

SEQ ID NO: 109588 - DNA, 25 bp, Mus musculus
gatgaactggactcttttgagacca

SEQ ID NO: 109589 - DNA, 25 bp, Mus musculus
gatgaactgtgaacttctagccacg

SEQ ID NO: 109590 - DNA, 25 bp, Mus musculus
gatgaacttcaggacaacgttttct

SEQ ID NO: 109591 - DNA, 25 bp, Mus musculus
gatgaacttctcagcacatgcattg

SEQ ID NO: 109592 - DNA, 25 bp, Mus musculus
gatgaacttgtcctccaaactgaca

SEQ ID NO: 109593 - DNA, 25 bp, Mus musculus
gatgaagaacatgtcctggaggaac

SEQ ID NO: 109594 - DNA, 25 bp, Mus musculus
gatgaagaagctagcgcgaccactt

SEQ ID NO: 109595 - DNA, 25 bp, Mus musculus
gatgaagacaaactccatattgtgg

SEQ ID NO: 109596 - DNA, 25 bp, Mus musculus
gatgaagaccattaccgggagcaac

SEQ ID NO: 109597 - DNA, 25 bp, Mus musculus
gatgaagaccttttctcaggagact

SEQ ID NO: 109598 - DNA, 25 bp, Mus musculus
gatgaagactatcccactgtacaac

SEQ ID NO: 109599 - DNA, 25 bp, Mus musculus
gatgaagactatcgaagtagacggc

SEQ ID NO: 109600 - DNA, 25 bp, Mus musculus
gatgaagaggctttggagcagatcc

SEQ ID NO: 109601 - DNA, 25 bp, Mus musculus
gatgaagagtatctgattgaacccc

SEQ ID NO: 109602 - DNA, 25 bp, Mus musculus
gatgaagagtatgcacaggcccaca

SEQ ID NO: 109603 - DNA, 25 bp, Mus musculus
gatgaagagttatactccaggcagc

SEQ ID NO: 109604 - DNA, 25 bp, Mus musculus
gatgaagataccagctacaccgttg

SEQ ID NO: 109605 - DNA, 25 bp, Mus musculus
gatgaagatattgagcccagtccag

SEQ ID NO: 109606 - DNA, 25 bp, Mus musculus
gatgaagatgaaatccggcctgtgc

SEQ ID NO: 109607 - DNA, 25 bp, Mus musculus
gatgaagatgtcaaccctgaggact

SEQ ID NO: 109608 - DNA, 25 bp, Mus musculus
gatgaagatttacacgtcaagcacc

SEQ ID NO: 109609 - DNA, 25 bp, Mus musculus
gatgaagatttcctgcaggcagcaa

SEQ ID NO: 109610 - DNA, 25 bp, Mus musculus
gatgaagcaagtggaaatgagtcta

SEQ ID NO: 109611 - DNA, 25 bp, Mus musculus
gatgaagcagtcttgcagcaaaagc

SEQ ID NO: 109612 - DNA, 25 bp, Mus musculus
gatgaagcagttttcagtcctcctg

SEQ ID NO: 109613 - DNA, 25 bp, Mus musculus
gatgaagcccacgagaggaccttgt

SEQ ID NO: 109614 - DNA, 25 bp, Mus musculus
gatgaagcccagacatgcacctgaa

SEQ ID NO: 109615 - DNA, 25 bp, Mus musculus
gatgaagccgcttctctacatcccg

SEQ ID NO: 109616 - DNA, 25 bp, Mus musculus
gatgaagcctacagcagccttgcag

SEQ ID NO: 109617 - DNA, 25 bp, Mus musculus
gatgaagccttcagcggacgcttga

SEQ ID NO: 109618 - DNA, 25 bp, Mus musculus
gatgaagcgctcttgactatgagta

SEQ ID NO: 109619 - DNA, 25 bp, Mus musculus
gatgaagctatgaggcgactccagg

SEQ ID NO: 109620 - DNA, 25 bp, Mus musculus
gatgaagctcatcaagggctctggt

SEQ ID NO: 109621 - DNA, 25 bp, Mus musculus
gatgaagcttctgctcggcatcgcg

SEQ ID NO: 109622 - DNA, 25 bp, Mus musculus
gatgaaggagccacccatgagaagt

SEQ ID NO: 109623 - DNA, 25 bp, Mus musculus
gatgaaggctctcagggctgtcctc

SEQ ID NO: 109624 - DNA, 25 bp, Mus musculus
gatgaaggcttggacatcacacaag

SEQ ID NO: 109625 - DNA, 25 bp, Mus musculus
gatgaaggtctccatcccaatgggc

SEQ ID NO: 109626 - DNA, 25 bp, Mus musculus
gatgaaggtggtacagctgctgccc

SEQ ID NO: 109627 - DNA, 25 bp, Mus musculus
gatgaagtacatgggcctgaagctg

SEQ ID NO: 109628 - DNA, 25 bp, Mus musculus
gatgaagtacggaggtcacggctac

SEQ ID NO: 109629 - DNA, 25 bp, Mus musculus
gatgaagtcatcaacacaccaggag

SEQ ID NO: 109630 - DNA, 25 bp, Mus musculus
gatgaagtccttctgcaaacctggc

SEQ ID NO: 109631 - DNA, 25 bp, Mus musculus
gatgaagtcgggtcatgtgtttaca

SEQ ID NO: 109632 - DNA, 25 bp, Mus musculus
gatgaagtctactgcccaagagatg

SEQ ID NO: 109633 - DNA, 25 bp, Mus musculus
gatgaagtgatcgacctgtacggcg

SEQ ID NO: 109634 - DNA, 25 bp, Mus musculus
gatgaagtttgttgggctggtctcc

SEQ ID NO: 109635 - DNA, 25 bp, Mus musculus
gatgaatacaagagctgacaacaca

SEQ ID NO: 109636 - DNA, 25 bp, Mus musculus
gatgaatacctagacaatggctcag

SEQ ID NO: 109637 - DNA, 25 bp, Mus musculus
gatgaatatctcacggcaggaacag

SEQ ID NO: 109638 - DNA, 25 bp, Mus musculus
gatgaatatgactcaagcccggctt

SEQ ID NO: 109639 - DNA, 25 bp, Mus musculus
gatgaatattcagtggtggctccga

SEQ ID NO: 109640 - DNA, 25 bp, Mus musculus
gatgaatattggtcccacgggagac

SEQ ID NO: 109641 - DNA, 25 bp, Mus musculus
gatgaatcggagctgcacttctgga

SEQ ID NO: 109642 - DNA, 25 bp, Mus musculus
gatgaatgctcgagtgccagtgcca

SEQ ID NO: 109643 - DNA, 25 bp, Mus musculus
gatgaatgtttactgcacccttgcc

SEQ ID NO: 109644 - DNA, 25 bp, Mus musculus
gatgaattcaaagcacacttttctg

SEQ ID NO: 109645 - DNA, 25 bp, Mus musculus
gatgaattcatagctgaggccttgg

SEQ ID NO: 109646 - DNA, 25 bp, Mus musculus
gatgaattccgaacagtcctgtgac

SEQ ID NO: 109647 - DNA, 25 bp, Mus musculus
gatgaattttgtaagcagcgccttc

SEQ ID NO: 109648 - DNA, 25 bp, Mus musculus
gatgacaaaagtccgcggttaccca

SEQ ID NO: 109649 - DNA, 25 bp, Mus musculus
gatgacaaagaacacctagccctgg

SEQ ID NO: 109650 - DNA, 25 bp, Mus musculus
gatgacaaagcgaagaaggcccgaa

SEQ ID NO: 109651 - DNA, 25 bp, Mus musculus
gatgacaaatcattcagccggcgaa

SEQ ID NO: 109652 - DNA, 25 bp, Mus musculus
gatgacaactggtaccttggccgca

SEQ ID NO: 109653 - DNA, 25 bp, Mus musculus
gatgacaacttactgcctactgagg

SEQ ID NO: 109654 - DNA, 25 bp, Mus musculus
gatgacaagaaggaactgagggccc

SEQ ID NO: 109655 - DNA, 25 bp, Mus musculus
gatgacaagcctagaaacatgctct

SEQ ID NO: 109656 - DNA, 25 bp, Mus musculus
gatgacaagttccattgcctgcgcc

SEQ ID NO: 109657 - DNA, 25 bp, Mus musculus
gatgacacagccctcagtgagagtg

SEQ ID NO: 109658 - DNA, 25 bp, Mus musculus
gatgacacagcttccctggatcgac

SEQ ID NO: 109659 - DNA, 25 bp, Mus musculus
gatgacaccaaagttctctgcagga

SEQ ID NO: 109660 - DNA, 25 bp, Mus musculus
gatgacaccctactatcctgttgga

SEQ ID NO: 109661 - DNA, 25 bp, Mus musculus
gatgacaccgacaccataatgcttg

SEQ ID NO: 109662 - DNA, 25 bp, Mus musculus
gatgacacctcgctcacctgagtga

SEQ ID NO: 109663 - DNA, 25 bp, Mus musculus
gatgacacggtcatgagcatcatga

SEQ ID NO: 109664 - DNA, 25 bp, Mus musculus
gatgacacttatccctgaggctgag

SEQ ID NO: 109665 - DNA, 25 bp, Mus musculus
gatgacagacaagaacctctcccag

SEQ ID NO: 109666 - DNA, 25 bp, Mus musculus
gatgacagagaagatcttttcgcag

SEQ ID NO: 109667 - DNA, 25 bp, Mus musculus
gatgacagagtatgcaagagccacc

SEQ ID NO: 109668 - DNA, 25 bp, Mus musculus
gatgacagcaagctagaggcgctct

SEQ ID NO: 109669 - DNA, 25 bp, Mus musculus
gatgacagcaatggatcaccagttc

SEQ ID NO: 109670 - DNA, 25 bp, Mus musculus
gatgacagcgtggaagagacctgcc

SEQ ID NO: 109671 - DNA, 25 bp, Mus musculus
gatgacagcttgcttccagggacgc

SEQ ID NO: 109672 - DNA, 25 bp, Mus musculus
gatgacagtaacagcacacaggagc

SEQ ID NO: 109673 - DNA, 25 bp, Mus musculus
gatgacagtaagacggaaaccagct

SEQ ID NO: 109674 - DNA, 25 bp, Mus musculus
gatgacagtatccacacagggcagc

SEQ ID NO: 109675 - DNA, 25 bp, Mus musculus
gatgacagtcaatgctcctcgaagc

SEQ ID NO: 109676 - DNA, 25 bp, Mus musculus
gatgacagtcctagggtaccctcga

SEQ ID NO: 109677 - DNA, 25 bp, Mus musculus
gatgacagtgacgtccacatgagct

SEQ ID NO: 109678 - DNA, 25 bp, Mus musculus
gatgacagtgccaactccctgaagc

SEQ ID NO: 109679 - DNA, 25 bp, Mus musculus
gatgacatcaccactgagcagcagg

SEQ ID NO: 109680 - DNA, 25 bp, Mus musculus
gatgacatcatgactactctgggct

SEQ ID NO: 109681 - DNA, 25 bp, Mus musculus
gatgacatccgcttccatgtggcca

SEQ ID NO: 109682 - DNA, 25 bp, Mus musculus
gatgacatcgaacgtttggccagcc

SEQ ID NO: 109683 - DNA, 25 bp, Mus musculus
gatgacatcgaattgctcccggaag

SEQ ID NO: 109684 - DNA, 25 bp, Mus musculus
gatgacatcttcagcagccatggtc

SEQ ID NO: 109685 - DNA, 25 bp, Mus musculus
gatgacatgaccgaaggtgacctag

SEQ ID NO: 109686 - DNA, 25 bp, Mus musculus
gatgacatggacttcctcacaaggc

SEQ ID NO: 109687 - DNA, 25 bp, Mus musculus
gatgacatgtttctcccattaagaa

SEQ ID NO: 109688 - DNA, 25 bp, Mus musculus
gatgacattgacatgcctgggcaga

SEQ ID NO: 109689 - DNA, 25 bp, Mus musculus
gatgacattgatctacagaacctca

SEQ ID NO: 109690 - DNA, 25 bp, Mus musculus
gatgaccacactcccacagaagatt

SEQ ID NO: 109691 - DNA, 25 bp, Mus musculus
gatgaccacgctctgaggaccattg

SEQ ID NO: 109692 - DNA, 25 bp, Mus musculus
gatgaccactacagcctacagagca

SEQ ID NO: 109693 - DNA, 25 bp, Mus musculus
gatgaccaggaaggcctctacagcc

SEQ ID NO: 109694 - DNA, 25 bp, Mus musculus
gatgaccaggtcacattccagttgt

SEQ ID NO: 109695 - DNA, 25 bp, Mus musculus
gatgaccatccagaggagctgagcc

SEQ ID NO: 109696 - DNA, 25 bp, Mus musculus
gatgaccatcttggcgctcttggca

SEQ ID NO: 109697 - DNA, 25 bp, Mus musculus
gatgaccatggctacatttcccgtg

SEQ ID NO: 109698 - DNA, 25 bp, Mus musculus
gatgacccaatgctcctgtcctcgg

SEQ ID NO: 109699 - DNA, 25 bp, Mus musculus
gatgaccccaatgtggcgaagacca

SEQ ID NO: 109700 - DNA, 25 bp, Mus musculus
gatgaccccgacaggtctctgcaag

SEQ ID NO: 109701 - DNA, 25 bp, Mus musculus
gatgacccgatgcacaacaaggaca

SEQ ID NO: 109702 - DNA, 25 bp, Mus musculus
gatgaccctccgtgcttatgttggc

SEQ ID NO: 109703 - DNA, 25 bp, Mus musculus
gatgaccgaaggagtaccctccacc

SEQ ID NO: 109704 - DNA, 25 bp, Mus musculus
gatgaccgacctgaagaccttacaa

SEQ ID NO: 109705 - DNA, 25 bp, Mus musculus
gatgaccgcagggatatcaggcgca

SEQ ID NO: 109706 - DNA, 25 bp, Mus musculus
gatgaccggcttgacatgaactgca

SEQ ID NO: 109707 - DNA, 25 bp, Mus musculus
gatgaccgggagcagttctacaaga

SEQ ID NO: 109708 - DNA, 25 bp, Mus musculus
gatgaccgtgtcacactgccaggat

SEQ ID NO: 109709 - DNA, 25 bp, Mus musculus
gatgaccgtgttgcaatccatgagg

SEQ ID NO: 109710 - DNA, 25 bp, Mus musculus
gatgaccgttgtgttgtacagccag

SEQ ID NO: 109711 - DNA, 25 bp, Mus musculus
gatgacctagtaaactcagatgagg

SEQ ID NO: 109712 - DNA, 25 bp, Mus musculus
gatgacctcagaagtcctggctgcg

SEQ ID NO: 109713 - DNA, 25 bp, Mus musculus
gatgacctccccaagaacatggaaa

SEQ ID NO: 109714 - DNA, 25 bp, Mus musculus
gatgacctccttgctgcttttgaca

SEQ ID NO: 109715 - DNA, 25 bp, Mus musculus
gatgacctcgtgcagcgactaatgg

SEQ ID NO: 109716 - DNA, 25 bp, Mus musculus
gatgacctgctgattggagtgccta

SEQ ID NO: 109717 - DNA, 25 bp, Mus musculus
gatgacctggcaaggttacgaagtg

SEQ ID NO: 109718 - DNA, 25 bp, Mus musculus
gatgacctggcttccaagaggactg

SEQ ID NO: 109719 - DNA, 25 bp, Mus musculus
gatgacctgtccagtgactcagagg

SEQ ID NO: 109720 - DNA, 25 bp, Mus musculus
gatgacctgtccttaaatgggcttg

SEQ ID NO: 109721 - DNA, 25 bp, Mus musculus
gatgacctgttttcacacagtacgg

SEQ ID NO: 109722 - DNA, 25 bp, Mus musculus
gatgaccttactcacaaattcaaag

SEQ ID NO: 109723 - DNA, 25 bp, Mus musculus
gatgacgactctcttcctgcagaaa

SEQ ID NO: 109724 - DNA, 25 bp, Mus musculus
gatgacgatgatgtcgggcaaccca

SEQ ID NO: 109725 - DNA, 25 bp, Mus musculus
gatgacgccactccattgggcagct

SEQ ID NO: 109726 - DNA, 25 bp, Mus musculus
gatgacgcccataacctgagagagg

SEQ ID NO: 109727 - DNA, 25 bp, Mus musculus
gatgacgcggcatggcaagaactgc

SEQ ID NO: 109728 - DNA, 25 bp, Mus musculus
gatgacggagtggatgaacaagtcc

SEQ ID NO: 109729 - DNA, 25 bp, Mus musculus
gatgacggcagtcgtatccgagaac

SEQ ID NO: 109730 - DNA, 25 bp, Mus musculus
gatgacgtccatatcttctcggaag

SEQ ID NO: 109731 - DNA, 25 bp, Mus musculus
gatgacgtgatcagccgcattgaca

SEQ ID NO: 109732 - DNA, 25 bp, Mus musculus
gatgactaagcttggatttttgcga

SEQ ID NO: 109733 - DNA, 25 bp, Mus musculus
gatgactacagcatggtccgcttcc

SEQ ID NO: 109734 - DNA, 25 bp, Mus musculus
gatgactataccaaccggactggtg

SEQ ID NO: 109735 - DNA, 25 bp, Mus musculus
gatgactatatggaagcgctggccc

SEQ ID NO: 109736 - DNA, 25 bp, Mus musculus
gatgactatcacatggcacctgggt

SEQ ID NO: 109737 - DNA, 25 bp, Mus musculus
gatgactatgaggtcagctgccctg

SEQ ID NO: 109738 - DNA, 25 bp, Mus musculus
gatgactatgtgtcaaagaaaccca

SEQ ID NO: 109739 - DNA, 25 bp, Mus musculus
gatgactcagtcgacaccaagacta

SEQ ID NO: 109740 - DNA, 25 bp, Mus musculus
gatgactccacaggatatgcggcct

SEQ ID NO: 109741 - DNA, 25 bp, Mus musculus
gatgactccatccagcgtctttgag

SEQ ID NO: 109742 - DNA, 25 bp, Mus musculus
gatgactcggtcatgttcgcgcggc

SEQ ID NO: 109743 - DNA, 25 bp, Mus musculus
gatgactcggtcctaaaatcccttg

SEQ ID NO: 109744 - DNA, 25 bp, Mus musculus
gatgactctgaaagaccccaggaag

SEQ ID NO: 109745 - DNA, 25 bp, Mus musculus
gatgactctgctgttctaagcctcc

SEQ ID NO: 109746 - DNA, 25 bp, Mus musculus
gatgactctggttaaatgtgcttgc

SEQ ID NO: 109747 - DNA, 25 bp, Mus musculus
gatgactcttgtgctgccctactgg

SEQ ID NO: 109748 - DNA, 25 bp, Mus musculus
gatgactgcatctctctgtccaagg

SEQ ID NO: 109749 - DNA, 25 bp, Mus musculus
gatgactgcccaccataaaagatgc

SEQ ID NO: 109750 - DNA, 25 bp, Mus musculus
gatgactgcgggttccattatggag

SEQ ID NO: 109751 - DNA, 25 bp, Mus musculus
gatgactggtctggatgccctctca

SEQ ID NO: 109752 - DNA, 25 bp, Mus musculus
gatgactgtaaccagacaggtcaga

SEQ ID NO: 109753 - DNA, 25 bp, Mus musculus
gatgacttcaagatctcaggcatga

SEQ ID NO: 109754 - DNA, 25 bp, Mus musculus
gatgacttcatccagggctgcatcg

SEQ ID NO: 109755 - DNA, 25 bp, Mus musculus
gatgacttccgatgccaggatggca

SEQ ID NO: 109756 - DNA, 25 bp, Mus musculus
gatgacttctttggagccggagaga

SEQ ID NO: 109757 - DNA, 25 bp, Mus musculus
gatgacttgaaagcggtatttactc

SEQ ID NO: 109758 - DNA, 25 bp, Mus musculus
gatgacttggacactcaggagagcg

SEQ ID NO: 109759 - DNA, 25 bp, Mus musculus
gatgacttggtgaccatctcagagc

SEQ ID NO: 109760 - DNA, 25 bp, Mus musculus
gatgacttgtacctcaatgccagca

SEQ ID NO: 109761 - DNA, 25 bp, Mus musculus
gatgactttccgctgtgacacagga

SEQ ID NO: 109762 - DNA, 25 bp, Mus musculus
gatgactttgaactacttgaccagg

SEQ ID NO: 109763 - DNA, 25 bp, Mus musculus
gatgagaaaaaccagatgatgacga

SEQ ID NO: 109764 - DNA, 25 bp, Mus musculus
gatgagaaatccacccacagtactg

SEQ ID NO: 109765 - DNA, 25 bp, Mus musculus
gatgagaaattcaaccagctggtcc

SEQ ID NO: 109766 - DNA, 25 bp, Mus musculus
gatgagaacccctctgatagcagca

SEQ ID NO: 109767 - DNA, 25 bp, Mus musculus
gatgagaaccttcactgaccacgtg

SEQ ID NO: 109768 - DNA, 25 bp, Mus musculus
gatgagaactccttcgtgggacctg

SEQ ID NO: 109769 - DNA, 25 bp, Mus musculus
gatgagaacttaccactgggcaagc

SEQ ID NO: 109770 - DNA, 25 bp, Mus musculus
gatgagaagaatcaagcctgctgcc

SEQ ID NO: 109771 - DNA, 25 bp, Mus musculus
gatgagaagttttgcctccggtgga

SEQ ID NO: 109772 - DNA, 25 bp, Mus musculus
gatgagaatggcaccagtgtcgctg

SEQ ID NO: 109773 - DNA, 25 bp, Mus musculus
gatgagaattttgaggcccagacct

SEQ ID NO: 109774 - DNA, 25 bp, Mus musculus
gatgagacagatcccgtacaccatg

SEQ ID NO: 109775 - DNA, 25 bp, Mus musculus
gatgagacatttgcggtgctgagcc

SEQ ID NO: 109776 - DNA, 25 bp, Mus musculus
gatgagacctcttctgggacaggaa

SEQ ID NO: 109777 - DNA, 25 bp, Mus musculus
gatgagactgcatgccaagggcaca

SEQ ID NO: 109778 - DNA, 25 bp, Mus musculus
gatgagagacgcatcattgagagcc

SEQ ID NO: 109779 - DNA, 25 bp, Mus musculus
gatgagagctcttcaggcgagaaca

SEQ ID NO: 109780 - DNA, 25 bp, Mus musculus
gatgagagtcccacaaaggagcagg

SEQ ID NO: 109781 - DNA, 25 bp, Mus musculus
gatgagataccaaagagagcccagg

SEQ ID NO: 109782 - DNA, 25 bp, Mus musculus
gatgagatactccaagacattgacc

SEQ ID NO: 109783 - DNA, 25 bp, Mus musculus
gatgagatagacaccgactctgcct

SEQ ID NO: 109784 - DNA, 25 bp, Mus musculus
gatgagatagtcacggagacgctgc

SEQ ID NO: 109785 - DNA, 25 bp, Mus musculus
gatgagatatattgcccaccagaaa

SEQ ID NO: 109786 - DNA, 25 bp, Mus musculus
gatgagatggatacacacaatgctg

SEQ ID NO: 109787 - DNA, 25 bp, Mus musculus
gatgagcaacctggacctgactaag

SEQ ID NO: 109788 - DNA, 25 bp, Mus musculus
gatgagcacccttgagaaatccaaa

SEQ ID NO: 109789 - DNA, 25 bp, Mus musculus
gatgagcaggaatgccttctctgtc

SEQ ID NO: 109790 - DNA, 25 bp, Mus musculus
gatgagcagtcgtaaaaccaagagt

SEQ ID NO: 109791 - DNA, 25 bp, Mus musculus
gatgagccaacagtcaacacgcaga

SEQ ID NO: 109792 - DNA, 25 bp, Mus musculus
gatgagccaatgacaccaaaggact

SEQ ID NO: 109793 - DNA, 25 bp, Mus musculus
gatgagccccaagaacctcaagagc

SEQ ID NO: 109794 - DNA, 25 bp, Mus musculus
gatgagccgacgaacccggttgtct

SEQ ID NO: 109795 - DNA, 25 bp, Mus musculus
gatgagccggatgcctttagagagc

SEQ ID NO: 109796 - DNA, 25 bp, Mus musculus
gatgagccgtggttggttcctcgac

SEQ ID NO: 109797 - DNA, 25 bp, Mus musculus
gatgagcctgacacaaatctcgtgg

SEQ ID NO: 109798 - DNA, 25 bp, Mus musculus
gatgagcctgccagtgaaacctgga

SEQ ID NO: 109799 - DNA, 25 bp, Mus musculus
gatgagcgcctgaactggatctact

SEQ ID NO: 109800 - DNA, 25 bp, Mus musculus
gatgagcgggctaccttactgaacg

SEQ ID NO: 109801 - DNA, 25 bp, Mus musculus
gatgagcgtgcggttgtgtccacca

SEQ ID NO: 109802 - DNA, 25 bp, Mus musculus
gatgagctcctgcaacctaggttcg

SEQ ID NO: 109803 - DNA, 25 bp, Mus musculus
gatgagctctttcctccaagcctga

SEQ ID NO: 109804 - DNA, 25 bp, Mus musculus
gatgagctgactgcaattctggaga

SEQ ID NO: 109805 - DNA, 25 bp, Mus musculus
gatgagctgactgcggatttcctgt

SEQ ID NO: 109806 - DNA, 25 bp, Mus musculus
gatgagctgccatccctggaagaag

SEQ ID NO: 109807 - DNA, 25 bp, Mus musculus
gatgagcttcaaaccacacagatgt

SEQ ID NO: 109808 - DNA, 25 bp, Mus musculus
gatgaggaaaacgatccagactatg

SEQ ID NO: 109809 - DNA, 25 bp, Mus musculus
gatgaggaagcatcttaggcattgc

SEQ ID NO: 109810 - DNA, 25 bp, Mus musculus
gatgaggacacagcaccgatggatg

SEQ ID NO: 109811 - DNA, 25 bp, Mus musculus
gatgaggacactattggtacccagc

SEQ ID NO: 109812 - DNA, 25 bp, Mus musculus
gatgaggacccctaacaacaggaga

SEQ ID NO: 109813 - DNA, 25 bp, Mus musculus
gatgaggagacaccattggcagctc

SEQ ID NO: 109814 - DNA, 25 bp, Mus musculus
gatgaggagatctccccaacacctc

SEQ ID NO: 109815 - DNA, 25 bp, Mus musculus
gatgaggcagtgagagagctcaccc

SEQ ID NO: 109816 - DNA, 25 bp, Mus musculus
gatgaggccctcaagtatctgtcca

SEQ ID NO: 109817 - DNA, 25 bp, Mus musculus
gatgaggccgaatccaacgatggca

SEQ ID NO: 109818 - DNA, 25 bp, Mus musculus
gatgaggccgtgtgtttctgtaacc

SEQ ID NO: 109819 - DNA, 25 bp, Mus musculus
gatgaggctcaactaccgatgggac

SEQ ID NO: 109820 - DNA, 25 bp, Mus musculus
gatgaggctgaactcttgccacctg

SEQ ID NO: 109821 - DNA, 25 bp, Mus musculus
gatgagggcaatgactactttaaag

SEQ ID NO: 109822 - DNA, 25 bp, Mus musculus
gatgagggccccacctgggaattct

SEQ ID NO: 109823 - DNA, 25 bp, Mus musculus
gatgaggtgccctaagctgtgccca

SEQ ID NO: 109824 - DNA, 25 bp, Mus musculus
gatgaggtggactcttgagacgctc

SEQ ID NO: 109825 - DNA, 25 bp, Mus musculus
gatgagtacgagaccgaaacgggct

SEQ ID NO: 109826 - DNA, 25 bp, Mus musculus
gatgagtacgattccaccaagagtg

SEQ ID NO: 109827 - DNA, 25 bp, Mus musculus
gatgagtatgaggaaccagcagccc

SEQ ID NO: 109828 - DNA, 25 bp, Mus musculus
gatgagtatgcactgctaactagga

SEQ ID NO: 109829 - DNA, 25 bp, Mus musculus
gatgagtccagtagagtccctgtgg

SEQ ID NO: 109830 - DNA, 25 bp, Mus musculus
gatgagtccgacctctacaactggg

SEQ ID NO: 109831 - DNA, 25 bp, Mus musculus
gatgagtctaactgcaggaacggag

SEQ ID NO: 109832 - DNA, 25 bp, Mus musculus
gatgagtctgaggatacagatactg

SEQ ID NO: 109833 - DNA, 25 bp, Mus musculus
gatgagtgacgtggtggtccaaccc

SEQ ID NO: 109834 - DNA, 25 bp, Mus musculus
gatgagtgagcatcacaagcgagcc

SEQ ID NO: 109835 - DNA, 25 bp, Mus musculus
gatgagtgcatagcgagctcccagt

SEQ ID NO: 109836 - DNA, 25 bp, Mus musculus
gatgagtgcgccaatccaagtcacg

SEQ ID NO: 109837 - DNA, 25 bp, Mus musculus
gatgagtggactttactggacctga

SEQ ID NO: 109838 - DNA, 25 bp, Mus musculus
gatgagtgtctgtgaccctggccag

SEQ ID NO: 109839 - DNA, 25 bp, Mus musculus
gatgagttacactaccaggacgtgg

SEQ ID NO: 109840 - DNA, 25 bp, Mus musculus
gatgagttactctgccagctagagg

SEQ ID NO: 109841 - DNA, 25 bp, Mus musculus
gatgagttgaccagacacttccgaa

SEQ ID NO: 109842 - DNA, 25 bp, Mus musculus
gatgagttgctgcttacaaaaccgt

SEQ ID NO: 109843 - DNA, 25 bp, Mus musculus
gatgagtttccaccgaaatgtcgga

SEQ ID NO: 109844 - DNA, 25 bp, Mus musculus
gatgagtttggtttccgtgtggaca

SEQ ID NO: 109845 - DNA, 25 bp, Mus musculus
gatgataatatcttccctgatggag

SEQ ID NO: 109846 - DNA, 25 bp, Mus musculus
gatgatacagtagtgcccctggccg

SEQ ID NO: 109847 - DNA, 25 bp, Mus musculus
gatgatacggatcctgacagcatga

SEQ ID NO: 109848 - DNA, 25 bp, Mus musculus
gatgatagatggtcatgacacctgg

SEQ ID NO: 109849 - DNA, 25 bp, Mus musculus
gatgatagctctgaactttccagca

SEQ ID NO: 109850 - DNA, 25 bp, Mus musculus
gatgatatcatggaccccaggagca

SEQ ID NO: 109851 - DNA, 25 bp, Mus musculus
gatgatcaccggtctctccaaggat

SEQ ID NO: 109852 - DNA, 25 bp, Mus musculus
gatgatcatgctgggcccattcgag

SEQ ID NO: 109853 - DNA, 25 bp, Mus musculus
gatgatcatgtgttccgctggctgg

SEQ ID NO: 109854 - DNA, 25 bp, Mus musculus
gatgatcatttttcaccggaggcag

SEQ ID NO: 109855 - DNA, 25 bp, Mus musculus
gatgatccagatccccgcaaggtta

SEQ ID NO: 109856 - DNA, 25 bp, Mus musculus
gatgatccagatccgtgaggaccat

SEQ ID NO: 109857 - DNA, 25 bp, Mus musculus
gatgatcccgctgaaaggaagtact

SEQ ID NO: 109858 - DNA, 25 bp, Mus musculus
gatgatcccgtatcccctggagaag

SEQ ID NO: 109859 - DNA, 25 bp, Mus musculus
gatgatccgccagttggcagggcca

SEQ ID NO: 109860 - DNA, 25 bp, Mus musculus
gatgatcctaaccaacccagaggga

SEQ ID NO: 109861 - DNA, 25 bp, Mus musculus
gatgatcctctgacaactgttcacg

SEQ ID NO: 109862 - DNA, 25 bp, Mus musculus
gatgatcctgacacccatcaaggcc

SEQ ID NO: 109863 - DNA, 25 bp, Mus musculus
gatgatcctttccttctgtacgcca

SEQ ID NO: 109864 - DNA, 25 bp, Mus musculus
gatgatcgaactgaaggtgctctgc

SEQ ID NO: 109865 - DNA, 25 bp, Mus musculus
gatgatcgcacacacaacatggaga

SEQ ID NO: 109866 - DNA, 25 bp, Mus musculus
gatgatcggaagacgctaatgacca

SEQ ID NO: 109867 - DNA, 25 bp, Mus musculus
gatgatctcaatccagaagctgttg

SEQ ID NO: 109868 - DNA, 25 bp, Mus musculus
gatgatctcagtctcctctgcagag

SEQ ID NO: 109869 - DNA, 25 bp, Mus musculus
gatgatctccggagccctattcgag

SEQ ID NO: 109870 - DNA, 25 bp, Mus musculus
gatgatctcctatgctacacccgtg

SEQ ID NO: 109871 - DNA, 25 bp, Mus musculus
gatgatctccttgagctgtacatgg

SEQ ID NO: 109872 - DNA, 25 bp, Mus musculus
gatgatcttttcaaggaagcaggca

SEQ ID NO: 109873 - DNA, 25 bp, Mus musculus
gatgatgaaaacgaccctggtgggc

SEQ ID NO: 109874 - DNA, 25 bp, Mus musculus
gatgatgaaacctgtcctgagaagc

SEQ ID NO: 109875 - DNA, 25 bp, Mus musculus
gatgatgaaagccagtacctcccgt

SEQ ID NO: 109876 - DNA, 25 bp, Mus musculus
gatgatgaacctgccttgaagcgcc

SEQ ID NO: 109877 - DNA, 25 bp, Mus musculus
gatgatgaagagttacggcaccgaa

SEQ ID NO: 109878 - DNA, 25 bp, Mus musculus
gatgatgacaaaagtgagacctgcc

SEQ ID NO: 109879 - DNA, 25 bp, Mus musculus
gatgatgaccatgaaactaaacgac

SEQ ID NO: 109880 - DNA, 25 bp, Mus musculus
gatgatgacccgaagccaggatgct

SEQ ID NO: 109881 - DNA, 25 bp, Mus musculus
gatgatgacgatgggcaggaactcc

SEQ ID NO: 109882 - DNA, 25 bp, Mus musculus
gatgatgaggctgttcctgcccaca

SEQ ID NO: 109883 - DNA, 25 bp, Mus musculus
gatgatgagtagcaagcacctgccg

SEQ ID NO: 109884 - DNA, 25 bp, Mus musculus
gatgatgatccaaacagcatagagt

SEQ ID NO: 109885 - DNA, 25 bp, Mus musculus
gatgatgatccctactgctggagag

SEQ ID NO: 109886 - DNA, 25 bp, Mus musculus
gatgatgatggcacctccgttagct

SEQ ID NO: 109887 - DNA, 25 bp, Mus musculus
gatgatgatgtatctccattcctgg

SEQ ID NO: 109888 - DNA, 25 bp, Mus musculus
gatgatgcacccaaatggtgttgca

SEQ ID NO: 109889 - DNA, 25 bp, Mus musculus
gatgatgcatggtcgtaacaacggc

SEQ ID NO: 109890 - DNA, 25 bp, Mus musculus
gatgatgccacatgccgactctttg

SEQ ID NO: 109891 - DNA, 25 bp, Mus musculus
gatgatgccacttttctgagcgcca

SEQ ID NO: 109892 - DNA, 25 bp, Mus musculus
gatgatgccagaaacctcagcgtgg

SEQ ID NO: 109893 - DNA, 25 bp, Mus musculus
gatgatgccagtttgtccccatggg

SEQ ID NO: 109894 - DNA, 25 bp, Mus musculus
gatgatgccttggatgaactttctg

SEQ ID NO: 109895 - DNA, 25 bp, Mus musculus
gatgatgcgctcaacacggtgtaaa

SEQ ID NO: 109896 - DNA, 25 bp, Mus musculus
gatgatgctgaagagcctgaggatc

SEQ ID NO: 109897 - DNA, 25 bp, Mus musculus
gatgatggacctaagtgacctgccc

SEQ ID NO: 109898 - DNA, 25 bp, Mus musculus
gatgatggagcagagatacgcccag

SEQ ID NO: 109899 - DNA, 25 bp, Mus musculus
gatgatgggactgagacgcacttca

SEQ ID NO: 109900 - DNA, 25 bp, Mus musculus
gatgatggtccatgcaaagcaatga

SEQ ID NO: 109901 - DNA, 25 bp, Mus musculus
gatgatggttattcggcacccagaa

SEQ ID NO: 109902 - DNA, 25 bp, Mus musculus
gatgatgtcacctactgggccatga

SEQ ID NO: 109903 - DNA, 25 bp, Mus musculus
gatgatgtcatgcaactcctcatga

SEQ ID NO: 109904 - DNA, 25 bp, Mus musculus
gatgatgtgcggcataaagtccatc

SEQ ID NO: 109905 - DNA, 25 bp, Mus musculus
gatgatgttaatctactgactgctg

SEQ ID NO: 109906 - DNA, 25 bp, Mus musculus
gatgatgttcacgtcactataggag

SEQ ID NO: 109907 - DNA, 25 bp, Mus musculus
gatgatgttgaaccgctgagttcca

SEQ ID NO: 109908 - DNA, 25 bp, Mus musculus
gatgatgtttacagcttccaatcta

SEQ ID NO: 109909 - DNA, 25 bp, Mus musculus
gatgattactacaccgatgccagtc

SEQ ID NO: 109910 - DNA, 25 bp, Mus musculus
gatgattcgacccaagactgagaac

SEQ ID NO: 109911 - DNA, 25 bp, Mus musculus
gatgattcgccaaaggaaatagcaa

SEQ ID NO: 109912 - DNA, 25 bp, Mus musculus
gatgattctacacaagtgcctcctg

SEQ ID NO: 109913 - DNA, 25 bp, Mus musculus
gatgattctgaagtgacgagacctg

SEQ ID NO: 109914 - DNA, 25 bp, Mus musculus
gatgattgccactagactttatccc

SEQ ID NO: 109915 - DNA, 25 bp, Mus musculus
gatgattgggactttctgccaccca

SEQ ID NO: 109916 - DNA, 25 bp, Mus musculus
gatgatttactacggctcccaaagg

SEQ ID NO: 109917 - DNA, 25 bp, Mus musculus
gatgcaaaaccatccttcagcatgg

SEQ ID NO: 109918 - DNA, 25 bp, Mus musculus
gatgcaaagcgatccggtgtcaaga

SEQ ID NO: 109919 - DNA, 25 bp, Mus musculus
gatgcaaagtgttccagtgtgacct

SEQ ID NO: 109920 - DNA, 25 bp, Mus musculus
gatgcaaatgcggaaaacccagtac

SEQ ID NO: 109921 - DNA, 25 bp, Mus musculus
gatgcaaatggccacgtgaccttca

SEQ ID NO: 109922 - DNA, 25 bp, Mus musculus
gatgcaaattcaaccaacagcagag

SEQ ID NO: 109923 - DNA, 25 bp, Mus musculus
gatgcaacagatcctcgcacgagtt

SEQ ID NO: 109924 - DNA, 25 bp, Mus musculus
gatgcaacagattgaggaaccctgc

SEQ ID NO: 109925 - DNA, 25 bp, Mus musculus
gatgcaagaatatcaccgagaatgg

SEQ ID NO: 109926 - DNA, 25 bp, Mus musculus
gatgcaagccaaacctagtggcaca

SEQ ID NO: 109927 - DNA, 25 bp, Mus musculus
gatgcaaggcctcattgctgtcgct

SEQ ID NO: 109928 - DNA, 25 bp, Mus musculus
gatgcaagtacccagatgagaagtt

SEQ ID NO: 109929 - DNA, 25 bp, Mus musculus
gatgcaatgaacatgggccacacgg

SEQ ID NO: 109930 - DNA, 25 bp, Mus musculus
gatgcaatgcctggaaggtgtacaa

SEQ ID NO: 109931 - DNA, 25 bp, Mus musculus
gatgcaatgctggaagtggatcgcg

SEQ ID NO: 109932 - DNA, 25 bp, Mus musculus
gatgcacagctacaaacaacaagtg

SEQ ID NO: 109933 - DNA, 25 bp, Mus musculus
gatgcacagtacgaaacctaggccc

SEQ ID NO: 109934 - DNA, 25 bp, Mus musculus
gatgcacatgccttctgatgggacc

SEQ ID NO: 109935 - DNA, 25 bp, Mus musculus
gatgcacccaaacactacctggata

SEQ ID NO: 109936 - DNA, 25 bp, Mus musculus
gatgcacctggcagcattaatggag

SEQ ID NO: 109937 - DNA, 25 bp, Mus musculus
gatgcacgcgtactgtgaaaaccca

SEQ ID NO: 109938 - DNA, 25 bp, Mus musculus
gatgcactccaaacctatgaaggga

SEQ ID NO: 109939 - DNA, 25 bp, Mus musculus
gatgcactccagaaattgaccgaaa

SEQ ID NO: 109940 - DNA, 25 bp, Mus musculus
gatgcactcctaagaacctggacta

SEQ ID NO: 109941 - DNA, 25 bp, Mus musculus
gatgcactccttgtggtctatacca

SEQ ID NO: 109942 - DNA, 25 bp, Mus musculus
gatgcactggaagacatgttctcgc

SEQ ID NO: 109943 - DNA, 25 bp, Mus musculus
gatgcactggctaagccccaaggaa

SEQ ID NO: 109944 - DNA, 25 bp, Mus musculus
gatgcacttccaagtttcccagaga

SEQ ID NO: 109945 - DNA, 25 bp, Mus musculus
gatgcagaaacacaagatcccattg

SEQ ID NO: 109946 - DNA, 25 bp, Mus musculus
gatgcagaactaatccaagccgggc

SEQ ID NO: 109947 - DNA, 25 bp, Mus musculus
gatgcagaaggctctgaaccgccag

SEQ ID NO: 109948 - DNA, 25 bp, Mus musculus
gatgcagacccagttcctgaagagg

SEQ ID NO: 109949 - DNA, 25 bp, Mus musculus
gatgcagagaaccatcacgaggcag

SEQ ID NO: 109950 - DNA, 25 bp, Mus musculus
gatgcagagaccctgtacaaggaga

SEQ ID NO: 109951 - DNA, 25 bp, Mus musculus
gatgcagagacggaagatgacttct

SEQ ID NO: 109952 - DNA, 25 bp, Mus musculus
gatgcagagatcgactccttgacca

SEQ ID NO: 109953 - DNA, 25 bp, Mus musculus
gatgcagaggaattccccaacctgt

SEQ ID NO: 109954 - DNA, 25 bp, Mus musculus
gatgcagatgaaataattcagtgtg

SEQ ID NO: 109955 - DNA, 25 bp, Mus musculus
gatgcagatgatgttgtgagcgcca

SEQ ID NO: 109956 - DNA, 25 bp, Mus musculus
gatgcagcagatcagtgcagcgtct

SEQ ID NO: 109957 - DNA, 25 bp, Mus musculus
gatgcagccatggagcgatacacac

SEQ ID NO: 109958 - DNA, 25 bp, Mus musculus
gatgcagccattttccgcacgctgg

SEQ ID NO: 109959 - DNA, 25 bp, Mus musculus
gatgcagccctaccttttcgtgtgg

SEQ ID NO: 109960 - DNA, 25 bp, Mus musculus
gatgcagccctgcaaagtgaccctg

SEQ ID NO: 109961 - DNA, 25 bp, Mus musculus
gatgcagcctcattacactctgtcc

SEQ ID NO: 109962 - DNA, 25 bp, Mus musculus
gatgcagcctttccaagcagcatgg

SEQ ID NO: 109963 - DNA, 25 bp, Mus musculus
gatgcagcgactattttaagagagc

SEQ ID NO: 109964 - DNA, 25 bp, Mus musculus
gatgcagcgggcaagctcgtcctgc

SEQ ID NO: 109965 - DNA, 25 bp, Mus musculus
gatgcagcgtctactgagcttcccg

SEQ ID NO: 109966 - DNA, 25 bp, Mus musculus
gatgcagctgaaacagagcacgtgc

SEQ ID NO: 109967 - DNA, 25 bp, Mus musculus
gatgcagctgcatgggattgcccag

SEQ ID NO: 109968 - DNA, 25 bp, Mus musculus
gatgcagctgcccagacgaatctgg

SEQ ID NO: 109969 - DNA, 25 bp, Mus musculus
gatgcagcttccttgaccatgagaa

SEQ ID NO: 109970 - DNA, 25 bp, Mus musculus
gatgcaggagaaacaggaagccttt

SEQ ID NO: 109971 - DNA, 25 bp, Mus musculus
gatgcaggcagcctaactgaaggct

SEQ ID NO: 109972 - DNA, 25 bp, Mus musculus
gatgcaggcgtattttccaacagag

SEQ ID NO: 109973 - DNA, 25 bp, Mus musculus
gatgcagggccatgaagatcagaac

SEQ ID NO: 109974 - DNA, 25 bp, Mus musculus
gatgcaggtcttaccccagtgtggc

SEQ ID NO: 109975 - DNA, 25 bp, Mus musculus
gatgcaggtgatagccccgttggca

SEQ ID NO: 109976 - DNA, 25 bp, Mus musculus
gatgcagtaaaccaagccggtgcca

SEQ ID NO: 109977 - DNA, 25 bp, Mus musculus
gatgcagtctgacccagctcttttg

SEQ ID NO: 109978 - DNA, 25 bp, Mus musculus
gatgcagtgctatctcgggccaatg

SEQ ID NO: 109979 - DNA, 25 bp, Mus musculus
gatgcagttcttggatgagatgaga

SEQ ID NO: 109980 - DNA, 25 bp, Mus musculus
gatgcataagtttccctgacgtgtc

SEQ ID NO: 109981 - DNA, 25 bp, Mus musculus
gatgcatacaaaggccttcttccag

SEQ ID NO: 109982 - DNA, 25 bp, Mus musculus
gatgcataccgtgcactactactgc

SEQ ID NO: 109983 - DNA, 25 bp, Mus musculus
gatgcatagcattgtgacccagggt

SEQ ID NO: 109984 - DNA, 25 bp, Mus musculus
gatgcataggactcagatggccgca

SEQ ID NO: 109985 - DNA, 25 bp, Mus musculus
gatgcataggctccttagaatcctt

SEQ ID NO: 109986 - DNA, 25 bp, Mus musculus
gatgcatcacagaaagagcccagct

SEQ ID NO: 109987 - DNA, 25 bp, Mus musculus
gatgcatcacgtccactcagaaagc

SEQ ID NO: 109988 - DNA, 25 bp, Mus musculus
gatgcatcgagtaaatacctcaaag

SEQ ID NO: 109989 - DNA, 25 bp, Mus musculus
gatgcatcgttatttcacgctggtc

SEQ ID NO: 109990 - DNA, 25 bp, Mus musculus
gatgcatctcctgcatgaagaggga

SEQ ID NO: 109991 - DNA, 25 bp, Mus musculus
gatgcatctcggcacatccttgaag

SEQ ID NO: 109992 - DNA, 25 bp, Mus musculus
gatgcatctgatggatcagcctaac

SEQ ID NO: 109993 - DNA, 25 bp, Mus musculus
gatgcatgacgtgacggcacaggac

SEQ ID NO: 109994 - DNA, 25 bp, Mus musculus
gatgcatgcctggaaacgcagtgga

SEQ ID NO: 109995 - DNA, 25 bp, Mus musculus
gatgcatgcttatctgggaaaccct

SEQ ID NO: 109996 - DNA, 25 bp, Mus musculus
gatgcatgggtgctttcagcctaag

SEQ ID NO: 109997 - DNA, 25 bp, Mus musculus
gatgccaaaaactctgatacagctc

SEQ ID NO: 109998 - DNA, 25 bp, Mus musculus
gatgccaaaggccagtacctgtttg

SEQ ID NO: 109999 - DNA, 25 bp, Mus musculus
gatgccaacctctgcttaaagggag

SEQ ID NO: 110000 - DNA, 25 bp, Mus musculus
gatgccaacttataaaaccagaccg

SEQ ID NO: 110001 - DNA, 25 bp, Mus musculus
gatgccaagactaggagccatgctg

SEQ ID NO: 110002 - DNA, 25 bp, Mus musculus
gatgccaagagtcgctacaagctga

SEQ ID NO: 110003 - DNA, 25 bp, Mus musculus
gatgccaagatcctgaatgacgttc

SEQ ID NO: 110004 - DNA, 25 bp, Mus musculus
gatgccaagggagtacaatgaggat

SEQ ID NO: 110005 - DNA, 25 bp, Mus musculus
gatgccaaggtcaaggtagtccgta

SEQ ID NO: 110006 - DNA, 25 bp, Mus musculus
gatgccaataagtcagcgtcgggcg

SEQ ID NO: 110007 - DNA, 25 bp, Mus musculus
gatgccaatgaagactacgaagact

SEQ ID NO: 110008 - DNA, 25 bp, Mus musculus
gatgccacaaaactggatacgtggg

SEQ ID NO: 110009 - DNA, 25 bp, Mus musculus
gatgccacaaagacatggtcctgat

SEQ ID NO: 110010 - DNA, 25 bp, Mus musculus
gatgccaccatccaggactccttag

SEQ ID NO: 110011 - DNA, 25 bp, Mus musculus
gatgccacccaagcgcatagctaag

SEQ ID NO: 110012 - DNA, 25 bp, Mus musculus
gatgccaccctcctgatacatgaag

SEQ ID NO: 110013 - DNA, 25 bp, Mus musculus
gatgccagactcgagacctacgatg

SEQ ID NO: 110014 - DNA, 25 bp, Mus musculus
gatgccagcggaaaagaggtacaac

SEQ ID NO: 110015 - DNA, 25 bp, Mus musculus
gatgccagcgtgtcctgaggtcttt

SEQ ID NO: 110016 - DNA, 25 bp, Mus musculus
gatgccagctgtgcatgagcagaaa

SEQ ID NO: 110017 - DNA, 25 bp, Mus musculus
gatgccagggccacaatggagctct

SEQ ID NO: 110018 - DNA, 25 bp, Mus musculus
gatgccagtaaagccgtgagcagcc

SEQ ID NO: 110019 - DNA, 25 bp, Mus musculus
gatgccagtgcagctcaaaggcctg

SEQ ID NO: 110020 - DNA, 25 bp, Mus musculus
gatgccagttcacctgaaggagaga

SEQ ID NO: 110021 - DNA, 25 bp, Mus musculus
gatgccataacagaaccctgggagg

SEQ ID NO: 110022 - DNA, 25 bp, Mus musculus
gatgccatcaaagtgcggtcggaga

SEQ ID NO: 110023 - DNA, 25 bp, Mus musculus
gatgccatcaatttccacgacaaga

SEQ ID NO: 110024 - DNA, 25 bp, Mus musculus
gatgccatccaagacgtcagtgtgc

SEQ ID NO: 110025 - DNA, 25 bp, Mus musculus
gatgccatccgaaagtctggagcca

SEQ ID NO: 110026 - DNA, 25 bp, Mus musculus
gatgccatctggactgaaagacctt

SEQ ID NO: 110027 - DNA, 25 bp, Mus musculus
gatgccatctttgaggtgcccagct

SEQ ID NO: 110028 - DNA, 25 bp, Mus musculus
gatgccatggacagacagagactta

SEQ ID NO: 110029 - DNA, 25 bp, Mus musculus
gatgccattattcggacggacgctc

SEQ ID NO: 110030 - DNA, 25 bp, Mus musculus
gatgccattgagaaagcccaggact

SEQ ID NO: 110031 - DNA, 25 bp, Mus musculus
gatgcccaaagttatatcgagctca

SEQ ID NO: 110032 - DNA, 25 bp, Mus musculus
gatgcccaatcggtcttggacgcca

SEQ ID NO: 110033 - DNA, 25 bp, Mus musculus
gatgcccaccccagaagtaatttat

SEQ ID NO: 110034 - DNA, 25 bp, Mus musculus
gatgcccacgagaaagatgacttcc

SEQ ID NO: 110035 - DNA, 25 bp, Mus musculus
gatgcccacttttccatcaacagag

SEQ ID NO: 110036 - DNA, 25 bp, Mus musculus
gatgcccatgccttcaaagagacgc

SEQ ID NO: 110037 - DNA, 25 bp, Mus musculus
gatgcccatgtcatcctgaacgata

SEQ ID NO: 110038 - DNA, 25 bp, Mus musculus
gatgccccaggatagggaaggactt

SEQ ID NO: 110039 - DNA, 25 bp, Mus musculus
gatgccccagtggatcacgttggaa

SEQ ID NO: 110040 - DNA, 25 bp, Mus musculus
gatgcccgaaaatgtgcttgcgcca

SEQ ID NO: 110041 - DNA, 25 bp, Mus musculus
gatgcccgagactgcgatttccaag

SEQ ID NO: 110042 - DNA, 25 bp, Mus musculus
gatgcccgagagagatgtacgacct

SEQ ID NO: 110043 - DNA, 25 bp, Mus musculus
gatgcccgatgtggtacagacaaga

SEQ ID NO: 110044 - DNA, 25 bp, Mus musculus
gatgccctaaccatgagctgagccg

SEQ ID NO: 110045 - DNA, 25 bp, Mus musculus
gatgccctccatgaaataccactga

SEQ ID NO: 110046 - DNA, 25 bp, Mus musculus
gatgccctgacccattggaactgct

SEQ ID NO: 110047 - DNA, 25 bp, Mus musculus
gatgccctgcgccagatgcaagtgt

SEQ ID NO: 110048 - DNA, 25 bp, Mus musculus
gatgccctggacctaactgatgtgg

SEQ ID NO: 110049 - DNA, 25 bp, Mus musculus
gatgcccttcgcaagatgatcaact

SEQ ID NO: 110050 - DNA, 25 bp, Mus musculus
gatgcccttgatatcctggctgaaa

SEQ ID NO: 110051 - DNA, 25 bp, Mus musculus
gatgccgagtggacaacagtcttca

SEQ ID NO: 110052 - DNA, 25 bp, Mus musculus
gatgccgatgattaccactccgagg

SEQ ID NO: 110053 - DNA, 25 bp, Mus musculus
gatgccgcactttctggactggttt

SEQ ID NO: 110054 - DNA, 25 bp, Mus musculus
gatgccgccggagagaaaagtttac

SEQ ID NO: 110055 - DNA, 25 bp, Mus musculus
gatgccgcgagcgaatacgctaaat

SEQ ID NO: 110056 - DNA, 25 bp, Mus musculus
gatgccgctgataagatggccccgg

SEQ ID NO: 110057 - DNA, 25 bp, Mus musculus
gatgccggcaagaccacatatgtga

SEQ ID NO: 110058 - DNA, 25 bp, Mus musculus
gatgccggcgcctacagttaaagga

SEQ ID NO: 110059 - DNA, 25 bp, Mus musculus
gatgccgtcgagttttgccatgaag

SEQ ID NO: 110060 - DNA, 25 bp, Mus musculus
gatgccgtggatctcctggagttcc

SEQ ID NO: 110061 - DNA, 25 bp, Mus musculus
gatgccgttccaaaccctctgctgg

SEQ ID NO: 110062 - DNA, 25 bp, Mus musculus
gatgcctaagcatctccaacaataa

SEQ ID NO: 110063 - DNA, 25 bp, Mus musculus
gatgcctacaatgaaaccatgacag

SEQ ID NO: 110064 - DNA, 25 bp, Mus musculus
gatgcctaccggacagacttagaag

SEQ ID NO: 110065 - DNA, 25 bp, Mus musculus
gatgcctacggtgaatgccagtgtg

SEQ ID NO: 110066 - DNA, 25 bp, Mus musculus
gatgcctagaacactggagaacgcc

SEQ ID NO: 110067 - DNA, 25 bp, Mus musculus
gatgcctagccacttggcaccaggg

SEQ ID NO: 110068 - DNA, 25 bp, Mus musculus
gatgcctataccctgagcggagctg

SEQ ID NO: 110069 - DNA, 25 bp, Mus musculus
gatgcctatactgagcagctgcaca

SEQ ID NO: 110070 - DNA, 25 bp, Mus musculus
gatgcctatgaccttgtttttgacc

SEQ ID NO: 110071 - DNA, 25 bp, Mus musculus
gatgcctatggtgtgggccgctaca

SEQ ID NO: 110072 - DNA, 25 bp, Mus musculus
gatgcctatgtgacagagactgcag

SEQ ID NO: 110073 - DNA, 25 bp, Mus musculus
gatgcctattgtgagcgccagtgaa

SEQ ID NO: 110074 - DNA, 25 bp, Mus musculus
gatgcctcagggatgccggacattt

SEQ ID NO: 110075 - DNA, 25 bp, Mus musculus
gatgcctcctgatgagactgtactg

SEQ ID NO: 110076 - DNA, 25 bp, Mus musculus
gatgcctcggaaggcagaatccttc

SEQ ID NO: 110077 - DNA, 25 bp, Mus musculus
gatgcctctctgaatgaaactgcca

SEQ ID NO: 110078 - DNA, 25 bp, Mus musculus
gatgcctgactccacaaggtagtaa

SEQ ID NO: 110079 - DNA, 25 bp, Mus musculus
gatgcctgactgatggatagcctgg

SEQ ID NO: 110080 - DNA, 25 bp, Mus musculus
gatgcctgatgagcctgaagagcca

SEQ ID NO: 110081 - DNA, 25 bp, Mus musculus
gatgcctgcagatcacagctgggta

SEQ ID NO: 110082 - DNA, 25 bp, Mus musculus
gatgcctgcctcatctggcctgaag

SEQ ID NO: 110083 - DNA, 25 bp, Mus musculus
gatgcctgccttcaacagattgctt

SEQ ID NO: 110084 - DNA, 25 bp, Mus musculus
gatgcctgctggaatgcttttcgag

SEQ ID NO: 110085 - DNA, 25 bp, Mus musculus
gatgcctggaaaccaaatgtctggg

SEQ ID NO: 110086 - DNA, 25 bp, Mus musculus
gatgcctgtaattgtttcccgggta

SEQ ID NO: 110087 - DNA, 25 bp, Mus musculus
gatgcctgtacaagcttctagctgt

SEQ ID NO: 110088 - DNA, 25 bp, Mus musculus
gatgcctgtgacaaagaagccgcga

SEQ ID NO: 110089 - DNA, 25 bp, Mus musculus
gatgcctgtgcttcgcgagtacctg

SEQ ID NO: 110090 - DNA, 25 bp, Mus musculus
gatgccttcaacttgctcctggaga

SEQ ID NO: 110091 - DNA, 25 bp, Mus musculus
gatgccttcaagactctgttcgtgg

SEQ ID NO: 110092 - DNA, 25 bp, Mus musculus
gatgccttcgccttgggactctgaa

SEQ ID NO: 110093 - DNA, 25 bp, Mus musculus
gatgccttctgccaagtgggccgac

SEQ ID NO: 110094 - DNA, 25 bp, Mus musculus
gatgccttctggagtgtgagcaaac

SEQ ID NO: 110095 - DNA, 25 bp, Mus musculus
gatgccttggcagttcctgcgtcga

SEQ ID NO: 110096 - DNA, 25 bp, Mus musculus
gatgcctttcatataacctgggtgg

SEQ ID NO: 110097 - DNA, 25 bp, Mus musculus
gatgcctttgggaagcatgtcacca

SEQ ID NO: 110098 - DNA, 25 bp, Mus musculus
gatgccttttccaccttctacctga

SEQ ID NO: 110099 - DNA, 25 bp, Mus musculus
gatgcgaactactccgttggcctgt

SEQ ID NO: 110100 - DNA, 25 bp, Mus musculus
gatgcgacctgctaatgacccaaag

SEQ ID NO: 110101 - DNA, 25 bp, Mus musculus
gatgcgactcgactgcttttggagc

SEQ ID NO: 110102 - DNA, 25 bp, Mus musculus
gatgcgagccgcgtcagagctcgct

SEQ ID NO: 110103 - DNA, 25 bp, Mus musculus
gatgcgatatcaccgacaatcagag

SEQ ID NO: 110104 - DNA, 25 bp, Mus musculus
gatgcgatctaaaaaagaagactcc

SEQ ID NO: 110105 - DNA, 25 bp, Mus musculus
gatgcgatgcatacaccaggctcat

SEQ ID NO: 110106 - DNA, 25 bp, Mus musculus
gatgcgcacacaatcatagccaaga

SEQ ID NO: 110107 - DNA, 25 bp, Mus musculus
gatgcgcagccgttgacagtttagg

SEQ ID NO: 110108 - DNA, 25 bp, Mus musculus
gatgcgccacggcttcggtagcgac

SEQ ID NO: 110109 - DNA, 25 bp, Mus musculus
gatgcgccagcagcaactagagtct

SEQ ID NO: 110110 - DNA, 25 bp, Mus musculus
gatgcgccagcctctagtttaaagg

SEQ ID NO: 110111 - DNA, 25 bp, Mus musculus
gatgcgcctgaaggattatgtcaag

SEQ ID NO: 110112 - DNA, 25 bp, Mus musculus
gatgcgcctggcaaggccctgtatg

SEQ ID NO: 110113 - DNA, 25 bp, Mus musculus
gatgcgccttgtcttactaaacgtg

SEQ ID NO: 110114 - DNA, 25 bp, Mus musculus
gatgcgctaccatattttgaccaag

SEQ ID NO: 110115 - DNA, 25 bp, Mus musculus
gatgcgctataaccggctgactgtg

SEQ ID NO: 110116 - DNA, 25 bp, Mus musculus
gatgcgctggtccagaagcacttga

SEQ ID NO: 110117 - DNA, 25 bp, Mus musculus
gatgcggattgtgcagaaacaccca

SEQ ID NO: 110118 - DNA, 25 bp, Mus musculus
gatgcggcatctactgagactactt

SEQ ID NO: 110119 - DNA, 25 bp, Mus musculus
gatgcggcatgcaatgttcctacca

SEQ ID NO: 110120 - DNA, 25 bp, Mus musculus
gatgcggcgtgtgagctcctactca

SEQ ID NO: 110121 - DNA, 25 bp, Mus musculus
gatgcgggaccagtccatttggcca

SEQ ID NO: 110122 - DNA, 25 bp, Mus musculus
gatgcgggcccgagacaatgtgtat

SEQ ID NO: 110123 - DNA, 25 bp, Mus musculus
gatgcgggctgtacgcctcgtccgc

SEQ ID NO: 110124 - DNA, 25 bp, Mus musculus
gatgcggtatatctcccatgtgcct

SEQ ID NO: 110125 - DNA, 25 bp, Mus musculus
gatgcggtcttcaggctcatggagc

SEQ ID NO: 110126 - DNA, 25 bp, Mus musculus
gatgcgtacactgcaactgccatta

SEQ ID NO: 110127 - DNA, 25 bp, Mus musculus
gatgcgtacactgtgcatgggagca

SEQ ID NO: 110128 - DNA, 25 bp, Mus musculus
gatgcgtacgctcttcggcttcctg

SEQ ID NO: 110129 - DNA, 25 bp, Mus musculus
gatgcgtctaagctggagtcactcg

SEQ ID NO: 110130 - DNA, 25 bp, Mus musculus
gatgcgtgcccgctctaaggtgtac

SEQ ID NO: 110131 - DNA, 25 bp, Mus musculus
gatgctaacgttctgactaacgagc

SEQ ID NO: 110132 - DNA, 25 bp, Mus musculus
gatgctaatatcagtgtgtgtttgc

SEQ ID NO: 110133 - DNA, 25 bp, Mus musculus
gatgctacaacgtcagaggaaccga

SEQ ID NO: 110134 - DNA, 25 bp, Mus musculus
gatgctaccacgataaacattgagg

SEQ ID NO: 110135 - DNA, 25 bp, Mus musculus
gatgctactggtatcctttcaatag

SEQ ID NO: 110136 - DNA, 25 bp, Mus musculus
gatgctactgtgttgcctgatgtcc

SEQ ID NO: 110137 - DNA, 25 bp, Mus musculus
gatgctactgttgcaagctctcctg

SEQ ID NO: 110138 - DNA, 25 bp, Mus musculus
gatgctagctacatggcagccgtca

SEQ ID NO: 110139 - DNA, 25 bp, Mus musculus
gatgctagctccagtgaaggcgaga

SEQ ID NO: 110140 - DNA, 25 bp, Mus musculus
gatgctagtgcatgattctttttct

SEQ ID NO: 110141 - DNA, 25 bp, Mus musculus
gatgctatccatgtgctacgaaacc

SEQ ID NO: 110142 - DNA, 25 bp, Mus musculus
gatgctatccgagtctttgccaaca

SEQ ID NO: 110143 - DNA, 25 bp, Mus musculus
gatgctatctccatggcaacactgg

SEQ ID NO: 110144 - DNA, 25 bp, Mus musculus
gatgctatctggtgcgcttcagcga

SEQ ID NO: 110145 - DNA, 25 bp, Mus musculus
gatgctcaagccacgctgcagaaga

SEQ ID NO: 110146 - DNA, 25 bp, Mus musculus
gatgctcaccactatggctgggagg

SEQ ID NO: 110147 - DNA, 25 bp, Mus musculus
gatgctcagcaatctcctggaaatg

SEQ ID NO: 110148 - DNA, 25 bp, Mus musculus
gatgctcagtcaaggcactcaggaa

SEQ ID NO: 110149 - DNA, 25 bp, Mus musculus
gatgctcattcacatccggacacac

SEQ ID NO: 110150 - DNA, 25 bp, Mus musculus
gatgctccacagaatcccggcattt

SEQ ID NO: 110151 - DNA, 25 bp, Mus musculus
gatgctccacatctagactccttgt

SEQ ID NO: 110152 - DNA, 25 bp, Mus musculus
gatgctccagatgcggatacggcca

SEQ ID NO: 110153 - DNA, 25 bp, Mus musculus
gatgctccatccaatcacgagttgg

SEQ ID NO: 110154 - DNA, 25 bp, Mus musculus
gatgctccatttgcgaagttcacag

SEQ ID NO: 110155 - DNA, 25 bp, Mus musculus
gatgctcccagcaatactcaatagt

SEQ ID NO: 110156 - DNA, 25 bp, Mus musculus
gatgctcccgagaaagtagccgatg

SEQ ID NO: 110157 - DNA, 25 bp, Mus musculus
gatgctccgaatgtaccaagccctg

SEQ ID NO: 110158 - DNA, 25 bp, Mus musculus
gatgctcctcatggtaactctggtg

SEQ ID NO: 110159 - DNA, 25 bp, Mus musculus
gatgctcgcgatgtccgggatgtcc

SEQ ID NO: 110160 - DNA, 25 bp, Mus musculus
gatgctcgcgcttggaagactttca

SEQ ID NO: 110161 - DNA, 25 bp, Mus musculus
gatgctcggacatcgttgataccag

SEQ ID NO: 110162 - DNA, 25 bp, Mus musculus
gatgctcggccaagtgtcaatgcgg

SEQ ID NO: 110163 - DNA, 25 bp, Mus musculus
gatgctcgggagtcctgcgttacca

SEQ ID NO: 110164 - DNA, 25 bp, Mus musculus
gatgctctccagtcacaagatgcgt

SEQ ID NO: 110165 - DNA, 25 bp, Mus musculus
gatgctctcccctgaagttggtcca

SEQ ID NO: 110166 - DNA, 25 bp, Mus musculus
gatgctctgctcgttgagtgaagaa

SEQ ID NO: 110167 - DNA, 25 bp, Mus musculus
gatgctctggagtggacaatgcctg

SEQ ID NO: 110168 - DNA, 25 bp, Mus musculus
gatgctctgtgagaccttgcccagt

SEQ ID NO: 110169 - DNA, 25 bp, Mus musculus
gatgctcttatcagacacttggaga

SEQ ID NO: 110170 - DNA, 25 bp, Mus musculus
gatgctgaaaagcttcgttctgtcg

SEQ ID NO: 110171 - DNA, 25 bp, Mus musculus
gatgctgaacaatcccaaaagggtt

SEQ ID NO: 110172 - DNA, 25 bp, Mus musculus
gatgctgaacttcatgggcgcgccc

SEQ ID NO: 110173 - DNA, 25 bp, Mus musculus
gatgctgacccgaaccttgaagtgg

SEQ ID NO: 110174 - DNA, 25 bp, Mus musculus
gatgctgactctcctcagggtgcca

SEQ ID NO: 110175 - DNA, 25 bp, Mus musculus
gatgctgagaccaacctctgagggc

SEQ ID NO: 110176 - DNA, 25 bp, Mus musculus
gatgctgagacccacttggctgaaa

SEQ ID NO: 110177 - DNA, 25 bp, Mus musculus
gatgctgatcaatattactgtgcgg

SEQ ID NO: 110178 - DNA, 25 bp, Mus musculus
gatgctgatgacaggaatgccccag

SEQ ID NO: 110179 - DNA, 25 bp, Mus musculus
gatgctgatgggtgcctgcttcacg

SEQ ID NO: 110180 - DNA, 25 bp, Mus musculus
gatgctgattcggtgcgtcccactg

SEQ ID NO: 110181 - DNA, 25 bp, Mus musculus
gatgctgattctgagtccctccagg

SEQ ID NO: 110182 - DNA, 25 bp, Mus musculus
gatgctgcaacttcaaggatgggca

SEQ ID NO: 110183 - DNA, 25 bp, Mus musculus
gatgctgcaggaattctcaaacgac

SEQ ID NO: 110184 - DNA, 25 bp, Mus musculus
gatgctgcatctggagccactgagg

SEQ ID NO: 110185 - DNA, 25 bp, Mus musculus
gatgctgccaacaaaaaccccttca

SEQ ID NO: 110186 - DNA, 25 bp, Mus musculus
gatgctgccattgacccctgggtag

SEQ ID NO: 110187 - DNA, 25 bp, Mus musculus
gatgctgccgcctttgagaagatga

SEQ ID NO: 110188 - DNA, 25 bp, Mus musculus
gatgctgcctatggaagctgcagtt

SEQ ID NO: 110189 - DNA, 25 bp, Mus musculus
gatgctgccttgaaagcacagatgg

SEQ ID NO: 110190 - DNA, 25 bp, Mus musculus
gatgctgcgaccatggatcacaatg

SEQ ID NO: 110191 - DNA, 25 bp, Mus musculus
gatgctgctatgtcaccaggactgg

SEQ ID NO: 110192 - DNA, 25 bp, Mus musculus
gatgctgctcatgggctcctaaggg

SEQ ID NO: 110193 - DNA, 25 bp, Mus musculus
gatgctgctggctcagggactcata

SEQ ID NO: 110194 - DNA, 25 bp, Mus musculus
gatgctgctgtccaggagaaaccag

SEQ ID NO: 110195 - DNA, 25 bp, Mus musculus
gatgctgctgttcagacactgaagg

SEQ ID NO: 110196 - DNA, 25 bp, Mus musculus
gatgctggaagtacaaggtggcccc

SEQ ID NO: 110197 - DNA, 25 bp, Mus musculus
gatgctggacattccctcagaaccg

SEQ ID NO: 110198 - DNA, 25 bp, Mus musculus
gatgctggcagtggaacccaccatg

SEQ ID NO: 110199 - DNA, 25 bp, Mus musculus
gatgctggccgatacctctgcctgg

SEQ ID NO: 110200 - DNA, 25 bp, Mus musculus
gatgctggccgctgaggctctttcc

SEQ ID NO: 110201 - DNA, 25 bp, Mus musculus
gatgctggctggacaaactgttact

SEQ ID NO: 110202 - DNA, 25 bp, Mus musculus
gatgctggtgctagtgtctgctccc

SEQ ID NO: 110203 - DNA, 25 bp, Mus musculus
gatgctggtgctgtccatccaaggc

SEQ ID NO: 110204 - DNA, 25 bp, Mus musculus
gatgctggtgtcatattcacttggt

SEQ ID NO: 110205 - DNA, 25 bp, Mus musculus
gatgctgtactgagagatgccacct

SEQ ID NO: 110206 - DNA, 25 bp, Mus musculus
gatgctgtcaagtgcacccactggg

SEQ ID NO: 110207 - DNA, 25 bp, Mus musculus
gatgctgtcaccaaggcaatccaag

SEQ ID NO: 110208 - DNA, 25 bp, Mus musculus
gatgctgtcagctgtcagtctagca

SEQ ID NO: 110209 - DNA, 25 bp, Mus musculus
gatgctgtccctaccaatggtctga

SEQ ID NO: 110210 - DNA, 25 bp, Mus musculus
gatgctgtctactcggatcgggtca

SEQ ID NO: 110211 - DNA, 25 bp, Mus musculus
gatgctgtgccgacatgtagccaac

SEQ ID NO: 110212 - DNA, 25 bp, Mus musculus
gatgctgtgctacaatcacgggttc

SEQ ID NO: 110213 - DNA, 25 bp, Mus musculus
gatgctgtggctgcattggatgccc

SEQ ID NO: 110214 - DNA, 25 bp, Mus musculus
gatgctgtgtaagccaactgccctg

SEQ ID NO: 110215 - DNA, 25 bp, Mus musculus
gatgctgttactgctcctgtgcccg

SEQ ID NO: 110216 - DNA, 25 bp, Mus musculus
gatgctgttggcttgggtacacaca

SEQ ID NO: 110217 - DNA, 25 bp, Mus musculus
gatgctgttgtgtcccaggtcctgg

SEQ ID NO: 110218 - DNA, 25 bp, Mus musculus
gatgcttactcctgcgttcgagctg

SEQ ID NO: 110219 - DNA, 25 bp, Mus musculus
gatgcttagcctactctatgttgaa

SEQ ID NO: 110220 - DNA, 25 bp, Mus musculus
gatgcttcatctgcagacatcagaa

SEQ ID NO: 110221 - DNA, 25 bp, Mus musculus
gatgcttcccacaaagacacctggg

SEQ ID NO: 110222 - DNA, 25 bp, Mus musculus
gatgcttccgttggccgtatgatga

SEQ ID NO: 110223 - DNA, 25 bp, Mus musculus
gatgcttctgaacttcaacaatctg

SEQ ID NO: 110224 - DNA, 25 bp, Mus musculus
gatgcttgacataaaggcttgggct

SEQ ID NO: 110225 - DNA, 25 bp, Mus musculus
gatgcttgagctgaaatccctgcag

SEQ ID NO: 110226 - DNA, 25 bp, Mus musculus
gatgcttgcggctgacgatatcggc

SEQ ID NO: 110227 - DNA, 25 bp, Mus musculus
gatgcttgctgatgacatggcgtgc

SEQ ID NO: 110228 - DNA, 25 bp, Mus musculus
gatgcttggcaggtcaaaaccggag

SEQ ID NO: 110229 - DNA, 25 bp, Mus musculus
gatgctttattatgggaatgcccag

SEQ ID NO: 110230 - DNA, 25 bp, Mus musculus
gatgctttattctcgtgaccggcgc

SEQ ID NO: 110231 - DNA, 25 bp, Mus musculus
gatgctttctgtttggctgggacaa

SEQ ID NO: 110232 - DNA, 25 bp, Mus musculus
gatgctttgctgagcctaggcgccg

SEQ ID NO: 110233 - DNA, 25 bp, Mus musculus
gatgcttttgatgatgtggacccag

SEQ ID NO: 110234 - DNA, 25 bp, Mus musculus
gatggaaaatctgatatatgtggac

SEQ ID NO: 110235 - DNA, 25 bp, Mus musculus
gatggaaagaccgaactctccttaa

SEQ ID NO: 110236 - DNA, 25 bp, Mus musculus
gatggaaagcctgaccaccttggcc

SEQ ID NO: 110237 - DNA, 25 bp, Mus musculus
gatggaaatcgtcaagaggtgcaaa

SEQ ID NO: 110238 - DNA, 25 bp, Mus musculus
gatggaacaaatcaccagcaattgg

SEQ ID NO: 110239 - DNA, 25 bp, Mus musculus
gatggaacctatcaaacgtggctgt

SEQ ID NO: 110240 - DNA, 25 bp, Mus musculus
gatggaacgagaagcgagagaaaat

SEQ ID NO: 110241 - DNA, 25 bp, Mus musculus
gatggaactgacacctgagcaggca

SEQ ID NO: 110242 - DNA, 25 bp, Mus musculus
gatggaagaaacaacacgtcagcag

SEQ ID NO: 110243 - DNA, 25 bp, Mus musculus
gatggaagacaccacctctgccatg

SEQ ID NO: 110244 - DNA, 25 bp, Mus musculus
gatggaagacatgagagcctgacgc

SEQ ID NO: 110245 - DNA, 25 bp, Mus musculus
gatggaagactgtgaaacgctggaa

SEQ ID NO: 110246 - DNA, 25 bp, Mus musculus
gatggaagccatcccctgcgttgtc

SEQ ID NO: 110247 - DNA, 25 bp, Mus musculus
gatggaagcgacagccacgtgttgc

SEQ ID NO: 110248 - DNA, 25 bp, Mus musculus
gatggaagttgacacactggagacc

SEQ ID NO: 110249 - DNA, 25 bp, Mus musculus
gatggaataccagatcctcagcgta

SEQ ID NO: 110250 - DNA, 25 bp, Mus musculus
gatggaatcacattgctcacgctga

SEQ ID NO: 110251 - DNA, 25 bp, Mus musculus
gatggaatgcagaaacgacctggga

SEQ ID NO: 110252 - DNA, 25 bp, Mus musculus
gatggaatgctacgccgtctgctga

SEQ ID NO: 110253 - DNA, 25 bp, Mus musculus
gatggaattacaggactatgtgcag

SEQ ID NO: 110254 - DNA, 25 bp, Mus musculus
gatggaattatggtcagcacacgag

SEQ ID NO: 110255 - DNA, 25 bp, Mus musculus
gatggacaacagctgagatctgacc

SEQ ID NO: 110256 - DNA, 25 bp, Mus musculus
gatggacaacctgtatcgggacggc

SEQ ID NO: 110257 - DNA, 25 bp, Mus musculus
gatggacaacggagaggcctgcttt

SEQ ID NO: 110258 - DNA, 25 bp, Mus musculus
gatggacaccagagaaagttcctcg

SEQ ID NO: 110259 - DNA, 25 bp, Mus musculus
gatggacaccttgctggacttgaag

SEQ ID NO: 110260 - DNA, 25 bp, Mus musculus
gatggacactctatttggaggactg

SEQ ID NO: 110261 - DNA, 25 bp, Mus musculus
gatggacatactgggcaccttgaag

SEQ ID NO: 110262 - DNA, 25 bp, Mus musculus
gatggaccaccaaaagactcgaagc

SEQ ID NO: 110263 - DNA, 25 bp, Mus musculus
gatggaccagcacttattaaatgtg

SEQ ID NO: 110264 - DNA, 25 bp, Mus musculus
gatggaccaggcgtcaatgtaccag

SEQ ID NO: 110265 - DNA, 25 bp, Mus musculus
gatggacccactcaagaatgtgctg

SEQ ID NO: 110266 - DNA, 25 bp, Mus musculus
gatggacccctcttatgtatgccgc

SEQ ID NO: 110267 - DNA, 25 bp, Mus musculus
gatggaccctcattctatctgcttg

SEQ ID NO: 110268 - DNA, 25 bp, Mus musculus
gatggaccctgcgtctctggagaac

SEQ ID NO: 110269 - DNA, 25 bp, Mus musculus
gatggaccggaactttgacacactg

SEQ ID NO: 110270 - DNA, 25 bp, Mus musculus
gatggacctccttcgcatattcagg

SEQ ID NO: 110271 - DNA, 25 bp, Mus musculus
gatggacctgagaccacatctggct

SEQ ID NO: 110272 - DNA, 25 bp, Mus musculus
gatggacctggtttcagctctctca

SEQ ID NO: 110273 - DNA, 25 bp, Mus musculus
gatggacgcaatcttaactgaggcc

SEQ ID NO: 110274 - DNA, 25 bp, Mus musculus
gatggacgtctgcaagtttctcaca

SEQ ID NO: 110275 - DNA, 25 bp, Mus musculus
gatggactaagtgaggcagccgctc

SEQ ID NO: 110276 - DNA, 25 bp, Mus musculus
gatggactcaacagccaatgaggtg

SEQ ID NO: 110277 - DNA, 25 bp, Mus musculus
gatggactcaccactgacaaggtca

SEQ ID NO: 110278 - DNA, 25 bp, Mus musculus
gatggactcagccacaaggaaacag

SEQ ID NO: 110279 - DNA, 25 bp, Mus musculus
gatggactgtatccccagatggatg

SEQ ID NO: 110280 - DNA, 25 bp, Mus musculus
gatggacttgagtggccaatacgag

SEQ ID NO: 110281 - DNA, 25 bp, Mus musculus
gatggacttgtataaaaccctgagg

SEQ ID NO: 110282 - DNA, 25 bp, Mus musculus
gatggagaaattgacctgaaactcc

SEQ ID NO: 110283 - DNA, 25 bp, Mus musculus
gatggagaacgatgacactgcggtc

SEQ ID NO: 110284 - DNA, 25 bp, Mus musculus
gatggagacaaagcacgatacctgg

SEQ ID NO: 110285 - DNA, 25 bp, Mus musculus
gatggagacactcagctatagctac

SEQ ID NO: 110286 - DNA, 25 bp, Mus musculus
gatggagaccataagagaatgcttg

SEQ ID NO: 110287 - DNA, 25 bp, Mus musculus
gatggagatgcatatgccctggtgc

SEQ ID NO: 110288 - DNA, 25 bp, Mus musculus
gatggagcagcacactagtaaccct

SEQ ID NO: 110289 - DNA, 25 bp, Mus musculus
gatggagcagtgtccgttcaccaca

SEQ ID NO: 110290 - DNA, 25 bp, Mus musculus
gatggagccagaaaactccttctga

SEQ ID NO: 110291 - DNA, 25 bp, Mus musculus
gatggagcccatcgttctgcagtac

SEQ ID NO: 110292 - DNA, 25 bp, Mus musculus
gatggagcccctgaataacctgcag

SEQ ID NO: 110293 - DNA, 25 bp, Mus musculus
gatggagcccgaaaagctggtgcac

SEQ ID NO: 110294 - DNA, 25 bp, Mus musculus
gatggagcctattcaactgtcagag

SEQ ID NO: 110295 - DNA, 25 bp, Mus musculus
gatggagcgagatgcacagttcaca

SEQ ID NO: 110296 - DNA, 25 bp, Mus musculus
gatggagcggcaactctcagcaaga

SEQ ID NO: 110297 - DNA, 25 bp, Mus musculus
gatggagctccaggaaaccatcaaa

SEQ ID NO: 110298 - DNA, 25 bp, Mus musculus
gatggagctctcgatggaaccaagg

SEQ ID NO: 110299 - DNA, 25 bp, Mus musculus
gatggagctggtgacttaagatcag

SEQ ID NO: 110300 - DNA, 25 bp, Mus musculus
gatggagcttcaccactggacaaag

SEQ ID NO: 110301 - DNA, 25 bp, Mus musculus
gatggagcttcagctgatgcagaac

SEQ ID NO: 110302 - DNA, 25 bp, Mus musculus
gatggagcttgcaattctgaatggc

SEQ ID NO: 110303 - DNA, 25 bp, Mus musculus
gatggaggacatcacgcaaatcgtg

SEQ ID NO: 110304 - DNA, 25 bp, Mus musculus
gatggaggactatcccagcttcatg

SEQ ID NO: 110305 - DNA, 25 bp, Mus musculus
gatggaggcacagcatatgtgtagc

SEQ ID NO: 110306 - DNA, 25 bp, Mus musculus
gatggaggcctttcccaacagtgta

SEQ ID NO: 110307 - DNA, 25 bp, Mus musculus
gatggaggcgcacaacgtatcagcc

SEQ ID NO: 110308 - DNA, 25 bp, Mus musculus
gatggagggcatctatctatttacc

SEQ ID NO: 110309 - DNA, 25 bp, Mus musculus
gatggagggctctgtcacactttgg

SEQ ID NO: 110310 - DNA, 25 bp, Mus musculus
gatggaggtcctctaagcttttgag

SEQ ID NO: 110311 - DNA, 25 bp, Mus musculus
gatggagtcaggctatgcctgcttc

SEQ ID NO: 110312 - DNA, 25 bp, Mus musculus
gatggagtcattgttggccagccaa

SEQ ID NO: 110313 - DNA, 25 bp, Mus musculus
gatggagtgacagctactaggctca

SEQ ID NO: 110314 - DNA, 25 bp, Mus musculus
gatggagtgttccacgctgccgaaa

SEQ ID NO: 110315 - DNA, 25 bp, Mus musculus
gatggatacatggagaaacataccc

SEQ ID NO: 110316 - DNA, 25 bp, Mus musculus
gatggatcacagacacctgcactgg

SEQ ID NO: 110317 - DNA, 25 bp, Mus musculus
gatggatcacttgttcctgcaggct

SEQ ID NO: 110318 - DNA, 25 bp, Mus musculus
gatggatccattccgaaaacgcctg

SEQ ID NO: 110319 - DNA, 25 bp, Mus musculus
gatggatccggccttgcaaatggca

SEQ ID NO: 110320 - DNA, 25 bp, Mus musculus
gatggatccgtcctgaaacagtttc

SEQ ID NO: 110321 - DNA, 25 bp, Mus musculus
gatggatcctgtatcacagacacag

SEQ ID NO: 110322 - DNA, 25 bp, Mus musculus
gatggatccttccataccgctggac

SEQ ID NO: 110323 - DNA, 25 bp, Mus musculus
gatggatcgagtgaccagatacccc

SEQ ID NO: 110324 - DNA, 25 bp, Mus musculus
gatggatgacgaggaatacagctgc

SEQ ID NO: 110325 - DNA, 25 bp, Mus musculus
gatggatgcagtggttctggtcacc

SEQ ID NO: 110326 - DNA, 25 bp, Mus musculus
gatggatgcccaaatgctaggcgga

SEQ ID NO: 110327 - DNA, 25 bp, Mus musculus
gatggatgccgattcatgaagcagc

SEQ ID NO: 110328 - DNA, 25 bp, Mus musculus
gatggatgtcacacttctggaagcc

SEQ ID NO: 110329 - DNA, 25 bp, Mus musculus
gatggatgtccctgtctgctggtcg

SEQ ID NO: 110330 - DNA, 25 bp, Mus musculus
gatggattagccctagaaaagacat

SEQ ID NO: 110331 - DNA, 25 bp, Mus musculus
gatggattccaaactgcacctgtgg

SEQ ID NO: 110332 - DNA, 25 bp, Mus musculus
gatggattgtcttgtcctgccgccc

SEQ ID NO: 110333 - DNA, 25 bp, Mus musculus
gatggatttcattctttggcctcgg

SEQ ID NO: 110334 - DNA, 25 bp, Mus musculus
gatggcaaaaacctctcgaagagcg

SEQ ID NO: 110335 - DNA, 25 bp, Mus musculus
gatggcaaaccggatcgtggattcc

SEQ ID NO: 110336 - DNA, 25 bp, Mus musculus
gatggcaaagaattagctgggacct

SEQ ID NO: 110337 - DNA, 25 bp, Mus musculus
gatggcaaatccacacctctagggt

SEQ ID NO: 110338 - DNA, 25 bp, Mus musculus
gatggcaactaccttgtgatcctgg

SEQ ID NO: 110339 - DNA, 25 bp, Mus musculus
gatggcaactctactagcagctggg

SEQ ID NO: 110340 - DNA, 25 bp, Mus musculus
gatggcaacttggagtcacagcacc

SEQ ID NO: 110341 - DNA, 25 bp, Mus musculus
gatggcaagaaactggcctcaggct

SEQ ID NO: 110342 - DNA, 25 bp, Mus musculus
gatggcaagattacctcaacagaag

SEQ ID NO: 110343 - DNA, 25 bp, Mus musculus
gatggcaatcagcttcggagtgcta

SEQ ID NO: 110344 - DNA, 25 bp, Mus musculus
gatggcacatttccaggactgactg

SEQ ID NO: 110345 - DNA, 25 bp, Mus musculus
gatggcaccaaggagtacactgaag

SEQ ID NO: 110346 - DNA, 25 bp, Mus musculus
gatggcaccattacaaaaagcccag

SEQ ID NO: 110347 - DNA, 25 bp, Mus musculus
gatggcaccccagaatgtagatcgg

SEQ ID NO: 110348 - DNA, 25 bp, Mus musculus
gatggcaccctcataccgcttagaa

SEQ ID NO: 110349 - DNA, 25 bp, Mus musculus
gatggcactacctcaaatgtcctga

SEQ ID NO: 110350 - DNA, 25 bp, Mus musculus
gatggcactgctattgagtcaacct

SEQ ID NO: 110351 - DNA, 25 bp, Mus musculus
gatggcacttccaaacgtcttggaa

SEQ ID NO: 110352 - DNA, 25 bp, Mus musculus
gatggcagacgatctgggagacgag

SEQ ID NO: 110353 - DNA, 25 bp, Mus musculus
gatggcagccaaggcacagatgtcc

SEQ ID NO: 110354 - DNA, 25 bp, Mus musculus
gatggcagccttacgcagaatcctt

SEQ ID NO: 110355 - DNA, 25 bp, Mus musculus
gatggcaggcatcgaatacatgaat

SEQ ID NO: 110356 - DNA, 25 bp, Mus musculus
gatggcaggcgacatctactccgta

SEQ ID NO: 110357 - DNA, 25 bp, Mus musculus
gatggcagtgacctaaaatcctcag

SEQ ID NO: 110358 - DNA, 25 bp, Mus musculus
gatggcagtgtcaccctgaacaagg

SEQ ID NO: 110359 - DNA, 25 bp, Mus musculus
gatggcatatcttaccctggtcaga

SEQ ID NO: 110360 - DNA, 25 bp, Mus musculus
gatggcatcacagaagagaccctca

SEQ ID NO: 110361 - DNA, 25 bp, Mus musculus
gatggcatcaccgaaacacgttgga

SEQ ID NO: 110362 - DNA, 25 bp, Mus musculus
gatggcatccatgagacatctgctc

SEQ ID NO: 110363 - DNA, 25 bp, Mus musculus
gatggcatcccaagattgtatcaga

SEQ ID NO: 110364 - DNA, 25 bp, Mus musculus
gatggcatccggactgacagaaagg

SEQ ID NO: 110365 - DNA, 25 bp, Mus musculus
gatggcatcgatccagaggctgcat

SEQ ID NO: 110366 - DNA, 25 bp, Mus musculus
gatggcatctcctcggttaagttca

SEQ ID NO: 110367 - DNA, 25 bp, Mus musculus
gatggcatctggactgaacaaaaga

SEQ ID NO: 110368 - DNA, 25 bp, Mus musculus
gatggcatcttcaaagctgagctga

SEQ ID NO: 110369 - DNA, 25 bp, Mus musculus
gatggcatgcagagactccccttag

SEQ ID NO: 110370 - DNA, 25 bp, Mus musculus
gatggcatgcgcaacaaagagacgc

SEQ ID NO: 110371 - DNA, 25 bp, Mus musculus
gatggcattcaagcactagtgagag

SEQ ID NO: 110372 - DNA, 25 bp, Mus musculus
gatggcattcacctcgtcactgaga

SEQ ID NO: 110373 - DNA, 25 bp, Mus musculus
gatggcattcctcctagcttctggt

SEQ ID NO: 110374 - DNA, 25 bp, Mus musculus
gatggccaaagctgtccgagagaag

SEQ ID NO: 110375 - DNA, 25 bp, Mus musculus
gatggccaaaggtagaatgctgtgc

SEQ ID NO: 110376 - DNA, 25 bp, Mus musculus
gatggccaaggatcgaaagagccgc

SEQ ID NO: 110377 - DNA, 25 bp, Mus musculus
gatggccacgtgtttgcaagtcagc

SEQ ID NO: 110378 - DNA, 25 bp, Mus musculus
gatggccactcacagaaccttgctg

SEQ ID NO: 110379 - DNA, 25 bp, Mus musculus
gatggccagattctacaaacacctg

SEQ ID NO: 110380 - DNA, 25 bp, Mus musculus
gatggccagcccttcaatgtgtact

SEQ ID NO: 110381 - DNA, 25 bp, Mus musculus
gatggccatcgtctctatgtcacca

SEQ ID NO: 110382 - DNA, 25 bp, Mus musculus
gatggccatcttgggcaacctgctg

SEQ ID NO: 110383 - DNA, 25 bp, Mus musculus
gatggccattgcacctaacgttaca

SEQ ID NO: 110384 - DNA, 25 bp, Mus musculus
gatggcccacaaactcggattgcag

SEQ ID NO: 110385 - DNA, 25 bp, Mus musculus
gatggcccctcatgaaccgttggtg

SEQ ID NO: 110386 - DNA, 25 bp, Mus musculus
gatggcccctgaagtcatggaacag

SEQ ID NO: 110387 - DNA, 25 bp, Mus musculus
gatggcccctttctgaactgaccta

SEQ ID NO: 110388 - DNA, 25 bp, Mus musculus
gatggcccgttagttattcagaccg

SEQ ID NO: 110389 - DNA, 25 bp, Mus musculus
gatggccgaacctcgatttaacaac

SEQ ID NO: 110390 - DNA, 25 bp, Mus musculus
gatggccgccataccgttacagaag

SEQ ID NO: 110391 - DNA, 25 bp, Mus musculus
gatggccgcctacggaaactagaag

SEQ ID NO: 110392 - DNA, 25 bp, Mus musculus
gatggccggcgctacatgatgatcg

SEQ ID NO: 110393 - DNA, 25 bp, Mus musculus
gatggccgggtctactgcagttcca

SEQ ID NO: 110394 - DNA, 25 bp, Mus musculus
gatggcctagttttatttgtatgaa

SEQ ID NO: 110395 - DNA, 25 bp, Mus musculus
gatggcctcaggcaaagtacgctgc

SEQ ID NO: 110396 - DNA, 25 bp, Mus musculus
gatggcctccaacagcattgcctga

SEQ ID NO: 110397 - DNA, 25 bp, Mus musculus
gatggcctctccaggaatgctgctg

SEQ ID NO: 110398 - DNA, 25 bp, Mus musculus
gatggcctggctgtttgcacctgac

SEQ ID NO: 110399 - DNA, 25 bp, Mus musculus
gatggccttaccatgcagtatgcag

SEQ ID NO: 110400 - DNA, 25 bp, Mus musculus
gatggccttgatgaccttaacgtgc

SEQ ID NO: 110401 - DNA, 25 bp, Mus musculus
gatggccttgctcctgtctagtaca

SEQ ID NO: 110402 - DNA, 25 bp, Mus musculus
gatggccttggctgtaagttacacc

SEQ ID NO: 110403 - DNA, 25 bp, Mus musculus
gatggcgatgacctcgacaactgta

SEQ ID NO: 110404 - DNA, 25 bp, Mus musculus
gatggcgcactggttttcagcaaca

SEQ ID NO: 110405 - DNA, 25 bp, Mus musculus
gatggcgcagctgcttcagtaccga

SEQ ID NO: 110406 - DNA, 25 bp, Mus musculus
gatggcgccgatggtcagactagcc

SEQ ID NO: 110407 - DNA, 25 bp, Mus musculus
gatggcgccttgtttcaccttcaga

SEQ ID NO: 110408 - DNA, 25 bp, Mus musculus
gatggcgctgactctccttggagga

SEQ ID NO: 110409 - DNA, 25 bp, Mus musculus
gatggcggcaagtacagcctggaac

SEQ ID NO: 110410 - DNA, 25 bp, Mus musculus
gatggcgtcaagtaccaagtgtcac

SEQ ID NO: 110411 - DNA, 25 bp, Mus musculus
gatggcgtcatccagtgtactgaga

SEQ ID NO: 110412 - DNA, 25 bp, Mus musculus
gatggcgtcccaagccatagctcga

SEQ ID NO: 110413 - DNA, 25 bp, Mus musculus
gatggcgtcctcacatctagcaagg

SEQ ID NO: 110414 - DNA, 25 bp, Mus musculus
gatggcgtgcccgtgtttaagttcc

SEQ ID NO: 110415 - DNA, 25 bp, Mus musculus
gatggcgtgggatgtactgacaaca

SEQ ID NO: 110416 - DNA, 25 bp, Mus musculus
gatggcgttatcactccctggcaat

SEQ ID NO: 110417 - DNA, 25 bp, Mus musculus
gatggctaaccagcacagggactgc

SEQ ID NO: 110418 - DNA, 25 bp, Mus musculus
gatggctaatgaagagctgcgcgcc

SEQ ID NO: 110419 - DNA, 25 bp, Mus musculus
gatggctacgtgatcaacattgcac

SEQ ID NO: 110420 - DNA, 25 bp, Mus musculus
gatggctactacttcttgctgcagg

SEQ ID NO: 110421 - DNA, 25 bp, Mus musculus
gatggctatattctttcctgaccta

SEQ ID NO: 110422 - DNA, 25 bp, Mus musculus
gatggctatgacaacagactgcggc

SEQ ID NO: 110423 - DNA, 25 bp, Mus musculus
gatggctcctgaggttatccgcctg

SEQ ID NO: 110424 - DNA, 25 bp, Mus musculus
gatggctcgcctgcaacattgaagt

SEQ ID NO: 110425 - DNA, 25 bp, Mus musculus
gatggctctctggtcatcagccgag

SEQ ID NO: 110426 - DNA, 25 bp, Mus musculus
gatggctgatcctgcaaagaatcca

SEQ ID NO: 110427 - DNA, 25 bp, Mus musculus
gatggctgcagcaactcctctgcgg

SEQ ID NO: 110428 - DNA, 25 bp, Mus musculus
gatggctgcccaagtgacactagag

SEQ ID NO: 110429 - DNA, 25 bp, Mus musculus
gatggctgcccagtctctgtttggt

SEQ ID NO: 110430 - DNA, 25 bp, Mus musculus
gatggctgtacatcgggctcatcct

SEQ ID NO: 110431 - DNA, 25 bp, Mus musculus
gatggctgtgcttaatcagctgccc

SEQ ID NO: 110432 - DNA, 25 bp, Mus musculus
gatggcttcagcagaggctttgcct

SEQ ID NO: 110433 - DNA, 25 bp, Mus musculus
gatggcttccacgtctaccagaagg

SEQ ID NO: 110434 - DNA, 25 bp, Mus musculus
gatggcttccccaagtggcttctgt

SEQ ID NO: 110435 - DNA, 25 bp, Mus musculus
gatggcttcttccttgggcgcattg

SEQ ID NO: 110436 - DNA, 25 bp, Mus musculus
gatggcttgaggcaagcaaacccct

SEQ ID NO: 110437 - DNA, 25 bp, Mus musculus
gatggcttgatgttttgatgttcag

SEQ ID NO: 110438 - DNA, 25 bp, Mus musculus
gatggctttgcatgaaggaccccag

SEQ ID NO: 110439 - DNA, 25 bp, Mus musculus
gatgggaaaagaaattccgtggacg

SEQ ID NO: 110440 - DNA, 25 bp, Mus musculus
gatgggaaacattggccgtcaactg

SEQ ID NO: 110441 - DNA, 25 bp, Mus musculus
gatgggaaaccaaaagcaacatggg

SEQ ID NO: 110442 - DNA, 25 bp, Mus musculus
gatgggaacaactcgaagagccttc

SEQ ID NO: 110443 - DNA, 25 bp, Mus musculus
gatgggaacacactcttgaataggg

SEQ ID NO: 110444 - DNA, 25 bp, Mus musculus
gatgggaatcctgccgttcctactg

SEQ ID NO: 110445 - DNA, 25 bp, Mus musculus
gatgggacacccactggacaagatg

SEQ ID NO: 110446 - DNA, 25 bp, Mus musculus
gatgggaccaactccttttagctga

SEQ ID NO: 110447 - DNA, 25 bp, Mus musculus
gatgggacctattccagccccttga

SEQ ID NO: 110448 - DNA, 25 bp, Mus musculus
gatgggacgcaatatggagacttct

SEQ ID NO: 110449 - DNA, 25 bp, Mus musculus
gatgggacttccaaccctgagagca

SEQ ID NO: 110450 - DNA, 25 bp, Mus musculus
gatgggacttctgcctgactggtga

SEQ ID NO: 110451 - DNA, 25 bp, Mus musculus
gatgggagaaaacacctctgacccg

SEQ ID NO: 110452 - DNA, 25 bp, Mus musculus
gatgggagcccttgcgctaaagctt

SEQ ID NO: 110453 - DNA, 25 bp, Mus musculus
gatgggagctgtatctgcacgccag

SEQ ID NO: 110454 - DNA, 25 bp, Mus musculus
gatgggagtctatcccggcatccag

SEQ ID NO: 110455 - DNA, 25 bp, Mus musculus
gatgggataaagacccgctatgcgg

SEQ ID NO: 110456 - DNA, 25 bp, Mus musculus
gatgggatcccaatgagatgttcaa

SEQ ID NO: 110457 - DNA, 25 bp, Mus musculus
gatgggcaacggtctctcccagtgt

SEQ ID NO: 110458 - DNA, 25 bp, Mus musculus
gatgggcaccatagaaccacctgat

SEQ ID NO: 110459 - DNA, 25 bp, Mus musculus
gatgggcactctgaattcctaaaag

SEQ ID NO: 110460 - DNA, 25 bp, Mus musculus
gatgggcataccgacctcagaaaac

SEQ ID NO: 110461 - DNA, 25 bp, Mus musculus
gatgggcatgctttgctacagcgct

SEQ ID NO: 110462 - DNA, 25 bp, Mus musculus
gatgggccagatgcaaatgagctct

SEQ ID NO: 110463 - DNA, 25 bp, Mus musculus
gatgggcccatttccgtgcattgca

SEQ ID NO: 110464 - DNA, 25 bp, Mus musculus
gatgggccggactgtgatagtactt

SEQ ID NO: 110465 - DNA, 25 bp, Mus musculus
gatgggcctcactcagacagggtct

SEQ ID NO: 110466 - DNA, 25 bp, Mus musculus
gatgggcctgcagctaatgagtgtc

SEQ ID NO: 110467 - DNA, 25 bp, Mus musculus
gatgggcgaatcaaacagactgctc

SEQ ID NO: 110468 - DNA, 25 bp, Mus musculus
gatgggcgccataaaccgttgcctg

SEQ ID NO: 110469 - DNA, 25 bp, Mus musculus
gatgggcgtaggtgacatgatctca

SEQ ID NO: 110470 - DNA, 25 bp, Mus musculus
gatgggctacaacagtgacagtcct

SEQ ID NO: 110471 - DNA, 25 bp, Mus musculus
gatgggctacctactgtctcagatg

SEQ ID NO: 110472 - DNA, 25 bp, Mus musculus
gatgggctcaccaccaggttctgtc

SEQ ID NO: 110473 - DNA, 25 bp, Mus musculus
gatgggctctaagtctccaggcaac

SEQ ID NO: 110474 - DNA, 25 bp, Mus musculus
gatgggctcttggaacgctgtgctc

SEQ ID NO: 110475 - DNA, 25 bp, Mus musculus
gatgggctgagactcctcgaacaga

SEQ ID NO: 110476 - DNA, 25 bp, Mus musculus
gatggggccacccactgaagaacct

SEQ ID NO: 110477 - DNA, 25 bp, Mus musculus
gatgggtacccgaaggtcctagcga

SEQ ID NO: 110478 - DNA, 25 bp, Mus musculus
gatgggtactgcttcacgatgatag

SEQ ID NO: 110479 - DNA, 25 bp, Mus musculus
gatgggtccactgcaagcaatgccg

SEQ ID NO: 110480 - DNA, 25 bp, Mus musculus
gatgggtccatagtcgtcattcaga

SEQ ID NO: 110481 - DNA, 25 bp, Mus musculus
gatgggtcctctagaaaacggtgtc

SEQ ID NO: 110482 - DNA, 25 bp, Mus musculus
gatgggtgtgcattctgtggcctac

SEQ ID NO: 110483 - DNA, 25 bp, Mus musculus
gatgggttcaccatgactgccacca

SEQ ID NO: 110484 - DNA, 25 bp, Mus musculus
gatgggttccccaacatgctaagag

SEQ ID NO: 110485 - DNA, 25 bp, Mus musculus
gatggtaaactctcccaacacttgg

SEQ ID NO: 110486 - DNA, 25 bp, Mus musculus
gatggtaacaacatagagtccgtgg

SEQ ID NO: 110487 - DNA, 25 bp, Mus musculus
gatggtaacacaacagtccctcttg

SEQ ID NO: 110488 - DNA, 25 bp, Mus musculus
gatggtaattccagacgacaggatg

SEQ ID NO: 110489 - DNA, 25 bp, Mus musculus
gatggtacagaacgagaggtcctct

SEQ ID NO: 110490 - DNA, 25 bp, Mus musculus
gatggtaccactcaaactgcaggcg

SEQ ID NO: 110491 - DNA, 25 bp, Mus musculus
gatggtaccatgtcccttgatatga

SEQ ID NO: 110492 - DNA, 25 bp, Mus musculus
gatggtacgacaagatgctcctgcc

SEQ ID NO: 110493 - DNA, 25 bp, Mus musculus
gatggtacggctgctgcttcaggca

SEQ ID NO: 110494 - DNA, 25 bp, Mus musculus
gatggtagatcgttggtcaggctcc

SEQ ID NO: 110495 - DNA, 25 bp, Mus musculus
gatggtagtacaccctcgtgcacag

SEQ ID NO: 110496 - DNA, 25 bp, Mus musculus
gatggtatccgtgggctgtcgctca

SEQ ID NO: 110497 - DNA, 25 bp, Mus musculus
gatggtcaccccaaatctgcagcag

SEQ ID NO: 110498 - DNA, 25 bp, Mus musculus
gatggtccagacagcacaataagtg

SEQ ID NO: 110499 - DNA, 25 bp, Mus musculus
gatggtccccaatgactgtaagcca

SEQ ID NO: 110500 - DNA, 25 bp, Mus musculus
gatggtccgaagacgccagcttgtg

SEQ ID NO: 110501 - DNA, 25 bp, Mus musculus
gatggtcctcatgaacgactggagc

SEQ ID NO: 110502 - DNA, 25 bp, Mus musculus
gatggtcgcctctcagtctgtacaa

SEQ ID NO: 110503 - DNA, 25 bp, Mus musculus
gatggtctacgatgacaccagtaag

SEQ ID NO: 110504 - DNA, 25 bp, Mus musculus
gatggtctccactatgtctgatggc

SEQ ID NO: 110505 - DNA, 25 bp, Mus musculus
gatggtctcgccctgattcagttca

SEQ ID NO: 110506 - DNA, 25 bp, Mus musculus
gatggtcttcctgaaaagctggccc

SEQ ID NO: 110507 - DNA, 25 bp, Mus musculus
gatggtgacagatcctgggctcgaa

SEQ ID NO: 110508 - DNA, 25 bp, Mus musculus
gatggtgaccattcctgcaggcagc

SEQ ID NO: 110509 - DNA, 25 bp, Mus musculus
gatggtgaccctggacctaaaggag

SEQ ID NO: 110510 - DNA, 25 bp, Mus musculus
gatggtgacctgcaaactggaaaca

SEQ ID NO: 110511 - DNA, 25 bp, Mus musculus
gatggtgactacaacaaaggatcca

SEQ ID NO: 110512 - DNA, 25 bp, Mus musculus
gatggtgactgtgattctgcctgcc

SEQ ID NO: 110513 - DNA, 25 bp, Mus musculus
gatggtgaggatgagcatgaggcag

SEQ ID NO: 110514 - DNA, 25 bp, Mus musculus
gatggtgataactacgttcgtcgca

SEQ ID NO: 110515 - DNA, 25 bp, Mus musculus
gatggtgatgaaaacagggcagcct

SEQ ID NO: 110516 - DNA, 25 bp, Mus musculus
gatggtgatgctccgctgctaaaga

SEQ ID NO: 110517 - DNA, 25 bp, Mus musculus
gatggtgcacgtagaaaacccacgc

SEQ ID NO: 110518 - DNA, 25 bp, Mus musculus
gatggtgcagagtgaacttcaacta

SEQ ID NO: 110519 - DNA, 25 bp, Mus musculus
gatggtgccaactggactgtctcca

SEQ ID NO: 110520 - DNA, 25 bp, Mus musculus
gatggtgccatcagcaacgctttca

SEQ ID NO: 110521 - DNA, 25 bp, Mus musculus
gatggtgcctacaacatggtccgcg

SEQ ID NO: 110522 - DNA, 25 bp, Mus musculus
gatggtgcttcgatcgctgctgtcc

SEQ ID NO: 110523 - DNA, 25 bp, Mus musculus
gatggtggatttctagacctgtcac

SEQ ID NO: 110524 - DNA, 25 bp, Mus musculus
gatggtggcccagcttttgatacaa

SEQ ID NO: 110525 - DNA, 25 bp, Mus musculus
gatggtggcgctcaacttccagaca

SEQ ID NO: 110526 - DNA, 25 bp, Mus musculus
gatggtggctcttcacttcctggaa

SEQ ID NO: 110527 - DNA, 25 bp, Mus musculus
gatggtgggcctgatgtatcctcca

SEQ ID NO: 110528 - DNA, 25 bp, Mus musculus
gatggtggtataacgcctgtgctca

SEQ ID NO: 110529 - DNA, 25 bp, Mus musculus
gatggtggttgctacatgagcctcc

SEQ ID NO: 110530 - DNA, 25 bp, Mus musculus
gatggtgtcaaatccagcattggct

SEQ ID NO: 110531 - DNA, 25 bp, Mus musculus
gatggtgtcaatgggagccgtccac

SEQ ID NO: 110532 - DNA, 25 bp, Mus musculus
gatggtgtcctcctcaaggccgttg

SEQ ID NO: 110533 - DNA, 25 bp, Mus musculus
gatggtgtcgacgtaggtgttcctc

SEQ ID NO: 110534 - DNA, 25 bp, Mus musculus
gatggtgtcgccctccttcatgtga

SEQ ID NO: 110535 - DNA, 25 bp, Mus musculus
gatggtgtcgcctcacaggagatgt

SEQ ID NO: 110536 - DNA, 25 bp, Mus musculus
gatggtgtggcctctgtgtccttca

SEQ ID NO: 110537 - DNA, 25 bp, Mus musculus
gatggtgtttgctcctgagtccgaa

SEQ ID NO: 110538 - DNA, 25 bp, Mus musculus
gatggttaaccatctgcccatgccg

SEQ ID NO: 110539 - DNA, 25 bp, Mus musculus
gatggttccagtttgttgagtgata

SEQ ID NO: 110540 - DNA, 25 bp, Mus musculus
gatggttctgtctgccaactgggcc

SEQ ID NO: 110541 - DNA, 25 bp, Mus musculus
gatggttcttgtcgtgcaccaaagc

SEQ ID NO: 110542 - DNA, 25 bp, Mus musculus
gatggttgaccccactcaggaagtt

SEQ ID NO: 110543 - DNA, 25 bp, Mus musculus
gatggttgagatgtttgttcgcaca

SEQ ID NO: 110544 - DNA, 25 bp, Mus musculus
gatggtttccaattccgggatgtgg

SEQ ID NO: 110545 - DNA, 25 bp, Mus musculus
gatggtttgcctacgtgatcgccac

SEQ ID NO: 110546 - DNA, 25 bp, Mus musculus
gatgtaaaaaatgcaggagacttga

SEQ ID NO: 110547 - DNA, 25 bp, Mus musculus
gatgtaaagccagcagcgtcatgtg

SEQ ID NO: 110548 - DNA, 25 bp, Mus musculus
gatgtaacatcaaagtcggaccctt

SEQ ID NO: 110549 - DNA, 25 bp, Mus musculus
gatgtaaccctctcagtgccgaatg

SEQ ID NO: 110550 - DNA, 25 bp, Mus musculus
gatgtaactcggtcctcccagggtt

SEQ ID NO: 110551 - DNA, 25 bp, Mus musculus
gatgtaactgtcacgtttatgtgta

SEQ ID NO: 110552 - DNA, 25 bp, Mus musculus
gatgtaagcactagggctctcaggc

SEQ ID NO: 110553 - DNA, 25 bp, Mus musculus
gatgtaatctacgtgaactggctca

SEQ ID NO: 110554 - DNA, 25 bp, Mus musculus
gatgtacactcagctgatgccagca

SEQ ID NO: 110555 - DNA, 25 bp, Mus musculus
gatgtacagccaaaacactggagga

SEQ ID NO: 110556 - DNA, 25 bp, Mus musculus
gatgtacaggacgagagctatcgcc

SEQ ID NO: 110557 - DNA, 25 bp, Mus musculus
gatgtacagggtgatccaggtgtca

SEQ ID NO: 110558 - DNA, 25 bp, Mus musculus
gatgtaccccaccagtagccagtgt

SEQ ID NO: 110559 - DNA, 25 bp, Mus musculus
gatgtaccgcaaatagcacccagca

SEQ ID NO: 110560 - DNA, 25 bp, Mus musculus
gatgtacgagctgtatgacccctgc

SEQ ID NO: 110561 - DNA, 25 bp, Mus musculus
gatgtactcaaagatcggcctcagg

SEQ ID NO: 110562 - DNA, 25 bp, Mus musculus
gatgtactgaggaagagtctccacc

SEQ ID NO: 110563 - DNA, 25 bp, Mus musculus
gatgtactggaagaatcggacccaa

SEQ ID NO: 110564 - DNA, 25 bp, Mus musculus
gatgtagacacaaccatagtgggcc

SEQ ID NO: 110565 - DNA, 25 bp, Mus musculus
gatgtagcaactcctaaacctcctg

SEQ ID NO: 110566 - DNA, 25 bp, Mus musculus
gatgtaggactgtgggacccttctc

SEQ ID NO: 110567 - DNA, 25 bp, Mus musculus
gatgtaggcgcaccaggaatatttg

SEQ ID NO: 110568 - DNA, 25 bp, Mus musculus
gatgtaggctcctgcactagagaca

SEQ ID NO: 110569 - DNA, 25 bp, Mus musculus
gatgtagggcatagccaagaactgg

SEQ ID NO: 110570 - DNA, 25 bp, Mus musculus
gatgtatacaccttgcgagagacca

SEQ ID NO: 110571 - DNA, 25 bp, Mus musculus
gatgtataccaggaagaagcccgca

SEQ ID NO: 110572 - DNA, 25 bp, Mus musculus
gatgtatacctgaagactgctcacc

SEQ ID NO: 110573 - DNA, 25 bp, Mus musculus
gatgtatcaaagtccaactaccggt

SEQ ID NO: 110574 - DNA, 25 bp, Mus musculus
gatgtatccaagctctcgctggcag

SEQ ID NO: 110575 - DNA, 25 bp, Mus musculus
gatgtatctgagaaccccggttgtt

SEQ ID NO: 110576 - DNA, 25 bp, Mus musculus
gatgtatgactagtcgctcaggaag

SEQ ID NO: 110577 - DNA, 25 bp, Mus musculus
gatgtatgaggaataccggccaccc

SEQ ID NO: 110578 - DNA, 25 bp, Mus musculus
gatgtatgtttaaaagttggcccac

SEQ ID NO: 110579 - DNA, 25 bp, Mus musculus
gatgtattcatgtcaccagctcagc

SEQ ID NO: 110580 - DNA, 25 bp, Mus musculus
gatgtcaaacaaattttcatgtcct

SEQ ID NO: 110581 - DNA, 25 bp, Mus musculus
gatgtcacaggcctgaaccaatccc

SEQ ID NO: 110582 - DNA, 25 bp, Mus musculus
gatgtcacatatagctggagtccct

SEQ ID NO: 110583 - DNA, 25 bp, Mus musculus
gatgtcaccctttaaacgccagctg

SEQ ID NO: 110584 - DNA, 25 bp, Mus musculus
gatgtcacggcagtcttcaaaccac

SEQ ID NO: 110585 - DNA, 25 bp, Mus musculus
gatgtcacgggctgtcctttcaaag

SEQ ID NO: 110586 - DNA, 25 bp, Mus musculus
gatgtcactctgaacatgctgccga

SEQ ID NO: 110587 - DNA, 25 bp, Mus musculus
gatgtcactgcaaaaaaggccgaga

SEQ ID NO: 110588 - DNA, 25 bp, Mus musculus
gatgtcactggcatcccaccttgca

SEQ ID NO: 110589 - DNA, 25 bp, Mus musculus
gatgtcagcaacctcaacaggcagt

SEQ ID NO: 110590 - DNA, 25 bp, Mus musculus
gatgtcagcattccctcaagttcct

SEQ ID NO: 110591 - DNA, 25 bp, Mus musculus
gatgtcaggagatgcagcttcttag

SEQ ID NO: 110592 - DNA, 25 bp, Mus musculus
gatgtcagtaaagtatagcagcagc

SEQ ID NO: 110593 - DNA, 25 bp, Mus musculus
gatgtcagttcagtgcctctagcaa

SEQ ID NO: 110594 - DNA, 25 bp, Mus musculus
gatgtcatccatgtcacacgagtgg

SEQ ID NO: 110595 - DNA, 25 bp, Mus musculus
gatgtcatccggacacctgcaggaa

SEQ ID NO: 110596 - DNA, 25 bp, Mus musculus
gatgtcatggcgaagaccgagtccc

SEQ ID NO: 110597 - DNA, 25 bp, Mus musculus
gatgtcattgctgtcacgaagggcc

SEQ ID NO: 110598 - DNA, 25 bp, Mus musculus
gatgtccaggacacctccaagaaga

SEQ ID NO: 110599 - DNA, 25 bp, Mus musculus
gatgtccatggttctgggccaactg

SEQ ID NO: 110600 - DNA, 25 bp, Mus musculus
gatgtcccggcattctgcacagggt

SEQ ID NO: 110601 - DNA, 25 bp, Mus musculus
gatgtccctactgtcgattcaaaaa

SEQ ID NO: 110602 - DNA, 25 bp, Mus musculus
gatgtccctgaaatgaacagtagct

SEQ ID NO: 110603 - DNA, 25 bp, Mus musculus
gatgtccctgtatgaacggcaagca

SEQ ID NO: 110604 - DNA, 25 bp, Mus musculus
gatgtccgcctggagctttcgcctt

SEQ ID NO: 110605 - DNA, 25 bp, Mus musculus
gatgtccggctcctgttctctagaa

SEQ ID NO: 110606 - DNA, 25 bp, Mus musculus
gatgtcctccaagctattgaccgtg

SEQ ID NO: 110607 - DNA, 25 bp, Mus musculus
gatgtcctctgatgatacggtccag

SEQ ID NO: 110608 - DNA, 25 bp, Mus musculus
gatgtcctctgccagtgtcgtgcca

SEQ ID NO: 110609 - DNA, 25 bp, Mus musculus
gatgtcctggagacgggtcattctc

SEQ ID NO: 110610 - DNA, 25 bp, Mus musculus
gatgtcctgtctcgcatgcctggga

SEQ ID NO: 110611 - DNA, 25 bp, Mus musculus
gatgtccttcaaccccatgaactgg

SEQ ID NO: 110612 - DNA, 25 bp, Mus musculus
gatgtcctttgccataatgttaacc

SEQ ID NO: 110613 - DNA, 25 bp, Mus musculus
gatgtcgaactctttggcgccttag

SEQ ID NO: 110614 - DNA, 25 bp, Mus musculus
gatgtcgaatcctagagccatgcag

SEQ ID NO: 110615 - DNA, 25 bp, Mus musculus
gatgtcgcccttaccaaatacagag

SEQ ID NO: 110616 - DNA, 25 bp, Mus musculus
gatgtcgcctatatttgcactgaga

SEQ ID NO: 110617 - DNA, 25 bp, Mus musculus
gatgtcgcctgcaaatgtcacggag

SEQ ID NO: 110618 - DNA, 25 bp, Mus musculus
gatgtcgctgtgacatcaccccgca

SEQ ID NO: 110619 - DNA, 25 bp, Mus musculus
gatgtcggaagaaaccaggcagagc

SEQ ID NO: 110620 - DNA, 25 bp, Mus musculus
gatgtcggcatgaagaaaccctgga

SEQ ID NO: 110621 - DNA, 25 bp, Mus musculus
gatgtcggtctccatattaaggctg

SEQ ID NO: 110622 - DNA, 25 bp, Mus musculus
gatgtcgtacatgcttccgcatctg

SEQ ID NO: 110623 - DNA, 25 bp, Mus musculus
gatgtcgtccaggaaagattgtaca

SEQ ID NO: 110624 - DNA, 25 bp, Mus musculus
gatgtcgtccgcatactcagtccga

SEQ ID NO: 110625 - DNA, 25 bp, Mus musculus
gatgtcgtgaatacaccgttgtcca

SEQ ID NO: 110626 - DNA, 25 bp, Mus musculus
gatgtctcatggatcggggctcgtc

SEQ ID NO: 110627 - DNA, 25 bp, Mus musculus
gatgtctcccgagttctaccgagag

SEQ ID NO: 110628 - DNA, 25 bp, Mus musculus
gatgtctgacgacgattgtgttcct

SEQ ID NO: 110629 - DNA, 25 bp, Mus musculus
gatgtctgccagagaaccttccgct

SEQ ID NO: 110630 - DNA, 25 bp, Mus musculus
gatgtctgcttgaacttcttgccca

SEQ ID NO: 110631 - DNA, 25 bp, Mus musculus
gatgtctgtcggagcacaactggaa

SEQ ID NO: 110632 - DNA, 25 bp, Mus musculus
gatgtcttcctggatggcaccggct

SEQ ID NO: 110633 - DNA, 25 bp, Mus musculus
gatgtcttctttggtgcagcagcca

SEQ ID NO: 110634 - DNA, 25 bp, Mus musculus
gatgtcttcttttgcttgctggagc

SEQ ID NO: 110635 - DNA, 25 bp, Mus musculus
gatgtcttgagtgtaccctgggcag

SEQ ID NO: 110636 - DNA, 25 bp, Mus musculus
gatgtgaacagctcccttctctggg

SEQ ID NO: 110637 - DNA, 25 bp, Mus musculus
gatgtgaacatgtctcccaaaggcc

SEQ ID NO: 110638 - DNA, 25 bp, Mus musculus
gatgtgaactgctcctgttgccagg

SEQ ID NO: 110639 - DNA, 25 bp, Mus musculus
gatgtgaatatctctgcctgccagc

SEQ ID NO: 110640 - DNA, 25 bp, Mus musculus
gatgtgacaaagctgggcatcccca

SEQ ID NO: 110641 - DNA, 25 bp, Mus musculus
gatgtgacagaagctctcatcctcc

SEQ ID NO: 110642 - DNA, 25 bp, Mus musculus
gatgtgacagagctaggagacctct

SEQ ID NO: 110643 - DNA, 25 bp, Mus musculus
gatgtgaccaaacgtgactacctgg

SEQ ID NO: 110644 - DNA, 25 bp, Mus musculus
gatgtgacctcatgcagaactatag

SEQ ID NO: 110645 - DNA, 25 bp, Mus musculus
gatgtgactgagctggaccaatacc

SEQ ID NO: 110646 - DNA, 25 bp, Mus musculus
gatgtgagggtcagtccagaagaaa

SEQ ID NO: 110647 - DNA, 25 bp, Mus musculus
gatgtgataacagtccaaaccccag

SEQ ID NO: 110648 - DNA, 25 bp, Mus musculus
gatgtgatcaagcaggccgactacg

SEQ ID NO: 110649 - DNA, 25 bp, Mus musculus
gatgtgatggaatctgcccaatgac

SEQ ID NO: 110650 - DNA, 25 bp, Mus musculus
gatgtgattcgtatgctgctgaccc

SEQ ID NO: 110651 - DNA, 25 bp, Mus musculus
gatgtgcaaagaacaccggcccata

SEQ ID NO: 110652 - DNA, 25 bp, Mus musculus
gatgtgcactgctactggactctac

SEQ ID NO: 110653 - DNA, 25 bp, Mus musculus
gatgtgcagttcctctcttcgccga

SEQ ID NO: 110654 - DNA, 25 bp, Mus musculus
gatgtgcccaagctatacccagagt

SEQ ID NO: 110655 - DNA, 25 bp, Mus musculus
gatgtgcccgccaattccatgaggc

SEQ ID NO: 110656 - DNA, 25 bp, Mus musculus
gatgtgccctccgaaagcctgagga

SEQ ID NO: 110657 - DNA, 25 bp, Mus musculus
gatgtgccggcagacctttacagga

SEQ ID NO: 110658 - DNA, 25 bp, Mus musculus
gatgtgcctcaaatcccagatggtg

SEQ ID NO: 110659 - DNA, 25 bp, Mus musculus
gatgtgcctgatgctcgaggagaca

SEQ ID NO: 110660 - DNA, 25 bp, Mus musculus
gatgtgccttaatcatcctattgaa

SEQ ID NO: 110661 - DNA, 25 bp, Mus musculus
gatgtgcgaccctggaatgacagcc

SEQ ID NO: 110662 - DNA, 25 bp, Mus musculus
gatgtgcgccagcaactgtttcagg

SEQ ID NO: 110663 - DNA, 25 bp, Mus musculus
gatgtgctacctgaacactgaacag

SEQ ID NO: 110664 - DNA, 25 bp, Mus musculus
gatgtgctcaatatcttccctgtgg

SEQ ID NO: 110665 - DNA, 25 bp, Mus musculus
gatgtgctcaccatcgtggctgtca

SEQ ID NO: 110666 - DNA, 25 bp, Mus musculus
gatgtgctcgtgatgcccaatctct

SEQ ID NO: 110667 - DNA, 25 bp, Mus musculus
gatgtgctgtacagcccggagctac

SEQ ID NO: 110668 - DNA, 25 bp, Mus musculus
gatgtgctgtcctccgagagaacgc

SEQ ID NO: 110669 - DNA, 25 bp, Mus musculus
gatgtggaaccacttaccagcttgg

SEQ ID NO: 110670 - DNA, 25 bp, Mus musculus
gatgtggacaaaaccatagctcagt

SEQ ID NO: 110671 - DNA, 25 bp, Mus musculus
gatgtggacagctccagacctgtga

SEQ ID NO: 110672 - DNA, 25 bp, Mus musculus
gatgtggacataattttcacgcggc

SEQ ID NO: 110673 - DNA, 25 bp, Mus musculus
gatgtggaccacactactctagtca

SEQ ID NO: 110674 - DNA, 25 bp, Mus musculus
gatgtggaccctgcaattcctttgg

SEQ ID NO: 110675 - DNA, 25 bp, Mus musculus
gatgtggacctactacctgagaccc

SEQ ID NO: 110676 - DNA, 25 bp, Mus musculus
gatgtggacgggaacgactactccg

SEQ ID NO: 110677 - DNA, 25 bp, Mus musculus
gatgtggacttcagttacctgcgca

SEQ ID NO: 110678 - DNA, 25 bp, Mus musculus
gatgtggatgcctcagacttccctc

SEQ ID NO: 110679 - DNA, 25 bp, Mus musculus
gatgtggatgttgaagacgcgccca

SEQ ID NO: 110680 - DNA, 25 bp, Mus musculus
gatgtggcaatccatctgggatctg

SEQ ID NO: 110681 - DNA, 25 bp, Mus musculus
gatgtggccatcaagctgaagttcc

SEQ ID NO: 110682 - DNA, 25 bp, Mus musculus
gatgtggctagagcagatggtccca

SEQ ID NO: 110683 - DNA, 25 bp, Mus musculus
gatgtggctgctttgaagtaccgag

SEQ ID NO: 110684 - DNA, 25 bp, Mus musculus
gatgtggcttcagaactcctgcgca

SEQ ID NO: 110685 - DNA, 25 bp, Mus musculus
gatgtggcttttgaacctggacctg

SEQ ID NO: 110686 - DNA, 25 bp, Mus musculus
gatgtgggaaaaatagtcccctgtg

SEQ ID NO: 110687 - DNA, 25 bp, Mus musculus
gatgtgggaaccgtcttcgtttgcc

SEQ ID NO: 110688 - DNA, 25 bp, Mus musculus
gatgtgggacggaagcctcctactt

SEQ ID NO: 110689 - DNA, 25 bp, Mus musculus
gatgtgggcatgaagtcccatcact

SEQ ID NO: 110690 - DNA, 25 bp, Mus musculus
gatgtgggtaacctagacttccacc

SEQ ID NO: 110691 - DNA, 25 bp, Mus musculus
gatgtgggttcgaacaaaggcgcca

SEQ ID NO: 110692 - DNA, 25 bp, Mus musculus
gatgtggtacagaaagccctccaag

SEQ ID NO: 110693 - DNA, 25 bp, Mus musculus
gatgtggtcacaacacacgtgcttt

SEQ ID NO: 110694 - DNA, 25 bp, Mus musculus
gatgtggtctatgccataatttcag

SEQ ID NO: 110695 - DNA, 25 bp, Mus musculus
gatgtggtggtatcagcctacgccc

SEQ ID NO: 110696 - DNA, 25 bp, Mus musculus
gatgtggttcggtttctggaagcca

SEQ ID NO: 110697 - DNA, 25 bp, Mus musculus
gatgtggtttttgccaaccgcccag

SEQ ID NO: 110698 - DNA, 25 bp, Mus musculus
gatgtgtacaagcaaaatccccgag

SEQ ID NO: 110699 - DNA, 25 bp, Mus musculus
gatgtgtagcccatatcccagcagc

SEQ ID NO: 110700 - DNA, 25 bp, Mus musculus
gatgtgtatgtgttcctaggcccag

SEQ ID NO: 110701 - DNA, 25 bp, Mus musculus
gatgtgtattcgaactggctctgga

SEQ ID NO: 110702 - DNA, 25 bp, Mus musculus
gatgtgtcagccatgaccgtgccaa

SEQ ID NO: 110703 - DNA, 25 bp, Mus musculus
gatgtgtcagctctatgatccagga

SEQ ID NO: 110704 - DNA, 25 bp, Mus musculus
gatgtgtcagttcagggttcccaga

SEQ ID NO: 110705 - DNA, 25 bp, Mus musculus
gatgtgtccatcgtggtcaaaggcc

SEQ ID NO: 110706 - DNA, 25 bp, Mus musculus
gatgtgtccccactgcgtcgagtga

SEQ ID NO: 110707 - DNA, 25 bp, Mus musculus
gatgtgtccccaggaccacgaaaca

SEQ ID NO: 110708 - DNA, 25 bp, Mus musculus
gatgtgtccttccagcagtcaagca

SEQ ID NO: 110709 - DNA, 25 bp, Mus musculus
gatgtgtcgcccattatgaataagc

SEQ ID NO: 110710 - DNA, 25 bp, Mus musculus
gatgtgtgaaaccttatagcgtcct

SEQ ID NO: 110711 - DNA, 25 bp, Mus musculus
gatgtgtgaacctgccgggctcttt

SEQ ID NO: 110712 - DNA, 25 bp, Mus musculus
gatgtgtgcatctcctccagtgata

SEQ ID NO: 110713 - DNA, 25 bp, Mus musculus
gatgtgtgcccctgaactgcaagcg

SEQ ID NO: 110714 - DNA, 25 bp, Mus musculus
gatgtgttaaactggcctggctgtg

SEQ ID NO: 110715 - DNA, 25 bp, Mus musculus
gatgtgttattatgtcaaaagccgg

SEQ ID NO: 110716 - DNA, 25 bp, Mus musculus
gatgtgttcgtctgcacagccgcga

SEQ ID NO: 110717 - DNA, 25 bp, Mus musculus
gatgtgttctatcctgggacaggcc

SEQ ID NO: 110718 - DNA, 25 bp, Mus musculus
gatgtgttctgtgtaccgctcctgg

SEQ ID NO: 110719 - DNA, 25 bp, Mus musculus
gatgtgttgaagaagaactgtcctc

SEQ ID NO: 110720 - DNA, 25 bp, Mus musculus
gatgtgttggtcctgaactattggc

SEQ ID NO: 110721 - DNA, 25 bp, Mus musculus
gatgtgtttgtccagcagacccagg

SEQ ID NO: 110722 - DNA, 25 bp, Mus musculus
gatgtgttttcacctcctgaggaga

SEQ ID NO: 110723 - DNA, 25 bp, Mus musculus
gatgttaacgcagatcccgaggtgc

SEQ ID NO: 110724 - DNA, 25 bp, Mus musculus
gatgttaatctcttggcctcggagc

SEQ ID NO: 110725 - DNA, 25 bp, Mus musculus
gatgttacactggaagcctcaagag

SEQ ID NO: 110726 - DNA, 25 bp, Mus musculus
gatgttaccaaacgcagtgcttccg

SEQ ID NO: 110727 - DNA, 25 bp, Mus musculus
gatgttaccatacgcccttctgctg

SEQ ID NO: 110728 - DNA, 25 bp, Mus musculus
gatgttacccgagtaggtctgctcc

SEQ ID NO: 110729 - DNA, 25 bp, Mus musculus
gatgttacctctcgcaagctgtgag

SEQ ID NO: 110730 - DNA, 25 bp, Mus musculus
gatgttacctggcacccagctggag

SEQ ID NO: 110731 - DNA, 25 bp, Mus musculus
gatgttagaattctcccagccagga

SEQ ID NO: 110732 - DNA, 25 bp, Mus musculus
gatgttagccagtcccattgccgga

SEQ ID NO: 110733 - DNA, 25 bp, Mus musculus
gatgttagccttccccagaaagggc

SEQ ID NO: 110734 - DNA, 25 bp, Mus musculus
gatgttagcggattcagcctctgac

SEQ ID NO: 110735 - DNA, 25 bp, Mus musculus
gatgttatcagagcccactgcctcg

SEQ ID NO: 110736 - DNA, 25 bp, Mus musculus
gatgttatcgagctcaagtacccgc

SEQ ID NO: 110737 - DNA, 25 bp, Mus musculus
gatgttattaatgacgtacgagaca

SEQ ID NO: 110738 - DNA, 25 bp, Mus musculus
gatgttcaagcagtgcacgtctctg

SEQ ID NO: 110739 - DNA, 25 bp, Mus musculus
gatgttcacacctctcacagtgaag

SEQ ID NO: 110740 - DNA, 25 bp, Mus musculus
gatgttcaccacacagacttcgtcg

SEQ ID NO: 110741 - DNA, 25 bp, Mus musculus
gatgttcatgagctctgcgaccgca

SEQ ID NO: 110742 - DNA, 25 bp, Mus musculus
gatgttcccagtaggtggagcccct

SEQ ID NO: 110743 - DNA, 25 bp, Mus musculus
gatgttccggatgctgagcagcagc

SEQ ID NO: 110744 - DNA, 25 bp, Mus musculus
gatgttcctgaaaccatagcatgct

SEQ ID NO: 110745 - DNA, 25 bp, Mus musculus
gatgttcctgttgagagcaaccagc

SEQ ID NO: 110746 - DNA, 25 bp, Mus musculus
gatgttcctttcagctggtcctata

SEQ ID NO: 110747 - DNA, 25 bp, Mus musculus
gatgttcgagaaaaccccagcttgg

SEQ ID NO: 110748 - DNA, 25 bp, Mus musculus
gatgttcgagttcctggagtacagc

SEQ ID NO: 110749 - DNA, 25 bp, Mus musculus
gatgttctacgctctcctctggaag

SEQ ID NO: 110750 - DNA, 25 bp, Mus musculus
gatgttctcaaagctctggccctag

SEQ ID NO: 110751 - DNA, 25 bp, Mus musculus
gatgttctgcgccaaactggaaatg

SEQ ID NO: 110752 - DNA, 25 bp, Mus musculus
gatgttctttatgccaaagtccaca

SEQ ID NO: 110753 - DNA, 25 bp, Mus musculus
gatgttgcactcaaacgagcggcag

SEQ ID NO: 110754 - DNA, 25 bp, Mus musculus
gatgttgccaaaagagtgaagccca

SEQ ID NO: 110755 - DNA, 25 bp, Mus musculus
gatgttgctagaatccacgcggagg

SEQ ID NO: 110756 - DNA, 25 bp, Mus musculus
gatgttgctcctgctcaagttggcg

SEQ ID NO: 110757 - DNA, 25 bp, Mus musculus
gatgttgctgtgctgacagataagc

SEQ ID NO: 110758 - DNA, 25 bp, Mus musculus
gatgttggcactcactctgacgtaa

SEQ ID NO: 110759 - DNA, 25 bp, Mus musculus
gatgttggcgccaccataactgatc

SEQ ID NO: 110760 - DNA, 25 bp, Mus musculus
gatgttggctcgatgctgaagtccc

SEQ ID NO: 110761 - DNA, 25 bp, Mus musculus
gatgttggtggagctaagcgccttc

SEQ ID NO: 110762 - DNA, 25 bp, Mus musculus
gatgttgtccgacaactgtgccaag

SEQ ID NO: 110763 - DNA, 25 bp, Mus musculus
gatgttgtgatggtccacgaaccca

SEQ ID NO: 110764 - DNA, 25 bp, Mus musculus
gatgttgttcagtccacctgggcag

SEQ ID NO: 110765 - DNA, 25 bp, Mus musculus
gatgtttatatcgagccatgggacc

SEQ ID NO: 110766 - DNA, 25 bp, Mus musculus
gatgtttattgatgcccagttgcca

SEQ ID NO: 110767 - DNA, 25 bp, Mus musculus
gatgtttcaagctactgcagcggaa

SEQ ID NO: 110768 - DNA, 25 bp, Mus musculus
gatgtttccgacaatgccttctcgg

SEQ ID NO: 110769 - DNA, 25 bp, Mus musculus
gatgtttcggaagacagcggatcct

SEQ ID NO: 110770 - DNA, 25 bp, Mus musculus
gatgtttgactgtaccatcgactgt

SEQ ID NO: 110771 - DNA, 25 bp, Mus musculus
gatgtttgtcggacagatccctagg

SEQ ID NO: 110772 - DNA, 25 bp, Mus musculus
gatgttttattcaatagagttcgga

SEQ ID NO: 110773 - DNA, 25 bp, Mus musculus
gatgttttccatctgctgcacggcc

SEQ ID NO: 110774 - DNA, 25 bp, Mus musculus
gatgttttctaaatatctgaagcac

SEQ ID NO: 110775 - DNA, 25 bp, Mus musculus
gatgttttggcgagagatgtattca

SEQ ID NO: 110776 - DNA, 25 bp, Mus musculus
gatgttttttgtccaggcagctcca

SEQ ID NO: 110777 - DNA, 25 bp, Mus musculus
gattaaaagatactgcttgcctgct

SEQ ID NO: 110778 - DNA, 25 bp, Mus musculus
gattaaacccagcttagcaacgtga

SEQ ID NO: 110779 - DNA, 25 bp, Mus musculus
gattaaagacccttgctgcgctggt

SEQ ID NO: 110780 - DNA, 25 bp, Mus musculus
gattaaagacgctagcaatggacac

SEQ ID NO: 110781 - DNA, 25 bp, Mus musculus
gattaaagaggtgcacagctctgct

SEQ ID NO: 110782 - DNA, 25 bp, Mus musculus
gattaaaggtagagccacaacagcg

SEQ ID NO: 110783 - DNA, 25 bp, Mus musculus
gattaacaagctacacgcaggtcct

SEQ ID NO: 110784 - DNA, 25 bp, Mus musculus
gattaacagccctggaatttgtgga

SEQ ID NO: 110785 - DNA, 25 bp, Mus musculus
gattaacatcctcagaagccgtcac

SEQ ID NO: 110786 - DNA, 25 bp, Mus musculus
gattaacggacatgagactgctgag

SEQ ID NO: 110787 - DNA, 25 bp, Mus musculus
gattaactgtgctgagactcccggt

SEQ ID NO: 110788 - DNA, 25 bp, Mus musculus
gattaagaaggtcctgctgctggtg

SEQ ID NO: 110789 - DNA, 25 bp, Mus musculus
gattaagcacttacagcgtcacatt

SEQ ID NO: 110790 - DNA, 25 bp, Mus musculus
gattaagccagtgaggaacctgctc

SEQ ID NO: 110791 - DNA, 25 bp, Mus musculus
gattaagcctgttgaagtcaccgag

SEQ ID NO: 110792 - DNA, 25 bp, Mus musculus
gattaagcgtctagaagagcccagc

SEQ ID NO: 110793 - DNA, 25 bp, Mus musculus
gattaatccggagggacctgctgct

SEQ ID NO: 110794 - DNA, 25 bp, Mus musculus
gattaatggaagacgggcatctgcg

SEQ ID NO: 110795 - DNA, 25 bp, Mus musculus
gattaatggcaccaacctagccggg

SEQ ID NO: 110796 - DNA, 25 bp, Mus musculus
gattaattaatacttggctgaactg

SEQ ID NO: 110797 - DNA, 25 bp, Mus musculus
gattacaaaaacaggctgcctcaag

SEQ ID NO: 110798 - DNA, 25 bp, Mus musculus
gattacacggccactgacactgatg

SEQ ID NO: 110799 - DNA, 25 bp, Mus musculus
gattacagcatcgagatcccggatc

SEQ ID NO: 110800 - DNA, 25 bp, Mus musculus
gattacagcgtagcatctcagcaca

SEQ ID NO: 110801 - DNA, 25 bp, Mus musculus
gattacaggagagaagatgcgagcc

SEQ ID NO: 110802 - DNA, 25 bp, Mus musculus
gattacaggcaggttccaccagaca

SEQ ID NO: 110803 - DNA, 25 bp, Mus musculus
gattacagtacacggcatgcagcct

SEQ ID NO: 110804 - DNA, 25 bp, Mus musculus
gattacagtccaaaggcaggtcagc

SEQ ID NO: 110805 - DNA, 25 bp, Mus musculus
gattacatccctaaagaactgagtg

SEQ ID NO: 110806 - DNA, 25 bp, Mus musculus
gattacatcctgaagtgcacaaaag

SEQ ID NO: 110807 - DNA, 25 bp, Mus musculus
gattacatcggaaagggcgaaccct

SEQ ID NO: 110808 - DNA, 25 bp, Mus musculus
gattacatggacctgctgtggacca

SEQ ID NO: 110809 - DNA, 25 bp, Mus musculus
gattaccactttgacatgctacggc

SEQ ID NO: 110810 - DNA, 25 bp, Mus musculus
gattaccagcgtggatgccatgaca

SEQ ID NO: 110811 - DNA, 25 bp, Mus musculus
gattacccatccctttggaagctgg

SEQ ID NO: 110812 - DNA, 25 bp, Mus musculus
gattaccccagtgagaatctggcct

SEQ ID NO: 110813 - DNA, 25 bp, Mus musculus
gattacccgactcctgcttgaggga

SEQ ID NO: 110814 - DNA, 25 bp, Mus musculus
gattaccctgaagcggcggtgttcc

SEQ ID NO: 110815 - DNA, 25 bp, Mus musculus
gattacccttgctctgaactggtgg

SEQ ID NO: 110816 - DNA, 25 bp, Mus musculus
gattaccgcacttcagatcgcactg

SEQ ID NO: 110817 - DNA, 25 bp, Mus musculus
gattaccgtattcatggcagtgccc

SEQ ID NO: 110818 - DNA, 25 bp, Mus musculus
gattaccgtcgctatgcagacacac

SEQ ID NO: 110819 - DNA, 25 bp, Mus musculus
gattacctgccataccagctgtggg

SEQ ID NO: 110820 - DNA, 25 bp, Mus musculus
gattacctggagtgtgaactgaacc

SEQ ID NO: 110821 - DNA, 25 bp, Mus musculus
gattacctggatatcggcaacaacc

SEQ ID NO: 110822 - DNA, 25 bp, Mus musculus
gattacctgtggctcaactaccagc

SEQ ID NO: 110823 - DNA, 25 bp, Mus musculus
gattaccttctgacgctagcagcag

SEQ ID NO: 110824 - DNA, 25 bp, Mus musculus
gattacggatccaaagtcagtctct

SEQ ID NO: 110825 - DNA, 25 bp, Mus musculus
gattacggtggtgccgtctgccaag

SEQ ID NO: 110826 - DNA, 25 bp, Mus musculus
gattacgtaagcgactgcggcccta

SEQ ID NO: 110827 - DNA, 25 bp, Mus musculus
gattactaataaaatggccacaggc

SEQ ID NO: 110828 - DNA, 25 bp, Mus musculus
gattactacagtctatgtgacaagc

SEQ ID NO: 110829 - DNA, 25 bp, Mus musculus
gattactatgacgatttcctgcagc

SEQ ID NO: 110830 - DNA, 25 bp, Mus musculus
gattactatgcctgtgcccggttgg

SEQ ID NO: 110831 - DNA, 25 bp, Mus musculus
gattactgagttctgtgcttcccac

SEQ ID NO: 110832 - DNA, 25 bp, Mus musculus
gattactgccggacctcagtgtcag

SEQ ID NO: 110833 - DNA, 25 bp, Mus musculus
gattactggcgattgcttgctcctg

SEQ ID NO: 110834 - DNA, 25 bp, Mus musculus
gattactgggtgaagcctctgagcg

SEQ ID NO: 110835 - DNA, 25 bp, Mus musculus
gattactgtactggacaacttcaga

SEQ ID NO: 110836 - DNA, 25 bp, Mus musculus
gattactgtgtgagcatctccccgg

SEQ ID NO: 110837 - DNA, 25 bp, Mus musculus
gattacttagaaacactctcatctc

SEQ ID NO: 110838 - DNA, 25 bp, Mus musculus
gattacttcccttccggcacgatga

SEQ ID NO: 110839 - DNA, 25 bp, Mus musculus
gattacttctgttccatcgcccaca

SEQ ID NO: 110840 - DNA, 25 bp, Mus musculus
gattacttctttgagccagcatcgg

SEQ ID NO: 110841 - DNA, 25 bp, Mus musculus
gattagactgtaagctcgccaaggg

SEQ ID NO: 110842 - DNA, 25 bp, Mus musculus
gattagagctccctgatcatccaga

SEQ ID NO: 110843 - DNA, 25 bp, Mus musculus
gattagattaccctcagctcagacg

SEQ ID NO: 110844 - DNA, 25 bp, Mus musculus
gattagcctcacaatcagtcacaag

SEQ ID NO: 110845 - DNA, 25 bp, Mus musculus
gattagctacatgccagattgccag

SEQ ID NO: 110846 - DNA, 25 bp, Mus musculus
gattaggaacagtgagccgctccag

SEQ ID NO: 110847 - DNA, 25 bp, Mus musculus
gattaggaacccacgaaggcttgtc

SEQ ID NO: 110848 - DNA, 25 bp, Mus musculus
gattaggagcagtacggttcatgac

SEQ ID NO: 110849 - DNA, 25 bp, Mus musculus
gattaggcccaagaaaccagttagg

SEQ ID NO: 110850 - DNA, 25 bp, Mus musculus
gattagggatcgtttctcagactca

SEQ ID NO: 110851 - DNA, 25 bp, Mus musculus
gattaggtccctgtagtccacgaag

SEQ ID NO: 110852 - DNA, 25 bp, Mus musculus
gattaggtgaccagtgacatcagcc

SEQ ID NO: 110853 - DNA, 25 bp, Mus musculus
gattagtatgatcagcgcaggcccc

SEQ ID NO: 110854 - DNA, 25 bp, Mus musculus
gattagtcttgatccagagaacttg

SEQ ID NO: 110855 - DNA, 25 bp, Mus musculus
gattagtgtccctccagtctgagca

SEQ ID NO: 110856 - DNA, 25 bp, Mus musculus
gattagtttggaggatgtattccag

SEQ ID NO: 110857 - DNA, 25 bp, Mus musculus
gattagttttccagcctcgagccca

SEQ ID NO: 110858 - DNA, 25 bp, Mus musculus
gattataatgagaccgactggtccc

SEQ ID NO: 110859 - DNA, 25 bp, Mus musculus
gattatatccgagattggactgccc

SEQ ID NO: 110860 - DNA, 25 bp, Mus musculus
gattatatcgtgaggcagccagacc

SEQ ID NO: 110861 - DNA, 25 bp, Mus musculus
gattatcaccaaagccaagtccctg

SEQ ID NO: 110862 - DNA, 25 bp, Mus musculus
gattatcatcagctccaaccggagg

SEQ ID NO: 110863 - DNA, 25 bp, Mus musculus
gattatcccgtagaaattcacgagt

SEQ ID NO: 110864 - DNA, 25 bp, Mus musculus
gattatcggcccagcaaagtctgca

SEQ ID NO: 110865 - DNA, 25 bp, Mus musculus
gattatcgtggagaccgaggcacag

SEQ ID NO: 110866 - DNA, 25 bp, Mus musculus
gattatgacaggtccttgagccgcc

SEQ ID NO: 110867 - DNA, 25 bp, Mus musculus
gattatgagggtggctccgtccgtc

SEQ ID NO: 110868 - DNA, 25 bp, Mus musculus
gattatgatggacggcctcacagcg

SEQ ID NO: 110869 - DNA, 25 bp, Mus musculus
gattatgcagcctccaaggatgccc

SEQ ID NO: 110870 - DNA, 25 bp, Mus musculus
gattatggccagtgtcgactccgtg

SEQ ID NO: 110871 - DNA, 25 bp, Mus musculus
gattatggcctcagaaaccgacagg

SEQ ID NO: 110872 - DNA, 25 bp, Mus musculus
gattatggtactgcccgtcggacag

SEQ ID NO: 110873 - DNA, 25 bp, Mus musculus
gattatgtaacagaccattggtgaa

SEQ ID NO: 110874 - DNA, 25 bp, Mus musculus
gattatgtacaagaccagtgccagc

SEQ ID NO: 110875 - DNA, 25 bp, Mus musculus
gattatgttctctgtgccccggaag

SEQ ID NO: 110876 - DNA, 25 bp, Mus musculus
gattattaacggtcattctcatgaa

SEQ ID NO: 110877 - DNA, 25 bp, Mus musculus
gattattaccgtgtccagggccggg

SEQ ID NO: 110878 - DNA, 25 bp, Mus musculus
gattattagacaccaagttggcggc

SEQ ID NO: 110879 - DNA, 25 bp, Mus musculus
gattattccacgcaggagttgcagc

SEQ ID NO: 110880 - DNA, 25 bp, Mus musculus
gattattccaggtatcctccaagag

SEQ ID NO: 110881 - DNA, 25 bp, Mus musculus
gattattcctgctcgccagtgagag

SEQ ID NO: 110882 - DNA, 25 bp, Mus musculus
gattattctataccacatgggcagc

SEQ ID NO: 110883 - DNA, 25 bp, Mus musculus
gattattctcaagtacccactgaag

SEQ ID NO: 110884 - DNA, 25 bp, Mus musculus
gattattgcacagaggatctacggg

SEQ ID NO: 110885 - DNA, 25 bp, Mus musculus
gattattgcgccagccaaccttgag

SEQ ID NO: 110886 - DNA, 25 bp, Mus musculus
gattattggagctttgggaccatgg

SEQ ID NO: 110887 - DNA, 25 bp, Mus musculus
gattatttgccagggtttcacaggc

SEQ ID NO: 110888 - DNA, 25 bp, Mus musculus
gattattttacctaagattcctgcc

SEQ ID NO: 110889 - DNA, 25 bp, Mus musculus
gattcaaagatgtccggaaccctga

SEQ ID NO: 110890 - DNA, 25 bp, Mus musculus
gattcaaattgccaaaccaccgggc

SEQ ID NO: 110891 - DNA, 25 bp, Mus musculus
gattcaaccaagatgcacaaagaga

SEQ ID NO: 110892 - DNA, 25 bp, Mus musculus
gattcaagacgatagccttcccacg

SEQ ID NO: 110893 - DNA, 25 bp, Mus musculus
gattcaagcaattgatgccaccgat

SEQ ID NO: 110894 - DNA, 25 bp, Mus musculus
gattcaagcaggtgctaagctgtca

SEQ ID NO: 110895 - DNA, 25 bp, Mus musculus
gattcaaggcttgtggcagccagca

SEQ ID NO: 110896 - DNA, 25 bp, Mus musculus
gattcaagttcatggattcctcagc

SEQ ID NO: 110897 - DNA, 25 bp, Mus musculus
gattcaatgagtctgcctgctagca

SEQ ID NO: 110898 - DNA, 25 bp, Mus musculus
gattcacaagacaactgcaaaggct

SEQ ID NO: 110899 - DNA, 25 bp, Mus musculus
gattcacacgctggctgatcacggt

SEQ ID NO: 110900 - DNA, 25 bp, Mus musculus
gattcacagtgatcgtcctgcctca

SEQ ID NO: 110901 - DNA, 25 bp, Mus musculus
gattcacatccaggaaagtccctgc

SEQ ID NO: 110902 - DNA, 25 bp, Mus musculus
gattcaccagagaatgcacacggga

SEQ ID NO: 110903 - DNA, 25 bp, Mus musculus
gattcaccagctaccatgcacgaag

SEQ ID NO: 110904 - DNA, 25 bp, Mus musculus
gattcaccaggagtggattcaccag

SEQ ID NO: 110905 - DNA, 25 bp, Mus musculus
gattcacccaagttcaagactacag

SEQ ID NO: 110906 - DNA, 25 bp, Mus musculus
gattcacggcaaacacaacgagagg

SEQ ID NO: 110907 - DNA, 25 bp, Mus musculus
gattcacttggccaggaacctcagg

SEQ ID NO: 110908 - DNA, 25 bp, Mus musculus
gattcagaagttcctcagcggagag

SEQ ID NO: 110909 - DNA, 25 bp, Mus musculus
gattcagaatgtcacgagccttatg

SEQ ID NO: 110910 - DNA, 25 bp, Mus musculus
gattcagacactagaaaagcttggc

SEQ ID NO: 110911 - DNA, 25 bp, Mus musculus
gattcagaccagcaatgtaaccaac

SEQ ID NO: 110912 - DNA, 25 bp, Mus musculus
gattcagacgttcccagtagtaaag

SEQ ID NO: 110913 - DNA, 25 bp, Mus musculus
gattcagactgggagagacctttca

SEQ ID NO: 110914 - DNA, 25 bp, Mus musculus
gattcagcagccaggaaaagtgact

SEQ ID NO: 110915 - DNA, 25 bp, Mus musculus
gattcagccctggtttcaactgcag

SEQ ID NO: 110916 - DNA, 25 bp, Mus musculus
gattcagccggatcaacatctacca

SEQ ID NO: 110917 - DNA, 25 bp, Mus musculus
gattcaggccttggaaaagactgct

SEQ ID NO: 110918 - DNA, 25 bp, Mus musculus
gattcagggaacctagcccatgtgg

SEQ ID NO: 110919 - DNA, 25 bp, Mus musculus
gattcagggcaatggcgagtcctca

SEQ ID NO: 110920 - DNA, 25 bp, Mus musculus
gattcagtacgaaaccctgagcgag

SEQ ID NO: 110921 - DNA, 25 bp, Mus musculus
gattcagtccttctccagttgcaca

SEQ ID NO: 110922 - DNA, 25 bp, Mus musculus
gattcagtgtaactcattagtggcg

SEQ ID NO: 110923 - DNA, 25 bp, Mus musculus
gattcagtgtctcaatgaccccagg

SEQ ID NO: 110924 - DNA, 25 bp, Mus musculus
gattcagtttatgagtaagtcgcac

SEQ ID NO: 110925 - DNA, 25 bp, Mus musculus
gattcatagagttccgggcctggga

SEQ ID NO: 110926 - DNA, 25 bp, Mus musculus
gattcatatcccaggacgccttcca

SEQ ID NO: 110927 - DNA, 25 bp, Mus musculus
gattcatatccggtccaagtgctga

SEQ ID NO: 110928 - DNA, 25 bp, Mus musculus
gattcatcaactgaaggagctcccc

SEQ ID NO: 110929 - DNA, 25 bp, Mus musculus
gattcatcacatggaggctcacgca

SEQ ID NO: 110930 - DNA, 25 bp, Mus musculus
gattcatcactgtaataacctcaga

SEQ ID NO: 110931 - DNA, 25 bp, Mus musculus
gattcatccccaaagagtcagtggc

SEQ ID NO: 110932 - DNA, 25 bp, Mus musculus
gattcatgaactgcggaacaagagg

SEQ ID NO: 110933 - DNA, 25 bp, Mus musculus
gattcatgagggtgcaagcttgccc

SEQ ID NO: 110934 - DNA, 25 bp, Mus musculus
gattcatgagtatgcccagagagac

SEQ ID NO: 110935 - DNA, 25 bp, Mus musculus
gattcattcccagccaggttcaaag

SEQ ID NO: 110936 - DNA, 25 bp, Mus musculus
gattcattgggacagccgtaaccca

SEQ ID NO: 110937 - DNA, 25 bp, Mus musculus
gattcattgtggaagccgacacccc

SEQ ID NO: 110938 - DNA, 25 bp, Mus musculus
gattccaagggcatgcatagacctg

SEQ ID NO: 110939 - DNA, 25 bp, Mus musculus
gattccaagtgtgggtttcggccca

SEQ ID NO: 110940 - DNA, 25 bp, Mus musculus
gattccaatgtggtgtgccgtgcac

SEQ ID NO: 110941 - DNA, 25 bp, Mus musculus
gattccacaccgttggctgttcaga

SEQ ID NO: 110942 - DNA, 25 bp, Mus musculus
gattccacagtgaaactaggagccg

SEQ ID NO: 110943 - DNA, 25 bp, Mus musculus
gattccacctatcgagctgtgccag

SEQ ID NO: 110944 - DNA, 25 bp, Mus musculus
gattccacctgaatgagcatctcta

SEQ ID NO: 110945 - DNA, 25 bp, Mus musculus
gattccaccttcagggcctacagag

SEQ ID NO: 110946 - DNA, 25 bp, Mus musculus
gattccagaaaatgggctgacctcc

SEQ ID NO: 110947 - DNA, 25 bp, Mus musculus
gattccagaatcaggtccacgtgct

SEQ ID NO: 110948 - DNA, 25 bp, Mus musculus
gattccagagttgtcctagcccctg

SEQ ID NO: 110949 - DNA, 25 bp, Mus musculus
gattccaggcttcaagatcagaggc

SEQ ID NO: 110950 - DNA, 25 bp, Mus musculus
gattccagtcacaattgtcaccggg

SEQ ID NO: 110951 - DNA, 25 bp, Mus musculus
gattccatcactgatctggatgaca

SEQ ID NO: 110952 - DNA, 25 bp, Mus musculus
gattccatcgctggttcagaaaggc

SEQ ID NO: 110953 - DNA, 25 bp, Mus musculus
gattccatgggcgtgcattctccga

SEQ ID NO: 110954 - DNA, 25 bp, Mus musculus
gattccattctggagcggctgacgc

SEQ ID NO: 110955 - DNA, 25 bp, Mus musculus
gattcccaagactgactgcaggcta

SEQ ID NO: 110956 - DNA, 25 bp, Mus musculus
gattcccactggacccagggagctt

SEQ ID NO: 110957 - DNA, 25 bp, Mus musculus
gattcccagactggacagagtgctc

SEQ ID NO: 110958 - DNA, 25 bp, Mus musculus
gattcccagtagatcccatgatgga

SEQ ID NO: 110959 - DNA, 25 bp, Mus musculus
gattccccaggaaaggctgtccgag

SEQ ID NO: 110960 - DNA, 25 bp, Mus musculus
gattccccttttggatatctagatg

SEQ ID NO: 110961 - DNA, 25 bp, Mus musculus
gattcccgacatctggacaccagga

SEQ ID NO: 110962 - DNA, 25 bp, Mus musculus
gattcccgggaatgcaagctgatga

SEQ ID NO: 110963 - DNA, 25 bp, Mus musculus
gattcccggtcaagaaatgctcagc

SEQ ID NO: 110964 - DNA, 25 bp, Mus musculus
gattcccggtgggtacattgccagc

SEQ ID NO: 110965 - DNA, 25 bp, Mus musculus
gattccctaaagctaagacactgca

SEQ ID NO: 110966 - DNA, 25 bp, Mus musculus
gattccctccaggaatttccctggg

SEQ ID NO: 110967 - DNA, 25 bp, Mus musculus
gattccctccttgggagaaccagca

SEQ ID NO: 110968 - DNA, 25 bp, Mus musculus
gattccctctccaaagggctgactg

SEQ ID NO: 110969 - DNA, 25 bp, Mus musculus
gattccctggtggaggacggactcc

SEQ ID NO: 110970 - DNA, 25 bp, Mus musculus
gattccgacatgagtttctgcgcca

SEQ ID NO: 110971 - DNA, 25 bp, Mus musculus
gattccgatgatgaagacaaactcc

SEQ ID NO: 110972 - DNA, 25 bp, Mus musculus
gattccgccatgttgagtcttgtgg

SEQ ID NO: 110973 - DNA, 25 bp, Mus musculus
gattccgccttcaaaagagcctgca

SEQ ID NO: 110974 - DNA, 25 bp, Mus musculus
gattccgggatttgctactgcctcc

SEQ ID NO: 110975 - DNA, 25 bp, Mus musculus
gattccgtggctcgagtttacccct

SEQ ID NO: 110976 - DNA, 25 bp, Mus musculus
gattcctaaaataactgctgctacc

SEQ ID NO: 110977 - DNA, 25 bp, Mus musculus
gattcctaaggctctcctggccagg

SEQ ID NO: 110978 - DNA, 25 bp, Mus musculus
gattcctacgacctaccaaagagag

SEQ ID NO: 110979 - DNA, 25 bp, Mus musculus
gattcctagcgtaaactggttgtcg

SEQ ID NO: 110980 - DNA, 25 bp, Mus musculus
gattcctatgagctgaccctccgag

SEQ ID NO: 110981 - DNA, 25 bp, Mus musculus
gattcctccagatatgccggtagca

SEQ ID NO: 110982 - DNA, 25 bp, Mus musculus
gattcctgaacgaatacctggactt

SEQ ID NO: 110983 - DNA, 25 bp, Mus musculus
gattcctgagcgcttcttccctgga

SEQ ID NO: 110984 - DNA, 25 bp, Mus musculus
gattcctgccctgtcattccattgg

SEQ ID NO: 110985 - DNA, 25 bp, Mus musculus
gattcctgggcagctcctccgtatt

SEQ ID NO: 110986 - DNA, 25 bp, Mus musculus
gattcctgtgaaacagtatccaaag

SEQ ID NO: 110987 - DNA, 25 bp, Mus musculus
gattccttacttttcccatgggagg

SEQ ID NO: 110988 - DNA, 25 bp, Mus musculus
gattcctttgagagcttggactcgc

SEQ ID NO: 110989 - DNA, 25 bp, Mus musculus
gattcgacaagtgcacaacagtttt

SEQ ID NO: 110990 - DNA, 25 bp, Mus musculus
gattcgaccaaagaccaaagattgg

SEQ ID NO: 110991 - DNA, 25 bp, Mus musculus
gattcgagcccagacaatgacagct

SEQ ID NO: 110992 - DNA, 25 bp, Mus musculus
gattcgagcccagagaagttacctg

SEQ ID NO: 110993 - DNA, 25 bp, Mus musculus
gattcgagctcagagagcccctgct

SEQ ID NO: 110994 - DNA, 25 bp, Mus musculus
gattcgaggccccaacatacaagga

SEQ ID NO: 110995 - DNA, 25 bp, Mus musculus
gattcgagtcatctgtgatgactac

SEQ ID NO: 110996 - DNA, 25 bp, Mus musculus
gattcgagtcgagctgagagtcaag

SEQ ID NO: 110997 - DNA, 25 bp, Mus musculus
gattcgagtgaatgcagagcctgcg

SEQ ID NO: 110998 - DNA, 25 bp, Mus musculus
gattcgatgacaggcagcttcggct

SEQ ID NO: 110999 - DNA, 25 bp, Mus musculus
gattcgcaacaggaggaagtatgcc

SEQ ID NO: 111000 - DNA, 25 bp, Mus musculus
gattcgcgagcgaggaaagcagcaa

SEQ ID NO: 111001 - DNA, 25 bp, Mus musculus
gattcgctaactaggtcactcatgg

SEQ ID NO: 111002 - DNA, 25 bp, Mus musculus
gattcggagtatacctgacacagtt

SEQ ID NO: 111003 - DNA, 25 bp, Mus musculus
gattcggagtcgcctggaacacaga

SEQ ID NO: 111004 - DNA, 25 bp, Mus musculus
gattcggcagctttggaccttcgag

SEQ ID NO: 111005 - DNA, 25 bp, Mus musculus
gattcggcccatgcaaaccatttca

SEQ ID NO: 111006 - DNA, 25 bp, Mus musculus
gattcggcgcagtaataacagtcgt

SEQ ID NO: 111007 - DNA, 25 bp, Mus musculus
gattcggctccagtaaatgtacaga

SEQ ID NO: 111008 - DNA, 25 bp, Mus musculus
gattcggcttttctcggttcagtct

SEQ ID NO: 111009 - DNA, 25 bp, Mus musculus
gattcgggaacctgaagaacggcgt

SEQ ID NO: 111010 - DNA, 25 bp, Mus musculus
gattcgggatcctcacactctgcat

SEQ ID NO: 111011 - DNA, 25 bp, Mus musculus
gattcggtcacccacattgtggcag

SEQ ID NO: 111012 - DNA, 25 bp, Mus musculus
gattcggtcgactctagcggttgct

SEQ ID NO: 111013 - DNA, 25 bp, Mus musculus
gattcgtcacccgtatgagacccag

SEQ ID NO: 111014 - DNA, 25 bp, Mus musculus
gattcgtcttcaaaacatacattta

SEQ ID NO: 111015 - DNA, 25 bp, Mus musculus
gattcgtgtcaatttggccaagcca

SEQ ID NO: 111016 - DNA, 25 bp, Mus musculus
gattctaaccttggctcggtacacg

SEQ ID NO: 111017 - DNA, 25 bp, Mus musculus
gattctacagcatctagcccaagtg

SEQ ID NO: 111018 - DNA, 25 bp, Mus musculus
gattctaccagaaggatgggcgccc

SEQ ID NO: 111019 - DNA, 25 bp, Mus musculus
gattctacggagactgcagcttctg

SEQ ID NO: 111020 - DNA, 25 bp, Mus musculus
gattctactacatagactcagatgg

SEQ ID NO: 111021 - DNA, 25 bp, Mus musculus
gattctactggaaaccctgctacta

SEQ ID NO: 111022 - DNA, 25 bp, Mus musculus
gattctactggaagcatgatgaccc

SEQ ID NO: 111023 - DNA, 25 bp, Mus musculus
gattctactgtagcagcccagagca

SEQ ID NO: 111024 - DNA, 25 bp, Mus musculus
gattctagagctggcgacactgcag

SEQ ID NO: 111025 - DNA, 25 bp, Mus musculus
gattctagagtgtccttccacagag

SEQ ID NO: 111026 - DNA, 25 bp, Mus musculus
gattctagatatgtgtgcagcccct

SEQ ID NO: 111027 - DNA, 25 bp, Mus musculus
gattctatacagctgagtctgccag

SEQ ID NO: 111028 - DNA, 25 bp, Mus musculus
gattctatagccctgggacctgcac

SEQ ID NO: 111029 - DNA, 25 bp, Mus musculus
gattctatcccctggaacttatgca

SEQ ID NO: 111030 - DNA, 25 bp, Mus musculus
gattctatctcaggtgcttgggcca

SEQ ID NO: 111031 - DNA, 25 bp, Mus musculus
gattctcaacagtccaatcagtggg

SEQ ID NO: 111032 - DNA, 25 bp, Mus musculus
gattctcaagacagcagagttgcgc

SEQ ID NO: 111033 - DNA, 25 bp, Mus musculus
gattctcaaggtcatgaacttcaca

SEQ ID NO: 111034 - DNA, 25 bp, Mus musculus
gattctcagaaggaactgtaccaag

SEQ ID NO: 111035 - DNA, 25 bp, Mus musculus
gattctcagttttagggccatggcc

SEQ ID NO: 111036 - DNA, 25 bp, Mus musculus
gattctcatggtgggcttagatgca

SEQ ID NO: 111037 - DNA, 25 bp, Mus musculus
gattctccttttccgacgcgcttgg

SEQ ID NO: 111038 - DNA, 25 bp, Mus musculus
gattctctaaagtagtgggctccag

SEQ ID NO: 111039 - DNA, 25 bp, Mus musculus
gattctctatgtgcgcgaggtctac

SEQ ID NO: 111040 - DNA, 25 bp, Mus musculus
gattctctctaaccataataaatga

SEQ ID NO: 111041 - DNA, 25 bp, Mus musculus
gattctctggaacatttcgtggaaa

SEQ ID NO: 111042 - DNA, 25 bp, Mus musculus
gattctgaaaagcttccttcttgta

SEQ ID NO: 111043 - DNA, 25 bp, Mus musculus
gattctgaaacgcatgaagttgtcc

SEQ ID NO: 111044 - DNA, 25 bp, Mus musculus
gattctgaacaggtatcacatccga

SEQ ID NO: 111045 - DNA, 25 bp, Mus musculus
gattctgaccaagggagatcccaca

SEQ ID NO: 111046 - DNA, 25 bp, Mus musculus
gattctgactactacagtcccgcgg

SEQ ID NO: 111047 - DNA, 25 bp, Mus musculus
gattctgactcacaagcccgtgctg

SEQ ID NO: 111048 - DNA, 25 bp, Mus musculus
gattctgagaaacgaaccccgcttc

SEQ ID NO: 111049 - DNA, 25 bp, Mus musculus
gattctgcaccaagccacaggaaag

SEQ ID NO: 111050 - DNA, 25 bp, Mus musculus
gattctgccctccaagacagtcttg

SEQ ID NO: 111051 - DNA, 25 bp, Mus musculus
gattctgcgggcagtctgccagatt

SEQ ID NO: 111052 - DNA, 25 bp, Mus musculus
gattctgctgaagagcaactgccag

SEQ ID NO: 111053 - DNA, 25 bp, Mus musculus
gattctgctgatggacgggcaaccc

SEQ ID NO: 111054 - DNA, 25 bp, Mus musculus
gattctggaccttcgagacgggctg

SEQ ID NO: 111055 - DNA, 25 bp, Mus musculus
gattctggatttactctgggacctc

SEQ ID NO: 111056 - DNA, 25 bp, Mus musculus
gattctgggacttccatgcactgcg

SEQ ID NO: 111057 - DNA, 25 bp, Mus musculus
gattctgggcctgcatttggacttg

SEQ ID NO: 111058 - DNA, 25 bp, Mus musculus
gattctggtgggttcttccgctcag

SEQ ID NO: 111059 - DNA, 25 bp, Mus musculus
gattctgtatgcagccgagtgtgcc

SEQ ID NO: 111060 - DNA, 25 bp, Mus musculus
gattctgtccgaagactatggagcc

SEQ ID NO: 111061 - DNA, 25 bp, Mus musculus
gattctgtctctgccacaataaagg

SEQ ID NO: 111062 - DNA, 25 bp, Mus musculus
gattctgtctggtttttagaccatg

SEQ ID NO: 111063 - DNA, 25 bp, Mus musculus
gattctgtgtcccaagttcctccca

SEQ ID NO: 111064 - DNA, 25 bp, Mus musculus
gattctgttctgtcaaaagctgaga

SEQ ID NO: 111065 - DNA, 25 bp, Mus musculus
gattcttctagttgtactgatattc

SEQ ID NO: 111066 - DNA, 25 bp, Mus musculus
gattcttctgcggtatggccagcac

SEQ ID NO: 111067 - DNA, 25 bp, Mus musculus
gattcttgatactgcactctctaag

SEQ ID NO: 111068 - DNA, 25 bp, Mus musculus
gattcttgggacacctgttttcctt

SEQ ID NO: 111069 - DNA, 25 bp, Mus musculus
gattcttgtcccctgccaatcgagg

SEQ ID NO: 111070 - DNA, 25 bp, Mus musculus
gattctttaaactggacaaaggaag

SEQ ID NO: 111071 - DNA, 25 bp, Mus musculus
gattctttgaaacagcttcccggaa

SEQ ID NO: 111072 - DNA, 25 bp, Mus musculus
gattcttttccagtccttagcgcca

SEQ ID NO: 111073 - DNA, 25 bp, Mus musculus
gattcttttgagcagttggcacttc

SEQ ID NO: 111074 - DNA, 25 bp, Mus musculus
gattgaaaccatgcgtagccctgat

SEQ ID NO: 111075 - DNA, 25 bp, Mus musculus
gattgaaagactgctcctagaagac

SEQ ID NO: 111076 - DNA, 25 bp, Mus musculus
gattgaaatgcttgacaggctcctg

SEQ ID NO: 111077 - DNA, 25 bp, Mus musculus
gattgaaattgaaacgcacccgacg

SEQ ID NO: 111078 - DNA, 25 bp, Mus musculus
gattgaacacccataacctgatgcg

SEQ ID NO: 111079 - DNA, 25 bp, Mus musculus
gattgaacccctgcaaggtggaccc

SEQ ID NO: 111080 - DNA, 25 bp, Mus musculus
gattgaagacatcaatggctgtcca

SEQ ID NO: 111081 - DNA, 25 bp, Mus musculus
gattgaattcctagccctcttgggt

SEQ ID NO: 111082 - DNA, 25 bp, Mus musculus
gattgacaattacacttaccctagg

SEQ ID NO: 111083 - DNA, 25 bp, Mus musculus
gattgacaccggctatggcatcctg

SEQ ID NO: 111084 - DNA, 25 bp, Mus musculus
gattgacactgtaaaggaccctgtg

SEQ ID NO: 111085 - DNA, 25 bp, Mus musculus
gattgacagagaccctacctacttt

SEQ ID NO: 111086 - DNA, 25 bp, Mus musculus
gattgacagtgtacacgcaagagcc

SEQ ID NO: 111087 - DNA, 25 bp, Mus musculus
gattgacatcccttcctttgactgg

SEQ ID NO: 111088 - DNA, 25 bp, Mus musculus
gattgacattttcacccagtacgga

SEQ ID NO: 111089 - DNA, 25 bp, Mus musculus
gattgaccaactcacacaccatggg

SEQ ID NO: 111090 - DNA, 25 bp, Mus musculus
gattgaccagaaaacacctctccga

SEQ ID NO: 111091 - DNA, 25 bp, Mus musculus
gattgacccaagctcctatggcgag

SEQ ID NO: 111092 - DNA, 25 bp, Mus musculus
gattgacctttctagagcgagtgca

SEQ ID NO: 111093 - DNA, 25 bp, Mus musculus
gattgacgatgaagaaattgagcgg

SEQ ID NO: 111094 - DNA, 25 bp, Mus musculus
gattgacgctgtctcaggaccttga

SEQ ID NO: 111095 - DNA, 25 bp, Mus musculus
gattgacggagcttacctgaccata

SEQ ID NO: 111096 - DNA, 25 bp, Mus musculus
gattgactccgtggctgatgctgat

SEQ ID NO: 111097 - DNA, 25 bp, Mus musculus
gattgactttcaggccgacaaaggg

SEQ ID NO: 111098 - DNA, 25 bp, Mus musculus
gattgactttgagactgaaccacct

SEQ ID NO: 111099 - DNA, 25 bp, Mus musculus
gattgagaacacaagcagcgtgcag

SEQ ID NO: 111100 - DNA, 25 bp, Mus musculus
gattgagaaggacctgcatcgccag

SEQ ID NO: 111101 - DNA, 25 bp, Mus musculus
gattgagatagacatcgaacccaca

SEQ ID NO: 111102 - DNA, 25 bp, Mus musculus
gattgagatagccaacaaaaccagc

SEQ ID NO: 111103 - DNA, 25 bp, Mus musculus
gattgagattgcctatggcaccagc

SEQ ID NO: 111104 - DNA, 25 bp, Mus musculus
gattgagcacctgaatgcgaccttc

SEQ ID NO: 111105 - DNA, 25 bp, Mus musculus
gattgagcgcatattcgagctggcc

SEQ ID NO: 111106 - DNA, 25 bp, Mus musculus
gattgagcgggctgagtgcaccatc

SEQ ID NO: 111107 - DNA, 25 bp, Mus musculus
gattgagctacacctgaatggaccc

SEQ ID NO: 111108 - DNA, 25 bp, Mus musculus
gattgagctactcaaaagaactgct

SEQ ID NO: 111109 - DNA, 25 bp, Mus musculus
gattgagctcctggaagacgcctta

SEQ ID NO: 111110 - DNA, 25 bp, Mus musculus
gattgagctggagaagcatatctcc

SEQ ID NO: 111111 - DNA, 25 bp, Mus musculus
gattgaggattgacaccagggcctc

SEQ ID NO: 111112 - DNA, 25 bp, Mus musculus
gattgagtactccactgcagacgaa

SEQ ID NO: 111113 - DNA, 25 bp, Mus musculus
gattgagtatgtgaccgaggagcct

SEQ ID NO: 111114 - DNA, 25 bp, Mus musculus
gattgagtttctaacccaagagcag

SEQ ID NO: 111115 - DNA, 25 bp, Mus musculus
gattgataatcctgctgacattctg

SEQ ID NO: 111116 - DNA, 25 bp, Mus musculus
gattgatcccaaggctagtctggaa

SEQ ID NO: 111117 - DNA, 25 bp, Mus musculus
gattgatcccctggctctggtgcaa

SEQ ID NO: 111118 - DNA, 25 bp, Mus musculus
gattgatcgtgaggtcatgaagccc

SEQ ID NO: 111119 - DNA, 25 bp, Mus musculus
gattgatcgtgagtcgggcaagaca

SEQ ID NO: 111120 - DNA, 25 bp, Mus musculus
gattgatctagaaaacctggcccgg

SEQ ID NO: 111121 - DNA, 25 bp, Mus musculus
gattgatgaagtgtccgcagctcgg

SEQ ID NO: 111122 - DNA, 25 bp, Mus musculus
gattgatgctggagaccgcttcctg

SEQ ID NO: 111123 - DNA, 25 bp, Mus musculus
gattgatgtcatgtgcctcttgcag

SEQ ID NO: 111124 - DNA, 25 bp, Mus musculus
gattgcaaaagaacagactgcccag

SEQ ID NO: 111125 - DNA, 25 bp, Mus musculus
gattgcaagcgctatctgggcctca

SEQ ID NO: 111126 - DNA, 25 bp, Mus musculus
gattgcacccctgtgtagaagccat

SEQ ID NO: 111127 - DNA, 25 bp, Mus musculus
gattgcacctaccttcagttcctgg

SEQ ID NO: 111128 - DNA, 25 bp, Mus musculus
gattgcacctcgttctttctggatg

SEQ ID NO: 111129 - DNA, 25 bp, Mus musculus
gattgcagacagtaaggaccacgtg

SEQ ID NO: 111130 - DNA, 25 bp, Mus musculus
gattgcagacgaggaagagccgatc

SEQ ID NO: 111131 - DNA, 25 bp, Mus musculus
gattgcagagctttcatatccacga

SEQ ID NO: 111132 - DNA, 25 bp, Mus musculus
gattgcagatttccaggatgtcctg

SEQ ID NO: 111133 - DNA, 25 bp, Mus musculus
gattgcagggcagtaaattcaggca

SEQ ID NO: 111134 - DNA, 25 bp, Mus musculus
gattgcagtaacctgatcccgcggg

SEQ ID NO: 111135 - DNA, 25 bp, Mus musculus
gattgcagtgctcccaaggaaatga

SEQ ID NO: 111136 - DNA, 25 bp, Mus musculus
gattgcagtggaagacctgagccct

SEQ ID NO: 111137 - DNA, 25 bp, Mus musculus
gattgccaagaggtcacacaactgg

SEQ ID NO: 111138 - DNA, 25 bp, Mus musculus
gattgccacgcttgcctctgggcta

SEQ ID NO: 111139 - DNA, 25 bp, Mus musculus
gattgccagcaacacctatgcatgc

SEQ ID NO: 111140 - DNA, 25 bp, Mus musculus
gattgccagtacctcagggtcaagg

SEQ ID NO: 111141 - DNA, 25 bp, Mus musculus
gattgccatcggtgtacaacatgat

SEQ ID NO: 111142 - DNA, 25 bp, Mus musculus
gattgcccaagcagcccaaagatgg

SEQ ID NO: 111143 - DNA, 25 bp, Mus musculus
gattgcccagggaacagcatcagtg

SEQ ID NO: 111144 - DNA, 25 bp, Mus musculus
gattgccccacacactggaggagta

SEQ ID NO: 111145 - DNA, 25 bp, Mus musculus
gattgccctagagcacacagatgtg

SEQ ID NO: 111146 - DNA, 25 bp, Mus musculus
gattgccgaggctatccctgagctg

SEQ ID NO: 111147 - DNA, 25 bp, Mus musculus
gattgcctatggcaccagctccggg

SEQ ID NO: 111148 - DNA, 25 bp, Mus musculus
gattgcctcagtccggagatcccta

SEQ ID NO: 111149 - DNA, 25 bp, Mus musculus
gattgcctgttagacttcttgcccg

SEQ ID NO: 111150 - DNA, 25 bp, Mus musculus
gattgcctttgttgatgtgcccaga

SEQ ID NO: 111151 - DNA, 25 bp, Mus musculus
gattgcgagttcagagacaggtccc

SEQ ID NO: 111152 - DNA, 25 bp, Mus musculus
gattgcgccccaccttttgactttg

SEQ ID NO: 111153 - DNA, 25 bp, Mus musculus
gattgcgccccagatccaggatttg

SEQ ID NO: 111154 - DNA, 25 bp, Mus musculus
gattgcggattacatcgtgaccagc

SEQ ID NO: 111155 - DNA, 25 bp, Mus musculus
gattgcggattttcggaggacacac

SEQ ID NO: 111156 - DNA, 25 bp, Mus musculus
gattgcgtcctcatccagggtgaca

SEQ ID NO: 111157 - DNA, 25 bp, Mus musculus
gattgctaaggaagccacggtttta

SEQ ID NO: 111158 - DNA, 25 bp, Mus musculus
gattgctcaaatcggtgactccatg

SEQ ID NO: 111159 - DNA, 25 bp, Mus musculus
gattgctctgttaggacttgggacc

SEQ ID NO: 111160 - DNA, 25 bp, Mus musculus
gattgctgcaagtcctttggtcggc

SEQ ID NO: 111161 - DNA, 25 bp, Mus musculus
gattgctgccagtcgacaggctagc

SEQ ID NO: 111162 - DNA, 25 bp, Mus musculus
gattgctgccttgctggctagccca

SEQ ID NO: 111163 - DNA, 25 bp, Mus musculus
gattgctgctggtgaagccatcgcg

SEQ ID NO: 111164 - DNA, 25 bp, Mus musculus
gattgctggcctccatttgaccaaa

SEQ ID NO: 111165 - DNA, 25 bp, Mus musculus
gattgctgggcaattaaaggaccct

SEQ ID NO: 111166 - DNA, 25 bp, Mus musculus
gattgctgtgggtccgtcggactgc

SEQ ID NO: 111167 - DNA, 25 bp, Mus musculus
gattgcttcggaggacacagaccaa

SEQ ID NO: 111168 - DNA, 25 bp, Mus musculus
gattgcttgatcttctgttgaccta

SEQ ID NO: 111169 - DNA, 25 bp, Mus musculus
gattggaaaacaggagagtccctct

SEQ ID NO: 111170 - DNA, 25 bp, Mus musculus
gattggaagccaagtgaagaccctt

SEQ ID NO: 111171 - DNA, 25 bp, Mus musculus
gattggaatggtggagaacttcaac

SEQ ID NO: 111172 - DNA, 25 bp, Mus musculus
gattggacaaccaacctcctgagga

SEQ ID NO: 111173 - DNA, 25 bp, Mus musculus
gattggacattgatgagaaacctct

SEQ ID NO: 111174 - DNA, 25 bp, Mus musculus
gattggactgggactgctttacttg

SEQ ID NO: 111175 - DNA, 25 bp, Mus musculus
gattggagaaagagttcgcaccctt

SEQ ID NO: 111176 - DNA, 25 bp, Mus musculus
gattggagacaccattgaattccgg

SEQ ID NO: 111177 - DNA, 25 bp, Mus musculus
gattggagctggagaacctccctaa

SEQ ID NO: 111178 - DNA, 25 bp, Mus musculus
gattggagtgaactaccatcgccac

SEQ ID NO: 111179 - DNA, 25 bp, Mus musculus
gattggagtgcatcctgcgaaggcc

SEQ ID NO: 111180 - DNA, 25 bp, Mus musculus
gattggatcaccctaaagcctgcaa

SEQ ID NO: 111181 - DNA, 25 bp, Mus musculus
gattggatcctacgcttcctcagca

SEQ ID NO: 111182 - DNA, 25 bp, Mus musculus
gattggcaaggtagctcatcagcta

SEQ ID NO: 111183 - DNA, 25 bp, Mus musculus
gattggcactctgactgcactacag

SEQ ID NO: 111184 - DNA, 25 bp, Mus musculus
gattggcagccaccattcgcttgtg

SEQ ID NO: 111185 - DNA, 25 bp, Mus musculus
gattggcagtgaggaacattttgaa

SEQ ID NO: 111186 - DNA, 25 bp, Mus musculus
gattggcagtgctggaactggcaaa

SEQ ID NO: 111187 - DNA, 25 bp, Mus musculus
gattggcatagacttgaagaaccgg

SEQ ID NO: 111188 - DNA, 25 bp, Mus musculus
gattggcatcaaagaaagcagtgca

SEQ ID NO: 111189 - DNA, 25 bp, Mus musculus
gattggcattgttccacacacagtg

SEQ ID NO: 111190 - DNA, 25 bp, Mus musculus
gattggcccagacacctgatcaaga

SEQ ID NO: 111191 - DNA, 25 bp, Mus musculus
gattggcctccggaacctggtgatg

SEQ ID NO: 111192 - DNA, 25 bp, Mus musculus
gattggcgcctatgactacgatgaa

SEQ ID NO: 111193 - DNA, 25 bp, Mus musculus
gattggcgcctattatgacttcgag

SEQ ID NO: 111194 - DNA, 25 bp, Mus musculus
gattggctaggcacacctgaacatg

SEQ ID NO: 111195 - DNA, 25 bp, Mus musculus
gattggctcggcttcgactgaggcc

SEQ ID NO: 111196 - DNA, 25 bp, Mus musculus
gattgggccaagacagaagatgcgc

SEQ ID NO: 111197 - DNA, 25 bp, Mus musculus
gattgggtcgaaaagctgaagacct

SEQ ID NO: 111198 - DNA, 25 bp, Mus musculus
gattggtaatcagactgcgactggt

SEQ ID NO: 111199 - DNA, 25 bp, Mus musculus
gattggtcaccaggattcggacaaa

SEQ ID NO: 111200 - DNA, 25 bp, Mus musculus
gattggtcacgttcatcgaggtggc

SEQ ID NO: 111201 - DNA, 25 bp, Mus musculus
gattggtcagcatcaagagccactg

SEQ ID NO: 111202 - DNA, 25 bp, Mus musculus
gattggtccacacacctcagagtgc

SEQ ID NO: 111203 - DNA, 25 bp, Mus musculus
gattggtccactgggaaatctgtca

SEQ ID NO: 111204 - DNA, 25 bp, Mus musculus
gattggtctcctgcacttagcttca

SEQ ID NO: 111205 - DNA, 25 bp, Mus musculus
gattggtgacacacacccactggag

SEQ ID NO: 111206 - DNA, 25 bp, Mus musculus
gattggtgcagggttgggagggacc

SEQ ID NO: 111207 - DNA, 25 bp, Mus musculus
gattggtgcgaggacaactacacta

SEQ ID NO: 111208 - DNA, 25 bp, Mus musculus
gattggtgtgtggaacggtctcaac

SEQ ID NO: 111209 - DNA, 25 bp, Mus musculus
gattgtaacctccagcacatcacct

SEQ ID NO: 111210 - DNA, 25 bp, Mus musculus
gattgtaatagtcttcccggagtcc

SEQ ID NO: 111211 - DNA, 25 bp, Mus musculus
gattgtactatgagctgctatgtgg

SEQ ID NO: 111212 - DNA, 25 bp, Mus musculus
gattgtactgtccatagccagcggc

SEQ ID NO: 111213 - DNA, 25 bp, Mus musculus
gattgtagtccaggtgacgccagca

SEQ ID NO: 111214 - DNA, 25 bp, Mus musculus
gattgtagttcaaaggacaaccttg

SEQ ID NO: 111215 - DNA, 25 bp, Mus musculus
gattgtatggaacaagagaaggcct

SEQ ID NO: 111216 - DNA, 25 bp, Mus musculus
gattgtcaatcgatgccatcgccgc

SEQ ID NO: 111217 - DNA, 25 bp, Mus musculus
gattgtcactctggaacgacttcgg

SEQ ID NO: 111218 - DNA, 25 bp, Mus musculus
gattgtcatggaaacgtgctcgggc

SEQ ID NO: 111219 - DNA, 25 bp, Mus musculus
gattgtccacgtattcagcttttcc

SEQ ID NO: 111220 - DNA, 25 bp, Mus musculus
gattgtcctgaagatccctgccaag

SEQ ID NO: 111221 - DNA, 25 bp, Mus musculus
gattgtcgtgaaaggcatgacccgg

SEQ ID NO: 111222 - DNA, 25 bp, Mus musculus
gattgtctaaatctcagaatacagt

SEQ ID NO: 111223 - DNA, 25 bp, Mus musculus
gattgtctacaaccacagctctggg

SEQ ID NO: 111224 - DNA, 25 bp, Mus musculus
gattgtctacaatgggtgaaccaca

SEQ ID NO: 111225 - DNA, 25 bp, Mus musculus
gattgtctcaggaagtcacgaccgg

SEQ ID NO: 111226 - DNA, 25 bp, Mus musculus
gattgtctcagtcgagcctttcggg

SEQ ID NO: 111227 - DNA, 25 bp, Mus musculus
gattgtgaaccggtactggagccag

SEQ ID NO: 111228 - DNA, 25 bp, Mus musculus
gattgtgaactttgctccaccctgt

SEQ ID NO: 111229 - DNA, 25 bp, Mus musculus
gattgtgaattctgagcctctctgg

SEQ ID NO: 111230 - DNA, 25 bp, Mus musculus
gattgtgatgatcaccacggtcacc

SEQ ID NO: 111231 - DNA, 25 bp, Mus musculus
gattgtgcacaaaaacagagctcag

SEQ ID NO: 111232 - DNA, 25 bp, Mus musculus
gattgtgcctgcgatgtccatatga

SEQ ID NO: 111233 - DNA, 25 bp, Mus musculus
gattgtgctcatctccgttgctgca

SEQ ID NO: 111234 - DNA, 25 bp, Mus musculus
gattgtgctcatctctggaacaggc

SEQ ID NO: 111235 - DNA, 25 bp, Mus musculus
gattgtgctgcacagcctggacctg

SEQ ID NO: 111236 - DNA, 25 bp, Mus musculus
gattgtggaaacctacaccgaggag

SEQ ID NO: 111237 - DNA, 25 bp, Mus musculus
gattgtggaacgtcagctgcgagct

SEQ ID NO: 111238 - DNA, 25 bp, Mus musculus
gattgtggaccagatgacacttggg

SEQ ID NO: 111239 - DNA, 25 bp, Mus musculus
gattgtggaccagctgcaacagttg

SEQ ID NO: 111240 - DNA, 25 bp, Mus musculus
gattgtggactgtatgtaccccgtg

SEQ ID NO: 111241 - DNA, 25 bp, Mus musculus
gattgtgggatatcctgctcgcagt

SEQ ID NO: 111242 - DNA, 25 bp, Mus musculus
gattgtgggcaagcacagcagcagt

SEQ ID NO: 111243 - DNA, 25 bp, Mus musculus
gattgtgtgacaactctctcctgga

SEQ ID NO: 111244 - DNA, 25 bp, Mus musculus
gattgttaatccagaccacagcgtt

SEQ ID NO: 111245 - DNA, 25 bp, Mus musculus
gattgttctgggaggagtcgccaca

SEQ ID NO: 111246 - DNA, 25 bp, Mus musculus
gattgttcttagcagggtatgaccc

SEQ ID NO: 111247 - DNA, 25 bp, Mus musculus
gattgttgaagatgacgaagagacc

SEQ ID NO: 111248 - DNA, 25 bp, Mus musculus
gattgtttttctctaagcgctgctg

SEQ ID NO: 111249 - DNA, 25 bp, Mus musculus
gatttaaaggcagcggagcggctca

SEQ ID NO: 111250 - DNA, 25 bp, Mus musculus
gatttaaatgctggtatctcccgga

SEQ ID NO: 111251 - DNA, 25 bp, Mus musculus
gatttaagcccagtcagtgagccag

SEQ ID NO: 111252 - DNA, 25 bp, Mus musculus
gatttaagttacagagcctgagccg

SEQ ID NO: 111253 - DNA, 25 bp, Mus musculus
gatttaattgctcaagcccggacag

SEQ ID NO: 111254 - DNA, 25 bp, Mus musculus
gatttacaggaagcagaacccaggc

SEQ ID NO: 111255 - DNA, 25 bp, Mus musculus
gatttacagggttaacagacgcgca

SEQ ID NO: 111256 - DNA, 25 bp, Mus musculus
gatttaccaatcctggcggctcacg

SEQ ID NO: 111257 - DNA, 25 bp, Mus musculus
gatttaccccactgggatcgggcag

SEQ ID NO: 111258 - DNA, 25 bp, Mus musculus
gatttaccggagctacatggacggc

SEQ ID NO: 111259 - DNA, 25 bp, Mus musculus
gatttactgaccttattgggcaccg

SEQ ID NO: 111260 - DNA, 25 bp, Mus musculus
gatttactggaggataactctcacc

SEQ ID NO: 111261 - DNA, 25 bp, Mus musculus
gatttactggagttgctactgggag

SEQ ID NO: 111262 - DNA, 25 bp, Mus musculus
gatttaggcccggaagatccgagtc

SEQ ID NO: 111263 - DNA, 25 bp, Mus musculus
gatttagggatgagaaaccttccac

SEQ ID NO: 111264 - DNA, 25 bp, Mus musculus
gatttagtgcggtttcttcgcccac

SEQ ID NO: 111265 - DNA, 25 bp, Mus musculus
gatttatagctggacacgatggccg

SEQ ID NO: 111266 - DNA, 25 bp, Mus musculus
gatttatattcgtctggtcagctga

SEQ ID NO: 111267 - DNA, 25 bp, Mus musculus
gatttatcaaaagtgccaaccatgg

SEQ ID NO: 111268 - DNA, 25 bp, Mus musculus
gatttatcgaggacaccacgttgac

SEQ ID NO: 111269 - DNA, 25 bp, Mus musculus
gatttatctacttgctttgagacag

SEQ ID NO: 111270 - DNA, 25 bp, Mus musculus
gatttattctggcagctactgggac

SEQ ID NO: 111271 - DNA, 25 bp, Mus musculus
gatttcacaaacgagaaccccttgg

SEQ ID NO: 111272 - DNA, 25 bp, Mus musculus
gatttcacatggattcttccaagtg

SEQ ID NO: 111273 - DNA, 25 bp, Mus musculus
gatttcactagcaggttataccgag

SEQ ID NO: 111274 - DNA, 25 bp, Mus musculus
gatttcactccctacaaatgtacag

SEQ ID NO: 111275 - DNA, 25 bp, Mus musculus
gatttcagatgcagagaaggccgcc

SEQ ID NO: 111276 - DNA, 25 bp, Mus musculus
gatttcagcaggcaccattctccga

SEQ ID NO: 111277 - DNA, 25 bp, Mus musculus
gatttcagctccaaagcccatggga

SEQ ID NO: 111278 - DNA, 25 bp, Mus musculus
gatttcatcatcttcgaggctgcac

SEQ ID NO: 111279 - DNA, 25 bp, Mus musculus
gatttcattgctacgtatcaggcta

SEQ ID NO: 111280 - DNA, 25 bp, Mus musculus
gatttccaacccaatatagcaaaga

SEQ ID NO: 111281 - DNA, 25 bp, Mus musculus
gatttccaaccggaagcagcctcag

SEQ ID NO: 111282 - DNA, 25 bp, Mus musculus
gatttccacacttctatgcctcctg

SEQ ID NO: 111283 - DNA, 25 bp, Mus musculus
gatttccacatactccacaggttgc

SEQ ID NO: 111284 - DNA, 25 bp, Mus musculus
gatttccacatgtgtccaggagctg

SEQ ID NO: 111285 - DNA, 25 bp, Mus musculus
gatttccagcctccatggcagcgag

SEQ ID NO: 111286 - DNA, 25 bp, Mus musculus
gatttccatctacaacagtaccagg

SEQ ID NO: 111287 - DNA, 25 bp, Mus musculus
gatttccattgagatgcacggcacc

SEQ ID NO: 111288 - DNA, 25 bp, Mus musculus
gatttcccagctcgtagtatcttgg

SEQ ID NO: 111289 - DNA, 25 bp, Mus musculus
gatttccccggcaaagttcagcagc

SEQ ID NO: 111290 - DNA, 25 bp, Mus musculus
gatttcccgggatgcaaggacctga

SEQ ID NO: 111291 - DNA, 25 bp, Mus musculus
gatttccgccgagagggatccggct

SEQ ID NO: 111292 - DNA, 25 bp, Mus musculus
gatttcctgatcatccacaccgagg

SEQ ID NO: 111293 - DNA, 25 bp, Mus musculus
gatttcctgccgtactttccatatg

SEQ ID NO: 111294 - DNA, 25 bp, Mus musculus
gatttcctgtacgatgaagtccacc

SEQ ID NO: 111295 - DNA, 25 bp, Mus musculus
gatttcgaaagatgacagaggctga

SEQ ID NO: 111296 - DNA, 25 bp, Mus musculus
gatttcgtcaaatacgtggatgaca

SEQ ID NO: 111297 - DNA, 25 bp, Mus musculus
gatttcgtcagaagctacggcaggg

SEQ ID NO: 111298 - DNA, 25 bp, Mus musculus
gatttcgtcagtccaggaacatggg

SEQ ID NO: 111299 - DNA, 25 bp, Mus musculus
gatttcgtgaaagtgccttgtgcca

SEQ ID NO: 111300 - DNA, 25 bp, Mus musculus
gatttctaaaggcaacgcacaaagg

SEQ ID NO: 111301 - DNA, 25 bp, Mus musculus
gatttctaacccaggatctgatggt

SEQ ID NO: 111302 - DNA, 25 bp, Mus musculus
gatttctatcacttgtctcaggaag

SEQ ID NO: 111303 - DNA, 25 bp, Mus musculus
gatttctcaggagccattgtcttca

SEQ ID NO: 111304 - DNA, 25 bp, Mus musculus
gatttctcccaagatgccagtgtgc

SEQ ID NO: 111305 - DNA, 25 bp, Mus musculus
gatttctcggtactcttcagggatg

SEQ ID NO: 111306 - DNA, 25 bp, Mus musculus
gatttctctatacggcaagtggtcc

SEQ ID NO: 111307 - DNA, 25 bp, Mus musculus
gatttctgcacaccctattgttaag

SEQ ID NO: 111308 - DNA, 25 bp, Mus musculus
gatttctgccaggaaccacaggtgg

SEQ ID NO: 111309 - DNA, 25 bp, Mus musculus
gatttctgcccagattgtggctcag

SEQ ID NO: 111310 - DNA, 25 bp, Mus musculus
gatttctggactgctgcgtgacccg

SEQ ID NO: 111311 - DNA, 25 bp, Mus musculus
gatttctggcttgacctcttcaggg

SEQ ID NO: 111312 - DNA, 25 bp, Mus musculus
gatttctggtggtgcattgaccgct

SEQ ID NO: 111313 - DNA, 25 bp, Mus musculus
gatttctggtgtcaatgtccccggc

SEQ ID NO: 111314 - DNA, 25 bp, Mus musculus
gatttctgtctaactatttcttccg

SEQ ID NO: 111315 - DNA, 25 bp, Mus musculus
gatttctgtgctctttcagcagtga

SEQ ID NO: 111316 - DNA, 25 bp, Mus musculus
gatttctgtttcactggcccagcca

SEQ ID NO: 111317 - DNA, 25 bp, Mus musculus
gatttctttgtacttcagctagccg

SEQ ID NO: 111318 - DNA, 25 bp, Mus musculus
gatttcttttggaagcaggcgctga

SEQ ID NO: 111319 - DNA, 25 bp, Mus musculus
gatttgaacgcgtcctgaccagtgg

SEQ ID NO: 111320 - DNA, 25 bp, Mus musculus
gatttgaagatcatcgagccggacg

SEQ ID NO: 111321 - DNA, 25 bp, Mus musculus
gatttgaaggtgacaccgtgtccct

SEQ ID NO: 111322 - DNA, 25 bp, Mus musculus
gatttgaatagggacctgtcactga

SEQ ID NO: 111323 - DNA, 25 bp, Mus musculus
gatttgaatttcgagtggtcacccc

SEQ ID NO: 111324 - DNA, 25 bp, Mus musculus
gatttgacatagataccccagatga

SEQ ID NO: 111325 - DNA, 25 bp, Mus musculus
gatttgacgccacacaggccttcgt

SEQ ID NO: 111326 - DNA, 25 bp, Mus musculus
gatttgagacctaggacctcctggg

SEQ ID NO: 111327 - DNA, 25 bp, Mus musculus
gatttgagctcatgggcagtccttc

SEQ ID NO: 111328 - DNA, 25 bp, Mus musculus
gatttgaggacaacccctgctttga

SEQ ID NO: 111329 - DNA, 25 bp, Mus musculus
gatttgagtcccaggaacgtggcag

SEQ ID NO: 111330 - DNA, 25 bp, Mus musculus
gatttgagtctcaggttagggcttt

SEQ ID NO: 111331 - DNA, 25 bp, Mus musculus
gatttgatcaggaagacacggactc

SEQ ID NO: 111332 - DNA, 25 bp, Mus musculus
gatttgatgataccctgacttgagc

SEQ ID NO: 111333 - DNA, 25 bp, Mus musculus
gatttgcacacaccaacattgagtc

SEQ ID NO: 111334 - DNA, 25 bp, Mus musculus
gatttgcagagccatcacgagctaa

SEQ ID NO: 111335 - DNA, 25 bp, Mus musculus
gatttgcagctccaacatgcgggat

SEQ ID NO: 111336 - DNA, 25 bp, Mus musculus
gatttgcaggaggaactaagcagca

SEQ ID NO: 111337 - DNA, 25 bp, Mus musculus
gatttgcatccttgaactaccctga

SEQ ID NO: 111338 - DNA, 25 bp, Mus musculus
gatttgcatctttaacccatttgga

SEQ ID NO: 111339 - DNA, 25 bp, Mus musculus
gatttgccatctgctaaggaagaga

SEQ ID NO: 111340 - DNA, 25 bp, Mus musculus
gatttgccatgagaagagggcccac

SEQ ID NO: 111341 - DNA, 25 bp, Mus musculus
gatttgcccaagaggaaacgtcccg

SEQ ID NO: 111342 - DNA, 25 bp, Mus musculus
gatttgccctctataagcggaccta

SEQ ID NO: 111343 - DNA, 25 bp, Mus musculus
gatttgccgtctcctaggctcggga

SEQ ID NO: 111344 - DNA, 25 bp, Mus musculus
gatttgcgcgctcaagaacctggag

SEQ ID NO: 111345 - DNA, 25 bp, Mus musculus
gatttgctacgaagaaaacgtcaag

SEQ ID NO: 111346 - DNA, 25 bp, Mus musculus
gatttgctacggcaccaaacctgga

SEQ ID NO: 111347 - DNA, 25 bp, Mus musculus
gatttgctcccatttttacagttgg

SEQ ID NO: 111348 - DNA, 25 bp, Mus musculus
gatttgctcctggaaccacacctgt

SEQ ID NO: 111349 - DNA, 25 bp, Mus musculus
gatttggaaacgtcatccggtggca

SEQ ID NO: 111350 - DNA, 25 bp, Mus musculus
gatttggaccttgtgactgacctgg

SEQ ID NO: 111351 - DNA, 25 bp, Mus musculus
gatttggagaaacccctgaagaagc

SEQ ID NO: 111352 - DNA, 25 bp, Mus musculus
gatttggagcgaaaacacctggatc

SEQ ID NO: 111353 - DNA, 25 bp, Mus musculus
gatttggatcccgactcgcatctgg

SEQ ID NO: 111354 - DNA, 25 bp, Mus musculus
gatttggattgacccttggccctgc

SEQ ID NO: 111355 - DNA, 25 bp, Mus musculus
gatttggcaataagtcagctccctc

SEQ ID NO: 111356 - DNA, 25 bp, Mus musculus
gatttggccggtattcttccctgag

SEQ ID NO: 111357 - DNA, 25 bp, Mus musculus
gatttggcggtgcatctgtaccccg

SEQ ID NO: 111358 - DNA, 25 bp, Mus musculus
gatttggcgtccctttccacggagt

SEQ ID NO: 111359 - DNA, 25 bp, Mus musculus
gatttggctccagtggctctaccta

SEQ ID NO: 111360 - DNA, 25 bp, Mus musculus
gatttggctgaaaatgaccccgagc

SEQ ID NO: 111361 - DNA, 25 bp, Mus musculus
gatttggctgatggcaacacctcac

SEQ ID NO: 111362 - DNA, 25 bp, Mus musculus
gatttggctggaacaaggtggccca

SEQ ID NO: 111363 - DNA, 25 bp, Mus musculus
gatttgggcagggtttcagtctcca

SEQ ID NO: 111364 - DNA, 25 bp, Mus musculus
gatttgggcccatttttgaagagca

SEQ ID NO: 111365 - DNA, 25 bp, Mus musculus
gatttgggcccgaggatgatcattt

SEQ ID NO: 111366 - DNA, 25 bp, Mus musculus
gatttgggccttcacactgtcaggc

SEQ ID NO: 111367 - DNA, 25 bp, Mus musculus
gatttggtgctgtcaactgtccgta

SEQ ID NO: 111368 - DNA, 25 bp, Mus musculus
gatttggtgtctccgtctgaccgtc

SEQ ID NO: 111369 - DNA, 25 bp, Mus musculus
gatttgtaaactcaagggcctctcc

SEQ ID NO: 111370 - DNA, 25 bp, Mus musculus
gatttgtacacccaggcagctgagg

SEQ ID NO: 111371 - DNA, 25 bp, Mus musculus
gatttgtaccgctgtgcccgtgtca

SEQ ID NO: 111372 - DNA, 25 bp, Mus musculus
gatttgtcacctctggagcctggct

SEQ ID NO: 111373 - DNA, 25 bp, Mus musculus
gatttgtcacgtttgagagcgagga

SEQ ID NO: 111374 - DNA, 25 bp, Mus musculus
gatttgtcagctagcctttggagag

SEQ ID NO: 111375 - DNA, 25 bp, Mus musculus
gatttgtccaaacaggtgctggccc

SEQ ID NO: 111376 - DNA, 25 bp, Mus musculus
gatttgtccctgttagagaaagcca

SEQ ID NO: 111377 - DNA, 25 bp, Mus musculus
gatttgtctagatcacaggtccgct

SEQ ID NO: 111378 - DNA, 25 bp, Mus musculus
gatttgtggctcaggtcggccctga

SEQ ID NO: 111379 - DNA, 25 bp, Mus musculus
gatttgtggtacgttccctggagaa

SEQ ID NO: 111380 - DNA, 25 bp, Mus musculus
gatttgtggtgacttccaggccagc

SEQ ID NO: 111381 - DNA, 25 bp, Mus musculus
gatttgtgtataggccacaccacag

SEQ ID NO: 111382 - DNA, 25 bp, Mus musculus
gatttgttaacctggctacctggga

SEQ ID NO: 111383 - DNA, 25 bp, Mus musculus
gatttgtttaatcctgacccaggga

SEQ ID NO: 111384 - DNA, 25 bp, Mus musculus
gattttaaacgacgactgtgccacc

SEQ ID NO: 111385 - DNA, 25 bp, Mus musculus
gattttacacgcagggcatctccca

SEQ ID NO: 111386 - DNA, 25 bp, Mus musculus
gattttacactggatattcgcatgc

SEQ ID NO: 111387 - DNA, 25 bp, Mus musculus
gattttactcttgcaagcttggcca

SEQ ID NO: 111388 - DNA, 25 bp, Mus musculus
gattttactgagactaagtgcctgc

SEQ ID NO: 111389 - DNA, 25 bp, Mus musculus
gattttatgggtaccgatgcagcca

SEQ ID NO: 111390 - DNA, 25 bp, Mus musculus
gattttcaagagtgagtctcacccc

SEQ ID NO: 111391 - DNA, 25 bp, Mus musculus
gattttcagcatagttaccgtccgg

SEQ ID NO: 111392 - DNA, 25 bp, Mus musculus
gattttcagcctgggtggaacccgc

SEQ ID NO: 111393 - DNA, 25 bp, Mus musculus
gattttcatcgtctcccagctggga

SEQ ID NO: 111394 - DNA, 25 bp, Mus musculus
gattttccagcttgaccaccaaggg

SEQ ID NO: 111395 - DNA, 25 bp, Mus musculus
gattttccagtatgggaacctccag

SEQ ID NO: 111396 - DNA, 25 bp, Mus musculus
gattttcctccatcccaaagactgt

SEQ ID NO: 111397 - DNA, 25 bp, Mus musculus
gattttcctgtgatgggctgagacc

SEQ ID NO: 111398 - DNA, 25 bp, Mus musculus
gattttcgtacagcaaggcactggg

SEQ ID NO: 111399 - DNA, 25 bp, Mus musculus
gattttctcacaccctaacgtgctc

SEQ ID NO: 111400 - DNA, 25 bp, Mus musculus
gattttctctgtccgccgtgttgta

SEQ ID NO: 111401 - DNA, 25 bp, Mus musculus
gattttgaaagcacgggcgctgaca

SEQ ID NO: 111402 - DNA, 25 bp, Mus musculus
gattttgaatagtatccctccaccc

SEQ ID NO: 111403 - DNA, 25 bp, Mus musculus
gattttgacatgaccctgagcagat

SEQ ID NO: 111404 - DNA, 25 bp, Mus musculus
gattttgacccacggaactgcctct

SEQ ID NO: 111405 - DNA, 25 bp, Mus musculus
gattttgacttatcatcccctggga

SEQ ID NO: 111406 - DNA, 25 bp, Mus musculus
gattttgcaaacacgattcctggac

SEQ ID NO: 111407 - DNA, 25 bp, Mus musculus
gattttggaaaaggccaccccagag

SEQ ID NO: 111408 - DNA, 25 bp, Mus musculus
gattttggataaggaacaccgccca

SEQ ID NO: 111409 - DNA, 25 bp, Mus musculus
gattttggatactgggccccagggc

SEQ ID NO: 111410 - DNA, 25 bp, Mus musculus
gattttggattttcagacgcagcag

SEQ ID NO: 111411 - DNA, 25 bp, Mus musculus
gattttggcagaacctgtctacacg

SEQ ID NO: 111412 - DNA, 25 bp, Mus musculus
gattttggcatccatcgttgtgacc

SEQ ID NO: 111413 - DNA, 25 bp, Mus musculus
gattttggccagaatccttgcctgg

SEQ ID NO: 111414 - DNA, 25 bp, Mus musculus
gattttgtacacatgcgagcgcttg

SEQ ID NO: 111415 - DNA, 25 bp, Mus musculus
gattttgtcaccatgcctgcaagga

SEQ ID NO: 111416 - DNA, 25 bp, Mus musculus
gattttgtgaccctccaggcgaacg

SEQ ID NO: 111417 - DNA, 25 bp, Mus musculus
gattttgtgttcgaatatcccaggc

SEQ ID NO: 111418 - DNA, 25 bp, Mus musculus
gatttttaatcgctgaatggctggc

SEQ ID NO: 111419 - DNA, 25 bp, Mus musculus
gatttttaatgtgggcacggacgac

SEQ ID NO: 111420 - DNA, 25 bp, Mus musculus
gatttttactctactcctctgcagc

SEQ ID NO: 111421 - DNA, 25 bp, Mus musculus
gatttttattcaagtgcacgtcgcg

SEQ ID NO: 111422 - DNA, 25 bp, Mus musculus
gatttttcacggtcaagctcccagt

SEQ ID NO: 111423 - DNA, 25 bp, Mus musculus
gatttttcctcagtcaagtcgcgct

SEQ ID NO: 111424 - DNA, 25 bp, Mus musculus
gatttttctgattcggcacatgctg

SEQ ID NO: 111425 - DNA, 25 bp, Mus musculus
gatttttggtgacttgatgcgattc

SEQ ID NO: 111426 - DNA, 25 bp, Mus musculus
gatttttggtggcaagcccaggcct

SEQ ID NO: 111427 - DNA, 25 bp, Mus musculus
gattttttgagctacatctgcccag

SEQ ID NO: 111428 - DNA, 25 bp, Mus musculus
gcaaaaaacttctggaggacgtgga

SEQ ID NO: 111429 - DNA, 25 bp, Mus musculus
gcaaaaacactgtttcccaacagct

SEQ ID NO: 111430 - DNA, 25 bp, Mus musculus
gcaaaaacccgagaggaggctgtct

SEQ ID NO: 111431 - DNA, 25 bp, Mus musculus
gcaaaaacctgctcggtctgggcca

SEQ ID NO: 111432 - DNA, 25 bp, Mus musculus
gcaaaaaggtgcatgacgcgctgga

SEQ ID NO: 111433 - DNA, 25 bp, Mus musculus
gcaaaaagtggtccctcggcggaca

SEQ ID NO: 111434 - DNA, 25 bp, Mus musculus
gcaaaaataacacggtcctgcggga

SEQ ID NO: 111435 - DNA, 25 bp, Mus musculus
gcaaaaataatcatacccagcctgg

SEQ ID NO: 111436 - DNA, 25 bp, Mus musculus
gcaaaaatcagcagaggctacccgg

SEQ ID NO: 111437 - DNA, 25 bp, Mus musculus
gcaaaaatcctttctaatgggcaca

SEQ ID NO: 111438 - DNA, 25 bp, Mus musculus
gcaaaaatgagcagtctcctgagga

SEQ ID NO: 111439 - DNA, 25 bp, Mus musculus
gcaaaacaatccattaacctcaggt

SEQ ID NO: 111440 - DNA, 25 bp, Mus musculus
gcaaaacaccatccagaatgaagct

SEQ ID NO: 111441 - DNA, 25 bp, Mus musculus
gcaaaaccgcgacttgacacagagc

SEQ ID NO: 111442 - DNA, 25 bp, Mus musculus
gcaaaacgtccagcctaagaagcag

SEQ ID NO: 111443 - DNA, 25 bp, Mus musculus
gcaaaactggtgtcaagcggcgtca

SEQ ID NO: 111444 - DNA, 25 bp, Mus musculus
gcaaaactgttgtcaccgaagctgg

SEQ ID NO: 111445 - DNA, 25 bp, Mus musculus
gcaaaagacgttgggctgcccctgt

SEQ ID NO: 111446 - DNA, 25 bp, Mus musculus
gcaaaagagaggactgacagagacc

SEQ ID NO: 111447 - DNA, 25 bp, Mus musculus
gcaaaagatgccctactgagtattt

SEQ ID NO: 111448 - DNA, 25 bp, Mus musculus
gcaaaagctataaagtggtacccgg

SEQ ID NO: 111449 - DNA, 25 bp, Mus musculus
gcaaaaggaggtagtcaggccaccg

SEQ ID NO: 111450 - DNA, 25 bp, Mus musculus
gcaaaagggctcattctcagaagaa

SEQ ID NO: 111451 - DNA, 25 bp, Mus musculus
gcaaaaggttcagttctcagacgct

SEQ ID NO: 111452 - DNA, 25 bp, Mus musculus
gcaaaagttggttctgtacgagcac

SEQ ID NO: 111453 - DNA, 25 bp, Mus musculus
gcaaaagtttcagcagaggcaaagc

SEQ ID NO: 111454 - DNA, 25 bp, Mus musculus
gcaaaatcccgaatgctggaccaca

SEQ ID NO: 111455 - DNA, 25 bp, Mus musculus
gcaaaatctaactgtacttaaaagc

SEQ ID NO: 111456 - DNA, 25 bp, Mus musculus
gcaaaatgctatggcatcgtaacca

SEQ ID NO: 111457 - DNA, 25 bp, Mus musculus
gcaaaatggttcgtgcctggcatct

SEQ ID NO: 111458 - DNA, 25 bp, Mus musculus
gcaaaattcgttgggcctggtggat

SEQ ID NO: 111459 - DNA, 25 bp, Mus musculus
gcaaacaactaagagagctggcccg

SEQ ID NO: 111460 - DNA, 25 bp, Mus musculus
gcaaacagaccatcgcggcgatctc

SEQ ID NO: 111461 - DNA, 25 bp, Mus musculus
gcaaacagctgacccgaagagaaat

SEQ ID NO: 111462 - DNA, 25 bp, Mus musculus
gcaaacagtcagaagacaagccaat

SEQ ID NO: 111463 - DNA, 25 bp, Mus musculus
gcaaacagttgcttgaacatccaga

SEQ ID NO: 111464 - DNA, 25 bp, Mus musculus
gcaaacatcattcgcgttggagaag

SEQ ID NO: 111465 - DNA, 25 bp, Mus musculus
gcaaacatcttggaccccgggagaa

SEQ ID NO: 111466 - DNA, 25 bp, Mus musculus
gcaaaccaatgccagctacctggag

SEQ ID NO: 111467 - DNA, 25 bp, Mus musculus
gcaaaccactgacttggcccagaga

SEQ ID NO: 111468 - DNA, 25 bp, Mus musculus
gcaaaccaggaatatcaggagccgg

SEQ ID NO: 111469 - DNA, 25 bp, Mus musculus
gcaaacccaggtgcatggatactaa

SEQ ID NO: 111470 - DNA, 25 bp, Mus musculus
gcaaaccccacaacggacagggtag

SEQ ID NO: 111471 - DNA, 25 bp, Mus musculus
gcaaaccctgggaagggcaaagccg

SEQ ID NO: 111472 - DNA, 25 bp, Mus musculus
gcaaacccttgcacatccatggcag

SEQ ID NO: 111473 - DNA, 25 bp, Mus musculus
gcaaaccgagttcctcctgcttctg

SEQ ID NO: 111474 - DNA, 25 bp, Mus musculus
gcaaacctatgaagaatttctgagc

SEQ ID NO: 111475 - DNA, 25 bp, Mus musculus
gcaaacctgggctatcacctcaaga

SEQ ID NO: 111476 - DNA, 25 bp, Mus musculus
gcaaacgtatgccagtcaaggaggt

SEQ ID NO: 111477 - DNA, 25 bp, Mus musculus
gcaaacgttgcttcattaagacatg

SEQ ID NO: 111478 - DNA, 25 bp, Mus musculus
gcaaactacattctcctggcgttct

SEQ ID NO: 111479 - DNA, 25 bp, Mus musculus
gcaaactagctgaagggtccgctgt

SEQ ID NO: 111480 - DNA, 25 bp, Mus musculus
gcaaactatttccagggtgctgatg

SEQ ID NO: 111481 - DNA, 25 bp, Mus musculus
gcaaactcgacattctggcagctgt

SEQ ID NO: 111482 - DNA, 25 bp, Mus musculus
gcaaactctaatggctccaaacctg

SEQ ID NO: 111483 - DNA, 25 bp, Mus musculus
gcaaactctcagaagccccgttaga

SEQ ID NO: 111484 - DNA, 25 bp, Mus musculus
gcaaactggaccaacaggcaaagat

SEQ ID NO: 111485 - DNA, 25 bp, Mus musculus
gcaaactggcactgagcaaggctat

SEQ ID NO: 111486 - DNA, 25 bp, Mus musculus
gcaaactgtcaggacggtaccggcg

SEQ ID NO: 111487 - DNA, 25 bp, Mus musculus
gcaaacttcttcattggaactgtca

SEQ ID NO: 111488 - DNA, 25 bp, Mus musculus
gcaaacttgatctcgctctgaagaa

SEQ ID NO: 111489 - DNA, 25 bp, Mus musculus
gcaaacttgcggttatagcatccaa

SEQ ID NO: 111490 - DNA, 25 bp, Mus musculus
gcaaactttgctttccctggttaag

SEQ ID NO: 111491 - DNA, 25 bp, Mus musculus
gcaaagaagtgcagtggtgtcgctt

SEQ ID NO: 111492 - DNA, 25 bp, Mus musculus
gcaaagaatgcttccacggagctga

SEQ ID NO: 111493 - DNA, 25 bp, Mus musculus
gcaaagacatcagggaaattctcca

SEQ ID NO: 111494 - DNA, 25 bp, Mus musculus
gcaaagacccacttcttgtccagtt

SEQ ID NO: 111495 - DNA, 25 bp, Mus musculus
gcaaagagagttctgctgggacccc

SEQ ID NO: 111496 - DNA, 25 bp, Mus musculus
gcaaagaggctttccatgtacggtg

SEQ ID NO: 111497 - DNA, 25 bp, Mus musculus
gcaaagatatcagcaaaacgtttcg

SEQ ID NO: 111498 - DNA, 25 bp, Mus musculus
gcaaagatcttatggagactgcaag

SEQ ID NO: 111499 - DNA, 25 bp, Mus musculus
gcaaagattgggtcgctacacagct

SEQ ID NO: 111500 - DNA, 25 bp, Mus musculus
gcaaagcaaggatatgaacagttct

SEQ ID NO: 111501 - DNA, 25 bp, Mus musculus
gcaaagcatgagaaacaggccctag

SEQ ID NO: 111502 - DNA, 25 bp, Mus musculus
gcaaagccaaagctgacatccagga

SEQ ID NO: 111503 - DNA, 25 bp, Mus musculus
gcaaagccagccctacgcggtgttg

SEQ ID NO: 111504 - DNA, 25 bp, Mus musculus
gcaaagcccgcggttctaggaagat

SEQ ID NO: 111505 - DNA, 25 bp, Mus musculus
gcaaagcccttcatgagcctggtga

SEQ ID NO: 111506 - DNA, 25 bp, Mus musculus
gcaaagccggcaatgacaagtctga

SEQ ID NO: 111507 - DNA, 25 bp, Mus musculus
gcaaagccgtcgagatgacctagag

SEQ ID NO: 111508 - DNA, 25 bp, Mus musculus
gcaaagccgtgattgtcgtccagga

SEQ ID NO: 111509 - DNA, 25 bp, Mus musculus
gcaaagccgttacattcccacttgg

SEQ ID NO: 111510 - DNA, 25 bp, Mus musculus
gcaaagcctctgagagagtcccaga

SEQ ID NO: 111511 - DNA, 25 bp, Mus musculus
gcaaagccttctggatcttctcgtg

SEQ ID NO: 111512 - DNA, 25 bp, Mus musculus
gcaaagctcagaggaaaaagaggca

SEQ ID NO: 111513 - DNA, 25 bp, Mus musculus
gcaaagctcatcacacagttcaagg

SEQ ID NO: 111514 - DNA, 25 bp, Mus musculus
gcaaaggaagtttggtggctctccc

SEQ ID NO: 111515 - DNA, 25 bp, Mus musculus
gcaaaggcgccctccggcagaagaa

SEQ ID NO: 111516 - DNA, 25 bp, Mus musculus
gcaaaggcggctccggagattcggc

SEQ ID NO: 111517 - DNA, 25 bp, Mus musculus
gcaaaggcttttggcttcaacgtcc

SEQ ID NO: 111518 - DNA, 25 bp, Mus musculus
gcaaagggcaaagaactgaacgaat

SEQ ID NO: 111519 - DNA, 25 bp, Mus musculus
gcaaagggctttgggatgacgctca

SEQ ID NO: 111520 - DNA, 25 bp, Mus musculus
gcaaaggggaactgcggacttactt

SEQ ID NO: 111521 - DNA, 25 bp, Mus musculus
gcaaaggtgtccaagcagaagcaga

SEQ ID NO: 111522 - DNA, 25 bp, Mus musculus
gcaaaggtgttccaagagtcgtcag

SEQ ID NO: 111523 - DNA, 25 bp, Mus musculus
gcaaaggttctgcaacacgcagcct

SEQ ID NO: 111524 - DNA, 25 bp, Mus musculus
gcaaaggtttttcctatgcggctaa

SEQ ID NO: 111525 - DNA, 25 bp, Mus musculus
gcaaagtctgccttttcggtgaaaa

SEQ ID NO: 111526 - DNA, 25 bp, Mus musculus
gcaaagtggacaaacgtagtgaccc

SEQ ID NO: 111527 - DNA, 25 bp, Mus musculus
gcaaagtgtccaagctgtccgaggt

SEQ ID NO: 111528 - DNA, 25 bp, Mus musculus
gcaaagtgtgtcaactgatccatcg

SEQ ID NO: 111529 - DNA, 25 bp, Mus musculus
gcaaagttcaacagtaagagcccct

SEQ ID NO: 111530 - DNA, 25 bp, Mus musculus
gcaaatacaaagtgaagctggtgga

SEQ ID NO: 111531 - DNA, 25 bp, Mus musculus
gcaaatatattcaaccagttcccag

SEQ ID NO: 111532 - DNA, 25 bp, Mus musculus
gcaaatatgccggaaagcggaccaa

SEQ ID NO: 111533 - DNA, 25 bp, Mus musculus
gcaaatcactgcagctgtcagatga

SEQ ID NO: 111534 - DNA, 25 bp, Mus musculus
gcaaatccaacaagatctttgtcgg

SEQ ID NO: 111535 - DNA, 25 bp, Mus musculus
gcaaatcgctggaccacatgcacag

SEQ ID NO: 111536 - DNA, 25 bp, Mus musculus
gcaaatctcagccaacgaagaggca

SEQ ID NO: 111537 - DNA, 25 bp, Mus musculus
gcaaatctgtgatcccagtgctggg

SEQ ID NO: 111538 - DNA, 25 bp, Mus musculus
gcaaatcttatgttccagggagcgt

SEQ ID NO: 111539 - DNA, 25 bp, Mus musculus
gcaaatctttctgccattcaggaac

SEQ ID NO: 111540 - DNA, 25 bp, Mus musculus
gcaaatgaattcactgtacctcagg

SEQ ID NO: 111541 - DNA, 25 bp, Mus musculus
gcaaatgacagctggcacttgggcc

SEQ ID NO: 111542 - DNA, 25 bp, Mus musculus
gcaaatgacctatcggtgagcccca

SEQ ID NO: 111543 - DNA, 25 bp, Mus musculus
gcaaatgcaatgctgccacagggct

SEQ ID NO: 111544 - DNA, 25 bp, Mus musculus
gcaaatgccaacatcgtgtctgagg

SEQ ID NO: 111545 - DNA, 25 bp, Mus musculus
gcaaatgccgagataagagagcaga

SEQ ID NO: 111546 - DNA, 25 bp, Mus musculus
gcaaatgctggacttcgcaggccta

SEQ ID NO: 111547 - DNA, 25 bp, Mus musculus
gcaaatgctgtttcccctcactgat

SEQ ID NO: 111548 - DNA, 25 bp, Mus musculus
gcaaatgggtggcttcatcagcaga

SEQ ID NO: 111549 - DNA, 25 bp, Mus musculus
gcaaattcacctgcaccagcggtaa

SEQ ID NO: 111550 - DNA, 25 bp, Mus musculus
gcaaattcttatggccagttgggca

SEQ ID NO: 111551 - DNA, 25 bp, Mus musculus
gcaacaaatctggtacggcgcctct

SEQ ID NO: 111552 - DNA, 25 bp, Mus musculus
gcaacaacaggaaggctagggtcct

SEQ ID NO: 111553 - DNA, 25 bp, Mus musculus
gcaacaacattgtagactgccgagg

SEQ ID NO: 111554 - DNA, 25 bp, Mus musculus
gcaacaaccaacaacaccaaagaag

SEQ ID NO: 111555 - DNA, 25 bp, Mus musculus
gcaacaacttgagcgggaacgatga

SEQ ID NO: 111556 - DNA, 25 bp, Mus musculus
gcaacaagactttgaaaacgagctg

SEQ ID NO: 111557 - DNA, 25 bp, Mus musculus
gcaacaagttcatgactggccagaa

SEQ ID NO: 111558 - DNA, 25 bp, Mus musculus
gcaacaagttcatgcacctgaccaa

SEQ ID NO: 111559 - DNA, 25 bp, Mus musculus
gcaacaatacttcccatggagccaa

SEQ ID NO: 111560 - DNA, 25 bp, Mus musculus
gcaacaatcgatcttccttcaggag

SEQ ID NO: 111561 - DNA, 25 bp, Mus musculus
gcaacaatgtatgcgtataaacaaa

SEQ ID NO: 111562 - DNA, 25 bp, Mus musculus
gcaacacaaacacaggcttcctagg

SEQ ID NO: 111563 - DNA, 25 bp, Mus musculus
gcaacacagtgagtgagacgtcagc

SEQ ID NO: 111564 - DNA, 25 bp, Mus musculus
gcaacaccccgctgaacttggagca

SEQ ID NO: 111565 - DNA, 25 bp, Mus musculus
gcaacaccctgactatgcagaatat

SEQ ID NO: 111566 - DNA, 25 bp, Mus musculus
gcaacaccttcgtatacagcagcag

SEQ ID NO: 111567 - DNA, 25 bp, Mus musculus
gcaacacgggcgagatcaaagcact

SEQ ID NO: 111568 - DNA, 25 bp, Mus musculus
gcaacacgtagaggcaggctctgaa

SEQ ID NO: 111569 - DNA, 25 bp, Mus musculus
gcaacactggtcctgcagggagctt

SEQ ID NO: 111570 - DNA, 25 bp, Mus musculus
gcaacagactgcgatgggaaaatct

SEQ ID NO: 111571 - DNA, 25 bp, Mus musculus
gcaacagcacagactacatcgccat

SEQ ID NO: 111572 - DNA, 25 bp, Mus musculus
gcaacagcagtactaggagagacct

SEQ ID NO: 111573 - DNA, 25 bp, Mus musculus
gcaacagcagtggaagtgtgtttca

SEQ ID NO: 111574 - DNA, 25 bp, Mus musculus
gcaacagcatacatgacacccagta

SEQ ID NO: 111575 - DNA, 25 bp, Mus musculus
gcaacagctggacctttaaatacgg

SEQ ID NO: 111576 - DNA, 25 bp, Mus musculus
gcaacaggtcttggcactggaggct

SEQ ID NO: 111577 - DNA, 25 bp, Mus musculus
gcaacagtacaagcctgcaggaagg

SEQ ID NO: 111578 - DNA, 25 bp, Mus musculus
gcaacagtagttgctgcggctgcca

SEQ ID NO: 111579 - DNA, 25 bp, Mus musculus
gcaacagttctgtgagccccaatgt

SEQ ID NO: 111580 - DNA, 25 bp, Mus musculus
gcaacagtttgcttgacggcctaga

SEQ ID NO: 111581 - DNA, 25 bp, Mus musculus
gcaacatcatcttactcctgggagg

SEQ ID NO: 111582 - DNA, 25 bp, Mus musculus
gcaacatcatggagggcaagtccgt

SEQ ID NO: 111583 - DNA, 25 bp, Mus musculus
gcaacatccaggttcagaagctgct

SEQ ID NO: 111584 - DNA, 25 bp, Mus musculus
gcaacatccctggaagtgtccgaga

SEQ ID NO: 111585 - DNA, 25 bp, Mus musculus
gcaacatccggcctgtcaagagaga

SEQ ID NO: 111586 - DNA, 25 bp, Mus musculus
gcaacatctcatgattggcaccgat

SEQ ID NO: 111587 - DNA, 25 bp, Mus musculus
gcaacatgggcagccttttcgggcg

SEQ ID NO: 111588 - DNA, 25 bp, Mus musculus
gcaaccagagcatcttttccgagga

SEQ ID NO: 111589 - DNA, 25 bp, Mus musculus
gcaaccatgagcagcaatgcaacag

SEQ ID NO: 111590 - DNA, 25 bp, Mus musculus
gcaacccagcaagtaatggactgcg

SEQ ID NO: 111591 - DNA, 25 bp, Mus musculus
gcaacccagcctgagtatctggtct

SEQ ID NO: 111592 - DNA, 25 bp, Mus musculus
gcaaccccgggatacacaatggcat

SEQ ID NO: 111593 - DNA, 25 bp, Mus musculus
gcaaccctgagaataacgtgggcct

SEQ ID NO: 111594 - DNA, 25 bp, Mus musculus
gcaaccctggacgatcttctggaca

SEQ ID NO: 111595 - DNA, 25 bp, Mus musculus
gcaaccgcaacgtcttcatgaagga

SEQ ID NO: 111596 - DNA, 25 bp, Mus musculus
gcaaccgggaagaggtgtaccagat

SEQ ID NO: 111597 - DNA, 25 bp, Mus musculus
gcaaccgggtggagcttctggtttt

SEQ ID NO: 111598 - DNA, 25 bp, Mus musculus
gcaacctacagcatctcaagtggaa

SEQ ID NO: 111599 - DNA, 25 bp, Mus musculus
gcaacctcagaacagggatgctttt

SEQ ID NO: 111600 - DNA, 25 bp, Mus musculus
gcaacctcgcagtggccatgtgcag

SEQ ID NO: 111601 - DNA, 25 bp, Mus musculus
gcaacctgcacttggatgggaagag

SEQ ID NO: 111602 - DNA, 25 bp, Mus musculus
gcaacctgctagtgctgcggctgtg

SEQ ID NO: 111603 - DNA, 25 bp, Mus musculus
gcaacctggctagcgaaaagcaaca

SEQ ID NO: 111604 - DNA, 25 bp, Mus musculus
gcaacctgggcaatattgctgtaga

SEQ ID NO: 111605 - DNA, 25 bp, Mus musculus
gcaacctgttatagtgcccatgtat

SEQ ID NO: 111606 - DNA, 25 bp, Mus musculus
gcaaccttttgtggcagggagacca

SEQ ID NO: 111607 - DNA, 25 bp, Mus musculus
gcaacgaaagcattgcctactttct

SEQ ID NO: 111608 - DNA, 25 bp, Mus musculus
gcaacgaactgctcctgctgacatc

SEQ ID NO: 111609 - DNA, 25 bp, Mus musculus
gcaacgacttttccagcgcggagaa

SEQ ID NO: 111610 - DNA, 25 bp, Mus musculus
gcaacgagaagctcttctaccgggt

SEQ ID NO: 111611 - DNA, 25 bp, Mus musculus
gcaacgccaacgctgtactgcagat

SEQ ID NO: 111612 - DNA, 25 bp, Mus musculus
gcaacgccatggtgatgacacagta

SEQ ID NO: 111613 - DNA, 25 bp, Mus musculus
gcaacgccgccgttttcttgccggg

SEQ ID NO: 111614 - DNA, 25 bp, Mus musculus
gcaacgccttggcaaagcatcagga

SEQ ID NO: 111615 - DNA, 25 bp, Mus musculus
gcaacgggaagataaacgggagcac

SEQ ID NO: 111616 - DNA, 25 bp, Mus musculus
gcaacgggcaccatggaaaaatcca

SEQ ID NO: 111617 - DNA, 25 bp, Mus musculus
gcaacgggcactatgctgtttgcca

SEQ ID NO: 111618 - DNA, 25 bp, Mus musculus
gcaacgggcccttcgtgagtacaat

SEQ ID NO: 111619 - DNA, 25 bp, Mus musculus
gcaacgggtcggtgtttggcatcca

SEQ ID NO: 111620 - DNA, 25 bp, Mus musculus
gcaacggtctctcccagtgtctgct

SEQ ID NO: 111621 - DNA, 25 bp, Mus musculus
gcaacgtacgtcaaacagcagtggt

SEQ ID NO: 111622 - DNA, 25 bp, Mus musculus
gcaacgtcgtcaactatgtccagca

SEQ ID NO: 111623 - DNA, 25 bp, Mus musculus
gcaacgttttcggttggctggaaca

SEQ ID NO: 111624 - DNA, 25 bp, Mus musculus
gcaactaccgggaactgcgctggtt

SEQ ID NO: 111625 - DNA, 25 bp, Mus musculus
gcaactaggaacaatgaggtccctt

SEQ ID NO: 111626 - DNA, 25 bp, Mus musculus
gcaactataagaagaggaagcgctc

SEQ ID NO: 111627 - DNA, 25 bp, Mus musculus
gcaactattggcctgatccggaacc

SEQ ID NO: 111628 - DNA, 25 bp, Mus musculus
gcaactcaggcagattcaagaagag

SEQ ID NO: 111629 - DNA, 25 bp, Mus musculus
gcaactcagtgtatgcgggcacagt

SEQ ID NO: 111630 - DNA, 25 bp, Mus musculus
gcaactccgaagatgccctggaagt

SEQ ID NO: 111631 - DNA, 25 bp, Mus musculus
gcaactccgccatggtgaagtcgaa

SEQ ID NO: 111632 - DNA, 25 bp, Mus musculus
gcaactctactactacaaggacgaa

SEQ ID NO: 111633 - DNA, 25 bp, Mus musculus
gcaactctctacgagctagctcggg

SEQ ID NO: 111634 - DNA, 25 bp, Mus musculus
gcaactctgatgtggacttcctgaa

SEQ ID NO: 111635 - DNA, 25 bp, Mus musculus
gcaactcttaaggactctgggcatc

SEQ ID NO: 111636 - DNA, 25 bp, Mus musculus
gcaactcttctatgtgggccactcg

SEQ ID NO: 111637 - DNA, 25 bp, Mus musculus
gcaactgaccctaaaggttttgtca

SEQ ID NO: 111638 - DNA, 25 bp, Mus musculus
gcaactgagctattaaaggcagccc

SEQ ID NO: 111639 - DNA, 25 bp, Mus musculus
gcaactggcccacaaatacttcgag

SEQ ID NO: 111640 - DNA, 25 bp, Mus musculus
gcaactggttctgcttggatggaca

SEQ ID NO: 111641 - DNA, 25 bp, Mus musculus
gcaactgtcggtttcgtgacatcgt

SEQ ID NO: 111642 - DNA, 25 bp, Mus musculus
gcaacttatctgctacccacatcga

SEQ ID NO: 111643 - DNA, 25 bp, Mus musculus
gcaacttcctcgagatcgacgtgag

SEQ ID NO: 111644 - DNA, 25 bp, Mus musculus
gcaactttgaaggaaagcgatacct

SEQ ID NO: 111645 - DNA, 25 bp, Mus musculus
gcaactttgctaaactctccagata

SEQ ID NO: 111646 - DNA, 25 bp, Mus musculus
gcaagaaaacagttcgccgtccagg

SEQ ID NO: 111647 - DNA, 25 bp, Mus musculus
gcaagaaagtcattccatcgctggg

SEQ ID NO: 111648 - DNA, 25 bp, Mus musculus
gcaagaaatattggtggagccagag

SEQ ID NO: 111649 - DNA, 25 bp, Mus musculus
gcaagaacacctatgtgccgggcga

SEQ ID NO: 111650 - DNA, 25 bp, Mus musculus
gcaagaacatcatggcagggccaca

SEQ ID NO: 111651 - DNA, 25 bp, Mus musculus
gcaagaactacgtacgcgtcgtgag

SEQ ID NO: 111652 - DNA, 25 bp, Mus musculus
gcaagaacttgttgctcccacaggg

SEQ ID NO: 111653 - DNA, 25 bp, Mus musculus
gcaagaaggccggtgccacagccaa

SEQ ID NO: 111654 - DNA, 25 bp, Mus musculus
gcaagaaggccgtgctctctgacat

SEQ ID NO: 111655 - DNA, 25 bp, Mus musculus
gcaagaaggcctttaagaagcacca

SEQ ID NO: 111656 - DNA, 25 bp, Mus musculus
gcaagaaggcgaagatcatctctgc

SEQ ID NO: 111657 - DNA, 25 bp, Mus musculus
gcaagaagtggaaggaaatcctgaa

SEQ ID NO: 111658 - DNA, 25 bp, Mus musculus
gcaagaatatgaaccccttccctgg

SEQ ID NO: 111659 - DNA, 25 bp, Mus musculus
gcaagaatcccgatgtggacacgag

SEQ ID NO: 111660 - DNA, 25 bp, Mus musculus
gcaagaatgcggagctcaaacaaca

SEQ ID NO: 111661 - DNA, 25 bp, Mus musculus
gcaagaatgcttgtggctccgacta

SEQ ID NO: 111662 - DNA, 25 bp, Mus musculus
gcaagaattcagttccggctgcctg

SEQ ID NO: 111663 - DNA, 25 bp, Mus musculus
gcaagaattccccaccgagtagaag

SEQ ID NO: 111664 - DNA, 25 bp, Mus musculus
gcaagacactgtagagatcaccact

SEQ ID NO: 111665 - DNA, 25 bp, Mus musculus
gcaagacagtgactcttggcaaaga

SEQ ID NO: 111666 - DNA, 25 bp, Mus musculus
gcaagacatgtatcaactggccgag

SEQ ID NO: 111667 - DNA, 25 bp, Mus musculus
gcaagaccagttccctgcagctgag

SEQ ID NO: 111668 - DNA, 25 bp, Mus musculus
gcaagaccggctgaagcgccgggag

SEQ ID NO: 111669 - DNA, 25 bp, Mus musculus
gcaagaccgtgagcattgtggagcc

SEQ ID NO: 111670 - DNA, 25 bp, Mus musculus
gcaagacctactcttctagagcaag

SEQ ID NO: 111671 - DNA, 25 bp, Mus musculus
gcaagacctttacatatcccctgga

SEQ ID NO: 111672 - DNA, 25 bp, Mus musculus
gcaagactctcaatgccagtgacgt

SEQ ID NO: 111673 - DNA, 25 bp, Mus musculus
gcaagactgactctaagaccgaaag

SEQ ID NO: 111674 - DNA, 25 bp, Mus musculus
gcaagacttcaagcagtggaggaag

SEQ ID NO: 111675 - DNA, 25 bp, Mus musculus
gcaagacttgtcatgacactcccat

SEQ ID NO: 111676 - DNA, 25 bp, Mus musculus
gcaagagactccagactgtggtaca

SEQ ID NO: 111677 - DNA, 25 bp, Mus musculus
gcaagagactgtttgtcgtcaagcc

SEQ ID NO: 111678 - DNA, 25 bp, Mus musculus
gcaagagattcttccgagaggcgct

SEQ ID NO: 111679 - DNA, 25 bp, Mus musculus
gcaagagcagaccatgggcacgttc

SEQ ID NO: 111680 - DNA, 25 bp, Mus musculus
gcaagagctgcctggttgcccggat

SEQ ID NO: 111681 - DNA, 25 bp, Mus musculus
gcaagagctgctgcctcgctatgaa

SEQ ID NO: 111682 - DNA, 25 bp, Mus musculus
gcaagagcttgattgtaacctccag

SEQ ID NO: 111683 - DNA, 25 bp, Mus musculus
gcaagaggctttagcagctgctcgt

SEQ ID NO: 111684 - DNA, 25 bp, Mus musculus
gcaagagggttgtactactcggcct

SEQ ID NO: 111685 - DNA, 25 bp, Mus musculus
gcaagagtcccagctttctactatg

SEQ ID NO: 111686 - DNA, 25 bp, Mus musculus
gcaagagttcatacggatccggcct

SEQ ID NO: 111687 - DNA, 25 bp, Mus musculus
gcaagataaagaatggcggccacac

SEQ ID NO: 111688 - DNA, 25 bp, Mus musculus
gcaagatctgtatgtccgcctcata

SEQ ID NO: 111689 - DNA, 25 bp, Mus musculus
gcaagatgactgttaatggcgctcc

SEQ ID NO: 111690 - DNA, 25 bp, Mus musculus
gcaagatgatcgtgacccagctgtc

SEQ ID NO: 111691 - DNA, 25 bp, Mus musculus
gcaagatgcaaaggcgcaaggcgac

SEQ ID NO: 111692 - DNA, 25 bp, Mus musculus
gcaagatgccttttggtcagctgat

SEQ ID NO: 111693 - DNA, 25 bp, Mus musculus
gcaagatgctggatgggtcccttct

SEQ ID NO: 111694 - DNA, 25 bp, Mus musculus
gcaagatggcggacttcctgccgtc

SEQ ID NO: 111695 - DNA, 25 bp, Mus musculus
gcaagatgtacaccaagagcagcca

SEQ ID NO: 111696 - DNA, 25 bp, Mus musculus
gcaagattgcaagggtccctcggct

SEQ ID NO: 111697 - DNA, 25 bp, Mus musculus
gcaagattgcctgtctctccagaag

SEQ ID NO: 111698 - DNA, 25 bp, Mus musculus
gcaagcaaagtagtcggcatagtaa

SEQ ID NO: 111699 - DNA, 25 bp, Mus musculus
gcaagcaaggagagcattgatgccc

SEQ ID NO: 111700 - DNA, 25 bp, Mus musculus
gcaagcaaggctattcccaggaaac

SEQ ID NO: 111701 - DNA, 25 bp, Mus musculus
gcaagcacatcaaagtcaggtctct

SEQ ID NO: 111702 - DNA, 25 bp, Mus musculus
gcaagcacggcatgcaaaagactga

SEQ ID NO: 111703 - DNA, 25 bp, Mus musculus
gcaagcactaaagtactgtcctgag

SEQ ID NO: 111704 - DNA, 25 bp, Mus musculus
gcaagcagcctacaccaaacgtgat

SEQ ID NO: 111705 - DNA, 25 bp, Mus musculus
gcaagcagcttacagtttttatacg

SEQ ID NO: 111706 - DNA, 25 bp, Mus musculus
gcaagcaggccgtcacggtttccta

SEQ ID NO: 111707 - DNA, 25 bp, Mus musculus
gcaagcaggctacccttaggaccat

SEQ ID NO: 111708 - DNA, 25 bp, Mus musculus
gcaagcagtccaagcggcgttctaa

SEQ ID NO: 111709 - DNA, 25 bp, Mus musculus
gcaagccacgattgagtcgttgaag

SEQ ID NO: 111710 - DNA, 25 bp, Mus musculus
gcaagccaggagagtatgtcctcaa

SEQ ID NO: 111711 - DNA, 25 bp, Mus musculus
gcaagcccaacactttctggagaag

SEQ ID NO: 111712 - DNA, 25 bp, Mus musculus
gcaagcccactaattgtgaatcact

SEQ ID NO: 111713 - DNA, 25 bp, Mus musculus
gcaagccccgcttctgagtgcgctg

SEQ ID NO: 111714 - DNA, 25 bp, Mus musculus
gcaagccctggtttgcagcaagaga

SEQ ID NO: 111715 - DNA, 25 bp, Mus musculus
gcaagcccttgaagcaaaaatcctt

SEQ ID NO: 111716 - DNA, 25 bp, Mus musculus
gcaagccctttgaccccgtgtttat

SEQ ID NO: 111717 - DNA, 25 bp, Mus musculus
gcaagccgagggagacatcagctgt

SEQ ID NO: 111718 - DNA, 25 bp, Mus musculus
gcaagccggcaagtggatatcgcga

SEQ ID NO: 111719 - DNA, 25 bp, Mus musculus
gcaagcctcgctcagtacaaggagt

SEQ ID NO: 111720 - DNA, 25 bp, Mus musculus
gcaagcgccagtatcagactccaat

SEQ ID NO: 111721 - DNA, 25 bp, Mus musculus
gcaagcggacacttctggccaagaa

SEQ ID NO: 111722 - DNA, 25 bp, Mus musculus
gcaagcggtctcctaagtcccgaga

SEQ ID NO: 111723 - DNA, 25 bp, Mus musculus
gcaagcgtgtgtgactgagcctaca

SEQ ID NO: 111724 - DNA, 25 bp, Mus musculus
gcaagctgaagaccgatgcaagcag

SEQ ID NO: 111725 - DNA, 25 bp, Mus musculus
gcaagctgagacgagtttgagaaga

SEQ ID NO: 111726 - DNA, 25 bp, Mus musculus
gcaagctgcctgctgatagacccag

SEQ ID NO: 111727 - DNA, 25 bp, Mus musculus
gcaagctgctctcggaagatccaga

SEQ ID NO: 111728 - DNA, 25 bp, Mus musculus
gcaagctgcttgaatgactgagcga

SEQ ID NO: 111729 - DNA, 25 bp, Mus musculus
gcaagctgtacagttcataaccaaa

SEQ ID NO: 111730 - DNA, 25 bp, Mus musculus
gcaagcttgacgagaagggctccct

SEQ ID NO: 111731 - DNA, 25 bp, Mus musculus
gcaagcttgtgatgagcgctcagca

SEQ ID NO: 111732 - DNA, 25 bp, Mus musculus
gcaaggaagcaggacgcatgtgcta

SEQ ID NO: 111733 - DNA, 25 bp, Mus musculus
gcaaggacaagaacatggcacccct

SEQ ID NO: 111734 - DNA, 25 bp, Mus musculus
gcaaggaccaatccgtctgttcatg

SEQ ID NO: 111735 - DNA, 25 bp, Mus musculus
gcaaggagcaccagaagaacagcag

SEQ ID NO: 111736 - DNA, 25 bp, Mus musculus
gcaaggagtacctgatgcgggccca

SEQ ID NO: 111737 - DNA, 25 bp, Mus musculus
gcaaggcagaggaagtcctttctct

SEQ ID NO: 111738 - DNA, 25 bp, Mus musculus
gcaaggcatccctgggaaaactggc

SEQ ID NO: 111739 - DNA, 25 bp, Mus musculus
gcaaggcattgcatggtgcaggcca

SEQ ID NO: 111740 - DNA, 25 bp, Mus musculus
gcaaggccgcagacaagatgaacat

SEQ ID NO: 111741 - DNA, 25 bp, Mus musculus
gcaaggcgagctcagacctcgtcag

SEQ ID NO: 111742 - DNA, 25 bp, Mus musculus
gcaaggcgaggcgagagctgcacag

SEQ ID NO: 111743 - DNA, 25 bp, Mus musculus
gcaaggctcacactagctaccgggt

SEQ ID NO: 111744 - DNA, 25 bp, Mus musculus
gcaaggctgtccattcgctatcccg

SEQ ID NO: 111745 - DNA, 25 bp, Mus musculus
gcaaggcttttaccgccaagacgtc

SEQ ID NO: 111746 - DNA, 25 bp, Mus musculus
gcaagggactagaataagagatgac

SEQ ID NO: 111747 - DNA, 25 bp, Mus musculus
gcaagggccgaacacacttttccag

SEQ ID NO: 111748 - DNA, 25 bp, Mus musculus
gcaagggcggctgggaccatggaga

SEQ ID NO: 111749 - DNA, 25 bp, Mus musculus
gcaaggggccatcctggtgtacaat

SEQ ID NO: 111750 - DNA, 25 bp, Mus musculus
gcaagggtctcctagacgctcagtc

SEQ ID NO: 111751 - DNA, 25 bp, Mus musculus
gcaaggtactgcaggaggacactct

SEQ ID NO: 111752 - DNA, 25 bp, Mus musculus
gcaaggtcacctcaagcggaaacga

SEQ ID NO: 111753 - DNA, 25 bp, Mus musculus
gcaaggttcgatagtggcagatcac

SEQ ID NO: 111754 - DNA, 25 bp, Mus musculus
gcaaggttcgctaccgaagggcagc

SEQ ID NO: 111755 - DNA, 25 bp, Mus musculus
gcaagtagctttgttggccgtggac

SEQ ID NO: 111756 - DNA, 25 bp, Mus musculus
gcaagtatcggtcaacaggcaaaca

SEQ ID NO: 111757 - DNA, 25 bp, Mus musculus
gcaagtatgtggtggtatccacgcc

SEQ ID NO: 111758 - DNA, 25 bp, Mus musculus
gcaagtattctcctcattcggaaga

SEQ ID NO: 111759 - DNA, 25 bp, Mus musculus
gcaagtcaatcctcaagtctcgcag

SEQ ID NO: 111760 - DNA, 25 bp, Mus musculus
gcaagtcacgatagatgccatccga

SEQ ID NO: 111761 - DNA, 25 bp, Mus musculus
gcaagtcatcacatccaagcagagg

SEQ ID NO: 111762 - DNA, 25 bp, Mus musculus
gcaagtcattctcctgcacctggag

SEQ ID NO: 111763 - DNA, 25 bp, Mus musculus
gcaagtccagcaccctagaggtaaa

SEQ ID NO: 111764 - DNA, 25 bp, Mus musculus
gcaagtccatccctcataactgcta

SEQ ID NO: 111765 - DNA, 25 bp, Mus musculus
gcaagtcgtcatgattctgtggtgg

SEQ ID NO: 111766 - DNA, 25 bp, Mus musculus
gcaagtctactccaacaaacctggg

SEQ ID NO: 111767 - DNA, 25 bp, Mus musculus
gcaagtctatgcgtcagtctacagc

SEQ ID NO: 111768 - DNA, 25 bp, Mus musculus
gcaagtctcaacctgatgggatcct

SEQ ID NO: 111769 - DNA, 25 bp, Mus musculus
gcaagtctcttaagcccatggtgtt

SEQ ID NO: 111770 - DNA, 25 bp, Mus musculus
gcaagtctggatgtctatgccaagt

SEQ ID NO: 111771 - DNA, 25 bp, Mus musculus
gcaagtcttgattcagagaatatag

SEQ ID NO: 111772 - DNA, 25 bp, Mus musculus
gcaagtcttgccatgaaatactcag

SEQ ID NO: 111773 - DNA, 25 bp, Mus musculus
gcaagtgaccctgctaaggcctgtt

SEQ ID NO: 111774 - DNA, 25 bp, Mus musculus
gcaagtgattcaacagaacccagcg

SEQ ID NO: 111775 - DNA, 25 bp, Mus musculus
gcaagtgcaacagcccagcatgtgt

SEQ ID NO: 111776 - DNA, 25 bp, Mus musculus
gcaagtgcgaatgcagccccggctg

SEQ ID NO: 111777 - DNA, 25 bp, Mus musculus
gcaagtggacacagctacaccaagt

SEQ ID NO: 111778 - DNA, 25 bp, Mus musculus
gcaagtggatcattcgactccggaa

SEQ ID NO: 111779 - DNA, 25 bp, Mus musculus
gcaagtgtacacagggaccaacgga

SEQ ID NO: 111780 - DNA, 25 bp, Mus musculus
gcaagtgtggtagctatcgacaaca

SEQ ID NO: 111781 - DNA, 25 bp, Mus musculus
gcaagttagatattctataccggag

SEQ ID NO: 111782 - DNA, 25 bp, Mus musculus
gcaagttcacatctatccgtcggac

SEQ ID NO: 111783 - DNA, 25 bp, Mus musculus
gcaagttcgatgtcaggcggttcac

SEQ ID NO: 111784 - DNA, 25 bp, Mus musculus
gcaagttcgcgccactccgcgggta

SEQ ID NO: 111785 - DNA, 25 bp, Mus musculus
gcaagttcgttcagttcatccacaa

SEQ ID NO: 111786 - DNA, 25 bp, Mus musculus
gcaagtttcgtcacctgcaaaggga

SEQ ID NO: 111787 - DNA, 25 bp, Mus musculus
gcaagtttttccgtagcgtagcgct

SEQ ID NO: 111788 - DNA, 25 bp, Mus musculus
gcaataagatgtacgttcacccaga

SEQ ID NO: 111789 - DNA, 25 bp, Mus musculus
gcaatacaatatatagccggcaaga

SEQ ID NO: 111790 - DNA, 25 bp, Mus musculus
gcaatactctttcttctaaggatca

SEQ ID NO: 111791 - DNA, 25 bp, Mus musculus
gcaatagaatgttcccgggctctca

SEQ ID NO: 111792 - DNA, 25 bp, Mus musculus
gcaatagacttttctccggaggagt

SEQ ID NO: 111793 - DNA, 25 bp, Mus musculus
gcaatatcgaatgggccagctgcac

SEQ ID NO: 111794 - DNA, 25 bp, Mus musculus
gcaatattcaaaccagagaccctgg

SEQ ID NO: 111795 - DNA, 25 bp, Mus musculus
gcaatcaaacagatacacgagcagt

SEQ ID NO: 111796 - DNA, 25 bp, Mus musculus
gcaatcacatcaagctgtcgggcag

SEQ ID NO: 111797 - DNA, 25 bp, Mus musculus
gcaatcagtgtagcttcgcctccaa

SEQ ID NO: 111798 - DNA, 25 bp, Mus musculus
gcaatcattggtgacatcaacacgg

SEQ ID NO: 111799 - DNA, 25 bp, Mus musculus
gcaatcctcctgtttggctccaact

SEQ ID NO: 111800 - DNA, 25 bp, Mus musculus
gcaatcctgatggtgatctcctcca

SEQ ID NO: 111801 - DNA, 25 bp, Mus musculus
gcaatcgctgaatcctttctctcca

SEQ ID NO: 111802 - DNA, 25 bp, Mus musculus
gcaatctagttgtttgtgccacagc

SEQ ID NO: 111803 - DNA, 25 bp, Mus musculus
gcaatctgaaatgacctggacaagg

SEQ ID NO: 111804 - DNA, 25 bp, Mus musculus
gcaatgaaagttgtaaaaagtgccc

SEQ ID NO: 111805 - DNA, 25 bp, Mus musculus
gcaatgaacatcgagctgaccagga

SEQ ID NO: 111806 - DNA, 25 bp, Mus musculus
gcaatgaagaggactatgacccaaa

SEQ ID NO: 111807 - DNA, 25 bp, Mus musculus
gcaatgaagtgtactctctggtgta

SEQ ID NO: 111808 - DNA, 25 bp, Mus musculus
gcaatgaatgcagccaggatgagag

SEQ ID NO: 111809 - DNA, 25 bp, Mus musculus
gcaatgacaccttctactcactggg

SEQ ID NO: 111810 - DNA, 25 bp, Mus musculus
gcaatgactgtaatggacgatccac

SEQ ID NO: 111811 - DNA, 25 bp, Mus musculus
gcaatgactgtcctaagccaaacgt

SEQ ID NO: 111812 - DNA, 25 bp, Mus musculus
gcaatgagtctggtaagacacccct

SEQ ID NO: 111813 - DNA, 25 bp, Mus musculus
gcaatgagttcacgctgggctccaa

SEQ ID NO: 111814 - DNA, 25 bp, Mus musculus
gcaatgattacttcagagttaccag

SEQ ID NO: 111815 - DNA, 25 bp, Mus musculus
gcaatgcacacaaacctccaggaag

SEQ ID NO: 111816 - DNA, 25 bp, Mus musculus
gcaatgcacctgtagctagcgggcg

SEQ ID NO: 111817 - DNA, 25 bp, Mus musculus
gcaatgcaggaatatatcgcggcag

SEQ ID NO: 111818 - DNA, 25 bp, Mus musculus
gcaatgcagtatggcttctttaatt

SEQ ID NO: 111819 - DNA, 25 bp, Mus musculus
gcaatgcatgcggtctctacagcaa

SEQ ID NO: 111820 - DNA, 25 bp, Mus musculus
gcaatgccaccattatcaatgaaga

SEQ ID NO: 111821 - DNA, 25 bp, Mus musculus
gcaatgcctgcggactctaccataa

SEQ ID NO: 111822 - DNA, 25 bp, Mus musculus
gcaatgctcacccacgggaacgtgg

SEQ ID NO: 111823 - DNA, 25 bp, Mus musculus
gcaatgctgacgactttcaatgagg

SEQ ID NO: 111824 - DNA, 25 bp, Mus musculus
gcaatgctttcccaggactccttcg

SEQ ID NO: 111825 - DNA, 25 bp, Mus musculus
gcaatggagactttgagtcctacac

SEQ ID NO: 111826 - DNA, 25 bp, Mus musculus
gcaatggagtcttctggtagtctct

SEQ ID NO: 111827 - DNA, 25 bp, Mus musculus
gcaatggatgtgatgaagccccgga

SEQ ID NO: 111828 - DNA, 25 bp, Mus musculus
gcaatggcttagctccagaggcaat

SEQ ID NO: 111829 - DNA, 25 bp, Mus musculus
gcaatgggccttgtaccaaaggacc

SEQ ID NO: 111830 - DNA, 25 bp, Mus musculus
gcaatgggtctctcccctgcatgga

SEQ ID NO: 111831 - DNA, 25 bp, Mus musculus
gcaatggtcgcactgctggtcacca

SEQ ID NO: 111832 - DNA, 25 bp, Mus musculus
gcaatgtacctttgcagataaaagg

SEQ ID NO: 111833 - DNA, 25 bp, Mus musculus
gcaatgtcttgccagatgctacgag

SEQ ID NO: 111834 - DNA, 25 bp, Mus musculus
gcaatgtgaagacccagcctgcagt

SEQ ID NO: 111835 - DNA, 25 bp, Mus musculus
gcaatgtgacgcctccaaacccagg

SEQ ID NO: 111836 - DNA, 25 bp, Mus musculus
gcaatgtgagaaattaaagataccc

SEQ ID NO: 111837 - DNA, 25 bp, Mus musculus
gcaatgttcccacatgtatcctgaa

SEQ ID NO: 111838 - DNA, 25 bp, Mus musculus
gcaattcaaatgagtctctccagaa

SEQ ID NO: 111839 - DNA, 25 bp, Mus musculus
gcaattcaagtgtctggaagcagag

SEQ ID NO: 111840 - DNA, 25 bp, Mus musculus
gcaattcgcccagtgtaaaataaac

SEQ ID NO: 111841 - DNA, 25 bp, Mus musculus
gcaattgcagaactggacacgctga

SEQ ID NO: 111842 - DNA, 25 bp, Mus musculus
gcaattgcctgcacaagacggccgt

SEQ ID NO: 111843 - DNA, 25 bp, Mus musculus
gcaattgctacagccactaggttgg

SEQ ID NO: 111844 - DNA, 25 bp, Mus musculus
gcaattgtctttccagtccagaaca

SEQ ID NO: 111845 - DNA, 25 bp, Mus musculus
gcaatttgatgagcagaccctgaag

SEQ ID NO: 111846 - DNA, 25 bp, Mus musculus
gcaatttgatgggtagagcagccaa

SEQ ID NO: 111847 - DNA, 25 bp, Mus musculus
gcaatttttgtcactgaccgtcacc

SEQ ID NO: 111848 - DNA, 25 bp, Mus musculus
gcacaaagcacaagattgacaagag

SEQ ID NO: 111849 - DNA, 25 bp, Mus musculus
gcacaaaggctatgcttttgtccag

SEQ ID NO: 111850 - DNA, 25 bp, Mus musculus
gcacaaagggacagagcaaggctgc

SEQ ID NO: 111851 - DNA, 25 bp, Mus musculus
gcacaaattacttcataccggagag

SEQ ID NO: 111852 - DNA, 25 bp, Mus musculus
gcacaaatttgcacacagtggcctg

SEQ ID NO: 111853 - DNA, 25 bp, Mus musculus
gcacaacaatcagatggcaccaggg

SEQ ID NO: 111854 - DNA, 25 bp, Mus musculus
gcacaacacaacctgaagatcttgg

SEQ ID NO: 111855 - DNA, 25 bp, Mus musculus
gcacaacatacggaaaagcaagcgt

SEQ ID NO: 111856 - DNA, 25 bp, Mus musculus
gcacaactgaagaggtagtccgagg

SEQ ID NO: 111857 - DNA, 25 bp, Mus musculus
gcacaactgtccatatgattacaaa

SEQ ID NO: 111858 - DNA, 25 bp, Mus musculus
gcacaagcacctgtagggaccagtt

SEQ ID NO: 111859 - DNA, 25 bp, Mus musculus
gcacaagccagattgagaaatttca

SEQ ID NO: 111860 - DNA, 25 bp, Mus musculus
gcacaagcccacagattttgagaag

SEQ ID NO: 111861 - DNA, 25 bp, Mus musculus
gcacaagccttttgtatataacgga

SEQ ID NO: 111862 - DNA, 25 bp, Mus musculus
gcacaagggatggaactggtcctcg

SEQ ID NO: 111863 - DNA, 25 bp, Mus musculus
gcacaagtaccagaagtggcccggt

SEQ ID NO: 111864 - DNA, 25 bp, Mus musculus
gcacaagttgtgtctcccgaaaccg

SEQ ID NO: 111865 - DNA, 25 bp, Mus musculus
gcacaattctatctcgtgggcaatc

SEQ ID NO: 111866 - DNA, 25 bp, Mus musculus
gcacacaatcatagccaagaattca

SEQ ID NO: 111867 - DNA, 25 bp, Mus musculus
gcacacaatgcagactatgagcggg

SEQ ID NO: 111868 - DNA, 25 bp, Mus musculus
gcacacagaccagctcacaggagtt

SEQ ID NO: 111869 - DNA, 25 bp, Mus musculus
gcacacagggcctggaagatccgga

SEQ ID NO: 111870 - DNA, 25 bp, Mus musculus
gcacaccaatgttctgaggcccaaa

SEQ ID NO: 111871 - DNA, 25 bp, Mus musculus
gcacacctgtgctccttgaaagaca

SEQ ID NO: 111872 - DNA, 25 bp, Mus musculus
gcacacgtcgttgcctgttcaggag

SEQ ID NO: 111873 - DNA, 25 bp, Mus musculus
gcacacgtggtgtacctctgcgcaa

SEQ ID NO: 111874 - DNA, 25 bp, Mus musculus
gcacactaagtggttatctaatccc

SEQ ID NO: 111875 - DNA, 25 bp, Mus musculus
gcacactagtaaccctactaaggaa

SEQ ID NO: 111876 - DNA, 25 bp, Mus musculus
gcacactgggagctctaattcaaga

SEQ ID NO: 111877 - DNA, 25 bp, Mus musculus
gcacagaatacagcgaagagaacat

SEQ ID NO: 111878 - DNA, 25 bp, Mus musculus
gcacagacacggcatgaccagtgga

SEQ ID NO: 111879 - DNA, 25 bp, Mus musculus
gcacagacctcaagtttgaccctgg

SEQ ID NO: 111880 - DNA, 25 bp, Mus musculus
gcacagacctcttgttcaggaagaa

SEQ ID NO: 111881 - DNA, 25 bp, Mus musculus
gcacagacttcgtagccgctgggaa

SEQ ID NO: 111882 - DNA, 25 bp, Mus musculus
gcacagagcaagaacgcctgagcct

SEQ ID NO: 111883 - DNA, 25 bp, Mus musculus
gcacagagtctatggtcagtcaccg

SEQ ID NO: 111884 - DNA, 25 bp, Mus musculus
gcacagagtgaacaagagacctcca

SEQ ID NO: 111885 - DNA, 25 bp, Mus musculus
gcacagatggaattacaggactatg

SEQ ID NO: 111886 - DNA, 25 bp, Mus musculus
gcacagcacagctcggcagttcggg

SEQ ID NO: 111887 - DNA, 25 bp, Mus musculus
gcacagcactggtgctgcgcgctcg

SEQ ID NO: 111888 - DNA, 25 bp, Mus musculus
gcacagcctgttgcctggactagca

SEQ ID NO: 111889 - DNA, 25 bp, Mus musculus
gcacagcctttcagattccgaacga

SEQ ID NO: 111890 - DNA, 25 bp, Mus musculus
gcacagcgacttttagccaaaggga

SEQ ID NO: 111891 - DNA, 25 bp, Mus musculus
gcacagcgggtgatcaaagacctca

SEQ ID NO: 111892 - DNA, 25 bp, Mus musculus
gcacagctatgtggaagccctgcat

SEQ ID NO: 111893 - DNA, 25 bp, Mus musculus
gcacagctcacttcagagttcagga

SEQ ID NO: 111894 - DNA, 25 bp, Mus musculus
gcacagctggtggaactggacctca

SEQ ID NO: 111895 - DNA, 25 bp, Mus musculus
gcacagctgtggcactgtcagactc

SEQ ID NO: 111896 - DNA, 25 bp, Mus musculus
gcacagcttgggacagtgatctcac

SEQ ID NO: 111897 - DNA, 25 bp, Mus musculus
gcacaggatgcagggcttacggcta

SEQ ID NO: 111898 - DNA, 25 bp, Mus musculus
gcacaggattatgaatgcagaagcc

SEQ ID NO: 111899 - DNA, 25 bp, Mus musculus
gcacaggtgcagcaagtactcaaca

SEQ ID NO: 111900 - DNA, 25 bp, Mus musculus
gcacaggtgcttttcgccaaggacg

SEQ ID NO: 111901 - DNA, 25 bp, Mus musculus
gcacagtcgcgagaaagggctctac

SEQ ID NO: 111902 - DNA, 25 bp, Mus musculus
gcacagtgatatggaaacagctctc

SEQ ID NO: 111903 - DNA, 25 bp, Mus musculus
gcacagtgatgtacggaactccgca

SEQ ID NO: 111904 - DNA, 25 bp, Mus musculus
gcacagtggccataactgaggacga

SEQ ID NO: 111905 - DNA, 25 bp, Mus musculus
gcacataagctctcaggcctctgga

SEQ ID NO: 111906 - DNA, 25 bp, Mus musculus
gcacataccactgagaaccacggga

SEQ ID NO: 111907 - DNA, 25 bp, Mus musculus
gcacatacccgccagaaacaaacgg

SEQ ID NO: 111908 - DNA, 25 bp, Mus musculus
gcacatacttttggccaggatcaga

SEQ ID NO: 111909 - DNA, 25 bp, Mus musculus
gcacatattactgccagcgtggaga

SEQ ID NO: 111910 - DNA, 25 bp, Mus musculus
gcacatcgatgtgggaggtcacatg

SEQ ID NO: 111911 - DNA, 25 bp, Mus musculus
gcacatcggcgttggcttctcatga

SEQ ID NO: 111912 - DNA, 25 bp, Mus musculus
gcacatctgcactccaatttagctg

SEQ ID NO: 111913 - DNA, 25 bp, Mus musculus
gcacatctgctctgctgtcgggctt

SEQ ID NO: 111914 - DNA, 25 bp, Mus musculus
gcacatgaagaagcagacttttgtt

SEQ ID NO: 111915 - DNA, 25 bp, Mus musculus
gcacatgagcatctcgggcagcagt

SEQ ID NO: 111916 - DNA, 25 bp, Mus musculus
gcacatgcattacctcccagaggag

SEQ ID NO: 111917 - DNA, 25 bp, Mus musculus
gcacatggccactatggaagccctg

SEQ ID NO: 111918 - DNA, 25 bp, Mus musculus
gcacatgggaaacctgtgattttcc

SEQ ID NO: 111919 - DNA, 25 bp, Mus musculus
gcacattcttctgcagggtgtctca

SEQ ID NO: 111920 - DNA, 25 bp, Mus musculus
gcacatttgaccctggcttccggag

SEQ ID NO: 111921 - DNA, 25 bp, Mus musculus
gcacatttgccggtccgggtttgta

SEQ ID NO: 111922 - DNA, 25 bp, Mus musculus
gcaccaaatgaaggagtatacgtcg

SEQ ID NO: 111923 - DNA, 25 bp, Mus musculus
gcaccaagaagctgtcacggaggaa

SEQ ID NO: 111924 - DNA, 25 bp, Mus musculus
gcaccaagggagagcgattcaaaga

SEQ ID NO: 111925 - DNA, 25 bp, Mus musculus
gcaccaagtctctcttcatgccaag

SEQ ID NO: 111926 - DNA, 25 bp, Mus musculus
gcaccaagtgatgacggcatacccg

SEQ ID NO: 111927 - DNA, 25 bp, Mus musculus
gcaccaagtggatcgctaacaactg

SEQ ID NO: 111928 - DNA, 25 bp, Mus musculus
gcaccaatgcccttggctggcctga

SEQ ID NO: 111929 - DNA, 25 bp, Mus musculus
gcaccaatggaaggtctgaccacat

SEQ ID NO: 111930 - DNA, 25 bp, Mus musculus
gcaccacagagtaagcagtccagat

SEQ ID NO: 111931 - DNA, 25 bp, Mus musculus
gcaccacctgcatgagtttttatta

SEQ ID NO: 111932 - DNA, 25 bp, Mus musculus
gcaccactgcccagatacgaggaga

SEQ ID NO: 111933 - DNA, 25 bp, Mus musculus
gcaccagaaactgctggctgacagc

SEQ ID NO: 111934 - DNA, 25 bp, Mus musculus
gcaccagaggccagcagcgggcatc

SEQ ID NO: 111935 - DNA, 25 bp, Mus musculus
gcaccagccggcacctttgtaaata

SEQ ID NO: 111936 - DNA, 25 bp, Mus musculus
gcaccagcgggaagatcacgtttga

SEQ ID NO: 111937 - DNA, 25 bp, Mus musculus
gcaccagggcttatgaggaaatgaa

SEQ ID NO: 111938 - DNA, 25 bp, Mus musculus
gcaccatcagaccaatggacatcga

SEQ ID NO: 111939 - DNA, 25 bp, Mus musculus
gcaccatcggacacatgatggagat

SEQ ID NO: 111940 - DNA, 25 bp, Mus musculus
gcaccatgacctgtggatcaggatt

SEQ ID NO: 111941 - DNA, 25 bp, Mus musculus
gcaccatggtgcagaagtcgcgcaa

SEQ ID NO: 111942 - DNA, 25 bp, Mus musculus
gcaccattggtgaaaattctcgaga

SEQ ID NO: 111943 - DNA, 25 bp, Mus musculus
gcacccatgaccagccatcagccca

SEQ ID NO: 111944 - DNA, 25 bp, Mus musculus
gcaccccagtgcagcagctgaatga

SEQ ID NO: 111945 - DNA, 25 bp, Mus musculus
gcaccccagtggacgacttagacag

SEQ ID NO: 111946 - DNA, 25 bp, Mus musculus
gcaccccgcaagtgttagacccatg

SEQ ID NO: 111947 - DNA, 25 bp, Mus musculus
gcacccctagctcctgtaagttcag

SEQ ID NO: 111948 - DNA, 25 bp, Mus musculus
gcacccctgcttatcatgccccgag

SEQ ID NO: 111949 - DNA, 25 bp, Mus musculus
gcacccctttgatgctgggaaatgg

SEQ ID NO: 111950 - DNA, 25 bp, Mus musculus
gcacccggcaggagatgacagtgat

SEQ ID NO: 111951 - DNA, 25 bp, Mus musculus
gcacccgtgaggatgacaaataccg

SEQ ID NO: 111952 - DNA, 25 bp, Mus musculus
gcacccgtttgctctttatggctgg

SEQ ID NO: 111953 - DNA, 25 bp, Mus musculus
gcaccctgacagcagcaagttgatc

SEQ ID NO: 111954 - DNA, 25 bp, Mus musculus
gcacccttggaagagtccgagagcc

SEQ ID NO: 111955 - DNA, 25 bp, Mus musculus
gcaccgagcctttgcagataagacc

SEQ ID NO: 111956 - DNA, 25 bp, Mus musculus
gcaccgagcgtggtcgtcactggta

SEQ ID NO: 111957 - DNA, 25 bp, Mus musculus
gcaccgagggctaccacgttttgcg

SEQ ID NO: 111958 - DNA, 25 bp, Mus musculus
gcaccgaggtaaagctgaggctcca

SEQ ID NO: 111959 - DNA, 25 bp, Mus musculus
gcaccgaggtgatccaggtgaccaa

SEQ ID NO: 111960 - DNA, 25 bp, Mus musculus
gcaccgagtgccatcagtggtataa

SEQ ID NO: 111961 - DNA, 25 bp, Mus musculus
gcaccgattttgaaacgccagcgcg

SEQ ID NO: 111962 - DNA, 25 bp, Mus musculus
gcaccgccgagtggtacaacattga

SEQ ID NO: 111963 - DNA, 25 bp, Mus musculus
gcaccgccttggaaggatctccaga

SEQ ID NO: 111964 - DNA, 25 bp, Mus musculus
gcaccgcgacacgttttccaaatgt

SEQ ID NO: 111965 - DNA, 25 bp, Mus musculus
gcaccgcggcgatgggaggttcggg

SEQ ID NO: 111966 - DNA, 25 bp, Mus musculus
gcaccgctgtacctgttctctatag

SEQ ID NO: 111967 - DNA, 25 bp, Mus musculus
gcaccggacagtatgaagcccttaa

SEQ ID NO: 111968 - DNA, 25 bp, Mus musculus
gcaccggaggtgtcccagcatgtat

SEQ ID NO: 111969 - DNA, 25 bp, Mus musculus
gcaccgtcaggttggcaccgctcta

SEQ ID NO: 111970 - DNA, 25 bp, Mus musculus
gcaccgtcgggctttgtcagtccct

SEQ ID NO: 111971 - DNA, 25 bp, Mus musculus
gcaccgtcttgccacttcttagctg

SEQ ID NO: 111972 - DNA, 25 bp, Mus musculus
gcaccgtggtttctactaggaaaga

SEQ ID NO: 111973 - DNA, 25 bp, Mus musculus
gcaccgttatgtgggaagcgaatcc

SEQ ID NO: 111974 - DNA, 25 bp, Mus musculus
gcacctaagaaaactgccttggatt

SEQ ID NO: 111975 - DNA, 25 bp, Mus musculus
gcacctacagagacgccaacattaa

SEQ ID NO: 111976 - DNA, 25 bp, Mus musculus
gcacctactgtagaaaaatagcctt

SEQ ID NO: 111977 - DNA, 25 bp, Mus musculus
gcacctagtgtctgtcgccgtgtga

SEQ ID NO: 111978 - DNA, 25 bp, Mus musculus
gcacctcagggactcacaattgtag

SEQ ID NO: 111979 - DNA, 25 bp, Mus musculus
gcacctcattgctggtggcaccgtg

SEQ ID NO: 111980 - DNA, 25 bp, Mus musculus
gcacctccacctacaatagaagaga

SEQ ID NO: 111981 - DNA, 25 bp, Mus musculus
gcacctcctggcatggctagtttga

SEQ ID NO: 111982 - DNA, 25 bp, Mus musculus
gcacctcggacaaacgctgctttgg

SEQ ID NO: 111983 - DNA, 25 bp, Mus musculus
gcacctcggcgcagccatgagtgcg

SEQ ID NO: 111984 - DNA, 25 bp, Mus musculus
gcacctctaagtcttgtgtgactca

SEQ ID NO: 111985 - DNA, 25 bp, Mus musculus
gcacctctttgaaaacgatcggcat

SEQ ID NO: 111986 - DNA, 25 bp, Mus musculus
gcacctgcagtgaatcgaagagctt

SEQ ID NO: 111987 - DNA, 25 bp, Mus musculus
gcacctgcatgaaaaagaagctgct

SEQ ID NO: 111988 - DNA, 25 bp, Mus musculus
gcacctgctgtgtttgcagaaagcc

SEQ ID NO: 111989 - DNA, 25 bp, Mus musculus
gcacctgctttggatactggctggg

SEQ ID NO: 111990 - DNA, 25 bp, Mus musculus
gcacctggagcctattctgaagaag

SEQ ID NO: 111991 - DNA, 25 bp, Mus musculus
gcacctggagtggaacatatgagaa

SEQ ID NO: 111992 - DNA, 25 bp, Mus musculus
gcacctgtcagtctttggcacctcg

SEQ ID NO: 111993 - DNA, 25 bp, Mus musculus
gcacctgtgtacatggctgctgtcc

SEQ ID NO: 111994 - DNA, 25 bp, Mus musculus
gcacctgttgccttcattagcagct

SEQ ID NO: 111995 - DNA, 25 bp, Mus musculus
gcaccttaggagaagggaccttcgg

SEQ ID NO: 111996 - DNA, 25 bp, Mus musculus
gcaccttcaggagattccggaccag

SEQ ID NO: 111997 - DNA, 25 bp, Mus musculus
gcaccttgaaataaagctgactttg

SEQ ID NO: 111998 - DNA, 25 bp, Mus musculus
gcaccttggccgtcgggaaatgacg

SEQ ID NO: 111999 - DNA, 25 bp, Mus musculus
gcacctttcagctttcgggacagca

SEQ ID NO: 112000 - DNA, 25 bp, Mus musculus
gcacctttgttctgacctgctcggg

SEQ ID NO: 112001 - DNA, 25 bp, Mus musculus
gcacgaaaagttggtggcctcacag

SEQ ID NO: 112002 - DNA, 25 bp, Mus musculus
gcacgaataaatagcggcggcggca

SEQ ID NO: 112003 - DNA, 25 bp, Mus musculus
gcacgaataggcttgcaaatctctt

SEQ ID NO: 112004 - DNA, 25 bp, Mus musculus
gcacgaatcacaggctctcaaggag

SEQ ID NO: 112005 - DNA, 25 bp, Mus musculus
gcacgaatccggatgagacagcagc

SEQ ID NO: 112006 - DNA, 25 bp, Mus musculus
gcacgacgtgcgtccttgggacttg

SEQ ID NO: 112007 - DNA, 25 bp, Mus musculus
gcacgatggtcctacacattccaga

SEQ ID NO: 112008 - DNA, 25 bp, Mus musculus
gcacgattacccctaaagtggaacg

SEQ ID NO: 112009 - DNA, 25 bp, Mus musculus
gcacgcacgtagtgaggttccacga

SEQ ID NO: 112010 - DNA, 25 bp, Mus musculus
gcacgccagggcacatcagttgtag

SEQ ID NO: 112011 - DNA, 25 bp, Mus musculus
gcacgcccttcaagacacagaggag

SEQ ID NO: 112012 - DNA, 25 bp, Mus musculus
gcacgccgcagagttcatcattcag

SEQ ID NO: 112013 - DNA, 25 bp, Mus musculus
gcacgccggcgcagtctacggaacc

SEQ ID NO: 112014 - DNA, 25 bp, Mus musculus
gcacgcgcagcgtttcgcgcgacga

SEQ ID NO: 112015 - DNA, 25 bp, Mus musculus
gcacgcgctggtggcttacttcaac

SEQ ID NO: 112016 - DNA, 25 bp, Mus musculus
gcacgcggactttcttcgaccttaa

SEQ ID NO: 112017 - DNA, 25 bp, Mus musculus
gcacgctcagccaggacatgcgagg

SEQ ID NO: 112018 - DNA, 25 bp, Mus musculus
gcacgctggaggtacagatgctcag

SEQ ID NO: 112019 - DNA, 25 bp, Mus musculus
gcacgctgttaagtgggtatcccac

SEQ ID NO: 112020 - DNA, 25 bp, Mus musculus
gcacggaaatgtcccgagagctaca

SEQ ID NO: 112021 - DNA, 25 bp, Mus musculus
gcacggactctatggaactcagcta

SEQ ID NO: 112022 - DNA, 25 bp, Mus musculus
gcacggccggagacgtttcctaaca

SEQ ID NO: 112023 - DNA, 25 bp, Mus musculus
gcacgggaagcaaaggcaaagacaa

SEQ ID NO: 112024 - DNA, 25 bp, Mus musculus
gcacgggatctgttttcattaagga

SEQ ID NO: 112025 - DNA, 25 bp, Mus musculus
gcacggtatcgtggacagtacagta

SEQ ID NO: 112026 - DNA, 25 bp, Mus musculus
gcacggtcccgggacatgagttcct

SEQ ID NO: 112027 - DNA, 25 bp, Mus musculus
gcacggtgtctccagccaagggaat

SEQ ID NO: 112028 - DNA, 25 bp, Mus musculus
gcacggtttcccaggtggtcacaga

SEQ ID NO: 112029 - DNA, 25 bp, Mus musculus
gcacgtactgtgagccttcgggagc

SEQ ID NO: 112030 - DNA, 25 bp, Mus musculus
gcacgtagagacaccacgcaactat

SEQ ID NO: 112031 - DNA, 25 bp, Mus musculus
gcacgtcctctcctgtgtgatcgaa

SEQ ID NO: 112032 - DNA, 25 bp, Mus musculus
gcacgtcgtctcctgcagcgttgga

SEQ ID NO: 112033 - DNA, 25 bp, Mus musculus
gcacgtctagcagtgaccgtcagag

SEQ ID NO: 112034 - DNA, 25 bp, Mus musculus
gcacgtgctcgcacttagctgcgca

SEQ ID NO: 112035 - DNA, 25 bp, Mus musculus
gcacgtggtccttcgctgcagaggt

SEQ ID NO: 112036 - DNA, 25 bp, Mus musculus
gcacgttctatggaaactggagcta

SEQ ID NO: 112037 - DNA, 25 bp, Mus musculus
gcacgttggcatacagtccggatcc

SEQ ID NO: 112038 - DNA, 25 bp, Mus musculus
gcactaaagggctgaaagtcaacct

SEQ ID NO: 112039 - DNA, 25 bp, Mus musculus
gcactactgcctggaggagagcaat

SEQ ID NO: 112040 - DNA, 25 bp, Mus musculus
gcactagactggactgagaagctcc

SEQ ID NO: 112041 - DNA, 25 bp, Mus musculus
gcactaggtgacacatggcttcaga

SEQ ID NO: 112042 - DNA, 25 bp, Mus musculus
gcactatgaccccaacaagcggatt

SEQ ID NO: 112043 - DNA, 25 bp, Mus musculus
gcactatgttcctcctgctcatgag

SEQ ID NO: 112044 - DNA, 25 bp, Mus musculus
gcactatttcattgacagagacggg

SEQ ID NO: 112045 - DNA, 25 bp, Mus musculus
gcactcaaatccgagagctctggga

SEQ ID NO: 112046 - DNA, 25 bp, Mus musculus
gcactccacagacgagggcagaact

SEQ ID NO: 112047 - DNA, 25 bp, Mus musculus
gcactccactgctggttaggagaag

SEQ ID NO: 112048 - DNA, 25 bp, Mus musculus
gcactccagggagctacatcactga

SEQ ID NO: 112049 - DNA, 25 bp, Mus musculus
gcactccgttctccttgactctaga

SEQ ID NO: 112050 - DNA, 25 bp, Mus musculus
gcactcggtggacctcattggccgc

SEQ ID NO: 112051 - DNA, 25 bp, Mus musculus
gcactctacttgcaggggtgcttac

SEQ ID NO: 112052 - DNA, 25 bp, Mus musculus
gcactctctggcatcctggataagg

SEQ ID NO: 112053 - DNA, 25 bp, Mus musculus
gcactctgcggatgaactgtctcga

SEQ ID NO: 112054 - DNA, 25 bp, Mus musculus
gcactgaccatggacaatcgcctga

SEQ ID NO: 112055 - DNA, 25 bp, Mus musculus
gcactgacctgctggcggatatcgg

SEQ ID NO: 112056 - DNA, 25 bp, Mus musculus
gcactgagagttccagccacgaaga

SEQ ID NO: 112057 - DNA, 25 bp, Mus musculus
gcactgcactgcacatgctgaggag

SEQ ID NO: 112058 - DNA, 25 bp, Mus musculus
gcactgcagaggactcggagacact

SEQ ID NO: 112059 - DNA, 25 bp, Mus musculus
gcactgcaggtgttgacaagatcca

SEQ ID NO: 112060 - DNA, 25 bp, Mus musculus
gcactgccagcgttgccctttagta

SEQ ID NO: 112061 - DNA, 25 bp, Mus musculus
gcactgcccgagctgattatcttgc

SEQ ID NO: 112062 - DNA, 25 bp, Mus musculus
gcactggaccaaagaacggcatcag

SEQ ID NO: 112063 - DNA, 25 bp, Mus musculus
gcactggagaagtttggccaagcca

SEQ ID NO: 112064 - DNA, 25 bp, Mus musculus
gcactggcaggaaattacccttaat

SEQ ID NO: 112065 - DNA, 25 bp, Mus musculus
gcactggccaaaggactcggcttgt

SEQ ID NO: 112066 - DNA, 25 bp, Mus musculus
gcactgggcaagactcctggaagag

SEQ ID NO: 112067 - DNA, 25 bp, Mus musculus
gcactgggcccaatttactaccgag

SEQ ID NO: 112068 - DNA, 25 bp, Mus musculus
gcactgggtccttagcatatcctgg

SEQ ID NO: 112069 - DNA, 25 bp, Mus musculus
gcactgtagcttgaggcccttccaa

SEQ ID NO: 112070 - DNA, 25 bp, Mus musculus
gcactgtctaagcagtacaatgctg

SEQ ID NO: 112071 - DNA, 25 bp, Mus musculus
gcactgtgatgtgaggaccgccata

SEQ ID NO: 112072 - DNA, 25 bp, Mus musculus
gcactgtgccatgtcctgctgggaa

SEQ ID NO: 112073 - DNA, 25 bp, Mus musculus
gcactgtgggcaaggtcgatgcaat

SEQ ID NO: 112074 - DNA, 25 bp, Mus musculus
gcactgtggttctgaagccaggaga

SEQ ID NO: 112075 - DNA, 25 bp, Mus musculus
gcactgtgtcagtccgtcgaggtca

SEQ ID NO: 112076 - DNA, 25 bp, Mus musculus
gcactgttctgggacgcacaagaga

SEQ ID NO: 112077 - DNA, 25 bp, Mus musculus
gcactgttgagtctgcaggccagca

SEQ ID NO: 112078 - DNA, 25 bp, Mus musculus
gcactgtttaatttataaaggagca

SEQ ID NO: 112079 - DNA, 25 bp, Mus musculus
gcactgtttagccaaacctgagttg

SEQ ID NO: 112080 - DNA, 25 bp, Mus musculus
gcactgttttggaagcggctcctca

SEQ ID NO: 112081 - DNA, 25 bp, Mus musculus
gcacttaaagaaagcctcgatgaga

SEQ ID NO: 112082 - DNA, 25 bp, Mus musculus
gcacttcatatctcggtgtctcgga

SEQ ID NO: 112083 - DNA, 25 bp, Mus musculus
gcacttcattgagtgcatattccac

SEQ ID NO: 112084 - DNA, 25 bp, Mus musculus
gcacttccagcgtgtgatcccagaa

SEQ ID NO: 112085 - DNA, 25 bp, Mus musculus
gcacttcgacctgcggtgggaggcc

SEQ ID NO: 112086 - DNA, 25 bp, Mus musculus
gcacttcgcctaccacaaagtggtg

SEQ ID NO: 112087 - DNA, 25 bp, Mus musculus
gcacttctctatggaactgcagcag

SEQ ID NO: 112088 - DNA, 25 bp, Mus musculus
gcacttgacccatggcatcctgaaa

SEQ ID NO: 112089 - DNA, 25 bp, Mus musculus
gcacttgcttgatgacctaaggtca

SEQ ID NO: 112090 - DNA, 25 bp, Mus musculus
gcacttggacacctggcatgggaca

SEQ ID NO: 112091 - DNA, 25 bp, Mus musculus
gcacttggacggcaggttcgacggg

SEQ ID NO: 112092 - DNA, 25 bp, Mus musculus
gcacttggtgcaaatggcctcctca

SEQ ID NO: 112093 - DNA, 25 bp, Mus musculus
gcactttcatcaatgcctcaaaccg

SEQ ID NO: 112094 - DNA, 25 bp, Mus musculus
gcactttgaggcgacatcgctgcga

SEQ ID NO: 112095 - DNA, 25 bp, Mus musculus
gcactttgattctgtctctgccaca

SEQ ID NO: 112096 - DNA, 25 bp, Mus musculus
gcactttggagaagcgctggaccct

SEQ ID NO: 112097 - DNA, 25 bp, Mus musculus
gcagaaaacagttgcgcagcagcac

SEQ ID NO: 112098 - DNA, 25 bp, Mus musculus
gcagaaaacctgctcctggatgctg

SEQ ID NO: 112099 - DNA, 25 bp, Mus musculus
gcagaaaactgaacggcgggagcta

SEQ ID NO: 112100 - DNA, 25 bp, Mus musculus
gcagaaaagagtgtccagcccttgg

SEQ ID NO: 112101 - DNA, 25 bp, Mus musculus
gcagaaaatcgctacccagtcacaa

SEQ ID NO: 112102 - DNA, 25 bp, Mus musculus
gcagaaacaagtaccagccagacaa

SEQ ID NO: 112103 - DNA, 25 bp, Mus musculus
gcagaaacagcgaccttcagaggaa

SEQ ID NO: 112104 - DNA, 25 bp, Mus musculus
gcagaaacccaagaaatcggcgaaa

SEQ ID NO: 112105 - DNA, 25 bp, Mus musculus
gcagaaagatcgaaacagcaggccc

SEQ ID NO: 112106 - DNA, 25 bp, Mus musculus
gcagaaagggtggaaacagacttca

SEQ ID NO: 112107 - DNA, 25 bp, Mus musculus
gcagaaagttctagaggcctcagcg

SEQ ID NO: 112108 - DNA, 25 bp, Mus musculus
gcagaaatgggctcctccgaatgag

SEQ ID NO: 112109 - DNA, 25 bp, Mus musculus
gcagaaattaagcaagggatccgtg

SEQ ID NO: 112110 - DNA, 25 bp, Mus musculus
gcagaaattcccagcgtccagggag

SEQ ID NO: 112111 - DNA, 25 bp, Mus musculus
gcagaaattggatgaccgggctcct

SEQ ID NO: 112112 - DNA, 25 bp, Mus musculus
gcagaacatccgttctcagcagcga

SEQ ID NO: 112113 - DNA, 25 bp, Mus musculus
gcagaacccagacactagcatcagg

SEQ ID NO: 112114 - DNA, 25 bp, Mus musculus
gcagaaccccaaggattcagaggag

SEQ ID NO: 112115 - DNA, 25 bp, Mus musculus
gcagaaccgcagtctagatgaatgg

SEQ ID NO: 112116 - DNA, 25 bp, Mus musculus
gcagaacgagccctttgaggaccct

SEQ ID NO: 112117 - DNA, 25 bp, Mus musculus
gcagaactatggctggaaattacag

SEQ ID NO: 112118 - DNA, 25 bp, Mus musculus
gcagaactccgaagctggatagagg

SEQ ID NO: 112119 - DNA, 25 bp, Mus musculus
gcagaactgagtctatagcccaggt

SEQ ID NO: 112120 - DNA, 25 bp, Mus musculus
gcagaactgctgaactccacgtgag

SEQ ID NO: 112121 - DNA, 25 bp, Mus musculus
gcagaactgtgatgtaattccagag

SEQ ID NO: 112122 - DNA, 25 bp, Mus musculus
gcagaacttcacagcctggcctgat

SEQ ID NO: 112123 - DNA, 25 bp, Mus musculus
gcagaagaacggcaaacaggaagtc

SEQ ID NO: 112124 - DNA, 25 bp, Mus musculus
gcagaagaagttagaagtggctatg

SEQ ID NO: 112125 - DNA, 25 bp, Mus musculus
gcagaagcaatggtccgggacctat

SEQ ID NO: 112126 - DNA, 25 bp, Mus musculus
gcagaagcagcatcatagaaccagg

SEQ ID NO: 112127 - DNA, 25 bp, Mus musculus
gcagaagccacagagcagtgcctac

SEQ ID NO: 112128 - DNA, 25 bp, Mus musculus
gcagaagccatcatgtcgatgagca

SEQ ID NO: 112129 - DNA, 25 bp, Mus musculus
gcagaagcggcttatccctgagagg

SEQ ID NO: 112130 - DNA, 25 bp, Mus musculus
gcagaaggtcatcgtgctgcccaag

SEQ ID NO: 112131 - DNA, 25 bp, Mus musculus
gcagaaggttctagtcccaaccggc

SEQ ID NO: 112132 - DNA, 25 bp, Mus musculus
gcagaagtcccatcctgaattccag

SEQ ID NO: 112133 - DNA, 25 bp, Mus musculus
gcagaagtctggacccagagccagg

SEQ ID NO: 112134 - DNA, 25 bp, Mus musculus
gcagaagtcttaagtccacccaata

SEQ ID NO: 112135 - DNA, 25 bp, Mus musculus
gcagaagttcccttgtcactaccag

SEQ ID NO: 112136 - DNA, 25 bp, Mus musculus
gcagaagtttcagctcaagataaag

SEQ ID NO: 112137 - DNA, 25 bp, Mus musculus
gcagaatacgcacatcccttggaaa

SEQ ID NO: 112138 - DNA, 25 bp, Mus musculus
gcagaatagcccagtcagctgagct

SEQ ID NO: 112139 - DNA, 25 bp, Mus musculus
gcagaatatattttccaccccatgg

SEQ ID NO: 112140 - DNA, 25 bp, Mus musculus
gcagaatatgaaattactccagatg

SEQ ID NO: 112141 - DNA, 25 bp, Mus musculus
gcagaatgactgatgggcgccttca

SEQ ID NO: 112142 - DNA, 25 bp, Mus musculus
gcagaatgcccagaattaagtgcag

SEQ ID NO: 112143 - DNA, 25 bp, Mus musculus
gcagaatggatgatcttggtgtaca

SEQ ID NO: 112144 - DNA, 25 bp, Mus musculus
gcagaatgtctggttgccttcccat

SEQ ID NO: 112145 - DNA, 25 bp, Mus musculus
gcagaattcgtccaggtcctcgaga

SEQ ID NO: 112146 - DNA, 25 bp, Mus musculus
gcagaattgagtatgagcccggcac

SEQ ID NO: 112147 - DNA, 25 bp, Mus musculus
gcagacaaaacaccttaggacataa

SEQ ID NO: 112148 - DNA, 25 bp, Mus musculus
gcagacaaaagaggccggcagtgca

SEQ ID NO: 112149 - DNA, 25 bp, Mus musculus
gcagacactcagtttggactgatga

SEQ ID NO: 112150 - DNA, 25 bp, Mus musculus
gcagacagtgcacgtgaagttcccg

SEQ ID NO: 112151 - DNA, 25 bp, Mus musculus
gcagacatcaatgaagagaatgagg

SEQ ID NO: 112152 - DNA, 25 bp, Mus musculus
gcagacatgcccagtggcgagtcct

SEQ ID NO: 112153 - DNA, 25 bp, Mus musculus
gcagaccaagcttcctgagccatgg

SEQ ID NO: 112154 - DNA, 25 bp, Mus musculus
gcagaccacagtttcagccgaacaa

SEQ ID NO: 112155 - DNA, 25 bp, Mus musculus
gcagaccacatatgctttacagagt

SEQ ID NO: 112156 - DNA, 25 bp, Mus musculus
gcagaccattacagcttcggagcag

SEQ ID NO: 112157 - DNA, 25 bp, Mus musculus
gcagacccacttttggagagctcca

SEQ ID NO: 112158 - DNA, 25 bp, Mus musculus
gcagacccgggaaagaattccgagc

SEQ ID NO: 112159 - DNA, 25 bp, Mus musculus
gcagaccctgaaacaacacttctgg

SEQ ID NO: 112160 - DNA, 25 bp, Mus musculus
gcagaccgaagtgctgttgcagcca

SEQ ID NO: 112161 - DNA, 25 bp, Mus musculus
gcagaccgtgtcagaggttaccgag

SEQ ID NO: 112162 - DNA, 25 bp, Mus musculus
gcagaccgtttatgtgcagcagcct

SEQ ID NO: 112163 - DNA, 25 bp, Mus musculus
gcagacctcagatcccgtcagaaaa

SEQ ID NO: 112164 - DNA, 25 bp, Mus musculus
gcagacctgtgcgagaacatggaca

SEQ ID NO: 112165 - DNA, 25 bp, Mus musculus
gcagaccttcgtcattcttgccggg

SEQ ID NO: 112166 - DNA, 25 bp, Mus musculus
gcagacgccggtagatagtccagat

SEQ ID NO: 112167 - DNA, 25 bp, Mus musculus
gcagacggctctgtgagctgcaaga

SEQ ID NO: 112168 - DNA, 25 bp, Mus musculus
gcagacggtcttactacctgaaagt

SEQ ID NO: 112169 - DNA, 25 bp, Mus musculus
gcagacggtggcaatggtatccctt

SEQ ID NO: 112170 - DNA, 25 bp, Mus musculus
gcagactacctctatgaaagtggag

SEQ ID NO: 112171 - DNA, 25 bp, Mus musculus
gcagactcagaggtgaccgtgcaga

SEQ ID NO: 112172 - DNA, 25 bp, Mus musculus
gcagactccagattggcgatttata

SEQ ID NO: 112173 - DNA, 25 bp, Mus musculus
gcagactcctgtttggatagtggga

SEQ ID NO: 112174 - DNA, 25 bp, Mus musculus
gcagactcttattggagcttccaga

SEQ ID NO: 112175 - DNA, 25 bp, Mus musculus
gcagactgcctcaatgggaccagca

SEQ ID NO: 112176 - DNA, 25 bp, Mus musculus
gcagactgctgggttcgatgaagct

SEQ ID NO: 112177 - DNA, 25 bp, Mus musculus
gcagactggctcatgaaaacttgtg

SEQ ID NO: 112178 - DNA, 25 bp, Mus musculus
gcagactgttgtaccccaagagagg

SEQ ID NO: 112179 - DNA, 25 bp, Mus musculus
gcagacttccacacctcagctgagt

SEQ ID NO: 112180 - DNA, 25 bp, Mus musculus
gcagacttctttgaggatgacacca

SEQ ID NO: 112181 - DNA, 25 bp, Mus musculus
gcagactttccagctcagagagtga

SEQ ID NO: 112182 - DNA, 25 bp, Mus musculus
gcagagaaggaaacccagaggaaga

SEQ ID NO: 112183 - DNA, 25 bp, Mus musculus
gcagagacatccttaaacaatcaga

SEQ ID NO: 112184 - DNA, 25 bp, Mus musculus
gcagagatttacaaagttttcaacc

SEQ ID NO: 112185 - DNA, 25 bp, Mus musculus
gcagagcacattttcttcagctgag

SEQ ID NO: 112186 - DNA, 25 bp, Mus musculus
gcagagcacttgtctcactttggca

SEQ ID NO: 112187 - DNA, 25 bp, Mus musculus
gcagagcagctcattcgggtgtact

SEQ ID NO: 112188 - DNA, 25 bp, Mus musculus
gcagagcattcaaaccttaccagga

SEQ ID NO: 112189 - DNA, 25 bp, Mus musculus
gcagagccacgctgcggttcgtcca

SEQ ID NO: 112190 - DNA, 25 bp, Mus musculus
gcagagccagacaggcgctgcctgt

SEQ ID NO: 112191 - DNA, 25 bp, Mus musculus
gcagagcccaacagatgcttatgga

SEQ ID NO: 112192 - DNA, 25 bp, Mus musculus
gcagagcggacggaagggaccggaa

SEQ ID NO: 112193 - DNA, 25 bp, Mus musculus
gcagagctacctcgcaatggagaaa

SEQ ID NO: 112194 - DNA, 25 bp, Mus musculus
gcagagctcagcttggccaggatcc

SEQ ID NO: 112195 - DNA, 25 bp, Mus musculus
gcagagctcattccagccggaatcc

SEQ ID NO: 112196 - DNA, 25 bp, Mus musculus
gcagagctctttgccgtggtgaaga

SEQ ID NO: 112197 - DNA, 25 bp, Mus musculus
gcagagctgcgacactggtcagaca

SEQ ID NO: 112198 - DNA, 25 bp, Mus musculus
gcagagctggaatatgagtccgtgc

SEQ ID NO: 112199 - DNA, 25 bp, Mus musculus
gcagagctgtccaaaggcgagtctg

SEQ ID NO: 112200 - DNA, 25 bp, Mus musculus
gcagagctgtgacgtcatactataa

SEQ ID NO: 112201 - DNA, 25 bp, Mus musculus
gcagagcttgctaggtcattaaaca

SEQ ID NO: 112202 - DNA, 25 bp, Mus musculus
gcagaggagccctaaaaccggtgtc

SEQ ID NO: 112203 - DNA, 25 bp, Mus musculus
gcagaggcctccatggctgtgataa

SEQ ID NO: 112204 - DNA, 25 bp, Mus musculus
gcagaggcctgctaagagaacgtac

SEQ ID NO: 112205 - DNA, 25 bp, Mus musculus
gcagaggtgacggacccatcccatg

SEQ ID NO: 112206 - DNA, 25 bp, Mus musculus
gcagagtaacagcatcagccggata

SEQ ID NO: 112207 - DNA, 25 bp, Mus musculus
gcagagtacagctagacttgcctga

SEQ ID NO: 112208 - DNA, 25 bp, Mus musculus
gcagagtacattcaccgcatcggaa

SEQ ID NO: 112209 - DNA, 25 bp, Mus musculus
gcagagtacggccttggcatttaca

SEQ ID NO: 112210 - DNA, 25 bp, Mus musculus
gcagagtcagaatcactgggagacc

SEQ ID NO: 112211 - DNA, 25 bp, Mus musculus
gcagagtccagctcagatcctgaag

SEQ ID NO: 112212 - DNA, 25 bp, Mus musculus
gcagagtggccaccatgggcaaact

SEQ ID NO: 112213 - DNA, 25 bp, Mus musculus
gcagagttaatcattggccaagcag

SEQ ID NO: 112214 - DNA, 25 bp, Mus musculus
gcagagttatcgttgcttctgagaa

SEQ ID NO: 112215 - DNA, 25 bp, Mus musculus
gcagagtttcttcagtgttcccagt

SEQ ID NO: 112216 - DNA, 25 bp, Mus musculus
gcagagttttcatcgcagaggctac

SEQ ID NO: 112217 - DNA, 25 bp, Mus musculus
gcagataaccctggctctgaagagg

SEQ ID NO: 112218 - DNA, 25 bp, Mus musculus
gcagataacctaaagggcccacctt

SEQ ID NO: 112219 - DNA, 25 bp, Mus musculus
gcagatacccttgtcggtagggcat

SEQ ID NO: 112220 - DNA, 25 bp, Mus musculus
gcagataccgcttcatccgcagtgt

SEQ ID NO: 112221 - DNA, 25 bp, Mus musculus
gcagatatcaagaaatgtaaacgtg

SEQ ID NO: 112222 - DNA, 25 bp, Mus musculus
gcagatcaaggctcaagctggagct

SEQ ID NO: 112223 - DNA, 25 bp, Mus musculus
gcagatcaccgcagtcattgtcaac

SEQ ID NO: 112224 - DNA, 25 bp, Mus musculus
gcagatccagcagggcttgcagacg

SEQ ID NO: 112225 - DNA, 25 bp, Mus musculus
gcagatcccagtggacctatcggaa

SEQ ID NO: 112226 - DNA, 25 bp, Mus musculus
gcagatcgctatgggcgccttgacc

SEQ ID NO: 112227 - DNA, 25 bp, Mus musculus
gcagatcggtttccattccacacag

SEQ ID NO: 112228 - DNA, 25 bp, Mus musculus
gcagatcgtgatggacaagggccca

SEQ ID NO: 112229 - DNA, 25 bp, Mus musculus
gcagatctgctcctcattgcacatg

SEQ ID NO: 112230 - DNA, 25 bp, Mus musculus
gcagatgacctggaaagtcccttat

SEQ ID NO: 112231 - DNA, 25 bp, Mus musculus
gcagatgatctgaatgccttgcaac

SEQ ID NO: 112232 - DNA, 25 bp, Mus musculus
gcagatgatgcttgtcgggcctaca

SEQ ID NO: 112233 - DNA, 25 bp, Mus musculus
gcagatgatgggaaaagaaattccg

SEQ ID NO: 112234 - DNA, 25 bp, Mus musculus
gcagatgccagctctgtaccttgaa

SEQ ID NO: 112235 - DNA, 25 bp, Mus musculus
gcagatgcccatagaccaaggtttt

SEQ ID NO: 112236 - DNA, 25 bp, Mus musculus
gcagatgcctctggaatcctaaaag

SEQ ID NO: 112237 - DNA, 25 bp, Mus musculus
gcagatgcctgtccaagctggtcaa

SEQ ID NO: 112238 - DNA, 25 bp, Mus musculus
gcagatgcctttcattgccgcaaga

SEQ ID NO: 112239 - DNA, 25 bp, Mus musculus
gcagatgctaaggatgatgacgaca

SEQ ID NO: 112240 - DNA, 25 bp, Mus musculus
gcagatggaagagaccgactcctcg

SEQ ID NO: 112241 - DNA, 25 bp, Mus musculus
gcagatggactcgtttgtgaaaagc

SEQ ID NO: 112242 - DNA, 25 bp, Mus musculus
gcagatgggcacagagtgccactac

SEQ ID NO: 112243 - DNA, 25 bp, Mus musculus
gcagatggtctgcaaaaacgaggca

SEQ ID NO: 112244 - DNA, 25 bp, Mus musculus
gcagatgtgcaaacggaaccttgag

SEQ ID NO: 112245 - DNA, 25 bp, Mus musculus
gcagatgtgcctgctaacatggata

SEQ ID NO: 112246 - DNA, 25 bp, Mus musculus
gcagatgtgtcccttcccataagtg

SEQ ID NO: 112247 - DNA, 25 bp, Mus musculus
gcagatgtgttttctccgggacaaa

SEQ ID NO: 112248 - DNA, 25 bp, Mus musculus
gcagattactcccaaacgcctagaa

SEQ ID NO: 112249 - DNA, 25 bp, Mus musculus
gcagattcacgacagtgccgtccag

SEQ ID NO: 112250 - DNA, 25 bp, Mus musculus
gcagattcctgtacttcctcaagag

SEQ ID NO: 112251 - DNA, 25 bp, Mus musculus
gcagattgagcctgtcaatggccag

SEQ ID NO: 112252 - DNA, 25 bp, Mus musculus
gcagattgtacatccagtggttcct

SEQ ID NO: 112253 - DNA, 25 bp, Mus musculus
gcagatttagctagaccagcactga

SEQ ID NO: 112254 - DNA, 25 bp, Mus musculus
gcagcaaaagaactctaagggaagt

SEQ ID NO: 112255 - DNA, 25 bp, Mus musculus
gcagcaaaatttgactacaagctaa

SEQ ID NO: 112256 - DNA, 25 bp, Mus musculus
gcagcaacagttagcagtggacaca

SEQ ID NO: 112257 - DNA, 25 bp, Mus musculus
gcagcaacataagctcccgaggaag

SEQ ID NO: 112258 - DNA, 25 bp, Mus musculus
gcagcaacccgaaggactactgcta

SEQ ID NO: 112259 - DNA, 25 bp, Mus musculus
gcagcaaccggtgtcagtgtcagaa

SEQ ID NO: 112260 - DNA, 25 bp, Mus musculus
gcagcaagaacacgatgccatcagt

SEQ ID NO: 112261 - DNA, 25 bp, Mus musculus
gcagcaagacctcgattctccagta

SEQ ID NO: 112262 - DNA, 25 bp, Mus musculus
gcagcaagagatggcaaatgttcga

SEQ ID NO: 112263 - DNA, 25 bp, Mus musculus
gcagcaagcaggtctgaaggactcc

SEQ ID NO: 112264 - DNA, 25 bp, Mus musculus
gcagcaagctcattctcatttggga

SEQ ID NO: 112265 - DNA, 25 bp, Mus musculus
gcagcaagtactgaccagctctggc

SEQ ID NO: 112266 - DNA, 25 bp, Mus musculus
gcagcaagtactgactccaagccta

SEQ ID NO: 112267 - DNA, 25 bp, Mus musculus
gcagcaatctcctgaccgagaggat

SEQ ID NO: 112268 - DNA, 25 bp, Mus musculus
gcagcaatgaagatggctaacatgg

SEQ ID NO: 112269 - DNA, 25 bp, Mus musculus
gcagcaatgcacagcggcagatgat

SEQ ID NO: 112270 - DNA, 25 bp, Mus musculus
gcagcaatggctaattcagtccgag

SEQ ID NO: 112271 - DNA, 25 bp, Mus musculus
gcagcacacacctacttctgatgta

SEQ ID NO: 112272 - DNA, 25 bp, Mus musculus
gcagcacactagtaaccctactaag

SEQ ID NO: 112273 - DNA, 25 bp, Mus musculus
gcagcacagggcttgggctactttt

SEQ ID NO: 112274 - DNA, 25 bp, Mus musculus
gcagcacattcagaacccggtggtg

SEQ ID NO: 112275 - DNA, 25 bp, Mus musculus
gcagcaccagccgtagttcttcaga

SEQ ID NO: 112276 - DNA, 25 bp, Mus musculus
gcagcaccaggccttggtaaccatg

SEQ ID NO: 112277 - DNA, 25 bp, Mus musculus
gcagcaccatcaaatgggatcacta

SEQ ID NO: 112278 - DNA, 25 bp, Mus musculus
gcagcaccatgcaggtgagcttcgt

SEQ ID NO: 112279 - DNA, 25 bp, Mus musculus
gcagcaccctgagacagcgtgaaga

SEQ ID NO: 112280 - DNA, 25 bp, Mus musculus
gcagcacctagggtacaggtccagg

SEQ ID NO: 112281 - DNA, 25 bp, Mus musculus
gcagcactatggaggactattcaca

SEQ ID NO: 112282 - DNA, 25 bp, Mus musculus
gcagcactcttaagtctcgaagtga

SEQ ID NO: 112283 - DNA, 25 bp, Mus musculus
gcagcactgctttcatcctatgaga

SEQ ID NO: 112284 - DNA, 25 bp, Mus musculus
gcagcacttccacagccaagtgcga

SEQ ID NO: 112285 - DNA, 25 bp, Mus musculus
gcagcagaagaagcctttgtaaacg

SEQ ID NO: 112286 - DNA, 25 bp, Mus musculus
gcagcagaagctattctccagagcg

SEQ ID NO: 112287 - DNA, 25 bp, Mus musculus
gcagcagaaggaagagtttgtaacg

SEQ ID NO: 112288 - DNA, 25 bp, Mus musculus
gcagcagacccctaaagagagactc

SEQ ID NO: 112289 - DNA, 25 bp, Mus musculus
gcagcagagaccatcaaccctgact

SEQ ID NO: 112290 - DNA, 25 bp, Mus musculus
gcagcagatggaactcaaccgagag

SEQ ID NO: 112291 - DNA, 25 bp, Mus musculus
gcagcagcaagaagatctagcccga

SEQ ID NO: 112292 - DNA, 25 bp, Mus musculus
gcagcagcaagcagaggaaggaact

SEQ ID NO: 112293 - DNA, 25 bp, Mus musculus
gcagcagcaatttccatatcagtgt

SEQ ID NO: 112294 - DNA, 25 bp, Mus musculus
gcagcagcacaagaaactcctggct

SEQ ID NO: 112295 - DNA, 25 bp, Mus musculus
gcagcagcagctactaaatcagcaa

SEQ ID NO: 112296 - DNA, 25 bp, Mus musculus
gcagcagcataaagacgcagttttg

SEQ ID NO: 112297 - DNA, 25 bp, Mus musculus
gcagcagcatcttccaatccaggca

SEQ ID NO: 112298 - DNA, 25 bp, Mus musculus
gcagcagccactgaaaatgtgactt

SEQ ID NO: 112299 - DNA, 25 bp, Mus musculus
gcagcagccatcagtttcccctttg

SEQ ID NO: 112300 - DNA, 25 bp, Mus musculus
gcagcagccgccagaagtggattgt

SEQ ID NO: 112301 - DNA, 25 bp, Mus musculus
gcagcagccgctgagaatgaccctg

SEQ ID NO: 112302 - DNA, 25 bp, Mus musculus
gcagcagccgttccgtgatagaatt

SEQ ID NO: 112303 - DNA, 25 bp, Mus musculus
gcagcagcctatacgtccttgtgag

SEQ ID NO: 112304 - DNA, 25 bp, Mus musculus
gcagcagcgatggtttgtgctacga

SEQ ID NO: 112305 - DNA, 25 bp, Mus musculus
gcagcagcgcctgtgggaaaaacta

SEQ ID NO: 112306 - DNA, 25 bp, Mus musculus
gcagcagcggatgcaaagcctgaga

SEQ ID NO: 112307 - DNA, 25 bp, Mus musculus
gcagcagctgattgacgagtaccac

SEQ ID NO: 112308 - DNA, 25 bp, Mus musculus
gcagcagcttgaagtcaatgactct

SEQ ID NO: 112309 - DNA, 25 bp, Mus musculus
gcagcaggaattcaaggatcgatct

SEQ ID NO: 112310 - DNA, 25 bp, Mus musculus
gcagcaggagcttcagggcattcac

SEQ ID NO: 112311 - DNA, 25 bp, Mus musculus
gcagcaggccaatcaagctccttca

SEQ ID NO: 112312 - DNA, 25 bp, Mus musculus
gcagcaggccttgtcctttgaggaa

SEQ ID NO: 112313 - DNA, 25 bp, Mus musculus
gcagcaggctgctcgaatcaaacag

SEQ ID NO: 112314 - DNA, 25 bp, Mus musculus
gcagcagggcctttgaacagttttt

SEQ ID NO: 112315 - DNA, 25 bp, Mus musculus
gcagcaggtctaccgtgagttccag

SEQ ID NO: 112316 - DNA, 25 bp, Mus musculus
gcagcagtacttattaaccaacgga

SEQ ID NO: 112317 - DNA, 25 bp, Mus musculus
gcagcagtagtctgcccttgcctga

SEQ ID NO: 112318 - DNA, 25 bp, Mus musculus
gcagcagtcgatggcctttcaaaga

SEQ ID NO: 112319 - DNA, 25 bp, Mus musculus
gcagcagtggctacttcagcagcag

SEQ ID NO: 112320 - DNA, 25 bp, Mus musculus
gcagcagtgtgacgattgattccat

SEQ ID NO: 112321 - DNA, 25 bp, Mus musculus
gcagcagttccgtcaagagcagcat

SEQ ID NO: 112322 - DNA, 25 bp, Mus musculus
gcagcagttctttccccaggctact

SEQ ID NO: 112323 - DNA, 25 bp, Mus musculus
gcagcagtttgcacagtccacagag

SEQ ID NO: 112324 - DNA, 25 bp, Mus musculus
gcagcatccatagccatggagaagc

SEQ ID NO: 112325 - DNA, 25 bp, Mus musculus
gcagcatccccgtgtacaagaagag

SEQ ID NO: 112326 - DNA, 25 bp, Mus musculus
gcagcatcgacatggtggactcacc

SEQ ID NO: 112327 - DNA, 25 bp, Mus musculus
gcagcatctgttttgccaagggaga

SEQ ID NO: 112328 - DNA, 25 bp, Mus musculus
gcagcatgcagtacgcatttccgag

SEQ ID NO: 112329 - DNA, 25 bp, Mus musculus
gcagcatgcgctgtatatctgggaa

SEQ ID NO: 112330 - DNA, 25 bp, Mus musculus
gcagcatggagaagcaaaagccctt

SEQ ID NO: 112331 - DNA, 25 bp, Mus musculus
gcagcatgtcttccctagagcgaga

SEQ ID NO: 112332 - DNA, 25 bp, Mus musculus
gcagcattgtcttctcagcccgagt

SEQ ID NO: 112333 - DNA, 25 bp, Mus musculus
gcagccaacaaagggtataacgatg

SEQ ID NO: 112334 - DNA, 25 bp, Mus musculus
gcagccaagcacataggcactgagt

SEQ ID NO: 112335 - DNA, 25 bp, Mus musculus
gcagccaattgagaacagtcctggg

SEQ ID NO: 112336 - DNA, 25 bp, Mus musculus
gcagccacatgttgaaggaggtgct

SEQ ID NO: 112337 - DNA, 25 bp, Mus musculus
gcagccaccacgtgagacagagcgc

SEQ ID NO: 112338 - DNA, 25 bp, Mus musculus
gcagccaccctgagtttagagagaa

SEQ ID NO: 112339 - DNA, 25 bp, Mus musculus
gcagccagagctggaatgctggagt

SEQ ID NO: 112340 - DNA, 25 bp, Mus musculus
gcagccaggcttacaatagtcccaa

SEQ ID NO: 112341 - DNA, 25 bp, Mus musculus
gcagcccaaaccatggaagccttcg

SEQ ID NO: 112342 - DNA, 25 bp, Mus musculus
gcagcccagagacagtgacattact

SEQ ID NO: 112343 - DNA, 25 bp, Mus musculus
gcagcccagagaggcccaagggatg

SEQ ID NO: 112344 - DNA, 25 bp, Mus musculus
gcagcccagccttggataaaccaga

SEQ ID NO: 112345 - DNA, 25 bp, Mus musculus
gcagcccagggaatagaagaccatt

SEQ ID NO: 112346 - DNA, 25 bp, Mus musculus
gcagccccaactctaatatgagtgg

SEQ ID NO: 112347 - DNA, 25 bp, Mus musculus
gcagccccagaccaggatgacgttt

SEQ ID NO: 112348 - DNA, 25 bp, Mus musculus
gcagcccgaccccatgaaatttgac

SEQ ID NO: 112349 - DNA, 25 bp, Mus musculus
gcagcccgattttcaagtctccagg

SEQ ID NO: 112350 - DNA, 25 bp, Mus musculus
gcagcccgcggtcttgacattgaag

SEQ ID NO: 112351 - DNA, 25 bp, Mus musculus
gcagcccggtcactaagatcatgct

SEQ ID NO: 112352 - DNA, 25 bp, Mus musculus
gcagcccttgcactatctttatttt

SEQ ID NO: 112353 - DNA, 25 bp, Mus musculus
gcagccgcagccagatttatccaaa

SEQ ID NO: 112354 - DNA, 25 bp, Mus musculus
gcagccgccttttgagatctactta

SEQ ID NO: 112355 - DNA, 25 bp, Mus musculus
gcagccggaggaaatgtaccagacc

SEQ ID NO: 112356 - DNA, 25 bp, Mus musculus
gcagccggctgagaatgtccatcaa

SEQ ID NO: 112357 - DNA, 25 bp, Mus musculus
gcagccgggtatgcgctctatggca

SEQ ID NO: 112358 - DNA, 25 bp, Mus musculus
gcagccggtgtgtcaagtcctctgg

SEQ ID NO: 112359 - DNA, 25 bp, Mus musculus
gcagccggttctcattagtttcacg

SEQ ID NO: 112360 - DNA, 25 bp, Mus musculus
gcagccgtcagctgtgcccctgaag

SEQ ID NO: 112361 - DNA, 25 bp, Mus musculus
gcagccgtgttcagacagataccga

SEQ ID NO: 112362 - DNA, 25 bp, Mus musculus
gcagcctacgccatcagcaagtttg

SEQ ID NO: 112363 - DNA, 25 bp, Mus musculus
gcagcctagccatgaagagccggtt

SEQ ID NO: 112364 - DNA, 25 bp, Mus musculus
gcagcctattgcctcagaatgaaga

SEQ ID NO: 112365 - DNA, 25 bp, Mus musculus
gcagcctctgctccttggtaaatag

SEQ ID NO: 112366 - DNA, 25 bp, Mus musculus
gcagcctcttcgaactcactatgga

SEQ ID NO: 112367 - DNA, 25 bp, Mus musculus
gcagcctgatgcattctgaatcgga

SEQ ID NO: 112368 - DNA, 25 bp, Mus musculus
gcagcctgcctgtaatcgcaggagt

SEQ ID NO: 112369 - DNA, 25 bp, Mus musculus
gcagcctgcgtcctggactccagtg

SEQ ID NO: 112370 - DNA, 25 bp, Mus musculus
gcagcctggctgagtacattgacat

SEQ ID NO: 112371 - DNA, 25 bp, Mus musculus
gcagcctggcttttggttggactca

SEQ ID NO: 112372 - DNA, 25 bp, Mus musculus
gcagccttgcactcgcgctggccag

SEQ ID NO: 112373 - DNA, 25 bp, Mus musculus
gcagccttgctgtaagctcagagga

SEQ ID NO: 112374 - DNA, 25 bp, Mus musculus
gcagcgaagtggtacaacgagcacc

SEQ ID NO: 112375 - DNA, 25 bp, Mus musculus
gcagcgaatgctcaactttgtccag

SEQ ID NO: 112376 - DNA, 25 bp, Mus musculus
gcagcgaccagaggcccatagatat

SEQ ID NO: 112377 - DNA, 25 bp, Mus musculus
gcagcgacggtataaagccggccac

SEQ ID NO: 112378 - DNA, 25 bp, Mus musculus
gcagcgactaaaggaggaatatcag

SEQ ID NO: 112379 - DNA, 25 bp, Mus musculus
gcagcgacttccaacgcagagttcc

SEQ ID NO: 112380 - DNA, 25 bp, Mus musculus
gcagcgagacgtttttggccaagct

SEQ ID NO: 112381 - DNA, 25 bp, Mus musculus
gcagcgattatgaccgttcccggga

SEQ ID NO: 112382 - DNA, 25 bp, Mus musculus
gcagcgattgtgaaaagcacccagt

SEQ ID NO: 112383 - DNA, 25 bp, Mus musculus
gcagcgcaagcggtgcaaccgctat

SEQ ID NO: 112384 - DNA, 25 bp, Mus musculus
gcagcgcagcaacgaactgctcctg

SEQ ID NO: 112385 - DNA, 25 bp, Mus musculus
gcagcgccagcaaggacagttatgt

SEQ ID NO: 112386 - DNA, 25 bp, Mus musculus
gcagcgccagttttaccacaagcag

SEQ ID NO: 112387 - DNA, 25 bp, Mus musculus
gcagcgccgctgtgggaaagtaaaa

SEQ ID NO: 112388 - DNA, 25 bp, Mus musculus
gcagcgcgaccgatttccggtttcc

SEQ ID NO: 112389 - DNA, 25 bp, Mus musculus
gcagcgcgcactcgcgcgtgcgtga

SEQ ID NO: 112390 - DNA, 25 bp, Mus musculus
gcagcgcgttgctttcccaaaatgg

SEQ ID NO: 112391 - DNA, 25 bp, Mus musculus
gcagcgctcttcactgtcttccggg

SEQ ID NO: 112392 - DNA, 25 bp, Mus musculus
gcagcgctgggtgctgacccttaaa

SEQ ID NO: 112393 - DNA, 25 bp, Mus musculus
gcagcggatccagggcctgctttgt

SEQ ID NO: 112394 - DNA, 25 bp, Mus musculus
gcagcggcaacatgaaatcaacctg

SEQ ID NO: 112395 - DNA, 25 bp, Mus musculus
gcagcggcaactgcgaatgttggaa

SEQ ID NO: 112396 - DNA, 25 bp, Mus musculus
gcagcggcaggaagaacggaggcac

SEQ ID NO: 112397 - DNA, 25 bp, Mus musculus
gcagcggctcatctacagtggcaag

SEQ ID NO: 112398 - DNA, 25 bp, Mus musculus
gcagcggctccgtggcctcttctgt

SEQ ID NO: 112399 - DNA, 25 bp, Mus musculus
gcagcggctgcaggttctggactat

SEQ ID NO: 112400 - DNA, 25 bp, Mus musculus
gcagcggtactactttgagggcatc

SEQ ID NO: 112401 - DNA, 25 bp, Mus musculus
gcagcgtccaggctcagtgtgaaca

SEQ ID NO: 112402 - DNA, 25 bp, Mus musculus
gcagcgtccatgcaccaagtgagaa

SEQ ID NO: 112403 - DNA, 25 bp, Mus musculus
gcagcgtccttacttcttgtcgtca

SEQ ID NO: 112404 - DNA, 25 bp, Mus musculus
gcagcgtgataagaatcaattccac

SEQ ID NO: 112405 - DNA, 25 bp, Mus musculus
gcagcgtgcccttctgtcgagaatc

SEQ ID NO: 112406 - DNA, 25 bp, Mus musculus
gcagcgtggtctgtgcagaagcact

SEQ ID NO: 112407 - DNA, 25 bp, Mus musculus
gcagcgtgtcagaccagttctatcg

SEQ ID NO: 112408 - DNA, 25 bp, Mus musculus
gcagcgttttgagcaagccgcggac

SEQ ID NO: 112409 - DNA, 25 bp, Mus musculus
gcagctaaagctaccagcatcagaa

SEQ ID NO: 112410 - DNA, 25 bp, Mus musculus
gcagctaccggctactaggcaagat

SEQ ID NO: 112411 - DNA, 25 bp, Mus musculus
gcagctagagcaggagcaattccat

SEQ ID NO: 112412 - DNA, 25 bp, Mus musculus
gcagctatcgagaacagaacagtgg

SEQ ID NO: 112413 - DNA, 25 bp, Mus musculus
gcagctatctcggtgtcaacttggg

SEQ ID NO: 112414 - DNA, 25 bp, Mus musculus
gcagctatgcacctagcagcagcag

SEQ ID NO: 112415 - DNA, 25 bp, Mus musculus
gcagctatgcgtcacaccagagaat

SEQ ID NO: 112416 - DNA, 25 bp, Mus musculus
gcagctatgcttttcgaccccttta

SEQ ID NO: 112417 - DNA, 25 bp, Mus musculus
gcagctcaagaccttagcccagagg

SEQ ID NO: 112418 - DNA, 25 bp, Mus musculus
gcagctcacacgttcttcatggcca

SEQ ID NO: 112419 - DNA, 25 bp, Mus musculus
gcagctcacggagaagttggcccgc

SEQ ID NO: 112420 - DNA, 25 bp, Mus musculus
gcagctcagtggcttcctgggtcac

SEQ ID NO: 112421 - DNA, 25 bp, Mus musculus
gcagctcatgtcctatattcaactc

SEQ ID NO: 112422 - DNA, 25 bp, Mus musculus
gcagctccgaagtctaaacgtttga

SEQ ID NO: 112423 - DNA, 25 bp, Mus musculus
gcagctcctcatagcagagtttcag

SEQ ID NO: 112424 - DNA, 25 bp, Mus musculus
gcagctcctggtagatccatttact

SEQ ID NO: 112425 - DNA, 25 bp, Mus musculus
gcagctcctggtggcatgaagaaca

SEQ ID NO: 112426 - DNA, 25 bp, Mus musculus
gcagctctacggcatgatctacaag

SEQ ID NO: 112427 - DNA, 25 bp, Mus musculus
gcagctctaggacctgtggaccaag

SEQ ID NO: 112428 - DNA, 25 bp, Mus musculus
gcagctctatgcaatgaaggtgtta

SEQ ID NO: 112429 - DNA, 25 bp, Mus musculus
gcagctctatgctatcacagaacag

SEQ ID NO: 112430 - DNA, 25 bp, Mus musculus
gcagctctgaaagataaactgacag

SEQ ID NO: 112431 - DNA, 25 bp, Mus musculus
gcagctcttcttaggtgggacacag

SEQ ID NO: 112432 - DNA, 25 bp, Mus musculus
gcagctcttgatgaagcccaaggag

SEQ ID NO: 112433 - DNA, 25 bp, Mus musculus
gcagctgaacaacgttactcttctg

SEQ ID NO: 112434 - DNA, 25 bp, Mus musculus
gcagctgagggtcctacctagcact

SEQ ID NO: 112435 - DNA, 25 bp, Mus musculus
gcagctgatcgaagccataagcaat

SEQ ID NO: 112436 - DNA, 25 bp, Mus musculus
gcagctgcaccttcgcacatgcact

SEQ ID NO: 112437 - DNA, 25 bp, Mus musculus
gcagctgcatttcttaacctcttag

SEQ ID NO: 112438 - DNA, 25 bp, Mus musculus
gcagctgccacggaagatgaactta

SEQ ID NO: 112439 - DNA, 25 bp, Mus musculus
gcagctgccagtcgcaagaggaaaa

SEQ ID NO: 112440 - DNA, 25 bp, Mus musculus
gcagctgccgtgtttgctttccgag

SEQ ID NO: 112441 - DNA, 25 bp, Mus musculus
gcagctgcgctctgagtacgtggca

SEQ ID NO: 112442 - DNA, 25 bp, Mus musculus
gcagctgcggctgcaatggacatga

SEQ ID NO: 112443 - DNA, 25 bp, Mus musculus
gcagctgctagttaatctgtgcaca

SEQ ID NO: 112444 - DNA, 25 bp, Mus musculus
gcagctggaccctcgtaaattgttg

SEQ ID NO: 112445 - DNA, 25 bp, Mus musculus
gcagctggaggagagtaccaaacct

SEQ ID NO: 112446 - DNA, 25 bp, Mus musculus
gcagctggtcgatgctgtgctaaca

SEQ ID NO: 112447 - DNA, 25 bp, Mus musculus
gcagctggtgaacatgggcttccca

SEQ ID NO: 112448 - DNA, 25 bp, Mus musculus
gcagctgtattcttcaacatgggcg

SEQ ID NO: 112449 - DNA, 25 bp, Mus musculus
gcagctgtcaatgacactccgaggg

SEQ ID NO: 112450 - DNA, 25 bp, Mus musculus
gcagctgtggccatgtaatttaaaa

SEQ ID NO: 112451 - DNA, 25 bp, Mus musculus
gcagctgttggatcctttcctaacg

SEQ ID NO: 112452 - DNA, 25 bp, Mus musculus
gcagcttagagcatcacaacacaga

SEQ ID NO: 112453 - DNA, 25 bp, Mus musculus
gcagcttagatgcgccacggcttcg

SEQ ID NO: 112454 - DNA, 25 bp, Mus musculus
gcagcttcagattctactgtgcgaa

SEQ ID NO: 112455 - DNA, 25 bp, Mus musculus
gcagcttccagtactgatccgcaga

SEQ ID NO: 112456 - DNA, 25 bp, Mus musculus
gcagcttcctaccttaatggcacag

SEQ ID NO: 112457 - DNA, 25 bp, Mus musculus
gcagcttcggatctttgaccccaga

SEQ ID NO: 112458 - DNA, 25 bp, Mus musculus
gcagcttctttgagcacgacgggca

SEQ ID NO: 112459 - DNA, 25 bp, Mus musculus
gcagcttgaggcacagacgaacttc

SEQ ID NO: 112460 - DNA, 25 bp, Mus musculus
gcagcttgcagctggacgggacctc

SEQ ID NO: 112461 - DNA, 25 bp, Mus musculus
gcagcttgggacaggacatctctga

SEQ ID NO: 112462 - DNA, 25 bp, Mus musculus
gcagcttggtccgaggcatcatgaa

SEQ ID NO: 112463 - DNA, 25 bp, Mus musculus
gcagctttcgaaatgccagcgaggt

SEQ ID NO: 112464 - DNA, 25 bp, Mus musculus
gcagctttcgaggatctgtccctca

SEQ ID NO: 112465 - DNA, 25 bp, Mus musculus
gcagctttgcaggaacgtcttgaca

SEQ ID NO: 112466 - DNA, 25 bp, Mus musculus
gcagcttttcggacgtatccccatg

SEQ ID NO: 112467 - DNA, 25 bp, Mus musculus
gcagcttttctgcagcgtccgagca

SEQ ID NO: 112468 - DNA, 25 bp, Mus musculus
gcagcttttgttaaatattctggga

SEQ ID NO: 112469 - DNA, 25 bp, Mus musculus
gcaggaaaagctctcaaaggcgcga

SEQ ID NO: 112470 - DNA, 25 bp, Mus musculus
gcaggaaagaacttcagggataaga

SEQ ID NO: 112471 - DNA, 25 bp, Mus musculus
gcaggaaagcgctccagatactggg

SEQ ID NO: 112472 - DNA, 25 bp, Mus musculus
gcaggaacttacaaagcagacatca

SEQ ID NO: 112473 - DNA, 25 bp, Mus musculus
gcaggaagaacagcgaaaacttggg

SEQ ID NO: 112474 - DNA, 25 bp, Mus musculus
gcaggaatatatcgcggcagttaaa

SEQ ID NO: 112475 - DNA, 25 bp, Mus musculus
gcaggacaccgatgaggacccatct

SEQ ID NO: 112476 - DNA, 25 bp, Mus musculus
gcaggacatgcccaaactccgtcgt

SEQ ID NO: 112477 - DNA, 25 bp, Mus musculus
gcaggacattgccaggtttacacgg

SEQ ID NO: 112478 - DNA, 25 bp, Mus musculus
gcaggaccagaggacgactttgaat

SEQ ID NO: 112479 - DNA, 25 bp, Mus musculus
gcaggacccagctatgcagcagcta

SEQ ID NO: 112480 - DNA, 25 bp, Mus musculus
gcaggaccctgagagctactggtat

SEQ ID NO: 112481 - DNA, 25 bp, Mus musculus
gcaggacgcacagatggctgacttt

SEQ ID NO: 112482 - DNA, 25 bp, Mus musculus
gcaggacgctcgtgcgcctgcagct

SEQ ID NO: 112483 - DNA, 25 bp, Mus musculus
gcaggactaccagcacttcgtgaag

SEQ ID NO: 112484 - DNA, 25 bp, Mus musculus
gcaggactgggcttttggcataatc

SEQ ID NO: 112485 - DNA, 25 bp, Mus musculus
gcaggagacgtgtttcagaacggat

SEQ ID NO: 112486 - DNA, 25 bp, Mus musculus
gcaggagagaattgaatttgcccat

SEQ ID NO: 112487 - DNA, 25 bp, Mus musculus
gcaggagaggtaccagactatcaca

SEQ ID NO: 112488 - DNA, 25 bp, Mus musculus
gcaggagccatgacggatgtgcacc

SEQ ID NO: 112489 - DNA, 25 bp, Mus musculus
gcaggagccccacaaacacatgttg

SEQ ID NO: 112490 - DNA, 25 bp, Mus musculus
gcaggagcctacattctcagcagat

SEQ ID NO: 112491 - DNA, 25 bp, Mus musculus
gcaggagctgactaacacgtcggcc

SEQ ID NO: 112492 - DNA, 25 bp, Mus musculus
gcaggatcacgatgttccggatgct

SEQ ID NO: 112493 - DNA, 25 bp, Mus musculus
gcaggatctaccttacccaggatgg

SEQ ID NO: 112494 - DNA, 25 bp, Mus musculus
gcaggatctgtagacccggagagaa

SEQ ID NO: 112495 - DNA, 25 bp, Mus musculus
gcaggatcttcaagggccatcgcta

SEQ ID NO: 112496 - DNA, 25 bp, Mus musculus
gcaggatgcccagatcaactctgtg

SEQ ID NO: 112497 - DNA, 25 bp, Mus musculus
gcaggatgccgtcaacattgtatgt

SEQ ID NO: 112498 - DNA, 25 bp, Mus musculus
gcaggcacatgagcagatcacacat

SEQ ID NO: 112499 - DNA, 25 bp, Mus musculus
gcaggcagggtgtgtattccaactc

SEQ ID NO: 112500 - DNA, 25 bp, Mus musculus
gcaggcatcatcaaccagccgtatt

SEQ ID NO: 112501 - DNA, 25 bp, Mus musculus
gcaggcatcattggctgggcatatg

SEQ ID NO: 112502 - DNA, 25 bp, Mus musculus
gcaggcatgccccggacactgactg

SEQ ID NO: 112503 - DNA, 25 bp, Mus musculus
gcaggcattgcagtctaccgaaaat

SEQ ID NO: 112504 - DNA, 25 bp, Mus musculus
gcaggcccacatattccacatggag

SEQ ID NO: 112505 - DNA, 25 bp, Mus musculus
gcaggcccagccaataacaaagatt

SEQ ID NO: 112506 - DNA, 25 bp, Mus musculus
gcaggcccgggctgcagaacagcta

SEQ ID NO: 112507 - DNA, 25 bp, Mus musculus
gcaggccctccagaaacagtttgta

SEQ ID NO: 112508 - DNA, 25 bp, Mus musculus
gcaggccgcactctgaccatggtat

SEQ ID NO: 112509 - DNA, 25 bp, Mus musculus
gcaggccggagcatcacaatttgag

SEQ ID NO: 112510 - DNA, 25 bp, Mus musculus
gcaggccggcctaaaggatcaaaag

SEQ ID NO: 112511 - DNA, 25 bp, Mus musculus
gcaggcgactgcaatggcttggact

SEQ ID NO: 112512 - DNA, 25 bp, Mus musculus
gcaggcgcacttccaacgtttgaga

SEQ ID NO: 112513 - DNA, 25 bp, Mus musculus
gcaggcgcgctcaagatgtcgtaca

SEQ ID NO: 112514 - DNA, 25 bp, Mus musculus
gcaggcgggtttttgggtcttctca

SEQ ID NO: 112515 - DNA, 25 bp, Mus musculus
gcaggctaatcaggaggcccgagta

SEQ ID NO: 112516 - DNA, 25 bp, Mus musculus
gcaggctcacagacctcagtcatgt

SEQ ID NO: 112517 - DNA, 25 bp, Mus musculus
gcaggctccacgctgaacggttaca

SEQ ID NO: 112518 - DNA, 25 bp, Mus musculus
gcaggctccggatactgactagtca

SEQ ID NO: 112519 - DNA, 25 bp, Mus musculus
gcaggctcctctacaggcattatgg

SEQ ID NO: 112520 - DNA, 25 bp, Mus musculus
gcaggctctactagttggcgaggca

SEQ ID NO: 112521 - DNA, 25 bp, Mus musculus
gcaggctctgtcacccactatggat

SEQ ID NO: 112522 - DNA, 25 bp, Mus musculus
gcaggctctttataggccctccagg

SEQ ID NO: 112523 - DNA, 25 bp, Mus musculus
gcaggctggctgagtatcaacccca

SEQ ID NO: 112524 - DNA, 25 bp, Mus musculus
gcaggctgggaggaatgctcttctc

SEQ ID NO: 112525 - DNA, 25 bp, Mus musculus
gcaggctgtcctgcctgctatgagg

SEQ ID NO: 112526 - DNA, 25 bp, Mus musculus
gcaggctgtgtcacacgggttttcc

SEQ ID NO: 112527 - DNA, 25 bp, Mus musculus
gcagggaagggtcatagtcggcccc

SEQ ID NO: 112528 - DNA, 25 bp, Mus musculus
gcagggactcgtgaaacagcaggat

SEQ ID NO: 112529 - DNA, 25 bp, Mus musculus
gcagggagtccttgacgaggcatac

SEQ ID NO: 112530 - DNA, 25 bp, Mus musculus
gcagggataccatggctccagagga

SEQ ID NO: 112531 - DNA, 25 bp, Mus musculus
gcagggatgttttctcacaggaggc

SEQ ID NO: 112532 - DNA, 25 bp, Mus musculus
gcagggattgctctgtgacacagcc

SEQ ID NO: 112533 - DNA, 25 bp, Mus musculus
gcagggatttttacccagccagcta

SEQ ID NO: 112534 - DNA, 25 bp, Mus musculus
gcagggcactgagcatcaaggaaca

SEQ ID NO: 112535 - DNA, 25 bp, Mus musculus
gcagggctcttatgggacagcagca

SEQ ID NO: 112536 - DNA, 25 bp, Mus musculus
gcagggctggacgtgaagccattca

SEQ ID NO: 112537 - DNA, 25 bp, Mus musculus
gcagggcttctactacgatggcaac

SEQ ID NO: 112538 - DNA, 25 bp, Mus musculus
gcagggtaacacaagtcccttgaag

SEQ ID NO: 112539 - DNA, 25 bp, Mus musculus
gcagggtagcctgttcaacgccaac

SEQ ID NO: 112540 - DNA, 25 bp, Mus musculus
gcagggtctcaatgctcagcgagga

SEQ ID NO: 112541 - DNA, 25 bp, Mus musculus
gcagggtgtatcatccagtgagcac

SEQ ID NO: 112542 - DNA, 25 bp, Mus musculus
gcaggtagcccagtctcggatcaat

SEQ ID NO: 112543 - DNA, 25 bp, Mus musculus
gcaggtatactctggtttcccaggg

SEQ ID NO: 112544 - DNA, 25 bp, Mus musculus
gcaggtcaggaaaccaggtctcaga

SEQ ID NO: 112545 - DNA, 25 bp, Mus musculus
gcaggtcagttaaacccgacgggca

SEQ ID NO: 112546 - DNA, 25 bp, Mus musculus
gcaggtccggtatgagcacaggttt

SEQ ID NO: 112547 - DNA, 25 bp, Mus musculus
gcaggtcctgagggcccttggaacc

SEQ ID NO: 112548 - DNA, 25 bp, Mus musculus
gcaggtggagagtggccatttccca

SEQ ID NO: 112549 - DNA, 25 bp, Mus musculus
gcaggttcagattggcttcacaggc

SEQ ID NO: 112550 - DNA, 25 bp, Mus musculus
gcaggttcattttgcaacacaaggg

SEQ ID NO: 112551 - DNA, 25 bp, Mus musculus
gcaggttccagaggctcgctgcttc

SEQ ID NO: 112552 - DNA, 25 bp, Mus musculus
gcaggttctgaccatgctgtgaaaa

SEQ ID NO: 112553 - DNA, 25 bp, Mus musculus
gcaggtttcctgtgtacccaatgga

SEQ ID NO: 112554 - DNA, 25 bp, Mus musculus
gcaggtttctctcttgggcaggcaa

SEQ ID NO: 112555 - DNA, 25 bp, Mus musculus
gcaggtttgcccagacaatggagca

SEQ ID NO: 112556 - DNA, 25 bp, Mus musculus
gcagtaaagaaaaagcggccgtgtt

SEQ ID NO: 112557 - DNA, 25 bp, Mus musculus
gcagtaaagcgctcactggctcgaa

SEQ ID NO: 112558 - DNA, 25 bp, Mus musculus
gcagtaacaggatctcaaccagcaa

SEQ ID NO: 112559 - DNA, 25 bp, Mus musculus
gcagtaactcatctctcagctcaac

SEQ ID NO: 112560 - DNA, 25 bp, Mus musculus
gcagtaactggcaacggatagacct

SEQ ID NO: 112561 - DNA, 25 bp, Mus musculus
gcagtaatagccgtcaaaccagtct

SEQ ID NO: 112562 - DNA, 25 bp, Mus musculus
gcagtacacatctatcgccctttgg

SEQ ID NO: 112563 - DNA, 25 bp, Mus musculus
gcagtacagtgctatcaaggaggaa

SEQ ID NO: 112564 - DNA, 25 bp, Mus musculus
gcagtacatgttttgggccctcgtt

SEQ ID NO: 112565 - DNA, 25 bp, Mus musculus
gcagtaccgcaaggaccctaaggaa

SEQ ID NO: 112566 - DNA, 25 bp, Mus musculus
gcagtaccggaagcgatgtggccta

SEQ ID NO: 112567 - DNA, 25 bp, Mus musculus
gcagtactctttgacatcaccgagg

SEQ ID NO: 112568 - DNA, 25 bp, Mus musculus
gcagtactgccacaaagctgtgaga

SEQ ID NO: 112569 - DNA, 25 bp, Mus musculus
gcagtacttcttcaaaccacagcgg

SEQ ID NO: 112570 - DNA, 25 bp, Mus musculus
gcagtagagcccaggttccaagaat

SEQ ID NO: 112571 - DNA, 25 bp, Mus musculus
gcagtagagtttgctccggtctcgc

SEQ ID NO: 112572 - DNA, 25 bp, Mus musculus
gcagtagcagtaggaagcgacctct

SEQ ID NO: 112573 - DNA, 25 bp, Mus musculus
gcagtagcctgtgccaaagtgccta

SEQ ID NO: 112574 - DNA, 25 bp, Mus musculus
gcagtagcgactagctctcctcggt

SEQ ID NO: 112575 - DNA, 25 bp, Mus musculus
gcagtaggaaccttcatgctcgggt

SEQ ID NO: 112576 - DNA, 25 bp, Mus musculus
gcagtagtatgtgaagcagccgcca

SEQ ID NO: 112577 - DNA, 25 bp, Mus musculus
gcagtataccggacagcctagcgat

SEQ ID NO: 112578 - DNA, 25 bp, Mus musculus
gcagtatagcacaatctcagaattt

SEQ ID NO: 112579 - DNA, 25 bp, Mus musculus
gcagtatccagttcagccgcctggg

SEQ ID NO: 112580 - DNA, 25 bp, Mus musculus
gcagtatccgagagctccatgagat

SEQ ID NO: 112581 - DNA, 25 bp, Mus musculus
gcagtatctctgcatctgggaaata

SEQ ID NO: 112582 - DNA, 25 bp, Mus musculus
gcagtatgaaaccatcctccgggag

SEQ ID NO: 112583 - DNA, 25 bp, Mus musculus
gcagtatgacatcccgtaccctgaa

SEQ ID NO: 112584 - DNA, 25 bp, Mus musculus
gcagtatggccttttccacggagaa

SEQ ID NO: 112585 - DNA, 25 bp, Mus musculus
gcagtatttgcgagaccttccagag

SEQ ID NO: 112586 - DNA, 25 bp, Mus musculus
gcagtcaaaacaccgatgtacataa

SEQ ID NO: 112587 - DNA, 25 bp, Mus musculus
gcagtcagactgtggccgctttcag

SEQ ID NO: 112588 - DNA, 25 bp, Mus musculus
gcagtcagcctcttgtcggtatgag

SEQ ID NO: 112589 - DNA, 25 bp, Mus musculus
gcagtcagtacctctctgctggagg

SEQ ID NO: 112590 - DNA, 25 bp, Mus musculus
gcagtcatccctagatcccttgtag

SEQ ID NO: 112591 - DNA, 25 bp, Mus musculus
gcagtccagatcagaaggcagagct

SEQ ID NO: 112592 - DNA, 25 bp, Mus musculus
gcagtccatccgagtgaggccagtt

SEQ ID NO: 112593 - DNA, 25 bp, Mus musculus
gcagtccccatgtcgtgttcaacgg

SEQ ID NO: 112594 - DNA, 25 bp, Mus musculus
gcagtcccggtcttggtccaggaaa

SEQ ID NO: 112595 - DNA, 25 bp, Mus musculus
gcagtccgagcccttgtcctggaga

SEQ ID NO: 112596 - DNA, 25 bp, Mus musculus
gcagtcctcaagtgtctccatggag

SEQ ID NO: 112597 - DNA, 25 bp, Mus musculus
gcagtcgctacttgatgctcacaaa

SEQ ID NO: 112598 - DNA, 25 bp, Mus musculus
gcagtcggaggtgctggtggcagcc

SEQ ID NO: 112599 - DNA, 25 bp, Mus musculus
gcagtctccggcactttgcttgtga

SEQ ID NO: 112600 - DNA, 25 bp, Mus musculus
gcagtctcggaacccaggaagtcaa

SEQ ID NO: 112601 - DNA, 25 bp, Mus musculus
gcagtctggttctctcaaaggctcc

SEQ ID NO: 112602 - DNA, 25 bp, Mus musculus
gcagtcttctggacccattaccaaa

SEQ ID NO: 112603 - DNA, 25 bp, Mus musculus
gcagtgaaaaccctaagactaaacg

SEQ ID NO: 112604 - DNA, 25 bp, Mus musculus
gcagtgacccggaaaaccttcatga

SEQ ID NO: 112605 - DNA, 25 bp, Mus musculus
gcagtgaccgaagtaacctgtccca

SEQ ID NO: 112606 - DNA, 25 bp, Mus musculus
gcagtgacgcagacaacgaaattac

SEQ ID NO: 112607 - DNA, 25 bp, Mus musculus
gcagtgacgtcatcatgatcgagag

SEQ ID NO: 112608 - DNA, 25 bp, Mus musculus
gcagtgacttcagtgacccggttta

SEQ ID NO: 112609 - DNA, 25 bp, Mus musculus
gcagtgacttctgcctgcgctcaag

SEQ ID NO: 112610 - DNA, 25 bp, Mus musculus
gcagtgatacacctgggagctccaa

SEQ ID NO: 112611 - DNA, 25 bp, Mus musculus
gcagtgatgggaagaaacacccgta

SEQ ID NO: 112612 - DNA, 25 bp, Mus musculus
gcagtgatgttgaagatccccggga

SEQ ID NO: 112613 - DNA, 25 bp, Mus musculus
gcagtgattcggacagcgaagttga

SEQ ID NO: 112614 - DNA, 25 bp, Mus musculus
gcagtgcaatgcagaccctctacca

SEQ ID NO: 112615 - DNA, 25 bp, Mus musculus
gcagtgcagaaataccgatggctcc

SEQ ID NO: 112616 - DNA, 25 bp, Mus musculus
gcagtgcatattaccactctgttta

SEQ ID NO: 112617 - DNA, 25 bp, Mus musculus
gcagtgccagctcttaatcgcacag

SEQ ID NO: 112618 - DNA, 25 bp, Mus musculus
gcagtgccgaggactacgaataccc

SEQ ID NO: 112619 - DNA, 25 bp, Mus musculus
gcagtgccttctatgacgtggccag

SEQ ID NO: 112620 - DNA, 25 bp, Mus musculus
gcagtgcggcaattcagtgtacagg

SEQ ID NO: 112621 - DNA, 25 bp, Mus musculus
gcagtgcggctcgttctcagctgga

SEQ ID NO: 112622 - DNA, 25 bp, Mus musculus
gcagtgcgggcctctcagacttgtt

SEQ ID NO: 112623 - DNA, 25 bp, Mus musculus
gcagtgctcactgctgagatcacca

SEQ ID NO: 112624 - DNA, 25 bp, Mus musculus
gcagtgctcgccacatggtcatgca

SEQ ID NO: 112625 - DNA, 25 bp, Mus musculus
gcagtgctcgcggaactgaatgcga

SEQ ID NO: 112626 - DNA, 25 bp, Mus musculus
gcagtgctgcacagaggaagttcca

SEQ ID NO: 112627 - DNA, 25 bp, Mus musculus
gcagtgctggatgcttgctgtgcca

SEQ ID NO: 112628 - DNA, 25 bp, Mus musculus
gcagtgctggcaacgcaaccatctc

SEQ ID NO: 112629 - DNA, 25 bp, Mus musculus
gcagtgctttggcaggactctttca

SEQ ID NO: 112630 - DNA, 25 bp, Mus musculus
gcagtggaccacatcaacagcagga

SEQ ID NO: 112631 - DNA, 25 bp, Mus musculus
gcagtggagttcacagtttaggtca

SEQ ID NO: 112632 - DNA, 25 bp, Mus musculus
gcagtgggacatctcctgtgcctga

SEQ ID NO: 112633 - DNA, 25 bp, Mus musculus
gcagtgggcgcccagttaccagcaa

SEQ ID NO: 112634 - DNA, 25 bp, Mus musculus
gcagtggtagccttaccccggaaat

SEQ ID NO: 112635 - DNA, 25 bp, Mus musculus
gcagtggtcctcatagtctttgggc

SEQ ID NO: 112636 - DNA, 25 bp, Mus musculus
gcagtggtgtgagatcggcttccaa

SEQ ID NO: 112637 - DNA, 25 bp, Mus musculus
gcagtgtaagctccagtccctttgg

SEQ ID NO: 112638 - DNA, 25 bp, Mus musculus
gcagtgtcagcgtatcttccaggtg

SEQ ID NO: 112639 - DNA, 25 bp, Mus musculus
gcagtgtcccctaaaacaaaggagt

SEQ ID NO: 112640 - DNA, 25 bp, Mus musculus
gcagtgtccctccagagtcctgaga

SEQ ID NO: 112641 - DNA, 25 bp, Mus musculus
gcagtgtcttgcaatggctcttcag

SEQ ID NO: 112642 - DNA, 25 bp, Mus musculus
gcagtgtgatgcaagcatggcagtt

SEQ ID NO: 112643 - DNA, 25 bp, Mus musculus
gcagtgtgcacaatctgtcctggag

SEQ ID NO: 112644 - DNA, 25 bp, Mus musculus
gcagtgtgcacttcccgacagttgt

SEQ ID NO: 112645 - DNA, 25 bp, Mus musculus
gcagtgtgctgcgtctttcgatcct

SEQ ID NO: 112646 - DNA, 25 bp, Mus musculus
gcagtgtggaaagccttaggagttc

SEQ ID NO: 112647 - DNA, 25 bp, Mus musculus
gcagtgtgtctacttcgtaagagcc

SEQ ID NO: 112648 - DNA, 25 bp, Mus musculus
gcagtgtttatcacaggcaaggaca

SEQ ID NO: 112649 - DNA, 25 bp, Mus musculus
gcagtgttttctacccctccattaa

SEQ ID NO: 112650 - DNA, 25 bp, Mus musculus
gcagttaagaggacattggctcgcc

SEQ ID NO: 112651 - DNA, 25 bp, Mus musculus
gcagttaagcaatgtgcaccaggaa

SEQ ID NO: 112652 - DNA, 25 bp, Mus musculus
gcagttacttcagtgacggcctcag

SEQ ID NO: 112653 - DNA, 25 bp, Mus musculus
gcagttagatgctgaggtgcgccct

SEQ ID NO: 112654 - DNA, 25 bp, Mus musculus
gcagttcaaggacttccagcgacga

SEQ ID NO: 112655 - DNA, 25 bp, Mus musculus
gcagttcaatgatgtaatacctgag

SEQ ID NO: 112656 - DNA, 25 bp, Mus musculus
gcagttcacagaaatgacctggtct

SEQ ID NO: 112657 - DNA, 25 bp, Mus musculus
gcagttcagcaaaatggagctccag

SEQ ID NO: 112658 - DNA, 25 bp, Mus musculus
gcagttcagcatagagaacagcact

SEQ ID NO: 112659 - DNA, 25 bp, Mus musculus
gcagttcagtattctgtaggttaaa

SEQ ID NO: 112660 - DNA, 25 bp, Mus musculus
gcagttccacaaacatgacttgctg

SEQ ID NO: 112661 - DNA, 25 bp, Mus musculus
gcagttccacctgagtaacctggag

SEQ ID NO: 112662 - DNA, 25 bp, Mus musculus
gcagttccagggatatggccaacaa

SEQ ID NO: 112663 - DNA, 25 bp, Mus musculus
gcagttcgggaaaataaaactgcgg

SEQ ID NO: 112664 - DNA, 25 bp, Mus musculus
gcagttctctccttcgcataggcag

SEQ ID NO: 112665 - DNA, 25 bp, Mus musculus
gcagttctggatttccgaacgccaa

SEQ ID NO: 112666 - DNA, 25 bp, Mus musculus
gcagttctggtttcaaggcaatcga

SEQ ID NO: 112667 - DNA, 25 bp, Mus musculus
gcagttgattgaacctggatgcaga

SEQ ID NO: 112668 - DNA, 25 bp, Mus musculus
gcagttgccttcctgacgcacagag

SEQ ID NO: 112669 - DNA, 25 bp, Mus musculus
gcagttgcggtctgtgtccagcgta

SEQ ID NO: 112670 - DNA, 25 bp, Mus musculus
gcagttgctggtacttggccctcag

SEQ ID NO: 112671 - DNA, 25 bp, Mus musculus
gcagttggagaggacagcaacagtc

SEQ ID NO: 112672 - DNA, 25 bp, Mus musculus
gcagttggccgggaaagacactcct

SEQ ID NO: 112673 - DNA, 25 bp, Mus musculus
gcagttgggcctgaaacaggtttct

SEQ ID NO: 112674 - DNA, 25 bp, Mus musculus
gcagttggtttcatggcctgaggca

SEQ ID NO: 112675 - DNA, 25 bp, Mus musculus
gcagttgtatgcagcagatcggaac

SEQ ID NO: 112676 - DNA, 25 bp, Mus musculus
gcagttgtccagaagcgctttggct

SEQ ID NO: 112677 - DNA, 25 bp, Mus musculus
gcagtttcaaaatgcagtgcaggcc

SEQ ID NO: 112678 - DNA, 25 bp, Mus musculus
gcagtttcggaagaatgatggctcc

SEQ ID NO: 112679 - DNA, 25 bp, Mus musculus
gcagtttctatattacacttctcga

SEQ ID NO: 112680 - DNA, 25 bp, Mus musculus
gcagtttctggctaaaatcaccaac

SEQ ID NO: 112681 - DNA, 25 bp, Mus musculus
gcagtttgaccactacctcgaggaa

SEQ ID NO: 112682 - DNA, 25 bp, Mus musculus
gcagtttgaggtacagcttcagcag

SEQ ID NO: 112683 - DNA, 25 bp, Mus musculus
gcagtttgcatgtcacggtggtacc

SEQ ID NO: 112684 - DNA, 25 bp, Mus musculus
gcagtttgcctcgatcctggacaca

SEQ ID NO: 112685 - DNA, 25 bp, Mus musculus
gcagtttggagaccgcgagttctac

SEQ ID NO: 112686 - DNA, 25 bp, Mus musculus
gcagtttggccagctggatcagcac

SEQ ID NO: 112687 - DNA, 25 bp, Mus musculus
gcagtttgtcgagaggcttccttcc

SEQ ID NO: 112688 - DNA, 25 bp, Mus musculus
gcagttttccgagggcagtgtgcca

SEQ ID NO: 112689 - DNA, 25 bp, Mus musculus
gcagttttcctattttaaaagcgag

SEQ ID NO: 112690 - DNA, 25 bp, Mus musculus
gcagttttttagcaaggcccagtaa

SEQ ID NO: 112691 - DNA, 25 bp, Mus musculus
gcagttttttgtacaggctctcagg

SEQ ID NO: 112692 - DNA, 25 bp, Mus musculus
gcataaaattacttgggcaggctca

SEQ ID NO: 112693 - DNA, 25 bp, Mus musculus
gcataaagaggtctctcctctatgg

SEQ ID NO: 112694 - DNA, 25 bp, Mus musculus
gcataaagtaatgagtgagatcaag

SEQ ID NO: 112695 - DNA, 25 bp, Mus musculus
gcataaatgtttgtgtccatgagat

SEQ ID NO: 112696 - DNA, 25 bp, Mus musculus
gcataacaaggaggctatcaggagg

SEQ ID NO: 112697 - DNA, 25 bp, Mus musculus
gcataacaatgagtaccggacagag

SEQ ID NO: 112698 - DNA, 25 bp, Mus musculus
gcataacatctgatgctaacgttct

SEQ ID NO: 112699 - DNA, 25 bp, Mus musculus
gcataactcccagattctatgtcca

SEQ ID NO: 112700 - DNA, 25 bp, Mus musculus
gcataagacatcctagccccagtcg

SEQ ID NO: 112701 - DNA, 25 bp, Mus musculus
gcataaggatctgcacacctatggg

SEQ ID NO: 112702 - DNA, 25 bp, Mus musculus
gcataatctggcctcttctctggga

SEQ ID NO: 112703 - DNA, 25 bp, Mus musculus
gcataatggatgagaggaaccgaca

SEQ ID NO: 112704 - DNA, 25 bp, Mus musculus
gcataatgtagctgaagttctcacc

SEQ ID NO: 112705 - DNA, 25 bp, Mus musculus
gcataattgatggaaggccggcgca

SEQ ID NO: 112706 - DNA, 25 bp, Mus musculus
gcatacagatgtgggagatatcaag

SEQ ID NO: 112707 - DNA, 25 bp, Mus musculus
gcatacagcccctgggtccttgtgg

SEQ ID NO: 112708 - DNA, 25 bp, Mus musculus
gcatacagtgactatgatcccaggg

SEQ ID NO: 112709 - DNA, 25 bp, Mus musculus
gcatacctcttgcagcaccctgagg

SEQ ID NO: 112710 - DNA, 25 bp, Mus musculus
gcatacgattcatggccagaagccg

SEQ ID NO: 112711 - DNA, 25 bp, Mus musculus
gcatacggccacaaaaggaaggaaa

SEQ ID NO: 112712 - DNA, 25 bp, Mus musculus
gcatactagcctgggttaccgtgaa

SEQ ID NO: 112713 - DNA, 25 bp, Mus musculus
gcatactctggttcccttcctacaa

SEQ ID NO: 112714 - DNA, 25 bp, Mus musculus
gcatactgctttgaggtggcagccc

SEQ ID NO: 112715 - DNA, 25 bp, Mus musculus
gcatactttctaaggcggtggccaa

SEQ ID NO: 112716 - DNA, 25 bp, Mus musculus
gcatactttggacactctgagcaga

SEQ ID NO: 112717 - DNA, 25 bp, Mus musculus
gcatagaaaaatcacgacagttgtt

SEQ ID NO: 112718 - DNA, 25 bp, Mus musculus
gcatagaacttccaaaggtgaaacc

SEQ ID NO: 112719 - DNA, 25 bp, Mus musculus
gcatagagcttcagttggtccgggt

SEQ ID NO: 112720 - DNA, 25 bp, Mus musculus
gcatagatgccagtcaaccagatgt

SEQ ID NO: 112721 - DNA, 25 bp, Mus musculus
gcatagatgtgcagctggccaagtt

SEQ ID NO: 112722 - DNA, 25 bp, Mus musculus
gcatagcagaagtaggcaccaacct

SEQ ID NO: 112723 - DNA, 25 bp, Mus musculus
gcatagcagtcacctaggatgatag

SEQ ID NO: 112724 - DNA, 25 bp, Mus musculus
gcatagcatgaaccgggtggcccat

SEQ ID NO: 112725 - DNA, 25 bp, Mus musculus
gcatagccattttggaagggaatga

SEQ ID NO: 112726 - DNA, 25 bp, Mus musculus
gcatagcggagttactggagatcct

SEQ ID NO: 112727 - DNA, 25 bp, Mus musculus
gcatagctagtttctggacagccag

SEQ ID NO: 112728 - DNA, 25 bp, Mus musculus
gcataggatccaggaatgtggccaa

SEQ ID NO: 112729 - DNA, 25 bp, Mus musculus
gcataggccgtactaacctgtcaga

SEQ ID NO: 112730 - DNA, 25 bp, Mus musculus
gcatagtagcaagtcctctggtagg

SEQ ID NO: 112731 - DNA, 25 bp, Mus musculus
gcatagtggaacagtctataacaca

SEQ ID NO: 112732 - DNA, 25 bp, Mus musculus
gcatataactggagcctctgccggg

SEQ ID NO: 112733 - DNA, 25 bp, Mus musculus
gcatatattctgtggtccaggctgt

SEQ ID NO: 112734 - DNA, 25 bp, Mus musculus
gcatatcagagggaaggaccacagt

SEQ ID NO: 112735 - DNA, 25 bp, Mus musculus
gcatatccaacagcctcgcaagtga

SEQ ID NO: 112736 - DNA, 25 bp, Mus musculus
gcatatggcctaaaaaagccgtcca

SEQ ID NO: 112737 - DNA, 25 bp, Mus musculus
gcatatgtgacgaaggctaccagcc

SEQ ID NO: 112738 - DNA, 25 bp, Mus musculus
gcatatgtggcaacccaagggcctt

SEQ ID NO: 112739 - DNA, 25 bp, Mus musculus
gcatcaaaattactacagccaggag

SEQ ID NO: 112740 - DNA, 25 bp, Mus musculus
gcatcaaagccatcgtacaactggt

SEQ ID NO: 112741 - DNA, 25 bp, Mus musculus
gcatcaaaggaggaccaggcactgt

SEQ ID NO: 112742 - DNA, 25 bp, Mus musculus
gcatcaacgccatggcagaagacgg

SEQ ID NO: 112743 - DNA, 25 bp, Mus musculus
gcatcaacttattgctgggagcaaa

SEQ ID NO: 112744 - DNA, 25 bp, Mus musculus
gcatcaagaatttcagaccccaaga

SEQ ID NO: 112745 - DNA, 25 bp, Mus musculus
gcatcaagacttacagaacagttag

SEQ ID NO: 112746 - DNA, 25 bp, Mus musculus
gcatcaagatggagcaccagctgga

SEQ ID NO: 112747 - DNA, 25 bp, Mus musculus
gcatcaagcagctggcagaagcgct

SEQ ID NO: 112748 - DNA, 25 bp, Mus musculus
gcatcaagcagtccacagcagtgtg

SEQ ID NO: 112749 - DNA, 25 bp, Mus musculus
gcatcaagcgcatctttcacaccgt

SEQ ID NO: 112750 - DNA, 25 bp, Mus musculus
gcatcaaggagtcctggctcttgtg

SEQ ID NO: 112751 - DNA, 25 bp, Mus musculus
gcatcaagttcgaagtggtccacaa

SEQ ID NO: 112752 - DNA, 25 bp, Mus musculus
gcatcaatgtcttcacctcagccaa

SEQ ID NO: 112753 - DNA, 25 bp, Mus musculus
gcatcacccgggagctactgtggtg

SEQ ID NO: 112754 - DNA, 25 bp, Mus musculus
gcatcactgaagtgcctgccaactg

SEQ ID NO: 112755 - DNA, 25 bp, Mus musculus
gcatcactgaggtcactggaggaca

SEQ ID NO: 112756 - DNA, 25 bp, Mus musculus
gcatcagaagctggacagagggcca

SEQ ID NO: 112757 - DNA, 25 bp, Mus musculus
gcatcagagatgtcatagccttccc

SEQ ID NO: 112758 - DNA, 25 bp, Mus musculus
gcatcagatgctcccaaaagccgga

SEQ ID NO: 112759 - DNA, 25 bp, Mus musculus
gcatcagcagaagcctcagggtttt

SEQ ID NO: 112760 - DNA, 25 bp, Mus musculus
gcatcagcaggaaagacgctctcaa

SEQ ID NO: 112761 - DNA, 25 bp, Mus musculus
gcatcagccgtgaacttgccatcaa

SEQ ID NO: 112762 - DNA, 25 bp, Mus musculus
gcatcagggcagtagctatttttat

SEQ ID NO: 112763 - DNA, 25 bp, Mus musculus
gcatcagtgaccttgacgaccacag

SEQ ID NO: 112764 - DNA, 25 bp, Mus musculus
gcatcagttgcagctcctagcggaa

SEQ ID NO: 112765 - DNA, 25 bp, Mus musculus
gcatcatccatgcactggttggctt

SEQ ID NO: 112766 - DNA, 25 bp, Mus musculus
gcatcatcgaggagacgctcgcgct

SEQ ID NO: 112767 - DNA, 25 bp, Mus musculus
gcatcatcggtaccctctgcggtag

SEQ ID NO: 112768 - DNA, 25 bp, Mus musculus
gcatcatcgtatgacggccctgaaa

SEQ ID NO: 112769 - DNA, 25 bp, Mus musculus
gcatcatgaaaagcctcctactggt

SEQ ID NO: 112770 - DNA, 25 bp, Mus musculus
gcatcatgacgttcttcgggcacct

SEQ ID NO: 112771 - DNA, 25 bp, Mus musculus
gcatcattattgacagccggacacc

SEQ ID NO: 112772 - DNA, 25 bp, Mus musculus
gcatcattccccaagctggagctgg

SEQ ID NO: 112773 - DNA, 25 bp, Mus musculus
gcatcattttcatcgctgcgctgag

SEQ ID NO: 112774 - DNA, 25 bp, Mus musculus
gcatccagtgatgtgcgggacagca

SEQ ID NO: 112775 - DNA, 25 bp, Mus musculus
gcatccatccgtactacaaccgtgt

SEQ ID NO: 112776 - DNA, 25 bp, Mus musculus
gcatccatgatgcatcgccaagaga

SEQ ID NO: 112777 - DNA, 25 bp, Mus musculus
gcatcccagagaacgacaaaccttg

SEQ ID NO: 112778 - DNA, 25 bp, Mus musculus
gcatcccatagagcaggctgcctgt

SEQ ID NO: 112779 - DNA, 25 bp, Mus musculus
gcatcccatgaatagtttgaaccct

SEQ ID NO: 112780 - DNA, 25 bp, Mus musculus
gcatcccctgcctggaagtgaccag

SEQ ID NO: 112781 - DNA, 25 bp, Mus musculus
gcatcccggcatggaagacgtgcag

SEQ ID NO: 112782 - DNA, 25 bp, Mus musculus
gcatcccgtgcaatattccaggcag

SEQ ID NO: 112783 - DNA, 25 bp, Mus musculus
gcatccctcgaggtgtacaaaggta

SEQ ID NO: 112784 - DNA, 25 bp, Mus musculus
gcatcccttgcatagcgtgcacaga

SEQ ID NO: 112785 - DNA, 25 bp, Mus musculus
gcatccgagcaagaagacaactttg

SEQ ID NO: 112786 - DNA, 25 bp, Mus musculus
gcatccgaggaagaatacgtgatta

SEQ ID NO: 112787 - DNA, 25 bp, Mus musculus
gcatccgctgctttcgggacatgca

SEQ ID NO: 112788 - DNA, 25 bp, Mus musculus
gcatccggttgaacaccaaggcctt

SEQ ID NO: 112789 - DNA, 25 bp, Mus musculus
gcatcctaatccctatgaagtcact

SEQ ID NO: 112790 - DNA, 25 bp, Mus musculus
gcatcctctgctacgtgggagccta

SEQ ID NO: 112791 - DNA, 25 bp, Mus musculus
gcatcctgcacggactagagctggg

SEQ ID NO: 112792 - DNA, 25 bp, Mus musculus
gcatcctgcactctaatggccttgg

SEQ ID NO: 112793 - DNA, 25 bp, Mus musculus
gcatcctggctgttacttggaccca

SEQ ID NO: 112794 - DNA, 25 bp, Mus musculus
gcatcctgggactggcttatgccat

SEQ ID NO: 112795 - DNA, 25 bp, Mus musculus
gcatcctttggacccctgaggcctg

SEQ ID NO: 112796 - DNA, 25 bp, Mus musculus
gcatcgacgtaagggaagagctctt

SEQ ID NO: 112797 - DNA, 25 bp, Mus musculus
gcatcgagggatgtggataccacca

SEQ ID NO: 112798 - DNA, 25 bp, Mus musculus
gcatcgcagaagaaaataaagtcct

SEQ ID NO: 112799 - DNA, 25 bp, Mus musculus
gcatcgcagccactaactttgaagg

SEQ ID NO: 112800 - DNA, 25 bp, Mus musculus
gcatcgccagttccctttccatgag

SEQ ID NO: 112801 - DNA, 25 bp, Mus musculus
gcatcgcctactacatgtactcggg

SEQ ID NO: 112802 - DNA, 25 bp, Mus musculus
gcatcgctcacggatgtgtctctag

SEQ ID NO: 112803 - DNA, 25 bp, Mus musculus
gcatcgctggctcggccctgtcgtt

SEQ ID NO: 112804 - DNA, 25 bp, Mus musculus
gcatcggaagatggccaaagtgatc

SEQ ID NO: 112805 - DNA, 25 bp, Mus musculus
gcatcggagcaaacaatacttcaga

SEQ ID NO: 112806 - DNA, 25 bp, Mus musculus
gcatcggcaatggaagcacgctgtt

SEQ ID NO: 112807 - DNA, 25 bp, Mus musculus
gcatcggcgaccttcaggcctttgt

SEQ ID NO: 112808 - DNA, 25 bp, Mus musculus
gcatcgggacatccatttgtaagaa

SEQ ID NO: 112809 - DNA, 25 bp, Mus musculus
gcatcgtagaacaacctccaggaat

SEQ ID NO: 112810 - DNA, 25 bp, Mus musculus
gcatcgtgggaaatgctgaattaga

SEQ ID NO: 112811 - DNA, 25 bp, Mus musculus
gcatctagagtcagggtgtccagaa

SEQ ID NO: 112812 - DNA, 25 bp, Mus musculus
gcatctatgaaatcccacagtgttc

SEQ ID NO: 112813 - DNA, 25 bp, Mus musculus
gcatctcacagatgaaactggagcg

SEQ ID NO: 112814 - DNA, 25 bp, Mus musculus
gcatctcattagctgtccgctcggg

SEQ ID NO: 112815 - DNA, 25 bp, Mus musculus
gcatctccaacagaagaggtcaaac

SEQ ID NO: 112816 - DNA, 25 bp, Mus musculus
gcatctccccgcagtttgtgtgtga

SEQ ID NO: 112817 - DNA, 25 bp, Mus musculus
gcatctcgctagcaagctggtccta

SEQ ID NO: 112818 - DNA, 25 bp, Mus musculus
gcatctctgagttacaccgttccaa

SEQ ID NO: 112819 - DNA, 25 bp, Mus musculus
gcatctctgtcaaaagttgtcacgg

SEQ ID NO: 112820 - DNA, 25 bp, Mus musculus
gcatctctgtcttgtggaggaggac

SEQ ID NO: 112821 - DNA, 25 bp, Mus musculus
gcatctgcacaatggctggcaggta

SEQ ID NO: 112822 - DNA, 25 bp, Mus musculus
gcatctgcagaacatagtagacttt

SEQ ID NO: 112823 - DNA, 25 bp, Mus musculus
gcatctgcagcctgatcctgccgga

SEQ ID NO: 112824 - DNA, 25 bp, Mus musculus
gcatctgcatgctacagaggctgaa

SEQ ID NO: 112825 - DNA, 25 bp, Mus musculus
gcatctgcgaaggaatgagcgtctc

SEQ ID NO: 112826 - DNA, 25 bp, Mus musculus
gcatctgtgactcgctcaacctcag

SEQ ID NO: 112827 - DNA, 25 bp, Mus musculus
gcatctgtgctgaccgacagggcct

SEQ ID NO: 112828 - DNA, 25 bp, Mus musculus
gcatctgtggtcatctgccaacgaa

SEQ ID NO: 112829 - DNA, 25 bp, Mus musculus
gcatcttacatgagctcttcgcggg

SEQ ID NO: 112830 - DNA, 25 bp, Mus musculus
gcatcttacctctgctcaatatata

SEQ ID NO: 112831 - DNA, 25 bp, Mus musculus
gcatcttccatcctggctcacaaaa

SEQ ID NO: 112832 - DNA, 25 bp, Mus musculus
gcatcttcggtaggcaggacatcca

SEQ ID NO: 112833 - DNA, 25 bp, Mus musculus
gcatcttgaagaacagcggctgcgg

SEQ ID NO: 112834 - DNA, 25 bp, Mus musculus
gcatcttgcttttcgggatcggcga

SEQ ID NO: 112835 - DNA, 25 bp, Mus musculus
gcatcttggagatcaatgggacccc

SEQ ID NO: 112836 - DNA, 25 bp, Mus musculus
gcatcttggcaaggctgagtacaga

SEQ ID NO: 112837 - DNA, 25 bp, Mus musculus
gcatctttaagccatcctgagtctg

SEQ ID NO: 112838 - DNA, 25 bp, Mus musculus
gcatctttagcaagggtgcctccga

SEQ ID NO: 112839 - DNA, 25 bp, Mus musculus
gcatgaacagtattaagccggacct

SEQ ID NO: 112840 - DNA, 25 bp, Mus musculus
gcatgaacctgataccacgacaaga

SEQ ID NO: 112841 - DNA, 25 bp, Mus musculus
gcatgaactttgagccaagggccac

SEQ ID NO: 112842 - DNA, 25 bp, Mus musculus
gcatgaagaaaaccaccggcctttg

SEQ ID NO: 112843 - DNA, 25 bp, Mus musculus
gcatgaagtcttcctgcagcgcctg

SEQ ID NO: 112844 - DNA, 25 bp, Mus musculus
gcatgaagttgccagaagacatcct

SEQ ID NO: 112845 - DNA, 25 bp, Mus musculus
gcatgacaactatctcctgtatgtg

SEQ ID NO: 112846 - DNA, 25 bp, Mus musculus
gcatgactcctggacagctcaagag

SEQ ID NO: 112847 - DNA, 25 bp, Mus musculus
gcatgacttctatcaaggattccga

SEQ ID NO: 112848 - DNA, 25 bp, Mus musculus
gcatgacttgatttgtaaccttggg

SEQ ID NO: 112849 - DNA, 25 bp, Mus musculus
gcatgagatcctttcagtagctgaa

SEQ ID NO: 112850 - DNA, 25 bp, Mus musculus
gcatgatcaacgagcagcaagtgga

SEQ ID NO: 112851 - DNA, 25 bp, Mus musculus
gcatgatccctcagtctgccgtaga

SEQ ID NO: 112852 - DNA, 25 bp, Mus musculus
gcatgatgacaggaacaagtcccgt

SEQ ID NO: 112853 - DNA, 25 bp, Mus musculus
gcatgatgcctttatggaccaagga

SEQ ID NO: 112854 - DNA, 25 bp, Mus musculus
gcatgatgtgtctgtcgccgccgtt

SEQ ID NO: 112855 - DNA, 25 bp, Mus musculus
gcatgatttccacagccacgagata

SEQ ID NO: 112856 - DNA, 25 bp, Mus musculus
gcatgatttggtcccctgggattct

SEQ ID NO: 112857 - DNA, 25 bp, Mus musculus
gcatgcacatctatcacctggactg

SEQ ID NO: 112858 - DNA, 25 bp, Mus musculus
gcatgcaccgtgatgatctccaagt

SEQ ID NO: 112859 - DNA, 25 bp, Mus musculus
gcatgcagccgcctatgtcacggtg

SEQ ID NO: 112860 - DNA, 25 bp, Mus musculus
gcatgcatcgattgtgcgcaccagc

SEQ ID NO: 112861 - DNA, 25 bp, Mus musculus
gcatgcatgtcaagccactggtcta

SEQ ID NO: 112862 - DNA, 25 bp, Mus musculus
gcatgcatgttaaaagactcctgaa

SEQ ID NO: 112863 - DNA, 25 bp, Mus musculus
gcatgcatttatcgctcaggccttg

SEQ ID NO: 112864 - DNA, 25 bp, Mus musculus
gcatgccaccgctggagatattggg

SEQ ID NO: 112865 - DNA, 25 bp, Mus musculus
gcatgccgagtgacctgtccactag

SEQ ID NO: 112866 - DNA, 25 bp, Mus musculus
gcatgcctagaagtggtccgataaa

SEQ ID NO: 112867 - DNA, 25 bp, Mus musculus
gcatgccttcagttgtaagtggcca

SEQ ID NO: 112868 - DNA, 25 bp, Mus musculus
gcatgcgacagcattccagggcaca

SEQ ID NO: 112869 - DNA, 25 bp, Mus musculus
gcatgcgactctgttctcgtaatga

SEQ ID NO: 112870 - DNA, 25 bp, Mus musculus
gcatgcgaggtcttccgggagatca

SEQ ID NO: 112871 - DNA, 25 bp, Mus musculus
gcatgctcaggaagggctgtctgcc

SEQ ID NO: 112872 - DNA, 25 bp, Mus musculus
gcatgctcgctaaccacgtgtgtga

SEQ ID NO: 112873 - DNA, 25 bp, Mus musculus
gcatgctgacgtttgcactggcact

SEQ ID NO: 112874 - DNA, 25 bp, Mus musculus
gcatgctgggaaagctctgacctcc

SEQ ID NO: 112875 - DNA, 25 bp, Mus musculus
gcatgcttcccaagagccaaatgtc

SEQ ID NO: 112876 - DNA, 25 bp, Mus musculus
gcatggacaggcattcaagagcacc

SEQ ID NO: 112877 - DNA, 25 bp, Mus musculus
gcatggacccggagctaatcaagca

SEQ ID NO: 112878 - DNA, 25 bp, Mus musculus
gcatggacgtcctgcatcggacata

SEQ ID NO: 112879 - DNA, 25 bp, Mus musculus
gcatggactacgaggccccactcat

SEQ ID NO: 112880 - DNA, 25 bp, Mus musculus
gcatggactcacaacccgagtgggc

SEQ ID NO: 112881 - DNA, 25 bp, Mus musculus
gcatggactcccttgggtggcaaaa

SEQ ID NO: 112882 - DNA, 25 bp, Mus musculus
gcatggactctgttccagacaccga

SEQ ID NO: 112883 - DNA, 25 bp, Mus musculus
gcatggactgacatcaagcctgtga

SEQ ID NO: 112884 - DNA, 25 bp, Mus musculus
gcatggagcctgcagacatcgctgt

SEQ ID NO: 112885 - DNA, 25 bp, Mus musculus
gcatggagctgtacaggaacgcacc

SEQ ID NO: 112886 - DNA, 25 bp, Mus musculus
gcatggaggagctttcgaggcccaa

SEQ ID NO: 112887 - DNA, 25 bp, Mus musculus
gcatggagtaggatagcagccttcc

SEQ ID NO: 112888 - DNA, 25 bp, Mus musculus
gcatggatgaaaacagactcactgg

SEQ ID NO: 112889 - DNA, 25 bp, Mus musculus
gcatggatgaaaataactatgacag

SEQ ID NO: 112890 - DNA, 25 bp, Mus musculus
gcatggatggtgactcgcaacgaag

SEQ ID NO: 112891 - DNA, 25 bp, Mus musculus
gcatggatgttcacgcagcctacga

SEQ ID NO: 112892 - DNA, 25 bp, Mus musculus
gcatggcagcttcctcgttcgagag

SEQ ID NO: 112893 - DNA, 25 bp, Mus musculus
gcatggcagggctagaccttgctca

SEQ ID NO: 112894 - DNA, 25 bp, Mus musculus
gcatggccacattgaaagacctccg

SEQ ID NO: 112895 - DNA, 25 bp, Mus musculus
gcatggccaccattttcagcatcac

SEQ ID NO: 112896 - DNA, 25 bp, Mus musculus
gcatggccacgtacttaaccctgag

SEQ ID NO: 112897 - DNA, 25 bp, Mus musculus
gcatggcccagctgataactaccga

SEQ ID NO: 112898 - DNA, 25 bp, Mus musculus
gcatggccctcgagttcaacaggtt

SEQ ID NO: 112899 - DNA, 25 bp, Mus musculus
gcatggcggcatctgtcactacact

SEQ ID NO: 112900 - DNA, 25 bp, Mus musculus
gcatggcttcaacttcaaccggcag

SEQ ID NO: 112901 - DNA, 25 bp, Mus musculus
gcatggcttttcttcacacactaga

SEQ ID NO: 112902 - DNA, 25 bp, Mus musculus
gcatgggcagtataacaagttttcc

SEQ ID NO: 112903 - DNA, 25 bp, Mus musculus
gcatgggccactccgactgcctaga

SEQ ID NO: 112904 - DNA, 25 bp, Mus musculus
gcatgggcccagcacggatatcatt

SEQ ID NO: 112905 - DNA, 25 bp, Mus musculus
gcatgggcctgggaaggatgagatg

SEQ ID NO: 112906 - DNA, 25 bp, Mus musculus
gcatgggcttctaccagcggtttcc

SEQ ID NO: 112907 - DNA, 25 bp, Mus musculus
gcatgggttctctctctcgagcaaa

SEQ ID NO: 112908 - DNA, 25 bp, Mus musculus
gcatggtaccaagaccagtatgcgc

SEQ ID NO: 112909 - DNA, 25 bp, Mus musculus
gcatggtctgtctgatggccgcttt

SEQ ID NO: 112910 - DNA, 25 bp, Mus musculus
gcatggtctttctggcgctctacgt

SEQ ID NO: 112911 - DNA, 25 bp, Mus musculus
gcatggtgcaaatccggatctcaga

SEQ ID NO: 112912 - DNA, 25 bp, Mus musculus
gcatgtaccgccagtcaaaggagca

SEQ ID NO: 112913 - DNA, 25 bp, Mus musculus
gcatgtatggtcgtgagagcagcaa

SEQ ID NO: 112914 - DNA, 25 bp, Mus musculus
gcatgtcgtagtttccaaagagccc

SEQ ID NO: 112915 - DNA, 25 bp, Mus musculus
gcatgtctcagagtgcacctgccag

SEQ ID NO: 112916 - DNA, 25 bp, Mus musculus
gcatgtctgctgatgaggacctaca

SEQ ID NO: 112917 - DNA, 25 bp, Mus musculus
gcatgtcttaggacctgcccaggtt

SEQ ID NO: 112918 - DNA, 25 bp, Mus musculus
gcatgtcttgtaaataggctctagg

SEQ ID NO: 112919 - DNA, 25 bp, Mus musculus
gcatgtgagaacgttttagctatta

SEQ ID NO: 112920 - DNA, 25 bp, Mus musculus
gcatgtgggaccatctgcaggagca

SEQ ID NO: 112921 - DNA, 25 bp, Mus musculus
gcatgtgtcagagtgccgggctcaa

SEQ ID NO: 112922 - DNA, 25 bp, Mus musculus
gcatgtgtgatgtgccaagccagca

SEQ ID NO: 112923 - DNA, 25 bp, Mus musculus
gcatgttaaaagactcctgaataaa

SEQ ID NO: 112924 - DNA, 25 bp, Mus musculus
gcatgttcaactacccagagctgag

SEQ ID NO: 112925 - DNA, 25 bp, Mus musculus
gcatgttcaagaatggaggcctcct

SEQ ID NO: 112926 - DNA, 25 bp, Mus musculus
gcatgttcacctggatcgagccgat

SEQ ID NO: 112927 - DNA, 25 bp, Mus musculus
gcatgttcctgtaacctgtggccca

SEQ ID NO: 112928 - DNA, 25 bp, Mus musculus
gcatgttcgtcttcggctatgacaa

SEQ ID NO: 112929 - DNA, 25 bp, Mus musculus
gcatgttggtcagccagcgagtgac

SEQ ID NO: 112930 - DNA, 25 bp, Mus musculus
gcattaaaagtgaggcaagccgaca

SEQ ID NO: 112931 - DNA, 25 bp, Mus musculus
gcattaaatggtcactttcaagaga

SEQ ID NO: 112932 - DNA, 25 bp, Mus musculus
gcattaacgatgacggcagcagcga

SEQ ID NO: 112933 - DNA, 25 bp, Mus musculus
gcattaagccaaacccacttcaggg

SEQ ID NO: 112934 - DNA, 25 bp, Mus musculus
gcattaagtgtgcaggaacccgagc

SEQ ID NO: 112935 - DNA, 25 bp, Mus musculus
gcattacctcatcatgacctgtcag

SEQ ID NO: 112936 - DNA, 25 bp, Mus musculus
gcattacctgctcagcacaaagcag

SEQ ID NO: 112937 - DNA, 25 bp, Mus musculus
gcattacggatcagagacgcttcga

SEQ ID NO: 112938 - DNA, 25 bp, Mus musculus
gcattactgtattgtctccggccac

SEQ ID NO: 112939 - DNA, 25 bp, Mus musculus
gcattactgtcaaggagctaaagct

SEQ ID NO: 112940 - DNA, 25 bp, Mus musculus
gcattagacaaagcatgtgtgccct

SEQ ID NO: 112941 - DNA, 25 bp, Mus musculus
gcattagccacaccctggtgtctct

SEQ ID NO: 112942 - DNA, 25 bp, Mus musculus
gcattagccaccaaagacatgagga

SEQ ID NO: 112943 - DNA, 25 bp, Mus musculus
gcattaggagactccagctggaggt

SEQ ID NO: 112944 - DNA, 25 bp, Mus musculus
gcattaggaggagcacacagtgcct

SEQ ID NO: 112945 - DNA, 25 bp, Mus musculus
gcattagtgacaaagccaaggagag

SEQ ID NO: 112946 - DNA, 25 bp, Mus musculus
gcattattgcagtgttcaccggaga

SEQ ID NO: 112947 - DNA, 25 bp, Mus musculus
gcattattgctatccaagagaacga

SEQ ID NO: 112948 - DNA, 25 bp, Mus musculus
gcattcagatctgggagaagtggcc

SEQ ID NO: 112949 - DNA, 25 bp, Mus musculus
gcattcagtgggacaagcagagccg

SEQ ID NO: 112950 - DNA, 25 bp, Mus musculus
gcattccacgggtattcagcaagtt

SEQ ID NO: 112951 - DNA, 25 bp, Mus musculus
gcattccactgagccgcccatctct

SEQ ID NO: 112952 - DNA, 25 bp, Mus musculus
gcattcccaccgacgtgcatggaga

SEQ ID NO: 112953 - DNA, 25 bp, Mus musculus
gcattcggaagcttgtggcaacgga

SEQ ID NO: 112954 - DNA, 25 bp, Mus musculus
gcattctaaggcttgctgcttgact

SEQ ID NO: 112955 - DNA, 25 bp, Mus musculus
gcattctagcatcccaaagccattg

SEQ ID NO: 112956 - DNA, 25 bp, Mus musculus
gcattctgaagaaggactaggtcct

SEQ ID NO: 112957 - DNA, 25 bp, Mus musculus
gcattctggaggcatcctttgtctc

SEQ ID NO: 112958 - DNA, 25 bp, Mus musculus
gcattgaagatcggcacccactggg

SEQ ID NO: 112959 - DNA, 25 bp, Mus musculus
gcattgacagcttctcaacaaaggg

SEQ ID NO: 112960 - DNA, 25 bp, Mus musculus
gcattgaccatgaggttgaccccgt

SEQ ID NO: 112961 - DNA, 25 bp, Mus musculus
gcattgactctgtctgctgggccca

SEQ ID NO: 112962 - DNA, 25 bp, Mus musculus
gcattgccctgcttgtagagcgaaa

SEQ ID NO: 112963 - DNA, 25 bp, Mus musculus
gcattgctgcagattgggattaaca

SEQ ID NO: 112964 - DNA, 25 bp, Mus musculus
gcattgcttctacaggagctctgag

SEQ ID NO: 112965 - DNA, 25 bp, Mus musculus
gcattggagagagcgcaaatctgct

SEQ ID NO: 112966 - DNA, 25 bp, Mus musculus
gcattggagccgcagcctccttgcg

SEQ ID NO: 112967 - DNA, 25 bp, Mus musculus
gcattggaggactgccatggtcaca

SEQ ID NO: 112968 - DNA, 25 bp, Mus musculus
gcattggcagtcgtgttgagctaca

SEQ ID NO: 112969 - DNA, 25 bp, Mus musculus
gcattggcggacaaacggcgtgact

SEQ ID NO: 112970 - DNA, 25 bp, Mus musculus
gcattggctccttcttggaactgaa

SEQ ID NO: 112971 - DNA, 25 bp, Mus musculus
gcattggctggcagacactgtccct

SEQ ID NO: 112972 - DNA, 25 bp, Mus musculus
gcattggcttgaatacctggcctat

SEQ ID NO: 112973 - DNA, 25 bp, Mus musculus
gcattgggcccatgagactgacaca

SEQ ID NO: 112974 - DNA, 25 bp, Mus musculus
gcattgggcgcactgactgtcacca

SEQ ID NO: 112975 - DNA, 25 bp, Mus musculus
gcattgtcgccagcaacactcgaga

SEQ ID NO: 112976 - DNA, 25 bp, Mus musculus
gcattgtgacagcagagaacctttg

SEQ ID NO: 112977 - DNA, 25 bp, Mus musculus
gcatttaaggctggcgacgtcatca

SEQ ID NO: 112978 - DNA, 25 bp, Mus musculus
gcatttagtccgagatggcgtccct

SEQ ID NO: 112979 - DNA, 25 bp, Mus musculus
gcatttatatcaccattgttgaaat

SEQ ID NO: 112980 - DNA, 25 bp, Mus musculus
gcatttcagaattgccaccctggga

SEQ ID NO: 112981 - DNA, 25 bp, Mus musculus
gcatttcccaggagcgccagtgtga

SEQ ID NO: 112982 - DNA, 25 bp, Mus musculus
gcatttcctgggaatctggtgacca

SEQ ID NO: 112983 - DNA, 25 bp, Mus musculus
gcatttgagaccctacactaccggt

SEQ ID NO: 112984 - DNA, 25 bp, Mus musculus
gcatttgatgaagtctacccagctc

SEQ ID NO: 112985 - DNA, 25 bp, Mus musculus
gcatttgcactgaaagccagagttg

SEQ ID NO: 112986 - DNA, 25 bp, Mus musculus
gcatttgccaatggaaagctctagg

SEQ ID NO: 112987 - DNA, 25 bp, Mus musculus
gcatttgccttcctaagaactgagt

SEQ ID NO: 112988 - DNA, 25 bp, Mus musculus
gcatttgtgatgcatataagtctct

SEQ ID NO: 112989 - DNA, 25 bp, Mus musculus
gcattttagctgagacgttccgtac

SEQ ID NO: 112990 - DNA, 25 bp, Mus musculus
gcattttcaggctcaccaacgctgg

SEQ ID NO: 112991 - DNA, 25 bp, Mus musculus
gcattttgatgcttgggagaccaca

SEQ ID NO: 112992 - DNA, 25 bp, Mus musculus
gcattttgccgcctgaagcttacca

SEQ ID NO: 112993 - DNA, 25 bp, Mus musculus
gcattttggataagatttggtgtgg

SEQ ID NO: 112994 - DNA, 25 bp, Mus musculus
gcattttttcaagcacggcggcaca

SEQ ID NO: 112995 - DNA, 25 bp, Mus musculus
gccaaaaacaaagtgggccgtgagg

SEQ ID NO: 112996 - DNA, 25 bp, Mus musculus
gccaaaagccagtgtccatcgtgtc

SEQ ID NO: 112997 - DNA, 25 bp, Mus musculus
gccaaaagcggagcttctgcacggg

SEQ ID NO: 112998 - DNA, 25 bp, Mus musculus
gccaaaatgccctgccgtgtgtact

SEQ ID NO: 112999 - DNA, 25 bp, Mus musculus
gccaaaattctacgatgagtgactg

SEQ ID NO: 113000 - DNA, 25 bp, Mus musculus
gccaaacagctatgcagagttgtgt

SEQ ID NO: 113001 - DNA, 25 bp, Mus musculus
gccaaacctggctccagacagaacg

SEQ ID NO: 113002 - DNA, 25 bp, Mus musculus
gccaaacgagtagagcttgccaagt

SEQ ID NO: 113003 - DNA, 25 bp, Mus musculus
gccaaacggcaagaaacctgctgca

SEQ ID NO: 113004 - DNA, 25 bp, Mus musculus
gccaaacgtatcacagcctctgagg

SEQ ID NO: 113005 - DNA, 25 bp, Mus musculus
gccaaactcgagaacatgctgcaga

SEQ ID NO: 113006 - DNA, 25 bp, Mus musculus
gccaaactgtggaaacggtgtacaa

SEQ ID NO: 113007 - DNA, 25 bp, Mus musculus
gccaaactgttggagtacctgacaa

SEQ ID NO: 113008 - DNA, 25 bp, Mus musculus
gccaaactttgtcgcatgcatatga

SEQ ID NO: 113009 - DNA, 25 bp, Mus musculus
gccaaagactctggaaccagccaat

SEQ ID NO: 113010 - DNA, 25 bp, Mus musculus
gccaaagagtctgtgcgggtaaaag

SEQ ID NO: 113011 - DNA, 25 bp, Mus musculus
gccaaagcaattgcctgccacaagt

SEQ ID NO: 113012 - DNA, 25 bp, Mus musculus
gccaaagcatcagcagcttccggag

SEQ ID NO: 113013 - DNA, 25 bp, Mus musculus
gccaaaggttgtttcagcaggtccc

SEQ ID NO: 113014 - DNA, 25 bp, Mus musculus
gccaaagttgagtgtgcgatccaga

SEQ ID NO: 113015 - DNA, 25 bp, Mus musculus
gccaaagtttgttctctgcgtgacg

SEQ ID NO: 113016 - DNA, 25 bp, Mus musculus
gccaaatggcctacatgaagagggt

SEQ ID NO: 113017 - DNA, 25 bp, Mus musculus
gccaacacaggtaagagactcagct

SEQ ID NO: 113018 - DNA, 25 bp, Mus musculus
gccaacatgggtcagaaggtcacag

SEQ ID NO: 113019 - DNA, 25 bp, Mus musculus
gccaacatgttggtgatacctccgg

SEQ ID NO: 113020 - DNA, 25 bp, Mus musculus
gccaaccaagtcaaaagggtccatt

SEQ ID NO: 113021 - DNA, 25 bp, Mus musculus
gccaaccaagtttgaaatgctcaga

SEQ ID NO: 113022 - DNA, 25 bp, Mus musculus
gccaaccatggcatttatgtcagga

SEQ ID NO: 113023 - DNA, 25 bp, Mus musculus
gccaacgagttttaggagtgccaat

SEQ ID NO: 113024 - DNA, 25 bp, Mus musculus
gccaacgggcatcatgtggtccaag

SEQ ID NO: 113025 - DNA, 25 bp, Mus musculus
gccaactggcctcaagaaagtggaa

SEQ ID NO: 113026 - DNA, 25 bp, Mus musculus
gccaactgggaaatgggaccaccaa

SEQ ID NO: 113027 - DNA, 25 bp, Mus musculus
gccaacttatgcagaactgctgtga

SEQ ID NO: 113028 - DNA, 25 bp, Mus musculus
gccaagaaagctgcccgtgactatg

SEQ ID NO: 113029 - DNA, 25 bp, Mus musculus
gccaagaaagcttctccagttcatg

SEQ ID NO: 113030 - DNA, 25 bp, Mus musculus
gccaagaacggaaaccatttcctga

SEQ ID NO: 113031 - DNA, 25 bp, Mus musculus
gccaagaagtggaaaacagcaccct

SEQ ID NO: 113032 - DNA, 25 bp, Mus musculus
gccaagagactagcagggatcacgt

SEQ ID NO: 113033 - DNA, 25 bp, Mus musculus
gccaagagctcttccgtggactact

SEQ ID NO: 113034 - DNA, 25 bp, Mus musculus
gccaagaggacaccgcagaagatat

SEQ ID NO: 113035 - DNA, 25 bp, Mus musculus
gccaagaggtcgagagatgcaagaa

SEQ ID NO: 113036 - DNA, 25 bp, Mus musculus
gccaagatgcaggttgtcagcaacg

SEQ ID NO: 113037 - DNA, 25 bp, Mus musculus
gccaagatggcgatgcaagcggcta

SEQ ID NO: 113038 - DNA, 25 bp, Mus musculus
gccaagccaatgcacccagaaaata

SEQ ID NO: 113039 - DNA, 25 bp, Mus musculus
gccaagccaccagtctagctgtaga

SEQ ID NO: 113040 - DNA, 25 bp, Mus musculus
gccaagccgccttccgtggaggatg

SEQ ID NO: 113041 - DNA, 25 bp, Mus musculus
gccaagccttactgcagagatctct

SEQ ID NO: 113042 - DNA, 25 bp, Mus musculus
gccaagcggttgtgttttccaggaa

SEQ ID NO: 113043 - DNA, 25 bp, Mus musculus
gccaagctcacagcccagtgttgtg

SEQ ID NO: 113044 - DNA, 25 bp, Mus musculus
gccaagctcctgcaagaagtgtctg

SEQ ID NO: 113045 - DNA, 25 bp, Mus musculus
gccaagctgacagagaccagtgcat

SEQ ID NO: 113046 - DNA, 25 bp, Mus musculus
gccaagcttcaccattactgtgaca

SEQ ID NO: 113047 - DNA, 25 bp, Mus musculus
gccaaggactatatgcatgctacag

SEQ ID NO: 113048 - DNA, 25 bp, Mus musculus
gccaaggcaccactctcacagtctc

SEQ ID NO: 113049 - DNA, 25 bp, Mus musculus
gccaaggccaaaactagacagtgtc

SEQ ID NO: 113050 - DNA, 25 bp, Mus musculus
gccaaggccatctttctggaacagt

SEQ ID NO: 113051 - DNA, 25 bp, Mus musculus
gccaaggccccaaggaagtgctgtt

SEQ ID NO: 113052 - DNA, 25 bp, Mus musculus
gccaaggctcaggacttcaacacag

SEQ ID NO: 113053 - DNA, 25 bp, Mus musculus
gccaagggctatacctcagagcagg

SEQ ID NO: 113054 - DNA, 25 bp, Mus musculus
gccaagggtaaaagcatcaattctc

SEQ ID NO: 113055 - DNA, 25 bp, Mus musculus
gccaaggtgcccatcgtgaagttct

SEQ ID NO: 113056 - DNA, 25 bp, Mus musculus
gccaaggtgttgatgttcccagcca

SEQ ID NO: 113057 - DNA, 25 bp, Mus musculus
gccaaggttccagcgaggcagaaaa

SEQ ID NO: 113058 - DNA, 25 bp, Mus musculus
gccaagtaagccgttcctaatttag

SEQ ID NO: 113059 - DNA, 25 bp, Mus musculus
gccaagtacaatgacctgttctctg

SEQ ID NO: 113060 - DNA, 25 bp, Mus musculus
gccaagtagccatgggatcccagag

SEQ ID NO: 113061 - DNA, 25 bp, Mus musculus
gccaagtgaagaccaatcgcctagt

SEQ ID NO: 113062 - DNA, 25 bp, Mus musculus
gccaagtgcacatcggacaccgtgt

SEQ ID NO: 113063 - DNA, 25 bp, Mus musculus
gccaagtggtgaatatcaaggccaa

SEQ ID NO: 113064 - DNA, 25 bp, Mus musculus
gccaagtggtgtatgtcttctccaa

SEQ ID NO: 113065 - DNA, 25 bp, Mus musculus
gccaagtgtgacctgcatgctgtga

SEQ ID NO: 113066 - DNA, 25 bp, Mus musculus
gccaagttcacatcaagtccagggt

SEQ ID NO: 113067 - DNA, 25 bp, Mus musculus
gccaagttccaacagattgtgcggg

SEQ ID NO: 113068 - DNA, 25 bp, Mus musculus
gccaagttccgccacgatgagatca

SEQ ID NO: 113069 - DNA, 25 bp, Mus musculus
gccaagtttgggttacgcttcgaca

SEQ ID NO: 113070 - DNA, 25 bp, Mus musculus
gccaatatgcccaacctggatgctg

SEQ ID NO: 113071 - DNA, 25 bp, Mus musculus
gccaatcacactttttacaatggat

SEQ ID NO: 113072 - DNA, 25 bp, Mus musculus
gccaatcctctttcgggcagacgat

SEQ ID NO: 113073 - DNA, 25 bp, Mus musculus
gccaatctcgacatcacagggcttg

SEQ ID NO: 113074 - DNA, 25 bp, Mus musculus
gccaatctgtttgatgcctcagcag

SEQ ID NO: 113075 - DNA, 25 bp, Mus musculus
gccaatcttacctgcaagcttgcca

SEQ ID NO: 113076 - DNA, 25 bp, Mus musculus
gccaatcttctgtgagctgcgacca

SEQ ID NO: 113077 - DNA, 25 bp, Mus musculus
gccaatgtggaatcaaaggcacttt

SEQ ID NO: 113078 - DNA, 25 bp, Mus musculus
gccaatgttgtgtcgcagcatcccg

SEQ ID NO: 113079 - DNA, 25 bp, Mus musculus
gccaattgcttcatcgctgaggagt

SEQ ID NO: 113080 - DNA, 25 bp, Mus musculus
gccacaaagatgtgggttctccagg

SEQ ID NO: 113081 - DNA, 25 bp, Mus musculus
gccacaaattacttagactgacaaa

SEQ ID NO: 113082 - DNA, 25 bp, Mus musculus
gccacacaaggatgagcaatgggaa

SEQ ID NO: 113083 - DNA, 25 bp, Mus musculus
gccacacagttaggctcctgggaga

SEQ ID NO: 113084 - DNA, 25 bp, Mus musculus
gccacacccctaaacggacagaagg

SEQ ID NO: 113085 - DNA, 25 bp, Mus musculus
gccacactagacagagcaccggtga

SEQ ID NO: 113086 - DNA, 25 bp, Mus musculus
gccacactgtagacctgccttatga

SEQ ID NO: 113087 - DNA, 25 bp, Mus musculus
gccacagagggataggtacagtcac

SEQ ID NO: 113088 - DNA, 25 bp, Mus musculus
gccacagaggttttcaaagagcaaa

SEQ ID NO: 113089 - DNA, 25 bp, Mus musculus
gccacagcaagtaccatggaccatg

SEQ ID NO: 113090 - DNA, 25 bp, Mus musculus
gccacagcacagtttccagagtctg

SEQ ID NO: 113091 - DNA, 25 bp, Mus musculus
gccacagcgtctcgcccgggttgaa

SEQ ID NO: 113092 - DNA, 25 bp, Mus musculus
gccacaggcgggataacaaaatgca

SEQ ID NO: 113093 - DNA, 25 bp, Mus musculus
gccacagtggatatgcttcaagcag

SEQ ID NO: 113094 - DNA, 25 bp, Mus musculus
gccacataacgcacctctttgaaaa

SEQ ID NO: 113095 - DNA, 25 bp, Mus musculus
gccacatcagggtcctacagaagga

SEQ ID NO: 113096 - DNA, 25 bp, Mus musculus
gccacatcatcctgtgtggtcagat

SEQ ID NO: 113097 - DNA, 25 bp, Mus musculus
gccacatctgcaaacttccgggaag

SEQ ID NO: 113098 - DNA, 25 bp, Mus musculus
gccacatgtcatgacttcactgaag

SEQ ID NO: 113099 - DNA, 25 bp, Mus musculus
gccaccacccattgcggaggagatt

SEQ ID NO: 113100 - DNA, 25 bp, Mus musculus
gccaccacgggaaactccatggaga

SEQ ID NO: 113101 - DNA, 25 bp, Mus musculus
gccaccagggaaataagggacattg

SEQ ID NO: 113102 - DNA, 25 bp, Mus musculus
gccaccattccgtgctgcagggata

SEQ ID NO: 113103 - DNA, 25 bp, Mus musculus
gccacccaagcgcatagctaagaga

SEQ ID NO: 113104 - DNA, 25 bp, Mus musculus
gccacccacgagttcaagcaggcct

SEQ ID NO: 113105 - DNA, 25 bp, Mus musculus
gccacccagagaccaattccaatga

SEQ ID NO: 113106 - DNA, 25 bp, Mus musculus
gccaccccgagtttgaagaggacag

SEQ ID NO: 113107 - DNA, 25 bp, Mus musculus
gccacccctgtgaggacatctttgg

SEQ ID NO: 113108 - DNA, 25 bp, Mus musculus
gccaccctggatctataactgtgaa

SEQ ID NO: 113109 - DNA, 25 bp, Mus musculus
gccaccggcaggacagcgtgagcct

SEQ ID NO: 113110 - DNA, 25 bp, Mus musculus
gccaccgtggcagtttcggatgcca

SEQ ID NO: 113111 - DNA, 25 bp, Mus musculus
gccacctaagaaagaactgccagag

SEQ ID NO: 113112 - DNA, 25 bp, Mus musculus
gccacctaattcagcccgtgttaaa

SEQ ID NO: 113113 - DNA, 25 bp, Mus musculus
gccacctatggaactgataagccag

SEQ ID NO: 113114 - DNA, 25 bp, Mus musculus
gccacctattttgtcggcaggctct

SEQ ID NO: 113115 - DNA, 25 bp, Mus musculus
gccacctgggtacacaagaatttct

SEQ ID NO: 113116 - DNA, 25 bp, Mus musculus
gccacctggtgttggtgcacagacc

SEQ ID NO: 113117 - DNA, 25 bp, Mus musculus
gccaccttcttagcagtgtgtcggg

SEQ ID NO: 113118 - DNA, 25 bp, Mus musculus
gccaccttgggaacctagctgatga

SEQ ID NO: 113119 - DNA, 25 bp, Mus musculus
gccaccttttgaagcgaacagtaaa

SEQ ID NO: 113120 - DNA, 25 bp, Mus musculus
gccacgaagttaaattggtctccag

SEQ ID NO: 113121 - DNA, 25 bp, Mus musculus
gccacgaccgctgtgatattcgaag

SEQ ID NO: 113122 - DNA, 25 bp, Mus musculus
gccacgacggcgtttgctcgggttc

SEQ ID NO: 113123 - DNA, 25 bp, Mus musculus
gccacgactgggagaagatttccaa

SEQ ID NO: 113124 - DNA, 25 bp, Mus musculus
gccacgatcggtctcctgggcactg

SEQ ID NO: 113125 - DNA, 25 bp, Mus musculus
gccacgatcgtgtaggtctctgttg

SEQ ID NO: 113126 - DNA, 25 bp, Mus musculus
gccacgccatttggtgaagccaggc

SEQ ID NO: 113127 - DNA, 25 bp, Mus musculus
gccacgcgactgatgaggagaagct

SEQ ID NO: 113128 - DNA, 25 bp, Mus musculus
gccacgcgcctgaaaatgttgaact

SEQ ID NO: 113129 - DNA, 25 bp, Mus musculus
gccacgctgggacgaatgcactatt

SEQ ID NO: 113130 - DNA, 25 bp, Mus musculus
gccacggagtcgcttgcaaagttca

SEQ ID NO: 113131 - DNA, 25 bp, Mus musculus
gccacggccctgctatgttcaagca

SEQ ID NO: 113132 - DNA, 25 bp, Mus musculus
gccacgggtgcacatcataaagaag

SEQ ID NO: 113133 - DNA, 25 bp, Mus musculus
gccacgggtggagtaaacctcctgg

SEQ ID NO: 113134 - DNA, 25 bp, Mus musculus
gccacggtacttccttctgaagagt

SEQ ID NO: 113135 - DNA, 25 bp, Mus musculus
gccacggttctctacattactgcct

SEQ ID NO: 113136 - DNA, 25 bp, Mus musculus
gccacgtgtttggtcaggcagcaaa

SEQ ID NO: 113137 - DNA, 25 bp, Mus musculus
gccacgttggcagaactggatgtta

SEQ ID NO: 113138 - DNA, 25 bp, Mus musculus
gccacgttggccgagattcatcact

SEQ ID NO: 113139 - DNA, 25 bp, Mus musculus
gccactactgcagggacatgaagaa

SEQ ID NO: 113140 - DNA, 25 bp, Mus musculus
gccactagatgtgatgggtatccaa

SEQ ID NO: 113141 - DNA, 25 bp, Mus musculus
gccactaggcatttgaacaatagga

SEQ ID NO: 113142 - DNA, 25 bp, Mus musculus
gccactatttactgagacatcacca

SEQ ID NO: 113143 - DNA, 25 bp, Mus musculus
gccactcaccaaacctgaagtgatt

SEQ ID NO: 113144 - DNA, 25 bp, Mus musculus
gccactcggacttttgagatgagga

SEQ ID NO: 113145 - DNA, 25 bp, Mus musculus
gccactgcatcccagagcggtggaa

SEQ ID NO: 113146 - DNA, 25 bp, Mus musculus
gccactgcttcatgttgtgctgatg

SEQ ID NO: 113147 - DNA, 25 bp, Mus musculus
gccactgcttccagaaggaaagtat

SEQ ID NO: 113148 - DNA, 25 bp, Mus musculus
gccactggaggaaatgaccacaata

SEQ ID NO: 113149 - DNA, 25 bp, Mus musculus
gccactggaggagagagcactttcg

SEQ ID NO: 113150 - DNA, 25 bp, Mus musculus
gccactggatttactctaggaggaa

SEQ ID NO: 113151 - DNA, 25 bp, Mus musculus
gccactggctacatccaatcagatt

SEQ ID NO: 113152 - DNA, 25 bp, Mus musculus
gccactgtgaggactacaagctaaa

SEQ ID NO: 113153 - DNA, 25 bp, Mus musculus
gccactgtgatataggatataaccc

SEQ ID NO: 113154 - DNA, 25 bp, Mus musculus
gccactgtgtgtctgttgcttagcc

SEQ ID NO: 113155 - DNA, 25 bp, Mus musculus
gccacttctacaacagggctcaagg

SEQ ID NO: 113156 - DNA, 25 bp, Mus musculus
gccactttcttcaggattgcatcag

SEQ ID NO: 113157 - DNA, 25 bp, Mus musculus
gccacttttgtaagggcgaggtcaa

SEQ ID NO: 113158 - DNA, 25 bp, Mus musculus
gccagaaaaagtttctttgcgggag

SEQ ID NO: 113159 - DNA, 25 bp, Mus musculus
gccagaaaaatcgaaaggcaaggag

SEQ ID NO: 113160 - DNA, 25 bp, Mus musculus
gccagaagataaagatgaaacagct

SEQ ID NO: 113161 - DNA, 25 bp, Mus musculus
gccagaagctcaggcggcatgcagt

SEQ ID NO: 113162 - DNA, 25 bp, Mus musculus
gccagaaggcgggactcaagcctgt

SEQ ID NO: 113163 - DNA, 25 bp, Mus musculus
gccagaagggagcagagtaaactct

SEQ ID NO: 113164 - DNA, 25 bp, Mus musculus
gccagaatgaacaagcgagatcagt

SEQ ID NO: 113165 - DNA, 25 bp, Mus musculus
gccagaatgaactgcgccagagact

SEQ ID NO: 113166 - DNA, 25 bp, Mus musculus
gccagaatgctgtcaacaactagat

SEQ ID NO: 113167 - DNA, 25 bp, Mus musculus
gccagaattctccatggcggcatga

SEQ ID NO: 113168 - DNA, 25 bp, Mus musculus
gccagaattggtgctgatgcagctc

SEQ ID NO: 113169 - DNA, 25 bp, Mus musculus
gccagacccgggataccacttatgt

SEQ ID NO: 113170 - DNA, 25 bp, Mus musculus
gccagaccgggagaagggcaaacta

SEQ ID NO: 113171 - DNA, 25 bp, Mus musculus
gccagaccggtgtactccacaaaga

SEQ ID NO: 113172 - DNA, 25 bp, Mus musculus
gccagacctcctccggggtgacaga

SEQ ID NO: 113173 - DNA, 25 bp, Mus musculus
gccagacgcttacctggatcccaga

SEQ ID NO: 113174 - DNA, 25 bp, Mus musculus
gccagacggccagaagtgttaaata

SEQ ID NO: 113175 - DNA, 25 bp, Mus musculus
gccagactccgcgaagaagaaacaa

SEQ ID NO: 113176 - DNA, 25 bp, Mus musculus
gccagacttgtggtctctgtgggaa

SEQ ID NO: 113177 - DNA, 25 bp, Mus musculus
gccagactttcatgctagacaggat

SEQ ID NO: 113178 - DNA, 25 bp, Mus musculus
gccagagacaagcaggtactccgct

SEQ ID NO: 113179 - DNA, 25 bp, Mus musculus
gccagagagtggaagtgacacagca

SEQ ID NO: 113180 - DNA, 25 bp, Mus musculus
gccagagatatttgaagcagccact

SEQ ID NO: 113181 - DNA, 25 bp, Mus musculus
gccagagcagccattcatatgatga

SEQ ID NO: 113182 - DNA, 25 bp, Mus musculus
gccagagccacctgttaaaccagta

SEQ ID NO: 113183 - DNA, 25 bp, Mus musculus
gccagaggccatagctttaaccaga

SEQ ID NO: 113184 - DNA, 25 bp, Mus musculus
gccagaggcctgcaaagccctgtgt

SEQ ID NO: 113185 - DNA, 25 bp, Mus musculus
gccagaggctcgcagaataccagta

SEQ ID NO: 113186 - DNA, 25 bp, Mus musculus
gccagagttcttttgcccagcagag

SEQ ID NO: 113187 - DNA, 25 bp, Mus musculus
gccagatcccagattcaacagcaga

SEQ ID NO: 113188 - DNA, 25 bp, Mus musculus
gccagatctactctcggtaccagac

SEQ ID NO: 113189 - DNA, 25 bp, Mus musculus
gccagattggcaatttgaaacgcac

SEQ ID NO: 113190 - DNA, 25 bp, Mus musculus
gccagatttccagcagagttctcca

SEQ ID NO: 113191 - DNA, 25 bp, Mus musculus
gccagcactttcgtctcggagatga

SEQ ID NO: 113192 - DNA, 25 bp, Mus musculus
gccagcagcggagtgaggatcaact

SEQ ID NO: 113193 - DNA, 25 bp, Mus musculus
gccagcagcgggacttacaacttag

SEQ ID NO: 113194 - DNA, 25 bp, Mus musculus
gccagcagctactctgccgcaatga

SEQ ID NO: 113195 - DNA, 25 bp, Mus musculus
gccagcaggatggttccatgggtaa

SEQ ID NO: 113196 - DNA, 25 bp, Mus musculus
gccagcagggcttttcaccagagca

SEQ ID NO: 113197 - DNA, 25 bp, Mus musculus
gccagcagtcctcccgggatgagca

SEQ ID NO: 113198 - DNA, 25 bp, Mus musculus
gccagcatccctttaccttgcaaag

SEQ ID NO: 113199 - DNA, 25 bp, Mus musculus
gccagcattgcaggcagaagatgcc

SEQ ID NO: 113200 - DNA, 25 bp, Mus musculus
gccagccagacaaaaagttatggtg

SEQ ID NO: 113201 - DNA, 25 bp, Mus musculus
gccagccatgctagagacgttatac

SEQ ID NO: 113202 - DNA, 25 bp, Mus musculus
gccagccgctgccaaagtgaacaga

SEQ ID NO: 113203 - DNA, 25 bp, Mus musculus
gccagcctgggaatattgcctctta

SEQ ID NO: 113204 - DNA, 25 bp, Mus musculus
gccagcctgggacggaaatcttcaa

SEQ ID NO: 113205 - DNA, 25 bp, Mus musculus
gccagcctgttgtcggtcagaaaga

SEQ ID NO: 113206 - DNA, 25 bp, Mus musculus
gccagcgctctcgaaggaatggatg

SEQ ID NO: 113207 - DNA, 25 bp, Mus musculus
gccagcggcttctcttcttcaagga

SEQ ID NO: 113208 - DNA, 25 bp, Mus musculus
gccagcgggagttgtacagtcagca

SEQ ID NO: 113209 - DNA, 25 bp, Mus musculus
gccagcgtagatcacatcaagttcg

SEQ ID NO: 113210 - DNA, 25 bp, Mus musculus
gccagcgtgtcgtcatggagaccat

SEQ ID NO: 113211 - DNA, 25 bp, Mus musculus
gccagctaagtctgtgccccatgaa

SEQ ID NO: 113212 - DNA, 25 bp, Mus musculus
gccagctagaggctgccaagcaagt

SEQ ID NO: 113213 - DNA, 25 bp, Mus musculus
gccagctcaagtgcctgaaggaagc

SEQ ID NO: 113214 - DNA, 25 bp, Mus musculus
gccagctcacatcgcaaaggttaag

SEQ ID NO: 113215 - DNA, 25 bp, Mus musculus
gccagctcagagcagatgcgtacgc

SEQ ID NO: 113216 - DNA, 25 bp, Mus musculus
gccagctgaggcgggagaaaaacat

SEQ ID NO: 113217 - DNA, 25 bp, Mus musculus
gccagctgctgtgcaagggtgacta

SEQ ID NO: 113218 - DNA, 25 bp, Mus musculus
gccagcttcccagcgagaaggatgg

SEQ ID NO: 113219 - DNA, 25 bp, Mus musculus
gccagcttgggagacacactatcag

SEQ ID NO: 113220 - DNA, 25 bp, Mus musculus
gccagcttgtgggacgtcacctaag

SEQ ID NO: 113221 - DNA, 25 bp, Mus musculus
gccaggaatccagtcagcaacagtt

SEQ ID NO: 113222 - DNA, 25 bp, Mus musculus
gccaggaccacatgtcacaggagga

SEQ ID NO: 113223 - DNA, 25 bp, Mus musculus
gccaggaccatcacggagacggtga

SEQ ID NO: 113224 - DNA, 25 bp, Mus musculus
gccaggacgtcctctaatgtgagaa

SEQ ID NO: 113225 - DNA, 25 bp, Mus musculus
gccaggactgttgcaaagagcccgt

SEQ ID NO: 113226 - DNA, 25 bp, Mus musculus
gccaggagcttcctccaggacaaga

SEQ ID NO: 113227 - DNA, 25 bp, Mus musculus
gccaggaggaggataagacatgaca

SEQ ID NO: 113228 - DNA, 25 bp, Mus musculus
gccaggagtcctctgggcgtacaac

SEQ ID NO: 113229 - DNA, 25 bp, Mus musculus
gccaggatatgaagcaagggccctt

SEQ ID NO: 113230 - DNA, 25 bp, Mus musculus
gccaggatcaacatctcagagggaa

SEQ ID NO: 113231 - DNA, 25 bp, Mus musculus
gccaggatcgaatgtaccaacggtt

SEQ ID NO: 113232 - DNA, 25 bp, Mus musculus
gccaggatcttctgccgtcttgatg

SEQ ID NO: 113233 - DNA, 25 bp, Mus musculus
gccaggcacaatgaaggttctctta

SEQ ID NO: 113234 - DNA, 25 bp, Mus musculus
gccaggcacggcttacaaatttcga

SEQ ID NO: 113235 - DNA, 25 bp, Mus musculus
gccaggcagtgccatctgctctgca

SEQ ID NO: 113236 - DNA, 25 bp, Mus musculus
gccaggccactgaatgcaatgagca

SEQ ID NO: 113237 - DNA, 25 bp, Mus musculus
gccaggcctatggagctgcctgtgc

SEQ ID NO: 113238 - DNA, 25 bp, Mus musculus
gccaggcgggtgaggtacatttcca

SEQ ID NO: 113239 - DNA, 25 bp, Mus musculus
gccaggctccaagggtgagatctac

SEQ ID NO: 113240 - DNA, 25 bp, Mus musculus
gccaggctgagcacgataatcccag

SEQ ID NO: 113241 - DNA, 25 bp, Mus musculus
gccaggctgctatcgaggagcttaa

SEQ ID NO: 113242 - DNA, 25 bp, Mus musculus
gccaggcttcaaaaggagcggaaag

SEQ ID NO: 113243 - DNA, 25 bp, Mus musculus
gccaggcttgctgtagttacccaga

SEQ ID NO: 113244 - DNA, 25 bp, Mus musculus
gccagggactggacattcttcaatg

SEQ ID NO: 113245 - DNA, 25 bp, Mus musculus
gccagggagatcaagatgcgaccaa

SEQ ID NO: 113246 - DNA, 25 bp, Mus musculus
gccagggcctgatcaatgactttaa

SEQ ID NO: 113247 - DNA, 25 bp, Mus musculus
gccagggcgtttacacctatgagga

SEQ ID NO: 113248 - DNA, 25 bp, Mus musculus
gccagggctttgaccgacacttgtt

SEQ ID NO: 113249 - DNA, 25 bp, Mus musculus
gccagggtggcagtcaagaagatcc

SEQ ID NO: 113250 - DNA, 25 bp, Mus musculus
gccagggtgggtcttcaatcgcaac

SEQ ID NO: 113251 - DNA, 25 bp, Mus musculus
gccagggttcgcgtcttacatacaa

SEQ ID NO: 113252 - DNA, 25 bp, Mus musculus
gccaggtcaaccacaccatggaggt

SEQ ID NO: 113253 - DNA, 25 bp, Mus musculus
gccaggtgatcgaggagagtctaca

SEQ ID NO: 113254 - DNA, 25 bp, Mus musculus
gccaggtggacgtgcctcttagtca

SEQ ID NO: 113255 - DNA, 25 bp, Mus musculus
gccaggtgggagatgccaatatcaa

SEQ ID NO: 113256 - DNA, 25 bp, Mus musculus
gccaggtttcctcagatgcttcgag

SEQ ID NO: 113257 - DNA, 25 bp, Mus musculus
gccagtacaggcctcttgacccctt

SEQ ID NO: 113258 - DNA, 25 bp, Mus musculus
gccagtagcttctctcggcggagca

SEQ ID NO: 113259 - DNA, 25 bp, Mus musculus
gccagtattgccctctatgacgtta

SEQ ID NO: 113260 - DNA, 25 bp, Mus musculus
gccagtatttgaggagccaccgaac

SEQ ID NO: 113261 - DNA, 25 bp, Mus musculus
gccagtcaagaagccctcaaaagtg

SEQ ID NO: 113262 - DNA, 25 bp, Mus musculus
gccagtcagattcaggaagttgcgt

SEQ ID NO: 113263 - DNA, 25 bp, Mus musculus
gccagtcctcgcagcaggtggtgca

SEQ ID NO: 113264 - DNA, 25 bp, Mus musculus
gccagtccttttgagaatgcagaga

SEQ ID NO: 113265 - DNA, 25 bp, Mus musculus
gccagtcgaaaagcaaacccagaga

SEQ ID NO: 113266 - DNA, 25 bp, Mus musculus
gccagtcgtaacatattcttagagg

SEQ ID NO: 113267 - DNA, 25 bp, Mus musculus
gccagtgagagttcatttatcccag

SEQ ID NO: 113268 - DNA, 25 bp, Mus musculus
gccagtggaactacaaagacgacga

SEQ ID NO: 113269 - DNA, 25 bp, Mus musculus
gccagtggatacctacatctttcag

SEQ ID NO: 113270 - DNA, 25 bp, Mus musculus
gccagtgggcatagaaaatctcaag

SEQ ID NO: 113271 - DNA, 25 bp, Mus musculus
gccagtgggcgcaagtgtctcttca

SEQ ID NO: 113272 - DNA, 25 bp, Mus musculus
gccagtggtgtcaaacccagcacaa

SEQ ID NO: 113273 - DNA, 25 bp, Mus musculus
gccagtgtacggtcagcttctagct

SEQ ID NO: 113274 - DNA, 25 bp, Mus musculus
gccagtgtgaacaaggagcccatct

SEQ ID NO: 113275 - DNA, 25 bp, Mus musculus
gccagtgtgataatgcaagtcccag

SEQ ID NO: 113276 - DNA, 25 bp, Mus musculus
gccagtgtgctccatgtcccaataa

SEQ ID NO: 113277 - DNA, 25 bp, Mus musculus
gccagttagccaagagtcccgggtt

SEQ ID NO: 113278 - DNA, 25 bp, Mus musculus
gccagttccgggttgactcgtcgaa

SEQ ID NO: 113279 - DNA, 25 bp, Mus musculus
gccagttccttacagagcagtgcat

SEQ ID NO: 113280 - DNA, 25 bp, Mus musculus
gccagttcgtggaaaactgcaaggg

SEQ ID NO: 113281 - DNA, 25 bp, Mus musculus
gccagttcgtggcttaaccaaaaca

SEQ ID NO: 113282 - DNA, 25 bp, Mus musculus
gccagttggcaccatgaaggtcttc

SEQ ID NO: 113283 - DNA, 25 bp, Mus musculus
gccagttggcgattactacacagaa

SEQ ID NO: 113284 - DNA, 25 bp, Mus musculus
gccagtttcggctcaaggcttctga

SEQ ID NO: 113285 - DNA, 25 bp, Mus musculus
gccagtttcgggagctctttgccag

SEQ ID NO: 113286 - DNA, 25 bp, Mus musculus
gccagtttggctactcgaggacata

SEQ ID NO: 113287 - DNA, 25 bp, Mus musculus
gccagttttgcaagagccttcgaga

SEQ ID NO: 113288 - DNA, 25 bp, Mus musculus
gccataaaatcaggtggtgacccag

SEQ ID NO: 113289 - DNA, 25 bp, Mus musculus
gccataaactgctggtgctcaccgg

SEQ ID NO: 113290 - DNA, 25 bp, Mus musculus
gccataatcaaggaaccttttccgg

SEQ ID NO: 113291 - DNA, 25 bp, Mus musculus
gccataatccaggagggcccaatgg

SEQ ID NO: 113292 - DNA, 25 bp, Mus musculus
gccataatggatacagccaactggg

SEQ ID NO: 113293 - DNA, 25 bp, Mus musculus
gccataatggctgtgtccgctgctc

SEQ ID NO: 113294 - DNA, 25 bp, Mus musculus
gccatacggatgtagcagacgtctt

SEQ ID NO: 113295 - DNA, 25 bp, Mus musculus
gccatagcgaacatggaaccctcgg

SEQ ID NO: 113296 - DNA, 25 bp, Mus musculus
gccataggccgagaagatgtggtcc

SEQ ID NO: 113297 - DNA, 25 bp, Mus musculus
gccatatcaagctcaggacagggaa

SEQ ID NO: 113298 - DNA, 25 bp, Mus musculus
gccatatgaggatgtcgccattcca

SEQ ID NO: 113299 - DNA, 25 bp, Mus musculus
gccatatgggcagatgtttacctca

SEQ ID NO: 113300 - DNA, 25 bp, Mus musculus
gccatcactacgagagctttcaaga

SEQ ID NO: 113301 - DNA, 25 bp, Mus musculus
gccatcagggccaagtataccgaga

SEQ ID NO: 113302 - DNA, 25 bp, Mus musculus
gccatcagtgccatcaaggctgaaa

SEQ ID NO: 113303 - DNA, 25 bp, Mus musculus
gccatcatgctgttggaagggcaaa

SEQ ID NO: 113304 - DNA, 25 bp, Mus musculus
gccatcatgtcgatgagcaggagcc

SEQ ID NO: 113305 - DNA, 25 bp, Mus musculus
gccatccatttatgagcctgctgag

SEQ ID NO: 113306 - DNA, 25 bp, Mus musculus
gccatccctcacatggttaaaagaa

SEQ ID NO: 113307 - DNA, 25 bp, Mus musculus
gccatccgcgagtttgcagagcaca

SEQ ID NO: 113308 - DNA, 25 bp, Mus musculus
gccatccggtacagaatgtattgcc

SEQ ID NO: 113309 - DNA, 25 bp, Mus musculus
gccatcctcatggatgaacttcagg

SEQ ID NO: 113310 - DNA, 25 bp, Mus musculus
gccatcctggcttcaagatcttcag

SEQ ID NO: 113311 - DNA, 25 bp, Mus musculus
gccatcctgggactgctgttcatta

SEQ ID NO: 113312 - DNA, 25 bp, Mus musculus
gccatccttattggaatgagccagt

SEQ ID NO: 113313 - DNA, 25 bp, Mus musculus
gccatcgcagttaccagcgcgacgt

SEQ ID NO: 113314 - DNA, 25 bp, Mus musculus
gccatcgccgtcagaatcttcagaa

SEQ ID NO: 113315 - DNA, 25 bp, Mus musculus
gccatctctggactcttcaactgcg

SEQ ID NO: 113316 - DNA, 25 bp, Mus musculus
gccatctgcagcttcgccatgtcgt

SEQ ID NO: 113317 - DNA, 25 bp, Mus musculus
gccatctggcagaggaacttcagga

SEQ ID NO: 113318 - DNA, 25 bp, Mus musculus
gccatctgtctagaagagttctcag

SEQ ID NO: 113319 - DNA, 25 bp, Mus musculus
gccatcttggattccgcggtagcgg

SEQ ID NO: 113320 - DNA, 25 bp, Mus musculus
gccatcttgttcttctcgtggttcc

SEQ ID NO: 113321 - DNA, 25 bp, Mus musculus
gccatctttggagggactcatggaa

SEQ ID NO: 113322 - DNA, 25 bp, Mus musculus
gccatgaagatgcagcgacgctgaa

SEQ ID NO: 113323 - DNA, 25 bp, Mus musculus
gccatgaaggatgtcctgttgccat

SEQ ID NO: 113324 - DNA, 25 bp, Mus musculus
gccatgaccacgttgctcctagaga

SEQ ID NO: 113325 - DNA, 25 bp, Mus musculus
gccatgaccatctggattctcaagg

SEQ ID NO: 113326 - DNA, 25 bp, Mus musculus
gccatgaccatggatgaagactacc

SEQ ID NO: 113327 - DNA, 25 bp, Mus musculus
gccatgactgcgttctctttgctaa

SEQ ID NO: 113328 - DNA, 25 bp, Mus musculus
gccatgagaccgagcaaaagagact

SEQ ID NO: 113329 - DNA, 25 bp, Mus musculus
gccatgagcagaatctattaccggg

SEQ ID NO: 113330 - DNA, 25 bp, Mus musculus
gccatgagccaggactttggctgga

SEQ ID NO: 113331 - DNA, 25 bp, Mus musculus
gccatgagctccacgcagttcaaca

SEQ ID NO: 113332 - DNA, 25 bp, Mus musculus
gccatgatcagagcgatggacacgc

SEQ ID NO: 113333 - DNA, 25 bp, Mus musculus
gccatgatcctgctggaggtgaaca

SEQ ID NO: 113334 - DNA, 25 bp, Mus musculus
gccatgcaaccatcgttaccaggga

SEQ ID NO: 113335 - DNA, 25 bp, Mus musculus
gccatgcagatggtgcccaggttct

SEQ ID NO: 113336 - DNA, 25 bp, Mus musculus
gccatgcagctttttcagggagtcc

SEQ ID NO: 113337 - DNA, 25 bp, Mus musculus
gccatgcctacaaatgaaaatcagg

SEQ ID NO: 113338 - DNA, 25 bp, Mus musculus
gccatgcgactggacagcctaggta

SEQ ID NO: 113339 - DNA, 25 bp, Mus musculus
gccatgcttacctcacagatcagat

SEQ ID NO: 113340 - DNA, 25 bp, Mus musculus
gccatggaaaagatacaagttctca

SEQ ID NO: 113341 - DNA, 25 bp, Mus musculus
gccatggcacagaaacccaagatag

SEQ ID NO: 113342 - DNA, 25 bp, Mus musculus
gccatggccaaccagtcaggctgga

SEQ ID NO: 113343 - DNA, 25 bp, Mus musculus
gccatggccgtggcttcaatgccag

SEQ ID NO: 113344 - DNA, 25 bp, Mus musculus
gccatggcctagaaacccttgtcag

SEQ ID NO: 113345 - DNA, 25 bp, Mus musculus
gccatggcctcagtgtgtgggacac

SEQ ID NO: 113346 - DNA, 25 bp, Mus musculus
gccatggctatgtgtacgagtaccc

SEQ ID NO: 113347 - DNA, 25 bp, Mus musculus
gccatggctctcaagcgcgtcttct

SEQ ID NO: 113348 - DNA, 25 bp, Mus musculus
gccatggtgacctctgcaatgatgt

SEQ ID NO: 113349 - DNA, 25 bp, Mus musculus
gccatggtttgctgtttagtatttt

SEQ ID NO: 113350 - DNA, 25 bp, Mus musculus
gccatgtatttgtctccttgtgaag

SEQ ID NO: 113351 - DNA, 25 bp, Mus musculus
gccatgtcactcacaactgggatga

SEQ ID NO: 113352 - DNA, 25 bp, Mus musculus
gccatgtgcacctcctttaaggaaa

SEQ ID NO: 113353 - DNA, 25 bp, Mus musculus
gccatgtgctccttcgaacggacag

SEQ ID NO: 113354 - DNA, 25 bp, Mus musculus
gccatgtggaagtggtctctgagct

SEQ ID NO: 113355 - DNA, 25 bp, Mus musculus
gccatgtgggaaatgctgcttctac

SEQ ID NO: 113356 - DNA, 25 bp, Mus musculus
gccatgttatcagccagacaggagg

SEQ ID NO: 113357 - DNA, 25 bp, Mus musculus
gccatgttgccgatcaatgtggacc

SEQ ID NO: 113358 - DNA, 25 bp, Mus musculus
gccattaaactggtgagtagaccgt

SEQ ID NO: 113359 - DNA, 25 bp, Mus musculus
gccattaactgtggccaccaggtgt

SEQ ID NO: 113360 - DNA, 25 bp, Mus musculus
gccattaaggtaggatcagccatca

SEQ ID NO: 113361 - DNA, 25 bp, Mus musculus
gccattaccagcgtttggaccagga

SEQ ID NO: 113362 - DNA, 25 bp, Mus musculus
gccattacgcttcagaacattggag

SEQ ID NO: 113363 - DNA, 25 bp, Mus musculus
gccattactgttgaggttgcatcct

SEQ ID NO: 113364 - DNA, 25 bp, Mus musculus
gccattatgaggagtgatgacccca

SEQ ID NO: 113365 - DNA, 25 bp, Mus musculus
gccattcctaagagtgcaattcggg

SEQ ID NO: 113366 - DNA, 25 bp, Mus musculus
gccattcctcaccatgtgcattaag

SEQ ID NO: 113367 - DNA, 25 bp, Mus musculus
gccattcctcctgtgtgataggtga

SEQ ID NO: 113368 - DNA, 25 bp, Mus musculus
gccattcgcggcctctggttctcgg

SEQ ID NO: 113369 - DNA, 25 bp, Mus musculus
gccattctgaggcagggagctacca

SEQ ID NO: 113370 - DNA, 25 bp, Mus musculus
gccattgagtttgttagccgctgaa

SEQ ID NO: 113371 - DNA, 25 bp, Mus musculus
gccattgatcccaaagcctcgtatg

SEQ ID NO: 113372 - DNA, 25 bp, Mus musculus
gccattgcaggaaccctgaagttca

SEQ ID NO: 113373 - DNA, 25 bp, Mus musculus
gccattgcgctgctcgtcatccttg

SEQ ID NO: 113374 - DNA, 25 bp, Mus musculus
gccattgtcctgtgccgtcagctgg

SEQ ID NO: 113375 - DNA, 25 bp, Mus musculus
gccatttaccgtgcgctggactggg

SEQ ID NO: 113376 - DNA, 25 bp, Mus musculus
gccatttcaaccagagatctgcctc

SEQ ID NO: 113377 - DNA, 25 bp, Mus musculus
gccatttgtcggcaacatctgctcc

SEQ ID NO: 113378 - DNA, 25 bp, Mus musculus
gccattttagagctgtgatgcacag

SEQ ID NO: 113379 - DNA, 25 bp, Mus musculus
gccattttgaaagtggagtcgcctg

SEQ ID NO: 113380 - DNA, 25 bp, Mus musculus
gccattttgcccacgggtcagaccg

SEQ ID NO: 113381 - DNA, 25 bp, Mus musculus
gccattttgggtggaagcgatcact

SEQ ID NO: 113382 - DNA, 25 bp, Mus musculus
gccattttgtgaagcggctgtggag

SEQ ID NO: 113383 - DNA, 25 bp, Mus musculus
gcccaaaccatggaagccttcgcag

SEQ ID NO: 113384 - DNA, 25 bp, Mus musculus
gcccaaagccactctgaaggtgcag

SEQ ID NO: 113385 - DNA, 25 bp, Mus musculus
gcccaaagcgaacatcacgtccgat

SEQ ID NO: 113386 - DNA, 25 bp, Mus musculus
gcccaacaatgtcggtgatgaagat

SEQ ID NO: 113387 - DNA, 25 bp, Mus musculus
gcccaacagactaatgactcacatg

SEQ ID NO: 113388 - DNA, 25 bp, Mus musculus
gcccaacgtggtctatacagccaga

SEQ ID NO: 113389 - DNA, 25 bp, Mus musculus
gcccaagacctgcaagaacttcgcg

SEQ ID NO: 113390 - DNA, 25 bp, Mus musculus
gcccaagacgaaaggattaaaacag

SEQ ID NO: 113391 - DNA, 25 bp, Mus musculus
gcccaagctggaagaatatgactcg

SEQ ID NO: 113392 - DNA, 25 bp, Mus musculus
gcccaaggtgatgcgcctgaaggat

SEQ ID NO: 113393 - DNA, 25 bp, Mus musculus
gcccaatggagattcggtgcacgga

SEQ ID NO: 113394 - DNA, 25 bp, Mus musculus
gcccacaaattcagaccaggcctgt

SEQ ID NO: 113395 - DNA, 25 bp, Mus musculus
gcccacagagaatgacgagtagaat

SEQ ID NO: 113396 - DNA, 25 bp, Mus musculus
gcccacagaggcttcgtttgggaac

SEQ ID NO: 113397 - DNA, 25 bp, Mus musculus
gcccacagatgggtcactatgctga

SEQ ID NO: 113398 - DNA, 25 bp, Mus musculus
gcccacagccagctctgctagatat

SEQ ID NO: 113399 - DNA, 25 bp, Mus musculus
gcccacagcgacgaagagatggagc

SEQ ID NO: 113400 - DNA, 25 bp, Mus musculus
gcccacagtgccgagcaaagtactg

SEQ ID NO: 113401 - DNA, 25 bp, Mus musculus
gcccacatctatgaaggccgtgtta

SEQ ID NO: 113402 - DNA, 25 bp, Mus musculus
gcccaccaccgaattccagaatatg

SEQ ID NO: 113403 - DNA, 25 bp, Mus musculus
gcccaccagcgggaacagaatgagc

SEQ ID NO: 113404 - DNA, 25 bp, Mus musculus
gcccaccagctaggagactttatcg

SEQ ID NO: 113405 - DNA, 25 bp, Mus musculus
gcccacctcgtgagaagacggttct

SEQ ID NO: 113406 - DNA, 25 bp, Mus musculus
gcccacgaaggcgatcaggtttaga

SEQ ID NO: 113407 - DNA, 25 bp, Mus musculus
gcccacgggaacgagattgcttcta

SEQ ID NO: 113408 - DNA, 25 bp, Mus musculus
gcccacgtttctctagtagtctgta

SEQ ID NO: 113409 - DNA, 25 bp, Mus musculus
gcccacttgctatggagaggatcaa

SEQ ID NO: 113410 - DNA, 25 bp, Mus musculus
gcccagaactctgatcgacagtcaa

SEQ ID NO: 113411 - DNA, 25 bp, Mus musculus
gcccagaagctcctcaattaccgaa

SEQ ID NO: 113412 - DNA, 25 bp, Mus musculus
gcccagaagtgtggcttgtcctaca

SEQ ID NO: 113413 - DNA, 25 bp, Mus musculus
gcccagacgaagaggagagagctcc

SEQ ID NO: 113414 - DNA, 25 bp, Mus musculus
gcccagagcgtgctgcaggacttac

SEQ ID NO: 113415 - DNA, 25 bp, Mus musculus
gcccagagctcggagaggatataga

SEQ ID NO: 113416 - DNA, 25 bp, Mus musculus
gcccagatctggtcgaatcactcca

SEQ ID NO: 113417 - DNA, 25 bp, Mus musculus
gcccagatgcgttcctgtgttgtta

SEQ ID NO: 113418 - DNA, 25 bp, Mus musculus
gcccagcaacgtgcgcgttgacgta

SEQ ID NO: 113419 - DNA, 25 bp, Mus musculus
gcccagcaccaaaatacacgaaagt

SEQ ID NO: 113420 - DNA, 25 bp, Mus musculus
gcccagcagcgtttccagtgtgtga

SEQ ID NO: 113421 - DNA, 25 bp, Mus musculus
gcccagccgcgaggtatcagtacat

SEQ ID NO: 113422 - DNA, 25 bp, Mus musculus
gcccagcctatgttgcagtatgaga

SEQ ID NO: 113423 - DNA, 25 bp, Mus musculus
gcccagcctggacatcgaagttaca

SEQ ID NO: 113424 - DNA, 25 bp, Mus musculus
gcccagcgggtatgtcagtgtcact

SEQ ID NO: 113425 - DNA, 25 bp, Mus musculus
gcccagctcagattgtgacatatga

SEQ ID NO: 113426 - DNA, 25 bp, Mus musculus
gcccagctccttccaggaatgtcgg

SEQ ID NO: 113427 - DNA, 25 bp, Mus musculus
gcccagctgcctttgccaggctgcc

SEQ ID NO: 113428 - DNA, 25 bp, Mus musculus
gcccagctggacacggaaggtatag

SEQ ID NO: 113429 - DNA, 25 bp, Mus musculus
gcccagcttgcagaagactgtctta

SEQ ID NO: 113430 - DNA, 25 bp, Mus musculus
gcccaggacaaggatttcggctttt

SEQ ID NO: 113431 - DNA, 25 bp, Mus musculus
gcccagggacgcttggtctcaaaca

SEQ ID NO: 113432 - DNA, 25 bp, Mus musculus
gcccagtagtgtgaatgcagcctct

SEQ ID NO: 113433 - DNA, 25 bp, Mus musculus
gcccagtatgagctgatcgcccaga

SEQ ID NO: 113434 - DNA, 25 bp, Mus musculus
gcccagtcagaggaagcaacggatt

SEQ ID NO: 113435 - DNA, 25 bp, Mus musculus
gcccagtcctaactccagaaaacgg

SEQ ID NO: 113436 - DNA, 25 bp, Mus musculus
gcccagtcgacgtggcacttcctat

SEQ ID NO: 113437 - DNA, 25 bp, Mus musculus
gcccagtcttgtgtgagctctagta

SEQ ID NO: 113438 - DNA, 25 bp, Mus musculus
gcccagtgcccgcagtgaagatgtc

SEQ ID NO: 113439 - DNA, 25 bp, Mus musculus
gcccagtggtgtaggcaagagtcac

SEQ ID NO: 113440 - DNA, 25 bp, Mus musculus
gcccatcgcgtgagctgtagagttt

SEQ ID NO: 113441 - DNA, 25 bp, Mus musculus
gcccatctactgtccctgagctatg

SEQ ID NO: 113442 - DNA, 25 bp, Mus musculus
gcccatgaggatattgccgtgaaag

SEQ ID NO: 113443 - DNA, 25 bp, Mus musculus
gcccatgattaagaaagctcgcaaa

SEQ ID NO: 113444 - DNA, 25 bp, Mus musculus
gcccatgcacaagatgatgaacacc

SEQ ID NO: 113445 - DNA, 25 bp, Mus musculus
gcccatgcccagagtcaaataccat

SEQ ID NO: 113446 - DNA, 25 bp, Mus musculus
gcccatgctgatggagtaccctgaa

SEQ ID NO: 113447 - DNA, 25 bp, Mus musculus
gcccatggctcttgtggtatgccga

SEQ ID NO: 113448 - DNA, 25 bp, Mus musculus
gcccatgtggcctgtacaaccagta

SEQ ID NO: 113449 - DNA, 25 bp, Mus musculus
gcccatgtgttggacggaaggccac

SEQ ID NO: 113450 - DNA, 25 bp, Mus musculus
gcccattggaatattaagcccggga

SEQ ID NO: 113451 - DNA, 25 bp, Mus musculus
gcccattgggcgctgtacctgtaag

SEQ ID NO: 113452 - DNA, 25 bp, Mus musculus
gcccattgtctccaaggatactgaa

SEQ ID NO: 113453 - DNA, 25 bp, Mus musculus
gcccattgtggccagaaagacagtg

SEQ ID NO: 113454 - DNA, 25 bp, Mus musculus
gcccattgttctggacagtctcaaa

SEQ ID NO: 113455 - DNA, 25 bp, Mus musculus
gcccatttctgcagtgtgttgacat

SEQ ID NO: 113456 - DNA, 25 bp, Mus musculus
gccccaaaatacagcttccagtaga

SEQ ID NO: 113457 - DNA, 25 bp, Mus musculus
gccccaaaatggttaaggttgcaag

SEQ ID NO: 113458 - DNA, 25 bp, Mus musculus
gccccaaggacgatgacaggaaagt

SEQ ID NO: 113459 - DNA, 25 bp, Mus musculus
gccccacagcttgttggagagttag

SEQ ID NO: 113460 - DNA, 25 bp, Mus musculus
gccccagaagggaaagcctcttaag

SEQ ID NO: 113461 - DNA, 25 bp, Mus musculus
gccccagaggccaaagagatatata

SEQ ID NO: 113462 - DNA, 25 bp, Mus musculus
gccccagctcagcagcaaggtgaag

SEQ ID NO: 113463 - DNA, 25 bp, Mus musculus
gccccagctgtagtacattcaaagg

SEQ ID NO: 113464 - DNA, 25 bp, Mus musculus
gccccaggacctcagagatttctgg

SEQ ID NO: 113465 - DNA, 25 bp, Mus musculus
gccccaggcagaccagactagattt

SEQ ID NO: 113466 - DNA, 25 bp, Mus musculus
gccccagggatttggtcagctaacc

SEQ ID NO: 113467 - DNA, 25 bp, Mus musculus
gccccaggttagcagaagagcgtct

SEQ ID NO: 113468 - DNA, 25 bp, Mus musculus
gccccagtgaagaaccgtggtcaga

SEQ ID NO: 113469 - DNA, 25 bp, Mus musculus
gccccatccagggaacagttattta

SEQ ID NO: 113470 - DNA, 25 bp, Mus musculus
gccccatgggctagaaaaggtacca

SEQ ID NO: 113471 - DNA, 25 bp, Mus musculus
gccccatgtgggagaaaagagttca

SEQ ID NO: 113472 - DNA, 25 bp, Mus musculus
gccccgaaagttgacctcctggtga

SEQ ID NO: 113473 - DNA, 25 bp, Mus musculus
gccccgaaatgccagccagaaagat

SEQ ID NO: 113474 - DNA, 25 bp, Mus musculus
gccccgactggacgaactgaatcaa

SEQ ID NO: 113475 - DNA, 25 bp, Mus musculus
gccccgcagtcgtgaacagcttact

SEQ ID NO: 113476 - DNA, 25 bp, Mus musculus
gccccgctacggtcttgaagtcaag

SEQ ID NO: 113477 - DNA, 25 bp, Mus musculus
gccccggaggcaatagcttttcgaa

SEQ ID NO: 113478 - DNA, 25 bp, Mus musculus
gccccggcgttcagctctatgagta

SEQ ID NO: 113479 - DNA, 25 bp, Mus musculus
gccccggtgatttacgggctggaat

SEQ ID NO: 113480 - DNA, 25 bp, Mus musculus
gccccgtgtgctgcaggaactgaac

SEQ ID NO: 113481 - DNA, 25 bp, Mus musculus
gccccgttctgcagtcgccggatta

SEQ ID NO: 113482 - DNA, 25 bp, Mus musculus
gccccgttgtggtctggaggatccc

SEQ ID NO: 113483 - DNA, 25 bp, Mus musculus
gcccctacatggcattcgttatgtc

SEQ ID NO: 113484 - DNA, 25 bp, Mus musculus
gcccctcaaacatgactcgcgattt

SEQ ID NO: 113485 - DNA, 25 bp, Mus musculus
gcccctcgcaggatcttccaggaaa

SEQ ID NO: 113486 - DNA, 25 bp, Mus musculus
gcccctcggtaccagtctatgagaa

SEQ ID NO: 113487 - DNA, 25 bp, Mus musculus
gcccctctacaaggaagagttggaa

SEQ ID NO: 113488 - DNA, 25 bp, Mus musculus
gcccctctgggaacatggcgaccgg

SEQ ID NO: 113489 - DNA, 25 bp, Mus musculus
gcccctgaaaacaataaaacacttg

SEQ ID NO: 113490 - DNA, 25 bp, Mus musculus
gcccctgacgttggaaacacctgta

SEQ ID NO: 113491 - DNA, 25 bp, Mus musculus
gcccctgagtgatgcctacctcagt

SEQ ID NO: 113492 - DNA, 25 bp, Mus musculus
gcccctggaagaacggcagattgcc

SEQ ID NO: 113493 - DNA, 25 bp, Mus musculus
gcccctggcgcctgaagtttctaca

SEQ ID NO: 113494 - DNA, 25 bp, Mus musculus
gcccctggcttatcagtcagatgag

SEQ ID NO: 113495 - DNA, 25 bp, Mus musculus
gcccctgtcttgaggaaagaactga

SEQ ID NO: 113496 - DNA, 25 bp, Mus musculus
gccccttacgagcaagaagatgatg

SEQ ID NO: 113497 - DNA, 25 bp, Mus musculus
gccccttagaatgggaagattacgt

SEQ ID NO: 113498 - DNA, 25 bp, Mus musculus
gccccttgaagcgaaccatgactgt

SEQ ID NO: 113499 - DNA, 25 bp, Mus musculus
gccccttgtctaaggaatcctggaa

SEQ ID NO: 113500 - DNA, 25 bp, Mus musculus
gccccttgtggccagagaacggtta

SEQ ID NO: 113501 - DNA, 25 bp, Mus musculus
gcccgaagccttttctgccgatgaa

SEQ ID NO: 113502 - DNA, 25 bp, Mus musculus
gcccgaccaaaacaggagaaagctt

SEQ ID NO: 113503 - DNA, 25 bp, Mus musculus
gcccgacgaggtggacaagttcaaa

SEQ ID NO: 113504 - DNA, 25 bp, Mus musculus
gcccgacgttcattggcccagatct

SEQ ID NO: 113505 - DNA, 25 bp, Mus musculus
gcccgactcaggtattgagttgctg

SEQ ID NO: 113506 - DNA, 25 bp, Mus musculus
gcccgactcggtgattgaagacaag

SEQ ID NO: 113507 - DNA, 25 bp, Mus musculus
gcccgagaacggtggaactttgact

SEQ ID NO: 113508 - DNA, 25 bp, Mus musculus
gcccgaggacggtgatccaccctaa

SEQ ID NO: 113509 - DNA, 25 bp, Mus musculus
gcccgatatccctcaactctgagga

SEQ ID NO: 113510 - DNA, 25 bp, Mus musculus
gcccgattaaagacagactgacagt

SEQ ID NO: 113511 - DNA, 25 bp, Mus musculus
gcccgcagcgaaaacaagaataaag

SEQ ID NO: 113512 - DNA, 25 bp, Mus musculus
gcccgccatggccgtggcttcaatg

SEQ ID NO: 113513 - DNA, 25 bp, Mus musculus
gcccgccgctcagttgtgtcaagaa

SEQ ID NO: 113514 - DNA, 25 bp, Mus musculus
gcccgcggatggaactcagcataga

SEQ ID NO: 113515 - DNA, 25 bp, Mus musculus
gcccgctatgaagctgcatgcaaca

SEQ ID NO: 113516 - DNA, 25 bp, Mus musculus
gcccgctcggagatgtccctatatt

SEQ ID NO: 113517 - DNA, 25 bp, Mus musculus
gcccggacatcaaggagcatcttca

SEQ ID NO: 113518 - DNA, 25 bp, Mus musculus
gcccggacatcgagcagagctttca

SEQ ID NO: 113519 - DNA, 25 bp, Mus musculus
gcccggatcctacagaagctcatgg

SEQ ID NO: 113520 - DNA, 25 bp, Mus musculus
gcccggcagcactatgagagacatc

SEQ ID NO: 113521 - DNA, 25 bp, Mus musculus
gcccggcaggagctctttatcttca

SEQ ID NO: 113522 - DNA, 25 bp, Mus musculus
gcccggccccaaggaggaaaatgtg

SEQ ID NO: 113523 - DNA, 25 bp, Mus musculus
gcccggcgaccctgtcattctatat

SEQ ID NO: 113524 - DNA, 25 bp, Mus musculus
gcccggctctactctgatcactatg

SEQ ID NO: 113525 - DNA, 25 bp, Mus musculus
gcccgggaaggcaaactggtcctgt

SEQ ID NO: 113526 - DNA, 25 bp, Mus musculus
gcccgggcgatgagaagctgcttct

SEQ ID NO: 113527 - DNA, 25 bp, Mus musculus
gcccgtacgtgcaagacctgtctaa

SEQ ID NO: 113528 - DNA, 25 bp, Mus musculus
gcccgtgcaggcgtcatactttgag

SEQ ID NO: 113529 - DNA, 25 bp, Mus musculus
gcccgtggacctgcatatgaaactg

SEQ ID NO: 113530 - DNA, 25 bp, Mus musculus
gcccgtggcgccttcatttggcatc

SEQ ID NO: 113531 - DNA, 25 bp, Mus musculus
gcccgtgtgcatccctgaaaagtct

SEQ ID NO: 113532 - DNA, 25 bp, Mus musculus
gcccgtgtggtatctggacgattcc

SEQ ID NO: 113533 - DNA, 25 bp, Mus musculus
gcccgttggttaagagcttggccca

SEQ ID NO: 113534 - DNA, 25 bp, Mus musculus
gcccgtttaagctcaaggtcatccg

SEQ ID NO: 113535 - DNA, 25 bp, Mus musculus
gccctaatctagaatgacctgttac

SEQ ID NO: 113536 - DNA, 25 bp, Mus musculus
gccctacactgcaactcaagacgga

SEQ ID NO: 113537 - DNA, 25 bp, Mus musculus
gccctacccaggttgacgactgaag

SEQ ID NO: 113538 - DNA, 25 bp, Mus musculus
gccctacctgctagacaaggcactg

SEQ ID NO: 113539 - DNA, 25 bp, Mus musculus
gccctacgcggccgcctaagcatgt

SEQ ID NO: 113540 - DNA, 25 bp, Mus musculus
gccctacgcggtgttgcggaggcag

SEQ ID NO: 113541 - DNA, 25 bp, Mus musculus
gccctagctttggacatgatggagt

SEQ ID NO: 113542 - DNA, 25 bp, Mus musculus
gccctaggacggaaaaatggcgcct

SEQ ID NO: 113543 - DNA, 25 bp, Mus musculus
gccctagttaggacagacatgcttg

SEQ ID NO: 113544 - DNA, 25 bp, Mus musculus
gccctatctatgctaccagctggag

SEQ ID NO: 113545 - DNA, 25 bp, Mus musculus
gccctatgacgataaagagttccag

SEQ ID NO: 113546 - DNA, 25 bp, Mus musculus
gccctatgccgtggcctgtgcttgg

SEQ ID NO: 113547 - DNA, 25 bp, Mus musculus
gccctcaaaagtgttttaccatgga

SEQ ID NO: 113548 - DNA, 25 bp, Mus musculus
gccctcagtgttcccgtgtggcctg

SEQ ID NO: 113549 - DNA, 25 bp, Mus musculus
gccctcatgaggatgctggacaatt

SEQ ID NO: 113550 - DNA, 25 bp, Mus musculus
gccctccccgaatagaagaactttg

SEQ ID NO: 113551 - DNA, 25 bp, Mus musculus
gccctccgatgtatcacctgatgaa

SEQ ID NO: 113552 - DNA, 25 bp, Mus musculus
gccctccgtggctgtgcataaagaa

SEQ ID NO: 113553 - DNA, 25 bp, Mus musculus
gccctcctcgagttacctggaatgt

SEQ ID NO: 113554 - DNA, 25 bp, Mus musculus
gccctcgtgtgcgcgggacccagca

SEQ ID NO: 113555 - DNA, 25 bp, Mus musculus
gccctctggtgatggttgtatctac

SEQ ID NO: 113556 - DNA, 25 bp, Mus musculus
gccctctgtgccctggatgttttaa

SEQ ID NO: 113557 - DNA, 25 bp, Mus musculus
gccctgaaaaccactcgcatgcaga

SEQ ID NO: 113558 - DNA, 25 bp, Mus musculus
gccctgaaaatgcaagtcctgtacg

SEQ ID NO: 113559 - DNA, 25 bp, Mus musculus
gccctgaagggtccaaaggagatca

SEQ ID NO: 113560 - DNA, 25 bp, Mus musculus
gccctgaagtcgtcccgggtccagg

SEQ ID NO: 113561 - DNA, 25 bp, Mus musculus
gccctgacagaggaaaaacgcgtct

SEQ ID NO: 113562 - DNA, 25 bp, Mus musculus
gccctgacgaatctttagaagttgg

SEQ ID NO: 113563 - DNA, 25 bp, Mus musculus
gccctgagaacgaggagtacatcct

SEQ ID NO: 113564 - DNA, 25 bp, Mus musculus
gccctgagattgagcagttcagcat

SEQ ID NO: 113565 - DNA, 25 bp, Mus musculus
gccctgagggaaaaggaagcacttc

SEQ ID NO: 113566 - DNA, 25 bp, Mus musculus
gccctgagtggaaaatcctttcatg

SEQ ID NO: 113567 - DNA, 25 bp, Mus musculus
gccctgcaaagataaagtggagctg

SEQ ID NO: 113568 - DNA, 25 bp, Mus musculus
gccctgcagctgttcgatgacttta

SEQ ID NO: 113569 - DNA, 25 bp, Mus musculus
gccctgcatgtgataacctggtcca

SEQ ID NO: 113570 - DNA, 25 bp, Mus musculus
gccctgccaaagtataaattagcag

SEQ ID NO: 113571 - DNA, 25 bp, Mus musculus
gccctgcccggttaagttgacatat

SEQ ID NO: 113572 - DNA, 25 bp, Mus musculus
gccctgccgcctgagaagattgaca

SEQ ID NO: 113573 - DNA, 25 bp, Mus musculus
gccctgcgggaacttctgtgcaaaa

SEQ ID NO: 113574 - DNA, 25 bp, Mus musculus
gccctgctcaatacagacctggtgg

SEQ ID NO: 113575 - DNA, 25 bp, Mus musculus
gccctgctccatgacacagtagaag

SEQ ID NO: 113576 - DNA, 25 bp, Mus musculus
gccctgctctatgcttactggacta

SEQ ID NO: 113577 - DNA, 25 bp, Mus musculus
gccctgctggagttcatacccattc

SEQ ID NO: 113578 - DNA, 25 bp, Mus musculus
gccctgctgggctatgacatctcgg

SEQ ID NO: 113579 - DNA, 25 bp, Mus musculus
gccctgctgttttcttcgcggcatt

SEQ ID NO: 113580 - DNA, 25 bp, Mus musculus
gccctggaattagaccgacagcggg

SEQ ID NO: 113581 - DNA, 25 bp, Mus musculus
gccctggctatatccgacagggtag

SEQ ID NO: 113582 - DNA, 25 bp, Mus musculus
gccctggctccccaaagtacctcta

SEQ ID NO: 113583 - DNA, 25 bp, Mus musculus
gccctggctgcactttcatcaacaa

SEQ ID NO: 113584 - DNA, 25 bp, Mus musculus
gccctgggaccctcggattgtggaa

SEQ ID NO: 113585 - DNA, 25 bp, Mus musculus
gccctgggcatagcaaccgtgaact

SEQ ID NO: 113586 - DNA, 25 bp, Mus musculus
gccctggtgcagatgttccgcagcg

SEQ ID NO: 113587 - DNA, 25 bp, Mus musculus
gccctggtgtgcctgagcatgctat

SEQ ID NO: 113588 - DNA, 25 bp, Mus musculus
gccctggttgaaggaagcacaaact

SEQ ID NO: 113589 - DNA, 25 bp, Mus musculus
gccctgtactcaaggccggctggct

SEQ ID NO: 113590 - DNA, 25 bp, Mus musculus
gccctgtcccaggatccataggagt

SEQ ID NO: 113591 - DNA, 25 bp, Mus musculus
gccctgtcgacttgggaggacctgt

SEQ ID NO: 113592 - DNA, 25 bp, Mus musculus
gccctgtcgttctccacagctgtac

SEQ ID NO: 113593 - DNA, 25 bp, Mus musculus
gccctgtgcactgtctggatgaaga

SEQ ID NO: 113594 - DNA, 25 bp, Mus musculus
gccctgttacaattggctttggcag

SEQ ID NO: 113595 - DNA, 25 bp, Mus musculus
gccctgttctcaagcgaagctcgga

SEQ ID NO: 113596 - DNA, 25 bp, Mus musculus
gccctgttgccataatagagctgga

SEQ ID NO: 113597 - DNA, 25 bp, Mus musculus
gcccttaaggctacaagttggttgg

SEQ ID NO: 113598 - DNA, 25 bp, Mus musculus
gcccttatgggcactgcaaacatat

SEQ ID NO: 113599 - DNA, 25 bp, Mus musculus
gcccttcactgctgagatctaccga

SEQ ID NO: 113600 - DNA, 25 bp, Mus musculus
gcccttcattctgagctgtaggcca

SEQ ID NO: 113601 - DNA, 25 bp, Mus musculus
gcccttccggtctgtgggatcgaga

SEQ ID NO: 113602 - DNA, 25 bp, Mus musculus
gcccttctcagacagatccaggagg

SEQ ID NO: 113603 - DNA, 25 bp, Mus musculus
gcccttcttgccctcttggtggtca

SEQ ID NO: 113604 - DNA, 25 bp, Mus musculus
gcccttgaaagacgccaggcagaga

SEQ ID NO: 113605 - DNA, 25 bp, Mus musculus
gcccttgacttcctgcacactaaag

SEQ ID NO: 113606 - DNA, 25 bp, Mus musculus
gcccttgatactgatgaacctgatg

SEQ ID NO: 113607 - DNA, 25 bp, Mus musculus
gcccttggcaccagagacggatgaa

SEQ ID NO: 113608 - DNA, 25 bp, Mus musculus
gcccttgtgaggtgtcttgccagag

SEQ ID NO: 113609 - DNA, 25 bp, Mus musculus
gcccttgtgcacagtcgatgtatga

SEQ ID NO: 113610 - DNA, 25 bp, Mus musculus
gcccttgtgcactcctccgttgaga

SEQ ID NO: 113611 - DNA, 25 bp, Mus musculus
gccctttccagcacatgggtgagaa

SEQ ID NO: 113612 - DNA, 25 bp, Mus musculus
gccctttggctctgcgagcttcgca

SEQ ID NO: 113613 - DNA, 25 bp, Mus musculus
gccctttgtgtataagcccgagatg

SEQ ID NO: 113614 - DNA, 25 bp, Mus musculus
gcccttttctgaccgggaaactgag

SEQ ID NO: 113615 - DNA, 25 bp, Mus musculus
gccgaacagcatttgagacgccctc

SEQ ID NO: 113616 - DNA, 25 bp, Mus musculus
gccgaacatgtgaactgcacccagc

SEQ ID NO: 113617 - DNA, 25 bp, Mus musculus
gccgaacgcgtgttggaactcgtct

SEQ ID NO: 113618 - DNA, 25 bp, Mus musculus
gccgaagacgacttcctggagccgg

SEQ ID NO: 113619 - DNA, 25 bp, Mus musculus
gccgaagcctttgctcaatgaaaaa

SEQ ID NO: 113620 - DNA, 25 bp, Mus musculus
gccgaaggagccagagactgttatc

SEQ ID NO: 113621 - DNA, 25 bp, Mus musculus
gccgaaggcctggaactgaaggaca

SEQ ID NO: 113622 - DNA, 25 bp, Mus musculus
gccgaattcatcgaggaccagcctg

SEQ ID NO: 113623 - DNA, 25 bp, Mus musculus
gccgaattcgaggactaaaagtctg

SEQ ID NO: 113624 - DNA, 25 bp, Mus musculus
gccgaattttggagaaaagcttttg

SEQ ID NO: 113625 - DNA, 25 bp, Mus musculus
gccgacaagtcgaaatggagacccg

SEQ ID NO: 113626 - DNA, 25 bp, Mus musculus
gccgacatcatcttcgacatcacag

SEQ ID NO: 113627 - DNA, 25 bp, Mus musculus
gccgacattgctgccttgaagaagg

SEQ ID NO: 113628 - DNA, 25 bp, Mus musculus
gccgaccagtatgatgccatctgct

SEQ ID NO: 113629 - DNA, 25 bp, Mus musculus
gccgacccgtggaagttgcatcctg

SEQ ID NO: 113630 - DNA, 25 bp, Mus musculus
gccgaccgagtcattcagagaacga

SEQ ID NO: 113631 - DNA, 25 bp, Mus musculus
gccgacgagaccgaatcaataacag

SEQ ID NO: 113632 - DNA, 25 bp, Mus musculus
gccgacgatggtgagaagacactgt

SEQ ID NO: 113633 - DNA, 25 bp, Mus musculus
gccgacgctgttgtagtgttgctca

SEQ ID NO: 113634 - DNA, 25 bp, Mus musculus
gccgacgtggctcctcacatgaaga

SEQ ID NO: 113635 - DNA, 25 bp, Mus musculus
gccgactactgcgagaataactaca

SEQ ID NO: 113636 - DNA, 25 bp, Mus musculus
gccgactccgccaggttcaaagtgt

SEQ ID NO: 113637 - DNA, 25 bp, Mus musculus
gccgactcctggagaaacctcattg

SEQ ID NO: 113638 - DNA, 25 bp, Mus musculus
gccgactgagatggaggaacttgct

SEQ ID NO: 113639 - DNA, 25 bp, Mus musculus
gccgactgctctgccgtttataaca

SEQ ID NO: 113640 - DNA, 25 bp, Mus musculus
gccgacttcaggtagacatggatga

SEQ ID NO: 113641 - DNA, 25 bp, Mus musculus
gccgacttcccgtggcgagcacagg

SEQ ID NO: 113642 - DNA, 25 bp, Mus musculus
gccgagaagcggaagaggtcttcca

SEQ ID NO: 113643 - DNA, 25 bp, Mus musculus
gccgagaatgcagttggacccaatg

SEQ ID NO: 113644 - DNA, 25 bp, Mus musculus
gccgagacacttttgcttggagaga

SEQ ID NO: 113645 - DNA, 25 bp, Mus musculus
gccgagagaatgatgcaaacccttg

SEQ ID NO: 113646 - DNA, 25 bp, Mus musculus
gccgagaggaacgagaaaaacagct

SEQ ID NO: 113647 - DNA, 25 bp, Mus musculus
gccgagatccgagacaagaacttca

SEQ ID NO: 113648 - DNA, 25 bp, Mus musculus
gccgagatttcagagccgcgagata

SEQ ID NO: 113649 - DNA, 25 bp, Mus musculus
gccgagcagtgtgcacatatttgaa

SEQ ID NO: 113650 - DNA, 25 bp, Mus musculus
gccgagccatggaaatcggcaccga

SEQ ID NO: 113651 - DNA, 25 bp, Mus musculus
gccgagctgcattctgacctgaaga

SEQ ID NO: 113652 - DNA, 25 bp, Mus musculus
gccgaggaaactggactaggccacg

SEQ ID NO: 113653 - DNA, 25 bp, Mus musculus
gccgaggaccagaaaagctatgatt

SEQ ID NO: 113654 - DNA, 25 bp, Mus musculus
gccgaggacgctggttagtctcgct

SEQ ID NO: 113655 - DNA, 25 bp, Mus musculus
gccgaggcctggactgaagtgccca

SEQ ID NO: 113656 - DNA, 25 bp, Mus musculus
gccgaggccttctctccgcgactcg

SEQ ID NO: 113657 - DNA, 25 bp, Mus musculus
gccgaggctcccagtatgatagaca

SEQ ID NO: 113658 - DNA, 25 bp, Mus musculus
gccgaggtctctgggatgtctctaa

SEQ ID NO: 113659 - DNA, 25 bp, Mus musculus
gccgaggtgaaggtcagcaaagaaa

SEQ ID NO: 113660 - DNA, 25 bp, Mus musculus
gccgaggttgccatcgagtgcagca

SEQ ID NO: 113661 - DNA, 25 bp, Mus musculus
gccgagtccccggaccagaagagga

SEQ ID NO: 113662 - DNA, 25 bp, Mus musculus
gccgagtgccgcctggggctgcggg

SEQ ID NO: 113663 - DNA, 25 bp, Mus musculus
gccgagtgctggttgcttcccgtaa

SEQ ID NO: 113664 - DNA, 25 bp, Mus musculus
gccgatactcggactttgagcggct

SEQ ID NO: 113665 - DNA, 25 bp, Mus musculus
gccgatactgagcacctgatgaggt

SEQ ID NO: 113666 - DNA, 25 bp, Mus musculus
gccgatactgcatgcttggctctga

SEQ ID NO: 113667 - DNA, 25 bp, Mus musculus
gccgataggtggtacagcgaaatca

SEQ ID NO: 113668 - DNA, 25 bp, Mus musculus
gccgatctgcatggaaaacaccttg

SEQ ID NO: 113669 - DNA, 25 bp, Mus musculus
gccgatgaggaatgccgtgccctct

SEQ ID NO: 113670 - DNA, 25 bp, Mus musculus
gccgatgatgagaactggatataca

SEQ ID NO: 113671 - DNA, 25 bp, Mus musculus
gccgatgggtccagaagaagttcca

SEQ ID NO: 113672 - DNA, 25 bp, Mus musculus
gccgattacgaagctggcagcctga

SEQ ID NO: 113673 - DNA, 25 bp, Mus musculus
gccgattcgccatagacccagagtt

SEQ ID NO: 113674 - DNA, 25 bp, Mus musculus
gccgatttgtttcaagtgacccaga

SEQ ID NO: 113675 - DNA, 25 bp, Mus musculus
gccgcaaatacgactttacgtccag

SEQ ID NO: 113676 - DNA, 25 bp, Mus musculus
gccgcaacatctctgtggagacagc

SEQ ID NO: 113677 - DNA, 25 bp, Mus musculus
gccgcaagagctacgaggactgtac

SEQ ID NO: 113678 - DNA, 25 bp, Mus musculus
gccgcaatatcgacacgctcagtga

SEQ ID NO: 113679 - DNA, 25 bp, Mus musculus
gccgcaatcggtttacaagagttac

SEQ ID NO: 113680 - DNA, 25 bp, Mus musculus
gccgcaatgtgtggagtcaatatca

SEQ ID NO: 113681 - DNA, 25 bp, Mus musculus
gccgcacatgcctacagaatttgac

SEQ ID NO: 113682 - DNA, 25 bp, Mus musculus
gccgcaccgctcagagatttcacag

SEQ ID NO: 113683 - DNA, 25 bp, Mus musculus
gccgcagattcgtcggccaacgcag

SEQ ID NO: 113684 - DNA, 25 bp, Mus musculus
gccgcagggctgaggcactcgcgcg

SEQ ID NO: 113685 - DNA, 25 bp, Mus musculus
gccgcagtggcaaccgtaagagctt

SEQ ID NO: 113686 - DNA, 25 bp, Mus musculus
gccgcatgcgggtcaaggccatttt

SEQ ID NO: 113687 - DNA, 25 bp, Mus musculus
gccgccaagggagtgcaaaatcaac

SEQ ID NO: 113688 - DNA, 25 bp, Mus musculus
gccgccacaggcagctatgataagg

SEQ ID NO: 113689 - DNA, 25 bp, Mus musculus
gccgccaccttcaatccagagttaa

SEQ ID NO: 113690 - DNA, 25 bp, Mus musculus
gccgcccatctggaatgaagacagt

SEQ ID NO: 113691 - DNA, 25 bp, Mus musculus
gccgcccgaggctggcctgaggagt

SEQ ID NO: 113692 - DNA, 25 bp, Mus musculus
gccgccctggaaagtactgagtgac

SEQ ID NO: 113693 - DNA, 25 bp, Mus musculus
gccgccgcagaacagccccagcgag

SEQ ID NO: 113694 - DNA, 25 bp, Mus musculus
gccgccgcggttttcgtctgcagca

SEQ ID NO: 113695 - DNA, 25 bp, Mus musculus
gccgccggagctgcggacggtttgc

SEQ ID NO: 113696 - DNA, 25 bp, Mus musculus
gccgccggcccatgaggatattgcc

SEQ ID NO: 113697 - DNA, 25 bp, Mus musculus
gccgcctcaagagtgttggccgtga

SEQ ID NO: 113698 - DNA, 25 bp, Mus musculus
gccgcctccacgagttgcttcgtat

SEQ ID NO: 113699 - DNA, 25 bp, Mus musculus
gccgcctccgatgtgttggaactga

SEQ ID NO: 113700 - DNA, 25 bp, Mus musculus
gccgcctcctccttgctgggtatga

SEQ ID NO: 113701 - DNA, 25 bp, Mus musculus
gccgccttgccaagcctggctgtta

SEQ ID NO: 113702 - DNA, 25 bp, Mus musculus
gccgcctttcggcagaagctggtca

SEQ ID NO: 113703 - DNA, 25 bp, Mus musculus
gccgccttttgagatctacttatgc

SEQ ID NO: 113704 - DNA, 25 bp, Mus musculus
gccgcgaaacggagaatgtcaagtc

SEQ ID NO: 113705 - DNA, 25 bp, Mus musculus
gccgcgacaagtatgccaagatctg

SEQ ID NO: 113706 - DNA, 25 bp, Mus musculus
gccgcgccgtcaacaaagtggtgta

SEQ ID NO: 113707 - DNA, 25 bp, Mus musculus
gccgcgctgtgcaaccgcatgctgg

SEQ ID NO: 113708 - DNA, 25 bp, Mus musculus
gccgcggccttggtggaacagttta

SEQ ID NO: 113709 - DNA, 25 bp, Mus musculus
gccgctaatcttcgccgctggaatc

SEQ ID NO: 113710 - DNA, 25 bp, Mus musculus
gccgctacgaaagcgcagggagctt

SEQ ID NO: 113711 - DNA, 25 bp, Mus musculus
gccgctagggcttcgttgacttgag

SEQ ID NO: 113712 - DNA, 25 bp, Mus musculus
gccgctatgaactggacacttggta

SEQ ID NO: 113713 - DNA, 25 bp, Mus musculus
gccgctcagctgttgcgcgatcaat

SEQ ID NO: 113714 - DNA, 25 bp, Mus musculus
gccgctcaggcacagttttcagaag

SEQ ID NO: 113715 - DNA, 25 bp, Mus musculus
gccgctccatgatcgatgacaccta

SEQ ID NO: 113716 - DNA, 25 bp, Mus musculus
gccgctccgaagttgcaaggcgaat

SEQ ID NO: 113717 - DNA, 25 bp, Mus musculus
gccgctccgcatttagtccgagatg

SEQ ID NO: 113718 - DNA, 25 bp, Mus musculus
gccgctccgtcgtccggagtggata

SEQ ID NO: 113719 - DNA, 25 bp, Mus musculus
gccgctgctgaagggaaaacctgct

SEQ ID NO: 113720 - DNA, 25 bp, Mus musculus
gccgctgctggctctgtgtctctgt

SEQ ID NO: 113721 - DNA, 25 bp, Mus musculus
gccgctggcctctagctgaaatgat

SEQ ID NO: 113722 - DNA, 25 bp, Mus musculus
gccgcttctgggatgactgtgtcaa

SEQ ID NO: 113723 - DNA, 25 bp, Mus musculus
gccgctttgcaggactggaggagct

SEQ ID NO: 113724 - DNA, 25 bp, Mus musculus
gccggaacgaactcattgcccgtta

SEQ ID NO: 113725 - DNA, 25 bp, Mus musculus
gccggaagacgccagaggaactact

SEQ ID NO: 113726 - DNA, 25 bp, Mus musculus
gccggaaggaggcattcccactctt

SEQ ID NO: 113727 - DNA, 25 bp, Mus musculus
gccggaagtggagtataacgtcaac

SEQ ID NO: 113728 - DNA, 25 bp, Mus musculus
gccggaatcccgagatgcatctgca

SEQ ID NO: 113729 - DNA, 25 bp, Mus musculus
gccggaatgaagacaaagaggcctg

SEQ ID NO: 113730 - DNA, 25 bp, Mus musculus
gccggaccaataaaagatgcaatcg

SEQ ID NO: 113731 - DNA, 25 bp, Mus musculus
gccggacctcatccagttgagaaag

SEQ ID NO: 113732 - DNA, 25 bp, Mus musculus
gccggacctggtgctgaaacagact

SEQ ID NO: 113733 - DNA, 25 bp, Mus musculus
gccggacggcgtcctcagctatcag

SEQ ID NO: 113734 - DNA, 25 bp, Mus musculus
gccggactcttttcttataaccgag

SEQ ID NO: 113735 - DNA, 25 bp, Mus musculus
gccggactgcggagggcgagtggac

SEQ ID NO: 113736 - DNA, 25 bp, Mus musculus
gccggagaactatgagaacgtgcag

SEQ ID NO: 113737 - DNA, 25 bp, Mus musculus
gccggagaccttgggaaacatgtaa

SEQ ID NO: 113738 - DNA, 25 bp, Mus musculus
gccggagactgaactggtagagact

SEQ ID NO: 113739 - DNA, 25 bp, Mus musculus
gccggagagagtaccagagtctgca

SEQ ID NO: 113740 - DNA, 25 bp, Mus musculus
gccggagccaccagcattgaagtta

SEQ ID NO: 113741 - DNA, 25 bp, Mus musculus
gccggagcggcctcggcgtacacag

SEQ ID NO: 113742 - DNA, 25 bp, Mus musculus
gccggagcggctctttgactcgcac

SEQ ID NO: 113743 - DNA, 25 bp, Mus musculus
gccggagctgcggacggtttgcccg

SEQ ID NO: 113744 - DNA, 25 bp, Mus musculus
gccggaggccacctaggaaagcatt

SEQ ID NO: 113745 - DNA, 25 bp, Mus musculus
gccggatcctatgcacagacacagt

SEQ ID NO: 113746 - DNA, 25 bp, Mus musculus
gccggatctacaacagcttcagaga

SEQ ID NO: 113747 - DNA, 25 bp, Mus musculus
gccggatctattaaagaaacaattg

SEQ ID NO: 113748 - DNA, 25 bp, Mus musculus
gccggcatttggacacggaagtcaa

SEQ ID NO: 113749 - DNA, 25 bp, Mus musculus
gccggccaatgctatcaaagagatg

SEQ ID NO: 113750 - DNA, 25 bp, Mus musculus
gccggccgaggctgatctttcacct

SEQ ID NO: 113751 - DNA, 25 bp, Mus musculus
gccggcctactttgcagtcacagag

SEQ ID NO: 113752 - DNA, 25 bp, Mus musculus
gccggcctagaccacgctttatgag

SEQ ID NO: 113753 - DNA, 25 bp, Mus musculus
gccggcgcagtctacggaaccgcat

SEQ ID NO: 113754 - DNA, 25 bp, Mus musculus
gccggcggcggaagaaagaatactt

SEQ ID NO: 113755 - DNA, 25 bp, Mus musculus
gccggctgcagaccatgtatgaaat

SEQ ID NO: 113756 - DNA, 25 bp, Mus musculus
gccggctgcagttgggtaccatgct

SEQ ID NO: 113757 - DNA, 25 bp, Mus musculus
gccgggaaacctgtagctgcctgta

SEQ ID NO: 113758 - DNA, 25 bp, Mus musculus
gccgggagatatcctcaagtctact

SEQ ID NO: 113759 - DNA, 25 bp, Mus musculus
gccgggagctcctggtcatcgagct

SEQ ID NO: 113760 - DNA, 25 bp, Mus musculus
gccgggagctgattcgaaatgtcta

SEQ ID NO: 113761 - DNA, 25 bp, Mus musculus
gccgggatactcaaccattacctca

SEQ ID NO: 113762 - DNA, 25 bp, Mus musculus
gccgggcagggtcttggagggccta

SEQ ID NO: 113763 - DNA, 25 bp, Mus musculus
gccgggctcaccagcatcttgtgga

SEQ ID NO: 113764 - DNA, 25 bp, Mus musculus
gccgggtatctacaccagagtttta

SEQ ID NO: 113765 - DNA, 25 bp, Mus musculus
gccgggtttatcaccaggctgggta

SEQ ID NO: 113766 - DNA, 25 bp, Mus musculus
gccggtagggactcgggctacaaga

SEQ ID NO: 113767 - DNA, 25 bp, Mus musculus
gccggtcactcccaggaggacaaga

SEQ ID NO: 113768 - DNA, 25 bp, Mus musculus
gccggtccttgttctttggaggcca

SEQ ID NO: 113769 - DNA, 25 bp, Mus musculus
gccggtgatgacgaggccatgttca

SEQ ID NO: 113770 - DNA, 25 bp, Mus musculus
gccggtgcggcctgccctttgtgct

SEQ ID NO: 113771 - DNA, 25 bp, Mus musculus
gccggtggctggtcttccatttaca

SEQ ID NO: 113772 - DNA, 25 bp, Mus musculus
gccggttccccatttggcacagctg

SEQ ID NO: 113773 - DNA, 25 bp, Mus musculus
gccgtaaaacactggtggcactctt

SEQ ID NO: 113774 - DNA, 25 bp, Mus musculus
gccgtaagcccacctgtaagaagat

SEQ ID NO: 113775 - DNA, 25 bp, Mus musculus
gccgtaagggtcacctgaaagccca

SEQ ID NO: 113776 - DNA, 25 bp, Mus musculus
gccgtacagaaagttcaagcccagt

SEQ ID NO: 113777 - DNA, 25 bp, Mus musculus
gccgtatccagccttatgaaacaaa

SEQ ID NO: 113778 - DNA, 25 bp, Mus musculus
gccgtatcgggcagcaaagctcgtt

SEQ ID NO: 113779 - DNA, 25 bp, Mus musculus
gccgtatcttgcatcatccgaaaaa

SEQ ID NO: 113780 - DNA, 25 bp, Mus musculus
gccgtatgactatggatctaattcc

SEQ ID NO: 113781 - DNA, 25 bp, Mus musculus
gccgtcacaggcctctgcaggaaat

SEQ ID NO: 113782 - DNA, 25 bp, Mus musculus
gccgtcactcgcagaaccaaggtgg

SEQ ID NO: 113783 - DNA, 25 bp, Mus musculus
gccgtcataaacaagcttccgagga

SEQ ID NO: 113784 - DNA, 25 bp, Mus musculus
gccgtcccagttcgaaacgagaaag

SEQ ID NO: 113785 - DNA, 25 bp, Mus musculus
gccgtcgcccagaagtcatcggacg

SEQ ID NO: 113786 - DNA, 25 bp, Mus musculus
gccgtcgggtcaaactccagggaat

SEQ ID NO: 113787 - DNA, 25 bp, Mus musculus
gccgtctttggcttacatcgtctga

SEQ ID NO: 113788 - DNA, 25 bp, Mus musculus
gccgtgactcgttgggctgcgtact

SEQ ID NO: 113789 - DNA, 25 bp, Mus musculus
gccgtgatcctcagctgttgctgca

SEQ ID NO: 113790 - DNA, 25 bp, Mus musculus
gccgtgatgtctatgagcctgcccg

SEQ ID NO: 113791 - DNA, 25 bp, Mus musculus
gccgtgcaggtttcgagctgtgctt

SEQ ID NO: 113792 - DNA, 25 bp, Mus musculus
gccgtgcatggtttctaggactcaa

SEQ ID NO: 113793 - DNA, 25 bp, Mus musculus
gccgtgctaccgcttaggcgtacaa

SEQ ID NO: 113794 - DNA, 25 bp, Mus musculus
gccgtgctgaactctgggaatgtcc

SEQ ID NO: 113795 - DNA, 25 bp, Mus musculus
gccgtgctgacgagtgtgccctgcc

SEQ ID NO: 113796 - DNA, 25 bp, Mus musculus
gccgtgctgagaagacaaaatcgtc

SEQ ID NO: 113797 - DNA, 25 bp, Mus musculus
gccgtgctgttggtcacattgctga

SEQ ID NO: 113798 - DNA, 25 bp, Mus musculus
gccgtggcacggagcaggtttacct

SEQ ID NO: 113799 - DNA, 25 bp, Mus musculus
gccgtggcattaaatctcctctcag

SEQ ID NO: 113800 - DNA, 25 bp, Mus musculus
gccgtggcctttacatccctgggaa

SEQ ID NO: 113801 - DNA, 25 bp, Mus musculus
gccgtggtgaacagcataggtctca

SEQ ID NO: 113802 - DNA, 25 bp, Mus musculus
gccgtggtgagaagaatgacatagt

SEQ ID NO: 113803 - DNA, 25 bp, Mus musculus
gccgtggtgcatccaggcttcctga

SEQ ID NO: 113804 - DNA, 25 bp, Mus musculus
gccgtgtccaccaggaaatcgacga

SEQ ID NO: 113805 - DNA, 25 bp, Mus musculus
gccgtgtcggtcctagcgaaagttt

SEQ ID NO: 113806 - DNA, 25 bp, Mus musculus
gccgtgtctgcctacttcgctggga

SEQ ID NO: 113807 - DNA, 25 bp, Mus musculus
gccgtgtgccggttggaagaaccca

SEQ ID NO: 113808 - DNA, 25 bp, Mus musculus
gccgtgtgctcttcctggaccaaca

SEQ ID NO: 113809 - DNA, 25 bp, Mus musculus
gccgtgtgttcatcatggacagctg

SEQ ID NO: 113810 - DNA, 25 bp, Mus musculus
gccgttcccgcggtggtcaactaag

SEQ ID NO: 113811 - DNA, 25 bp, Mus musculus
gccgttcgctttttgtacacgagag

SEQ ID NO: 113812 - DNA, 25 bp, Mus musculus
gccgttcggagtcccggcctttcag

SEQ ID NO: 113813 - DNA, 25 bp, Mus musculus
gccgttgcaccgagttttacagaaa

SEQ ID NO: 113814 - DNA, 25 bp, Mus musculus
gccgtttggcacagatcgaatctac

SEQ ID NO: 113815 - DNA, 25 bp, Mus musculus
gcctaaaattgtgcaccattaatga

SEQ ID NO: 113816 - DNA, 25 bp, Mus musculus
gcctaacgggccaaaggaataccag

SEQ ID NO: 113817 - DNA, 25 bp, Mus musculus
gcctaacggtagaggagctgcagca

SEQ ID NO: 113818 - DNA, 25 bp, Mus musculus
gcctaactctgaagccgagcctggt

SEQ ID NO: 113819 - DNA, 25 bp, Mus musculus
gcctaacttttctggcaactggaag

SEQ ID NO: 113820 - DNA, 25 bp, Mus musculus
gcctaagaccaaatggatccctttg

SEQ ID NO: 113821 - DNA, 25 bp, Mus musculus
gcctaagcacagcaggaccccaaga

SEQ ID NO: 113822 - DNA, 25 bp, Mus musculus
gcctaagcccgccatattaataaag

SEQ ID NO: 113823 - DNA, 25 bp, Mus musculus
gcctaagctgcgcaagtggtacaca

SEQ ID NO: 113824 - DNA, 25 bp, Mus musculus
gcctaaggaacggaaatttgcacat

SEQ ID NO: 113825 - DNA, 25 bp, Mus musculus
gcctacctcccgtggctggagagaa

SEQ ID NO: 113826 - DNA, 25 bp, Mus musculus
gcctacctgcaaagctattctcaat

SEQ ID NO: 113827 - DNA, 25 bp, Mus musculus
gcctacctgtggttcggaggatgaa

SEQ ID NO: 113828 - DNA, 25 bp, Mus musculus
gcctacggaaagaaaggacagcccg

SEQ ID NO: 113829 - DNA, 25 bp, Mus musculus
gcctacttccagcagcacggctgta

SEQ ID NO: 113830 - DNA, 25 bp, Mus musculus
gcctactttaagctacgtggtgtga

SEQ ID NO: 113831 - DNA, 25 bp, Mus musculus
gcctagaaaccttggtgtctttcct

SEQ ID NO: 113832 - DNA, 25 bp, Mus musculus
gcctagacagccaatggaggctggg

SEQ ID NO: 113833 - DNA, 25 bp, Mus musculus
gcctagcaagttcagctgccgaaag

SEQ ID NO: 113834 - DNA, 25 bp, Mus musculus
gcctagccctgagcatcctgagtgt

SEQ ID NO: 113835 - DNA, 25 bp, Mus musculus
gcctagcctgttggaagacttcggg

SEQ ID NO: 113836 - DNA, 25 bp, Mus musculus
gcctagctaatctccatgccatggg

SEQ ID NO: 113837 - DNA, 25 bp, Mus musculus
gcctaggcccatggagatgcattgt

SEQ ID NO: 113838 - DNA, 25 bp, Mus musculus
gcctaggctccacccagagttgggt

SEQ ID NO: 113839 - DNA, 25 bp, Mus musculus
gcctagggtctcagtcagttgtata

SEQ ID NO: 113840 - DNA, 25 bp, Mus musculus
gcctaggtggttgcgtatctgaacg

SEQ ID NO: 113841 - DNA, 25 bp, Mus musculus
gcctagtgaagccacagttcttgga

SEQ ID NO: 113842 - DNA, 25 bp, Mus musculus
gcctagtggcctttgcagagacgtg

SEQ ID NO: 113843 - DNA, 25 bp, Mus musculus
gcctagtggtcaagcagaacctgac

SEQ ID NO: 113844 - DNA, 25 bp, Mus musculus
gcctagtgtggtggtgaaatgtgtg

SEQ ID NO: 113845 - DNA, 25 bp, Mus musculus
gcctataaggccaaccgggacttga

SEQ ID NO: 113846 - DNA, 25 bp, Mus musculus
gcctataggttgcaatctcagcccc

SEQ ID NO: 113847 - DNA, 25 bp, Mus musculus
gcctatatcaagtggcaccgggcct

SEQ ID NO: 113848 - DNA, 25 bp, Mus musculus
gcctatcgtccagattatcactcag

SEQ ID NO: 113849 - DNA, 25 bp, Mus musculus
gcctatctccgaggaagcttctgga

SEQ ID NO: 113850 - DNA, 25 bp, Mus musculus
gcctatgcacggtgctgtggcacct

SEQ ID NO: 113851 - DNA, 25 bp, Mus musculus
gcctatgccattggaatgtacctga

SEQ ID NO: 113852 - DNA, 25 bp, Mus musculus
gcctatgggagcagggatttctcga

SEQ ID NO: 113853 - DNA, 25 bp, Mus musculus
gcctatgtgaaagatgcctgccgca

SEQ ID NO: 113854 - DNA, 25 bp, Mus musculus
gcctatgttaaaatactgggtggaa

SEQ ID NO: 113855 - DNA, 25 bp, Mus musculus
gcctatgtttgggttgcgtgaatcc

SEQ ID NO: 113856 - DNA, 25 bp, Mus musculus
gcctatttcctgctggtcattggtg

SEQ ID NO: 113857 - DNA, 25 bp, Mus musculus
gcctcaaacacttcaacccggaaga

SEQ ID NO: 113858 - DNA, 25 bp, Mus musculus
gcctcaaactggataacgggaagct

SEQ ID NO: 113859 - DNA, 25 bp, Mus musculus
gcctcaaagccatatggacactgtg

SEQ ID NO: 113860 - DNA, 25 bp, Mus musculus
gcctcaaagctggttgaagcccacg

SEQ ID NO: 113861 - DNA, 25 bp, Mus musculus
gcctcaaaggagttgtccgacactg

SEQ ID NO: 113862 - DNA, 25 bp, Mus musculus
gcctcaaatgcctggaataattccg

SEQ ID NO: 113863 - DNA, 25 bp, Mus musculus
gcctcaactgagtgatacgcctggt

SEQ ID NO: 113864 - DNA, 25 bp, Mus musculus
gcctcaatgggcgtgtggatctgca

SEQ ID NO: 113865 - DNA, 25 bp, Mus musculus
gcctcaatggtctggttaaacacgt

SEQ ID NO: 113866 - DNA, 25 bp, Mus musculus
gcctcaattttatgaagaacctggt

SEQ ID NO: 113867 - DNA, 25 bp, Mus musculus
gcctcacacgggaagcatagactct

SEQ ID NO: 113868 - DNA, 25 bp, Mus musculus
gcctcacatcggaaactacagactg

SEQ ID NO: 113869 - DNA, 25 bp, Mus musculus
gcctcaccaggccaagtggaatgtt

SEQ ID NO: 113870 - DNA, 25 bp, Mus musculus
gcctcactcctaagaagcagctctg

SEQ ID NO: 113871 - DNA, 25 bp, Mus musculus
gcctcagactttcactacgataaat

SEQ ID NO: 113872 - DNA, 25 bp, Mus musculus
gcctcagagctgactagtcccctga

SEQ ID NO: 113873 - DNA, 25 bp, Mus musculus
gcctcagagtttgggcggctaacaa

SEQ ID NO: 113874 - DNA, 25 bp, Mus musculus
gcctcagcgcgttgcagtgtatgaa

SEQ ID NO: 113875 - DNA, 25 bp, Mus musculus
gcctcagcggagactggaatcctct

SEQ ID NO: 113876 - DNA, 25 bp, Mus musculus
gcctcagcttaagggtatagttacc

SEQ ID NO: 113877 - DNA, 25 bp, Mus musculus
gcctcaggaagtgcaagacgtgtcg

SEQ ID NO: 113878 - DNA, 25 bp, Mus musculus
gcctcaggccatttgttacaccaaa

SEQ ID NO: 113879 - DNA, 25 bp, Mus musculus
gcctcagtacttccctggctgagta

SEQ ID NO: 113880 - DNA, 25 bp, Mus musculus
gcctcagtgagatcaaccatcaaga

SEQ ID NO: 113881 - DNA, 25 bp, Mus musculus
gcctcagtgagctccactgtgacaa

SEQ ID NO: 113882 - DNA, 25 bp, Mus musculus
gcctcagttcctggcattcctgata

SEQ ID NO: 113883 - DNA, 25 bp, Mus musculus
gcctcagttgagcttccggcgcgaa

SEQ ID NO: 113884 - DNA, 25 bp, Mus musculus
gcctcagttggcagatcaagtcccg

SEQ ID NO: 113885 - DNA, 25 bp, Mus musculus
gcctcatcacctgcgggagagtctg

SEQ ID NO: 113886 - DNA, 25 bp, Mus musculus
gcctcatctcactgcatacctggtt

SEQ ID NO: 113887 - DNA, 25 bp, Mus musculus
gcctcatctcccagagatcatcttt

SEQ ID NO: 113888 - DNA, 25 bp, Mus musculus
gcctcatggcaagtcgacagtacgt

SEQ ID NO: 113889 - DNA, 25 bp, Mus musculus
gcctcatgttcttggcagtgatgta

SEQ ID NO: 113890 - DNA, 25 bp, Mus musculus
gcctcattggcactcagtttaggaa

SEQ ID NO: 113891 - DNA, 25 bp, Mus musculus
gcctcattggtctacacttcaagat

SEQ ID NO: 113892 - DNA, 25 bp, Mus musculus
gcctcatttctatcaccacgtgtgg

SEQ ID NO: 113893 - DNA, 25 bp, Mus musculus
gcctccaaagacagcgccaaagtgg

SEQ ID NO: 113894 - DNA, 25 bp, Mus musculus
gcctccaaggttgccaatgacaaga

SEQ ID NO: 113895 - DNA, 25 bp, Mus musculus
gcctccagggtccagaaatcatgtt

SEQ ID NO: 113896 - DNA, 25 bp, Mus musculus
gcctccaggtcatgtccagggaaat

SEQ ID NO: 113897 - DNA, 25 bp, Mus musculus
gcctccatcgggaaggacatcatag

SEQ ID NO: 113898 - DNA, 25 bp, Mus musculus
gcctccatgcagaacgtggtctttg

SEQ ID NO: 113899 - DNA, 25 bp, Mus musculus
gcctcccgtggagttaaaggaccag

SEQ ID NO: 113900 - DNA, 25 bp, Mus musculus
gcctccctcgggtgcaaagcagaat

SEQ ID NO: 113901 - DNA, 25 bp, Mus musculus
gcctccgacatgaagaaagacgtga

SEQ ID NO: 113902 - DNA, 25 bp, Mus musculus
gcctccgagatgcagaagcctggtt

SEQ ID NO: 113903 - DNA, 25 bp, Mus musculus
gcctccgaggacctgtccaaaagag

SEQ ID NO: 113904 - DNA, 25 bp, Mus musculus
gcctccgggctttgcatgtctatga

SEQ ID NO: 113905 - DNA, 25 bp, Mus musculus
gcctccgggtctctgtaggaaagaa

SEQ ID NO: 113906 - DNA, 25 bp, Mus musculus
gcctccggtggtatgctagcttgca

SEQ ID NO: 113907 - DNA, 25 bp, Mus musculus
gcctcctagataagacgtgctccag

SEQ ID NO: 113908 - DNA, 25 bp, Mus musculus
gcctcctattactgggctatgcgga

SEQ ID NO: 113909 - DNA, 25 bp, Mus musculus
gcctcctcaagtgtgtgcagaaaaa

SEQ ID NO: 113910 - DNA, 25 bp, Mus musculus
gcctcctccagcaaaaagattagtg

SEQ ID NO: 113911 - DNA, 25 bp, Mus musculus
gcctcctgagtctttgctgtgccaa

SEQ ID NO: 113912 - DNA, 25 bp, Mus musculus
gcctcctgcgagatgtgttaactac

SEQ ID NO: 113913 - DNA, 25 bp, Mus musculus
gcctcctggaaaacccggcaaggat

SEQ ID NO: 113914 - DNA, 25 bp, Mus musculus
gcctcgaatgacacccacggatgat

SEQ ID NO: 113915 - DNA, 25 bp, Mus musculus
gcctcgagactgagaaaatggaaca

SEQ ID NO: 113916 - DNA, 25 bp, Mus musculus
gcctcgagatcgtgccctggtaacg

SEQ ID NO: 113917 - DNA, 25 bp, Mus musculus
gcctcgagctgctgtcctcaccaag

SEQ ID NO: 113918 - DNA, 25 bp, Mus musculus
gcctcgaggtacttcaagggaccag

SEQ ID NO: 113919 - DNA, 25 bp, Mus musculus
gcctcgatgggttaaaatcttcaca

SEQ ID NO: 113920 - DNA, 25 bp, Mus musculus
gcctcgccgtgaaagcatagactgg

SEQ ID NO: 113921 - DNA, 25 bp, Mus musculus
gcctcgctttgtgatgtcgaagaat

SEQ ID NO: 113922 - DNA, 25 bp, Mus musculus
gcctcggaactgaaaacgggcttca

SEQ ID NO: 113923 - DNA, 25 bp, Mus musculus
gcctcggatccttggatctcttgca

SEQ ID NO: 113924 - DNA, 25 bp, Mus musculus
gcctcggcttgtacacctttgtgaa

SEQ ID NO: 113925 - DNA, 25 bp, Mus musculus
gcctcgggcgctctcaatcatttga

SEQ ID NO: 113926 - DNA, 25 bp, Mus musculus
gcctcggtcagtcaaaatgcatatg

SEQ ID NO: 113927 - DNA, 25 bp, Mus musculus
gcctcgtggctgctgcttttgctat

SEQ ID NO: 113928 - DNA, 25 bp, Mus musculus
gcctctaaccatagccctagtgatg

SEQ ID NO: 113929 - DNA, 25 bp, Mus musculus
gcctctaaggtctcactggtgtgga

SEQ ID NO: 113930 - DNA, 25 bp, Mus musculus
gcctctacggtttcacagtgtccaa

SEQ ID NO: 113931 - DNA, 25 bp, Mus musculus
gcctctatgggctaatgaagctagt

SEQ ID NO: 113932 - DNA, 25 bp, Mus musculus
gcctctcgggataggagacgacgaa

SEQ ID NO: 113933 - DNA, 25 bp, Mus musculus
gcctctctgtgcacgtgaagaccaa

SEQ ID NO: 113934 - DNA, 25 bp, Mus musculus
gcctctgaaactggacacgagcttc

SEQ ID NO: 113935 - DNA, 25 bp, Mus musculus
gcctctgaaagctgtctgtctggaa

SEQ ID NO: 113936 - DNA, 25 bp, Mus musculus
gcctctgccacgcaacaagcaagtg

SEQ ID NO: 113937 - DNA, 25 bp, Mus musculus
gcctctgcggagattccaggcccca

SEQ ID NO: 113938 - DNA, 25 bp, Mus musculus
gcctctgctaattgagaaagtggat

SEQ ID NO: 113939 - DNA, 25 bp, Mus musculus
gcctctggagttgtgcctagtcgaa

SEQ ID NO: 113940 - DNA, 25 bp, Mus musculus
gcctctgggtgctccaatatcacag

SEQ ID NO: 113941 - DNA, 25 bp, Mus musculus
gcctctggttctcggcgggagcggc

SEQ ID NO: 113942 - DNA, 25 bp, Mus musculus
gcctctgtccaagagctactgagac

SEQ ID NO: 113943 - DNA, 25 bp, Mus musculus
gcctctgtcgactgccttatgatgt

SEQ ID NO: 113944 - DNA, 25 bp, Mus musculus
gcctctgtgggaatcatgctcacat

SEQ ID NO: 113945 - DNA, 25 bp, Mus musculus
gcctctgttaacactgagcctttga

SEQ ID NO: 113946 - DNA, 25 bp, Mus musculus
gcctcttacctgatgtgtgccttaa

SEQ ID NO: 113947 - DNA, 25 bp, Mus musculus
gcctcttaggactcttgggaactaa

SEQ ID NO: 113948 - DNA, 25 bp, Mus musculus
gcctcttccgcgttctcgacggaga

SEQ ID NO: 113949 - DNA, 25 bp, Mus musculus
gcctcttcgccctaggctggcctct

SEQ ID NO: 113950 - DNA, 25 bp, Mus musculus
gcctcttcggaaccgggatccagtc

SEQ ID NO: 113951 - DNA, 25 bp, Mus musculus
gcctcttgccacctgactataaaat

SEQ ID NO: 113952 - DNA, 25 bp, Mus musculus
gcctcttgtcggaagaaacgagagt

SEQ ID NO: 113953 - DNA, 25 bp, Mus musculus
gcctctttgcccaggaatcttggaa

SEQ ID NO: 113954 - DNA, 25 bp, Mus musculus
gcctgaaaacttagtagaatctctc

SEQ ID NO: 113955 - DNA, 25 bp, Mus musculus
gcctgaaactgaagggccgccacca

SEQ ID NO: 113956 - DNA, 25 bp, Mus musculus
gcctgaaagtgcacagcgactccgt

SEQ ID NO: 113957 - DNA, 25 bp, Mus musculus
gcctgaaatggcagtcgctagtctc

SEQ ID NO: 113958 - DNA, 25 bp, Mus musculus
gcctgaacaggcacttgctgactgc

SEQ ID NO: 113959 - DNA, 25 bp, Mus musculus
gcctgaacctccagagtcttgcgcc

SEQ ID NO: 113960 - DNA, 25 bp, Mus musculus
gcctgaagaatatatgactgcccaa

SEQ ID NO: 113961 - DNA, 25 bp, Mus musculus
gcctgaagatctgatggaagcctgt

SEQ ID NO: 113962 - DNA, 25 bp, Mus musculus
gcctgaaggtctgctttctgagaac

SEQ ID NO: 113963 - DNA, 25 bp, Mus musculus
gcctgaagtacgttaacgtgggaga

SEQ ID NO: 113964 - DNA, 25 bp, Mus musculus
gcctgaatagagattcttgatttga

SEQ ID NO: 113965 - DNA, 25 bp, Mus musculus
gcctgaatcagaagggcaccatctt

SEQ ID NO: 113966 - DNA, 25 bp, Mus musculus
gcctgacagcttgaggaccggatta

SEQ ID NO: 113967 - DNA, 25 bp, Mus musculus
gcctgaccacagtagccttgaaaga

SEQ ID NO: 113968 - DNA, 25 bp, Mus musculus
gcctgacgggctgttcagaaatcga

SEQ ID NO: 113969 - DNA, 25 bp, Mus musculus
gcctgacgtctgtcctctccaagtg

SEQ ID NO: 113970 - DNA, 25 bp, Mus musculus
gcctgactcagcagttggcagttaa

SEQ ID NO: 113971 - DNA, 25 bp, Mus musculus
gcctgagacaatcttccacctggga

SEQ ID NO: 113972 - DNA, 25 bp, Mus musculus
gcctgagatgtgtgttgctgccctg

SEQ ID NO: 113973 - DNA, 25 bp, Mus musculus
gcctgagattctgcctgacggagac

SEQ ID NO: 113974 - DNA, 25 bp, Mus musculus
gcctgagccaggatgaaggctctca

SEQ ID NO: 113975 - DNA, 25 bp, Mus musculus
gcctgagccctgatgtagacgtcat

SEQ ID NO: 113976 - DNA, 25 bp, Mus musculus
gcctgagccctttgagacattggaa

SEQ ID NO: 113977 - DNA, 25 bp, Mus musculus
gcctgagcgcgtcactagctcggaa

SEQ ID NO: 113978 - DNA, 25 bp, Mus musculus
gcctgagctagtcgagccaccgtcg

SEQ ID NO: 113979 - DNA, 25 bp, Mus musculus
gcctgagggcggtaaagatttcctt

SEQ ID NO: 113980 - DNA, 25 bp, Mus musculus
gcctgaggtctctggtggacaagaa

SEQ ID NO: 113981 - DNA, 25 bp, Mus musculus
gcctgagtgagaagcaacgttccca

SEQ ID NO: 113982 - DNA, 25 bp, Mus musculus
gcctgagtgagccaagacccttaat

SEQ ID NO: 113983 - DNA, 25 bp, Mus musculus
gcctgagttacctgcagacttggag

SEQ ID NO: 113984 - DNA, 25 bp, Mus musculus
gcctgagttaggtaccatgtccaca

SEQ ID NO: 113985 - DNA, 25 bp, Mus musculus
gcctgatgttggaagacatgcccaa

SEQ ID NO: 113986 - DNA, 25 bp, Mus musculus
gcctgattatgccatggcagcccga

SEQ ID NO: 113987 - DNA, 25 bp, Mus musculus
gcctgcaaacacatacgatccggag

SEQ ID NO: 113988 - DNA, 25 bp, Mus musculus
gcctgcaacccattctcctgctgga

SEQ ID NO: 113989 - DNA, 25 bp, Mus musculus
gcctgcaagtagcacgagtctccca

SEQ ID NO: 113990 - DNA, 25 bp, Mus musculus
gcctgcaccatagacatcgaagcat

SEQ ID NO: 113991 - DNA, 25 bp, Mus musculus
gcctgcacggcattgagttaactga

SEQ ID NO: 113992 - DNA, 25 bp, Mus musculus
gcctgcacttttgagccacacgaga

SEQ ID NO: 113993 - DNA, 25 bp, Mus musculus
gcctgcagtggatacgtacagagga

SEQ ID NO: 113994 - DNA, 25 bp, Mus musculus
gcctgcataagttttccacccggga

SEQ ID NO: 113995 - DNA, 25 bp, Mus musculus
gcctgccaaatccaaggtcggacgg

SEQ ID NO: 113996 - DNA, 25 bp, Mus musculus
gcctgccagccggatgactttttca

SEQ ID NO: 113997 - DNA, 25 bp, Mus musculus
gcctgcccgatcttcaaactttttt

SEQ ID NO: 113998 - DNA, 25 bp, Mus musculus
gcctgcccgggtctcctgctgtttg

SEQ ID NO: 113999 - DNA, 25 bp, Mus musculus
gcctgccctgactgacaactacatg

SEQ ID NO: 114000 - DNA, 25 bp, Mus musculus
gcctgccgggttggagcattcatac

SEQ ID NO: 114001 - DNA, 25 bp, Mus musculus
gcctgcctccagtcgatgatttttg

SEQ ID NO: 114002 - DNA, 25 bp, Mus musculus
gcctgcctgaggtagctgacggtca

SEQ ID NO: 114003 - DNA, 25 bp, Mus musculus
gcctgcctgatcttgaggaggagcc

SEQ ID NO: 114004 - DNA, 25 bp, Mus musculus
gcctgcctgctatgcagaggatcca

SEQ ID NO: 114005 - DNA, 25 bp, Mus musculus
gcctgcctggcagtcgagaacgtga

SEQ ID NO: 114006 - DNA, 25 bp, Mus musculus
gcctgcctggcattcacatagtatt

SEQ ID NO: 114007 - DNA, 25 bp, Mus musculus
gcctgcctggccaaagagacgtgga

SEQ ID NO: 114008 - DNA, 25 bp, Mus musculus
gcctgcctttaagtgctcacaggaa

SEQ ID NO: 114009 - DNA, 25 bp, Mus musculus
gcctgcgagtagctataaaagtgcg

SEQ ID NO: 114010 - DNA, 25 bp, Mus musculus
gcctgcggcctttgttcgagaagaa

SEQ ID NO: 114011 - DNA, 25 bp, Mus musculus
gcctgcgtctgactgggacactcaa

SEQ ID NO: 114012 - DNA, 25 bp, Mus musculus
gcctgctaacaatgggactccctgt

SEQ ID NO: 114013 - DNA, 25 bp, Mus musculus
gcctgctcacggacatcaagctgaa

SEQ ID NO: 114014 - DNA, 25 bp, Mus musculus
gcctgctgcagctaggatgccaacg

SEQ ID NO: 114015 - DNA, 25 bp, Mus musculus
gcctgctgggaacgtgacctcatat

SEQ ID NO: 114016 - DNA, 25 bp, Mus musculus
gcctgctgggcctttcatgtataaa

SEQ ID NO: 114017 - DNA, 25 bp, Mus musculus
gcctgctgtacctggaactgggaaa

SEQ ID NO: 114018 - DNA, 25 bp, Mus musculus
gcctgcttcaggcagcaaccagata

SEQ ID NO: 114019 - DNA, 25 bp, Mus musculus
gcctggaacagctggaatgccttga

SEQ ID NO: 114020 - DNA, 25 bp, Mus musculus
gcctggaacagtaagctgcaataca

SEQ ID NO: 114021 - DNA, 25 bp, Mus musculus
gcctggaaccttctgaaacccacag

SEQ ID NO: 114022 - DNA, 25 bp, Mus musculus
gcctggaacgaagccaccaatgttt

SEQ ID NO: 114023 - DNA, 25 bp, Mus musculus
gcctggaacgagaagacagcagtga

SEQ ID NO: 114024 - DNA, 25 bp, Mus musculus
gcctggaactcggtatgtagctgag

SEQ ID NO: 114025 - DNA, 25 bp, Mus musculus
gcctggaagacgattgcctggccgc

SEQ ID NO: 114026 - DNA, 25 bp, Mus musculus
gcctggaatgtcctagctctggatg

SEQ ID NO: 114027 - DNA, 25 bp, Mus musculus
gcctggacccagttcctactatgta

SEQ ID NO: 114028 - DNA, 25 bp, Mus musculus
gcctggacttccatgaaaagtacaa

SEQ ID NO: 114029 - DNA, 25 bp, Mus musculus
gcctggacttgttcagtaacgtgcc

SEQ ID NO: 114030 - DNA, 25 bp, Mus musculus
gcctggagcccatctcacctttaga

SEQ ID NO: 114031 - DNA, 25 bp, Mus musculus
gcctggagcggaaatagccattgat

SEQ ID NO: 114032 - DNA, 25 bp, Mus musculus
gcctggagtacccaagcctattttt

SEQ ID NO: 114033 - DNA, 25 bp, Mus musculus
gcctggcagtcggatgtcagcacac

SEQ ID NO: 114034 - DNA, 25 bp, Mus musculus
gcctggccagtatgtccctaaaatg

SEQ ID NO: 114035 - DNA, 25 bp, Mus musculus
gcctggccccaaaagtggacgttag

SEQ ID NO: 114036 - DNA, 25 bp, Mus musculus
gcctgggacgggagaaaacaatgat

SEQ ID NO: 114037 - DNA, 25 bp, Mus musculus
gcctgggcagcaaaggtcaatattg

SEQ ID NO: 114038 - DNA, 25 bp, Mus musculus
gcctgggcccagtcttttgataacc

SEQ ID NO: 114039 - DNA, 25 bp, Mus musculus
gcctgggccgacctgttgactgaaa

SEQ ID NO: 114040 - DNA, 25 bp, Mus musculus
gcctgggcctagtggcttaacagta

SEQ ID NO: 114041 - DNA, 25 bp, Mus musculus
gcctgggctcaagcgtgcggagaat

SEQ ID NO: 114042 - DNA, 25 bp, Mus musculus
gcctgggtcctagggaatgccgata

SEQ ID NO: 114043 - DNA, 25 bp, Mus musculus
gcctgggtgctcgtgtatttctgca

SEQ ID NO: 114044 - DNA, 25 bp, Mus musculus
gcctgggtggtatgcagtgcacata

SEQ ID NO: 114045 - DNA, 25 bp, Mus musculus
gcctgggtgtgctcttctcattata

SEQ ID NO: 114046 - DNA, 25 bp, Mus musculus
gcctggtacgcaacgtggagtatta

SEQ ID NO: 114047 - DNA, 25 bp, Mus musculus
gcctggtcaaaaatagcgagcccct

SEQ ID NO: 114048 - DNA, 25 bp, Mus musculus
gcctggtcaacaagtggagcacatt

SEQ ID NO: 114049 - DNA, 25 bp, Mus musculus
gcctggtcatcgactgtagctttga

SEQ ID NO: 114050 - DNA, 25 bp, Mus musculus
gcctggtcccagatttgtcctccga

SEQ ID NO: 114051 - DNA, 25 bp, Mus musculus
gcctggtccgcctttcttgggtctc

SEQ ID NO: 114052 - DNA, 25 bp, Mus musculus
gcctggtctcaggatatggatcaga

SEQ ID NO: 114053 - DNA, 25 bp, Mus musculus
gcctggtctccgttatgactgtgaa

SEQ ID NO: 114054 - DNA, 25 bp, Mus musculus
gcctggtgaccctgaatgacatgaa

SEQ ID NO: 114055 - DNA, 25 bp, Mus musculus
gcctggtgccaatggttggaaacaa

SEQ ID NO: 114056 - DNA, 25 bp, Mus musculus
gcctggtgctgaccatccgggaaaa

SEQ ID NO: 114057 - DNA, 25 bp, Mus musculus
gcctggtggaccgtctggagaccat

SEQ ID NO: 114058 - DNA, 25 bp, Mus musculus
gcctggtggccatccggaaggcact

SEQ ID NO: 114059 - DNA, 25 bp, Mus musculus
gcctggttacctgggagaatgacaa

SEQ ID NO: 114060 - DNA, 25 bp, Mus musculus
gcctggttggcgtctgcaatgaaca

SEQ ID NO: 114061 - DNA, 25 bp, Mus musculus
gcctggttggctcaatcgacaatga

SEQ ID NO: 114062 - DNA, 25 bp, Mus musculus
gcctgtaacatggaagagtgcaacg

SEQ ID NO: 114063 - DNA, 25 bp, Mus musculus
gcctgtaatcggtgcaagccaagaa

SEQ ID NO: 114064 - DNA, 25 bp, Mus musculus
gcctgtacagaatgctaaaactaaa

SEQ ID NO: 114065 - DNA, 25 bp, Mus musculus
gcctgtagtggagcccggcgcagga

SEQ ID NO: 114066 - DNA, 25 bp, Mus musculus
gcctgtataaggtacgagactcctt

SEQ ID NO: 114067 - DNA, 25 bp, Mus musculus
gcctgtatctctgacaccttgggaa

SEQ ID NO: 114068 - DNA, 25 bp, Mus musculus
gcctgtatgagaaggacaacaccta

SEQ ID NO: 114069 - DNA, 25 bp, Mus musculus
gcctgtatgctgctcggattcctga

SEQ ID NO: 114070 - DNA, 25 bp, Mus musculus
gcctgtcacaaagcagcacgctgga

SEQ ID NO: 114071 - DNA, 25 bp, Mus musculus
gcctgtcactcagcaagaattccga

SEQ ID NO: 114072 - DNA, 25 bp, Mus musculus
gcctgtcctttgagacctctgagag

SEQ ID NO: 114073 - DNA, 25 bp, Mus musculus
gcctgtcgagcttcatttcccggcg

SEQ ID NO: 114074 - DNA, 25 bp, Mus musculus
gcctgtctccgaagtaacgccatga

SEQ ID NO: 114075 - DNA, 25 bp, Mus musculus
gcctgtgaagccatcaaccgcatgt

SEQ ID NO: 114076 - DNA, 25 bp, Mus musculus
gcctgtgagacctggatagatctct

SEQ ID NO: 114077 - DNA, 25 bp, Mus musculus
gcctgtgagggatgcgccgcctact

SEQ ID NO: 114078 - DNA, 25 bp, Mus musculus
gcctgtgcaggtggaagccaacttg

SEQ ID NO: 114079 - DNA, 25 bp, Mus musculus
gcctgtgccctttcccttgtagatg

SEQ ID NO: 114080 - DNA, 25 bp, Mus musculus
gcctgtgccgctgttacgaagagaa

SEQ ID NO: 114081 - DNA, 25 bp, Mus musculus
gcctgtgcgtctttgtagcctgcca

SEQ ID NO: 114082 - DNA, 25 bp, Mus musculus
gcctgtgcgttttctcccgatggag

SEQ ID NO: 114083 - DNA, 25 bp, Mus musculus
gcctgtgctccctcggacggaagcg

SEQ ID NO: 114084 - DNA, 25 bp, Mus musculus
gcctgtgcttccctattagatgtgg

SEQ ID NO: 114085 - DNA, 25 bp, Mus musculus
gcctgtggcagatcaaccttcatga

SEQ ID NO: 114086 - DNA, 25 bp, Mus musculus
gcctgttaacgctttagggaggaga

SEQ ID NO: 114087 - DNA, 25 bp, Mus musculus
gcctgttacatggttatgcagcaca

SEQ ID NO: 114088 - DNA, 25 bp, Mus musculus
gcctgttagacgaagctatgctgga

SEQ ID NO: 114089 - DNA, 25 bp, Mus musculus
gcctgttagtaaatatgtgtggcac

SEQ ID NO: 114090 - DNA, 25 bp, Mus musculus
gcctgttatcaaggtggctgccata

SEQ ID NO: 114091 - DNA, 25 bp, Mus musculus
gcctgttgaccgactgccagtgaga

SEQ ID NO: 114092 - DNA, 25 bp, Mus musculus
gcctgttggacacaagagaacactg

SEQ ID NO: 114093 - DNA, 25 bp, Mus musculus
gcctgtttccctggcgagtgtagaa

SEQ ID NO: 114094 - DNA, 25 bp, Mus musculus
gccttaacagcacaacaggtccgat

SEQ ID NO: 114095 - DNA, 25 bp, Mus musculus
gccttaaccctgacgggcgaactgt

SEQ ID NO: 114096 - DNA, 25 bp, Mus musculus
gccttaagagaaacactccctgcag

SEQ ID NO: 114097 - DNA, 25 bp, Mus musculus
gccttaagcgctgcaccgaacttga

SEQ ID NO: 114098 - DNA, 25 bp, Mus musculus
gccttaagtgtcaggagcagacccg

SEQ ID NO: 114099 - DNA, 25 bp, Mus musculus
gccttaatggttgtgagagccctga

SEQ ID NO: 114100 - DNA, 25 bp, Mus musculus
gccttacaggcctggcaatttgcaa

SEQ ID NO: 114101 - DNA, 25 bp, Mus musculus
gccttaccgaagctgattacctgag

SEQ ID NO: 114102 - DNA, 25 bp, Mus musculus
gccttacgatcgagcagtggactgg

SEQ ID NO: 114103 - DNA, 25 bp, Mus musculus
gccttacgctgtgggattatgctaa

SEQ ID NO: 114104 - DNA, 25 bp, Mus musculus
gccttacggcatccgatgacatccg

SEQ ID NO: 114105 - DNA, 25 bp, Mus musculus
gccttacggtgtttataagaatcac

SEQ ID NO: 114106 - DNA, 25 bp, Mus musculus
gccttagagatcgtttgcccagaaa

SEQ ID NO: 114107 - DNA, 25 bp, Mus musculus
gccttagagcagttccagagccaga

SEQ ID NO: 114108 - DNA, 25 bp, Mus musculus
gccttagatcttcgtcttagtgaca

SEQ ID NO: 114109 - DNA, 25 bp, Mus musculus
gccttagatttggaccggatgaaac

SEQ ID NO: 114110 - DNA, 25 bp, Mus musculus
gccttagccaagatcaaccgtggga

SEQ ID NO: 114111 - DNA, 25 bp, Mus musculus
gccttagcgtgaagccaaatgtcag

SEQ ID NO: 114112 - DNA, 25 bp, Mus musculus
gccttaggacctcttcggaactgaa

SEQ ID NO: 114113 - DNA, 25 bp, Mus musculus
gccttagttaaggaaagaaattctg

SEQ ID NO: 114114 - DNA, 25 bp, Mus musculus
gccttatgtggatcggcagaaccga

SEQ ID NO: 114115 - DNA, 25 bp, Mus musculus
gccttattcaatgaagcaagctgga

SEQ ID NO: 114116 - DNA, 25 bp, Mus musculus
gccttcaacaacaacgtgagcgtgg

SEQ ID NO: 114117 - DNA, 25 bp, Mus musculus
gccttcaacctggacgtcgaaagtc

SEQ ID NO: 114118 - DNA, 25 bp, Mus musculus
gccttcaagagggagatgtcgtcca

SEQ ID NO: 114119 - DNA, 25 bp, Mus musculus
gccttcaccgaacgctctgggcttt

SEQ ID NO: 114120 - DNA, 25 bp, Mus musculus
gccttcagagaagcgcacacggtta

SEQ ID NO: 114121 - DNA, 25 bp, Mus musculus
gccttcagctagcatggagtgcaga

SEQ ID NO: 114122 - DNA, 25 bp, Mus musculus
gccttcagctattcagcaaagagct

SEQ ID NO: 114123 - DNA, 25 bp, Mus musculus
gccttcattgtagctatggggatga

SEQ ID NO: 114124 - DNA, 25 bp, Mus musculus
gccttccaaaggagaatagttacca

SEQ ID NO: 114125 - DNA, 25 bp, Mus musculus
gccttccacatgcttcgagatcctg

SEQ ID NO: 114126 - DNA, 25 bp, Mus musculus
gccttccagaagtacgggcgctcta

SEQ ID NO: 114127 - DNA, 25 bp, Mus musculus
gccttccatttagggcaagagccag

SEQ ID NO: 114128 - DNA, 25 bp, Mus musculus
gccttcccggaaagcattgctgtgt

SEQ ID NO: 114129 - DNA, 25 bp, Mus musculus
gccttccggattaacgacagcagct

SEQ ID NO: 114130 - DNA, 25 bp, Mus musculus
gccttccggcccacgaagaaagagt

SEQ ID NO: 114131 - DNA, 25 bp, Mus musculus
gccttccgggatcacttaacgatga

SEQ ID NO: 114132 - DNA, 25 bp, Mus musculus
gccttccggtgcgagtactgtgaca

SEQ ID NO: 114133 - DNA, 25 bp, Mus musculus
gccttccttgaggagtttgggactt

SEQ ID NO: 114134 - DNA, 25 bp, Mus musculus
gccttcgagggcacgtgtgtctcca

SEQ ID NO: 114135 - DNA, 25 bp, Mus musculus
gccttcgtgacgctccttaccggag

SEQ ID NO: 114136 - DNA, 25 bp, Mus musculus
gccttctgaacttcgtgggaaacca

SEQ ID NO: 114137 - DNA, 25 bp, Mus musculus
gccttctgtatactggaccgagcga

SEQ ID NO: 114138 - DNA, 25 bp, Mus musculus
gccttgacagtgacccatttccgaa

SEQ ID NO: 114139 - DNA, 25 bp, Mus musculus
gccttgaccaggacatgggatgctg

SEQ ID NO: 114140 - DNA, 25 bp, Mus musculus
gccttgaggacgtactgagacccga

SEQ ID NO: 114141 - DNA, 25 bp, Mus musculus
gccttgatctttggctactggagaa

SEQ ID NO: 114142 - DNA, 25 bp, Mus musculus
gccttgcaactaataagcagtcgga

SEQ ID NO: 114143 - DNA, 25 bp, Mus musculus
gccttgcactgccaagaatttggag

SEQ ID NO: 114144 - DNA, 25 bp, Mus musculus
gccttgccaagctttatggtgccga

SEQ ID NO: 114145 - DNA, 25 bp, Mus musculus
gccttgccggaagagaaacagctcg

SEQ ID NO: 114146 - DNA, 25 bp, Mus musculus
gccttgcggagagcactgggctact

SEQ ID NO: 114147 - DNA, 25 bp, Mus musculus
gccttgctaggccacgcactgcaag

SEQ ID NO: 114148 - DNA, 25 bp, Mus musculus
gccttgctccaggacgtgtttggga

SEQ ID NO: 114149 - DNA, 25 bp, Mus musculus
gccttggaaatacagacataccgcc

SEQ ID NO: 114150 - DNA, 25 bp, Mus musculus
gccttggaggacatgatggctctga

SEQ ID NO: 114151 - DNA, 25 bp, Mus musculus
gccttggcccacaggatgtcaggaa

SEQ ID NO: 114152 - DNA, 25 bp, Mus musculus
gccttgggaagtaggacctggaact

SEQ ID NO: 114153 - DNA, 25 bp, Mus musculus
gccttgggtcttggacgctggccca

SEQ ID NO: 114154 - DNA, 25 bp, Mus musculus
gccttggtgcccctagatgacataa

SEQ ID NO: 114155 - DNA, 25 bp, Mus musculus
gccttggtggaagacacaaagctcc

SEQ ID NO: 114156 - DNA, 25 bp, Mus musculus
gccttggttcaacagctacccggga

SEQ ID NO: 114157 - DNA, 25 bp, Mus musculus
gccttgtccctgacggcgatccgta

SEQ ID NO: 114158 - DNA, 25 bp, Mus musculus
gccttgtctaggttgttcagctcca

SEQ ID NO: 114159 - DNA, 25 bp, Mus musculus
gccttgtgaagggtggctcagctcc

SEQ ID NO: 114160 - DNA, 25 bp, Mus musculus
gccttgtgatgacctcgcctgtatt

SEQ ID NO: 114161 - DNA, 25 bp, Mus musculus
gccttgttggatgctgaaccgccca

SEQ ID NO: 114162 - DNA, 25 bp, Mus musculus
gccttgtttctgagtttagcctata

SEQ ID NO: 114163 - DNA, 25 bp, Mus musculus
gcctttaagcagacggacagcgaga

SEQ ID NO: 114164 - DNA, 25 bp, Mus musculus
gcctttaagtatctcagttctcttc

SEQ ID NO: 114165 - DNA, 25 bp, Mus musculus
gcctttacagcggacaggcacagaa

SEQ ID NO: 114166 - DNA, 25 bp, Mus musculus
gcctttacttccacaagtgctcagg

SEQ ID NO: 114167 - DNA, 25 bp, Mus musculus
gcctttagcagagcccaccgtattg

SEQ ID NO: 114168 - DNA, 25 bp, Mus musculus
gcctttagtgggaagggcagcctca

SEQ ID NO: 114169 - DNA, 25 bp, Mus musculus
gcctttcgcgcctctgcaacgtgga

SEQ ID NO: 114170 - DNA, 25 bp, Mus musculus
gcctttcggtcctttcgctcctggg

SEQ ID NO: 114171 - DNA, 25 bp, Mus musculus
gcctttctctatggtgacagcctca

SEQ ID NO: 114172 - DNA, 25 bp, Mus musculus
gcctttgaccggacatttgctgaca

SEQ ID NO: 114173 - DNA, 25 bp, Mus musculus
gcctttgcatctggcctggcgtcag

SEQ ID NO: 114174 - DNA, 25 bp, Mus musculus
gcctttgccacactcgtatctgaca

SEQ ID NO: 114175 - DNA, 25 bp, Mus musculus
gcctttgcggaaaagcgagccagca

SEQ ID NO: 114176 - DNA, 25 bp, Mus musculus
gcctttggaacccagcacgaaagtt

SEQ ID NO: 114177 - DNA, 25 bp, Mus musculus
gcctttggaggatcggctcttccca

SEQ ID NO: 114178 - DNA, 25 bp, Mus musculus
gcctttggctgtgagaactcgggcc

SEQ ID NO: 114179 - DNA, 25 bp, Mus musculus
gcctttgggcttccatccgtagaga

SEQ ID NO: 114180 - DNA, 25 bp, Mus musculus
gcctttgtattcaccattaagcttg

SEQ ID NO: 114181 - DNA, 25 bp, Mus musculus
gcctttgtggaaaccctgcagtaaa

SEQ ID NO: 114182 - DNA, 25 bp, Mus musculus
gccttttaaagacgcgctcactcag

SEQ ID NO: 114183 - DNA, 25 bp, Mus musculus
gccttttacaatggaacctggtaca

SEQ ID NO: 114184 - DNA, 25 bp, Mus musculus
gccttttgggacgactggatgcgcc

SEQ ID NO: 114185 - DNA, 25 bp, Mus musculus
gcgaaaacgctttgaataacctgga

SEQ ID NO: 114186 - DNA, 25 bp, Mus musculus
gcgaaaccggagattgcaggcagca

SEQ ID NO: 114187 - DNA, 25 bp, Mus musculus
gcgaaactggtctgcaagtccgatg

SEQ ID NO: 114188 - DNA, 25 bp, Mus musculus
gcgaaactgtcaaccagtgccaaaa

SEQ ID NO: 114189 - DNA, 25 bp, Mus musculus
gcgaaagtcccgttctctcaggaga

SEQ ID NO: 114190 - DNA, 25 bp, Mus musculus
gcgaacatcacgtccgatgagctct

SEQ ID NO: 114191 - DNA, 25 bp, Mus musculus
gcgaacatttggcaggtaaggctca

SEQ ID NO: 114192 - DNA, 25 bp, Mus musculus
gcgaaccgggagtacattgagatca

SEQ ID NO: 114193 - DNA, 25 bp, Mus musculus
gcgaacctgcagatacccaattgtg

SEQ ID NO: 114194 - DNA, 25 bp, Mus musculus
gcgaaccttcgaacgcaagtgcgag

SEQ ID NO: 114195 - DNA, 25 bp, Mus musculus
gcgaacgacgaacaaccctgagata

SEQ ID NO: 114196 - DNA, 25 bp, Mus musculus
gcgaactctgactgaacactctgaa

SEQ ID NO: 114197 - DNA, 25 bp, Mus musculus
gcgaagaccttatccagcagctcag

SEQ ID NO: 114198 - DNA, 25 bp, Mus musculus
gcgaagactattgttcaggctgctt

SEQ ID NO: 114199 - DNA, 25 bp, Mus musculus
gcgaagagctgcatatgcctgggaa

SEQ ID NO: 114200 - DNA, 25 bp, Mus musculus
gcgaagagtcatagccgaagggtca

SEQ ID NO: 114201 - DNA, 25 bp, Mus musculus
gcgaagctcggagcccagtggccgg

SEQ ID NO: 114202 - DNA, 25 bp, Mus musculus
gcgaagcttcgaggcggccagtact

SEQ ID NO: 114203 - DNA, 25 bp, Mus musculus
gcgaaggacttgatgaccgaccata

SEQ ID NO: 114204 - DNA, 25 bp, Mus musculus
gcgaaggattcttcctggatgcatc

SEQ ID NO: 114205 - DNA, 25 bp, Mus musculus
gcgaagggcgagaatgtaagtccac

SEQ ID NO: 114206 - DNA, 25 bp, Mus musculus
gcgaagttctggatgggaagacacc

SEQ ID NO: 114207 - DNA, 25 bp, Mus musculus
gcgaatggcgttgttcaggaactga

SEQ ID NO: 114208 - DNA, 25 bp, Mus musculus
gcgacaatcacagcacaattacttt

SEQ ID NO: 114209 - DNA, 25 bp, Mus musculus
gcgacaatttaagaagacagcactc

SEQ ID NO: 114210 - DNA, 25 bp, Mus musculus
gcgacagatggccaacgcacggatt

SEQ ID NO: 114211 - DNA, 25 bp, Mus musculus
gcgacagcacgataccaagaatggc

SEQ ID NO: 114212 - DNA, 25 bp, Mus musculus
gcgacagcacttccggttggacatg

SEQ ID NO: 114213 - DNA, 25 bp, Mus musculus
gcgacagcgagaagggctaagattt

SEQ ID NO: 114214 - DNA, 25 bp, Mus musculus
gcgacagcggtattccggaaccgga

SEQ ID NO: 114215 - DNA, 25 bp, Mus musculus
gcgacaggcatcttgcggcagactg

SEQ ID NO: 114216 - DNA, 25 bp, Mus musculus
gcgaccaagggcagtgctagcatct

SEQ ID NO: 114217 - DNA, 25 bp, Mus musculus
gcgaccaagtctgaattcctggagg

SEQ ID NO: 114218 - DNA, 25 bp, Mus musculus
gcgaccaagttttcatctacctctg

SEQ ID NO: 114219 - DNA, 25 bp, Mus musculus
gcgacccaaacgaaaaatgtacagg

SEQ ID NO: 114220 - DNA, 25 bp, Mus musculus
gcgacccaggaactaatcagcagct

SEQ ID NO: 114221 - DNA, 25 bp, Mus musculus
gcgacccagtggaatcccagagaaa

SEQ ID NO: 114222 - DNA, 25 bp, Mus musculus
gcgaccgcaggaatcagaatactac

SEQ ID NO: 114223 - DNA, 25 bp, Mus musculus
gcgaccgccggctgcctgagaaagc

SEQ ID NO: 114224 - DNA, 25 bp, Mus musculus
gcgaccgtcagggttgcaccatggt

SEQ ID NO: 114225 - DNA, 25 bp, Mus musculus
gcgacctcctggaagaaccaaccag

SEQ ID NO: 114226 - DNA, 25 bp, Mus musculus
gcgacctctataaggcccgctgtga

SEQ ID NO: 114227 - DNA, 25 bp, Mus musculus
gcgacctgagacctccatgagtgga

SEQ ID NO: 114228 - DNA, 25 bp, Mus musculus
gcgacctggtgttactctacgagct

SEQ ID NO: 114229 - DNA, 25 bp, Mus musculus
gcgacgagatttatctcacaaggag

SEQ ID NO: 114230 - DNA, 25 bp, Mus musculus
gcgacgcctatgaacctcgggcggc

SEQ ID NO: 114231 - DNA, 25 bp, Mus musculus
gcgacgcctgagctagtcgagccac

SEQ ID NO: 114232 - DNA, 25 bp, Mus musculus
gcgacgggacccatttccagaagaa

SEQ ID NO: 114233 - DNA, 25 bp, Mus musculus
gcgacgggtcgcagcagttcgtgtg

SEQ ID NO: 114234 - DNA, 25 bp, Mus musculus
gcgacgtctctgcatgagggaccca

SEQ ID NO: 114235 - DNA, 25 bp, Mus musculus
gcgacgtctggacctacagggaata

SEQ ID NO: 114236 - DNA, 25 bp, Mus musculus
gcgactactcgtgacaatgtcccag

SEQ ID NO: 114237 - DNA, 25 bp, Mus musculus
gcgactccagtggtaagtctttaat

SEQ ID NO: 114238 - DNA, 25 bp, Mus musculus
gcgactccgttctagagcaggtgtg

SEQ ID NO: 114239 - DNA, 25 bp, Mus musculus
gcgactggccagtggtgaaaccatt

SEQ ID NO: 114240 - DNA, 25 bp, Mus musculus
gcgactgtaatgtcatcctgggctc

SEQ ID NO: 114241 - DNA, 25 bp, Mus musculus
gcgacttgatcgaacaggcagctga

SEQ ID NO: 114242 - DNA, 25 bp, Mus musculus
gcgagaaaccgagctcgagccttgg

SEQ ID NO: 114243 - DNA, 25 bp, Mus musculus
gcgagaatggcaccagcttgaccga

SEQ ID NO: 114244 - DNA, 25 bp, Mus musculus
gcgagaattcatgccaaagcctgtg

SEQ ID NO: 114245 - DNA, 25 bp, Mus musculus
gcgagaattttctggcccgaggcaa

SEQ ID NO: 114246 - DNA, 25 bp, Mus musculus
gcgagacccagtacgagagcaaggt

SEQ ID NO: 114247 - DNA, 25 bp, Mus musculus
gcgagacctggatagaaaatgccct

SEQ ID NO: 114248 - DNA, 25 bp, Mus musculus
gcgagacgcttttacctggaacatg

SEQ ID NO: 114249 - DNA, 25 bp, Mus musculus
gcgagagcattacataacatggcca

SEQ ID NO: 114250 - DNA, 25 bp, Mus musculus
gcgagagcgctcttattaccgagga

SEQ ID NO: 114251 - DNA, 25 bp, Mus musculus
gcgagagtgccttgaagtaacttta

SEQ ID NO: 114252 - DNA, 25 bp, Mus musculus
gcgagattttcattgggaaacttcc

SEQ ID NO: 114253 - DNA, 25 bp, Mus musculus
gcgagcacctcaaccttttggaaga

SEQ ID NO: 114254 - DNA, 25 bp, Mus musculus
gcgagcacctgaacctcttggagaa

SEQ ID NO: 114255 - DNA, 25 bp, Mus musculus
gcgagccaatgacctgcagcagatt

SEQ ID NO: 114256 - DNA, 25 bp, Mus musculus
gcgagccaggcgagatctacaacat

SEQ ID NO: 114257 - DNA, 25 bp, Mus musculus
gcgagccctcagaaagcaagatgga

SEQ ID NO: 114258 - DNA, 25 bp, Mus musculus
gcgagccgcgttgggtttatgtctt

SEQ ID NO: 114259 - DNA, 25 bp, Mus musculus
gcgagccttgcgagcgcgcctaacg

SEQ ID NO: 114260 - DNA, 25 bp, Mus musculus
gcgagcgaaccatcgaaggagcaaa

SEQ ID NO: 114261 - DNA, 25 bp, Mus musculus
gcgagcgcaacaagaagcggctgct

SEQ ID NO: 114262 - DNA, 25 bp, Mus musculus
gcgagcgcgcctaacggagaacggg

SEQ ID NO: 114263 - DNA, 25 bp, Mus musculus
gcgagcggtcagcatgcatcttcac

SEQ ID NO: 114264 - DNA, 25 bp, Mus musculus
gcgagcgtcctctgtactgaaatct

SEQ ID NO: 114265 - DNA, 25 bp, Mus musculus
gcgagctatctgtcaagcaccgaga

SEQ ID NO: 114266 - DNA, 25 bp, Mus musculus
gcgaggaaagcgaatgaagcaaagc

SEQ ID NO: 114267 - DNA, 25 bp, Mus musculus
gcgaggactcctcatgctgaagaca

SEQ ID NO: 114268 - DNA, 25 bp, Mus musculus
gcgaggacttcctgaaagctgccat

SEQ ID NO: 114269 - DNA, 25 bp, Mus musculus
gcgaggagccaacgcagtactcttt

SEQ ID NO: 114270 - DNA, 25 bp, Mus musculus
gcgaggatttggtggcgccaaccat

SEQ ID NO: 114271 - DNA, 25 bp, Mus musculus
gcgaggcccgagcttccgcgtcgag

SEQ ID NO: 114272 - DNA, 25 bp, Mus musculus
gcgaggctggcccaaaggcaaaaaa

SEQ ID NO: 114273 - DNA, 25 bp, Mus musculus
gcgagggaaccctaacttcacacca

SEQ ID NO: 114274 - DNA, 25 bp, Mus musculus
gcgagggcaccatttcagacaagga

SEQ ID NO: 114275 - DNA, 25 bp, Mus musculus
gcgagtcccagcactttgcaagtaa

SEQ ID NO: 114276 - DNA, 25 bp, Mus musculus
gcgagtctcacagagtcctatttca

SEQ ID NO: 114277 - DNA, 25 bp, Mus musculus
gcgagtctctacaaggcttagcagc

SEQ ID NO: 114278 - DNA, 25 bp, Mus musculus
gcgagtgcaccgacgtgtccctcgg

SEQ ID NO: 114279 - DNA, 25 bp, Mus musculus
gcgagtggccgaactatttatgttt

SEQ ID NO: 114280 - DNA, 25 bp, Mus musculus
gcgagttggagttcaagtttaaccg

SEQ ID NO: 114281 - DNA, 25 bp, Mus musculus
gcgagttgtaacattgccaccccga

SEQ ID NO: 114282 - DNA, 25 bp, Mus musculus
gcgatcattcgaacaccagtggtgg

SEQ ID NO: 114283 - DNA, 25 bp, Mus musculus
gcgatgccccgctacgagttggctt

SEQ ID NO: 114284 - DNA, 25 bp, Mus musculus
gcgatgcccggcgtgaagctgacta

SEQ ID NO: 114285 - DNA, 25 bp, Mus musculus
gcgatggaccgcagcgtcccggatc

SEQ ID NO: 114286 - DNA, 25 bp, Mus musculus
gcgatggactgttagctgtgaacca

SEQ ID NO: 114287 - DNA, 25 bp, Mus musculus
gcgattcccatggtcatctttggca

SEQ ID NO: 114288 - DNA, 25 bp, Mus musculus
gcgattgctgactcctggctgggaa

SEQ ID NO: 114289 - DNA, 25 bp, Mus musculus
gcgcaaatacaaagtgaagctggtg

SEQ ID NO: 114290 - DNA, 25 bp, Mus musculus
gcgcaagcttggaggccaagctatg

SEQ ID NO: 114291 - DNA, 25 bp, Mus musculus
gcgcaagttggacaccatcctaaac

SEQ ID NO: 114292 - DNA, 25 bp, Mus musculus
gcgcacagtcgtccttcagcaagat

SEQ ID NO: 114293 - DNA, 25 bp, Mus musculus
gcgcacatgagagagcgagcacatt

SEQ ID NO: 114294 - DNA, 25 bp, Mus musculus
gcgcaccatcagaccaatggacatc

SEQ ID NO: 114295 - DNA, 25 bp, Mus musculus
gcgcacgcagtatagcagccaaggt

SEQ ID NO: 114296 - DNA, 25 bp, Mus musculus
gcgcacgcgcagcaagatcggtttt

SEQ ID NO: 114297 - DNA, 25 bp, Mus musculus
gcgcacgttgaagggctccattgaa

SEQ ID NO: 114298 - DNA, 25 bp, Mus musculus
gcgcagacggagaaccaacctaagt

SEQ ID NO: 114299 - DNA, 25 bp, Mus musculus
gcgcagagcggacggaagggaccgg

SEQ ID NO: 114300 - DNA, 25 bp, Mus musculus
gcgcagaggatcacgtacaagtact

SEQ ID NO: 114301 - DNA, 25 bp, Mus musculus
gcgcagcccctaagagcatcgtgta

SEQ ID NO: 114302 - DNA, 25 bp, Mus musculus
gcgcagccgagacgcttacatctgt

SEQ ID NO: 114303 - DNA, 25 bp, Mus musculus
gcgcaggcggaacaagatgactcaa

SEQ ID NO: 114304 - DNA, 25 bp, Mus musculus
gcgcaggctcgagaactatccaaga

SEQ ID NO: 114305 - DNA, 25 bp, Mus musculus
gcgcagtctttcatcgaacccctat

SEQ ID NO: 114306 - DNA, 25 bp, Mus musculus
gcgcatgcaggatcctgggttcaat

SEQ ID NO: 114307 - DNA, 25 bp, Mus musculus
gcgcattgggaaagatctcagcaat

SEQ ID NO: 114308 - DNA, 25 bp, Mus musculus
gcgccagacgcggaggaaaggagct

SEQ ID NO: 114309 - DNA, 25 bp, Mus musculus
gcgccagagcaccaatagagttaga

SEQ ID NO: 114310 - DNA, 25 bp, Mus musculus
gcgccagcccatttccagtttacaa

SEQ ID NO: 114311 - DNA, 25 bp, Mus musculus
gcgccagcgaaagctacaggacttt

SEQ ID NO: 114312 - DNA, 25 bp, Mus musculus
gcgccagctccacgttaaagagggt

SEQ ID NO: 114313 - DNA, 25 bp, Mus musculus
gcgccagtggaacatgtggatccca

SEQ ID NO: 114314 - DNA, 25 bp, Mus musculus
gcgccagttggctctgcagcttcag

SEQ ID NO: 114315 - DNA, 25 bp, Mus musculus
gcgcccactgggatgtttcgccagt

SEQ ID NO: 114316 - DNA, 25 bp, Mus musculus
gcgcccagggcagacactagggtaa

SEQ ID NO: 114317 - DNA, 25 bp, Mus musculus
gcgcccctggatgatgcccaagaaa

SEQ ID NO: 114318 - DNA, 25 bp, Mus musculus
gcgcccgactcaggtattgagttgc

SEQ ID NO: 114319 - DNA, 25 bp, Mus musculus
gcgccctcagttgatgcgactaaaa

SEQ ID NO: 114320 - DNA, 25 bp, Mus musculus
gcgccctgttggcagcagttacaag

SEQ ID NO: 114321 - DNA, 25 bp, Mus musculus
gcgccgccaaagacgtgaaattact

SEQ ID NO: 114322 - DNA, 25 bp, Mus musculus
gcgccgcctgggaattatgatgcat

SEQ ID NO: 114323 - DNA, 25 bp, Mus musculus
gcgccgcgctgttcatgaagcatgt

SEQ ID NO: 114324 - DNA, 25 bp, Mus musculus
gcgccggacgctgaaaatgacggat

SEQ ID NO: 114325 - DNA, 25 bp, Mus musculus
gcgccgtcccggaaggaagcagatt

SEQ ID NO: 114326 - DNA, 25 bp, Mus musculus
gcgcctcctcgcagccactgtgttc

SEQ ID NO: 114327 - DNA, 25 bp, Mus musculus
gcgcctcggtggttgcgattcgaaa

SEQ ID NO: 114328 - DNA, 25 bp, Mus musculus
gcgcctgaaggtgaagacgtccgaa

SEQ ID NO: 114329 - DNA, 25 bp, Mus musculus
gcgcctgcgcgttgtaggtttcggg

SEQ ID NO: 114330 - DNA, 25 bp, Mus musculus
gcgcctgtaacctgaatatgaccgt

SEQ ID NO: 114331 - DNA, 25 bp, Mus musculus
gcgccttactaactccatgatgatg

SEQ ID NO: 114332 - DNA, 25 bp, Mus musculus
gcgcgaagaaccaacaagccatgtg

SEQ ID NO: 114333 - DNA, 25 bp, Mus musculus
gcgcgaagatgcaacgggacatcga

SEQ ID NO: 114334 - DNA, 25 bp, Mus musculus
gcgcgcaccagttcccgggaggaaa

SEQ ID NO: 114335 - DNA, 25 bp, Mus musculus
gcgcgccctgcattgccttcggatg

SEQ ID NO: 114336 - DNA, 25 bp, Mus musculus
gcgcgccgcaatcgctgaatccttt

SEQ ID NO: 114337 - DNA, 25 bp, Mus musculus
gcgcgccgtgcgttaaaagctgttt

SEQ ID NO: 114338 - DNA, 25 bp, Mus musculus
gcgcgcctccgctatttccagggat

SEQ ID NO: 114339 - DNA, 25 bp, Mus musculus
gcgcgcgcgaacatccgcagtggct

SEQ ID NO: 114340 - DNA, 25 bp, Mus musculus
gcgcgcgggtcgtttcagccacaga

SEQ ID NO: 114341 - DNA, 25 bp, Mus musculus
gcgcgcggtgctgaactccaaattt

SEQ ID NO: 114342 - DNA, 25 bp, Mus musculus
gcgcgcttgcagttccctcgtagtt

SEQ ID NO: 114343 - DNA, 25 bp, Mus musculus
gcgcggaaactgaactggcacaact

SEQ ID NO: 114344 - DNA, 25 bp, Mus musculus
gcgcggacagcgacttcacctgtga

SEQ ID NO: 114345 - DNA, 25 bp, Mus musculus
gcgcggactcctgttttgcgggcca

SEQ ID NO: 114346 - DNA, 25 bp, Mus musculus
gcgcggcccttagcggagaggagaa

SEQ ID NO: 114347 - DNA, 25 bp, Mus musculus
gcgcgggctcgctcgccagccgtcc

SEQ ID NO: 114348 - DNA, 25 bp, Mus musculus
gcgcgggtgctgtgactgctcctcc

SEQ ID NO: 114349 - DNA, 25 bp, Mus musculus
gcgcgtcctcggagttctcagcttt

SEQ ID NO: 114350 - DNA, 25 bp, Mus musculus
gcgcgtctacgtggagctgaagttc

SEQ ID NO: 114351 - DNA, 25 bp, Mus musculus
gcgcgtctccgctttgaggctgagc

SEQ ID NO: 114352 - DNA, 25 bp, Mus musculus
gcgcgttagaagagcagaacctcca

SEQ ID NO: 114353 - DNA, 25 bp, Mus musculus
gcgctaaacagctggacacgggact

SEQ ID NO: 114354 - DNA, 25 bp, Mus musculus
gcgctaatgagcgtggcaagtcccc

SEQ ID NO: 114355 - DNA, 25 bp, Mus musculus
gcgctaccttactgcgatgcatggg

SEQ ID NO: 114356 - DNA, 25 bp, Mus musculus
gcgctagctacggaggcgtttgtaa

SEQ ID NO: 114357 - DNA, 25 bp, Mus musculus
gcgctcagcgtcattctggtagtta

SEQ ID NO: 114358 - DNA, 25 bp, Mus musculus
gcgctctcagctgaatgacatctca

SEQ ID NO: 114359 - DNA, 25 bp, Mus musculus
gcgctgccgagctgcgtcacgtcat

SEQ ID NO: 114360 - DNA, 25 bp, Mus musculus
gcgctgcgggagaatgacaccttga

SEQ ID NO: 114361 - DNA, 25 bp, Mus musculus
gcgctgctgcatccacggaggcggt

SEQ ID NO: 114362 - DNA, 25 bp, Mus musculus
gcgctggccggaagaaattattgtc

SEQ ID NO: 114363 - DNA, 25 bp, Mus musculus
gcgctggtggtatgagaagctcatc

SEQ ID NO: 114364 - DNA, 25 bp, Mus musculus
gcgctgtgctgtggtgcggacctcg

SEQ ID NO: 114365 - DNA, 25 bp, Mus musculus
gcgcttacggtttgctggaccaaga

SEQ ID NO: 114366 - DNA, 25 bp, Mus musculus
gcgcttccctgtccgcgctgtgccg

SEQ ID NO: 114367 - DNA, 25 bp, Mus musculus
gcgcttccgaattccacacagtgca

SEQ ID NO: 114368 - DNA, 25 bp, Mus musculus
gcgcttgcgtaggaaatcgttctcc

SEQ ID NO: 114369 - DNA, 25 bp, Mus musculus
gcgctttacgttaacagcgctcggg

SEQ ID NO: 114370 - DNA, 25 bp, Mus musculus
gcgctttgattatgaggactgccag

SEQ ID NO: 114371 - DNA, 25 bp, Mus musculus
gcgcttttacccacacctatgattg

SEQ ID NO: 114372 - DNA, 25 bp, Mus musculus
gcggaaaactttgggccaagcttca

SEQ ID NO: 114373 - DNA, 25 bp, Mus musculus
gcggaaacacgagctgctggccaag

SEQ ID NO: 114374 - DNA, 25 bp, Mus musculus
gcggaaagaaaagctgtcggcagac

SEQ ID NO: 114375 - DNA, 25 bp, Mus musculus
gcggaaatgtcctcttcaatggtta

SEQ ID NO: 114376 - DNA, 25 bp, Mus musculus
gcggaagccccaaccttcttccctg

SEQ ID NO: 114377 - DNA, 25 bp, Mus musculus
gcggaagtctacacagcattggatc

SEQ ID NO: 114378 - DNA, 25 bp, Mus musculus
gcggaagtcttcagctagccgaccg

SEQ ID NO: 114379 - DNA, 25 bp, Mus musculus
gcggaattgcagatggagacgccca

SEQ ID NO: 114380 - DNA, 25 bp, Mus musculus
gcggacaaagcagaggagatcatta

SEQ ID NO: 114381 - DNA, 25 bp, Mus musculus
gcggacaatcggttcagtttactga

SEQ ID NO: 114382 - DNA, 25 bp, Mus musculus
gcggacacacgttctgccacaagtg

SEQ ID NO: 114383 - DNA, 25 bp, Mus musculus
gcggacactcacaggcttcacaaag

SEQ ID NO: 114384 - DNA, 25 bp, Mus musculus
gcggaccacatagaaggcagcagga

SEQ ID NO: 114385 - DNA, 25 bp, Mus musculus
gcggaccagtatgcctgtgagcact

SEQ ID NO: 114386 - DNA, 25 bp, Mus musculus
gcggacccaggatatgaaatgacaa

SEQ ID NO: 114387 - DNA, 25 bp, Mus musculus
gcggaccctggactctgactacgca

SEQ ID NO: 114388 - DNA, 25 bp, Mus musculus
gcggaccgaatctctgcaaggcttg

SEQ ID NO: 114389 - DNA, 25 bp, Mus musculus
gcggacctcgacaagtgcatggact

SEQ ID NO: 114390 - DNA, 25 bp, Mus musculus
gcggacctggcatggagttgtccaa

SEQ ID NO: 114391 - DNA, 25 bp, Mus musculus
gcggacgacctgtgggccctttagt

SEQ ID NO: 114392 - DNA, 25 bp, Mus musculus
gcggacgagctccttctaacggaga

SEQ ID NO: 114393 - DNA, 25 bp, Mus musculus
gcggacgctgtagctgctctgaagt

SEQ ID NO: 114394 - DNA, 25 bp, Mus musculus
gcggacggccaacatccgaggactc

SEQ ID NO: 114395 - DNA, 25 bp, Mus musculus
gcggactggacatgcttattctaaa

SEQ ID NO: 114396 - DNA, 25 bp, Mus musculus
gcggacttaaaaggcaccgtcttgc

SEQ ID NO: 114397 - DNA, 25 bp, Mus musculus
gcggacttgggtggagaacaaatca

SEQ ID NO: 114398 - DNA, 25 bp, Mus musculus
gcggacttgtacacttcccgggtga

SEQ ID NO: 114399 - DNA, 25 bp, Mus musculus
gcggactttgtcaacatcaggagaa

SEQ ID NO: 114400 - DNA, 25 bp, Mus musculus
gcggagagcccaccttaagacagga

SEQ ID NO: 114401 - DNA, 25 bp, Mus musculus
gcggagagctgattccaaagtctaa

SEQ ID NO: 114402 - DNA, 25 bp, Mus musculus
gcggagatccaaggctgctgatgaa

SEQ ID NO: 114403 - DNA, 25 bp, Mus musculus
gcggagcatcgtggcaatcaggcat

SEQ ID NO: 114404 - DNA, 25 bp, Mus musculus
gcggagcccaggagcttggacttcc

SEQ ID NO: 114405 - DNA, 25 bp, Mus musculus
gcggagccttgttatttgtcagcct

SEQ ID NO: 114406 - DNA, 25 bp, Mus musculus
gcggagcggccgctgggtccgccat

SEQ ID NO: 114407 - DNA, 25 bp, Mus musculus
gcggagctcagagagtccttacact

SEQ ID NO: 114408 - DNA, 25 bp, Mus musculus
gcggaggcacgagctacttcctttc

SEQ ID NO: 114409 - DNA, 25 bp, Mus musculus
gcggaggctccagcaaaaagaggaa

SEQ ID NO: 114410 - DNA, 25 bp, Mus musculus
gcggaggctgccatcaaccgccaga

SEQ ID NO: 114411 - DNA, 25 bp, Mus musculus
gcggaggttaacaccacactcgagg

SEQ ID NO: 114412 - DNA, 25 bp, Mus musculus
gcggagtacctcatgcgtgcagaga

SEQ ID NO: 114413 - DNA, 25 bp, Mus musculus
gcggagtcgtcagcggccactcagt

SEQ ID NO: 114414 - DNA, 25 bp, Mus musculus
gcggagtggaataagtacgatgacc

SEQ ID NO: 114415 - DNA, 25 bp, Mus musculus
gcggataatttccacgctgattcca

SEQ ID NO: 114416 - DNA, 25 bp, Mus musculus
gcggatagtgttttcgccttccgga

SEQ ID NO: 114417 - DNA, 25 bp, Mus musculus
gcggatatacagacccaagagcagc

SEQ ID NO: 114418 - DNA, 25 bp, Mus musculus
gcggatcctccccagtgagaagtcc

SEQ ID NO: 114419 - DNA, 25 bp, Mus musculus
gcggatcgggatacagatgcagtaa

SEQ ID NO: 114420 - DNA, 25 bp, Mus musculus
gcggcaacccaactccattaataaa

SEQ ID NO: 114421 - DNA, 25 bp, Mus musculus
gcggcaatagaaacaaacactgagg

SEQ ID NO: 114422 - DNA, 25 bp, Mus musculus
gcggcaccattatgagcagcagcaa

SEQ ID NO: 114423 - DNA, 25 bp, Mus musculus
gcggcacctgcgagtggaagctggg

SEQ ID NO: 114424 - DNA, 25 bp, Mus musculus
gcggcactaatggaccccttctaag

SEQ ID NO: 114425 - DNA, 25 bp, Mus musculus
gcggcagaacctcgactattaccaa

SEQ ID NO: 114426 - DNA, 25 bp, Mus musculus
gcggcagccgcgtgcgggctgcggg

SEQ ID NO: 114427 - DNA, 25 bp, Mus musculus
gcggcagtctccttcgtagttacaa

SEQ ID NO: 114428 - DNA, 25 bp, Mus musculus
gcggcatgcccatacggattgaaaa

SEQ ID NO: 114429 - DNA, 25 bp, Mus musculus
gcggcattcgccatcacagttgtag

SEQ ID NO: 114430 - DNA, 25 bp, Mus musculus
gcggccacacgatttcttcgatgca

SEQ ID NO: 114431 - DNA, 25 bp, Mus musculus
gcggccagagctcaagaatcacatt

SEQ ID NO: 114432 - DNA, 25 bp, Mus musculus
gcggccatgaagaaccaggtagcga

SEQ ID NO: 114433 - DNA, 25 bp, Mus musculus
gcggcccagccatcagttatccagt

SEQ ID NO: 114434 - DNA, 25 bp, Mus musculus
gcggccccgaggacggaagtgagaa

SEQ ID NO: 114435 - DNA, 25 bp, Mus musculus
gcggccctcttgtccacgatgtgta

SEQ ID NO: 114436 - DNA, 25 bp, Mus musculus
gcggcccttggacgaatgtgtacta

SEQ ID NO: 114437 - DNA, 25 bp, Mus musculus
gcggccgcagcgtctgcaagttcgc

SEQ ID NO: 114438 - DNA, 25 bp, Mus musculus
gcggccgctgatgccaagaaacaga

SEQ ID NO: 114439 - DNA, 25 bp, Mus musculus
gcggccggacgctacctgtttaagt

SEQ ID NO: 114440 - DNA, 25 bp, Mus musculus
gcggccgggactcaaaaaaataatg

SEQ ID NO: 114441 - DNA, 25 bp, Mus musculus
gcggccgtccgagccaaaaacatga

SEQ ID NO: 114442 - DNA, 25 bp, Mus musculus
gcggccgtcgccattttgtagggtt

SEQ ID NO: 114443 - DNA, 25 bp, Mus musculus
gcggccttactgactaccatgatgt

SEQ ID NO: 114444 - DNA, 25 bp, Mus musculus
gcggccttggctgtgaacatctgcg

SEQ ID NO: 114445 - DNA, 25 bp, Mus musculus
gcggcctttcctgacgtaactctga

SEQ ID NO: 114446 - DNA, 25 bp, Mus musculus
gcggcgcgaactcttcctccgggaa

SEQ ID NO: 114447 - DNA, 25 bp, Mus musculus
gcggcggcccgaagccgaagagcgg

SEQ ID NO: 114448 - DNA, 25 bp, Mus musculus
gcggcggcggcagacgcgtgtggcg

SEQ ID NO: 114449 - DNA, 25 bp, Mus musculus
gcggcggctcctttaggcagctgaa

SEQ ID NO: 114450 - DNA, 25 bp, Mus musculus
gcggcggtgactgtggcgggcgcta

SEQ ID NO: 114451 - DNA, 25 bp, Mus musculus
gcggcgttaggtacagacaggcact

SEQ ID NO: 114452 - DNA, 25 bp, Mus musculus
gcggcgttctcaaagttcggacagt

SEQ ID NO: 114453 - DNA, 25 bp, Mus musculus
gcggcgttgcggctgagctcgtgtg

SEQ ID NO: 114454 - DNA, 25 bp, Mus musculus
gcggcgtttccctgagtcgtgcaga

SEQ ID NO: 114455 - DNA, 25 bp, Mus musculus
gcggctaagtcaagtcctgcatcta

SEQ ID NO: 114456 - DNA, 25 bp, Mus musculus
gcggctccaagggtttggaacttag

SEQ ID NO: 114457 - DNA, 25 bp, Mus musculus
gcggctccggaaaaggacagagttt

SEQ ID NO: 114458 - DNA, 25 bp, Mus musculus
gcggctctcctagctctggaagaaa

SEQ ID NO: 114459 - DNA, 25 bp, Mus musculus
gcggctctctgatgaaattctgata

SEQ ID NO: 114460 - DNA, 25 bp, Mus musculus
gcggctctgaacacaccattgatgg

SEQ ID NO: 114461 - DNA, 25 bp, Mus musculus
gcggctgagtgtggccatccctaaa

SEQ ID NO: 114462 - DNA, 25 bp, Mus musculus
gcggctgctgccaaaaacgggacat

SEQ ID NO: 114463 - DNA, 25 bp, Mus musculus
gcggctggcaacacatggaactggt

SEQ ID NO: 114464 - DNA, 25 bp, Mus musculus
gcggctgggcaactacgtcatcaat

SEQ ID NO: 114465 - DNA, 25 bp, Mus musculus
gcggctgtccttagcccaagccggg

SEQ ID NO: 114466 - DNA, 25 bp, Mus musculus
gcggcttaacactcaaatcactcaa

SEQ ID NO: 114467 - DNA, 25 bp, Mus musculus
gcggcttggagatccggacgcatct

SEQ ID NO: 114468 - DNA, 25 bp, Mus musculus
gcgggaaagtgtaccagcgcctgat

SEQ ID NO: 114469 - DNA, 25 bp, Mus musculus
gcgggaagctcgtgtttaagtagac

SEQ ID NO: 114470 - DNA, 25 bp, Mus musculus
gcgggacatcaagcagactgggatt

SEQ ID NO: 114471 - DNA, 25 bp, Mus musculus
gcgggaccagagtttctcagaaccg

SEQ ID NO: 114472 - DNA, 25 bp, Mus musculus
gcgggacctttacttcgagttcaga

SEQ ID NO: 114473 - DNA, 25 bp, Mus musculus
gcgggacgcagactgccccacatag

SEQ ID NO: 114474 - DNA, 25 bp, Mus musculus
gcgggacgtcgttctcctggtagta

SEQ ID NO: 114475 - DNA, 25 bp, Mus musculus
gcgggagatagtaggcgtatccaca

SEQ ID NO: 114476 - DNA, 25 bp, Mus musculus
gcgggaggtgggtccgcgcgtgatc

SEQ ID NO: 114477 - DNA, 25 bp, Mus musculus
gcgggagtcagatccacgaccagtt

SEQ ID NO: 114478 - DNA, 25 bp, Mus musculus
gcgggagttgaggagcaggccggcc

SEQ ID NO: 114479 - DNA, 25 bp, Mus musculus
gcgggatccgtcagtgttccctcgc

SEQ ID NO: 114480 - DNA, 25 bp, Mus musculus
gcgggatgcctttcagcaaatcaaa

SEQ ID NO: 114481 - DNA, 25 bp, Mus musculus
gcgggcacttcctgtctccaagatg

SEQ ID NO: 114482 - DNA, 25 bp, Mus musculus
gcgggcagatcctgagcaagctgaa

SEQ ID NO: 114483 - DNA, 25 bp, Mus musculus
gcgggcagcctcacgcacatcgaag

SEQ ID NO: 114484 - DNA, 25 bp, Mus musculus
gcgggcagggatcacttcatccgaa

SEQ ID NO: 114485 - DNA, 25 bp, Mus musculus
gcgggcagtgccctaagctgttcaa

SEQ ID NO: 114486 - DNA, 25 bp, Mus musculus
gcgggcatcttggagcacatgttca

SEQ ID NO: 114487 - DNA, 25 bp, Mus musculus
gcgggccctttatcgaccaggtgta

SEQ ID NO: 114488 - DNA, 25 bp, Mus musculus
gcgggccttcgctggttactgctca

SEQ ID NO: 114489 - DNA, 25 bp, Mus musculus
gcgggctcagctgtacattgataca

SEQ ID NO: 114490 - DNA, 25 bp, Mus musculus
gcgggctccaatccggttccatccg

SEQ ID NO: 114491 - DNA, 25 bp, Mus musculus
gcgggctcccttcgacctttttgag

SEQ ID NO: 114492 - DNA, 25 bp, Mus musculus
gcgggcttagcagcattcgaccaaa

SEQ ID NO: 114493 - DNA, 25 bp, Mus musculus
gcgggtaccggtttggcatctctca

SEQ ID NO: 114494 - DNA, 25 bp, Mus musculus
gcgggtccgccatgctgatcatcat

SEQ ID NO: 114495 - DNA, 25 bp, Mus musculus
gcgggtcgtttcagccacagaagtg

SEQ ID NO: 114496 - DNA, 25 bp, Mus musculus
gcgggtgacctcatctggccacgac

SEQ ID NO: 114497 - DNA, 25 bp, Mus musculus
gcgggtgccttgctttcatactgga

SEQ ID NO: 114498 - DNA, 25 bp, Mus musculus
gcgggttctcattactggtgccact

SEQ ID NO: 114499 - DNA, 25 bp, Mus musculus
gcgggttctctatctcgtccaagga

SEQ ID NO: 114500 - DNA, 25 bp, Mus musculus
gcgggtttcggcaggacagcttctc

SEQ ID NO: 114501 - DNA, 25 bp, Mus musculus
gcggtaatgaggacttatggacact

SEQ ID NO: 114502 - DNA, 25 bp, Mus musculus
gcggtagaatccttgcgggccatct

SEQ ID NO: 114503 - DNA, 25 bp, Mus musculus
gcggtatagcttgggacgctagact

SEQ ID NO: 114504 - DNA, 25 bp, Mus musculus
gcggtattgctgtgctttgacatca

SEQ ID NO: 114505 - DNA, 25 bp, Mus musculus
gcggtcgccttgacgacggcggacg

SEQ ID NO: 114506 - DNA, 25 bp, Mus musculus
gcggtcgctggatgtgctcactgca

SEQ ID NO: 114507 - DNA, 25 bp, Mus musculus
gcggtctggccgatgagatcaactt

SEQ ID NO: 114508 - DNA, 25 bp, Mus musculus
gcggtctttggagaacgtgccatca

SEQ ID NO: 114509 - DNA, 25 bp, Mus musculus
gcggtgacttttcctagtgggccca

SEQ ID NO: 114510 - DNA, 25 bp, Mus musculus
gcggtgagttacgattgggccctat

SEQ ID NO: 114511 - DNA, 25 bp, Mus musculus
gcggtgatgaaagcgatggcggcgg

SEQ ID NO: 114512 - DNA, 25 bp, Mus musculus
gcggtgatggcggacaacgccttca

SEQ ID NO: 114513 - DNA, 25 bp, Mus musculus
gcggtgcagacctgagtttgcaaaa

SEQ ID NO: 114514 - DNA, 25 bp, Mus musculus
gcggtgcctctagaagcctgggata

SEQ ID NO: 114515 - DNA, 25 bp, Mus musculus
gcggtgtgtaggatcctctgcagat

SEQ ID NO: 114516 - DNA, 25 bp, Mus musculus
gcggtgttgccctccttaaccaagg

SEQ ID NO: 114517 - DNA, 25 bp, Mus musculus
gcggttatttaaggacgggccatct

SEQ ID NO: 114518 - DNA, 25 bp, Mus musculus
gcggttccggaagctcctacattta

SEQ ID NO: 114519 - DNA, 25 bp, Mus musculus
gcggttcgtccattcctaggtcatt

SEQ ID NO: 114520 - DNA, 25 bp, Mus musculus
gcggttctttgcgtgtaacaggatc

SEQ ID NO: 114521 - DNA, 25 bp, Mus musculus
gcggtttttccatgaaacagaaaca

SEQ ID NO: 114522 - DNA, 25 bp, Mus musculus
gcgtaaagcctaggcgcgaggctca

SEQ ID NO: 114523 - DNA, 25 bp, Mus musculus
gcgtaacacggctgggcatttctac

SEQ ID NO: 114524 - DNA, 25 bp, Mus musculus
gcgtaaccctgtacggcaccgctct

SEQ ID NO: 114525 - DNA, 25 bp, Mus musculus
gcgtaagattcgaatcatcatggca

SEQ ID NO: 114526 - DNA, 25 bp, Mus musculus
gcgtaataatagagaaggtgccaga

SEQ ID NO: 114527 - DNA, 25 bp, Mus musculus
gcgtacaaaggtaaaggcggccgca

SEQ ID NO: 114528 - DNA, 25 bp, Mus musculus
gcgtataatctattgaagagggatc

SEQ ID NO: 114529 - DNA, 25 bp, Mus musculus
gcgtatgagtgagttccggtatttc

SEQ ID NO: 114530 - DNA, 25 bp, Mus musculus
gcgtattcacaaagaggccttcctt

SEQ ID NO: 114531 - DNA, 25 bp, Mus musculus
gcgtattgacgcaatactctttctt

SEQ ID NO: 114532 - DNA, 25 bp, Mus musculus
gcgtcaaaattatccgaaaccgcct

SEQ ID NO: 114533 - DNA, 25 bp, Mus musculus
gcgtcaatttctatggccccaagag

SEQ ID NO: 114534 - DNA, 25 bp, Mus musculus
gcgtcaccctgctcgatgcttctga

SEQ ID NO: 114535 - DNA, 25 bp, Mus musculus
gcgtcagtcaagtccaacatccggg

SEQ ID NO: 114536 - DNA, 25 bp, Mus musculus
gcgtcatgaccctcacaagctggtg

SEQ ID NO: 114537 - DNA, 25 bp, Mus musculus
gcgtcatgtttaccaactgtatgca

SEQ ID NO: 114538 - DNA, 25 bp, Mus musculus
gcgtccaggccctttaccaagagga

SEQ ID NO: 114539 - DNA, 25 bp, Mus musculus
gcgtcccagtggaataagcacgttt

SEQ ID NO: 114540 - DNA, 25 bp, Mus musculus
gcgtccccaagaagctgcagtgtaa

SEQ ID NO: 114541 - DNA, 25 bp, Mus musculus
gcgtccccgctgaagaagtgccttt

SEQ ID NO: 114542 - DNA, 25 bp, Mus musculus
gcgtccgagcaaggccgaaaggtcc

SEQ ID NO: 114543 - DNA, 25 bp, Mus musculus
gcgtccgccagaatgaaagcaactg

SEQ ID NO: 114544 - DNA, 25 bp, Mus musculus
gcgtccgcccggaagaagagtcact

SEQ ID NO: 114545 - DNA, 25 bp, Mus musculus
gcgtccgctgcgtctccggcatttg

SEQ ID NO: 114546 - DNA, 25 bp, Mus musculus
gcgtcctaccagttttcttcaacgg

SEQ ID NO: 114547 - DNA, 25 bp, Mus musculus
gcgtcctcctcgagttccggctccg

SEQ ID NO: 114548 - DNA, 25 bp, Mus musculus
gcgtcctctccaagcctaagtggga

SEQ ID NO: 114549 - DNA, 25 bp, Mus musculus
gcgtcctgaggcactcggtggacct

SEQ ID NO: 114550 - DNA, 25 bp, Mus musculus
gcgtcgatgccagcttatgcctgtc

SEQ ID NO: 114551 - DNA, 25 bp, Mus musculus
gcgtcgcaaccttctctggctagag

SEQ ID NO: 114552 - DNA, 25 bp, Mus musculus
gcgtcgcccgacttgttttcttgga

SEQ ID NO: 114553 - DNA, 25 bp, Mus musculus
gcgtcgccgaggtcgacgcagctca

SEQ ID NO: 114554 - DNA, 25 bp, Mus musculus
gcgtcgccgctccttgtcgctttga

SEQ ID NO: 114555 - DNA, 25 bp, Mus musculus
gcgtcgtcatgtggcccagagtgct

SEQ ID NO: 114556 - DNA, 25 bp, Mus musculus
gcgtcgtctccgagcgtctttccgt

SEQ ID NO: 114557 - DNA, 25 bp, Mus musculus
gcgtctccctcgcaagtgcgccaga

SEQ ID NO: 114558 - DNA, 25 bp, Mus musculus
gcgtctcctgtaacgtctctgtgga

SEQ ID NO: 114559 - DNA, 25 bp, Mus musculus
gcgtctcggcggatgcccaaagact

SEQ ID NO: 114560 - DNA, 25 bp, Mus musculus
gcgtctcttttctccaggaggaaaa

SEQ ID NO: 114561 - DNA, 25 bp, Mus musculus
gcgtctgaatcggagaaaaacctta

SEQ ID NO: 114562 - DNA, 25 bp, Mus musculus
gcgtctggagcatgagaatccccga

SEQ ID NO: 114563 - DNA, 25 bp, Mus musculus
gcgtctggatgggagaaacctcaca

SEQ ID NO: 114564 - DNA, 25 bp, Mus musculus
gcgtcttcttgaccagagtgccctg

SEQ ID NO: 114565 - DNA, 25 bp, Mus musculus
gcgtgaacagcatccgctacgagaa

SEQ ID NO: 114566 - DNA, 25 bp, Mus musculus
gcgtgaaccgctgcattctgtgtgg

SEQ ID NO: 114567 - DNA, 25 bp, Mus musculus
gcgtgaagacattacatccagtgca

SEQ ID NO: 114568 - DNA, 25 bp, Mus musculus
gcgtgactccgcagactaggactta

SEQ ID NO: 114569 - DNA, 25 bp, Mus musculus
gcgtgagccctcattgtgatagcac

SEQ ID NO: 114570 - DNA, 25 bp, Mus musculus
gcgtgagttcggatcctaacaccca

SEQ ID NO: 114571 - DNA, 25 bp, Mus musculus
gcgtgatcgcggggctgccgggcgg

SEQ ID NO: 114572 - DNA, 25 bp, Mus musculus
gcgtgatcttgaacctggcgaagga

SEQ ID NO: 114573 - DNA, 25 bp, Mus musculus
gcgtgatttcgagttggcccaggca

SEQ ID NO: 114574 - DNA, 25 bp, Mus musculus
gcgtgcaaagtccttaccaaagatg

SEQ ID NO: 114575 - DNA, 25 bp, Mus musculus
gcgtgcccctggaagttaacctggc

SEQ ID NO: 114576 - DNA, 25 bp, Mus musculus
gcgtgcgcgctaccttgtgttcttg

SEQ ID NO: 114577 - DNA, 25 bp, Mus musculus
gcgtgctcaggtcccgggattctac

SEQ ID NO: 114578 - DNA, 25 bp, Mus musculus
gcgtgctggcagatcaagtatggac

SEQ ID NO: 114579 - DNA, 25 bp, Mus musculus
gcgtggagctgccaaagcattactt

SEQ ID NO: 114580 - DNA, 25 bp, Mus musculus
gcgtggaggacagctccgcagcgcg

SEQ ID NO: 114581 - DNA, 25 bp, Mus musculus
gcgtggatggaagcccagaaatgct

SEQ ID NO: 114582 - DNA, 25 bp, Mus musculus
gcgtggcaccagcagccgttgaaaa

SEQ ID NO: 114583 - DNA, 25 bp, Mus musculus
gcgtggccaccaactaagatgaaaa

SEQ ID NO: 114584 - DNA, 25 bp, Mus musculus
gcgtggcgtgtgacattcctgaaca

SEQ ID NO: 114585 - DNA, 25 bp, Mus musculus
gcgtggctttcagcctcccgaaggt

SEQ ID NO: 114586 - DNA, 25 bp, Mus musculus
gcgtgggccgacagaagaacagttc

SEQ ID NO: 114587 - DNA, 25 bp, Mus musculus
gcgtgggctacaaaatctcatctga

SEQ ID NO: 114588 - DNA, 25 bp, Mus musculus
gcgtggtcaacatccccgcggcgga

SEQ ID NO: 114589 - DNA, 25 bp, Mus musculus
gcgtgtactcatctttgcttcatac

SEQ ID NO: 114590 - DNA, 25 bp, Mus musculus
gcgtgtagcgttgctaacgccgcca

SEQ ID NO: 114591 - DNA, 25 bp, Mus musculus
gcgtgtatcggctccgccatggctc

SEQ ID NO: 114592 - DNA, 25 bp, Mus musculus
gcgtgtcgcccgacctcgagtggca

SEQ ID NO: 114593 - DNA, 25 bp, Mus musculus
gcgtgtgcatcccatcgacttgtat

SEQ ID NO: 114594 - DNA, 25 bp, Mus musculus
gcgtgttttgaaacaagcccagtga

SEQ ID NO: 114595 - DNA, 25 bp, Mus musculus
gcgttaaacacacttcgaatctggg

SEQ ID NO: 114596 - DNA, 25 bp, Mus musculus
gcgttacgtcttaccggcagtcatt

SEQ ID NO: 114597 - DNA, 25 bp, Mus musculus
gcgttagaatacttgcaggctttgg

SEQ ID NO: 114598 - DNA, 25 bp, Mus musculus
gcgttagctccagatgtttgtgcct

SEQ ID NO: 114599 - DNA, 25 bp, Mus musculus
gcgttagctgcgtcccggctcagag

SEQ ID NO: 114600 - DNA, 25 bp, Mus musculus
gcgttcaaggcagagtccacaggtg

SEQ ID NO: 114601 - DNA, 25 bp, Mus musculus
gcgttccctgaaagagtcccggtag

SEQ ID NO: 114602 - DNA, 25 bp, Mus musculus
gcgttccgggccaggtggacttcta

SEQ ID NO: 114603 - DNA, 25 bp, Mus musculus
gcgttcggtgaggacatagatctac

SEQ ID NO: 114604 - DNA, 25 bp, Mus musculus
gcgttctacgtccacgatgctgaga

SEQ ID NO: 114605 - DNA, 25 bp, Mus musculus
gcgttcttcttataattactgacaa

SEQ ID NO: 114606 - DNA, 25 bp, Mus musculus
gcgttgagaagctattacacccaga

SEQ ID NO: 114607 - DNA, 25 bp, Mus musculus
gcgttggttcgagaagaccttcagc

SEQ ID NO: 114608 - DNA, 25 bp, Mus musculus
gcgttgttgcaagacccattggaga

SEQ ID NO: 114609 - DNA, 25 bp, Mus musculus
gcgtttaagataatgttccagcccc

SEQ ID NO: 114610 - DNA, 25 bp, Mus musculus
gcgtttaggctaacaggtggcacca

SEQ ID NO: 114611 - DNA, 25 bp, Mus musculus
gcgtttccgcaaacagaatcgtgga

SEQ ID NO: 114612 - DNA, 25 bp, Mus musculus
gcgtttcgcgcgacgattggctgcc

SEQ ID NO: 114613 - DNA, 25 bp, Mus musculus
gcgtttgaagaagagcgagccagct

SEQ ID NO: 114614 - DNA, 25 bp, Mus musculus
gcgtttgagtcaacctggagtggca

SEQ ID NO: 114615 - DNA, 25 bp, Mus musculus
gcgtttgattcaaggaaccgtagaa

SEQ ID NO: 114616 - DNA, 25 bp, Mus musculus
gcgtttgcaagaggtggtaccgcct

SEQ ID NO: 114617 - DNA, 25 bp, Mus musculus
gcgtttgctactaaaggatccccag

SEQ ID NO: 114618 - DNA, 25 bp, Mus musculus
gcgtttggaagaagtacagcctcac

SEQ ID NO: 114619 - DNA, 25 bp, Mus musculus
gcgtttgggaattaggcacgtctcc

SEQ ID NO: 114620 - DNA, 25 bp, Mus musculus
gcgtttgtgttcatcttatcaggga

SEQ ID NO: 114621 - DNA, 25 bp, Mus musculus
gctaaaaaacgctacattgaacaga

SEQ ID NO: 114622 - DNA, 25 bp, Mus musculus
gctaaaaacgcagcagcaacctggg

SEQ ID NO: 114623 - DNA, 25 bp, Mus musculus
gctaaaaagaaaagccctgagtggt

SEQ ID NO: 114624 - DNA, 25 bp, Mus musculus
gctaaaaagtctggaggagctacca

SEQ ID NO: 114625 - DNA, 25 bp, Mus musculus
gctaaaaccaaggaaaatcgccagt

SEQ ID NO: 114626 - DNA, 25 bp, Mus musculus
gctaaaacgagtaaattgcgcccat

SEQ ID NO: 114627 - DNA, 25 bp, Mus musculus
gctaaaagcagcctatgaccgagag

SEQ ID NO: 114628 - DNA, 25 bp, Mus musculus
gctaaaataagaacggccagggagg

SEQ ID NO: 114629 - DNA, 25 bp, Mus musculus
gctaaaatcgctgtggaagcccaga

SEQ ID NO: 114630 - DNA, 25 bp, Mus musculus
gctaaaattgcttgcttggccggga

SEQ ID NO: 114631 - DNA, 25 bp, Mus musculus
gctaaacattattcatgtcactggg

SEQ ID NO: 114632 - DNA, 25 bp, Mus musculus
gctaaaccctaatgcaaaggtatgg

SEQ ID NO: 114633 - DNA, 25 bp, Mus musculus
gctaaacctcacaggaattggcgag

SEQ ID NO: 114634 - DNA, 25 bp, Mus musculus
gctaaactcttgtccggagcgactg

SEQ ID NO: 114635 - DNA, 25 bp, Mus musculus
gctaaacttccataacctgcctgag

SEQ ID NO: 114636 - DNA, 25 bp, Mus musculus
gctaaagacgcgtttcctggctatc

SEQ ID NO: 114637 - DNA, 25 bp, Mus musculus
gctaaagagatcacatattctgacc

SEQ ID NO: 114638 - DNA, 25 bp, Mus musculus
gctaaagatactgctagaccggctc

SEQ ID NO: 114639 - DNA, 25 bp, Mus musculus
gctaaagcaattatcaaccttgctg

SEQ ID NO: 114640 - DNA, 25 bp, Mus musculus
gctaaaggactgtgtgctgcaaccc

SEQ ID NO: 114641 - DNA, 25 bp, Mus musculus
gctaaatcgagtccctgctgtgcag

SEQ ID NO: 114642 - DNA, 25 bp, Mus musculus
gctaaatgtgtggacttgcaacgga

SEQ ID NO: 114643 - DNA, 25 bp, Mus musculus
gctaaatgttaatggggcccgcaga

SEQ ID NO: 114644 - DNA, 25 bp, Mus musculus
gctaaatgtttctaggatgcagtac

SEQ ID NO: 114645 - DNA, 25 bp, Mus musculus
gctaaattatcgatgccctgtccag

SEQ ID NO: 114646 - DNA, 25 bp, Mus musculus
gctaaattgagccagcaggtcagga

SEQ ID NO: 114647 - DNA, 25 bp, Mus musculus
gctaacaaggcaccaggcagtgact

SEQ ID NO: 114648 - DNA, 25 bp, Mus musculus
gctaacacttcggtccatgcaggga

SEQ ID NO: 114649 - DNA, 25 bp, Mus musculus
gctaacagatttcctcagcaggcct

SEQ ID NO: 114650 - DNA, 25 bp, Mus musculus
gctaacatggataagcatgccttga

SEQ ID NO: 114651 - DNA, 25 bp, Mus musculus
gctaacatggcgtggccgtgcatca

SEQ ID NO: 114652 - DNA, 25 bp, Mus musculus
gctaacattctgatcacggagctgt

SEQ ID NO: 114653 - DNA, 25 bp, Mus musculus
gctaacccagatgcgaaggaccatt

SEQ ID NO: 114654 - DNA, 25 bp, Mus musculus
gctaaccgggagaagatgactcaaa

SEQ ID NO: 114655 - DNA, 25 bp, Mus musculus
gctaacctagctatttgccagtggg

SEQ ID NO: 114656 - DNA, 25 bp, Mus musculus
gctaaccttatcctttgtcgcagag

SEQ ID NO: 114657 - DNA, 25 bp, Mus musculus
gctaacgttctgactaacgagctaa

SEQ ID NO: 114658 - DNA, 25 bp, Mus musculus
gctaactaggaatgtgcaaaaggat

SEQ ID NO: 114659 - DNA, 25 bp, Mus musculus
gctaagaaggactacaacgaagctt

SEQ ID NO: 114660 - DNA, 25 bp, Mus musculus
gctaagagagcaattgaactgaacc

SEQ ID NO: 114661 - DNA, 25 bp, Mus musculus
gctaagataagtttcaccctggcca

SEQ ID NO: 114662 - DNA, 25 bp, Mus musculus
gctaagccagaacagaatccaggga

SEQ ID NO: 114663 - DNA, 25 bp, Mus musculus
gctaagcgagctgcaagtgtcacat

SEQ ID NO: 114664 - DNA, 25 bp, Mus musculus
gctaagcgttcagagccatgggcta

SEQ ID NO: 114665 - DNA, 25 bp, Mus musculus
gctaagctctacatcgaattgctga

SEQ ID NO: 114666 - DNA, 25 bp, Mus musculus
gctaaggccgtttcgatctgtcgtg

SEQ ID NO: 114667 - DNA, 25 bp, Mus musculus
gctaaggctggtgttcctttaccac

SEQ ID NO: 114668 - DNA, 25 bp, Mus musculus
gctaagggactatctgctgcctgga

SEQ ID NO: 114669 - DNA, 25 bp, Mus musculus
gctaagggctttagcctgagcgatg

SEQ ID NO: 114670 - DNA, 25 bp, Mus musculus
gctaagtactttggggatgcacccc

SEQ ID NO: 114671 - DNA, 25 bp, Mus musculus
gctaagtagcgtgcaggagtccgat

SEQ ID NO: 114672 - DNA, 25 bp, Mus musculus
gctaagtctgatgaaatgtgctgcc

SEQ ID NO: 114673 - DNA, 25 bp, Mus musculus
gctaagtgtgctacacatccatggg

SEQ ID NO: 114674 - DNA, 25 bp, Mus musculus
gctaagttcccaggctacaaaagag

SEQ ID NO: 114675 - DNA, 25 bp, Mus musculus
gctaagttccggcatgtggcacatg

SEQ ID NO: 114676 - DNA, 25 bp, Mus musculus
gctaataagactgaaggccgcatca

SEQ ID NO: 114677 - DNA, 25 bp, Mus musculus
gctaatcaggatggagaaaccagca

SEQ ID NO: 114678 - DNA, 25 bp, Mus musculus
gctaatcatgcagagaacgccaccg

SEQ ID NO: 114679 - DNA, 25 bp, Mus musculus
gctaatccatcaagctcgggccagt

SEQ ID NO: 114680 - DNA, 25 bp, Mus musculus
gctaatcctgagttcgaccaacggg

SEQ ID NO: 114681 - DNA, 25 bp, Mus musculus
gctaatcctgggtgccattggcaaa

SEQ ID NO: 114682 - DNA, 25 bp, Mus musculus
gctaatgaagagactgaatggctcc

SEQ ID NO: 114683 - DNA, 25 bp, Mus musculus
gctaatgagaaccttgagtcccagt

SEQ ID NO: 114684 - DNA, 25 bp, Mus musculus
gctaatgatggccccatgccccaga

SEQ ID NO: 114685 - DNA, 25 bp, Mus musculus
gctaatggcaacaaacgtgggacct

SEQ ID NO: 114686 - DNA, 25 bp, Mus musculus
gctaattattatgacccctttcccg

SEQ ID NO: 114687 - DNA, 25 bp, Mus musculus
gctaattattgccagggaaagggcc

SEQ ID NO: 114688 - DNA, 25 bp, Mus musculus
gctaattgacattgcccgacagaca

SEQ ID NO: 114689 - DNA, 25 bp, Mus musculus
gctaattgtttaccgttttgaagct

SEQ ID NO: 114690 - DNA, 25 bp, Mus musculus
gctaatttatgtgctcccagcaagg

SEQ ID NO: 114691 - DNA, 25 bp, Mus musculus
gctacaaaaggaaccgcaggagggt

SEQ ID NO: 114692 - DNA, 25 bp, Mus musculus
gctacaaactcgtcccagctgagag

SEQ ID NO: 114693 - DNA, 25 bp, Mus musculus
gctacaaactgctcagcactgaagg

SEQ ID NO: 114694 - DNA, 25 bp, Mus musculus
gctacaaagggaggattcagctaaa

SEQ ID NO: 114695 - DNA, 25 bp, Mus musculus
gctacaacccaaacgaacggacaag

SEQ ID NO: 114696 - DNA, 25 bp, Mus musculus
gctacaagatcctggcagcctgctg

SEQ ID NO: 114697 - DNA, 25 bp, Mus musculus
gctacaagtgtctccctcgtgctgg

SEQ ID NO: 114698 - DNA, 25 bp, Mus musculus
gctacaatgccacaacccaggagat

SEQ ID NO: 114699 - DNA, 25 bp, Mus musculus
gctacaccactgcatggaaaccagg

SEQ ID NO: 114700 - DNA, 25 bp, Mus musculus
gctacaccggtggacctgaagctga

SEQ ID NO: 114701 - DNA, 25 bp, Mus musculus
gctacacgcgctgctattggcactt

SEQ ID NO: 114702 - DNA, 25 bp, Mus musculus
gctacagaaaagagcaggagcgcct

SEQ ID NO: 114703 - DNA, 25 bp, Mus musculus
gctacagaatgaggtgaggcagctc

SEQ ID NO: 114704 - DNA, 25 bp, Mus musculus
gctacagacaacttctgtgaagatg

SEQ ID NO: 114705 - DNA, 25 bp, Mus musculus
gctacagagtacattacaggagctc

SEQ ID NO: 114706 - DNA, 25 bp, Mus musculus
gctacagagtgcctgacctgggtca

SEQ ID NO: 114707 - DNA, 25 bp, Mus musculus
gctacagcaacaaggatctcacagt

SEQ ID NO: 114708 - DNA, 25 bp, Mus musculus
gctacagcagatcaaatggcacagg

SEQ ID NO: 114709 - DNA, 25 bp, Mus musculus
gctacagccagaaagaaccccgttt

SEQ ID NO: 114710 - DNA, 25 bp, Mus musculus
gctacagcctcttggcggagatcgg

SEQ ID NO: 114711 - DNA, 25 bp, Mus musculus
gctacagcgtatccgtgccaaggga

SEQ ID NO: 114712 - DNA, 25 bp, Mus musculus
gctacagctggcatgatgacggtga

SEQ ID NO: 114713 - DNA, 25 bp, Mus musculus
gctacaggcatacaaccggaggttg

SEQ ID NO: 114714 - DNA, 25 bp, Mus musculus
gctacagggatcttggaccaggctc

SEQ ID NO: 114715 - DNA, 25 bp, Mus musculus
gctacaggtcacgatcgagatcccg

SEQ ID NO: 114716 - DNA, 25 bp, Mus musculus
gctacagtctgtggcagtttcagaa

SEQ ID NO: 114717 - DNA, 25 bp, Mus musculus
gctacagtggcagccttgcaagaga

SEQ ID NO: 114718 - DNA, 25 bp, Mus musculus
gctacagtgtcattgggtggtacca

SEQ ID NO: 114719 - DNA, 25 bp, Mus musculus
gctacataggtgtgtaaatctggac

SEQ ID NO: 114720 - DNA, 25 bp, Mus musculus
gctacatgaccataatgaacggctg

SEQ ID NO: 114721 - DNA, 25 bp, Mus musculus
gctacatgatggctgtgagttcata

SEQ ID NO: 114722 - DNA, 25 bp, Mus musculus
gctacatggaaacacgaacaacttg

SEQ ID NO: 114723 - DNA, 25 bp, Mus musculus
gctacatgtactgaaggtgaaccga

SEQ ID NO: 114724 - DNA, 25 bp, Mus musculus
gctaccacgttggagaagacctacg

SEQ ID NO: 114725 - DNA, 25 bp, Mus musculus
gctaccagcgggtgagtcctgttaa

SEQ ID NO: 114726 - DNA, 25 bp, Mus musculus
gctaccaggtgacaggagaccgtct

SEQ ID NO: 114727 - DNA, 25 bp, Mus musculus
gctaccagtagtgcagtttcaaagg

SEQ ID NO: 114728 - DNA, 25 bp, Mus musculus
gctaccatggatgaggtgcacacct

SEQ ID NO: 114729 - DNA, 25 bp, Mus musculus
gctaccatggccaccaataaggaga

SEQ ID NO: 114730 - DNA, 25 bp, Mus musculus
gctaccccatcaggctttgaagagg

SEQ ID NO: 114731 - DNA, 25 bp, Mus musculus
gctacccgttggctctgttttaccg

SEQ ID NO: 114732 - DNA, 25 bp, Mus musculus
gctacccttgccactgagagaaatg

SEQ ID NO: 114733 - DNA, 25 bp, Mus musculus
gctaccctttggtgccctgagagca

SEQ ID NO: 114734 - DNA, 25 bp, Mus musculus
gctaccgcaggtggatgaagaatga

SEQ ID NO: 114735 - DNA, 25 bp, Mus musculus
gctaccgccatgcagtcctccggct

SEQ ID NO: 114736 - DNA, 25 bp, Mus musculus
gctaccgctattttcctggccgtgg

SEQ ID NO: 114737 - DNA, 25 bp, Mus musculus
gctaccgtcaggacctccagttgag

SEQ ID NO: 114738 - DNA, 25 bp, Mus musculus
gctaccgtctctatgccgagtctga

SEQ ID NO: 114739 - DNA, 25 bp, Mus musculus
gctaccgtctgccttccaatgtgga

SEQ ID NO: 114740 - DNA, 25 bp, Mus musculus
gctacctatgatggcgagtggtgtc

SEQ ID NO: 114741 - DNA, 25 bp, Mus musculus
gctacctcagagcatcggactccaa

SEQ ID NO: 114742 - DNA, 25 bp, Mus musculus
gctacctcatgaagcattacaggat

SEQ ID NO: 114743 - DNA, 25 bp, Mus musculus
gctacctcggcttcttcatcaacga

SEQ ID NO: 114744 - DNA, 25 bp, Mus musculus
gctacctgaaattcgagagaagata

SEQ ID NO: 114745 - DNA, 25 bp, Mus musculus
gctacctggagaagcagatagtgaa

SEQ ID NO: 114746 - DNA, 25 bp, Mus musculus
gctacctggagcatcaactccgcag

SEQ ID NO: 114747 - DNA, 25 bp, Mus musculus
gctacctgggtgaccgatacaaccg

SEQ ID NO: 114748 - DNA, 25 bp, Mus musculus
gctaccttggcgttgtcttgggact

SEQ ID NO: 114749 - DNA, 25 bp, Mus musculus
gctaccttgtcacatggaatcctga

SEQ ID NO: 114750 - DNA, 25 bp, Mus musculus
gctacgacacaaaaggctgaacggg

SEQ ID NO: 114751 - DNA, 25 bp, Mus musculus
gctacgagggcaccgaagacgatta

SEQ ID NO: 114752 - DNA, 25 bp, Mus musculus
gctacgaggtggacaagattgccca

SEQ ID NO: 114753 - DNA, 25 bp, Mus musculus
gctacgagttggctttgattctgaa

SEQ ID NO: 114754 - DNA, 25 bp, Mus musculus
gctacgatgacgtgcgagggcttca

SEQ ID NO: 114755 - DNA, 25 bp, Mus musculus
gctacgatggagtcctcaggctcag

SEQ ID NO: 114756 - DNA, 25 bp, Mus musculus
gctacgattaccagaggcagcctga

SEQ ID NO: 114757 - DNA, 25 bp, Mus musculus
gctacgcacacatcccggtcaggat

SEQ ID NO: 114758 - DNA, 25 bp, Mus musculus
gctacgcacacgcaaaggaggcttt

SEQ ID NO: 114759 - DNA, 25 bp, Mus musculus
gctacgcagatgagagcgggaacat

SEQ ID NO: 114760 - DNA, 25 bp, Mus musculus
gctacgccagcttggaggaagatga

SEQ ID NO: 114761 - DNA, 25 bp, Mus musculus
gctacgcctctaatgcagtgtctga

SEQ ID NO: 114762 - DNA, 25 bp, Mus musculus
gctacgcggcaaagccaaggtcaat

SEQ ID NO: 114763 - DNA, 25 bp, Mus musculus
gctacggcatttcttcctagtggaa

SEQ ID NO: 114764 - DNA, 25 bp, Mus musculus
gctacggcctacatgaacatcgtga

SEQ ID NO: 114765 - DNA, 25 bp, Mus musculus
gctacgggacccaagatcaattcaa

SEQ ID NO: 114766 - DNA, 25 bp, Mus musculus
gctacggtgctagaagaaatgcccc

SEQ ID NO: 114767 - DNA, 25 bp, Mus musculus
gctacgtgactgtggtgagcctgca

SEQ ID NO: 114768 - DNA, 25 bp, Mus musculus
gctacgtgataacctgacgctgtgg

SEQ ID NO: 114769 - DNA, 25 bp, Mus musculus
gctacgtggattcgtgcccatcgca

SEQ ID NO: 114770 - DNA, 25 bp, Mus musculus
gctacgtgggcctttgtgatgccat

SEQ ID NO: 114771 - DNA, 25 bp, Mus musculus
gctacgtggtctacgaaaacctgaa

SEQ ID NO: 114772 - DNA, 25 bp, Mus musculus
gctacgtgtgctccctgacagaaga

SEQ ID NO: 114773 - DNA, 25 bp, Mus musculus
gctacgttggctggtaacttccgga

SEQ ID NO: 114774 - DNA, 25 bp, Mus musculus
gctactaaacaagccggcatcggcg

SEQ ID NO: 114775 - DNA, 25 bp, Mus musculus
gctactaaggaaggagaacgaggct

SEQ ID NO: 114776 - DNA, 25 bp, Mus musculus
gctactacaaggaacagaaggcgct

SEQ ID NO: 114777 - DNA, 25 bp, Mus musculus
gctactacatcgagggcatcaacca

SEQ ID NO: 114778 - DNA, 25 bp, Mus musculus
gctactacgacgatcgctcagacca

SEQ ID NO: 114779 - DNA, 25 bp, Mus musculus
gctactatgaagaccgccaatgtga

SEQ ID NO: 114780 - DNA, 25 bp, Mus musculus
gctactcacttgacactgacccagg

SEQ ID NO: 114781 - DNA, 25 bp, Mus musculus
gctactcagagagccgcgtggagaa

SEQ ID NO: 114782 - DNA, 25 bp, Mus musculus
gctactcagggcgaacaggacaatt

SEQ ID NO: 114783 - DNA, 25 bp, Mus musculus
gctactccaaccgtatgaacgtgtg

SEQ ID NO: 114784 - DNA, 25 bp, Mus musculus
gctactccaacggaccaggtgtcag

SEQ ID NO: 114785 - DNA, 25 bp, Mus musculus
gctactccgggatgttcaactggcc

SEQ ID NO: 114786 - DNA, 25 bp, Mus musculus
gctactcgaaagaacataccctgtg

SEQ ID NO: 114787 - DNA, 25 bp, Mus musculus
gctactcggcccaagtctctggcta

SEQ ID NO: 114788 - DNA, 25 bp, Mus musculus
gctactctcgtagattccggagaaa

SEQ ID NO: 114789 - DNA, 25 bp, Mus musculus
gctactctggattaagaatcgctag

SEQ ID NO: 114790 - DNA, 25 bp, Mus musculus
gctactgaaggtagcgggcagccct

SEQ ID NO: 114791 - DNA, 25 bp, Mus musculus
gctactgcatggactgtgtactcga

SEQ ID NO: 114792 - DNA, 25 bp, Mus musculus
gctactgcgcttaagacctgtatca

SEQ ID NO: 114793 - DNA, 25 bp, Mus musculus
gctactgctgcctggatatctggga

SEQ ID NO: 114794 - DNA, 25 bp, Mus musculus
gctactgctttctggcatgccggaa

SEQ ID NO: 114795 - DNA, 25 bp, Mus musculus
gctactggaagctgggacagccacg

SEQ ID NO: 114796 - DNA, 25 bp, Mus musculus
gctactgggcaccatccaaatgctg

SEQ ID NO: 114797 - DNA, 25 bp, Mus musculus
gctactgtcagagagagttccagaa

SEQ ID NO: 114798 - DNA, 25 bp, Mus musculus
gctactgtgggcgatgtaaatacag

SEQ ID NO: 114799 - DNA, 25 bp, Mus musculus
gctacttgaaccgagaaggtcccaa

SEQ ID NO: 114800 - DNA, 25 bp, Mus musculus
gctacttgcgggacattcttctggc

SEQ ID NO: 114801 - DNA, 25 bp, Mus musculus
gctacttggctgaatgccgtgcgaa

SEQ ID NO: 114802 - DNA, 25 bp, Mus musculus
gctacttgtgatattttggagacac

SEQ ID NO: 114803 - DNA, 25 bp, Mus musculus
gctactttgttgcacctggagggaa

SEQ ID NO: 114804 - DNA, 25 bp, Mus musculus
gctagaaaagacatactccgccaag

SEQ ID NO: 114805 - DNA, 25 bp, Mus musculus
gctagaacatccctgcagacgaaag

SEQ ID NO: 114806 - DNA, 25 bp, Mus musculus
gctagaagcgatcaaagctcgagtc

SEQ ID NO: 114807 - DNA, 25 bp, Mus musculus
gctagaaggagataaagagtccctc

SEQ ID NO: 114808 - DNA, 25 bp, Mus musculus
gctagaagtgcttgctcgtccgcag

SEQ ID NO: 114809 - DNA, 25 bp, Mus musculus
gctagaatatcagccttggaggtcc

SEQ ID NO: 114810 - DNA, 25 bp, Mus musculus
gctagaatcgtggatggaagcagat

SEQ ID NO: 114811 - DNA, 25 bp, Mus musculus
gctagaatctgccaacgagtcgcgt

SEQ ID NO: 114812 - DNA, 25 bp, Mus musculus
gctagacaaggaccacactacagcg

SEQ ID NO: 114813 - DNA, 25 bp, Mus musculus
gctagacacactgagcagagctgaa

SEQ ID NO: 114814 - DNA, 25 bp, Mus musculus
gctagacactacaaagacgcgcagg

SEQ ID NO: 114815 - DNA, 25 bp, Mus musculus
gctagacagagttcacaggagacca

SEQ ID NO: 114816 - DNA, 25 bp, Mus musculus
gctagaccagcgcttttcagagaat

SEQ ID NO: 114817 - DNA, 25 bp, Mus musculus
gctagacctacagaagcaactggga

SEQ ID NO: 114818 - DNA, 25 bp, Mus musculus
gctagacctgagtgagctccgcaaa

SEQ ID NO: 114819 - DNA, 25 bp, Mus musculus
gctagactacgacaaactgggcaag

SEQ ID NO: 114820 - DNA, 25 bp, Mus musculus
gctagactgtctgcttccatggatc

SEQ ID NO: 114821 - DNA, 25 bp, Mus musculus
gctagactttctctccagctatgag

SEQ ID NO: 114822 - DNA, 25 bp, Mus musculus
gctagagctcggaatcggagcccaa

SEQ ID NO: 114823 - DNA, 25 bp, Mus musculus
gctagaggatggtacgagcagctac

SEQ ID NO: 114824 - DNA, 25 bp, Mus musculus
gctagaggccttgcttgtagagccc

SEQ ID NO: 114825 - DNA, 25 bp, Mus musculus
gctagatcaggttcatgcactgatt

SEQ ID NO: 114826 - DNA, 25 bp, Mus musculus
gctagatgagctccattcccaccga

SEQ ID NO: 114827 - DNA, 25 bp, Mus musculus
gctagattatcgaaaagcctttgga

SEQ ID NO: 114828 - DNA, 25 bp, Mus musculus
gctagcaaaacatccccggtcaggt

SEQ ID NO: 114829 - DNA, 25 bp, Mus musculus
gctagcaagagaaacttgaactttg

SEQ ID NO: 114830 - DNA, 25 bp, Mus musculus
gctagcatgctggatcaggacctca

SEQ ID NO: 114831 - DNA, 25 bp, Mus musculus
gctagcatgggcaccaaagcttcct

SEQ ID NO: 114832 - DNA, 25 bp, Mus musculus
gctagccaggtatgccgtgacagct

SEQ ID NO: 114833 - DNA, 25 bp, Mus musculus
gctagccccgtatcttccatctcct

SEQ ID NO: 114834 - DNA, 25 bp, Mus musculus
gctagccgattccttggagccgtca

SEQ ID NO: 114835 - DNA, 25 bp, Mus musculus
gctagccttcctggtcgtaatgaca

SEQ ID NO: 114836 - DNA, 25 bp, Mus musculus
gctagctgaagagaacgagcggctc

SEQ ID NO: 114837 - DNA, 25 bp, Mus musculus
gctagctgtcttccgagctcgggaa

SEQ ID NO: 114838 - DNA, 25 bp, Mus musculus
gctagcttcacatcaggacaactgg

SEQ ID NO: 114839 - DNA, 25 bp, Mus musculus
gctagcttctaggatgtcaagggag

SEQ ID NO: 114840 - DNA, 25 bp, Mus musculus
gctaggaagcagctgatcgagcctt

SEQ ID NO: 114841 - DNA, 25 bp, Mus musculus
gctaggcagtatcccaaggcacttt

SEQ ID NO: 114842 - DNA, 25 bp, Mus musculus
gctaggcctctgtgccaaaattgag

SEQ ID NO: 114843 - DNA, 25 bp, Mus musculus
gctaggcggagcactccaaggattt

SEQ ID NO: 114844 - DNA, 25 bp, Mus musculus
gctaggctagcgaagcccgagcgca

SEQ ID NO: 114845 - DNA, 25 bp, Mus musculus
gctagggcccaaagcaatgtagtgt

SEQ ID NO: 114846 - DNA, 25 bp, Mus musculus
gctagggtctgtgttcaacgcgccg

SEQ ID NO: 114847 - DNA, 25 bp, Mus musculus
gctaggtaagtcatgctcttagaga

SEQ ID NO: 114848 - DNA, 25 bp, Mus musculus
gctagtaagacaccacacacgtgga

SEQ ID NO: 114849 - DNA, 25 bp, Mus musculus
gctagtcaataagcacgtggctcct

SEQ ID NO: 114850 - DNA, 25 bp, Mus musculus
gctagtcccacaggcctgctgttga

SEQ ID NO: 114851 - DNA, 25 bp, Mus musculus
gctagtctatgatcctgccaaacga

SEQ ID NO: 114852 - DNA, 25 bp, Mus musculus
gctagtctgattgagcacactgcac

SEQ ID NO: 114853 - DNA, 25 bp, Mus musculus
gctagtctgggacaaagattttcca

SEQ ID NO: 114854 - DNA, 25 bp, Mus musculus
gctagtcttgaaggccacactggca

SEQ ID NO: 114855 - DNA, 25 bp, Mus musculus
gctagtgctaaacccttgccagaag

SEQ ID NO: 114856 - DNA, 25 bp, Mus musculus
gctagtgctatttggtggctggaca

SEQ ID NO: 114857 - DNA, 25 bp, Mus musculus
gctagtggaagtggcggcatcgctg

SEQ ID NO: 114858 - DNA, 25 bp, Mus musculus
gctagttagtagcactgggaccttt

SEQ ID NO: 114859 - DNA, 25 bp, Mus musculus
gctagttcgctttccggcttgagaa

SEQ ID NO: 114860 - DNA, 25 bp, Mus musculus
gctagttcttcattcaagcaccgaa

SEQ ID NO: 114861 - DNA, 25 bp, Mus musculus
gctagtttctgcagtgagccgtgaa

SEQ ID NO: 114862 - DNA, 25 bp, Mus musculus
gctagtttgtaaacacggccggcct

SEQ ID NO: 114863 - DNA, 25 bp, Mus musculus
gctagttttcaggttcgcaccagag

SEQ ID NO: 114864 - DNA, 25 bp, Mus musculus
gctataactttggacgctacctgga

SEQ ID NO: 114865 - DNA, 25 bp, Mus musculus
gctataagcgcctagcttcgggcca

SEQ ID NO: 114866 - DNA, 25 bp, Mus musculus
gctataatacctatgcgtccgcgat

SEQ ID NO: 114867 - DNA, 25 bp, Mus musculus
gctataatgcagacaaagcacagtc

SEQ ID NO: 114868 - DNA, 25 bp, Mus musculus
gctataatgtatattgccccagaat

SEQ ID NO: 114869 - DNA, 25 bp, Mus musculus
gctatacagttcagatgctggtgtc

SEQ ID NO: 114870 - DNA, 25 bp, Mus musculus
gctataccacactggctggcctgga

SEQ ID NO: 114871 - DNA, 25 bp, Mus musculus
gctatagcacttacgatgaccggca

SEQ ID NO: 114872 - DNA, 25 bp, Mus musculus
gctatagctcaaggtggaacaatcc

SEQ ID NO: 114873 - DNA, 25 bp, Mus musculus
gctatagctgatatgaacgcggctc

SEQ ID NO: 114874 - DNA, 25 bp, Mus musculus
gctataggacagacgacaaaactca

SEQ ID NO: 114875 - DNA, 25 bp, Mus musculus
gctatagggtacatccacagtctga

SEQ ID NO: 114876 - DNA, 25 bp, Mus musculus
gctatatggacgctcgggatacaac

SEQ ID NO: 114877 - DNA, 25 bp, Mus musculus
gctatattctgcacagaggaacctg

SEQ ID NO: 114878 - DNA, 25 bp, Mus musculus
gctatcaagaacgactcaagggctg

SEQ ID NO: 114879 - DNA, 25 bp, Mus musculus
gctatcaatgctactgtgatcggac

SEQ ID NO: 114880 - DNA, 25 bp, Mus musculus
gctatcagctgcctaaaacgagcca

SEQ ID NO: 114881 - DNA, 25 bp, Mus musculus
gctatcaggtgatttcagggcccca

SEQ ID NO: 114882 - DNA, 25 bp, Mus musculus
gctatcagtagcagcagtgacagca

SEQ ID NO: 114883 - DNA, 25 bp, Mus musculus
gctatcccaaggcttctgtgcagta

SEQ ID NO: 114884 - DNA, 25 bp, Mus musculus
gctatccgaaaggtgtgacatccca

SEQ ID NO: 114885 - DNA, 25 bp, Mus musculus
gctatcctggaccaacataccaggg

SEQ ID NO: 114886 - DNA, 25 bp, Mus musculus
gctatcgagaacagaacagtggttg

SEQ ID NO: 114887 - DNA, 25 bp, Mus musculus
gctatcgcctgtgtgatccttctgt

SEQ ID NO: 114888 - DNA, 25 bp, Mus musculus
gctatcggctggtggactatctgga

SEQ ID NO: 114889 - DNA, 25 bp, Mus musculus
gctatctacaatcaacccggctggg

SEQ ID NO: 114890 - DNA, 25 bp, Mus musculus
gctatctccgagctgccctgattgg

SEQ ID NO: 114891 - DNA, 25 bp, Mus musculus
gctatctgaagatgcagcagcctga

SEQ ID NO: 114892 - DNA, 25 bp, Mus musculus
gctatctgacacctggaagggctca

SEQ ID NO: 114893 - DNA, 25 bp, Mus musculus
gctatcttgctcagagctttaccaa

SEQ ID NO: 114894 - DNA, 25 bp, Mus musculus
gctatgaacttcactattgggcgcg

SEQ ID NO: 114895 - DNA, 25 bp, Mus musculus
gctatgaagtctacacgcagggtgg

SEQ ID NO: 114896 - DNA, 25 bp, Mus musculus
gctatgacagctcagaacgggactt

SEQ ID NO: 114897 - DNA, 25 bp, Mus musculus
gctatgactacgaaggctgccctgt

SEQ ID NO: 114898 - DNA, 25 bp, Mus musculus
gctatgagaccatcctgaaggagca

SEQ ID NO: 114899 - DNA, 25 bp, Mus musculus
gctatgagcccaagcatattgtgga

SEQ ID NO: 114900 - DNA, 25 bp, Mus musculus
gctatgagctggcagacgaccacat

SEQ ID NO: 114901 - DNA, 25 bp, Mus musculus
gctatgaggcttaactgctgtcata

SEQ ID NO: 114902 - DNA, 25 bp, Mus musculus
gctatgagtgtaactgcccgcctga

SEQ ID NO: 114903 - DNA, 25 bp, Mus musculus
gctatgataagtcccaaatggcagt

SEQ ID NO: 114904 - DNA, 25 bp, Mus musculus
gctatgatgagtttggtttccgtgt

SEQ ID NO: 114905 - DNA, 25 bp, Mus musculus
gctatgcaatcatggccggtgcccg

SEQ ID NO: 114906 - DNA, 25 bp, Mus musculus
gctatgcaattcctgacggcccaga

SEQ ID NO: 114907 - DNA, 25 bp, Mus musculus
gctatgcacctaattgatgttgcca

SEQ ID NO: 114908 - DNA, 25 bp, Mus musculus
gctatgcattctaccctggacccag

SEQ ID NO: 114909 - DNA, 25 bp, Mus musculus
gctatgccctgatacgccttttgga

SEQ ID NO: 114910 - DNA, 25 bp, Mus musculus
gctatgcgaaattatttaaaagaac

SEQ ID NO: 114911 - DNA, 25 bp, Mus musculus
gctatgctgagcaaggcaccaactg

SEQ ID NO: 114912 - DNA, 25 bp, Mus musculus
gctatgctgcacttcccaggagtca

SEQ ID NO: 114913 - DNA, 25 bp, Mus musculus
gctatggaaagcaagcaccggcctt

SEQ ID NO: 114914 - DNA, 25 bp, Mus musculus
gctatggaacctgatgggcaacgcc

SEQ ID NO: 114915 - DNA, 25 bp, Mus musculus
gctatggagatgtacctggcacgga

SEQ ID NO: 114916 - DNA, 25 bp, Mus musculus
gctatggagcagaaagagcttctca

SEQ ID NO: 114917 - DNA, 25 bp, Mus musculus
gctatggagcagtgcatgtgcccct

SEQ ID NO: 114918 - DNA, 25 bp, Mus musculus
gctatggatggttgcttctgcacct

SEQ ID NO: 114919 - DNA, 25 bp, Mus musculus
gctatggatttgctgcgggagctga

SEQ ID NO: 114920 - DNA, 25 bp, Mus musculus
gctatggccaacagagatcgacaca

SEQ ID NO: 114921 - DNA, 25 bp, Mus musculus
gctatggctctctgcagatctgaaa

SEQ ID NO: 114922 - DNA, 25 bp, Mus musculus
gctatgggcgcaggtatggccccaa

SEQ ID NO: 114923 - DNA, 25 bp, Mus musculus
gctatggtacgcttttatatggaaa

SEQ ID NO: 114924 - DNA, 25 bp, Mus musculus
gctatggttaccaagccctggtgca

SEQ ID NO: 114925 - DNA, 25 bp, Mus musculus
gctatgtactcctctgatgcaaggg

SEQ ID NO: 114926 - DNA, 25 bp, Mus musculus
gctatgtagcagaaacagtaccaca

SEQ ID NO: 114927 - DNA, 25 bp, Mus musculus
gctatgtccggaagggaatcccgct

SEQ ID NO: 114928 - DNA, 25 bp, Mus musculus
gctatgtgcccatgagccctaaagg

SEQ ID NO: 114929 - DNA, 25 bp, Mus musculus
gctatgtgtatagtccattgggctc

SEQ ID NO: 114930 - DNA, 25 bp, Mus musculus
gctatgtgtatccatggagacaaga

SEQ ID NO: 114931 - DNA, 25 bp, Mus musculus
gctatgttgaaactgctaacctgga

SEQ ID NO: 114932 - DNA, 25 bp, Mus musculus
gctattagcttgaccaacacgttgg

SEQ ID NO: 114933 - DNA, 25 bp, Mus musculus
gctattcaacagaaaagaaccgtgg

SEQ ID NO: 114934 - DNA, 25 bp, Mus musculus
gctattcagcaaagagctattatcc

SEQ ID NO: 114935 - DNA, 25 bp, Mus musculus
gctattcataaagagactggccaga

SEQ ID NO: 114936 - DNA, 25 bp, Mus musculus
gctattcgagaggtctgcacgcctg

SEQ ID NO: 114937 - DNA, 25 bp, Mus musculus
gctattcgtaagatgcacagactcg

SEQ ID NO: 114938 - DNA, 25 bp, Mus musculus
gctattgaaagcaagtgcccggagg

SEQ ID NO: 114939 - DNA, 25 bp, Mus musculus
gctattgcagagaaaaaccgtcggg

SEQ ID NO: 114940 - DNA, 25 bp, Mus musculus
gctattgctggcctacaactccggt

SEQ ID NO: 114941 - DNA, 25 bp, Mus musculus
gctattggatcaagatcagtcccta

SEQ ID NO: 114942 - DNA, 25 bp, Mus musculus
gctattggctattactgactgttaa

SEQ ID NO: 114943 - DNA, 25 bp, Mus musculus
gctattgggccaacggtacgggcca

SEQ ID NO: 114944 - DNA, 25 bp, Mus musculus
gctatttaaaggtgcgcgcccgagc

SEQ ID NO: 114945 - DNA, 25 bp, Mus musculus
gctatttccgacagggcaggaggct

SEQ ID NO: 114946 - DNA, 25 bp, Mus musculus
gctcaaaaacgcaactagggatggg

SEQ ID NO: 114947 - DNA, 25 bp, Mus musculus
gctcaaaaatggcaaacctgcaggg

SEQ ID NO: 114948 - DNA, 25 bp, Mus musculus
gctcaaaactttctacacaccagag

SEQ ID NO: 114949 - DNA, 25 bp, Mus musculus
gctcaaaagggagcgcacaggctct

SEQ ID NO: 114950 - DNA, 25 bp, Mus musculus
gctcaaaagttacaggacccgcttg

SEQ ID NO: 114951 - DNA, 25 bp, Mus musculus
gctcaaacggctgcagaacaacgat

SEQ ID NO: 114952 - DNA, 25 bp, Mus musculus
gctcaaactgtccagcacccaagaa

SEQ ID NO: 114953 - DNA, 25 bp, Mus musculus
gctcaaacttatgcttctgttggag

SEQ ID NO: 114954 - DNA, 25 bp, Mus musculus
gctcaaatgctaaagacgtggtcag

SEQ ID NO: 114955 - DNA, 25 bp, Mus musculus
gctcaaattctgaaaatgtgtgtct

SEQ ID NO: 114956 - DNA, 25 bp, Mus musculus
gctcaacaagaggatgccaaccact

SEQ ID NO: 114957 - DNA, 25 bp, Mus musculus
gctcaacaagttctataccaagaag

SEQ ID NO: 114958 - DNA, 25 bp, Mus musculus
gctcaacagagccatcgatgctgcc

SEQ ID NO: 114959 - DNA, 25 bp, Mus musculus
gctcaacagcgaggatgacgtcagt

SEQ ID NO: 114960 - DNA, 25 bp, Mus musculus
gctcaaccttaacctgggcgtcgtg

SEQ ID NO: 114961 - DNA, 25 bp, Mus musculus
gctcaacgcttggaaatttggcttg

SEQ ID NO: 114962 - DNA, 25 bp, Mus musculus
gctcaacttgaagatgaaggcaact

SEQ ID NO: 114963 - DNA, 25 bp, Mus musculus
gctcaagaacgcctatgaggagtct

SEQ ID NO: 114964 - DNA, 25 bp, Mus musculus
gctcaagatgaatcgggcactggat

SEQ ID NO: 114965 - DNA, 25 bp, Mus musculus
gctcaagatgagtgtgggcctgcca

SEQ ID NO: 114966 - DNA, 25 bp, Mus musculus
gctcaaggagaatctgaaggacacc

SEQ ID NO: 114967 - DNA, 25 bp, Mus musculus
gctcaagggatagacgaaccaatcg

SEQ ID NO: 114968 - DNA, 25 bp, Mus musculus
gctcaagtcattctcctggtcattc

SEQ ID NO: 114969 - DNA, 25 bp, Mus musculus
gctcaagttcaaggcgtgtctggta

SEQ ID NO: 114970 - DNA, 25 bp, Mus musculus
gctcaatcatgtactgaaatcctgg

SEQ ID NO: 114971 - DNA, 25 bp, Mus musculus
gctcaatgagaaacgacaacgccga

SEQ ID NO: 114972 - DNA, 25 bp, Mus musculus
gctcaatgcttagtgaaggacatcc

SEQ ID NO: 114973 - DNA, 25 bp, Mus musculus
gctcaatgttgagcatagcagtcac

SEQ ID NO: 114974 - DNA, 25 bp, Mus musculus
gctcaattggaaacgcgcctgtcaa

SEQ ID NO: 114975 - DNA, 25 bp, Mus musculus
gctcacaaaacatgggactccggga

SEQ ID NO: 114976 - DNA, 25 bp, Mus musculus
gctcacacatagcacagaccaggat

SEQ ID NO: 114977 - DNA, 25 bp, Mus musculus
gctcacactaaaacccaaaatatat

SEQ ID NO: 114978 - DNA, 25 bp, Mus musculus
gctcacagatgaatgctgcaaaggt

SEQ ID NO: 114979 - DNA, 25 bp, Mus musculus
gctcacagtggatggtagctggaaa

SEQ ID NO: 114980 - DNA, 25 bp, Mus musculus
gctcacatgacctggttgctgggaa

SEQ ID NO: 114981 - DNA, 25 bp, Mus musculus
gctcaccccgcaagagaacgagtct

SEQ ID NO: 114982 - DNA, 25 bp, Mus musculus
gctcacccgcagtaaacaccaagtg

SEQ ID NO: 114983 - DNA, 25 bp, Mus musculus
gctcaccctgttgcaagagcactgg

SEQ ID NO: 114984 - DNA, 25 bp, Mus musculus
gctcacgctggatttctgccgaaga

SEQ ID NO: 114985 - DNA, 25 bp, Mus musculus
gctcagaaaagactcgaccctagga

SEQ ID NO: 114986 - DNA, 25 bp, Mus musculus
gctcagaagagctcccaattgcagg

SEQ ID NO: 114987 - DNA, 25 bp, Mus musculus
gctcagaccacaggtagtgcggacg

SEQ ID NO: 114988 - DNA, 25 bp, Mus musculus
gctcagacctggcatatacaagtga

SEQ ID NO: 114989 - DNA, 25 bp, Mus musculus
gctcagacgtgaacaaggaccatta

SEQ ID NO: 114990 - DNA, 25 bp, Mus musculus
gctcagagaaagatcacccgggtgt

SEQ ID NO: 114991 - DNA, 25 bp, Mus musculus
gctcagagagctagcactgtacagg

SEQ ID NO: 114992 - DNA, 25 bp, Mus musculus
gctcagaggcacatcagtgacctgt

SEQ ID NO: 114993 - DNA, 25 bp, Mus musculus
gctcagagggagtgttagctttaac

SEQ ID NO: 114994 - DNA, 25 bp, Mus musculus
gctcagatagaattttatcagaaca

SEQ ID NO: 114995 - DNA, 25 bp, Mus musculus
gctcagatgggcagacggcaaaatg

SEQ ID NO: 114996 - DNA, 25 bp, Mus musculus
gctcagatgggcttcagattcaaga

SEQ ID NO: 114997 - DNA, 25 bp, Mus musculus
gctcagcagacaacgtgacggtgat

SEQ ID NO: 114998 - DNA, 25 bp, Mus musculus
gctcagcagaggtttcagttcagtc

SEQ ID NO: 114999 - DNA, 25 bp, Mus musculus
gctcagcagctgagcgcggaagccc

SEQ ID NO: 115000 - DNA, 25 bp, Mus musculus
gctcagcagtatatcgtggtcaccg

SEQ ID NO: 115001 - DNA, 25 bp, Mus musculus
gctcagccacgtaccgggagttcgt

SEQ ID NO: 115002 - DNA, 25 bp, Mus musculus
gctcagccagtgcaaagccagagga

SEQ ID NO: 115003 - DNA, 25 bp, Mus musculus
gctcagcctggatgacgtcaaaaga

SEQ ID NO: 115004 - DNA, 25 bp, Mus musculus
gctcagcctttgtctcgggccgctg

SEQ ID NO: 115005 - DNA, 25 bp, Mus musculus
gctcagcgaggtgcagtggctcttc

SEQ ID NO: 115006 - DNA, 25 bp, Mus musculus
gctcagcgggaagttgaccagtcgt

SEQ ID NO: 115007 - DNA, 25 bp, Mus musculus
gctcagcgggccattgaagcgactc

SEQ ID NO: 115008 - DNA, 25 bp, Mus musculus
gctcagctccggtgatgtgggaaca

SEQ ID NO: 115009 - DNA, 25 bp, Mus musculus
gctcagcttttggtcaatccccaga

SEQ ID NO: 115010 - DNA, 25 bp, Mus musculus
gctcaggagatctacttcctgagtg

SEQ ID NO: 115011 - DNA, 25 bp, Mus musculus
gctcaggcagtagaggagccgtcca

SEQ ID NO: 115012 - DNA, 25 bp, Mus musculus
gctcaggccctagagctgtctaaga

SEQ ID NO: 115013 - DNA, 25 bp, Mus musculus
gctcaggcggcgttttccgatcctg

SEQ ID NO: 115014 - DNA, 25 bp, Mus musculus
gctcagggcttagtgctcaccggaa

SEQ ID NO: 115015 - DNA, 25 bp, Mus musculus
gctcaggggacaagaaggccactgt

SEQ ID NO: 115016 - DNA, 25 bp, Mus musculus
gctcaggtgcctgaaaagaggtccc

SEQ ID NO: 115017 - DNA, 25 bp, Mus musculus
gctcaggttccgcatccaacaacaa

SEQ ID NO: 115018 - DNA, 25 bp, Mus musculus
gctcagtcactgaagggacagaagt

SEQ ID NO: 115019 - DNA, 25 bp, Mus musculus
gctcagtcagcgctagattctacgt

SEQ ID NO: 115020 - DNA, 25 bp, Mus musculus
gctcagtcagtcaaccatggattcg

SEQ ID NO: 115021 - DNA, 25 bp, Mus musculus
gctcagtctggaaggaaacaccatg

SEQ ID NO: 115022 - DNA, 25 bp, Mus musculus
gctcagtggaagtgtaaagcctgct

SEQ ID NO: 115023 - DNA, 25 bp, Mus musculus
gctcagtggttcaccaactacctga

SEQ ID NO: 115024 - DNA, 25 bp, Mus musculus
gctcagttactgaagcaagaacaga

SEQ ID NO: 115025 - DNA, 25 bp, Mus musculus
gctcagttctgacaccagggatgga

SEQ ID NO: 115026 - DNA, 25 bp, Mus musculus
gctcagtttccacgagagtgtgcca

SEQ ID NO: 115027 - DNA, 25 bp, Mus musculus
gctcagtttgaccgctacctctcag

SEQ ID NO: 115028 - DNA, 25 bp, Mus musculus
gctcataaggtcattggtggcagga

SEQ ID NO: 115029 - DNA, 25 bp, Mus musculus
gctcatagttctgaaagccaggaga

SEQ ID NO: 115030 - DNA, 25 bp, Mus musculus
gctcatattttatgttgctaacatg

SEQ ID NO: 115031 - DNA, 25 bp, Mus musculus
gctcatcaaacccaagaagctgctg

SEQ ID NO: 115032 - DNA, 25 bp, Mus musculus
gctcatcatcggctgcctgtccagt

SEQ ID NO: 115033 - DNA, 25 bp, Mus musculus
gctcatccagcatcgacgacacaga

SEQ ID NO: 115034 - DNA, 25 bp, Mus musculus
gctcatcccgcatagaagagttcag

SEQ ID NO: 115035 - DNA, 25 bp, Mus musculus
gctcatccggcaatttgaggctgaa

SEQ ID NO: 115036 - DNA, 25 bp, Mus musculus
gctcatcctaatctgtttacccatg

SEQ ID NO: 115037 - DNA, 25 bp, Mus musculus
gctcatctatgtggcaggccgggaa

SEQ ID NO: 115038 - DNA, 25 bp, Mus musculus
gctcatgacctggagctactgagaa

SEQ ID NO: 115039 - DNA, 25 bp, Mus musculus
gctcatgatgatgtttacagcttcc

SEQ ID NO: 115040 - DNA, 25 bp, Mus musculus
gctcatgatggccttctacacggga

SEQ ID NO: 115041 - DNA, 25 bp, Mus musculus
gctcatgccaacatgaatgccaatg

SEQ ID NO: 115042 - DNA, 25 bp, Mus musculus
gctcatgctggtcatcatctacgtg

SEQ ID NO: 115043 - DNA, 25 bp, Mus musculus
gctcatggctcttcacctgcagtga

SEQ ID NO: 115044 - DNA, 25 bp, Mus musculus
gctcatgtgattcaatcagtagcat

SEQ ID NO: 115045 - DNA, 25 bp, Mus musculus
gctcatgtggaaagcacgtgcgtgc

SEQ ID NO: 115046 - DNA, 25 bp, Mus musculus
gctcattcgctctctgacagagctg

SEQ ID NO: 115047 - DNA, 25 bp, Mus musculus
gctcattgcccaccagaaaggacag

SEQ ID NO: 115048 - DNA, 25 bp, Mus musculus
gctccaaaaaactcggtagcgacta

SEQ ID NO: 115049 - DNA, 25 bp, Mus musculus
gctccaaacctgtagaagttgtcct

SEQ ID NO: 115050 - DNA, 25 bp, Mus musculus
gctccaaatggagaggcggctacgt

SEQ ID NO: 115051 - DNA, 25 bp, Mus musculus
gctccaacagaaggaacttagcagt

SEQ ID NO: 115052 - DNA, 25 bp, Mus musculus
gctccaagcagtgagatcacgcagt

SEQ ID NO: 115053 - DNA, 25 bp, Mus musculus
gctccacagagtattgcggcggtta

SEQ ID NO: 115054 - DNA, 25 bp, Mus musculus
gctccacatattccagaaggagaag

SEQ ID NO: 115055 - DNA, 25 bp, Mus musculus
gctccacatggaatagacagtttct

SEQ ID NO: 115056 - DNA, 25 bp, Mus musculus
gctccacgagtctctatttggctca

SEQ ID NO: 115057 - DNA, 25 bp, Mus musculus
gctccacgggagctctcagtaacta

SEQ ID NO: 115058 - DNA, 25 bp, Mus musculus
gctccactttggcttcagagacgaa

SEQ ID NO: 115059 - DNA, 25 bp, Mus musculus
gctccagagccattccggcatcgag

SEQ ID NO: 115060 - DNA, 25 bp, Mus musculus
gctccagcgaccctatggcgtgtaa

SEQ ID NO: 115061 - DNA, 25 bp, Mus musculus
gctccagcgggttcattcaaaggca

SEQ ID NO: 115062 - DNA, 25 bp, Mus musculus
gctccaggctgtagttggctaacac

SEQ ID NO: 115063 - DNA, 25 bp, Mus musculus
gctccaggtcccgactgagagatcg

SEQ ID NO: 115064 - DNA, 25 bp, Mus musculus
gctccaggtgaggtgtgcgcacata

SEQ ID NO: 115065 - DNA, 25 bp, Mus musculus
gctccagtttcaataagagaccttg

SEQ ID NO: 115066 - DNA, 25 bp, Mus musculus
gctccagtttgggactgctgacaca

SEQ ID NO: 115067 - DNA, 25 bp, Mus musculus
gctccatatgccatgggaatgaaaa

SEQ ID NO: 115068 - DNA, 25 bp, Mus musculus
gctccatcatttggtctgaagcaaa

SEQ ID NO: 115069 - DNA, 25 bp, Mus musculus
gctccatgaagaggaagtgctccca

SEQ ID NO: 115070 - DNA, 25 bp, Mus musculus
gctccatggagtatctgccgctgcg

SEQ ID NO: 115071 - DNA, 25 bp, Mus musculus
gctcccagccgtgatgatgaatgca

SEQ ID NO: 115072 - DNA, 25 bp, Mus musculus
gctcccagcgctataaaaactttat

SEQ ID NO: 115073 - DNA, 25 bp, Mus musculus
gctcccagggtcagacagatcgttt

SEQ ID NO: 115074 - DNA, 25 bp, Mus musculus
gctcccagtgttgagagaccctata

SEQ ID NO: 115075 - DNA, 25 bp, Mus musculus
gctccccaaggaagtgaaggtttat

SEQ ID NO: 115076 - DNA, 25 bp, Mus musculus
gctccccggtcagtatgaactagtg

SEQ ID NO: 115077 - DNA, 25 bp, Mus musculus
gctcccgaatgcagagaccgcatct

SEQ ID NO: 115078 - DNA, 25 bp, Mus musculus
gctcccgagtgacggcttcctgctg

SEQ ID NO: 115079 - DNA, 25 bp, Mus musculus
gctcccgatctcgattctacagtgg

SEQ ID NO: 115080 - DNA, 25 bp, Mus musculus
gctcccgcgtatgccttgttgaaga

SEQ ID NO: 115081 - DNA, 25 bp, Mus musculus
gctcccgggatcagcataaacagtg

SEQ ID NO: 115082 - DNA, 25 bp, Mus musculus
gctcccgggtatgagaagaattcca

SEQ ID NO: 115083 - DNA, 25 bp, Mus musculus
gctccctatggacaacaagaccaat

SEQ ID NO: 115084 - DNA, 25 bp, Mus musculus
gctccctcaactttggattatatgg

SEQ ID NO: 115085 - DNA, 25 bp, Mus musculus
gctccctcgctgtgcagactttcgt

SEQ ID NO: 115086 - DNA, 25 bp, Mus musculus
gctccctgatgtggtgctgctgaac

SEQ ID NO: 115087 - DNA, 25 bp, Mus musculus
gctcccttgggatacaaagaaccag

SEQ ID NO: 115088 - DNA, 25 bp, Mus musculus
gctccgatggaaagaggaaccccaa

SEQ ID NO: 115089 - DNA, 25 bp, Mus musculus
gctccgcgatgggagccggagcggc

SEQ ID NO: 115090 - DNA, 25 bp, Mus musculus
gctccgcggttgacagacacagtgt

SEQ ID NO: 115091 - DNA, 25 bp, Mus musculus
gctccgcttccagactgaggatgat

SEQ ID NO: 115092 - DNA, 25 bp, Mus musculus
gctccggactctttcccgatgacgt

SEQ ID NO: 115093 - DNA, 25 bp, Mus musculus
gctccggcaaaaaatatcaagtctg

SEQ ID NO: 115094 - DNA, 25 bp, Mus musculus
gctccgggaggagtggatctgctcc

SEQ ID NO: 115095 - DNA, 25 bp, Mus musculus
gctccgggagttgctagacttcaca

SEQ ID NO: 115096 - DNA, 25 bp, Mus musculus
gctccgggcagagaacaagtcagct

SEQ ID NO: 115097 - DNA, 25 bp, Mus musculus
gctccgggtcttgccagatgctgtg

SEQ ID NO: 115098 - DNA, 25 bp, Mus musculus
gctccgtacgcaaggaagacattca

SEQ ID NO: 115099 - DNA, 25 bp, Mus musculus
gctccgtgacaaaagcgcagttgca

SEQ ID NO: 115100 - DNA, 25 bp, Mus musculus
gctccgttccatcgctgtctactat

SEQ ID NO: 115101 - DNA, 25 bp, Mus musculus
gctcctaaatgaacatggaccaaac

SEQ ID NO: 115102 - DNA, 25 bp, Mus musculus
gctcctcccagatgaagagtggctt

SEQ ID NO: 115103 - DNA, 25 bp, Mus musculus
gctcctcccctggtaaagcaatagg

SEQ ID NO: 115104 - DNA, 25 bp, Mus musculus
gctcctccggcagcgacggggttaa

SEQ ID NO: 115105 - DNA, 25 bp, Mus musculus
gctcctccgggacagaatagtctta

SEQ ID NO: 115106 - DNA, 25 bp, Mus musculus
gctcctctgccatatccagcgtggg

SEQ ID NO: 115107 - DNA, 25 bp, Mus musculus
gctcctgaaggaggttcccgagatg

SEQ ID NO: 115108 - DNA, 25 bp, Mus musculus
gctcctgaccacgagaaggcttgtg

SEQ ID NO: 115109 - DNA, 25 bp, Mus musculus
gctcctgactggctacgcggcaaag

SEQ ID NO: 115110 - DNA, 25 bp, Mus musculus
gctcctgagaaagatcgaatgccat

SEQ ID NO: 115111 - DNA, 25 bp, Mus musculus
gctcctgatccttgaacatgtcgca

SEQ ID NO: 115112 - DNA, 25 bp, Mus musculus
gctcctgcccttggtctggtcggaa

SEQ ID NO: 115113 - DNA, 25 bp, Mus musculus
gctcctgcctcgcagttctggcttg

SEQ ID NO: 115114 - DNA, 25 bp, Mus musculus
gctcctgctttctatggctttaaaa

SEQ ID NO: 115115 - DNA, 25 bp, Mus musculus
gctcctggaaggaccctgaagctga

SEQ ID NO: 115116 - DNA, 25 bp, Mus musculus
gctcctggaatgtgagcagacctct

SEQ ID NO: 115117 - DNA, 25 bp, Mus musculus
gctcctggaggctttgtacccaaaa

SEQ ID NO: 115118 - DNA, 25 bp, Mus musculus
gctcctggccacacggatagaagtg

SEQ ID NO: 115119 - DNA, 25 bp, Mus musculus
gctcctgggactacaaggtgacaca

SEQ ID NO: 115120 - DNA, 25 bp, Mus musculus
gctcctgggagttacagcctactat

SEQ ID NO: 115121 - DNA, 25 bp, Mus musculus
gctcctggtaaagctgtgggctcac

SEQ ID NO: 115122 - DNA, 25 bp, Mus musculus
gctcctggtagtggcacgaggctct

SEQ ID NO: 115123 - DNA, 25 bp, Mus musculus
gctcctgtccagaagtcaagtacga

SEQ ID NO: 115124 - DNA, 25 bp, Mus musculus
gctcctgtgaggatctgaactgcaa

SEQ ID NO: 115125 - DNA, 25 bp, Mus musculus
gctccttattcaggcagcttgcaag

SEQ ID NO: 115126 - DNA, 25 bp, Mus musculus
gctccttcagggtggacgttacgaa

SEQ ID NO: 115127 - DNA, 25 bp, Mus musculus
gctccttccatagtgcctgttctga

SEQ ID NO: 115128 - DNA, 25 bp, Mus musculus
gctccttcgttgtggatcgggaaca

SEQ ID NO: 115129 - DNA, 25 bp, Mus musculus
gctccttgcagggagagacattgaa

SEQ ID NO: 115130 - DNA, 25 bp, Mus musculus
gctcctttacagacagctcagaggg

SEQ ID NO: 115131 - DNA, 25 bp, Mus musculus
gctcctttgacgcagtgggtcctcg

SEQ ID NO: 115132 - DNA, 25 bp, Mus musculus
gctcctttgctaacccagactcgaa

SEQ ID NO: 115133 - DNA, 25 bp, Mus musculus
gctcgaaagctacctgaacctggcg

SEQ ID NO: 115134 - DNA, 25 bp, Mus musculus
gctcgaccagatagcgccgctatgt

SEQ ID NO: 115135 - DNA, 25 bp, Mus musculus
gctcgacgccatgagtaggtacacc

SEQ ID NO: 115136 - DNA, 25 bp, Mus musculus
gctcgagaaagaggccacagtgaag

SEQ ID NO: 115137 - DNA, 25 bp, Mus musculus
gctcgagcggccgtcgccattttgt

SEQ ID NO: 115138 - DNA, 25 bp, Mus musculus
gctcgaggccgaaggatgtttgacc

SEQ ID NO: 115139 - DNA, 25 bp, Mus musculus
gctcgagtctctttgctgcgctcaa

SEQ ID NO: 115140 - DNA, 25 bp, Mus musculus
gctcgcaaggtggtctcctgcctgt

SEQ ID NO: 115141 - DNA, 25 bp, Mus musculus
gctcgcacagatagtccaggcttgg

SEQ ID NO: 115142 - DNA, 25 bp, Mus musculus
gctcgcctgctcgtcgggtgtagta

SEQ ID NO: 115143 - DNA, 25 bp, Mus musculus
gctcgcgcactcagcgggttgtgct

SEQ ID NO: 115144 - DNA, 25 bp, Mus musculus
gctcgcggcactgtctataaagttg

SEQ ID NO: 115145 - DNA, 25 bp, Mus musculus
gctcgctaggcgtctatctacagga

SEQ ID NO: 115146 - DNA, 25 bp, Mus musculus
gctcgctcggacagtcggagccatg

SEQ ID NO: 115147 - DNA, 25 bp, Mus musculus
gctcgctgctgtctagatgttacca

SEQ ID NO: 115148 - DNA, 25 bp, Mus musculus
gctcgcttgcctgttcctgaaacgg

SEQ ID NO: 115149 - DNA, 25 bp, Mus musculus
gctcggaacctgttggactctcaca

SEQ ID NO: 115150 - DNA, 25 bp, Mus musculus
gctcggaacttcctcagggccatga

SEQ ID NO: 115151 - DNA, 25 bp, Mus musculus
gctcggacgctggattaacacctgt

SEQ ID NO: 115152 - DNA, 25 bp, Mus musculus
gctcggagactaacagcaagaaccg

SEQ ID NO: 115153 - DNA, 25 bp, Mus musculus
gctcggatcattttacagcagatag

SEQ ID NO: 115154 - DNA, 25 bp, Mus musculus
gctcggcgctatggccttaaggata

SEQ ID NO: 115155 - DNA, 25 bp, Mus musculus
gctcggctctgctccttcgtgaggg

SEQ ID NO: 115156 - DNA, 25 bp, Mus musculus
gctcggctgcggaggtacaacgcgg

SEQ ID NO: 115157 - DNA, 25 bp, Mus musculus
gctcgggaccgatctggctaggcca

SEQ ID NO: 115158 - DNA, 25 bp, Mus musculus
gctcgggactcagacttcaatggaa

SEQ ID NO: 115159 - DNA, 25 bp, Mus musculus
gctcgggagagcaatccggctgccc

SEQ ID NO: 115160 - DNA, 25 bp, Mus musculus
gctcggtcacacatctgcaagaact

SEQ ID NO: 115161 - DNA, 25 bp, Mus musculus
gctcgtaagactcaaactcctgcag

SEQ ID NO: 115162 - DNA, 25 bp, Mus musculus
gctcgtcccttggtcagcatgaaaa

SEQ ID NO: 115163 - DNA, 25 bp, Mus musculus
gctcgtgggctccaatgaggtcaaa

SEQ ID NO: 115164 - DNA, 25 bp, Mus musculus
gctcgttcagaacagaatcccgctc

SEQ ID NO: 115165 - DNA, 25 bp, Mus musculus
gctcgtttgagaatgcaggaagatc

SEQ ID NO: 115166 - DNA, 25 bp, Mus musculus
gctctaaagaggatgagaaggctcc

SEQ ID NO: 115167 - DNA, 25 bp, Mus musculus
gctctaaaggtgatccggctgcagg

SEQ ID NO: 115168 - DNA, 25 bp, Mus musculus
gctctaaatcagatgcagtggcaga

SEQ ID NO: 115169 - DNA, 25 bp, Mus musculus
gctctaacgtttgcatataagggaa

SEQ ID NO: 115170 - DNA, 25 bp, Mus musculus
gctctaagactgaggtagtcgcgtt

SEQ ID NO: 115171 - DNA, 25 bp, Mus musculus
gctctacaaccactaccgacatgat

SEQ ID NO: 115172 - DNA, 25 bp, Mus musculus
gctctaccctctatcactgcacaag

SEQ ID NO: 115173 - DNA, 25 bp, Mus musculus
gctctaccggaacagcttagctcat

SEQ ID NO: 115174 - DNA, 25 bp, Mus musculus
gctctaccggactacgagtatctgg

SEQ ID NO: 115175 - DNA, 25 bp, Mus musculus
gctctacggtatctggcagcagcca

SEQ ID NO: 115176 - DNA, 25 bp, Mus musculus
gctctactacggctggaagttcctg

SEQ ID NO: 115177 - DNA, 25 bp, Mus musculus
gctctactagactttcttacagatt

SEQ ID NO: 115178 - DNA, 25 bp, Mus musculus
gctctactcagagggagatcctgga

SEQ ID NO: 115179 - DNA, 25 bp, Mus musculus
gctctactggacttttgtctccccg

SEQ ID NO: 115180 - DNA, 25 bp, Mus musculus
gctctagaaggaggcgaccgactga

SEQ ID NO: 115181 - DNA, 25 bp, Mus musculus
gctctagccagaggacctactgtgg

SEQ ID NO: 115182 - DNA, 25 bp, Mus musculus
gctctataacaacaccattaaagtg

SEQ ID NO: 115183 - DNA, 25 bp, Mus musculus
gctctataacggaccctgctggaaa

SEQ ID NO: 115184 - DNA, 25 bp, Mus musculus
gctctatctgacaatggctggtgcc

SEQ ID NO: 115185 - DNA, 25 bp, Mus musculus
gctctatgaactgctggctacccaa

SEQ ID NO: 115186 - DNA, 25 bp, Mus musculus
gctctatggtgacccgaatctccgc

SEQ ID NO: 115187 - DNA, 25 bp, Mus musculus
gctctattcatgaagtgccactatt

SEQ ID NO: 115188 - DNA, 25 bp, Mus musculus
gctctatttaagcagcagccgtgta

SEQ ID NO: 115189 - DNA, 25 bp, Mus musculus
gctctcaagaaaatggcctgcatag

SEQ ID NO: 115190 - DNA, 25 bp, Mus musculus
gctctcagactgatacagttttcag

SEQ ID NO: 115191 - DNA, 25 bp, Mus musculus
gctctcagagttcaggactccggac

SEQ ID NO: 115192 - DNA, 25 bp, Mus musculus
gctctcagcacctagtaacaaatgt

SEQ ID NO: 115193 - DNA, 25 bp, Mus musculus
gctctcagccataaggatgccatct

SEQ ID NO: 115194 - DNA, 25 bp, Mus musculus
gctctcatcaggtgcgaagtgcaga

SEQ ID NO: 115195 - DNA, 25 bp, Mus musculus
gctctccagctgacccaggtttctt

SEQ ID NO: 115196 - DNA, 25 bp, Mus musculus
gctctccagctgttcctaggccggg

SEQ ID NO: 115197 - DNA, 25 bp, Mus musculus
gctctccaggcctagcaagggattt

SEQ ID NO: 115198 - DNA, 25 bp, Mus musculus
gctctccagggatcacaggttcaaa

SEQ ID NO: 115199 - DNA, 25 bp, Mus musculus
gctctccattggaagcataagtgct

SEQ ID NO: 115200 - DNA, 25 bp, Mus musculus
gctctcccgatcatggcttcttcga

SEQ ID NO: 115201 - DNA, 25 bp, Mus musculus
gctctccgggagaaaaaggtcgtct

SEQ ID NO: 115202 - DNA, 25 bp, Mus musculus
gctctcctggaacttaaaagtaagt

SEQ ID NO: 115203 - DNA, 25 bp, Mus musculus
gctctcctggttggcggctttctca

SEQ ID NO: 115204 - DNA, 25 bp, Mus musculus
gctctccttggtggaagccttgagg

SEQ ID NO: 115205 - DNA, 25 bp, Mus musculus
gctctcgagttgcatcgctgacgta

SEQ ID NO: 115206 - DNA, 25 bp, Mus musculus
gctctcgcgagctttgtctggaaga

SEQ ID NO: 115207 - DNA, 25 bp, Mus musculus
gctctcggcttagggcatggatgct

SEQ ID NO: 115208 - DNA, 25 bp, Mus musculus
gctctctaaagctagtgaccccaga

SEQ ID NO: 115209 - DNA, 25 bp, Mus musculus
gctctctctggcaattgggctagat

SEQ ID NO: 115210 - DNA, 25 bp, Mus musculus
gctctctgaaaggagggcactctct

SEQ ID NO: 115211 - DNA, 25 bp, Mus musculus
gctctctgaactccgagggctgtcc

SEQ ID NO: 115212 - DNA, 25 bp, Mus musculus
gctctctggaacacatgcttggtca

SEQ ID NO: 115213 - DNA, 25 bp, Mus musculus
gctctcttctagttagtattaattg

SEQ ID NO: 115214 - DNA, 25 bp, Mus musculus
gctctgaaagggggaagctccctcc

SEQ ID NO: 115215 - DNA, 25 bp, Mus musculus
gctctgaacccgagaaagttgataa

SEQ ID NO: 115216 - DNA, 25 bp, Mus musculus
gctctgaagcggatgttgaatttca

SEQ ID NO: 115217 - DNA, 25 bp, Mus musculus
gctctgaagtgtgtcggcagctacc

SEQ ID NO: 115218 - DNA, 25 bp, Mus musculus
gctctgaatagttgggcagcatcca

SEQ ID NO: 115219 - DNA, 25 bp, Mus musculus
gctctgaatatgagacgatgctgac

SEQ ID NO: 115220 - DNA, 25 bp, Mus musculus
gctctgaatgcaacggatgctgtca

SEQ ID NO: 115221 - DNA, 25 bp, Mus musculus
gctctgacatcctgatggaggcgct

SEQ ID NO: 115222 - DNA, 25 bp, Mus musculus
gctctgaccaatggaggcctgaacc

SEQ ID NO: 115223 - DNA, 25 bp, Mus musculus
gctctgagagtgtagcttgggtcta

SEQ ID NO: 115224 - DNA, 25 bp, Mus musculus
gctctgaggtacctgaactttttca

SEQ ID NO: 115225 - DNA, 25 bp, Mus musculus
gctctgatactggagacggcgtctg

SEQ ID NO: 115226 - DNA, 25 bp, Mus musculus
gctctgatgagagtagatatggcca

SEQ ID NO: 115227 - DNA, 25 bp, Mus musculus
gctctgatgcagaagaaccggcgca

SEQ ID NO: 115228 - DNA, 25 bp, Mus musculus
gctctgatggccagacatatgggaa

SEQ ID NO: 115229 - DNA, 25 bp, Mus musculus
gctctgcagttttcatcccgtggga

SEQ ID NO: 115230 - DNA, 25 bp, Mus musculus
gctctgcatgagttcaaacctgtcg

SEQ ID NO: 115231 - DNA, 25 bp, Mus musculus
gctctgccacgcctgtaagcgacgt

SEQ ID NO: 115232 - DNA, 25 bp, Mus musculus
gctctgccgcactcatgcctggaaa

SEQ ID NO: 115233 - DNA, 25 bp, Mus musculus
gctctgccttagactgtgttctcag

SEQ ID NO: 115234 - DNA, 25 bp, Mus musculus
gctctgcgtaaactggatgacacca

SEQ ID NO: 115235 - DNA, 25 bp, Mus musculus
gctctgctaagcatatggaccgaga

SEQ ID NO: 115236 - DNA, 25 bp, Mus musculus
gctctgctagatattagctggttta

SEQ ID NO: 115237 - DNA, 25 bp, Mus musculus
gctctgctcggtacaacttagcgat

SEQ ID NO: 115238 - DNA, 25 bp, Mus musculus
gctctgctcttctggacaatgtgga

SEQ ID NO: 115239 - DNA, 25 bp, Mus musculus
gctctgctggctctgaaaaattcgt

SEQ ID NO: 115240 - DNA, 25 bp, Mus musculus
gctctgctgggtctaggtcttgtca

SEQ ID NO: 115241 - DNA, 25 bp, Mus musculus
gctctgctgtgtgctgtcaccgtca

SEQ ID NO: 115242 - DNA, 25 bp, Mus musculus
gctctggaatcaaaactgcactgtc

SEQ ID NO: 115243 - DNA, 25 bp, Mus musculus
gctctggacaaagtattccgaccag

SEQ ID NO: 115244 - DNA, 25 bp, Mus musculus
gctctggagtcaagtacaccaagtc

SEQ ID NO: 115245 - DNA, 25 bp, Mus musculus
gctctggcattgtgggccaacgcct

SEQ ID NO: 115246 - DNA, 25 bp, Mus musculus
gctctggccgccgttataagtgcct

SEQ ID NO: 115247 - DNA, 25 bp, Mus musculus
gctctgggccaccatggaatgttcc

SEQ ID NO: 115248 - DNA, 25 bp, Mus musculus
gctctgggttagcagatgccacagc

SEQ ID NO: 115249 - DNA, 25 bp, Mus musculus
gctctgtaagcagaataagctcatt

SEQ ID NO: 115250 - DNA, 25 bp, Mus musculus
gctctgtacaactcaatcaagaacg

SEQ ID NO: 115251 - DNA, 25 bp, Mus musculus
gctctgtaggcttggcactggctta

SEQ ID NO: 115252 - DNA, 25 bp, Mus musculus
gctctgtagggaagacagctctgtc

SEQ ID NO: 115253 - DNA, 25 bp, Mus musculus
gctctgtccgcattgatcagctgga

SEQ ID NO: 115254 - DNA, 25 bp, Mus musculus
gctctgtcggaagaacgcggcatta

SEQ ID NO: 115255 - DNA, 25 bp, Mus musculus
gctctgtcgtgaaaagcagcataca

SEQ ID NO: 115256 - DNA, 25 bp, Mus musculus
gctctgtgctgctacttgggcggca

SEQ ID NO: 115257 - DNA, 25 bp, Mus musculus
gctctgtgctgctaggttgtggcca

SEQ ID NO: 115258 - DNA, 25 bp, Mus musculus
gctctgtggagagagtgaacaaact

SEQ ID NO: 115259 - DNA, 25 bp, Mus musculus
gctctgtgtcaacccagaacctcaa

SEQ ID NO: 115260 - DNA, 25 bp, Mus musculus
gctctgtgtgcagtctgtgaagacc

SEQ ID NO: 115261 - DNA, 25 bp, Mus musculus
gctctgttacaacgctgcatgtgca

SEQ ID NO: 115262 - DNA, 25 bp, Mus musculus
gctctgttatgctgcgtggccccat

SEQ ID NO: 115263 - DNA, 25 bp, Mus musculus
gctcttaatgaagtcgacgatgcag

SEQ ID NO: 115264 - DNA, 25 bp, Mus musculus
gctcttcagaagaggatcaccctga

SEQ ID NO: 115265 - DNA, 25 bp, Mus musculus
gctcttcagctatatgcagtgggtg

SEQ ID NO: 115266 - DNA, 25 bp, Mus musculus
gctcttccaagtgtcactctgacag

SEQ ID NO: 115267 - DNA, 25 bp, Mus musculus
gctcttccccgtcgtggaggccatg

SEQ ID NO: 115268 - DNA, 25 bp, Mus musculus
gctcttcccggagagtgaactttcc

SEQ ID NO: 115269 - DNA, 25 bp, Mus musculus
gctcttcgcggcaaagtgcagcggc

SEQ ID NO: 115270 - DNA, 25 bp, Mus musculus
gctcttctcccacactcagctcagg

SEQ ID NO: 115271 - DNA, 25 bp, Mus musculus
gctcttctggactgattggctacaa

SEQ ID NO: 115272 - DNA, 25 bp, Mus musculus
gctcttgaagaagcagaaaagtata

SEQ ID NO: 115273 - DNA, 25 bp, Mus musculus
gctcttgaccgtgcgcaagcgcagt

SEQ ID NO: 115274 - DNA, 25 bp, Mus musculus
gctcttgccagaattaacaccgggt

SEQ ID NO: 115275 - DNA, 25 bp, Mus musculus
gctcttgccgcgtgctggtgttgga

SEQ ID NO: 115276 - DNA, 25 bp, Mus musculus
gctcttggacaagtacttcggcagc

SEQ ID NO: 115277 - DNA, 25 bp, Mus musculus
gctcttggacacacatggaaattct

SEQ ID NO: 115278 - DNA, 25 bp, Mus musculus
gctcttggttgctgtggccatcaca

SEQ ID NO: 115279 - DNA, 25 bp, Mus musculus
gctcttgtcctgcagacaatctggg

SEQ ID NO: 115280 - DNA, 25 bp, Mus musculus
gctcttgtctctctcggtgactgtc

SEQ ID NO: 115281 - DNA, 25 bp, Mus musculus
gctctttagagcagcaggacacctg

SEQ ID NO: 115282 - DNA, 25 bp, Mus musculus
gctctttagccagattggaccttgt

SEQ ID NO: 115283 - DNA, 25 bp, Mus musculus
gctctttatgccgacgttagtggaa

SEQ ID NO: 115284 - DNA, 25 bp, Mus musculus
gctctttcctgctcaacaccaacat

SEQ ID NO: 115285 - DNA, 25 bp, Mus musculus
gctctttctccttccagaacttcat

SEQ ID NO: 115286 - DNA, 25 bp, Mus musculus
gctctttgccaaactcgagaacatg

SEQ ID NO: 115287 - DNA, 25 bp, Mus musculus
gctctttgccgacatcctcaacgat

SEQ ID NO: 115288 - DNA, 25 bp, Mus musculus
gctcttttgtcacaaagagtcctaa

SEQ ID NO: 115289 - DNA, 25 bp, Mus musculus
gctctttttagcagcgctagtccgg

SEQ ID NO: 115290 - DNA, 25 bp, Mus musculus
gctgaaaacctgagacgccgtctag

SEQ ID NO: 115291 - DNA, 25 bp, Mus musculus
gctgaaaactatgatctggctctaa

SEQ ID NO: 115292 - DNA, 25 bp, Mus musculus
gctgaaaagcaagtatgaggacctc

SEQ ID NO: 115293 - DNA, 25 bp, Mus musculus
gctgaaacaccaaaaagagcagtca

SEQ ID NO: 115294 - DNA, 25 bp, Mus musculus
gctgaaacatccaaagtgctccgtg

SEQ ID NO: 115295 - DNA, 25 bp, Mus musculus
gctgaaacttatgcccgttaccggt

SEQ ID NO: 115296 - DNA, 25 bp, Mus musculus
gctgaaagacaaagggccactctgg

SEQ ID NO: 115297 - DNA, 25 bp, Mus musculus
gctgaaagatttactgcccgaacat

SEQ ID NO: 115298 - DNA, 25 bp, Mus musculus
gctgaaagggctggacacttacttc

SEQ ID NO: 115299 - DNA, 25 bp, Mus musculus
gctgaaatagcaagtcttgattcag

SEQ ID NO: 115300 - DNA, 25 bp, Mus musculus
gctgaaatcatcatccttgtggtga

SEQ ID NO: 115301 - DNA, 25 bp, Mus musculus
gctgaaatccgtgaagagcagtttt

SEQ ID NO: 115302 - DNA, 25 bp, Mus musculus
gctgaaattgacaagttggccactg

SEQ ID NO: 115303 - DNA, 25 bp, Mus musculus
gctgaaattgtcaggagctcctccg

SEQ ID NO: 115304 - DNA, 25 bp, Mus musculus
gctgaacaaatgctgaaggtctgac

SEQ ID NO: 115305 - DNA, 25 bp, Mus musculus
gctgaacagaaaagctaaggagctg

SEQ ID NO: 115306 - DNA, 25 bp, Mus musculus
gctgaacagactttggagccatgaa

SEQ ID NO: 115307 - DNA, 25 bp, Mus musculus
gctgaacagcaaccctggagagaag

SEQ ID NO: 115308 - DNA, 25 bp, Mus musculus
gctgaaccaagaaaaggccaacctg

SEQ ID NO: 115309 - DNA, 25 bp, Mus musculus
gctgaaccagctatgggagaaggcc

SEQ ID NO: 115310 - DNA, 25 bp, Mus musculus
gctgaaccattagtcgtcgatctta

SEQ ID NO: 115311 - DNA, 25 bp, Mus musculus
gctgaaccatttcttagtgggacta

SEQ ID NO: 115312 - DNA, 25 bp, Mus musculus
gctgaaccttttgcaacttagaggg

SEQ ID NO: 115313 - DNA, 25 bp, Mus musculus
gctgaacgaattgcttgaggccatc

SEQ ID NO: 115314 - DNA, 25 bp, Mus musculus
gctgaacgacgtgaagaccctggtc

SEQ ID NO: 115315 - DNA, 25 bp, Mus musculus
gctgaacgagctagaaccggagaag

SEQ ID NO: 115316 - DNA, 25 bp, Mus musculus
gctgaactacagccatatctggacc

SEQ ID NO: 115317 - DNA, 25 bp, Mus musculus
gctgaactcccgtgtccatggtgga

SEQ ID NO: 115318 - DNA, 25 bp, Mus musculus
gctgaactgacatgaacaaccgaga

SEQ ID NO: 115319 - DNA, 25 bp, Mus musculus
gctgaactgtctgaaggagatccca

SEQ ID NO: 115320 - DNA, 25 bp, Mus musculus
gctgaagaacgctgaccaactgaaa

SEQ ID NO: 115321 - DNA, 25 bp, Mus musculus
gctgaagaatgatgccccggttgtg

SEQ ID NO: 115322 - DNA, 25 bp, Mus musculus
gctgaagaccctgaacgtggagtcc

SEQ ID NO: 115323 - DNA, 25 bp, Mus musculus
gctgaagaccctgtagaatctactg

SEQ ID NO: 115324 - DNA, 25 bp, Mus musculus
gctgaagactaagaccctaagggaa

SEQ ID NO: 115325 - DNA, 25 bp, Mus musculus
gctgaagactccacccaggacgtta

SEQ ID NO: 115326 - DNA, 25 bp, Mus musculus
gctgaagatccagttgcaagatgca

SEQ ID NO: 115327 - DNA, 25 bp, Mus musculus
gctgaagccatcaagaaccatgagg

SEQ ID NO: 115328 - DNA, 25 bp, Mus musculus
gctgaagcccgctctgcctttgcat

SEQ ID NO: 115329 - DNA, 25 bp, Mus musculus
gctgaagccgttatccaggattcta

SEQ ID NO: 115330 - DNA, 25 bp, Mus musculus
gctgaagccttatgtggcggcccaa

SEQ ID NO: 115331 - DNA, 25 bp, Mus musculus
gctgaagcgagaaaccgcatgggaa

SEQ ID NO: 115332 - DNA, 25 bp, Mus musculus
gctgaagcgccacactgaatatatt

SEQ ID NO: 115333 - DNA, 25 bp, Mus musculus
gctgaagcggccattgataatgaaa

SEQ ID NO: 115334 - DNA, 25 bp, Mus musculus
gctgaagctgctcgtctacggtccc

SEQ ID NO: 115335 - DNA, 25 bp, Mus musculus
gctgaagctgggtacgttggaaaca

SEQ ID NO: 115336 - DNA, 25 bp, Mus musculus
gctgaagctgtttgtggtactagag

SEQ ID NO: 115337 - DNA, 25 bp, Mus musculus
gctgaaggaaagaacgccatcctta

SEQ ID NO: 115338 - DNA, 25 bp, Mus musculus
gctgaaggacagcatttccaccatg

SEQ ID NO: 115339 - DNA, 25 bp, Mus musculus
gctgaaggagaaactacgagacgtc

SEQ ID NO: 115340 - DNA, 25 bp, Mus musculus
gctgaaggagtcactagggacccct

SEQ ID NO: 115341 - DNA, 25 bp, Mus musculus
gctgaaggatacatgtggtgccaat

SEQ ID NO: 115342 - DNA, 25 bp, Mus musculus
gctgaaggtaaggaagaggacacac

SEQ ID NO: 115343 - DNA, 25 bp, Mus musculus
gctgaagtaaaaggcaaggagcaag

SEQ ID NO: 115344 - DNA, 25 bp, Mus musculus
gctgaagtctgtgctgggatttaag

SEQ ID NO: 115345 - DNA, 25 bp, Mus musculus
gctgaagtgagtgcaggatgctctt

SEQ ID NO: 115346 - DNA, 25 bp, Mus musculus
gctgaagtgctttgccaacggaggc

SEQ ID NO: 115347 - DNA, 25 bp, Mus musculus
gctgaagtttcaagacaccgacatc

SEQ ID NO: 115348 - DNA, 25 bp, Mus musculus
gctgaatacctttcggcgcactggg

SEQ ID NO: 115349 - DNA, 25 bp, Mus musculus
gctgaatcagcacgttgtcatccaa

SEQ ID NO: 115350 - DNA, 25 bp, Mus musculus
gctgaatcgcacgtaggtggtacct

SEQ ID NO: 115351 - DNA, 25 bp, Mus musculus
gctgaatctcctctcatgggtggca

SEQ ID NO: 115352 - DNA, 25 bp, Mus musculus
gctgaatgaagttgggccagacgct

SEQ ID NO: 115353 - DNA, 25 bp, Mus musculus
gctgaatgactccaaagagtaccca

SEQ ID NO: 115354 - DNA, 25 bp, Mus musculus
gctgaatgagcaccgaaggatccac

SEQ ID NO: 115355 - DNA, 25 bp, Mus musculus
gctgaatgagttctgggacgtcctc

SEQ ID NO: 115356 - DNA, 25 bp, Mus musculus
gctgaatgcagagctcagaggccgt

SEQ ID NO: 115357 - DNA, 25 bp, Mus musculus
gctgaatgcagtgcgcaggcaagct

SEQ ID NO: 115358 - DNA, 25 bp, Mus musculus
gctgaatgctcaggactcttgggtc

SEQ ID NO: 115359 - DNA, 25 bp, Mus musculus
gctgaattttcccaaatgcgacagg

SEQ ID NO: 115360 - DNA, 25 bp, Mus musculus
gctgacaaaaaggaccgagacgcat

SEQ ID NO: 115361 - DNA, 25 bp, Mus musculus
gctgacaacatggatgcttacctgg

SEQ ID NO: 115362 - DNA, 25 bp, Mus musculus
gctgacaagagcctaacaagtgcca

SEQ ID NO: 115363 - DNA, 25 bp, Mus musculus
gctgacaaggccgacagtgtgactc

SEQ ID NO: 115364 - DNA, 25 bp, Mus musculus
gctgacaagtaaccacggacaggcc

SEQ ID NO: 115365 - DNA, 25 bp, Mus musculus
gctgacagactgtgggccttgtgca

SEQ ID NO: 115366 - DNA, 25 bp, Mus musculus
gctgacagaggtcttcacccagagg

SEQ ID NO: 115367 - DNA, 25 bp, Mus musculus
gctgacagctgtcgaactcacagaa

SEQ ID NO: 115368 - DNA, 25 bp, Mus musculus
gctgacatctgtgcgaaactctgcc

SEQ ID NO: 115369 - DNA, 25 bp, Mus musculus
gctgacatgggacacttaaagtatt

SEQ ID NO: 115370 - DNA, 25 bp, Mus musculus
gctgacattctggttatcgctgcct

SEQ ID NO: 115371 - DNA, 25 bp, Mus musculus
gctgacattgacatcgacactgtag

SEQ ID NO: 115372 - DNA, 25 bp, Mus musculus
gctgacatttgcctctaccctggaa

SEQ ID NO: 115373 - DNA, 25 bp, Mus musculus
gctgaccaatgaggacagagctctt

SEQ ID NO: 115374 - DNA, 25 bp, Mus musculus
gctgaccatcaaaagcaacgacttt

SEQ ID NO: 115375 - DNA, 25 bp, Mus musculus
gctgaccatggagtataacgagaag

SEQ ID NO: 115376 - DNA, 25 bp, Mus musculus
gctgaccctcacagtccatttagga

SEQ ID NO: 115377 - DNA, 25 bp, Mus musculus
gctgaccctgcggacgtgagcttgc

SEQ ID NO: 115378 - DNA, 25 bp, Mus musculus
gctgaccgggcagagattgaacttc

SEQ ID NO: 115379 - DNA, 25 bp, Mus musculus
gctgacctgaagctctttgcctaga

SEQ ID NO: 115380 - DNA, 25 bp, Mus musculus
gctgacctgcggagacagccacctt

SEQ ID NO: 115381 - DNA, 25 bp, Mus musculus
gctgacgaagttgatcaatgccgag

SEQ ID NO: 115382 - DNA, 25 bp, Mus musculus
gctgacggacgttttgagggctctc

SEQ ID NO: 115383 - DNA, 25 bp, Mus musculus
gctgacggcattcaagaccgctgta

SEQ ID NO: 115384 - DNA, 25 bp, Mus musculus
gctgacgtcacctaacttcatcctg

SEQ ID NO: 115385 - DNA, 25 bp, Mus musculus
gctgacgtcaggagccaaaatggcg

SEQ ID NO: 115386 - DNA, 25 bp, Mus musculus
gctgactaagccagtggtgctgatc

SEQ ID NO: 115387 - DNA, 25 bp, Mus musculus
gctgactcatacgaaaaactggaaa

SEQ ID NO: 115388 - DNA, 25 bp, Mus musculus
gctgactgaattccctctgcgcatg

SEQ ID NO: 115389 - DNA, 25 bp, Mus musculus
gctgactgctacacccaggactttg

SEQ ID NO: 115390 - DNA, 25 bp, Mus musculus
gctgactggaggcagtgtcaaacca

SEQ ID NO: 115391 - DNA, 25 bp, Mus musculus
gctgactggttaggccttaaggaca

SEQ ID NO: 115392 - DNA, 25 bp, Mus musculus
gctgacttaagaagaaggttgtctg

SEQ ID NO: 115393 - DNA, 25 bp, Mus musculus
gctgacttccgcgactggagccgtg

SEQ ID NO: 115394 - DNA, 25 bp, Mus musculus
gctgacttctgctaagaggcttcca

SEQ ID NO: 115395 - DNA, 25 bp, Mus musculus
gctgactttgatccaccagaggtgg

SEQ ID NO: 115396 - DNA, 25 bp, Mus musculus
gctgactttgcgaaggaaacccgga

SEQ ID NO: 115397 - DNA, 25 bp, Mus musculus
gctgagaaactccagaaggcctttg

SEQ ID NO: 115398 - DNA, 25 bp, Mus musculus
gctgagaaagtcctcgctggcaaat

SEQ ID NO: 115399 - DNA, 25 bp, Mus musculus
gctgagacagggagagtcatctacg

SEQ ID NO: 115400 - DNA, 25 bp, Mus musculus
gctgagagcattgcattccgcaggc

SEQ ID NO: 115401 - DNA, 25 bp, Mus musculus
gctgagagccctgccctatgtctaa

SEQ ID NO: 115402 - DNA, 25 bp, Mus musculus
gctgagagctctgttcttgggtacc

SEQ ID NO: 115403 - DNA, 25 bp, Mus musculus
gctgagatcacgatgttccgcttca

SEQ ID NO: 115404 - DNA, 25 bp, Mus musculus
gctgagattccgttgcgcatgcgca

SEQ ID NO: 115405 - DNA, 25 bp, Mus musculus
gctgagcaagcgtgaagtggtccca

SEQ ID NO: 115406 - DNA, 25 bp, Mus musculus
gctgagcaatgtgcacttcactgga

SEQ ID NO: 115407 - DNA, 25 bp, Mus musculus
gctgagcagcagaacaccacaaatt

SEQ ID NO: 115408 - DNA, 25 bp, Mus musculus
gctgagccccgtaaagagaagatga

SEQ ID NO: 115409 - DNA, 25 bp, Mus musculus
gctgagcctgaagctccctctggaa

SEQ ID NO: 115410 - DNA, 25 bp, Mus musculus
gctgagcctgagagtactggtgcca

SEQ ID NO: 115411 - DNA, 25 bp, Mus musculus
gctgagcgacaaaggaatgaagccc

SEQ ID NO: 115412 - DNA, 25 bp, Mus musculus
gctgagcgcggaacgtgcccgtaac

SEQ ID NO: 115413 - DNA, 25 bp, Mus musculus
gctgagcgcggaagccccacggcat

SEQ ID NO: 115414 - DNA, 25 bp, Mus musculus
gctgagcgctgggagttatgcccca

SEQ ID NO: 115415 - DNA, 25 bp, Mus musculus
gctgagcgcttagctgacaaatatg

SEQ ID NO: 115416 - DNA, 25 bp, Mus musculus
gctgagcggacagaggtgctgcggg

SEQ ID NO: 115417 - DNA, 25 bp, Mus musculus
gctgagctcattcttggaggcccaa

SEQ ID NO: 115418 - DNA, 25 bp, Mus musculus
gctgagctcctgacgcagaactaca

SEQ ID NO: 115419 - DNA, 25 bp, Mus musculus
gctgagctctcgaagcagaatggct

SEQ ID NO: 115420 - DNA, 25 bp, Mus musculus
gctgagctgagacaacagggttttc

SEQ ID NO: 115421 - DNA, 25 bp, Mus musculus
gctgagctggcagggcctaaacaac

SEQ ID NO: 115422 - DNA, 25 bp, Mus musculus
gctgagctggctgaattaccactga

SEQ ID NO: 115423 - DNA, 25 bp, Mus musculus
gctgagcttcaaggagggcgacctc

SEQ ID NO: 115424 - DNA, 25 bp, Mus musculus
gctgaggaatcgacagcccgtgcgc

SEQ ID NO: 115425 - DNA, 25 bp, Mus musculus
gctgaggagcagtttctggagcact

SEQ ID NO: 115426 - DNA, 25 bp, Mus musculus
gctgaggagctagccaaatgacctt

SEQ ID NO: 115427 - DNA, 25 bp, Mus musculus
gctgaggagtataggaatcaacttc

SEQ ID NO: 115428 - DNA, 25 bp, Mus musculus
gctgaggcaattctgtgactggaca

SEQ ID NO: 115429 - DNA, 25 bp, Mus musculus
gctgaggctgacagtgggctctcca

SEQ ID NO: 115430 - DNA, 25 bp, Mus musculus
gctgaggctgcagcccgagtggagc

SEQ ID NO: 115431 - DNA, 25 bp, Mus musculus
gctgaggtcccatcatcagactgtg

SEQ ID NO: 115432 - DNA, 25 bp, Mus musculus
gctgaggtccggaaccaattctagg

SEQ ID NO: 115433 - DNA, 25 bp, Mus musculus
gctgaggtgtgtacaaggccaccga

SEQ ID NO: 115434 - DNA, 25 bp, Mus musculus
gctgagtaagatgagctccctcctg

SEQ ID NO: 115435 - DNA, 25 bp, Mus musculus
gctgagtagggttttcagacacccc

SEQ ID NO: 115436 - DNA, 25 bp, Mus musculus
gctgagtgaactgtaactgttaaac

SEQ ID NO: 115437 - DNA, 25 bp, Mus musculus
gctgagtgagaaaaagcaggccttt

SEQ ID NO: 115438 - DNA, 25 bp, Mus musculus
gctgagttcttctggccgtgtatcc

SEQ ID NO: 115439 - DNA, 25 bp, Mus musculus
gctgataaccaatactgaccggcga

SEQ ID NO: 115440 - DNA, 25 bp, Mus musculus
gctgataataggaagatgtcccgga

SEQ ID NO: 115441 - DNA, 25 bp, Mus musculus
gctgataatgaaccgagctgctctc

SEQ ID NO: 115442 - DNA, 25 bp, Mus musculus
gctgatacagaggagacggtcactt

SEQ ID NO: 115443 - DNA, 25 bp, Mus musculus
gctgatacagtacgcactggaccag

SEQ ID NO: 115444 - DNA, 25 bp, Mus musculus
gctgatactgctagtggcccggaaa

SEQ ID NO: 115445 - DNA, 25 bp, Mus musculus
gctgatcaacgtcaaaggcaaaggg

SEQ ID NO: 115446 - DNA, 25 bp, Mus musculus
gctgatcaagaagacaaacctggca

SEQ ID NO: 115447 - DNA, 25 bp, Mus musculus
gctgatcaaggaaggcgacacagcc

SEQ ID NO: 115448 - DNA, 25 bp, Mus musculus
gctgatcaggaagacatggctcaat

SEQ ID NO: 115449 - DNA, 25 bp, Mus musculus
gctgatcagtataagcccaaggcca

SEQ ID NO: 115450 - DNA, 25 bp, Mus musculus
gctgatccctatccagatgtttctg

SEQ ID NO: 115451 - DNA, 25 bp, Mus musculus
gctgatccggaaagcccagggtctt

SEQ ID NO: 115452 - DNA, 25 bp, Mus musculus
gctgatcgcgtacggcaatggcttt

SEQ ID NO: 115453 - DNA, 25 bp, Mus musculus
gctgatctgaactgcatgaaagatc

SEQ ID NO: 115454 - DNA, 25 bp, Mus musculus
gctgatctttcagagagctggccaa

SEQ ID NO: 115455 - DNA, 25 bp, Mus musculus
gctgatgaaaagcaggagctcgctt

SEQ ID NO: 115456 - DNA, 25 bp, Mus musculus
gctgatgaagcaccaaaccaatatt

SEQ ID NO: 115457 - DNA, 25 bp, Mus musculus
gctgatgatctgacaccgtccgtga

SEQ ID NO: 115458 - DNA, 25 bp, Mus musculus
gctgatgcaggtgaatgatacactg

SEQ ID NO: 115459 - DNA, 25 bp, Mus musculus
gctgatgcagttgttgtgctacccc

SEQ ID NO: 115460 - DNA, 25 bp, Mus musculus
gctgatgctgtctatcccctgggat

SEQ ID NO: 115461 - DNA, 25 bp, Mus musculus
gctgatggacaagcagaccttctgc

SEQ ID NO: 115462 - DNA, 25 bp, Mus musculus
gctgatggcaaagctgacggcccta

SEQ ID NO: 115463 - DNA, 25 bp, Mus musculus
gctgatggcactaaacactgttctc

SEQ ID NO: 115464 - DNA, 25 bp, Mus musculus
gctgatggctatgacctagagatcc

SEQ ID NO: 115465 - DNA, 25 bp, Mus musculus
gctgatggctccttctctgacgaga

SEQ ID NO: 115466 - DNA, 25 bp, Mus musculus
gctgatggctgtgaattggctgaaa

SEQ ID NO: 115467 - DNA, 25 bp, Mus musculus
gctgatggctttggagcagacactc

SEQ ID NO: 115468 - DNA, 25 bp, Mus musculus
gctgatgtggtagaagccttcctca

SEQ ID NO: 115469 - DNA, 25 bp, Mus musculus
gctgattaatcacacaaagaaactg

SEQ ID NO: 115470 - DNA, 25 bp, Mus musculus
gctgattatgagtacccaccgggac

SEQ ID NO: 115471 - DNA, 25 bp, Mus musculus
gctgattgacaagaccaaggtgaca

SEQ ID NO: 115472 - DNA, 25 bp, Mus musculus
gctgattggaagacccgccgatggt

SEQ ID NO: 115473 - DNA, 25 bp, Mus musculus
gctgatttgtacctattagattccc

SEQ ID NO: 115474 - DNA, 25 bp, Mus musculus
gctgattttcattcttccggctgcg

SEQ ID NO: 115475 - DNA, 25 bp, Mus musculus
gctgcaaaggcatctagttcccatt

SEQ ID NO: 115476 - DNA, 25 bp, Mus musculus
gctgcaagaagagtttcggaccctg

SEQ ID NO: 115477 - DNA, 25 bp, Mus musculus
gctgcaaggaaagcccagacaacag

SEQ ID NO: 115478 - DNA, 25 bp, Mus musculus
gctgcaagtcctaagcccgggaaat

SEQ ID NO: 115479 - DNA, 25 bp, Mus musculus
gctgcaatcatgctgataacgcttg

SEQ ID NO: 115480 - DNA, 25 bp, Mus musculus
gctgcacaatgtccgtcgagtctca

SEQ ID NO: 115481 - DNA, 25 bp, Mus musculus
gctgcacagactgaaagtggaccaa

SEQ ID NO: 115482 - DNA, 25 bp, Mus musculus
gctgcacctgcctatcatgggacta

SEQ ID NO: 115483 - DNA, 25 bp, Mus musculus
gctgcacgcacaagaacgaagtttt

SEQ ID NO: 115484 - DNA, 25 bp, Mus musculus
gctgcacggttgctcctggaagatc

SEQ ID NO: 115485 - DNA, 25 bp, Mus musculus
gctgcactagcatccagagtcagag

SEQ ID NO: 115486 - DNA, 25 bp, Mus musculus
gctgcactatagcatctgtagaggc

SEQ ID NO: 115487 - DNA, 25 bp, Mus musculus
gctgcactggtggaacgcctcttta

SEQ ID NO: 115488 - DNA, 25 bp, Mus musculus
gctgcacttgtgaggccacgtgtga

SEQ ID NO: 115489 - DNA, 25 bp, Mus musculus
gctgcagaacaagacacaggtggca

SEQ ID NO: 115490 - DNA, 25 bp, Mus musculus
gctgcagaacctccaggtgacaaag

SEQ ID NO: 115491 - DNA, 25 bp, Mus musculus
gctgcagaatgcatagcaccttaca

SEQ ID NO: 115492 - DNA, 25 bp, Mus musculus
gctgcagacatctttaaacactaca

SEQ ID NO: 115493 - DNA, 25 bp, Mus musculus
gctgcagagctatgcgcaggagatc

SEQ ID NO: 115494 - DNA, 25 bp, Mus musculus
gctgcagagttcaaaagggacaatt

SEQ ID NO: 115495 - DNA, 25 bp, Mus musculus
gctgcagatagcttccttgtggagc

SEQ ID NO: 115496 - DNA, 25 bp, Mus musculus
gctgcagcaagaaagggaacctacc

SEQ ID NO: 115497 - DNA, 25 bp, Mus musculus
gctgcagcactggagcgagtacatc

SEQ ID NO: 115498 - DNA, 25 bp, Mus musculus
gctgcagcagctcttgttgcaaaca

SEQ ID NO: 115499 - DNA, 25 bp, Mus musculus
gctgcagccaaccagagagtggaaa

SEQ ID NO: 115500 - DNA, 25 bp, Mus musculus
gctgcagccaagaagaacgaattga

SEQ ID NO: 115501 - DNA, 25 bp, Mus musculus
gctgcagccagcatcatgagctttg

SEQ ID NO: 115502 - DNA, 25 bp, Mus musculus
gctgcagccaggatcctacgttgct

SEQ ID NO: 115503 - DNA, 25 bp, Mus musculus
gctgcagccctcttcattgccaagg

SEQ ID NO: 115504 - DNA, 25 bp, Mus musculus
gctgcagcgagttctagagcaccgt

SEQ ID NO: 115505 - DNA, 25 bp, Mus musculus
gctgcagcgctgtgaactaaatcgg

SEQ ID NO: 115506 - DNA, 25 bp, Mus musculus
gctgcaggcaccgtaaacacaagtg

SEQ ID NO: 115507 - DNA, 25 bp, Mus musculus
gctgcaggccctgaaagttcaagca

SEQ ID NO: 115508 - DNA, 25 bp, Mus musculus
gctgcagggtgccttcccttccaag

SEQ ID NO: 115509 - DNA, 25 bp, Mus musculus
gctgcaggtccccaaaacaatagta

SEQ ID NO: 115510 - DNA, 25 bp, Mus musculus
gctgcagtcagtgccatgaccatga

SEQ ID NO: 115511 - DNA, 25 bp, Mus musculus
gctgcagtccgatgctcagcagctg

SEQ ID NO: 115512 - DNA, 25 bp, Mus musculus
gctgcagtcgcatgtgagccttctg

SEQ ID NO: 115513 - DNA, 25 bp, Mus musculus
gctgcagtcggagcgggttctctat

SEQ ID NO: 115514 - DNA, 25 bp, Mus musculus
gctgcagtgacatgtccagcatgaa

SEQ ID NO: 115515 - DNA, 25 bp, Mus musculus
gctgcagtgatactggagagcatct

SEQ ID NO: 115516 - DNA, 25 bp, Mus musculus
gctgcagtgctgttttgttaccgtg

SEQ ID NO: 115517 - DNA, 25 bp, Mus musculus
gctgcagtgtcagatccgcgggatc

SEQ ID NO: 115518 - DNA, 25 bp, Mus musculus
gctgcagttactggataaagccatg

SEQ ID NO: 115519 - DNA, 25 bp, Mus musculus
gctgcagttgaaatgtgcagttgtg

SEQ ID NO: 115520 - DNA, 25 bp, Mus musculus
gctgcagttgcagtatggactcgga

SEQ ID NO: 115521 - DNA, 25 bp, Mus musculus
gctgcataatagctcaggctccggg

SEQ ID NO: 115522 - DNA, 25 bp, Mus musculus
gctgcatccacggaggcggtgggct

SEQ ID NO: 115523 - DNA, 25 bp, Mus musculus
gctgcatccactccagacaagctgg

SEQ ID NO: 115524 - DNA, 25 bp, Mus musculus
gctgcatccgtgaggagtattcctg

SEQ ID NO: 115525 - DNA, 25 bp, Mus musculus
gctgcatctgaatcaaaagactgct

SEQ ID NO: 115526 - DNA, 25 bp, Mus musculus
gctgcatctggaggatacgtgaata

SEQ ID NO: 115527 - DNA, 25 bp, Mus musculus
gctgcatgaccacaacgacttgggc

SEQ ID NO: 115528 - DNA, 25 bp, Mus musculus
gctgcatgctgctggaaggactact

SEQ ID NO: 115529 - DNA, 25 bp, Mus musculus
gctgcattaaagaacggacacacca

SEQ ID NO: 115530 - DNA, 25 bp, Mus musculus
gctgcattcggagccgtacatcatg

SEQ ID NO: 115531 - DNA, 25 bp, Mus musculus
gctgcattcgggaggagactctcag

SEQ ID NO: 115532 - DNA, 25 bp, Mus musculus
gctgcattgcgagcatgtagacggt

SEQ ID NO: 115533 - DNA, 25 bp, Mus musculus
gctgcattttttctcacctatgaat

SEQ ID NO: 115534 - DNA, 25 bp, Mus musculus
gctgccaaagagcaaaaggaagtcc

SEQ ID NO: 115535 - DNA, 25 bp, Mus musculus
gctgccaagctgacccacaataagg

SEQ ID NO: 115536 - DNA, 25 bp, Mus musculus
gctgccaaggagacaggtagtatcc

SEQ ID NO: 115537 - DNA, 25 bp, Mus musculus
gctgccaagggctatagaagtgtgc

SEQ ID NO: 115538 - DNA, 25 bp, Mus musculus
gctgccacagtatgaggaaaccttc

SEQ ID NO: 115539 - DNA, 25 bp, Mus musculus
gctgccacccacgagttcaagcagg

SEQ ID NO: 115540 - DNA, 25 bp, Mus musculus
gctgccacgggtggagtaaacctcc

SEQ ID NO: 115541 - DNA, 25 bp, Mus musculus
gctgccagagtccaaagtaatcggt

SEQ ID NO: 115542 - DNA, 25 bp, Mus musculus
gctgccagctgctctgtcagtgcca

SEQ ID NO: 115543 - DNA, 25 bp, Mus musculus
gctgccagtgccaagcacctcatga

SEQ ID NO: 115544 - DNA, 25 bp, Mus musculus
gctgccatatgaggatgtcgccatt

SEQ ID NO: 115545 - DNA, 25 bp, Mus musculus
gctgccatgagcgtagagacgtgcc

SEQ ID NO: 115546 - DNA, 25 bp, Mus musculus
gctgccatgtcagaagactcttgcg

SEQ ID NO: 115547 - DNA, 25 bp, Mus musculus
gctgcccaacttcagcgagtgctgg

SEQ ID NO: 115548 - DNA, 25 bp, Mus musculus
gctgcccaagcggacagtaaagctg

SEQ ID NO: 115549 - DNA, 25 bp, Mus musculus
gctgcccactgtgcgggcagacctt

SEQ ID NO: 115550 - DNA, 25 bp, Mus musculus
gctgcccaggcagacatcggttctg

SEQ ID NO: 115551 - DNA, 25 bp, Mus musculus
gctgcccattctttcttatcatcaa

SEQ ID NO: 115552 - DNA, 25 bp, Mus musculus
gctgccccaggtcctaactgaagaa

SEQ ID NO: 115553 - DNA, 25 bp, Mus musculus
gctgcccgatgaagtggaaaacccg

SEQ ID NO: 115554 - DNA, 25 bp, Mus musculus
gctgcccgtcctggtgatccaaagg

SEQ ID NO: 115555 - DNA, 25 bp, Mus musculus
gctgcccgtcttgggtatgattaaa

SEQ ID NO: 115556 - DNA, 25 bp, Mus musculus
gctgcccgtgatgctatcctgaaaa

SEQ ID NO: 115557 - DNA, 25 bp, Mus musculus
gctgccctcagaagaagctcgagtg

SEQ ID NO: 115558 - DNA, 25 bp, Mus musculus
gctgccctcgtgtgcggtgttgtct

SEQ ID NO: 115559 - DNA, 25 bp, Mus musculus
gctgccctgaaactccatgggaagt

SEQ ID NO: 115560 - DNA, 25 bp, Mus musculus
gctgccctttgaaaaccgtggtcga

SEQ ID NO: 115561 - DNA, 25 bp, Mus musculus
gctgccgagggcttcactgacattg

SEQ ID NO: 115562 - DNA, 25 bp, Mus musculus
gctgccgatgtggtgtctactgact

SEQ ID NO: 115563 - DNA, 25 bp, Mus musculus
gctgccgctaacgtttgaggataca

SEQ ID NO: 115564 - DNA, 25 bp, Mus musculus
gctgccgtctccaccgcgagagaag

SEQ ID NO: 115565 - DNA, 25 bp, Mus musculus
gctgcctcacgatgaagaccctgaa

SEQ ID NO: 115566 - DNA, 25 bp, Mus musculus
gctgcctccgctgagaattcctgag

SEQ ID NO: 115567 - DNA, 25 bp, Mus musculus
gctgcctccttctcaagctctaaga

SEQ ID NO: 115568 - DNA, 25 bp, Mus musculus
gctgcctcgattatccacgcaaggg

SEQ ID NO: 115569 - DNA, 25 bp, Mus musculus
gctgcctgacaagggacacttcggg

SEQ ID NO: 115570 - DNA, 25 bp, Mus musculus
gctgcctgagatgccgactatttgg

SEQ ID NO: 115571 - DNA, 25 bp, Mus musculus
gctgcctgcaggatgaactgtcgat

SEQ ID NO: 115572 - DNA, 25 bp, Mus musculus
gctgcctgcccgcttcttggccagt

SEQ ID NO: 115573 - DNA, 25 bp, Mus musculus
gctgcctggtgactcctgttctgaa

SEQ ID NO: 115574 - DNA, 25 bp, Mus musculus
gctgcctgtagaagcagacatttta

SEQ ID NO: 115575 - DNA, 25 bp, Mus musculus
gctgcctgttagcatgtgacaccag

SEQ ID NO: 115576 - DNA, 25 bp, Mus musculus
gctgcctgttgtgatgcctcctaag

SEQ ID NO: 115577 - DNA, 25 bp, Mus musculus
gctgccttcaactagtgcctggtca

SEQ ID NO: 115578 - DNA, 25 bp, Mus musculus
gctgccttggtagcatgttcctgga

SEQ ID NO: 115579 - DNA, 25 bp, Mus musculus
gctgcgagctacatcagaagaggct

SEQ ID NO: 115580 - DNA, 25 bp, Mus musculus
gctgcgagtggctgctctgatcagt

SEQ ID NO: 115581 - DNA, 25 bp, Mus musculus
gctgcgcagccggtactcatgtact

SEQ ID NO: 115582 - DNA, 25 bp, Mus musculus
gctgcgcagtttccccgaagtaagt

SEQ ID NO: 115583 - DNA, 25 bp, Mus musculus
gctgcgccaatgctaacaacagggt

SEQ ID NO: 115584 - DNA, 25 bp, Mus musculus
gctgcgcccgttaccaaaatggtcg

SEQ ID NO: 115585 - DNA, 25 bp, Mus musculus
gctgcgccggagtggctcctaataa

SEQ ID NO: 115586 - DNA, 25 bp, Mus musculus
gctgcgccgtcatgaaacagtttgc

SEQ ID NO: 115587 - DNA, 25 bp, Mus musculus
gctgcgcgtcaaggtaaacgaagcc

SEQ ID NO: 115588 - DNA, 25 bp, Mus musculus
gctgcgctcagaacaagtgtaactt

SEQ ID NO: 115589 - DNA, 25 bp, Mus musculus
gctgcgctttatccaggcctggcaa

SEQ ID NO: 115590 - DNA, 25 bp, Mus musculus
gctgcggacccatcatagctgacca

SEQ ID NO: 115591 - DNA, 25 bp, Mus musculus
gctgcggacggtttgcccgagcccg

SEQ ID NO: 115592 - DNA, 25 bp, Mus musculus
gctgcggagcctgtacacactagtg

SEQ ID NO: 115593 - DNA, 25 bp, Mus musculus
gctgcggagcgctcggatgtttcca

SEQ ID NO: 115594 - DNA, 25 bp, Mus musculus
gctgcggcctattcgccttcggagg

SEQ ID NO: 115595 - DNA, 25 bp, Mus musculus
gctgcgggaagctcgtgtttaagta

SEQ ID NO: 115596 - DNA, 25 bp, Mus musculus
gctgcggtcaaaggaatgtctgcca

SEQ ID NO: 115597 - DNA, 25 bp, Mus musculus
gctgcggtcgactgaactgcgacat

SEQ ID NO: 115598 - DNA, 25 bp, Mus musculus
gctgcggtgctgttcatcacgggaa

SEQ ID NO: 115599 - DNA, 25 bp, Mus musculus
gctgcggttcgtccattcctaggtc

SEQ ID NO: 115600 - DNA, 25 bp, Mus musculus
gctgcgtaaaagaggtgtctcagtg

SEQ ID NO: 115601 - DNA, 25 bp, Mus musculus
gctgcgtaccctgcgtgctggaatg

SEQ ID NO: 115602 - DNA, 25 bp, Mus musculus
gctgcgtactgtggcttcctcttct

SEQ ID NO: 115603 - DNA, 25 bp, Mus musculus
gctgcgtcccggaaaccaaggtggt

SEQ ID NO: 115604 - DNA, 25 bp, Mus musculus
gctgcgtgctcttcgaaacctttgg

SEQ ID NO: 115605 - DNA, 25 bp, Mus musculus
gctgcgtggaagagctcaagcgttt

SEQ ID NO: 115606 - DNA, 25 bp, Mus musculus
gctgcgtgtatcactggtggcaaca

SEQ ID NO: 115607 - DNA, 25 bp, Mus musculus
gctgctaaccggaacctatcgggtg

SEQ ID NO: 115608 - DNA, 25 bp, Mus musculus
gctgctacagatcgctgatgatttt

SEQ ID NO: 115609 - DNA, 25 bp, Mus musculus
gctgctactagatgaccctcaggaa

SEQ ID NO: 115610 - DNA, 25 bp, Mus musculus
gctgctactgtaggtgccgcgctgt

SEQ ID NO: 115611 - DNA, 25 bp, Mus musculus
gctgctagcattggaaagggccttg

SEQ ID NO: 115612 - DNA, 25 bp, Mus musculus
gctgctagtaatgaaacctaccagg

SEQ ID NO: 115613 - DNA, 25 bp, Mus musculus
gctgctattttgatggtgaccggag

SEQ ID NO: 115614 - DNA, 25 bp, Mus musculus
gctgctcaagcattgctgacagtgg

SEQ ID NO: 115615 - DNA, 25 bp, Mus musculus
gctgctcatgacctggagctactga

SEQ ID NO: 115616 - DNA, 25 bp, Mus musculus
gctgctccagatgccagaatgtgtg

SEQ ID NO: 115617 - DNA, 25 bp, Mus musculus
gctgctcccagctgaaaccggataa

SEQ ID NO: 115618 - DNA, 25 bp, Mus musculus
gctgctccgatatgaaggctttgaa

SEQ ID NO: 115619 - DNA, 25 bp, Mus musculus
gctgctcctggctctactgtgtgaa

SEQ ID NO: 115620 - DNA, 25 bp, Mus musculus
gctgctccttcgaggcctgtgtctg

SEQ ID NO: 115621 - DNA, 25 bp, Mus musculus
gctgctcgactatgccctggaagtg

SEQ ID NO: 115622 - DNA, 25 bp, Mus musculus
gctgctcgaggaaggagtgtcaccc

SEQ ID NO: 115623 - DNA, 25 bp, Mus musculus
gctgctcgtcatccttgtcatctgc

SEQ ID NO: 115624 - DNA, 25 bp, Mus musculus
gctgctcgtcctactgaagctggat

SEQ ID NO: 115625 - DNA, 25 bp, Mus musculus
gctgctctcgaaggtctcacaggaa

SEQ ID NO: 115626 - DNA, 25 bp, Mus musculus
gctgctctgaaaaacccccctatta

SEQ ID NO: 115627 - DNA, 25 bp, Mus musculus
gctgctcttcacacagggctctggg

SEQ ID NO: 115628 - DNA, 25 bp, Mus musculus
gctgctgaaatcctcaaacctggaa

SEQ ID NO: 115629 - DNA, 25 bp, Mus musculus
gctgctgaaccgaatgtcgtccgaa

SEQ ID NO: 115630 - DNA, 25 bp, Mus musculus
gctgctgaacgtcaggccctggatt

SEQ ID NO: 115631 - DNA, 25 bp, Mus musculus
gctgctgaccatctacgcctgggag

SEQ ID NO: 115632 - DNA, 25 bp, Mus musculus
gctgctgaccattgggacagtaaaa

SEQ ID NO: 115633 - DNA, 25 bp, Mus musculus
gctgctgactttgcacaggctgcca

SEQ ID NO: 115634 - DNA, 25 bp, Mus musculus
gctgctgagacgaccttgcgagaaa

SEQ ID NO: 115635 - DNA, 25 bp, Mus musculus
gctgctgagagaaacaaggagccca

SEQ ID NO: 115636 - DNA, 25 bp, Mus musculus
gctgctgagagcagatgtccttgct

SEQ ID NO: 115637 - DNA, 25 bp, Mus musculus
gctgctgaggcagaggcgaccggcg

SEQ ID NO: 115638 - DNA, 25 bp, Mus musculus
gctgctgagggatcgagagtctaca

SEQ ID NO: 115639 - DNA, 25 bp, Mus musculus
gctgctgagttattgggccccttgg

SEQ ID NO: 115640 - DNA, 25 bp, Mus musculus
gctgctgatcatggcgtatgcactg

SEQ ID NO: 115641 - DNA, 25 bp, Mus musculus
gctgctgatgctcttaccgtggaaa

SEQ ID NO: 115642 - DNA, 25 bp, Mus musculus
gctgctgcagagacacagtgctgga

SEQ ID NO: 115643 - DNA, 25 bp, Mus musculus
gctgctgcatccacggaggcggtgg

SEQ ID NO: 115644 - DNA, 25 bp, Mus musculus
gctgctgccacagggttcatttttg

SEQ ID NO: 115645 - DNA, 25 bp, Mus musculus
gctgctgcctgtggcagagcttgaa

SEQ ID NO: 115646 - DNA, 25 bp, Mus musculus
gctgctgcgcactgacagatgacat

SEQ ID NO: 115647 - DNA, 25 bp, Mus musculus
gctgctgcggctacagaagtaaagg

SEQ ID NO: 115648 - DNA, 25 bp, Mus musculus
gctgctgctatcgatgccaagacat

SEQ ID NO: 115649 - DNA, 25 bp, Mus musculus
gctgctgctatgaacaagcggattc

SEQ ID NO: 115650 - DNA, 25 bp, Mus musculus
gctgctgctgccgattcaagtttgg

SEQ ID NO: 115651 - DNA, 25 bp, Mus musculus
gctgctgcttacaacctcgggagag

SEQ ID NO: 115652 - DNA, 25 bp, Mus musculus
gctgctgcttctggcgctgccgctc

SEQ ID NO: 115653 - DNA, 25 bp, Mus musculus
gctgctgcttgggagccatggctct

SEQ ID NO: 115654 - DNA, 25 bp, Mus musculus
gctgctgctttcactgctgcaccaa

SEQ ID NO: 115655 - DNA, 25 bp, Mus musculus
gctgctggcattgggaaagatttca

SEQ ID NO: 115656 - DNA, 25 bp, Mus musculus
gctgctggcgcaagaagcgacgatt

SEQ ID NO: 115657 - DNA, 25 bp, Mus musculus
gctgctgggactttgaagatacctg

SEQ ID NO: 115658 - DNA, 25 bp, Mus musculus
gctgctgggcctacaaatcatatgg

SEQ ID NO: 115659 - DNA, 25 bp, Mus musculus
gctgctgggcctgaaacagtgcctg

SEQ ID NO: 115660 - DNA, 25 bp, Mus musculus
gctgctgggtcaagacaaggtatca

SEQ ID NO: 115661 - DNA, 25 bp, Mus musculus
gctgctgtagaaccaaacccactga

SEQ ID NO: 115662 - DNA, 25 bp, Mus musculus
gctgctgtcaacatctggaaaaaca

SEQ ID NO: 115663 - DNA, 25 bp, Mus musculus
gctgctgtcagtccaagctgtcagt

SEQ ID NO: 115664 - DNA, 25 bp, Mus musculus
gctgctgtcatctgcacaaatggga

SEQ ID NO: 115665 - DNA, 25 bp, Mus musculus
gctgctgtcctggagtacctgactg

SEQ ID NO: 115666 - DNA, 25 bp, Mus musculus
gctgctgtctttgacaagttcatca

SEQ ID NO: 115667 - DNA, 25 bp, Mus musculus
gctgctgtgtgacgtgctgctggtg

SEQ ID NO: 115668 - DNA, 25 bp, Mus musculus
gctgctgttagagagcatttccggg

SEQ ID NO: 115669 - DNA, 25 bp, Mus musculus
gctgcttaaggctcgtgcactcgag

SEQ ID NO: 115670 - DNA, 25 bp, Mus musculus
gctgcttacacgagtccaaaggccg

SEQ ID NO: 115671 - DNA, 25 bp, Mus musculus
gctgcttacccaagaggccgtgtga

SEQ ID NO: 115672 - DNA, 25 bp, Mus musculus
gctgcttattcctcccagacctgtg

SEQ ID NO: 115673 - DNA, 25 bp, Mus musculus
gctgcttcaagtgcaagtcctgtgg

SEQ ID NO: 115674 - DNA, 25 bp, Mus musculus
gctgcttcactaagaggaggaagag

SEQ ID NO: 115675 - DNA, 25 bp, Mus musculus
gctgcttcggaatcatctactgctg

SEQ ID NO: 115676 - DNA, 25 bp, Mus musculus
gctgcttcggcggaggacatgaccc

SEQ ID NO: 115677 - DNA, 25 bp, Mus musculus
gctgcttggagaaacgctgattacc

SEQ ID NO: 115678 - DNA, 25 bp, Mus musculus
gctgcttgggatgcacgtgttatca

SEQ ID NO: 115679 - DNA, 25 bp, Mus musculus
gctgctttccggcagacgttttccg

SEQ ID NO: 115680 - DNA, 25 bp, Mus musculus
gctgctttcggcatcaagtgggcct

SEQ ID NO: 115681 - DNA, 25 bp, Mus musculus
gctgcttttgctgcgccatggagac

SEQ ID NO: 115682 - DNA, 25 bp, Mus musculus
gctgcttttgggacagacacgagga

SEQ ID NO: 115683 - DNA, 25 bp, Mus musculus
gctggaaaacctggcagcagacggt

SEQ ID NO: 115684 - DNA, 25 bp, Mus musculus
gctggaaaaggagtcgccgctcgcc

SEQ ID NO: 115685 - DNA, 25 bp, Mus musculus
gctggaaaatcatgggaacaggccc

SEQ ID NO: 115686 - DNA, 25 bp, Mus musculus
gctggaaagacaaaagagggagtcc

SEQ ID NO: 115687 - DNA, 25 bp, Mus musculus
gctggaaagacaacacttctgaact

SEQ ID NO: 115688 - DNA, 25 bp, Mus musculus
gctggaaagtcacaaaatggtctca

SEQ ID NO: 115689 - DNA, 25 bp, Mus musculus
gctggaacgcctacagcgggatcct

SEQ ID NO: 115690 - DNA, 25 bp, Mus musculus
gctggaagcccattttcatggctgt

SEQ ID NO: 115691 - DNA, 25 bp, Mus musculus
gctggaagctgtgtacgaacgactc

SEQ ID NO: 115692 - DNA, 25 bp, Mus musculus
gctggaagctttgtgggccgtaacc

SEQ ID NO: 115693 - DNA, 25 bp, Mus musculus
gctggaaggcgccactttatttaac

SEQ ID NO: 115694 - DNA, 25 bp, Mus musculus
gctggaaggctaccggaacatcatt

SEQ ID NO: 115695 - DNA, 25 bp, Mus musculus
gctggaagtcaacgagaacggcaaa

SEQ ID NO: 115696 - DNA, 25 bp, Mus musculus
gctggaatatgagtccgtgctgtgt

SEQ ID NO: 115697 - DNA, 25 bp, Mus musculus
gctggaatccctctgtgtgcatgaa

SEQ ID NO: 115698 - DNA, 25 bp, Mus musculus
gctggaatgccaatcactctcactg

SEQ ID NO: 115699 - DNA, 25 bp, Mus musculus
gctggacaaaatggtgaccaggaag

SEQ ID NO: 115700 - DNA, 25 bp, Mus musculus
gctggacactggcattggacttcaa

SEQ ID NO: 115701 - DNA, 25 bp, Mus musculus
gctggacagtccaatgccactttat

SEQ ID NO: 115702 - DNA, 25 bp, Mus musculus
gctggacagtgattcagagacgcct

SEQ ID NO: 115703 - DNA, 25 bp, Mus musculus
gctggacatcaagactcggctggaa

SEQ ID NO: 115704 - DNA, 25 bp, Mus musculus
gctggacatgaaagctatggattcc

SEQ ID NO: 115705 - DNA, 25 bp, Mus musculus
gctggaccaggttctacaaaaggca

SEQ ID NO: 115706 - DNA, 25 bp, Mus musculus
gctggaccatggaagagagtaccct

SEQ ID NO: 115707 - DNA, 25 bp, Mus musculus
gctggaccctttttgagcacctatc

SEQ ID NO: 115708 - DNA, 25 bp, Mus musculus
gctggacgacggacactccatctgt

SEQ ID NO: 115709 - DNA, 25 bp, Mus musculus
gctggactccgtcttgctcctctca

SEQ ID NO: 115710 - DNA, 25 bp, Mus musculus
gctggacttaggagctccggagccc

SEQ ID NO: 115711 - DNA, 25 bp, Mus musculus
gctggactttgagggtactacctaa

SEQ ID NO: 115712 - DNA, 25 bp, Mus musculus
gctggactttgtagccccgtcaagg

SEQ ID NO: 115713 - DNA, 25 bp, Mus musculus
gctggagaaccgaatcaaagagctt

SEQ ID NO: 115714 - DNA, 25 bp, Mus musculus
gctggagaacctccctaaatgaatg

SEQ ID NO: 115715 - DNA, 25 bp, Mus musculus
gctggagaacggcatccctgccagc

SEQ ID NO: 115716 - DNA, 25 bp, Mus musculus
gctggagaactgctctgccaacgga

SEQ ID NO: 115717 - DNA, 25 bp, Mus musculus
gctggagaagcaacgcagggagatc

SEQ ID NO: 115718 - DNA, 25 bp, Mus musculus
gctggagacccaaagaaaatacagt

SEQ ID NO: 115719 - DNA, 25 bp, Mus musculus
gctggagacggccatgcgtaactta

SEQ ID NO: 115720 - DNA, 25 bp, Mus musculus
gctggagagcgatcacattgtcttt

SEQ ID NO: 115721 - DNA, 25 bp, Mus musculus
gctggagagtctggcaaaagcacca

SEQ ID NO: 115722 - DNA, 25 bp, Mus musculus
gctggagatcgctcaccgtgggaat

SEQ ID NO: 115723 - DNA, 25 bp, Mus musculus
gctggagccaggacaggacgtggat

SEQ ID NO: 115724 - DNA, 25 bp, Mus musculus
gctggagcccagctgataatccttg

SEQ ID NO: 115725 - DNA, 25 bp, Mus musculus
gctggagccctcgactcttgtaaat

SEQ ID NO: 115726 - DNA, 25 bp, Mus musculus
gctggagcgctttgctcgcggcact

SEQ ID NO: 115727 - DNA, 25 bp, Mus musculus
gctggagcgtgtatttgagcgcaca

SEQ ID NO: 115728 - DNA, 25 bp, Mus musculus
gctggagctggttcggaccttctct

SEQ ID NO: 115729 - DNA, 25 bp, Mus musculus
gctggaggcagagaacaacctggct

SEQ ID NO: 115730 - DNA, 25 bp, Mus musculus
gctggaggccctacacagtgaacat

SEQ ID NO: 115731 - DNA, 25 bp, Mus musculus
gctggaggtgaacaaccgcatcatc

SEQ ID NO: 115732 - DNA, 25 bp, Mus musculus
gctggaggtgccatgtcttccaagt

SEQ ID NO: 115733 - DNA, 25 bp, Mus musculus
gctggagtaaagagaaccaaactca

SEQ ID NO: 115734 - DNA, 25 bp, Mus musculus
gctggagtccttgatcgagcactgt

SEQ ID NO: 115735 - DNA, 25 bp, Mus musculus
gctggagttcatacccattcctgag

SEQ ID NO: 115736 - DNA, 25 bp, Mus musculus
gctggataaactcacagctggcaaa

SEQ ID NO: 115737 - DNA, 25 bp, Mus musculus
gctggataccctggccggaaacagt

SEQ ID NO: 115738 - DNA, 25 bp, Mus musculus
gctggatatgcctaatgttagagag

SEQ ID NO: 115739 - DNA, 25 bp, Mus musculus
gctggatatggaagctatgggtaca

SEQ ID NO: 115740 - DNA, 25 bp, Mus musculus
gctggatcaccgtaggcaattgcct

SEQ ID NO: 115741 - DNA, 25 bp, Mus musculus
gctggatcccaaactctgctacttg

SEQ ID NO: 115742 - DNA, 25 bp, Mus musculus
gctggatcttccgtgaagtgttcct

SEQ ID NO: 115743 - DNA, 25 bp, Mus musculus
gctggatgaacgaggaatgcacacc

SEQ ID NO: 115744 - DNA, 25 bp, Mus musculus
gctggatgcctcagatctgacgtgg

SEQ ID NO: 115745 - DNA, 25 bp, Mus musculus
gctggatgtgactgaagccaacaaa

SEQ ID NO: 115746 - DNA, 25 bp, Mus musculus
gctggatgttaagatgtctgtggac

SEQ ID NO: 115747 - DNA, 25 bp, Mus musculus
gctggattacagcatcgagatcccg

SEQ ID NO: 115748 - DNA, 25 bp, Mus musculus
gctggattagcaagacgcacgttta

SEQ ID NO: 115749 - DNA, 25 bp, Mus musculus
gctggattctgcagcacaaatcttc

SEQ ID NO: 115750 - DNA, 25 bp, Mus musculus
gctggcaaatcggtgggacccacct

SEQ ID NO: 115751 - DNA, 25 bp, Mus musculus
gctggcaacctggaataaaaaatcc

SEQ ID NO: 115752 - DNA, 25 bp, Mus musculus
gctggcaactacagacggacggtgc

SEQ ID NO: 115753 - DNA, 25 bp, Mus musculus
gctggcaagtttaaggatgatcccg

SEQ ID NO: 115754 - DNA, 25 bp, Mus musculus
gctggcaatccttggtattatggca

SEQ ID NO: 115755 - DNA, 25 bp, Mus musculus
gctggcacgcttaccaacaagatgg

SEQ ID NO: 115756 - DNA, 25 bp, Mus musculus
gctggcactgaaatgcctggcccca

SEQ ID NO: 115757 - DNA, 25 bp, Mus musculus
gctggcaggcactcaaggatggatc

SEQ ID NO: 115758 - DNA, 25 bp, Mus musculus
gctggcagtccagggaaaaaggacc

SEQ ID NO: 115759 - DNA, 25 bp, Mus musculus
gctggcattggttggagactcctca

SEQ ID NO: 115760 - DNA, 25 bp, Mus musculus
gctggccaaattcagtcctgatttg

SEQ ID NO: 115761 - DNA, 25 bp, Mus musculus
gctggccaaggacttgttcttgtac

SEQ ID NO: 115762 - DNA, 25 bp, Mus musculus
gctggccaagtttgacggtgttcta

SEQ ID NO: 115763 - DNA, 25 bp, Mus musculus
gctggccacaagaattatggaacac

SEQ ID NO: 115764 - DNA, 25 bp, Mus musculus
gctggccactctgcttgcatgagca

SEQ ID NO: 115765 - DNA, 25 bp, Mus musculus
gctggccagctaagctatatggacc

SEQ ID NO: 115766 - DNA, 25 bp, Mus musculus
gctggccagctatcttcacacgggt

SEQ ID NO: 115767 - DNA, 25 bp, Mus musculus
gctggccatcgaccacctgaatgaa

SEQ ID NO: 115768 - DNA, 25 bp, Mus musculus
gctggccatcgggaggtatcccatt

SEQ ID NO: 115769 - DNA, 25 bp, Mus musculus
gctggccatgaaaacggagctccca

SEQ ID NO: 115770 - DNA, 25 bp, Mus musculus
gctggccgacgaagatacactgtcc

SEQ ID NO: 115771 - DNA, 25 bp, Mus musculus
gctggccgagacattgaggacattg

SEQ ID NO: 115772 - DNA, 25 bp, Mus musculus
gctggccgagatggcctccaaggtc

SEQ ID NO: 115773 - DNA, 25 bp, Mus musculus
gctggccggccctgacaaggagaat

SEQ ID NO: 115774 - DNA, 25 bp, Mus musculus
gctggccgtgtatggagctgaccca

SEQ ID NO: 115775 - DNA, 25 bp, Mus musculus
gctggcctaagcaccatgttccaag

SEQ ID NO: 115776 - DNA, 25 bp, Mus musculus
gctggcctccctgcatgtcatgatg

SEQ ID NO: 115777 - DNA, 25 bp, Mus musculus
gctggcctctgcggagattccaggc

SEQ ID NO: 115778 - DNA, 25 bp, Mus musculus
gctggcctctggaattcaagtggat

SEQ ID NO: 115779 - DNA, 25 bp, Mus musculus
gctggcctgagcagcctatgcaatg

SEQ ID NO: 115780 - DNA, 25 bp, Mus musculus
gctggcctggtctttggcagactcc

SEQ ID NO: 115781 - DNA, 25 bp, Mus musculus
gctggccttgagtgcctggttctcc

SEQ ID NO: 115782 - DNA, 25 bp, Mus musculus
gctggccttgtggtaaagctgctaa

SEQ ID NO: 115783 - DNA, 25 bp, Mus musculus
gctggcctttgacatcgctgagaag

SEQ ID NO: 115784 - DNA, 25 bp, Mus musculus
gctggcgaaagaggtctacgcgtca

SEQ ID NO: 115785 - DNA, 25 bp, Mus musculus
gctggcgaagcctaagaccaactgg

SEQ ID NO: 115786 - DNA, 25 bp, Mus musculus
gctggcgacgtcatcaaagtcttgg

SEQ ID NO: 115787 - DNA, 25 bp, Mus musculus
gctggcggaccatgaaaaaacttgg

SEQ ID NO: 115788 - DNA, 25 bp, Mus musculus
gctggcggccaaaacatgagggatc

SEQ ID NO: 115789 - DNA, 25 bp, Mus musculus
gctggcgggacgcgggggaggcgcg

SEQ ID NO: 115790 - DNA, 25 bp, Mus musculus
gctggcggtgcatggaatccagaat

SEQ ID NO: 115791 - DNA, 25 bp, Mus musculus
gctggcggttctgtgcctctgctga

SEQ ID NO: 115792 - DNA, 25 bp, Mus musculus
gctggcgtcaccttctgtaacctgg

SEQ ID NO: 115793 - DNA, 25 bp, Mus musculus
gctggctaagcagacctcaggtcct

SEQ ID NO: 115794 - DNA, 25 bp, Mus musculus
gctggctactgctttgtggaattcg

SEQ ID NO: 115795 - DNA, 25 bp, Mus musculus
gctggctcagatgctacagatggaa

SEQ ID NO: 115796 - DNA, 25 bp, Mus musculus
gctggctcaggaagacagcctcaac

SEQ ID NO: 115797 - DNA, 25 bp, Mus musculus
gctggctcctcgagtctgccttcat

SEQ ID NO: 115798 - DNA, 25 bp, Mus musculus
gctggctctggctacacgatttcgt

SEQ ID NO: 115799 - DNA, 25 bp, Mus musculus
gctggctcttcgcaaaaccgtgatg

SEQ ID NO: 115800 - DNA, 25 bp, Mus musculus
gctggctgactttcgtgctgttgat

SEQ ID NO: 115801 - DNA, 25 bp, Mus musculus
gctggctgccatttgcgtactgaga

SEQ ID NO: 115802 - DNA, 25 bp, Mus musculus
gctggctgctattgtgtttgatcac

SEQ ID NO: 115803 - DNA, 25 bp, Mus musculus
gctggctggtgactctcagagaccc

SEQ ID NO: 115804 - DNA, 25 bp, Mus musculus
gctggctgtatatgcagctcttgaa

SEQ ID NO: 115805 - DNA, 25 bp, Mus musculus
gctggctgttgtaactggacctcca

SEQ ID NO: 115806 - DNA, 25 bp, Mus musculus
gctggcttacatcatctggtggaca

SEQ ID NO: 115807 - DNA, 25 bp, Mus musculus
gctggcttccagttcaagggctaca

SEQ ID NO: 115808 - DNA, 25 bp, Mus musculus
gctggcttcgatgaagtgcgatcaa

SEQ ID NO: 115809 - DNA, 25 bp, Mus musculus
gctggcttctggagagactgacaga

SEQ ID NO: 115810 - DNA, 25 bp, Mus musculus
gctggcttggcattggagtctgtct

SEQ ID NO: 115811 - DNA, 25 bp, Mus musculus
gctggctttgccacgattgctggaa

SEQ ID NO: 115812 - DNA, 25 bp, Mus musculus
gctgggaaaatgcaagcggttcttt

SEQ ID NO: 115813 - DNA, 25 bp, Mus musculus
gctgggaccagtcctagccccgtcc

SEQ ID NO: 115814 - DNA, 25 bp, Mus musculus
gctgggaccccagcttatttatttt

SEQ ID NO: 115815 - DNA, 25 bp, Mus musculus
gctgggacctcactatacaagtcgg

SEQ ID NO: 115816 - DNA, 25 bp, Mus musculus
gctgggacgtctctacatgtgtgaa

SEQ ID NO: 115817 - DNA, 25 bp, Mus musculus
gctgggactaacacaagaccaaggg

SEQ ID NO: 115818 - DNA, 25 bp, Mus musculus
gctgggactctacgtggctgaacaa

SEQ ID NO: 115819 - DNA, 25 bp, Mus musculus
gctgggagccaaagttgaaatacaa

SEQ ID NO: 115820 - DNA, 25 bp, Mus musculus
gctgggaggagggacattaaactat

SEQ ID NO: 115821 - DNA, 25 bp, Mus musculus
gctgggatccttcgccatgagcatc

SEQ ID NO: 115822 - DNA, 25 bp, Mus musculus
gctgggatggtgttcgcaactatca

SEQ ID NO: 115823 - DNA, 25 bp, Mus musculus
gctgggatttaaggcttccgaggct

SEQ ID NO: 115824 - DNA, 25 bp, Mus musculus
gctgggcaatgggacaacgaatcat

SEQ ID NO: 115825 - DNA, 25 bp, Mus musculus
gctgggcaccccatcggtgcagctg

SEQ ID NO: 115826 - DNA, 25 bp, Mus musculus
gctgggcagctgtcatattacttct

SEQ ID NO: 115827 - DNA, 25 bp, Mus musculus
gctgggcatttctaccctttggtgg

SEQ ID NO: 115828 - DNA, 25 bp, Mus musculus
gctgggccatcgaccacgtgtacat

SEQ ID NO: 115829 - DNA, 25 bp, Mus musculus
gctgggccatgtcacaacactgctg

SEQ ID NO: 115830 - DNA, 25 bp, Mus musculus
gctgggcctcaagttcccttgctga

SEQ ID NO: 115831 - DNA, 25 bp, Mus musculus
gctgggcctgcagatcttcaatgca

SEQ ID NO: 115832 - DNA, 25 bp, Mus musculus
gctgggcctggagaacatctactgg

SEQ ID NO: 115833 - DNA, 25 bp, Mus musculus
gctgggccttctgagcatgcgcaaa

SEQ ID NO: 115834 - DNA, 25 bp, Mus musculus
gctgggcggcaagagtgctaactcc

SEQ ID NO: 115835 - DNA, 25 bp, Mus musculus
gctgggctaacaacaagcaagtgca

SEQ ID NO: 115836 - DNA, 25 bp, Mus musculus
gctgggctcctgtaggacctgcgat

SEQ ID NO: 115837 - DNA, 25 bp, Mus musculus
gctgggcttcgatacacgagtgact

SEQ ID NO: 115838 - DNA, 25 bp, Mus musculus
gctgggctttcttggatcaaacaca

SEQ ID NO: 115839 - DNA, 25 bp, Mus musculus
gctgggtccccgtaatgtactgctg

SEQ ID NO: 115840 - DNA, 25 bp, Mus musculus
gctgggtcccgagtgagccatacat

SEQ ID NO: 115841 - DNA, 25 bp, Mus musculus
gctgggtcgttgttcccatgccctg

SEQ ID NO: 115842 - DNA, 25 bp, Mus musculus
gctgggtctgccttgccacccagga

SEQ ID NO: 115843 - DNA, 25 bp, Mus musculus
gctgggtgcggtgaaacctcagcca

SEQ ID NO: 115844 - DNA, 25 bp, Mus musculus
gctgggttcagcaattctcggttta

SEQ ID NO: 115845 - DNA, 25 bp, Mus musculus
gctgggttccctgaaacgtgaccat

SEQ ID NO: 115846 - DNA, 25 bp, Mus musculus
gctggtaacaggtgctcgggctaat

SEQ ID NO: 115847 - DNA, 25 bp, Mus musculus
gctggtaaggcgctgttcacctgaa

SEQ ID NO: 115848 - DNA, 25 bp, Mus musculus
gctggtacaaggacctccaccgtta

SEQ ID NO: 115849 - DNA, 25 bp, Mus musculus
gctggtacccagtgcctttgagaag

SEQ ID NO: 115850 - DNA, 25 bp, Mus musculus
gctggtactccaacagtttgatttt

SEQ ID NO: 115851 - DNA, 25 bp, Mus musculus
gctggtagccatgaacgagactgac

SEQ ID NO: 115852 - DNA, 25 bp, Mus musculus
gctggtatctgagtttaccaactca

SEQ ID NO: 115853 - DNA, 25 bp, Mus musculus
gctggtcaacgagcacaagtgcctg

SEQ ID NO: 115854 - DNA, 25 bp, Mus musculus
gctggtcaactaccacggctgcagg

SEQ ID NO: 115855 - DNA, 25 bp, Mus musculus
gctggtcaccatctgtagcctggaa

SEQ ID NO: 115856 - DNA, 25 bp, Mus musculus
gctggtcaggatgcaggttcccgtc

SEQ ID NO: 115857 - DNA, 25 bp, Mus musculus
gctggtcatcctggctcagctgaca

SEQ ID NO: 115858 - DNA, 25 bp, Mus musculus
gctggtcccttacaaactgatccgg

SEQ ID NO: 115859 - DNA, 25 bp, Mus musculus
gctggtcctcccatatgtgcggcat

SEQ ID NO: 115860 - DNA, 25 bp, Mus musculus
gctggtcctggataactgtaagtca

SEQ ID NO: 115861 - DNA, 25 bp, Mus musculus
gctggtcgacaatctgccagaggaa

SEQ ID NO: 115862 - DNA, 25 bp, Mus musculus
gctggtcgctctcagggacaacaca

SEQ ID NO: 115863 - DNA, 25 bp, Mus musculus
gctggtctgatagcttaccaactgg

SEQ ID NO: 115864 - DNA, 25 bp, Mus musculus
gctggtctgccctgaatggctctta

SEQ ID NO: 115865 - DNA, 25 bp, Mus musculus
gctggtcttgcccttcctgcacttt

SEQ ID NO: 115866 - DNA, 25 bp, Mus musculus
gctggtgaaaatcgcaagtgatatc

SEQ ID NO: 115867 - DNA, 25 bp, Mus musculus
gctggtgacaaactaacagaggtcc

SEQ ID NO: 115868 - DNA, 25 bp, Mus musculus
gctggtgaccctctgaatgctaaga

SEQ ID NO: 115869 - DNA, 25 bp, Mus musculus
gctggtgatgggtgtgagcggctcc

SEQ ID NO: 115870 - DNA, 25 bp, Mus musculus
gctggtgattgcatctggaagtgcc

SEQ ID NO: 115871 - DNA, 25 bp, Mus musculus
gctggtgcccggatcgcaacttgat

SEQ ID NO: 115872 - DNA, 25 bp, Mus musculus
gctggtggacggctgctactccttc

SEQ ID NO: 115873 - DNA, 25 bp, Mus musculus
gctggtggatccttagtcccgggac

SEQ ID NO: 115874 - DNA, 25 bp, Mus musculus
gctggtggcttacttcaacatcgag

SEQ ID NO: 115875 - DNA, 25 bp, Mus musculus
gctggtgggaccaaacagtgacact

SEQ ID NO: 115876 - DNA, 25 bp, Mus musculus
gctggtgtgccaacgtgagtcctac

SEQ ID NO: 115877 - DNA, 25 bp, Mus musculus
gctggtgtggtcaatacggtcttca

SEQ ID NO: 115878 - DNA, 25 bp, Mus musculus
gctggttacctatccatactgtgga

SEQ ID NO: 115879 - DNA, 25 bp, Mus musculus
gctggttccaggataacaagggcta

SEQ ID NO: 115880 - DNA, 25 bp, Mus musculus
gctggttctggcaacctgactctga

SEQ ID NO: 115881 - DNA, 25 bp, Mus musculus
gctggttgggctgacattcgcctct

SEQ ID NO: 115882 - DNA, 25 bp, Mus musculus
gctggtttactggagcagatgctct

SEQ ID NO: 115883 - DNA, 25 bp, Mus musculus
gctggtttgagctggtgcgtctcca

SEQ ID NO: 115884 - DNA, 25 bp, Mus musculus
gctgtaaacaacattaaccctgggt

SEQ ID NO: 115885 - DNA, 25 bp, Mus musculus
gctgtaaccatctccaccagagtga

SEQ ID NO: 115886 - DNA, 25 bp, Mus musculus
gctgtaaccggatggcaaacttggc

SEQ ID NO: 115887 - DNA, 25 bp, Mus musculus
gctgtaacctgggttccggaagaag

SEQ ID NO: 115888 - DNA, 25 bp, Mus musculus
gctgtaaggccttcactacgaggga

SEQ ID NO: 115889 - DNA, 25 bp, Mus musculus
gctgtacaacaaggagaagctactc

SEQ ID NO: 115890 - DNA, 25 bp, Mus musculus
gctgtacagaaacactctgaaagaa

SEQ ID NO: 115891 - DNA, 25 bp, Mus musculus
gctgtacagttatccagtcccgtgt

SEQ ID NO: 115892 - DNA, 25 bp, Mus musculus
gctgtaccatggagttgaaccccgg

SEQ ID NO: 115893 - DNA, 25 bp, Mus musculus
gctgtacccgagaccacaggatggg

SEQ ID NO: 115894 - DNA, 25 bp, Mus musculus
gctgtacctgtcaaccaggctttgt

SEQ ID NO: 115895 - DNA, 25 bp, Mus musculus
gctgtacctgttctctatagcagag

SEQ ID NO: 115896 - DNA, 25 bp, Mus musculus
gctgtacggctcttcagcaccttga

SEQ ID NO: 115897 - DNA, 25 bp, Mus musculus
gctgtactatgaagctaaagaatat

SEQ ID NO: 115898 - DNA, 25 bp, Mus musculus
gctgtactccaacttccggcggaaa

SEQ ID NO: 115899 - DNA, 25 bp, Mus musculus
gctgtactctaccttgtcaccttgg

SEQ ID NO: 115900 - DNA, 25 bp, Mus musculus
gctgtactggatgctgttgacccaa

SEQ ID NO: 115901 - DNA, 25 bp, Mus musculus
gctgtactgtcctggaagttggcca

SEQ ID NO: 115902 - DNA, 25 bp, Mus musculus
gctgtacttcaacatcagccttcga

SEQ ID NO: 115903 - DNA, 25 bp, Mus musculus
gctgtagaagttaagagaccccggg

SEQ ID NO: 115904 - DNA, 25 bp, Mus musculus
gctgtagacggaactgtcgtgcgta

SEQ ID NO: 115905 - DNA, 25 bp, Mus musculus
gctgtagagtttgtggacgcatttc

SEQ ID NO: 115906 - DNA, 25 bp, Mus musculus
gctgtagattgacggccccgcgcta

SEQ ID NO: 115907 - DNA, 25 bp, Mus musculus
gctgtagcagcagttctccggaata

SEQ ID NO: 115908 - DNA, 25 bp, Mus musculus
gctgtagggacgaaatcccgtgtga

SEQ ID NO: 115909 - DNA, 25 bp, Mus musculus
gctgtagggacgaagaggactactt

SEQ ID NO: 115910 - DNA, 25 bp, Mus musculus
gctgtagtctgctcttcctaactaa

SEQ ID NO: 115911 - DNA, 25 bp, Mus musculus
gctgtataagtacgaatgcagtctt

SEQ ID NO: 115912 - DNA, 25 bp, Mus musculus
gctgtatatggacttcaagaccaat

SEQ ID NO: 115913 - DNA, 25 bp, Mus musculus
gctgtatcacaagaagccgctggtg

SEQ ID NO: 115914 - DNA, 25 bp, Mus musculus
gctgtatcctcggtgctcgcagtac

SEQ ID NO: 115915 - DNA, 25 bp, Mus musculus
gctgtatctgcaatagctggccaca

SEQ ID NO: 115916 - DNA, 25 bp, Mus musculus
gctgtattcaagaatggtgtttctc

SEQ ID NO: 115917 - DNA, 25 bp, Mus musculus
gctgtattccatggtaccatccatc

SEQ ID NO: 115918 - DNA, 25 bp, Mus musculus
gctgtattggagaaacacctcaaag

SEQ ID NO: 115919 - DNA, 25 bp, Mus musculus
gctgtatttaaggacacctgcaccc

SEQ ID NO: 115920 - DNA, 25 bp, Mus musculus
gctgtcaaagcattgcagacctctg

SEQ ID NO: 115921 - DNA, 25 bp, Mus musculus
gctgtcacaccaagaggactgggcc

SEQ ID NO: 115922 - DNA, 25 bp, Mus musculus
gctgtcagaagaaagcgcccgcttg

SEQ ID NO: 115923 - DNA, 25 bp, Mus musculus
gctgtcagcaccagtatgtcttaca

SEQ ID NO: 115924 - DNA, 25 bp, Mus musculus
gctgtcaggaatggaaggctctccc

SEQ ID NO: 115925 - DNA, 25 bp, Mus musculus
gctgtcagtatctgggttaagagca

SEQ ID NO: 115926 - DNA, 25 bp, Mus musculus
gctgtcagtcatggcgctgtcctcg

SEQ ID NO: 115927 - DNA, 25 bp, Mus musculus
gctgtcatagactcactcctgggtg

SEQ ID NO: 115928 - DNA, 25 bp, Mus musculus
gctgtcatcaggagacttcaaaagg

SEQ ID NO: 115929 - DNA, 25 bp, Mus musculus
gctgtcatgacgatgacccctggag

SEQ ID NO: 115930 - DNA, 25 bp, Mus musculus
gctgtcattcagtgggctgctccgg

SEQ ID NO: 115931 - DNA, 25 bp, Mus musculus
gctgtccaaagaacagatcgcaaat

SEQ ID NO: 115932 - DNA, 25 bp, Mus musculus
gctgtccaaggaataaactttgtgt

SEQ ID NO: 115933 - DNA, 25 bp, Mus musculus
gctgtccacatctccctacgaagat

SEQ ID NO: 115934 - DNA, 25 bp, Mus musculus
gctgtcccagtaccaagagccgata

SEQ ID NO: 115935 - DNA, 25 bp, Mus musculus
gctgtccgcgtgctctgctctgcgt

SEQ ID NO: 115936 - DNA, 25 bp, Mus musculus
gctgtccgggaaggaatgttgccat

SEQ ID NO: 115937 - DNA, 25 bp, Mus musculus
gctgtccgtacctataaacaagaga

SEQ ID NO: 115938 - DNA, 25 bp, Mus musculus
gctgtcctaccaaagcacctgactg

SEQ ID NO: 115939 - DNA, 25 bp, Mus musculus
gctgtcctcgaattctgaacaccaa

SEQ ID NO: 115940 - DNA, 25 bp, Mus musculus
gctgtcctggactgggaactttcca

SEQ ID NO: 115941 - DNA, 25 bp, Mus musculus
gctgtcgaactcacagaaaaaattg

SEQ ID NO: 115942 - DNA, 25 bp, Mus musculus
gctgtcgacatgaagaaggtttccg

SEQ ID NO: 115943 - DNA, 25 bp, Mus musculus
gctgtcgctcttgacgagactctgg

SEQ ID NO: 115944 - DNA, 25 bp, Mus musculus
gctgtcgctgacatccactgtgaga

SEQ ID NO: 115945 - DNA, 25 bp, Mus musculus
gctgtcggaagctgcggactcgtcc

SEQ ID NO: 115946 - DNA, 25 bp, Mus musculus
gctgtctaatacacgagcgccttac

SEQ ID NO: 115947 - DNA, 25 bp, Mus musculus
gctgtctacatctgggaaagcctcc

SEQ ID NO: 115948 - DNA, 25 bp, Mus musculus
gctgtctaccaagagggtgctcctg

SEQ ID NO: 115949 - DNA, 25 bp, Mus musculus
gctgtctccggctgcttgaagctgt

SEQ ID NO: 115950 - DNA, 25 bp, Mus musculus
gctgtctcgatgataggtccctgta

SEQ ID NO: 115951 - DNA, 25 bp, Mus musculus
gctgtctctggcgatgaccctgggc

SEQ ID NO: 115952 - DNA, 25 bp, Mus musculus
gctgtctgagcccataagggttcca

SEQ ID NO: 115953 - DNA, 25 bp, Mus musculus
gctgtctgctgaccatagccacgga

SEQ ID NO: 115954 - DNA, 25 bp, Mus musculus
gctgtctgctttatccccaagggtg

SEQ ID NO: 115955 - DNA, 25 bp, Mus musculus
gctgtctggcctatcttgctgctca

SEQ ID NO: 115956 - DNA, 25 bp, Mus musculus
gctgtctgttcgatttagtggcaac

SEQ ID NO: 115957 - DNA, 25 bp, Mus musculus
gctgtcttccctcacctgactgtgg

SEQ ID NO: 115958 - DNA, 25 bp, Mus musculus
gctgtcttcttcaggaaagcctgga

SEQ ID NO: 115959 - DNA, 25 bp, Mus musculus
gctgtcttctttggcgcctgttaca

SEQ ID NO: 115960 - DNA, 25 bp, Mus musculus
gctgtcttggtagaacaaacccgct

SEQ ID NO: 115961 - DNA, 25 bp, Mus musculus
gctgtctttggaacggcaatctcgg

SEQ ID NO: 115962 - DNA, 25 bp, Mus musculus
gctgtctttgtactgccattgtttt

SEQ ID NO: 115963 - DNA, 25 bp, Mus musculus
gctgtgaaagaaagccggtgcatgc

SEQ ID NO: 115964 - DNA, 25 bp, Mus musculus
gctgtgaaagggtcaaagtctttga

SEQ ID NO: 115965 - DNA, 25 bp, Mus musculus
gctgtgaaccaaaagagctcttcct

SEQ ID NO: 115966 - DNA, 25 bp, Mus musculus
gctgtgaagctcatcattggtcgac

SEQ ID NO: 115967 - DNA, 25 bp, Mus musculus
gctgtgaattggctgaaaacatcac

SEQ ID NO: 115968 - DNA, 25 bp, Mus musculus
gctgtgacaactgccgtagacctgg

SEQ ID NO: 115969 - DNA, 25 bp, Mus musculus
gctgtgacctgacaacgctcgtgaa

SEQ ID NO: 115970 - DNA, 25 bp, Mus musculus
gctgtgacctgatgaccaaaaccaa

SEQ ID NO: 115971 - DNA, 25 bp, Mus musculus
gctgtgacgccctcgctgcaggagc

SEQ ID NO: 115972 - DNA, 25 bp, Mus musculus
gctgtgactccgaagactgtagtac

SEQ ID NO: 115973 - DNA, 25 bp, Mus musculus
gctgtgactctcgactggaaagggt

SEQ ID NO: 115974 - DNA, 25 bp, Mus musculus
gctgtgagactgaacgaggaaccat

SEQ ID NO: 115975 - DNA, 25 bp, Mus musculus
gctgtgagcaatccgaaagctggcc

SEQ ID NO: 115976 - DNA, 25 bp, Mus musculus
gctgtgataagcctcatgttcttgg

SEQ ID NO: 115977 - DNA, 25 bp, Mus musculus
gctgtgatctgtaggcacccgagtg

SEQ ID NO: 115978 - DNA, 25 bp, Mus musculus
gctgtgatgatgtttgtaggcttcc

SEQ ID NO: 115979 - DNA, 25 bp, Mus musculus
gctgtgattgcagaaatgtacctcc

SEQ ID NO: 115980 - DNA, 25 bp, Mus musculus
gctgtgattgccttgcagaggagtt

SEQ ID NO: 115981 - DNA, 25 bp, Mus musculus
gctgtgcacaacaaaccatcactgg

SEQ ID NO: 115982 - DNA, 25 bp, Mus musculus
gctgtgcacaagatagaagagggac

SEQ ID NO: 115983 - DNA, 25 bp, Mus musculus
gctgtgcagactttcgtaggctgcc

SEQ ID NO: 115984 - DNA, 25 bp, Mus musculus
gctgtgcaggactgaagtcaaacca

SEQ ID NO: 115985 - DNA, 25 bp, Mus musculus
gctgtgccatgctgatttctgagtc

SEQ ID NO: 115986 - DNA, 25 bp, Mus musculus
gctgtgccccatgtaaggaacctgg

SEQ ID NO: 115987 - DNA, 25 bp, Mus musculus
gctgtgcccctgaagcccatagact

SEQ ID NO: 115988 - DNA, 25 bp, Mus musculus
gctgtgccctcaacaagagttccga

SEQ ID NO: 115989 - DNA, 25 bp, Mus musculus
gctgtgcctgatcctagccagagag

SEQ ID NO: 115990 - DNA, 25 bp, Mus musculus
gctgtgcgacagaaagcgcctgtaa

SEQ ID NO: 115991 - DNA, 25 bp, Mus musculus
gctgtgcgacagagacctaacggtg

SEQ ID NO: 115992 - DNA, 25 bp, Mus musculus
gctgtgcgccatgtttgtcctctga

SEQ ID NO: 115993 - DNA, 25 bp, Mus musculus
gctgtgcgctctcaacgtggtttat

SEQ ID NO: 115994 - DNA, 25 bp, Mus musculus
gctgtgcggactctgtgaaaagacc

SEQ ID NO: 115995 - DNA, 25 bp, Mus musculus
gctgtgcgggaccaagcttggctgt

SEQ ID NO: 115996 - DNA, 25 bp, Mus musculus
gctgtgctcccaaagtactgtgtgc

SEQ ID NO: 115997 - DNA, 25 bp, Mus musculus
gctgtgctctttgccaaactcgaga

SEQ ID NO: 115998 - DNA, 25 bp, Mus musculus
gctgtgctgtcagtatctgggttaa

SEQ ID NO: 115999 - DNA, 25 bp, Mus musculus
gctgtggaacgccaactttcggtat

SEQ ID NO: 116000 - DNA, 25 bp, Mus musculus
gctgtggaagcgactgtgtcagtac

SEQ ID NO: 116001 - DNA, 25 bp, Mus musculus
gctgtggaccatacggagatctgcc

SEQ ID NO: 116002 - DNA, 25 bp, Mus musculus
gctgtggacctcagacatgcagggt

SEQ ID NO: 116003 - DNA, 25 bp, Mus musculus
gctgtggactccaaaccactgctag

SEQ ID NO: 116004 - DNA, 25 bp, Mus musculus
gctgtggagttcaccccggatgagt

SEQ ID NO: 116005 - DNA, 25 bp, Mus musculus
gctgtggcaaccgaaatgagactcc

SEQ ID NO: 116006 - DNA, 25 bp, Mus musculus
gctgtggcccagagacttttcagta

SEQ ID NO: 116007 - DNA, 25 bp, Mus musculus
gctgtggccgcaacctgtgattaaa

SEQ ID NO: 116008 - DNA, 25 bp, Mus musculus
gctgtggcgaggaccataccgtgaa

SEQ ID NO: 116009 - DNA, 25 bp, Mus musculus
gctgtggctgacctctggaaaccct

SEQ ID NO: 116010 - DNA, 25 bp, Mus musculus
gctgtggctgactatgtggaacctt

SEQ ID NO: 116011 - DNA, 25 bp, Mus musculus
gctgtgggccatgctcattgtcgtg

SEQ ID NO: 116012 - DNA, 25 bp, Mus musculus
gctgtggtcctgtcaaggaaactct

SEQ ID NO: 116013 - DNA, 25 bp, Mus musculus
gctgtggtccttctgctaaagcaaa

SEQ ID NO: 116014 - DNA, 25 bp, Mus musculus
gctgtggtctgcctgttactggaaa

SEQ ID NO: 116015 - DNA, 25 bp, Mus musculus
gctgtgtaaacgagccctggagatc

SEQ ID NO: 116016 - DNA, 25 bp, Mus musculus
gctgtgtagccttttaaccacctga

SEQ ID NO: 116017 - DNA, 25 bp, Mus musculus
gctgtgtcagaagaccatggctcca

SEQ ID NO: 116018 - DNA, 25 bp, Mus musculus
gctgtgtccgcagcaagcgatgaga

SEQ ID NO: 116019 - DNA, 25 bp, Mus musculus
gctgtgtccgtttccccactgatgg

SEQ ID NO: 116020 - DNA, 25 bp, Mus musculus
gctgtgtctcaggaagctgctcagg

SEQ ID NO: 116021 - DNA, 25 bp, Mus musculus
gctgtgtgacggtgtggcttcctca

SEQ ID NO: 116022 - DNA, 25 bp, Mus musculus
gctgtgtgactgtccccgaggaact

SEQ ID NO: 116023 - DNA, 25 bp, Mus musculus
gctgtgtgccccaagagtgactctg

SEQ ID NO: 116024 - DNA, 25 bp, Mus musculus
gctgtgtgcgatgacgtgcaatgca

SEQ ID NO: 116025 - DNA, 25 bp, Mus musculus
gctgtgtgcgcgcaggagcgagctg

SEQ ID NO: 116026 - DNA, 25 bp, Mus musculus
gctgtgtggcactaacaagaatttg

SEQ ID NO: 116027 - DNA, 25 bp, Mus musculus
gctgtgttcccctagacgaaaaact

SEQ ID NO: 116028 - DNA, 25 bp, Mus musculus
gctgtgtttaaacggcccaaatctt

SEQ ID NO: 116029 - DNA, 25 bp, Mus musculus
gctgtgtttcaaatcaacctatatt

SEQ ID NO: 116030 - DNA, 25 bp, Mus musculus
gctgtgttttcagaagtagcacgca

SEQ ID NO: 116031 - DNA, 25 bp, Mus musculus
gctgtgttttctctgtcaagtactg

SEQ ID NO: 116032 - DNA, 25 bp, Mus musculus
gctgttaagaagagtgccaccatgg

SEQ ID NO: 116033 - DNA, 25 bp, Mus musculus
gctgttaccactccttgtaccttga

SEQ ID NO: 116034 - DNA, 25 bp, Mus musculus
gctgttaggcctctgccattggcag

SEQ ID NO: 116035 - DNA, 25 bp, Mus musculus
gctgttatcgaacgcagtcggcaca

SEQ ID NO: 116036 - DNA, 25 bp, Mus musculus
gctgttcaaaaactagcccgaaggg

SEQ ID NO: 116037 - DNA, 25 bp, Mus musculus
gctgttccccaagagagctcatgtg

SEQ ID NO: 116038 - DNA, 25 bp, Mus musculus
gctgttccgcaagatcaatgccaga

SEQ ID NO: 116039 - DNA, 25 bp, Mus musculus
gctgttcctgcccaagagtgtatct

SEQ ID NO: 116040 - DNA, 25 bp, Mus musculus
gctgttcgcgtggtctctgctcctg

SEQ ID NO: 116041 - DNA, 25 bp, Mus musculus
gctgttcgtcaagagtatgtcgagc

SEQ ID NO: 116042 - DNA, 25 bp, Mus musculus
gctgttctaagtagtccactggcat

SEQ ID NO: 116043 - DNA, 25 bp, Mus musculus
gctgttctcatatgctatcctggga

SEQ ID NO: 116044 - DNA, 25 bp, Mus musculus
gctgttctctgtgcggaaggcccgt

SEQ ID NO: 116045 - DNA, 25 bp, Mus musculus
gctgttctgctgtggtgccggtttc

SEQ ID NO: 116046 - DNA, 25 bp, Mus musculus
gctgttctgttctgtggttcctcac

SEQ ID NO: 116047 - DNA, 25 bp, Mus musculus
gctgttcttattctctattctccgg

SEQ ID NO: 116048 - DNA, 25 bp, Mus musculus
gctgttgacatcagctcagggctca

SEQ ID NO: 116049 - DNA, 25 bp, Mus musculus
gctgttgacccaaagatgatgatga

SEQ ID NO: 116050 - DNA, 25 bp, Mus musculus
gctgttgagtcacctgcgagccgaa

SEQ ID NO: 116051 - DNA, 25 bp, Mus musculus
gctgttgctgcacttccgcttctct

SEQ ID NO: 116052 - DNA, 25 bp, Mus musculus
gctgttgctgccctcgtgtccgctg

SEQ ID NO: 116053 - DNA, 25 bp, Mus musculus
gctgttgctggacatcctgccttcc

SEQ ID NO: 116054 - DNA, 25 bp, Mus musculus
gctgttggagaacattccagaaaac

SEQ ID NO: 116055 - DNA, 25 bp, Mus musculus
gctgttggcagactctaccttgtcc

SEQ ID NO: 116056 - DNA, 25 bp, Mus musculus
gctgttggcccgagactttgagaag

SEQ ID NO: 116057 - DNA, 25 bp, Mus musculus
gctgttggccgagtcaccctggctt

SEQ ID NO: 116058 - DNA, 25 bp, Mus musculus
gctgttggcggaatataaacacaca

SEQ ID NO: 116059 - DNA, 25 bp, Mus musculus
gctgttggcggcgttgcggctgagc

SEQ ID NO: 116060 - DNA, 25 bp, Mus musculus
gctgttggcggctgcagaaccagat

SEQ ID NO: 116061 - DNA, 25 bp, Mus musculus
gctgttgtccaattcctcaggcggg

SEQ ID NO: 116062 - DNA, 25 bp, Mus musculus
gctgttgtgctcagcgctgctggcc

SEQ ID NO: 116063 - DNA, 25 bp, Mus musculus
gctgttgtgggaaaaagctgcatca

SEQ ID NO: 116064 - DNA, 25 bp, Mus musculus
gctgtttccaaagaagtgactcgaa

SEQ ID NO: 116065 - DNA, 25 bp, Mus musculus
gctgtttcgcatccaatagactagg

SEQ ID NO: 116066 - DNA, 25 bp, Mus musculus
gctgtttctgaccaagcaggagctg

SEQ ID NO: 116067 - DNA, 25 bp, Mus musculus
gctgtttgcaacacagtactgtggc

SEQ ID NO: 116068 - DNA, 25 bp, Mus musculus
gctgtttgcagagccaagagcctga

SEQ ID NO: 116069 - DNA, 25 bp, Mus musculus
gctgtttgccacaccgatgcctata

SEQ ID NO: 116070 - DNA, 25 bp, Mus musculus
gctgtttgcggcttctctggtcgag

SEQ ID NO: 116071 - DNA, 25 bp, Mus musculus
gctgttttagaattaggactccgca

SEQ ID NO: 116072 - DNA, 25 bp, Mus musculus
gctgttttatagcaccgcagagaga

SEQ ID NO: 116073 - DNA, 25 bp, Mus musculus
gctgttttgtcctgcccacgtttct

SEQ ID NO: 116074 - DNA, 25 bp, Mus musculus
gctgttttgttaccgtgtgccctat

SEQ ID NO: 116075 - DNA, 25 bp, Mus musculus
gcttaaaaagcaccgaggttgccaa

SEQ ID NO: 116076 - DNA, 25 bp, Mus musculus
gcttaaaacacagtgaacccggagc

SEQ ID NO: 116077 - DNA, 25 bp, Mus musculus
gcttaaatcgcagggaggactcaga

SEQ ID NO: 116078 - DNA, 25 bp, Mus musculus
gcttaaattttatcagagagctgca

SEQ ID NO: 116079 - DNA, 25 bp, Mus musculus
gcttaacagtgacaagaaggagaag

SEQ ID NO: 116080 - DNA, 25 bp, Mus musculus
gcttaagacccaagtccagagtgtg

SEQ ID NO: 116081 - DNA, 25 bp, Mus musculus
gcttaagcgcgagcctgggagagaa

SEQ ID NO: 116082 - DNA, 25 bp, Mus musculus
gcttaaggtcaggtggcaggactca

SEQ ID NO: 116083 - DNA, 25 bp, Mus musculus
gcttaagtaagatcctgcaggaccc

SEQ ID NO: 116084 - DNA, 25 bp, Mus musculus
gcttaagtgaagacggctacaccta

SEQ ID NO: 116085 - DNA, 25 bp, Mus musculus
gcttaataaccctggtgcagcctga

SEQ ID NO: 116086 - DNA, 25 bp, Mus musculus
gcttaatgaactatgtgggccactg

SEQ ID NO: 116087 - DNA, 25 bp, Mus musculus
gcttaatgcccatcttcacagaaga

SEQ ID NO: 116088 - DNA, 25 bp, Mus musculus
gcttaattgtgcacatccgcgtcca

SEQ ID NO: 116089 - DNA, 25 bp, Mus musculus
gcttacaaggttcatgaagacatgt

SEQ ID NO: 116090 - DNA, 25 bp, Mus musculus
gcttacacatgctgatttggacgaa

SEQ ID NO: 116091 - DNA, 25 bp, Mus musculus
gcttacactgggaggctacttctgc

SEQ ID NO: 116092 - DNA, 25 bp, Mus musculus
gcttacacttgcttggaggctgcca

SEQ ID NO: 116093 - DNA, 25 bp, Mus musculus
gcttacatgtgtgtcccgtgtcctg

SEQ ID NO: 116094 - DNA, 25 bp, Mus musculus
gcttaccaaggttagcagccagcta

SEQ ID NO: 116095 - DNA, 25 bp, Mus musculus
gcttacgcaaattcaacgcccggag

SEQ ID NO: 116096 - DNA, 25 bp, Mus musculus
gcttacggatccacaggcattcggg

SEQ ID NO: 116097 - DNA, 25 bp, Mus musculus
gcttacggccgtggcgttgtcaccg

SEQ ID NO: 116098 - DNA, 25 bp, Mus musculus
gcttacggctctgctggctttgacc

SEQ ID NO: 116099 - DNA, 25 bp, Mus musculus
gcttacgtcatggagcacaggcaca

SEQ ID NO: 116100 - DNA, 25 bp, Mus musculus
gcttacgtggctgaagtctggacca

SEQ ID NO: 116101 - DNA, 25 bp, Mus musculus
gcttactaagtgctcggcatgatgt

SEQ ID NO: 116102 - DNA, 25 bp, Mus musculus
gcttagaccattaaagggaccaggg

SEQ ID NO: 116103 - DNA, 25 bp, Mus musculus
gcttagacctgggtattgggaatat

SEQ ID NO: 116104 - DNA, 25 bp, Mus musculus
gcttagagcagctgctgccggagct

SEQ ID NO: 116105 - DNA, 25 bp, Mus musculus
gcttagagtcatggtcctcacggca

SEQ ID NO: 116106 - DNA, 25 bp, Mus musculus
gcttagatgcgccacggcttcggta

SEQ ID NO: 116107 - DNA, 25 bp, Mus musculus
gcttagcacgtcttcccaggcttcg

SEQ ID NO: 116108 - DNA, 25 bp, Mus musculus
gcttagccaccagaaacagaatcag

SEQ ID NO: 116109 - DNA, 25 bp, Mus musculus
gcttagccggcaactacagaagatg

SEQ ID NO: 116110 - DNA, 25 bp, Mus musculus
gcttagcctaccctttcccagatgg

SEQ ID NO: 116111 - DNA, 25 bp, Mus musculus
gcttagcctatctgcccgaatggaa

SEQ ID NO: 116112 - DNA, 25 bp, Mus musculus
gcttagcctctgaccatagtggaca

SEQ ID NO: 116113 - DNA, 25 bp, Mus musculus
gcttagcggctggagcaccgattct

SEQ ID NO: 116114 - DNA, 25 bp, Mus musculus
gcttagcttccgcagttccaggtga

SEQ ID NO: 116115 - DNA, 25 bp, Mus musculus
gcttaggaacacaagtgccatgcct

SEQ ID NO: 116116 - DNA, 25 bp, Mus musculus
gcttagggagaatgagcaccatgcc

SEQ ID NO: 116117 - DNA, 25 bp, Mus musculus
gcttagggccaacaaggagaacttg

SEQ ID NO: 116118 - DNA, 25 bp, Mus musculus
gcttagtgctccatacagggttgca

SEQ ID NO: 116119 - DNA, 25 bp, Mus musculus
gcttagtggtcctggcaatgctgca

SEQ ID NO: 116120 - DNA, 25 bp, Mus musculus
gcttagttttcacacagctgaggat

SEQ ID NO: 116121 - DNA, 25 bp, Mus musculus
gcttataccaggcacgcatcgtcaa

SEQ ID NO: 116122 - DNA, 25 bp, Mus musculus
gcttatacccctagaaggaagatgg

SEQ ID NO: 116123 - DNA, 25 bp, Mus musculus
gcttataggagatcaagaacccgag

SEQ ID NO: 116124 - DNA, 25 bp, Mus musculus
gcttatcacggaccaccactggaac

SEQ ID NO: 116125 - DNA, 25 bp, Mus musculus
gcttatgggttgctgtccagacaca

SEQ ID NO: 116126 - DNA, 25 bp, Mus musculus
gcttatgtccatatctcccagtgcg

SEQ ID NO: 116127 - DNA, 25 bp, Mus musculus
gcttattcagggacactgggcacca

SEQ ID NO: 116128 - DNA, 25 bp, Mus musculus
gcttattctgcagtggtttttgaca

SEQ ID NO: 116129 - DNA, 25 bp, Mus musculus
gcttattgagttcgcctacacggcc

SEQ ID NO: 116130 - DNA, 25 bp, Mus musculus
gcttatttgtggaggcgacacccca

SEQ ID NO: 116131 - DNA, 25 bp, Mus musculus
gcttcaaaataatgcccgcggcgga

SEQ ID NO: 116132 - DNA, 25 bp, Mus musculus
gcttcaaacgttctcggaccctgga

SEQ ID NO: 116133 - DNA, 25 bp, Mus musculus
gcttcaaagcacacaagaatgtcct

SEQ ID NO: 116134 - DNA, 25 bp, Mus musculus
gcttcaactttcacacgcaaaatgg

SEQ ID NO: 116135 - DNA, 25 bp, Mus musculus
gcttcaagcccatcaagcacgggag

SEQ ID NO: 116136 - DNA, 25 bp, Mus musculus
gcttcaagctcagtagcaggacctg

SEQ ID NO: 116137 - DNA, 25 bp, Mus musculus
gcttcacacgcgtccagagaaatgg

SEQ ID NO: 116138 - DNA, 25 bp, Mus musculus
gcttcacagatgacgacaagactga

SEQ ID NO: 116139 - DNA, 25 bp, Mus musculus
gcttcacattggtggcctgggaccc

SEQ ID NO: 116140 - DNA, 25 bp, Mus musculus
gcttcaccacctacgagatcagggt

SEQ ID NO: 116141 - DNA, 25 bp, Mus musculus
gcttcaccagagatggaatgggact

SEQ ID NO: 116142 - DNA, 25 bp, Mus musculus
gcttcacccaggtttccgacgaact

SEQ ID NO: 116143 - DNA, 25 bp, Mus musculus
gcttcactgtgagggactgcagcag

SEQ ID NO: 116144 - DNA, 25 bp, Mus musculus
gcttcagaaaaggacagcggctccg

SEQ ID NO: 116145 - DNA, 25 bp, Mus musculus
gcttcagagagcagtgtagagtcct

SEQ ID NO: 116146 - DNA, 25 bp, Mus musculus
gcttcagatctggtcactatggtac

SEQ ID NO: 116147 - DNA, 25 bp, Mus musculus
gcttcagcaggagccaaggaactca

SEQ ID NO: 116148 - DNA, 25 bp, Mus musculus
gcttcagcccggagatgaggttgcc

SEQ ID NO: 116149 - DNA, 25 bp, Mus musculus
gcttcagccggttcaaaaacagaga

SEQ ID NO: 116150 - DNA, 25 bp, Mus musculus
gcttcagcctagatccgctcatgga

SEQ ID NO: 116151 - DNA, 25 bp, Mus musculus
gcttcagcgctgtttgtgggcataa

SEQ ID NO: 116152 - DNA, 25 bp, Mus musculus
gcttcagcggtgagatccccgatga

SEQ ID NO: 116153 - DNA, 25 bp, Mus musculus
gcttcagctcaactccgcagaggag

SEQ ID NO: 116154 - DNA, 25 bp, Mus musculus
gcttcaggagcgaatgatgagccta

SEQ ID NO: 116155 - DNA, 25 bp, Mus musculus
gcttcaggagctctactgtgagatt

SEQ ID NO: 116156 - DNA, 25 bp, Mus musculus
gcttcaggatcaagaaccgctgctg

SEQ ID NO: 116157 - DNA, 25 bp, Mus musculus
gcttcaggcacttcttggacatcat

SEQ ID NO: 116158 - DNA, 25 bp, Mus musculus
gcttcagtaaatgctccccggagtg

SEQ ID NO: 116159 - DNA, 25 bp, Mus musculus
gcttcagtccagagtatcggcgcat

SEQ ID NO: 116160 - DNA, 25 bp, Mus musculus
gcttcagtctgacctatcctcacaa

SEQ ID NO: 116161 - DNA, 25 bp, Mus musculus
gcttcagtgatgacaggcagctgtc

SEQ ID NO: 116162 - DNA, 25 bp, Mus musculus
gcttcagtggacaaaatcatctcgc

SEQ ID NO: 116163 - DNA, 25 bp, Mus musculus
gcttcatatgggaatgctgtgtgta

SEQ ID NO: 116164 - DNA, 25 bp, Mus musculus
gcttcatatgtcatggaaactagga

SEQ ID NO: 116165 - DNA, 25 bp, Mus musculus
gcttcatcaaaagagtccacatgtg

SEQ ID NO: 116166 - DNA, 25 bp, Mus musculus
gcttcatcacgtacacagtgggtgt

SEQ ID NO: 116167 - DNA, 25 bp, Mus musculus
gcttcatccagctaaaaccaaaggt

SEQ ID NO: 116168 - DNA, 25 bp, Mus musculus
gcttcatcctgtttggaaattctac

SEQ ID NO: 116169 - DNA, 25 bp, Mus musculus
gcttcatgatgcaccagatccggaa

SEQ ID NO: 116170 - DNA, 25 bp, Mus musculus
gcttcatggctgaatgtgctaggga

SEQ ID NO: 116171 - DNA, 25 bp, Mus musculus
gcttcatgggctacctgagaatctt

SEQ ID NO: 116172 - DNA, 25 bp, Mus musculus
gcttcattaaacattctgcattggg

SEQ ID NO: 116173 - DNA, 25 bp, Mus musculus
gcttcattttgtgatccaccaaggg

SEQ ID NO: 116174 - DNA, 25 bp, Mus musculus
gcttccaagacaaaacccgagcagg

SEQ ID NO: 116175 - DNA, 25 bp, Mus musculus
gcttccaagtgaggaggttccgtca

SEQ ID NO: 116176 - DNA, 25 bp, Mus musculus
gcttccagacggtgtacaactactt

SEQ ID NO: 116177 - DNA, 25 bp, Mus musculus
gcttccagaggaacgagcgcttcat

SEQ ID NO: 116178 - DNA, 25 bp, Mus musculus
gcttccagagttcccaaggttactg

SEQ ID NO: 116179 - DNA, 25 bp, Mus musculus
gcttccagcagcagaaacttcgtgt

SEQ ID NO: 116180 - DNA, 25 bp, Mus musculus
gcttccagccatacgagtcctacga

SEQ ID NO: 116181 - DNA, 25 bp, Mus musculus
gcttccaggcctgcggggcgagagt

SEQ ID NO: 116182 - DNA, 25 bp, Mus musculus
gcttccagtgctacggttatgaccc

SEQ ID NO: 116183 - DNA, 25 bp, Mus musculus
gcttccagtggacgagaccttctcg

SEQ ID NO: 116184 - DNA, 25 bp, Mus musculus
gcttccataaggatagactgacatg

SEQ ID NO: 116185 - DNA, 25 bp, Mus musculus
gcttcccagaagacgatgagcccct

SEQ ID NO: 116186 - DNA, 25 bp, Mus musculus
gcttcccagctcgaagaggagtttg

SEQ ID NO: 116187 - DNA, 25 bp, Mus musculus
gcttcccaggcaaagatggacgtga

SEQ ID NO: 116188 - DNA, 25 bp, Mus musculus
gcttcccagtagaggaccagcgtga

SEQ ID NO: 116189 - DNA, 25 bp, Mus musculus
gcttcccgctgatagattcaagttc

SEQ ID NO: 116190 - DNA, 25 bp, Mus musculus
gcttcccgtctgacattggcgtctt

SEQ ID NO: 116191 - DNA, 25 bp, Mus musculus
gcttccctgagcgaaaacatccttg

SEQ ID NO: 116192 - DNA, 25 bp, Mus musculus
gcttccctgtgctcaggactccaga

SEQ ID NO: 116193 - DNA, 25 bp, Mus musculus
gcttcccttaaaacaaatctgcctg

SEQ ID NO: 116194 - DNA, 25 bp, Mus musculus
gcttccgaagccaggaggatctaaa

SEQ ID NO: 116195 - DNA, 25 bp, Mus musculus
gcttccgaagtcttagtgccctgtt

SEQ ID NO: 116196 - DNA, 25 bp, Mus musculus
gcttccgaggaacaccgtgcgccag

SEQ ID NO: 116197 - DNA, 25 bp, Mus musculus
gcttccgagtcaaggagaacttcga

SEQ ID NO: 116198 - DNA, 25 bp, Mus musculus
gcttccggaaacatgcttgctcttg

SEQ ID NO: 116199 - DNA, 25 bp, Mus musculus
gcttccggaagcgttggttcaccat

SEQ ID NO: 116200 - DNA, 25 bp, Mus musculus
gcttccggtactgttggcgcgcatc

SEQ ID NO: 116201 - DNA, 25 bp, Mus musculus
gcttccgtttggaaagccgcagcct

SEQ ID NO: 116202 - DNA, 25 bp, Mus musculus
gcttcctagtgtacagtgagcgcac

SEQ ID NO: 116203 - DNA, 25 bp, Mus musculus
gcttcctcactctgcgggtggctac

SEQ ID NO: 116204 - DNA, 25 bp, Mus musculus
gcttcctcagaagagcagcgacgaa

SEQ ID NO: 116205 - DNA, 25 bp, Mus musculus
gcttcctccgtgtacccaagtgggt

SEQ ID NO: 116206 - DNA, 25 bp, Mus musculus
gcttcctctggtatcagattgccca

SEQ ID NO: 116207 - DNA, 25 bp, Mus musculus
gcttcctgaatgagaggcgggaaca

SEQ ID NO: 116208 - DNA, 25 bp, Mus musculus
gcttcctgccggaggcttttgccca

SEQ ID NO: 116209 - DNA, 25 bp, Mus musculus
gcttcctggtgagccaaatgactct

SEQ ID NO: 116210 - DNA, 25 bp, Mus musculus
gcttccttctcgcaaccggaactgg

SEQ ID NO: 116211 - DNA, 25 bp, Mus musculus
gcttcgaagaccttaacctggccgg

SEQ ID NO: 116212 - DNA, 25 bp, Mus musculus
gcttcgaagtcggaatctaggacat

SEQ ID NO: 116213 - DNA, 25 bp, Mus musculus
gcttcgagccaaggaatggaaaaca

SEQ ID NO: 116214 - DNA, 25 bp, Mus musculus
gcttcgagtaccttccacagctcaa

SEQ ID NO: 116215 - DNA, 25 bp, Mus musculus
gcttcgcaaagatgagcagagctcg

SEQ ID NO: 116216 - DNA, 25 bp, Mus musculus
gcttcgcaccaggtactgcagtctg

SEQ ID NO: 116217 - DNA, 25 bp, Mus musculus
gcttcgcatcaagtccgagaacgga

SEQ ID NO: 116218 - DNA, 25 bp, Mus musculus
gcttcgcggagcttgcacaaatcta

SEQ ID NO: 116219 - DNA, 25 bp, Mus musculus
gcttcgcgggcgacgatgctccccg

SEQ ID NO: 116220 - DNA, 25 bp, Mus musculus
gcttcgctctatcttcccaggagga

SEQ ID NO: 116221 - DNA, 25 bp, Mus musculus
gcttcgctgatggtgtcggtgaacc

SEQ ID NO: 116222 - DNA, 25 bp, Mus musculus
gcttcgctttgttcacgaggcacca

SEQ ID NO: 116223 - DNA, 25 bp, Mus musculus
gcttcggatctactatacctctagg

SEQ ID NO: 116224 - DNA, 25 bp, Mus musculus
gcttcggcaaagctggaatatagga

SEQ ID NO: 116225 - DNA, 25 bp, Mus musculus
gcttcggcttccagcgcttgaggga

SEQ ID NO: 116226 - DNA, 25 bp, Mus musculus
gcttcgggaccctaactgtatggac

SEQ ID NO: 116227 - DNA, 25 bp, Mus musculus
gcttcgggtccagcttaagaggcac

SEQ ID NO: 116228 - DNA, 25 bp, Mus musculus
gcttcgtcttcatccggctcatcgt

SEQ ID NO: 116229 - DNA, 25 bp, Mus musculus
gcttcgtgccctatttcatactgga

SEQ ID NO: 116230 - DNA, 25 bp, Mus musculus
gcttcgtgtgctgcaagaccttcga

SEQ ID NO: 116231 - DNA, 25 bp, Mus musculus
gcttcgtgttcatcagcatgatcct

SEQ ID NO: 116232 - DNA, 25 bp, Mus musculus
gcttctaaagctggttcctacactc

SEQ ID NO: 116233 - DNA, 25 bp, Mus musculus
gcttctaagcagatcaccaggccag

SEQ ID NO: 116234 - DNA, 25 bp, Mus musculus
gcttctaatctgtgggaaccgcggg

SEQ ID NO: 116235 - DNA, 25 bp, Mus musculus
gcttctacaggatcgacagagccca

SEQ ID NO: 116236 - DNA, 25 bp, Mus musculus
gcttctaccagatgcatggatgaaa

SEQ ID NO: 116237 - DNA, 25 bp, Mus musculus
gcttctaccagtgggcgtgcctaca

SEQ ID NO: 116238 - DNA, 25 bp, Mus musculus
gcttctagaagtgtcgcagcacgtg

SEQ ID NO: 116239 - DNA, 25 bp, Mus musculus
gcttctagaggaagaaacctacgtt

SEQ ID NO: 116240 - DNA, 25 bp, Mus musculus
gcttctagctttgtacttgctccag

SEQ ID NO: 116241 - DNA, 25 bp, Mus musculus
gcttctaggaggacagcggacctct

SEQ ID NO: 116242 - DNA, 25 bp, Mus musculus
gcttctaggctagcaaaggagtcct

SEQ ID NO: 116243 - DNA, 25 bp, Mus musculus
gcttctatatacatttccagggtgg

SEQ ID NO: 116244 - DNA, 25 bp, Mus musculus
gcttctatcacaagagagtcaggag

SEQ ID NO: 116245 - DNA, 25 bp, Mus musculus
gcttctatcaggcactgctgacggt

SEQ ID NO: 116246 - DNA, 25 bp, Mus musculus
gcttctcacctctgacgacaaagtt

SEQ ID NO: 116247 - DNA, 25 bp, Mus musculus
gcttctcagccaaaagaccggcgtg

SEQ ID NO: 116248 - DNA, 25 bp, Mus musculus
gcttctcagcctcaagtgttccagg

SEQ ID NO: 116249 - DNA, 25 bp, Mus musculus
gcttctcccgcgtcgccggcggctg

SEQ ID NO: 116250 - DNA, 25 bp, Mus musculus
gcttctccgtgtccatgctagcagg

SEQ ID NO: 116251 - DNA, 25 bp, Mus musculus
gcttctcctttcacattacctcaag

SEQ ID NO: 116252 - DNA, 25 bp, Mus musculus
gcttctcggagtccctgctctgaca

SEQ ID NO: 116253 - DNA, 25 bp, Mus musculus
gcttctcggtcttccagctgcttat

SEQ ID NO: 116254 - DNA, 25 bp, Mus musculus
gcttctcgtttgaggattccgaccg

SEQ ID NO: 116255 - DNA, 25 bp, Mus musculus
gcttctctcggacttttggtcatga

SEQ ID NO: 116256 - DNA, 25 bp, Mus musculus
gcttctctgcaagaactggctcaga

SEQ ID NO: 116257 - DNA, 25 bp, Mus musculus
gcttctgaacgtcgtgaggccatca

SEQ ID NO: 116258 - DNA, 25 bp, Mus musculus
gcttctgacgaagacgagcgcttgt

SEQ ID NO: 116259 - DNA, 25 bp, Mus musculus
gcttctgagagtaagtggccctggc

SEQ ID NO: 116260 - DNA, 25 bp, Mus musculus
gcttctgagctaaggaatggccatg

SEQ ID NO: 116261 - DNA, 25 bp, Mus musculus
gcttctgcaaacataagtggctctg

SEQ ID NO: 116262 - DNA, 25 bp, Mus musculus
gcttctgcagaagatgttttatcac

SEQ ID NO: 116263 - DNA, 25 bp, Mus musculus
gcttctgccaggacccagtcatttg

SEQ ID NO: 116264 - DNA, 25 bp, Mus musculus
gcttctgcctaaagtggtgaacaca

SEQ ID NO: 116265 - DNA, 25 bp, Mus musculus
gcttctggaaatcaccgaagggtca

SEQ ID NO: 116266 - DNA, 25 bp, Mus musculus
gcttctggacgcgttgcctgctctg

SEQ ID NO: 116267 - DNA, 25 bp, Mus musculus
gcttctggagcatcgaaagcagcag

SEQ ID NO: 116268 - DNA, 25 bp, Mus musculus
gcttctgggaacaagatggcatccg

SEQ ID NO: 116269 - DNA, 25 bp, Mus musculus
gcttctgggctacctgaaaaatacc

SEQ ID NO: 116270 - DNA, 25 bp, Mus musculus
gcttctgggctattctggccttggt

SEQ ID NO: 116271 - DNA, 25 bp, Mus musculus
gcttctgggttgctagactcatgtc

SEQ ID NO: 116272 - DNA, 25 bp, Mus musculus
gcttctggtgcctcaacagggagca

SEQ ID NO: 116273 - DNA, 25 bp, Mus musculus
gcttctgtaagtgagtcccgggacg

SEQ ID NO: 116274 - DNA, 25 bp, Mus musculus
gcttctgtactaagatgcccgtgga

SEQ ID NO: 116275 - DNA, 25 bp, Mus musculus
gcttctgtcggagtcagagattcaa

SEQ ID NO: 116276 - DNA, 25 bp, Mus musculus
gcttctgtctgggatcgctctggca

SEQ ID NO: 116277 - DNA, 25 bp, Mus musculus
gcttctgtgggaacaatcctgacta

SEQ ID NO: 116278 - DNA, 25 bp, Mus musculus
gcttcttagagaacgcccataggga

SEQ ID NO: 116279 - DNA, 25 bp, Mus musculus
gcttcttagccatgtttgtcgccac

SEQ ID NO: 116280 - DNA, 25 bp, Mus musculus
gcttcttcagaacaggaagcaccca

SEQ ID NO: 116281 - DNA, 25 bp, Mus musculus
gcttcttccaacaaaaaggcctccg

SEQ ID NO: 116282 - DNA, 25 bp, Mus musculus
gcttcttccagagacatgggctgtg

SEQ ID NO: 116283 - DNA, 25 bp, Mus musculus
gcttcttgcgcacggatcagctgga

SEQ ID NO: 116284 - DNA, 25 bp, Mus musculus
gcttcttgctctcaaagagccggga

SEQ ID NO: 116285 - DNA, 25 bp, Mus musculus
gcttctttcccgtggtaacaccaag

SEQ ID NO: 116286 - DNA, 25 bp, Mus musculus
gcttctttctatgagcgagcaggca

SEQ ID NO: 116287 - DNA, 25 bp, Mus musculus
gcttctttgaacagcggaaccagcg

SEQ ID NO: 116288 - DNA, 25 bp, Mus musculus
gcttgaacaccacgatacaggcctg

SEQ ID NO: 116289 - DNA, 25 bp, Mus musculus
gcttgaagatagaggccgccaatgt

SEQ ID NO: 116290 - DNA, 25 bp, Mus musculus
gcttgaagcaaaaaccaataagaaa

SEQ ID NO: 116291 - DNA, 25 bp, Mus musculus
gcttgaagccaaggaggacctgtat

SEQ ID NO: 116292 - DNA, 25 bp, Mus musculus
gcttgaatgaccgagtgtgcccgaa

SEQ ID NO: 116293 - DNA, 25 bp, Mus musculus
gcttgaatgcagatgtctcctggaa

SEQ ID NO: 116294 - DNA, 25 bp, Mus musculus
gcttgaatttcctggcagctaaggg

SEQ ID NO: 116295 - DNA, 25 bp, Mus musculus
gcttgacaactttatcccagggtgg

SEQ ID NO: 116296 - DNA, 25 bp, Mus musculus
gcttgacatctagggacacacccag

SEQ ID NO: 116297 - DNA, 25 bp, Mus musculus
gcttgaccgcattggcaaaggctca

SEQ ID NO: 116298 - DNA, 25 bp, Mus musculus
gcttgacgctggatctttttctgca

SEQ ID NO: 116299 - DNA, 25 bp, Mus musculus
gcttgacttcttgcacaggctacgt

SEQ ID NO: 116300 - DNA, 25 bp, Mus musculus
gcttgagaaagagatccaagatctt

SEQ ID NO: 116301 - DNA, 25 bp, Mus musculus
gcttgagaaggaattacactatgtc

SEQ ID NO: 116302 - DNA, 25 bp, Mus musculus
gcttgagagcaacaccctatcacag

SEQ ID NO: 116303 - DNA, 25 bp, Mus musculus
gcttgagagtcccaaagagacgccc

SEQ ID NO: 116304 - DNA, 25 bp, Mus musculus
gcttgagcagctccgtggaaacgtt

SEQ ID NO: 116305 - DNA, 25 bp, Mus musculus
gcttgagcgcacaggcacaaccaag

SEQ ID NO: 116306 - DNA, 25 bp, Mus musculus
gcttgagggtccagtcaccggaagt

SEQ ID NO: 116307 - DNA, 25 bp, Mus musculus
gcttgagtcccagaatcagctgctg

SEQ ID NO: 116308 - DNA, 25 bp, Mus musculus
gcttgagtccgtgcctagagtctta

SEQ ID NO: 116309 - DNA, 25 bp, Mus musculus
gcttgagtgaggtcgacaagaactc

SEQ ID NO: 116310 - DNA, 25 bp, Mus musculus
gcttgataaagaatgccagaggctc

SEQ ID NO: 116311 - DNA, 25 bp, Mus musculus
gcttgatgcagcttcgtacgcagga

SEQ ID NO: 116312 - DNA, 25 bp, Mus musculus
gcttgatggcctgtgtgtccgcaga

SEQ ID NO: 116313 - DNA, 25 bp, Mus musculus
gcttgatttctgttgtctcaaagga

SEQ ID NO: 116314 - DNA, 25 bp, Mus musculus
gcttgcacattagagcgcacgtggt

SEQ ID NO: 116315 - DNA, 25 bp, Mus musculus
gcttgcaccacaggacaggttacga

SEQ ID NO: 116316 - DNA, 25 bp, Mus musculus
gcttgcagaatggagtcctggtcct

SEQ ID NO: 116317 - DNA, 25 bp, Mus musculus
gcttgcagctcactacagaacgaat

SEQ ID NO: 116318 - DNA, 25 bp, Mus musculus
gcttgcaggacagtgccaggctgca

SEQ ID NO: 116319 - DNA, 25 bp, Mus musculus
gcttgcaggccaaatgcacagagct

SEQ ID NO: 116320 - DNA, 25 bp, Mus musculus
gcttgcagggtggtcatgtcctcca

SEQ ID NO: 116321 - DNA, 25 bp, Mus musculus
gcttgcagtcgcagagtcctgagta

SEQ ID NO: 116322 - DNA, 25 bp, Mus musculus
gcttgccaaacagctatgcagagtt

SEQ ID NO: 116323 - DNA, 25 bp, Mus musculus
gcttgccaaagagctcaaagagttc

SEQ ID NO: 116324 - DNA, 25 bp, Mus musculus
gcttgccagacctccacgaagagtg

SEQ ID NO: 116325 - DNA, 25 bp, Mus musculus
gcttgccaggcatcaaaggagataa

SEQ ID NO: 116326 - DNA, 25 bp, Mus musculus
gcttgccgcccctacagtatgtgtt

SEQ ID NO: 116327 - DNA, 25 bp, Mus musculus
gcttgcctcgggatcactcttggaa

SEQ ID NO: 116328 - DNA, 25 bp, Mus musculus
gcttgcctctgtcttttgtccagtg

SEQ ID NO: 116329 - DNA, 25 bp, Mus musculus
gcttgcctcttgctggaccctgaga

SEQ ID NO: 116330 - DNA, 25 bp, Mus musculus
gcttgcgacaaggactctcagtgcg

SEQ ID NO: 116331 - DNA, 25 bp, Mus musculus
gcttgcggaagctagaacaagtgct

SEQ ID NO: 116332 - DNA, 25 bp, Mus musculus
gcttgcggccgcgtgtcgggctgtt

SEQ ID NO: 116333 - DNA, 25 bp, Mus musculus
gcttgcgggctctatatgaaactcc

SEQ ID NO: 116334 - DNA, 25 bp, Mus musculus
gcttgcgttgccagagtaaccggat

SEQ ID NO: 116335 - DNA, 25 bp, Mus musculus
gcttgctaaaatttgcacaactcac

SEQ ID NO: 116336 - DNA, 25 bp, Mus musculus
gcttgctacatggaggaactgcgac

SEQ ID NO: 116337 - DNA, 25 bp, Mus musculus
gcttgctacttgactgagactcgga

SEQ ID NO: 116338 - DNA, 25 bp, Mus musculus
gcttgctcaatgtcagccggactga

SEQ ID NO: 116339 - DNA, 25 bp, Mus musculus
gcttgctctcttttcccctcggaag

SEQ ID NO: 116340 - DNA, 25 bp, Mus musculus
gcttgctctgcaggcaccgtgtgca

SEQ ID NO: 116341 - DNA, 25 bp, Mus musculus
gcttgctgagccttatgggaaaata

SEQ ID NO: 116342 - DNA, 25 bp, Mus musculus
gcttgctggagcctgtctcttctta

SEQ ID NO: 116343 - DNA, 25 bp, Mus musculus
gcttgctggttctctatgttcttct

SEQ ID NO: 116344 - DNA, 25 bp, Mus musculus
gcttgcttggctaattcatgtggga

SEQ ID NO: 116345 - DNA, 25 bp, Mus musculus
gcttgcttgttacctgcagcgcgga

SEQ ID NO: 116346 - DNA, 25 bp, Mus musculus
gcttggaaagaagaggtagcaactt

SEQ ID NO: 116347 - DNA, 25 bp, Mus musculus
gcttggaatatgtaacgcacctctg

SEQ ID NO: 116348 - DNA, 25 bp, Mus musculus
gcttggacactagctttctgcacaa

SEQ ID NO: 116349 - DNA, 25 bp, Mus musculus
gcttggaccgggagcatatcctggc

SEQ ID NO: 116350 - DNA, 25 bp, Mus musculus
gcttggacttctatggcccagggcc

SEQ ID NO: 116351 - DNA, 25 bp, Mus musculus
gcttggaggcaatacccgtggctct

SEQ ID NO: 116352 - DNA, 25 bp, Mus musculus
gcttggatagacacaccttcagggc

SEQ ID NO: 116353 - DNA, 25 bp, Mus musculus
gcttggatctgtgaaccctgtactg

SEQ ID NO: 116354 - DNA, 25 bp, Mus musculus
gcttggcaaagcagaagagccgcac

SEQ ID NO: 116355 - DNA, 25 bp, Mus musculus
gcttggcacagttagccaccttgtg

SEQ ID NO: 116356 - DNA, 25 bp, Mus musculus
gcttggccatatggaagtacatgaa

SEQ ID NO: 116357 - DNA, 25 bp, Mus musculus
gcttggccattggaggcaacccaga

SEQ ID NO: 116358 - DNA, 25 bp, Mus musculus
gcttggcccagaacctcgtgagtga

SEQ ID NO: 116359 - DNA, 25 bp, Mus musculus
gcttggcccggaaatgatcactctg

SEQ ID NO: 116360 - DNA, 25 bp, Mus musculus
gcttggccgagaatgcagttggacc

SEQ ID NO: 116361 - DNA, 25 bp, Mus musculus
gcttggcctgacaaagcggaggcta

SEQ ID NO: 116362 - DNA, 25 bp, Mus musculus
gcttggcctgataactggactgacc

SEQ ID NO: 116363 - DNA, 25 bp, Mus musculus
gcttggcgacgatgcagctgtacct

SEQ ID NO: 116364 - DNA, 25 bp, Mus musculus
gcttggcgagaagggcttgcggccg

SEQ ID NO: 116365 - DNA, 25 bp, Mus musculus
gcttggcgctgcttcgagaacagtg

SEQ ID NO: 116366 - DNA, 25 bp, Mus musculus
gcttggcggcggttcattcagcact

SEQ ID NO: 116367 - DNA, 25 bp, Mus musculus
gcttggctcaccatgtttgatgcgg

SEQ ID NO: 116368 - DNA, 25 bp, Mus musculus
gcttgggaatgatgtcagctgctcc

SEQ ID NO: 116369 - DNA, 25 bp, Mus musculus
gcttgggagaacatggccactcttt

SEQ ID NO: 116370 - DNA, 25 bp, Mus musculus
gcttgggagtgcctcacagcaaacg

SEQ ID NO: 116371 - DNA, 25 bp, Mus musculus
gcttgggccccagctatgatgtacc

SEQ ID NO: 116372 - DNA, 25 bp, Mus musculus
gcttgggccgccatgaaaacgccat

SEQ ID NO: 116373 - DNA, 25 bp, Mus musculus
gcttgggtcttcctgctgatctaca

SEQ ID NO: 116374 - DNA, 25 bp, Mus musculus
gcttggtacaactcaggatcctgga

SEQ ID NO: 116375 - DNA, 25 bp, Mus musculus
gcttggtatagatcagccccgctca

SEQ ID NO: 116376 - DNA, 25 bp, Mus musculus
gcttggtgaccttctctggagcagg

SEQ ID NO: 116377 - DNA, 25 bp, Mus musculus
gcttggttctcccaggtcaactcct

SEQ ID NO: 116378 - DNA, 25 bp, Mus musculus
gcttggttttcatgggttgttgtat

SEQ ID NO: 116379 - DNA, 25 bp, Mus musculus
gcttgtaaatagtccaccctacccg

SEQ ID NO: 116380 - DNA, 25 bp, Mus musculus
gcttgtaagggaagagtcaactgga

SEQ ID NO: 116381 - DNA, 25 bp, Mus musculus
gcttgtactggaacccgcaggacat

SEQ ID NO: 116382 - DNA, 25 bp, Mus musculus
gcttgtatactttgctccacctgtg

SEQ ID NO: 116383 - DNA, 25 bp, Mus musculus
gcttgtatcacacgctgttcccggg

SEQ ID NO: 116384 - DNA, 25 bp, Mus musculus
gcttgtcgattgctcagctcattga

SEQ ID NO: 116385 - DNA, 25 bp, Mus musculus
gcttgtctactctgcggcgctatga

SEQ ID NO: 116386 - DNA, 25 bp, Mus musculus
gcttgtctgagaatggggccgcaat

SEQ ID NO: 116387 - DNA, 25 bp, Mus musculus
gcttgtctttggagtattgcttcat

SEQ ID NO: 116388 - DNA, 25 bp, Mus musculus
gcttgtctttgggaactacagcacc

SEQ ID NO: 116389 - DNA, 25 bp, Mus musculus
gcttgtgacatactgtcgcagcttg

SEQ ID NO: 116390 - DNA, 25 bp, Mus musculus
gcttgtgaccatgttaacgattcta

SEQ ID NO: 116391 - DNA, 25 bp, Mus musculus
gcttgtgccaggtcattcccattaa

SEQ ID NO: 116392 - DNA, 25 bp, Mus musculus
gcttgtgcggtctcctatggtgccc

SEQ ID NO: 116393 - DNA, 25 bp, Mus musculus
gcttgtgctactgcaaggctttgca

SEQ ID NO: 116394 - DNA, 25 bp, Mus musculus
gcttgtgctcactttctaggattca

SEQ ID NO: 116395 - DNA, 25 bp, Mus musculus
gcttgtggcgcctggttacccgctc

SEQ ID NO: 116396 - DNA, 25 bp, Mus musculus
gcttgtgtcacctacggaacggaca

SEQ ID NO: 116397 - DNA, 25 bp, Mus musculus
gcttgtgtgcaaaaccctccgtggc

SEQ ID NO: 116398 - DNA, 25 bp, Mus musculus
gcttgtgttgaatcccgaacctgca

SEQ ID NO: 116399 - DNA, 25 bp, Mus musculus
gcttgttacattgacattcctgcag

SEQ ID NO: 116400 - DNA, 25 bp, Mus musculus
gcttgttcccatggagtatgtcggc

SEQ ID NO: 116401 - DNA, 25 bp, Mus musculus
gcttgttctatagaatagggtggcc

SEQ ID NO: 116402 - DNA, 25 bp, Mus musculus
gcttgttctctactggctgtgctcc

SEQ ID NO: 116403 - DNA, 25 bp, Mus musculus
gcttgtttgaggtggccagagacca

SEQ ID NO: 116404 - DNA, 25 bp, Mus musculus
gctttaaaagatctgcgtctgacag

SEQ ID NO: 116405 - DNA, 25 bp, Mus musculus
gctttaaactgccatagggcgcccc

SEQ ID NO: 116406 - DNA, 25 bp, Mus musculus
gctttaaagagctacacactgaggg

SEQ ID NO: 116407 - DNA, 25 bp, Mus musculus
gctttaaagccacaaacaaaacgtg

SEQ ID NO: 116408 - DNA, 25 bp, Mus musculus
gctttaaagctgtatccgggcaacc

SEQ ID NO: 116409 - DNA, 25 bp, Mus musculus
gctttaaatgtactaatggcgatga

SEQ ID NO: 116410 - DNA, 25 bp, Mus musculus
gctttaacagataccgaatggccaa

SEQ ID NO: 116411 - DNA, 25 bp, Mus musculus
gctttaaccctgtgtgcgcttccga

SEQ ID NO: 116412 - DNA, 25 bp, Mus musculus
gctttaatcgccttcggcaggaaca

SEQ ID NO: 116413 - DNA, 25 bp, Mus musculus
gctttaatgaatagacggtttcccg

SEQ ID NO: 116414 - DNA, 25 bp, Mus musculus
gctttacagggcagagctcagtcct

SEQ ID NO: 116415 - DNA, 25 bp, Mus musculus
gctttaccacccaaacaatctaaga

SEQ ID NO: 116416 - DNA, 25 bp, Mus musculus
gctttacctttgtctagatgccggg

SEQ ID NO: 116417 - DNA, 25 bp, Mus musculus
gctttacgacgacattgaggctgga

SEQ ID NO: 116418 - DNA, 25 bp, Mus musculus
gctttacgttaacagcgctcgggac

SEQ ID NO: 116419 - DNA, 25 bp, Mus musculus
gctttactgtgattgggcctggcct

SEQ ID NO: 116420 - DNA, 25 bp, Mus musculus
gctttagacccacacaaggctgagg

SEQ ID NO: 116421 - DNA, 25 bp, Mus musculus
gctttagagaccaatgaggaccccg

SEQ ID NO: 116422 - DNA, 25 bp, Mus musculus
gctttagagatgcaacgacttttcc

SEQ ID NO: 116423 - DNA, 25 bp, Mus musculus
gctttagccagaaggtagtccagag

SEQ ID NO: 116424 - DNA, 25 bp, Mus musculus
gctttagccctcgatgtcccggaga

SEQ ID NO: 116425 - DNA, 25 bp, Mus musculus
gctttagcctgagcgatgtgcctca

SEQ ID NO: 116426 - DNA, 25 bp, Mus musculus
gctttagggcccatttaggtcagac

SEQ ID NO: 116427 - DNA, 25 bp, Mus musculus
gctttagtaacagcgcgagtgccgg

SEQ ID NO: 116428 - DNA, 25 bp, Mus musculus
gctttagtgaaactccctcgctcca

SEQ ID NO: 116429 - DNA, 25 bp, Mus musculus
gctttatgaagcacaacacgtctcg

SEQ ID NO: 116430 - DNA, 25 bp, Mus musculus
gctttatgagctcccctgtgctcag

SEQ ID NO: 116431 - DNA, 25 bp, Mus musculus
gctttatgtgagaatgcgagatcca

SEQ ID NO: 116432 - DNA, 25 bp, Mus musculus
gctttattaaatacatggccaaacc

SEQ ID NO: 116433 - DNA, 25 bp, Mus musculus
gctttattgaattggcaaaaactgt

SEQ ID NO: 116434 - DNA, 25 bp, Mus musculus
gctttcaactctgtccaactgagga

SEQ ID NO: 116435 - DNA, 25 bp, Mus musculus
gctttcaagcagtgtcagtacaagg

SEQ ID NO: 116436 - DNA, 25 bp, Mus musculus
gctttcacagtttgcgggactcagt

SEQ ID NO: 116437 - DNA, 25 bp, Mus musculus
gctttcagaaagtgtgctcaccaga

SEQ ID NO: 116438 - DNA, 25 bp, Mus musculus
gctttcagaagccttgccagagaca

SEQ ID NO: 116439 - DNA, 25 bp, Mus musculus
gctttcagaccccagatccaggatg

SEQ ID NO: 116440 - DNA, 25 bp, Mus musculus
gctttcagagaccagccggtgctga

SEQ ID NO: 116441 - DNA, 25 bp, Mus musculus
gctttcagataattggacctcagtg

SEQ ID NO: 116442 - DNA, 25 bp, Mus musculus
gctttcagctactcacggagtccgg

SEQ ID NO: 116443 - DNA, 25 bp, Mus musculus
gctttcagtgcctgctggtgcgccc

SEQ ID NO: 116444 - DNA, 25 bp, Mus musculus
gctttccaaagttgttgctgcctgt

SEQ ID NO: 116445 - DNA, 25 bp, Mus musculus
gctttccagcagtcgggcacagctg

SEQ ID NO: 116446 - DNA, 25 bp, Mus musculus
gctttccatgaccaaaggcacagga

SEQ ID NO: 116447 - DNA, 25 bp, Mus musculus
gctttccccggacctcgcggaagag

SEQ ID NO: 116448 - DNA, 25 bp, Mus musculus
gctttccccgtgacatgtagttgag

SEQ ID NO: 116449 - DNA, 25 bp, Mus musculus
gctttcccgattgacactgctctgt

SEQ ID NO: 116450 - DNA, 25 bp, Mus musculus
gctttccgagcagtgaacctgatgg

SEQ ID NO: 116451 - DNA, 25 bp, Mus musculus
gctttccgaggagccagtgttgctg

SEQ ID NO: 116452 - DNA, 25 bp, Mus musculus
gctttccgtcggttctgtaagaaga

SEQ ID NO: 116453 - DNA, 25 bp, Mus musculus
gctttcctccacatcacactggtgg

SEQ ID NO: 116454 - DNA, 25 bp, Mus musculus
gctttcctcggagacaggtggcatg

SEQ ID NO: 116455 - DNA, 25 bp, Mus musculus
gctttcctgttaagcagttcaatga

SEQ ID NO: 116456 - DNA, 25 bp, Mus musculus
gctttccttgcctgctatgccatgg

SEQ ID NO: 116457 - DNA, 25 bp, Mus musculus
gctttcgaagacgtcagagtgccta

SEQ ID NO: 116458 - DNA, 25 bp, Mus musculus
gctttcgcagcagaagaggctcctg

SEQ ID NO: 116459 - DNA, 25 bp, Mus musculus
gctttcgggctaccttgaacgagat

SEQ ID NO: 116460 - DNA, 25 bp, Mus musculus
gctttcgtagctggcgattcccgtt

SEQ ID NO: 116461 - DNA, 25 bp, Mus musculus
gctttcgtcaggaagtgggctcgca

SEQ ID NO: 116462 - DNA, 25 bp, Mus musculus
gctttcgtcagtagaggaggatcca

SEQ ID NO: 116463 - DNA, 25 bp, Mus musculus
gctttcgtccgagatggatctggcc

SEQ ID NO: 116464 - DNA, 25 bp, Mus musculus
gctttctagtgacaagattgccacc

SEQ ID NO: 116465 - DNA, 25 bp, Mus musculus
gctttctgacccatcgaccattgag

SEQ ID NO: 116466 - DNA, 25 bp, Mus musculus
gctttctgactaacaacccagtgga

SEQ ID NO: 116467 - DNA, 25 bp, Mus musculus
gctttctgccaccacttgtgctgaa

SEQ ID NO: 116468 - DNA, 25 bp, Mus musculus
gctttctggaatccggcctgcagga

SEQ ID NO: 116469 - DNA, 25 bp, Mus musculus
gctttcttaagaaccatgtgggcca

SEQ ID NO: 116470 - DNA, 25 bp, Mus musculus
gctttcttccagagggcgggtgtta

SEQ ID NO: 116471 - DNA, 25 bp, Mus musculus
gctttcttctcccagctctgtgttc

SEQ ID NO: 116472 - DNA, 25 bp, Mus musculus
gctttcttggagaccaggacctgac

SEQ ID NO: 116473 - DNA, 25 bp, Mus musculus
gctttgaaccagtatggctgaccct

SEQ ID NO: 116474 - DNA, 25 bp, Mus musculus
gctttgaactagtgaaggcctcgcc

SEQ ID NO: 116475 - DNA, 25 bp, Mus musculus
gctttgaacttcaccgcgcacgtgg

SEQ ID NO: 116476 - DNA, 25 bp, Mus musculus
gctttgacctgaacagctaccggga

SEQ ID NO: 116477 - DNA, 25 bp, Mus musculus
gctttgacctgccatccgttgctga

SEQ ID NO: 116478 - DNA, 25 bp, Mus musculus
gctttgacgacggagggctactaca

SEQ ID NO: 116479 - DNA, 25 bp, Mus musculus
gctttgacgagcactgaggatcctg

SEQ ID NO: 116480 - DNA, 25 bp, Mus musculus
gctttgagcgggagcagcaacactt

SEQ ID NO: 116481 - DNA, 25 bp, Mus musculus
gctttgaggaaaagtagccaccaca

SEQ ID NO: 116482 - DNA, 25 bp, Mus musculus
gctttgaggcagagacagctggacc

SEQ ID NO: 116483 - DNA, 25 bp, Mus musculus
gctttgaggtagatgcacccctggc

SEQ ID NO: 116484 - DNA, 25 bp, Mus musculus
gctttgagtcgtccaccttctccgg

SEQ ID NO: 116485 - DNA, 25 bp, Mus musculus
gctttgatgacaccaaccctgagaa

SEQ ID NO: 116486 - DNA, 25 bp, Mus musculus
gctttgatgatgaggaatcagtgga

SEQ ID NO: 116487 - DNA, 25 bp, Mus musculus
gctttgatgtcgctccctgtgatga

SEQ ID NO: 116488 - DNA, 25 bp, Mus musculus
gctttgattgctgtgggactgaccc

SEQ ID NO: 116489 - DNA, 25 bp, Mus musculus
gctttgccataccagagagtctcga

SEQ ID NO: 116490 - DNA, 25 bp, Mus musculus
gctttgccatcggagccttgctggt

SEQ ID NO: 116491 - DNA, 25 bp, Mus musculus
gctttgccatttaccgtgcgctgga

SEQ ID NO: 116492 - DNA, 25 bp, Mus musculus
gctttgcccagatgctcaaggatgg

SEQ ID NO: 116493 - DNA, 25 bp, Mus musculus
gctttgccccaaatgtacccagatc

SEQ ID NO: 116494 - DNA, 25 bp, Mus musculus
gctttgcgaacttagcaggtccctg

SEQ ID NO: 116495 - DNA, 25 bp, Mus musculus
gctttgcgcacagagcatctcgttg

SEQ ID NO: 116496 - DNA, 25 bp, Mus musculus
gctttgcgccttactcagtgccgga

SEQ ID NO: 116497 - DNA, 25 bp, Mus musculus
gctttgctaaaatgcaccagaaggg

SEQ ID NO: 116498 - DNA, 25 bp, Mus musculus
gctttgctaacgagccccagtggac

SEQ ID NO: 116499 - DNA, 25 bp, Mus musculus
gctttgctcaccaagaaggctttga

SEQ ID NO: 116500 - DNA, 25 bp, Mus musculus
gctttgctcccgaacagaaggagat

SEQ ID NO: 116501 - DNA, 25 bp, Mus musculus
gctttgctctgctgggaggacaccc

SEQ ID NO: 116502 - DNA, 25 bp, Mus musculus
gctttggacatacaagacctccctg

SEQ ID NO: 116503 - DNA, 25 bp, Mus musculus
gctttggaccagacaacatgggcag

SEQ ID NO: 116504 - DNA, 25 bp, Mus musculus
gctttggagaaagacaacagcaagt

SEQ ID NO: 116505 - DNA, 25 bp, Mus musculus
gctttggagaagtgcgcatcaggac

SEQ ID NO: 116506 - DNA, 25 bp, Mus musculus
gctttggcaacctcctacagagtct

SEQ ID NO: 116507 - DNA, 25 bp, Mus musculus
gctttggccgagaacgcaattcagg

SEQ ID NO: 116508 - DNA, 25 bp, Mus musculus
gctttggcgttgttgtcagcctccg

SEQ ID NO: 116509 - DNA, 25 bp, Mus musculus
gctttgggatgaccagctagcatct

SEQ ID NO: 116510 - DNA, 25 bp, Mus musculus
gctttgggcatatgagtactacagg

SEQ ID NO: 116511 - DNA, 25 bp, Mus musculus
gctttggtaccaagacacttacggg

SEQ ID NO: 116512 - DNA, 25 bp, Mus musculus
gctttggtggacagcttgctcccca

SEQ ID NO: 116513 - DNA, 25 bp, Mus musculus
gctttggtgtagaccccaacagaaa

SEQ ID NO: 116514 - DNA, 25 bp, Mus musculus
gctttgtacggcttagaggactccc

SEQ ID NO: 116515 - DNA, 25 bp, Mus musculus
gctttgtacttgctccagaacgaca

SEQ ID NO: 116516 - DNA, 25 bp, Mus musculus
gctttgtagaagcaccactccgggc

SEQ ID NO: 116517 - DNA, 25 bp, Mus musculus
gctttgtattctgccgccgggttcg

SEQ ID NO: 116518 - DNA, 25 bp, Mus musculus
gctttgtcactgttagggtttccac

SEQ ID NO: 116519 - DNA, 25 bp, Mus musculus
gctttgtgcctgcaagatggttcag

SEQ ID NO: 116520 - DNA, 25 bp, Mus musculus
gctttgtggaaacagtgacaacccc

SEQ ID NO: 116521 - DNA, 25 bp, Mus musculus
gctttgtggaactatctgagccaga

SEQ ID NO: 116522 - DNA, 25 bp, Mus musculus
gctttgtgttcagccgaaaccggct

SEQ ID NO: 116523 - DNA, 25 bp, Mus musculus
gctttgttaagttccatgatccaga

SEQ ID NO: 116524 - DNA, 25 bp, Mus musculus
gctttgttagtagagatattgatca

SEQ ID NO: 116525 - DNA, 25 bp, Mus musculus
gctttgttcaactcgatggcctcca

SEQ ID NO: 116526 - DNA, 25 bp, Mus musculus
gctttgttgccctactaccgtcaga

SEQ ID NO: 116527 - DNA, 25 bp, Mus musculus
gcttttacaacacggaggcagtcat

SEQ ID NO: 116528 - DNA, 25 bp, Mus musculus
gcttttacaaccctgaagtgcgaga

SEQ ID NO: 116529 - DNA, 25 bp, Mus musculus
gcttttacataaacctgggcctgga

SEQ ID NO: 116530 - DNA, 25 bp, Mus musculus
gcttttacatctatcaggagggctc

SEQ ID NO: 116531 - DNA, 25 bp, Mus musculus
gcttttagaacacaggacttgcccc

SEQ ID NO: 116532 - DNA, 25 bp, Mus musculus
gcttttcaaaaggatcgctcggagt

SEQ ID NO: 116533 - DNA, 25 bp, Mus musculus
gcttttcagcatttctcctcaccag

SEQ ID NO: 116534 - DNA, 25 bp, Mus musculus
gcttttcccaagctcaaacggcaag

SEQ ID NO: 116535 - DNA, 25 bp, Mus musculus
gcttttcgacagattacagtgcaca

SEQ ID NO: 116536 - DNA, 25 bp, Mus musculus
gcttttctcggttcagtctccgtga

SEQ ID NO: 116537 - DNA, 25 bp, Mus musculus
gcttttctgggacttggcaccgaca

SEQ ID NO: 116538 - DNA, 25 bp, Mus musculus
gcttttgaagcagagctgtggccac

SEQ ID NO: 116539 - DNA, 25 bp, Mus musculus
gcttttgagcagagatacgcggctg

SEQ ID NO: 116540 - DNA, 25 bp, Mus musculus
gcttttgagccttgtcacagcgaag

SEQ ID NO: 116541 - DNA, 25 bp, Mus musculus
gcttttgattgcagggactgagtcc

SEQ ID NO: 116542 - DNA, 25 bp, Mus musculus
gcttttgcagccgtgaacgtgtgga

SEQ ID NO: 116543 - DNA, 25 bp, Mus musculus
gcttttgctagaactgttgggctct

SEQ ID NO: 116544 - DNA, 25 bp, Mus musculus
gcttttggatccctcaacgatgaga

SEQ ID NO: 116545 - DNA, 25 bp, Mus musculus
gcttttgggagctttagaacacaag

SEQ ID NO: 116546 - DNA, 25 bp, Mus musculus
gcttttgtgcgagcagatgtcagcc

SEQ ID NO: 116547 - DNA, 25 bp, Mus musculus
gctttttaacaatgcaaaggcctac

SEQ ID NO: 116548 - DNA, 25 bp, Mus musculus
gctttttaagaccaaattagagaag

SEQ ID NO: 116549 - DNA, 25 bp, Mus musculus
gctttttgaggcacagcagaccaca

SEQ ID NO: 116550 - DNA, 25 bp, Mus musculus
gctttttgatgaaaccaccagggca

SEQ ID NO: 116551 - DNA, 25 bp, Mus musculus
gctttttgcaaagatcgactttgcc

SEQ ID NO: 116552 - DNA, 25 bp, Mus musculus
gctttttggacgctcagggtgttct

SEQ ID NO: 116553 - DNA, 25 bp, Mus musculus
gctttttggcaccacaggaaactgt

SEQ ID NO: 116554 - DNA, 25 bp, Mus musculus
gctttttgtccgctcgacagtcggg

SEQ ID NO: 116555 - DNA, 25 bp, Mus musculus
ggaaaaaacttgagataccagctgt

SEQ ID NO: 116556 - DNA, 25 bp, Mus musculus
ggaaaaacaagtataagaatcttct

SEQ ID NO: 116557 - DNA, 25 bp, Mus musculus
ggaaaaaccccagactcctgtgaag

SEQ ID NO: 116558 - DNA, 25 bp, Mus musculus
ggaaaaacttcagtcgtagctcgga

SEQ ID NO: 116559 - DNA, 25 bp, Mus musculus
ggaaaaagcctcattgcctctgact

SEQ ID NO: 116560 - DNA, 25 bp, Mus musculus
ggaaaaagcgagcaccgagcttctg

SEQ ID NO: 116561 - DNA, 25 bp, Mus musculus
ggaaaaagtctaacatctcgcccaa

SEQ ID NO: 116562 - DNA, 25 bp, Mus musculus
ggaaaaatcccagttgacaccttag

SEQ ID NO: 116563 - DNA, 25 bp, Mus musculus
ggaaaaatcgtatccacaaaggcaa

SEQ ID NO: 116564 - DNA, 25 bp, Mus musculus
ggaaaaattccactgaagccgccac

SEQ ID NO: 116565 - DNA, 25 bp, Mus musculus
ggaaaacaagaacctgaccggcact

SEQ ID NO: 116566 - DNA, 25 bp, Mus musculus
ggaaaacagtagacttcaggcccag

SEQ ID NO: 116567 - DNA, 25 bp, Mus musculus
ggaaaacatttacgagaacaacaag

SEQ ID NO: 116568 - DNA, 25 bp, Mus musculus
ggaaaaccagatcctcacccgagat

SEQ ID NO: 116569 - DNA, 25 bp, Mus musculus
ggaaaacccttgtgatgctgttgtc

SEQ ID NO: 116570 - DNA, 25 bp, Mus musculus
ggaaaacctactttgctcacgatgc

SEQ ID NO: 116571 - DNA, 25 bp, Mus musculus
ggaaaacctccttagcaaagctgaa

SEQ ID NO: 116572 - DNA, 25 bp, Mus musculus
ggaaaacctgctagcctcgttcggg

SEQ ID NO: 116573 - DNA, 25 bp, Mus musculus
ggaaaaccttcctgctgtacaacca

SEQ ID NO: 116574 - DNA, 25 bp, Mus musculus
ggaaaaccttcttgctgggcccagt

SEQ ID NO: 116575 - DNA, 25 bp, Mus musculus
ggaaaacgatccagactatgaccca

SEQ ID NO: 116576 - DNA, 25 bp, Mus musculus
ggaaaacgcccatctgaaaatcttg

SEQ ID NO: 116577 - DNA, 25 bp, Mus musculus
ggaaaacgcgtttatactggacact

SEQ ID NO: 116578 - DNA, 25 bp, Mus musculus
ggaaaactattctcaccacggaaga

SEQ ID NO: 116579 - DNA, 25 bp, Mus musculus
ggaaaacttgtgcttggcgtctact

SEQ ID NO: 116580 - DNA, 25 bp, Mus musculus
ggaaaagaatgtggaccaggcctct

SEQ ID NO: 116581 - DNA, 25 bp, Mus musculus
ggaaaagaggtacaacagtgtcctg

SEQ ID NO: 116582 - DNA, 25 bp, Mus musculus
ggaaaagatattctacccagtggcg

SEQ ID NO: 116583 - DNA, 25 bp, Mus musculus
ggaaaagatgcagacccggtggtaa

SEQ ID NO: 116584 - DNA, 25 bp, Mus musculus
ggaaaagcacgtcctcccaagatag

SEQ ID NO: 116585 - DNA, 25 bp, Mus musculus
ggaaaagcccttacatgtccctggg

SEQ ID NO: 116586 - DNA, 25 bp, Mus musculus
ggaaaaggcccttgactacatcaaa

SEQ ID NO: 116587 - DNA, 25 bp, Mus musculus
ggaaaagggcttcacaatcaatgag

SEQ ID NO: 116588 - DNA, 25 bp, Mus musculus
ggaaaaggtgccctagctccagatt

SEQ ID NO: 116589 - DNA, 25 bp, Mus musculus
ggaaaagttcacgactgccaaccgg

SEQ ID NO: 116590 - DNA, 25 bp, Mus musculus
ggaaaagttctctcatgcccaccat

SEQ ID NO: 116591 - DNA, 25 bp, Mus musculus
ggaaaagttgatgcggtagacctga

SEQ ID NO: 116592 - DNA, 25 bp, Mus musculus
ggaaaataccacagcatcaaagagg

SEQ ID NO: 116593 - DNA, 25 bp, Mus musculus
ggaaaatattctgctctgtcacgtt

SEQ ID NO: 116594 - DNA, 25 bp, Mus musculus
ggaaaatcaagtgcaaactccaccc

SEQ ID NO: 116595 - DNA, 25 bp, Mus musculus
ggaaaatcacctataagaacctggg

SEQ ID NO: 116596 - DNA, 25 bp, Mus musculus
ggaaaatctctcttgcaacagctag

SEQ ID NO: 116597 - DNA, 25 bp, Mus musculus
ggaaaatctgatatatgtggacatg

SEQ ID NO: 116598 - DNA, 25 bp, Mus musculus
ggaaaatcttgacttcatcactaag

SEQ ID NO: 116599 - DNA, 25 bp, Mus musculus
ggaaaatggattggatggcaccaag

SEQ ID NO: 116600 - DNA, 25 bp, Mus musculus
ggaaaattccagagcacgtccttgg

SEQ ID NO: 116601 - DNA, 25 bp, Mus musculus
ggaaacaccaggatccagactcgct

SEQ ID NO: 116602 - DNA, 25 bp, Mus musculus
ggaaacaccgttgtcagcacttgga

SEQ ID NO: 116603 - DNA, 25 bp, Mus musculus
ggaaacacggccttacacatcgcat

SEQ ID NO: 116604 - DNA, 25 bp, Mus musculus
ggaaacagcaagcatcagccatcac

SEQ ID NO: 116605 - DNA, 25 bp, Mus musculus
ggaaacagccagtctcttcccgaag

SEQ ID NO: 116606 - DNA, 25 bp, Mus musculus
ggaaacagtcacatccatagaacag

SEQ ID NO: 116607 - DNA, 25 bp, Mus musculus
ggaaacataccaatggttcccagtt

SEQ ID NO: 116608 - DNA, 25 bp, Mus musculus
ggaaacatccctgctctagtgaggc

SEQ ID NO: 116609 - DNA, 25 bp, Mus musculus
ggaaacatctcgctgtgaacaagga

SEQ ID NO: 116610 - DNA, 25 bp, Mus musculus
ggaaacatcttcacaaattgctgtg

SEQ ID NO: 116611 - DNA, 25 bp, Mus musculus
ggaaacatgtcctagctgctgccta

SEQ ID NO: 116612 - DNA, 25 bp, Mus musculus
ggaaaccaagactggtagactctcg

SEQ ID NO: 116613 - DNA, 25 bp, Mus musculus
ggaaaccacatctctcggactctga

SEQ ID NO: 116614 - DNA, 25 bp, Mus musculus
ggaaaccaggagtgccagggactaa

SEQ ID NO: 116615 - DNA, 25 bp, Mus musculus
ggaaaccatttcctgagccagctct

SEQ ID NO: 116616 - DNA, 25 bp, Mus musculus
ggaaacccactaggctgccgaattg

SEQ ID NO: 116617 - DNA, 25 bp, Mus musculus
ggaaaccccaatcttctgccactgg

SEQ ID NO: 116618 - DNA, 25 bp, Mus musculus
ggaaacccgaaatgctagagccctg

SEQ ID NO: 116619 - DNA, 25 bp, Mus musculus
ggaaaccctggagtcctccctgaag

SEQ ID NO: 116620 - DNA, 25 bp, Mus musculus
ggaaaccgaggcgtcgcgggctcag

SEQ ID NO: 116621 - DNA, 25 bp, Mus musculus
ggaaacctcaaaacagtggctacag

SEQ ID NO: 116622 - DNA, 25 bp, Mus musculus
ggaaacctcaccgaagatgaaacat

SEQ ID NO: 116623 - DNA, 25 bp, Mus musculus
ggaaacctctgtttgtggagctgta

SEQ ID NO: 116624 - DNA, 25 bp, Mus musculus
ggaaacctgcttgcagcacacttgt

SEQ ID NO: 116625 - DNA, 25 bp, Mus musculus
ggaaacgacgggaatcagcctccag

SEQ ID NO: 116626 - DNA, 25 bp, Mus musculus
ggaaacgcgcgctcagccatgtctc

SEQ ID NO: 116627 - DNA, 25 bp, Mus musculus
ggaaacggcttcagcggaaccgact

SEQ ID NO: 116628 - DNA, 25 bp, Mus musculus
ggaaacggttccaacatgtggccca

SEQ ID NO: 116629 - DNA, 25 bp, Mus musculus
ggaaactaggtcgacggccgacagc

SEQ ID NO: 116630 - DNA, 25 bp, Mus musculus
ggaaactcagactccttgcgcatag

SEQ ID NO: 116631 - DNA, 25 bp, Mus musculus
ggaaactctcttcagacccggaatg

SEQ ID NO: 116632 - DNA, 25 bp, Mus musculus
ggaaactgcccattttcacagcgtc

SEQ ID NO: 116633 - DNA, 25 bp, Mus musculus
ggaaactgctaccttgtcctctaca

SEQ ID NO: 116634 - DNA, 25 bp, Mus musculus
ggaaactgctatgtctggaacctga

SEQ ID NO: 116635 - DNA, 25 bp, Mus musculus
ggaaactggctctccgttgaagcga

SEQ ID NO: 116636 - DNA, 25 bp, Mus musculus
ggaaacttctctccagaatagacag

SEQ ID NO: 116637 - DNA, 25 bp, Mus musculus
ggaaacttgaccatgtgctcggctg

SEQ ID NO: 116638 - DNA, 25 bp, Mus musculus
ggaaacttgctagaaatgatgtacc

SEQ ID NO: 116639 - DNA, 25 bp, Mus musculus
ggaaagaaaatgctccaggcgccct

SEQ ID NO: 116640 - DNA, 25 bp, Mus musculus
ggaaagaacgccatccttattggaa

SEQ ID NO: 116641 - DNA, 25 bp, Mus musculus
ggaaagaagctctaacgcggacgtc

SEQ ID NO: 116642 - DNA, 25 bp, Mus musculus
ggaaagaagttcacgcaacgcggaa

SEQ ID NO: 116643 - DNA, 25 bp, Mus musculus
ggaaagacatggtctctgcgcccgg

SEQ ID NO: 116644 - DNA, 25 bp, Mus musculus
ggaaagaccacgataatgaagaata

SEQ ID NO: 116645 - DNA, 25 bp, Mus musculus
ggaaagagaaaagccattgccagtg

SEQ ID NO: 116646 - DNA, 25 bp, Mus musculus
ggaaagagtgggacctgaagcccat

SEQ ID NO: 116647 - DNA, 25 bp, Mus musculus
ggaaagataccagctcctgcgtggg

SEQ ID NO: 116648 - DNA, 25 bp, Mus musculus
ggaaagatctccgacgaaatggaag

SEQ ID NO: 116649 - DNA, 25 bp, Mus musculus
ggaaagatggccgacatgtacaccc

SEQ ID NO: 116650 - DNA, 25 bp, Mus musculus
ggaaagcagatgatggacctaggac

SEQ ID NO: 116651 - DNA, 25 bp, Mus musculus
ggaaagcatgattagcaccatcaag

SEQ ID NO: 116652 - DNA, 25 bp, Mus musculus
ggaaagccacaaattacttagactg

SEQ ID NO: 116653 - DNA, 25 bp, Mus musculus
ggaaagccagcaaaccagctgcttg

SEQ ID NO: 116654 - DNA, 25 bp, Mus musculus
ggaaagccgccgagaatctgagaag

SEQ ID NO: 116655 - DNA, 25 bp, Mus musculus
ggaaagcctgacttcagactatttc

SEQ ID NO: 116656 - DNA, 25 bp, Mus musculus
ggaaagcctggtatcccgtgtgcca

SEQ ID NO: 116657 - DNA, 25 bp, Mus musculus
ggaaagcctggttgttcccaccaag

SEQ ID NO: 116658 - DNA, 25 bp, Mus musculus
ggaaagcgattcttataaatatagc

SEQ ID NO: 116659 - DNA, 25 bp, Mus musculus
ggaaagcgcaaaggcaaatcccagt

SEQ ID NO: 116660 - DNA, 25 bp, Mus musculus
ggaaagcgcatccacgaactggaga

SEQ ID NO: 116661 - DNA, 25 bp, Mus musculus
ggaaagcgcgaggagacgccgccgc

SEQ ID NO: 116662 - DNA, 25 bp, Mus musculus
ggaaagctaacatcccaattatgga

SEQ ID NO: 116663 - DNA, 25 bp, Mus musculus
ggaaagctagctgtacatatcctct

SEQ ID NO: 116664 - DNA, 25 bp, Mus musculus
ggaaagctattgtcagtggctctag

SEQ ID NO: 116665 - DNA, 25 bp, Mus musculus
ggaaagctcacatcttttgcaacac

SEQ ID NO: 116666 - DNA, 25 bp, Mus musculus
ggaaagctctacctcatcctcgagt

SEQ ID NO: 116667 - DNA, 25 bp, Mus musculus
ggaaagctggcctttgctcacgtgc

SEQ ID NO: 116668 - DNA, 25 bp, Mus musculus
ggaaaggaatatccacacaggagaa

SEQ ID NO: 116669 - DNA, 25 bp, Mus musculus
ggaaaggcaaaatgaccacattgtt

SEQ ID NO: 116670 - DNA, 25 bp, Mus musculus
ggaaaggccacaataccggagagca

SEQ ID NO: 116671 - DNA, 25 bp, Mus musculus
ggaaagggcaggagcgagctagctg

SEQ ID NO: 116672 - DNA, 25 bp, Mus musculus
ggaaagggcccaaggctccgagctc

SEQ ID NO: 116673 - DNA, 25 bp, Mus musculus
ggaaagggctcatcgcctagcagag

SEQ ID NO: 116674 - DNA, 25 bp, Mus musculus
ggaaagtagagaagccttctttctc

SEQ ID NO: 116675 - DNA, 25 bp, Mus musculus
ggaaagtccagagcagttacctgca

SEQ ID NO: 116676 - DNA, 25 bp, Mus musculus
ggaaagtcccctcaagtgcctgtaa

SEQ ID NO: 116677 - DNA, 25 bp, Mus musculus
ggaaagtgttgtaccagcgtgcgcc

SEQ ID NO: 116678 - DNA, 25 bp, Mus musculus
ggaaagttcttcatactacagcatg

SEQ ID NO: 116679 - DNA, 25 bp, Mus musculus
ggaaagttttcatcacccgcaagtc

SEQ ID NO: 116680 - DNA, 25 bp, Mus musculus
ggaaataatgaccaagtacctcact

SEQ ID NO: 116681 - DNA, 25 bp, Mus musculus
ggaaatacatggagacactgcggac

SEQ ID NO: 116682 - DNA, 25 bp, Mus musculus
ggaaatacgtgcgttgcctgtgacg

SEQ ID NO: 116683 - DNA, 25 bp, Mus musculus
ggaaatactccctaagcgctgtgtg

SEQ ID NO: 116684 - DNA, 25 bp, Mus musculus
ggaaatatgatgaataaagacttcc

SEQ ID NO: 116685 - DNA, 25 bp, Mus musculus
ggaaatcaacactaaccaggaagct

SEQ ID NO: 116686 - DNA, 25 bp, Mus musculus
ggaaatcaccgcatagtctctgaag

SEQ ID NO: 116687 - DNA, 25 bp, Mus musculus
ggaaatccacacatatctgggcgca

SEQ ID NO: 116688 - DNA, 25 bp, Mus musculus
ggaaatccacgaaatttcgctccat

SEQ ID NO: 116689 - DNA, 25 bp, Mus musculus
ggaaatccagaagcgtgtgtccaca

SEQ ID NO: 116690 - DNA, 25 bp, Mus musculus
ggaaatcgagaaaggtgccagaacc

SEQ ID NO: 116691 - DNA, 25 bp, Mus musculus
ggaaatcgagcgtggccctgcctct

SEQ ID NO: 116692 - DNA, 25 bp, Mus musculus
ggaaatcgtagctattatcacctcg

SEQ ID NO: 116693 - DNA, 25 bp, Mus musculus
ggaaatcgtagtaaccccttctgct

SEQ ID NO: 116694 - DNA, 25 bp, Mus musculus
ggaaatctgtgataacttatacata

SEQ ID NO: 116695 - DNA, 25 bp, Mus musculus
ggaaatcttagcagccatcgcggca

SEQ ID NO: 116696 - DNA, 25 bp, Mus musculus
ggaaatcttcatcactgacttcgag

SEQ ID NO: 116697 - DNA, 25 bp, Mus musculus
ggaaatcttgctgcgctaactaagg

SEQ ID NO: 116698 - DNA, 25 bp, Mus musculus
ggaaatgaacaagcgcctaacagaa

SEQ ID NO: 116699 - DNA, 25 bp, Mus musculus
ggaaatgaacgcaaaaggtgccgct

SEQ ID NO: 116700 - DNA, 25 bp, Mus musculus
ggaaatgaatctgatcctgcctccc

SEQ ID NO: 116701 - DNA, 25 bp, Mus musculus
ggaaatgatcttttgcacacgcaag

SEQ ID NO: 116702 - DNA, 25 bp, Mus musculus
ggaaatgccacagtgttatggtttc

SEQ ID NO: 116703 - DNA, 25 bp, Mus musculus
ggaaatgccagtgccgaacaggtct

SEQ ID NO: 116704 - DNA, 25 bp, Mus musculus
ggaaatgctaccctgagcccagtga

SEQ ID NO: 116705 - DNA, 25 bp, Mus musculus
ggaaatgctccattcgctcagcgca

SEQ ID NO: 116706 - DNA, 25 bp, Mus musculus
ggaaatgctgcttgccatagctgga

SEQ ID NO: 116707 - DNA, 25 bp, Mus musculus
ggaaatgcttcagtaccgcttcaag

SEQ ID NO: 116708 - DNA, 25 bp, Mus musculus
ggaaatggacattgccccgtgcttg

SEQ ID NO: 116709 - DNA, 25 bp, Mus musculus
ggaaatgggagaaccaaccatgaag

SEQ ID NO: 116710 - DNA, 25 bp, Mus musculus
ggaaatgttaagtgccttggcctcc

SEQ ID NO: 116711 - DNA, 25 bp, Mus musculus
ggaaattacagctcgaaaccaaatg

SEQ ID NO: 116712 - DNA, 25 bp, Mus musculus
ggaaattacagttcctgctccaaca

SEQ ID NO: 116713 - DNA, 25 bp, Mus musculus
ggaaattactcttccaccgctccag

SEQ ID NO: 116714 - DNA, 25 bp, Mus musculus
ggaaattatcacagtagcctaggca

SEQ ID NO: 116715 - DNA, 25 bp, Mus musculus
ggaaattcacaaggatcaacccggc

SEQ ID NO: 116716 - DNA, 25 bp, Mus musculus
ggaaattcatcaagccctgggagag

SEQ ID NO: 116717 - DNA, 25 bp, Mus musculus
ggaaattcgtatcctagccaggctt

SEQ ID NO: 116718 - DNA, 25 bp, Mus musculus
ggaaattcttcagcgcttcactgga

SEQ ID NO: 116719 - DNA, 25 bp, Mus musculus
ggaaattgaaacctatctcatcctc

SEQ ID NO: 116720 - DNA, 25 bp, Mus musculus
ggaaattgtccaaatgcctctgaaa

SEQ ID NO: 116721 - DNA, 25 bp, Mus musculus
ggaaattgttcctgatcccaggaag

SEQ ID NO: 116722 - DNA, 25 bp, Mus musculus
ggaaatttatatgctcccgagaatg

SEQ ID NO: 116723 - DNA, 25 bp, Mus musculus
ggaaatttcgacgttgccctggaca

SEQ ID NO: 116724 - DNA, 25 bp, Mus musculus
ggaacaaacccatcacagtgccgtt

SEQ ID NO: 116725 - DNA, 25 bp, Mus musculus
ggaacaaatccaacacctgaaaagt

SEQ ID NO: 116726 - DNA, 25 bp, Mus musculus
ggaacaaccttgaccctgacagaat

SEQ ID NO: 116727 - DNA, 25 bp, Mus musculus
ggaacaagcctacttctgcggttag

SEQ ID NO: 116728 - DNA, 25 bp, Mus musculus
ggaacaaggccatcatggagagcct

SEQ ID NO: 116729 - DNA, 25 bp, Mus musculus
ggaacaaggcttccacccatggctg

SEQ ID NO: 116730 - DNA, 25 bp, Mus musculus
ggaacaagtggtcaaccaagcccct

SEQ ID NO: 116731 - DNA, 25 bp, Mus musculus
ggaacaagtttgctgcccacgtgag

SEQ ID NO: 116732 - DNA, 25 bp, Mus musculus
ggaacaatcgctgttgagccaggca

SEQ ID NO: 116733 - DNA, 25 bp, Mus musculus
ggaacaatgcccaggctctctaaat

SEQ ID NO: 116734 - DNA, 25 bp, Mus musculus
ggaacacacatctctaaccaggact

SEQ ID NO: 116735 - DNA, 25 bp, Mus musculus
ggaacacagcaagctgcccattgag

SEQ ID NO: 116736 - DNA, 25 bp, Mus musculus
ggaacacaggcactcatccgagaga

SEQ ID NO: 116737 - DNA, 25 bp, Mus musculus
ggaacaccatctaacctgggaaagg

SEQ ID NO: 116738 - DNA, 25 bp, Mus musculus
ggaacaccccagctagaaatgtgag

SEQ ID NO: 116739 - DNA, 25 bp, Mus musculus
ggaacaccctatagttacggcccag

SEQ ID NO: 116740 - DNA, 25 bp, Mus musculus
ggaacacctcactttatggccccag

SEQ ID NO: 116741 - DNA, 25 bp, Mus musculus
ggaacactcccgaaacttggccaat

SEQ ID NO: 116742 - DNA, 25 bp, Mus musculus
ggaacactgtaaaactctgctctat

SEQ ID NO: 116743 - DNA, 25 bp, Mus musculus
ggaacacttaaggaaagctgacaaa

SEQ ID NO: 116744 - DNA, 25 bp, Mus musculus
ggaacactttcgcttgctcagagtc

SEQ ID NO: 116745 - DNA, 25 bp, Mus musculus
ggaacagaactacgcccctggtgaa

SEQ ID NO: 116746 - DNA, 25 bp, Mus musculus
ggaacagaagaagaacccacaagct

SEQ ID NO: 116747 - DNA, 25 bp, Mus musculus
ggaacagacgagagaagatgaccct

SEQ ID NO: 116748 - DNA, 25 bp, Mus musculus
ggaacagcagttcagccccatgatg

SEQ ID NO: 116749 - DNA, 25 bp, Mus musculus
ggaacagcatgcgaagtggtaccca

SEQ ID NO: 116750 - DNA, 25 bp, Mus musculus
ggaacagcggactgcacaacatcac

SEQ ID NO: 116751 - DNA, 25 bp, Mus musculus
ggaacagcttccgaccatgggatga

SEQ ID NO: 116752 - DNA, 25 bp, Mus musculus
ggaacagcttccgaggccttgagga

SEQ ID NO: 116753 - DNA, 25 bp, Mus musculus
ggaacaggatatactgtggaggctt

SEQ ID NO: 116754 - DNA, 25 bp, Mus musculus
ggaacaggcatttcaaagcccaccg

SEQ ID NO: 116755 - DNA, 25 bp, Mus musculus
ggaacaggcccaccggcatttactg

SEQ ID NO: 116756 - DNA, 25 bp, Mus musculus
ggaacaggcgctgcggctcatcttc

SEQ ID NO: 116757 - DNA, 25 bp, Mus musculus
ggaacaggctccaactgtaggctta

SEQ ID NO: 116758 - DNA, 25 bp, Mus musculus
ggaacagtcctccagacaccctggt

SEQ ID NO: 116759 - DNA, 25 bp, Mus musculus
ggaacagtgacctcatatgggccca

SEQ ID NO: 116760 - DNA, 25 bp, Mus musculus
ggaacagtgcaatctggactacagc

SEQ ID NO: 116761 - DNA, 25 bp, Mus musculus
ggaacagttagatcagcccatcgca

SEQ ID NO: 116762 - DNA, 25 bp, Mus musculus
ggaacagttctagtccgcagaccag

SEQ ID NO: 116763 - DNA, 25 bp, Mus musculus
ggaacagttgagtaagacaaaccta

SEQ ID NO: 116764 - DNA, 25 bp, Mus musculus
ggaacatactccctcggccctggcc

SEQ ID NO: 116765 - DNA, 25 bp, Mus musculus
ggaacatagagttgatccccaccat

SEQ ID NO: 116766 - DNA, 25 bp, Mus musculus
ggaacatcacacataccacataaaa

SEQ ID NO: 116767 - DNA, 25 bp, Mus musculus
ggaacatcaggtggtgacggtcccc

SEQ ID NO: 116768 - DNA, 25 bp, Mus musculus
ggaacatcgtgtgtcctgcagggat

SEQ ID NO: 116769 - DNA, 25 bp, Mus musculus
ggaacatctcattcgctggctgcgg

SEQ ID NO: 116770 - DNA, 25 bp, Mus musculus
ggaacatggaagctactaacgccta

SEQ ID NO: 116771 - DNA, 25 bp, Mus musculus
ggaaccaactatggagaagaacttg

SEQ ID NO: 116772 - DNA, 25 bp, Mus musculus
ggaaccaactcttcaggaccagcag

SEQ ID NO: 116773 - DNA, 25 bp, Mus musculus
ggaaccaacttcttcactggcgagg

SEQ ID NO: 116774 - DNA, 25 bp, Mus musculus
ggaaccaccaaagattaccccgatg

SEQ ID NO: 116775 - DNA, 25 bp, Mus musculus
ggaaccacctgattctgaccaagag

SEQ ID NO: 116776 - DNA, 25 bp, Mus musculus
ggaaccagaaatcaccatgcaagcg

SEQ ID NO: 116777 - DNA, 25 bp, Mus musculus
ggaaccagagattgacagccctcga

SEQ ID NO: 116778 - DNA, 25 bp, Mus musculus
ggaaccagccaatcacactttttac

SEQ ID NO: 116779 - DNA, 25 bp, Mus musculus
ggaaccagcgcctgcgagggaaccc

SEQ ID NO: 116780 - DNA, 25 bp, Mus musculus
ggaaccaggagcaagaacgacagct

SEQ ID NO: 116781 - DNA, 25 bp, Mus musculus
ggaaccaggctgatcacttcttggg

SEQ ID NO: 116782 - DNA, 25 bp, Mus musculus
ggaaccagtctgtgaggctacctct

SEQ ID NO: 116783 - DNA, 25 bp, Mus musculus
ggaaccagtgtcgttactgcaggct

SEQ ID NO: 116784 - DNA, 25 bp, Mus musculus
ggaaccatctcctccacaatgtgat

SEQ ID NO: 116785 - DNA, 25 bp, Mus musculus
ggaaccatcttctctgcctattcat

SEQ ID NO: 116786 - DNA, 25 bp, Mus musculus
ggaaccatggaaaacatccctacag

SEQ ID NO: 116787 - DNA, 25 bp, Mus musculus
ggaacccactaccagatcattaaga

SEQ ID NO: 116788 - DNA, 25 bp, Mus musculus
ggaacccatgtcctatgactcagat

SEQ ID NO: 116789 - DNA, 25 bp, Mus musculus
ggaaccccagtagtgaatcaagtga

SEQ ID NO: 116790 - DNA, 25 bp, Mus musculus
ggaaccccttcccaaatgcagatga

SEQ ID NO: 116791 - DNA, 25 bp, Mus musculus
ggaacccctttctcacacagtggca

SEQ ID NO: 116792 - DNA, 25 bp, Mus musculus
ggaaccctccggtgtgcggtgacca

SEQ ID NO: 116793 - DNA, 25 bp, Mus musculus
ggaaccctctctgcgggtgctgctg

SEQ ID NO: 116794 - DNA, 25 bp, Mus musculus
ggaaccctgtccgaatctctgtgaa

SEQ ID NO: 116795 - DNA, 25 bp, Mus musculus
ggaaccgaaactgtccaagtgcaga

SEQ ID NO: 116796 - DNA, 25 bp, Mus musculus
ggaaccgactcttcaacctgggtgc

SEQ ID NO: 116797 - DNA, 25 bp, Mus musculus
ggaaccgcatcgagtacctcagctc

SEQ ID NO: 116798 - DNA, 25 bp, Mus musculus
ggaaccgggacctcttgtcagagaa

SEQ ID NO: 116799 - DNA, 25 bp, Mus musculus
ggaaccgggccatagaaaccatgta

SEQ ID NO: 116800 - DNA, 25 bp, Mus musculus
ggaaccggtgtccaagtccctgatg

SEQ ID NO: 116801 - DNA, 25 bp, Mus musculus
ggaaccggttccatgctgcacatag

SEQ ID NO: 116802 - DNA, 25 bp, Mus musculus
ggaaccgtcccattctccgagttga

SEQ ID NO: 116803 - DNA, 25 bp, Mus musculus
ggaaccgtggtctacagcatcacca

SEQ ID NO: 116804 - DNA, 25 bp, Mus musculus
ggaacctcatccgtgacaaccgtgt

SEQ ID NO: 116805 - DNA, 25 bp, Mus musculus
ggaacctcctcagcctgtttgagga

SEQ ID NO: 116806 - DNA, 25 bp, Mus musculus
ggaacctcgtgtcccagtacttgga

SEQ ID NO: 116807 - DNA, 25 bp, Mus musculus
ggaacctgagcctagggagagatca

SEQ ID NO: 116808 - DNA, 25 bp, Mus musculus
ggaacctgcactagatccttggtga

SEQ ID NO: 116809 - DNA, 25 bp, Mus musculus
ggaacctgccgaagccctcgctatg

SEQ ID NO: 116810 - DNA, 25 bp, Mus musculus
ggaacctggattcctctctagagca

SEQ ID NO: 116811 - DNA, 25 bp, Mus musculus
ggaacctggcccgtttatctagatt

SEQ ID NO: 116812 - DNA, 25 bp, Mus musculus
ggaacctggctaactctggatctga

SEQ ID NO: 116813 - DNA, 25 bp, Mus musculus
ggaacctggtactcttcaacggccg

SEQ ID NO: 116814 - DNA, 25 bp, Mus musculus
ggaacctgtgatcaagcattctgga

SEQ ID NO: 116815 - DNA, 25 bp, Mus musculus
ggaaccttcccacaagcagtatgct

SEQ ID NO: 116816 - DNA, 25 bp, Mus musculus
ggaacgaaggaacaaagggacgctg

SEQ ID NO: 116817 - DNA, 25 bp, Mus musculus
ggaacgacagtgagcttaccaccta

SEQ ID NO: 116818 - DNA, 25 bp, Mus musculus
ggaacgactgtcttcataacccgag

SEQ ID NO: 116819 - DNA, 25 bp, Mus musculus
ggaacgagttacctctctgaaagta

SEQ ID NO: 116820 - DNA, 25 bp, Mus musculus
ggaacgcactgctgagctgtacaaa

SEQ ID NO: 116821 - DNA, 25 bp, Mus musculus
ggaacgcagctatggtcactgagga

SEQ ID NO: 116822 - DNA, 25 bp, Mus musculus
ggaacgcccgtggagacactgaagt

SEQ ID NO: 116823 - DNA, 25 bp, Mus musculus
ggaacgcctacagcgggatccttgg

SEQ ID NO: 116824 - DNA, 25 bp, Mus musculus
ggaacgctgaaaacattgccatcgt

SEQ ID NO: 116825 - DNA, 25 bp, Mus musculus
ggaacgctgaagtctgggtttccca

SEQ ID NO: 116826 - DNA, 25 bp, Mus musculus
ggaacgctgcccacctttatgagct

SEQ ID NO: 116827 - DNA, 25 bp, Mus musculus
ggaacgctttccaagggatgaataa

SEQ ID NO: 116828 - DNA, 25 bp, Mus musculus
ggaacggacagaagatagcgcccta

SEQ ID NO: 116829 - DNA, 25 bp, Mus musculus
ggaacggcagacctagactcacttg

SEQ ID NO: 116830 - DNA, 25 bp, Mus musculus
ggaacggccacacagcccttgtcaa

SEQ ID NO: 116831 - DNA, 25 bp, Mus musculus
ggaacggctccatgcaaaatttaac

SEQ ID NO: 116832 - DNA, 25 bp, Mus musculus
ggaacggctcggaatttgctccagc

SEQ ID NO: 116833 - DNA, 25 bp, Mus musculus
ggaacggtcccctggtgcaatggaa

SEQ ID NO: 116834 - DNA, 25 bp, Mus musculus
ggaacggttctgtgctaacatcata

SEQ ID NO: 116835 - DNA, 25 bp, Mus musculus
ggaacgtagaggtttactgctctgc

SEQ ID NO: 116836 - DNA, 25 bp, Mus musculus
ggaacgtgctcagtctcgctcaaaa

SEQ ID NO: 116837 - DNA, 25 bp, Mus musculus
ggaacgtgtggccttctagccgcct

SEQ ID NO: 116838 - DNA, 25 bp, Mus musculus
ggaactacacctttgccagcactga

SEQ ID NO: 116839 - DNA, 25 bp, Mus musculus
ggaactacagctgtcctgctgtaaa

SEQ ID NO: 116840 - DNA, 25 bp, Mus musculus
ggaactagccttgcctggagaactg

SEQ ID NO: 116841 - DNA, 25 bp, Mus musculus
ggaactagtgcttcccagcgcctta

SEQ ID NO: 116842 - DNA, 25 bp, Mus musculus
ggaactatgccatctagatgccctg

SEQ ID NO: 116843 - DNA, 25 bp, Mus musculus
ggaactcactcatctgcctgacagg

SEQ ID NO: 116844 - DNA, 25 bp, Mus musculus
ggaactcactcgacagaagaagaca

SEQ ID NO: 116845 - DNA, 25 bp, Mus musculus
ggaactcagagcctcgtccggtgca

SEQ ID NO: 116846 - DNA, 25 bp, Mus musculus
ggaactcagtgaatattgccctggg

SEQ ID NO: 116847 - DNA, 25 bp, Mus musculus
ggaactcatcgctgctgctgaagtg

SEQ ID NO: 116848 - DNA, 25 bp, Mus musculus
ggaactcattctttgtcatgacaaa

SEQ ID NO: 116849 - DNA, 25 bp, Mus musculus
ggaactcattgtcggcgcttctgga

SEQ ID NO: 116850 - DNA, 25 bp, Mus musculus
ggaactccggatgtagactagccta

SEQ ID NO: 116851 - DNA, 25 bp, Mus musculus
ggaactcctcatgcagaagcggctg

SEQ ID NO: 116852 - DNA, 25 bp, Mus musculus
ggaactcctctgttcacactcagga

SEQ ID NO: 116853 - DNA, 25 bp, Mus musculus
ggaactctcaactctcgagcctgag

SEQ ID NO: 116854 - DNA, 25 bp, Mus musculus
ggaactgaaaacctgctcaagcaag

SEQ ID NO: 116855 - DNA, 25 bp, Mus musculus
ggaactgaacaggtcctgtgcacga

SEQ ID NO: 116856 - DNA, 25 bp, Mus musculus
ggaactgaagcctcaaccaatcatg

SEQ ID NO: 116857 - DNA, 25 bp, Mus musculus
ggaactgaggaacgaacattctgct

SEQ ID NO: 116858 - DNA, 25 bp, Mus musculus
ggaactgatcacagccgcacatgag

SEQ ID NO: 116859 - DNA, 25 bp, Mus musculus
ggaactgcaccctggagggccgcta

SEQ ID NO: 116860 - DNA, 25 bp, Mus musculus
ggaactgcagatccgctgtaaagga

SEQ ID NO: 116861 - DNA, 25 bp, Mus musculus
ggaactgcagcaaatcaaaacatgg

SEQ ID NO: 116862 - DNA, 25 bp, Mus musculus
ggaactgccgcaatctctgaaagac

SEQ ID NO: 116863 - DNA, 25 bp, Mus musculus
ggaactgcgaatagagctcttcaga

SEQ ID NO: 116864 - DNA, 25 bp, Mus musculus
ggaactggatgggactgagaataaa

SEQ ID NO: 116865 - DNA, 25 bp, Mus musculus
ggaactggcttgatacctgaccacg

SEQ ID NO: 116866 - DNA, 25 bp, Mus musculus
ggaactgggagtatttatgtagcca

SEQ ID NO: 116867 - DNA, 25 bp, Mus musculus
ggaactgggcggacttttctaacag

SEQ ID NO: 116868 - DNA, 25 bp, Mus musculus
ggaactggttctgcggactctcagg

SEQ ID NO: 116869 - DNA, 25 bp, Mus musculus
ggaactgtacgatgctctgatggac

SEQ ID NO: 116870 - DNA, 25 bp, Mus musculus
ggaactgtagctcccaatatgaaga

SEQ ID NO: 116871 - DNA, 25 bp, Mus musculus
ggaactgtatgctcaccacgctgtg

SEQ ID NO: 116872 - DNA, 25 bp, Mus musculus
ggaactgtcaactggaagtcctgca

SEQ ID NO: 116873 - DNA, 25 bp, Mus musculus
ggaactgtccaagaactaacctgcc

SEQ ID NO: 116874 - DNA, 25 bp, Mus musculus
ggaactgtctctacagtccagccag

SEQ ID NO: 116875 - DNA, 25 bp, Mus musculus
ggaactgtgatatgtcccttgtgaa

SEQ ID NO: 116876 - DNA, 25 bp, Mus musculus
ggaactgtgccgtatctgacctgca

SEQ ID NO: 116877 - DNA, 25 bp, Mus musculus
ggaactgtttgctgcgccctcagaa

SEQ ID NO: 116878 - DNA, 25 bp, Mus musculus
ggaacttagctgtgcaatctgagaa

SEQ ID NO: 116879 - DNA, 25 bp, Mus musculus
ggaacttattaaggaccgccactgt

SEQ ID NO: 116880 - DNA, 25 bp, Mus musculus
ggaacttctcaagcaccagcggatg

SEQ ID NO: 116881 - DNA, 25 bp, Mus musculus
ggaacttctcagtgtccatacggga

SEQ ID NO: 116882 - DNA, 25 bp, Mus musculus
ggaacttgctcaaacatgtgctggg

SEQ ID NO: 116883 - DNA, 25 bp, Mus musculus
ggaacttgttctataatcgttgtgc

SEQ ID NO: 116884 - DNA, 25 bp, Mus musculus
ggaacttttctatgaggcctgcatg

SEQ ID NO: 116885 - DNA, 25 bp, Mus musculus
ggaacttttgtaatggagcacagct

SEQ ID NO: 116886 - DNA, 25 bp, Mus musculus
ggaagaaaagctccaacaatttgtg

SEQ ID NO: 116887 - DNA, 25 bp, Mus musculus
ggaagaaactaaccacaacgagatg

SEQ ID NO: 116888 - DNA, 25 bp, Mus musculus
ggaagaaagcccaaacgctcactga

SEQ ID NO: 116889 - DNA, 25 bp, Mus musculus
ggaagaacagaattacccgtgacca

SEQ ID NO: 116890 - DNA, 25 bp, Mus musculus
ggaagaaccacaggaaggcaggcct

SEQ ID NO: 116891 - DNA, 25 bp, Mus musculus
ggaagaaccacatgtactcctgcag

SEQ ID NO: 116892 - DNA, 25 bp, Mus musculus
ggaagaaccagcacagttacactgc

SEQ ID NO: 116893 - DNA, 25 bp, Mus musculus
ggaagaaccgatgctggaacagcgc

SEQ ID NO: 116894 - DNA, 25 bp, Mus musculus
ggaagaagaacatccgtgcgaccga

SEQ ID NO: 116895 - DNA, 25 bp, Mus musculus
ggaagaaggctttcgagaccgagca

SEQ ID NO: 116896 - DNA, 25 bp, Mus musculus
ggaagaagtttcagtggcctgcaag

SEQ ID NO: 116897 - DNA, 25 bp, Mus musculus
ggaagaatactcacaactacagggt

SEQ ID NO: 116898 - DNA, 25 bp, Mus musculus
ggaagaatctaaacccgcactggaa

SEQ ID NO: 116899 - DNA, 25 bp, Mus musculus
ggaagaatgtgccaccagctgttct

SEQ ID NO: 116900 - DNA, 25 bp, Mus musculus
ggaagaattccacctccgtcaagag

SEQ ID NO: 116901 - DNA, 25 bp, Mus musculus
ggaagaattccgactggccatggct

SEQ ID NO: 116902 - DNA, 25 bp, Mus musculus
ggaagacacacagtacatggccatg

SEQ ID NO: 116903 - DNA, 25 bp, Mus musculus
ggaagacaccatcgaagaaaaacag

SEQ ID NO: 116904 - DNA, 25 bp, Mus musculus
ggaagacatattcaccctgcccgtg

SEQ ID NO: 116905 - DNA, 25 bp, Mus musculus
ggaagaccccgttcacacatttagg

SEQ ID NO: 116906 - DNA, 25 bp, Mus musculus
ggaagacccgagattactccttgag

SEQ ID NO: 116907 - DNA, 25 bp, Mus musculus
ggaagacccggaaagatcagctaga

SEQ ID NO: 116908 - DNA, 25 bp, Mus musculus
ggaagaccggctagagattaccaac

SEQ ID NO: 116909 - DNA, 25 bp, Mus musculus
ggaagacctggtggattctctcaag

SEQ ID NO: 116910 - DNA, 25 bp, Mus musculus
ggaagacggcgtgcaaatgagaaca

SEQ ID NO: 116911 - DNA, 25 bp, Mus musculus
ggaagactatgagccgacagatgaa

SEQ ID NO: 116912 - DNA, 25 bp, Mus musculus
ggaagactccctgaaaatcccaaga

SEQ ID NO: 116913 - DNA, 25 bp, Mus musculus
ggaagacttcccttggatcagaatc

SEQ ID NO: 116914 - DNA, 25 bp, Mus musculus
ggaagacttgcctcaaacaactgag

SEQ ID NO: 116915 - DNA, 25 bp, Mus musculus
ggaagacttgggaaagctgcagcca

SEQ ID NO: 116916 - DNA, 25 bp, Mus musculus
ggaagagaagctagacctggtcacc

SEQ ID NO: 116917 - DNA, 25 bp, Mus musculus
ggaagagaccaagcctgtgttagaa

SEQ ID NO: 116918 - DNA, 25 bp, Mus musculus
ggaagagatccctatggccattaaa

SEQ ID NO: 116919 - DNA, 25 bp, Mus musculus
ggaagagcttccatttcgccagcgc

SEQ ID NO: 116920 - DNA, 25 bp, Mus musculus
ggaagaggaccaaagtgctgtcttt

SEQ ID NO: 116921 - DNA, 25 bp, Mus musculus
ggaagaggattaattaatacttggc

SEQ ID NO: 116922 - DNA, 25 bp, Mus musculus
ggaagatacacactgccgtccagtc

SEQ ID NO: 116923 - DNA, 25 bp, Mus musculus
ggaagatcatcctactgcagagcag

SEQ ID NO: 116924 - DNA, 25 bp, Mus musculus
ggaagatcccgtccttgaaagtaga

SEQ ID NO: 116925 - DNA, 25 bp, Mus musculus
ggaagatctaaatgcccaagttgaa

SEQ ID NO: 116926 - DNA, 25 bp, Mus musculus
ggaagatgctgatcctcggctccat

SEQ ID NO: 116927 - DNA, 25 bp, Mus musculus
ggaagattccaacagaaacaaatag

SEQ ID NO: 116928 - DNA, 25 bp, Mus musculus
ggaagattcgctgctcgtgagagaa

SEQ ID NO: 116929 - DNA, 25 bp, Mus musculus
ggaagattcggagtcgcctggaaca

SEQ ID NO: 116930 - DNA, 25 bp, Mus musculus
ggaagattgcgtactgagggccacc

SEQ ID NO: 116931 - DNA, 25 bp, Mus musculus
ggaagatttaagtccacgttctgga

SEQ ID NO: 116932 - DNA, 25 bp, Mus musculus
ggaagatttccagtctcgcccgatt

SEQ ID NO: 116933 - DNA, 25 bp, Mus musculus
ggaagattttcaaagccggcccact

SEQ ID NO: 116934 - DNA, 25 bp, Mus musculus
ggaagcaaaaaggatgcccctgatg

SEQ ID NO: 116935 - DNA, 25 bp, Mus musculus
ggaagcaccatctacaacacgagga

SEQ ID NO: 116936 - DNA, 25 bp, Mus musculus
ggaagcacccagaaaggaactttgt

SEQ ID NO: 116937 - DNA, 25 bp, Mus musculus
ggaagcacctgagtcgccagtgaag

SEQ ID NO: 116938 - DNA, 25 bp, Mus musculus
ggaagcagattcaatgagttcaagg

SEQ ID NO: 116939 - DNA, 25 bp, Mus musculus
ggaagcagctactggaagacatcca

SEQ ID NO: 116940 - DNA, 25 bp, Mus musculus
ggaagcaggcattgaaccaaacggc

SEQ ID NO: 116941 - DNA, 25 bp, Mus musculus
ggaagcaggctatgcagacctcgat

SEQ ID NO: 116942 - DNA, 25 bp, Mus musculus
ggaagcagtagtcccctttcggtag

SEQ ID NO: 116943 - DNA, 25 bp, Mus musculus
ggaagcatgtgctccttttgtcgga

SEQ ID NO: 116944 - DNA, 25 bp, Mus musculus
ggaagcattccagcccgagttagag

SEQ ID NO: 116945 - DNA, 25 bp, Mus musculus
ggaagccaagagaatagcagagatg

SEQ ID NO: 116946 - DNA, 25 bp, Mus musculus
ggaagccaccaactttccactgagg

SEQ ID NO: 116947 - DNA, 25 bp, Mus musculus
ggaagccacccactttttggagaga

SEQ ID NO: 116948 - DNA, 25 bp, Mus musculus
ggaagccacctttggttgatcagcc

SEQ ID NO: 116949 - DNA, 25 bp, Mus musculus
ggaagccactgtcctcactgggatg

SEQ ID NO: 116950 - DNA, 25 bp, Mus musculus
ggaagccagcgagaagaactagaca

SEQ ID NO: 116951 - DNA, 25 bp, Mus musculus
ggaagccagtccttcattactttga

SEQ ID NO: 116952 - DNA, 25 bp, Mus musculus
ggaagccagtgaaatacagagcagg

SEQ ID NO: 116953 - DNA, 25 bp, Mus musculus
ggaagccagtggcatgaaatccacc

SEQ ID NO: 116954 - DNA, 25 bp, Mus musculus
ggaagccatgccatatgcacctgct

SEQ ID NO: 116955 - DNA, 25 bp, Mus musculus
ggaagccattcctgcagtttgcaag

SEQ ID NO: 116956 - DNA, 25 bp, Mus musculus
ggaagccattgcctggttaatagtt

SEQ ID NO: 116957 - DNA, 25 bp, Mus musculus
ggaagcccacgaacaaggcatggac

SEQ ID NO: 116958 - DNA, 25 bp, Mus musculus
ggaagcccaggcaccatacagtgtg

SEQ ID NO: 116959 - DNA, 25 bp, Mus musculus
ggaagcccctaaactgtcgaagaag

SEQ ID NO: 116960 - DNA, 25 bp, Mus musculus
ggaagcccctgctgacatgggagca

SEQ ID NO: 116961 - DNA, 25 bp, Mus musculus
ggaagccctcatgaagatgctgaag

SEQ ID NO: 116962 - DNA, 25 bp, Mus musculus
ggaagccctcggtctcagtgctgag

SEQ ID NO: 116963 - DNA, 25 bp, Mus musculus
ggaagccctggacctgtacaataag

SEQ ID NO: 116964 - DNA, 25 bp, Mus musculus
ggaagccgaacctcaccggaagatt

SEQ ID NO: 116965 - DNA, 25 bp, Mus musculus
ggaagccgacctagctcaagtcaag

SEQ ID NO: 116966 - DNA, 25 bp, Mus musculus
ggaagccgagtgatcactcccgtga

SEQ ID NO: 116967 - DNA, 25 bp, Mus musculus
ggaagccgttctgtgacatcatgga

SEQ ID NO: 116968 - DNA, 25 bp, Mus musculus
ggaagcctgctgttgatgcccgcta

SEQ ID NO: 116969 - DNA, 25 bp, Mus musculus
ggaagcctgtctcaagtacggtgca

SEQ ID NO: 116970 - DNA, 25 bp, Mus musculus
ggaagccttacccacaagctggaga

SEQ ID NO: 116971 - DNA, 25 bp, Mus musculus
ggaagccttcccttgccctttctga

SEQ ID NO: 116972 - DNA, 25 bp, Mus musculus
ggaagccttggtctcctagtaagaa

SEQ ID NO: 116973 - DNA, 25 bp, Mus musculus
ggaagccttttccaagcatggccag

SEQ ID NO: 116974 - DNA, 25 bp, Mus musculus
ggaagctaatgctctggccatgcaa

SEQ ID NO: 116975 - DNA, 25 bp, Mus musculus
ggaagctaccattttgccctgagtg

SEQ ID NO: 116976 - DNA, 25 bp, Mus musculus
ggaagctagtcctctctgggtttct

SEQ ID NO: 116977 - DNA, 25 bp, Mus musculus
ggaagctatgcgaaattatttaaaa

SEQ ID NO: 116978 - DNA, 25 bp, Mus musculus
ggaagctcacccgagacacgtttga

SEQ ID NO: 116979 - DNA, 25 bp, Mus musculus
ggaagctcctggtgttgctcctgga

SEQ ID NO: 116980 - DNA, 25 bp, Mus musculus
ggaagctcgagtgcctggtgttatt

SEQ ID NO: 116981 - DNA, 25 bp, Mus musculus
ggaagctcgtgtttaagtagacgcg

SEQ ID NO: 116982 - DNA, 25 bp, Mus musculus
ggaagctctatagtgaccaatgcca

SEQ ID NO: 116983 - DNA, 25 bp, Mus musculus
ggaagctctctcactgtatacgaag

SEQ ID NO: 116984 - DNA, 25 bp, Mus musculus
ggaagctctgccctcgactagatga

SEQ ID NO: 116985 - DNA, 25 bp, Mus musculus
ggaagctgatgcaggtgaatgatac

SEQ ID NO: 116986 - DNA, 25 bp, Mus musculus
ggaagctgcccatagtcaacgatca

SEQ ID NO: 116987 - DNA, 25 bp, Mus musculus
ggaagctgcccgcagcgaaaacaag

SEQ ID NO: 116988 - DNA, 25 bp, Mus musculus
ggaagctgctctcgctgagtacgaa

SEQ ID NO: 116989 - DNA, 25 bp, Mus musculus
ggaagctgtccaccaagaaagcctg

SEQ ID NO: 116990 - DNA, 25 bp, Mus musculus
ggaaggacagactccactgatgctg

SEQ ID NO: 116991 - DNA, 25 bp, Mus musculus
ggaaggacatccagtacgctactag

SEQ ID NO: 116992 - DNA, 25 bp, Mus musculus
ggaaggactgcatcatgcacgggta

SEQ ID NO: 116993 - DNA, 25 bp, Mus musculus
ggaaggactgctgtgctgactacaa

SEQ ID NO: 116994 - DNA, 25 bp, Mus musculus
ggaaggagttcagagcctaggccca

SEQ ID NO: 116995 - DNA, 25 bp, Mus musculus
ggaaggatgagatgactgatgaaga

SEQ ID NO: 116996 - DNA, 25 bp, Mus musculus
ggaaggattgagatgccagatccca

SEQ ID NO: 116997 - DNA, 25 bp, Mus musculus
ggaaggcaatatctctccagaccag

SEQ ID NO: 116998 - DNA, 25 bp, Mus musculus
ggaaggcactgtccctaagtctggt

SEQ ID NO: 116999 - DNA, 25 bp, Mus musculus
ggaaggcacttatgacacagctctg

SEQ ID NO: 117000 - DNA, 25 bp, Mus musculus
ggaaggcagccaaacctcaggaggt

SEQ ID NO: 117001 - DNA, 25 bp, Mus musculus
ggaaggccactgacactgctggcag

SEQ ID NO: 117002 - DNA, 25 bp, Mus musculus
ggaaggccatcacgtacacttatga

SEQ ID NO: 117003 - DNA, 25 bp, Mus musculus
ggaaggcccacgtcctgtacattga

SEQ ID NO: 117004 - DNA, 25 bp, Mus musculus
ggaaggcccctttggcgaagaccat

SEQ ID NO: 117005 - DNA, 25 bp, Mus musculus
ggaaggccctgtatctgtagagtga

SEQ ID NO: 117006 - DNA, 25 bp, Mus musculus
ggaaggccgacagctctactggact

SEQ ID NO: 117007 - DNA, 25 bp, Mus musculus
ggaaggcgtactggcaaagttatcc

SEQ ID NO: 117008 - DNA, 25 bp, Mus musculus
ggaaggctcggatgttactccagag

SEQ ID NO: 117009 - DNA, 25 bp, Mus musculus
ggaaggctgaaaccatacaggctga

SEQ ID NO: 117010 - DNA, 25 bp, Mus musculus
ggaaggctttccaccagaacgacgt

SEQ ID NO: 117011 - DNA, 25 bp, Mus musculus
ggaagggattctcgactcactcata

SEQ ID NO: 117012 - DNA, 25 bp, Mus musculus
ggaagggcacccatccacaatgaag

SEQ ID NO: 117013 - DNA, 25 bp, Mus musculus
ggaagggctacatctttttctcact

SEQ ID NO: 117014 - DNA, 25 bp, Mus musculus
ggaagggctctcattactctgcaag

SEQ ID NO: 117015 - DNA, 25 bp, Mus musculus
ggaaggtgccaaccgtgaaatcctg

SEQ ID NO: 117016 - DNA, 25 bp, Mus musculus
ggaaggttaccataagccagatcag

SEQ ID NO: 117017 - DNA, 25 bp, Mus musculus
ggaaggttcagtggatggagttgcc

SEQ ID NO: 117018 - DNA, 25 bp, Mus musculus
ggaaggttccagtcggtgctctcac

SEQ ID NO: 117019 - DNA, 25 bp, Mus musculus
ggaaggttccttgcggatcatccgg

SEQ ID NO: 117020 - DNA, 25 bp, Mus musculus
ggaaggtttcaaggcacggacgcca

SEQ ID NO: 117021 - DNA, 25 bp, Mus musculus
ggaagtaaacattgctcaccagatc

SEQ ID NO: 117022 - DNA, 25 bp, Mus musculus
ggaagtaaacgcgtcctaatttgag

SEQ ID NO: 117023 - DNA, 25 bp, Mus musculus
ggaagtaagaaagccaccagaagcc

SEQ ID NO: 117024 - DNA, 25 bp, Mus musculus
ggaagtacatcgaggccaggtcgca

SEQ ID NO: 117025 - DNA, 25 bp, Mus musculus
ggaagtaccaatacccagaagttga

SEQ ID NO: 117026 - DNA, 25 bp, Mus musculus
ggaagtagcagaatgcctccctgac

SEQ ID NO: 117027 - DNA, 25 bp, Mus musculus
ggaagtatccgtgtcccctgtgtgg

SEQ ID NO: 117028 - DNA, 25 bp, Mus musculus
ggaagtattatcagctaccaagatg

SEQ ID NO: 117029 - DNA, 25 bp, Mus musculus
ggaagtattccaccagcctctatgc

SEQ ID NO: 117030 - DNA, 25 bp, Mus musculus
ggaagtcaactccaaaacacagctt

SEQ ID NO: 117031 - DNA, 25 bp, Mus musculus
ggaagtcaatctcccatccggagtc

SEQ ID NO: 117032 - DNA, 25 bp, Mus musculus
ggaagtcaccacaacgcttcgagag

SEQ ID NO: 117033 - DNA, 25 bp, Mus musculus
ggaagtcacgctgaacaaacaggtg

SEQ ID NO: 117034 - DNA, 25 bp, Mus musculus
ggaagtcagagctctcccagctaga

SEQ ID NO: 117035 - DNA, 25 bp, Mus musculus
ggaagtcagatccaagctgtcccct

SEQ ID NO: 117036 - DNA, 25 bp, Mus musculus
ggaagtcagcacacatgaaaagcag

SEQ ID NO: 117037 - DNA, 25 bp, Mus musculus
ggaagtcatcccatcccggctggat

SEQ ID NO: 117038 - DNA, 25 bp, Mus musculus
ggaagtcatgaaggcgtgtaccacc

SEQ ID NO: 117039 - DNA, 25 bp, Mus musculus
ggaagtccatctcatcgaaagcaca

SEQ ID NO: 117040 - DNA, 25 bp, Mus musculus
ggaagtcctgccctaaatggtctgt

SEQ ID NO: 117041 - DNA, 25 bp, Mus musculus
ggaagtccttttaccatctgttgag

SEQ ID NO: 117042 - DNA, 25 bp, Mus musculus
ggaagtctcagaccacaactatgag

SEQ ID NO: 117043 - DNA, 25 bp, Mus musculus
ggaagtctcagggtcacacacattg

SEQ ID NO: 117044 - DNA, 25 bp, Mus musculus
ggaagtctccaaaacgaatgtgaaa

SEQ ID NO: 117045 - DNA, 25 bp, Mus musculus
ggaagtctgacaaggcagccaatga

SEQ ID NO: 117046 - DNA, 25 bp, Mus musculus
ggaagtctggttctgaatcatgttg

SEQ ID NO: 117047 - DNA, 25 bp, Mus musculus
ggaagtctgtactgctaactctgag

SEQ ID NO: 117048 - DNA, 25 bp, Mus musculus
ggaagtcttccatgccccaagaggt

SEQ ID NO: 117049 - DNA, 25 bp, Mus musculus
ggaagtgaagaacccacgtgatctg

SEQ ID NO: 117050 - DNA, 25 bp, Mus musculus
ggaagtgaagtgacagagctctcag

SEQ ID NO: 117051 - DNA, 25 bp, Mus musculus
ggaagtgacatcgtacctcagagta

SEQ ID NO: 117052 - DNA, 25 bp, Mus musculus
ggaagtgactgtctaccaccgacgg

SEQ ID NO: 117053 - DNA, 25 bp, Mus musculus
ggaagtggccggcaggcggccctgg

SEQ ID NO: 117054 - DNA, 25 bp, Mus musculus
ggaagtggtaagaacatttgcttag

SEQ ID NO: 117055 - DNA, 25 bp, Mus musculus
ggaagtgtacccactagagctactg

SEQ ID NO: 117056 - DNA, 25 bp, Mus musculus
ggaagtgtcaaccagactgccatgg

SEQ ID NO: 117057 - DNA, 25 bp, Mus musculus
ggaagtgtgccaacctagaagttca

SEQ ID NO: 117058 - DNA, 25 bp, Mus musculus
ggaagtgtgcctcttccacgccatg

SEQ ID NO: 117059 - DNA, 25 bp, Mus musculus
ggaagttcaaagtctccgggcgcca

SEQ ID NO: 117060 - DNA, 25 bp, Mus musculus
ggaagttccaccatgccttgacagt

SEQ ID NO: 117061 - DNA, 25 bp, Mus musculus
ggaagttcgcagtgaaagcacacca

SEQ ID NO: 117062 - DNA, 25 bp, Mus musculus
ggaagttgaccccaagtcctgttga

SEQ ID NO: 117063 - DNA, 25 bp, Mus musculus
ggaagtttaccagtctatcggccac

SEQ ID NO: 117064 - DNA, 25 bp, Mus musculus
ggaagtttcaattacgctaataaag

SEQ ID NO: 117065 - DNA, 25 bp, Mus musculus
ggaagtttccataccctgtgcagtg

SEQ ID NO: 117066 - DNA, 25 bp, Mus musculus
ggaagtttctctaccctccagagct

SEQ ID NO: 117067 - DNA, 25 bp, Mus musculus
ggaagtttgctcaatctcagccgaa

SEQ ID NO: 117068 - DNA, 25 bp, Mus musculus
ggaagtttgtctcctctggaaccac

SEQ ID NO: 117069 - DNA, 25 bp, Mus musculus
ggaataacccctgcatacctcaagg

SEQ ID NO: 117070 - DNA, 25 bp, Mus musculus
ggaatacacactgttcgagaccatc

SEQ ID NO: 117071 - DNA, 25 bp, Mus musculus
ggaatacactgacaacagcacaggg

SEQ ID NO: 117072 - DNA, 25 bp, Mus musculus
ggaatacatgtccttcagcgcccat

SEQ ID NO: 117073 - DNA, 25 bp, Mus musculus
ggaatacccctaatgaagacgacag

SEQ ID NO: 117074 - DNA, 25 bp, Mus musculus
ggaatactaagcaccaccctgagga

SEQ ID NO: 117075 - DNA, 25 bp, Mus musculus
ggaatactatcacctcctagccgag

SEQ ID NO: 117076 - DNA, 25 bp, Mus musculus
ggaatactgattctagctctcggaa

SEQ ID NO: 117077 - DNA, 25 bp, Mus musculus
ggaatagaatttgcaaccctttgag

SEQ ID NO: 117078 - DNA, 25 bp, Mus musculus
ggaatagccaaagccatccaatact

SEQ ID NO: 117079 - DNA, 25 bp, Mus musculus
ggaatagccagagccggtttagact

SEQ ID NO: 117080 - DNA, 25 bp, Mus musculus
ggaatagctttgatccttagccacg

SEQ ID NO: 117081 - DNA, 25 bp, Mus musculus
ggaatatccccgtgcacaagtggtg

SEQ ID NO: 117082 - DNA, 25 bp, Mus musculus
ggaatatctagcataccggcccatc

SEQ ID NO: 117083 - DNA, 25 bp, Mus musculus
ggaatatctgatccaggagctccga

SEQ ID NO: 117084 - DNA, 25 bp, Mus musculus
ggaatatgacgcatctccaggagac

SEQ ID NO: 117085 - DNA, 25 bp, Mus musculus
ggaatatggattccagtatgagctt

SEQ ID NO: 117086 - DNA, 25 bp, Mus musculus
ggaatatgtcacttgtcacacatgc

SEQ ID NO: 117087 - DNA, 25 bp, Mus musculus
ggaatattccagttatcgggcagcc

SEQ ID NO: 117088 - DNA, 25 bp, Mus musculus
ggaatcaatgactccccagctctgg

SEQ ID NO: 117089 - DNA, 25 bp, Mus musculus
ggaatcacaagatccatcctgaatg

SEQ ID NO: 117090 - DNA, 25 bp, Mus musculus
ggaatcacacaagcgaaaagccctt

SEQ ID NO: 117091 - DNA, 25 bp, Mus musculus
ggaatcacacactacagaaatggca

SEQ ID NO: 117092 - DNA, 25 bp, Mus musculus
ggaatcacattggagcagctgggaa

SEQ ID NO: 117093 - DNA, 25 bp, Mus musculus
ggaatcacctgaagccactagttgg

SEQ ID NO: 117094 - DNA, 25 bp, Mus musculus
ggaatcacgcttgcttctagccaag

SEQ ID NO: 117095 - DNA, 25 bp, Mus musculus
ggaatcactgtatgctgctagggaa

SEQ ID NO: 117096 - DNA, 25 bp, Mus musculus
ggaatcagacggtgccccatagatg

SEQ ID NO: 117097 - DNA, 25 bp, Mus musculus
ggaatcatcccggagtcaggacaaa

SEQ ID NO: 117098 - DNA, 25 bp, Mus musculus
ggaatcatcctgacgggctggcaga

SEQ ID NO: 117099 - DNA, 25 bp, Mus musculus
ggaatccagaagacaggctaccgtg

SEQ ID NO: 117100 - DNA, 25 bp, Mus musculus
ggaatccaggcagtgagggtcttca

SEQ ID NO: 117101 - DNA, 25 bp, Mus musculus
ggaatccagttcttcacgttagctg

SEQ ID NO: 117102 - DNA, 25 bp, Mus musculus
ggaatcccagatcaagaagctccat

SEQ ID NO: 117103 - DNA, 25 bp, Mus musculus
ggaatccgactgtagaatgccactc

SEQ ID NO: 117104 - DNA, 25 bp, Mus musculus
ggaatcctgccctgtatgccagcaa

SEQ ID NO: 117105 - DNA, 25 bp, Mus musculus
ggaatcctggttaacaccccgacag

SEQ ID NO: 117106 - DNA, 25 bp, Mus musculus
ggaatcgcaattcccggcgcggttt

SEQ ID NO: 117107 - DNA, 25 bp, Mus musculus
ggaatcgccattgcgctgctcgtca

SEQ ID NO: 117108 - DNA, 25 bp, Mus musculus
ggaatcgctagagttgcagtgcatg

SEQ ID NO: 117109 - DNA, 25 bp, Mus musculus
ggaatcgctgtcagtactgtcgcta

SEQ ID NO: 117110 - DNA, 25 bp, Mus musculus
ggaatctccccacggtgttcgtcta

SEQ ID NO: 117111 - DNA, 25 bp, Mus musculus
ggaatctgaagtccatcctacgaca

SEQ ID NO: 117112 - DNA, 25 bp, Mus musculus
ggaatctgctatgaggcttaactgc

SEQ ID NO: 117113 - DNA, 25 bp, Mus musculus
ggaatctggcagatctccgccgtag

SEQ ID NO: 117114 - DNA, 25 bp, Mus musculus
ggaatgaaaggcctgcaccatagac

SEQ ID NO: 117115 - DNA, 25 bp, Mus musculus
ggaatgacagccagtcagacctctg

SEQ ID NO: 117116 - DNA, 25 bp, Mus musculus
ggaatgacagtctggtccctgacta

SEQ ID NO: 117117 - DNA, 25 bp, Mus musculus
ggaatgacgatgtctgccagaggca

SEQ ID NO: 117118 - DNA, 25 bp, Mus musculus
ggaatgacgcatggcttcccagtca

SEQ ID NO: 117119 - DNA, 25 bp, Mus musculus
ggaatgactctgactggcgtccaca

SEQ ID NO: 117120 - DNA, 25 bp, Mus musculus
ggaatgagaaaacttgccctgcaaa

SEQ ID NO: 117121 - DNA, 25 bp, Mus musculus
ggaatgcaactgcacagacggttta

SEQ ID NO: 117122 - DNA, 25 bp, Mus musculus
ggaatgcagcagatccagcttgtgg

SEQ ID NO: 117123 - DNA, 25 bp, Mus musculus
ggaatgcatttcctgggctccagaa

SEQ ID NO: 117124 - DNA, 25 bp, Mus musculus
ggaatgccacctccacgtctatgag

SEQ ID NO: 117125 - DNA, 25 bp, Mus musculus
ggaatgccactgtatgcctagccaa

SEQ ID NO: 117126 - DNA, 25 bp, Mus musculus
ggaatgccatccatacctggctcag

SEQ ID NO: 117127 - DNA, 25 bp, Mus musculus
ggaatgcccttatcccaagtcattg

SEQ ID NO: 117128 - DNA, 25 bp, Mus musculus
ggaatgccgctgtcatcctgaggag

SEQ ID NO: 117129 - DNA, 25 bp, Mus musculus
ggaatgccttcgttctgctcacggt

SEQ ID NO: 117130 - DNA, 25 bp, Mus musculus
ggaatgcgatcaggagggaaaactc

SEQ ID NO: 117131 - DNA, 25 bp, Mus musculus
ggaatgctctccagccatattactg

SEQ ID NO: 117132 - DNA, 25 bp, Mus musculus
ggaatgcttcctatgaccctgctgc

SEQ ID NO: 117133 - DNA, 25 bp, Mus musculus
ggaatggactgatgacgacctggta

SEQ ID NO: 117134 - DNA, 25 bp, Mus musculus
ggaatggactgtgggccacctgcaa

SEQ ID NO: 117135 - DNA, 25 bp, Mus musculus
ggaatggcacatattgaggcgatca

SEQ ID NO: 117136 - DNA, 25 bp, Mus musculus
ggaatggcttagacagggccctgca

SEQ ID NO: 117137 - DNA, 25 bp, Mus musculus
ggaatggcttcgatcctgagctgta

SEQ ID NO: 117138 - DNA, 25 bp, Mus musculus
ggaatggtccccagccggttttctg

SEQ ID NO: 117139 - DNA, 25 bp, Mus musculus
ggaatgtacctctccaacgaccagg

SEQ ID NO: 117140 - DNA, 25 bp, Mus musculus
ggaatgtccccaagtgtctacgtct

SEQ ID NO: 117141 - DNA, 25 bp, Mus musculus
ggaatgtgtctacaaggaccagcag

SEQ ID NO: 117142 - DNA, 25 bp, Mus musculus
ggaatgttaaaacggttgccctgct

SEQ ID NO: 117143 - DNA, 25 bp, Mus musculus
ggaatgttcaccagcgagctcagcc

SEQ ID NO: 117144 - DNA, 25 bp, Mus musculus
ggaatgttcccactccatttggcag

SEQ ID NO: 117145 - DNA, 25 bp, Mus musculus
ggaattacgatgctcccgaagccgt

SEQ ID NO: 117146 - DNA, 25 bp, Mus musculus
ggaattacggcctgaagaccggctt

SEQ ID NO: 117147 - DNA, 25 bp, Mus musculus
ggaattagcctcgagagactccgca

SEQ ID NO: 117148 - DNA, 25 bp, Mus musculus
ggaattatccactgaagtccagtct

SEQ ID NO: 117149 - DNA, 25 bp, Mus musculus
ggaattatgctccttctgggacgga

SEQ ID NO: 117150 - DNA, 25 bp, Mus musculus
ggaattcaaaataagaatctcctga

SEQ ID NO: 117151 - DNA, 25 bp, Mus musculus
ggaattcacctgagccttgagagag

SEQ ID NO: 117152 - DNA, 25 bp, Mus musculus
ggaattccagaaaggcaaggtagca

SEQ ID NO: 117153 - DNA, 25 bp, Mus musculus
ggaattcctagaccccagcaagagg

SEQ ID NO: 117154 - DNA, 25 bp, Mus musculus
ggaattccttgcaactggagctcag

SEQ ID NO: 117155 - DNA, 25 bp, Mus musculus
ggaattcgccatggcgtttgccaca

SEQ ID NO: 117156 - DNA, 25 bp, Mus musculus
ggaattcgctctacttctcgcgaga

SEQ ID NO: 117157 - DNA, 25 bp, Mus musculus
ggaattcggaactgctcgatgcgca

SEQ ID NO: 117158 - DNA, 25 bp, Mus musculus
ggaattcgtggaaagaccctgccct

SEQ ID NO: 117159 - DNA, 25 bp, Mus musculus
ggaattcgtttgcatcaaatattag

SEQ ID NO: 117160 - DNA, 25 bp, Mus musculus
ggaattctacaacgaggcctccaat

SEQ ID NO: 117161 - DNA, 25 bp, Mus musculus
ggaattctctctcaagagctgcgtg

SEQ ID NO: 117162 - DNA, 25 bp, Mus musculus
ggaattctctggactgaactgttta

SEQ ID NO: 117163 - DNA, 25 bp, Mus musculus
ggaattctgaactatgcccttgaag

SEQ ID NO: 117164 - DNA, 25 bp, Mus musculus
ggaattggaaaagcatatgcagaag

SEQ ID NO: 117165 - DNA, 25 bp, Mus musculus
ggaattggacctgggacatcaactc

SEQ ID NO: 117166 - DNA, 25 bp, Mus musculus
ggaattggccaacacgctctataac

SEQ ID NO: 117167 - DNA, 25 bp, Mus musculus
ggaatttacatcagcaccctcaaga

SEQ ID NO: 117168 - DNA, 25 bp, Mus musculus
ggaatttcctcctcgcctgattgtg

SEQ ID NO: 117169 - DNA, 25 bp, Mus musculus
ggaatttcgtcccttcattcgaagg

SEQ ID NO: 117170 - DNA, 25 bp, Mus musculus
ggaatttctaatgcagcccaggcta

SEQ ID NO: 117171 - DNA, 25 bp, Mus musculus
ggaatttctgaactgagccgcaaag

SEQ ID NO: 117172 - DNA, 25 bp, Mus musculus
ggaatttctgcgcacctatgctggg

SEQ ID NO: 117173 - DNA, 25 bp, Mus musculus
ggaatttgaaacttacggctgctac

SEQ ID NO: 117174 - DNA, 25 bp, Mus musculus
ggaatttgctgtctctggccctccg

SEQ ID NO: 117175 - DNA, 25 bp, Mus musculus
ggaatttggaacagagtgcttgcag

SEQ ID NO: 117176 - DNA, 25 bp, Mus musculus
ggaatttggcatcgcagaccctgaa

SEQ ID NO: 117177 - DNA, 25 bp, Mus musculus
ggacaaaactactctccgaagagga

SEQ ID NO: 117178 - DNA, 25 bp, Mus musculus
ggacaaaatcatctcgcattttggg

SEQ ID NO: 117179 - DNA, 25 bp, Mus musculus
ggacaaaatggtggctgtcgcctca

SEQ ID NO: 117180 - DNA, 25 bp, Mus musculus
ggacaaaccattgcactgggacaac

SEQ ID NO: 117181 - DNA, 25 bp, Mus musculus
ggacaaactcatcaagaggctgcag

SEQ ID NO: 117182 - DNA, 25 bp, Mus musculus
ggacaaagcccagactacactaggg

SEQ ID NO: 117183 - DNA, 25 bp, Mus musculus
ggacaaatgtttgacggcgccctcc

SEQ ID NO: 117184 - DNA, 25 bp, Mus musculus
ggacaacacagcactttctcgagcg

SEQ ID NO: 117185 - DNA, 25 bp, Mus musculus
ggacaacctggctttcggaggccca

SEQ ID NO: 117186 - DNA, 25 bp, Mus musculus
ggacaaccttgagctgacagcctac

SEQ ID NO: 117187 - DNA, 25 bp, Mus musculus
ggacaacgggtcatcctagaggaga

SEQ ID NO: 117188 - DNA, 25 bp, Mus musculus
ggacaactcattccaagtcacctat

SEQ ID NO: 117189 - DNA, 25 bp, Mus musculus
ggacaactcggttcacgggcgtcat

SEQ ID NO: 117190 - DNA, 25 bp, Mus musculus
ggacaacttgaaagacactctcaaa

SEQ ID NO: 117191 - DNA, 25 bp, Mus musculus
ggacaactttgaagctcgaatggca

SEQ ID NO: 117192 - DNA, 25 bp, Mus musculus
ggacaagacagagaggaaaaaggac

SEQ ID NO: 117193 - DNA, 25 bp, Mus musculus
ggacaagacccacctgaacatgagt

SEQ ID NO: 117194 - DNA, 25 bp, Mus musculus
ggacaagagtttttctgcaagggcc

SEQ ID NO: 117195 - DNA, 25 bp, Mus musculus
ggacaagcagcaaaagaactctaag

SEQ ID NO: 117196 - DNA, 25 bp, Mus musculus
ggacaaggaccccaagtacagtgct

SEQ ID NO: 117197 - DNA, 25 bp, Mus musculus
ggacaaggtctctgcccattctgag

SEQ ID NO: 117198 - DNA, 25 bp, Mus musculus
ggacaagtgctagaatgttccctca

SEQ ID NO: 117199 - DNA, 25 bp, Mus musculus
ggacaagttcaacccacaatggagg

SEQ ID NO: 117200 - DNA, 25 bp, Mus musculus
ggacaatatccaactcactccagag

SEQ ID NO: 117201 - DNA, 25 bp, Mus musculus
ggacaatctggtcaacggcacagga

SEQ ID NO: 117202 - DNA, 25 bp, Mus musculus
ggacaatgaagctcctcaattatgc

SEQ ID NO: 117203 - DNA, 25 bp, Mus musculus
ggacaattggctgctgcaaccgcat

SEQ ID NO: 117204 - DNA, 25 bp, Mus musculus
ggacacaagtgtcatggcgctctcc

SEQ ID NO: 117205 - DNA, 25 bp, Mus musculus
ggacacacacgttggcacttcttgg

SEQ ID NO: 117206 - DNA, 25 bp, Mus musculus
ggacacagacccttgcggaagctga

SEQ ID NO: 117207 - DNA, 25 bp, Mus musculus
ggacacaggccagaaatgctccgag

SEQ ID NO: 117208 - DNA, 25 bp, Mus musculus
ggacacataccctgcaattgcaagg

SEQ ID NO: 117209 - DNA, 25 bp, Mus musculus
ggacacattttatggcatctggaaa

SEQ ID NO: 117210 - DNA, 25 bp, Mus musculus
ggacaccagagtctagcccagaaag

SEQ ID NO: 117211 - DNA, 25 bp, Mus musculus
ggacaccagtgcaagagctctcagt

SEQ ID NO: 117212 - DNA, 25 bp, Mus musculus
ggacaccatcttctgccgctggacg

SEQ ID NO: 117213 - DNA, 25 bp, Mus musculus
ggacacccaagtcaaaggccactga

SEQ ID NO: 117214 - DNA, 25 bp, Mus musculus
ggacacccttcaggatacgctggaa

SEQ ID NO: 117215 - DNA, 25 bp, Mus musculus
ggacaccgaagcatccatcagggaa

SEQ ID NO: 117216 - DNA, 25 bp, Mus musculus
ggacacctcagcattggcgttgaca

SEQ ID NO: 117217 - DNA, 25 bp, Mus musculus
ggacacctccgagaaggcaagtgcc

SEQ ID NO: 117218 - DNA, 25 bp, Mus musculus
ggacacctgtaaagccgccaatctg

SEQ ID NO: 117219 - DNA, 25 bp, Mus musculus
ggacacctttgctctaaagactgcg

SEQ ID NO: 117220 - DNA, 25 bp, Mus musculus
ggacacggacgaggtgaaaaagctt

SEQ ID NO: 117221 - DNA, 25 bp, Mus musculus
ggacactcaactccaatgatcccaa

SEQ ID NO: 117222 - DNA, 25 bp, Mus musculus
ggacactccaacacctttctctaca

SEQ ID NO: 117223 - DNA, 25 bp, Mus musculus
ggacactcctgctctaactggctag

SEQ ID NO: 117224 - DNA, 25 bp, Mus musculus
ggacactcctttcctgacgggacag

SEQ ID NO: 117225 - DNA, 25 bp, Mus musculus
ggacactcgagacgatccctacaga

SEQ ID NO: 117226 - DNA, 25 bp, Mus musculus
ggacactgacgtgccagggtagttc

SEQ ID NO: 117227 - DNA, 25 bp, Mus musculus
ggacactgactgaagaggccaagat

SEQ ID NO: 117228 - DNA, 25 bp, Mus musculus
ggacactgcagaccttgggaagaca

SEQ ID NO: 117229 - DNA, 25 bp, Mus musculus
ggacactgcccaaggaacctggatt

SEQ ID NO: 117230 - DNA, 25 bp, Mus musculus
ggacactgtccccatgctgaatgct

SEQ ID NO: 117231 - DNA, 25 bp, Mus musculus
ggacacttttgtactgggacccaga

SEQ ID NO: 117232 - DNA, 25 bp, Mus musculus
ggacagaagcaatttctccctcaga

SEQ ID NO: 117233 - DNA, 25 bp, Mus musculus
ggacagaccaacagaagttcctttg

SEQ ID NO: 117234 - DNA, 25 bp, Mus musculus
ggacagacttaaacctgtcattggg

SEQ ID NO: 117235 - DNA, 25 bp, Mus musculus
ggacagacttctcccaccagtgggt

SEQ ID NO: 117236 - DNA, 25 bp, Mus musculus
ggacagagactaagagccaccactt

SEQ ID NO: 117237 - DNA, 25 bp, Mus musculus
ggacagagtgcctaggtatgagcct

SEQ ID NO: 117238 - DNA, 25 bp, Mus musculus
ggacagatctgaggagaaagcaata

SEQ ID NO: 117239 - DNA, 25 bp, Mus musculus
ggacagatgcccagtatcatgccta

SEQ ID NO: 117240 - DNA, 25 bp, Mus musculus
ggacagcaagaatcaagctccagga

SEQ ID NO: 117241 - DNA, 25 bp, Mus musculus
ggacagcacgctttgaatgccacac

SEQ ID NO: 117242 - DNA, 25 bp, Mus musculus
ggacagcatcctccggagaagacaa

SEQ ID NO: 117243 - DNA, 25 bp, Mus musculus
ggacagcatgatttcctgaagcggg

SEQ ID NO: 117244 - DNA, 25 bp, Mus musculus
ggacagccatatcgagtcaccttag

SEQ ID NO: 117245 - DNA, 25 bp, Mus musculus
ggacagccttcccattgtgtgcgca

SEQ ID NO: 117246 - DNA, 25 bp, Mus musculus
ggacagcgtggccaatcatctgaga

SEQ ID NO: 117247 - DNA, 25 bp, Mus musculus
ggacagctacgattacaccatcaga

SEQ ID NO: 117248 - DNA, 25 bp, Mus musculus
ggacagctcatttcactaccgcaga

SEQ ID NO: 117249 - DNA, 25 bp, Mus musculus
ggacagcttgatgaccttagagaca

SEQ ID NO: 117250 - DNA, 25 bp, Mus musculus
ggacagcttgctgcctatggctata

SEQ ID NO: 117251 - DNA, 25 bp, Mus musculus
ggacagctttgcagcatctacctca

SEQ ID NO: 117252 - DNA, 25 bp, Mus musculus
ggacaggaccttatgagcaatgctc

SEQ ID NO: 117253 - DNA, 25 bp, Mus musculus
ggacaggcattgcagctgcctccat

SEQ ID NO: 117254 - DNA, 25 bp, Mus musculus
ggacaggcccagtcttctcaaaaag

SEQ ID NO: 117255 - DNA, 25 bp, Mus musculus
ggacagggaacgacagaaactagaa

SEQ ID NO: 117256 - DNA, 25 bp, Mus musculus
ggacagggagccacgacttacagta

SEQ ID NO: 117257 - DNA, 25 bp, Mus musculus
ggacagggcatttctgagacagacc

SEQ ID NO: 117258 - DNA, 25 bp, Mus musculus
ggacagtacacaccaccagagtctg

SEQ ID NO: 117259 - DNA, 25 bp, Mus musculus
ggacagtccctacgatatcagccgg

SEQ ID NO: 117260 - DNA, 25 bp, Mus musculus
ggacagtctgcaccttcccttacgg

SEQ ID NO: 117261 - DNA, 25 bp, Mus musculus
ggacagtgccaccaggaaatgctac

SEQ ID NO: 117262 - DNA, 25 bp, Mus musculus
ggacagtgtcctcagcatagctggt

SEQ ID NO: 117263 - DNA, 25 bp, Mus musculus
ggacagttggacctcttcctgagag

SEQ ID NO: 117264 - DNA, 25 bp, Mus musculus
ggacagtttcttctgatgcacaaga

SEQ ID NO: 117265 - DNA, 25 bp, Mus musculus
ggacataacacacagacctcaatcg

SEQ ID NO: 117266 - DNA, 25 bp, Mus musculus
ggacataacctctccgcttgtgaca

SEQ ID NO: 117267 - DNA, 25 bp, Mus musculus
ggacatacgccttttctcgacgagt

SEQ ID NO: 117268 - DNA, 25 bp, Mus musculus
ggacatagccaccactgaagctggg

SEQ ID NO: 117269 - DNA, 25 bp, Mus musculus
ggacatatttatggctccacttccc

SEQ ID NO: 117270 - DNA, 25 bp, Mus musculus
ggacatcaaagaaggcattcccctg

SEQ ID NO: 117271 - DNA, 25 bp, Mus musculus
ggacatcacagagccatcatgcatt

SEQ ID NO: 117272 - DNA, 25 bp, Mus musculus
ggacatcatccaggaaaacccactg

SEQ ID NO: 117273 - DNA, 25 bp, Mus musculus
ggacatcatgttagcaactcaaaga

SEQ ID NO: 117274 - DNA, 25 bp, Mus musculus
ggacatccaaggtgtacaacccgaa

SEQ ID NO: 117275 - DNA, 25 bp, Mus musculus
ggacatcgatatcaccactttcaag

SEQ ID NO: 117276 - DNA, 25 bp, Mus musculus
ggacatcgtcctccatgtttttaag

SEQ ID NO: 117277 - DNA, 25 bp, Mus musculus
ggacatctctgagtactatgagcaa

SEQ ID NO: 117278 - DNA, 25 bp, Mus musculus
ggacatctggtgtcctgacagagga

SEQ ID NO: 117279 - DNA, 25 bp, Mus musculus
ggacatcttgctgcttctaacctgg

SEQ ID NO: 117280 - DNA, 25 bp, Mus musculus
ggacatctttggagtgagcaccaca

SEQ ID NO: 117281 - DNA, 25 bp, Mus musculus
ggacatgaaacctgagaacttgctc

SEQ ID NO: 117282 - DNA, 25 bp, Mus musculus
ggacatgagaggcatcttcctggcc

SEQ ID NO: 117283 - DNA, 25 bp, Mus musculus
ggacatgcaaggcttgtggagagaa

SEQ ID NO: 117284 - DNA, 25 bp, Mus musculus
ggacatgccagccaacaacaagtgc

SEQ ID NO: 117285 - DNA, 25 bp, Mus musculus
ggacatgctttcctcgctgggcaga

SEQ ID NO: 117286 - DNA, 25 bp, Mus musculus
ggacatggcatttctgtacccagaa

SEQ ID NO: 117287 - DNA, 25 bp, Mus musculus
ggacatggtcatggtaagcatacaa

SEQ ID NO: 117288 - DNA, 25 bp, Mus musculus
ggacatgtacctagttcccaaactg

SEQ ID NO: 117289 - DNA, 25 bp, Mus musculus
ggacatgtccatactgccgggcata

SEQ ID NO: 117290 - DNA, 25 bp, Mus musculus
ggacatgtcggtctctttccacacg

SEQ ID NO: 117291 - DNA, 25 bp, Mus musculus
ggacatgtgtgttttcaagttagaa

SEQ ID NO: 117292 - DNA, 25 bp, Mus musculus
ggacattacgacgtcagtactgaca

SEQ ID NO: 117293 - DNA, 25 bp, Mus musculus
ggacattactctcaaggacctggga

SEQ ID NO: 117294 - DNA, 25 bp, Mus musculus
ggacattagagagctgacagcgcac

SEQ ID NO: 117295 - DNA, 25 bp, Mus musculus
ggacattccctgcttcctaaggaga

SEQ ID NO: 117296 - DNA, 25 bp, Mus musculus
ggacattcccttcgagagagaccag

SEQ ID NO: 117297 - DNA, 25 bp, Mus musculus
ggacattcgcttcccacagagtgga

SEQ ID NO: 117298 - DNA, 25 bp, Mus musculus
ggacattgcgtacatctacccctgg

SEQ ID NO: 117299 - DNA, 25 bp, Mus musculus
ggacattgcttcgacatgaccacag

SEQ ID NO: 117300 - DNA, 25 bp, Mus musculus
ggacattgtattccatgaacaccaa

SEQ ID NO: 117301 - DNA, 25 bp, Mus musculus
ggacatttcccaaacctggcctgga

SEQ ID NO: 117302 - DNA, 25 bp, Mus musculus
ggacatttcctgttcggcctctgga

SEQ ID NO: 117303 - DNA, 25 bp, Mus musculus
ggacatttttccaaggcccctgtga

SEQ ID NO: 117304 - DNA, 25 bp, Mus musculus
ggaccaaaaaatgtagcccgtgctt

SEQ ID NO: 117305 - DNA, 25 bp, Mus musculus
ggaccaaacctccatgattgtaatg

SEQ ID NO: 117306 - DNA, 25 bp, Mus musculus
ggaccaaagtgcagcgatgcccatg

SEQ ID NO: 117307 - DNA, 25 bp, Mus musculus
ggaccaacataccagggctaccatc

SEQ ID NO: 117308 - DNA, 25 bp, Mus musculus
ggaccaacgtgcctctagactctga

SEQ ID NO: 117309 - DNA, 25 bp, Mus musculus
ggaccaagggtcacagcttacaaga

SEQ ID NO: 117310 - DNA, 25 bp, Mus musculus
ggaccaataccacccaagatgaaca

SEQ ID NO: 117311 - DNA, 25 bp, Mus musculus
ggaccaatgctgaaatccgggccat

SEQ ID NO: 117312 - DNA, 25 bp, Mus musculus
ggaccaatggtcaaggaatcggaac

SEQ ID NO: 117313 - DNA, 25 bp, Mus musculus
ggaccaattcatggagtcactccga

SEQ ID NO: 117314 - DNA, 25 bp, Mus musculus
ggaccacaatggactctatgcagat

SEQ ID NO: 117315 - DNA, 25 bp, Mus musculus
ggaccacacacttgagggaacggaa

SEQ ID NO: 117316 - DNA, 25 bp, Mus musculus
ggaccacaccttggctcgagagtca

SEQ ID NO: 117317 - DNA, 25 bp, Mus musculus
ggaccacgacaaggaaaatcagcat

SEQ ID NO: 117318 - DNA, 25 bp, Mus musculus
ggaccacgagctgccaactgaagtg

SEQ ID NO: 117319 - DNA, 25 bp, Mus musculus
ggaccacggaagcaactgaggcttt

SEQ ID NO: 117320 - DNA, 25 bp, Mus musculus
ggaccacgttgtactggagcgacct

SEQ ID NO: 117321 - DNA, 25 bp, Mus musculus
ggaccactccaactgataaacatat

SEQ ID NO: 117322 - DNA, 25 bp, Mus musculus
ggaccagaagtttcataacatgacg

SEQ ID NO: 117323 - DNA, 25 bp, Mus musculus
ggaccagactcggttcctcctgagg

SEQ ID NO: 117324 - DNA, 25 bp, Mus musculus
ggaccagagcagtaaaccagccttg

SEQ ID NO: 117325 - DNA, 25 bp, Mus musculus
ggaccagaggtagcagtagcaccct

SEQ ID NO: 117326 - DNA, 25 bp, Mus musculus
ggaccagcacgggaagccatatttc

SEQ ID NO: 117327 - DNA, 25 bp, Mus musculus
ggaccagccacattagcatctatct

SEQ ID NO: 117328 - DNA, 25 bp, Mus musculus
ggaccagcctcagagcagtcagaga

SEQ ID NO: 117329 - DNA, 25 bp, Mus musculus
ggaccagcggctcgtgtcattgccc

SEQ ID NO: 117330 - DNA, 25 bp, Mus musculus
ggaccagctacaagctcagaccaag

SEQ ID NO: 117331 - DNA, 25 bp, Mus musculus
ggaccagctagtgtaccaagtgcct

SEQ ID NO: 117332 - DNA, 25 bp, Mus musculus
ggaccaggaaccaactcagtctagt

SEQ ID NO: 117333 - DNA, 25 bp, Mus musculus
ggaccaggaagtgttcactctgaca

SEQ ID NO: 117334 - DNA, 25 bp, Mus musculus
ggaccaggcccaagagcagctcagt

SEQ ID NO: 117335 - DNA, 25 bp, Mus musculus
ggaccagtactgctttgagtgtgac

SEQ ID NO: 117336 - DNA, 25 bp, Mus musculus
ggaccagtgtgagttcttgcatgaa

SEQ ID NO: 117337 - DNA, 25 bp, Mus musculus
ggaccagtgtttgacttgaccacca

SEQ ID NO: 117338 - DNA, 25 bp, Mus musculus
ggaccatccccatgtttgtgccaga

SEQ ID NO: 117339 - DNA, 25 bp, Mus musculus
ggaccatccctgtagcagtttggaa

SEQ ID NO: 117340 - DNA, 25 bp, Mus musculus
ggaccatgaggtgaagactctacag

SEQ ID NO: 117341 - DNA, 25 bp, Mus musculus
ggaccatgggatttagcaagagcaa

SEQ ID NO: 117342 - DNA, 25 bp, Mus musculus
ggaccatggtaccaaactcacctgc

SEQ ID NO: 117343 - DNA, 25 bp, Mus musculus
ggaccattaatattacagcactgaa

SEQ ID NO: 117344 - DNA, 25 bp, Mus musculus
ggacccaagatgaaaacccagtagt

SEQ ID NO: 117345 - DNA, 25 bp, Mus musculus
ggacccacactttaagcgaacgaag

SEQ ID NO: 117346 - DNA, 25 bp, Mus musculus
ggacccagagcttgtcttctcagca

SEQ ID NO: 117347 - DNA, 25 bp, Mus musculus
ggacccagccatcccaggagtgtat

SEQ ID NO: 117348 - DNA, 25 bp, Mus musculus
ggacccagccgtaggcaagacggcc

SEQ ID NO: 117349 - DNA, 25 bp, Mus musculus
ggacccagctctctaggaagcagga

SEQ ID NO: 117350 - DNA, 25 bp, Mus musculus
ggacccatcgcagcgtgacctggat

SEQ ID NO: 117351 - DNA, 25 bp, Mus musculus
ggaccccaacgctgtggtcattgga

SEQ ID NO: 117352 - DNA, 25 bp, Mus musculus
ggaccccacaggacttcacatactg

SEQ ID NO: 117353 - DNA, 25 bp, Mus musculus
ggaccccagcgtcggaagctgcttt

SEQ ID NO: 117354 - DNA, 25 bp, Mus musculus
ggaccccgagttatgtagcctgcag

SEQ ID NO: 117355 - DNA, 25 bp, Mus musculus
ggaccccgccatattcgaggagaga

SEQ ID NO: 117356 - DNA, 25 bp, Mus musculus
ggaccccggaatacatagcacctga

SEQ ID NO: 117357 - DNA, 25 bp, Mus musculus
ggaccccttggtctgtgctgacata

SEQ ID NO: 117358 - DNA, 25 bp, Mus musculus
ggacccgcctctcaacgtggataaa

SEQ ID NO: 117359 - DNA, 25 bp, Mus musculus
ggacccggcgtactctaagtgacga

SEQ ID NO: 117360 - DNA, 25 bp, Mus musculus
ggacccggttgcgactgtcactgag

SEQ ID NO: 117361 - DNA, 25 bp, Mus musculus
ggacccgttttatcttcatccttgt

SEQ ID NO: 117362 - DNA, 25 bp, Mus musculus
ggaccctaaagcacgcagcgaagtc

SEQ ID NO: 117363 - DNA, 25 bp, Mus musculus
ggaccctcccagatgtttcgaagat

SEQ ID NO: 117364 - DNA, 25 bp, Mus musculus
ggaccctcgggttttccagctgcaa

SEQ ID NO: 117365 - DNA, 25 bp, Mus musculus
ggaccctctgcgttatcacctggat

SEQ ID NO: 117366 - DNA, 25 bp, Mus musculus
ggaccctgaagaaggcgcggtacaa

SEQ ID NO: 117367 - DNA, 25 bp, Mus musculus
ggaccctgacagtgacggactttaa

SEQ ID NO: 117368 - DNA, 25 bp, Mus musculus
ggaccctgggcagctgtttccgatg

SEQ ID NO: 117369 - DNA, 25 bp, Mus musculus
ggacccttcaacatctgggcagaaa

SEQ ID NO: 117370 - DNA, 25 bp, Mus musculus
ggacccttctcttacgaaaaatcag

SEQ ID NO: 117371 - DNA, 25 bp, Mus musculus
ggaccgaaggttcagattccatact

SEQ ID NO: 117372 - DNA, 25 bp, Mus musculus
ggaccgacctgatcactgccatgaa

SEQ ID NO: 117373 - DNA, 25 bp, Mus musculus
ggaccgacttgttgagccactgcgt

SEQ ID NO: 117374 - DNA, 25 bp, Mus musculus
ggaccgcacggaattcgaacagtat

SEQ ID NO: 117375 - DNA, 25 bp, Mus musculus
ggaccgctcacctctggtgtccgtg

SEQ ID NO: 117376 - DNA, 25 bp, Mus musculus
ggaccgctggaggtgccatgtcttc

SEQ ID NO: 117377 - DNA, 25 bp, Mus musculus
ggaccgcttcgagaaaaccaacgag

SEQ ID NO: 117378 - DNA, 25 bp, Mus musculus
ggaccgctttgtgatgcctgctgaa

SEQ ID NO: 117379 - DNA, 25 bp, Mus musculus
ggaccgggagatctaccagctcaag

SEQ ID NO: 117380 - DNA, 25 bp, Mus musculus
ggaccgtagacccactcgtggcaaa

SEQ ID NO: 117381 - DNA, 25 bp, Mus musculus
ggaccgtctgcttggccattgccag

SEQ ID NO: 117382 - DNA, 25 bp, Mus musculus
ggaccgtgagttccctaatgacaga

SEQ ID NO: 117383 - DNA, 25 bp, Mus musculus
ggaccgtgtctctggaaaagttcaa

SEQ ID NO: 117384 - DNA, 25 bp, Mus musculus
ggaccgttgcgccaccatgtgtctc

SEQ ID NO: 117385 - DNA, 25 bp, Mus musculus
ggacctaaagtttctctcagaagag

SEQ ID NO: 117386 - DNA, 25 bp, Mus musculus
ggacctagagctgctgatccagacg

SEQ ID NO: 117387 - DNA, 25 bp, Mus musculus
ggacctagctaaaaagtacctgtgg

SEQ ID NO: 117388 - DNA, 25 bp, Mus musculus
ggacctaggactcctaatgttacag

SEQ ID NO: 117389 - DNA, 25 bp, Mus musculus
ggacctatatcccagaagcagcggc

SEQ ID NO: 117390 - DNA, 25 bp, Mus musculus
ggacctatcaaggagtgaacctgcg

SEQ ID NO: 117391 - DNA, 25 bp, Mus musculus
ggacctcactggattgattgctgaa

SEQ ID NO: 117392 - DNA, 25 bp, Mus musculus
ggacctcagagcttcgttcacttca

SEQ ID NO: 117393 - DNA, 25 bp, Mus musculus
ggacctcaggattgccagacaacct

SEQ ID NO: 117394 - DNA, 25 bp, Mus musculus
ggacctcagtaaccctcaggacttt

SEQ ID NO: 117395 - DNA, 25 bp, Mus musculus
ggacctccagaagcatgggaacatt

SEQ ID NO: 117396 - DNA, 25 bp, Mus musculus
ggacctcccaccaggtctttctggt

SEQ ID NO: 117397 - DNA, 25 bp, Mus musculus
ggacctccggactactgcatttaga

SEQ ID NO: 117398 - DNA, 25 bp, Mus musculus
ggacctcctagaaagatcgcgacag

SEQ ID NO: 117399 - DNA, 25 bp, Mus musculus
ggacctcgcggaagagcgtcaccag

SEQ ID NO: 117400 - DNA, 25 bp, Mus musculus
ggacctcgctgtgggtgatgactat

SEQ ID NO: 117401 - DNA, 25 bp, Mus musculus
ggacctctatgaagccattgacagt

SEQ ID NO: 117402 - DNA, 25 bp, Mus musculus
ggacctctggccacagtgagactag

SEQ ID NO: 117403 - DNA, 25 bp, Mus musculus
ggacctctgggaagtctggtgacaa

SEQ ID NO: 117404 - DNA, 25 bp, Mus musculus
ggacctcttggaaacagcattaggc

SEQ ID NO: 117405 - DNA, 25 bp, Mus musculus
ggacctgaagacactgagtgccatc

SEQ ID NO: 117406 - DNA, 25 bp, Mus musculus
ggacctgaattctcctatgagggaa

SEQ ID NO: 117407 - DNA, 25 bp, Mus musculus
ggacctgacagttcaaaaagctgat

SEQ ID NO: 117408 - DNA, 25 bp, Mus musculus
ggacctgatccaccgcattaatgag

SEQ ID NO: 117409 - DNA, 25 bp, Mus musculus
ggacctgcatgcaacagcctctgtg

SEQ ID NO: 117410 - DNA, 25 bp, Mus musculus
ggacctgctgcggtccttgccgaga

SEQ ID NO: 117411 - DNA, 25 bp, Mus musculus
ggacctgctgttaattacgctgtga

SEQ ID NO: 117412 - DNA, 25 bp, Mus musculus
ggacctggacctgaatctgattgaa

SEQ ID NO: 117413 - DNA, 25 bp, Mus musculus
ggacctggaccttttagagagctct

SEQ ID NO: 117414 - DNA, 25 bp, Mus musculus
ggacctgggaagacagagccgtttc

SEQ ID NO: 117415 - DNA, 25 bp, Mus musculus
ggacctggtcgttcactccctgaag

SEQ ID NO: 117416 - DNA, 25 bp, Mus musculus
ggacctgtcttccaaccggctagaa

SEQ ID NO: 117417 - DNA, 25 bp, Mus musculus
ggacctgttcaccaactacatttca

SEQ ID NO: 117418 - DNA, 25 bp, Mus musculus
ggaccttaggtgtctgccagcctct

SEQ ID NO: 117419 - DNA, 25 bp, Mus musculus
ggaccttatggatttgatccgcaga

SEQ ID NO: 117420 - DNA, 25 bp, Mus musculus
ggaccttcatcactatcggagacag

SEQ ID NO: 117421 - DNA, 25 bp, Mus musculus
ggaccttccattcccggagatcacg

SEQ ID NO: 117422 - DNA, 25 bp, Mus musculus
ggaccttccggcagatgctgatgga

SEQ ID NO: 117423 - DNA, 25 bp, Mus musculus
ggaccttcgagtggaactcctcgga

SEQ ID NO: 117424 - DNA, 25 bp, Mus musculus
ggaccttctaccatgaacagctcga

SEQ ID NO: 117425 - DNA, 25 bp, Mus musculus
ggaccttgactttcgagaattggaa

SEQ ID NO: 117426 - DNA, 25 bp, Mus musculus
ggaccttgttgagaggcctcagaca

SEQ ID NO: 117427 - DNA, 25 bp, Mus musculus
ggacctttcgttcatgtagcaggaa

SEQ ID NO: 117428 - DNA, 25 bp, Mus musculus
ggacctttctcttcatgggccaggg

SEQ ID NO: 117429 - DNA, 25 bp, Mus musculus
ggacctttggaaggatcacctaacg

SEQ ID NO: 117430 - DNA, 25 bp, Mus musculus
ggacgaaaagcagcggctacagaat

SEQ ID NO: 117431 - DNA, 25 bp, Mus musculus
ggacgaaagaagacgagctcccgaa

SEQ ID NO: 117432 - DNA, 25 bp, Mus musculus
ggacgaactgttcaaaccccaggag

SEQ ID NO: 117433 - DNA, 25 bp, Mus musculus
ggacgaatatgacgagaacagttcg

SEQ ID NO: 117434 - DNA, 25 bp, Mus musculus
ggacgacaatatttgaagacctcta

SEQ ID NO: 117435 - DNA, 25 bp, Mus musculus
ggacgactactcaaggccaaaaggc

SEQ ID NO: 117436 - DNA, 25 bp, Mus musculus
ggacgagcccactgaaacagagaca

SEQ ID NO: 117437 - DNA, 25 bp, Mus musculus
ggacgagctggaggttatcctcaaa

SEQ ID NO: 117438 - DNA, 25 bp, Mus musculus
ggacgatccggagctcaactttcaa

SEQ ID NO: 117439 - DNA, 25 bp, Mus musculus
ggacgatggcgcgactggtggcagt

SEQ ID NO: 117440 - DNA, 25 bp, Mus musculus
ggacgattagcagcaacagcttctg

SEQ ID NO: 117441 - DNA, 25 bp, Mus musculus
ggacgcaagggaagcaaactttact

SEQ ID NO: 117442 - DNA, 25 bp, Mus musculus
ggacgcagacatgtgcacctctaag

SEQ ID NO: 117443 - DNA, 25 bp, Mus musculus
ggacgcagagccagagcccgatcca

SEQ ID NO: 117444 - DNA, 25 bp, Mus musculus
ggacgcagccgttgagtcctgcaaa

SEQ ID NO: 117445 - DNA, 25 bp, Mus musculus
ggacgcagggcggtgtcggaggcag

SEQ ID NO: 117446 - DNA, 25 bp, Mus musculus
ggacgccacacgtcgggtcccgttg

SEQ ID NO: 117447 - DNA, 25 bp, Mus musculus
ggacgcctatctacgctttgacgaa

SEQ ID NO: 117448 - DNA, 25 bp, Mus musculus
ggacgcctccttcgatgacttggtg

SEQ ID NO: 117449 - DNA, 25 bp, Mus musculus
ggacgcgggggaggcgcgcggcacg

SEQ ID NO: 117450 - DNA, 25 bp, Mus musculus
ggacgctacggatcctgaagccttg

SEQ ID NO: 117451 - DNA, 25 bp, Mus musculus
ggacgctatgtacccctggatgaga

SEQ ID NO: 117452 - DNA, 25 bp, Mus musculus
ggacgctggcccacaacaggattgt

SEQ ID NO: 117453 - DNA, 25 bp, Mus musculus
ggacgctggcgcctgtctttagaac

SEQ ID NO: 117454 - DNA, 25 bp, Mus musculus
ggacgcttgcatcagttttgtcacg

SEQ ID NO: 117455 - DNA, 25 bp, Mus musculus
ggacggaagcctcctacttttggag

SEQ ID NO: 117456 - DNA, 25 bp, Mus musculus
ggacggaatatcaagctacacacgg

SEQ ID NO: 117457 - DNA, 25 bp, Mus musculus
ggacggaggccacggcggtatgtgg

SEQ ID NO: 117458 - DNA, 25 bp, Mus musculus
ggacggatgcctttttatgcagagg

SEQ ID NO: 117459 - DNA, 25 bp, Mus musculus
ggacggcatcatctctaaacctaag

SEQ ID NO: 117460 - DNA, 25 bp, Mus musculus
ggacggcatctccttcgagtaccac

SEQ ID NO: 117461 - DNA, 25 bp, Mus musculus
ggacggccttctccagacaatctga

SEQ ID NO: 117462 - DNA, 25 bp, Mus musculus
ggacgtcggatgtagacctggacaa

SEQ ID NO: 117463 - DNA, 25 bp, Mus musculus
ggacgtctcggtggctgtgctaccc

SEQ ID NO: 117464 - DNA, 25 bp, Mus musculus
ggacgtgaaggctccgctggactta

SEQ ID NO: 117465 - DNA, 25 bp, Mus musculus
ggacgtgcgcatctctggtgttaca

SEQ ID NO: 117466 - DNA, 25 bp, Mus musculus
ggacgtgtacgtgcagctctacctg

SEQ ID NO: 117467 - DNA, 25 bp, Mus musculus
ggacgtgtcgccaaaatgttgccaa

SEQ ID NO: 117468 - DNA, 25 bp, Mus musculus
ggacgtgtctacctctcaggccgta

SEQ ID NO: 117469 - DNA, 25 bp, Mus musculus
ggacgttacgaaacttcagcacagg

SEQ ID NO: 117470 - DNA, 25 bp, Mus musculus
ggacgttctgtttccaagctcaaga

SEQ ID NO: 117471 - DNA, 25 bp, Mus musculus
ggacgtttcaacagattcggtgcta

SEQ ID NO: 117472 - DNA, 25 bp, Mus musculus
ggacgtttccccagtacatgtagga

SEQ ID NO: 117473 - DNA, 25 bp, Mus musculus
ggacgttttgcctgtcgctgtagga

SEQ ID NO: 117474 - DNA, 25 bp, Mus musculus
ggactaagaaacagggcaatgcacc

SEQ ID NO: 117475 - DNA, 25 bp, Mus musculus
ggactaagatccttctgggccacaa

SEQ ID NO: 117476 - DNA, 25 bp, Mus musculus
ggactacagcgtttgggatcacatc

SEQ ID NO: 117477 - DNA, 25 bp, Mus musculus
ggactacagttttctggaccaggac

SEQ ID NO: 117478 - DNA, 25 bp, Mus musculus
ggactaccttgagggcatcttctgc

SEQ ID NO: 117479 - DNA, 25 bp, Mus musculus
ggactacggcgactgcttaacacac

SEQ ID NO: 117480 - DNA, 25 bp, Mus musculus
ggactacgtagccttcatcgaaggg

SEQ ID NO: 117481 - DNA, 25 bp, Mus musculus
ggactactctcctgtgggctccttc

SEQ ID NO: 117482 - DNA, 25 bp, Mus musculus
ggactagagtctttaagccttatca

SEQ ID NO: 117483 - DNA, 25 bp, Mus musculus
ggactagcgcaatctccctgttaga

SEQ ID NO: 117484 - DNA, 25 bp, Mus musculus
ggactaggcacctctaatataggaa

SEQ ID NO: 117485 - DNA, 25 bp, Mus musculus
ggactaggccttctctcctggtgga

SEQ ID NO: 117486 - DNA, 25 bp, Mus musculus
ggactataactacccactgtgcgca

SEQ ID NO: 117487 - DNA, 25 bp, Mus musculus
ggactatatccagaagcaccctgag

SEQ ID NO: 117488 - DNA, 25 bp, Mus musculus
ggactatatgcagatgaaagccagg

SEQ ID NO: 117489 - DNA, 25 bp, Mus musculus
ggactatgtacaagccctttgggaa

SEQ ID NO: 117490 - DNA, 25 bp, Mus musculus
ggactatgtgcagaaaacctactct

SEQ ID NO: 117491 - DNA, 25 bp, Mus musculus
ggactcaccatgatcgccatgctca

SEQ ID NO: 117492 - DNA, 25 bp, Mus musculus
ggactcacggttctgctccctgaaa

SEQ ID NO: 117493 - DNA, 25 bp, Mus musculus
ggactcactggcctagaagtagtag

SEQ ID NO: 117494 - DNA, 25 bp, Mus musculus
ggactcatatccagaggctgctgtg

SEQ ID NO: 117495 - DNA, 25 bp, Mus musculus
ggactcatcacttgcctgactggag

SEQ ID NO: 117496 - DNA, 25 bp, Mus musculus
ggactcattcctaccacacactggg

SEQ ID NO: 117497 - DNA, 25 bp, Mus musculus
ggactccaaaccactgctagctgct

SEQ ID NO: 117498 - DNA, 25 bp, Mus musculus
ggactccagcccctgttggcagtac

SEQ ID NO: 117499 - DNA, 25 bp, Mus musculus
ggactccagcctctgtcgtgagcga

SEQ ID NO: 117500 - DNA, 25 bp, Mus musculus
ggactccagggatcactatctcttg

SEQ ID NO: 117501 - DNA, 25 bp, Mus musculus
ggactccagggtatctagcaccaga

SEQ ID NO: 117502 - DNA, 25 bp, Mus musculus
ggactcccctaagctgccagtggaa

SEQ ID NO: 117503 - DNA, 25 bp, Mus musculus
ggactcccgtcgtcttcctagctga

SEQ ID NO: 117504 - DNA, 25 bp, Mus musculus
ggactccctggctgacaaaacactg

SEQ ID NO: 117505 - DNA, 25 bp, Mus musculus
ggactccggccgtcacgatgacgag

SEQ ID NO: 117506 - DNA, 25 bp, Mus musculus
ggactccggctacgctactaggaca

SEQ ID NO: 117507 - DNA, 25 bp, Mus musculus
ggactccgtccttgataccgatggg

SEQ ID NO: 117508 - DNA, 25 bp, Mus musculus
ggactcctcgcagactttataccgg

SEQ ID NO: 117509 - DNA, 25 bp, Mus musculus
ggactcctgacattataatcccggg

SEQ ID NO: 117510 - DNA, 25 bp, Mus musculus
ggactcctgagtgagctccctgagg

SEQ ID NO: 117511 - DNA, 25 bp, Mus musculus
ggactcctgggaacaatctgcatga

SEQ ID NO: 117512 - DNA, 25 bp, Mus musculus
ggactccttggttcagctaatgcac

SEQ ID NO: 117513 - DNA, 25 bp, Mus musculus
ggactcctttcaccgaagagcgtct

SEQ ID NO: 117514 - DNA, 25 bp, Mus musculus
ggactctaatggagaagccctgtgg

SEQ ID NO: 117515 - DNA, 25 bp, Mus musculus
ggactctatagagaagcgcaccact

SEQ ID NO: 117516 - DNA, 25 bp, Mus musculus
ggactctgccgaggttacatgaaga

SEQ ID NO: 117517 - DNA, 25 bp, Mus musculus
ggactgaccatctgagccagcttgc

SEQ ID NO: 117518 - DNA, 25 bp, Mus musculus
ggactgacggagaccgggcctcctg

SEQ ID NO: 117519 - DNA, 25 bp, Mus musculus
ggactgagaaggtggtgaacatcct

SEQ ID NO: 117520 - DNA, 25 bp, Mus musculus
ggactgcacacaggcattggccggc

SEQ ID NO: 117521 - DNA, 25 bp, Mus musculus
ggactgcagaaatcagcggatctgt

SEQ ID NO: 117522 - DNA, 25 bp, Mus musculus
ggactgcagtctattctttgaagtt

SEQ ID NO: 117523 - DNA, 25 bp, Mus musculus
ggactgcatttcctcgctgacggga

SEQ ID NO: 117524 - DNA, 25 bp, Mus musculus
ggactgcccgtggtataaccaaggg

SEQ ID NO: 117525 - DNA, 25 bp, Mus musculus
ggactgccgaagaccaattaccgct

SEQ ID NO: 117526 - DNA, 25 bp, Mus musculus
ggactgccttaattaaagtgaggga

SEQ ID NO: 117527 - DNA, 25 bp, Mus musculus
ggactgcgacactcccagtcattag

SEQ ID NO: 117528 - DNA, 25 bp, Mus musculus
ggactgcggcaaaaaggtagctgaa

SEQ ID NO: 117529 - DNA, 25 bp, Mus musculus
ggactgcgtgttccaagatctctcg

SEQ ID NO: 117530 - DNA, 25 bp, Mus musculus
ggactgctacgcctctgtgttcaaa

SEQ ID NO: 117531 - DNA, 25 bp, Mus musculus
ggactgctcatccaccagagtaagg

SEQ ID NO: 117532 - DNA, 25 bp, Mus musculus
ggactgctgcattacatcaacccag

SEQ ID NO: 117533 - DNA, 25 bp, Mus musculus
ggactgctttgggtgccttcgagaa

SEQ ID NO: 117534 - DNA, 25 bp, Mus musculus
ggactggaccaaccagcggcttaac

SEQ ID NO: 117535 - DNA, 25 bp, Mus musculus
ggactggacctcttgtggacttgca

SEQ ID NO: 117536 - DNA, 25 bp, Mus musculus
ggactggactccgaacacaagctgt

SEQ ID NO: 117537 - DNA, 25 bp, Mus musculus
ggactggagatctctggcaccttca

SEQ ID NO: 117538 - DNA, 25 bp, Mus musculus
ggactggcatgagaagagcccacag

SEQ ID NO: 117539 - DNA, 25 bp, Mus musculus
ggactggcgcttgaagaccacggct

SEQ ID NO: 117540 - DNA, 25 bp, Mus musculus
ggactgggacgtgcctgactaatca

SEQ ID NO: 117541 - DNA, 25 bp, Mus musculus
ggactgtccagcgaacgagcaagcc

SEQ ID NO: 117542 - DNA, 25 bp, Mus musculus
ggactgtcggacaccatcttctgcc

SEQ ID NO: 117543 - DNA, 25 bp, Mus musculus
ggactgtctgttggcacccactgga

SEQ ID NO: 117544 - DNA, 25 bp, Mus musculus
ggactgttcattctgagcacccgat

SEQ ID NO: 117545 - DNA, 25 bp, Mus musculus
ggacttacaaagggcgggacttgca

SEQ ID NO: 117546 - DNA, 25 bp, Mus musculus
ggacttacgggactctgacttgcaa

SEQ ID NO: 117547 - DNA, 25 bp, Mus musculus
ggacttactcctgcggcattgccaa

SEQ ID NO: 117548 - DNA, 25 bp, Mus musculus
ggacttagacgctgtcagtgccaca

SEQ ID NO: 117549 - DNA, 25 bp, Mus musculus
ggacttagataaggagtttctccaa

SEQ ID NO: 117550 - DNA, 25 bp, Mus musculus
ggacttattcggttccacgtcagaa

SEQ ID NO: 117551 - DNA, 25 bp, Mus musculus
ggacttatttcagctctcctgggca

SEQ ID NO: 117552 - DNA, 25 bp, Mus musculus
ggacttcaaaacatgacctgcatta

SEQ ID NO: 117553 - DNA, 25 bp, Mus musculus
ggacttcaagaacagccgcatcaaa

SEQ ID NO: 117554 - DNA, 25 bp, Mus musculus
ggacttcagaccagtgtcatggcgg

SEQ ID NO: 117555 - DNA, 25 bp, Mus musculus
ggacttcaggtcactcaggtttaaa

SEQ ID NO: 117556 - DNA, 25 bp, Mus musculus
ggacttcatgatccaaggcggcgac

SEQ ID NO: 117557 - DNA, 25 bp, Mus musculus
ggacttccagcgaatccctggccag

SEQ ID NO: 117558 - DNA, 25 bp, Mus musculus
ggacttccgagatcgctctctgaga

SEQ ID NO: 117559 - DNA, 25 bp, Mus musculus
ggacttcctcgtggtataactacag

SEQ ID NO: 117560 - DNA, 25 bp, Mus musculus
ggacttcctgtctctctgtgctgaa

SEQ ID NO: 117561 - DNA, 25 bp, Mus musculus
ggacttcgtgcttcgcgggcttcga

SEQ ID NO: 117562 - DNA, 25 bp, Mus musculus
ggacttctagagttccctcctgtgg

SEQ ID NO: 117563 - DNA, 25 bp, Mus musculus
ggacttctgcaagtgcttccggaga

SEQ ID NO: 117564 - DNA, 25 bp, Mus musculus
ggacttgaaccagctgagtgcggcc

SEQ ID NO: 117565 - DNA, 25 bp, Mus musculus
ggacttgaacttgcccttggactga

SEQ ID NO: 117566 - DNA, 25 bp, Mus musculus
ggacttgaagaaacagtcggaagac

SEQ ID NO: 117567 - DNA, 25 bp, Mus musculus
ggacttgaagttgaccccattacag

SEQ ID NO: 117568 - DNA, 25 bp, Mus musculus
ggacttgacacaaggcgggacttct

SEQ ID NO: 117569 - DNA, 25 bp, Mus musculus
ggacttgatcgctcctgatccttga

SEQ ID NO: 117570 - DNA, 25 bp, Mus musculus
ggacttgcacatctccaacagccag

SEQ ID NO: 117571 - DNA, 25 bp, Mus musculus
ggactttctctagcacatactgtgg

SEQ ID NO: 117572 - DNA, 25 bp, Mus musculus
ggactttctgcttaagacctgcatg

SEQ ID NO: 117573 - DNA, 25 bp, Mus musculus
ggactttctgtagactggcccgcaa

SEQ ID NO: 117574 - DNA, 25 bp, Mus musculus
ggactttggatttaagcaccgcctc

SEQ ID NO: 117575 - DNA, 25 bp, Mus musculus
ggactttggcccttctagtgggaca

SEQ ID NO: 117576 - DNA, 25 bp, Mus musculus
ggacttttgagggtgcagctgcatc

SEQ ID NO: 117577 - DNA, 25 bp, Mus musculus
ggacttttgcaatcagagataacag

SEQ ID NO: 117578 - DNA, 25 bp, Mus musculus
ggacttttgtctccccgcagctagg

SEQ ID NO: 117579 - DNA, 25 bp, Mus musculus
ggagaaaacattgacacttccagtg

SEQ ID NO: 117580 - DNA, 25 bp, Mus musculus
ggagaaaagtaagccgtggttcctg

SEQ ID NO: 117581 - DNA, 25 bp, Mus musculus
ggagaaaatttcatgatgcccttca

SEQ ID NO: 117582 - DNA, 25 bp, Mus musculus
ggagaaacctttccggtgcacagaa

SEQ ID NO: 117583 - DNA, 25 bp, Mus musculus
ggagaaactccatgactgtaaagaa

SEQ ID NO: 117584 - DNA, 25 bp, Mus musculus
ggagaaactggacaacctgatgttg

SEQ ID NO: 117585 - DNA, 25 bp, Mus musculus
ggagaaacttgggatctgtggcaaa

SEQ ID NO: 117586 - DNA, 25 bp, Mus musculus
ggagaaagaacccaactgcaagcca

SEQ ID NO: 117587 - DNA, 25 bp, Mus musculus
ggagaaagaagtccacgagcagctt

SEQ ID NO: 117588 - DNA, 25 bp, Mus musculus
ggagaaagcagcttactgttccaaa

SEQ ID NO: 117589 - DNA, 25 bp, Mus musculus
ggagaaagtcccattagaggcgacc

SEQ ID NO: 117590 - DNA, 25 bp, Mus musculus
ggagaaatatgaactcgcccaccca

SEQ ID NO: 117591 - DNA, 25 bp, Mus musculus
ggagaaatggctccccaggctgcat

SEQ ID NO: 117592 - DNA, 25 bp, Mus musculus
ggagaaattcatgacagaggacaca

SEQ ID NO: 117593 - DNA, 25 bp, Mus musculus
ggagaaattcttccgagatgccaag

SEQ ID NO: 117594 - DNA, 25 bp, Mus musculus
ggagaacaaatcacttcctgccccg

SEQ ID NO: 117595 - DNA, 25 bp, Mus musculus
ggagaacaccgggagacatggcttc

SEQ ID NO: 117596 - DNA, 25 bp, Mus musculus
ggagaacactgaagaacggcaccac

SEQ ID NO: 117597 - DNA, 25 bp, Mus musculus
ggagaacagaaatcctagactactg

SEQ ID NO: 117598 - DNA, 25 bp, Mus musculus
ggagaacatcttggatccccggctg

SEQ ID NO: 117599 - DNA, 25 bp, Mus musculus
ggagaacatgctacttagacacgga

SEQ ID NO: 117600 - DNA, 25 bp, Mus musculus
ggagaaccagatccacactggaatg

SEQ ID NO: 117601 - DNA, 25 bp, Mus musculus
ggagaaccctcataccctgaagcct

SEQ ID NO: 117602 - DNA, 25 bp, Mus musculus
ggagaaccgacgtatcacacacatc

SEQ ID NO: 117603 - DNA, 25 bp, Mus musculus
ggagaaccgtgtaccacgcggaaga

SEQ ID NO: 117604 - DNA, 25 bp, Mus musculus
ggagaacctaacaacctgggagagg

SEQ ID NO: 117605 - DNA, 25 bp, Mus musculus
ggagaaccttgactcagagacatcg

SEQ ID NO: 117606 - DNA, 25 bp, Mus musculus
ggagaacgggacagcacgctttgaa

SEQ ID NO: 117607 - DNA, 25 bp, Mus musculus
ggagaacgtttcatctggcctgtca

SEQ ID NO: 117608 - DNA, 25 bp, Mus musculus
ggagaactacctgtcagaacactgc

SEQ ID NO: 117609 - DNA, 25 bp, Mus musculus
ggagaactcagatgaccccgtggaa

SEQ ID NO: 117610 - DNA, 25 bp, Mus musculus
ggagaactctgaggaactactagaa

SEQ ID NO: 117611 - DNA, 25 bp, Mus musculus
ggagaactgaccaaggcctggatga

SEQ ID NO: 117612 - DNA, 25 bp, Mus musculus
ggagaactgcccttgaatgaaatcg

SEQ ID NO: 117613 - DNA, 25 bp, Mus musculus
ggagaactgtaactgccgcatggtc

SEQ ID NO: 117614 - DNA, 25 bp, Mus musculus
ggagaacttcaaccaggcacttaag

SEQ ID NO: 117615 - DNA, 25 bp, Mus musculus
ggagaacttgcacttaatggcctaa

SEQ ID NO: 117616 - DNA, 25 bp, Mus musculus
ggagaagaataacagcatcaccagc

SEQ ID NO: 117617 - DNA, 25 bp, Mus musculus
ggagaagacacccattatcagagaa

SEQ ID NO: 117618 - DNA, 25 bp, Mus musculus
ggagaagacctaagaccagagcctg

SEQ ID NO: 117619 - DNA, 25 bp, Mus musculus
ggagaagagcactaccactttagtt

SEQ ID NO: 117620 - DNA, 25 bp, Mus musculus
ggagaagattctgcagagcacagca

SEQ ID NO: 117621 - DNA, 25 bp, Mus musculus
ggagaagattgatggaccactcaag

SEQ ID NO: 117622 - DNA, 25 bp, Mus musculus
ggagaagcactggacgttgccctca

SEQ ID NO: 117623 - DNA, 25 bp, Mus musculus
ggagaagcagaggtcacaaatcagc

SEQ ID NO: 117624 - DNA, 25 bp, Mus musculus
ggagaagccgagattcatgttcaac

SEQ ID NO: 117625 - DNA, 25 bp, Mus musculus
ggagaagcggctatcaaattcctgc

SEQ ID NO: 117626 - DNA, 25 bp, Mus musculus
ggagaaggacagacttcaagttcaa

SEQ ID NO: 117627 - DNA, 25 bp, Mus musculus
ggagaaggacctcaacacgctatga

SEQ ID NO: 117628 - DNA, 25 bp, Mus musculus
ggagaaggataaactgaaagccaag

SEQ ID NO: 117629 - DNA, 25 bp, Mus musculus
ggagaaggcagagctaaacccagag

SEQ ID NO: 117630 - DNA, 25 bp, Mus musculus
ggagaaggtacgacatcacactggg

SEQ ID NO: 117631 - DNA, 25 bp, Mus musculus
ggagaagtatacacgctgaggtcac

SEQ ID NO: 117632 - DNA, 25 bp, Mus musculus
ggagaagtatcgcatcatcgagcag

SEQ ID NO: 117633 - DNA, 25 bp, Mus musculus
ggagaagtccctatcagagcagaga

SEQ ID NO: 117634 - DNA, 25 bp, Mus musculus
ggagaagtgatctcgctcccgggct

SEQ ID NO: 117635 - DNA, 25 bp, Mus musculus
ggagaagtgcaccagatacattgac

SEQ ID NO: 117636 - DNA, 25 bp, Mus musculus
ggagaatcaggaaaaagcaccattg

SEQ ID NO: 117637 - DNA, 25 bp, Mus musculus
ggagaatcccaaaagtgtacataag

SEQ ID NO: 117638 - DNA, 25 bp, Mus musculus
ggagaatcgattgaaggaagagacc

SEQ ID NO: 117639 - DNA, 25 bp, Mus musculus
ggagaatctatctatggagccccat

SEQ ID NO: 117640 - DNA, 25 bp, Mus musculus
ggagaatctcaaaaactggctgctg

SEQ ID NO: 117641 - DNA, 25 bp, Mus musculus
ggagaatgaggagcgtaccatgatc

SEQ ID NO: 117642 - DNA, 25 bp, Mus musculus
ggagaatgcgttttcctgccccgca

SEQ ID NO: 117643 - DNA, 25 bp, Mus musculus
ggagaatggatttatcaggagtgaa

SEQ ID NO: 117644 - DNA, 25 bp, Mus musculus
ggagaattcctacggctctgaacag

SEQ ID NO: 117645 - DNA, 25 bp, Mus musculus
ggagaattcctagatgcctggctta

SEQ ID NO: 117646 - DNA, 25 bp, Mus musculus
ggagaattgtcacctggagcagaat

SEQ ID NO: 117647 - DNA, 25 bp, Mus musculus
ggagaattttgcacactcggacacg

SEQ ID NO: 117648 - DNA, 25 bp, Mus musculus
ggagacaacacttcatcagtttcga

SEQ ID NO: 117649 - DNA, 25 bp, Mus musculus
ggagacacggccctaatcacaaggc

SEQ ID NO: 117650 - DNA, 25 bp, Mus musculus
ggagacactcctataatgaaaacaa

SEQ ID NO: 117651 - DNA, 25 bp, Mus musculus
ggagacactgtcactggcgtaacga

SEQ ID NO: 117652 - DNA, 25 bp, Mus musculus
ggagacagcttcctatgccaagtgc

SEQ ID NO: 117653 - DNA, 25 bp, Mus musculus
ggagacaggacagcatttgcctaat

SEQ ID NO: 117654 - DNA, 25 bp, Mus musculus
ggagacatacttcctgacccatcag

SEQ ID NO: 117655 - DNA, 25 bp, Mus musculus
ggagacatccacctcaaccagattg

SEQ ID NO: 117656 - DNA, 25 bp, Mus musculus
ggagacattttaccttgcccaagac

SEQ ID NO: 117657 - DNA, 25 bp, Mus musculus
ggagaccaagacgatcgtgtacgac

SEQ ID NO: 117658 - DNA, 25 bp, Mus musculus
ggagaccatctacctttgcaaattc

SEQ ID NO: 117659 - DNA, 25 bp, Mus musculus
ggagaccatttaaatcttccagatc

SEQ ID NO: 117660 - DNA, 25 bp, Mus musculus
ggagaccccaccgtgtcagcttagt

SEQ ID NO: 117661 - DNA, 25 bp, Mus musculus
ggagaccccggtgattccaacatcg

SEQ ID NO: 117662 - DNA, 25 bp, Mus musculus
ggagaccctcctaccatggcagagg

SEQ ID NO: 117663 - DNA, 25 bp, Mus musculus
ggagaccctgctctatgcgaaagaa

SEQ ID NO: 117664 - DNA, 25 bp, Mus musculus
ggagacccttaaccctgtgtacgtg

SEQ ID NO: 117665 - DNA, 25 bp, Mus musculus
ggagacccttgtgatttcgccgaca

SEQ ID NO: 117666 - DNA, 25 bp, Mus musculus
ggagaccgaacctcctcctctggaa

SEQ ID NO: 117667 - DNA, 25 bp, Mus musculus
ggagacctagactttacttacgtca

SEQ ID NO: 117668 - DNA, 25 bp, Mus musculus
ggagacctatcctctgcctctgcta

SEQ ID NO: 117669 - DNA, 25 bp, Mus musculus
ggagacctgcagtctcaagccatgg

SEQ ID NO: 117670 - DNA, 25 bp, Mus musculus
ggagacctgggcctacgaaactgta

SEQ ID NO: 117671 - DNA, 25 bp, Mus musculus
ggagaccttcgagctggaccgtatg

SEQ ID NO: 117672 - DNA, 25 bp, Mus musculus
ggagaccttgctactttgggaggat

SEQ ID NO: 117673 - DNA, 25 bp, Mus musculus
ggagaccttggctatcagacttgaa

SEQ ID NO: 117674 - DNA, 25 bp, Mus musculus
ggagaccttgtcaacctgatgagca

SEQ ID NO: 117675 - DNA, 25 bp, Mus musculus
ggagacgcttttgtgggcttccaca

SEQ ID NO: 117676 - DNA, 25 bp, Mus musculus
ggagacggagagttcggtggagccc

SEQ ID NO: 117677 - DNA, 25 bp, Mus musculus
ggagactcactaactggcttttgga

SEQ ID NO: 117678 - DNA, 25 bp, Mus musculus
ggagactcatccctacacaggagaa

SEQ ID NO: 117679 - DNA, 25 bp, Mus musculus
ggagactccaggctttcacaggaaa

SEQ ID NO: 117680 - DNA, 25 bp, Mus musculus
ggagactcgatagctctcggcctca

SEQ ID NO: 117681 - DNA, 25 bp, Mus musculus
ggagactcggaagaaacccaagatg

SEQ ID NO: 117682 - DNA, 25 bp, Mus musculus
ggagactcggagtcgccacagttcg

SEQ ID NO: 117683 - DNA, 25 bp, Mus musculus
ggagactgaggagaccttgctactt

SEQ ID NO: 117684 - DNA, 25 bp, Mus musculus
ggagactgctttcctctacgccatc

SEQ ID NO: 117685 - DNA, 25 bp, Mus musculus
ggagactggagccatcttccatgga

SEQ ID NO: 117686 - DNA, 25 bp, Mus musculus
ggagactgtgtacaactcactgaat

SEQ ID NO: 117687 - DNA, 25 bp, Mus musculus
ggagacttcaaaatcaccacctgtg

SEQ ID NO: 117688 - DNA, 25 bp, Mus musculus
ggagacttcaatttgccacgagaca

SEQ ID NO: 117689 - DNA, 25 bp, Mus musculus
ggagacttcgatatttcagtgctga

SEQ ID NO: 117690 - DNA, 25 bp, Mus musculus
ggagacttcttcagtgaactctcac

SEQ ID NO: 117691 - DNA, 25 bp, Mus musculus
ggagagaaacgctaccaaatgtgaa

SEQ ID NO: 117692 - DNA, 25 bp, Mus musculus
ggagagaagcttcgcaacactttca

SEQ ID NO: 117693 - DNA, 25 bp, Mus musculus
ggagagaagcttttcggaccctatg

SEQ ID NO: 117694 - DNA, 25 bp, Mus musculus
ggagagacatgtcccagatttctgt

SEQ ID NO: 117695 - DNA, 25 bp, Mus musculus
ggagagaccatatacttcgaagcat

SEQ ID NO: 117696 - DNA, 25 bp, Mus musculus
ggagagaccccacttcctcagaaga

SEQ ID NO: 117697 - DNA, 25 bp, Mus musculus
ggagagaccccatcgtggcgcgatc

SEQ ID NO: 117698 - DNA, 25 bp, Mus musculus
ggagagactccctgccacttggtgt

SEQ ID NO: 117699 - DNA, 25 bp, Mus musculus
ggagagactcccttgcagtgtgcaa

SEQ ID NO: 117700 - DNA, 25 bp, Mus musculus
ggagagacttatcgccgaaccctgg

SEQ ID NO: 117701 - DNA, 25 bp, Mus musculus
ggagagacttatgcccaggtgaaac

SEQ ID NO: 117702 - DNA, 25 bp, Mus musculus
ggagagactttaccgatgcatcagg

SEQ ID NO: 117703 - DNA, 25 bp, Mus musculus
ggagagagccacagacactttgaag

SEQ ID NO: 117704 - DNA, 25 bp, Mus musculus
ggagagccaccatctcactgagcta

SEQ ID NO: 117705 - DNA, 25 bp, Mus musculus
ggagagccagctgctggattattct

SEQ ID NO: 117706 - DNA, 25 bp, Mus musculus
ggagagccctccttaggaacagaaa

SEQ ID NO: 117707 - DNA, 25 bp, Mus musculus
ggagagcgctgctctcccttcaaaa

SEQ ID NO: 117708 - DNA, 25 bp, Mus musculus
ggagagctggtcttctacgagcctg

SEQ ID NO: 117709 - DNA, 25 bp, Mus musculus
ggagagcttgcactacggacactac

SEQ ID NO: 117710 - DNA, 25 bp, Mus musculus
ggagaggacctgctcattgcgactc

SEQ ID NO: 117711 - DNA, 25 bp, Mus musculus
ggagaggcaaatgaatggagaccca

SEQ ID NO: 117712 - DNA, 25 bp, Mus musculus
ggagaggcccactttggcccaggcc

SEQ ID NO: 117713 - DNA, 25 bp, Mus musculus
ggagaggcctccagagtggaccact

SEQ ID NO: 117714 - DNA, 25 bp, Mus musculus
ggagaggttcccagctagcacttct

SEQ ID NO: 117715 - DNA, 25 bp, Mus musculus
ggagagtacctgttcgtcgccatca

SEQ ID NO: 117716 - DNA, 25 bp, Mus musculus
ggagagtatgaatgtaatgccacca

SEQ ID NO: 117717 - DNA, 25 bp, Mus musculus
ggagagtcaagcacccgtttcaaag

SEQ ID NO: 117718 - DNA, 25 bp, Mus musculus
ggagagtcatctctgcacaacagtc

SEQ ID NO: 117719 - DNA, 25 bp, Mus musculus
ggagagtgactcagataagggccct

SEQ ID NO: 117720 - DNA, 25 bp, Mus musculus
ggagagttctcatccatttcaagcg

SEQ ID NO: 117721 - DNA, 25 bp, Mus musculus
ggagagtttgccatcccgaaggaca

SEQ ID NO: 117722 - DNA, 25 bp, Mus musculus
ggagatacagccaacaaccagtgct

SEQ ID NO: 117723 - DNA, 25 bp, Mus musculus
ggagataccgtctctgccctgtgag

SEQ ID NO: 117724 - DNA, 25 bp, Mus musculus
ggagatacctattacacagcatgtt

SEQ ID NO: 117725 - DNA, 25 bp, Mus musculus
ggagatatggttcttttagagccgc

SEQ ID NO: 117726 - DNA, 25 bp, Mus musculus
ggagatcaaacaccctaacctggtg

SEQ ID NO: 117727 - DNA, 25 bp, Mus musculus
ggagatcacaatcatcaaccctgca

SEQ ID NO: 117728 - DNA, 25 bp, Mus musculus
ggagatcatacactgcaaaagctgc

SEQ ID NO: 117729 - DNA, 25 bp, Mus musculus
ggagatccacagacttgccaaagag

SEQ ID NO: 117730 - DNA, 25 bp, Mus musculus
ggagatcccgcccaaacttgctagt

SEQ ID NO: 117731 - DNA, 25 bp, Mus musculus
ggagatcctgaacaccaaagtaagc

SEQ ID NO: 117732 - DNA, 25 bp, Mus musculus
ggagatcctgaagcgtaaggctgct

SEQ ID NO: 117733 - DNA, 25 bp, Mus musculus
ggagatcctgttgaagcccttgctg

SEQ ID NO: 117734 - DNA, 25 bp, Mus musculus
ggagatcgcctttaccttgcggagt

SEQ ID NO: 117735 - DNA, 25 bp, Mus musculus
ggagatcgcggacgcgggactgagc

SEQ ID NO: 117736 - DNA, 25 bp, Mus musculus
ggagatctaccgagcttttgtgaag

SEQ ID NO: 117737 - DNA, 25 bp, Mus musculus
ggagatctatgccacacgccttggt

SEQ ID NO: 117738 - DNA, 25 bp, Mus musculus
ggagatctgacatccggtgcaggca

SEQ ID NO: 117739 - DNA, 25 bp, Mus musculus
ggagatctgctatgcccttcgggct

SEQ ID NO: 117740 - DNA, 25 bp, Mus musculus
ggagatcttcaactgccacctgcag

SEQ ID NO: 117741 - DNA, 25 bp, Mus musculus
ggagatcttcgaacaaaacgctggg

SEQ ID NO: 117742 - DNA, 25 bp, Mus musculus
ggagatgaattatcaagaggcggca

SEQ ID NO: 117743 - DNA, 25 bp, Mus musculus
ggagatgacccatgcttgagctgta

SEQ ID NO: 117744 - DNA, 25 bp, Mus musculus
ggagatgactcactacttataacag

SEQ ID NO: 117745 - DNA, 25 bp, Mus musculus
ggagatgacttgattgtgaccccgt

SEQ ID NO: 117746 - DNA, 25 bp, Mus musculus
ggagatgagccgtccctaaagcaag

SEQ ID NO: 117747 - DNA, 25 bp, Mus musculus
ggagatgcccaatgtaccctggtgg

SEQ ID NO: 117748 - DNA, 25 bp, Mus musculus
ggagatgcctgtgcccgattggcca

SEQ ID NO: 117749 - DNA, 25 bp, Mus musculus
ggagatgcttcacttgtccccagtg

SEQ ID NO: 117750 - DNA, 25 bp, Mus musculus
ggagatggccgacttctataaggac

SEQ ID NO: 117751 - DNA, 25 bp, Mus musculus
ggagatggctctttccacgcatggt

SEQ ID NO: 117752 - DNA, 25 bp, Mus musculus
ggagatggcttccacatgcgtgact

SEQ ID NO: 117753 - DNA, 25 bp, Mus musculus
ggagattagttgtagcacctgcagc

SEQ ID NO: 117754 - DNA, 25 bp, Mus musculus
ggagattatccacaaaccttctagg

SEQ ID NO: 117755 - DNA, 25 bp, Mus musculus
ggagattgtgtaccccaccattgaa

SEQ ID NO: 117756 - DNA, 25 bp, Mus musculus
ggagatttgttaacccatggccaac

SEQ ID NO: 117757 - DNA, 25 bp, Mus musculus
ggagcaaagccaagacagtatcgcc

SEQ ID NO: 117758 - DNA, 25 bp, Mus musculus
ggagcaaagcctgcaatgccgctat

SEQ ID NO: 117759 - DNA, 25 bp, Mus musculus
ggagcaagccctggatggaccttct

SEQ ID NO: 117760 - DNA, 25 bp, Mus musculus
ggagcaagggagaagttctgtatat

SEQ ID NO: 117761 - DNA, 25 bp, Mus musculus
ggagcaatcacccacatcatgcagc

SEQ ID NO: 117762 - DNA, 25 bp, Mus musculus
ggagcaatgaggaggtctctgccca

SEQ ID NO: 117763 - DNA, 25 bp, Mus musculus
ggagcacaccaaatccaggatcact

SEQ ID NO: 117764 - DNA, 25 bp, Mus musculus
ggagcacaccctgtaccagtgtatg

SEQ ID NO: 117765 - DNA, 25 bp, Mus musculus
ggagcacagtgaatgtcagcatcta

SEQ ID NO: 117766 - DNA, 25 bp, Mus musculus
ggagcacagttgtcatccctgcact

SEQ ID NO: 117767 - DNA, 25 bp, Mus musculus
ggagcacagtttacaagaggccaaa

SEQ ID NO: 117768 - DNA, 25 bp, Mus musculus
ggagcacattcacggttacccttgg

SEQ ID NO: 117769 - DNA, 25 bp, Mus musculus
ggagcaccaggaagaaccagataac

SEQ ID NO: 117770 - DNA, 25 bp, Mus musculus
ggagcaccgcatcatagcctgcgat

SEQ ID NO: 117771 - DNA, 25 bp, Mus musculus
ggagcacgcacgcactttgagcaaa

SEQ ID NO: 117772 - DNA, 25 bp, Mus musculus
ggagcacgctgaggctgcggaaagc

SEQ ID NO: 117773 - DNA, 25 bp, Mus musculus
ggagcacgctgcctatgatgtctcg

SEQ ID NO: 117774 - DNA, 25 bp, Mus musculus
ggagcactacactgacctgaaggac

SEQ ID NO: 117775 - DNA, 25 bp, Mus musculus
ggagcactggtccttcagtgaagcc

SEQ ID NO: 117776 - DNA, 25 bp, Mus musculus
ggagcagaaagaacttcccctgaac

SEQ ID NO: 117777 - DNA, 25 bp, Mus musculus
ggagcagaaccctggcaagtttgag

SEQ ID NO: 117778 - DNA, 25 bp, Mus musculus
ggagcagataccctagccttcatgt

SEQ ID NO: 117779 - DNA, 25 bp, Mus musculus
ggagcagatcgcactgaacgtggac

SEQ ID NO: 117780 - DNA, 25 bp, Mus musculus
ggagcagcaaccgaaacaaagcgga

SEQ ID NO: 117781 - DNA, 25 bp, Mus musculus
ggagcagcacactagtaaccctact

SEQ ID NO: 117782 - DNA, 25 bp, Mus musculus
ggagcagcccaagctgtacagctgg

SEQ ID NO: 117783 - DNA, 25 bp, Mus musculus
ggagcagcctacatttccctcggga

SEQ ID NO: 117784 - DNA, 25 bp, Mus musculus
ggagcagcgccttaccacaaatacc

SEQ ID NO: 117785 - DNA, 25 bp, Mus musculus
ggagcagctcacaaccaaggatcat

SEQ ID NO: 117786 - DNA, 25 bp, Mus musculus
ggagcagctgctccgcctcctgata

SEQ ID NO: 117787 - DNA, 25 bp, Mus musculus
ggagcagctgtcataccaatcaaag

SEQ ID NO: 117788 - DNA, 25 bp, Mus musculus
ggagcaggcatcatcacgacatttg

SEQ ID NO: 117789 - DNA, 25 bp, Mus musculus
ggagcaggccgaagccgacaaaaag

SEQ ID NO: 117790 - DNA, 25 bp, Mus musculus
ggagcaggctcccttggccatagaa

SEQ ID NO: 117791 - DNA, 25 bp, Mus musculus
ggagcagtccctccttggccaaaat

SEQ ID NO: 117792 - DNA, 25 bp, Mus musculus
ggagcagtcctttgtcatccgggca

SEQ ID NO: 117793 - DNA, 25 bp, Mus musculus
ggagcagtgccctctgcagctgaat

SEQ ID NO: 117794 - DNA, 25 bp, Mus musculus
ggagcagttaccacctcaagaggca

SEQ ID NO: 117795 - DNA, 25 bp, Mus musculus
ggagcagttcgctacctgatgaata

SEQ ID NO: 117796 - DNA, 25 bp, Mus musculus
ggagcagttgctccgatcgccctga

SEQ ID NO: 117797 - DNA, 25 bp, Mus musculus
ggagcatcactgagcatttgaacaa

SEQ ID NO: 117798 - DNA, 25 bp, Mus musculus
ggagcatcaggcaccagacgtgctt

SEQ ID NO: 117799 - DNA, 25 bp, Mus musculus
ggagcatccatctagatcccaaggg

SEQ ID NO: 117800 - DNA, 25 bp, Mus musculus
ggagcatcgagctggacatgcgcac

SEQ ID NO: 117801 - DNA, 25 bp, Mus musculus
ggagcatgacaaactgcaacagctg

SEQ ID NO: 117802 - DNA, 25 bp, Mus musculus
ggagcatgcccagcagatacagatg

SEQ ID NO: 117803 - DNA, 25 bp, Mus musculus
ggagcatgccgcagatctatggact

SEQ ID NO: 117804 - DNA, 25 bp, Mus musculus
ggagcatggcactctggcgagcata

SEQ ID NO: 117805 - DNA, 25 bp, Mus musculus
ggagcatgtgcgaattcacccggaa

SEQ ID NO: 117806 - DNA, 25 bp, Mus musculus
ggagcattaacctcctggagacgga

SEQ ID NO: 117807 - DNA, 25 bp, Mus musculus
ggagcattccgactacagagccaaa

SEQ ID NO: 117808 - DNA, 25 bp, Mus musculus
ggagcattctctcaaacaggaacag

SEQ ID NO: 117809 - DNA, 25 bp, Mus musculus
ggagcattgctatcatcgtgccact

SEQ ID NO: 117810 - DNA, 25 bp, Mus musculus
ggagcattggctgctgacattgaca

SEQ ID NO: 117811 - DNA, 25 bp, Mus musculus
ggagcatttcccaagagatcaagcc

SEQ ID NO: 117812 - DNA, 25 bp, Mus musculus
ggagcattttaaagacaatggcaga

SEQ ID NO: 117813 - DNA, 25 bp, Mus musculus
ggagccaagataactaacaacctct

SEQ ID NO: 117814 - DNA, 25 bp, Mus musculus
ggagccaatgatagatttgaacccc

SEQ ID NO: 117815 - DNA, 25 bp, Mus musculus
ggagccacccctcatataactgctg

SEQ ID NO: 117816 - DNA, 25 bp, Mus musculus
ggagccaccctggaattgtccgtag

SEQ ID NO: 117817 - DNA, 25 bp, Mus musculus
ggagccacctgtccaaccagagttg

SEQ ID NO: 117818 - DNA, 25 bp, Mus musculus
ggagccagacctcatgccgtgtgac

SEQ ID NO: 117819 - DNA, 25 bp, Mus musculus
ggagccagactgtgccaagtatcaa

SEQ ID NO: 117820 - DNA, 25 bp, Mus musculus
ggagccagaggagcacatcttggac

SEQ ID NO: 117821 - DNA, 25 bp, Mus musculus
ggagccagcaataccctcatgggaa

SEQ ID NO: 117822 - DNA, 25 bp, Mus musculus
ggagccatccaaaaaacgagccgta

SEQ ID NO: 117823 - DNA, 25 bp, Mus musculus
ggagccatgatagcccaagctggtt

SEQ ID NO: 117824 - DNA, 25 bp, Mus musculus
ggagccatggtctggagattcacgc

SEQ ID NO: 117825 - DNA, 25 bp, Mus musculus
ggagcccagcaagatcacaaagttt

SEQ ID NO: 117826 - DNA, 25 bp, Mus musculus
ggagcccagccgagtgccgcctggg

SEQ ID NO: 117827 - DNA, 25 bp, Mus musculus
ggagcccagtctgtttgaaacgcaa

SEQ ID NO: 117828 - DNA, 25 bp, Mus musculus
ggagcccatggtacatctgcagcta

SEQ ID NO: 117829 - DNA, 25 bp, Mus musculus
ggagccccaggctacttcttcagag

SEQ ID NO: 117830 - DNA, 25 bp, Mus musculus
ggagccccgggagcctcgattcggg

SEQ ID NO: 117831 - DNA, 25 bp, Mus musculus
ggagcccctggcagacaataaagag

SEQ ID NO: 117832 - DNA, 25 bp, Mus musculus
ggagcccctgtttcgaatgtgcaga

SEQ ID NO: 117833 - DNA, 25 bp, Mus musculus
ggagcccgggcagcggagccgagca

SEQ ID NO: 117834 - DNA, 25 bp, Mus musculus
ggagcccgtgggtgtcatctacaac

SEQ ID NO: 117835 - DNA, 25 bp, Mus musculus
ggagccctggtccacctgaatggaa

SEQ ID NO: 117836 - DNA, 25 bp, Mus musculus
ggagcccttgcgtaaaccactggtg

SEQ ID NO: 117837 - DNA, 25 bp, Mus musculus
ggagccctttcagtgatgctgatca

SEQ ID NO: 117838 - DNA, 25 bp, Mus musculus
ggagccgctcaaagtcacgatcgtc

SEQ ID NO: 117839 - DNA, 25 bp, Mus musculus
ggagccgctccaaagatcgtggcca

SEQ ID NO: 117840 - DNA, 25 bp, Mus musculus
ggagcctaccctccgtcgcgctgta

SEQ ID NO: 117841 - DNA, 25 bp, Mus musculus
ggagcctaccgtctacttcggcgtg

SEQ ID NO: 117842 - DNA, 25 bp, Mus musculus
ggagcctatgatgcaaaacactttc

SEQ ID NO: 117843 - DNA, 25 bp, Mus musculus
ggagcctcatagaccctgactctga

SEQ ID NO: 117844 - DNA, 25 bp, Mus musculus
ggagcctgagaacacctacattctg

SEQ ID NO: 117845 - DNA, 25 bp, Mus musculus
ggagcctggagatcctcccttgtta

SEQ ID NO: 117846 - DNA, 25 bp, Mus musculus
ggagcctggttctacagcgtctgac

SEQ ID NO: 117847 - DNA, 25 bp, Mus musculus
ggagcctgtctcttcttatcctgtt

SEQ ID NO: 117848 - DNA, 25 bp, Mus musculus
ggagcctttcatgggacagtggaca

SEQ ID NO: 117849 - DNA, 25 bp, Mus musculus
ggagcgacctccaggccatgtttct

SEQ ID NO: 117850 - DNA, 25 bp, Mus musculus
ggagcgcacactgtgaatggacctt

SEQ ID NO: 117851 - DNA, 25 bp, Mus musculus
ggagcgccgccaaaggtttcatatc

SEQ ID NO: 117852 - DNA, 25 bp, Mus musculus
ggagcgccttacagttccctagtaa

SEQ ID NO: 117853 - DNA, 25 bp, Mus musculus
ggagcgcgcgggggcggaagcggcg

SEQ ID NO: 117854 - DNA, 25 bp, Mus musculus
ggagcgctaccacctgttttcaaga

SEQ ID NO: 117855 - DNA, 25 bp, Mus musculus
ggagcgctccgcctgtagcttgcct

SEQ ID NO: 117856 - DNA, 25 bp, Mus musculus
ggagcgcttccgcagtgtgacccat

SEQ ID NO: 117857 - DNA, 25 bp, Mus musculus
ggagcggacatggacttcgactcgt

SEQ ID NO: 117858 - DNA, 25 bp, Mus musculus
ggagcggacccgttttatcttcatc

SEQ ID NO: 117859 - DNA, 25 bp, Mus musculus
ggagcggcatgtgaccatcactggc

SEQ ID NO: 117860 - DNA, 25 bp, Mus musculus
ggagcggctcctgaagagactcttc

SEQ ID NO: 117861 - DNA, 25 bp, Mus musculus
ggagcgggatccgtcagtgttccct

SEQ ID NO: 117862 - DNA, 25 bp, Mus musculus
ggagcgtactgaatccctagtcact

SEQ ID NO: 117863 - DNA, 25 bp, Mus musculus
ggagcgtcttcctcattctcagtgg

SEQ ID NO: 117864 - DNA, 25 bp, Mus musculus
ggagcgtttcacatccatgacacga

SEQ ID NO: 117865 - DNA, 25 bp, Mus musculus
ggagctaagaagattcatctgggtg

SEQ ID NO: 117866 - DNA, 25 bp, Mus musculus
ggagctaatccgcactgccaagtgg

SEQ ID NO: 117867 - DNA, 25 bp, Mus musculus
ggagctaattaagacagacccagag

SEQ ID NO: 117868 - DNA, 25 bp, Mus musculus
ggagctacagaaggccctgacgact

SEQ ID NO: 117869 - DNA, 25 bp, Mus musculus
ggagctacatcagatgatcctgaca

SEQ ID NO: 117870 - DNA, 25 bp, Mus musculus
ggagctacctggaacgcaggctctt

SEQ ID NO: 117871 - DNA, 25 bp, Mus musculus
ggagctactcaaaacctcggcaggg

SEQ ID NO: 117872 - DNA, 25 bp, Mus musculus
ggagctaggtactctgatccccaag

SEQ ID NO: 117873 - DNA, 25 bp, Mus musculus
ggagctagttcaagagatcacgcaa

SEQ ID NO: 117874 - DNA, 25 bp, Mus musculus
ggagctatctcttgctggcagccag

SEQ ID NO: 117875 - DNA, 25 bp, Mus musculus
ggagctatgttcagagccatccaca

SEQ ID NO: 117876 - DNA, 25 bp, Mus musculus
ggagctattccgagaacgcaggcac

SEQ ID NO: 117877 - DNA, 25 bp, Mus musculus
ggagctatttcctatgacagttctg

SEQ ID NO: 117878 - DNA, 25 bp, Mus musculus
ggagctcaacccttatgctgcctgg

SEQ ID NO: 117879 - DNA, 25 bp, Mus musculus
ggagctcaacctcaatctctgccag

SEQ ID NO: 117880 - DNA, 25 bp, Mus musculus
ggagctcaactgttcaggttctcaa

SEQ ID NO: 117881 - DNA, 25 bp, Mus musculus
ggagctcagagaggcttttgccaaa

SEQ ID NO: 117882 - DNA, 25 bp, Mus musculus
ggagctcagcatggagcagaaaact

SEQ ID NO: 117883 - DNA, 25 bp, Mus musculus
ggagctcaggtcaacgcacaagaca

SEQ ID NO: 117884 - DNA, 25 bp, Mus musculus
ggagctcattagaaacacctgcaag

SEQ ID NO: 117885 - DNA, 25 bp, Mus musculus
ggagctccagcagattcttatatgg

SEQ ID NO: 117886 - DNA, 25 bp, Mus musculus
ggagctccatggctatccaacagat

SEQ ID NO: 117887 - DNA, 25 bp, Mus musculus
ggagctcccatccagaacgcttcag

SEQ ID NO: 117888 - DNA, 25 bp, Mus musculus
ggagctcccgtgtatccgaaaattc

SEQ ID NO: 117889 - DNA, 25 bp, Mus musculus
ggagctcctggcagatatcgtgcag

SEQ ID NO: 117890 - DNA, 25 bp, Mus musculus
ggagctctgggcactctttgatcat

SEQ ID NO: 117891 - DNA, 25 bp, Mus musculus
ggagctctgtgatgggacgcaatat

SEQ ID NO: 117892 - DNA, 25 bp, Mus musculus
ggagctcttctgtttcctgtgcagc

SEQ ID NO: 117893 - DNA, 25 bp, Mus musculus
ggagctgaaactacgcatcttccga

SEQ ID NO: 117894 - DNA, 25 bp, Mus musculus
ggagctgaacaagaccatctgggag

SEQ ID NO: 117895 - DNA, 25 bp, Mus musculus
ggagctgaacgtcgacaactctgcc

SEQ ID NO: 117896 - DNA, 25 bp, Mus musculus
ggagctgacaatcacaggcctgcct

SEQ ID NO: 117897 - DNA, 25 bp, Mus musculus
ggagctgatccaccgatacgtagag

SEQ ID NO: 117898 - DNA, 25 bp, Mus musculus
ggagctgatgctaaacaactggaaa

SEQ ID NO: 117899 - DNA, 25 bp, Mus musculus
ggagctgcagcgaagtccgccagat

SEQ ID NO: 117900 - DNA, 25 bp, Mus musculus
ggagctgccaacacttccagaggga

SEQ ID NO: 117901 - DNA, 25 bp, Mus musculus
ggagctgcgcatccctctggactat

SEQ ID NO: 117902 - DNA, 25 bp, Mus musculus
ggagctgctaaacccaaagagttgt

SEQ ID NO: 117903 - DNA, 25 bp, Mus musculus
ggagctgctcaacacagtccagagg

SEQ ID NO: 117904 - DNA, 25 bp, Mus musculus
ggagctgctcagtcagaagaccagg

SEQ ID NO: 117905 - DNA, 25 bp, Mus musculus
ggagctgctccgtggttgcatcgaa

SEQ ID NO: 117906 - DNA, 25 bp, Mus musculus
ggagctgctgacatccaagatcgga

SEQ ID NO: 117907 - DNA, 25 bp, Mus musculus
ggagctggccaacatgaatcggctt

SEQ ID NO: 117908 - DNA, 25 bp, Mus musculus
ggagctggccatctcgacaggaaaa

SEQ ID NO: 117909 - DNA, 25 bp, Mus musculus
ggagctgggtttgtagctgacttcc

SEQ ID NO: 117910 - DNA, 25 bp, Mus musculus
ggagctgtactccaagaaggccttg

SEQ ID NO: 117911 - DNA, 25 bp, Mus musculus
ggagctgtgcagcaaagccttcaag

SEQ ID NO: 117912 - DNA, 25 bp, Mus musculus
ggagcttaggaatctctttcatgga

SEQ ID NO: 117913 - DNA, 25 bp, Mus musculus
ggagcttcataatataatctgttcg

SEQ ID NO: 117914 - DNA, 25 bp, Mus musculus
ggagcttccttgtgcgtgccagcga

SEQ ID NO: 117915 - DNA, 25 bp, Mus musculus
ggagcttcgctctgttcggggccca

SEQ ID NO: 117916 - DNA, 25 bp, Mus musculus
ggagcttctgctgtccaaggaataa

SEQ ID NO: 117917 - DNA, 25 bp, Mus musculus
ggagcttgactgaccaacactgtgt

SEQ ID NO: 117918 - DNA, 25 bp, Mus musculus
ggagcttgtcccagagtctcaggca

SEQ ID NO: 117919 - DNA, 25 bp, Mus musculus
ggagctttgtgaacatctgcccggc

SEQ ID NO: 117920 - DNA, 25 bp, Mus musculus
ggaggaaacctgtccagttcttgga

SEQ ID NO: 117921 - DNA, 25 bp, Mus musculus
ggaggaaccagactccactgccaag

SEQ ID NO: 117922 - DNA, 25 bp, Mus musculus
ggaggaaccccgatctgtgtgactt

SEQ ID NO: 117923 - DNA, 25 bp, Mus musculus
ggaggaacttatccaccagctgagg

SEQ ID NO: 117924 - DNA, 25 bp, Mus musculus
ggaggaagagatcccagagacaatc

SEQ ID NO: 117925 - DNA, 25 bp, Mus musculus
ggaggaagaggctgcgtcccatcac

SEQ ID NO: 117926 - DNA, 25 bp, Mus musculus
ggaggaagccttcatccatatccag

SEQ ID NO: 117927 - DNA, 25 bp, Mus musculus
ggaggaagctctgcacatctgtatg

SEQ ID NO: 117928 - DNA, 25 bp, Mus musculus
ggaggaatgtgcaaagtcccagctt

SEQ ID NO: 117929 - DNA, 25 bp, Mus musculus
ggaggaattggaacgctgcaccttt

SEQ ID NO: 117930 - DNA, 25 bp, Mus musculus
ggaggacaagactccacagcgctca

SEQ ID NO: 117931 - DNA, 25 bp, Mus musculus
ggaggacaagatcccactgctggtc

SEQ ID NO: 117932 - DNA, 25 bp, Mus musculus
ggaggacaatgtagctggaccacta

SEQ ID NO: 117933 - DNA, 25 bp, Mus musculus
ggaggacaccagaagacgcgtatag

SEQ ID NO: 117934 - DNA, 25 bp, Mus musculus
ggaggacagtgaccttgctctcccc

SEQ ID NO: 117935 - DNA, 25 bp, Mus musculus
ggaggacatcttcatccgatggctg

SEQ ID NO: 117936 - DNA, 25 bp, Mus musculus
ggaggacattgttttcctgccccaa

SEQ ID NO: 117937 - DNA, 25 bp, Mus musculus
ggaggaccaacctttccgcatgatg

SEQ ID NO: 117938 - DNA, 25 bp, Mus musculus
ggaggaccaacttcattcacctgca

SEQ ID NO: 117939 - DNA, 25 bp, Mus musculus
ggaggaccccgcagattactgcaaa

SEQ ID NO: 117940 - DNA, 25 bp, Mus musculus
ggaggaccctcttcgcttgcgtaga

SEQ ID NO: 117941 - DNA, 25 bp, Mus musculus
ggaggacctatatgaactcttcaag

SEQ ID NO: 117942 - DNA, 25 bp, Mus musculus
ggaggacgagatatttacgctcacc

SEQ ID NO: 117943 - DNA, 25 bp, Mus musculus
ggaggactcagaatgccgacggttt

SEQ ID NO: 117944 - DNA, 25 bp, Mus musculus
ggaggactccgccatcaaatgcgag

SEQ ID NO: 117945 - DNA, 25 bp, Mus musculus
ggaggactcgatccaagtctcgtga

SEQ ID NO: 117946 - DNA, 25 bp, Mus musculus
ggaggactgtcttccactgcctgga

SEQ ID NO: 117947 - DNA, 25 bp, Mus musculus
ggaggacttgaaccggctaaacatt

SEQ ID NO: 117948 - DNA, 25 bp, Mus musculus
ggaggagaccaagttacattagatg

SEQ ID NO: 117949 - DNA, 25 bp, Mus musculus
ggaggagacccatcacctggtggaa

SEQ ID NO: 117950 - DNA, 25 bp, Mus musculus
ggaggagacctgcttactgtgtaaa

SEQ ID NO: 117951 - DNA, 25 bp, Mus musculus
ggaggagaccttaccacttgaagat

SEQ ID NO: 117952 - DNA, 25 bp, Mus musculus
ggaggagcattacgtgacacagcaa

SEQ ID NO: 117953 - DNA, 25 bp, Mus musculus
ggaggagccccatgaacttcttgta

SEQ ID NO: 117954 - DNA, 25 bp, Mus musculus
ggaggagcccttgccaccattggct

SEQ ID NO: 117955 - DNA, 25 bp, Mus musculus
ggaggagcctacacagacaggtgct

SEQ ID NO: 117956 - DNA, 25 bp, Mus musculus
ggaggagctttgctaacgagcccca

SEQ ID NO: 117957 - DNA, 25 bp, Mus musculus
ggaggaggaccagattctaacagaa

SEQ ID NO: 117958 - DNA, 25 bp, Mus musculus
ggaggaggcccataagctgacacgt

SEQ ID NO: 117959 - DNA, 25 bp, Mus musculus
ggaggaggttcttcagtactgccag

SEQ ID NO: 117960 - DNA, 25 bp, Mus musculus
ggaggagtccctcaggatctacgca

SEQ ID NO: 117961 - DNA, 25 bp, Mus musculus
ggaggagtccgaggcggaggagcca

SEQ ID NO: 117962 - DNA, 25 bp, Mus musculus
ggaggatctcctaagcatcccatag

SEQ ID NO: 117963 - DNA, 25 bp, Mus musculus
ggaggatgcccttcagtcgaggcca

SEQ ID NO: 117964 - DNA, 25 bp, Mus musculus
ggaggatgctcatgcagaccctgaa

SEQ ID NO: 117965 - DNA, 25 bp, Mus musculus
ggaggatgcttttcactttgtcagt

SEQ ID NO: 117966 - DNA, 25 bp, Mus musculus
ggaggatggcttcgacaccattcct

SEQ ID NO: 117967 - DNA, 25 bp, Mus musculus
ggaggatggtgcgacctttactgtc

SEQ ID NO: 117968 - DNA, 25 bp, Mus musculus
ggaggatggtttccagaccgtccct

SEQ ID NO: 117969 - DNA, 25 bp, Mus musculus
ggaggatgtgagaacagcaaatgtt

SEQ ID NO: 117970 - DNA, 25 bp, Mus musculus
ggaggattccagtcttcacagtcga

SEQ ID NO: 117971 - DNA, 25 bp, Mus musculus
ggaggattctgcctttctttggccc

SEQ ID NO: 117972 - DNA, 25 bp, Mus musculus
ggaggattgtcctgaattggtcccc

SEQ ID NO: 117973 - DNA, 25 bp, Mus musculus
ggaggatttctcaggctatgccatg

SEQ ID NO: 117974 - DNA, 25 bp, Mus musculus
ggaggattttatgctgaaattacca

SEQ ID NO: 117975 - DNA, 25 bp, Mus musculus
ggaggcaacaactggaggtccaacg

SEQ ID NO: 117976 - DNA, 25 bp, Mus musculus
ggaggcaatccagcaagtggcagat

SEQ ID NO: 117977 - DNA, 25 bp, Mus musculus
ggaggcacgagctacttcctttctg

SEQ ID NO: 117978 - DNA, 25 bp, Mus musculus
ggaggcagcgcctgcgacgacgacg

SEQ ID NO: 117979 - DNA, 25 bp, Mus musculus
ggaggcatgactactggcttctggc

SEQ ID NO: 117980 - DNA, 25 bp, Mus musculus
ggaggccaagatccgccagacacac

SEQ ID NO: 117981 - DNA, 25 bp, Mus musculus
ggaggccaagccttctcgaagaagc

SEQ ID NO: 117982 - DNA, 25 bp, Mus musculus
ggaggccacctttgcagagtatgaa

SEQ ID NO: 117983 - DNA, 25 bp, Mus musculus
ggaggcccagagcaaattcaccaag

SEQ ID NO: 117984 - DNA, 25 bp, Mus musculus
ggaggcccagccaaaagtggataca

SEQ ID NO: 117985 - DNA, 25 bp, Mus musculus
ggaggccccacagatgaactatatc

SEQ ID NO: 117986 - DNA, 25 bp, Mus musculus
ggaggcccgaatgaccctagaaact

SEQ ID NO: 117987 - DNA, 25 bp, Mus musculus
ggaggccctgtcaccctgagtgaga

SEQ ID NO: 117988 - DNA, 25 bp, Mus musculus
ggaggccgaaggatcgtttactgaa

SEQ ID NO: 117989 - DNA, 25 bp, Mus musculus
ggaggccgggccaataatcatcggt

SEQ ID NO: 117990 - DNA, 25 bp, Mus musculus
ggaggcctcatgcaggaacattgct

SEQ ID NO: 117991 - DNA, 25 bp, Mus musculus
ggaggccttcttgggctctgtagca

SEQ ID NO: 117992 - DNA, 25 bp, Mus musculus
ggaggcgaccgactgatctcttcag

SEQ ID NO: 117993 - DNA, 25 bp, Mus musculus
ggaggcgcccagctccctactgttg

SEQ ID NO: 117994 - DNA, 25 bp, Mus musculus
ggaggcgcgcggcacggggagcggc

SEQ ID NO: 117995 - DNA, 25 bp, Mus musculus
ggaggcgctttcctactgattatgc

SEQ ID NO: 117996 - DNA, 25 bp, Mus musculus
ggaggcggcgcgctgcgcacccgga

SEQ ID NO: 117997 - DNA, 25 bp, Mus musculus
ggaggcggctttcattctctgtctt

SEQ ID NO: 117998 - DNA, 25 bp, Mus musculus
ggaggcgtccagcatccagattttc

SEQ ID NO: 117999 - DNA, 25 bp, Mus musculus
ggaggctaagcctgccaagttccct

SEQ ID NO: 118000 - DNA, 25 bp, Mus musculus
ggaggctagtcttcgctgcatatgg

SEQ ID NO: 118001 - DNA, 25 bp, Mus musculus
ggaggctatgcagcttacagatatg

SEQ ID NO: 118002 - DNA, 25 bp, Mus musculus
ggaggctcctaagtaataaccgcac

SEQ ID NO: 118003 - DNA, 25 bp, Mus musculus
ggaggctgcccttgtgccaatgagc

SEQ ID NO: 118004 - DNA, 25 bp, Mus musculus
ggaggcttaatgacccagcggaaca

SEQ ID NO: 118005 - DNA, 25 bp, Mus musculus
ggagggaaagacagaagtccttgca

SEQ ID NO: 118006 - DNA, 25 bp, Mus musculus
ggagggaactttccgcagctccatc

SEQ ID NO: 118007 - DNA, 25 bp, Mus musculus
ggagggaccagttcatggaagccat

SEQ ID NO: 118008 - DNA, 25 bp, Mus musculus
ggagggacccgctgttttgtcctgc

SEQ ID NO: 118009 - DNA, 25 bp, Mus musculus
ggagggacctgaattgcgtccccga

SEQ ID NO: 118010 - DNA, 25 bp, Mus musculus
ggagggagatcccaaaccacgtgct

SEQ ID NO: 118011 - DNA, 25 bp, Mus musculus
ggagggccccaactatcaatggatg

SEQ ID NO: 118012 - DNA, 25 bp, Mus musculus
ggagggcctggactttcatcgattc

SEQ ID NO: 118013 - DNA, 25 bp, Mus musculus
ggagggcctgtttttaggatcagca

SEQ ID NO: 118014 - DNA, 25 bp, Mus musculus
ggagggtcagcaagtcgccaacagc

SEQ ID NO: 118015 - DNA, 25 bp, Mus musculus
ggagggtggtatccactccccaaat

SEQ ID NO: 118016 - DNA, 25 bp, Mus musculus
ggagggttcacacatgcacagttag

SEQ ID NO: 118017 - DNA, 25 bp, Mus musculus
ggaggtagagtgctccttcacacca

SEQ ID NO: 118018 - DNA, 25 bp, Mus musculus
ggaggtataccaaagcatcgcggac

SEQ ID NO: 118019 - DNA, 25 bp, Mus musculus
ggaggtcacgctgcacaaagaaggc

SEQ ID NO: 118020 - DNA, 25 bp, Mus musculus
ggaggtccaggcaagaaacagtcat

SEQ ID NO: 118021 - DNA, 25 bp, Mus musculus
ggaggtccatcagccaacagaagtc

SEQ ID NO: 118022 - DNA, 25 bp, Mus musculus
ggaggtcttctacctgatccgcaag

SEQ ID NO: 118023 - DNA, 25 bp, Mus musculus
ggaggtgaacaaccgcatcatcgag

SEQ ID NO: 118024 - DNA, 25 bp, Mus musculus
ggaggtgctttaactgatgcgagtc

SEQ ID NO: 118025 - DNA, 25 bp, Mus musculus
ggaggtgggtccgcgcgtgatcgcg

SEQ ID NO: 118026 - DNA, 25 bp, Mus musculus
ggaggttgaaccttcgcagccagtg

SEQ ID NO: 118027 - DNA, 25 bp, Mus musculus
ggagtaaacttgcatcaaactgtaa

SEQ ID NO: 118028 - DNA, 25 bp, Mus musculus
ggagtaatgctaaatatcgctgcag

SEQ ID NO: 118029 - DNA, 25 bp, Mus musculus
ggagtacaacccctatgcttggaac

SEQ ID NO: 118030 - DNA, 25 bp, Mus musculus
ggagtacacgaaacgaattctgctg

SEQ ID NO: 118031 - DNA, 25 bp, Mus musculus
ggagtacagcctggagcaccagctg

SEQ ID NO: 118032 - DNA, 25 bp, Mus musculus
ggagtaccccggaacccgatctcag

SEQ ID NO: 118033 - DNA, 25 bp, Mus musculus
ggagtacttagcatcggagcggcaa

SEQ ID NO: 118034 - DNA, 25 bp, Mus musculus
ggagtagacacctgcatctggctca

SEQ ID NO: 118035 - DNA, 25 bp, Mus musculus
ggagtagatgccgtaggaccctgca

SEQ ID NO: 118036 - DNA, 25 bp, Mus musculus
ggagtagtcctgtccaccgagagta

SEQ ID NO: 118037 - DNA, 25 bp, Mus musculus
ggagtatcgcttccacgcagagctg

SEQ ID NO: 118038 - DNA, 25 bp, Mus musculus
ggagtatctcacacagccatcgtct

SEQ ID NO: 118039 - DNA, 25 bp, Mus musculus
ggagtattaacagagcccttcctgc

SEQ ID NO: 118040 - DNA, 25 bp, Mus musculus
ggagtattgcttcatgaagtcccac

SEQ ID NO: 118041 - DNA, 25 bp, Mus musculus
ggagtcaaacgacccatacagctga

SEQ ID NO: 118042 - DNA, 25 bp, Mus musculus
ggagtcaagttagggatcaggccat

SEQ ID NO: 118043 - DNA, 25 bp, Mus musculus
ggagtcaccccttcctgctgggaaa

SEQ ID NO: 118044 - DNA, 25 bp, Mus musculus
ggagtcacccgctatggcatctgtg

SEQ ID NO: 118045 - DNA, 25 bp, Mus musculus
ggagtcactcgaagttatacaaagc

SEQ ID NO: 118046 - DNA, 25 bp, Mus musculus
ggagtcagaaccctccccagagtaa

SEQ ID NO: 118047 - DNA, 25 bp, Mus musculus
ggagtcagattccacaatagtctat

SEQ ID NO: 118048 - DNA, 25 bp, Mus musculus
ggagtcagggccacgtcctgccatg

SEQ ID NO: 118049 - DNA, 25 bp, Mus musculus
ggagtcagtcttccgaacaggcgtc

SEQ ID NO: 118050 - DNA, 25 bp, Mus musculus
ggagtcatctttccccactgcgggt

SEQ ID NO: 118051 - DNA, 25 bp, Mus musculus
ggagtccaacgatgaataacccaga

SEQ ID NO: 118052 - DNA, 25 bp, Mus musculus
ggagtccaagctagcatcatgcagg

SEQ ID NO: 118053 - DNA, 25 bp, Mus musculus
ggagtccaccagcatcctgtagtgc

SEQ ID NO: 118054 - DNA, 25 bp, Mus musculus
ggagtccagcagtaccactggcatg

SEQ ID NO: 118055 - DNA, 25 bp, Mus musculus
ggagtccagtggttgccaaatgcca

SEQ ID NO: 118056 - DNA, 25 bp, Mus musculus
ggagtccatgtagcaggcggcatct

SEQ ID NO: 118057 - DNA, 25 bp, Mus musculus
ggagtccctatagtacagtggccaa

SEQ ID NO: 118058 - DNA, 25 bp, Mus musculus
ggagtccctttggagagaaaagcaa

SEQ ID NO: 118059 - DNA, 25 bp, Mus musculus
ggagtccggtcttcatggtgccgca

SEQ ID NO: 118060 - DNA, 25 bp, Mus musculus
ggagtccgtgtccacgtccagcgat

SEQ ID NO: 118061 - DNA, 25 bp, Mus musculus
ggagtcctagcatcacgtggtacaa

SEQ ID NO: 118062 - DNA, 25 bp, Mus musculus
ggagtcctctccatctggctctaag

SEQ ID NO: 118063 - DNA, 25 bp, Mus musculus
ggagtcgcgcgctgctgcatccacg

SEQ ID NO: 118064 - DNA, 25 bp, Mus musculus
ggagtcggacattgaccttctctac

SEQ ID NO: 118065 - DNA, 25 bp, Mus musculus
ggagtcggagccctaatcatccctc

SEQ ID NO: 118066 - DNA, 25 bp, Mus musculus
ggagtcggtcttcacacaaattcag

SEQ ID NO: 118067 - DNA, 25 bp, Mus musculus
ggagtcgtgcgagccggccggactg

SEQ ID NO: 118068 - DNA, 25 bp, Mus musculus
ggagtctaactacaaccggctgaag

SEQ ID NO: 118069 - DNA, 25 bp, Mus musculus
ggagtctcaatccttactgatttga

SEQ ID NO: 118070 - DNA, 25 bp, Mus musculus
ggagtctcagctagtcagtccttga

SEQ ID NO: 118071 - DNA, 25 bp, Mus musculus
ggagtctccctaagtacagcatatg

SEQ ID NO: 118072 - DNA, 25 bp, Mus musculus
ggagtctccgctgaaattgtcagga

SEQ ID NO: 118073 - DNA, 25 bp, Mus musculus
ggagtctctggatcagctagaaacc

SEQ ID NO: 118074 - DNA, 25 bp, Mus musculus
ggagtctgctttccaacccaggaag

SEQ ID NO: 118075 - DNA, 25 bp, Mus musculus
ggagtcttacccctatgaagcgaag

SEQ ID NO: 118076 - DNA, 25 bp, Mus musculus
ggagtcttcactgccaaaatgacat

SEQ ID NO: 118077 - DNA, 25 bp, Mus musculus
ggagtcttccagtgaaccaggctaa

SEQ ID NO: 118078 - DNA, 25 bp, Mus musculus
ggagtgacagccatagcctttgtga

SEQ ID NO: 118079 - DNA, 25 bp, Mus musculus
ggagtgaccaacacatcccagagtc

SEQ ID NO: 118080 - DNA, 25 bp, Mus musculus
ggagtgactccggttcaacagctac

SEQ ID NO: 118081 - DNA, 25 bp, Mus musculus
ggagtgatgtccctgagacctgcct

SEQ ID NO: 118082 - DNA, 25 bp, Mus musculus
ggagtgattcctaagcctaccagct

SEQ ID NO: 118083 - DNA, 25 bp, Mus musculus
ggagtgccaggcttacttcaggaag

SEQ ID NO: 118084 - DNA, 25 bp, Mus musculus
ggagtgcctaattgggattggtgca

SEQ ID NO: 118085 - DNA, 25 bp, Mus musculus
ggagtgcggacaacccaaaatggca

SEQ ID NO: 118086 - DNA, 25 bp, Mus musculus
ggagtgcgtaaagccctccaggact

SEQ ID NO: 118087 - DNA, 25 bp, Mus musculus
ggagtgctacattcagttcctggac

SEQ ID NO: 118088 - DNA, 25 bp, Mus musculus
ggagtgctgggatcgattcctccag

SEQ ID NO: 118089 - DNA, 25 bp, Mus musculus
ggagtggaagaagacaataagctgt

SEQ ID NO: 118090 - DNA, 25 bp, Mus musculus
ggagtggaccatcccgaatatccag

SEQ ID NO: 118091 - DNA, 25 bp, Mus musculus
ggagtggactgcagaacaaaccatg

SEQ ID NO: 118092 - DNA, 25 bp, Mus musculus
ggagtggagaggagagggcgagtct

SEQ ID NO: 118093 - DNA, 25 bp, Mus musculus
ggagtggagtcagctctgttcccta

SEQ ID NO: 118094 - DNA, 25 bp, Mus musculus
ggagtgggagtgcaggtgacttggg

SEQ ID NO: 118095 - DNA, 25 bp, Mus musculus
ggagtgggtcttctcaccacaggaa

SEQ ID NO: 118096 - DNA, 25 bp, Mus musculus
ggagtgtacccttggatgccctggc

SEQ ID NO: 118097 - DNA, 25 bp, Mus musculus
ggagtgtccagcctatgttcagaaa

SEQ ID NO: 118098 - DNA, 25 bp, Mus musculus
ggagtgtttcctatccccggttcag

SEQ ID NO: 118099 - DNA, 25 bp, Mus musculus
ggagttacaacgaagacccacagga

SEQ ID NO: 118100 - DNA, 25 bp, Mus musculus
ggagttacattcagcccaacagtgg

SEQ ID NO: 118101 - DNA, 25 bp, Mus musculus
ggagttatcttttccagcgctgagc

SEQ ID NO: 118102 - DNA, 25 bp, Mus musculus
ggagttcagatctcgaagcccagca

SEQ ID NO: 118103 - DNA, 25 bp, Mus musculus
ggagttcagccatctatgcctacag

SEQ ID NO: 118104 - DNA, 25 bp, Mus musculus
ggagttcataaaccaaaagattgtc

SEQ ID NO: 118105 - DNA, 25 bp, Mus musculus
ggagttcatacccattcctgagcaa

SEQ ID NO: 118106 - DNA, 25 bp, Mus musculus
ggagttccctgctagaatacggagc

SEQ ID NO: 118107 - DNA, 25 bp, Mus musculus
ggagttcctctacgacaagcttagg

SEQ ID NO: 118108 - DNA, 25 bp, Mus musculus
ggagttctcagaaaatggaccacat

SEQ ID NO: 118109 - DNA, 25 bp, Mus musculus
ggagttctcctgcatggaccaccag

SEQ ID NO: 118110 - DNA, 25 bp, Mus musculus
ggagttctgcatctacaaccgcaac

SEQ ID NO: 118111 - DNA, 25 bp, Mus musculus
ggagttctgtcgtcggttggcacac

SEQ ID NO: 118112 - DNA, 25 bp, Mus musculus
ggagttcttcgaaatccgcaccgag

SEQ ID NO: 118113 - DNA, 25 bp, Mus musculus
ggagttgaatttgctcttcccaaga

SEQ ID NO: 118114 - DNA, 25 bp, Mus musculus
ggagttgcccggagaccatgtcaat

SEQ ID NO: 118115 - DNA, 25 bp, Mus musculus
ggagttgcctttatgtttatgttca

SEQ ID NO: 118116 - DNA, 25 bp, Mus musculus
ggagtttaagtaccacccagagtgc

SEQ ID NO: 118117 - DNA, 25 bp, Mus musculus
ggagtttcaacccagacaccttcag

SEQ ID NO: 118118 - DNA, 25 bp, Mus musculus
ggagtttgaacattacctcaagagg

SEQ ID NO: 118119 - DNA, 25 bp, Mus musculus
ggagtttgcaaacacagtagctgag

SEQ ID NO: 118120 - DNA, 25 bp, Mus musculus
ggagtttgccaaccggctgtccaag

SEQ ID NO: 118121 - DNA, 25 bp, Mus musculus
ggagttttcgagaacaaccgcgtca

SEQ ID NO: 118122 - DNA, 25 bp, Mus musculus
ggagttttcgcagaacatgaacacg

SEQ ID NO: 118123 - DNA, 25 bp, Mus musculus
ggataaaacccattgggcccaagtg

SEQ ID NO: 118124 - DNA, 25 bp, Mus musculus
ggataaaagtttgtcgccgctgtct

SEQ ID NO: 118125 - DNA, 25 bp, Mus musculus
ggataaataactcccagtcggctca

SEQ ID NO: 118126 - DNA, 25 bp, Mus musculus
ggataacaacagcactgagccaggg

SEQ ID NO: 118127 - DNA, 25 bp, Mus musculus
ggataactgagggatgcctggaccc

SEQ ID NO: 118128 - DNA, 25 bp, Mus musculus
ggataagaagaaagaccgagagaag

SEQ ID NO: 118129 - DNA, 25 bp, Mus musculus
ggataataatggaatacctaggtgg

SEQ ID NO: 118130 - DNA, 25 bp, Mus musculus
ggataatacggtggccaaggactga

SEQ ID NO: 118131 - DNA, 25 bp, Mus musculus
ggataatgtgctctcccagctggac

SEQ ID NO: 118132 - DNA, 25 bp, Mus musculus
ggataattagccaagggttccccag

SEQ ID NO: 118133 - DNA, 25 bp, Mus musculus
ggataattttcttaacgccctcacg

SEQ ID NO: 118134 - DNA, 25 bp, Mus musculus
ggatacatcatgtcaccggcatgtg

SEQ ID NO: 118135 - DNA, 25 bp, Mus musculus
ggatacatttccacacaggccttgt

SEQ ID NO: 118136 - DNA, 25 bp, Mus musculus
ggataccactcttaactcagctcgg

SEQ ID NO: 118137 - DNA, 25 bp, Mus musculus
ggataccatctacgtccatgagaag

SEQ ID NO: 118138 - DNA, 25 bp, Mus musculus
ggatacccaaggcaagagaccctct

SEQ ID NO: 118139 - DNA, 25 bp, Mus musculus
ggataccctgccttcttagggaaga

SEQ ID NO: 118140 - DNA, 25 bp, Mus musculus
ggataccctgtggtgactttgggct

SEQ ID NO: 118141 - DNA, 25 bp, Mus musculus
ggatacccttccttgagttcagctg

SEQ ID NO: 118142 - DNA, 25 bp, Mus musculus
ggatacctataaaaagggccttgat

SEQ ID NO: 118143 - DNA, 25 bp, Mus musculus
ggatacctgtaaatttctgcccacg

SEQ ID NO: 118144 - DNA, 25 bp, Mus musculus
ggatacctgtgccttttagagccca

SEQ ID NO: 118145 - DNA, 25 bp, Mus musculus
ggatacgctgaagaagccccttacg

SEQ ID NO: 118146 - DNA, 25 bp, Mus musculus
ggatacggtttccagacaggtctga

SEQ ID NO: 118147 - DNA, 25 bp, Mus musculus
ggatactctgatcaagctccgccga

SEQ ID NO: 118148 - DNA, 25 bp, Mus musculus
ggatactgccggctttgaaaatgaa

SEQ ID NO: 118149 - DNA, 25 bp, Mus musculus
ggatacttcctctttggtcgccatg

SEQ ID NO: 118150 - DNA, 25 bp, Mus musculus
ggatacttgatgcaaactcaagacc

SEQ ID NO: 118151 - DNA, 25 bp, Mus musculus
ggatacttgccttgtttgtggcagc

SEQ ID NO: 118152 - DNA, 25 bp, Mus musculus
ggatagacagccagagttcactcag

SEQ ID NO: 118153 - DNA, 25 bp, Mus musculus
ggatagataggttccgggcatcccc

SEQ ID NO: 118154 - DNA, 25 bp, Mus musculus
ggatagattccccaacctgtgtagc

SEQ ID NO: 118155 - DNA, 25 bp, Mus musculus
ggatagcaatactggaaaccctggg

SEQ ID NO: 118156 - DNA, 25 bp, Mus musculus
ggataggttacctgctgggccgctc

SEQ ID NO: 118157 - DNA, 25 bp, Mus musculus
ggatagtcatcaacagagcccgggt

SEQ ID NO: 118158 - DNA, 25 bp, Mus musculus
ggatagtgtcctgccctgtacgaac

SEQ ID NO: 118159 - DNA, 25 bp, Mus musculus
ggatataaccctcctttttgtgagg

SEQ ID NO: 118160 - DNA, 25 bp, Mus musculus
ggatatacccgttcacgcaaagtgg

SEQ ID NO: 118161 - DNA, 25 bp, Mus musculus
ggatatcaccgctgagctggaagag

SEQ ID NO: 118162 - DNA, 25 bp, Mus musculus
ggatatccaggcatcacagttacgg

SEQ ID NO: 118163 - DNA, 25 bp, Mus musculus
ggatatcccctcaaagtatgactgg

SEQ ID NO: 118164 - DNA, 25 bp, Mus musculus
ggatatctcaaactcaaaggctgtg

SEQ ID NO: 118165 - DNA, 25 bp, Mus musculus
ggatatgacaccaagttgacccgga

SEQ ID NO: 118166 - DNA, 25 bp, Mus musculus
ggatatgtaccttgacaatagctcc

SEQ ID NO: 118167 - DNA, 25 bp, Mus musculus
ggatattactacacagccaccggtg

SEQ ID NO: 118168 - DNA, 25 bp, Mus musculus
ggatattttgctctataagctagca

SEQ ID NO: 118169 - DNA, 25 bp, Mus musculus
ggatcaacacctgtacagcagtgac

SEQ ID NO: 118170 - DNA, 25 bp, Mus musculus
ggatcaactttggtctctcaaagtc

SEQ ID NO: 118171 - DNA, 25 bp, Mus musculus
ggatcaagagttctgacacacgctg

SEQ ID NO: 118172 - DNA, 25 bp, Mus musculus
ggatcaatgctcatggcctccgaga

SEQ ID NO: 118173 - DNA, 25 bp, Mus musculus
ggatcacaagtagaaagcccagtgg

SEQ ID NO: 118174 - DNA, 25 bp, Mus musculus
ggatcacatcgaggtgtcggacgat

SEQ ID NO: 118175 - DNA, 25 bp, Mus musculus
ggatcacattctgaaaccacttcgg

SEQ ID NO: 118176 - DNA, 25 bp, Mus musculus
ggatcacccatcattctgaggtccc

SEQ ID NO: 118177 - DNA, 25 bp, Mus musculus
ggatcacctcaacagtcacgtcaga

SEQ ID NO: 118178 - DNA, 25 bp, Mus musculus
ggatcacttcctatagacccattgg

SEQ ID NO: 118179 - DNA, 25 bp, Mus musculus
ggatcagaattcttcccagacgaag

SEQ ID NO: 118180 - DNA, 25 bp, Mus musculus
ggatcagacattttgcacatggctt

SEQ ID NO: 118181 - DNA, 25 bp, Mus musculus
ggatcagatcccaccaacttacatg

SEQ ID NO: 118182 - DNA, 25 bp, Mus musculus
ggatcagatccgattgaagtgtatc

SEQ ID NO: 118183 - DNA, 25 bp, Mus musculus
ggatcagatcctaactgtgctgctg

SEQ ID NO: 118184 - DNA, 25 bp, Mus musculus
ggatcaggaattgtcacccggaggc

SEQ ID NO: 118185 - DNA, 25 bp, Mus musculus
ggatcaggattctgtggccgcgcct

SEQ ID NO: 118186 - DNA, 25 bp, Mus musculus
ggatcaggcctacgatatttcacaa

SEQ ID NO: 118187 - DNA, 25 bp, Mus musculus
ggatcagggactttcaggcttgcag

SEQ ID NO: 118188 - DNA, 25 bp, Mus musculus
ggatcagggctactagtcgcaacag

SEQ ID NO: 118189 - DNA, 25 bp, Mus musculus
ggatcataaaaatgcccaggcacag

SEQ ID NO: 118190 - DNA, 25 bp, Mus musculus
ggatcatgtcctgcctctgcaagaa

SEQ ID NO: 118191 - DNA, 25 bp, Mus musculus
ggatcattcaacagccttcgagtgg

SEQ ID NO: 118192 - DNA, 25 bp, Mus musculus
ggatcattcccagcatccttggcag

SEQ ID NO: 118193 - DNA, 25 bp, Mus musculus
ggatcattctaacagccagccactg

SEQ ID NO: 118194 - DNA, 25 bp, Mus musculus
ggatccaacagcttttaggactcag

SEQ ID NO: 118195 - DNA, 25 bp, Mus musculus
ggatccaagctccattgtacctttg

SEQ ID NO: 118196 - DNA, 25 bp, Mus musculus
ggatccacaccccatgaagaacttg

SEQ ID NO: 118197 - DNA, 25 bp, Mus musculus
ggatccacagcgtgcttcagggctt

SEQ ID NO: 118198 - DNA, 25 bp, Mus musculus
ggatccagagagcacccaatttacc

SEQ ID NO: 118199 - DNA, 25 bp, Mus musculus
ggatccagagcggtcaggccaagac

SEQ ID NO: 118200 - DNA, 25 bp, Mus musculus
ggatccagggatgctaagtagaaac

SEQ ID NO: 118201 - DNA, 25 bp, Mus musculus
ggatccagtccatcaaggaagagaa

SEQ ID NO: 118202 - DNA, 25 bp, Mus musculus
ggatccagtgcagagttaccaacct

SEQ ID NO: 118203 - DNA, 25 bp, Mus musculus
ggatccatgtggtcatcagcgatga

SEQ ID NO: 118204 - DNA, 25 bp, Mus musculus
ggatcccagagacatagcttagctt

SEQ ID NO: 118205 - DNA, 25 bp, Mus musculus
ggatcccagcctccgaattgcagag

SEQ ID NO: 118206 - DNA, 25 bp, Mus musculus
ggatcccagtctctaatctgatgag

SEQ ID NO: 118207 - DNA, 25 bp, Mus musculus
ggatccctaattgattcccagaaag

SEQ ID NO: 118208 - DNA, 25 bp, Mus musculus
ggatccctctgtctgtttatgcctg

SEQ ID NO: 118209 - DNA, 25 bp, Mus musculus
ggatccctgccctcagaagtcagag

SEQ ID NO: 118210 - DNA, 25 bp, Mus musculus
ggatccctgtacactcgaaccgtta

SEQ ID NO: 118211 - DNA, 25 bp, Mus musculus
ggatccctttgacactttggcaaca

SEQ ID NO: 118212 - DNA, 25 bp, Mus musculus
ggatccgagccattttccgggccgg

SEQ ID NO: 118213 - DNA, 25 bp, Mus musculus
ggatccgcggcatcatcagtgagct

SEQ ID NO: 118214 - DNA, 25 bp, Mus musculus
ggatcctaaatacggcatgtttcga

SEQ ID NO: 118215 - DNA, 25 bp, Mus musculus
ggatcctagaatagcgtctcaagct

SEQ ID NO: 118216 - DNA, 25 bp, Mus musculus
ggatcctcttttagcagcagcgggc

SEQ ID NO: 118217 - DNA, 25 bp, Mus musculus
ggatcctggatgtcgttctccttgt

SEQ ID NO: 118218 - DNA, 25 bp, Mus musculus
ggatcctggccaccgattatgaaaa

SEQ ID NO: 118219 - DNA, 25 bp, Mus musculus
ggatcctggtactattgctgctgca

SEQ ID NO: 118220 - DNA, 25 bp, Mus musculus
ggatcctgtgaacgagaccctgtac

SEQ ID NO: 118221 - DNA, 25 bp, Mus musculus
ggatccttaagtcaaccatggctgc

SEQ ID NO: 118222 - DNA, 25 bp, Mus musculus
ggatccttcctgatggcaccgtgga

SEQ ID NO: 118223 - DNA, 25 bp, Mus musculus
ggatcctttggattatgaaaccgtc

SEQ ID NO: 118224 - DNA, 25 bp, Mus musculus
ggatcgacaaccacaccaaggaagt

SEQ ID NO: 118225 - DNA, 25 bp, Mus musculus
ggatcgagaaaagctgataaccacg

SEQ ID NO: 118226 - DNA, 25 bp, Mus musculus
ggatcgagaacacaggtttccttga

SEQ ID NO: 118227 - DNA, 25 bp, Mus musculus
ggatcgaggaacaaatcacctgctg

SEQ ID NO: 118228 - DNA, 25 bp, Mus musculus
ggatcgatctggaaactgtgtcctc

SEQ ID NO: 118229 - DNA, 25 bp, Mus musculus
ggatcgatgtcacggatgcgtttca

SEQ ID NO: 118230 - DNA, 25 bp, Mus musculus
ggatcgcagcgaagccactttgata

SEQ ID NO: 118231 - DNA, 25 bp, Mus musculus
ggatcgctgctccaactctaacgtg

SEQ ID NO: 118232 - DNA, 25 bp, Mus musculus
ggatcgcttacacttgagaagaact

SEQ ID NO: 118233 - DNA, 25 bp, Mus musculus
ggatcggactcatctctgactgtca

SEQ ID NO: 118234 - DNA, 25 bp, Mus musculus
ggatcgttgtagtcagccttagtgg

SEQ ID NO: 118235 - DNA, 25 bp, Mus musculus
ggatctacacacaccagagcgatgt

SEQ ID NO: 118236 - DNA, 25 bp, Mus musculus
ggatctagtactgtgccaccgtgga

SEQ ID NO: 118237 - DNA, 25 bp, Mus musculus
ggatctatccgatggacatcctcca

SEQ ID NO: 118238 - DNA, 25 bp, Mus musculus
ggatctattcaagtgccctgaccag

SEQ ID NO: 118239 - DNA, 25 bp, Mus musculus
ggatctcaaggaagtggcgctcaaa

SEQ ID NO: 118240 - DNA, 25 bp, Mus musculus
ggatctcattgaacgggaccggacc

SEQ ID NO: 118241 - DNA, 25 bp, Mus musculus
ggatctccatgaattacagaccagc

SEQ ID NO: 118242 - DNA, 25 bp, Mus musculus
ggatctccctgacatgcacatgagg

SEQ ID NO: 118243 - DNA, 25 bp, Mus musculus
ggatctcccttcaaagccgacattg

SEQ ID NO: 118244 - DNA, 25 bp, Mus musculus
ggatctcgctgccttcgacaaatcc

SEQ ID NO: 118245 - DNA, 25 bp, Mus musculus
ggatctcggacaccaacctggagga

SEQ ID NO: 118246 - DNA, 25 bp, Mus musculus
ggatctgaagcgggcccacatcttc

SEQ ID NO: 118247 - DNA, 25 bp, Mus musculus
ggatctgaatctccctgagtgctgg

SEQ ID NO: 118248 - DNA, 25 bp, Mus musculus
ggatctgcatgagagcacacgccaa

SEQ ID NO: 118249 - DNA, 25 bp, Mus musculus
ggatctggattattactctgtaaaa

SEQ ID NO: 118250 - DNA, 25 bp, Mus musculus
ggatctggcctcttcgtgcttcaaa

SEQ ID NO: 118251 - DNA, 25 bp, Mus musculus
ggatctgtgctagagggcacctact

SEQ ID NO: 118252 - DNA, 25 bp, Mus musculus
ggatcttactaaaacacggctgcaa

SEQ ID NO: 118253 - DNA, 25 bp, Mus musculus
ggatcttagaacgtgaagggccccg

SEQ ID NO: 118254 - DNA, 25 bp, Mus musculus
ggatcttgagttgaaaatatagcta

SEQ ID NO: 118255 - DNA, 25 bp, Mus musculus
ggatcttgcggaagtgaagtcagaa

SEQ ID NO: 118256 - DNA, 25 bp, Mus musculus
ggatctttctggagattcagtcaag

SEQ ID NO: 118257 - DNA, 25 bp, Mus musculus
ggatctttggtcattcacatttggc

SEQ ID NO: 118258 - DNA, 25 bp, Mus musculus
ggatcttttctccaactgcaccgag

SEQ ID NO: 118259 - DNA, 25 bp, Mus musculus
ggatgaacacaaagaacccaatgat

SEQ ID NO: 118260 - DNA, 25 bp, Mus musculus
ggatgaactcataccattgtgtgaa

SEQ ID NO: 118261 - DNA, 25 bp, Mus musculus
ggatgaagcattgcagcaccctttc

SEQ ID NO: 118262 - DNA, 25 bp, Mus musculus
ggatgaatcaggctgcttgtgacca

SEQ ID NO: 118263 - DNA, 25 bp, Mus musculus
ggatgacaactccattgtccagaac

SEQ ID NO: 118264 - DNA, 25 bp, Mus musculus
ggatgacagacttgacttccagcat

SEQ ID NO: 118265 - DNA, 25 bp, Mus musculus
ggatgacataaagaccctgggcagt

SEQ ID NO: 118266 - DNA, 25 bp, Mus musculus
ggatgacatcttggactctcttggt

SEQ ID NO: 118267 - DNA, 25 bp, Mus musculus
ggatgacatggttctggaccccagc

SEQ ID NO: 118268 - DNA, 25 bp, Mus musculus
ggatgaccccaatactccacgagtg

SEQ ID NO: 118269 - DNA, 25 bp, Mus musculus
ggatgaccctgttgagaagcctgca

SEQ ID NO: 118270 - DNA, 25 bp, Mus musculus
ggatgacgattatgaccaagagcca

SEQ ID NO: 118271 - DNA, 25 bp, Mus musculus
ggatgacgccactccattgggcagc

SEQ ID NO: 118272 - DNA, 25 bp, Mus musculus
ggatgactacgacacactgactgac

SEQ ID NO: 118273 - DNA, 25 bp, Mus musculus
ggatgagagagtccatgcccgcatt

SEQ ID NO: 118274 - DNA, 25 bp, Mus musculus
ggatgagatccgatgaggctctgcc

SEQ ID NO: 118275 - DNA, 25 bp, Mus musculus
ggatgagctccccatgatttacagc

SEQ ID NO: 118276 - DNA, 25 bp, Mus musculus
ggatgaggacaagcctatcctacct

SEQ ID NO: 118277 - DNA, 25 bp, Mus musculus
ggatgagtagaagctcaccaagtgg

SEQ ID NO: 118278 - DNA, 25 bp, Mus musculus
ggatgatacggtcaacttccaggac

SEQ ID NO: 118279 - DNA, 25 bp, Mus musculus
ggatgatcacacagctaactgcggg

SEQ ID NO: 118280 - DNA, 25 bp, Mus musculus
ggatgatctgtcactacacctgcag

SEQ ID NO: 118281 - DNA, 25 bp, Mus musculus
ggatgatgctgatgttaaccccaag

SEQ ID NO: 118282 - DNA, 25 bp, Mus musculus
ggatgatgtcttcactgtcaccgaa

SEQ ID NO: 118283 - DNA, 25 bp, Mus musculus
ggatgattactacagcaaaagcagc

SEQ ID NO: 118284 - DNA, 25 bp, Mus musculus
ggatgatttcatccctggtcacctc

SEQ ID NO: 118285 - DNA, 25 bp, Mus musculus
ggatgcacaaaaagtcgctggaggc

SEQ ID NO: 118286 - DNA, 25 bp, Mus musculus
ggatgcacctgctgtgtttgcagaa

SEQ ID NO: 118287 - DNA, 25 bp, Mus musculus
ggatgcaccttctcctgacaggaca

SEQ ID NO: 118288 - DNA, 25 bp, Mus musculus
ggatgcactctctgaaaccctggga

SEQ ID NO: 118289 - DNA, 25 bp, Mus musculus
ggatgcactctttgcagcccctgga

SEQ ID NO: 118290 - DNA, 25 bp, Mus musculus
ggatgcagagacctatttcaactac

SEQ ID NO: 118291 - DNA, 25 bp, Mus musculus
ggatgcagccagagcgaacacggcc

SEQ ID NO: 118292 - DNA, 25 bp, Mus musculus
ggatgcagtctaatctccactgagt

SEQ ID NO: 118293 - DNA, 25 bp, Mus musculus
ggatgcattacttacacatggaagc

SEQ ID NO: 118294 - DNA, 25 bp, Mus musculus
ggatgcattccagaagcctgttcca

SEQ ID NO: 118295 - DNA, 25 bp, Mus musculus
ggatgccaagcacaccaactttgtg

SEQ ID NO: 118296 - DNA, 25 bp, Mus musculus
ggatgccatcccaacggaatgagga

SEQ ID NO: 118297 - DNA, 25 bp, Mus musculus
ggatgccccatactgtactccggag

SEQ ID NO: 118298 - DNA, 25 bp, Mus musculus
ggatgccctggaaagtaacctctta

SEQ ID NO: 118299 - DNA, 25 bp, Mus musculus
ggatgccgattgatgaaccgacctc

SEQ ID NO: 118300 - DNA, 25 bp, Mus musculus
ggatgccgtctggagcccgaatgcc

SEQ ID NO: 118301 - DNA, 25 bp, Mus musculus
ggatgcctcctggaaccccaagtta

SEQ ID NO: 118302 - DNA, 25 bp, Mus musculus
ggatgcctggccttattcataaaaa

SEQ ID NO: 118303 - DNA, 25 bp, Mus musculus
ggatgcctggttggccaagtaccca

SEQ ID NO: 118304 - DNA, 25 bp, Mus musculus
ggatgcgcgctttctttcctagacc

SEQ ID NO: 118305 - DNA, 25 bp, Mus musculus
ggatgcggtaaaaactcagaaagcc

SEQ ID NO: 118306 - DNA, 25 bp, Mus musculus
ggatgcgtcaaatcatctcttttga

SEQ ID NO: 118307 - DNA, 25 bp, Mus musculus
ggatgcgtccttcccctatgaagca

SEQ ID NO: 118308 - DNA, 25 bp, Mus musculus
ggatgcgttacccagagtgccactt

SEQ ID NO: 118309 - DNA, 25 bp, Mus musculus
ggatgcgttcgtgaactccctgcag

SEQ ID NO: 118310 - DNA, 25 bp, Mus musculus
ggatgctaacgtccatgccatgaga

SEQ ID NO: 118311 - DNA, 25 bp, Mus musculus
ggatgctaattcgacagccctttac

SEQ ID NO: 118312 - DNA, 25 bp, Mus musculus
ggatgctaccgaggaccaacatggt

SEQ ID NO: 118313 - DNA, 25 bp, Mus musculus
ggatgctccggattccaatacaaat

SEQ ID NO: 118314 - DNA, 25 bp, Mus musculus
ggatgctgcattccgtggtcctgac

SEQ ID NO: 118315 - DNA, 25 bp, Mus musculus
ggatgctgctaatggcttcccgcag

SEQ ID NO: 118316 - DNA, 25 bp, Mus musculus
ggatgctgctttgatgcctatttta

SEQ ID NO: 118317 - DNA, 25 bp, Mus musculus
ggatgctggaccacttgaccaagaa

SEQ ID NO: 118318 - DNA, 25 bp, Mus musculus
ggatgctgtatcctttcaagccaga

SEQ ID NO: 118319 - DNA, 25 bp, Mus musculus
ggatgctgtcacatacctcgcaggg

SEQ ID NO: 118320 - DNA, 25 bp, Mus musculus
ggatgctgtcctccctttgtgtctg

SEQ ID NO: 118321 - DNA, 25 bp, Mus musculus
ggatgctgtccttggctgacggcca

SEQ ID NO: 118322 - DNA, 25 bp, Mus musculus
ggatgcttatccaagggccgcagat

SEQ ID NO: 118323 - DNA, 25 bp, Mus musculus
ggatggaactcctttaactgctgaa

SEQ ID NO: 118324 - DNA, 25 bp, Mus musculus
ggatggaagactttctgcagctctg

SEQ ID NO: 118325 - DNA, 25 bp, Mus musculus
ggatggaagcctagatgcctcaccg

SEQ ID NO: 118326 - DNA, 25 bp, Mus musculus
ggatggagccaactactgtgtgaca

SEQ ID NO: 118327 - DNA, 25 bp, Mus musculus
ggatggatatcatgcgcaggtttcc

SEQ ID NO: 118328 - DNA, 25 bp, Mus musculus
ggatggcagcatcaacagttatagc

SEQ ID NO: 118329 - DNA, 25 bp, Mus musculus
ggatggcagcgagtctctcggaact

SEQ ID NO: 118330 - DNA, 25 bp, Mus musculus
ggatggcatctcacttctcactcag

SEQ ID NO: 118331 - DNA, 25 bp, Mus musculus
ggatggcatgtgaaacctacaagaa

SEQ ID NO: 118332 - DNA, 25 bp, Mus musculus
ggatggccacacactcttcgattat

SEQ ID NO: 118333 - DNA, 25 bp, Mus musculus
ggatggcccatgcttcacgagtgaa

SEQ ID NO: 118334 - DNA, 25 bp, Mus musculus
ggatggcctggaacccgtgtgcttt

SEQ ID NO: 118335 - DNA, 25 bp, Mus musculus
ggatggcctggaagatcccctggaa

SEQ ID NO: 118336 - DNA, 25 bp, Mus musculus
ggatggcctggagacaacctttcag

SEQ ID NO: 118337 - DNA, 25 bp, Mus musculus
ggatggctatgactacacgtggaaa

SEQ ID NO: 118338 - DNA, 25 bp, Mus musculus
ggatggctccccatactgtgagaaa

SEQ ID NO: 118339 - DNA, 25 bp, Mus musculus
ggatggctccggacatcagctgctt

SEQ ID NO: 118340 - DNA, 25 bp, Mus musculus
ggatggctggctcatcatcgaccta

SEQ ID NO: 118341 - DNA, 25 bp, Mus musculus
ggatggcttaactgcctcttcccct

SEQ ID NO: 118342 - DNA, 25 bp, Mus musculus
ggatgggacccaattacagtgtgcc

SEQ ID NO: 118343 - DNA, 25 bp, Mus musculus
ggatgggcctcagtaccaccttgct

SEQ ID NO: 118344 - DNA, 25 bp, Mus musculus
ggatgggctcaaacttatgcttctg

SEQ ID NO: 118345 - DNA, 25 bp, Mus musculus
ggatggggacttccctccacatgag

SEQ ID NO: 118346 - DNA, 25 bp, Mus musculus
ggatgggtccctgtctctctggctg

SEQ ID NO: 118347 - DNA, 25 bp, Mus musculus
ggatggtccaccatgcctagaacca

SEQ ID NO: 118348 - DNA, 25 bp, Mus musculus
ggatggtcgctacaatccctgcgct

SEQ ID NO: 118349 - DNA, 25 bp, Mus musculus
ggatggtgcgacctttactgtcaca

SEQ ID NO: 118350 - DNA, 25 bp, Mus musculus
ggatgtaccaggtgtacagccacca

SEQ ID NO: 118351 - DNA, 25 bp, Mus musculus
ggatgtagacagaatgccaaggcca

SEQ ID NO: 118352 - DNA, 25 bp, Mus musculus
ggatgtattcctaaatcccctggaa

SEQ ID NO: 118353 - DNA, 25 bp, Mus musculus
ggatgtattcgcagccacgggtgaa

SEQ ID NO: 118354 - DNA, 25 bp, Mus musculus
ggatgtcccacctctctgagctctg

SEQ ID NO: 118355 - DNA, 25 bp, Mus musculus
ggatgtcccgctagacagccatgga

SEQ ID NO: 118356 - DNA, 25 bp, Mus musculus
ggatgtccgcttctcccaaaggatg

SEQ ID NO: 118357 - DNA, 25 bp, Mus musculus
ggatgtgcacccactttgaagaaca

SEQ ID NO: 118358 - DNA, 25 bp, Mus musculus
ggatgtgccctacaggataagcctg

SEQ ID NO: 118359 - DNA, 25 bp, Mus musculus
ggatgtgctacctcaccatcaagga

SEQ ID NO: 118360 - DNA, 25 bp, Mus musculus
ggatgtgctcctggccatgatcata

SEQ ID NO: 118361 - DNA, 25 bp, Mus musculus
ggatgtggatcagcgagagtcccca

SEQ ID NO: 118362 - DNA, 25 bp, Mus musculus
ggatgtgtttttactgccgaccaga

SEQ ID NO: 118363 - DNA, 25 bp, Mus musculus
ggatgttcaaaccagagaccagccg

SEQ ID NO: 118364 - DNA, 25 bp, Mus musculus
ggatgttcaatgctagcgccgttac

SEQ ID NO: 118365 - DNA, 25 bp, Mus musculus
ggatgttccatgtcaccagtgtcag

SEQ ID NO: 118366 - DNA, 25 bp, Mus musculus
ggatgttgacactgacccactgaag

SEQ ID NO: 118367 - DNA, 25 bp, Mus musculus
ggatgttgtcatacggcctaggacg

SEQ ID NO: 118368 - DNA, 25 bp, Mus musculus
ggatgtttccagaagccctcagaag

SEQ ID NO: 118369 - DNA, 25 bp, Mus musculus
ggatgttttcatgcatgcaaaccta

SEQ ID NO: 118370 - DNA, 25 bp, Mus musculus
ggattaacatgatggcactgcctgg

SEQ ID NO: 118371 - DNA, 25 bp, Mus musculus
ggattaatcccggagagccagagcc

SEQ ID NO: 118372 - DNA, 25 bp, Mus musculus
ggattacacaacacctcccagtgag

SEQ ID NO: 118373 - DNA, 25 bp, Mus musculus
ggattacccaccaggcatcagctgt

SEQ ID NO: 118374 - DNA, 25 bp, Mus musculus
ggattacctcacagatctagagctg

SEQ ID NO: 118375 - DNA, 25 bp, Mus musculus
ggattactggaggaagtccctgtca

SEQ ID NO: 118376 - DNA, 25 bp, Mus musculus
ggattacttaacacaagccgtggag

SEQ ID NO: 118377 - DNA, 25 bp, Mus musculus
ggattatcacgccagaactctaaga

SEQ ID NO: 118378 - DNA, 25 bp, Mus musculus
ggattatctgcactcagagcgcaag

SEQ ID NO: 118379 - DNA, 25 bp, Mus musculus
ggattatgactcctagcgccctgtg

SEQ ID NO: 118380 - DNA, 25 bp, Mus musculus
ggattattatgtcgcctacctgagg

SEQ ID NO: 118381 - DNA, 25 bp, Mus musculus
ggattcaagtcctatgcacagagga

SEQ ID NO: 118382 - DNA, 25 bp, Mus musculus
ggattcactttgttgttgacccgca

SEQ ID NO: 118383 - DNA, 25 bp, Mus musculus
ggattcaggacaccattgccgcaaa

SEQ ID NO: 118384 - DNA, 25 bp, Mus musculus
ggattcatagctgactcccttctag

SEQ ID NO: 118385 - DNA, 25 bp, Mus musculus
ggattcattactacagccggctcac

SEQ ID NO: 118386 - DNA, 25 bp, Mus musculus
ggattccaagtactgtaagcagcaa

SEQ ID NO: 118387 - DNA, 25 bp, Mus musculus
ggattccagggtggctctatcgacc

SEQ ID NO: 118388 - DNA, 25 bp, Mus musculus
ggattcccaggacaagctgctagca

SEQ ID NO: 118389 - DNA, 25 bp, Mus musculus
ggattcccagtcaggcatcatgcta

SEQ ID NO: 118390 - DNA, 25 bp, Mus musculus
ggattcgccgtggacttcttcgagc

SEQ ID NO: 118391 - DNA, 25 bp, Mus musculus
ggattctcccagcaggacaatggcc

SEQ ID NO: 118392 - DNA, 25 bp, Mus musculus
ggattctccttaactgcccttactg

SEQ ID NO: 118393 - DNA, 25 bp, Mus musculus
ggattctgacaaaactggagctcgt

SEQ ID NO: 118394 - DNA, 25 bp, Mus musculus
ggattctgcaaccagaccctgagga

SEQ ID NO: 118395 - DNA, 25 bp, Mus musculus
ggattctggagtacgcaccttgccg

SEQ ID NO: 118396 - DNA, 25 bp, Mus musculus
ggattctggtgggttcttccgctca

SEQ ID NO: 118397 - DNA, 25 bp, Mus musculus
ggattctgtccagtacaccctgttg

SEQ ID NO: 118398 - DNA, 25 bp, Mus musculus
ggattctgttccagtccccagtgac

SEQ ID NO: 118399 - DNA, 25 bp, Mus musculus
ggattcttcgagctccagcgcctat

SEQ ID NO: 118400 - DNA, 25 bp, Mus musculus
ggattcttgagcagatagcacagcc

SEQ ID NO: 118401 - DNA, 25 bp, Mus musculus
ggattgacccagtggactccagcct

SEQ ID NO: 118402 - DNA, 25 bp, Mus musculus
ggattgcaacggaaaatggagcccc

SEQ ID NO: 118403 - DNA, 25 bp, Mus musculus
ggattgcacctagtgtctgtcgccg

SEQ ID NO: 118404 - DNA, 25 bp, Mus musculus
ggattgcatgccacactatagtctg

SEQ ID NO: 118405 - DNA, 25 bp, Mus musculus
ggattgccatttactctgcgaggga

SEQ ID NO: 118406 - DNA, 25 bp, Mus musculus
ggattgccgggcagcggacattcct

SEQ ID NO: 118407 - DNA, 25 bp, Mus musculus
ggattgctctgcctccaaatctgag

SEQ ID NO: 118408 - DNA, 25 bp, Mus musculus
ggattgctgctgctcatatttggga

SEQ ID NO: 118409 - DNA, 25 bp, Mus musculus
ggattgctggcatgctgtaccctca

SEQ ID NO: 118410 - DNA, 25 bp, Mus musculus
ggattggcaagaacggagacctacc

SEQ ID NO: 118411 - DNA, 25 bp, Mus musculus
ggattggccgtgctctttctgctta

SEQ ID NO: 118412 - DNA, 25 bp, Mus musculus
ggattggtaaccctttcactttgtg

SEQ ID NO: 118413 - DNA, 25 bp, Mus musculus
ggatttaacatctacgtcagtgata

SEQ ID NO: 118414 - DNA, 25 bp, Mus musculus
ggatttaaggcttccgaggctgaga

SEQ ID NO: 118415 - DNA, 25 bp, Mus musculus
ggatttacaagagaggctccctgct

SEQ ID NO: 118416 - DNA, 25 bp, Mus musculus
ggatttacggctggaggaaaagatg

SEQ ID NO: 118417 - DNA, 25 bp, Mus musculus
ggatttagaaaacggacagcacaca

SEQ ID NO: 118418 - DNA, 25 bp, Mus musculus
ggatttagtcatctccttagcaaaa

SEQ ID NO: 118419 - DNA, 25 bp, Mus musculus
ggatttatcaaacttctcaggaacc

SEQ ID NO: 118420 - DNA, 25 bp, Mus musculus
ggatttatgacttaacagacgctag

SEQ ID NO: 118421 - DNA, 25 bp, Mus musculus
ggatttatttctctacaagggacac

SEQ ID NO: 118422 - DNA, 25 bp, Mus musculus
ggatttcacaaagttacccctggct

SEQ ID NO: 118423 - DNA, 25 bp, Mus musculus
ggatttccttactccctcagcgagg

SEQ ID NO: 118424 - DNA, 25 bp, Mus musculus
ggatttcgaatctaccacaaattgg

SEQ ID NO: 118425 - DNA, 25 bp, Mus musculus
ggatttgaagctccccaagcaagga

SEQ ID NO: 118426 - DNA, 25 bp, Mus musculus
ggatttgccatcttaggaacggaag

SEQ ID NO: 118427 - DNA, 25 bp, Mus musculus
ggatttgccatttccgcagcgttgc

SEQ ID NO: 118428 - DNA, 25 bp, Mus musculus
ggatttgctcgcatacctcgaaagg

SEQ ID NO: 118429 - DNA, 25 bp, Mus musculus
ggatttgctggaccctttccagaag

SEQ ID NO: 118430 - DNA, 25 bp, Mus musculus
ggatttggacaatagccaccagtct

SEQ ID NO: 118431 - DNA, 25 bp, Mus musculus
ggatttgtcatcaacgccatctatg

SEQ ID NO: 118432 - DNA, 25 bp, Mus musculus
ggattttaaactgatctaccggcaa

SEQ ID NO: 118433 - DNA, 25 bp, Mus musculus
ggattttaaccccaacggcacatgc

SEQ ID NO: 118434 - DNA, 25 bp, Mus musculus
ggattttaaggactcagactgcaga

SEQ ID NO: 118435 - DNA, 25 bp, Mus musculus
ggattttatgtcgatgcgggacccc

SEQ ID NO: 118436 - DNA, 25 bp, Mus musculus
ggatttttcccaagtgatgctgtca

SEQ ID NO: 118437 - DNA, 25 bp, Mus musculus
ggatttttctggagatacggggcat

SEQ ID NO: 118438 - DNA, 25 bp, Mus musculus
ggcaaaaaacttcatcactcgggag

SEQ ID NO: 118439 - DNA, 25 bp, Mus musculus
ggcaaaaattgcctgcggtattctc

SEQ ID NO: 118440 - DNA, 25 bp, Mus musculus
ggcaaaagtattccgacccagagac

SEQ ID NO: 118441 - DNA, 25 bp, Mus musculus
ggcaaaagtgcaggagacctcggct

SEQ ID NO: 118442 - DNA, 25 bp, Mus musculus
ggcaaaatccgtcagagcctacgca

SEQ ID NO: 118443 - DNA, 25 bp, Mus musculus
ggcaaaatcgaaggcctcacggatg

SEQ ID NO: 118444 - DNA, 25 bp, Mus musculus
ggcaaaatctgtctataaatctgta

SEQ ID NO: 118445 - DNA, 25 bp, Mus musculus
ggcaaaatcttcacaacccctggag

SEQ ID NO: 118446 - DNA, 25 bp, Mus musculus
ggcaaacagtgtgtcaaccgcatca

SEQ ID NO: 118447 - DNA, 25 bp, Mus musculus
ggcaaaccggaaaaacagctctgag

SEQ ID NO: 118448 - DNA, 25 bp, Mus musculus
ggcaaacgcctagctcaatgtctgc

SEQ ID NO: 118449 - DNA, 25 bp, Mus musculus
ggcaaacttgaacagacggtctcta

SEQ ID NO: 118450 - DNA, 25 bp, Mus musculus
ggcaaactttaggtcgagctcagct

SEQ ID NO: 118451 - DNA, 25 bp, Mus musculus
ggcaaagaagagagacgaggaccca

SEQ ID NO: 118452 - DNA, 25 bp, Mus musculus
ggcaaagagatcgacctcctacgga

SEQ ID NO: 118453 - DNA, 25 bp, Mus musculus
ggcaaagatgctgccaccgctgaga

SEQ ID NO: 118454 - DNA, 25 bp, Mus musculus
ggcaaagcaacaagaatggcacctg

SEQ ID NO: 118455 - DNA, 25 bp, Mus musculus
ggcaaagccaaggtcaatcaagaga

SEQ ID NO: 118456 - DNA, 25 bp, Mus musculus
ggcaaagctgcaatccctggtggaa

SEQ ID NO: 118457 - DNA, 25 bp, Mus musculus
ggcaaagcttgatgcccggcagtct

SEQ ID NO: 118458 - DNA, 25 bp, Mus musculus
ggcaaagctttcgtccagtctcagt

SEQ ID NO: 118459 - DNA, 25 bp, Mus musculus
ggcaaaggagagaagacgaaaaacg

SEQ ID NO: 118460 - DNA, 25 bp, Mus musculus
ggcaaaggtctgcaaagcccgataa

SEQ ID NO: 118461 - DNA, 25 bp, Mus musculus
ggcaaaggtttcagtcacagctcaa

SEQ ID NO: 118462 - DNA, 25 bp, Mus musculus
ggcaaagtccttaaccgagttgtga

SEQ ID NO: 118463 - DNA, 25 bp, Mus musculus
ggcaaagtctggagtccaaggcccc

SEQ ID NO: 118464 - DNA, 25 bp, Mus musculus
ggcaaagttgccatcgacagaggaa

SEQ ID NO: 118465 - DNA, 25 bp, Mus musculus
ggcaaatagcatgttctgagcagca

SEQ ID NO: 118466 - DNA, 25 bp, Mus musculus
ggcaaatatgtcaccaccacactct

SEQ ID NO: 118467 - DNA, 25 bp, Mus musculus
ggcaaatcaaaggagaaaaactatt

SEQ ID NO: 118468 - DNA, 25 bp, Mus musculus
ggcaaatcatgtcttctccaccagt

SEQ ID NO: 118469 - DNA, 25 bp, Mus musculus
ggcaaatcctcagacccctgtggaa

SEQ ID NO: 118470 - DNA, 25 bp, Mus musculus
ggcaaatcgagggaaacataccaat

SEQ ID NO: 118471 - DNA, 25 bp, Mus musculus
ggcaaatgaagcaatatccaagttg

SEQ ID NO: 118472 - DNA, 25 bp, Mus musculus
ggcaaatgagctttggccctgtagc

SEQ ID NO: 118473 - DNA, 25 bp, Mus musculus
ggcaaatgcggaatatatgtctcca

SEQ ID NO: 118474 - DNA, 25 bp, Mus musculus
ggcaaatgcttgagaccctggaact

SEQ ID NO: 118475 - DNA, 25 bp, Mus musculus
ggcaacacttgcatcctcagggagg

SEQ ID NO: 118476 - DNA, 25 bp, Mus musculus
ggcaacagagaaatgaagcgcctct

SEQ ID NO: 118477 - DNA, 25 bp, Mus musculus
ggcaacagctacaacgcagcaagca

SEQ ID NO: 118478 - DNA, 25 bp, Mus musculus
ggcaacagttcctgtcctgctcatc

SEQ ID NO: 118479 - DNA, 25 bp, Mus musculus
ggcaacataaacaaccagcaggctg

SEQ ID NO: 118480 - DNA, 25 bp, Mus musculus
ggcaacatccctcaagtcttcagag

SEQ ID NO: 118481 - DNA, 25 bp, Mus musculus
ggcaaccagttccaatgtgatgatc

SEQ ID NO: 118482 - DNA, 25 bp, Mus musculus
ggcaacctgacctgtgaagatgact

SEQ ID NO: 118483 - DNA, 25 bp, Mus musculus
ggcaacctgctggtaatcatagcca

SEQ ID NO: 118484 - DNA, 25 bp, Mus musculus
ggcaacctggatcccaaaatcacag

SEQ ID NO: 118485 - DNA, 25 bp, Mus musculus
ggcaacctggttacacatcagcgga

SEQ ID NO: 118486 - DNA, 25 bp, Mus musculus
ggcaacgctaccatggctttctgaa

SEQ ID NO: 118487 - DNA, 25 bp, Mus musculus
ggcaacggcacacagcagactttct

SEQ ID NO: 118488 - DNA, 25 bp, Mus musculus
ggcaactaccgctcgtctggctgta

SEQ ID NO: 118489 - DNA, 25 bp, Mus musculus
ggcaactctcgcgagaacgcgggct

SEQ ID NO: 118490 - DNA, 25 bp, Mus musculus
ggcaactgccaacttaggtccggag

SEQ ID NO: 118491 - DNA, 25 bp, Mus musculus
ggcaactgtcactttgattttgcac

SEQ ID NO: 118492 - DNA, 25 bp, Mus musculus
ggcaagaaatgtgaaccggaacgtc

SEQ ID NO: 118493 - DNA, 25 bp, Mus musculus
ggcaagaaggttagaggccgtctct

SEQ ID NO: 118494 - DNA, 25 bp, Mus musculus
ggcaagacaacacagaagatcggct

SEQ ID NO: 118495 - DNA, 25 bp, Mus musculus
ggcaagatcaccttctgcactggca

SEQ ID NO: 118496 - DNA, 25 bp, Mus musculus
ggcaagatcgcggaccgctttctgc

SEQ ID NO: 118497 - DNA, 25 bp, Mus musculus
ggcaagcagtcaccctcatgatgga

SEQ ID NO: 118498 - DNA, 25 bp, Mus musculus
ggcaagccacttgttaaccctgagt

SEQ ID NO: 118499 - DNA, 25 bp, Mus musculus
ggcaagccattgctcaaggctgtga

SEQ ID NO: 118500 - DNA, 25 bp, Mus musculus
ggcaagcccttgatgtgtgtgaaaa

SEQ ID NO: 118501 - DNA, 25 bp, Mus musculus
ggcaagccgcaaacacaagtctaag

SEQ ID NO: 118502 - DNA, 25 bp, Mus musculus
ggcaagcgttatgtccctgagcagt

SEQ ID NO: 118503 - DNA, 25 bp, Mus musculus
ggcaaggaggaataagaacacaacc

SEQ ID NO: 118504 - DNA, 25 bp, Mus musculus
ggcaaggagggtttctttcactcct

SEQ ID NO: 118505 - DNA, 25 bp, Mus musculus
ggcaaggcattatacccatcaggca

SEQ ID NO: 118506 - DNA, 25 bp, Mus musculus
ggcaaggccttcagcgtcaaacaca

SEQ ID NO: 118507 - DNA, 25 bp, Mus musculus
ggcaagggcgaaatcacgcccgccg

SEQ ID NO: 118508 - DNA, 25 bp, Mus musculus
ggcaagtatgagttccctgacaagg

SEQ ID NO: 118509 - DNA, 25 bp, Mus musculus
ggcaagtatggatcgccctgtacaa

SEQ ID NO: 118510 - DNA, 25 bp, Mus musculus
ggcaagtccttcacactgtagcagt

SEQ ID NO: 118511 - DNA, 25 bp, Mus musculus
ggcaagtgcaaaaacctgtgatggt

SEQ ID NO: 118512 - DNA, 25 bp, Mus musculus
ggcaagttctgcataagactacctg

SEQ ID NO: 118513 - DNA, 25 bp, Mus musculus
ggcaagttgctcaagggtatcgaca

SEQ ID NO: 118514 - DNA, 25 bp, Mus musculus
ggcaataagacaaagaactacatgc

SEQ ID NO: 118515 - DNA, 25 bp, Mus musculus
ggcaataagtctgacctgcggccgg

SEQ ID NO: 118516 - DNA, 25 bp, Mus musculus
ggcaatagaggctggtcacgcatca

SEQ ID NO: 118517 - DNA, 25 bp, Mus musculus
ggcaatagatcctaactagcaaggg

SEQ ID NO: 118518 - DNA, 25 bp, Mus musculus
ggcaataggtgtgtgtttaatctgt

SEQ ID NO: 118519 - DNA, 25 bp, Mus musculus
ggcaatcaccgaaagcagtcactct

SEQ ID NO: 118520 - DNA, 25 bp, Mus musculus
ggcaatccaagaagctcgccagatg

SEQ ID NO: 118521 - DNA, 25 bp, Mus musculus
ggcaatccaagacccagacctggag

SEQ ID NO: 118522 - DNA, 25 bp, Mus musculus
ggcaatcgccaggaagatacctaca

SEQ ID NO: 118523 - DNA, 25 bp, Mus musculus
ggcaatgaatcgaaccaaggaccta

SEQ ID NO: 118524 - DNA, 25 bp, Mus musculus
ggcaatggcccagctaagggtccct

SEQ ID NO: 118525 - DNA, 25 bp, Mus musculus
ggcaatgggcttggagctctacctg

SEQ ID NO: 118526 - DNA, 25 bp, Mus musculus
ggcaattactttaccaggcgtgctg

SEQ ID NO: 118527 - DNA, 25 bp, Mus musculus
ggcaatttgaaacgcactgtctgtg

SEQ ID NO: 118528 - DNA, 25 bp, Mus musculus
ggcacaaggactgaatttccaaaag

SEQ ID NO: 118529 - DNA, 25 bp, Mus musculus
ggcacaatgaccatcgagatcgact

SEQ ID NO: 118530 - DNA, 25 bp, Mus musculus
ggcacaatggctatgaccctagggt

SEQ ID NO: 118531 - DNA, 25 bp, Mus musculus
ggcacacactcttactgaaagcaga

SEQ ID NO: 118532 - DNA, 25 bp, Mus musculus
ggcacacagccagcacagtgaagag

SEQ ID NO: 118533 - DNA, 25 bp, Mus musculus
ggcacacctttcacagccatcaggg

SEQ ID NO: 118534 - DNA, 25 bp, Mus musculus
ggcacacgcttctaaagctggttcc

SEQ ID NO: 118535 - DNA, 25 bp, Mus musculus
ggcacacggatctctgcaggcaaaa

SEQ ID NO: 118536 - DNA, 25 bp, Mus musculus
ggcacactccacagctttgaagaaa

SEQ ID NO: 118537 - DNA, 25 bp, Mus musculus
ggcacacttaggtttccaaaagctg

SEQ ID NO: 118538 - DNA, 25 bp, Mus musculus
ggcacagcaattagtgtcacagtac

SEQ ID NO: 118539 - DNA, 25 bp, Mus musculus
ggcacagccaacaagatgaacggag

SEQ ID NO: 118540 - DNA, 25 bp, Mus musculus
ggcacagccttggagaaatacgcca

SEQ ID NO: 118541 - DNA, 25 bp, Mus musculus
ggcacagctctaagttccttggaca

SEQ ID NO: 118542 - DNA, 25 bp, Mus musculus
ggcacagctgatgccctgggcctaa

SEQ ID NO: 118543 - DNA, 25 bp, Mus musculus
ggcacaggggtctcaacagaaggca

SEQ ID NO: 118544 - DNA, 25 bp, Mus musculus
ggcacagtcatcgtcccttttagga

SEQ ID NO: 118545 - DNA, 25 bp, Mus musculus
ggcacagtctgcctcaagtacctgc

SEQ ID NO: 118546 - DNA, 25 bp, Mus musculus
ggcacatcaatttgtggaaggcgag

SEQ ID NO: 118547 - DNA, 25 bp, Mus musculus
ggcacatccttgagaaaaacctgaa

SEQ ID NO: 118548 - DNA, 25 bp, Mus musculus
ggcacatctttgaagctccctggca

SEQ ID NO: 118549 - DNA, 25 bp, Mus musculus
ggcacatgctaccagtctccaaagt

SEQ ID NO: 118550 - DNA, 25 bp, Mus musculus
ggcacatttttgacgatggacctcg

SEQ ID NO: 118551 - DNA, 25 bp, Mus musculus
ggcaccaaccttggtttctaccatt

SEQ ID NO: 118552 - DNA, 25 bp, Mus musculus
ggcaccaagagcagtcccggactgt

SEQ ID NO: 118553 - DNA, 25 bp, Mus musculus
ggcaccaatgaatggaagacagttg

SEQ ID NO: 118554 - DNA, 25 bp, Mus musculus
ggcaccaatggtggcaacgactgct

SEQ ID NO: 118555 - DNA, 25 bp, Mus musculus
ggcaccacgcggacattggaggtat

SEQ ID NO: 118556 - DNA, 25 bp, Mus musculus
ggcaccactctcacagtctcctcag

SEQ ID NO: 118557 - DNA, 25 bp, Mus musculus
ggcaccagcactcaacatacacatg

SEQ ID NO: 118558 - DNA, 25 bp, Mus musculus
ggcaccagcctcacgtggcatgact

SEQ ID NO: 118559 - DNA, 25 bp, Mus musculus
ggcaccagctacatcaatccttgag

SEQ ID NO: 118560 - DNA, 25 bp, Mus musculus
ggcaccatctgcagtttgctgctac

SEQ ID NO: 118561 - DNA, 25 bp, Mus musculus
ggcaccatgcgtctacagcttggca

SEQ ID NO: 118562 - DNA, 25 bp, Mus musculus
ggcaccattctagctggttcgaagg

SEQ ID NO: 118563 - DNA, 25 bp, Mus musculus
ggcacccagcgattcaaactcaaag

SEQ ID NO: 118564 - DNA, 25 bp, Mus musculus
ggcacccaggctatatcagtcatga

SEQ ID NO: 118565 - DNA, 25 bp, Mus musculus
ggcacccaggggctcactgagaaat

SEQ ID NO: 118566 - DNA, 25 bp, Mus musculus
ggcaccgagtcaccattaagtagaa

SEQ ID NO: 118567 - DNA, 25 bp, Mus musculus
ggcaccgatcctcgaacaattctta

SEQ ID NO: 118568 - DNA, 25 bp, Mus musculus
ggcaccgcgcgaactctgccaacct

SEQ ID NO: 118569 - DNA, 25 bp, Mus musculus
ggcaccgcgcgctgcggactgtcat

SEQ ID NO: 118570 - DNA, 25 bp, Mus musculus
ggcaccggcaacaaatcgactgacg

SEQ ID NO: 118571 - DNA, 25 bp, Mus musculus
ggcacctccgtctggctagtggaac

SEQ ID NO: 118572 - DNA, 25 bp, Mus musculus
ggcacctgaacatgtgtggcataca

SEQ ID NO: 118573 - DNA, 25 bp, Mus musculus
ggcacctgcaacttctctgaagaac

SEQ ID NO: 118574 - DNA, 25 bp, Mus musculus
ggcacctggcacacccactataggt

SEQ ID NO: 118575 - DNA, 25 bp, Mus musculus
ggcacctggtcctgaagagcttcaa

SEQ ID NO: 118576 - DNA, 25 bp, Mus musculus
ggcacctgtgtcaacgtgggttgca

SEQ ID NO: 118577 - DNA, 25 bp, Mus musculus
ggcacgagaccaggagaccttgcat

SEQ ID NO: 118578 - DNA, 25 bp, Mus musculus
ggcacgagccggtcaagatgatgaa

SEQ ID NO: 118579 - DNA, 25 bp, Mus musculus
ggcacgatccttcgattaaccacat

SEQ ID NO: 118580 - DNA, 25 bp, Mus musculus
ggcacgatgataccagaggccatgc

SEQ ID NO: 118581 - DNA, 25 bp, Mus musculus
ggcacgccaggaccttttccctaag

SEQ ID NO: 118582 - DNA, 25 bp, Mus musculus
ggcacgcgccgctcagcctgctgtc

SEQ ID NO: 118583 - DNA, 25 bp, Mus musculus
ggcacgctgaagagcagacacaaca

SEQ ID NO: 118584 - DNA, 25 bp, Mus musculus
ggcacgctggagtatcacaacgcta

SEQ ID NO: 118585 - DNA, 25 bp, Mus musculus
ggcacgctggtggacaatttatcta

SEQ ID NO: 118586 - DNA, 25 bp, Mus musculus
ggcacggtgcctttgtacctcagat

SEQ ID NO: 118587 - DNA, 25 bp, Mus musculus
ggcacgtcctacaccactactacgt

SEQ ID NO: 118588 - DNA, 25 bp, Mus musculus
ggcacgtctccggatcttgcaggaa

SEQ ID NO: 118589 - DNA, 25 bp, Mus musculus
ggcacgtgactttcgcatccctgat

SEQ ID NO: 118590 - DNA, 25 bp, Mus musculus
ggcactaaacctgttactggtggac

SEQ ID NO: 118591 - DNA, 25 bp, Mus musculus
ggcactacgacccagacttcttgcg

SEQ ID NO: 118592 - DNA, 25 bp, Mus musculus
ggcactaggccagatcttcaacaag

SEQ ID NO: 118593 - DNA, 25 bp, Mus musculus
ggcactatgatagacctggacccag

SEQ ID NO: 118594 - DNA, 25 bp, Mus musculus
ggcactcaggctattggagaactaa

SEQ ID NO: 118595 - DNA, 25 bp, Mus musculus
ggcactcccatgactgatttgacag

SEQ ID NO: 118596 - DNA, 25 bp, Mus musculus
ggcactcttcagactgcattgggaa

SEQ ID NO: 118597 - DNA, 25 bp, Mus musculus
ggcactgaagcagcagcgatttcca

SEQ ID NO: 118598 - DNA, 25 bp, Mus musculus
ggcactgaatcaaagccacaggtgg

SEQ ID NO: 118599 - DNA, 25 bp, Mus musculus
ggcactgactacagcaggtggagat

SEQ ID NO: 118600 - DNA, 25 bp, Mus musculus
ggcactgatggaggacactatgacg

SEQ ID NO: 118601 - DNA, 25 bp, Mus musculus
ggcactgatggctcacactactgga

SEQ ID NO: 118602 - DNA, 25 bp, Mus musculus
ggcactgcaaaaccaaaccggagct

SEQ ID NO: 118603 - DNA, 25 bp, Mus musculus
ggcactgcagtactcaccggagaaa

SEQ ID NO: 118604 - DNA, 25 bp, Mus musculus
ggcactggaaaatggactcaactga

SEQ ID NO: 118605 - DNA, 25 bp, Mus musculus
ggcactgggcaagatgatcggctct

SEQ ID NO: 118606 - DNA, 25 bp, Mus musculus
ggcactgtcaggaattttaccgagc

SEQ ID NO: 118607 - DNA, 25 bp, Mus musculus
ggcactgtcaggacccgggagactc

SEQ ID NO: 118608 - DNA, 25 bp, Mus musculus
ggcacttgaccttcgcttatcggag

SEQ ID NO: 118609 - DNA, 25 bp, Mus musculus
ggcacttgacgagcatcacctctta

SEQ ID NO: 118610 - DNA, 25 bp, Mus musculus
ggcactttccgcatggttcctgaag

SEQ ID NO: 118611 - DNA, 25 bp, Mus musculus
ggcagaaactgatcacctaaatggt

SEQ ID NO: 118612 - DNA, 25 bp, Mus musculus
ggcagaacacatgcaacccttggag

SEQ ID NO: 118613 - DNA, 25 bp, Mus musculus
ggcagaaccaagagcagtttctgct

SEQ ID NO: 118614 - DNA, 25 bp, Mus musculus
ggcagaacttcaggacaagtaccag

SEQ ID NO: 118615 - DNA, 25 bp, Mus musculus
ggcagaagatctttctgtacttgaa

SEQ ID NO: 118616 - DNA, 25 bp, Mus musculus
ggcagaagcctttgcaggtatcaaa

SEQ ID NO: 118617 - DNA, 25 bp, Mus musculus
ggcagaagcttcaatcaggacagat

SEQ ID NO: 118618 - DNA, 25 bp, Mus musculus
ggcagaaggctgtcttctactgcgg

SEQ ID NO: 118619 - DNA, 25 bp, Mus musculus
ggcagaagtcaaactcccagtgtga

SEQ ID NO: 118620 - DNA, 25 bp, Mus musculus
ggcagaatccgacagtaatggcagt

SEQ ID NO: 118621 - DNA, 25 bp, Mus musculus
ggcagaatggaatactctccacccc

SEQ ID NO: 118622 - DNA, 25 bp, Mus musculus
ggcagacaacatcatccaggcagga

SEQ ID NO: 118623 - DNA, 25 bp, Mus musculus
ggcagacaagtccagagtttccaag

SEQ ID NO: 118624 - DNA, 25 bp, Mus musculus
ggcagacacctcactaaagcgctgg

SEQ ID NO: 118625 - DNA, 25 bp, Mus musculus
ggcagacaggttttcacagtgactc

SEQ ID NO: 118626 - DNA, 25 bp, Mus musculus
ggcagaccgaaaccacgagaagaat

SEQ ID NO: 118627 - DNA, 25 bp, Mus musculus
ggcagacctggctcaaatacaacga

SEQ ID NO: 118628 - DNA, 25 bp, Mus musculus
ggcagacgccccaagattgttgtga

SEQ ID NO: 118629 - DNA, 25 bp, Mus musculus
ggcagactttcctcccagcaatgat

SEQ ID NO: 118630 - DNA, 25 bp, Mus musculus
ggcagagaagttccgccctgacatg

SEQ ID NO: 118631 - DNA, 25 bp, Mus musculus
ggcagagaatctttgaccaccaccg

SEQ ID NO: 118632 - DNA, 25 bp, Mus musculus
ggcagagagagatctggaataaaac

SEQ ID NO: 118633 - DNA, 25 bp, Mus musculus
ggcagagctcacgttgcattgaaga

SEQ ID NO: 118634 - DNA, 25 bp, Mus musculus
ggcagagctggcgacaagaccccaa

SEQ ID NO: 118635 - DNA, 25 bp, Mus musculus
ggcagaggaggtgaacagatctcac

SEQ ID NO: 118636 - DNA, 25 bp, Mus musculus
ggcagagggcgctttaatttcaaaa

SEQ ID NO: 118637 - DNA, 25 bp, Mus musculus
ggcagagtacctcccttcagcaggg

SEQ ID NO: 118638 - DNA, 25 bp, Mus musculus
ggcagagtctagacagtatgttcat

SEQ ID NO: 118639 - DNA, 25 bp, Mus musculus
ggcagagtgccaagaaaccatgact

SEQ ID NO: 118640 - DNA, 25 bp, Mus musculus
ggcagagttcttcgcgcttcaggac

SEQ ID NO: 118641 - DNA, 25 bp, Mus musculus
ggcagataaggttctacctcagcga

SEQ ID NO: 118642 - DNA, 25 bp, Mus musculus
ggcagatccagcgttgagaaacaag

SEQ ID NO: 118643 - DNA, 25 bp, Mus musculus
ggcagatcccaccattagcctgtaa

SEQ ID NO: 118644 - DNA, 25 bp, Mus musculus
ggcagatccccctctacatagacga

SEQ ID NO: 118645 - DNA, 25 bp, Mus musculus
ggcagatcttcacagctttcgacgt

SEQ ID NO: 118646 - DNA, 25 bp, Mus musculus
ggcagatgttcagatatatcttgaa

SEQ ID NO: 118647 - DNA, 25 bp, Mus musculus
ggcagattgtcaccacagtagagaa

SEQ ID NO: 118648 - DNA, 25 bp, Mus musculus
ggcagcaagatcagcgagatccggc

SEQ ID NO: 118649 - DNA, 25 bp, Mus musculus
ggcagcaagcgttcacagtccgtga

SEQ ID NO: 118650 - DNA, 25 bp, Mus musculus
ggcagcacggcttttccatggagat

SEQ ID NO: 118651 - DNA, 25 bp, Mus musculus
ggcagcagagctttgatctcttggt

SEQ ID NO: 118652 - DNA, 25 bp, Mus musculus
ggcagcagccatgtctggatcacat

SEQ ID NO: 118653 - DNA, 25 bp, Mus musculus
ggcagcagctccatcgtgaacaagg

SEQ ID NO: 118654 - DNA, 25 bp, Mus musculus
ggcagcagtatcctctctgtacggg

SEQ ID NO: 118655 - DNA, 25 bp, Mus musculus
ggcagcagtcggagcttaacagcca

SEQ ID NO: 118656 - DNA, 25 bp, Mus musculus
ggcagcagtctcttccatccaggag

SEQ ID NO: 118657 - DNA, 25 bp, Mus musculus
ggcagcatcctgagttatgtcgtca

SEQ ID NO: 118658 - DNA, 25 bp, Mus musculus
ggcagcatggatcttcgaagccaag

SEQ ID NO: 118659 - DNA, 25 bp, Mus musculus
ggcagcatgtcaacgaccagaagga

SEQ ID NO: 118660 - DNA, 25 bp, Mus musculus
ggcagccaaggctaaactcacggag

SEQ ID NO: 118661 - DNA, 25 bp, Mus musculus
ggcagccactgaggaaatagtaatt

SEQ ID NO: 118662 - DNA, 25 bp, Mus musculus
ggcagccagcaagtgatccttatca

SEQ ID NO: 118663 - DNA, 25 bp, Mus musculus
ggcagcccccacttgtaacaggcat

SEQ ID NO: 118664 - DNA, 25 bp, Mus musculus
ggcagcccctcatgcataaagatgg

SEQ ID NO: 118665 - DNA, 25 bp, Mus musculus
ggcagccctagacgagcagatgcta

SEQ ID NO: 118666 - DNA, 25 bp, Mus musculus
ggcagccctagagttcataaatgga

SEQ ID NO: 118667 - DNA, 25 bp, Mus musculus
ggcagcctctagtagtgaccacaag

SEQ ID NO: 118668 - DNA, 25 bp, Mus musculus
ggcagcctctgtaccatatgtcaaa

SEQ ID NO: 118669 - DNA, 25 bp, Mus musculus
ggcagcctgcctcagtttaggaaca

SEQ ID NO: 118670 - DNA, 25 bp, Mus musculus
ggcagcctgcgccacagtaaagtgt

SEQ ID NO: 118671 - DNA, 25 bp, Mus musculus
ggcagcgatgccaggatgcccgtct

SEQ ID NO: 118672 - DNA, 25 bp, Mus musculus
ggcagcggcatttaccatatcaaag

SEQ ID NO: 118673 - DNA, 25 bp, Mus musculus
ggcagcggccgaacaatgaagctct

SEQ ID NO: 118674 - DNA, 25 bp, Mus musculus
ggcagcgtgcttcgctcaattggca

SEQ ID NO: 118675 - DNA, 25 bp, Mus musculus
ggcagctaatgatggccccatgccc

SEQ ID NO: 118676 - DNA, 25 bp, Mus musculus
ggcagctacctcagtcgcgttaaac

SEQ ID NO: 118677 - DNA, 25 bp, Mus musculus
ggcagctataaagggacggtatcca

SEQ ID NO: 118678 - DNA, 25 bp, Mus musculus
ggcagctcctccgtattctgcaaag

SEQ ID NO: 118679 - DNA, 25 bp, Mus musculus
ggcagctgacagacctgtgcaccaa

SEQ ID NO: 118680 - DNA, 25 bp, Mus musculus
ggcagctgcttatcttgacccaaac

SEQ ID NO: 118681 - DNA, 25 bp, Mus musculus
ggcagcttagatgcgccacggcttc

SEQ ID NO: 118682 - DNA, 25 bp, Mus musculus
ggcagcttccagatgatcttccgaa

SEQ ID NO: 118683 - DNA, 25 bp, Mus musculus
ggcagcttcgccagctactggaaaa

SEQ ID NO: 118684 - DNA, 25 bp, Mus musculus
ggcaggacccaccagttaaagaaat

SEQ ID NO: 118685 - DNA, 25 bp, Mus musculus
ggcaggactcatgctagtgcagaac

SEQ ID NO: 118686 - DNA, 25 bp, Mus musculus
ggcaggagagacaccagattgtaat

SEQ ID NO: 118687 - DNA, 25 bp, Mus musculus
ggcaggagctgtggtaacatactac

SEQ ID NO: 118688 - DNA, 25 bp, Mus musculus
ggcaggagtcccatgcatagagtca

SEQ ID NO: 118689 - DNA, 25 bp, Mus musculus
ggcaggcacactggtaacggacata

SEQ ID NO: 118690 - DNA, 25 bp, Mus musculus
ggcaggcacacttgagaagacacgt

SEQ ID NO: 118691 - DNA, 25 bp, Mus musculus
ggcaggcaggatcttctacttcagt

SEQ ID NO: 118692 - DNA, 25 bp, Mus musculus
ggcaggccgcatctctgaatacgat

SEQ ID NO: 118693 - DNA, 25 bp, Mus musculus
ggcaggcctcctatctccattacag

SEQ ID NO: 118694 - DNA, 25 bp, Mus musculus
ggcagggatcctccggtgcttcctt

SEQ ID NO: 118695 - DNA, 25 bp, Mus musculus
ggcagggtaccagacttgtgtttct

SEQ ID NO: 118696 - DNA, 25 bp, Mus musculus
ggcagggtcaccatttgcagcgcga

SEQ ID NO: 118697 - DNA, 25 bp, Mus musculus
ggcagggtggtcaacatgtccagct

SEQ ID NO: 118698 - DNA, 25 bp, Mus musculus
ggcaggtacgccaactctttgagaa

SEQ ID NO: 118699 - DNA, 25 bp, Mus musculus
ggcaggtacttcagcaggacggcta

SEQ ID NO: 118700 - DNA, 25 bp, Mus musculus
ggcaggtgaacagaaaccctcaagt

SEQ ID NO: 118701 - DNA, 25 bp, Mus musculus
ggcagtaaaatcaacccgaggcttt

SEQ ID NO: 118702 - DNA, 25 bp, Mus musculus
ggcagtacagcaggaatgagcccct

SEQ ID NO: 118703 - DNA, 25 bp, Mus musculus
ggcagtacatccctgttaaagtgaa

SEQ ID NO: 118704 - DNA, 25 bp, Mus musculus
ggcagtactgtccagatgatatctg

SEQ ID NO: 118705 - DNA, 25 bp, Mus musculus
ggcagtacttgggatcagggctact

SEQ ID NO: 118706 - DNA, 25 bp, Mus musculus
ggcagtatcccacgcgaatttaaac

SEQ ID NO: 118707 - DNA, 25 bp, Mus musculus
ggcagtatgtccttccccttcagaa

SEQ ID NO: 118708 - DNA, 25 bp, Mus musculus
ggcagtatgtggtgaacttggattc

SEQ ID NO: 118709 - DNA, 25 bp, Mus musculus
ggcagtcaactgaacccaacctgga

SEQ ID NO: 118710 - DNA, 25 bp, Mus musculus
ggcagtcccctttgcattgaagaaa

SEQ ID NO: 118711 - DNA, 25 bp, Mus musculus
ggcagtccgcagcatcatggttgca

SEQ ID NO: 118712 - DNA, 25 bp, Mus musculus
ggcagtcctgctctacatcttcggg

SEQ ID NO: 118713 - DNA, 25 bp, Mus musculus
ggcagtcgcgaatgtttctgcttga

SEQ ID NO: 118714 - DNA, 25 bp, Mus musculus
ggcagtcggcttgggaacacgaaca

SEQ ID NO: 118715 - DNA, 25 bp, Mus musculus
ggcagtctcgccatggcttgctaca

SEQ ID NO: 118716 - DNA, 25 bp, Mus musculus
ggcagtctgctcaagccaggaggct

SEQ ID NO: 118717 - DNA, 25 bp, Mus musculus
ggcagtctggtcatcaggccttaca

SEQ ID NO: 118718 - DNA, 25 bp, Mus musculus
ggcagtgaagctggctgaccagcca

SEQ ID NO: 118719 - DNA, 25 bp, Mus musculus
ggcagtgacgtgtcccttcctcaga

SEQ ID NO: 118720 - DNA, 25 bp, Mus musculus
ggcagtgactaagtggccaccttct

SEQ ID NO: 118721 - DNA, 25 bp, Mus musculus
ggcagtgactgtatgttcgaaatca

SEQ ID NO: 118722 - DNA, 25 bp, Mus musculus
ggcagtgccatctgctctgcagcct

SEQ ID NO: 118723 - DNA, 25 bp, Mus musculus
ggcagtgccctaagctgttcaacaa

SEQ ID NO: 118724 - DNA, 25 bp, Mus musculus
ggcagtgcggcaacaatatcgtcct

SEQ ID NO: 118725 - DNA, 25 bp, Mus musculus
ggcagtgcgtgaggtgttccacaca

SEQ ID NO: 118726 - DNA, 25 bp, Mus musculus
ggcagtggccacatactttctcaga

SEQ ID NO: 118727 - DNA, 25 bp, Mus musculus
ggcagtggcctaaacaataccctta

SEQ ID NO: 118728 - DNA, 25 bp, Mus musculus
ggcagtgttaccagaatcccggagg

SEQ ID NO: 118729 - DNA, 25 bp, Mus musculus
ggcagttagtgcttccctcgagccg

SEQ ID NO: 118730 - DNA, 25 bp, Mus musculus
ggcagttcactacacggtcggctgt

SEQ ID NO: 118731 - DNA, 25 bp, Mus musculus
ggcagttctacactactaccatggg

SEQ ID NO: 118732 - DNA, 25 bp, Mus musculus
ggcagttctttcatgtgtcgccaga

SEQ ID NO: 118733 - DNA, 25 bp, Mus musculus
ggcagttgcctttatcactcaggac

SEQ ID NO: 118734 - DNA, 25 bp, Mus musculus
ggcagtttctgaacccaaacaagga

SEQ ID NO: 118735 - DNA, 25 bp, Mus musculus
ggcagtttctgaacctcaggctcct

SEQ ID NO: 118736 - DNA, 25 bp, Mus musculus
ggcagtttgtccctgaagatctcaa

SEQ ID NO: 118737 - DNA, 25 bp, Mus musculus
ggcataagacttggagccgaccctg

SEQ ID NO: 118738 - DNA, 25 bp, Mus musculus
ggcatacaacatgtcttcacggaga

SEQ ID NO: 118739 - DNA, 25 bp, Mus musculus
ggcatacagcctcataggaccggaa

SEQ ID NO: 118740 - DNA, 25 bp, Mus musculus
ggcatacagctacatccaggagaga

SEQ ID NO: 118741 - DNA, 25 bp, Mus musculus
ggcatagataagaccaatggtgtcc

SEQ ID NO: 118742 - DNA, 25 bp, Mus musculus
ggcatagatggaagccaggcctaca

SEQ ID NO: 118743 - DNA, 25 bp, Mus musculus
ggcatagatgttcctgtccagcgtc

SEQ ID NO: 118744 - DNA, 25 bp, Mus musculus
ggcatatgccaggaacctgtcggct

SEQ ID NO: 118745 - DNA, 25 bp, Mus musculus
ggcatattgctacgccagcgcagag

SEQ ID NO: 118746 - DNA, 25 bp, Mus musculus
ggcatcaaactcaagaggttcactt

SEQ ID NO: 118747 - DNA, 25 bp, Mus musculus
ggcatcaaagtgagaatacagattt

SEQ ID NO: 118748 - DNA, 25 bp, Mus musculus
ggcatcaaatgccagccttggaatt

SEQ ID NO: 118749 - DNA, 25 bp, Mus musculus
ggcatcacacacactcgagcaattg

SEQ ID NO: 118750 - DNA, 25 bp, Mus musculus
ggcatcaccaaacgctgtcagtcat

SEQ ID NO: 118751 - DNA, 25 bp, Mus musculus
ggcatcagccgtccaaaccaaatgt

SEQ ID NO: 118752 - DNA, 25 bp, Mus musculus
ggcatcagcgcagctacctgtagca

SEQ ID NO: 118753 - DNA, 25 bp, Mus musculus
ggcatcatgggcttcctgaagttct

SEQ ID NO: 118754 - DNA, 25 bp, Mus musculus
ggcatcatgtggatccaggttcgaa

SEQ ID NO: 118755 - DNA, 25 bp, Mus musculus
ggcatccaagatggcgacatcatcg

SEQ ID NO: 118756 - DNA, 25 bp, Mus musculus
ggcatccacagtacggcacaaaagt

SEQ ID NO: 118757 - DNA, 25 bp, Mus musculus
ggcatccacctctacagaatacagg

SEQ ID NO: 118758 - DNA, 25 bp, Mus musculus
ggcatccaggctcagaatggcacta

SEQ ID NO: 118759 - DNA, 25 bp, Mus musculus
ggcatccagggagctccacttgtca

SEQ ID NO: 118760 - DNA, 25 bp, Mus musculus
ggcatcccaagcatcatccatacgt

SEQ ID NO: 118761 - DNA, 25 bp, Mus musculus
ggcatcccatgcctgaaggagctaa

SEQ ID NO: 118762 - DNA, 25 bp, Mus musculus
ggcatccccatccaattgtcagagg

SEQ ID NO: 118763 - DNA, 25 bp, Mus musculus
ggcatccggaccctcccagatgttt

SEQ ID NO: 118764 - DNA, 25 bp, Mus musculus
ggcatcctcatttccactcagcggg

SEQ ID NO: 118765 - DNA, 25 bp, Mus musculus
ggcatccttcttgagcaccgagaaa

SEQ ID NO: 118766 - DNA, 25 bp, Mus musculus
ggcatccttttctgcggataccctc

SEQ ID NO: 118767 - DNA, 25 bp, Mus musculus
ggcatcgaccttcatcccactgtgg

SEQ ID NO: 118768 - DNA, 25 bp, Mus musculus
ggcatcgctaccctggtctctggca

SEQ ID NO: 118769 - DNA, 25 bp, Mus musculus
ggcatcgctggctcggccctgtcgt

SEQ ID NO: 118770 - DNA, 25 bp, Mus musculus
ggcatcgtagctgggatcttcctca

SEQ ID NO: 118771 - DNA, 25 bp, Mus musculus
ggcatcgtggctactgctggacgtt

SEQ ID NO: 118772 - DNA, 25 bp, Mus musculus
ggcatctacaacacaacagagctgg

SEQ ID NO: 118773 - DNA, 25 bp, Mus musculus
ggcatctctacctctcaagggctaa

SEQ ID NO: 118774 - DNA, 25 bp, Mus musculus
ggcatctcttaatgcgggcctggat

SEQ ID NO: 118775 - DNA, 25 bp, Mus musculus
ggcatctgagaatggaagccagacc

SEQ ID NO: 118776 - DNA, 25 bp, Mus musculus
ggcatctgattacccacagtaaggg

SEQ ID NO: 118777 - DNA, 25 bp, Mus musculus
ggcatctggctctgtttattctccg

SEQ ID NO: 118778 - DNA, 25 bp, Mus musculus
ggcatctggtattgaccaccctctg

SEQ ID NO: 118779 - DNA, 25 bp, Mus musculus
ggcatctgtcagtatccccaggagg

SEQ ID NO: 118780 - DNA, 25 bp, Mus musculus
ggcatgaaccgctacgccatggact

SEQ ID NO: 118781 - DNA, 25 bp, Mus musculus
ggcatgaactgcactactgagaaca

SEQ ID NO: 118782 - DNA, 25 bp, Mus musculus
ggcatgatcgttaccaaccctggga

SEQ ID NO: 118783 - DNA, 25 bp, Mus musculus
ggcatgatgcaaccaactgacataa

SEQ ID NO: 118784 - DNA, 25 bp, Mus musculus
ggcatgattgagagactgtcccctg

SEQ ID NO: 118785 - DNA, 25 bp, Mus musculus
ggcatgccccggacactgactgcct

SEQ ID NO: 118786 - DNA, 25 bp, Mus musculus
ggcatgcccggcagatcaatacgct

SEQ ID NO: 118787 - DNA, 25 bp, Mus musculus
ggcatgctcagagtggtaccatcat

SEQ ID NO: 118788 - DNA, 25 bp, Mus musculus
ggcatgctcagctggccatacagaa

SEQ ID NO: 118789 - DNA, 25 bp, Mus musculus
ggcatgctgaattcgccataatcaa

SEQ ID NO: 118790 - DNA, 25 bp, Mus musculus
ggcatgctgcgtcccaaggctttga

SEQ ID NO: 118791 - DNA, 25 bp, Mus musculus
ggcatgctgggaacgctagcccttc

SEQ ID NO: 118792 - DNA, 25 bp, Mus musculus
ggcatgcttcccctgacactgtggg

SEQ ID NO: 118793 - DNA, 25 bp, Mus musculus
ggcatgctttaatctcccgagaagc

SEQ ID NO: 118794 - DNA, 25 bp, Mus musculus
ggcatggcgcattacaacttcaaga

SEQ ID NO: 118795 - DNA, 25 bp, Mus musculus
ggcatggctggcataaagagaccct

SEQ ID NO: 118796 - DNA, 25 bp, Mus musculus
ggcatggctggtgtgtcctcggagg

SEQ ID NO: 118797 - DNA, 25 bp, Mus musculus
ggcatgggcctgtctcctgataaca

SEQ ID NO: 118798 - DNA, 25 bp, Mus musculus
ggcattagacgtgagcgctcagcgc

SEQ ID NO: 118799 - DNA, 25 bp, Mus musculus
ggcattagccccagaagaagtgatt

SEQ ID NO: 118800 - DNA, 25 bp, Mus musculus
ggcattagcccccttcagcaaatgg

SEQ ID NO: 118801 - DNA, 25 bp, Mus musculus
ggcattagtccaaggtgtttccgat

SEQ ID NO: 118802 - DNA, 25 bp, Mus musculus
ggcattatgcacctgtacaagacaa

SEQ ID NO: 118803 - DNA, 25 bp, Mus musculus
ggcattccagtcgtcaacggcgaga

SEQ ID NO: 118804 - DNA, 25 bp, Mus musculus
ggcattcctgatactcttcagtgtg

SEQ ID NO: 118805 - DNA, 25 bp, Mus musculus
ggcattcggctactgaaaaccatca

SEQ ID NO: 118806 - DNA, 25 bp, Mus musculus
ggcattgccttctggtccctggtga

SEQ ID NO: 118807 - DNA, 25 bp, Mus musculus
ggcattgccttttcgggccgccaaa

SEQ ID NO: 118808 - DNA, 25 bp, Mus musculus
ggcattgtcatttgcggcagcgcag

SEQ ID NO: 118809 - DNA, 25 bp, Mus musculus
ggcatttcaaatggcgttggcacgc

SEQ ID NO: 118810 - DNA, 25 bp, Mus musculus
ggcatttgacaaggcagaccgggaa

SEQ ID NO: 118811 - DNA, 25 bp, Mus musculus
ggcatttgtacaagccgcacgggca

SEQ ID NO: 118812 - DNA, 25 bp, Mus musculus
ggcatttgtggtcagagagctccca

SEQ ID NO: 118813 - DNA, 25 bp, Mus musculus
ggcattttaaccacatgagctcctc

SEQ ID NO: 118814 - DNA, 25 bp, Mus musculus
ggccaaaccaaataacatctttcag

SEQ ID NO: 118815 - DNA, 25 bp, Mus musculus
ggccaaaggctagggtccagagact

SEQ ID NO: 118816 - DNA, 25 bp, Mus musculus
ggccaaagtcactaaccccaagtga

SEQ ID NO: 118817 - DNA, 25 bp, Mus musculus
ggccaaagttataaccactgtcctg

SEQ ID NO: 118818 - DNA, 25 bp, Mus musculus
ggccaaccgcctgatcaaaaagtaa

SEQ ID NO: 118819 - DNA, 25 bp, Mus musculus
ggccaacctgtccacttcaagatga

SEQ ID NO: 118820 - DNA, 25 bp, Mus musculus
ggccaaccttggaatctgtccggaa

SEQ ID NO: 118821 - DNA, 25 bp, Mus musculus
ggccaacgaacaggcgctggcgtct

SEQ ID NO: 118822 - DNA, 25 bp, Mus musculus
ggccaagacgctcatctcagctgca

SEQ ID NO: 118823 - DNA, 25 bp, Mus musculus
ggccaagccctcttgtgattaagca

SEQ ID NO: 118824 - DNA, 25 bp, Mus musculus
ggccaagcgcaaaggagtgcactgc

SEQ ID NO: 118825 - DNA, 25 bp, Mus musculus
ggccaagcgtggaacccacatactg

SEQ ID NO: 118826 - DNA, 25 bp, Mus musculus
ggccaaggcaccactctcacagtct

SEQ ID NO: 118827 - DNA, 25 bp, Mus musculus
ggccaagggaccagtaacagacgtg

SEQ ID NO: 118828 - DNA, 25 bp, Mus musculus
ggccaagtcccatggccagctcagg

SEQ ID NO: 118829 - DNA, 25 bp, Mus musculus
ggccaagtgcagacgctgtgtcctg

SEQ ID NO: 118830 - DNA, 25 bp, Mus musculus
ggccaagtgctgatattcctgggtc

SEQ ID NO: 118831 - DNA, 25 bp, Mus musculus
ggccaagttctaccccgaagacgtg

SEQ ID NO: 118832 - DNA, 25 bp, Mus musculus
ggccaagttctgctatgctgataag

SEQ ID NO: 118833 - DNA, 25 bp, Mus musculus
ggccaatagaatagcctcagaggca

SEQ ID NO: 118834 - DNA, 25 bp, Mus musculus
ggccaatgatggatcattacttgaa

SEQ ID NO: 118835 - DNA, 25 bp, Mus musculus
ggccaatgccaacaaccctatgaat

SEQ ID NO: 118836 - DNA, 25 bp, Mus musculus
ggccaatggcgtatactcagctgca

SEQ ID NO: 118837 - DNA, 25 bp, Mus musculus
ggccacaatccttgcagctgacagt

SEQ ID NO: 118838 - DNA, 25 bp, Mus musculus
ggccaccaaagcactgtagaagaca

SEQ ID NO: 118839 - DNA, 25 bp, Mus musculus
ggccaccactttcttgttgatgagg

SEQ ID NO: 118840 - DNA, 25 bp, Mus musculus
ggccaccagcagtttatccagcaga

SEQ ID NO: 118841 - DNA, 25 bp, Mus musculus
ggccacccaggatcaaggtcggaaa

SEQ ID NO: 118842 - DNA, 25 bp, Mus musculus
ggccaccctgcctataatgtgagaa

SEQ ID NO: 118843 - DNA, 25 bp, Mus musculus
ggccacctcgaagcatcaaggacat

SEQ ID NO: 118844 - DNA, 25 bp, Mus musculus
ggccacctggtattctcgctcaagt

SEQ ID NO: 118845 - DNA, 25 bp, Mus musculus
ggccacggcgcgatggagtcgccgg

SEQ ID NO: 118846 - DNA, 25 bp, Mus musculus
ggccacgggccagctaactttctat

SEQ ID NO: 118847 - DNA, 25 bp, Mus musculus
ggccactccggaaagagccggaaat

SEQ ID NO: 118848 - DNA, 25 bp, Mus musculus
ggccactgtgggaaactcatacaag

SEQ ID NO: 118849 - DNA, 25 bp, Mus musculus
ggccacttcactgggttcaacggaa

SEQ ID NO: 118850 - DNA, 25 bp, Mus musculus
ggccactttgaaccagatgatggaa

SEQ ID NO: 118851 - DNA, 25 bp, Mus musculus
ggccagaactttatccccatcagaa

SEQ ID NO: 118852 - DNA, 25 bp, Mus musculus
ggccagaagccaaagaagcgcaaga

SEQ ID NO: 118853 - DNA, 25 bp, Mus musculus
ggccagacgaggagaaaacgcatca

SEQ ID NO: 118854 - DNA, 25 bp, Mus musculus
ggccagagataagaagctgagtctg

SEQ ID NO: 118855 - DNA, 25 bp, Mus musculus
ggccagagatgaccctgccttctta

SEQ ID NO: 118856 - DNA, 25 bp, Mus musculus
ggccagataatcaccaaggaggact

SEQ ID NO: 118857 - DNA, 25 bp, Mus musculus
ggccagatgtggaaactcattagaa

SEQ ID NO: 118858 - DNA, 25 bp, Mus musculus
ggccagcaaataccaagtctcagtg

SEQ ID NO: 118859 - DNA, 25 bp, Mus musculus
ggccagcaagcccatgattcgtgat

SEQ ID NO: 118860 - DNA, 25 bp, Mus musculus
ggccagcacggtccagacatacagt

SEQ ID NO: 118861 - DNA, 25 bp, Mus musculus
ggccagcactgcttcgtctcagaag

SEQ ID NO: 118862 - DNA, 25 bp, Mus musculus
ggccagccagcgacgtcatgtgtgt

SEQ ID NO: 118863 - DNA, 25 bp, Mus musculus
ggccagccagcgggcgccattttga

SEQ ID NO: 118864 - DNA, 25 bp, Mus musculus
ggccagccgaggcaacgaaatcgtt

SEQ ID NO: 118865 - DNA, 25 bp, Mus musculus
ggccagccgctgtcctacaagttag

SEQ ID NO: 118866 - DNA, 25 bp, Mus musculus
ggccagctaacatctaatagtcagc

SEQ ID NO: 118867 - DNA, 25 bp, Mus musculus
ggccagctaagctatatggacccag

SEQ ID NO: 118868 - DNA, 25 bp, Mus musculus
ggccagctactgtgggcacacggaa

SEQ ID NO: 118869 - DNA, 25 bp, Mus musculus
ggccagcttgggaggtttcctctac

SEQ ID NO: 118870 - DNA, 25 bp, Mus musculus
ggccaggatccagcccttagagtaa

SEQ ID NO: 118871 - DNA, 25 bp, Mus musculus
ggccaggatctgtaggagatgaact

SEQ ID NO: 118872 - DNA, 25 bp, Mus musculus
ggccaggcggcactcagatttcagt

SEQ ID NO: 118873 - DNA, 25 bp, Mus musculus
ggccagggccttaagcgagttgtca

SEQ ID NO: 118874 - DNA, 25 bp, Mus musculus
ggccagggccttctgcggtacaata

SEQ ID NO: 118875 - DNA, 25 bp, Mus musculus
ggccagtaatagagaaaaggattca

SEQ ID NO: 118876 - DNA, 25 bp, Mus musculus
ggccagtactccgtgtcagacatga

SEQ ID NO: 118877 - DNA, 25 bp, Mus musculus
ggccagtcaacattccccggaaaga

SEQ ID NO: 118878 - DNA, 25 bp, Mus musculus
ggccagtcaagagctgttcacgagt

SEQ ID NO: 118879 - DNA, 25 bp, Mus musculus
ggccagtcggaattccgcttcccgt

SEQ ID NO: 118880 - DNA, 25 bp, Mus musculus
ggccagtctcagtttccctagggaa

SEQ ID NO: 118881 - DNA, 25 bp, Mus musculus
ggccagttacctagtgtcctaccaa

SEQ ID NO: 118882 - DNA, 25 bp, Mus musculus
ggccagttgccccagttcgagtgtt

SEQ ID NO: 118883 - DNA, 25 bp, Mus musculus
ggccagtttgagtgatacagccaac

SEQ ID NO: 118884 - DNA, 25 bp, Mus musculus
ggccagtttgtagcacccagtgata

SEQ ID NO: 118885 - DNA, 25 bp, Mus musculus
ggccatagatctaccttgccttctg

SEQ ID NO: 118886 - DNA, 25 bp, Mus musculus
ggccatattgccgagctgtctgcgg

SEQ ID NO: 118887 - DNA, 25 bp, Mus musculus
ggccatcaaatattaccgggaagca

SEQ ID NO: 118888 - DNA, 25 bp, Mus musculus
ggccatcaagccatactaccagaag

SEQ ID NO: 118889 - DNA, 25 bp, Mus musculus
ggccatcagtttggtgtgtgaagct

SEQ ID NO: 118890 - DNA, 25 bp, Mus musculus
ggccatccaacactcagaacactgt

SEQ ID NO: 118891 - DNA, 25 bp, Mus musculus
ggccatcccgcttcattgtgagcag

SEQ ID NO: 118892 - DNA, 25 bp, Mus musculus
ggccatcggcgcttccattgctgtt

SEQ ID NO: 118893 - DNA, 25 bp, Mus musculus
ggccatcttgttcttctcgtggttc

SEQ ID NO: 118894 - DNA, 25 bp, Mus musculus
ggccatctttgcctgctactgctag

SEQ ID NO: 118895 - DNA, 25 bp, Mus musculus
ggccatgaagtagctgcggccgcca

SEQ ID NO: 118896 - DNA, 25 bp, Mus musculus
ggccatgaatttgacctctatgaaa

SEQ ID NO: 118897 - DNA, 25 bp, Mus musculus
ggccatgatccccaagtgtgtgtgt

SEQ ID NO: 118898 - DNA, 25 bp, Mus musculus
ggccatgcacctgatcaagaagcgt

SEQ ID NO: 118899 - DNA, 25 bp, Mus musculus
ggccatgcccggctgcattctgagg

SEQ ID NO: 118900 - DNA, 25 bp, Mus musculus
ggccatgctgaaacagatgaacagt

SEQ ID NO: 118901 - DNA, 25 bp, Mus musculus
ggccatggcatgagttcacagaata

SEQ ID NO: 118902 - DNA, 25 bp, Mus musculus
ggccatggccatgggcagcgtggag

SEQ ID NO: 118903 - DNA, 25 bp, Mus musculus
ggccatggcgaaaaagagcgctgaa

SEQ ID NO: 118904 - DNA, 25 bp, Mus musculus
ggccatggggcagcgaccgggggtt

SEQ ID NO: 118905 - DNA, 25 bp, Mus musculus
ggccatgtgctcagaacggtgacaa

SEQ ID NO: 118906 - DNA, 25 bp, Mus musculus
ggccattcataaccccagtccgtgg

SEQ ID NO: 118907 - DNA, 25 bp, Mus musculus
ggccattcctgtgcgccatggacga

SEQ ID NO: 118908 - DNA, 25 bp, Mus musculus
ggccattcttcaatgagagggtggt

SEQ ID NO: 118909 - DNA, 25 bp, Mus musculus
ggccattgattttacccaagaagaa

SEQ ID NO: 118910 - DNA, 25 bp, Mus musculus
ggccattgcctggagcaaccagaca

SEQ ID NO: 118911 - DNA, 25 bp, Mus musculus
ggccattttggcacagactcgtctg

SEQ ID NO: 118912 - DNA, 25 bp, Mus musculus
ggcccaaatcatcgacaccagaaga

SEQ ID NO: 118913 - DNA, 25 bp, Mus musculus
ggcccaagcggttctaccaggaata

SEQ ID NO: 118914 - DNA, 25 bp, Mus musculus
ggcccaccgtgtttcgatggacagg

SEQ ID NO: 118915 - DNA, 25 bp, Mus musculus
ggcccacgaggattaagaggacttc

SEQ ID NO: 118916 - DNA, 25 bp, Mus musculus
ggcccacgggagaagagaaacctca

SEQ ID NO: 118917 - DNA, 25 bp, Mus musculus
ggcccagaacagagaatccttaagg

SEQ ID NO: 118918 - DNA, 25 bp, Mus musculus
ggcccagaagcctatagacacatga

SEQ ID NO: 118919 - DNA, 25 bp, Mus musculus
ggcccagacaagtacttgtcagata

SEQ ID NO: 118920 - DNA, 25 bp, Mus musculus
ggcccagatgttccgtcaagtccta

SEQ ID NO: 118921 - DNA, 25 bp, Mus musculus
ggcccagcaacttctagcaagcagg

SEQ ID NO: 118922 - DNA, 25 bp, Mus musculus
ggcccagcagggagtcgtatttata

SEQ ID NO: 118923 - DNA, 25 bp, Mus musculus
ggcccagcctgagtagacacttcag

SEQ ID NO: 118924 - DNA, 25 bp, Mus musculus
ggcccagcggcttattgagattctc

SEQ ID NO: 118925 - DNA, 25 bp, Mus musculus
ggcccagctgaacaggaacagaacc

SEQ ID NO: 118926 - DNA, 25 bp, Mus musculus
ggcccagctgcctgtagatgttgta

SEQ ID NO: 118927 - DNA, 25 bp, Mus musculus
ggcccagcttctcctaccttgataa

SEQ ID NO: 118928 - DNA, 25 bp, Mus musculus
ggcccaggagatacaatgcaggttg

SEQ ID NO: 118929 - DNA, 25 bp, Mus musculus
ggcccaggcactcactgaaagctga

SEQ ID NO: 118930 - DNA, 25 bp, Mus musculus
ggcccaggcttggattgcacaaaga

SEQ ID NO: 118931 - DNA, 25 bp, Mus musculus
ggcccaggtgggacttgatcgctcc

SEQ ID NO: 118932 - DNA, 25 bp, Mus musculus
ggcccagtacccaaacatatcgcgt

SEQ ID NO: 118933 - DNA, 25 bp, Mus musculus
ggcccagtcatccataatgctgaag

SEQ ID NO: 118934 - DNA, 25 bp, Mus musculus
ggcccagtgaacgtgtccaacaaat

SEQ ID NO: 118935 - DNA, 25 bp, Mus musculus
ggcccagtggcttccgtcaaggtta

SEQ ID NO: 118936 - DNA, 25 bp, Mus musculus
ggcccagttaaaatctgagagtgaa

SEQ ID NO: 118937 - DNA, 25 bp, Mus musculus
ggcccagttgatcagctatagcctg

SEQ ID NO: 118938 - DNA, 25 bp, Mus musculus
ggcccatcccagtcatgtgctcagt

SEQ ID NO: 118939 - DNA, 25 bp, Mus musculus
ggcccatgctatgtatccgggtatg

SEQ ID NO: 118940 - DNA, 25 bp, Mus musculus
ggcccattcctccagtacaactttg

SEQ ID NO: 118941 - DNA, 25 bp, Mus musculus
ggcccattcttgtgctgaaggacga

SEQ ID NO: 118942 - DNA, 25 bp, Mus musculus
ggccccaaactgcacaagaatgata

SEQ ID NO: 118943 - DNA, 25 bp, Mus musculus
ggccccaatttggtccctagcaggt

SEQ ID NO: 118944 - DNA, 25 bp, Mus musculus
ggccccactggtatccacattcttg

SEQ ID NO: 118945 - DNA, 25 bp, Mus musculus
ggccccagcaagaagtcagtcgtgt

SEQ ID NO: 118946 - DNA, 25 bp, Mus musculus
ggccccatgtgctaacaaagatgaa

SEQ ID NO: 118947 - DNA, 25 bp, Mus musculus
ggccccgaccagaggagtacgaatt

SEQ ID NO: 118948 - DNA, 25 bp, Mus musculus
ggccccgagttgaaaagagttgtct

SEQ ID NO: 118949 - DNA, 25 bp, Mus musculus
ggccccgccccttttactgtgaatg

SEQ ID NO: 118950 - DNA, 25 bp, Mus musculus
ggccccgtgagggttgtgcctcctg

SEQ ID NO: 118951 - DNA, 25 bp, Mus musculus
ggcccctagtcaccaggaaacaatg

SEQ ID NO: 118952 - DNA, 25 bp, Mus musculus
ggcccctctctctgcaagtgttaca

SEQ ID NO: 118953 - DNA, 25 bp, Mus musculus
ggcccctgcggtgaggacaaagatt

SEQ ID NO: 118954 - DNA, 25 bp, Mus musculus
ggcccctggcacttgaaaaatccct

SEQ ID NO: 118955 - DNA, 25 bp, Mus musculus
ggccccttgccactgaccaatggaa

SEQ ID NO: 118956 - DNA, 25 bp, Mus musculus
ggcccgagaacaacatcccatatgc

SEQ ID NO: 118957 - DNA, 25 bp, Mus musculus
ggcccgagacctgctagtagatgga

SEQ ID NO: 118958 - DNA, 25 bp, Mus musculus
ggcccgcgcctcatctaacaagagt

SEQ ID NO: 118959 - DNA, 25 bp, Mus musculus
ggcccggcaggcgccgaggaggaag

SEQ ID NO: 118960 - DNA, 25 bp, Mus musculus
ggcccggtgtccagtcaaggttaca

SEQ ID NO: 118961 - DNA, 25 bp, Mus musculus
ggcccgtgtcctggagagcttcaga

SEQ ID NO: 118962 - DNA, 25 bp, Mus musculus
ggccctacgcggccgcctaagcatg

SEQ ID NO: 118963 - DNA, 25 bp, Mus musculus
ggccctatcacagtcagaggctgag

SEQ ID NO: 118964 - DNA, 25 bp, Mus musculus
ggccctccaggcaagcataacatga

SEQ ID NO: 118965 - DNA, 25 bp, Mus musculus
ggccctcccatatggtcactgaaaa

SEQ ID NO: 118966 - DNA, 25 bp, Mus musculus
ggccctccgaggaatagacttggaa

SEQ ID NO: 118967 - DNA, 25 bp, Mus musculus
ggccctcctgagaaaccatggtgcg

SEQ ID NO: 118968 - DNA, 25 bp, Mus musculus
ggccctcgagggtcatatccaagca

SEQ ID NO: 118969 - DNA, 25 bp, Mus musculus
ggccctcgtggctcgtttgtataaa

SEQ ID NO: 118970 - DNA, 25 bp, Mus musculus
ggccctcgtgtggaatatgaagtac

SEQ ID NO: 118971 - DNA, 25 bp, Mus musculus
ggccctgaaccgagccatgagagaa

SEQ ID NO: 118972 - DNA, 25 bp, Mus musculus
ggccctgaacctcatccgtggagtt

SEQ ID NO: 118973 - DNA, 25 bp, Mus musculus
ggccctgatccctttgaacccttca

SEQ ID NO: 118974 - DNA, 25 bp, Mus musculus
ggccctggccaggtggcatccagta

SEQ ID NO: 118975 - DNA, 25 bp, Mus musculus
ggccctggcctcttagtcctggtta

SEQ ID NO: 118976 - DNA, 25 bp, Mus musculus
ggccctgggcatcacatgcgtgcaa

SEQ ID NO: 118977 - DNA, 25 bp, Mus musculus
ggccctgggcggtcttcgaattgaa

SEQ ID NO: 118978 - DNA, 25 bp, Mus musculus
ggccctgttcaccataggagcccag

SEQ ID NO: 118979 - DNA, 25 bp, Mus musculus
ggcccttcaagcatactgtggatga

SEQ ID NO: 118980 - DNA, 25 bp, Mus musculus
ggcccttcagcaagtattcccagaa

SEQ ID NO: 118981 - DNA, 25 bp, Mus musculus
ggcccttcggcttcctcaagtgcaa

SEQ ID NO: 118982 - DNA, 25 bp, Mus musculus
ggcccttgtgtctgctgattctcga

SEQ ID NO: 118983 - DNA, 25 bp, Mus musculus
ggccgaccggatcaaggcgttttat

SEQ ID NO: 118984 - DNA, 25 bp, Mus musculus
ggccgaggaaaagcagacgtcacct

SEQ ID NO: 118985 - DNA, 25 bp, Mus musculus
ggccgagtattatccagtccttcca

SEQ ID NO: 118986 - DNA, 25 bp, Mus musculus
ggccgagtgtttgtcctaccctgca

SEQ ID NO: 118987 - DNA, 25 bp, Mus musculus
ggccgcaagagaaacagtgccctct

SEQ ID NO: 118988 - DNA, 25 bp, Mus musculus
ggccgcacgagctttgacaggaaca

SEQ ID NO: 118989 - DNA, 25 bp, Mus musculus
ggccgcacgtgcaacaagacatcta

SEQ ID NO: 118990 - DNA, 25 bp, Mus musculus
ggccgcagcccttcgttggtactct

SEQ ID NO: 118991 - DNA, 25 bp, Mus musculus
ggccgcatcaccctggaagagtata

SEQ ID NO: 118992 - DNA, 25 bp, Mus musculus
ggccgcccatttggctccaaggtga

SEQ ID NO: 118993 - DNA, 25 bp, Mus musculus
ggccgcctctctatgcaggagttaa

SEQ ID NO: 118994 - DNA, 25 bp, Mus musculus
ggccgcgcgtgacgacgtctaggga

SEQ ID NO: 118995 - DNA, 25 bp, Mus musculus
ggccgctttccccagagaatgtgca

SEQ ID NO: 118996 - DNA, 25 bp, Mus musculus
ggccggaaacagtgcccattttggg

SEQ ID NO: 118997 - DNA, 25 bp, Mus musculus
ggccggacctcaacatggatagaat

SEQ ID NO: 118998 - DNA, 25 bp, Mus musculus
ggccggataacgaagactaccctct

SEQ ID NO: 118999 - DNA, 25 bp, Mus musculus
ggccggatgacattcacctgctgta

SEQ ID NO: 119000 - DNA, 25 bp, Mus musculus
ggccggcctgaaacaactgctgact

SEQ ID NO: 119001 - DNA, 25 bp, Mus musculus
ggccggctacttgctaattaaaaag

SEQ ID NO: 119002 - DNA, 25 bp, Mus musculus
ggccgggacgtctctcgatatctga

SEQ ID NO: 119003 - DNA, 25 bp, Mus musculus
ggccgggctctttgcacagttctaa

SEQ ID NO: 119004 - DNA, 25 bp, Mus musculus
ggccgggtagccagtcccttgagat

SEQ ID NO: 119005 - DNA, 25 bp, Mus musculus
ggccggtggtctacatcatgccaag

SEQ ID NO: 119006 - DNA, 25 bp, Mus musculus
ggccgtcagctttacacaggagtca

SEQ ID NO: 119007 - DNA, 25 bp, Mus musculus
ggccgtcattgggaaagcatcgaga

SEQ ID NO: 119008 - DNA, 25 bp, Mus musculus
ggccgtccgaaacatccataagctg

SEQ ID NO: 119009 - DNA, 25 bp, Mus musculus
ggccgtcctggccttgaatatccag

SEQ ID NO: 119010 - DNA, 25 bp, Mus musculus
ggccgtcgcctggattatgattata

SEQ ID NO: 119011 - DNA, 25 bp, Mus musculus
ggccgtctgcacaacaaactgggtc

SEQ ID NO: 119012 - DNA, 25 bp, Mus musculus
ggccgtgcggatccttctgaataaa

SEQ ID NO: 119013 - DNA, 25 bp, Mus musculus
ggccgtggactacctcaataatcat

SEQ ID NO: 119014 - DNA, 25 bp, Mus musculus
ggccgttaccgatttgctcctggaa

SEQ ID NO: 119015 - DNA, 25 bp, Mus musculus
ggccgttctctctgctgtcatctgt

SEQ ID NO: 119016 - DNA, 25 bp, Mus musculus
ggccgttggctcgtcattgctctca

SEQ ID NO: 119017 - DNA, 25 bp, Mus musculus
ggcctaagatcaactgacacaagta

SEQ ID NO: 119018 - DNA, 25 bp, Mus musculus
ggcctacaagacagctcctgagcta

SEQ ID NO: 119019 - DNA, 25 bp, Mus musculus
ggcctacacacgaagggtgcccttc

SEQ ID NO: 119020 - DNA, 25 bp, Mus musculus
ggcctacaggatctacgcaagcaag

SEQ ID NO: 119021 - DNA, 25 bp, Mus musculus
ggcctacatcctcatctttcttact

SEQ ID NO: 119022 - DNA, 25 bp, Mus musculus
ggcctaggacgacctgctccgtggg

SEQ ID NO: 119023 - DNA, 25 bp, Mus musculus
ggcctagggtgtttcataatatcac

SEQ ID NO: 119024 - DNA, 25 bp, Mus musculus
ggcctagttcaccttgatgtcaagc

SEQ ID NO: 119025 - DNA, 25 bp, Mus musculus
ggcctataacactctaattggaagc

SEQ ID NO: 119026 - DNA, 25 bp, Mus musculus
ggcctataggcagctagcagtaatg

SEQ ID NO: 119027 - DNA, 25 bp, Mus musculus
ggcctcacagactgctgcctcaaga

SEQ ID NO: 119028 - DNA, 25 bp, Mus musculus
ggcctcagaacctctaagcttggag

SEQ ID NO: 119029 - DNA, 25 bp, Mus musculus
ggcctcaggctacagggaccttgtt

SEQ ID NO: 119030 - DNA, 25 bp, Mus musculus
ggcctccaaggatgccaggtaaaca

SEQ ID NO: 119031 - DNA, 25 bp, Mus musculus
ggcctccaaggcacctgaacatgtg

SEQ ID NO: 119032 - DNA, 25 bp, Mus musculus
ggcctccacccaaacgactcactag

SEQ ID NO: 119033 - DNA, 25 bp, Mus musculus
ggcctccacgttattgcgggacgaa

SEQ ID NO: 119034 - DNA, 25 bp, Mus musculus
ggcctccggagcagatcgatcttcg

SEQ ID NO: 119035 - DNA, 25 bp, Mus musculus
ggcctcctgcaactcacgattctgt

SEQ ID NO: 119036 - DNA, 25 bp, Mus musculus
ggcctcctgggcaaagctacagaca

SEQ ID NO: 119037 - DNA, 25 bp, Mus musculus
ggcctcgcggtcatgcactatatca

SEQ ID NO: 119038 - DNA, 25 bp, Mus musculus
ggcctcgctagccaatcgctgctga

SEQ ID NO: 119039 - DNA, 25 bp, Mus musculus
ggcctcggcgtacacagcccgcgct

SEQ ID NO: 119040 - DNA, 25 bp, Mus musculus
ggcctcgggatggaaatctgctggg

SEQ ID NO: 119041 - DNA, 25 bp, Mus musculus
ggcctcgttgcatacctaccgtgga

SEQ ID NO: 119042 - DNA, 25 bp, Mus musculus
ggcctctacagcaaccttcagcagt

SEQ ID NO: 119043 - DNA, 25 bp, Mus musculus
ggcctctacttctgcatctgcgtgg

SEQ ID NO: 119044 - DNA, 25 bp, Mus musculus
ggcctctcctgacccactgatatgt

SEQ ID NO: 119045 - DNA, 25 bp, Mus musculus
ggcctctgcacaagatgccaggttt

SEQ ID NO: 119046 - DNA, 25 bp, Mus musculus
ggcctctgcggagattccaggcccc

SEQ ID NO: 119047 - DNA, 25 bp, Mus musculus
ggcctctgctttggcattggaatta

SEQ ID NO: 119048 - DNA, 25 bp, Mus musculus
ggcctctggaagttctagccaaaag

SEQ ID NO: 119049 - DNA, 25 bp, Mus musculus
ggcctctgtctttggtgctactgga

SEQ ID NO: 119050 - DNA, 25 bp, Mus musculus
ggcctcttctatgtccggtgttgaa

SEQ ID NO: 119051 - DNA, 25 bp, Mus musculus
ggcctctttcagttagcaggtcaaa

SEQ ID NO: 119052 - DNA, 25 bp, Mus musculus
ggcctctttggatcacgctctttgg

SEQ ID NO: 119053 - DNA, 25 bp, Mus musculus
ggcctgaacttgactggagctgaca

SEQ ID NO: 119054 - DNA, 25 bp, Mus musculus
ggcctgaagcttctcttggactgaa

SEQ ID NO: 119055 - DNA, 25 bp, Mus musculus
ggcctgagcctgtatctaaacctga

SEQ ID NO: 119056 - DNA, 25 bp, Mus musculus
ggcctgagcgcgtcactagctcgga

SEQ ID NO: 119057 - DNA, 25 bp, Mus musculus
ggcctgagctttgtgggttgtcata

SEQ ID NO: 119058 - DNA, 25 bp, Mus musculus
ggcctgaggaagatctctgcctata

SEQ ID NO: 119059 - DNA, 25 bp, Mus musculus
ggcctgaggcgaaggccctccgaat

SEQ ID NO: 119060 - DNA, 25 bp, Mus musculus
ggcctgagtcccatgctgagcctga

SEQ ID NO: 119061 - DNA, 25 bp, Mus musculus
ggcctgatgcgctgcacattgagaa

SEQ ID NO: 119062 - DNA, 25 bp, Mus musculus
ggcctgcaccctagaatcataactg

SEQ ID NO: 119063 - DNA, 25 bp, Mus musculus
ggcctgcacctcagaaaaccagaag

SEQ ID NO: 119064 - DNA, 25 bp, Mus musculus
ggcctgcatagaacttccaaaggtg

SEQ ID NO: 119065 - DNA, 25 bp, Mus musculus
ggcctgcctaaaagatactgagttt

SEQ ID NO: 119066 - DNA, 25 bp, Mus musculus
ggcctgcctgggtgacccgattcct

SEQ ID NO: 119067 - DNA, 25 bp, Mus musculus
ggcctgcgaagcatccctggcctgt

SEQ ID NO: 119068 - DNA, 25 bp, Mus musculus
ggcctgcggtgcatcaagtatctgc

SEQ ID NO: 119069 - DNA, 25 bp, Mus musculus
ggcctggaacaaccttctaagtcgt

SEQ ID NO: 119070 - DNA, 25 bp, Mus musculus
ggcctggaacccgacatcacagatt

SEQ ID NO: 119071 - DNA, 25 bp, Mus musculus
ggcctggcacaactgagacttctag

SEQ ID NO: 119072 - DNA, 25 bp, Mus musculus
ggcctggcagctctacctcagataa

SEQ ID NO: 119073 - DNA, 25 bp, Mus musculus
ggcctgggagacttcatcttctaca

SEQ ID NO: 119074 - DNA, 25 bp, Mus musculus
ggcctggggccacatctttcaactt

SEQ ID NO: 119075 - DNA, 25 bp, Mus musculus
ggcctgggtgccttctgtaacttca

SEQ ID NO: 119076 - DNA, 25 bp, Mus musculus
ggcctggtctgagcaattcctggga

SEQ ID NO: 119077 - DNA, 25 bp, Mus musculus
ggcctggtggtcttgcgcatgtcca

SEQ ID NO: 119078 - DNA, 25 bp, Mus musculus
ggcctgtacattggcaacttcaaag

SEQ ID NO: 119079 - DNA, 25 bp, Mus musculus
ggcctgtgcgtgtctcctgcagaag

SEQ ID NO: 119080 - DNA, 25 bp, Mus musculus
ggcctgtgctgactacttcctggaa

SEQ ID NO: 119081 - DNA, 25 bp, Mus musculus
ggcctgtttctgcagcgaccctgaa

SEQ ID NO: 119082 - DNA, 25 bp, Mus musculus
ggccttactctttgtggaccactaa

SEQ ID NO: 119083 - DNA, 25 bp, Mus musculus
ggccttagaaaagcaccggatgtac

SEQ ID NO: 119084 - DNA, 25 bp, Mus musculus
ggccttagaatcttgcagaaagcag

SEQ ID NO: 119085 - DNA, 25 bp, Mus musculus
ggccttagcaccttcgatttcctca

SEQ ID NO: 119086 - DNA, 25 bp, Mus musculus
ggccttcacacccaaagaatgtagg

SEQ ID NO: 119087 - DNA, 25 bp, Mus musculus
ggccttcaccggtcgctgcattctt

SEQ ID NO: 119088 - DNA, 25 bp, Mus musculus
ggccttccaaaggatgctggcgatg

SEQ ID NO: 119089 - DNA, 25 bp, Mus musculus
ggccttctcttgttgcacgggcaga

SEQ ID NO: 119090 - DNA, 25 bp, Mus musculus
ggccttctgatagctccgtgcagcg

SEQ ID NO: 119091 - DNA, 25 bp, Mus musculus
ggccttctgttttgaatatgcgcga

SEQ ID NO: 119092 - DNA, 25 bp, Mus musculus
ggccttcttgatgtaggtatgccac

SEQ ID NO: 119093 - DNA, 25 bp, Mus musculus
ggccttgaaaaaagacagagaaact

SEQ ID NO: 119094 - DNA, 25 bp, Mus musculus
ggccttgagaaaccctttgtgtcga

SEQ ID NO: 119095 - DNA, 25 bp, Mus musculus
ggccttgagtaacctgctcccgtga

SEQ ID NO: 119096 - DNA, 25 bp, Mus musculus
ggccttgatctttggctactggaga

SEQ ID NO: 119097 - DNA, 25 bp, Mus musculus
ggccttgatgcatacccctggttga

SEQ ID NO: 119098 - DNA, 25 bp, Mus musculus
ggccttgcagccaggaaagcaactg

SEQ ID NO: 119099 - DNA, 25 bp, Mus musculus
ggccttggctattacagactctgag

SEQ ID NO: 119100 - DNA, 25 bp, Mus musculus
ggcctttagcatgtacgacctggac

SEQ ID NO: 119101 - DNA, 25 bp, Mus musculus
ggccttttgctcgagattcctccag

SEQ ID NO: 119102 - DNA, 25 bp, Mus musculus
ggcctttttggcgtcctgaatgaaa

SEQ ID NO: 119103 - DNA, 25 bp, Mus musculus
ggcgaaaactcaccaccagaaagga

SEQ ID NO: 119104 - DNA, 25 bp, Mus musculus
ggcgaaaagccaatcttacctgcaa

SEQ ID NO: 119105 - DNA, 25 bp, Mus musculus
ggcgaaacagatctggatgctgaaa

SEQ ID NO: 119106 - DNA, 25 bp, Mus musculus
ggcgaacatctacttggagtcaaag

SEQ ID NO: 119107 - DNA, 25 bp, Mus musculus
ggcgaaccctccactgtctgatgaa

SEQ ID NO: 119108 - DNA, 25 bp, Mus musculus
ggcgaacccttagaactgctgtgca

SEQ ID NO: 119109 - DNA, 25 bp, Mus musculus
ggcgaagagatcctaaccgtgttac

SEQ ID NO: 119110 - DNA, 25 bp, Mus musculus
ggcgaagcactctagcagtcctcat

SEQ ID NO: 119111 - DNA, 25 bp, Mus musculus
ggcgaagctgctggctcggtacatc

SEQ ID NO: 119112 - DNA, 25 bp, Mus musculus
ggcgaaggactgatttccccaccaa

SEQ ID NO: 119113 - DNA, 25 bp, Mus musculus
ggcgaagtccccaaacacgaatata

SEQ ID NO: 119114 - DNA, 25 bp, Mus musculus
ggcgacattggcacgtcctgttaca

SEQ ID NO: 119115 - DNA, 25 bp, Mus musculus
ggcgacccaggcttccccgagtgga

SEQ ID NO: 119116 - DNA, 25 bp, Mus musculus
ggcgacccgggcttctgtgaaacat

SEQ ID NO: 119117 - DNA, 25 bp, Mus musculus
ggcgaccctccgtgctgtggcagca

SEQ ID NO: 119118 - DNA, 25 bp, Mus musculus
ggcgaccgtcccacagattacagga

SEQ ID NO: 119119 - DNA, 25 bp, Mus musculus
ggcgacgggccagcggctagcggcg

SEQ ID NO: 119120 - DNA, 25 bp, Mus musculus
ggcgacgtcctgatcgacattggct

SEQ ID NO: 119121 - DNA, 25 bp, Mus musculus
ggcgacgtcttcatgaagccttaga

SEQ ID NO: 119122 - DNA, 25 bp, Mus musculus
ggcgactccagtggtaagtctttaa

SEQ ID NO: 119123 - DNA, 25 bp, Mus musculus
ggcgactctacaagatgctgtgcca

SEQ ID NO: 119124 - DNA, 25 bp, Mus musculus
ggcgacttcagtgttcacatcagca

SEQ ID NO: 119125 - DNA, 25 bp, Mus musculus
ggcgacttcgccctcgatcggattt

SEQ ID NO: 119126 - DNA, 25 bp, Mus musculus
ggcgagatatgggttgtcccgaaca

SEQ ID NO: 119127 - DNA, 25 bp, Mus musculus
ggcgagcacattcgatatgcaacag

SEQ ID NO: 119128 - DNA, 25 bp, Mus musculus
ggcgagcgcgcttatgacatatact

SEQ ID NO: 119129 - DNA, 25 bp, Mus musculus
ggcgagcttcacaagcagtgtactg

SEQ ID NO: 119130 - DNA, 25 bp, Mus musculus
ggcgaggactcttccatcctggaga

SEQ ID NO: 119131 - DNA, 25 bp, Mus musculus
ggcgaggcccggcaggcgccgagga

SEQ ID NO: 119132 - DNA, 25 bp, Mus musculus
ggcgaggccttctttgtccaggagc

SEQ ID NO: 119133 - DNA, 25 bp, Mus musculus
ggcgagtgttaccagcttgaagcaa

SEQ ID NO: 119134 - DNA, 25 bp, Mus musculus
ggcgatattcatacacagcgacata

SEQ ID NO: 119135 - DNA, 25 bp, Mus musculus
ggcgatcagctcatctggactcaga

SEQ ID NO: 119136 - DNA, 25 bp, Mus musculus
ggcgatccctgcaaacaacaagtga

SEQ ID NO: 119137 - DNA, 25 bp, Mus musculus
ggcgatcgagccctacaaaaaagtt

SEQ ID NO: 119138 - DNA, 25 bp, Mus musculus
ggcgatgccaacattaatactcagg

SEQ ID NO: 119139 - DNA, 25 bp, Mus musculus
ggcgatggcatctttcggcgccctg

SEQ ID NO: 119140 - DNA, 25 bp, Mus musculus
ggcgattgtgttgttacagtattgc

SEQ ID NO: 119141 - DNA, 25 bp, Mus musculus
ggcgcaaagcgtgcagacgccaatt

SEQ ID NO: 119142 - DNA, 25 bp, Mus musculus
ggcgcaaggccatgtttgacagtga

SEQ ID NO: 119143 - DNA, 25 bp, Mus musculus
ggcgcacgtacagcgagctgctgaa

SEQ ID NO: 119144 - DNA, 25 bp, Mus musculus
ggcgcactgaagaaaggtccctatg

SEQ ID NO: 119145 - DNA, 25 bp, Mus musculus
ggcgcagaattcatctcttcgagag

SEQ ID NO: 119146 - DNA, 25 bp, Mus musculus
ggcgcagagagctgcgcccatttcc

SEQ ID NO: 119147 - DNA, 25 bp, Mus musculus
ggcgcagcacatgtcccagtggtca

SEQ ID NO: 119148 - DNA, 25 bp, Mus musculus
ggcgcagcatcccttgcatagcgtg

SEQ ID NO: 119149 - DNA, 25 bp, Mus musculus
ggcgcagccgttcccattatcgttt

SEQ ID NO: 119150 - DNA, 25 bp, Mus musculus
ggcgcaggtgatggccccgggaagg

SEQ ID NO: 119151 - DNA, 25 bp, Mus musculus
ggcgcagtagtagcaggacctctat

SEQ ID NO: 119152 - DNA, 25 bp, Mus musculus
ggcgcagtggcctggcttggcggta

SEQ ID NO: 119153 - DNA, 25 bp, Mus musculus
ggcgcagttcctacattcacgttat

SEQ ID NO: 119154 - DNA, 25 bp, Mus musculus
ggcgcatccttttgaaatcccagag

SEQ ID NO: 119155 - DNA, 25 bp, Mus musculus
ggcgcatgagcatcaaggcctatgt

SEQ ID NO: 119156 - DNA, 25 bp, Mus musculus
ggcgcatgttgactgagacctaccg

SEQ ID NO: 119157 - DNA, 25 bp, Mus musculus
ggcgccacgggaccggagcgagcgg

SEQ ID NO: 119158 - DNA, 25 bp, Mus musculus
ggcgccagagtctcatttaccatgt

SEQ ID NO: 119159 - DNA, 25 bp, Mus musculus
ggcgcccaaactttccagtctgcgg

SEQ ID NO: 119160 - DNA, 25 bp, Mus musculus
ggcgcccagccagcatcaattttgg

SEQ ID NO: 119161 - DNA, 25 bp, Mus musculus
ggcgcccatcgcatctatacagaga

SEQ ID NO: 119162 - DNA, 25 bp, Mus musculus
ggcgccctacagatctacacagata

SEQ ID NO: 119163 - DNA, 25 bp, Mus musculus
ggcgccggaacaatggacagcttct

SEQ ID NO: 119164 - DNA, 25 bp, Mus musculus
ggcgcctatagtagcaatcctggag

SEQ ID NO: 119165 - DNA, 25 bp, Mus musculus
ggcgcctgcgcatcaaggcattttt

SEQ ID NO: 119166 - DNA, 25 bp, Mus musculus
ggcgcgcacgcagcggtctcatcgc

SEQ ID NO: 119167 - DNA, 25 bp, Mus musculus
ggcgcgcagcgctcaatttggttcg

SEQ ID NO: 119168 - DNA, 25 bp, Mus musculus
ggcgcgcagtcagaaaacacgagac

SEQ ID NO: 119169 - DNA, 25 bp, Mus musculus
ggcgcgcatttcttccagcgatgga

SEQ ID NO: 119170 - DNA, 25 bp, Mus musculus
ggcgcgcggcacggggagcggccag

SEQ ID NO: 119171 - DNA, 25 bp, Mus musculus
ggcgcgcggccttgtggtaaaacca

SEQ ID NO: 119172 - DNA, 25 bp, Mus musculus
ggcgcggctggaattctttgatcac

SEQ ID NO: 119173 - DNA, 25 bp, Mus musculus
ggcgcgggcaccctttctagaaagt

SEQ ID NO: 119174 - DNA, 25 bp, Mus musculus
ggcgcggtcagggtcggaaggagtc

SEQ ID NO: 119175 - DNA, 25 bp, Mus musculus
ggcgcggtttccttttccctgcaga

SEQ ID NO: 119176 - DNA, 25 bp, Mus musculus
ggcgcgtgggctgtattcaacaaaa

SEQ ID NO: 119177 - DNA, 25 bp, Mus musculus
ggcgctaccgacagctcaatgagaa

SEQ ID NO: 119178 - DNA, 25 bp, Mus musculus
ggcgctagccaatggaatttccaga

SEQ ID NO: 119179 - DNA, 25 bp, Mus musculus
ggcgctagggaaacaagaagcgatc

SEQ ID NO: 119180 - DNA, 25 bp, Mus musculus
ggcgctagtggaagtggcggcatcg

SEQ ID NO: 119181 - DNA, 25 bp, Mus musculus
ggcgctcacacgcatcttcaggctg

SEQ ID NO: 119182 - DNA, 25 bp, Mus musculus
ggcgctcagtttccaccatgaatct

SEQ ID NO: 119183 - DNA, 25 bp, Mus musculus
ggcgctccgggttggagtcatcctc

SEQ ID NO: 119184 - DNA, 25 bp, Mus musculus
ggcgctgtgttcctggtcctctgac

SEQ ID NO: 119185 - DNA, 25 bp, Mus musculus
ggcgcttaaggatcccgcggctcct

SEQ ID NO: 119186 - DNA, 25 bp, Mus musculus
ggcgcttctcctccgggccggtgag

SEQ ID NO: 119187 - DNA, 25 bp, Mus musculus
ggcgcttcttcttctaggctccgag

SEQ ID NO: 119188 - DNA, 25 bp, Mus musculus
ggcgctttcatcttccccgttgtca

SEQ ID NO: 119189 - DNA, 25 bp, Mus musculus
ggcggaaattcttcacacagtgtga

SEQ ID NO: 119190 - DNA, 25 bp, Mus musculus
ggcggacaacgccttcagtttcaga

SEQ ID NO: 119191 - DNA, 25 bp, Mus musculus
ggcggacagccacctctaacatata

SEQ ID NO: 119192 - DNA, 25 bp, Mus musculus
ggcggagcaatggagcatcatccca

SEQ ID NO: 119193 - DNA, 25 bp, Mus musculus
ggcggaggtcgctgtttcgttctct

SEQ ID NO: 119194 - DNA, 25 bp, Mus musculus
ggcggatactaaggaactggtgtca

SEQ ID NO: 119195 - DNA, 25 bp, Mus musculus
ggcggcaacagtggtatctcggata

SEQ ID NO: 119196 - DNA, 25 bp, Mus musculus
ggcggcaacccactgaaaaactctg

SEQ ID NO: 119197 - DNA, 25 bp, Mus musculus
ggcggccatcagcaaataaccagag

SEQ ID NO: 119198 - DNA, 25 bp, Mus musculus
ggcggccatgcttcttgcagtggca

SEQ ID NO: 119199 - DNA, 25 bp, Mus musculus
ggcggccccttgatctgcaatggca

SEQ ID NO: 119200 - DNA, 25 bp, Mus musculus
ggcggcccggctggcggggaggcgc

SEQ ID NO: 119201 - DNA, 25 bp, Mus musculus
ggcggccgtccaggccgagtgaaga

SEQ ID NO: 119202 - DNA, 25 bp, Mus musculus
ggcggcctctcgagcaatctgagca

SEQ ID NO: 119203 - DNA, 25 bp, Mus musculus
ggcggcctggcacaaagaaaacgaa

SEQ ID NO: 119204 - DNA, 25 bp, Mus musculus
ggcggcgattgcaggatctccaaca

SEQ ID NO: 119205 - DNA, 25 bp, Mus musculus
ggcggcgattgtctggcggcctggg

SEQ ID NO: 119206 - DNA, 25 bp, Mus musculus
ggcggcgctcactgcagtctcggat

SEQ ID NO: 119207 - DNA, 25 bp, Mus musculus
ggcggcgtcacatcccggcgtatga

SEQ ID NO: 119208 - DNA, 25 bp, Mus musculus
ggcggctcttatattccgacgaata

SEQ ID NO: 119209 - DNA, 25 bp, Mus musculus
ggcggctcttttccagtcagtagaa

SEQ ID NO: 119210 - DNA, 25 bp, Mus musculus
ggcggctttcattctctgtcttccg

SEQ ID NO: 119211 - DNA, 25 bp, Mus musculus
ggcggctttctcatccttcttgcaa

SEQ ID NO: 119212 - DNA, 25 bp, Mus musculus
ggcggctttttgagtgacacccaag

SEQ ID NO: 119213 - DNA, 25 bp, Mus musculus
ggcgggaccctgagcttccctcgga

SEQ ID NO: 119214 - DNA, 25 bp, Mus musculus
ggcgggactcccaaagtgctttggt

SEQ ID NO: 119215 - DNA, 25 bp, Mus musculus
ggcgggaggtgggtccgcgcgtgat

SEQ ID NO: 119216 - DNA, 25 bp, Mus musculus
ggcgggcgttccaggacagttcact

SEQ ID NO: 119217 - DNA, 25 bp, Mus musculus
ggcgggtatggaggcggcgcgctgc

SEQ ID NO: 119218 - DNA, 25 bp, Mus musculus
ggcgggtctagagcgtcgtcttatc

SEQ ID NO: 119219 - DNA, 25 bp, Mus musculus
ggcggtctcgcacatgaagtccatg

SEQ ID NO: 119220 - DNA, 25 bp, Mus musculus
ggcggtgacgccaattacaagcttt

SEQ ID NO: 119221 - DNA, 25 bp, Mus musculus
ggcggtgcccctccaaacatggatg

SEQ ID NO: 119222 - DNA, 25 bp, Mus musculus
ggcggtggagatcccaggtcgctca

SEQ ID NO: 119223 - DNA, 25 bp, Mus musculus
ggcggtggcccaggatttattgtct

SEQ ID NO: 119224 - DNA, 25 bp, Mus musculus
ggcggtgggtgaggcagtgaggccc

SEQ ID NO: 119225 - DNA, 25 bp, Mus musculus
ggcggtgtcggaggcagccagcggt

SEQ ID NO: 119226 - DNA, 25 bp, Mus musculus
ggcggttcaatttcaacatggctga

SEQ ID NO: 119227 - DNA, 25 bp, Mus musculus
ggcggttcctggctttcagatttca

SEQ ID NO: 119228 - DNA, 25 bp, Mus musculus
ggcggttgtctcctccgagttcaga

SEQ ID NO: 119229 - DNA, 25 bp, Mus musculus
ggcgtacatcctggctatcatcgga

SEQ ID NO: 119230 - DNA, 25 bp, Mus musculus
ggcgtaccagaagacggacatcgat

SEQ ID NO: 119231 - DNA, 25 bp, Mus musculus
ggcgtacgttctccctggacaccat

SEQ ID NO: 119232 - DNA, 25 bp, Mus musculus
ggcgtactggcaaagttatccagat

SEQ ID NO: 119233 - DNA, 25 bp, Mus musculus
ggcgtagaactctcgactacttctc

SEQ ID NO: 119234 - DNA, 25 bp, Mus musculus
ggcgtagcctccttatccagtgtgg

SEQ ID NO: 119235 - DNA, 25 bp, Mus musculus
ggcgtccagctcagccgctaaagaa

SEQ ID NO: 119236 - DNA, 25 bp, Mus musculus
ggcgtcgccggagtgaattgatccg

SEQ ID NO: 119237 - DNA, 25 bp, Mus musculus
ggcgtcgttgtcaccatcgtctcgg

SEQ ID NO: 119238 - DNA, 25 bp, Mus musculus
ggcgtctccgacatctccggaacat

SEQ ID NO: 119239 - DNA, 25 bp, Mus musculus
ggcgtctcttcatcaccaacaggtg

SEQ ID NO: 119240 - DNA, 25 bp, Mus musculus
ggcgtctgactttccaatgctgaga

SEQ ID NO: 119241 - DNA, 25 bp, Mus musculus
ggcgtgaacctcaggacctcagtgt

SEQ ID NO: 119242 - DNA, 25 bp, Mus musculus
ggcgtgaccatccaagagtgacaga

SEQ ID NO: 119243 - DNA, 25 bp, Mus musculus
ggcgtgcctctcatgaccctgaatg

SEQ ID NO: 119244 - DNA, 25 bp, Mus musculus
ggcgtgcctgccttcagttccgaaa

SEQ ID NO: 119245 - DNA, 25 bp, Mus musculus
ggcgtgcgacgttcggctagatatc

SEQ ID NO: 119246 - DNA, 25 bp, Mus musculus
ggcgtgcttttgtcaataccagaaa

SEQ ID NO: 119247 - DNA, 25 bp, Mus musculus
ggcgtggaccaatcagaagagctgt

SEQ ID NO: 119248 - DNA, 25 bp, Mus musculus
ggcgtggagtagaacagaatcacca

SEQ ID NO: 119249 - DNA, 25 bp, Mus musculus
ggcgtgggactgaccttcgctaagt

SEQ ID NO: 119250 - DNA, 25 bp, Mus musculus
ggcgttcactgcgacctgggagtaa

SEQ ID NO: 119251 - DNA, 25 bp, Mus musculus
ggcgttcagcaaaggatttcgaatc

SEQ ID NO: 119252 - DNA, 25 bp, Mus musculus
ggcgttcaggccagtcagctgtttc

SEQ ID NO: 119253 - DNA, 25 bp, Mus musculus
ggcgttgaccccaccaaagatatat

SEQ ID NO: 119254 - DNA, 25 bp, Mus musculus
ggcgttggtcctcatttatgccata

SEQ ID NO: 119255 - DNA, 25 bp, Mus musculus
ggcgttggttcgagaagaccttcag

SEQ ID NO: 119256 - DNA, 25 bp, Mus musculus
ggcgttggtttcttccttgcttaga

SEQ ID NO: 119257 - DNA, 25 bp, Mus musculus
ggcgttgtaaaccactcagacagtg

SEQ ID NO: 119258 - DNA, 25 bp, Mus musculus
ggcgtttgaagtgaagctgctcaca

SEQ ID NO: 119259 - DNA, 25 bp, Mus musculus
ggctaaacctccagaagagtgcaaa

SEQ ID NO: 119260 - DNA, 25 bp, Mus musculus
ggctaaccagcaagatgactccatg

SEQ ID NO: 119261 - DNA, 25 bp, Mus musculus
ggctaacgaacgcatgaacctgatg

SEQ ID NO: 119262 - DNA, 25 bp, Mus musculus
ggctaacgactactgcttctgtcat

SEQ ID NO: 119263 - DNA, 25 bp, Mus musculus
ggctaagaagctgaagacgtccatc

SEQ ID NO: 119264 - DNA, 25 bp, Mus musculus
ggctaagactctgcaccattgaaat

SEQ ID NO: 119265 - DNA, 25 bp, Mus musculus
ggctaaggtgatcccagctactcag

SEQ ID NO: 119266 - DNA, 25 bp, Mus musculus
ggctaatagtgatacccagactcca

SEQ ID NO: 119267 - DNA, 25 bp, Mus musculus
ggctacaacaccagtccatgaggct

SEQ ID NO: 119268 - DNA, 25 bp, Mus musculus
ggctacaacctttgacatctggaag

SEQ ID NO: 119269 - DNA, 25 bp, Mus musculus
ggctacaactctgcaaactgctgga

SEQ ID NO: 119270 - DNA, 25 bp, Mus musculus
ggctacaactttgaggacctgacag

SEQ ID NO: 119271 - DNA, 25 bp, Mus musculus
ggctacacacagtcagtgaaggaga

SEQ ID NO: 119272 - DNA, 25 bp, Mus musculus
ggctacaccgtgaaaggcatccaga

SEQ ID NO: 119273 - DNA, 25 bp, Mus musculus
ggctacacctgtaccctgcggattt

SEQ ID NO: 119274 - DNA, 25 bp, Mus musculus
ggctacatcaagacttggcaccctc

SEQ ID NO: 119275 - DNA, 25 bp, Mus musculus
ggctacatcctgtccacaacagcgg

SEQ ID NO: 119276 - DNA, 25 bp, Mus musculus
ggctacattaagaatccctacaaca

SEQ ID NO: 119277 - DNA, 25 bp, Mus musculus
ggctaccatggagacacctctgaaa

SEQ ID NO: 119278 - DNA, 25 bp, Mus musculus
ggctaccccaggaatggacgtggaa

SEQ ID NO: 119279 - DNA, 25 bp, Mus musculus
ggctacctaaagatcctcccaatgt

SEQ ID NO: 119280 - DNA, 25 bp, Mus musculus
ggctacctgacgctgtgcaacgagt

SEQ ID NO: 119281 - DNA, 25 bp, Mus musculus
ggctacctgattcccacagtctgtg

SEQ ID NO: 119282 - DNA, 25 bp, Mus musculus
ggctacctgggctttcttcggagaa

SEQ ID NO: 119283 - DNA, 25 bp, Mus musculus
ggctacgacagaaaagactaaactc

SEQ ID NO: 119284 - DNA, 25 bp, Mus musculus
ggctacgatcctacagtggagaata

SEQ ID NO: 119285 - DNA, 25 bp, Mus musculus
ggctacggcattcgttatgaatacg

SEQ ID NO: 119286 - DNA, 25 bp, Mus musculus
ggctacgggcagaagcatgacatca

SEQ ID NO: 119287 - DNA, 25 bp, Mus musculus
ggctactactctggatgcacagggc

SEQ ID NO: 119288 - DNA, 25 bp, Mus musculus
ggctactagaacctttggctccaga

SEQ ID NO: 119289 - DNA, 25 bp, Mus musculus
ggctactcttggctgttggacataa

SEQ ID NO: 119290 - DNA, 25 bp, Mus musculus
ggctactggttggagatctttgaca

SEQ ID NO: 119291 - DNA, 25 bp, Mus musculus
ggctacttcttcagagctcccgggc

SEQ ID NO: 119292 - DNA, 25 bp, Mus musculus
ggctacttttgacccaaaggccatg

SEQ ID NO: 119293 - DNA, 25 bp, Mus musculus
ggctagaactgaggcgtcgcacaat

SEQ ID NO: 119294 - DNA, 25 bp, Mus musculus
ggctagaaggcgactatttccgtca

SEQ ID NO: 119295 - DNA, 25 bp, Mus musculus
ggctagaggaagcaaaactggtctt

SEQ ID NO: 119296 - DNA, 25 bp, Mus musculus
ggctagcccctgcatctgacaagag

SEQ ID NO: 119297 - DNA, 25 bp, Mus musculus
ggctaggaactcacgtcacagggtt

SEQ ID NO: 119298 - DNA, 25 bp, Mus musculus
ggctaggaccagagttttttgacca

SEQ ID NO: 119299 - DNA, 25 bp, Mus musculus
ggctagtcttatgtctatagtcttt

SEQ ID NO: 119300 - DNA, 25 bp, Mus musculus
ggctagtgcgcgacttcacagtgtg

SEQ ID NO: 119301 - DNA, 25 bp, Mus musculus
ggctataaaactgccaagcgtctcg

SEQ ID NO: 119302 - DNA, 25 bp, Mus musculus
ggctataaagtcagcgccctggaga

SEQ ID NO: 119303 - DNA, 25 bp, Mus musculus
ggctataccagcatcggacttgccc

SEQ ID NO: 119304 - DNA, 25 bp, Mus musculus
ggctatatccgacagggtagcgtaa

SEQ ID NO: 119305 - DNA, 25 bp, Mus musculus
ggctatcatatcatgttgcctttca

SEQ ID NO: 119306 - DNA, 25 bp, Mus musculus
ggctatccaacagatcaggaattgg

SEQ ID NO: 119307 - DNA, 25 bp, Mus musculus
ggctatccagttgttcatcctcaca

SEQ ID NO: 119308 - DNA, 25 bp, Mus musculus
ggctatcctgaagtggcgctgcatt

SEQ ID NO: 119309 - DNA, 25 bp, Mus musculus
ggctatcttgccacagttgttcatg

SEQ ID NO: 119310 - DNA, 25 bp, Mus musculus
ggctatgccgaagccgctgagaaaa

SEQ ID NO: 119311 - DNA, 25 bp, Mus musculus
ggctatgtacctttgcttgaagaca

SEQ ID NO: 119312 - DNA, 25 bp, Mus musculus
ggctatgtcattgcaacaatccagt

SEQ ID NO: 119313 - DNA, 25 bp, Mus musculus
ggctatgtgcaccacttccgttgtg

SEQ ID NO: 119314 - DNA, 25 bp, Mus musculus
ggctatttaaaggtgcgcgcccgag

SEQ ID NO: 119315 - DNA, 25 bp, Mus musculus
ggctcaatgaccacggcaagaactg

SEQ ID NO: 119316 - DNA, 25 bp, Mus musculus
ggctcacaatattgtatacaaagac

SEQ ID NO: 119317 - DNA, 25 bp, Mus musculus
ggctcacaatgaggtagaacccctt

SEQ ID NO: 119318 - DNA, 25 bp, Mus musculus
ggctcacagaccttctggccggaaa

SEQ ID NO: 119319 - DNA, 25 bp, Mus musculus
ggctcaccaaagaggtcactgctgc

SEQ ID NO: 119320 - DNA, 25 bp, Mus musculus
ggctcaccacactggcgcaggcggt

SEQ ID NO: 119321 - DNA, 25 bp, Mus musculus
ggctcaccctttggatctttggaac

SEQ ID NO: 119322 - DNA, 25 bp, Mus musculus
ggctcactggcatagtcccttcctg

SEQ ID NO: 119323 - DNA, 25 bp, Mus musculus
ggctcactgtttgctacagcatcgg

SEQ ID NO: 119324 - DNA, 25 bp, Mus musculus
ggctcagaaactattgatattactg

SEQ ID NO: 119325 - DNA, 25 bp, Mus musculus
ggctcagaatctaccaacaggcgtt

SEQ ID NO: 119326 - DNA, 25 bp, Mus musculus
ggctcagatagaattttatcagaac

SEQ ID NO: 119327 - DNA, 25 bp, Mus musculus
ggctcagcagcacatagaaacgtgt

SEQ ID NO: 119328 - DNA, 25 bp, Mus musculus
ggctcagcgttaaggccaagccggc

SEQ ID NO: 119329 - DNA, 25 bp, Mus musculus
ggctcagctaagaaatacgtcccgc

SEQ ID NO: 119330 - DNA, 25 bp, Mus musculus
ggctcagcttgttgaagaggccaca

SEQ ID NO: 119331 - DNA, 25 bp, Mus musculus
ggctcagggcgttacagaagttcac

SEQ ID NO: 119332 - DNA, 25 bp, Mus musculus
ggctcagtatgacaccccaaaaggt

SEQ ID NO: 119333 - DNA, 25 bp, Mus musculus
ggctcagttcgaatgaccctcaaga

SEQ ID NO: 119334 - DNA, 25 bp, Mus musculus
ggctcagttctgacaccagggatgg

SEQ ID NO: 119335 - DNA, 25 bp, Mus musculus
ggctcagttgctgatgaccagaagc

SEQ ID NO: 119336 - DNA, 25 bp, Mus musculus
ggctcataatgaccaaatccctgga

SEQ ID NO: 119337 - DNA, 25 bp, Mus musculus
ggctcatagcctttcatcacggaga

SEQ ID NO: 119338 - DNA, 25 bp, Mus musculus
ggctcatcaaccttatgcacagata

SEQ ID NO: 119339 - DNA, 25 bp, Mus musculus
ggctcatctgtatcactcgggctgg

SEQ ID NO: 119340 - DNA, 25 bp, Mus musculus
ggctcatggagactgttcagcattt

SEQ ID NO: 119341 - DNA, 25 bp, Mus musculus
ggctcatgtaagactcgtattcacg

SEQ ID NO: 119342 - DNA, 25 bp, Mus musculus
ggctcattcactgatccccaaggaa
